United States Patent 7,504,490 (NUCLEIC ACID AND AMINO ACID SEQUENCES RELATING TO APERGILLUS FUMIGATUS FOR DIAGNOSTICS AND THERAPEUTICS) - sequence listing, part 3

SEQ ID NO: 10010 - DNA, 1389 bp, A.fumigatus
  unsure (355),(377),(395): Identity of nucleotide sequences at the above locations are unknown.
ccccgagcccccctccccccctgcgttccactcatgtggaaccatgcgctaaacgctccgtcgttgcagacttatcaccggcttcggtgtcggtttcgcctcgatgatcaaccccctctacgtgtcggagaacgctcctcgtgccatccgtggcatgctgaccgggctgtaccagctcttcatcaccatgggcatcatgctggcgttctggatcaactacggctccctgctgcacatcagcggcccggccatgtacctcgtgccgctggccatgcaggccctccccgccatcctcctcctggtcggtatgctcctgtgcaacgagtccccacgctggctcgcccgccaggaccgntgggaagccgcgcgcgccacantagcccgagtgcgccacntgccccccacccacccatacgtcgagcgcgaattccaggacatcgtcgcgcagctcgagcacgagcgccagctcatcggcggctcgggcccctgggacctcatgcgagagatgtggacgatcccgggcaaccgcaagcgcgccctcatcagcatcttcctcatgatctgccagcagatgaccggcaccaacgccatcaactactacgcaccccagatcttcaagaacctgggcgtcaccggcaacgcgaccggcctcttcgccaccggcgtctacggcatcgtcaaggtcgtcggctgcgccgtcttcctcgttttcgtcgccgactccctcggccgccgccgctccctcctgtggacctccgtcgcccagggcctgacaatgctctacatcggcctgtacgtccgcatcgcgccccccgtagccggcgagcccgtcatccccgccggctacgtcgccctcgtctgcatcttcctcttcgccgcctgcttccagtttggctgggggcccgtctgctggatctacgtctccgagatccccaccgcccgcctgcgaggcctgaacgtctccttcgctgccgctacccagtggctcttcaactttgttgtcgcccgcgccgtccccaatatgcttgctaccgtcggtgcgaatggttatgggtacctctctctctctctctccccggaaatcccctgagatatcagacgcgtgctaacgggctcacagaacgtacatcattttctcctgcttctgtctctccatgggtgtgtacgtatggttcttcatccctgagaccaagggtaactctcccctccccggccaatcaacagttcatgctgatgagaataggtctctcgctcgagaaaatggatgagttgttcggcgtcacaacgccccaggatagcaaggtggccgatgctgagcgggccatgagttcgaccgacaaggaggctgaggctgagaccgccgtggagacaagggttgaaaggctgtag

SEQ ID NO: 10011 - DNA, 1038 bp, A.fumigatus
  unsure (303),(325),(343): Identity of nucleotide sequences at the above locations are unknown.
acgctccgtcgttgcagacttatcaccggcttcggtgtcggtttcgcctcgatgatcaaccccctctacgtgtcggagaacgctcctcgtgccatccgtggcatgctgaccgggctgtaccagctcttcatcaccatgggcatcatgctggcgttctggatcaactacggctccctgctgcacatcagcggcccggccatgtacctcgtgccgctggccatgcaggccctccccgccatcctcctcctggtcggtatgctcctgtgcaacgagtccccacgctggctcgcccgccaggaccgntgggaagccgcgcgcgccacantagcccgagtgcgccacntgccccccacccacccatacgtcgagcgcgaattccaggacatcgtcgcgcagctcgagcacgagcgccagctcatcggcggctcgggcccctgggacctcatgcgagagatgtggacgatcccgggcaaccgcaagcgcgccctcatcagcatcttcctcatgatctgccagcagatgaccggcaccaacgccatcaactactacgcaccccagatcttcaagaacctgggcgtcaccggcaacgcgaccggcctcttcgccaccggcgtctacggcatcgtcaaggtcgtcggctgcgccgtcttcctcgttttcgtcgccgactccctcggccgccgccgctccctcctgtggacctccgtcgcccagggcctgacaatgctctacatcggcctgtacgtccgcatcgcgccccccgtagccggcgagcccgtcatccccgccggctacgtcgccctcgtctgcatcttcctcttcgccgcctgcttccagtttggctgggggcccgtctgctggatctacgtctccgagatccccaccgcccgcctgcgaggcctgaacgtctccttcgctgccgctacccagtggctcttcaactttgttgtcgcccgcgccgtccccaatatgcttgctaccgtcggtgcgaatggttatgggtacctctctctctctctctccccggaaatcccctga

SEQ ID NO: 10012 - DNA, 729 bp, A.fumigatus
  unsure (711),(729): Identity of nucleotide sequences at the above locations are unknown.
cacgcgtctgatatctcaggggatttccggggagagagagagagagaggtacccataaccattcgcaccgacggtagcaagcatattggggacggcgcgggcgacaacaaagttgaagagccactgggtagcggcagcgaaggagacgttcaggcctcgcaggcgggcggtggggatctcggagacgtagatccagcagacgggcccccagccaaactggaagcaggcggcgaagaggaagatgcagacgagggcgacgtagccggcggggatgacgggctcgccggctacggggggcgcgatgcggacgtacaggccgatgtagagcattgtcaggccctgggcgacggaggtccacaggagggagcggcggcggccgagggagtcggcgacgaaaacgaggaagacggcgcagccgacgaccttgacgatgccgtagacgccggtggcgaagaggccggtcgcgttgccggtgacgcccaggttcttgaagatctggggtgcgtagtagttgatggcgttggtgccggtcatctgctggcagatcatgaggaagatgctgatgagggcgcgcttgcggttgcccgggatcgtccacatctctcgcatgaggtcccaggggcccgagccgccgatgagctggcgctcgtgctcgagctgcgcgacgatgtcctggaattcgcgctcgacgtatgggtgggtggggggcangtggcgcactcgggctan

SEQ ID NO: 10013 - DNA, 789 bp, A.fumigatus
agtgcaagtctgattgcgggatttgcattgttggatgccctcaagcagcccatcgcgcaatggaacggcatggagatccttgtctatttcgccgagcttatggcggccgtccaccttggggggcaccttccacacgtgtcgttcgagagacattattttgacagatatgggaaacttctgttgatcttcatgaccgttcaggaagcattggggctattatctctctaccgtattacgacaactagcgatactagctctcaagcgcggcagcccggccagtctccggacgcaagcgccccgggcagtccgtcactcgggagcgttcggcccgagcaaccatcttcatcattcagttcttccgagccccctgttccccctctttcattttcttcgacggctgctggttccagcttcatgacgcagccaccggaggcacagtaccaactagcattcccgaaccagaatcaaggtctcaaacgtgatcacagcttcacgctgaatagtctgaaggacaatgaatccgacttctctgatgcctacgatcgcgattcagataccgagacgaccgtgacgacagcgacgacagccacgagcaacacggtcaggaatatccgttacggacggaacccgacggatgcattcttctcaccaaggcgctcagagcttggtcctggaatcggggggttaagccttgatgataagcccacccggcgagtaacgcgcagtcagtcgcagagactcgccggaaatgagggaattcgtaaatactcgatgcgcggtctgaagtaa

SEQ ID NO: 10014 - DNA, 225 bp, A.fumigatus
ccatgttcatgtttaggagtcactgtgaaacatctgtacaacgagagaaatggcagtatagaacgatggcgtagtagtaggaatcttagaaaacagcgtgatttcatcgcccgtggtttctccgcgttcctttttctttcttctccgcaactcaccctcgcttccttcatctcttcccttgcagccacttacagagccgtcggagatgcttttgatctcctctag

SEQ ID NO: 10015 - DNA, 249 bp, A.fumigatus
gatttggctatcggatcccacttcacaatggttgagttacaaccgatcttcaagaaggcctactggacgctggccgctggaggtctggtctatgtgagcttcatctgcgcgctcacatggcccaatgtccaaagattgtatgctttgcttatccatatttctacgaacgcgacgactaacgattctggcgccatgcgcatagcgccctgtatgcgaacaaagtcaaccctgctctgtgggaggatgtga

SEQ ID NO: 10016 - DNA, 1176 bp, A.fumigatus
gtacgtgggaaggcccagctatccatggagtggtcgttgttgacttggccagaaacacaggtccaaccgttcaatctggttacccccgataatgacacaatctatggctggcatttactccctctacacctctgccgtgagcacgaagaggaactgaacgcaaacgagccatctggcccagctgacgactatacccagaccccagctttcaagtttctagcccacgaccctaacgctcgagtagttgttaactgtaagcgcactggttacttcgcttgcgacacaatcatgatgtgcacattaactaatctttgttcaactgcagtccacggcaatgccgcgcatctcggctccgctcagagacctgaaatctatcgcatgcttctgggcttgtcaagtccctccaaccccgtccatgtcttcacaattgactatcatgggtatggagtgtccaccggctctccaacggaagaaggcctaattaccgatggggtctccctcatcaatttcctgaccgccggtcctttgaacatcccgccttccagaattgtcatcgcgggacagagcctgggaaccgctgtgagcgccgcagtcgctgagcgctatgcatttggatcgccagatcccgcagctgtgcaacccgccattaatgatcccgaaccgttcgccggtgtggtcctcctcgcatcattcagcaacatgcgcaaccttatcgaatcctacagcttcaaaggtcttacgccgccgatgctttctcccttgattgggtaccctcgcgtacaaagatgggtgagaagccatatcgtcgaccactgggacacggctgctcgtcttgcacgcctgacgggcgtcggaccatcggctgaggaagacgcgaaggcagggtacaacagcaaaaatctggatctcgcaatcattcatgcattcaatgatgtcgagatcccctggtacgaaggacgtagtgtctggattgctgccactggtgaaaaccagaaagacgcccccggcacccttgcgtaccagaaaaaggaagagggcggtccgaccgaggtgaagatctgggagaacaggtccgggaagcacgctgtgaaaacggttcgatgggaacgtgtaggctacggtggtatgtcgcagattcgtttcaatgttcttgttcacagggaaagatataactga

SEQ ID NO: 10017 - DNA, 204 bp, A.fumigatus
tacctgtgggaggtggggggggggagacgttcagtaacacattcaagaacccataacctacttatgattaggatttccttttttttgccgctaaatttctatactctcaaaatcttaggtcattttgacattgtgaataccgtgcctacccctatccctttcccattcatatcttccatggctcccccagttgtggtagcctag

SEQ ID NO: 10018 - DNA, 831 bp, A.fumigatus
ctgtttgatgtaaaagataccggatctaagccgttcgtgtgcaaagagtgtcgtcgaccattcgcccgccaagatgctcttactcgtcatgaaaagctacatactagggcaacaagctcaactcccacaatcaaagtgacccaaggggacactgctatacatcttcctccccagactactgcctcagacgcccatacttgggattctacaagagctgtaacagacgatgcggcgttaaaccctgctcctagtcacacatggaacacccctccgtccgggcagcagtctgggttccagcaggctgcctcagatctcgacttctccttgatatggcctgactcggagaatctgttccatagcatcatgtcttcggatacgacggagcattggcagatgcccctgggaacacttccatttcctcccgtggtacaggacgtcagcaccatcaatttcggttctcccaactccttcgacgatcggagttcctcaataggcgcgattccctcaggtggtagtcaccaagctgttagggatgtgacggaaatggtgaccagctcagtaagcatcctgacagtatttctcgtattcgcagaagacctaattgttctacagtcctcgagtgtgacagcggccatcaaggcgacctcaatcacatctgtctttctcgatgaatgtctgcatatgttttttgtgaggttcattcccacctttccgatcttgcaccgggcgacctttgtttttcgcgagtgcacgcatcctcttctgctcaacgccatggcgcttggctctttgtatctcgggccgaaagattctgtcgcaaaggtaacatga

SEQ ID NO: 10019 - DNA, 282 bp, A.fumigatus
tgtggtgcttcgtgctgcagcgtcgatagcaagccgtccactgccgaaactggattcttctccgcgctgtcatttcttgacaaagtcatgattggttcgtctgcttcttgctggaagccacaatggagccaaatgcatgtagctaagattaggcttgaggctcgctcgtgttcggtgcagacttactccggaaatcaaggcacgcctttgtgcaaggaaatctatgtgcagatctttgataccaacctgacagatgagggtttgtttcttgagcgggtctga

SEQ ID NO: 10020 - DNA, 561 bp, A.fumigatus
ccgacaccttctttcgatgccgtttacgctatcgaggccaccgtccatgctcctgaccttgaaggtgtctacaaggaaatcttccgtgtgttgaagcctggtggagttttcggtgtctatgaatggctcatgactgacgcgtacgacaacgacaaccctgagcatcgcaggatccgtctgggtatcgagctgggtgatggtatttccaacatggtcaaggtctcggaaggtcttactgcctttaagaacgctggtttcgagctgctgcacaacgaggatctcgccgatcgccctgatgccattccgtggtactaccctctcgccggatcgttcaagcacatgacttcgccttgggatttcttcaccattgcccgtatgacatggtggggtcgcggtatcgcccatcggttctgcggagctatggaaactattggtctcttccccaagggcacccagaagaccgccgacagtctcgccattgctggtgactgtctggtcgctggtggtgagaagaagctcttcacgcccatgtatttgatggtcggacgcaagcccgagtaa

SEQ ID NO: 10021 - DNA, 207 bp, A.fumigatus
tccaccggtaccatggatctgatgcgatcgcgggggatgaatatcagacgatggatggacctaagtctgccatcccagggcaatgtgtcggtgtcatatattactcacgaccccgctcctacatatatacccagctcagtcggcgacgaagggaagttcgcccaccccatcacctcctttccttccttgctgagctcatcgcactga

SEQ ID NO: 10022 - DNA, 831 bp, A.fumigatus
  unsure (648): Identity of nucleotide sequences at the above locations are unknown.
ctcgttgcgaccatgacgcatgagtcagaggtcacgccacctgtgccgattagtgacgaatactatgatctcggcgcgttcggtcggaagatcacaacctccagcgccgacactcaggcctggttcgatcggggcctcagttgggcttacgccttcaaccatgtcgagggcgcctactgctttgaacaagccatcgctcacgatccgtcgtgcgccatagcatactgggggttggcatacgcagttggccccaactacaacaagccatgggaacggtttgataaggacgacctgaagatctgcatgaaacgggcatacgaagcgtcgcgcaaggccaaggaacatgcaagtaatgcaaccccaattgagcaagggttgatcgaagccatccaatcccgattccagagcgcctcgccaccccagacggcggaggagcagtcggcactgaaccatgcgtatgcgacggccatgaagcctgtttaccaagcctttggcgacgatctggatgtcgctgctctctacgcagacgcgttgatgaaccagactccttgggcgctgtggaatctgtttactggcgaacccaatcccaaagcagccaccatggaggtcgaagaagtactggaacgcgctctgactcaaaaagaatcngagaacacccggggctgctgcacttctatatccactacattgaaatgtcgccaaattcccaagttcggtgtcaatgtcgccgaacaactgcgtgacttgatgcctgatgcaagccacatccaccatatgccatctcatctccactttctgatccgggatggcgggccttcgattggcttccaa

SEQ ID NO: 10023 - DNA, 645 bp, A.fumigatus
ctctcggcataccactgcctctgcgccgtcatgccccggattgacacagtggcgattatcggcgccggtccttcagggctagctcttgctctggctttgcacaagcaatccattgcctgcaccctctacgaggctcgcgcatccgccctcgacattggcggcgccatgatgctgtgtcccaacggactgaggatcctcgactctctgggcgtgtacagccgcatccgaccagaaggctatgagtttgataagctctacttccgctccccggacgaccagcccatggacacatatgagtttggtggggtggaacaatacggctaccgcgccatgcgcatttaccgtcatgttctgattcgggaactctctgctatggttcgcgaagcgggcatccccattgagtatcataagaaattcgtgcgggtgcttgcagagacagagaaggacattacctgggaatttagtgacggctccacagcaacagcaacctgcgtggtgggcgctgatggcatccactccagagtccgccattacctctatcccggcctcgagccatcctttacgaagatggtcatcgtggcggccgcagtaccaacaagccagctacaggtcccgagcagctacaacctcccagtgacaatcctg

SEQ ID NO: 10024 - DNA, 420 bp, A.fumigatus
gcagcagaccattccatcactcatcagaacgagccatcccttgcaacaggtctgttaaatagcccacttccctacaccgtgttttcaacagcgcgcacgttgctcagctctatgactgtagtacggcccatgagccgtatgatgaagcgcatgctttccctgcgcactaaaccactccaattccctccggctcagtgtgcccctccaattcctcaacacgaacttgttgatgaagaagcctccccagcgtacaaccccaaatacttctatccagctaaaccaggggagttacttgccaatcactatcagttactagtgaagattggttggggcacacgttcgactacgtggctggcaaaagatattacaaggtatacacccgactttgtttctgtcatgcctactgcaataatagtctaa

SEQ ID NO: 10025 - DNA, 363 bp, A.fumigatus
gaagttgtctttagatacagatggcagcctgaacgttttgtaaccctgaaaataataaacaaccgcagccttgacgaagcttaccgtgaacgcgacattgaggagcacatttcaaggcaaaatccgtctcatcgcggccgtgcgatcattcggacccaccttgacagcttcgaggtgacaagttccgaaggaagccatctatgccttgcatatgagcctatgcgggaacctctgtggattcttcagaaacgctttgttgatcaaagactccctctccccattgcaaaggcatatctccttattctccttgctggtcttgactatctccattcggaatgcggggttgtccataccggcaggtaa

SEQ ID NO: 10026 - DNA, 381 bp, A.fumigatus
tctttttggttcatgctagatctaaagcttgataacattttgatgacctttgaaaatgaagacgtccttcccaactttctcaaagtacaaatcaatagcatgcctatgcaatacaaaacagagtcagtgactaggcgaacaatctatcgctgtcacaatgattttgggcccctggactggagagaactgagaaaaatggtgcctaagattgtcgattttgggttagcgacttcactcaagagcgacagtcaaggacaaggagggaagagtgaattaggtctccatccaatacaaccggaccagtatcgtgctccggaagtcatacttggctgcggatggagctttagcgcagacatatggaattttggggttctggtatga

SEQ ID NO: 10027 - DNA, 417 bp, A.fumigatus
actgtcagcagctccccgattgaaatgagccggatccaggtaattttttttattttatcgcagcagacaatcagtatgttgtcgctgtatagatgcacatcttgtaatgaactcatccagcctacaaaagcgcgtctctcatgtgcttcctgcgcgccccgtctaaccctatgtgccaactgctatgttgtacagaattatcctctgcagcaccaggagaatccctcacattcaatcttgctgcacgcaaagagcggcttcatccctatccctccaccacctccaccaccacaatcgcagtcggtccgcagcccatatgttcctgctcagcgccgtcctatacctatttcaaacagagatagcaataccccgccaaggaaacctccacgccctacaaatccggaacaaagaaactaa

SEQ ID NO: 10028 - DNA, 249 bp, A.fumigatus
caagctcgctcctacaacgtgattttgcagagaggcctaaagtcgacttatctcatcagatgggttgctgacatggaaggagctattttggcctctgttaattgcattggcccttatttcttcttctgtatcctgtctgaccccgctatgctccgttatgtcctcgtcgtggacagagagtttaactttggcccgcaactattacagtcaacaaatgcaagctccggggtcagtatccagatctcttaa

SEQ ID NO: 10029 - DNA, 1014 bp, A.fumigatus
gcatcgataatgtcacttgaccccagtgttgtccctagctccacaagctccccatcattgatctcagtgcccgacaccccgaccgatccaagctccggcccgttcacccactctaccacgccgccctcggaagctccactgcggaacccaccccggccccaaattaatgaggcccaggctacgcagtccgctacgatggccgatcccaacgacaacagtaatgctggattggataccaagcatgaggttgagccttccatcgacaataacggagtaaagacagaggcaaagccatctgtttctgtaacggaaagtacttccgtcaaaatcgcatgcaaaaagcattcaggaaaagagtcgaacgccgccggccgaaaacgtgattccaagaaaaagagccataaatcgatctcaacgccggacgaggatacgagctcggcgtcaacttcatcctctggcagctgtagtgtcagcgagtctggctctcaggatgacgagacgtcgtccagctcatgtgaatcagagacatctcgaaagaaccgaagcaaccggtcaaagaacaaagccaagaagatccttaagggtaaccggaagaggaaatctcggtcccatcagcaagtagcttcggatacagacactactagcgatgatatcggcgacgatgacgaaccccttgacgagaaaacgctgagaaggcttttggctaggctccagacgaaaaggggggcaaagaagcttcgaaccaagggggaatcttccgaggatcaaccggaagaggatgttgaggccaattctgaagaactggctttgttgctggcaaaagaattggcggctctgagtctcaaacttggcgacggacgcaaactaaacgatggacgcaggggcaaaactcgcggaaagagacacgcggctgacggtctcacagatggtcagaagggcaacctgcagaagtctaagcataaattgaaagctgcttcgaaaatggccttcaagcgggttgatcaatgtgagtga

SEQ ID NO: 10030 - DNA, 1080 bp, A.fumigatus
  unsure (1064): Identity of nucleotide sequences at the above locations are unknown.
gggcgggatatgctgacattttcttccctgttagtgtgggataatacgatccataattacaagctcaccgagactgtcgatgatactggtgcgaatgagtgggatcagtatatttttacggttcggcgcaagtttgactgggagaacaagtatctggaaactgtcgttgacatcaagagtaaacacttgcgggacgctctggctaagatcatggacggtgtcaagggtgtgagcttggtacaggagactgccgttgtcgatccaaacatgctcttcctgtatctcgaggagactcgcgcatacatgaaggaactgaagcagcaggccaaaaaagaaacgaagaaaaaggccaaaaagctggcggatctcaaagcagcgcaactcaaggttctcgtcaagtatctggacactgactacgcagagacgaaaaagactctgtatcctctgctggaagcgaacatgatcaccttcgatctgctgtgggcactatacaagccgaacaccatcgcctatacatcgacttacggcaatcaggacgaaccacgtgccttcaagattgaatacgccaccaaggaatcctccttcatgaaaggccaatggtacagcatcgagggtcgctacttggagtacgacggcaagtcattcggtatgggaacaatggctgctgaggtagaattcttcaagggcgttcgcaagattacgagcctcgggtgttatccactcaagtaccacagggaggctgaggaggtcaacgccaagctgatcgagcgcggcaagaaatttgtggcactttgcggtatgaattaccgcttccacaaaggaatggctttctacaagaagaaacggacaatcatcaaagtcaacatcaatggtcgagtcatggttgatcccgcgatccatcgtcgcatcaaccccaactacccaatcagtactgttcgtcccaaggaccctgatatcctaggtgcttcagatgacaaaccgagcgaagacggatgcaaatgcggaatgtctgattcagatgtcgatcagcaacaacccaagagtcgagactctgataaccccanaatcttgtacaaggtc

SEQ ID NO: 10031 - DNA, 426 bp, A.fumigatus
acatcaaagttttcccgatctaccttggtgtctttgagaatcagactgagaattcgaagccgctgtgcggccggaggaagggtcacagggaacttcttaggcatccgcctaaggatcgcttcatcaatatcctggatacgatttgtggctccgagaacaacaacccgctgcggttcacccagagaatttgcggaggtcaggccatcccagtgggtcatgaattcggctttgaccatgccactcgcctcatgctcaccgctccgccgtgtgccgagcactgcatctatctcgtcaatgaagacaatcgagggttgcagcttgcgcgctaacgagaaaacagcgttgaccagcttgttcgaatcaccataccacttctcggtcaaggtggaaatatggagatttatgaagcacgcgccactctcatga

SEQ ID NO: 10032 - DNA, 537 bp, A.fumigatus
ttagcagaatataatataatattcgtgttgcctgagatgccgaaacgaaaagcgacaggcaggctttctggtcaggccggctcggatggtgcgaatgccatgcaggtcaatggcaatgatgctggacagcgcgaaaacgagcgtccagctaagagagcaagaggaaggccgcgatccaagtctgttgaaagcaagccgccagccgaaacgaagcgtaattcgacagtggcccaagcgcaagcccctgacagtggtccaaagaaagcatccaaacggggacgaccaaagggtagccgaaactcggcgcacggcgcaactcaagaaggtccggagaggaaaggtggcaacgagaaaatcaaggatgaggttggagtcgaagaattcgagagtttggcggcgtccgacgacgagctggacggtgctcccgttgctactaagacaaatcaaaaggcaaaatcggccaaacctgcagctacacggggacgcaagaaagtcagtgctggaaagcaggtgcagacagatggcgagtttgaatat

SEQ ID NO: 10033 - DNA, 1134 bp, A.fumigatus
tctgcctccgcatactttctcattcgctaccttttatcgcgccttgatttcgacccagagagccagaagaaagaagagcaacggcgcaaatctgccgccattctgcggaagctcgacggtggagaggaatccgatggggactcaccacgcaggggggctaaaaaggcgcgccgacaaaggaggggagatttggtcctcaaccagtacgagcaagccatcgctatggatgttgtcgctcccgatgacattcatgtctcatttgaggacatcggaggcctggatgatattatcgaagagctgaaggaatccgtcatctatcctctgaccatgcctcatctctactcttccacgtcatcccttctcaacgcgccatcgggagtattactttatggcccgccagggtgcggaaagactatgcttgctaaagcgctggctcatgagagtggcgcgtgcttcataaatctccatatttccaccttgaccgagaagtggtatggtgattcgaacaagctggtcaacgctgttttctcgttagcgcgcaagctgcaaccctcgattgtcttcattgacgagatagatgcagtgctcggcacacggcggagcggtgagcatgaggcgagtggcatggtcaaagccgaattcatgacccactgggatggcctgacctccgcaaattctctgggtgaaccgcagcgggttgttgttctcggagccacaaatcgtatccaggatattgatgaagcgatccttaggcggatgcctaagaagttccctgtgacccttcctccggccgcacagcggcttcgaattctcagtctgattctcaaagacaccaaggtagatcgggaaaactttgatgttcattatttggtcaaggcaatggccgggatgtccggtagtgatatcaaggaagcttgccgggatgccgccatggtccctgttcgagaactggatccacaaaagaaagcagaaggcattcggatgacatcggtaaacccgacggaagttcgcgggcttgatacaggggactttttctctcgagccggaggccgtcaggttcatttcgcaaccctgtcagcaccagacaggacttaccagctaagccagttcggagaaagagtggagcactgctga

SEQ ID NO: 10034 - DNA, 636 bp, A.fumigatus
tcatgccccggctgggaaatgagactgcaaagtacgcgaacttcttgttttgaaactgagacacgtactgaattagactgggcaatatcagagcagagttgggacgtgcgacctggaaatatttccataccatgctggctcggtatccagaagacccgacggaagagcaacaggaaacattacgctcgtttatcctcctctttgcgcgactttatccttggtgcgtttttcgttgttgacctaacgaaagacctttcagaagctgactcgtggactagcggtgaatgcgcctctcactttcaaggtcacctgaagaaatacccgccacaagtgtcttcaaggaatgcggctgcaggctggggctgctttattcataacgaggtcaatacaatgctagggaaacccgaatttgattgcaacaacatcggcgacttttatgattgcggttgcgcagaggacgagaaggcagccggccataaagacaagtctcaagctgcgagtcggggtgtgcctcagaaaaaggatcacgaaggcgacgctactacgcctgtcgagatacacaaggagccgtcagtagcccctcagtatttcacatttcagctgctgacagaccatcgcagaactactcggggctga

SEQ ID NO: 10035 - DNA, 210 bp, A.fumigatus
tactcgcttatctgcaaggcgttgggtgcaaacacaagcttcagcatgtccatatcagttggaggggcatatgacagtctgcacaaggctacacatgaattcctctctggacgtgtgactttaattggcaacctccaagcattcgtgactcacacaactgaccgtggccattcaaaggaggcagttccttcatattgccgtcactactag

SEQ ID NO: 10036 - DNA, 564 bp, A.fumigatus
gtacaggttgcttgggtatcaggcgatgaagttctttctacaatcaagaaatctctacagtctgggaaatccacgtttagcaacgtctacactggcgagaaactctcagaatggtcatttgagccaatatacggccaatgttacctggggggtctcggaatcgctgcggctctcgctcaaggagccgacattgttctgtgtggacgagtatcacacgcgtcgcccgtgatcggtgcagcgtactggtatcacggatgggaccgcaatgaccttgatcaattggcaaatgcatttgtggctggccacctcattgaatgcaacaactacgtctgtggccgtaactttacgggcttcaagatgctggaaaacgccggtggtgatggctggaccaatatcggatatcccattgcagagatctccgcacaacgccacgtggttcatcccaagcaatcatactcttccggtggtgctgtccccgttccacacatgttcctccccaactgctgttaccagaatcaacgcccgttggtactttcacctcccaatgttgaatgccaatactga

SEQ ID NO: 10037 - DNA, 258 bp, A.fumigatus
aaggtgctcgccaataaggtccttcacgaggctttaatctctgaatctagcctcctctcccggttttggatcccaatgatcgcctgcagggtgtcggttcattggtttcaggcaacttctaagattcctgactccaagttacattccctttcactgttcactgcccctaccgaaccatgtatccatcttccaatagcgactctgtaccatatgcaaaccctatacgaaactacgcagacatttaataatcataagtga

SEQ ID NO: 10038 - DNA, 255 bp, A.fumigatus
  unsure (221): Identity of nucleotide sequences at the above locations are unknown.
cacctgtttaatttctccttcgttccccttgataagatcaaagtaacccccgctcataagctccttgacggccccacgccggatatgggtcgcagcagcgccaacggggtcgtagaccacaggatttccgcgttcgttgtaagatttgatggcttggaggtagttcggtatactttcgcgcgacaaggttcccatattgatgacaagagctccgtcgaatntggccaggtcgactgcttcttcaccgtatggtga

SEQ ID NO: 10039 - DNA, 690 bp, A.fumigatus
  unsure (523): Identity of nucleotide sequences at the above locations are unknown.
cttgccagtaaaacgaacacaaaacacatcctcggaaccgcgggcacgcaggcgattcttgacgctatttccgactcgagtcgaaatgtcgggaccgtcgccatcggcggtattaagctttcgaacgttcagcgtgtgatctaccagtccaaagcgcccaggaagggactggatggcgtcgctatcgtcagtgccatcatggcagctgacgacccacgcgctgcagccgaggagtttgtcaagcgtatcaacaacccacctagctttgcatgggagcccaaggcacctcgagcgaacgaagctgcggcattggccgaagaggtggctcaaatcgttcagaagatggttaaggcacaccccttggtccataacatgatcaactacgttgtggccaattttgttgccaatgttgctctcgcgatgtacgtctgtatttggatcattattgatttgtctaattggcttgcagaggcgcttccccgatcatgtcaccatacggtgaagaagcagtcgacctggccanattcgacggagctcttgtcatcaatatgggaaccttgtcgcgcgaaagtataccgaactacctccaagccatcaaatcttacaacgaacgcggaaatcctgtggtctacgaccccgttggcgctgctgcgacccatatccggcgtggggccgtcaaggagcttatga

SEQ ID NO: 10040 - DNA, 198 bp, A.fumigatus
ccagaagagagcgtacgctacaccgtccttgcaagtgggatcgagttgctaactctgtcaggaaacgtcgtccttttgaccggcgccgtcgactatctaagcgacggcgagcgtgtgatcgctgtcgagaatggtcatgaattccttggacaagtcaccggcgtacgtctattactctcttcttcaagcgcttgctaa

SEQ ID NO: 10041 - DNA, 267 bp, A.fumigatus
ctcaacgtacagactgggtgtgccgtgggaatggtatccggctgcttcctggctgtacacccctcagacaagctcctggccgttctgtcgggtctcctgatgtatgagattgcggcggaaaacgccgcgtcaaaggaatacgtccgtggaccaggaagcttcgtcccggctttcctggacgagctctacgccatccggcaagcagctctaaagggtgatgacagctggttctccggacgggcaaagatccaagagatcaaactatag

SEQ ID NO: 10042 - DNA, 195 bp, A.fumigatus
acgatgtgtcccgtatacctgttaataaaaagctgtgatatttgcaatatggtccagctgactggcttgctcggagaacaatacctagaactgtttctgttgaagcctgatttctcgggcgaaaagcttccccgcactggtccgactgtcttcaccacggggctggaaggatccgacgcgggctctatgtctata

SEQ ID NO: 10043 - DNA, 213 bp, A.fumigatus
tgtgttacatcaggcgtgactatcgttcaatatagagacaaaacgagcgacacaggggctttgattcaaacagcgaaagagctgcacaaaatcaccaaagcttatggagtcccactgttgatcaacgatcgtgtagatgtcgccctcgctgttggggcagaaggcgtccatctcgggcaagacgatatgtgtacgagccatggcctcaggtga

SEQ ID NO: 10044 - DNA, 516 bp, A.fumigatus
  unsure (65): Identity of nucleotide sequences at the above locations are unknown.
ttggcttgcagaggcgcttccccgatcatgtcaccatacggtgaagaagcagtcgacctggccanattcgacggagctcttgtcatcaatatgggaaccttgtcgcgcgaaagtataccgaactacctccaagccatcaaatcttacaacgaacgcggaaatcctgtggtctacgaccccgttggcgctgctgcgacccatatccggcgtggggccgtcaaggagcttatgagcgggggttactttgatcttatcaaggggaacgaaggagaaattaaacaggtgtcaggaagccgtaatgcggtccagcgcggcgtggacagcggaccaagcactcttgacggtcaagagaaggccagattggcccgcgacctagccagaagagagcgtacgctacaccgtccttgcaagtgggatcgagttgctaactctgtcaggaaacgtcgtccttttgaccggcgccgtcgactatctaagcgacggcgagcgtgtgatcgctgtcgagaatggtcatga

SEQ ID NO: 10045 - DNA, 525 bp, A.fumigatus
tctggatcagtgattcaagttggcttcggcaagaacatgtgggatgtcatccccatggacaacatcaccgaggtgaacaaggttggtggccgtttgtccctgagtccaacggccagcgcactcacctatcattcacagcgcttcttcgccttcgtcgtcttatacaagacgcagatctccctcgccaaaatttcggtctgcctcttccttctgcgaatcttccagaccctggcgttccgatacacgacgtacgcgatcatcggactcaatgctgctattggagtgacgtgggtccttgtcgactcgctgcgatgcaacccagtccatctggcatgggacggctggacaggagagacgccgggaacatgcatcaatttcaccagcgcgacattcgccaatgcgtttgtcaacatcgccgtggatactgtcatggtgctgatgcctgtctatgaaatttcgaagctcaacctgtcgggaaggaagaagcttggtgtgagtgtcatgttcgccatgggtctagtgtag

SEQ ID NO: 10046 - DNA, 504 bp, A.fumigatus
  unsure (166),(456): Identity of nucleotide sequences at the above locations are unknown.
agattatatccagaatggcagtggcgacgggcacatcagcttatgctccagtccaaattcataatcacgaagcagtgcatggagcgccatcccagccaaccaccatgcccccctaccgaccaccaaacgaccaagagatggtgcccatggtccctctgggactggntctgggagctcgcagcatgcgtcgtggccatcctcacgctgatcggcatgatcgcggtcctgcgcatttacgacggaaagacgcagccaaactggccagcggggatcaacctcaacgccatcatcgccctgctgacgactctcatgaaagctgccatggccacatatatcgcagaagctctgtcgcaactcaaatactcttggttcaaggatacacgcagattgagtgatcttgctgcactcgattcggccagtcgcggtgcgtggggtgcagcacagctcttggtgaantacgtgcctcggtgcgcaacctctctcccatcactggcttctcgctaa

SEQ ID NO: 10047 - DNA, 231 bp, A.fumigatus
tcgggggtcccagggcggactgtatcagttgttaaacgcctgggcgcccgcgcatgcaatgtccccgtccaccagggccggccggagggagaagctgccacactgttccctttgattctggcttcagtcttgttctttaaccgaatggccgccaaatccatgggcctggctggtggttggggctccgacgagtacaccatcatcggcgcctatgtacgatatcctctttga

SEQ ID NO: 10048 - DNA, 501 bp, A.fumigatus
ctttgcttttggtgggctaggatacctgtcaatgttggtttcggccataagattgttgcccagctcccaatgctaacgcctgctcgttgtaggttcctctctggacagatgcatgtattccgccctagagctgatctctggcgctgcattctggctttaataccgatgttgtgcgcgctgatgatcgcaatctcgcgccttgaggactatcggcacgatgtctatgatgtgacctgtgggtctatccttggcctgattattgctcatttctcctaccgacgctactaccctccgttgcggtctgtcgcctgtgatgttccacacgaggcttatgaaatcgtcggtccaaatggcttttctaaactgccaggcgatgaggaacaacagatccaagaacgaggtctaggctcacgtggctgggaagcccaaacatatcagctggaggatctgccttctcatcacgatcggttgcactatacgtcctcggctactcctgcatag

SEQ ID NO: 10049 - DNA, 432 bp, A.fumigatus
gcattctcagaatctgacaccagtttgccctacgctcataaattgccagtatggtcgattatctatgctggtgtcgtcccacttctgattctggtttgctgggcagccattttccgccccaaaccataccaggttcaagtcactattctcgggctactcgtcgcgcttatgttgacttccctgattacggacatcatcaagaatgctgttgggagacctcgacccgatcttatctcacggtgtatgcccaagaagggcactccggccaacacattggtagcctggacggtctgtacacagtcgaacaaccacatactccaggagggatggagaagtttccccagtggtcacagtagctttgcttttggtgggctaggatacctgtcaatgttggtttcggccataagattgttgcccagctcccaatgctaa

SEQ ID NO: 10050 - DNA, 357 bp, A.fumigatus
gaggggttcttcttcgaaccagatgaggagcgcggtgagattaagatctgcgacgaacatccggggtataccaatatggtacagtctgccgacggcacgatgatgagcattccttttgaaaagactcagattcctaaagaagccgagacgagggttagagctctgcttaaagagacgatgccacagcttgcagaccgtccattcagtttcgccaggatttgttggtgcgccgacactgccaaccgggagttcttgatcgatcgccatcctcagtaccattcgcttgtgctgggctgcggcgcttccggcagaggtaagactttcacatcaagagatgttaaacgcaacaatcgctga

SEQ ID NO: 10051 - DNA, 348 bp, A.fumigatus
ctgccactcctcaggggcagagtagtcactttaatatttgagaataacgatgtcaaaggtgccgttacggcagacggcaagatttggcgtgcagagcgcacattcttttgcgccggtgccagcgctggtcagttcctcgacttcaagaatcagttgcgtccaacggcatggacgctggttcatattgctttgaagcctgaggagcgggctcttcacaagaatatcccagttatcttcaacattgagaggggttcttcttcgaaccagatgaggagcgcggtgagattaagatctgcgacgaacatccggggtataccaatatggtacagtctgccgacggcacgatga

SEQ ID NO: 10052 - DNA, 222 bp, A.fumigatus
ggattcaaatatctaccttcaattggcaatctcatcgttgatgctatggaaggcaaggtccctcaaaagatccacgaactgattaaatggaacccagagattgctgccaatcgcaactggagggatactttggggagattcgggggtcccaacagagtaatggacttccacgacgtcaaggagtggacaaatgtacaatatagagatatttccaagttataa

SEQ ID NO: 10053 - DNA, 213 bp, A.fumigatus
ccactggggaaacttctccatccctcctggagtatgtggttgttcgactgtgtacagaccgtccaggctaccaatgtgttggccggagtgcccttcttgggcatacaccgtgagataagatcgggtcgaggtctcccaacagcattcttgatgatgtccgtaatcagggaagtcaacataagcgcgacgagtagcccgagaatagtgacttga

SEQ ID NO: 10054 - DNA, 1881 bp, A.fumigatus
ggctctgccaccaattatgataccaaggctttttttcccagtctcccaccgcttttcccaaactccggaaagctcgatcgcaagaagctccgggcaaccgttgagactttacccaaagatcagctcaaatcttacgctacactgacggctggctccagacaagcgtctgatgagggagttgaggggacactcagaagcctctgggaagaagctctgggtcttgcgtcaggttcggtcagtgctgaagacagctttttcagcttaggtggtgattctttctccgccatgaagctcgttggagccgccaattcccagggaatctctctcacatttgccgacgtttacgaggatccagtctttatgaacatggccaagcgctgtggcatgttacagggaaggtccggccgacagacagtgactccgtttagcctgctgcccgcctcagtcgaccgtgaacagctcttggaggaagtagcggaacaatgtggcgtgcctcgagcatccattgtcgatctctacccatgcagccctgtccaggagggtctcctcactttgtcagtcaagcagaacggtgcttatattgctcagccaatcttccggctctcagagggaatagatctcgacatgttcaaagctgcttggcaacaggttgtggatgagctggatatcttgcggactcgtattgtgcatactgagtctctgaactttttgcaggctgttattgacaaagaagagatctcttgggcttcagcaaccaccctggatgaattgacagccgagagccccgagctgccgcgacacaatggcgggcggctgactggttatgcgattgccgcgtcgcagactggccggtacttctgttggacaattcatcacgcgctgtacgacggatggagtatcccgctcgttctacgaagagtggaggaggtttacacgaattccacagctagcgctcgaacagttccctacaacttatttataaactatctgctggaacggagcatggcagactctgacgagtattggaagtctcaactggccaacctatcctgttctccattcccacaaagcaggaatcccctgcctgactctgttcgagtaggaaataggcatcacagcagcatgaagatctctcgagccgccagcggagtggatcttactatccccgagcttattcgtgctgcgtgggcgatcgtcgtctctgcccatactggatccagtgatgtatgcttcggcgagacgctcatgggaagaaatatcgacctcgctggtgttacagatattgctggacccgttcttaccactgtccctacccgcattcaagttgacaatgagctgccaattacccagtatctggagaatatgcaccatctgacgaccacaatgcttcctcatcagcattcaggactgcagcaaattcgaaaactcaacagtgacacagcatcggcttgtgaatttcaaaatctgcttgtcatccagaccggagagggccagttgaacaaggccttgtgggtggctgaacccatccaaaccagtggagacttcttcactcatccacttgtcgtcgaatgcaaggtcgatacttctgaggtgtcgattacgatgcaccatgacgaaatcgtactgaacagctggcagactgagaagctcataggtcaattcagcttcgtgctcgagcagctgctctccattaacaagggggagacaaggaagttgagcgagctcgagattttcagtccacttgatagcaaggaagtcgcactatggaacaagaaggcacctgagggcgttgagaaatgtgctcatgatatcatttccgagagatgctctacccaccccgacgctccagctgtctgcgcttgggatggcgaagtctcgtaa

SEQ ID NO: 10055 - DNA, 1446 bp, A.fumigatus
aaagagatgtacacacttgcctcgtcttttgcgtcctatctaacttgtcgtggcgttggcccagagactttggggccaatttgcctggataagtctctgtgggcaatcatcacaattctgggaatcttgattgctggtggtgcttatgtaccactcgatcctgttcatccaacatctagacatgaagaaatcttcactgaagtggatgctcgtattctgatatgctcccctcaataccagagccgttactctagcattgtcaaaacgataatccccgtcagcaaggagacgatcagagcttattttgccctcaattaccaggcgaaaggactcaggcgtgtcacgccgttcaatatggcctatgcaatctttacctcaggaagtactggtcgcgccaagggcattatcatcgaccaccgcgcacttgcaagcagtgccatggcattcgggccgattgtgcacttgaatgagacttcccgtgcattccaatttgcgtcccttacctttgatgcagctgtcatggaaattctagctactctgatgcatggaggatgcatttgtatcccaagtgaggatgagcgcctgaatgatgtcgccggcgccattcgacgtatgaatgtcacatggacttttctgactccgtcgatagctagcattatcgagccatcaaccgttccctcactggaagtgcttgcctgtggaggagaaaaattgtcacgcgaagtcgtgacaaaatgggcgcatcgcgttaaactcatcaatggatatggacccacagagacaaccatcttcgctgtcttgaataacgtgtccccgactaccgatcctgcttgcattggttacggaataccatgcactttgacctgggttgtcgatcccgaaaaccacgatcgacttaccccattgggagccatcggagaacttgccttggaaggtccagctctggcaagggagtatttgaagaaccccaagaagactgccgaggcattcgtggatgagccagcgtggatgaagcatttccagtcgaccctgccgtctccgcgaagaatatacaagactggagaccttgtccggtataaccctgacggatcggtggaatacatcagccgcaaagactaccaagtcaagcttcatggccagcgcatggagctcggtgaaattgagcatcggttacatgaggacgaccgcgtccgtcatgccattgtcatccttcccaaggagggtcttcttaaggggcgtctggtcacgattctctccctgaactctctgaaatcaggttcgagcatcatctccgataatgcatgtgagcttatcagtcgtgaggatctggcgagagtcgcgtattctgagctcatcacgattcagaagaatctcgaagcccagctgccgatttacatgggtcctcagacctcttctccacaagggccagcgaccgcgcaggcacaa

SEQ ID NO: 10056 - DNA, 843 bp, A.fumigatus
gttgtcttgtaccgctcgaaagaatacgatacgaaccgcgacccccggggtccgctctctgcgggtgcagaggtcctctacggcatcatgtcggattttgtgacggcgctcgcaacggcaccagtggacatcgccgaggcgatctcgcgccatcaccaccaccataagaaacatgggtggcgtcacagtcacgacgaggaggttacctgcggctgtgaggcacggatagggaggagtgtaaaatcaaaggacgggatccccccggaagaccaggtgcggtcacagctgggcgcggtggcgagtatccgccgatcgtcgtccgattccccgacatcgagtccatccggttctgcagacgaggaagaggacgacgatgagggcgagcaagttggtagtgaaagtacgagctttgtctctgctcccgatcggatatccaggaatagcgtgccggcgccgagaagtcggatatcagatcagtccacaatgcaatcggattccacagaaacgcatgtcgagagcgacgaggacagtggtgaactcgacctggagaagaccatcagccgccgggcgacaagggaggcgcggggaggcgtacatgtagtgctaaccgagaccggctatcatggcaaacggttcggcaagcgactgctgaactggttgattacgattcctaccgatgtaacgctgagtctgtccaagggtttccacaatgcaccaaagctgtaccacgacaggacggtggccgaaaccccgacagtgatgggcgtacggagtggcttccgagccgctggaaaggttggcattccacgctattccctctcgtcccagatgggttgcaactaa

SEQ ID NO: 10057 - DNA, 756 bp, A.fumigatus
gcattaaagcaaggcaagaaatatgatgatccagcttccgcagctcagatccgggactttatcaacttccatcagcttgacttgtcagaggttttgttacctcttgaccaattcaaaacgttcaatgagttcttttaccgacaattgaagcctggcgcacgcctttgttcagctccaaatgagccgaggatcatcgtgtcgcctgctgactgccgatctgttgtttttgaccgcatcgacgaggcgaccagtatttgggtcaagggcagggagttttccgtggagaggcttctcggcaatgcgtacccggaggatgctccgcgctataagaatggagccttgggaattttccgcctggctcctcaggactaccaccgcttccatattcctgttgacggtgttatgggtacccccaagaccatcgagggcgagtactacacagtgaacccgatggcgatccgttctgcactggatgtgtacggtgaaaacgtaagaattcttgtaccaatcgactcgatcgcccacggccgggtcatggtggtctgtgtaggggccatgatggtcggaagcacggtgatcactcgaaaggcaggcgagaaggtcactcgtggcgaagagcttggatacttcaagtttggcggaagtactgtgctgctcctctttgaggaaggcgtgatgaagtttgataaagacctggttgataactctaggggtgctttggagactttggtgagcacaatcaatcccctttgctga

SEQ ID NO: 10058 - DNA, 606 bp, A.fumigatus
cgtattaaggtcgatttatcatccttcgtccctgcgatgatgttggaggctggagatatggctgaagaacaaacctgtcttgatcaagagagcagagaggttcggggcgaagaaactggcgagggcaacgacgacaagtggcaagaacagacacacggagagtttgtagtagaatcagttgcagagaggggatcaggtgagagagacagtctggctagtaacaacagtctgtcaaaagaagagttagtcgaagagggagaaccagccgacaaggaatcggtggacgagcaatcgggcgccattgaattagccgacgagaagtcagctgacaaggaagcagatgaggaggaatgcagcgaggaggaatcggacaaggaggatctggcgcctgtttcagctgcctactattcagggataaaggtttacggctacggtctctcggaccgtccctggattacgcgcgacggccaggatttcatttggctaccccccgaattccgccccgagtgctctgccgtacagggcgacacaattgccatcggttgtcgatcgggtcgggtcctcatcttcggcttcgcaccagatggatgttccaccggtgcttaa

SEQ ID NO: 10059 - DNA, 645 bp, A.fumigatus
tggcttagccttagtgatcatgctgttggcgtgcacccgaaacctgctgaagtagaacatttaaagagctcacttcacttcccgcaaggacatctcttccttagcaagcttgatgactctaattcgtctgtatctgccaacatgactattactcaagagctcgtcaaagataagactgcagaggattctgatcgaccgtctgccgagcaaccacccggctatgaccagattgacgagcaaccatcaacaatcccaccgttggatctgtcgcacaatgccggtccccctgcgtcaacaaccgtcaccagggaccagtgtgtcgctcatctcaaattcatcgcggcattagcggacctgcgtgatagtgtggccgggaacgatggcctcttcggcctccatgacccgccgccgaccgagttccctgaccacatcaacgaggttcgggctcgcatgagagaaaagagatgggctgtctatacggctagagcagttgatcgttacacgaagtggtgggtgaagtgcgtccccaacgacaggccacgcgctcgccttacggacttgatggatgagagctatgatcacattacccaagacatccggctgatatcttggtccaaggattcgctgccccctttaggtgagtga

SEQ ID NO: 10060 - DNA, 534 bp, A.fumigatus
tggcgtcgagtagtgctaacaggagcagatgtcctcatggtatggcatgcgcatatgctgaaccccagagccttcctcgaggactgcattcggtctgggaagatgtgctgctgggcgagcggtttcccctgggaaacgatcaatgactgtatcgataaccgaaccctggagtatgacgcgggggatcgcgcgagggtccatttcaaccgcatgacgcgctttgcatgggaaaatctggacgatcccctgaacaagttaatcgagtgtcccgcttgtgaaaatacagtatcggtgccttggactcaaggcagaatctcccttccgcttcagacggcgtttgacaagttcaacggctatgcagacaagaacttccacgtaaaatgcccaaagtgcggctcgacagtcgaccacgagctgctgagagtccgaaaattcagaagggatgtcgcgaattggctgaaagagaagatgccgatgccagggacattgtacaatatgcgtggaatcccgcaatcgaccaggagtcaaactcgt

SEQ ID NO: 10061 - DNA, 231 bp, A.fumigatus
tggaaggcttccagaaacacgttcttccaccataccactactgtatggcccatttattttattttattttatttttcttttatattgttatttttatctcgtctatttaacaattatctagttagtatgtgcgttttgattgcgatgattattattaatagcaagtattcggcgcgttttattatttcaataataaatcatttattttcaagggttaatattatttcatga

SEQ ID NO: 10062 - DNA, 183 bp, A.fumigatus
cctgcagaaaggaaaaagagtaatcaacggcaagtggataatacgccaaatacaatcactattttgggacttacgacttgcgacttgcgaggcactttctggcccgcttatcactcccctactgcaagattattcgccattgtgcgacatatggaaccttacaagtgcagacgtactatttag

SEQ ID NO: 10063 - DNA, 288 bp, A.fumigatus
agtctcgctaacccaggcgtaggaggaggctcgggctttggcgcggctatatctcggcggtttggtgaggagggcgccaaggtgattgtcgccgatatcgatgtcgagaacggagagaagatcgccgcgcaaaatcccgaaaacttggttttttacaagatggacgtcacaagcgcttcggactgggacgaggtcatggatcttgcctttgccaagtttggtcgattggacgtgctggtcaacaatgccggaactacatacaggaataaggttcggactatcagatga

SEQ ID NO: 10064 - DNA, 243 bp, A.fumigatus
ggtgcccccttggctgacgtccgtgccctacagcccactttggaagtcaccgaggaggaatgggaacgtgtgttcaatgttaacgttcggagcatcttccttggatcgaaagcattgatggggcggttgatccagcagggccaaggaggctctatgatcaacatctcctccaccggagcctcgagaccgcgaccgggattggtgtggtacaatgcatccaagggcgctgtttccaatgtatga

SEQ ID NO: 10065 - DNA, 267 bp, A.fumigatus
gccaccaaagggcttgcggctgagtacggcccccacaatatccgcgtcaacacagtcagtcctctcttgtccgggacgggcctattttccatgttcactggcatggaggacacgcctgagaaccgtgagaagtttatcgggaatgtgcccctcggccggttgaccgacccaaatgatgtggcgaatatgtgtttgtaccttgccagtgatgagggcagtttcatcaacggcgcggagatgatcgtcgatggtggcaagtgtatatga

SEQ ID NO: 10066 - DNA, 234 bp, A.fumigatus
aatgcgaccacagacgagatccgtcgtaccgaaatgattcactctagatcatatacacttgccaccatcgacgatcatctccgcgccgttgatgaaactgccctcatcactggcaaggtacaaacacatattcgccacatcatttgggtcggtcaaccggccgaggggcacattcccgataaacttctcacggttctcaggcgtgtcctccatgccagtgaacatggaaaatag

SEQ ID NO: 10067 - DNA, 939 bp, A.fumigatus
gatgatagaagcaagtttttacctagaatgctagcaggtattttgatcgaggtcgaacgcatagtagattgttggcaattcacattacgtgggagttatgataatcacgtgactaaaatatcaccatttttgcttcttggaacggcagaggagagacaatcgaacaacgtcaccaatcgaccaatcatgtcgtctcctacagtgtcggcaaagcttgaaggctcgaaggagcagtccaaatcggctccggattccaagatcgatcatgcggcctcgttgaagtattggaacgatgtccctgctacctccaacggcatgctggccatgctcggcgattatccgtggtattcccgcattgacctacgaggatcacgggccttcttggccaaagtgcgtcggcttttaccatcctgcagcacagaaggcaagctcaaactgggggtggattgtggtgccggagtcggacggataacggaagggtttctcagtcatgtctgcgaggttgtggatgtggtcgaaccggtcgcaaaattcaccgaggtcgtgcgcaacagctccctgaagaaggatggtattgttggggatatctacactgtggggcttgagaactggtatccggagaagaagtacgatttgatctggacgcagtggtgtgtgggacatctgacggacgcgcaattgcttgaatatgtgaaacgatgtcgggccgccttgacagagactggcattatggtggtcaaggagaaccaatctacggatatcaacggggaggacatgttcgatgaggtggacagcagcgtcaccaggaccgatgagaagttcaagaagatctttaaggaagctggaatgaccgtcttcctctcggagattcagacggggttcccgaaaaatttcaggctcttgccggtcagatcgtacgcgttacggcccaatagctga

SEQ ID NO: 10068 - DNA, 1050 bp, A.fumigatus
ttagccattgaaatcaaccccagttcctccatctacctctccaaccgggctgcggcatatctctctgccaaccgctacctcgaagcgttagaagatgccgagcgcgcactggagctcgatcccgacaactccaagatcatgtaccgcctggcccgcattctgactgcgctggggcgtccgtccgaggctctcgaggttttatcccgtgttcagccccccgcctctgcgaccgaccgtgccgctccagaaaagatgcagcgcttcatcaaacaggccgaggaaaccttggcggaagatcgaggtgtgtcgatggtgctattctgcattgagcaggcacggcagctgctgggccgtggagtcaaggaaccccgcaagtggactcttctgaccgccgaagcacaactgaagatgggcagcgaaaactcgtttaggaaagcgcaggatatcgccatttctatgctccgtgagaacaaccaggaccctgatgccctcatgatccgtgctcgtgcgtactacggcttgggagaatccgaacaagcgctgaaaacgctcaagatgtgtctgggtctggatcccgacatgaagccggcgatcaagatgctgcgcactgtccagaagctcacccgcaccaaagaggaaggaaacaatgctttcaaggccaaggattaccgcaaggctatcgagctgtggtccgaagcgcttgaggtggaccctcagaacaaggacatgaattccaagattctgcagaaccgagctcaggcatacatcaacctgaaggaatacgagaacgccatcaacgattgcaatgaggctctgaaattggatccctcgtacgtcaaggcgcagaagatgcgcgccaaggcctacggtggcgccggcaattgggaagaagcgatccgcgactacaatgcggtggccgatgccaaccccggtgagataggcatccaggaagacattcgccgcgcagagtgtgagctgaagaaggctcaacggaaggactactacaagattctgggtgtctccaaggatgcatctgagtcggagattaag

SEQ ID NO: 10069 - DNA, 918 bp, A.fumigatus
  unsure (578),(659),(683): Identity of nucleotide sequences at the above locations are unknown.
attgattttggacatccgatattcttctggatctcgtcctcccacctctgtattgttcacgatcgtctgctctcgccagtatacgggcggaagaataccaagataaacatttccaccgccttcgccgacattcgataccctcagccaatcagggactgcaattctgataaccagaaaaagaccagaacaggaaaacgccgtaaagaagaaaaagatatggttcttcctcacctctttgcccgtcacaaatccaagcgatccacttcatccaaagaggattcgaagaagacttcatcgccaaaaagtcctcctccatcgacggagacccttccttctcggtcgtcctcgacttcgacgtcttcgtctcgccacacccccagtcatcatcctcatcatcttcgctctccctcacacccaccgccgactcccgttcctcttcctcatcatctattcatccaccgtcctctcattcctcgagatcgtccaaattccaagtcgagatcccacacctccgctaaatccaaatcttcctcgtccaaggacgccgccgccgccgcgaggttcagtttccctgcttnccggctctcctccaccttcgatcgttactcgcacgatcccgactttcatcctttgaatcttcaccccgacgagctacgtcngttatccgccatggcttctgccgncgatcgcagttcgatggatatcgattcgcctggctcttcctcccagaacatcaatggggtgaacggcgttcagactgaccgggttctaccccgccgccgcacaagtccaatggctcggtcgccgaagccgactcattcaaattggcgggcaataaatttttcaaggacggaaattacaatcgcgcaattgaagagttcaccaaaggtgagtatgcaattttcgtctctaaaataa

SEQ ID NO: 10070 - DNA, 528 bp, A.fumigatus
  unsure (472): Identity of nucleotide sequences at the above locations are unknown.
acatttccaccgccttcgccgacattcgataccctcagccaatcagggactgcaattctgataaccagaaaaagaccagaacaggaaaacgccgtaaagaagaaaaagatatggttcttcctcacctctttgcccgtcacaaatccaagcgatccacttcatccaaagaggattcgaagaagacttcatcgccaaaaagtcctcctccatcgacggagacccttccttctcggtcgtcctcgacttcgacgtcttcgtctcgccacacccccagtcatcatcctcatcatcttcgctctccctcacacccaccgccgactcccgttcctcttcctcatcatctattcatccaccgtcctctcattcctcgagatcgtccaaattccaagtcgagatcccacacctccgctaaatccaaatcttcctcgtccaaggacgccgccgccgccgcgaggttcagtttccctgcttnccggctctcctccaccttcgatcgttactcgcacgatcccgactttcatcctttga

SEQ ID NO: 10071 - DNA, 312 bp, A.fumigatus
tccatcctcttgaccgcagctctgggtatgcccaaagcattgatccgggtccagctcctctgggtgaacctggtcactgatgggttgcctgctaccgctttgtcgttcaaccctcctgaccatgatgtgatgagacgcgcgcccagaaagcgcgatgagcctcttgtgggcggctggctacttttcagatacctggccatcggcacgtacgtcggtgctgctactgtttttggttacatatggtggtttgtttataatccagagggacctcagatctccttttggcagctggtaagcaaattgtctcagtga

SEQ ID NO: 10072 - DNA, 378 bp, A.fumigatus
gcaaattgtctcagtgagaccttttcgtgcctgtctaactcgtatttgcagtcccatttccacaagtgctccgctcaattccccgagattggctgcgagatgttctccaacgagatgtcgcggtctgcatccaccgtgtcgctctcaatccttgtggttattgagatgttgaacgccatgaacgcgctctcatccagcgagtcactcctcgccttccctctttggaacaatatgatgctggtgtacgccatcattctgtcaatgaccctccatttcgccattctgtatattccattcttgcagacattgttctctattttgccgttgaactggactgaatggaaggcggttctggctatcagcgctcctgttgtgtaa

SEQ ID NO: 10073 - DNA, 204 bp, A.fumigatus
ctggttgtcagggcatatccactcgcatcgctgggttacgctaactggattctgcgtcactacggatacaaggccgtctctatctttggactgaccctgtatggtattggagcgctctgcatgtggccggccggcctcaatcgatcctttgggggtttctgcgcggccacattcctcatctggtcggggctggggtccttatag

SEQ ID NO: 10074 - DNA, 246 bp, A.fumigatus
cagcccataggcaaatccctacacatggaccatgatcagcatatgtttgtcgacttcaagttcgatcagtcaatccaggtgtcgactcacccacataaagaagagaatcgtgaccagggcgaggggccacaggctctgacgcaaggtgagcgtagctgcagaggtggtactcttattgttcacccggagcgccgagcgggatctgagaacctgagcgacccccatttcggcaattgcggaggttaa

SEQ ID NO: 10075 - DNA, 234 bp, A.fumigatus
ttcaatatgaggaataaggtcattacgcgctacccgtattactctggcccttactttcaagtatacagggatagcacagcactagacgactttgatattagtcttcggctgcagatgcagggaatggggtgcggctcgacgcaatccagtatccgtgcctcaggctgcacccactccggccgcgccggagtgggtgcgccttactgtaattgtagatttcaagcggaattgtag

SEQ ID NO: 10076 - DNA, 2034 bp, A.fumigatus
acggagaacacaatactaacaatcttcaggattggcagggactttgccagaaggggaacgtgttctttcaaaaacggcaagtttcaacacgtaaatgacaccggaaggcgagatgacaatcgaccaaaacgagacgtgagacccaaaagaccagaactctcagattcagagaaacaatttcgatcctggaaggatacccttaacacagacttccgtgcatctcgtccaggtcgcgcgaagttgaataacttcttccgagatgctcgacagcttatcgaagttgacgctggtctcatgcaaggagtgatacgtgagctatccgaggagacgggattggaacatattcgagatcttgtggagaataaattccccaaagccgagtcgaaggcaaaggaggaagtcttccggtcacaggtccttcccatgctggaaaccgtctcgcaccctaaggttttatcatcgctgatcttagaacaagcagtgggaactatttacaacgtgctgtatggtatcaacggccgcagggcagcgctgttcctgagctcagtatgcgatgtgctatcaaaaatcagcgaggaggaaacggccgtagagtggttggaaatttcactcctcgtgttcgcaaaaatcgtcgatctcaactccaccgcattcgttcaagatgcactcaaagatcaagcaaaaaggtttcagcagctttttctccgtatggctgagggtggcctggcgagctctctccaccactcgcgcaatcttcttgatcacctcctatgccgattggaaattgggagctccctaccatctgcaccggcgaacgataagctcgaaagtgagccgaaatctactgcaacatttatggtacatcgcgaaccgcctggtggcagacatgataacgaccatgccgatattgtgaacatcgctatcatgccaaccctcgatgagatccaaagctcgcgtatcgaatacctaccggtcaatgatcctcgtcagtggcatgtgggtggtctggacggtttgttagatcgtaatttccgtctactaagggaagacacgattggtcagctgcgagatgctattcaccaggagctcaaagggtcacaggaaccaggccgacagatttcccaggttcggacacacgtctatcctcgtgcgaagatcagacaaatctactttgacaaattccttggcttccatttcaaggtgcaattccctcaaccgccacgcgtcagtgagatgtcggtcaaggatcgggaaaactggtggcagttgtcaaagcgtttgctacccggtgctcttgtgtgtctcatcatgaatggacgcaatggaaggacggttgtcttttgtaccatcgtggacgagcaagtcaggtctcccaaaaagcaaacagacaacgctaataaggaaagcgagaatgtagcatccctgtgggaagatgcgaaggaagcgtcagtcaaaataatgctagtcgatacgaaacccggcatggtccgcacaatattgaataaggtcctgagtaaacgggatttttctattgttgaattcccaggcattctactggctggcttcgaaccaaccttgcgagcactgaagaagatcaaggagaatagggagctaccattcctagagattctcgtcgcgagcggcaatgtaggtccagtcgacgttcctcctcccctctatgcgttgagacccggatttcgctttaaccttcgttgcttgatgaataacaatgccgacctatacgtccaagccgataaaccggttgatatagaatatttgcaacgcaattcaaccctcgactgggcccaggcgagagccttggtcaatagcctccaacaccgaattggcttgatccaggggcctcctggtacaggtaagagttacacaggtgttgcgcttatccaggtactcctagcaaataaaaagcaaggaaagacaaatcttggtcctatgttatgtgttacttatacgaaccatgccctggaccagttgctagaagctctcatcgacaaaggagtaacgtcccagtcttaa

SEQ ID NO: 10077 - DNA, 486 bp, A.fumigatus
gactggcagcggggaaccggcacaatcctttacaatcctgcggttcgtgcatcggtcggcggatccacttcgatgaacaccagcagcgtgggcaatggctacagcagtcgtccgtacaaccgcactggtaacggcgccgatttcagcgacggtcaatccggcggatatggcagacgctctaatcccgatacctccaaccgcggctatccccttgtcactgaggacggcgaagaaattcaaactcagaatatcagcattcctgcggacatggtcggttgcatcatcggcaggggtggaagcaaaatcaccgagatacgcagaagctctggagcccgcatttccatcgctaaagcgcctcacgatgagaccggagagcgcatgttcacgatcatgggcagcgctcaggctaatgagaaggctctgtacttgctgtacgaaaacctcgaggccgagaagacccgccgaagccagttgcctcaggaataa

SEQ ID NO: 10078 - DNA, 639 bp, A.fumigatus
  unsure (258): Identity of nucleotide sequences at the above locations are unknown.
cctactgcggcattgtctggcagaatggtcttttcagaagaaaatcagttggacctgggccttggagctcttttcaaagcccaggtatctgagaatggtgcagccgtagcggtcgagagcgatggccatgcattatcatatgctgatttgcattcaaaagcgctgtatctggcttatcagatacaacggctctgcccctgcgacggaactccggttggaatcctcatcccgagaggtataaatcatatcctgggccangttgctgtgctctacttgggtagatcatgcgtgcctcttgattttaagctacccgatgatcatctcaataacatgctacacgatatcggcaccaacctcgtcatatgtgaccaagagaccacgcatcggcttccgactttcacacatgtcctcgctgaccacacgattgaagctcctggccctagcttcgagccattactcaagggccccaaaagctgctctcatatccttcatacctctggcacgactggcaagcccaaagccatcgaaatctttgcagaaggggcttatcaacatccttctcgatcctttgttccttgtaaaagaaaggtgaccgtttcggtcatataccgagtgtgcctttttccgcttcgttggtag

SEQ ID NO: 10079 - DNA, 1800 bp, A.fumigatus
  unsure (1480),(1628): Identity of nucleotide sequences at the above locations are unknown.
aagaaaggtgaccgtttcggtcatataccgagtgtgcctttttccgcttcgttggtagacctctggggaagcttagtgaccggggcgacaatagtttgcattccgaaggaaacagtactcgatcctctcgagctctctcgccagatcaaaagcctgaagctcaacgttatgcaaatcacgacatcattgcttaatatcactgcgtacgcttcaccaagtgctttttcttcccttgaaaccctgatcaccggtggcgaagcaatcaatgttcaaaccatcaggaccatattcgaggggggaccaccacggcgtatcatcaatggctacgggcccacagagtgcagtgtatacacactctggcaccccgtctcgcgggaggaggcacagcggggcgagatacccgtaggcaagcctttttgcaacgtacagacctgccttgtggatgaaaacctaatacccgtcaaggccggcgttatcggtgagctcctcatagcgggtgcaggcgtcgctggcggatacattggagagcctgaaaagaccgccaaaagcttcgtctcccttcctcatcttccgctccacagcaaccgcggaccaggacatatttaccgcacaggcgacctgatgcgtatggatgaagatggtgtctattactatatcggtcgaaaggacagccagataaagatccgagggcaaagagtcgagattgaggctctggaatccaatcttgtccagttaaaagccgtcagtgctgcagcagtgattaagatcacaccaaaaggggcggggagaaatccatttctggttgcattctgtgtcccaatatctccttgcatcaccgccgccgccataaccaaagaatatgtggaaggtaaaaccattaaattggtccttcgcattgaagttgtggtttcgttgccgctcaagaccaatggcaaaacagaccgcaaggagttggagcatcgatatcttgcgaaaattacagattcgtgcatgacaagccgatatgcaggcaaggatatcggcaatgtggaagccaagctgaaggcgctctgtgttgacattttgagtctccccaccgaggacatcgatccaaccgatgacttcatggccatgggaaccaattcattgatggttgcaattttgctcgctagaattaaccgtacatttggagtctcgctgggcgcgtcgaagatttacgaaaacccgaccctaagaagccttaccaacctattggaaactactcagggccacagtacggagcttaccaacgaagccgaacaggagctatggttgcaggacacgcaactggggcagcacttgaggcctctgcctggcaccgttgtcgactgggaagacgtttctgagggacgtgttttcctcacaggagctactggcttcgttggtgcgttctttctcgcagaattgttgcgaatgccgacggtgaagaaggtcgcttgtttgatccgcgccaaaaaccaanccgctgggcggttgcgccttgagaacgttcttcgtaaataccagatctactcagacctcgacaaagttgtagtcctgccaggcagtttcagtgaagcaaacctcggattaaatcgcaaggactacgattactatgctgagtgggccancgtagtctttcatcttggagctaaagtgagctatgttgctccctattcgtcccatagaatggacaatgtcgttggcacatgcaacattctcgaatttgccagcccaaagccgtccaaaggccactcattacacctccaccatccccggtatatgggcctaccgggctcttga

SEQ ID NO: 10080 - DNA, 1401 bp, A.fumigatus
aaacccgcaggtgtcaatacaggatttggtggaagcgctgactctcggactgatcgagtcgttgcactgcagtctgggctgctccaactcctccaggcaggcgttctagttagatcagacaagggcttacagtgtcagcagcagcagtcgcttgaatcgcacgctatgcctgcctcgtgggtgcgaggcacaatgctggttcgatgcaattcaaacgctcgcggccattctgccgtctcattgcctgtgatcgagtcattgctgcggctgatcgagaatcatatcacgcctgttgtacctctgagaggctccatctcggcttcaggtgacctgatgccgctttcctacatcgcgggagccatcgaaggtagcccggatgtatatgtgcaagttcaggatgcagataaaacccgcatcatgaactcgcgcgatgctttgctgtccacgggcctcgaggcgcagacactaggaccaaaggagggcctcggcctcgtcaatggtacttctgcctctgctgcactggccagtctggtcatgtatgaagcgcatcaactggctgtcctagtccaggcactatcagctgtgaccgtggaagccctcatgggcaacgcagaaagcttccatccgttcatctccgccatccgcccgcacgatgggcaaattgaatgcgcgagaaatgtcttgtccttcctgcagggctcgcagctcgcacagaacgtggagcgggatctgaaagaccgcaaccgtccaggcctgatacaggatcgctacgcacttcgcaccgtgccacagtggataggcccgcagcttgaggatctccttctcgcacaccaccaagtcaccgtcgagctcaattcctcctgtgacaaccccctagtggacatgcagtccggcgacatcttttacggcggcaacttccaagctgtctccatcacctccgccatggaaaagacccggacttgtcttcagatgttcggtcggctgctcttcgcccaggccaccgagctcatcgacccaaacctcaacaacggactgcccaccaacctcgtcgctgacgaccccagcctctccttcaccatgaaaggcgtcgacatcagcatggcctcctacatggcggaactagcctacctcgccaacccagtcagctcccacgtccagacagccgagatgcacaaccagtccgtgaactccatggccttcgtgtcgagccggtacacaatgcaagcggtggaaatcgtctccctcatgtgcgcctgcagcgtctacatcggctgccaggcactagacctgcgggtccccaactccacctcctggacggcccaaaggaagaatttccagcggttcactccccacatgttcctcagaaaaccccccgaaaccgaactccgcaatcctcaatga

SEQ ID NO: 10081 - DNA, 204 bp, A.fumigatus
ctagtaatactcctcattcattccggtcttaatcgcaaaataagaaaattttggcgtcccttctgcccctataactcaattaatttagattcggaagaaggttgtgaaggctctgtctctgtaggccgccatgtcgtgccttacggccaccatacctatgataaaaaagaagttaagtacggaatatccaattacctactttag

SEQ ID NO: 10082 - DNA, 1806 bp, A.fumigatus
  unsure (3),(9),(10): Identity of nucleotide sequences at the above locations are unknown.
gcncatgannaaggtctagctctccggaataacctgaccggttatgttcccttgactgcggtttccaagaagttggacgagaagatcgagaaaattcttaacgataatgacaatgaggatagcgacgcggaggaggaggacggcgacgatgattccttggatctgaccgactacttttatcttggccaatatctgcgtgcatccgttgtttctgttgggagcaacgccgcagatgctccttcgaagaacaagaagcgtattgaactttcagttgacccgagacaggcaaacgccgggctctcaaaatcggatctggaggtcaatacagccattcaagcttcggttgtcagtgtggaagaccatggtctggtgatggacctgggtattgagggcgcggacgtcaagggctttatgtctaagaaggagatcgaccccaagacagactattcgagcatcaaagaaggatcggttttcctttgtatggtcaccggccaaaacgccaacggaagtgttgtcaaactatctgccaaccttcagtctgccggatctatcaaaaaatcacattatctcagcacggcgtcgacaatcaactcattccttcctggtactgcagcagaaatcttgttgacggaggtttcttctagcggattgatcggtaagatcatgggtatgctcgatgccacagtggacttggtacagtctggtggcaactctggaaaagacgacttgacaaagaagtttcagatgggtgcgaaaatcaagggacgtattgtctgcaccttcccagcttctgagccattcaaggtcggcttttcaatactcgaccatgttttgaagtttgcgactgagggtcatggtcctggcacctctgaggatgcgccggcaatctctgcaatcatacctgaaacaaaagttgtcatggttgatcccggaatgggtgtttatgtgcagatgggctctacgaagcacgtgggctttgttcatgtctcccgattagcagacggaaaagttgaacacattgcaccagaacacggtcccttccgaatcgattctgtccatgaggctagggttgtcggctacagtgcttttgatggcctctatctactctcctttgagaggaaagttattgagcagcccttcttacgtctggaggatgtgactgtgggtactgtggtcaaggggaagattgagaagctgttaattgggccggcgggggttgacggactgattgtgaccttggcggatggtatcaccggtcttgttccctctatgcacttcgcagacacggcccttcaattccctgagaagaagttccgggaaggcatgacgatcactgctcgaatcttgtcggtcaaccttcagaagcgccagattcgcctaactctgaagaagagtctactcaacagcgaatctgccatctggaaagattaccaagatatcgtcccaggctctcagtctccaggtactattgtaaacattcaaccacatggcgctgtcgttcaattctacggcccagttcgtggttttcttcctgtgtcggagatgagcgaagcttacatcaaggatccttcgcaacacttcagacaagggcaggtggttaacgttcacgctttaagtgtggatccagctcttggaaaactagcagtttcgtgcaaagacccctcgaccttcactgagacctatagaaaggcgttcgagaagattcagcccgggttgcgtgtcacagggacggtgtttgagaagtctgtcgatgatgttctgctcaagttggagtcttcaccacggggctggaaggatacgcggtaa

SEQ ID NO: 10083 - DNA, 1794 bp, A.fumigatus
cacaatgaattttccatacttgtgccgacaaaccacgcacccagcaacgaaatgtctgccgattccagctctcctctcgtcgtgaaggaacccaaagacggtgggatgccgacggaaggcgaaaagctgaggctggtcatcattggtggcgcccgggggggaatgtccgcggcggttcgagcacggcgactcaatgaaaacgcatcgatcattgttatcgagcgaggctcttatatcagctacaccaactgttttgcccccttcagcctgggtggggccattgaaagggatacgtggatcgcagtccaaacccccgcggggctcaaggctcgattcaacgtggacgtgcgcgtctgtaccgagctcgtcagcatctccagagagcgtcattcgattactgtgcgatgtcggaagaccgacaccacctatgacttgccgtacgataagatgatcctcgcacaaggcgcggatcccgctggtcgccctatggccgacatcgagaaagacaaggtgttcccgctgcagacccccgccgatctgcaggccatccgatcgttcgtggtgaagaatgattgtcgggaggtcgtcatcctcgggggcgccttcacgggcctgaaagccgtggagagtctgcatagtttcggcctccatgtccgcgtggtcgaggctggcgaccgcctctgtccggaattcgatccggattttgccacgatcattcagaaagagctcgtgaaaagaggagttgggattcatcttggacggggggaatgtcaaacgatcgccgagaccgaggacagcgatcgctgtcgcatagaattccacgatggctcaagcctctccgcggacctggtggtcgtggccacggaacccgagccacgagtgcagcacgccaagaacgcaggcctcacggtcaggaaagggattgtggtgaatgcgttcatgcagaccagcgatccggacatctatgccgtcggcagtgtcgcagaggtggtgaacagtatctcccatatgccgcaggtgtcgtcgtcgatgagcggagcctcgaatcgacagggccgactcgcagcggatcacatcttcactcgtgcgactgcgtatccgggaaccgctgggacccatgtataccacgtcttccacttgacagcggccattacggggctctccgtctccgagctccggcagattggatatgaccctcagtctgtgaccatccaccagccggaccatgcggggtatttcccgtcggcccagcagctgacgttgcgagtggcctttgaacgagcgagtggcgtcctgctgggtgcccagattatcggacattctggcgtggacggccgcatcgatgtgctcgctacggccatgcaggcggggatgactgtcttcgacttggagcatctcgagctctcctatatgccccagtatggctccgtgagggatcccgtcaatctggcgggctccgtgggcagtaacctgcttcgcggggaccttcatatcgtccatcctcaagacctacaaggccatctgcacgaatggccgatcatcgatgtgcggtccgccgagcattttgcccagggccatctaccgcttgcgcgaaatattcctattgactcgctgaggtcacggctggctgaaatcggaaaggatcggccggtcctggtctactccagggtaggctaccatggctatctggcctaccgaaacctagtgcagtcgggctatcgggccgcgaacctggatgggggcttgaagttgtttaccgatggtggatatcagccacaattaactgtggactag

SEQ ID NO: 10084 - DNA, 537 bp, A.fumigatus
tgcatagtagcttggcgcaaggtcttgaaagacctcatcatctttttcaaggaagtccagaagtcctacgaaacccggtctaagctctacctgtcggcgtcgaatgtagtgaataacgcctcgctccctccgacatttctcaaatctggtggcctcgccgacgcaaccgacattttgcgcgattttcaccgtcagggctacctagaagcgaataaggccgccgaggtggagagcgaagtcgttaaccagctcatgggccttcgcaacgacctgcaaaagaagaccaaagaaatcaagagccttcaaggtgatttccggaactccgtcgacaaagaagtagagaacacgcgcaagacggttcgccaactgcacgaagcgctaggtctggtcgataccgacccgtctgctacatcaggcaagggagacccgttcattattcgtctgagcgtcgacagacagattgagaaacagattgaggaggaaaattacctccaccgtgtgagtctttcggaagcttcctatagactcaatcactga

SEQ ID NO: 10085 - DNA, 252 bp, A.fumigatus
accatcgacactgccgttcgcctggtaaccgaactcgactaccctgattcctattcagatcgtgtgcttagatccgactccttttatgattattatatgatttcttttaccattccgttcgctcctcccgtgctccttattactgcgaactcccgttcaatttccaacgcttctggacaaaccgacaacgcattgattggagcgctcccttatctcactacaggaattgcactgcccgactatcctgggtag

SEQ ID NO: 10086 - DNA, 342 bp, A.fumigatus
gcattcttaaacctggaaaactccggtcgcgaacttgaatcgatcgtcgtcagtgagatacaaaaggcgtacaatgcgtatgccagtatccttaaacgagaagccgatgaggcctatgacaccgtcgagaagctgcggactgggcccatatctatgcctcatgaccacgaatggaaccacttcatcgccaataccgacgaactcgtcgatccccgcgtttctctccggaacgtggagaacatcacctatcctggcaaggaccatccggctgcggctgaagttcgatccggcatgctggagcgaaagagcaagtatctgaagagctatacacccggctggtaa

SEQ ID NO: 10087 - DNA, 399 bp, A.fumigatus
ttagatattaggtatgtcttgtcaccaactcatctacacgagttcaagtctgccgatcgggtagcatggcagacgccagtgatgtcactgtacctacccgagcagaaattaggatcgcactcgcagccggactcgacgtcgcacaagttcatgctcaaggggcgacaaaccggtcccatgcatcgtggtcactcgtgggttttccgcgcggaatcacacgagaccatgatggcgtggtacgaagacatcgaaagcttgatctcaaagacgggcgaagcacgttatgcatacgttagacgacacgtccgcactgtgaaccgcgcaagtgcttcgaccacattgatctggatgaagaccaagccgatcgcacaccgtatgcaacggaggccagtcgggtaa

SEQ ID NO: 10088 - DNA, 1065 bp, A.fumigatus
cagtcctcctgggaacttatcacaacccacctctcatcacaacaacttggggagcccttcaactcaatactgtggcggagggcagaaaaaatgtgcttgatagagaagtacacagacgtatatccaatggaaattcgaacgagaacagtgatccgcagatgcttgttcagcgacggaagggggacttgcgaccgtgctcgagtgtatgatcgcggcgaattctaccacgttagacagtcccagcagggaggtcccagaagaatgacttctccgaggatcaaaaccatcgtgcctaggaacctcagtgagacaagatgccaggaggaacatagacatccttcgccgacatggagattatcacaagctcgaagccggtcatattcgttccggataccgatttccagaaggtcttccgagacaagtgacagagagacgttgtgcgagcgccgcggccgtcagagatcaccccatcccattgttgttgattcccctgaggttgaggagcggacaccgcgcaacgatcggccagattcggtccgaattcgatgcatttcaccacaggcaggaagagctccgaccactaccgacagggagcaagcaaatgacgttgttgaaatacctcgtcaggctcgatcacaacaaccgtcacgagagcaacgacctcctcgggaacgtacacctgttactgaacgtgagccagtacaacgcagaccacgtcgaagtctgaattgtgtggttgacattcacaatgacgcggctgcatcgcaagacagacagcgccaaagtgcagaacctcggcaagttcgtttctccagcgacgtggaatatgaaatgaatgtaaacagcaccagggcgcgtaaccggtctgctgcattccatcaagaagaatctatcgacgcaagagcaccaactcaccggagcctattcacgcaacaaccgttctgcaagagacgccgacagcaggagcaacgggggcgagccatttccagagaaagcaatccatatccacgagttcactcttcccaatcccgaaagggtgaagacagccgcattcaggaggactaa

SEQ ID NO: 10089 - DNA, 213 bp, A.fumigatus
  unsure (123): Identity of nucleotide sequences at the above locations are unknown.
agagacatggagaattcaccactatgtcctgccagattcatttcatctgaggacggcacgagacgggagtttaaaaagtctaagcacgatgataagcgcaaggctattacgctatgcccactnttccatgaacttttctcggctcctatcacgctggtggagcacgtccaagttgagccgttcgatccccttttgaagtcgacccaattgtga

SEQ ID NO: 10090 - DNA, 261 bp, A.fumigatus
ggacacgatataggatatccaacctggcatcagaagatggccctccatcagttcgattacctcttcgcccttggcactatctttgcgttcctcgatgcatacaacatcggtgccaatgatgtcgccaactcctgggcgacatcggtgtcgtctcgctcgttgcagtactggcaggccatggttctggcctctatcatggaattcagtggaaggtatgtttgctccggtacaggtatagcatttccatttggaggatactga

SEQ ID NO: 10091 - DNA, 537 bp, A.fumigatus
ctattctgcaatagtattggtgtaggtgctcgtgtcgcagataccatccgaaccaagatcgtcgacgtcaaggccttcgaggagaaccctgccctgctgatgctgggcatggtctgcgctgtcacggcttcctccatctacctcaccgtcgctacccgccttggtatgccggtctcgaccactcactccatcatgggcggtgtgatcggtatgggcattgctgctctgggatccgatggcattcagtggtggggaggagacatcaactcgggtgtcgtccaggtcttccttgcctggatcattgcgcctgttctgtccggtgcctttggtgccattatcttccttctcaccaggtacggagtcatggagcgtaagaactcggttttgaaggctttcatctccatccctatctactttggcatcacctccgctttgctcaccagtatggtccccggccctagcacgatgcttgatgatactgactggcacagtgcttatcgtgtggaagggtggttccagcagaatcaagctcactga

SEQ ID NO: 10092 - DNA, 1179 bp, A.fumigatus
aggctttcatctccatccctatctactttggcatcacctccgctttgctcaccagtatggtccccggccctagcacgatgcttgatgatactgactggcacagtgcttatcgtgtggaagggtggttccagcagaatcaagctcactgattcggaaaccaccggtgtgatcatcggcgttggtgctgccgtcgcgctactcgttgccgtcttcttcctcccgtggctttaccggaggttgatcaaagaggattggcagctgaagtggtaccacctcttcatgggtcctcttgtgctgcgtcgcggcgaggtgccccctcctcccgagggctataagaccgtacaggattattacaagggccacaagaccctagaggagctggaacgcgaacgtgctaacatcgagagagccggaccttccgacgaggagagcgagcctgccgtggacaaggaaggcaaggaaggccaggctgctgctgcttctgtcgagatcgaagagcccaagtttaccctcatcgggcctcgtcctgacggagccgccttcagccccgccgtgctcttctggcagttccgtcgcttcttcttccgcggaattgagcaggatgttgtcagtctgcagaagaagaggaacattctcactggggacttggagatggtccatgcccatgcgcgccattacgacaacaaggccgaatacatgtactccttcctccaggtcatgactgcttctactgcatctttcacgcacggtgccaacgatgtctccaagtatgtatcctcgcgactttgcgtgttgaagcctgctgaccgatttatccagcgctgttggtccttatgccaccatctactatgtttggtcaaccaaccagctcaagtccaagagtcccgttccgtactggatcctgtgagtagccattttgacattcatagacacattctaatcaatcttagggctttcggaggtgccgccatcgtgatcggtctgtggacctacggctacaacatcatgcgcaacctgggtaacagaatcactctgcactctccatcccgcggtttctccatggagctgggctcagccattaccgtcatcatggctaccaagctgagtatgctacatcctttatgcttcactgatcataatcgtgtcttcaccacggggctggaaggagccgctctaata

SEQ ID NO: 10093 - DNA, 348 bp, A.fumigatus
aggactttagccggaccccgcgcgtgcaataagaaagatcctgttacccatcatcactttggcttctgctatacatctcttgccttctctgaagtactgattcatagcgtcatgtcgccaattaatcccatcataccgggtttcgcaccggatccgtctgtcgtcaaagtaggcgaatggttctttctcatcaactccagcttccatctatttccaggtctgcctatctacgcttctcaggacctggtttcatggcgacatataggttcgcgttctagcagggatgaaatcaccagtgcaaaactaatgcaacaccaggaaacgcaattaatcgccaatctcagctga

SEQ ID NO: 10094 - DNA, 1419 bp, A.fumigatus
aatcaccagtgcaaaactaatgcaacaccaggaaacgcaattaatcgccaatctcagctgagtctgtccagatcgaaaacagaacttcacccgttgcccacgggtgaagttctggtggccactggaggcttatatgcgcccacaatccgataccatgacggcactttttatgtcgtatgcaccaatgtggttcgtacagtcaccggcgactccacccagaactttatcatctcatccaaggatatctgggccgacagctggagcgatccggtctatttcgagttcgatggcatcgacccgagcctcttctttgatgacgacggcaagacttacattcagggatccgcggcacctgggcctttcaccacgataaatatgttcgaaatcgatctcggctccggcagaaagctctcagaggagagaacgatatggcgcgggactggcggtatatatcccgagggtccacacttgtacaagcagaaaggctattactatgtggtcattgcagagggtggcacccatgaagggcatatggtgacaatggcgcgatcaacggacatctggggtccatatgaagggtgtcctgacaatcccgtactcactgcgcgagacaccgacgagtacatccagtacaccgggcactgcgatgttttccaggacgacagggaccaatggtggtgtacctgccttggcgtgcggaaggataaaaatggccgctatgttatgggtcgagagacttttctgacccaagggagatgggatggagattggctctccctggaccaggtcaaaccaatgcctagtggtcttctaagccgcggtgaagggaagaaacttgttgccaatcccagcgtcgactacgtctatatacgtgatgccattctgagcaattacaccctacccagcagtgccagtgacggtctgactctgactgcttcaagcgctgatctgtcgcatcccgaaaaaagccctagtttcattggcaagaggcagcgccacttagacggatgcagcggtgtcgagctggacattgtggaggcgacttggatggccacaaagctgcgggctggaatggcctgctacaaggacgaacatcgcttcctccgaatctactatgacgctacagagcttgctattgttactgagacaatcaacaagccaaagggaatttgtcgacaggagcggctgacactcgagagtctacccaagtcaatagcgtttcgcatccaatatacggaacaggagtatcggttatttcatactgttggaaatgccggtcaggcgaattggaagtgtgtatcgacgattgacaccctaaatctgactggccccgattttacaggcccagtcattggcgtctttgcggtggcagagtcaacagatactgaagtgcgttttagaaacctcactatttgctaa

SEQ ID NO: 10095 - DNA, 336 bp, A.fumigatus
gtagtgaccgctgctccctcctccagatcgtgtacggcgttgttgacgacctgtcaaccgggcctttgtattcccatacaagtaccttataattcaatcttgcaactatctgtttcaatggagagcgtgcgccaatcatgtcggcctaaacaccaggtcttggtcctcaaatgttacccacaataccagaaaggagtccaggatgtgaaaccaaattccagtgaactctcttatctactctactatgtgagcacgcgccggagcaagctgaccaaggtcggcgcctttttggagaaaagggcagctcgggatgtctggcgtaacaagttagggtga

SEQ ID NO: 10096 - DNA, 1335 bp, A.fumigatus
  unsure (1330),(1331): Identity of nucleotide sequences at the above locations are unknown.
gttccaagcgagcctgctcgcagtcatcaaccatcgcggtggcaatctcccctgacttatttgggtattttacacaggaatgtacaggtaacacttcaaatcctcacggccctcatcgagaaagttccccgcgatcttcctatctatgctagatcggtgatgaacgtccttgaaaccgtcctacgctccggagatctttccatggttgaagagtcgatatcaacgttcgagacattctgtcagcatcaggatatggccgcgctatctgctgaacaggatttcgccagtcaataccgggaagtcgtgcggacttatgcagatttcgcagaccagacaaaatccgtttctcagctgaagactgcaccgagcagtccaatggtaatacgttggaggacagcgggattgcgagcgatcaagggtgtggttagttccgaagcaggtctcgcggcggacggcggagattcactgaggatccttctcccggtcatcctggaatgtctttacaatggtgacgatagcttgttggcgtccctcgagctcagattgcacgagtcggagaagaatgagccggcgcttggtcgacgacggaggatcagtactgccaccgtgcagacagttgacgcgatggatggagatcccgcattggcgtcacagtctgcggccgacgttgacaggcaggcggaaatggacatgcgcttgcttgctctccgatgcttggaacgcatagtcgtgacgggaagtagccgtggtcagattcgcgtcactacgaaagtggtgctgcaattcattctgggcaacagcccattatccgaagatggcaaacctatgcatatggattcgacgggtggctgggctacgtctctagtggaactcgtcgccaagtggtgtcccgttcaagtccgtttcatcattttggtttctgcaatggagatgttgctcgagaaccagccctcagaagagaccctgcaacgctcgcatgccctgatatacttgatcgactggttgctcaaatcccctgtaaacatgatcggtcttagtgttattgacatactgctgggcctgatgcaattcatgtcgaccctgttatcgcgcccagccagcgcgaggtctgcggaacaaggactggatgagaagctgggcgatcacgacttggttctgtcccctgagagattgaagatgcttgcgctactccagaggactattggagatctcactacacatatttattacggtgatcaggttgtcgatatggtcaggacgatcctgactcgtgtgaagccatcgtcttcaccacgggggtggaaggtaccaaagcggctggctcaagggnncttc

SEQ ID NO: 10097 - DNA, 546 bp, A.fumigatus
gatttgtggaccttccagcccgccgtggtgaagacgaattattgggccatcaaggccttgaacgcgtctcgctcggcttggatgtctgcctggagttttcgagtctggcggagtgcttcgtcgctgcaaacagttagctatctcgtattcacaccggttatagaaacacgtaccggtcagattgtagttcggccacctcgatttgggcccggttcatccgaccgaccacctcctccatctccgtatctgcatctcgcaggagcttctccagctccttcacccgcttctcgagtgtctgcctctggatcgcctcgtccagcgggatccccttgccactggtcgtcttgtccaggcggggcgagcgcgcgccaaatggtgagctgggcggctttggcgacaacgccgccgggctgcgagagccgttcttcacacgcatcagctgcgcgttgtggctggcctcgaggttgcggatctcctcctcgtgtcgcgccatttcctcctcggaatgctgctgcgccagcagcagcgcctcttccatttccttga

SEQ ID NO: 10098 - DNA, 849 bp, A.fumigatus
ggacgccaaacgatggcattccgtctatcatccagccgcccaccgcctttgcacatcgagtccaacggtcgaaccgcatcggccagctcctcggactcgaaacatcccaagacccctgggaacaaaatcagctcctttttcggctggaaagccgtcaccacatcgcccagcgcggagtcctcgagcaccgagatctcggattcgggccggtcccctctcccatctccgatgcctccttcaatgcccaccacctccttctccatcaccccctcgaccacagtcccatttgatcccactcgggtcccggcccgcaacccctccctaagcggcgccagtatcctcgaggccgcgtctgcctcgaagctcgcggatctcgaaaatgaacttcgcgagatcagctccgagctggccggttccatccggcgggagatggaattggaagacttggtcgagcggttgcaatccgagataccgcaagacgccaaccggcgcaccagcgactatttctccgactccggaactagctcgatacgatatatatacgatgccagcggaaaaattgatgacttggacaagtatcggcgagcagccgagcaggaacgtgcacagctcaaggttgagctgtcgcagaagtggcaggaagagagagcccgtcgggccgcaaccgagtctcatgttcagatactcgagtcacaagtaaaccaagtatggttcccccccctggttctgtcggctttggctcagctaatgtggtcagttacgacgagagagagtcgagtcctccgacctatcatccaaggctcgggagctcgagattgctctggaagatacccgcagaaaactggctga

SEQ ID NO: 10099 - DNA, 336 bp, A.fumigatus
ccccgggctgaggacgccaaacgatggcattccgtctatcatccagccgcccaccgcctttgcacatcgagtccaacggtcgaaccgcatcggccagctcctcggactcgaaacatcccaagacccctgggaacaaaatcagctcctttttcggctggaaagccgtcaccacatcgcccagcgcggagtcctcgagcaccgagatctcggattcgggccggtcccctctcccatctccgatgcctccttcaatgcccaccacctccttctccatcaccccctcgaccacagtcccatttgatcccactcgggtcccggcccgcaacccctccctaa

SEQ ID NO: 10100 - DNA, 1572 bp, A.fumigatus
tgtggtcagttacgacgagagagagtcgagtcctccgacctatcatccaaggctcgggagctcgagattgctctggaagatacccgcagaaaactggctgaggaacgtcagatcaaggacaactttgaagatctcttgacggcgatgcgagtggagctggagcagttgcgaaacgagcgcgatcatctgcgggataatgtgattcctcaattacaacagcaacagcaacagccgccgcagagcacacccgcccccgagtcctcggagattcagcgattactcggcgagattgaggctctgaaaatcgagaatgcctcgctggcgcaactgcaaggcagtcgattcgcgtcgatcgccgaggaaggtggtctgccccaacggagacccgcgggactgggtctgtcccggtcaaattcgctggcacggcactcgaaatcgagcggtgtaggtgggctgtcgcggtccaactcgttgtctcggtcaaattccgtgtcgaccaaggatcgcccggatcgcgagacgttggcggaccgtatggaagatgtggaagcgcagcgggatgcgctgcaccaagccctgcggtatctacttatgagacaagaacagcaggctcgagagtacgaaaagcgcctgaagctcatggagttggagctggctcgtgcccaggaactgggctcgccacgtcgattggggtacgaacgcgaggtgcggaatctccgggaggaggtgaatcatctccgccagcgggcagaggatgccttggaacagaagtggcaatgcgaaaagggactggcagggttgaagatggatttggaccgtgccgagcaggagaccacttcgctgcgcgttctgctgcaggagcatgatatcgcgttcccggagggaactgaatccgaacgtgacggctttgccgaggtcatcgcgacctcttcgtatctggagatggcatacaagcagttgcaggcggaacgggaagtcgtcgaagccagtgctgctcactctccgctggtggagagtgaggcctttgcggcgtccatcagtcgcacagaagcactggcgaatcatgtgcagcaacagctgcagaggaacaactccctgcgcaaccgcctggccaaggcgattggcaagggtgagaaggatcagcagctgtcggcggcccggatcaacgagctgcaggccagactcaaggaaatggaagaggcgctgctgctggcgcagcagcattccgaggaggaaatggcgcgacacgaggaggagatccgcaacctcgaggccagccacaacgcgcagctgatgcgtgtgaagaacggctctcgcagcccggcggcgttgtcgccaaagccgcccagctcaccatttggcgcgcgctcgccccgcctggacaagacgaccagtggcaaggggatcccgctggacgaggcgatccagaggcagacactcgagaagcgggtgaaggagctggagaagctcctgcgagatgcagatacggagatggaggaggtggtcggtcggatgaaccgggcccaaatcgaggtggccgaactacaatctgaccggtacgtgtttctataa

SEQ ID NO: 10101 - DNA, 579 bp, A.fumigatus
ttgaacgccatggaactctggacctggatcctattccaagcccatcaaatgccgatccatacaactggcctctctggaaggtatcaatgcctttgcccctatctttccgtcgttcaaaaaatgactgacctctgtctcctttttcagaaagtgctcaatctagtcctcgtggcattccatgcttgcatggcaaccctgacagcggcatccattacgccagcatacgaagacatcgccatcgaatttggaaagtcggtacagagcgccagctatctcacgtctctccagattgcaattctgggtggagctcctttgttctggaagccattgtcaaaccggtttggacgtcggcccatctttctcctgtctttgattatcagcttgatctgcaatgtcggctgtgccaagagccctacatatggatccatggctgcgtgccgagccttggtagccttcttcatatcacccgctgcagcgattggaagtgctgttgtgacggaaaccttcttcaagaaagagagagccaagtacatgggcgtcttcaccacggggatgggaggatcaatgggtgtgtctatt

SEQ ID NO: 10102 - DNA, 1269 bp, A.fumigatus
agaaatccaagcgaagcgctttcgtcttcgttcgatccctcgttttccgtttcgcttctcggcaacgtgtcgagagagataggttcggcgttggccgacggcctgaacaggctggatctgagtcaactgtctgaatcgtcagcctcctcgtcatccgagtccgcctcgttcgatatgtcgtcttcggaaggggcgcccgagtcatggatctcctccttctgctcgctgatgggccatgaattcttcgcagaggtgtcggaggactttatcgaggatgacttcaatcttacgggtctgcagtcgcaggtgcccatgtacaaggaggcgctcgagatgattctggatgtggaaccggaggaggacgaagatgaggaggaggaagaagaggaagaggaggaggatgatgacgagattctcggtgatgagcgacccccgggctaccgcagagctggcgaccggagacatgcgcgggtggccagcgacttgagtgtgatcgaaagttctgcggagctgctctacggcctcatccaccagcgctacatcacgtcgcgaccgggaatccagcagatgctggagaagtacgaaatgcagcactttggtgtctgtccgcgcacgtactgcaatggaagcaaggtcttgcccgtgggctgctccgacacgcctgggcaagagacggtgaagctgttttgtcccagttgccaggatctgtacactccgcccaacagtcgttttcactcggtcgatggggccttcttcgggaccacgttcggataccttttcttcatgacttttcccgacctggacattgggccccgcctggatccctccatgttaaccgctgcccctacgaatgcaaacaatcaatctcgatcttcgtctctgacgtctggggtcaaccgcgcgactcctgatctgccgccgccgccgcctaaccagccaacagagatcaacggcgtgcgaacgtccaacttctgccccggcctgggaccaggtaggatttacgagtcgaagatttacggatttcgcgtttcggagcgatccagagttggtccgcgcatgaagtggctgcggatgaagccggcggatatccgggagttggacgaattggctcagtacgaggccatccacggttcagcgaacgatggcggcgataccgagatgaacattgaagctcagaatgcagccgcaatcgcagccaggaagaaagcgcccatgcggagacggcggcatcatcccgatcagatgagcatcaacggggcggaaggttga

SEQ ID NO: 10103 - DNA, 1503 bp, A.fumigatus
  unsure (1473): Identity of nucleotide sequences at the above locations are unknown.
ttcgaagcaagcgcagcttcaaaaacccccagaaccagaatgcctcgttctgttcctccaaatatatcgcccttgcctcaaaaggacgactcgagtctttcggcaagcgaatatccaaacatcgcttcccgcaccgctcctccgtctccatcggccgtcaggcgtacacattcccttctgtccgaaactcataccgggtatcagtctttggaatcccagatggaagccggtgaaaccacaagtttgttagggaagacccgtgaaaatcatcggggtacaccacgaagatcgtacaccagcatctccgctattccgacccctgataattatctcagacactccttgacgagtggtagcctacgccggtcccgacatcacagtcgtgcaaattcgcaatccctgagatttagccgcagaagcagtattgacgacgagcaagatgaagaccttccaccatcggccaaagatggaatgaccgcgtcatttcttgacgagcgtaactggtacgaccagttcacctcgactgactgggtgcatgacagtattgctgacggagcgcgtctgcgggaactgcgcaagcggaaggattttcgcggtcgcctgctcgcggcgttcgatggtgcccagggctggattctggttgcgttgatcggctgcatcaccgctgccatcgcctattttgtggacgtgaccgaggatttcgtcttcgatctgaaagaaggattttgtacgacacgatggttccataaccgtgaaagctgctgtgcagacaccctggactgctctcgttggcggtcatggtcgcagattctcagtccgtccggttctgacaacggatgggtcgaccattccatgtttgtgctctgggtggttattctttcagttatctcatgctacctgacgctgttcaccaagactgtcgtgccatcgtcggtctcgctcacgacgctagatgagaacctcggtgctgggacttcccgaggaacgaaccatgatgcctccgaggacaattctccagcatcactaattaacccgaaggcgcattatccaactatctctacgcgccccgccatgacttactattccgcagcgggcagcggagtggccgaggtgaaagtcatcaacagcggtttcgtccttcacggctatcttgggttcaagaccttggtcatcaagactattgcgctagttttcagcgtctcgtccggcctgagtcttggtaaggagggtccgtatgtgcatattggcgcctgtgtcggaaacattgcatgtcggttgttctccaagtacaacgataacgacggcaaaagacgagaggtgctcagcgccagcgctgcaagtggtgtcgccgtcgcctttggtgccccaatcggtggagttctgttcagtttggaaaaaattagttattatttcccgccaaagacattgttcaggacgttcttttgctgcattgcagcagctctttctttgaanattcctcaacccctacggcactaccaaaga

SEQ ID NO: 10104 - DNA, 2250 bp, A.fumigatus
tttctttcaccccctgctgcattgggctgttatgattttctaagtgtattattaactaaaatacctttttctttctttctcagtcttcttataaatcgtcgcagtcgtcttgctttgcataacatgtcagcccacactgcgaaaagaaggaaactaagcccgcgtccagaaaatggatctactcagaagttcagctcagacggccgggatgcagaactgtcgaagagtatccgttcaaacagaaaggtgcaggacgaccgcgccggagaacttgcactagccagtggactctacaagtctagcttcttcaaactgcaactggatgaactgctgtcgtcgtcgaagcccaattacgacaaacaggtctcaagagttcaggacactttacacagagtaaaggaggccatcgaacaactccacgagagacctccgatgctaccttgtgaggcggagagggagttgcgcaccacacatggcattgtcgtcccgttcccagaccctcgaccctcgagggagacaaaatactccgtatcttatgttccaccaacgaacatcaatgtggtagggagtttcgcctcgaaaactggtattaagcagacagaaaagtacacaatcgatttagcagtgacaatgcctcgttctcttttccaagagaaagattatgtcaattaccgcttctttcataagcgagcgtactacattgcatgccttgctgctggccttcgggaagcgcaagacctagggctggatgtcaaattcgctacacaggaaggcgatagtcttcgtccagtcctcatcttggaaccgagcagtgctaccagcgctttagcactcgcaaggtcccaaattcgcgtcattacagccatcgaagatgatttgtttcccatctctcgaacgctgccaacgaagaataatgtgcgtcatgtctcaagcgaaaacactgggaacagtgagcctacgcccttttacaattcggctctccgctcagaggccactgtcgggtcttatcacaaacatttacattcgaccattcggcaatgcgatgcttaccaagacgcttgtcttttaggccgaatctggctccggcaacggggttttgcctcatcgtttcacatgggcggcttcgggggctttgagtgggcgttactcatgtctcttttgttggagggtggcggcgctaatgggaaaccggtccttctcaaatcgtatagttgctatcagctgtttaaagcaactatccaatttctcgccggccgtgacttcaccaagccattactattttccactgtcgatgaagtttctgttccaggggatgggcctgttgtatacgacgggaaacggggaatcaatatactctacaagatgactccttggtcttatgctttccttcgtcacgaagcgggcatgaccctcaaaatgttgaacgagtcccgcgatgacaactttgaaaaagtcttcattgtgaaagtcaatgaacccatgttgaggttcgatcggatcattgtactcccttcttttgacaacagaaacattcttcaggccattcgcaatcagcgggctatctatggtgtccttttgagagcccttggagatcgagtaaaacttattcatatctccagccgctccatcgaaccgtggtctgtcctagcgagtccatcctcgaagaagctaaaggaaagaatatcagttggactgcttatgaacccagaaaatgtttcgcgtgttgtcgaccatggtccttccgcggagcaaaaggaagaagcagcatctttccggtcgttttggggagagaaagctgaactccggcgcttcaaagatggcagtattctggagagtcttgtgtggtccgatcatccatcctcgaaatcgatagtctttcagatattgtcttatattctgcggcgccatttcaattttgttgacgaagacattcattatattggtgatgaattcgaggagagacttaacagctacggaagtggtataatctcatatactagcccatctttccagctgatcgcggatgccttcagctcgttggaaaagtctattcaagacatggaaggcgttccattgacagtgaggcacctagcacctgctagcccgcttttgcgatatgctgccctccgggttcaacatccttctagcatatcaggcgaacgtgtcgatgtggtgctccagttcgagagctcggcgcgttggccagacgatcttgtgggttttcacagcgccggccgcaggtcaatgtac

SEQ ID NO: 10105 - DNA, 822 bp, A.fumigatus
  unsure (716): Identity of nucleotide sequences at the above locations are unknown.
gtgatggcacaagatcacactcctgacgctgtcccggtcaatgaaaaagaccctccgaatcagcagctcgatgataccacaagtgatcgctttgttcctctggcaggctttccccgcgatgaggagtccggtgtgaacaatggggttgatcctcggtcgaagtcgctttcgagaaccgccaccaataccagtcatatcggaacattggctgcccggaccttgtcgcttgtgcggaccagagaatctgggaaggatatcggtcctcctcccgatggaggcctctttgcttggacccaggtcctcctggcccacttcgtcatctttaacacgtggggctatatcaacgggttcggtgtcttccagacatactatacggagcacttgggccggcctccctccgacatctcctgggtcggcagcatccagattttcctgctcttcttcattggaacactgtcaggccgtgcgacggatgccggcttcttcaaagttactttggccacgggagcgctgctggaagtcttttgcatcttcatgacctctctgtgcaccgagtactggcagctgttcctcactcagggagtcggtcagggcatcggttgcggcctcatgttctgcccgaccgtagccctgatggccacctattttaccacgaaacgggctcttgccatcgggatcgtggcctgtggatcggcgacgggagggttggtttttcnccgcggtcgtcgtgcgcctgctgccacaagttggatacgcctggacaatgcgcgtgctgggcttcatcaccctggccacgctcctcccccccggtggtttttctaa

SEQ ID NO: 10106 - DNA, 639 bp, A.fumigatus
aacaacggttgccgccccggaagagcggcccgatggtggaatgggccgccttcaaggagctgccgtacctgttttttgccatcgggatgttcctcaatttctgggggctctacgtcggcttcttctacatcggtagctttagcccgcaacatcatcggggtctccgagaccacctcggtgtatatcctgctggttatgaacggcatcggcatcctgggccggttgatgcccaataccatggctgactggtacaccggtccgttgaacatgctaatccccttcagcttggtcaccggcctagtatccttctgctgggccggagttgacgagattcatgggttatacgcatggagcgccttttatggtctagccgccgcgggcatccagtcgttattcccggccaccctgacctccctgaccaccgacttgaagaaagccggagtgagaatgggcatggtgctcagcgtggtcgcggtcgcagcgctgatcgggtctccgatcgcgggagccctggtccagacggccggtggacaatatctctacgctcagatgttcatgggcagtgcgattctagccggtacactaactttgatcgctgcaagagtagcgaaactgggattcacatggcatcggatgtag

SEQ ID NO: 10107 - DNA, 222 bp, A.fumigatus
cccaccgtatacctttctcaagaagatgtgagcgtcccatcgctggttttgtccctctctagctctacccctccatacgacacgaccctctcccgtctacagcagcttcaagacagcgtgttttatttgctaatcggcggtgttaattcattcagttctttgcagccattgcattcgtggagtttttacgcaatctgcgctacttcctgcatctctacttaa

SEQ ID NO: 10108 - DNA, 582 bp, A.fumigatus
cgagcgcgataccttccagcccgggtcgtgaagataccggcgagctcaccgttgcgatcgaaatcacaagattggacaacctggctcaatgtctgggcaatagctattgcttctgatattcgtgttggtgccgtcgccatgctaacagcaatgacagcgccattggccatggcctttctactgtatcacacctacctcatctgggctggcatgacaacaaacgagagcgcaaaatggtcagactggaaagaagatgttgcagatggcctggtattcaagtccaccagaagcgagatttatgggaatcaatcccactctgatgaggacactccggctcaaagaacctggccagtgagcagtgatcagatcctagtaatcacggacggcgagccccccaaggagggcttccagctctgctcacggtcgaatgaaattcttcagaaggatgatccgcaggcgccagttgacacaagatggactgaagtgaacagtatgcgggagattgacaatatatatgacttgggattttgggacaatctacgggaagttttccatatgcctattagacgctgcgtacggtga

SEQ ID NO: 10109 - DNA, 2082 bp, A.fumigatus
ttgatgataaacgcttggagcatatgctatctgctgggaaacagatcctttacaaaacacatcaggagagcgacgtcaggtatgctttatttggtaatctcggactgcgaaacgttgtctgactgcttcacttacaacagacacaatctgggcttatcgccagacatttggcaaggctttacggatgtactgacgaaagcgataccggttctggaatcacaatcatttgcttggaagagccctccgtccgctaactacgaacactcttcctcaaatttgattgcatacaactacttctccctcgtcaaagacatcgagcgcttaaacgacctgtgcactatagctcggaaccttctcgccacaacgaagaaagcgcagaatattgcggcggagaaaggttttgatcaaaggattttggcactggtagatacttgcgtgagagtcacagcgcgggggtttgacggagagacaaatgcgagaaacgaggagcgctggcagaaagtggtcaatctatataagcgattattgatcacatgtcttcaattcctgcacaattttattatgcataatgagcagcggaaaatggtcttgtggttagatctgtttggctaccattcgactggcgactctaatatcattcaacctagagagccgcttgatcaggctaacgctcaggctgagggggtggcaccagtcgtcaagattggtgagaggattgtcaatcccccgatcagggctctatacgatcagaccgcagaagatttgttactggaaaccatctcgaatttcccacgggagccagcgacaatcaaagaagaagcagccatgctactccttgccaacattaaagaccacatggagaaacttcttggacgagatctcacggccattcaagaaatgggcaaggacccggagcaggtgaaggagattcgagccgccttgacagctattcttggagccaaggtggatggatggtcagatctccaggatagagccagagatcttccacctgcactccccgaagacgaaccgccgaggaaaaaggcaatcctgacaatagaccgcagccaaaccgccggttttcctcgtatatgttgggctgacttacccgacctcaacgaatacggcgcactggcagcaggggatgcaccaataacggaggaagacacaagcatgccccgatctgctcaatctgcggctgagaccttgcaagaagccaaggatgagttgatggctcgactgcaggaatcctcccagattgctgatcatggcgaccaagattatgatgctggcgacgctgggacaattggcgacgacgattcgcacagcctggaagccgttgctgacggaagcatggaagaagaggaggaagaggacgacgaggacgatgaagactaccgaggtcgacctggcgatcagcagcgtggcctgctgaccgacatccctcttgttctagggcccgcggaaattgaagctcttcccatgatcattcaggccggtattgtggacagcttcggactcaagggtggcgagcgcacaggttcgagaaacatgcaagctctcagatgccacatccttctcacccaggaaactggtcgaaatctgttacgggaattattgatcttcatcgccgcctgggatctccctgatgatgagctatatttcaagatgatggtacagattatggatgcagttctgaagaacgggctgatgtctcacgcctactctgacttcgggcagccaaaggacatcatctctcccgctcaggccgtcgtggtcaagatcttgacgcacattttcagagcaaaatactcacctgcctcggttacaggcgcagcccagcagagcgccacgaagaacccggcgcctctttccagggttgatatcctcacggtccgctacatatttactatcttccgtggaaacatcatccccgaaacctgcgccttaatctaccttcaaggacagatcagggccggacgtgcgctacctgaagatttcccactgaatctgtgggacatggaacgagatctacgaaggtgtttaccagtttttggagtagctctgctctggttacagtaa

SEQ ID NO: 10110 - DNA, 345 bp, A.fumigatus
cacgcagacagcccaatccatccgaaaagctttgtctgcaactgcaaaatggccgcggacgaagtaaatggagcgcctgttctggagggacatgacaccaaggcgttcccgaaatccgtcgcagcagaggcgtctacatcttcattgtcaagtgatgagccccgacgatacaaaaatgcagattccgcatttgatacctctgaagacccgcggtattacaagccaattccgacctatgaaggtatccaccgctgggatcccgatttcgagtggaccgaagaagaggagaagagattgataagaaaggtactccaaactcagtttagtctttacaaacagtactga

SEQ ID NO: 10111 - DNA, 246 bp, A.fumigatus
cttgttctaagcagagtgcaatcgtgtcaagaatacctcaaaatggccccttcactggttgaaaacgttgctcttcgcactgccccggtcaccaagctcaagaccgacgcaggattcaacaaggagaatgtgctcggctatggcgaggcctatagccatgaaaacgaggtgaaaggcacagagaagcagcctcctgcttcgttccctcactatcttcccgtgtgggacaacgaaacggagaggtaa

SEQ ID NO: 10112 - DNA, 192 bp, A.fumigatus
gcgtgctctttgacctccttctcattggaaattcacaacaataattatcatcctgtggagagcgataatggcaatattagaaaacgatccatgctggtggaatatcttctgtctgcgagttacaaagattggctattcctgtttaatctccatgttagctccaaactttcccggctgcaaagcatcctatga

SEQ ID NO: 10113 - DNA, 234 bp, A.fumigatus
cacacgagtatgcatactgatgagctggaaggaaatggaaagggcgatgtcattctcttcgagccttctacttcagagcatgtctcgacaaggaccatctttgaccccattacggctttggcaccggcctctgactgccgaacatatgccatcgggtacgtaaataatcttcattggaataaggaagatggaaaggacgacggggtcatgggaatgtacattgttgtcgattga

SEQ ID NO: 10114 - DNA, 1125 bp, A.fumigatus
acggctgtggtgctctctgcggtggaagatacacttcgcgaccaaaaggcagatttttccgcgaccgcttatttcgcagcgcttcttgcgttgctggcgcagtccgtgtcagctactcagggcattgtcaacaaagatctagcaacctccgttgtctacctgctcgatatcacaacagaatacgtccctgcgcccatcctccgctcgaagttctctcagatcctcaccagccttgctcccgcgctctctctgccggaagtcgatgctccccttctcagaccatcgattggctgcctggaatcactgctcatcgcccaggatgctgcctcatggaacctcccgcacacacaaataggcccgcgccgagcgattgcgggactgttgagtctggcagtggaccaccgacccaaggtccggaagagggcgcaggaagctctcatcaaggtcctcaagaaccctccccccagcccttcgctcgatcaccccgcggcggacatgtgcgcagaaaccggactgcggacactgggcgacagcatcgcggctgcggccaagcacaagcgggggcgtcatgatgcgaacagccgagagaaccacgatcccctggtaatccactccctccagctggtaaagacaatcgcgaccgcatcgggaggctggccgagcaagaagattgagccgctttgtgagttgctgatgaatgcgtctcggtccagcaacgagttcatcacaatgggcgcttttgaagtctttgaagtcatcttctccagcatggcggatgaattttcgtcttcgaagctgccccgtcttttagatgctatctctgagctcaaacccgctcagaacgattcgcagctgctccctccctggattgcggtattgtcccgtggttatgatgtgtctgcacagatcagcccagaggatacctttgaaaaattgccggctctgtttaacatgatttcgggataccttgcttcgccctcgatgaacatccgtgtttccgcctcggaatgcctgatctcgtttttggccaactgcatcccgaaaaatgtcatcctcgagccttcagtctatgatgaaaagactgtcgagaaggttcccagttttcaccatgcgaatggggcataa

SEQ ID NO: 10115 - DNA, 189 bp, A.fumigatus
cagatgaccctcccgcacacacacgaaagttcccttatcgacgtcgacgcaaccctgcagagcttgttagaaagggaggatacggacaggaacatgcagataacgattgaggatgctggaccgaaggtatgtggcttggtctggctattggcccggaacggtgcaagtcatatttcgagcgacggctga

SEQ ID NO: 10116 - DNA, 282 bp, A.fumigatus
caagggcatgcccacttactagtccagaactatgccggcgacatcaaaggcaaagtcattttcaccaccggcgtctccccgggctcactaggcagccacttcgcacagtccatcgcagccgccggaccgagatgcctcaacctcgccggtcgcaacaggagcaaaatccagcaggcagctgacgagatcaaggcttctcacccaagcgtcgagacccacctcgagatcgatctagccgccttggatagcttccggcgagcagcgtcgcaaatccactcgtaa

SEQ ID NO: 10117 - DNA, 1839 bp, A.fumigatus
ggatgctggaccgaaggtatgtggcttggtctggctattggcccggaacggtgcaagtcatatttcgagcgacggctgattggtgctatccaggtgttatcagtaggaaccgctgcgtcatccgggtacaaccgattcgatgtgcgaggaacgtacatgctctccaatcttctccaggagctcaccatcgccaaagactatgggaggaagcacatcattctcgacgaagctcgtttgagcgagaaccctgttgcacgtctatctcgccttatcaagaattcattttgggacgctctcactcgtcgcattgatggttcgaatattgaagtcgccggtagggatcccaaagattggactgaggacccgcggcctcgaatctatgtcccccacggtgcccccgagcagttcgagtactacaaggggattgccaaggagcaccccgagttgcgacttgatgtgcagatgctcgaggagaacattacaccggactatgtgagggatcttaactccaaacctggattgctcgcgttggcaatgcagaagaaatacaatgaatccacccaaaagactgaatgcgtcggcgtgccgtttgttgtcccaggaggaagattcaacgaactgtatgggtgggacagttatatggagtctctcggcttgttggtcagcaaccgagtggacttggccaaggccatggtcatcaacttttgcttctgcatcaagcaatacggcaagatattgaatgccaaccgctcatattacctcacccgttcgcagccaccgttcttgaccgacatggccctgcgtgtctatgagcgtatcaagaatgagccggacgcaatggatttccttcgcaacgcaacacttgctgcgattaaggaatattacagcgtctggacagctgcaccgcggtatgacgagctgtcgggtctgtcgaggtaccgtccagaaggaagaggtgtccctcccgaaactgaaccgactcatttcacgcatatcctcactccatatgctgaaaagcatggtatgactttcaaggagtttgtccaggcttacaacgagggcagagtgcaggaacctgagctcgacgaatatttcttgcacgatagggccgtccgtgaatcgggccatgataccagctaccgtctcgagagagtctgcgccaatttggccacggtagacttgaactctcttttgtacaagtacgaggtcgatatcgccaggattattcggacctatttcaaagacaggctagagatccctccggaattccgcactgagtcgaccaaggatatcgaaagtgagtcatcctctgtgtgggatcgtcgtgcaagacgacgcaaggtgcggatggatacctacctctgggatgaagagaagggcatgtatttcgactatgacacggttctgcagaagcggacgacctatgagagcgccacaacattctgggccatgtgggccggacttgcgacaccgcaccaggcggcagaattggtgaggaaggctttgcccagatttgaggtttacggtggcttggtatccggaaccgaggagtcccgcggtgctgtaggcctggacagacccaaccggcaatgggactacccgtacggttgggctccgcagcagatgttggcatggacgggcctactgagatacggctaccaggaggaagctgagcgtctggcctacaagtggttgttcatgatcaccaaggcctttgtcgacttcaacggtgttgtcgtcgagaaatacgacgtcacccggcccatcgatccacaccgggtcgatgccgaatatggcaaccagggtgtagatttcaagggtgcgcctcgcgaagggtaa

SEQ ID NO: 10118 - DNA, 189 bp, A.fumigatus
  unsure (79),(80): Identity of nucleotide sequences at the above locations are unknown.
gcatttgggaaaccgacattgtcgactgattcgtacctgaattactttacactaacctttggcgccacccccaaaaggnnaaaaaaggggaaaattttttttttaaaaaacccccaaaacccccccccccccctttttttttggggccccccccttttaaccccccccgccccaaatttggggttttaa

SEQ ID NO: 10119 - DNA, 717 bp, A.fumigatus
ccgatatcacagcaaaaccctgacaaggaacagttctctggccaacgaactgcaacaccatctccagctctcagattatctgatgctgctcgcgtctcaagtccgatcttctcgctgggggctttagactacaccagcgaggatttcaaccgtgatgagaagattcaagcaatgggcttcgtcggcgaacattctgagattgcctggatctacagattgaaaagactgcttgagcaggtctctgttggatctaaagagatcgatactgaccgtcagtcggttgcttcggcaagctttttcctggatgattcggatatcactgtgctggatgatatcgatctctcgcaacgcccagcgcaaacagttgctgatcagctcgtggacgagtatttccaagttgtacacccttcctttccgattatcggcaaactggtttttttgagacagtacaggtcgttctactccagtcctcacgtacgcccagggaagaggtggctcgcagtactcaatttggttttcgctatcggcgcaagatgctctcgctattcgcagggggacaacggaggggtgacagatgacgaaacactatacttctcgcgagcatggcgactgagcatgagcgacattgctctgctggatcatcccaatcttcagcaggtgcaggtggaaggtttgacttcattctatttgttatccgtgggacaggtgaaccggtaa

SEQ ID NO: 10120 - DNA, 303 bp, A.fumigatus
gttgtcttcggtattcgatggtgtgacggaagcctccgcttatcgtatgcgctaaaccgcctagaaggccagtgcaaccaccgaagggggaaattcttcgccgtgggggccacagcttcccatatcgctctttcaaagaacgtattcgaagccttattcagttcagtgagggtcattacttataattatcatgacacttggcttgatgctgcagagacttttactacagtgatgtggctgattgccggaccgaattgcgctcagaacgccagattacgaataccaatcgaccactgccaatga

SEQ ID NO: 10121 - DNA, 1155 bp, A.fumigatus
accggtaagtgttccatgcaacgacgtcaatttctagtttcatgcctgaccggaggcgtcctcacaatacccaggtcttggagaatatgtggcatttccttacgctccgcggttacgatggggttgaaccttcggagtgagagcaatacaattgctcatgtatctaaggagacccgatatcgcgtctggtggtctcttttcatgttggatatctcactgtgtgtaatgactggccgcccatcgagcagtagcgatgagttttgcactactcctccgcctctaccattcaaagaggaagatttttctgatgatcgagtggttcaactgattgctgatcacgaagcgcgaggtcttttcacggaagctttgggcaagaccacggcaacggcggaaacggcattaacaccggacttatctgaccacccgtccaacatgaatagagactgtgagcaagtcgcgtccagtgcaatcgaatcattaacaccgaatatatcgctctactttctctacaatgttgagttggatttgatacttcgagaggctgtggtcactctgtatgctcccggagccgctcgaaaatcttggcatgaaattgaactctccattgttacactcaattccaaggcagatgtttggctttccaggcttccggctgcatttcatttcgagacaggcgcccgtgtatttgagcggcagaggttgaacttggccttttgcttttacagcaccaagatcattatagcccaaccttgttttagccgcctcactcggcaggccccggggtcagagcctccgggtgttgcgtgcgagacgatggcgaccatgtgtgtcgattttgcggcgcagatgctcaatcttcttccaacaataccccaggcatcctgggtctaccgtgtctctccctggtggtgctttttacactatctgatgcagtcaaccactgttcttttaacccaaatactacttttgtcagaagcgggcaccgtcaagtacaatcgggtactagagcaactttccaaagcgactcgctggttatcggaactgtcgacaaacgatccatcttctgcaagagcctggctcttctgcagggatctcatctctcaacatgccccagaacttgaccttggagcctccatcgagaaccacagaaattga

SEQ ID NO: 10122 - DNA, 441 bp, A.fumigatus
  unsure (50),(51): Identity of nucleotide sequences at the above locations are unknown.
ttcgtacctgaattactttacactaacctttggcgccacccccaaaaggnnaaaaaaggggaaaattttttttttaaaaaacccccaaaacccccccccccccctttttttttggggccccccccttttaaccccccccgccccaaatttggggttttaaaaaattttgggccccaaaagaggccccggggggggttttccccgggaaaatttggggccccccccgggggtttaaaatttttccccaaaaaatttgggggtttttttttgggggggggggggggggggagaaaaaaaaaggggaaaaaaggggcccccgggttttttccccaaaaatatttctcccccaaaaatttttttaaaaaccccccaaaaaaggggggggccctcccccccaaaaaacccccccaaaaattttttttttttttaaaaaaatatttt

SEQ ID NO: 10123 - DNA, 492 bp, A.fumigatus
ttacttgttttctggcggatacgaaagatgatgctcttgttaatgttgcttcttttcactctttgtgatattgctactgctggttcagtatccgttgaagatctgaccttgaacctcgacctagatcgtcgaggtatcgctttgtccacggaacctcccgtggatcagtccctactggcaattcagataggaggcattgttggggcatacgtgatcttcgttgcaatactcttgactctgttgctcttcgtgggacggcgactacgaagagcggtacaagcatcgaactacactttacaggttgagatgatgaaacctagcaaacaagccgttagcatggatcctagtccggtcactccagtctcagctcgtcttccaagcccaattgcacaaaacggcttcaacaggtcctggggcagcttggctaatggtccaagaccccatgtctccggcaatggcagcgctgctaccattgatgagtctgtggttgct

SEQ ID NO: 10124 - DNA, 192 bp, A.fumigatus
gtgctgtctcatacacagatacttagaaatgcatctgaatgtattacagtcaagtatgcagatctggttacaattgatctgtcggagttcgatcagccaggaggaaaggagaagctcgccgcacaactaaaggatgtggttcatgaagttggtaatttcttctttcctcggtgtctcttacctgactactga

SEQ ID NO: 10125 - DNA, 276 bp, A.fumigatus
ttctgctgggggcccctcgcatttttcatcgcatattgcatcgcagtccaacatcccctccgtcatgccctccaactcattatgtccacgggacaagtctatggggatgttctttactacgccacgagcttgtttgacctctatttccatggggtgatcttctgtcggccagaacgctactacttttggttctactactttttcatgaactttatttggattgcgattccctcctgttcgtcagccctgaactatgtccctgcagtatcttgttga

SEQ ID NO: 10126 - DNA, 615 bp, A.fumigatus
  unsure (523),(582): Identity of nucleotide sequences at the above locations are unknown.
aggatgtggttcatgaagttggtaatttcttctttcctcggtgtctcttacctgactactgactccccaggcttcttctacgtgaccaactttgggctcacccaagaacaagtggaccgacagttcgccatcgccaaagagttcttctctctacctgaggaagaaaggcgcagtttccgcgctccactggaagaaggcatttataacggctaccgtcctctgggctcgatcgaaattctcccaggcctccgcgataatatcgaattctacaacatcatgaagttcctcccgcaatatgagcgaacccaccccgatgtaatccggcgacactgggcggagatcgagaagttccatcgccatgtgcacgaacacatcgcgtacagactattccgcttgctagctattgttctagaaattcccgaagacgaactcgaaaaaggccacctgtatgattctaactgcgacagcgggctgcgaaacatgtgtttacgtgcgcgttctgccgaggagaacgagaagtacnagagcctctattcacgaagccatacggataacggcaccatcacctttgtcttccaacancctgtggcgggggttacaggtcaaaaaacctga

SEQ ID NO: 10127 - DNA, 306 bp, A.fumigatus
gtcatgaagcacttgcatcctacttcagttcatacgtgtggactatatttctatcctttatctgtccgtcctatcacctcatgtttggattaccgtttcaggttccaaaaagaatactcgggtctgactagcacccgatgcgagacatacttcatttcagcgcccgaactcgacgtcagcggcgagattttgcttgacacacatgcctcacctcggttcgtaagctgtcgatggcgaactgagagcctttggtttgcagatttcgcaaataaattcgtgattgaggacaatttccgtgagaattaa

SEQ ID NO: 10128 - DNA, 255 bp, A.fumigatus
acgcatgcgctgtccttcggcccggcgctgatgagctttctagacattagtattggcaacctcttgagcaaacgcaagacataccttcgcaacaggacaaggctcacctccaacaacagaggcgagagtccgatgctttgcagaatgatctccgccgtcaagaccaccttgctcggattggaaacagctatcgccatcgcggaacctgcaattcggactgaccagcctcgattagccctgtccgagagaccatag

SEQ ID NO: 10129 - DNA, 282 bp, A.fumigatus
tcaatcaacctcaactcagagtcaatcactatgaaggcgaatacaatgcagtctctctccgtgggccacacccgcatcgcaattgctgaagtgaccatcttctctttcatccaattggtacaatttatcacaagattcatgcaagaatggcagtactggcaccacagaagggagagaaatgtccgcagatgcgtgctgtactcctggtttggcatgcttgggattttggcgcagcgtaagtgtgaatttacctgcccactatggtctctcggacagggctaa

SEQ ID NO: 10130 - DNA, 663 bp, A.fumigatus
tcacatggcctgacaaacgatctccttgcgggatggctgataccttttcctgcagacctcctcaatgcacacgcccaatacgtcgaattatacatcaaccagctcgcctattccgtcagccaaaactcgcttccgctcaatctgaccggacagctgggattcgaacgcctgcaatgtctgtggcagtcggttgagaacatcaagtcgtggctgggccatttctaccagatcccttgctcggacctggtcggccagccttttcatttttggtcccagatgattctgaccgtcaccctgctgaagtacctatcaacactccatgaccccgaatgggattgccaggcggtgcgggggacagttcacctaatcacgacgatggactcgatggttcaaaagctcgatctgagcagcaaagtgccggagtatcagtgcgacgaccatttactcaagtttctgtccaagcttttgaccagatgtcgtcggtgggctgaagctcggtggcacgacgaggagacctggccgggccggagcgccagctcagacaccactggtcacaatcatccgatcccggagctggatcagatggtctggatgcagtcgatggatttgggggatgatcagtggtttgaaaatgtcctgggcatgcccagcgcattctactag

SEQ ID NO: 10131 - DNA, 1575 bp, A.fumigatus
aaattaggcgcggattcttccagccccgtggtgaagacttattgtggctcctatggtgtggagtacattcacattcctgatcgtaagccctgcgactggatccgtgatcgcttcgaaattcctgagccctacaagtactcggttgacgacaagcgccgtatccttgaccgtctgatctggagtcacagcttcgaggccttcctggccaccaagttccccaatgacaagcgtttcggtctggagggttgcgagacccttgtgcctggtatgaaggcgttgattgaccgcagcgtcgagcacggcatcaaggacattgtcattggtatgcctcaccgtggtcgtctcaatgtactgtccaacgttgttcgtaagcccaacgagtccatcttcagtgaattctctggatccgccgagccttcggatgaagggttcggtgatgtcaagtaccacctgggtatgaacttcgaacgtcccacgccctctggtaagcgtgtgcagctctcgctggtcgccaacccctcccatctggaagccgaggaccccgttgttcttggcaagacgcgctctattctgcactacaacaatgatgagaaggacttcaacagcgccatgggtgttctgctgcacggtgatgctgccttcgccggccagggtgtcgtctacgagaccatgggcttccactctctccccgcctactcgaccggtggtactatccacatcatcgtgaacaaccagattggtttcactaccgacccccgttactcgcgttccaccccgtactgctcggatatcgccaagtccatcgacgcccctgtgttccacgtgaacgctgatgatgtcgaggccgtgaactacgtttgtcaggttgctgccgactggcgtgccgagttcaagcgcgacgtcgtcattgacatcgtctgctaccgtaagcagggtcacaacgaaaccgaccagccctctttcactcagcccttgatgtacaagcgcatcgccgagcagaaggctcagcttgacaagtatgtcgagaagctgattgctgagggcaccttcaccaaagaggacattgacgagcacaaaaagtgggtttggggtatgctcaacgacagcttcgaccgcagcaaggattaccagcccaccggcaaggaatggctgacctctgcttggaacggcttcaagactccgaaggagctggccaccgaggttctgcctcatctgcctaccgctgttgatgcttctttgttgagccacattgccgacaagattagcggcgcccccgagggcttcaccgtccaccgcaacctcaagcgtattttggccaaccgcaagaaggccgttgatgagggtaagaacatcgactgggccaccgcggaggccctcgcctttggttctctggtgaaagagggctaccatgtccgtgtttccggtcaggacgttgaacgtggtaccttctcccagcgtcacgccgttctgcacgaccaggagaacgaggctacgtatacccccttgaagcacatcgctgaggatcagggcagcttcgtcatctccaactcttcccttagcgaattcggagcgtaa

SEQ ID NO: 10132 - DNA, 564 bp, A.fumigatus
ctcttcattaactcaattgccatagccctcgtgatcttcttctccaagtccctcctccgtcatcctattgctcgctccgatatcgaggaattcaccggtgactcgcacttcaggtggatcatccctgacccggcccacggtagcaccattgacgagcccgagaagatcgagcgcgtcattttgtgcagtggccaggtctatgctaccttggtcaagcaccgcgaagccaatggtatccgcaacactgccatcacccgtgttgagcagctgcaccccttcccttgggctcagctgaaggagaacctggacagctaccctaacgccaaggacattgtctgggctcaggaagagcctctgaacgccggtgcttggagttacacccagccccgtattgagaccctgctgaacgagactgagcaccacaaccgtcgccacgtcctctacgctggtcggcccccaagcgcctccgtcgcgactggtctcaagtccgtccacgccaaggaggaacaggacttccttcaggaagcattcactgtccaccagcatcgtctgaagggcgagtaa

SEQ ID NO: 10133 - DNA, 555 bp, A.fumigatus
agcacatcgctgaggatcagggcagcttcgtcatctccaactcttcccttagcgaattcggagcgtaagttgacttccacattgaccagcttacctttgctctctcaagctaacttattttcaagccttggttttgaatacggttactctctgacctcccctaatgccctggtcatgtgggaggcccagttcggtgacttcgccaataatgctcagtgcattattgaccagttcatcgcctctggagagtccaagtggctgcagcgctccggtctcgttgtctccctgcctcacggttatgatggccagggtcctgagcactcgtcgggtagaatggagcgttggttgcagctttgcaacgaggaacctcgccagttccccactcaggacaagttggaccgtcagcaccaggactgcaatatgcagattgcctacatgacctctcctgccaatcttttccacatcttgcgtcgccaaatccaccgccagttccgcaagcgtaagtcttggttccctgcctccttgaatgactcttcattaactcaattgccatag

SEQ ID NO: 10134 - DNA, 414 bp, A.fumigatus
agagtcattcaaggaggcagggaaccaagacttacgcttgcggaactggcggtggatttggcgacgcaagatgtggaaaagattggcaggagaggtcatgtaggcaatctgcatattgcagtcctggtgctgacggtccaacttgtcctgagtggggaactggcgaggttcctcgttgcaaagctgcaaccaacgctccattctacccgacgagtgctcaggaccctggccatcataaccgtgaggcagggagacaacgagaccggagcgctgcagccacttggactctccagaggcgatgaactggtcaataatgcactgagcattattggcgaagtcaccgaactgggcctcccacatgaccagggcattaggggaggtcagagagtaaccgtattcaaaaccaaggcttga

SEQ ID NO: 10135 - DNA, 609 bp, A.fumigatus
ctcctacaaatcaaagcacctaagacgataatccaacagtggctacaacgtccccacttactcgcccttcagacgatgctggtggacagtgaatgcttcctgaaggaagtcctgttcctccttggcgtggacggacttgagaccagtcgcgacggaggcgcttgggggccgaccagcgtagaggacgtggcgacggttgtggtgctcagtctcgttcagcagggtctcaatacggggctgggtgtaactccaagcaccggcgttcagaggctcttcctgagcccagacaatgtccttggcgttagggtagctgtccaggttctccttcagctgagcccaagggaaggggtgcagctgctcaacacgggtgatggcagtgttgcggataccattggcttcgcggtgcttgaccaaggtagcatagacctggccactgcacaaaatgacgcgctcgatcttctcgggctcgtcaatggtgctaccgtgggccgggtcagggatgatccacctgaagtgcgagtcaccggtgaattcctcgatatcggagcgagcaataggatgacggaggagggacttggagaagaagatcacgagggctatggcaattga

SEQ ID NO: 10136 - DNA, 1608 bp, A.fumigatus
gagagcaaaggtaagctggtcaatgtggaagtcaacttacgctccgaattcgctaagggaagagttggagatgacgaagctgccctgatcctcagcgatgtgcttcaagggggtatacgtagcctcgttctcctggtcgtgcagaacggcgtgacgctgggagaaggtaccacgttcaacgtcctgaccggaaacacggacatggtagccctctttcaccagagaaccaaaggcgagggcctccgcggtggcccagtcgatgttcttaccctcatcaacggccttcttgcggttggccaaaatacgcttgaggttgcggtggacggtgaagccctcgggggcgccgctaatcttgtcggcaatgtggctcaacaaagaagcatcaacagcggtaggcagatgaggcagaacctcggtggccagctccttcggagtcttgaagccgttccaagcagaggtcagccattccttgccggtgggctggtaatccttgctgcggtcgaagctgtcgttgagcataccccaaacccactttttgtgctcgtcaatgtcctctttggtgaaggtgccctcagcaatcagcttctcgacatacttgtcaagctgagccttctgctcggcgatgcgcttgtacatcaagggctgagtgaaagagggctggtcggtttcgttgtgaccctgcttacggtagcagacgatgtcaatgacgacgtcgcgcttgaactcggcacgccagtcggcagcaacctgacaaacgtagttcacggcctcgacatcatcagcgttcacgtggaacacaggggcgtcgatggacttggcgatatccgagcagtacggggtggaacgcgagtaacgggggtcggtagtgaaaccaatctggttgttcacgatgatgtggatagtaccaccggtcgagtaggcggggagagagtggaagcccatggtctcgtagacgacaccctggccggcgaaggcagcatcaccgtgcagcagaacacccatggcgctgttgaagtccttctcatcattgttgtagtgcagaatagagcgcgtcttgccaagaacaacggggtcctcggcttccagatgggaggggttggcgaccagcgagagctgcacacgcttaccagagggcgtgggacgttcgaagttcatacccaggtggtacttgacatcaccgaacccttcatccgaaggctcggcggatccagagaattcactgaagatggactcgttgggcttacgaacaacgttggacagtacattgagacgaccacggtgaggcataccaatgacaatgtccttgatgccgtgctcgacgctgcggtcaatcaacgccttcataccaggcacaagggtctcgcaaccctccagaccgaaacgcttgtcattggggaacttggtggccaggaaggcctcgaagctgtgactccagatcagacggtcaaggatacggcgcttgtcgtcaaccgagtacttgtagggctcaggaatttcgaagcgatcacggatccagtcgcagggcttacgatcaggaatgtgaatgtactccacaccataggagccacaataagtcttcaccacggggctggaagaatccgcgcctaa

SEQ ID NO: 10137 - DNA, 1128 bp, A.fumigatus
ctagtagataccttctcagttggccaccgtcgcaatgccgagcacgatgtcaaacccaaggagcaagtcatcgtttgggtcgatcacgctggacacacgatcggtattgagcataagcatcaaacccctactgcaaccttcaagagcgtatgtttatttgcaactgaccaatgtataacccgcctgaatataaaactgacaccgagacagtcgcccacggagctgcctctgctcccaaacaccgacaatatcatccctgacaaccccctccccaaactcaccgtcgaagtacctgagctgaacacaaaccggggccctcgcttcggcatcacctactcgccttacaccagccacggcacctgcaagaccttcgaccagataaaccaggacattgagcacctgcgccatcacgccttcatccgcatctacggcatcgactgcgatcagaccaagctcgtcacccaagcagccagacagcacggcctaaaagtcttcgcaggtgtcttcgacctccataacttccccgacagcctgcattacatccgcgacgccgccaccgccgcaggaggtgactggtccattttccacaccatcgccatcggcaacgagctcgtcaacaagggccagaataaaccagctgacgtcgtcaacgccgtcaacaccgcccgcggcatcctccgcggcgcaggctaccagggccccgtggtcacagtcgacaccttttccgtgatgctgcagcacccggaactctgcgccgcgtccgactactgcgccgccaactgccacgccttcttcgataacaaccagctccccgaaaccgcgggggagtacgcgctcgacaaggcccgccgcatctccgctgcggcgggcgggaagaaaacggtaatcacggagtcggggtggcctcatgcgggccagccgaatgggcgcgcggtgccgtcgccggagaaccagaagaaagccattgcgagtctgagaaaggcgtttgcagacgatccggacttagtcctcttcactgcgtttgatgacttgtggaagtcggataatcaatggacgtttggcgcggagcggttctgggggattcaggatatggggcgcgagcgggagcgtgagcaggatcgggagtaa

SEQ ID NO: 10138 - DNA, 249 bp, A.fumigatus
cagcatcgcatacagcaatatcagcaagacatcttcaacgaactacgcggcgaagatgagcttgttatccttgcccgaggtttaggcctcctgcgcttggtgacgaacttactccacttctacgatgctgcagggaataacttagtactggttgtgggtgctgatgatcgggagaatgaatggatcggtgaaggtacggagtacgcggatttcaataccttacaggtctctcagaagttgcgagactaa

SEQ ID NO: 10139 - DNA, 477 bp, A.fumigatus
gcgacttcggccatgtctcactcttcccttgtattaattcatcattaccagagcatggctgtcaccctcacccatgacaagagtcaagaagatcctcaggaacaattccttcgcacagtgaacacgcgtatcgccggagggggtcgattagccgcaactgcatcacctcctcgagtagtcgtggacgttagagagttcagaagcgctctgccgtctctgttgcacgggaacaacatgatcatcgtcccgtgccagttaacagtcggcgattacatcctaacacccgatatctgtgtggagcggaaatcagttcgtgacctcatcacttccttgagaaatgggcgcctctacaaccaggccgagacgatgctccagcattacaagaaccctctactgctcatcgaattcgaccagaacaaatccttcacatgcgatggtcttcagcacgtggatggaaggatcagacgcgggctgtct

SEQ ID NO: 10140 - DNA, 498 bp, A.fumigatus
aggcatcctaggatagtagcaacttctaccgaagcttttataattcggatctatcggcaaataaacaagtctggctttctgaaggctttctccgactcgccagagccattcactacgggatttgctcctctggctaattatatgcgtaacctgtttttgcgcaaaacatcattatggccacgttttcacgtcactgttgccgagtcattagagggacacaggaaagccgaggtgattgagcttgaggtgccgatgaccgataaaatgcgcgaaatccagaatgcggtcttagagtgtgtggaaatcagtattgcagaattgaagaaagcaaataccggacttgacatggcggactggactctggacagcgcgttgcataggagctttgatattgcgataaggcgtcagctcgatcccatgtggcatcgagtgagttttaggaccaggcagattgtcagcgacctgtctgatcttcgcgcgattcttcagtacgtttga

SEQ ID NO: 10141 - DNA, 1287 bp, A.fumigatus
gttttaggaccaggcagattgtcagcgacctgtctgatcttcgcgcgattcttcagtacgtttgattgccccaaacatgcactatctggtgttcgcataggaactcactactggtacagtgcgttgcttacctatgatgcggtctccttcgtgaaatatctggatactattgtgaccgcgcattccccaccgcctggttcgacaagacataattattcaccctggctctttctcgatgctgctcacgtactcttccagaccgcgaagtcaagggtgtacgaaggaaagatcacccgtgatgcagccaatactctcgattctacccttcaacctgttctggaggaacagcccaaatgggcagttctagcagaagtgctggaagagattgaacaagatgcttatttgaatcctgtcagcacggatggatcgaatagtactgtgcttatcatgtgtaccgaccagcggacttgccggcagattagggagtatctcggaacaatgcatgccagaattggtaaagacaaggcagaagatccgggagaccttgatgctatgagtgaaaagaaattttccgcggaggtaatgttgcggaggagactgcgcgaatatcttgattggaagacttcgttggcgaatgttaacaggaatctatctgccaaatcaggcgacgacacccagaacgcaaagggccaggagtcaccgaagccaacgagtcagcaaggtagagctcctccgaacaagcgacgccgtgttcgcggtggaggaacagtaacatcggctgcagcgcgagtgccaaatgctagcgtgcagactgacaccgaattgccgggtcaagtttctagtttactagaagaactacaaccaacagatattgaagagacacagaaaggagagatcatcagtgatgacctggaagacatggaagactttttcgagctctatgacatggacgacctggttatagtgcatccctacgatggcgatatggacgagcatatactggaagaagtacggccgcgatacattattatgtacgaacccgatgcagcattcattcgacgagtggaagtctatcgcagctcgcatgttggaaggaatataagggtatacttcatctactacgggggctctgtggaagaacaacgttacctaagtgcagtccgacgagagaaggactcatttactaagctaataaaagagaaaggggtaagcgacttcggccatgtctcactcttcccttgtattaattcatcattaccagagcatggctgtcaccctcacccatga

SEQ ID NO: 10142 - DNA, 858 bp, A.fumigatus
ttgctccagaggacggacggctcgacatcaagttccgcggccaaaaaccaagcctcacgaacctcctcaaacacctggaaaagccacagaaaccaaccgcggaagacatacgacaaggatacgttcccccgacctctattgagaaaccggagcgcttcccgctccgcctcaacatcgtcatccaagtggtcggatcgcggcggggacgtacaacccttcatcgcactcggcatggcccatcaagagaacggggcccccggggtccgactcgcaacacacctgggcgttccggggacttggtccagggaccacggtctccaattgttcagtatgggcggcgatcccgcggagctcagggggttcatggtgaagaaccccggtctgctgccggggatgaaaacactgcgcagcggggcgatccggcgccggcggagggaaatggcggcgatattctccggctgttggcgatcgtgtttcgagaccggcgatgggacgggactgcaccatgtgcccgaggatctgtggagcgagacggtggactaccgggagcagccgttcgtggcggacgcgatcatcgccaacccgccgagttttgcacacatcagctgcgcggagaaattgggcgtaccgctgacgctcatgttcacgatgccttggacgcctacacaggcctttccgcatccgctggccaacgtgcgtccgacgcgtacgaagcgctctgtcgcgaatttcgcctcgtatgcgattgtcgagatgatgctttatgagggattgggagatctgctgaataaattccgcaagcgagagttggggctggatccattggagcctttttacttcacgccgggatggaagata

SEQ ID NO: 10143 - DNA, 213 bp, A.fumigatus
ggaggccgatggggtggcccattgggcaccaccatcgcgacccccttgtgcacttcgccctctagcgacactgtccgtttcactggcgagactggccaagttagcgcgcagagactccaggcgactgtcttggacccagaaggcatcggacatgtctgttgtcgatgcttccatgactgccacgataactactggctcaagtccgagtattag

SEQ ID NO: 10144 - DNA, 273 bp, A.fumigatus
tgtctcaagagtcaagatactagttgtgctctgctctctcatgaagttccccagtgtattagtctttacacctgggatcttgattcccccaaggacgcgatgcctccgcaacaacctactggtggaatcacgacggcggactggccgcaacaggccctgagcgacctggttgccgcagaccgtcatcacaaccccctgctggaccatgggatgaatacaggggtgcggataacaggtatgatggcggtgtcagcagaaaagcagcaaagctga

SEQ ID NO: 10145 - DNA, 672 bp, A.fumigatus
tcctccagtgtccgcacaataaaagcccccatccccgttccaatcgcaaaagagaccaaaacccgcttcgaccaaatctccaccctcttccagaacgtcatccccgacgtcaccggcctcaacagctggcgctaccagcgccaactcagcggcgccatccaggaattcatcgaagcgctctctttcaaccactatctacagacccaatccctcatctcccacgccgaagtcagcaagcaccttcctgccgagatcctcgtcacggaagaagattacctgttgggcatgttcgatctaaccggtgaaatgatgcggtttgcgattacgtcattgtcgacggggacgatggggcaggaggatagcggcggtgatgatctggcggcgcgggatatttctggagctggtgcgcatcatagtctgccgaagctgccggccacgcaggcgggtattgttgttgatttgcgggaaatgcggtcgtcgttcgagttgctgagtgtgccgcggcggcatgcgaataatatgcttcgggatatggggaagaaggtggaagtaatgcagaatagtgtggagaaggttgagcgggctgcgtatgggattttggtgcgtggtagtgagcgcccgtcggggtggacgccggatttgtccgcgccggttgatatggaggtttattga

SEQ ID NO: 10146 - DNA, 405 bp, A.fumigatus
atgcagatcttatcagataacaatcaccccaaaacggttaagcccagcggaggaatgacgaccatgaccgtcaatcaatcgcaatttgtactatcaccccaaaaacagtccaaactccagcaacatcaccccatggcaggtaacaagcgatcgtgggaaggcaatccggtgagagttgagaaaacacagacaaacatggccgtagcaccagtcgatcagccttctacacatattctttccatgttcgagaccttccgcgacgaactcgatcagcaccacgaccgccgagaacgagtcatcaagacgagcagagatattacagccctgagtaagaagatgttagtgccctgtcccgttcgtcccgtttgcatacattcgcactcaagctcaattcgcggacgctaa

SEQ ID NO: 10147 - DNA, 192 bp, A.fumigatus
ttgcttatgacaggtaacatcctcccgcatatcaacgccgcgccggcgctgcaggccaacgcaaaggaactcgagaagcatatgctcgctgataaccttgaccagaagctgcagcgtagaccgcagccggaggagcttatctcgcagggtatcttgacggaagatgaggacccgaggtgcccggctgtgtag

SEQ ID NO: 10148 - DNA, 561 bp, A.fumigatus
cgcgagcctcgaacagccatggttctagctcgtgatagagaattactgagggacactcttcgcactcaacggaccgcactcactgccgccgatcgcgaaaatatcctgaagccatatttgccggatccatcagaactagcacgtcgaccacaccgactgaagaaacccccccgaaaagctcccattcgaacgttcttaaagtctcggctgcatcaacttacctataccttcattcatattgtctatgggattatcctgcgtctagttcagagctaccatgcccttgtggatcaggttcttgcaattgtctattatcatcaccgcacaccaaaattgatacgaaaagatgtcaagggcctaagacgtttgccgggacatctgaccgttgttttatcactacgtaaggaagatgatgcgcttgcgattctgatggacgaagttgcagaactggctgcttggagtgttagcgctggcatacccatgctgagtgtatatgagaagagcggtatgtccagacacttcacacttggcattctggcttcctcaagcgctctgaggtag

SEQ ID NO: 10149 - DNA, 615 bp, A.fumigatus
gtagttgaccattctctagggattctgaagtcatgcatcccgatgctgcatcatgtggttgcaagcaaattcgcttcatattacggttcaattcctcagcagccaactctgcggcttttcgctcctcatcattctgtttatgagccagctcttgatcatgataaggcccgtagagtcaatactgactctcttaccctgcttctgctatcagctaccgatggaagagaaaccatagttgatcttactcaaacgctagcggagatgtcacagaatggtaaactgtcaccaggtgatatcaccatggaattggtggatgcagaaattagcgaaattacaacgcagccattgcagccggcctcgttgagcattggtgacaggcaaacgactgctgttcaccccactattgcagtgaagccagaaccagatttactattagtgttcgcgcccttcctgaagctggatggatatcctccctggcatattcgcctgactgaaatgttttgcactggtggtaaaggtagcggcgttactagttatggtgatgctgtcgaatatcagggttttctcagaggtttatggcactacgccggagctcagatgaggtttggtcgctag

SEQ ID NO: 10150 - DNA, 1098 bp, A.fumigatus
  unsure (101): Identity of nucleotide sequences at the above locations are unknown.
aggggagaacggcccacggcatctcaatctcgcaaaaagcggagccaagtctcggtcaatcataagccatccacccggctggattgcatcggacgtggggnaagctctcgtgtctaccgcgtcatggccgagaattataaattctttgctctgaaacgagtgaatctcgaagatgtcgacccagtgactctagctggctacaagggcgagatcgacctcttgaagaggctggaaaacattgatcgggttgtccgattatttgactgggaactcaattcggacaagcacaccctcagcgttctgatggaaatcggagagtctgatttggagaagattttgacctaccggttgaatgccgaggatgctgtgtttgatatcaacttcacgcggtattactggaaagagatgcttgagtgtgttcaggcggtccacaattgcaatattgtgcattctgatctgaagcccgccaacttcctcctcgttcagggaaggttgaagctgatcgattttggaatcgccaacgctatccaggataacacggtcaacgtgcatcgcgagcagcaagtcggcacacccaattatatgtcaccagaagccttgatcgactcgaatgcctcacttgggcttccagccagtgttggaaagatgatgaagctcggcaagcccagcgatgtctggagtctaggctgtatcctctataaaatggtctatggccaaccgccatttgccaaaatcgccaaatattatgagcgcatcatggccatccccaaccctaaagtgcagatcgacttcccagcttttggtgttggaggagttgcgataccgccggggctgattcgtaccctgaagcgctgcctgcagcgggatcagaccctacgaccgacagtggaagaacttcttagccaaagagattcatttttgtaccctgacgcacaattggaaggcactgttcccgtcaatcaggacatgctgggcaggatcctgatgaatgttgtccaccactgccggactcggggcatacccaaggacgaagaaatagccgcctggccggctggattctatgcgaaaatcaaggcggcactagaagaaaatacttga

SEQ ID NO: 10151 - DNA, 876 bp, A.fumigatus
catgactctgtcttgggagatacattggtgaaaggtcacatacgcattgaccgtgccatcgttctcaggagtattggtgatctgcgcatatttaccccatacgacctttccgcttgtcgtgacgagacccaattcggagacgttgacttcgatgatggttcccttggtcaggactcccagttgggtgtacagagggttctgcgggttcttcttgacgcccaggatgggcagttgcacggtgacgccgagctccgggctgataaattgtcagttgggttgcaacgcaaaaagcttagagggaaggaaggcagcatactgcgtgacattggccttcttgtaacgcagacccatcggccggatgaaacgctcgtacttgaccggtcgccgggtgaagtcgctaccgacaaatgtgggcttggtgatcatccgcttccacgacttcttgtgcgtcttcttgcccgtgttgacgaccttgaacatctcctcctcactgatacccttcaccttgggcaggggcaccgcgaacttggccgccttctcagcacgcttatccttgatagcactggacagagccttggcgttggtcgcctgccaacggtcgaacaggtactggggcagaggggtcttggaccgctcgtcgggggcggaggacttgaccttctttccctcccgtgccttgatgcccctgcccctctggatcttcctggcctgacgcttctgctggtactgcttggcccgcaggccccgcctgttccggggcatcctggagaccggttggtgcgattccccggccttggcgtcttgcggaagccccccctccttggttccgacctcccttaccgtggcggcttttggccacccgcccccatattccct

SEQ ID NO: 10152 - DNA, 609 bp, A.fumigatus
agggaatatgggggcgggtggccaaaagccgccacggtaagggaggtcggaaccaaggagggggggcttccgcaagacgccaaggccggggaatcgcaccaaccggtctccaggatgccccggaacaggcggggcctgcgggccaagcagtaccagcagaagcgtcaggccaggaagatccagaggggcaggggcatcaaggcacgggagggaaagaaggtcaagtcctccgcccccgacgagcggtccaagacccctctgccccagtacctgttcgaccgttggcaggcgaccaacgccaaggctctgtccagtgctatcaaggataagcgtgctgagaaggcggccaagttcgcggtgcccctgcccaaggtgaagggtatcagtgaggaggagatgttcaaggtcgtcaacacgggcaagaagacgcacaagaagtcgtggaagcggatgatcaccaagcccacatttgtcggtagcgacttcacccggcgaccggtcaagtacgagcgtttcatccggccgatgggtctgcgttacaagaaggccaatgtcacgcagtatgctgccttccttccctctaagctttttgcgttgcaacccaactga

SEQ ID NO: 10153 - DNA, 300 bp, A.fumigatus
caatttatcagcccggagctcggcgtcaccgtgcaactgcccatcctgggcgtcaagaagaacccgcagaaccctctgtacacccaactgggagtcctgaccaagggaaccatcatcgaagtcaacgtctccgaattgggtctcgtcacgacaagcggaaaggtcgtatggggtaaatatgcgcagatcaccaatactcctgagaacgatggcacggtcaatgcgtatgtgacctttcaccaatgtatctcccaagacagagtcatgctaatcttcgtgcgcagagtcctcctggtctaa

SEQ ID NO: 10154 - DNA, 201 bp, A.fumigatus
gctttttgcgttgcaacccaactgacaatttatcagcccggagctcggcgtcaccgtgcaactgcccatcctgggcgtcaagaagaacccgcagaaccctctgtacacccaactgggagtcctgaccaagggaaccatcatcgaagtcaacgtctccgaattgggtctcgtcacgacaagcggaaaggtcgtatggggtaa

SEQ ID NO: 10155 - DNA, 222 bp, A.fumigatus
ttcagcagtctatattcctgggaggcgttcaaggcgcgcactgtgattccaactatcaaaagtatgcatctagttcatcgatccgatttgcaagtcagtagaaatagacatcatgattttgatgagcagatcttcacgtcggccgtcgattaccttgtatacatacatatacgtcgttcaccaagctacggtatatattcagttaacatacgtatcctctaa

SEQ ID NO: 10156 - DNA, 306 bp, A.fumigatus
  unsure (39),(86),(104),(115): Identity of nucleotide sequences at the above locations are unknown.
ctgcattacaatctctatcaactcgatcttccattcatntgcattttgttcttcctagggccccattgtgaagaaaagaaaaaganaatgacattcggaacccnccgcggccggnaggccctctctctcagcattgcatttaccacattagccactgttttcacaattattcgagtttacacccgaatattcctggtgaagcagatgggcgccgatgattgggctatcattgtggctctggtaaggctttcgcaggagttccatagccgaggacggatttgccgactaaccctcgcaggcctttag

SEQ ID NO: 10157 - DNA, 438 bp, A.fumigatus
tccaacttgtgcgtttttcccacatcgacatcaatctaccgaaagaaccaaactaactctcagctcctagatgataacccaggcgctgccaagtggtccgccattgaatgcaacgtcgccattatctgcgcctgcctccctggcatccgtgcctttatcaccaagctcctccctcgcttcctctccagctacaagagcaagagcaacacccgcacgaggacccaacgcagccatgttacccacttctccaacttccattcttccatcgctgaccgccagtccaaattccacatgcagtctgtcagccacggcccggagggcggcgactacaaggctagcggtttcgaggaaggcacttcgaataagatcaaagtcaccaccattgtgtcacaggaatccgtgtcgaatgatgcttcgagtgtgcggcagttattataa

SEQ ID NO: 10158 - DNA, 183 bp, A.fumigatus
ttcaattcctggggcgtctggtcactcgcacaaactctcgaccaacatggcaacatcagctccagttcccacattaactccgggtactattactctattactctattaggcattgactactttaggctatcgtttaactacttaagtgcccatgaacctaaagacgtcagccaacggatctag

SEQ ID NO: 10159 - DNA, 408 bp, A.fumigatus
atgataacccaggcgctgccaagtggtccgccattgaatgcaacgtcgccattatctgcgcctgcctccctggcatccgtgcctttatcaccaagctcctccctcgcttcctctccagctacaagagcaagagcaacacccgcacgaggacccaacgcagccatgttacccacttctccaacttccattcttccatcgctgaccgccagtccaaattccacatgcagtctgtcagccacggcccggagggcggcgactacaaggctagcggtttcgaggaaggcacttcgaataagatcaaagtcaccaccattgtgtcacaggaatccgtgtcgaatgatgcttcgagtgtgcggcagttattataagggttgttatccctggacgggttctttctgccatgcatga

SEQ ID NO: 10160 - DNA, 231 bp, A.fumigatus
tcccatccagcccgaaatcgctcacccggagaagcaggctccatccgcccgcagggacgccaacgggtagtccttcgagttccgcgacgacacgatcccggcgggcctgtagttgcgccacatacggcgccagagtctggggcgaccggtccagcgcaaccgcgacggcttcctgggcgatccccacgggcacgacgacattggccatgcacaccgcggcaatgtcgctga

SEQ ID NO: 10161 - DNA, 288 bp, A.fumigatus
acttcccagatcaccctcaacatgcacttcatctaccaggccctgtctgccctggcggcctctctcctcttctcatccgccaccgcagggatcgcgcactgcaaggtcggagaggcatggcccgattcctccgactgccacaacttctacgagtgcgcgtccgaaggcgcccccgtcctcaagacctgcggccccggtactgcctactgcccgacgacgggtgtttgtgtccacgaggaaaacgtccccagctgcttccacagaggtcatcactctgaggatgagtag

SEQ ID NO: 10162 - DNA, 1014 bp, A.fumigatus
actgtgaccatgcctcgtactcgcccccgacggctcaaccacctgcaaggcatcaatgtggaccagatggcccagatcgccgacgccgccaacaacgactacctccgtctcgaaaacctcgacgtcaacatcccgccggaaccagaggctctagcttacatgcagcaggccgtcgccgacgaggcatgtaatagttacctcccattcaccggcaaagcccgcctgaaagacatcgcagccagacacgtctcgcaggtgtcgggcatggcatataccggccagcgccactgcgtgatctccgcgggcgggctatccggcatcctgaacgttctcctggcaaccatcgaggaaggcgacgaggtgatcttgacggatccgacgtaccgggggctcctcaaccgggtcctgctcgcgggcggcgtccccaaactagtcccgttcaccttccagccagggcaggagtggcggttagaccaggccgcactgcgcgcggcgattactgagaaaaccacagccattcttctcatgtcgccgtcgatgccgagcgggggctacttgactcgagacgactggaccctcgttgccgagatctgcgtgcagaatgacctgcttctcattctggatacggcaatggagcgtctgctgttcgatgcgcggccggtgattcaccctgccggtttccctgggatgttcgagcggacggtgacggtcggctcgtccgcgaaagagctgcgcatgatcggctggcgcgtcggctggatcgtgggacccgaggagctgatcagcgacattgccgcggtgtgcatggccaatgtcgtcgtgcccgtggggatcgcccaggaagccgtcgcggttgcgctggaccggtcgccccagactctggcgccgtatgtggcgcaactacaggcccgccgggatcgtgtcgtcgcggaactcgaaggactacccgttggcgtccctgcgggcggatggagcctgcttctccgggtgagcgatttcgggctggatgggagc

SEQ ID NO: 10163 - DNA, 828 bp, A.fumigatus
  unsure (621),(650),(672): Identity of nucleotide sequences at the above locations are unknown.
ggccatgaccttgagctcagtatcaaccatcctttcaaaagatcaatcgagaatcaagtttcaatctccagatattggctcgcatcgtccttattactctcagtcgcatactcaggtatttccacctactcaaatcatccagcagtcactaaacttcccagatcaccctcaacatgcacttcatctaccaggccctgtctgccctggcggcctctctcctcttctcatccgccaccgcagggatcgcgcactgcaaggtcggagaggcatggcccgattcctccgactgccacaacttctacgagtgcgcgtccgaaggcgcccccgtcctcaagacctgcggccccggtactgcctactgcccgacgacgggtgtttgtgtccacgaggaaaacgtccccagctgcttccacagaggtcatcactctgaggatgagtagttgtactttgatgcgcggggactggtatactgcaagatgtataatccatgcattggagactggactgcatgtgtttctgttttgggttttataccatgttttgatagagggagatagactggttcctgttattagaattgtttggatgttgaggctaatcatcgagaattcatgtcattcntaccaatatctcagcattgcatgcccctntaggtttcttcagttctgcttntacacaaatctcacgaacttgttgcgcagcaaccagaccaacatggatcacgttcatgagaacagaacaaccagctctattcaagaggatcaggcctatagcattagcggcgcaccacctcatagcagccaaattgcttcccttctggatcgctga

SEQ ID NO: 10164 - DNA, 966 bp, A.fumigatus
gtgatgatctatggttgtgtagtgatgtcactgacttcaatccaaatcacagagctgctccttgagagatggaagtctaaaagaaaacactatctcatcctgtctgctgctgggaagcccatttggaccagacatggtgatggcggactgatctcgggttacataggtgtcattctgacgattatatcgttttatgaagatgccaatgatcgtttgaccagtttttgcgccggggatacaaagtttgtgattgttaccaagggtccattatatttggtagccattagtcgactcttggagagcgatacgcagctgaaattacagctagaagccttgtacatgcagattttgtctaccctaacactgccttcgttgacacatctcttttctgttcgaccgtctaccgatctcaaaaggccgttgcaggggtccgagacgttactgtctactctggcagacagcttcacaaagggatcaccgtccactttcctttccgcattggaatgcttgaaaatccgcaagtcacatcgacaagcgatcaacaatgcgcttttaaaaacaaaggtgagcagcctactgtatggtctggtggttgccgggggtagattagttagtgttgtgagacccaagaaacattcgctgcatcctggtgacttacaacttctcttcaacatgatcttcgaagcagaaggcatcaaagctggaggtggggaaagctggatcccagtctgtttaccgggattcaacagcagcggttatctatatatgtatgtcagttttcttgatctccgcgaaaactcaggcacttctgccagcgagacgacgacaacagagcagtcggtggccatcatcctgataagcccgaataaggaagggtttttcgagatgcaggagatgcgaaattcacttgtcgaggtatgtaaatcgtcttcaccacggggctggaaggatcggcgggaaagcata

SEQ ID NO: 10165 - DNA, 276 bp, A.fumigatus
  unsure (169): Identity of nucleotide sequences at the above locations are unknown.
ccaaatgcatcacccggggcagaagaagtctcccggaatgccgggttttttgtttacctcactccttcggcggcattgggttcgattaccgcttgcaatggccatccccagacatgtacatcaaactccctgaaggaaaaatccgacaatgagtgggaaatgggtaatntagccttcaccttaaccaacagacgtcacggcgagaagacaatcgcctatgcagaaagccatgatcaagcgttagtcccctcccgagatctgcaatgtcgtccgtag

SEQ ID NO: 10166 - DNA, 201 bp, A.fumigatus
cgacggcgtagtgctcctcaccgacgatacgggggtcgagcatacgagacttggagtcgagagggtcgacagcagggtagatacccaactcagagataccacgggacaagacagtggtggcgtccaagtgagcgaaggtggtggcgggggcagggtcagtcagatcgtcagcgggcacgtagacggcctggacggaggtaa

SEQ ID NO: 10167 - DNA, 882 bp, A.fumigatus
tcaagcgttagtcccctcccgagatctgcaatgtcgtccgtagcaactaacttcttcagcctggtcggcgataaaacgctcatgatgtggctctgcgacaaggaaatgtacacccacatgtccgtactgaccgagttcacccccaccatcgaacgaggcatggccctgcacaagatgatccgactggtcacccacggtctgggaggagagggctacctcaacttcgaaggtaacgagttcggtcacccagaatggctcgactttccccgagccggaaacaacaattccttctggtatgcccgccgccaactcaacctcaccgaagaccatctcctccgctacaagttcctcaacgagttcgaccgcagcatgcagttgaccgaggagaagtacggctggctgcactctccacaagcctacgtgagcctcaagcacgagatcgacaaggtcctcgccttcgagcgcgcaggtctgctctggatcttcaacttccaccctacagaaagcttcaccgactaccgtgtcggcgtcgagcaagcaggtacctaccgcatcgtcctagacactgatgatccagaatttggcggcttcggtcgtaatctcaaggagacccgcttcttcaccaccgatatgccctggaacggccggagtaattacctgcaggtctatcttcctacccgaacagcgctggtatgtactccatccaccttccccttcgttggcgatttaagagctaacaagaagcttcaatgcaggtcttcgccctggaagaaacactgtagtcatcttaatggattcatgccacgtttgggtcgcggtcaatgcgagtcattacatattgatatcaaatatgttgcgctacctaataatttacctcaataa

SEQ ID NO: 10168 - DNA, 909 bp, A.fumigatus
  unsure (528): Identity of nucleotide sequences at the above locations are unknown.
atcatgttcaaacttaccctcaggaagatcatcaccttcaccgttgatgatggccttgaaactgcggatggtgtccttgaggtcgaccagcttaccctcgataccagtgaagacctgggcgacagtgaaaggctggctcaggaaacgctggagcttacgagcacgctcgacggtgagcttgtcagcttcagaaagttcgtccatacccaaaatggcaatgatatcctggagggacttgtactcctggagcatctgctggacacgggtagcgacggcgtagtgctcctcaccgacgatacgggggtcgagcatacgagacttggagtcgagagggtcgacagcagggtagatacccaactcagagataccacgggacaagacagtggtggcgtccaagtgagcgaaggtggtggcgggggcagggtcagtcagatcgtcagcgggcacgtagacggcctggacggaggtaatagaacccttcttggtggtggtgatacgctcctgcataccacccatgtcgacggccanggtgggctggtaaccgacggcagaggggatacgaccgagaagggcagacacctcagaaccggcctgggtgaaacggaaaatgttgtcaatgaagagcagcacgtcctgaccctcctcgtcacggaagtactcggcaatggtcagaccggtaagggcgacacgggcacgggcaccggggggctcgttcatctgtccgaacaccagtgcgaccttggattcaccctcgagctgaatgacaccagtctcctgcatttcgtggtacagatcgttaccctcacgagtacgccccccaacaccagtgaagacggagtaaccaccgtgggccttggcaatgttggttctacatggtttgcgttattgaaaagatcgagcgaaaactaa

SEQ ID NO: 10169 - DNA, 948 bp, A.fumigatus
  unsure (355): Identity of nucleotide sequences at the above locations are unknown.
cgcaaaccatgtagaaccaacattgccaaggcccacggtggttactccgtcttcactggtgttggggggcgtactcgtgagggtaacgatctgtaccacgaaatgcaggagactggtgtcattcagctcgagggtgaatccaaggtcgcactggtgttcggacagatgaacgagccccccggtgcccgtgcccgtgtcgcccttaccggtctgaccattgccgagtacttccgtgacgaggagggtcaggacgtgctgctcttcattgacaacattttccgtttcacccaggccggttctgaggtgtctgcccttctcggtcgtatcccctctgccgtcggttaccagcccaccntggccgtcgacatgggtggtatgcaggagcgtatcaccaccaccaagaagggttctattacctccgtccaggccgtctacgtgcccgctgacgatctgactgaccctgcccccgccaccaccttcgctcacttggacgccaccactgtcttgtcccgtggtatctctgagttgggtatctaccctgctgtcgaccctctcgactccaagtctcgtatgctcgacccccgtatcgtcggtgaggagcactacgccgtcgctacccgtgtccagcagatgctccaggagtacaagtccctccaggatatcattgccattttgggtatggacgaactttctgaagctgacaagctcaccgtcgagcgtgctcgtaagctccagcgtttcctgagccagcctttcactgtcgcccaggtcttcactggtatcgagggtaagctggtcgacctcaaggacaccatccgcagtttcaaggccatcatcaacggtgaaggtgatgatcttcctgagggtaagtttgaacatgatctatcgtctataattcgaaataaagtgctaatgacattttttagctgccttctacatggttggtga

SEQ ID NO: 10170 - DNA, 708 bp, A.fumigatus
tcatcaatagtttcccggagttccctttccagcatctgcactcgctgctgcagatcgctgctaccaggctttccagctttgagggctgcgagctcctccgcaagttcaaggtttctagtgttcaagtcatcaagttccttttggatagctggattggcggccacctctgctgctcgttgggctctgctaccgtacgcaccatcgagctccgctttggccattgtcagttccgtttgtaccctaactacttcgccttccatttcagtcagttcggcctgcagacggctcgcgctctgttctgcgtttgcgcgtccctcaactgcttctctcactcgcgactccatgtcgacgcgaagcttttccatagcgtcttgcagccgagagacctcgctgaccatttcactcaattcagcctgcagccgagtcgcactctcttctgcagcgacacgagaatcaaaggcttccttgatccgtgcgtcagcatcgttgcgaacctgctgcatcgtctgctccagctgcagtacttgttgttcggctcggtccccgggcctcgacagcttcctcagctctggtgttggcctcctgacgaagttgatcaaccaaattctgcaggcgtgtgacttcactatcagccttcaagcgagcggcagtgagttcctctgtttgagagacgctttcggatcgaagttgttcgagctgggattctag

SEQ ID NO: 10171 - DNA, 264 bp, A.fumigatus
agcttcgagttgcttgattgccaggtcgagttcatcctttgcactctgagccccctgctcagacagttcgaggtctttccggagatgagcgatctgctccaccagatcggctatgtgcgcatctcgttccgcgtccgatttggagttcagttctctctgttgctgaatttgagtggtcaagatgctcttctgttcgaggagcttctcgatctggctatgaaggtcatcaatgccaagattcaggtattcgaaatgtgcttgtag

SEQ ID NO: 10172 - DNA, 861 bp, A.fumigatus
actgcaaaatcagctgaaacaccgcgcacattggaatcgaatcacggtgcggagaaccatctagtggagatcaacgcccgactgcaccacatcgtggggcaatctggatcttctcgctcgcaggctctctctcctcccccagcgtcatccgggaatggcctacaagcacatttcgaatacctgaatcttggcattgatgaccttcatagccagatcgagaagctcctcgaacagaagagcatcttgaccactcaaattcagcaacagagagaactgaactccaaatcggacgcggaacgagatgcgcacatagccgatctggtggagcagatcgctcatctccggaaagacctcgaactgtctgagcagggggctcagagtgcaaaggatgaactcgacctggcaatcaagcaactcgaagctctacggcaggaactcaacgaccttcaacaacacaagagcgccgcggaagatcacgcgagtgctttggcatccgaaaaggaagctcgagtgcatgtggaggcagagctgtcgcgcttacagactgtcatccaggaacttaagcaggagagggacgcgcagatggaagctgatgaagcccgtgtgcgggctgagcgcgaggtcgctcgtctagaatcccagctcgaacaacttcgatccgaaagcgtctctcaaacagaggaactcactgccgctcgcttgaaggctgatagtgaagtcacacgcctgcagaatttggttgatcaacttcgtcaggaggccaacaccagagctgaggaagctgtcgaggcccggggaccgagccgaacaacaagtactgcagctggagcagacgatgcagcaggttcgcaacgatgctga

SEQ ID NO: 10173 - DNA, 975 bp, A.fumigatus
aggctgatagtgaagtcacacgcctgcagaatttggttgatcaacttcgtcaggaggccaacaccagagctgaggaagctgtcgaggcccggggaccgagccgaacaacaagtactgcagctggagcagacgatgcagcaggttcgcaacgatgctgacgcacggatcaaggaagcctttgattctcgtgtcgctgcagaagagagtgcgactcggctgcaggctgaattgagtgaaatggtcagcgaggtctctcggctgcaagacgctatggaaaagcttcgcgtcgacatggagtcgcgagtgagagaagcagttgagggacgcgcaaacgcagaacagagcgcgagccgtctgcaggccgaactgactgaaatggaaggcgaagtagttagggtacaaacggaactgacaatggccaaagcggagctcgatggtgcgtacggtagcagagcccaacgagcagcagaggtggccgccaatccagctatccaaaaggaacttgatgacttgaacactagaaaccttgaacttgcggaggagctcgcagccctcaaagctggaaagcctggtagcagcgatctgcagcagcgagtgcagatgctggaaagggaactccgggaaactattgatgattatgaggtcatgaccaaggccagcatcgagttcgagaaagagcgtgagcggtacgaaggcatgattgatggtctacgtgaccgctgcgagcaattggagacgcagctcaacgaggagcgaatcaattggatgggtatcaacaacgcaatgggacgagatgggacgtatgagaccacctctacaatggtcctgaagaatgaattcaaaaagatgatgcgtgacactcgtatcgagaacatgaagatcctcaaggttagttacaatgtcgtcgctttccgttcccattatgccaagctaagctatctgtgcaggcggaacaagaagaacgaaggcgactag

SEQ ID NO: 10174 - DNA, 1434 bp, A.fumigatus
  unsure (835): Identity of nucleotide sequences at the above locations are unknown.
ttgacaatcctaaggctaggaactatcaactccctccctccggacctgatctataaatccgccactcagaccgcgttagagcttgcaccgaatctgcgccaacagggcgcggatatcatcgttgccgtcacccaccaacgagaaccgaacgactataaactggcgcagaacctcccccctggcacgatagatctcatattaggaggccatgatcatttctacgggcatgcggtgatcaatgacacccatatcttgcggtccggcaccgacttcaaacagctaagttatatcgaggcgtggcgcaagaccgatgggccgggatgggacttcaacatcgtccgtcgcgatatagttcgcacgattcccgaagatcccgccaccgtagccctggttagccggttgacctcgagtcttaaggcgaagctggagaagccggtcggatacactgtccgaccgctcgatggtcgcttttccaccgttcgtcagaaagagtccaacctaggcaactttgtctgcgatctcatgcgattctactatgccgccgactgcgctatgatggctggtgggacgatccgcggtgaccagatctacccacccggtctgctacggctcaaggatttgttaaactgcttccccttccaagaaccggtggtattgctccgtatcaagggctccgcacttatggatgctctgaaaaacgggttgagccagcttcccgctctggaggaccgcttcccacaggtatcgaacatctctttagttacaacccgtccgaaccccctggctcgcgcctcactggggcaaggtagccggacacccgatcgcgttcgaacgnagctacgtcctcgcgacaaggggctacatggcccgcggaaaggacgggttcgcatcgcttcttgtgaagtctgccgaaggcgaggtggaagagattgtcgacgaagagaacggcgtgatgatcagcaccatcctccgccaatacttcctcagcctccggatcttgggcaagtggcagcgctggagcaaaagtctatcccggcactgggccaaagtccaccagaatctccactgcgagggctggctgaaacccgcctccgcgcaagcctcccccgtctccgaaaaggcgcccagccggcttttcgtgtcacgaccgagtctcaaacgcacaaagcactattactacggccggttcgccaatatcgaaggcaacgggactgcgggggtccgcgaagacgaggaggagggcacaagcatggactcggactcggattcggacccggagatcttgacctccccgcagccaaccaccaactacgtcaccctgcctgcccgctccgccgcggaagaagaacgtcgactgcggcttgcgcgccgggcggtccggaaatggatgcgggccgctggattcgagcccacaacactcaatacagccgatga

SEQ ID NO: 10175 - DNA, 249 bp, A.fumigatus
ccgtgtcccagagctggttccgctgaacctgttggcggtgtctccagattccaatctgtgatcaactactatcgttctcacccgcggtttaccggactccccgatgtcctcaccttcttctccggcgatgcctttaaccccagtcttgagagcacagtcaccaaagggcgacatatggtaccgttcctgaacaaagcagggacggatgtagcatgtgttggggtatgtgaacgttgcacgaagacttga

SEQ ID NO: 10176 - DNA, 750 bp, A.fumigatus
  unsure (75): Identity of nucleotide sequences at the above locations are unknown.
ttacaacccgtccgaaccccctggctcgcgcctcactggggcaaggtagccggacacccgatcgcgttcgaacgnagctacgtcctcgcgacaaggggctacatggcccgcggaaaggacgggttcgcatcgcttcttgtgaagtctgccgaaggcgaggtggaagagattgtcgacgaagagaacggcgtgatgatcagcaccatcctccgccaatacttcctcagcctccggatcttgggcaagtggcagcgctggagcaaaagtctatcccggcactgggccaaagtccaccagaatctccactgcgagggctggctgaaacccgcctccgcgcaagcctcccccgtctccgaaaaggcgcccagccggcttttcgtgtcacgaccgagtctcaaacgcacaaagcactattactacggccggttcgccaatatcgaaggcaacgggactgcgggggtccgcgaagacgaggaggagggcacaagcatggactcggactcggattcggacccggagatcttgacctccccgcagccaaccaccaactacgtcaccctgcctgcccgctccgccgcggaagaagaacgtcgactgcggcttgcgcgccgggcggtccggaaatggatgcgggccgctggattcgagcccacaacactcaatacagccgatgatgctcaggggttcacgccggcgtggacgcctggcattgcacccaggctggaggggcgcatcgttatcgagaagtag

SEQ ID NO: 10177 - DNA, 864 bp, A.fumigatus
cccaacattgctctcagctcatcttctgcaaggctggtccttgccattgagttcaaaggaccttttcccactacacaattagctaaagcctcaaccccttcgaacccaagcatcatggcacccatcctcacctccagcccgactctccgtatcacccccgaacccttcaccaaagaggccttcgcgcccttcggcaccgccatcagctgtcctcttccgcgcgatctctcctccgcgcctcctctctcctcgctccctcctcatgatcccgctccagtcattgccaaccaatcctccgccctcaagtacagccccatctccccgctgctcgaccactacgcgcaatgtcccagcactcagccctcttccgcccgcatgagcatgttctcgtgctttccacgcaaactgcgcaccgccaaagcaacaggaggggagactaatgtcttcgacgtccgcatcctggagcgacaccccttcaccacgcagacattcacaccgctcgacctatccaaccaaccccgcgcaggcgatgcagaggaaccattctacctggtcatcgtggcgcccacgttgaagggccagacggcaacggcgactacgccttcgggagatactgtggcgatcagggatccgcccgacttgaacaatatgcgggcatttgtggcgcggggcgggcaggcggtgacgtatggggttgggacgtggcatgcgccgatggtggtgctgggtcctaggcgggtggattttgtggttgtgcagttcgtcaatggagtggatgatgaggatgtgcaggaggctgcgtttggggaggggattgtggttgatttggggaggagtcggacgtcgggggcttccaagctctga

SEQ ID NO: 10178 - DNA, 720 bp, A.fumigatus
ggaaggcacccaacagtcaagcttgggcttgaggagcaagggcgacagtttgtcagtaacgactgtttcctgggcgattcggagaggatctggctcatcactggtccgaacatggctggtaaaagcacgttcttgcgccaaaatgcgctcatcaccattctggcgcaggttggatcatttgtgcccgcggagtatgcggagatcggcattgtagatcagatatttagtcggattggggcggccgacgatttatttcgagaccagtccactttcatggtggagatgctggagacggccaccatattgaagcaggcgacagcgcgctcctttgttatcatggatgaggttggccgcgggacaacgccagaagacggaacagccgtcagttttgcctgtctgcaccatctgcactaccgcaacaagtgccggacgttgttcgcaacccatttccatgctttagcggacatgacggatgactttgaggcactggggcgatactgtaccgatgtgaaagagagcgcatcggggtcgttctcatttgtccatcgactgcgcaagggagtgaaccgtaactcccatgcgctgaaagtcgcccagctcgcaggcctgccgaaggagaccctagagatggccagtcgagtgcgagagtcgttgggtaaccgcgctccatggtcatcaggcggcagcgatagccatcctatcgtgtcagctaccgtgtag

SEQ ID NO: 10179 - DNA, 816 bp, A.fumigatus
  unsure (704),(736),(811): Identity of nucleotide sequences at the above locations are unknown.
agaaagaaagaagaattcagcttccagtacgtacccttgagactggtatctcactctcctttgtcgtctaacacaattgctaaggactaccactcgctctatcggtggtcgacggacaatcgtgcatctttttgggacttttgctggaggtactttcccatcatctcagaaggtacttacagaactgtggtcgatgaatcagcacgcattgacagtgtccccacctggtttgagggtgtgcgactcaactttgccgagaatatgttgttttcggcggagagatcaagctcggggcatatccagattacaacgaaaggcaaggaggacaataaaattgctctgacagaaatcagggagggtggggcggaagcacctcgccacattacatgggccgagttgagacgcaagacagggcgaatggtgcaagccctcaaagcagccggggtcgtcaagggagatcgagtcgccgctgtagcaagtaacagcgtcgatacactggtcgtcctcctggcaacaacggctctcggagcgtggttctcgtcaacgtccactgacacgggcgtcaaagggatcctcgatcgtctgctccagttgaagccaaagtacgtctatgttgacgattttgcaatctacaatgggaaacggattgaccttcgaacaaaaattcaggacatcgccgatgggctccgggaagtttccgaatntgaaagcatcattgcgtttgcacggttcccanggcaaccagttgatgttgaccacgtgcccaaaacccacctgttgaagcccttctggcaagggcacctttgccaancctga

SEQ ID NO: 10180 - DNA, 963 bp, A.fumigatus
cacgcatatccttccactccgggctgtcgattcctctcgttcatcagaactgatattggcaccgcctatatcaagtcgcttctggatggcgatttcgaagctgagaatatgacattcttggagctcctactggcattctcgactctgaaacagagagagattttgactcagccattgaaccctcaatacagtcaggttcttaccttaattcacgccctgttgaaagcccccggttatgctgcagtggatgacttggcatcgccgcttgccatcgagtggtggactgaagtcgccgatgatttccaggagattatcgctgattcagataatcattttaactttgagcctgcgaagcaaaatctcgcccgtgctgctctggactgcttcgagaagctcaagtatccgactccagaggagctgcaagagtggagagatgatgatcgcagtgaattcagttcgtttcgtcgtgacgcttgcgactttattctagccgtatatcccattctgggtgtggatctagttcgagtgtttcaagaacgcacaaggacttctctcgcagaacagaattggagaacgtttgaggccgcagtcttctgtattgctcagctttcagaggccgtggatgacaaccagcatgcggatgattgtttgaacgcaatcttcttttgcgacgagtttgctcatctctgcaggggtgaaggaatatcgatctcagacaaagctcgccaaacgctggtggatatgctaggacgataccagtcttacttcgagcgtacccatgctttactcccactggcgcgtatccctctgtttgcatctcttgacgtcgcatcctgtgcgccaattggtttccaagtctatttcttcattttgcagttcgtccgtaaatgctttgacttttcagctcccagcatcctggatcaattcgatcatttcgtcacaaagcgacgccaccagtcatga

SEQ ID NO: 10181 - DNA, 1287 bp, A.fumigatus
cttttcagctcccagcatcctggatcaattcgatcatttcgtcacaaagcgacgccaccagtcatgacgatggagaaagtcctggagggtatcgctgccatcattcaagcgttgcctacagatgagggtaaagcacaggttcttgagaggatcttagattatctccgtcaacaggccatagtggcaagggatgaggccgcgcgtgacttgtctgatgccgcgtatagccgctctctgttagtgttacgctgcatcgcaagtattggtaaaggtctcaggacagaaaccgaaatcgttttggagtctagcgacagcagcaatggcgactcccactcacttaccttttggaattccggtcgaggagctaatgctcagagtttgattattcaatccatgcagctcctaatgaccgaagttcccagggatgcgagcacgattgaggctgcctgtgatatactgaaggctggcttcactgagaaagcaggtccatatgtcttcccgccgatggtgactgtcagtttcgtcaaaagcattcctttgggcagcgcgggtacagatatggtcatgggtactgcctctgcgtttctagcgtctcacagtgcacacccagagcatatccgagaggagaccgtcgctttgattgtccacgtgtacgaaagcatatgccagatgcaggagatgccaggatttttcgaccccgaagttgcaaacagtggcattgatttcctcactcgcctagtcccgaagtactattccgtcctcttcgcgcttacttctgcgccgccaccctccggcgaaagtggcacatcgcggcgttctgtgctgcagacgattctagactttactctacagtctttgcaaggtccagaaccacttcctctccgctctgcctcgcagttctgggtgagcgtgttgagcttgacgaccgatcccagtgaggcagaccccgtccaggttgtcatcaacgagtatctgccgtcgctttgtcgcgttctgatcctccagcttgcgggccgctgcgctcgctcggatatcgagcacctctgcgatgttctcagaaaagttatcttcagacaccaaggccaagctcgcctccatctttcagcggctctttcctcagtggatatcgacgtctcccacgaagggcaaggccatgtttctccccaggagaaagagcggttggtttcgtcactcatagccgctagaggtctcagagcgcacacgaaccagcttgcacgtggcttttggatcaaatgtcgtggagcaggctttgactacattggataa

SEQ ID NO: 10182 - DNA, 498 bp, A.fumigatus
tgtggtccaactccggcttttaggaagaaatcaaaccaatcgtactcgggcccaactgatgcaccggcgcgattggcctcggatttcggctccgatttctgggctcggcggcgaatatcagacagaggcttgtcttcgtccaaagaaacgccagtaagcttttccacatattcgaggtcctcaatagacatcttgggaatggggacagcaatcttgactccgttggtcttatggaggtggatcttcccatcttgcaagccgataaattgcgcttcgaccgtgaaagacttggtacgatccgtccacagccttgtcttggtaggatccggttctgtaatctcgtttagatgcggatttcaaagtattatggggttaggcaaagcgggggaaaggacatactcggcctactggcgctcttgctgtcacgttttttgtgctgctcgagattgtcagtattctctcttaccagggtcactgtcgtttgatagggcagcttaa

SEQ ID NO: 10183 - DNA, 768 bp, A.fumigatus
agttatggggcaagagggaagaagatgccaacgacattgggcattaacatcgcgactggaacgatctttatctcaccagaaggggacggcgacatgcaaggatggactgcagatagactcacccattactctattgaaggcaagcatgtcttcctcgatctggttcggcccagcaaaagcattgattttcatgctggagccaaggacaccgctcgagagattgtttccgcgctgggtgaaatttatggggcctaccgtgccgagggcctgaaggaagtcattgcagccggcgcaggaggcggcggcaagaagaagggtcaaattttgtatgatttcatggcgcagggagatgacgaggttactgtggctgccggcgatgaggttgtcattctggacgacaccaaatccgaggaatggtggatggtgcgacgcatgaagaatggcagagagggtgtggtaccaagcagctacatcgagatcacgggctttgtttccagtcaacccactggcgtcgagtcgggcctatccacggtagaaaggaatcgacttgaagagacacgcctggccaaggaggcgatgcggaaatcgaggactgactcgatagattcgcggacctctgaggtaagctgtaccgttaagctgccctatcaaacgacagtgaccctggtaagagagaatactgacaatctcgagcagcacaaaaaacgtgacagcaagagcgccagtaggccgagtatgtcctttcccccgctttgcctaaccccataa

SEQ ID NO: 10184 - DNA, 504 bp, A.fumigatus
agcaacctaaacagcccgcgtcttcggcgccgccctcttcatcgccaccaccggccacagcaccccctggctacaacccaagctccagtgcaaaaacaacttactggggcaatggctgacctatccctactgcaagcacctctgcagccaactcccgcacaaccggcgcccgcacctacatctcaggcctctcaagctgcgtcatcccccgctgctatccagccacagccgactgcagtgcctgctccccagatgcagccccaacagacaggtgccactcctggctttttcacacaagtggcacaaatagcacagcagcccatgcaaacggggccccagacattcagcccccaacagacaggctttcagcaggcatcgaggcagcgcccacaaccccctcagaatatggctcagagctcgctcctcccgccgcctccacagaggccgctttctgcgccacagaagtcttcaccacggggctggaaggtacgagggtgctcaggt

SEQ ID NO: 10185 - DNA, 972 bp, A.fumigatus
gctcctgcgatcagccatgcaaaggcactgtacgactatacacgccagaccgacgaagaagtctcattctccgaggacgcggaactggtggtgtacgatacttccgatccagattggacattagttggtgtcaatggcgattttggtttcgcccctgcaaactacatcgaggttcaggagggtgatacttccaccgcccggccttctctcccttctcctgctgctgtcgagccgtccgctccggcccttccgcaacgcccggtcgaggtaccgacacaggaaccggtcgcgcccgcatctactagctctccgattgacacgatacagaacccagcggcagcagcaatagcggatatcattcataaacagcacgcatcacccgtagaatccgaaccctccagggatatcccgccgccacaaacccaacgaccgtctcagcgaccagaagacagctatcagagggagccctcgccgccgcctccaacgttaccgcagcgacctccgtcgcaacagatctctcctccagtggaccggtactctccgccagaaccctctcctcctctacgccctcagcatgccacggtgagggagcacgatggccagggccatgtgcgggagtctccgccatataatcgaatcggacagtcgacacctcgttccccttccggctatcatctgtacaatatcaatgaaatggttgaagttatggggcaagagggaagaagatgccaacgacattgggcattaacatcgcgactggaacgatctttatctcaccagaaggggacggcgacatgcaaggatggactgcagatagactcacccattactctattgaaggcaagcatgtcttcctcgatctggttcggcccagcaaaagcattgattttcatgctggagccaaggacaccgctcgagagattgtttccgcgctgggtgaaatttatggggcctaccgtgccgagggcctga

SEQ ID NO: 10186 - DNA, 921 bp, A.fumigatus
aatccgcatctaaacgagattacagaaccggatcctaccaagacaaggctgtggacggatcgtaccaagtctttcacggtcgaagcgcaatttatcggcttgcaagatgggaagatccacctccataagaccaacggagtcaagattgctgtccccattcccaagatgtctattgaggacctcgaatatgtggaaaagcttactggcgtttctttggacgaagacaagcctctgtctgatattcgccgccgagcccagaaatcggagccgaaatccgaggccaatcgcgccggtgcatcagttgggcccgagtacgattggtttgatttcttcctaaaagccggagttggaccacatcaatgcgagcggtatgcccagaactttatcaaggactccatggatgaagcgattctaccggacattacctctgagaacctgcgtacccttggattgaaggagggtgacattctacgggttatgcggcatctggacaatatgttcggcagaactgggtccaagtccaagctgcgcaatgtcagcttcggtggagaagaggtcatcagcaatggggaagctggctctcctggcggtcttttctccggccctggaggggttctacgcaacaacacccgcaagggcaggccggcacccgcagtccagaccggtgatgtcgttgatccgaaggccttcgaacagaaggaggatgcacccaacccgcaggaacgcacgggaactccacccgcttctgctgcagttgagaaaccggtacaacgtggcttcgatgacgatgcttgggaggtgaagcaacctaaacagcccgcgtcttcggcgccgccctcttcatcgccaccaccggccacagcaccccctggctacaacccaagctccagtgcaaaaacaacttactggggcaatggctga

SEQ ID NO: 10187 - DNA, 807 bp, A.fumigatus
tttctatcatccgtcctctttgcaagacgcattgctgatctcgacaggtatgtttcttgtattttctcagacccattcgatggtccgaccgagccatcagctgtgctgcactgcgttcaagaactgctagatatgggctgctacgaagtcagcctaggcgacacacttggggtcggcaacccaggcaaagtccgcagcctgctccactacctagccgaccaccatatcccacttgacaaaatggcgggtcacttccacgatacctatggccaggcggtggcaaatgtctgggaagcgtacaactgcggcgtgcgcgtgttcgacagcagtgtgggtggtctgggcggatgcccctatgcgccaggggccaaagggaacgtcgccacggaggatctggtgtacatgtttgaaacagcgggcatcaacacgggcgttgacctgcggaagctggttgagacgggagtatggatatctagacggttgtccaagactaatgccagccgtgctgggaccgcgctggcggcgaagtatggccttgttcccttcaaacggtcgtcatcgtcccgaacaaccaccaagaaccagatattctggactgtggtgaaagatcccaacggttcgttagcctaccgctccggcgtgaacgtcaagcccatcatcgaccgactgaaaaggcgcaacgtatttacctcctctggctcgtcgaagacaccccggccgacccctccgtcttctgactcttcatcacaggaacgggaaggttcttttctacaggcatggatttcaacaagaactgtacacctgtag

SEQ ID NO: 10188 - DNA, 285 bp, A.fumigatus
agcgcggtaccttccagccctggcgtgaagacccgcgatgtactggggaatgagtccatcagacagctgcaaggaacaccggacctccggctgcctgtccttgtaccgaacgtaaaaggactggatattgcgatcgagcatggcgccaaggaggtcgcggtgtttgtgagtgcgacggagggtttcagtaaagccaatatcaactgcacggtgcaacagggactagagcgagcaaaagctgtagcgaagaaagcgactgagtgtgggattaccgtccgagggtag

SEQ ID NO: 10189 - DNA, 555 bp, A.fumigatus
actgactcgatactcgatgttagtttgcaaacttccattcccgatatctatgccattggcgaatgtgctagttgggagaatcagacgttcggaataatagcacctgggattgagatggccgacgtgctttccttcaacctgacaaatcccgataaggagccaaagagcttcaagcgacccgatctgagcacaaagctcaagctccttggtgttgacgttgccagctttggtgacttctttgccgacagagatgggcctaaattccttccggggcaacggccatcgattgtcgatggctctgtggggaacgctgatggtgacaaagagccaagtgtcaaggcattgacatacaaggaccccttcgccggaatctacaagaagtacttgttcactatggatgggaagtacttgcttggaggtatgatgattggcgacaccaaggactacgtgaagttgaaccagatggtcaagagccaaaagcctctcgaagtacctcccagtcagtttattcttggagcgcagaaggaaggcgaagagaatgccgatgacttgtaa

SEQ ID NO: 10190 - DNA, 183 bp, A.fumigatus
ccaccggtactatcaaatagtgagaaaatcgtcaaacaagatgcagagagacgcaagtacgacattgttgtgattggggaggagcctcacattgcctataatcgcgtcggtctctcctcgttttttgaacatcgcaagatcgaggatttgtacctcaatcccaaggaatgggtaagtacttga

SEQ ID NO: 10191 - DNA, 315 bp, A.fumigatus
gacttcgtcacgatgccgttgattgataactcaagaagcaacgatgctgtccagagcagtatctgcaacggtatatcccatacgacaatcatcgagtctgtcagagacccagattatcgtcacaatgacccgaaccgacggcagaagattgtaatcgtcgggttgggcatggttgcgatctcattcatgtatgttgccagcttggtggataaggaccgatctcgagaggggttgtctactaaccaccggtactatcaaatagtgagaaaatcgtcaaacaagatgcagagagacgcaagtacgacattgttgtga

SEQ ID NO: 10192 - DNA, 555 bp, A.fumigatus
tacgggtcattcaaggaccggtcattcgattatcacctcaacaccaaggtcactgacattttccctgaacgcaagaccgtcaggacgtcaactggcgacgttatcccctatgatattctagtcctcgctacaggctcagatgcagtactccccacacacactcctggctataatgccaagggtatcttcgtttacagaacaattcaagacctggaacgtctcatcgagttcgcttcgaaacacaagggcgagaccgcggtcactgtaggaggaggcttgctcggcttggaagcagccaaagcaatgacagatctcgaggatttcggaagagtcaaactcattgaccgcaacaagtgggttctggcacgacagctcgacggcgatgccggcacactcgtaactcggaagatcagagagctaggcctggacgtattacacgagaagcgggtcgcaaagatcaaaacggatgacgacaacaacgtcacaggcatcacctttgaagatggggaagagattgactgctgctgcatctgttttgctgtaagtcgctcttga

SEQ ID NO: 10193 - DNA, 297 bp, A.fumigatus
  unsure (34): Identity of nucleotide sequences at the above locations are unknown.
cttgtaagttttgggctggcatgctggacaggantaggcactgacacaaacattaatagagacgacgacgctcagatctgctcgtgccacaatgtcacaaagggggacatcgttgagaacgtcaagagtggtacatgcaagactattggcgagattaaatcgtgcacgaaagccgggagtggttgtgggggctgtatgcccttggtgcagtcgatcttcaacaaggccatgcgggacatgggccaagaagtatccaaccatcgtaagtcttcaccaccgggctggaaggtaacgcgc

SEQ ID NO: 10194 - DNA, 201 bp, A.fumigatus
tccctcgcatctctcgagcccagacattcgatgccctcaggtgagttaccacggggcttacgagcaggctggatcaagaaaatggccagtgctaacggtgaggcaagctctatggccaatattgccgggtacaaggctgttttagaagcatcgaaccactttggccgtttcttgaccggtcaagttaccgctgctgggtaa

SEQ ID NO: 10195 - DNA, 522 bp, A.fumigatus
gttggagctcaaccctctccagatgtcagtaaactcatgctgaccatttcagggtatacggatttcccgtcacgcctaccgacgcaagcatccaccctatattcaaacaatatcgccaagttccttctatccatggcaccgcaagagaaatcctttggtattgacctgtcggacgaggttgtgcgcggctctatcgttaccctcaacggcgcgatactgcccccagctccacgaccagcaccaccgccaccaaagccggcagctgcggcgactccagccaaagaacaagccgagttatcactcacaccctggcagaaggctactcgcgatgttgcaactgttacagctggtatggggactgcacttgctctgggaaaagccactggtcccatattcatgagcaacatgatgacctttgggcttgctggtctcgtcggctatcgggctgtatggggtgttgctcctgctctccattctcctttgatgagtgtgacgaatgcaatctcaggtgagcaggcatga

SEQ ID NO: 10196 - DNA, 186 bp, A.fumigatus
agcacttaccgtcctctaggcccgactgacccgcccgaatatccatggctttacgccatacccgctgttatcttcagtggcggattcatagcagcagctagtactggaatggctggcttagtgagcgctggctatctcgttagcactcttctctgcatcagtaagtggaactgtggcatactttga

SEQ ID NO: 10197 - DNA, 267 bp, A.fumigatus
tcggttagttatgcctgtgtcgccggactcgtttatggtcactacatgattttggctcacaattttacaggagcattaattgggcgccgcattaccccaactagcttacctcagactgtggcggcccttcattcagtcgtcggtgtggctgctgtcctcacgagtattgaaagcgtgatggccgatattggtgacatttcaaccttgcatatggtgactgcgtatcttggtgttctcattggtattagctcagattcaggtgcttga

SEQ ID NO: 10198 - DNA, 267 bp, A.fumigatus
gcccgccgcttaggcgccattgtccgtggctttgatacgcgttctgctgcccgtgagcaggttcaatctctaggtgccgaattcatcgaggtcgacattcaggaagaaggcgctggtcagggcggatacgcgaaggaaatgtccaaggaattctatgacgcagaaatgaagctcttcatggaacaagcccgtgacgttgatatcattatcactacagcgctgattccaggcaaggcggcaccaaaactcattaccaaggaggtctga

SEQ ID NO: 10199 - DNA, 222 bp, A.fumigatus
catcctcacgcatggactctaggcatggtcggaatcggtggtcttttcatcatgggtggaggctatacgcctagcacgatccctgaggctctcggagcggtttctgtcttgttggcatcgatgaacgtcgccggcggctttgttattaccaagcgcatgctagacatgttcaagcgtcagtctttcaccccgattgaagatgaagcacttaccgtcctctag

SEQ ID NO: 10200 - DNA, 186 bp, A.fumigatus
cattatgtagctgtcgttatcactgttctcaatgcatattcgggattcgccctggtcgccgagggatttatgcttaacaatccactactcacgagcgttggatcattgattggggtcagcggatctattttgtcgtacatcatggttcgtgtctttatgtgcctattcgcggatcatgctgactga

SEQ ID NO: 10201 - DNA, 465 bp, A.fumigatus
agaccaggtacatctgccccgtcagatgtacctgttgtcccgtactcctcgctgactgttggcgtccccagcgagacatggcccaacgagcgtcgcgtggctctcacaccgcagaatgtgacgttgctactgaagaaaggcttctcgcgcgtactagtcgagcgcggtgccggcgaacaagcccagatccatgaccaggcctacgaacaagtcggagctaccctggtcgaccgagctgctgtatggtccgaaagtaatatcgtcctgaaagtccgtagtccgcgacaggagggccccatagatgaagtcgaagccctccgacagggaagcaccctgatttcgttcttgtatcctgcccagaataagcttttggtagaggctattgcgtcacgcggagtcacggccttcgccatggatatgatccctcgcatctctcgagcccagacattcgatgccctcaggtga

SEQ ID NO: 10202 - DNA, 312 bp, A.fumigatus
cgctggacaggtggggttacctttactggttctattgtagctttcctgaagcttgcgggtcgcatgtcgtcaaaacctacgattcttccaggccgccatgttattaattcgacgttgcttgggacaaacatggcgacaatgggagcttttgtatcaatgggccctgcgtctccgctcattgctgctacttgcttgggtgcaaataccatgttaagtttcctgaaaggctatacgaccactgctgctattggaggagctgatatgcgtatgtccctgcgcctcacactggagaaggtcactaacattatgtag

SEQ ID NO: 10203 - DNA, 429 bp, A.fumigatus
ccgacgagaccagcaagcccaaaggtcatcatgttgctcatgaatatgggaccagtggcttttcccagagcaagtgcagtccccataccagctgtaacagttgcaacatcgcgagtagccttctgccagggtgtgagtgataactcggcttgttctttggctggagtcgccgcagctgccggctttggtggcggtggtgctggtcgtggagctgggggcagtatcgcgccgttgagggtaacgatagagccgcgcacaacctcgtccgacaggtcaataccaaaggatttctcttgcggtgccatggatagaaggaacttggcgatattgtttgaatatagggtggatgcttgcgtcggtaggcgtgacgggaaatccgtataccctgaaatggtcagcatgagtttactgacatctggagagggttga

SEQ ID NO: 10204 - DNA, 234 bp, A.fumigatus
cgcaatagcctctaccaaaagcttattctgggcaggatacaagaacgaaatcagggtgcttccctgtcggagggcttcgacttcatctatggggccctcctgtcgcggactacggactttcaggacgatattactttcggaccatacagcagctcggtcgaccagggtagctccgacttgttcgtaggcctggtcatggatctgggcttgttcgccggcaccgcgctcgactag

SEQ ID NO: 10205 - DNA, 1743 bp, A.fumigatus
aaattgataggcctcctctctgctgttctcctgcaaatctacatcatatggtccttgtcactccagggggagcgcctacaagtaccttcgacgcggcgttttgcaagataccactcttctctacaagtccatattgcctgtcttcagtctgggagtttcctgtctttgattgaaatggatccaggacatccgccaactaatggaaacggatgcttccaggacgcctcggtgtcctcctaccaggctgagaggacgatcaacataagcgcgttgtcccatgaagcaatctgtgaccgaatccgtcaatcactagtggaagtaagcagcggcctcgtcgcggacaaaatccatttcacctccacctgtggccagcacgtgtccgctgtgcgcagtcgagtagaggatgcattgattgacgcactcgcaagcccgtaccgatgggcggttcgtccatattgggtccaagatcacgagccaggactcatcttgttgtccactcgccaatataacacgtacgagtcatccttcaacggccttctccgcgcggtatcggacatggagaacttagtacctactgcggacacgttgtaccgactcgcaaacgagctcgacaatcggtcgcttcgcagtattctgcccgaaaaagcaaggatcctggagaaaaagctgatgtccatctcccacagcaacagccttttgctggccactctcgctgcggagatcttgacgtaccaaggcataccaacgttgccgatgaaagcgatcatgcaactgcaacaacgcgcgggcagttcggtcgacctcaatgggtaccccaggcatgccgctgcgaccttcgaaaagcgcatcaaggtggatgactacaatttcttcgagctagtccaccccgcttacttccgccaaaccgtggctctggcgcaactggtgaccaaatttatcaagaatccttgtcctcgggccgttgatgtcggccccggtccaggtaccaaccttctcgcattcctcgaactcctcccccagacgaaagttctggccgtcgagcccagcgatattgcattccagtaccttattgatcatttcaaaggccaatcgaacattacatgcgtccaaaaagacttcctgtgtgtgccggtggaattggacgaagtcgattatatcatgtcaacggggtcgtcccatcacttttacacggacggattccttcagcgcagtgcacagtggctccgacggggaagctattggttcattgcagacgagatgatatcgccatttgaaacccggagagaacgacatctcaatcttctacgccaccatcttgcgtacatggttcccctgtgttttccgtggcctgcgggggatgtcgatccccgaacacgcgcggagcgagaattcgtggacgatttcaacaataccgtcccgctggccaagttccttgcggatactggcagagtggacgccgcggaaagtctctgtcgtgaactgctgtcccgcgcggagcgacatggattcacaaccaaggtttccgacccacaccttgcgttctggcgactgcagtggctcgagttgcaagctctcgtagccgggctcgattacgaagtggagcaaaaaacgtatccgtggcacttcatcaagatggcggagggtgcggggctcaaatgtgttgctcatcagcgagtctatggcactgtgggattaaccgatgactgtgctggaacacatgttatggctttccagaaggcatga

SEQ ID NO: 10206 - DNA, 723 bp, A.fumigatus
gtgaagagttccgcgcataagttcatcgaagcaaaagccacgttcccccatgtggtcgacgacgctcagatcatctcctacctgatgatcaacatgattgccggcgcggacaccaccgccatcaccctcaacgcggcgctgtactttgcgctcaagaaccccgccgtgtggaaacgactgcaggaggagactgcatcgctccattgcgagggatcacccatcgtaccattcaaaacggcgcaggacctgccctacctcaacgcggtcatccgcgaggccatgcgcatgcaccccggcgtcgccatgtgtctggagcgctacgtgccggacgaaggcctcacccttcccggcggccagttcatccccggaggatgcatcgtcggcatgaacccctacgtgctcgcccgcaaccagtcggtctggggcgaggacgccgacgtcttccggcccgagcgctggcttcgcgaccccacccgcgagaccgaggaggcgtaccaggagcgtctcaagcggatgaacgcggcggatctgacctttggtgcggggagccgggtgtgcattggacggaacttggggatgatggaggtgtacaaggtcgtggccatgctggtctcgaggtatgagattgagttagtggacccgaaaggggaatggaagacgcataatagcttttttgttcgtcaggaggggattgaagtgcggcttcgccggcggagcacttag

SEQ ID NO: 10207 - DNA, 603 bp, A.fumigatus
gttcatcgaagcaaaagccacgttcccccatgtggtcgacgacgctcagatcatctcctacctgatgatcaacatgattgccggcgcggacaccaccgccatcaccctcaacgcggcgctgtactttgcgctcaagaaccccgccgtgtggaaacgactgcaggaggagactgcatcgctccattgcgagggatcacccatcgtaccattcaaaacggcgcaggacctgccctacctcaacgcggtcatccgcgaggccatgcgcatgcaccccggcgtcgccatgtgtctggagcgctacgtgccggacgaaggcctcacccttcccggcggccagttcatccccggaggatgcatcgtcggcatgaacccctacgtgctcgcccgcaaccagtcggtctggggcgaggacgccgacgtcttccggcccgagcgctggcttcgcgaccccacccgcgagaccgaggaggcgtaccaggagcgtctcaagcggatgaacgcggcggatctgacctttggtgcggggagccgggtgtgcattggacggaacttggggatgatggaggtgtacaaggtcgtggccatgctggtctcgaggtatga

SEQ ID NO: 10208 - DNA, 186 bp, A.fumigatus
caggccgctggccttctcgttgatttcctgctccatgtactagctatcttgttcgcaaccactttttttctcttcggcgcctcttcttctcaatctccttctaatatctcccgctctgctgatactcctctctacgaaacgtcctcggacccccgtcaaagcgaaacctcctcgccagtccgctag

SEQ ID NO: 10209 - DNA, 273 bp, A.fumigatus
atggatccagattataaagctcgcaaagaggcctttgtctcaggtcttgcaggaggaagcatcctggaaatcaacgccgtcaccttggttgcttcggttcgtgttactatcttattgtggctacttcgcctacattgtttctcgactaaccgagtctctttgcgatcaatcaggtatccgtttttctgtggtcaattctacaatctcgcctatcctttttcacaacctaacaggccgctggccttctcgttgatttcctgctccatgtactag

SEQ ID NO: 10210 - DNA, 1173 bp, A.fumigatus
  unsure (848): Identity of nucleotide sequences at the above locations are unknown.
ctatcttgttcgcaaccactttttttctcttcggcgcctcttcttctcaatctccttctaatatctcccgctctgctgatactcctctctacgaaacgtcctcggacccccgtcaaagcgaaacctcctcgccagtccgctagagctgggaaagatgactcgaaacatgcgacagccttgccagagtctctacccattcatccatttctcacgacatatcgcgccgccatgatggttatcacgtgcatcgctatcttggctgtggattttcgcatttttcctcgccgattcgccaaggtagaaaactggggtacatcactcatggatctgggcgttggatcgtttgtcttttcgggcggagtagtatccgctcgctcactactcaagagcaggaccaatggctctaaaaggttgcctcttgccaagaggttgattgcgtcgacgcgacactctattcctctgctcgtcctcggcctgattcggctatacagcgtcaaaggcttggactatgcggagcacgtcaccgagtacggcgtacattggaacttcttctttacattgggtcttttgcctccgttcgtggaggtcttcgacgccttggctacgatcattccgtcatacgaggttctctccgtggggatcgccgtcttgtatcaagttgccctagagtcaacagacttgaaaagctacatcctcgtctcccctcgtgggccaagcttactgtccaagaatcgtgaaggcgtcttctccttctcaggttatctcgcgatttttcttgctggtcgtgcgatcggcattcggataatccctcgcggaacttctttctcaagaagcccagaacaggccangagacgggtcctgatcagccttggcgtgcaagcgttagtgtggaccactctttttgtgttgaactccacttatgcgatgggatacggagctaatatccctgtctcccgccgcctcgctaacatgccctatgtcctttgggtttcggcgttcaacaccgcgcaactgtttgtgttctgcctgatcgaaacactctgctttcttgcagttcatccgacaacgactcaagagagcgaatctgagcgagtcgattttgctacgacccgaatcttgtcggccttcaataaaaacagtctcgcgatctttcttttggccaattctcctgaa

SEQ ID NO: 10211 - DNA, 1824 bp, A.fumigatus
agctcaatgatggatgattccattgcgtcttctgaccccacaatggaggaacatcatattgttaaggccgacgaggtcgatcaaacaggaaccgacatcacaactgtgtcagatgatcagttgatggaagaggtcgcacaaggcctgcgacaggagcaagcttccaaagcgacgtctgctgggccaaatgaatcgcaagagcaaagacccaacccatcgaggcgtccagaactgcgtcggaatgtatcagctcccccgcctcctttacagcctccgcctcctgccccggtgcagcaactgccggacagaccgccagactcgctgagtctggctcaattaaaacaaatagttcaggatatgcccaaggtcaatcaacctgcttatgcattcgagtacgctgactcccagcctcttgtggaagaaatcgaagaatggtttcagtacagcgagtttgatcggataatgctccttggcatgaagtctacatttgagcgaaaatgggcttctttctgtgagaatcagtctgcggtttccgatcggctaccttggcttgatgctcctcatgacttacgcaaatctttcatggagcagataataaacgggctaccggatcgagacatttcttctcgtaccgaagcattagaggttgtttgctatgcattgactggtatctggggtagtactgctggaaaagcagtccctgactacccagaagatctgcccccgcaggcagtcacagatacgcccaaatcaaaatcactgcaaatcatatggatgcagagaaatgccgagcttgtcaatgagtgttcaggacttggcccattgctcagttgcctgtgcaaagctcttgagaagaatcggagctcatacaatcccgaatcggacggcctggactcgcactcggattccgcaaatgttgctgcgtcagaacatgaggtgaaccttgtgcttacggctttatacatagtcgtagagattggccgaagacaagagaaacattctcaagatgtttccctgcgagatgcgctcatgggactgaagcctaacttgtcagtctttcttgtcgaagtcattgcgcgactgcggtgggatgattcagcaaacattccgctcacgcgaatcatcctccttttctggaagtgtcttctccttttctttgggggaagtgatagcttgaagaaagcaaaggaagagttggagccgcgaatggaagcacgggaaaactctcccaaccgaaggacaccgtttctgactgcttcccccctggattatcacctgttccggcaagagatcacatcaaaataccctgcttacaaccccccactgcctgtcgttcctctggagcttgaaaacaactctattctccctcctcttcctcagcatcctagccgcaccagttcatctaccggtctcttttccggagtaggtccctctgtggctggtggaaacggttctatcctccatcagtctgtccacatcgctacaccagcaccatcacctccaccatcacctataggacccggcggtaaagcgggcaagaagcagaattaccagacgaaccagaactttccttttatgtatcctcctttggatgactcgagcaatgatatcggcggaaaaggcagcgctgaacggcaagatgccctcgtgggaaagcggtgggaaggaagtgatgttccggcgtcaatcattgaagccggaaagctcttctccacccacgttaagatgactagagccatgcgccagctgtgggaagaaagggagcgtttcatgaaatatgaccgcggttggtatcttgacgagaactcacctagctcagactag

SEQ ID NO: 10212 - DNA, 1128 bp, A.fumigatus
tctattgaattctctgccggcgatggggacgatgatgaggttggagattccacaggtaatgctaacggtaccaacagcgcccttttgaagcctaaggatggatccagcggtaatagcctagaggggctgctcttggctcgcaacaagaagctgacagatgaacttaccgttcttcgtgtgtcccatcgtgacctccaagatcagcttgaacttctgcgtgaggacctctcaaataccaaagaggaactggagaaatccaagcagttatccacaacccttgagaatgatctgctccgtgtacagcaggaggcggcgaacgctttcccatcgtctgcaatgtctgttgctggtacctacagctcaaggtacccccactcaaccaggaggggagcagcgtcgcccacctcgtccataatttcgggttttgaccaggcggcaacctcttccaatgcaatggacgctatacgcgctggggagcctgtgggtggtggttcgggtctgctgcctatgatacaggctcagcgtgaccgcttcaagaagaagaatgcggagctggaagaggagctgtcgaagatgtacagcacggtcaagtccttgaggcaagaggttgcttccctccagaaggacaaccttagcctttacgagaaaacgcgatacgtctcaacgtacagccgtggcggagcctcttcgtcagcctccgcctatgcgaataaacccagcaattcctccgtccatgtctccgcggacacgccttctggcctttcattagaccggtatcagtctgcctacgaagctcggctatcaccatttgctgctttccgaggccgtgagtcggtgcgggcgtacaagcgcatgagcttgcccgaaaggatcgtgttttccatcacacgaatcatcttggctaatcgaacgagccgaaacctctttgcgggatattgctttgccctccatgtcttactgtttctagcattgtatatgatgagtaccatggaaatagaaaaacacagtagcgccagtctgggagctgctgccgctgctgcaatggctggtggaggcgggtctgggagtagcagtggccagctacatggtgatgattggcagcaggagggtttcaaccatgcagcttag

SEQ ID NO: 10213 - DNA, 942 bp, A.fumigatus
  unsure (2): Identity of nucleotide sequences at the above locations are unknown.
tntgcatttctacagctttactcctctctgtcggaagctcctgatccttacccactccttgaagcctcggtcgactcccttgtgctctccgagcaaaccgtccccaaattgacgtccgagagagaccaattgcaaagatctgtgagtcgtcttacaacccaattagaggatacggaaaagcgactacaggaggaacgagctgcgagaagaaatttggaggacagccaggaaacaaagatcaaagagatcgagtcgtcctggtccgccgtgctagcggaaaagtcgaacaactgggccgccaaggagaagagcttggaggagaaggttgaaaatcaagaccgcttgctgaaggaaatcaaggcaagttacgaagtatcccaaagactgggtcaggagaacgatggcagtgatgcctcccaacatggggcgactgctgcagagctagaattggtgtctgccgatttggaaaagacaaccttgcgactagccgaggtggaggcacgaaacgagcaactcaggcttgagctggctcaagccgtttcacattcgcaggctacacagccgacctcggttgaagacgatcccgcctatcttcgccttcagtcagaaaactcgtccctgttgcgcaaactggatgctgcgcgattcgatcgggagtccgaacgtcactcatgggagtcgaagctctcacaactggaaagacagagctcgaaggtggctgcggagagggacgagctgcggtcgcggttggaaaagaccgctgactatgaagatatccgccgcgagctggagatgatcaaggtaggatatttcctatggcaagacagccgtacttgcttgctgattcttcgtagtctattgaattctctgccggcgatggggacgatgatgaggttggagattccacaggtaatgctaacggtaccaacagcgcccttttga

SEQ ID NO: 10214 - DNA, 240 bp, A.fumigatus
gcaatccaacattctgagacaaattctgtattcaattttgactctttgttagtgaaagaagtttactaccctaagtataacaactcgagggttttctacgaagacttccgtacccccagtggtgggtatggtggtctgttctccatcacttttcactctgacgctgaagccattgcatttttcgatcatctcgaagttctcaaaggccctagccttggaacaaatttcacgctcaggtaa

SEQ ID NO: 10215 - DNA, 477 bp, A.fumigatus
aaagctggcgagagatttcttgcgctttttaccgaatttccgggaaacccattactcaaatctcctgatttgaagagaatatacgcacttgcacagaaatatgatttcgcagtggtggtggatgagacagtgggcaacttcttgaacattaatgtgcttccttatgcagacattgtcgtcagcagtctgacaaaggtcttcagtggagatagcaatgttatgggaggaagtgctgttatcaatccacatgggcgctattatcaggaactgcgagccactttcagccgtgactacgaggataatctttgggcggaagacgctgttttcctggagaggaatagccgtgactttgtgtctcgaattgaaaagataaacaaaaccaccgaagacataacggccttgctaaaggagtccccagtcggtgagcaatccaacattctgagacaaattctgtattcaattttgactctttgttag

SEQ ID NO: 10216 - DNA, 264 bp, A.fumigatus
accagttcgccatatacgctactcgcacattacaatgagctcgactgggtaagtattgcgttgttcgccccaattcttcttctgtggctcgatgtttcgctcccttctcctggatcagagccccccgctcactgcccattgcaggctgcttcatttggtgttgagtcgaatttggtgagaataagcgtgggtttggaggatgtatcggatctccgcgaccaagtccagcgagccctcgcggcagcagctgaagcgaaggattaa

SEQ ID NO: 10217 - DNA, 1461 bp, A.fumigatus
ttgcactgctccttccagccccgtggtgaagaccaggatcctattggccgactgctgaatgctgcgcaaatgaagcacttggcgaaaatgaccgatgaagctgttgccaccgcagatgaggcctgggaaacgtatcgtggacaaaaggaggattatcgagaccggtatacgctgcattcattcttctcggtcttcctggagctgcaccagacacaccgtgtccaagatgtgttggacttggccgcttctcatcctcaggagtttcagtttaccgaacgaatcggtttggtcgagttcctcgcgtcaacactgacttggacacgccgtctggtatatagggtccttcaccatacgcggacccggggcgacgggaagcttattgaccttgtggcctcggctgtggccagagccgaggcctcggagggggaattaacagatgacctggcggcggcgaaatacttcatcgcatcactgatggtcgaaaacggccgattcagcgcaggaatccaggcttggtaccagcttgccgccctcgaccaccctcgcggggatagggaaagggctcaggcgcggtcgctgagtcgcttagcagccgtgtgcttatgcaatccggagattccactgtgcgacgagccccctctgagactggatgaaaaggccgaatacagtgatatctgtctggtcatctcgagttggctgcggtatcacggtgatctcgcaaacgcccggacagctctccgcggacgggtgaagaaaagtatcgagctgttgtcggacgacgatccttccaacgacgatgatgccttcctgagcctcttccagacacttctgacggcggcggacagtgacgaggatctgagcggagccttgtactgtaccaaggcctggtacaaggactgtctgcgggaagcgaagagcgaccatcgaatgtccgaaggtggcgtcgccgaatctctgaaccaagtgcacctggtcgctgacgagacccaggtaccggatgatggggtctctgaacgccggatctcgtacacgatcgactatttcgccgagtgttcgaactgcaagtgtgagatgaaatccatctgccactggtacttttgcctttgttgcccgttcatgatgctgtgtcaatggtgttaccacgagatccagtccgcctcatcccaggatggtacgtcccatccccagggtatctgcgaccctcagcacgagttctattataccggcggtccgcttcgggccgttgagcgtgtgcccgaagggatgacggtccttgacggtcttgatggaacgaagcggacggcatggatcgaggaatggaagcatcagctgtccgagaagtgggagacggccgactttgcctttgcgggaggactgtcggcctggtgtatgcgcatattgccggagccccagcgatctcggtgggctcgactctttgtgcgaccactcggtagtgcttaa

SEQ ID NO: 10218 - DNA, 657 bp, A.fumigatus
ttcggacgcgcccgaaccgtggaaaccaatgtgaacctggtggtgttatggaacgcatcgtcattcaattgcttggccgagctagatggaatgaatgggggtgaagagaacagtgggggtgtatttgttatcggcgccaccaatcgtcccgacctactggatacggcccttttacgtcctgggcgtttcgacaagatgctctaccttggtgtttcggatacacatgagaaacaagctactatccttgaggctttgacgagaaagttcacactcgaccccgaagtgtcgctccgccgagtcgccgaccggcttccccttacttatacgggtgccgatctgtatgctctgtgctccgacgccatgctgaaggctatcacgcgcaaggcgacggcggtggacgaaaaaatcaagcagcttccgggagggccggtcagtactgcctacttctttgaccatctcgcgacgccggacgacgtggctgtcatggtgacggaagaagatttcaaccgggctcagagcgagatggttcccagcgtcaggtacgtccctagtagtcaataccctgagaagattattgaaagacatttgctaagatccctgcagtgccaaggaactggaacatttcgagcggattcggcggcaattcgaatccgatga

SEQ ID NO: 10219 - DNA, 1944 bp, A.fumigatus
  unsure (913),(1021),(1037): Identity of nucleotide sequences at the above locations are unknown.
gtgaagacaaagatcgacggcttgccaggccttccgtctgccaagcctaggtattcaatcaaccaatcctcagacaggcgccctagcatctctcaacgccctccgcagcggctcactccgtcggtctatacttctccattgctgttgaacaatcttgagaacacgaaatatgtgcgcatctccccaatggcatttgccactggtaacggcccttcaaagtccgctgttctgcatcaagtcaaagccagctcggccaggcagccacctttggccaaggaagtgaatcttttgaaggtttccacgccgctctcgatggatcgtgtccttcagccggccctgttcgcaggactcaagcagtatttcgagtcgaagaggcggatcttgaaaagcggtgatcttgttggcatcagcgttgatgagagacttggcagagctgttttctccggtgccgccgccacggatgcaagcacgccagacgaagatttgacaatacgtttcaatcaagccaatgagtctgcacagggtgtgaagaaggttggcgtggcatggttccgcgtcgctcatgtggttcctggcaagtccgaggatcaggatgaagacgatcaatggggaggggtagccgttattgactctgcgaccactaggatggtgcaggctggaagcgatattagccgggttccgggcatcttggagaatggttgggagtactggcttggggtgaaatccgtaccaaagtccattagtaatgcgccgggccttcatggtctggtcactgagccaccgcagccgttcataccgccactgcaaaaacgaattcgcgagcttatggcagtggcaacgagtcctcgcgctattcagctggggatgaaacccgttgtgattcttctgaggtcgcagcaaagacatattgganaaactacggtagcaacgcgcgcgtgtgcagacatcggccttcatacctttcccattgatgcctacgacatcctgactgagggtgggcgcaatggcggcgatgtgaaanacgaagcctaccttanagcgagagccgagcgggcgttcgatcgtggaccgcactgtacagcgcttctcatcaagcacattgaggtgctaactgccgatagaatagtgtcggcgatggcagaaatcctcgcagatgcgagagttgttattgccacaactacggatgtggagcaaatcccagaagggatccgtagcatgttcacccacgaatttgagatgaccgcaccagaggagaaggagcgtgagggcattctccgaaatgctgtggccgaacgaagcatcagactgtcacccgacgtcgacctgggatcggtggctctgaagacggcggctttggttgcaggtgatttagtggatgtcgtcgaaagggcgtcagccatccgaactgcccgcctggaaaaactagcggaaacgccaagtaaggttgcgccagaatccaatgtcagcgtcagggatgtgcttgtctctggcggcgatgcagcacgaggtgtcaccaaagccgatttcgacgccgctgttgaagctgccaggaagaactttgccgactccattggagcccccaagatcccaaacgtcaagtgggaagacgtgggtggactgaccaatgtcaaggatgctctggttgaaactattcagctgcctttggaaagacctgagctctttgccaagggcatgaagaagcgcagtggtattctattctatggtcctcccggtactggaaagaccttgcttgccaaagccattgccaccgaattctccctcaacttcttctccgtcaagggccccgaactgctcaatatgtacattggtgaatccgaggcgaatgtgcggcgagtgtcccagcgagctcgggatgctcggacttgcgttgttatcattgatgagcttgattcggacgcgcccgaaccgtggaaaccaatgtga

SEQ ID NO: 10220 - DNA, 624 bp, A.fumigatus
  unsure (616): Identity of nucleotide sequences at the above locations are unknown.
atagtttcaaccagagcatccttgacattggtcagtccacccacgtcttcccacttgacgtttgggatcttgggggctccaatggagtcggcaaagttcttcctggcagcttcaacagcggcgtcgaaatcggctttggtgacacctcgtgctgcatcgccgccagagacaagcacatccctgacgctgacattggattctggcgcaaccttacttggcgtttccgctagtttttccaggcgggcagttcggatggctgacgccctttcgacgacatccactaaatcacctgcaaccaaagccgccgtcttcagagccaccgatcccaggtcgacgtcgggtgacagtctgatgcttcgttcggccacagcatttcggagaatgccctcacgctccttctcctctggtgcggtcatctcaaattcgtgggtgaacatgctacggatcccttctgggatttgctccacatccgtagttgtggcaataacaactctcgcatctgcgaggatttctgccatcgccgacactattctatcggcagttagcacctcaatgtgcttgatgagaagcgctgtacagtgcggtccacgatcgaacgcccgctcggctctcgctntaaggtag

SEQ ID NO: 10221 - DNA, 1407 bp, A.fumigatus
  unsure (1363): Identity of nucleotide sequences at the above locations are unknown.
ctcgccggcccggttcgccatgcgccgacaatgtcggtaacaacgtccctttggtggcctgaagaccgaatccaagccactctctgtccggagtatgtctttggtcatcttccgtccgatcttttgcctcgccttgtggcacctttaccttggggagagggccttaccagtgagacatatctcgactggatcctgcacaaggctggcaggctctttttgatcctagtcgacatcggcatccctgagcgcatcttctccctggtcgacgagtcattcgatgacgcagacttgccaattgcagcccacagtgtcgagcgtctgaagctctcccttgacgacaagaatccgacgctagatgccaaattcttccatgctcagtggcgtttcctcgtccgagggatcaagcaaggtgatcatatcaagtataccgagaacgaaggcgttccggtcgaattaatacgcaacgaggcggcgcttgcacgagaagggatcgagaaagtcgttctggcgggcgcggtctgtcaggtatatctgcgaacccaggttaccgtcggaggtgcgccgcatttctttgaagaacaggaggttctggatgagattcggtccctgcgacggttatctcatgatcatgtcttttccatttacgcttcttactttgttgatgataccatgtgcattctgttttccggtacatacgatcgttccctgatgtcctttctcaccgatgttccccaacctttcaaacgcctgcccaagaatcggcgccgcgagatcctgatcaactggccgcactgtttagttgatgggctggcatggttgcatgctcacaaccaagtccatggcgccattcggccgtccaatgtcctaattgactcggaataccgtatcttcctcggccagtttgaggcgctcgatacattactgccacctgccaagatagacgacgtcgagtcatatcagtacggagccccggagcgctgggtacgtgccgttaccgttcaggataccggcccgactcgaacagttcttccatctggtggtcgcacgggtcgacgtcagccatcatcccgccctggaagactgaccctgttctcgagaggcccgggttctgatgacgcggtggaccattcgctgagttcgcgagctgagtccgtcacctcccacggcaccgccattcgcattggaggattgcccgattcaccgacgcggttctccttcgcgctgtcttcatcgtcctccgggtccagtggaagtgctcgcaagcgggttgtcaccccggtcaagcggcggatcttatacactccatccatcaccttgtccaactcctccggctcctccagtagcttctcttttacggtcctcngacccggctcgactcccaggcactcgatcgaaaaccgctgtggt

SEQ ID NO: 10222 - DNA, 321 bp, A.fumigatus
ccagtcaacaacaccaaggcacttttcttccagcctgattggaagaggctcagtcaagaggaaacatgccgtgactcgaattttagcccaagtgacagtcatgaggctcatataaggctattaaatgcagctggtgcagccactctgcgcgcctcacctctccgtcaacatctcaaagaaacagagcaccttgttgcaaataacaaaaatgcgcctcccggccatcatcccctccgccctcctaggcgtcgccttcgtcttcgccgtcatcgagctcggcctcggcggccatatcgcctccatctctaccggctcccgtaa

SEQ ID NO: 10223 - DNA, 672 bp, A.fumigatus
atgcagctggtgcagccactctgcgcgcctcacctctccgtcaacatctcaaagaaacagagcaccttgttgcaaataacaaaaatgcgcctcccggccatcatcccctccgccctcctaggcgtcgccttcgtcttcgccgtcatcgagctcggcctcggcggccatatcgcctccatctctaccggctcccgtaaaatccccttctacgacccctccagctcgtggggctactcctacaagactatcaagtactccgtcccaggtatcgtcgctttccagatcttcacctctgtgtggaccatgctcgtctctgtcgccgcgtttcttctcccctggttcttgcgcgtcaaggccgcccccggaacacggctcaatacgatcatcacaggtgcgctaggcggcgcgtacttcgtgacaatggtgttctggctcgcgtgctttgcggacatcgcgaccaagctggatgagttgggcgctacgtccgattactataatgcggtaattgcatttgcggtgctctcgtggttagtttattttcttcacacccatctaatttacccccccccccccgccggcgaggtcgacgtggctaatgcgagtgagcaggctgctctttgtcgcgctcttcgtcatcgttgttcttgccatacttgggattctggagtgtga

SEQ ID NO: 10224 - DNA, 384 bp, A.fumigatus
  unsure (53): Identity of nucleotide sequences at the above locations are unknown.
atggactggaacccgttctgcaaggctaccagtttgaacaagaaggctgctanactgagatggatgcgtctcaaggcaaagatcgaaggcgctctgaaggaagacgagactgaaagcgctgacgacatcgccgcgaagtctggcaacggcaacggcaacggcaacggcaacgccgaagtcaagcctgaagctgcaaaagcgcctggcaaggctatgcccaagatgggtgttttcaagccccgtcgttccaagaacatcaacactgctgaatctgagatcgctcccccttctaagaagagacgcacctctaagcgcaatagaggcgatcacgccgacagcgatgacgccaacaagggtgcctctgaggctattgccgagaagtag

SEQ ID NO: 10225 - DNA, 201 bp, A.fumigatus
tttggttcaataccatgcagcatcttttggtgcattgtctggttggatggatttgtgtctgttactggcaattacatgaacacaggaagaggtgtgttgaatctggaggatggtaagataggagctctactccgtaggttaattcaactacaagttaagggtttcatggagcacgtgagccaccatgactacagattgtag

SEQ ID NO: 10226 - DNA, 444 bp, A.fumigatus
actccgcgtcgcgttccgcgcctcggcttcacgctttcgaaacaagaactcatttccctcctcacgacctacggcgtcccccggccccaagtacaacagcaatcggcgtcccaggcagcgcagcatcaggcgcagtcgaagacgacgccggccaccaacccccagcatccgtccaacctcctcatgccgctgtcggcctttcaggccgtgacggccgttaagattctggagcgggatccgcgggacgagatcctccgggcatttgagctgtttgacgagggcgggaagggatacattgatcttgaggatttgcggcgggttgcgagggaattgggggagacggggttggaggaggaggagctacgcgcgatgatcgaggagtttgatttggaaggtgtcggtggtgttacgagggatgcgtttgtgagtatctgctggcagtga

SEQ ID NO: 10227 - DNA, 189 bp, A.fumigatus
caccaccgacaccttccaaatcaaactcctcgatcatcgcgcgtagctcctcctcctccaaccccgtctcccccaattccctcgcaacccgccgcaaatcctcaagatcaatgtatcccttcccgccctcgtcaaacagctcaaatgcccggaggatctcgtcccgcggatcccgctccagaatcttaa

SEQ ID NO: 10228 - DNA, 201 bp, A.fumigatus
cgaacgaggcatgtcattctgagtcaacccattctggtccaatctgacgatttgctaggtatcgatgttgtcagaagtcggatcaaaggctttgcccagaagaaggtgacgctcccaccgggccgtcacaagattgtcattctcgatgaagcggataggtatgaaactagaggattcaaaatatgtgcgactggtcgctga

SEQ ID NO: 10229 - DNA, 243 bp, A.fumigatus
ctttttagggtggagaaataccgaccaatattcctcgatgacatcgtcggcaatacagaaacaattgagcgattgaaaattatagccaaagatggcaacatgccccacgttatcatctcgggcatgcctggtataggaaagactacctcgattctgtgcttggcgaggcaactactaggagaggcttataaggaggcggtattggaactgaatgctagtgacgaacgaggcatgtcattctga

SEQ ID NO: 10230 - DNA, 672 bp, A.fumigatus
  unsure (641): Identity of nucleotide sequences at the above locations are unknown.
aggattcaaaatatgtgcgactggtcgctgatcatttatagcatgactcctggcgcgcagcaggcattacgacgaacgatggaaatctattcttcaacaacacggttcgcatttgcttgcaaccagtcaaataagatcattgaacccatccagtctcgatgcgctatcctgcgctacgcccgactgacagacgcacaggtggtgaaacgattgaaacagatatgcgacgctgagaaggtggaacacacagaagatgggatcgctgccttggttttcagtgctgagggagatatgcgtcaggctatcaataacctgcagagcacatggtcaggttttggtctggtcagtggagataatgtctttcgtgtggtcgatagcccacacccgatcaaggtccaagctatgatcaaggcatgctgggaagggaaggtcgacgctgccctagaaaccctgaacgagttatggtatgcgcatgatgcgttcgattattgcttcgtcatcgatattctgataactcttagggacctcggttactcatctcatgatatcatcagcaccatgtttcgagtcaccaagacaattccgactttgtcagagcattctaagctggaatttatcagggagaccggcctcacacactntgttagcgccagcatcgaaaagtacatcggg

SEQ ID NO: 10231 - DNA, 345 bp, A.fumigatus
cctacctctctccaggtcatacagtccagcaaaactaactgcgataagctcatcttcatcactttgcgagatttctgtcgggaattagacatgtctctcatcaggggaattatggagcttacttctcaacgaccaggaatcccgcaactttctggccctctgagcaaaggactgctccccggcggtattagttgcgatatggaatttagagccggtaaggttcttctgcgcaatgcttgggcttctgctgtgcgctccattcaccctgtccttttgaatatctcgaagattgatatcgtctctggggtcattcagaacaggctcatatctagattagtcatgtaa

SEQ ID NO: 10232 - DNA, 270 bp, A.fumigatus
cacgtatgcgggctgatgcagccctcaagcagggcaattcaaaagcagcggttgtggatttccatgatgcactacggactctggaaagcgagccagcattggacaccgagagattgtttcgcgcgtccatcttacattcgatgggacatgcataccgcagtctggacatggctgcagaatcagaagcctgctacttggaggcactggggctctacaaacgatcctttgggcgcgaccaccctacgaactttgcagttctgcacgatctag

SEQ ID NO: 10233 - DNA, 186 bp, A.fumigatus
ttcaggctgagtggcccttatagtcttatcaccaagggctaccggatggaaaaacggtttttgcctctgaattcccgtccgctccgatttttctgcgagcattgcgagaagcaatttaccatggatgacaaggatgaaatagtggatcgacaacgaggtgagacggtcacccgtaatttcctatga

SEQ ID NO: 10234 - DNA, 234 bp, A.fumigatus
ttactgccagcgccgaatgatgtccatattattggctcaaagacatcgggtatggccctttgtgaggaggaaaatgagcattatggaagcgattatgttgattcgcagggaaagttcgttcggaatcaaacacaaggaacaccgccatcaccatctcgaaggcaatcttttctgcagagaatatttggtcgtaccgttccgaaaggtctgcttgatgaatataatgctggatag

SEQ ID NO: 10235 - DNA, 1197 bp, A.fumigatus
  unsure (1193): Identity of nucleotide sequences at the above locations are unknown.
cggagaacaggcctgtcacgcgcaaaatctacctctaatcgagggagaaagttgctgaaaagagtcaacaccgtgaggctctctttcacgcaaaggggctccaagaacgaaagtcatacaagcttagaaagtgaagggagctcaagtgatgtgaaacccgcagccaagacacaacgcagagcagatggagttcgaacagctgtttccgaagccgagtacatggatttgttaagaaactgtcagaacattttcattcatatccaacacctctcgggaggcgcaatggttcatgacgcctctggacgtcaaagactgcttcagatggatgaggtagcccagctctttctccagctgaagaatgagctctccgcctcgactgcctattccaaagccctgataacacgtatgcgggctgatgcagccctcaagcagggcaattcaaaagcagcggttgtggatttccatgatgcactacggactctggaaagcgagccagcattggacaccgagagattgtttcgcgcgtccatcttacattcgatgggacatgcataccgcagtctggacatggctgcagaatcagaagcctgctacttggaggcactggggctctacaaacgatcctttgggcgcgaccaccctacgaactttgcagttctgcacgatctaggcgcgctttgtgagaaggacggatacgccacagaagcagctgcactatatgagcgctcgttcgcaggcaggttgaagactctgggacaacacgcaccagaaacgttgagtagcatgcaacgtctcgcgtctctcaaagtctccttaggtgatctagaatctgcgctcctcctattggagagagcggttcctgctctggacacggtttttggactccagaacgaaacgaccttgaacgcaatgaataagttatctcttctatatcagaagcttggtttagtcaaggagtctcgtatgatatgcggcaaaaccatcccacattgcaagacgatcttcggtgtagcgagtgctatcacgagagatgctgttatccggtacatccaaagctctgacaattttgacttacccccagaaatcctggacatactcgatcaataccggaactccagcgaccccgaggcccttcgggttatccatcgactaggccgatcttacatggatgcaggtctaaatcgagacgccgnttga

SEQ ID NO: 10236 - DNA, 195 bp, A.fumigatus
agccacccgtcattagccctgggggcgtactctcagtggctcctggccactactgtgaaggtacttggtggatcctatggcggccacaacgcctcctcccgtgcgccaatccgccccaagcgtcaccaagctccctcatgcagtcttgacccccgagtcaagcattggcattaccagctgtcgatgacatgttga

SEQ ID NO: 10237 - DNA, 249 bp, A.fumigatus
atgcggtgtttgagaatcctcctcgcccacgtcccccgagatacactgctggagaatgtggaagacttctgccagaaattcgggttgatggaccacatcgacgcatttcgcaaaggggccctcatctcgcagaaccccgctggtgctttggaattgccggagctgcaggaggatgagaaggccatccttccgccgggagtcgactcacaaatggtcccagccatggcagctgtactttatggcttgtaa

SEQ ID NO: 10238 - DNA, 195 bp, A.fumigatus
cctcgctcagccatgtgctcgctggctgccgcagtccaaggcatggatgaaacggtgaataatggcgcccaagccatttacctgaagcagttcaacatcaccaaccccgatcaccctgaagactcgagattttcgcaatccatgcagagataccgtcttacacgcccggggctggaagctaaacgcgtacggcga

SEQ ID NO: 10239 - DNA, 195 bp, A.fumigatus
cgtgtttatatagctgccttagttatagggaaggtctgctatagtaggttaaattataatgctagctatatagatctatctctatactataatctgctaattctctgtgtctctactttcccccctcctcttttttttttttttttaaagaaggattatattatcttaggcgtgcttaggcaggggctgtcttag

SEQ ID NO: 10240 - DNA, 189 bp, A.fumigatus
ttattaagaagagatataagatatgtgaccttgagactctctctaatttatgttaattctaactctgattataactctgcccctgactctgttaataggttattaagtttactaagtatctacttcacaggatggattaggtcttttttaatatggctactatttataagagtctgggaagttaaataa

SEQ ID NO: 10241 - DNA, 2118 bp, A.fumigatus
  unsure (2107): Identity of nucleotide sequences at the above locations are unknown.
gactatgaccttcgcgctcgattttgcgactcaatctacgccatgtacgacaacgtcaaggcccgggaagggggcgggactagtgacttgaagattttaatcgaccttaagcgctgctggcacggcaaatgtgccgcctactgggaattaccgacaggtcatatagctccaggcaccgccattgtcccgggtggtcatgacttcgaggcaggccccaagggcgaaggcaacgctgaggagcacgagtacgattccacaacgcctgaagtcaaccaggagcaccagactggtgtccaacagagtctccctgcttttcaacagatccagcacgatcggaacaattccacagctacggcaaagagcatgccggcatctacaaaaagcggtcatagtgtccaggctacatcttgttccttgccacccaaatctcctaagcgtctctccgtacctgtcgccgcacgcaaggcgcctcatccagtgcctataatcccgtctaagcttctatgttccccaccagagtcccccaatgtgtccccagttatagcgaagcgcctcccgttccatggccatatgcacaagcgcagtggcagcttttctgactccgttcgggatgacagggcgcctttgtgtttgctgaagcttgaacagcaggcgttcgcttctcaagagatattgaacctaggaagcctaattcgcggagagctgtaccctccagccgagtcgtacatgaccatgatggcgccgccctctccccctttgccctcgtctgcaagcgctggcacgcaggaccgtcgcaatactataaatgagacttcgaagcctcctggctcgagttcagggatgaagacgattatcgggtctattcgccgagctctacataccagacacgggggacaaagcgtctcgccgcgtgctgcgaatggccaatggagtccttcaatgcggggcaaaacatcagccttacctaacaatgtagcctttggatctgatctctacagagacagaaagactgcggcgacgtcaaaaagaccgattcgaatcgatattctgtccgacgaggctttgcaagaatatcgtcgtgcagttggcgaggtagtctcaccccagacggcgaggggccccagactagaagtgaccgagcaggcgatggaactggaaggcaagaagatagatcgcccggaacccggcttcgaccgctcaatggccaaaagtcagattaccatgggcagccaatctattgtcattgtggatggcaccgggttgggagaacccgtcatgtctggagctgtgctggagcattcgatggggcttgagcaacctcctggctttctgaacgctgcatacacacccacaactgtcaaggcagcctctctgcgccgtctgtctcataggttggatctggcagaagatcaatattccctgcccatctactatgaggaagcggactctgggccacctaatcgtatctcgaggttccttcgctcatctagaatctctgacccccgccgatcattctccacggagcgtttctcggtctcttggaaaagaacctcaccctctcttcgtctccgaaagtatgcttcttttcaaagtgggatatcaagacagcgttcagccatggcgcgagaaccatctctgccgccaactgcggctatgaacccttctaaactcaccgctggagcgcaggttggaccaacgcttcgtcggcgccctggtggagatttgcggcagatgcagaccgtaggtggcctgcggtcgcgcccggattccgggtcatttacatctggatcaacctatcgcagctccttctctgatagcctgatgagtgggcaacatgatgtttccagacgccaaacaagcctgatccctcctaatccgcgatatgagttgattcagactcactcgtctcagatgttgaggcgctcatttgaagctgctatagcgcagtttgcgcagataccggatgacgacgacggaggaatcgagtcagcgttgttgaaactcgagggaaagtggcccgggtcccctaccagcggggagccggcagggctctcaaatggtggcagctgcagagagccaggccatgttcaacacgatcaggccctgnggctcgtctga

SEQ ID NO: 10242 - DNA, 744 bp, A.fumigatus
  unsure (92),(97),(100),(189),(198): Identity of nucleotide sequences at the above locations are unknown.
ccatacagaatcttcgttcagggccttcctgcaccacgcccatggatccagttttgtttcccggcggagccattgactccagacctttcacntaggnacnagaacaccgaacggaacaattttcgccccgtgaatacgcaccaggtctcgggtgatgtactctctcaaaccgagatggatcgccaacgntacaatatntccaagaaccctgaaccagaccatgtcccgtttattctctcatgcgaatcccagatccttgctcagcagctgaccctggtcgagatggctgcgctcagtgaggtggattggaaagacttggtcgatatgaattggagtagcggctcgccctccactcgcaactgggtccagttccttaccgaggaggaacgaaggggaatagatcttgtagtaggtcgattcaacctcatggtgcgatgggtggtttcagagatcgttctcgtgcgtacactagaagagcgagctagcaccatcgtcaaattcatccatactgctgcccacgcgaaacggatctgcaactacgcaacgatgctgcagattgccattgctttgtcttctacggactgctcgcgactgcaaaagacttgggccctggtgcctccatcggaaaggcgcttgctgaaagacatggaactactcatccagcctgtgcggaacttccatgatcttcgcatggaaatggaaacggccaatctgcaggaaggctgtatcccgtttgtcggttag

SEQ ID NO: 10243 - DNA, 399 bp, A.fumigatus
aagacatggaactactcatccagcctgtgcggaacttccatgatcttcgcatggaaatggaaacggccaatctgcaggaaggctgtatcccgtttgtcggttagtgagctctcgaccgacggtatcttagacatactgactggattttcaggattatacgtccatgacctcacctacaacgcgcagaaaccagctcaggtagcaaaccccaacggagaaccgctggtcaactttgagcgatatcgcacggcagccaggatcgtcaagagccttcttcgactgattgacgcgagcaccaaatacaaattcgagcctgtgccgggcatcatcgagcgttgtctctggatcgcatcgctttccgaagaccagatccaaaaacgcagtaggatgctggaatga

SEQ ID NO: 10244 - DNA, 852 bp, A.fumigatus
aaggttcttatattgcttgtcagattgcgtgccatttcgccaatcatggccgcacctcgcgatgcgctcaagccacagatcgaccgtcagaagaccacacctttccacctgaagctcttctatcgcgtgaactccttccaccctctatccgactttgccattccctcatcgccatcttcctacagtggaccgactagcggtcctaatgcgattcgagctcggtcccctcccccagttcgactccccccgcatctggagatctacacctggcagtcctgcaccctacgagaattaacccagctcctcacctcggcgttgccatcacttcttcctgatcccgctgtcgggacacgcatatgcttccgcctgatctacccggacaccaagggcgccacgacaatgggcggcgacgcgcgagggcgatacctgagcaaggacgtggggagtgtggtcgttgggccgaaggacagtccctaccggggcgagaatgacgaggagaatgggggcagtgctgcgacggggccacgtgcgctgcggctacaaggtaacgatgcggacaagacgctgcaggactttcgtttcgtgattggcgactatgtggattgcgcgatcctgccgccgttggaggacggctctgttgctccgccacttgttacggggcgggggtcggtgagcgggcccgttggagggggtatgagggcgttccgtgatcccgggtttggacggcctggtcgggggagaggtgatcgagggataccatctggtgattggaggcgtggggagaggctaccggatggaggagggcgcaattatggtgggggacctgggagaaggggatgggcgccgtactag

SEQ ID NO: 10245 - DNA, 771 bp, A.fumigatus
cgtgattttcaggctgaaaatgagaacgaagaaaaagttcccgaagttccttcgtcggatcaagaacagggtattcttcctaaactcattgccacgcttgttggtcgccggcgcgaagtaaagaaattgatgaaatccaaatccgcgacacctgaacagcttgcgctgtgggacaccaagcaattggctttcaagttgaccgctaattctatgtatggatgtttgggttatacgcagagtcgtttctatgctcgtcctctggcaatgctcacaactttcaagggtcgtgagattctgaggagcaccaaggagcttgcggaatcaaagcagctccgcgtcatctatggcgatactgactctgttatgattaacaccaacatggacactatcagtgatgcactcaaggttggcgaggagttcaagaaatccgtcaacgaacgataccggctcctggaaatagatatcgacaacatcttccgtcgcctgttattgcacgctaaaaagaagtatgcagccatcaacatgactgaggtggacggaaagtttgtggacaagctcgaggtcaaaggtttggatatgaaacgtcgtgaatactgtgccctatcgaaggaagtatctcagaaacttcttaatgaaatcctctccggcgaagaccaagagctggttctcaatcgagtccatgactaccttcgagacctcgccgacaaaatgcgagggtaccaaattccagttcagaaatacgtgatctacacggtaagcttccagccctga

SEQ ID NO: 10246 - DNA, 1017 bp, A.fumigatus
tgctctctacagaaactgtctaaacgaccagaggaataccccaacaaggaaacgatgcctcccgcacaagttgcgctacgtgagctcgcccgtggcaagacaattcgacccaacgatgtcatttcatacattgtgacaaatggagactcggagacctcatcgctaccaccagcgaagcggtcatataccgtccatgatgtcatgaaatctgataataacctcaaacccgatattgaattttacctcctcaagcagattttccctcctattgagcgtctctgtgcgcctattccgggtactgatgcagttcggctagctgagtgtctgggtctggatgtacgcaagtatcaaatcaatacgtccagtggaagcaatcagcagaatgcggatatctttccgttggagtcccagattccagactctgttcgtttcgagaatgctgctcgtcttaccctgacttgtcgatcttgcaaagagaaatcgatcttcgagggacttgtggcctcgactcatatgtgcacagccaacggcattgtctgccctaaccaagcatgtcaaaaacctttcaccgtgctgacgataatcgcacaattggagagccaaatccgtgcccaaacgtctaagtactacgaaggctggctggtttgtgatgactctgcatgtggcaaccgcactcgccagatgagcgtttatgggcaccggtgcctggggcctcgtggccgcgctgagggctgccttggtcgtatgacgtatgagtactcagagaagcagatgtacaaccaattgctttactttgcaggtctgtgggatgtggacaaggccaaagtcaatgcccagaaggaggccagcggcgaaaagaaagacagcatcgcagcgctggtcgaattcaatcgcactcgcttcggcaccattaaggatgtggtggatggctacctgaagaaatgcggccgacaatgggttgaaatggatgcccttttcccgtcttcgaccacgggccggcaaggaaccgcgattgag

SEQ ID NO: 10247 - DNA, 516 bp, A.fumigatus
aaacgtctcgcaaatggtgctggcaattcctgggctcgaaccctcagtggtactcgcgctgaacgtaacgaatacatcctgctgcatgagttccaccgaaacaaatacatctgcccagacaaatactcatccaagctgcagaaggcagaagagaagtatcaggatggcgacgatgatgatgccggtgacaagaagaagaaggacaaatacaaaggaggtcttgtcttcgagcctgaaaaaggtctctatgacaagtttgtcttggtcatggacttcaacagtttgtacccgagcatcatccaagagtacaatatctgcttcacgaccgtggatcggaccgccacagtaagcactcaaccgttgtctcgacaaatcctactcacaacccctactaacgtgattttcaggctgaaaatgagaacgaagaaaaagttcccgaagttccttcgtcggatcaagaacagggtattcttcctaaactcattgccacgcttgttggtcgccggcgcgaagtaa

SEQ ID NO: 10248 - DNA, 681 bp, A.fumigatus
  unsure (181),(195): Identity of nucleotide sequences at the above locations are unknown.
cttcaagcaggcacagcagacgccgcagtcgacgaagtaaccgaactcttcaagggcctctcgaaaaagaagaagaccaagaagcccaaggacactgaggccggtgaaggcgacgacgccgctgccaccgccgatggggaattcgaccccaccgccctgaaaaagaagaagaaaaaagtcnagaaggtcaatacnggtgactttgaggctaagctcgccgaagctggtatctcggagaaagccgctaccgaggagaaagaaggcgagttgcctgagggcgatctcgaagccggcaccggtatctgggcgcacgacgcaacccaggccatcccgtactcactcctcgtctcccgattcttctccctcatccagagccaacatcccgacctgctgtccaacggcaccaagtcgtataagatccctcctcctcagtgtctgcgtgaaggtaaccgtcgtaccatcttcgcgaaaatcgccgacatctgcaagcgtatgaagcgttcggacgaccacgtcatgcagttcttgttcgccgaattgggtaccagcggcagtgtcgacggtagcaggcgtctggtcattaagggtcgtttccagcagaagcagattgagaacgtcttgagaagatatatcggtatgttcctttatgtccctcttggatttgaatactacagtagctga

SEQ ID NO: 10249 - DNA, 222 bp, A.fumigatus
caggtcgagcctactcctcaaaagcaacgcaaatcggttgccttcagtgaaggtgcagtcatcatggacacaaacggcgaagtcacagaggctcccgctcctcaaatcaccacagctgagaatgaagctggtatgcttctacttttcctgtcgctcaaacctgcgaccgcagccgaaactgacttcaagcaggcacagcagacgccgcagtcgacgaagtaa

SEQ ID NO: 10250 - DNA, 456 bp, A.fumigatus
ggtgtccgattgaggccaagccaggtgagtgccattttttcggaacctgaaaagtccacgaggctcatgatacggtcaggggcaatgatcgcaatgtcgcacacgatcacactaagaggaagcatcaaattctctctgaaaaagatgtttgccggcggcgagatgtcactgtccacatacactggccccggcgagcttctgcttgcgcccgcggcactgggtgatatcattatgctgcgcttctctggctctgaccagtggaaggtcggaaaagatgccttcctggcctcgactagcggtatctcaaaggactatcaagcgcaaggtttgtcgaagggtgtcttctccggagaggggttgttcgtgtacaagctgtctggtgtcggtctcgtgtggctccagagcttcggtgctattatcaggaaagatgtaagctacccttcccgtagcttctag

SEQ ID NO: 10251 - DNA, 234 bp, A.fumigatus
caatcaactgcccagattgccgacggagaatcctactacgtcgataacgggcacctcgttgcctggaactgcaagtacaagatggagcgtgtcgcttcaggaggtatcatttccaatataagttctggcgagggtctagcatgccgtttcaccggccctgggaccgtgtacttgcagacgaggaacgtcactgcctttgccgcgcatattggagcgcatactgccagtaattaa

SEQ ID NO: 10252 - DNA, 522 bp, A.fumigatus
gcgcagcgcgataccttccagccccgtggtgaagaatgtcccttcggtgccatccacattatcaacttgcccacaaacctggaaaccgaggtcacccaccgttattcggccaacagcttcaagcttcaccgtcttcctatgcctcgccctggtcaggtccttggtcttgttggaacaaacggtatcggaaagagtactgcattgaagattcttagtggcaagctgaagcctaatctcggacgctacgataaccctcccgattgggaagagattctgagatatttccgtggttccgaactgcagagtacgtacactgccgagtcaaaaaaaaatccgcgtaaattttctatgatatctaactttcatagactactttaccaaggtcctggaagacaacctgaaggccgtggtcaagccccagtatgtctaccagattcctcgggctgtgaagggcccggtcaagaacgtcggggagctcatcaaggcccgctctcagatggacaacatggaacgcatccttga

SEQ ID NO: 10253 - DNA, 192 bp, A.fumigatus
tatctaactttcatagactactttaccaaggtcctggaagacaacctgaaggccgtggtcaagccccagtatgtctaccagattcctcgggctgtgaagggcccggtcaagaacgtcggggagctcatcaaggcccgctctcagatggacaacatggaacgcatccttgatgctcttggtatggccatttga

SEQ ID NO: 10254 - DNA, 1305 bp, A.fumigatus
caaagccgtcttcctacctcgatgttaaacagcgtttggcgggccgcccgctccattcgtgagcttctgcgccctgatgactacgtcattgttgtcgagcacgatttgtccgtccttgactatctttccgacttcgtctgtgttttgtatggtagacctgctgtctatggtgtggttacgcttcctgcttctgtccgcgaaggtatcaatatcttcttggatggtcacatccctaccgagaatcttcggttccgagaggagtctctgactttccgtctggctgaggctggtgatgacttcatggttgacaaggcccgtgctttcagctacccgagcatggagaagactcttggcaatttccacctgaagatcgacgctggttcattcactgactccgaaatcattgtcatgatgggtgaaaatggaaccggcaagactactttctgtagaatgctcgctggtgcagagaagcctgacggcaacgtcaccatgccccgcatgcacatcagcatgaagcctcaaaagattacacccaagttccagggtaccgtgcgtcagctcttcttcaagcgtatcaaggctgctttcctttcgcctcagttccagaccgatgtctacaagcccctcaagatcgatgatttcatcgaccaggaagttcagaacctgtctggtggtgaattgcaacgtgttgctattgtccttgctctcggaatgccggccgatatctacgtgatcgacgagcctagcgcttaccttgactctgaacagcgtatcgtggctgccagagttatcaagcgtttcatcatgcacaccaagaagaccgccttcattgtcgagcacgatttcatcatggccacctatctcgccgaccgtgtcattgtctttgacggcaagccttcggttgacgcacatgccaatgcccccgagtccctggtcactggttgcaacactttcttgaggaaccttgatgtcaccttccgtcgtgatcccaacagttaccgtcctcgtatcaacaagtacaacagtcagatggaccaggagcagaagttggctggcaacttcgtaagtcaccccaacccgatccgtgcacatttattttacgtcatactaatatgtttcactatagtacttcttggaggaagagagttgaaaagggcatcccaggcaaacataatcgcaaccatcacagggacgatggtcgcgatgctgacccgcggcgacgtcgtggtcaatggaaaacccttcgtttatgggcggtattcgggtttcccggggtcccgcgtggccgcacttggggcggggggc

SEQ ID NO: 10255 - DNA, 459 bp, A.fumigatus
gcacaccgaccaccacaggccgcgaacaccacctctcctaattctagccccggtgcttcgctctatccctggtcgcaacgtcgactcaatttctctacaccccaaggaaatccgtttccgcgatatggtgcagcaatcaacgcggtcgcttcgaaagaaggtgacatttacatgatgggtggattgatcgatggatctactgtcaagggcgatctttggatggttgagagcagcggcgggaatttgtcgtgctttccaattgctactgtttccgaaggacccggtcccagagtcggccatgcaagtttgctagttggaaatgctttcatcgtgtttggaggagatacaaaggtcgatgaaaatgacaccttggacgatactctataccttctcaacacctgtgggtttccagctcttttcggtcacttgcagcgcacgttcaccttgctgacgttatga

SEQ ID NO: 10256 - DNA, 297 bp, A.fumigatus
tttccctcagcgtcccgacagtggtcgcgggcaattccccccaaccctcgtccagcaggacgttatggtcacaccattaatattctgggctccaagctctacgtttttggtggtcaggtcgaaggttactttttcaacgatcttgtcgcctttgatctcaatcagcttcagaatcctacgaataaatgggagtttctgattcacaatagccatgagggaggaccgtcccctggtcaaattcctccggcgaggaccaatcatacaatggtcagtttcaacgacaagctttacttgtaa

SEQ ID NO: 10257 - DNA, 996 bp, A.fumigatus
aggtttggtggcacaaatggcctgcaatggttcaacgatgtctggtcttacgacccgcgagcgaatcaatggtctcagttggactgtgttggatttattcctactcctcgcgaaggacatgccgcggctcttgtcaacgacgtcatgtatatattcggtggtcgtacggatgagggcattgacctgggtgatttagccgctttccgcattacgactcggcgatggtattcttttcagaacatgggaccagcgccttccccgagatcaggccacagtatgacagcttttggcaaacaaatcattgtcttggccggtgagccaagctctgcacctcgggatcccgtggagctcagtatgacatatattcttgacacctccaagattcgttacccaaccgaaacccagaatggagacaaggtcggtgcacctcctctggccatgaggaaaggaagcagtgaccgacacggggcgccaactggcagaacgtcacgagaggcgcagaataccccacctgcagactcacagcaacggcgaggaccaggtcaaacaagggagagtatgatggtagccccgaacggtcgaccaggcgaccatggtccagggccgggctctcgattaccacgagcgtccatcgcgcaggcgcctgcgggccctcctccgccaggtcaggcacctacacctggtccccgaggcagcacaccacaacacgccatgaaccccagaagtaaaacgccaaccgatcgtaactacggcggtccggcagcggacactgtccggacgatggaatccgagagagacagggagtctccagtcgcgagagattcttctaaagaccctcgctctgctaacgacccaaggtctatgtcaagtggacatcgaactcccactcaaacgccgtcaagaatgtctgccaaaagccatggaggctggcgaagctgctcctttagccagacagcgctctctacgtcagcatcgccaacgcagctccatggatag

SEQ ID NO: 10258 - DNA, 384 bp, A.fumigatus
  unsure (69): Identity of nucleotide sequences at the above locations are unknown.
tccttcgtcccctgtggtgaagatcctgagaggatcgactctttacaatgtcttggaggccctccgatngagagttccaaggggaactatggcgtccaaggctcaatgagaggatctatgaagaacccctggagctgggacaacactgccatggtttacggcggaaagaagaaccagttcacctggaacaataactgtggaaataccaccgcgcagaattgcggcaacacagtctccacaaattgcggtgacacgtcaacctacaataatacgaagaccatccagactggggatatctccagcaatggtggaaacgcaagcaacgcgtcaggaactgcttctggtggctccggcggccgcatcatcattgatggacacgactag

SEQ ID NO: 10259 - DNA, 207 bp, A.fumigatus
tgtatcttacccttcgatatcacattggttggaaccaagacttacgtggagcgactaaacctcgggatggccaagaccatatgcctccccactcctttagcaccccaattaacattgatctaccacaagctagtcatctatcacctcgtgtcctcttctccagcaatttatcctgaagattatgaaattattcaattcctacttgca

SEQ ID NO: 10260 - DNA, 1491 bp, A.fumigatus
tgtctgccgtccgagcgtggatcttccagcccggcggcgaagttgtcaaagggccctagcagcccgaagagactagacgaggccataaagggctcaaagtttatgaaacggctcataggattctatcgacctttcaaatacagattctctatggttcccaacaccaagcccaatcagcgctatattcggactggatgcgcgttgatgcgcactctagtccaagtccctgagggaactaagtatctggcggaaaacaaattcctaaggcaggtcgctgaatgtctcgcacaagtcgaccgcatgagcggactgacctcctcctcgccacttttttcgcgagagcagatggctaccacgttgagcggaggatactttgccatgttaggaacgctaagcggcgaccccaacggccttgctatgatggagcgatggcacatgctcaacatgttctaccatataattgaacttcgggatcgggacgatctgatacaaacccttttgggtaacctcgactatagtcaagaaagtcatttgagagttctgctgtctaaagctctcactactggttctaaagatattcgcatattcgcgacgaagctgctgcggaagtatgcagttggaaatgcgcatctttccgcgcaagggggactgggtagagcggactgggttgttaagctgttggtaactcagctgtatgatcctgatgtttcggtatgtcagattgccgtcaagatacttgaggaagcgtgcaaccatcgagactaccttgaatatgttgtcaaatgccggccttcgctcgatcacctcggtgaaatcggagcacctttacttttgcgatttttatcgacatcagttggctatcattacttggacggcctcgactacatcacgcaagaaatggatgattggttcttagggcggaacgacgcctacgttggtctcgtggaagctgcgctttctagagcctacgttgatcaaccccgcagggggagctttgcgcctgaggatttcgtggatttgcaggacgttggagttgtaccgccccatttctacagagaacttgcgaggacgaaagagggatgtcgacttctggaacaatcgggccacttcagtgaattcgcttggaccattagagattttcgattggacgaagaagataccgaggcgcttctcaaagtcaagggctgcctctgggctgtcggcaacgttggttccatggaattgggagcaccgtttctcgagacggacatcgtccaacagattgtgaagattgccgaaagtgctgaagtcttgacaatgaggggcactgctttctttgtccttggcttaatttctcgcagtcgacatggcttgaaagtactccgggaagctggctgggactccgcagtcgaccagaaaggggactcgatcgggctgagtttgcctacggactttaaaaagctgttcttggtaggtaacacattagcagttacggcgtccaaagtatactga

SEQ ID NO: 10261 - DNA, 255 bp, A.fumigatus
tggactgtttcatggctgggccacccgttttgggcctttgtaaccttttcctcatcctacgttaaaaccatcatcgttacatatctctttcttcccctcctctcattgactgtgaatgacgatgatggttacgaaccgccctattgcattcctgatttcaaggtcaggcattctacgcgaaatgctacgttttcttccagagtacccccttctgtcttggtatggcgttcaggcatgtccagtcatgagcaatga

SEQ ID NO: 10262 - DNA, 1212 bp, A.fumigatus
cggccggggttccttgagaaaaggagggatttttgggaggacttgcgaaggggaaacaaaacacttgggtgcccgggggatgaacagtttacgggggatttgacctggcggttccccgggggaaaggcaacgctcccccgggcagaacccagtcaacgggatatatcggcccagcagctgttgaacacgttccttaatggagatgccacaatcggtacactcacatcctcgccgttcgaaatctcgcacaaatacatcaacttcctcgtcggaggcggcagcaacctcaatgaaaccgcaatccggctgaaagtcaacggacagacggtccacacttccacaggatccaacagcgagggcctcgcctggcaaagctgggatgtaagcgcgctacaaggaaagacagcggtaattgagataatcgacaacagcacgggaggctggggtcatatcaacgtcgaccagatttccttctccaaccagcccgcaacgagcacgattgcaaactggatggactggggaccagacttttacgcggcgcttgggttcaacggcctaccccaggacaagcgtacgatcatcgcgtggatgaataactggcagtatgggggggtcatcccgacggatccctggcggagtgcgatgtcggttccccggcaactggcactgaagacgattaacgggaaggcaacaattgtccaggagcccgcgggcaaatggagcgcacttacgcatggcggccagaccttctcttttccccgtgtggagggtgtccgcggtctcgggcggatcgggaagactctggaactggagttgaccttctcgagcaggcagtcgcccgcggctgggaaagccgaattcggagttgctgtcgctgccacaaaagactacagtcatgaaacccgcgtcggatacaactttgcaacccagcaggtctttgttgaccgcactcactcaggagatacgtccttcgatggtacgttcgcgagtgtgtaccaagcgcctctggctccgtcggcagacgggactgtctccctgagggttctggttgactggtcaagtgttgaggtttttggaggccacggcgaggtcacgattacgagccagattttccctgcgagtgatgctgtgtacggtcgactcttctctacagacggggaaaccaagaatgtgaagctgcgtgtgaaggaagtgcgctctacctggcggtga

SEQ ID NO: 10263 - DNA, 240 bp, A.fumigatus
ctgggttctgcccgggggagcgttgcctttcccccggggaaccgccaggtcaaatcccccgtaaactgttcatcccccgggcacccaagtgttttgtttccccttcgcaagtcctcccaaaaatccctccttttctcaaggaaccccggccgtcataaaatccggttcggcatctgggggtttaaactaatgccgcttgaaatcccccacctaatttcccgaattccccacaacccaact

SEQ ID NO: 10264 - DNA, 543 bp, A.fumigatus
ccgcggctgtcagcgacttcttcattcctcgagagcggatggcagagcacaagatccagtcgtccgagcttcccgcacaccttgacaattcaaattccgtcgcgggatcggaaatatacacaggtgggctggaaacccagggcaggaaacagcaagaaactcgtgatcggtctggacccggtgcccaagtttctgcatagactggtggacggctgggcacctgatggaagtatggttgtctccttcaagctgggaaaccgatcccaacctgcttgtctacaaggcgcggacggcgctgaagcggtactcacaccatctggttattggcaaccttctctcaacacgcaaatgggaggtcgtctttgtgacgccagatcccccatacgaacgctggattcgggtgcccaagtcgagacggagcaagagcatctctggtgcggaagatcaggtgggcctggcagaggcagggagagcgagcgaatcggcgaaccgtcccagtggggaagcccgagaggacaacgaccagaaaccagcaagtgttaa

SEQ ID NO: 10265 - DNA, 477 bp, A.fumigatus
tcggtctggacccggtgcccaagtttctgcatagactggtggacggctgggcacctgatggaagtatggttgtctccttcaagctgggaaaccgatcccaacctgcttgtctacaaggcgcggacggcgctgaagcggtactcacaccatctggttattggcaaccttctctcaacacgcaaatgggaggtcgtctttgtgacgccagatcccccatacgaacgctggattcgggtgcccaagtcgagacggagcaagagcatctctggtgcggaagatcaggtgggcctggcagaggcagggagagcgagcgaatcggcgaaccgtcccagtggggaagcccgagaggacaacgaccagaaaccagcaagtgttaacactgcggagggagtggagattgagagtctgatcatccctgagttggtgcagctgcactcgaacatgatcgccaaacaacaggcaaagcaacggccatga

SEQ ID NO: 10266 - DNA, 828 bp, A.fumigatus
agaattggagcagtttcgcagcgaagaccatttacaatggcggcagcaacaacagaggaaatgacgcctgcagagcaagagtctgtttatttcaacaactacccacctccgaagaacctcccaaaacatgaagccctcgccagagcttttatcgaatatcacgccgaagcgaacaggcggctggtcctggttacgtccggaggcacaactgtgccccttgagaaccagacagtgcgatttatagacaacttctcggctggaaccagaggtgcaacttccgccgaatattttctccaagaaggctacgcggtgatcttccttcaccggcaattcagtctgctaccatattcacggcattacagccactcgacgaactgcttcttggactttatggatgaggcacccccatcaggctcgtcagagtctgccaatcccggccatggccctatagtggtgcgcagtgagtatcaggaccagatgcgggacgttttgcggaagtaccgctatgccaaacaaaacaacttattattgcttctgccatttaccacgatctcggagtacttgttcgagttacgaatgttggccaagttgatgagaccactgggacccaacgcattattctacctagccgcggctgtcagcgacttcttcattcctcgagagcggatggcagagcacaagatccagtcgtccgagcttcccgcacaccttgacaattcaaattccgtcgcgggatcggaaatatacacaggtgggctggaaacccagggcaggaaacagcaagaaactcgtgatcggtctggacccggtgcccaagtttctgcatag

SEQ ID NO: 10267 - DNA, 183 bp, A.fumigatus
  unsure (109),(174): Identity of nucleotide sequences at the above locations are unknown.
agggccattgggggactcaaagcttcaattgctttgaactcaagtgtgattgtttggtttactttccgcttgggccgtacttaccttataaaaagccccccctctgccnacggcgctcctttgcaatttttttcaacttacatcattcgactgaccctgtttcagggtctcaanaattgctct

SEQ ID NO: 10268 - DNA, 300 bp, A.fumigatus
acccagccaacgaggcaggtggatttcccggtcgggcccaagaaggggaaaagaggcggaacgaaaaggaaggaggagtttcgcaagatgcttgctaaacagaacggcaacaaagtggacgaagaattacaggaagaggttgtcaagaaaacatgggatagcaatgtcattactccaggaacaccgttcatggacattctcgctgcatctctccgctactggattgcttacaagttgaatactgacccagcttgggagaaggtacgatatttcggcgggtctaatgcgaatgcctgctaa

SEQ ID NO: 10269 - DNA, 1818 bp, A.fumigatus
gacgccgatttgatcatgctgggtcttgctacccatgaaccccatttcagagtattgcgtgaagacgtcttcttccaggagtctcgggcacgaacctgccatctctgtggtcaacagggtcacaaggcagaggagtgcaggggtcaggcgaaggagaagaatggggaatttgatgaaaagcagaaaggttcctctctcaaaccattcatctggctccatgtttccatcctcagagagtatctcgctgccgagctgtatgtgccgcatcaaccattcccctttgacctcgaacgggctttggatgattgggttttcatgtgcttctttgtaggaaatgacttcctgcctcacctaccgtcattagacatccgtgagaatggtatagatactctgattgcaatctggcgcgataacattcccgtcatgggcgggtatctaaccgaggatgggcatgtcgatctgaagcgggctcagctcattctgcagggactcgcaaagcaggaagatgccatcttccggcgtcgtagacaagcagaggaaagaaagctggccaacgagaaaagacggaagcaggaagcaaaggctcgagaagaagaacgagccaggaagcgacgaagaagctcccccacttatgagcccatggactcacccgtcggtcaccgtgctccccgaggtggtggtgatgcagcgccgccgaatcaattggaacttatcacccccagtcgaggagaattgtctcgacagacaagggaactcactcacagcatggtagtcaatcgcggcgctgtttatcgggccaacatggcaaataagagcgcggcggccgtcttgaagagcaagctaatgcagggctctcaaaatggtcaaaatggtgaggagaaatccgagggggccacgacaaacaatgatgagccttcacaggatcagccggatcagacggagcaaacttcgccatcggtccttggcaagagaaaggccgatctcgtggaagaggaggatacggacgcaggaactccaggcagagactcgcctgctgtgcctgttgctgccaaggaggatgagctgcctcccgacacagttcgtctgtgggaggaaggatacgccgaccggtactacgagcagaagtttggcgtcgacccccaggataaggaatttcgccacaaggttgcgcgggcatacgccgagggtctcgcatgggttctactgtattatttccaaggatgcccgtcctggacttggtactatccgtaccattacgctcctttcgccgcagattttgtggacattggcgatatggagataaccttcgacaagggagtgcccttcaaaccatttgaacagttgatgggagttctcccagcctcctccaatcacgctattcccaaagttttccacgaccttatgagcagcccagatagtgaaatcattgatttctatccggaggattttgctgtggatttgaatggcaagaagttcgcttggcagggtgtgattctactacccttcattgacgagaagcggcttcttgccgccatggaaaagaaatacccgcttctcactgaagacgaaaagctccgcaacagcgtgggacgagaggtgttgctgatttcggaggctcatccattgtatcaagacctggtagccaatttctattcgaagaagcagggcgtccagaagtacaagttgaacatgcgtataagtgacggtttggcgggcaaggtcgagcgtaatgaggcctatattcctcatagctctctgccatcgtcactcgaggaatacggcatgccgagtttggaggatgatcggtccttgacgtga

SEQ ID NO: 10270 - DNA, 672 bp, A.fumigatus
ctaacgagttttcatcctagtgtgaactatgagatcccgaagtcaaatcacgttcacaagtccatgcttcttcgaggagtcaaattcaaccctccagcgttggataacgcagatatccaagcagtcaagcacaaggctcaaaactctggaaggtcgtatggcggtgcccctttgcgcggtggacaaaaaggtggccgtatcaactatgcaagcgacaggcctaatcctttcgctgcgcatctcgaccctggtttcataccgcccgtccctggtaatgttggtggcggtcctataatgccttctggctgggttccacccattccagggtccgctggcttctccagaggtcctccccctcctccacatggaggaatgtccggttcgcatcatcggcctccatacgggcaaggacccggtcagtaccaaggcaaccatggccagggcgaccactatggtcagggccagcaaggatactataatcagtcctcatattacaaccagtccaatcagtataatggcaggtcctccgaccatggtggcagcggaggatacagaggcggcggaggataccatcgcggaggtaactatcgcggaggcggttatcgcgatcagcgccaatataaccaagaccagtactcctccagaaactcaggtggatacggtcgttactga

SEQ ID NO: 10271 - DNA, 228 bp, A.fumigatus
ggaggccgcatcatcgatgaatgcgttcaggtaggattcaatgcaaacaccttttgctccttttctgtcttgactaacctcggctgcagtgctctcgctagcttggacgacaacatggccacctcacctccctcgaaccctacctcacctttgctaaccaagtctcaacctgccgttgagcgccgtccttccaaggccccatcgaccaccggcgaggaagcatcatag

SEQ ID NO: 10272 - DNA, 249 bp, A.fumigatus
ctgacatgtgtgcatgctcttctcgttcctctcttgctttgcttttacgccacatttgcatctacattggcttggtgtatgccgtctttgtttgtctgtgtgtctgtctacctccgcttcgctgccattttcattctagacaaaatgccgttagaaaagtttccttctttcccccccctcctccgtcttggtatctatctatcatatcgacgctgcaagcttcatgtctatgcctatgtctcaatataa

SEQ ID NO: 10273 - DNA, 399 bp, A.fumigatus
tctttgattctcaaggccgctcgtgctcagcaagaggccgagatggagcgtctccggcagcaagccaaccgtggcaaccgtccacaaatgggccgtggtgatgctcgcagcttctctggttacggaaaccaggcccctcctcccgactacgcatccagcaaggttggaagcgatgatctccgccgtctgcggacgacacgcaacaccaaccagcccatgtcctttggcccatctagcatgcttgggtctcgtagcagcagcggccgcaagaaccttggccctggaggcaacttggttcgtggcagcgacgatagcgcagccagcagccgatccggaacccctactgccggaaagaaggaagataaggaggccgcatcatcgatgaatgcgttcaggtag

SEQ ID NO: 10274 - DNA, 1875 bp, A.fumigatus
  unsure (1068),(1143),(1156): Identity of nucleotide sequences at the above locations are unknown.
agacaggagagggagcgtaaagagagggaggagcgcgaggcctacgaagcgaacttgaaacaagccgaggccgaggccgaagctctcgaggaggagcgtcagcggaagcgcgaggctgccgcagagacgtctaacaaggagctgtttgcggcgctcaagaagggcggcttagctgctacagaggacagcacgcctgccgacagcggcaccgccactccagtctccgacatctccatgggacctcctggcaagcccgccagtgcccagaagcgggagaagcctgctgctttgaagctggagaccaccaaggcagtcgagcctccccagcccagcgctgccatgaagtcgcttcaatcggcccgcttcgtcgacgacttgagcaagatcaactacccgccctctatcgtttctcctaacccggctctcaatgccaacgctcctgcggaccgcaagttccactacaacaaggaattcttgctccagttccagagtgtcttcaaggagaagccgtccattgattgggatgcccgtgttcgtgagaccgtgggtgagagcgacacatcgcgtcctcagtccgcccgtacgcccatgggagcacgtaatccttctcgcggcggtgtggctcagcctttcgtcatgggctccttcggacagccggcggccagaaccacctctgagcaacgcttcgctgcttctaatgctcgcggtcccgctatgccgtttggccagttcggccgtcctcctgtgggcatgggagctccttccatcagccgtcccggctccaatatgggtattggacccggaactccccgtggtggtggcagccgctccaacacacggaccggcagcaagcgcgagaagcagtccgccaagaaggaggaggagatggccaaggccatgcctcttaccgccggcaaggaagtcaaggcgctccagatctcctcgacgggctggaagcctcgtagcatcgttcagcccgccgccggtcccactccgggcggtcatcttcccccggatatggtgcagcgtaaggtcaaggctcctctcaacaagatgaccctgaggatnttcgaccgtatctccgttcaattcctggaaatcgtatcgcagtccaaggatgaatccgacggacgtactctgcgncaggttatccagnttaccttcgagaaggcaaccgacgaagctcactgggcgtcaatttatgccaaattctgcaagcgtatgcttgagagcatgagccccgagatcaaggacgagaatatccgtgacaagaacggcaatgtcgtcactggtggcagtctgttccgaaagtacttgctcaaccgatgccaggaagagttcgagcgtggttggaaggtcaacttgcctcccaagccggaaggtacgactgaagaagccgccatgctgtcagacgagtactatgctgctgccgccgccaagcgtcgtggtcttggtctcgtcaagttcattggtgaactatacaagctgggcatgttgaccgagcgtatcatgcacgagtgcgtgaagaagttggtcgactacgagggtatgcctgaggaggcagaggtggagagtttgactagtctcctgcgcaccatcggtgccagcctcgatgcttcggagagaggtcacaccttcatggatgcctactttgctcgcatcaatatgatgatggatatcccaggcttaccaagccgattgaggttcatgctgatggtaagtttatctccctttcggacgtgtagctttgggatcaatctaaccgatttacaggatattgttgatctgcgcaatgctcgctggcaatcaaaggatgctgacaagggtcctaagaccattcagcagattcgtgaggaggtatgtgatcgctcatga

SEQ ID NO: 10275 - DNA, 1413 bp, A.fumigatus
ctgccaccccgtggtgaagacattcccttcacatcgcccaaagaggtgtatgatgaatggaggaagatgtcgttcggtcgaccgctcgactgtagcgcgctgacatatgagaaattgaccggtggatcggggatccagtggccatgcacgaaagaacatccatatggaaaagaccgcttgtttgacgacgggaaattcttcacagatacggactactgtgagagttatggtcatgatctggagaccgggaccccgtacaccagggcccaataccaggcgatgaaccctgctggccgggccattctcaagtcggcacagtacaagccatcgctggagatcccaaatgaggactatcctctcttgttgtctacagggcgcaacgtcttccactttcatacgcgcaccaaaaccgggagagcaaggcgtctgcagcaagccgatcaggagccgatcgtgcagatttcggtggaagacgcccaagccctgcatgtcactgaaggggagatggcggtcgtgcgatcgcgacgggggagtgttgagcttccagtgagaatcgggggaatcaacgacggtcatgttttcattccttttcactttggttattgggacgctacagacgggagagcacgggcagccaacgagcttacgattggtaggtacaatgtcgagaagactgactggctggaataccgcatcctaacgaatgcagagcaatgggacccagtttccaaacagccgatgttcaagtccggcgccgtccgcattgaaaagtgtgtccaaaaggaggcagaacgacaaacaatggccgtccggagtgtcgagatgaggaaaccagacgcggcaagcagcgcaggagacaatagcaacgacaagaagcccatccggcggatggagctctggctgggagcgactgaccaggcactggagatgctgcgcgacatgtacgtcgacatgatcccgcgtttggtgcatgatatggagatccaaagtggtctccaggtgatgagacgcattacctgtgagatttcggaccagttcaagcccattattgagcgatatcacgagagccaacaatacggtcgccgggtggccgagcacctacgagacagcattttccctgcgattggtgaatcgaaggatccgtacgaggcactggcagcgctacagtcactggacttgttcctgaccgatatcgaagggcatctaacagctctatctcccgcgagtcaggcactctgggattgtgatttcattgaagcagtcaaattcgcccagaagggcattcaaagacagaaagggtgggttagccagcatatcaaagtgaaaagcccacagacgctactagtcccgtcggcggctgcagaggaattaagtggagaggattctcgaatggccgggcagattcgttgttga

SEQ ID NO: 10276 - DNA, 255 bp, A.fumigatus
  unsure (21): Identity of nucleotide sequences at the above locations are unknown.
ttgaaaaccaatgacgccgantcttccagccccgtggtgaagacgctggaagaacttaagacacactctaaccagccagtctcatttggctgtcgttcgagcctactactaattcatatatggaccaaaggtactaacagtgacataacctccttttttcatgctgaggtacgtaaggtaccggacaactataggctatttgagatcgttgtgaacagtctcttgtgggcagagatcgggctgttcatgaaatga

SEQ ID NO: 10277 - DNA, 222 bp, A.fumigatus
gagctgaagctcaatgtttctgctccaacagtcaggatcatcgcccttttagagggacctgggtacaccgtgcctggtaacctttatgcagcatcatgggcaatcggtctacatcagctgattgctggcttagcatctaacttttctctgttcgtattcaccatgctctccaccatctatcagttccaccacaccctgcttcctctcattctgaccgagtag

SEQ ID NO: 10278 - DNA, 606 bp, A.fumigatus
accatacagctcctaagccacgatagcactaccgcgcaacaaatccccataacctcccaactcttctccatctacaccgaactcgtccgccccgtctacgcaggttcgactctacactccgtccgcgcagccttcgaaaaggccatcggcgatcccgctcatttgccccacacaggcacaggcgcactcacaaacggcgtcagcagcagcacatcaaccgcgctctcaagcctcactctctggaaactgtacatcatgttcgaactctctcgtcatgagatcaaccgcgccaaagaagtcttctaccgcgctattcgcgcctgtccttggtccaaggaactcgttatgctggcgtttacgcacctgcgtgcggacgtcgtccgggaccgatacaaagattccccgagaaagggggaggggatgggcttcgatgaacttcgccgcgtgtataatgttcttgtggagaaagagttgcggatccatgtcgatattgaggaggagttggatcgactcgcggcgaggaggcttgaggatgctgctatgtctctggggccgattcagatgcccgacgatgcggaaagtgagggtgagcggatgcaattatag

SEQ ID NO: 10279 - DNA, 540 bp, A.fumigatus
acccgctggggatgtacgaagtcgccctccagaacggccagaaaatgcccaagctgctcgtcgacggaccttacggcgcccccgccgaggacgtctttgaaaacgaaattgccgtcctcatcggcaccggcatcggtgtcacaccctgggcctccattctcaagaacatctggcacctccgcacaggaccgaacccgccccgccgtctacgtcgggtcgagttcatctgggtctgcaaagacacctcctccttcgagtggttccaggcccttctgtcctcgctcgagtcccagtccgccagcgccgccgccagccagggcagtgccgagttcctgcgcatccacacctacctcacgcagcggctcgacgaggacactgccgccaacatctacctcaactccgtcggtcaggaggtcgacccgctcactgagctccgcagtcgcacgaacttcggccggcctgacttcaatcggctcttcacggcaatgcgagacgggctgcatgaccagacatacatgcctggtttccatccggccatga

SEQ ID NO: 10280 - DNA, 864 bp, A.fumigatus
gacagcatgaagtacaaagccggacaatggctcttcatccaggttcccgaggtgtctaacactcagtggcaccccttcaccatcacatcctgtccctttgatccgtatatcagtatccacgttcgccaagtgggcgacttcactcgggcgctcggtgacgctctcggatgcggtcccgcacaggccagagatatggaaggcttagacccgctggggatgtacgaagtcgccctccagaacggccagaaaatgcccaagctgctcgtcgacggaccttacggcgcccccgccgaggacgtctttgaaaacgaaattgccgtcctcatcggcaccggcatcggtgtcacaccctgggcctccattctcaagaacatctggcacctccgcacaggaccgaacccgccccgccgtctacgtcgggtcgagttcatctgggtctgcaaagacacctcctccttcgagtggttccaggcccttctgtcctcgctcgagtcccagtccgccagcgccgccgccagccagggcagtgccgagttcctgcgcatccacacctacctcacgcagcggctcgacgaggacactgccgccaacatctacctcaactccgtcggtcaggaggtcgacccgctcactgagctccgcagtcgcacgaacttcggccggcctgacttcaatcggctcttcacggcaatgcgagacgggctgcatgaccagacatacatgcctggtttccatccggccatgacgacggagatcggagtgtacttttgcggcccgaatgcggcagcccggcagattcgtgaagcggccaagagggcatccaccagggacgtcaggttcaaattctggaaggaacatttctag

SEQ ID NO: 10281 - DNA, 1818 bp, A.fumigatus
  unsure (815): Identity of nucleotide sequences at the above locations are unknown.
cctcccgtctaccttcttgtaaagatgcaaaaagtgaccaggcatattcccaccaaggacgacttgggcaagtccttcgcctatttgcggctcctcttttccttggactacacgatcgccgatgttctgctcataattgggggcttattattcgccatttgcgccggtattcccttccctctactcggtatcgtcttcggtgacctgatcaacgacctgaatacggtgacgtgcagttcctcggatcgcgctactgcggacctctcctcggctgtgcgggcgaaggtgttgtatgtcatctacatcacaattgcaaacttttgtttcatctacgcccacagcacttgctggtgtttggtgagtgagcgcctggcacgccgctaccgtcgccgttactttgagagcattatcaaacaggaggccaaattcatcgaatcacttccttcgggtgacgttgtttcgcgtctggtcagtgacattgaacttgtgcagtcgggcacgtcggagaaggtgggactcgtcatctcaactctgtcatactttgtggctgcctatgtggttgccttcatcaaagtgcccaagattgcaggcatgctagtctctgtggttccttgtttcttcttgatggcacttggcggagggcattacatcaagaaatttgcgggtcgtctggccgaaaaagtcaatgcggccacatccatagcttcctccagtttgtcacacctgacacttgttcatgccttcaatgcgaacgaacggctcgagaagcgtttcgccgggctactctttgcatcgaagaaagacgcggttcgatnagctactactcacgcggcacaattgggctgtctttacttcattgcctattccgccaacgccctagcattttgggaaggatcccaaatgatctcaaaatcggtggccgacggaaactctggaacctctgtcggtgcggtttacaccgttatcttcgtcctcattgacgcatccttcattctcagtcaggtcgctcccttcatccacgtgttcgcctcggctgcaggcgcttcagagaggcttttgcaggtgatcaacaggccttctgccattgatgggacgtctgattcaggcgataagactgccgcatttggtgaggaggatattcgctttcgggatgttcacttcaagtacccctcacgcccggatgtccctgtcctgcaaggagtgactttcaacatcccgcccaaaaagcatacagcgattgtgggtccttctggcggtggaaagtcaacagttgttgcacttctagagcgcttctacgatcccgattcaggggatgttctgatcggcgacaagaatttccgggacataaatgttagatacctgcgcgggaatatcggctatgtacaacaagaaccttcgttgctggatcgtaccattctggaaaatattgcatatggcttattgtcgtctgcgatggagcggcatcagcggctcgccccctttatcctcgactcgagtctgcctgatcttgccgaaaaaattcgagaaggccttacagagaaggaagcactccgcgagtacgacagtgtgtcaacgagattgtggaccttttccaagaaacggctgccaatgcgatggcgcctggctttattgaagcactggcctatagtttcgccaccaaacgtaggtaccgcaaggaatcactttagcggtggccaaaaagcaaccatttggtttttgccctgctcttggtcgagaacccttgctgtttatatttggacaaagcaattgtcggttttgattttaaccgttgaaccactttatccaggccccttttaa

SEQ ID NO: 10282 - DNA, 270 bp, A.fumigatus
atctcattcgcattcaactcattcattttgcatcattgcttatctactttgcgcttggccctcgatacagcccctggaggctggcgcgctgatgctggcatcctaacatacagtagtcgcttcttgtccctccccctcatttattccctgtgcacatcggttgtctcagacacattcgccccatatgggcaacaatccttcaaagggcccttccggagatgctccgccaagttcggcctcatcaaatttatcggctcccgcaggcgataa

SEQ ID NO: 10283 - DNA, 867 bp, A.fumigatus
  unsure (548): Identity of nucleotide sequences at the above locations are unknown.
catacagtagtcgcttcttgtccctccccctcatttattccctgtgcacatcggttgtctcagacacattcgccccatatgggcaacaatccttcaaagggcccttccggagatgctccgccaagttcggcctcatcaaatttatcggctcccgcaggcgataagaaggtgaatcgccggccgtcaaccaacgcaatatccggggcagcaaaggcaactgcggccgacccctctgcatctattgagacagcaacaggacattcggccacagcacgtcaaactccagttcagcagcgccttcaatcgcgcaatattacagactcttctaggggtaattccgagcgacacgaccgacatgatgcaaagaaagcagagcctcactacagggatattccctcaccggatccttcgaatcctgtgcaagtaccagtttctcgggctgctgccagaaatgatgcgactgtagcaccgtctggcccacctctcaacacatattatagtgcttccacccaccttcaacgtccgcctcggatgcccctacccatcgnggcgatgcaaccgctactccaggttcaccgatcatcggaccgaagactccctatcggttttgtctcgggcgaccgttcattgggcgaacaagcaagtcaagacaatgcaggcatcaccaatactgccattgacgatgaggagacgcttgacgagctcgaaccatataccccgagcggtgtaggcagggctgtaccaacatgtatcgaatggaatggccctggagaaaaagtatacgttactggtacctttgtgaactgggaaaagaaatatcgtcttcacagaaagtatgtaaccctccatgcttactgctgtgtctga

SEQ ID NO: 10284 - DNA, 672 bp, A.fumigatus
  unsure (644): Identity of nucleotide sequences at the above locations are unknown.
tatgtgaacagtgaaagtaatccaggggtcatgtccacaacgttaaatctccgtcctggcacacaccatctgaagtttattgtggatggggaaatgcgggcttcagataatctgccgactgcagtcgattttacgaatcatctcgtcaactacattgaggtcagcgcggacgacgtcaaccaatcgcgcagggggagtgatagaacgaacaaaagtgcagttccttcaggggttcatcctccccaggttattcccaatcttattggggacgaccgcaatggtgtcgaaaatcagtcggacaaggaagaaccagaggagattcccttgggagactttcagactatcatcccccaatttcttgtcgatcttgacaaggatgaagacagtccagaataccagcaagccgctaatgtgattggtgatactcctacgcccccaagtcttccacttttcttgggtaaatcgatcctcaacggcacgacgccgatgaaagatgacagcagtgttctcaactatcctaatcatacagtactcaatcatctcgcgacgagtagcatcaaaaatggcgttctggcaaccagtgtgactaccagatacaaaagaaaggtaagatctccgccaaattccaccacatttgtcagatntagcccaccggggctggaaataccacgt

SEQ ID NO: 10285 - DNA, 1854 bp, A.fumigatus
  unsure (1299): Identity of nucleotide sequences at the above locations are unknown.
tacgagatctaccacctccagcttcctcaggtacgagccctgaaatttgacatccactaccaggatcgcgaccgtgtaagccctggctattggttcgtcgctccgtatggccagatcgagcccgaagcgccgacccatcggttcgaacagtatcaaatcggaccgtatatctacgatggtgacggcactctcgtctgggctggatcgcccatgttcgataatcggaacgtttttgatttcaaagccgtccacagtatcggggatgagccgcatctctcgttggtttggcagcattcatgggacaatgaggatcagggccatggtgtgattttgaaaaacaactatgagattcaaaagaagctcccctttcgagaagatttgggcgcctttgatattcacgaattcaatattcttgatgatggcaagacgggcctggcgatgacatatcgagagcaggagatcagtctggaggacttcgggcgcccggaagagcgaacggcgattctgtccggtgggttcgtgcggctggatctcaacaccgccgacatcttgttcgaatgggactccctcaaccaggttcccttgcacgagtcggtccactatggccccgactcgccgccggaagggcgccccggctgggactatgtgcatgccaactcggtcgatatgaacgctgcgggagactacattgtgtcctttcgcttcaccaacaccatctacctgatctcgggggcggacggacgcatcttgtggcggcttggcggccagggccaccacagcgactttgtgcaggattttaccttttccaagcagcatgacatcaagttcgtcgagtccaatggcactcatcacatcatctcttttctcaacaatgcgtctgacgaggatacaaatgacgagcccgtctccagcgcgctcattgtggagctcgacaccggtgcacaacccatgacagccaatgccatccggcgctacaaccgccccgacggggggctgacccggctgcgtgggaacccgcagctgcttcccaacaacaacctttttgttggctggagtgaacgtgggtacatcaccgagtttgcccccgaaagcgaagtcctgctgagtgcaatgttcaactcgactcgcttctcgacctaccgggcctacaagttttgcgttccacggcgggccccaacacgccgcccgacctgttcccctcccgtccccgggacagacgcatcagatttcgtgaccacgatttatgtcagctggaacggagccactgacgttgcgcggtggaatttttatgcacgcgcngcagccaacgccccgccggttttcattggaaacaccaccaagacgaattttgagaccatctatctcgcccatgggtatctggactgggtctccgccgaggcggtcgatcacgccggcaacgtcctgggggtatcgcgggtccatcggagccgtgtgcctgccgattgggccgcagccgggttcaagggcaaggtgacagaactgcatcctgcagatccacaccttctgtactcgctgaacggagccaacaagcaaaaaggtacccactcaagcatccctgcaggggtcgaagcagatacaagcggtaacagcggtatcacatctgtcggcactgccgaggaggccctccggatagcgcaggagacgtatgaactggtccgggattttggggctctgtttatgtctgtgttggtcctgtgtcttgtggcggggattgcggcgtgtgtctatacggtgctacgccggcggcggcgcacgaaggcgtaccagcatgttccgagtgaggagggcctacccgaggagcagatccggcttcggtcaacgactcaagagtga

SEQ ID NO: 10286 - DNA, 552 bp, A.fumigatus
  unsure (529),(547): Identity of nucleotide sequences at the above locations are unknown.
cgacatatcaaaatgcttgacctctccctccccactgccctcgtcctaatcgacaaccaagcagccttcacccaccccacctactggggcacgtcgcgctccaatcccgcctacgaaaccaaccttgcctctttgcttcatgccttccgcacagcccgaaagaccaaccccaccctcccccttgagatcatccacgtcttccactcctccccctcgcccaccagccctctccaccccgccgacccaagcaaaggcgcgcacccgctagactttgcgcagcccgcagccgacaactccgagccagttttctggaagaacgtcaactcgagttttatcggaacggggctggaggcgtacctccgcgacaagaaaatcaggcaggtggtgtttgcggggttgacaacggaccattgtgtttcgacgacggtgcggatggcggcgaatctgggggtcgcggatgtctatcctgacggaaagccggagatcctcgcggacgggacgcagactgtcaaggtcttcaccacggggntggagggatccacggagnctcaa

SEQ ID NO: 10287 - DNA, 1080 bp, A.fumigatus
acgaacaaagttgccttaagcctgatcctcgtaggtgtggtagaagctgggctttttcctggtcttattacatacctcacgctcttctatagttcacatcagatagcgctgcggacggggtacctcttcagcagcgcagccatcgcgggagccttcgacggcattctagcatacggcattggttatatggatggaattagcgggctgaggggctggcgatggattatgatacttgaaggtatcccgactgtcatcctgggtatcataacttggttcgttctcgcagacgaacccgacacagcctattatctcaacgaagaggaaagagcgcttattgtccgctgccgtaatcgttatgtcgggcaaacagtgtcagcgcagaagtttcactgggcagatgtcaaagaaggcttcctggattggaagatctacgctttcagcatcggccagtttggcgtcgatactatgctttacggctacagcacgttccttccgacgatcatcaaagggatggggtcatggtcgactccggaagttcaggcacttaccatcccttgctatgcgttaggtgcactggcatacctcgccattgcgtggctcagcgatcgactccagcgtcgcgcattgttcatctgcattttcagcgtcatctctatggtcggctatgggatccttatctcagatgtctcctccggcgcgcactactttggagcactgctcattgccctgggattgtatgtgacagttggtctaccgctcgcctggctgccaactacccttccgcgttacggaaagaggacgctggcgacgggtatgcagcttacttttggcaacgtcagcggggtgatgtcgcccttcctgtacaaaacaacagaggctcctcgttatgtgcgcggcaatgccgtgaccttatcactgatcggatttgcgggcatgatgtgggttatgatgtggctttattaccatcatgagaatagccgcagagctaatggacttgaggacgagaagattgcgggcatgacagaggaggagatccaggagctgggcgataatagccctcggttccgatacactacatga

SEQ ID NO: 10288 - DNA, 645 bp, A.fumigatus
tccctaaagcacctcatcatctccatcagtgcttccacccctcacaaaaatacggcctcggccgccatctcgtgccagtgtcacggagtcaccatggccgctcagtccaaattactccctcccgagcgctctatccgacagattctctccagcctatcgtccctttacctgcgccaccgcaaacagatctcccgcaccgtctacctggctctcttcgtcgctctagtcaagcgtgtccacaatgccatctccgagcaaaaggccgcgtcccggtcgcaggtcgacctgcgcaaacggcccggtaccagcagcctaggtgatggcgacgagccgccccggaagagggtcgaggtgaaccgcgagttctttcgaaatctactccggctgctgaagattgtgattccggggtggaagagcaaggagtttcggttactcattgggcacagtgtttttttggtgttgcggacaatgcttagcttgtatgtggcggaattggacggaaggttggtaagcagtttggtgcgaggcaaggggaaggacttcctgctgggtcttacatggtggatgattgtagcggtgccagcgacgttcacgaactcgatggtgagttgctgctggtcttgtaggatcgccatcggattttga

SEQ ID NO: 10289 - DNA, 645 bp, A.fumigatus
  unsure (360): Identity of nucleotide sequences at the above locations are unknown.
ctctcctatcaccagtgcaagcttgctctcagctaccggaagcgtctcacggattatatccacgacaagtatctcagcaacatgacattctatgcgatctcggcgttggatgaccgagtcaaaaatcccgaccaattgatcacggtcgatgtctctcgcttctctgacagcttggcagagctctactccaacttagcgaagccgattctggacatggttatatacaactactcactgtcgaagagcgtgggaggcgaaggcctattcatcatgagtctcttggtccagttgtctgctaatattatgcgggcgctgacgccgccatttggaaaatatgtcgctgatgacgcgcgtctgganggacaattccggttcctccattcaagactgattgactaccgtgaggacgtggccctctatcaccgccaagatgccgataaggactcctggacacagggtacttccccctcattaaccccgtcaaccggattttaccaagaccaatatttccccgattcctgcgaagatttggtcctcaaatatttccgggggagctccaagctggatcttgttttacctgccccgttttcctcccgcctcccccggcccaatcccccccaactttggcgcaacgcccccaaactt

SEQ ID NO: 10290 - DNA, 681 bp, A.fumigatus
  unsure (20): Identity of nucleotide sequences at the above locations are unknown.
ggggggggggggagcttccntccgtctaccatcgtgtataagacgttgcatgggcccattcagcgctttgaggacgaatacccagagactcgggtcaagccagcgtctgttgtatctgcccttcaagagactagctcacaaatctctggtgatgatgcggcggccgcacccgccggtagtggccaattgttcggcatgactatcgacgagaacgctgtggatgatgatgataccgaccagtatgccattcgtctctcacgtactagctcaattacctcactgcatgcacgcgcgatgacttcggaagaaggtcacgttcatcgacttggccagaatctccgccgtgatttcctgagtccgtccttgaatcaaggcgatggccacccttcatcgacttcccttgatgaatctcacttggaagctctgcgaaataagcttgagcgtttgcacgaggagcaaactcgctctcatttcgagggcgcaaatgccgacaaggcgtttgaagaaatgggctctgtcgttgaagaactgtgggcgatggagaaacaggatacggcggcatttgagcaatggcgacaaactcaaattgctgctcaaataaatagcggcaagcagactgcatccccgaagcccagtgatgctatcaaagaacaactggaggtgaaccagaagccgtcttaa

SEQ ID NO: 10291 - DNA, 705 bp, A.fumigatus
actactttaaaaaaaaatacatactctgtctcatcggctccccctccccatacatcatacccggagatcaatgcgccgattaataccaccgcgacccagaatggcgcactccaaaccgaaacacctccctcccccattttcacctcctacgaacggggcctcctccgctcgacctggggcaccaaacgcggcgtcatcagccgcgactccttcctccctttcggctcctgtcgactctgcctacagccggcccgaacgcccgtcgcctgcgccacgaacggcgacctcttctgtcgcgaatgcgccatcaacgatctcctcgcgcaaagacaggagatcaaacgtctcgagcgagaacgcgaagaggcccggaagcgcctggctgaggacgaagagcgggcgctcgaggatgcgcggcggagggaacttcgcgagtttgagcttgtgagcatggggctggaggcggcgaagaatgatcacacgaaggggaccggcggcggcggcggtaatggggatagtcagcggaagcgcaaggcggaggagacggaggaggcattggctgcattcaaggcgcgcgagatcgaggtcgacgggaagcggaagaagatttttgagctggatgagaaggaaatggctcggattgcgcgggaagaacaggagcggctgaagcgggagctgaagcgggagaaggtacttgggttgtag

SEQ ID NO: 10292 - DNA, 354 bp, A.fumigatus
tgggctcaaggcgatgtgtatgtattgccctactacgcgccactcgcgggctcagttcggctaacgaaattagtggcgaaaccctgcggtcatgttatctgccaaccgtgcgtcaccaagttcatgacgccgcacgatgtccccgatccccatgccagcaaggaggaacaagagcggacggcgaaactacacggtctgattctctgctacgtgtgtgaggcggacattacaccgcgggatcccaaggctgaagctgatgagcatggaaccgaaaagggcaacgggaagaagtcgaagaagaaggataaggagcaggggattccgtcttcaccacgaactggaagatccgcgtcc

SEQ ID NO: 10293 - DNA, 372 bp, A.fumigatus
agcgggagaaggtacttgggttgtagttgtaggggctttggtgtacatctggctaactgggtgcagtcggagtcgagcaaatccgcgctcccttcgttatgggtcccctcgctcacgccatcgaccgatcccaacgaaatcgccgctaacaaggccgtcaagatgacgcctatctgtcccggttcgacggacgagaaccgccatgcctattcgctcaagtcgctggtcgatgtgcattttacagaggaaaaggcggcggacggcacagtctcacggatctgtcccagctgcaacaagaacctgagtaatgggctcaaggcgatgtgtatgtattgccctactacgcgccactcgcgggctcagttcggctaa

SEQ ID NO: 10294 - DNA, 1617 bp, A.fumigatus
cggtataaaagtccgctggcattacgagcttcgggaggatcagagcgggggaggaagccaaggccgcccgaaaatcttcgtagaatgagaggttccgccgcgaaggggggaggagtgcccccggggttttttaaagtatgccgaattccaccagccccaagggttcgtcaggggggggccgccaatgctcagatctggaagagataccatatgattgctttgcagccggagaatgcaaaggtgttagtgctggggctgaacctggcgtttgtgaaccatgcgtgcatcgcgaatgcgtctctctactatacgttgcggtatccgagggatgagaacggggaggaagataaaagcctgcccccgaagattggacgggcggtggtgcgtgcgtccagggacatcaggcccggcgaggagatcaccgttgcctacttctacgccaagggggagtgtggcgtacgccagttgatgtccagtatgtactgtaagttctggtgcgtgtgtcggttctgccgggacccggtccgcgagacggagaatgctctcgagaagctctacactctcgagaccatctttgaggacgcagataccctgtataaacggcccgcggtggtgttcaagaacgcctatgagctgatcaagctatacgagcggctcaagatcagcgacacgcgccaggtccaggtctggctctactgcgcggtgattgcgggatacaactgcgatctcggccgagctatgctcttcttgatcaaggcgcgcggcttggttctgattctccatggtcccaacggtcatctgtacgacagaatcagggtctattgtcagatgcctcctctcatgccgggcttcggaactaccacccgcggccgatccgccgtgaaacagtgctatttcatgtttgcagaccaaaagcactctgcagatgtcctgttcatgctcacagcaaagccggacgagtacatccgactgcaccgctaccgtcgtattcccgaccgcctggcaaagcctggagagagcagataccttatccgctacgatgcgcaggacgcgagacggaagaaattcgaggacgaggagccagaccctgtcgagttcatcccatggtggtatgatgccgaggtgaggaaacagataattgaggagaaaacggcaaaggaggcagagcgaaaggaagagagaaagaagacagccaggaagaagaagagggaggaacaaaagcgtaaggagactacaattacgaatccagactgcattgagccagaaaaggatttcctagacgtctgccgcgaattagtagccgaattcgaggctcacgacaagcagaagccagagccgcagcagcgggaattaagagagcgcaacagggacgctctgcaacacctgctaggcgcaaggaatgaaccgaagaagcgagctgacgaagaagacaaaggagaaagcaaacaggagcatgagacccttggcggaccatggacccaggtgtctcctcacgagcatgagccggttccgtcgcagcctgctgtgcaccaggtagcagccagaaagagagtggtgctcgagacgcctcctgttcggccggagaccgagaaatatgctccggttgagctttgctaa

SEQ ID NO: 10295 - DNA, 351 bp, A.fumigatus
gacacaaagatggcccattccaacgatctacaggtcctcccccccagcgccggctatggcatcgtcatcggcatcgggggcatcttcgccctcttcatgctgggcctcacctggctccaaaaccgctacacaaccttctccacccatcaagccgaagaattcaacacggcttcccgatccgtcaagcccgggctcatctccgccggcattgtttcgtcgtggacctggtccgccacgctcctgaccagctccaccttcgcatacagctacggcgtctgcggcccaatgtggtacgccgccatggggaccctgcagatcctcctcttcgcgctgattgcgatcaagatctaa

SEQ ID NO: 10296 - DNA, 318 bp, A.fumigatus
atacctgcctttccctcgcccgaatccatccaaatcatcagatcgaatcaccagaacaaccagcatacatcaatctcctacttcaatcagctcaaaatgcccgctaaccagaaccccggaaactttgccaaccgccctcaggaggaggtcgagagcattgctcgcaagggaggccagtccagccaccagggtggtttcgccagcatggacccccggaagcaggtacgtcttcacaacggtctttgcacgttgacgtcccccactgacgtcttcacagagagacatcgcttccaagggtggccacgcctccagcggtag

SEQ ID NO: 10297 - DNA, 204 bp, A.fumigatus
ttagtcttatccaatgaccaactattcaacattaagctcagctctgttcccggtttctggaatctagaattttactggtggtatggacttttgctgccgagtaactccgatcagcattcagcattagcatttgctggcaggacattatccatatccaccccacaatatgagcgattgagcggtagagcagtcgcagtgcaatag

SEQ ID NO: 10298 - DNA, 183 bp, A.fumigatus
gcctttattagctttggcaacttttaccggcgatttatcaaggatttcttaagaattattgctcccttagtgaacctgactaggaaggatgtcccatttatatggactacagcctgtaaattaagctttaaagccctgaagaaggcatttataaacaccccaatcttaaaactatttaactag

SEQ ID NO: 10299 - DNA, 231 bp, A.fumigatus
tataataataaaggagtcctgcaccctattgcattcttctctaagaagctctcagtcactgagtgcaactatgagatctatgataaagagttgctcaccatcattcgctgctttaaggaatggcgccctgaactagagggtacaccatcactaatcaaagttataactaatcactgtaacctggaatatttcatgtctactaagctgctcaatagacaacaagcctactag

SEQ ID NO: 10300 - DNA, 210 bp, A.fumigatus
  unsure (101): Identity of nucleotide sequences at the above locations are unknown.
tctgaattcctgtcccgcttcaactttaaaattatatatcaacccgggaagcaaggagttaagcctgatgctctgaccaggaggtcagaagatctccctanagaggaggataaacggctacaacaccagagccagacaattctaaagaaagagaaccttgaccctgaaattcagaactcagtgaaactaggagccattacaaatagctag

SEQ ID NO: 10301 - DNA, 186 bp, A.fumigatus
tggaatctggccgttatcttgccgcagtcacaacggaagatgtgtgtatctgctatccttgggaagccacgtatgtactggacctttgtcgctttccttattttctcagatactaacggagactccaacaacaacagggatatcgaagagcacgacagactggccatggacacccccttgttatag

SEQ ID NO: 10302 - DNA, 255 bp, A.fumigatus
gattatcccagttgtacgtccctctgcgttgctccgctcgctgtttacagttgtccaagttgcccgctgacccttgcgcggtttgctcatcagcttcccttctacggcctaatatgtttcgcctgctacctgggtggtcggctcggtctggccatcctgacgttcaacgattgtcccgaggcacacaaggagttgcagaaggagattgagcaggcgaaggccgacctgcgcagcaagaacgtcgatgttgactaa

SEQ ID NO: 10303 - DNA, 627 bp, A.fumigatus
ttctctggcgatgtaacagctagtgtggcgtccaactgccttgttattgatttcagccggttcaccggctgtgatggatccaatggtacgaaggcggctccaagcttgttgattgccagcatggccacgattgcccatgaagatttgcaaaagcacacggggatcaggtcgccgggctgcacaccagatcctcgcaggcgatacgcaaccttcaaggagagcgtctctagctcactgtatgagagcgcgcggtctgccgcaatgactgcaggatggtgccgtcgatccgtggctcggtcatggacaacttggtgcatcgccttgaacttaggctggactaaagcacgctcgttccatttcccaatctggtccaactgccttcggctcactaagcaaatctcactcaggggaatacctcttcccgccctagcaagctcgacgacttcttcgaaggaggacttcagatgcgtagcttggatatcggtcagcacggtggttttgtatgcaagaaaacatttccgccaattggagtcgagatcgagttccagaactaacagcacattgcaagccttcatccggtctggtcagcccttcattcgaggagaatccgtcaggagccatcattag

SEQ ID NO: 10304 - DNA, 2190 bp, A.fumigatus
ccagaccggatgaaggcttgcaatgtgctgttagttctggaactcgatctcgactccaattggcggaaatgttttcttgcatacaaaaccaccgtgctgaccgatatccaagctacgcatctgaagtcctccttcgaagaagtcgtcgagcttgctagggcgggaagaggtattcccctgagtgagatttgcttagtgagccgaaggcagttggaccagattgggaaatggaacgagcgtgctttagtccagcctaagttcaaggcgatgcaccaagttgtccatgaccgagccacggatcgacggcaccatcctgcagtcattgcggcagaccgcgcgctctcatacagtgagctagagacgctctccttgaaggttgcgtatcgcctgcgaggatctggtgtgcagcccggcgacctgatccccgtgtgcttttgcaaatcttcatgggcaatcgtggccatgctggcaatcaacaagcttggagccgccttcgtaccattggatccatcacagccggtgaaccggctgaaatcaataacaaggcagttggacgccacactagctgttacatcgccagagaatcaaagtctggtagaggacctggtcacgactacggtggttgtttccgagaccactgtgtcggagctggtggacgtccataacgagattgtcctgccagcgtgtgacccgggggcgccagcgtattgtcttttcacttcgggaagtacaggaaaacccaagggatgcgtagtagatcacgcggcgttggctagcgtcgcgacccattcccacgcactacatctgggaccgacaagccgagtgctacagttcgcatccttcactttcggggtgtctctgattgaggtctggtgcacactcgctgcaggaggtacggtgtgtctcccgtccgactcagaccgcgtgagccgtctagcggatgcaatcagatcgatgggagtagactggtgcatcctgaccccgacggtgcttgccacgctcgagcccgaggctgttccaaatctgcgcaccatcctcgtggctggagagcctctgaaaaaggcccagttctccctctgggctgagcgtgctcgcctgtttcaagcgtatgggttcacggaatgggcaggaatctgctgcgtgtcgccgcagatcaggtctattggggacgttggcatcattggaacgcctgccaatgctcgatgctggctagtcgaaccggggaatccgaaccagcttgctcccattggtgctgtagcggaattggcggtagaagggccaagtctggcgcagggctatttgcatgatcctgagaaaacggcggcaactttgatcccgccaccgcgctggcgggcgcaatatggacatgccgacggcaagcggatctatactactggtgatctggtctactacgattcgaatggaatgctgcggtacgttagtcgaaaagaccggcaggtcaagatccgtgggcaacgcatagacttggccgagccggaatatcatatcgcgcaggcttgctgcacgattcgcaatgtggtgcttgatgccattgtccccgcggatagtaatggagacgccattctagttgcctttgttcttccctcgagagatgaaagttctagcaatggagggcacgactcaccgttgtttgcggtgccagatgatcacttcacatcttcagtccgacaactgacgtccttcttggaggacaagcttccagactacatggtcccccgactctttctgcagctcaaggagacgcctgtcacaatcaccggcaagattgcgcggcagaagctgcgggaagcggctgaggcgctgcggcacgatgagctggtggccttagcaggacttgaaacccgtgtccttccgccgaatacccacaaggagaccctaatccaccagctggtagttgaactcctccatctgccgccggagatggtcggcatgaaccacaatttcttctcgcttggcggggactctgtgagcgtaatgaaattggtgagtcgggcaaagcgcgtcgggctctctttcacggtgaaggatgtctttcgctcgccacagcttggtgatctagcacgtttgaccgatgtggtcaactcaggagccgcacaacatatgccgcccttctctctgctggatcgcggtgcgcagcccggtctcctttccatggcagccaagatatgc

SEQ ID NO: 10305 - DNA, 195 bp, A.fumigatus
ggtaagcacggagcctgggccggtagagtgagcatcatctcaaaaggtgtttacatcatggacagatatgcgaccaaaggcaaggatgactattcatcggaaacgtcaagtgaagggaagttgattgttgactggttccgatgtttctgttactttccaacgatgcgggcggacatgtgcggtgctgcccaatga

SEQ ID NO: 10306 - DNA, 1467 bp, A.fumigatus
tggctggaagacgaaagatcgccggtgactaacttgacggacacgaatactcagattcaagcgatccttactcgagagtcgttagaagagtatagtagggactaccctgaccaaaagttgaaaaagggcggtatgccaggatatactataaatttgttggatttcgagcttgtcttcgaatacaccaccgcagagcccaagattcatctgtacgtcaagcgtttcagcatcgcatgggataaaagcaggcttaggaggccgccacagggcaagaaaatcagaaacaaacgtgaggtgtatgctttgatgcgatctgcccttcagatggccaaatctcgagagactgccaccacagatagttcgggaaatgggagccactccgatgagtcgatcaagtctcaggacggcgaaacagatgaaatcaacgactctcaaaaccagttaatgtcccagatgcccccaaagcagccggtagaactctttgctagtgcttttgcctctgcaaagacgctgttgggttccttgaaaccctctgccaggccgtcgcaagactcacaacaaaagaaagacaatgatacggatattgtcgcctcaggaagggatcatcatgctcttgacgaagcaaccaaagagcctaatatcaatcgttgcgccgcgcatatcgatgagttgtccgcaggtccctcggttgttggccctcgtcagaacggcaatgcaaccgtcagggaatctgatcaaactgataccgacacggctggtgaagtaccagccaagaccagaagcggcaaagggccttccgatactaagacccaggagagaaccttgacagattataacaaagagccagaccacgcagtgaatattgggacagtctcaaaagagattgtccagaaaaatcatttggaacaagttgatccagctgtggagactattctaacagaagttgataacagcaacgcagacccttgggatggtatgacagagattcgaacagaagacattgctatacccaaggatcaggcaaacctgttagacgagcaggccaagctttgctggttaccgccagcccctggccagggttatccacagcccaatgtgccccctttgctcctacagcaatggaatgaaatcgcgttgcaaagaagtattcgggcggaagaacgtaagatcaaggagttggagaccttggaactccagggatcccgtccgagctcttcggatgctagcagctccactgactccgcctatgagaccccgagcggcgatcggatcgaatggtctcagtctcctccccgaggtcgggacctacctgtggacagtagcccgcccgaggcaagaccggtagaacggcctattgtgtataaaggcaacggaggaaatggtccgtcgaatcagccattccgtgatgcggaagaggaacagcgggcaagtgttcatcacgaaatatcgcatgaacaggaggagctt

SEQ ID NO: 10307 - DNA, 222 bp, A.fumigatus
tggcatagaaatggtctagccatagtcttttggagtcagtccactattattgattcaggacaatacccctcgtatctctctatgattcctttcatgcttgacgcggttccacgcgtaggaccgcctacctttagtggcaatctaaaccgccacaaagtgcctcagccacatccacgtcattgggcagcaccgcacatgtccgcccgcatcgttggaaagtaa

SEQ ID NO: 10308 - DNA, 1248 bp, A.fumigatus
  unsure (1247): Identity of nucleotide sequences at the above locations are unknown.
atggcgtatcaacagtctcaagggacgtcaagtccatccgcgtcctccatcttcctcccccttgggcgacgaggttcacgagcctccgtctcaagccaggccgaacgggaaagtctgaatgcagcccttgaccagatacatacggctgcctaccagtcggattctctcaccgtattcaatgatttcactacccctccggttccggcttccgctacagaagaaaagaatctttcagcagagctgcaaggtggtctgagtggattgtacagccgttttcgaacttctgtaggaggaatgagagacattgtcagcggtgttgggaaggcttcggacaaaagcgctcctgacggaccagcaatgaagagtccaccctcagagcgctcagtttccaagttcgctgctgattcaacgggtcccttggccgaggctcaacaatccaacccaagctcttctcagggcttcaggctgcaatctccaacgcctggcagctctcaaaacactcacgaactgcctacagggaaagcttcgaagctctcatcgaaagccgcaagcatatcctccaaggcctctgtctctccttcgcctacacttaaatctcctaccgtgcccttaccaaagtctaccagcaatgcagcaaccgtagatccgacagttaccgaacttcatgttagcgctgtcaaggaacccacacattactcgagcaacacctccgtcaatgtatcttccagcagcctccagaccgtgggttctacgggtgctgagagagaggagaaccattatgttccttcgatgagttcgtccggtttcagtgagcgactaacgcactcaccagcactgtcggcaaaggcccacaatccgcccaacgaagggcatgccgcattagactccagcaacaaatcgaagctgacaagtcaaccatccgacagtacaaagagactagagaggcgtacctcacatgatctcgagccttcattgactgcgccgctgcaaatgacaaaaaatacaactcagggagaaagcgaggggacgtcacctgctcaagatagaatcaggtcgaactccgccacctcttttggcctcgatcgcgcttcagtaactgcgagctctggagcaaccagtgtttctcagctgcctagtaacaaggctggtaccttgcatgattctcagggtccctctacaagcgcaacctccttgtcgctgatggatggaaacccgaaattagacgcatcaccaaaaggccccttctna

SEQ ID NO: 10309 - DNA, 447 bp, A.fumigatus
cttcgtggacgtatgtacatgcttgccatccattcggacctatgtctccaaacactgatcgcatggtcgcagacatacaaagccatggagaaattgctgtccaccggcaagaccaaagccattggcgtttcaaacttctccaaggcagagatggaacgtttggtccagaacacctcggtcgtgccggccgtacaccagcttgaaggtcatccttggctgcagcagcgttcctttgtcgatttgcacaaatcaaagggtatccatgtcactcattactctccctttggcaaccaaaacgagatctactcctcaaaagtccagattggcaaactgattgacgagccggtattggccgaaatcgggaagaagtacaataagtcctccgcacaggttgctctgggtaagttttcttgtagaccaattcaagctggaaacaatgtttactga

SEQ ID NO: 10310 - DNA, 564 bp, A.fumigatus
tatatttacagcatccttgcggtgataggatttggctttcacaaggtccagccgaaccatagacctttttccctgaccgacccaagcatttcttttccgtatacggaacatgaaacagtctcaacagctgtcctaatggtggtagctctgattgctccggctgtcattattgtgatcacagctttgcttatcccaatgtccacaaaagaccagaatgtgcctcgatcatcactctggagatacaagctatgggaatggaatgcagggtggatgggtttggcggtcgcttgtgcatgggcgtggatggcgaccgagggtttgaaggacttatatggcaggccccgacccgacatgcttgcgcgttgtaacccggatctctcgaatatagccacttatgctgtcggtggcctgggagagaatcttgcaggggcccccacaatggtgacttggaagatatgccaaaacaagtcaaaagtacttgcaaacgacggatttgcaagtttccccagcggccattcatcttgtaagtggctgatgtctgctccagagggtctacaatattga

SEQ ID NO: 10311 - DNA, 489 bp, A.fumigatus
caccttgcagtttcttttgccggtttgacatacttgactttatggctgtgttcaaagctctcaatcgcatttccatacctcggacactctttgttgaaccaaaatccgatcggcccgatcaatggatcaattcgaaagcgtggagcagccccgccggtctatatgcttgtagtcgcctttgtgcctattgcagttgccagcttcattggcgcgtcccgctggttcgactaccgtcatcacgcttttgacattctatttggcagtatcatgggcgctatatttgcatggatcgggtttcgaatgtatcatctccccatcacgcgaggcgaagggtggtcttgggcggcaagaagtcggagacatgcgttcttcaagtctcccagattcccaagtgaagcagatgaacgccggccaattgatacgcacgacactcaaaagacaacgcggcaggatattgatgtcgagagggcagctgagaatctggtgtaa

SEQ ID NO: 10312 - DNA, 255 bp, A.fumigatus
accaattcaagctggaaacaatgtttactgactgtaatcgcatattcagcatggggtgtcacacagggccattcggtactgccgaaatccaagactccatctcgaattaaagccaatctcgagggcgacttccacttgagtgatgaagatatgaagaagattcaaggcatcgacaagaagctacgcttcaatgatagcagcgctgactttggtcgggacttctttaccgacttggagggaaaggggtcggtttga

SEQ ID NO: 10313 - DNA, 1170 bp, A.fumigatus
tgcactggtcctagaagaacggaagcaacgacatggttagatttccaacttgtatttgagcttcgattccaaagagttaatatcgccaacatagatgccaatcttcgcaaggccctctccccgctggccgccaaagcatgcaagatcgtgtccaagatccgcgctcgtgagctcgagaccgtatggtccaaggggtcgacacaagagcaagctcacggagccgatgagattctctacccgggggtgatgttccatctggcaaggggtcgcatggaaaacaccgacttgtggaaaatcgtgcaaaagatgcccaaaggatccctcttacatgctcacatggacgccatgttcgatattgattttctggttgaccaggccttttctaccccaggaatgcacatatttgctccacagccgctcattaccgcgaaggaacttgaggaggcgccgttctacctccggttctcgtctcagccattagaggaatcagaggacaaacctacgatgtggacgtcttcctacgagtcttcacgactggtatctctgcaaaaggcagcctcgtcatttcccaagggtggagaggccggtttccgcgagtggctgaagagtcgctgtgttctcggccctgaacattcctacctccaccatcacggagtagacgccatctgggacatcttccgacgaacgttcccagtcatcaattccattctaaactacgagccgatcttccgcgcatgtctgcgccgcatgttcgaacaactcgctagtgatggaatcagatacgtggactttcgtatcgcatttgtcttcgagtaccgacgggaaggacgtgatacgcccgaggaaggctacttcgagtggtgccgagtcttcaaagaagaactcgaacgctttaagaacaccgaacaaggccgacggttctacggggcccgcatcatctggaccaccctccgcaatttccccaacaaagacatcgcagccagcatgaagcaatgcatcgagacgaagctcgccttcccggacgtgatctgcgggttcgacgttgtcggacaggaagaccaaggccggccgctggtcgatctcgtcccagtgttattctggttccgcaaacgctgcgtcgaggaaggcgtgaccattcccttcttcttccacgcaggcgagtgcctcggc

SEQ ID NO: 10314 - DNA, 183 bp, A.fumigatus
ctacagaatctggggtggcaaaaatgggattctcatgatctcgctcagcccgaggccaacgtcctaggtagtaggtactccgtaatagaactcgcgggtctggagcatacattttataataaggcaagcctggagctacgcgttatgggacaaaggatttctagggatttgacagcacaatag

SEQ ID NO: 10315 - DNA, 207 bp, A.fumigatus
gacaatcacccacagatgcaggcaatgtggaccgatcgtaacgtcgaactggaagagccagaaatctacgtcgttttcagagtctactacttgggtaaggagaacatggggctgaaggtttatgttgatccggaaaggctacggcaagaggagagattaattttctcgccggagtcctacagtgtttatcccagtctggtcgcatag

SEQ ID NO: 10316 - DNA, 312 bp, A.fumigatus
ggaatactagatttagtatctctccgaaagtgtgtctggaatggacacccctctcttcggacgaagcaccctcttgctactcacccggaatactcgaacgatccacatgtggcatgtttgttcagagatatactctctgttcgtgatgccgacgttagcacgtacgtcgaggagcttcagtggcgcaaagacaacgcggatgttggtttggacgacctgaaggcgatttataactgtatcttgcagaatatacagaatcccgaagatggcgctatgatactgtacgagttatgcatgtggcatgaaggttga

SEQ ID NO: 10317 - DNA, 615 bp, A.fumigatus
ggaacaatgccgtcgcgccgatctcactccaaatctcatcatgggtgcacccagtgcaaggggcgtcaaatcaaatgtgatgaagtccgtccgatctatggttcctgccgcaggaaacaactcccatgtaattttcaaagctttgcgccccaaacctccccgcagccgtcaattgccgatgccattctagggcatcgggacagttttgtactcccactgctggacttggagctgttgcatcactggcataccgtgacagggaactacctaccagatgctaagccgctgcaggatgtcatacgcaccgtcatgccacaggaggggctggcgaaccctttcttgatgcacagcatcctggcagtttctgcccttcaccgggcacacagtgcacccttgagccatcgccatatgtactctgaggccgccacgatgcatcatagccggtctctggcattgtgtacccctttgttcaagaacattacccgccaaaactgccacgccctgtttgcgctgtcttgtctggttccagtctttgtattcacgtctcggaacccaagcaaaaacccgaggatccaaagtctgaccgcagtggtccaagcgttcaggttagttcgt

SEQ ID NO: 10318 - DNA, 1227 bp, A.fumigatus
cagcgaggccaagtcgcggaaacaaagatggctattctttctctcgtcatcctaggcggactctgcctgtccacagcctcagggcaagcgcctacgcagcctgaacccttcacaattgtcgaacttcccctccctcccgtcgtgtcgagcaacgctgttggggcctgcaccactgacgtgaatccacgtcgaacgggctgcattggtcagatatcagaggaatttcaggccggtgattttacatcagacgggaagcatgtcattgtcaatgtcgagttcgtgggcgccccagctgctcctgatcccgccagcgtatataccggcaagcagcttatcctcgtcaaagccgacggcaccaactttagcaacggtgacccgtggaagtgccttagctgcggcgttcccgctgcaaatgcccggtcacttgactcccagagagactatccacatgttgctcgcagtgggaaaagggcgctctggggccacaacatcgtggaatgcagcggtctgcttttggctagcgacgaatgcactccgaataggacctgtagctaccccatttactggcctgtaaacgcagatggttcggggccgggtggagctccccgtgagatgcgtatgcatccagacgatgagcacatgggatggagctcattcacgtccaatggaggacagtttgcctactttggccggcttgcattcaacaagaacccatcaactggcaacatccgagcccctcgctatgacctggtcgatgtcaacctgctgattttacccaacgggccggctcctattatggcaaacggggatgaactggagttacacgatgaggccatcacagtcggagagctgcgcggattcagcggctccggggatgagattctttacattggctcccctagggaggcaaataatatcgatgtgtttgctgtccaccttgtcactggcgccgttcgccgtctaacgagtcaccctgaatatacagaccctgtcgcgttctctcgtgatgataagtggttcgtcgcaatggacacccggggctctgatcgccagatgtggatgtctggcatgcgcatggtccctcccctgattgacctggtcactgtcacagccgcatcgtcaacgcgcaacaatggcccgcgtcgcttctttcaacctatattaatcgaccgccatggtgaccgtggtgactactttgtcttcaccacggggctggaagaatccacg

SEQ ID NO: 10319 - DNA, 756 bp, A.fumigatus
ttgaggtatatagctgaactccccccggatgggtcaacctgcaacgacatcctgttttcactactaggacttacatacgacgctgtgatcgcctcaaaaatggtcggactcgcagtcgagcacaacatccaagtcaacgatggccccttgacctccgaaaacgccgctgttctccgtccctcagacccctccctccccctggacgaactccgcgcccgctacgaacaagacggctacctcttcctcaaacaccttctcccccgcgacgacgtcctcgaagcccgcagacagtacttctccctgctcgccccaaccggcgtcctccaagaaggcacagaccccgtccaaggcatcttcaaccccacgaaatcccccgatcagtaccccggcatcggcgccggcgcagtaggcaacaacggccgtccggggggcgaccaggctgcagagtttgtggatctagccatcgaggcgcattaccaggattggtatgcggacaagttctgcaaccatcccgctttggtccgctttgtggccgagttcacgagctggggcgagcgtacgttgaatttccgccggacgctgctgaggaataatacgcctggtacgaaacccattggcgttcactacgatcagatcttcttgcggtatggggagccgacgagtgtcacggcgtgggtgcctatgggggatatcaaaatcaacggtggagggttgatctacctcgaggatagtatgctgtcgtcttgtgtgccttga

SEQ ID NO: 10320 - DNA, 282 bp, A.fumigatus
caatgcatctgcacattagctgacggaccaggcgaccctgttggactcaaaatcgaggaagaattcaccaccaaggccaagcaggccggtttgaccgatgaagaggctagatcggctttcaactcgaacatgatggcgacgggccttttgtccgagtcgccgatcgagtttgccaggcagcatggccgtcgctggctggtgtccgcctatgaagccggtgatgttgtcttgcacaaacctcatatggtatgtctccgtccgttacctcgaatgttatcctga

SEQ ID NO: 10321 - DNA, 576 bp, A.fumigatus
actccccccggatgggtcaacctgcaacgacatcctgttttcactactaggacttacatacgacgctgtgatcgcctcaaaaatggtcggactcgcagtcgagcacaacatccaagtcaacgatggccccttgacctccgaaaacgccgctgttctccgtccctcagacccctccctccccctggacgaactccgcgcccgctacgaacaagacggctacctcttcctcaaacaccttctcccccgcgacgacgtcctcgaagcccgcagacagtacttctccctgctcgccccaaccggcgtcctccaagaaggcacagaccccgtccaaggcatcttcaaccccacgaaatcccccgatcagtaccccggcatcggcgccggcgcagtaggcaacaacggccgtccggggggcgaccaggctgcagagtttgtggatctagccatcgaggcgcattaccaggattggtatgcggacaagttctgcaaccatcccgctttggtccgctttgtggccgagttcacgagctggggcgagcgtacgttgaatttccgccggacgctgctgaggaataa

SEQ ID NO: 10322 - DNA, 258 bp, A.fumigatus
gtggatcggcaacgactgggtcatcctcttctcccaccccgaagactacaccccgtctgcaccaccgaactggcagacctagccaagcaccaatccgaattcgccaagcgcggcgtcaagctgatcggcctgtccgccaattcgattgagtcgcacgatggatggatcaacgacattaccgagatcgctggctgttcgttgacattgcctgtcattggcgatgaggatcgcaagattgcccatacttatgatatgtaa

SEQ ID NO: 10323 - DNA, 360 bp, A.fumigatus
caaagtgcgacgaggaacaggctcgaccaccaggacgtcaccaacgtcggcgcccgcggcatcgcctacacgatccggtctgtatttatcatcgattccaacaaggtgatccgcctcatccaggcgtatccggcctctaccggtcgcagcacaactgagctgctccgtgtcgtggattccctgcttgtcaccgacaagtactccgtcaacacccccgccaactgggagcctggtgatgatgtagtcgttcccgcgggtctcactgccgaggaggcgcaggttaagtatccaaatatggaaactgtgaagccgtatttgcgcttcataccattggccaggcaccatctttatcagcattag

SEQ ID NO: 10324 - DNA, 222 bp, A.fumigatus
cgatccacaatgttaagtcaatgtgctgccaatcatttgacaattctatctgactatgcgtcgatctacagactccgcctgggatttaaagcccccaacttccaagctgacaccaccatcggtcgtatcgacttctatgagtggatcggcaacgactgggtcatcctcttctcccaccccgaagactacaccccgtctgcaccaccgaactggcagacctag

SEQ ID NO: 10325 - DNA, 591 bp, A.fumigatus
cacctaatgctgataaagatggtgcctggccaatggtatgaagcgcaaatacggcttcacagtttccatatttggatacttaacctgcgcctcctcggcagtgagacccgcgggaacgactacatcatcaccaggctcccagttggcgggggtgttgacggagtacttgtcggtgacaagcagggaatccacgacacggagcagctcagttgtgctgcgaccggtagaggccggatacgcctggatgaggcggatcaccttgttggaatcgatgataaatacagaccggatcgtgtaggcgatgccgcgggcgccgacgttggtgacgtcctggtggtcgagcctgttcctcgtcgcactttgttagtgtcgagccaacagtgggcggcagacgaaaaggggagagatcccttacatatcataagtatgggcaatcttgcgatcctcatcgccaatgacaggcaatgtcaacgaacagccagcgatctcggtaatgtcgttgatccatccatcgtgcgactcaatcgaattggcggacaggccgatcagcttgacgccgcgcttggcgaattcggattggtgcttggctag

SEQ ID NO: 10326 - DNA, 315 bp, A.fumigatus
  unsure (253): Identity of nucleotide sequences at the above locations are unknown.
gtccgcatcgcgtttccttccagccccggtgttgaagacgagatccgccttacaaagaacctcaattcagtcaacttccctgaattctcgtctactcagagcctcaactcatatggcgatgtgcggacgcaattgattcaacttgcggagtatgaacacatacacactctctcatgcttgaatgatttgacgcaaatcttggagaattctggccgtcaaaccatctccctctacctgcaaatgtaccaccgtngttgtattatttacaatgaaacatgtgtcaagtatgctgttggctctaccacagcgatgtga

SEQ ID NO: 10327 - DNA, 225 bp, A.fumigatus
gtatgggcaatcttgcgatcctcatcgccaatgacaggcaatgtcaacgaacagccagcgatctcggtaatgtcgttgatccatccatcgtgcgactcaatcgaattggcggacaggccgatcagcttgacgccgcgcttggcgaattcggattggtgcttggctaggtctgccagttcggtggtgcagacggggtgtagtcttcggggtgggagaagaggatga

SEQ ID NO: 10328 - DNA, 222 bp, A.fumigatus
acctcagaaacaatcagatctagcctgtataatatctgtaaatatctaatcatgtgcatgtctaatactgaattttcttacaaggtgggtaaaagtgccattgagaagtacaagaaagttcatgaagcaaaagcagtgactgcacaactctggcagtcgatatatggaatggagcagcaaaaaccagtttttgcaagattgctcttagtctcccagagctag

SEQ ID NO: 10329 - DNA, 330 bp, A.fumigatus
gcctgttcaagatgctggcaaggtcggctcaatgcggagcagctattaccccaatgctttcaaggtgagtcgatctcatgcaggcacggagacgatgctcaccctcacgctcgaccgcagagaatccgcgctgcagagcaaagcctcaacatcgataggaacaactacctccacatccagatgatggacagactctggggctcgggtgatcccaacgagtccctgactgacacctactacgccgcctacgacgaccaccgttatctaaagtgggccagcgtcgccgtctccaaggacagctacatcagcacatcctgcagcgaccagctc

SEQ ID NO: 10330 - DNA, 300 bp, A.fumigatus
atccgttcttcgatgctaccataccagccggatcacccctttgattcctccaaccccaagtctggatctgtgtcaacacaccgagcattgaagatcgccaggcagcaggtttttttggttttttctttttttttttataatagccctccaatttatctactgcccattcacgttctccagcgtatctcgacaaccgacggaatgctagcggctagtcttagtctcgcacgtcacagtctgcctggggaaacccgacagcatacgcaaatgatcggcatcttcaggctcaggggcggctaa

SEQ ID NO: 10331 - DNA, 900 bp, A.fumigatus
caggaatgcggatcgcatttctctttgcgtcgatattttgtgaaaggcagctcaattaaaatgattagaagactcgcagctttcagcgctctatcgggcctggcaaccgcctggctgcccgaggtcaacaagaagatcacctcaacaaacgggacgaacctcttcacgagttcgaacggcaagatccggggcgtgaatctgggctcccaatttgtctttgagccatggatcgcagagaaggcgtggtcggatatgggctgcggcggccagaaatccgagttcgactgcgtctcgcgcctgggtcaggccaacgcgaacagtgcttttgcgagccactggggctcctggatcacacaggatgacatcgctgagatggtaagttatgggctgaataccatccgggtccctgtcgggtactggatgcgcgaggacctggtctactcggacagtgagcatttccctcaaggcgggttgcagtacctggagaatttgtgtgagtgggctagtgatgcgggcttgtatattatcattgatctgcatggtgctcccggggcccaggcgccgcagaatccgtttacgggccagtatgcgcccatcgctggattttaccaggattatcagttcgagagggcgctgaagttcctggagtggatgaccaccaacatccaccagaacgacaagttccgcaatgttggaatgctcgaggttgtcaatgagcctgttcaagatgctggcaaggtcggctcaatgcggagcagctattaccccaatgctttcaaggtgagtcgatctcatgcaggcacggagacgatgctcaccctcacgctcgaccgcagagaatccgcgctgcagagcaaagcctcaacatcgataggaacaactacctccacatccagatga

SEQ ID NO: 10332 - DNA, 210 bp, A.fumigatus
tcaggtcatgatacggatacaatgtcaatttatagtttgacaccaagtatcgtgcgactgtctccccataataagggcggaacagttctgtgggagtatgccacaattgacgggccacgtccggctgtgtttcatccaatttattttcgaattctgtataccgctctccgagcatgcgatggaatgccggcccgtcttcgatgttattga

SEQ ID NO: 10333 - DNA, 1311 bp, A.fumigatus
cttttgcttgctctgcagacacatctgtcaatggcaaatgtacatggtatgctgatcagttctgctgtttttgtagatagtctatataatcctcattacggctatttctcgaaacacgcgaccatcttcagccccggcgagccgtttgatttcaataacatcgaagacgggccggcattccatcgcatgctcggagagcggtatacagaattcgaaaataaattggatgaaacacagccggacgtggcccgtcaattgtggcatactcccacagaactgttccgcccttattatggggagacagtcgcacgatacttggtgtcaaactataaattgacattgtatccgtatcatgacctgatcatatacgagatgggagccggcaacggtacaatgatgatcaatattttggatttcatccgggatacagattacgaagtataccagcggaccaagttcaagatcattgaaatctcccccgcactcgcgagcctgcagatgaagaatctgaccgattcggtgaatgcagctgggcatatggaccatgttgaaatcatcaaccgatccatatttgactgggatacctatgtacattcgccctgcttctttctcgcgttggaggtgtttgataatttctctcacgatgcgattcgatatgactgcaagacggaacttccccaacaaggcggcgtgctgattgatgcggacggcgaatttcatgaatactacaatgcgcaacttgaccctgtggcttctcggttcttgcgcgtcagacaggctgcggcgcgtcggccgttcccgagccctctgggccccaaagctatgcgccaattgcgcggtgccttgccgttccagagcccttatacccttcctgagtacattcgtactcggctcatgcagttctttgatatcttggatagctactttcgtgcacatcggctggtcgcgagtgactttaatagtctcccagatgctgttccgggtatcaatgcgccagtagtgcagacacgttacaagagacgaacagtcccagtgtctaccccctttgtaagtactttcttttttctgacgcttcggacgcattctaattgtgcaatacaggttcatcaaggctacttcgatatattcttccccaccgacttcaacgtcattgaggatctctaccgcgccattactgggaaactgacacaagtgatgagtcacgaggatttcgtccgccgttgggcgtatatagaagacaccgagacgaggagcggcgagaatccgctgctgacctggtacaaaaatgccagcatgctgatgacggtctag

SEQ ID NO: 10334 - DNA, 396 bp, A.fumigatus
  unsure (133),(177),(336),(337),(359): Identity of nucleotide sequences at the above locations are unknown.
ccacgcaaactgataaacatcatgacaccctcaccaataccacattggaaatcagcggtgcagcaaaaacgcgcagcccaactcaacgccatccccccctcctggcgtctcccttccacaatcctcacacctnccctacccaataccctcgaaactatccgatcatgcggtctgctntctgcggaggagcttgaatggaccgagactaacgatgtgaccaatctcctttcccgcctggcttcccgggaggtgagtttcgtacagttgactacagcgttctgcaagcgggcggcaatcgcgcaacaaatgaccaagtgcctgacggagatcttcttnnaccgggcgctacgcgagcgaanggactggatgatcagtatgagaagactggttttttga

SEQ ID NO: 10335 - DNA, 186 bp, A.fumigatus
gcttctataacaattcagatcactaattgtcgatcattgccaggcgcatccatggcgtcaatcacgacagaatacatcagtgttgggggaaacaggcatccggccgccgcagactgggatgtgcagttaggcgtgctcgcctttggcgcagataacaatgtggccttgtggaatccaagtgtatga

SEQ ID NO: 10336 - DNA, 2343 bp, A.fumigatus
gatgcctctcagcgcggggtctatgccctcctcgttggccatactgacaaagtcagtgcggtcagattctacacatgtcctgccacgggtacgaagctacttcttaccggctccattgaccaaacaattcggatatggcgggctgatacagtcgaccccaccaaatttgcccatgcacatactcttacgggtcatacaggctcagtaaatacgattgccgttgccgatggcgtcgctatcatcgcatctggagccgcagatggtaccgtcaagatctggaagattgacacgcaggaaacagtaataagggccgatctatttcagagtcttacgatgaaacctcgcttcttcccgttggcattatcattgaagccgctgtcaacaccgctgtcaacagaattgaaagacaaacctgtggtattggcagtcgccggcacgatgaataatgttcaggtctatgtttctgaggacacacttgccggggcaaactttagactatctgcgactctttcaggccacgaggcatgggtacgttctctctccttcacggaggataaacaaagcaagtccggggacctattgctcgcctcagccagtcaagataaatatatccggttgtggaggcttcaacgaggagaggccaccaagtctgcactatcagatgatgcagatcctatgcttggaggacttgaaaccaccttatccaataaagctcatcagttcgaagcagctgggtccaaatattcggtcactttcgaagctcttctgtttggaaatgaggattggatttacaccgcctgttggaacccaagcacggaacgccaacagctgctttctgcttctgcagacaatactttgacgatctgggagcaggacccagtgtccggagtatggctctccgtagagaggatgggagagattagcgtccaaaagggatctaccacagctacaggaagcactggtggtttctggattggtctttggtcgccgaacggaaggcaagtcgtgagtctgggccgaacaggtagctggagggcatggaggtatgatgccgatcgcgatatgtggctgcaggcactggggattacgggtcatgtgcgctctgtgaatggtgtgcagtgggaaccaacgggagggtatttactttccaccagcgcagaccagactactcgcctgcatgcagagtggttgcgtgagggactgaagtcttggcatgagttttccagaccacaaattcatggttacgatctgaactgcattgatatcttgggacccgctcgctttgtatcaggcgccgacgaaaagcttttacgggtgtttaacgagccgaaacccatcgcacaactactggagaagctggcgggattcaaaccaggaacggacgaagagcttccagatactgcccagattccagttctcggcctgtctaaccaggccgtgggcgatgacatcccaatggaggtagacgaagagagtgctgcaggggcgcggcaggtccaagcaaaccaggcaatgatatcaaacctgtggcatccaccactggaagaccagttggctcgctatacactatggcccgagcatgagaaactctatggccacggttatgagatatcagccgttgccgtgaaccatgatcgcaccctggttgcgactgcttgtaaagcaagctcaatagaccatgcggtgatacggctgtacgacacttctgactggcgtgagattcgaccttccctgaaagcgcattctttgactattacaagtctttgtttttcgagtgatgaccgataccttctcagtgttgggcgagaccggcagtgggctgtcttcctacgaagtgggcaggacccttcttcattctcgcttctgacatcgaatcccaaaggccattttagaatgattttagatgcggcatgggccccccaagtggcaaaacctgtcttcgcgacggctggccgagacaaatcaataaaactatgggagaaggtccaggactcgttcacttgcaagacgactatctctctagaaaactcggtcacggctgtttcaattcttccaagtatacttgacgcttccttcttccttgcagcgggggaagaaagcggaaaattatcgatctaccaggtgacagttgacggtctcgaagcgagacacattgctactgttgataggtcggtatccccctctagagcgatcacccaattatcgtggcggccgtcccaccggacggatgttagagatactcagagcagatttgagcttgctgtggcaagtgaggattcctcggtgcgtgtatatgctatttcgtcttcaccacgcgggtcgaaggatccacgctatgcgtat

SEQ ID NO: 10337 - DNA, 477 bp, A.fumigatus
agacaaatccgttccaacccaggaggtcaagcatggcattctttcttcaaaaataaagtaatgcgcaggggctggcttgagtggcttcagatgtcgatgccgagcaattattatccatcaagaatttctatgcgagtttttattgtgcttcaatcagtcgacgtatccatagtgtcagtcacagtctgcgtcaagggctgtcgtcgtgccgctagtctctccgccttaaatgcatcaatcctggccttgagctccgtatctaggcaaacccagtcagccgcgtcgctttcgacgattaagaaagacaaaagacaagagcttaccaggggttacatcttccatcttgagcggagctctgttgaacggatcatgtgggtcactcagaagatgagatcgaagagtagaacgatccatggataccttggatccagggaggataactggatcttccatcaaggtatagatcaggggatctag

SEQ ID NO: 10338 - DNA, 1539 bp, A.fumigatus
  unsure (4),(10),(11),(16): Identity of nucleotide sequences at the above locations are unknown.
cctnacttannccccnagtggtggacacacggggaaaaagggactaccaacttcatcactgaaatctcttttttgacggttgctgctcatcactacggtagtgagtccctgacgtcaaagctggaccagcttgagaaggaccttcggcacatggagggtacgatcaggaggtttgagctggagcgacccagatggatccacaatccagtgcagcttagggtattcgaacaggctctgaggaaatacaaggacaagctggacctgggtctggccctgaagtacagtctgcaaggcgttctgttcgacgaccaatggcaggcacgttccatgctgttcatgagatatgtcatcgtttggctgctcaggcttgtgtccggcgtcaacttcccaaaggaaccgatcaagttgcctcttccggagcagcagccggaagtttttaaatgtctccccgaatactttgtggatgacattgtcagcaacttcaaattcatcatgtggtgcatgccgcagataatcactgcgacacagggggacgagttagttatgctctgtatcacttttctggagagttcggactacatcaagaacccttacctgaaagcgggtcttgtttcgatcctgttccgggggacatggcctcgccctggtggcgcacgcggtgttctagtcgatcttttgaactctttcccttttgctaatgaatacctgctgcatgccgttatgaagttctatattgaagcagagcatacggggacgcacacccagttctttgacaagttcaacatccgctacgaaatcttccagataatcaagtgtatctggccaaacactctgtatcgaaacaagctctacaaccagtccaagcaaaatctggactttttcgttcgctttgtgaacttgcttctaaacgacgtgacatatgtgcttgatgaatcctttggcgcattcatcacgattcatgatacccaggtggagctcagtcgcaatgggaacaacatggatcctcaggagcgtcaacaaaaagaggagcatcttgcatccgctcaacggaacgccaaatcctacatgcagttaacgaacgagacggtcgccatgctcaagttgtttacggaagcattggcagactcgttcaccatgcctgaaatcgtccagagattggcagacatgcttgattacaacctggatgccatggttggcccaaagagctccagcttgcgagtagacaatctgcaagagtacggtttcaacccgcgggctttgctgagtgagatcgtcgatgtgtatctcaacctgatgggcaaggaaaacttcatcctcgccgtcgcaagggacggacggtcctacaagccggcgaattttcaaaaggcaggggagatcctccgcaaatggtcgctgaaatctccggaggagctccaacaatgggaacagctgcaggcgaaggtcagggcggccaaggaggctgatgaacaagccgaggaggatcttggcgaaattcctgatgaattcttgggtatgttcggcgaattacttacgtggtga

SEQ ID NO: 10339 - DNA, 372 bp, A.fumigatus
aatctccggaggagctccaacaatgggaacagctgcaggcgaaggtcagggcggccaaggaggctgatgaacaagccgaggaggatcttggcgaaattcctgatgaattcttgggtatgttcggcgaattacttacgtggtgatggccagatagctgatgggttttctctagatcccctgatctataccttgatggaagatccagttatcctccctggatccaaggtatccatggatcgttctactcttcgatctcatcttctgagtgacccacatgatccgttcaacagagctccgctcaagatggaagatgtaacccctggtaagctcttgtcttttgtctttcttaatcgtcgaaagcgacgcggctga

SEQ ID NO: 10340 - DNA, 492 bp, A.fumigatus
caatcacaggaatccaacagcctcaataggagcatcgtaggcgcatggagcacgaactctaaaccgcaaaagtcagccgaacccagcgcttctgaaagtgcacctacgcctgcaccagtcccgacaaagagacgacagcatggaggggaatctcaatcgtccaaacgacgcaaggccgacgtgactgttgatcgctcgcctccgacacatgtgagccttgcggatctgggtggattggacgacgtgattcagagcttgggagatctcctcatcctgccaatgacccgtccacaagtttttgtgtcgtcaaatgttcaaccaccccgtggtgtgctattgcatggaccgccaggttgcggtaaaacaatgatcgccaatgcgttcgcagcagaactaggcgtcccattcatcccgatatctgctccttcgattgtatcgggaatgtcgggagagtccgaaaatcttcacgacgaggagcaagaaacgcgtcaa

SEQ ID NO: 10341 - DNA, 396 bp, A.fumigatus
cgtggagaattgctggtattaagggccattctggatttgaagaatcagcgcgataagcttcgtcagtatcaaaaaagaatcactgtcctcacagaccgcgagaccgccatagcaagggaatgccttgcgcgagatgaccgccgacgtgctctgttggctcttcgtcgcaagaaatatcaagaaacactcctaagtaaaacggatgcgcagctggagcagctggaacatctgacaagtcaggtggaattttcgctggtccagaaagatgtcctctttggcttgcaacagggaacaaaggtgctccaagctattaacaaggaaatgggaggtatcgaggctgtcgagaagctgatgggcgaaactgaagaagccagggcttaccaagaggtaaagtaa

SEQ ID NO: 10342 - DNA, 936 bp, A.fumigatus
gaatataccgtgacccaagttagcaatccatccctgcttgccaccctggaagcccttgaccatgacctcgacagcttcggtaatagcttcgcgactaccgtaaagtatgccggggtcggcattgccctggatcgttacgcggcccttcgcaatctgcatcgcctcagcaggatcatgcaaccagtcaagcccgacaacattatagcccgactcgcaaagatcctcgagagcgtaccacgcccctttggcaaagacggtcattggcacgcgctccagacccatcgcgtccagtcgcttggggaggttggcagaaatgtaccgcaggtatgggagagagaaggtcttgaatgccgcaggggacatttctccggcccaggagtcaaacacctggacgagctgcgccccggaggcaacctggagggcgagatactccacgcagatctcggcaatcttctgcagcagtgcctgcgactcctttggatacttgtagatccacatcttggactgcacaaacagcttggttccaccaccttcaaccatgtagcagagcagagtccatggggcaccgcagaagccaatcagaggcacgcggcctttcaacttgtgccgggtaagcgtgatggccttgtatacatagtccagctcctccttcacgttgacctccttctgcataaccttctcgtattgtccatcgtccggcgacttcagaggttcagggaagtggggtcccttcttgtccaccatttctacctgcattcccatggcctgagggatgacaaggatatccgaaaatatgattgcagcatcgatcaatcctgcataccgatccacgggctggatggtcagcgtggatgcaatctccgggttccggcagcattcgaagaaatcgcggtttcctttcgcttcatggtattcggggaggtagcggccagctag

SEQ ID NO: 10343 - DNA, 312 bp, A.fumigatus
tgggacccgtcaaaacccacttctgatattgactgctccgtacataacttgtctacaatccatctttcgttttatcaagctcgtgtactgagtctgttttccgtgacgctctggatccacatattgaaactcatcacaatggaaacagacgctggcttcatcgccgccttggaggaggcaaagaaaggcgccgctgaaggtggagtccctatcggtgcagctctggtgtccaaggatggcaagattctcggccgtggacacaatatgcgcgttcagaaaggaagcgccaccttgcatgttagtcccaattga

SEQ ID NO: 10344 - DNA, 333 bp, A.fumigatus
gctgagatgtctgctctcgagaattccggccgtcttcccgcgtccgcctacgagggtgcgactatgtacaccacgctgtctccatgcgacatgtgcacgggtgcctgcatactctacaaggttaagcgggttgtcatcggggagaacaagaacttcatgggcggcgaggagtatcttctaaatcggggtaaagaagttgtagtgctggataatgaagagtgcaagcaactgatggagaagtttatcaaggagaagccggagctttggtacgtctttcagtctcaactctggttttcttgcggcatcatcccgctgctactctcttgcagttga

SEQ ID NO: 10345 - DNA, 420 bp, A.fumigatus
acgaaacttacgattcattccagctcctcgaagcttctttgctttacgcttgagtctgatggctcgttgaaagcacagaactccatccaggcttctggcaacgtgcttgacttaaccgttcctagcgagaacagctcgatagtagtgtctgtcgatgcagtacgggaggctgggtccacacaagaatggagaacttctccttcatcgccgtcgaccctggttgaggcttttcgcttgaagccagcgtctgagggtcctcttgattgggagcgcacatcagaggcgatcactgcacagataaattccgaaggtacctccgacatatcggcagacctcgatgagaagcagaagaaggagttaaacgattcgttgtatagtttgggcaacctgcggaagaagaatatgggtgaagacgactaa

SEQ ID NO: 10346 - DNA, 1065 bp, A.fumigatus
ctcgatgctctagctggccgctacctccccgaataccatgaagcgaaaggaaaccgcgatttcttcgaatgctgccggaacccggagattgcatccacgctgaccatccagcccgtggatcggtatgcaggattgatcgatgctgcaatcatattttcggatatccttgtcatccctcaggccatgggaatgcaggtagaaatggtggacaagaagggaccccacttccctgaacctctgaagtcgccggacgatggacaatacgagaaggttatgcagaaggaggtcaacgtgaaggaggagctggactatgtatacaaggccatcacgcttacccggcacaagttgaaaggccgcgtgcctctgattggcttctgcggtgccccatggactctgctctgctacatggttgaaggtggtggaaccaagctgtttgtgcagtccaagatgtggatctacaagtatccaaaggagtcgcaggcactgctgcagaagattgccgagatctgcgtggagtatctcgccctccaggttgcctccggggcgcagctcgtccaggtgtttgactcctgggccggagaaatgtcccctgcggcattcaagaccttctctctcccatacctgcggtacatttctgccaacctccccaagcgactggacgcgatgggtctggagcgcgtgccaatgaccgtctttgccaaaggggcgtggtacgctctcgaggatctttgcgagtcgggctataatgttgtcgggcttgactggttgcatgatcctgctgaggcgatgcagattgcgaagggccgcgtaacgatccagggcaatgccgaccccggcatactttacggtagtcgcgaagctattaccgaagctgtcgaggtcatggtcaagggcttccagggtggcaagcagggatggattgctaacttgggtcacggtatattctcatcacttgtacgaacttcatcaattcgagcgctaacggtaacaggtattactccatttgtgaaacctgacgatctcaaattcttcttcgaagagattcaccgtttgacggctgcatag

SEQ ID NO: 10347 - DNA, 432 bp, A.fumigatus
cgatcggtaagctccgactctggcaccagcacgtcaacgccgcaatcgagcttgccgtcaatgtggtcatccgtgatgcgcttgatcgagatggggactaccatgccctcggccagggtgtccgacgtctcgcccgtgagcatggtgaaaacatcgtcagtgctcagcaaggcgaattgcttgcgcagttcttcatacggctgttgcaactcggcccggatcgtttccagcgtcgctcgcttccgctggttgaggttcttttccagctgttccgcatactcttccaggattaggtcgttgaccctgtcctgcgcttcatcccggaagagcttccggacgatagcgccaggtccattctcatcggtttctgccttgatgtcttcctcgtccagttccaaggcatcagctgccatcttccgcgcaatatcgtag

SEQ ID NO: 10348 - DNA, 2433 bp, A.fumigatus
  unsure (146): Identity of nucleotide sequences at the above locations are unknown.
gtccaggaattgctatctaggccgtttaccatgaaagacttccagattgtcaaggattacgttcatttcagtaatgcctgcaagttgcgcgatattaacttaatgaatggggaggccaacggcgaaacgcatcggcgcaaggcgantggcaggtccttctttgagcgtgtccgcaatggcaaggcttacggtcttgttcgcgcgtttggcatcacggccgatgctttcgcgcagaatgcgctgaaggagggccgtcgccagtacactgaggatccggccgagcgcccggaggagatggctgatagcttcattgacaacgacttctccaatgcttcccatgtgctcaaaaccgccaaggccttgtttgcggaggagatcgtgatgagtcctaagatgcgcaaggtgatccggcaagcatactatatgaacggcgcagtcgattgcttccggactgaaaagggtctccggaggattgacgaacagcacccttactacgaattcaagtacctgagaaatcagcagctcagtgacatcgcgcgtcagcccgaactttatcttcggatgctaaaggctgaagaagagggtctggtggaagtcaaggttcgatttgagaatttcgatcacttccggcagcgcctctacccggatattgaatcggataactacagtgaaatcgccgatgcttggaatcgtacccgccgtgaagtcctggacatggcgctgggcaagctggagcgtttgatcaatcgcagcgtcaaggaaaatatccgtcaggagtgcgagaatcacgtggcgaaggagtgtcgtgaagctttctctcagcgcttggatcaggctccttataagcccaagggcatggttctgggcaccgttcctcgggtcctggccatgtctactggtaccggcattgtcggacgcgaccccatccactgggcgtacgtcgaagaggacggtcgcgtgttggaaaacggcaagtttgtcgacttgtcaattggtgaccgagatcgcagcattcccgacggtaaagatgtcgaggccttgatcgagctgctggagcgccgccgaccggacgtcatcggtgtctcgggcatgtccccggaaacccgtaagctgtacaagcttctgaccgaattggtcgagaagaaggatcttcgcggcgctacatacaccgatgaacgggacgaagaaatcagcgaccccttggaggtggtgattgtgaatgacgaagtggcgcggctctaccagcatagtgagcgggcgaagaaggatcatcccagcttcggtcccttgacgcattattgtgtcgcattggccaagtatcttcagagccctctgaaggagtacgcctcgctaggccgggatatcgtttccattcagttcaagcgaggccagcaattggttgctcaggagctgctcctgaaacagctggagaccgctttggttgatatggtcaacttggtgggggttgatatcaacgaggccgtcaccgatcctgcgacagcaaaccttctcccctatgtctgcggtcttggcccccgcaaggctgcccatctactcaagatcgtcaacatgaacggcggtgtggtcaataatcgggttgagctactgggtgtaaatgcgcagtatccggccatgggcgtgaaagtctggaacaattgcgccagcttcctcttcattgacttcgaaaatgccgacccggatgctgatccgttggataacacccgagtgcacccggaagactacgatattgcgcggaagatggcagctgatgccttggaactggacgaggaagacatcaaggcagaaaccgatgagaatggacctggcgctatcgtccggaagctcttccgggatgaagcgcaggacagggtcaacgacctaatcctggaagagtatgcggaacagctggaaaagaacctcaaccagcggaagcgagcgacgctggaaacgatccgggccgagttgcaacagccgtatgaagaactgcgcaagcaattcgccttgctgagcactgacgatgttttcaccatgctcacgggcgagacgtcggacaccctggccgagggcatggtagtccccatctcgatcaagcgcatcacggatgaccacattgacggcaagctcgattgcggcgttgacgtgctggtgccagagtcggagcttaccgatcgctacgacatccccgtacgggctctctactcactacaccagacgcttccagccaaggtgctgttcttaaacaagaagaacttcttgtgcaatgtttcgctacgcgaggagcaagtcagtcgaccaacgcccagacctcgcgaccatatgcgtggggaatgggacgatcgacaggaggcaaaggaccgggagatgctgcaggagaagacgcagagtggcgggcgcgtcagtcttcaccgcggggatgggaaaatccattcagtg

SEQ ID NO: 10349 - DNA, 204 bp, A.fumigatus
gggcctgcactgatatcatcacactcgcagatagacaaatcttacacttccgattcacgatgccgccccggttacgactcgctaatggacgcatttcgttccgccgccagagagtcctatgtcaattcgaattaccagtcgctgctcgttatgcaagcaccgcaactagagcaacgactccggccgcatctattgaacagatga

SEQ ID NO: 10350 - DNA, 381 bp, A.fumigatus
cgctctactcaggtcaccatgttgtctgcgcatgaatttgaccagaagcctaatcaggtttcgatctcacccctccttcagaaactcgcctaccctactacacaggttcctgttgatcccgccgaaatcgcttcagcatttgcattgatctttgaagatcgtctatcggccatccagacggccgctcttttaactcttttgcattctactggaaaagatcgagatgcacaggtcattgcattatgttcacttcgcatgagagaggcagctagccagatcgagaagagctctttgcaaaaagccatcaaagctcgtgggaagaaggaaggaaactatggaggcggcttggtgagtgaatcgaaaccagagccgatagcttga

SEQ ID NO: 10351 - DNA, 996 bp, A.fumigatus
ctgtcttgcttattcgacaaatttgttttggtccagtgcgatattgttgggaccggtggtgattcacattctacattcaacatttcaacgactgcctctattatcgcctcgccgctccttatgatggccaagcacggcaaccgcgcacaaacttcattctctggctctgccgacgtcctgaacgcgatctccccagttcctccgaagatctccgcagttactgccgagaaccttgcccaagtctacgaagcaacgagctacgcgttcctgttcgcccccaatttccaccccggtatgatgtacgccaacccagtgcgtcggggcttgggcctgcgaactatcttcaatctaatgggcccattggcaaacccggtcgactgggcgctggaagcgagagtggtcggtgtggcttatcagagcctgggccccgtgttcgctgaagccttgcgctccagtggggtgacgaaggcccttgttgtctgtggtgcggaggacctggatgaaatcagttgcgcgggtccaacaaactgctggaaacttacgggataccccaatcccgactacgacggccctgatgaggactgctcctgtgacgaggacgaaaatattccccggactttggtcaagatagaaaccttccagcttcacccgtctgattttggtctgcccgcacatcctctaagcgcagtctatggtagaaagatgccgaaagaaaacgcagccaagatcatgagtatcttgcgaaacgagctgcctccggatgatcccatccttacattcgtcttgattaatgttgccgccctcctcgtgatttcgggcatttgtgaagccgacaccagtaacatgggccctggtgatgatggcaaggtgattaccgaacgtggtccgggcggtggtcgctggaaggagggtgttcgacgagcaagatgggccgtcgaaagcggttcggcacttaaatgcttggaacagttcatcgaagtcacaaacagactttaa

SEQ ID NO: 10352 - DNA, 573 bp, A.fumigatus
  unsure (66): Identity of nucleotide sequences at the above locations are unknown.
ttcggaggtcccacgggggaagataaaggtgaggggtggcaggggtctttggtcttgaccccgttntcggtcatggatcttagaaggccgcgtttagcaacatggtctgagtatcttagcagacgactaggttggcggggaaagagggggaactcaccaccgaggaggccgaagagggcgccgcccgagttggaattggagttggtggcggcggtaccgctggtgcttgcttcagcgttggaaccggtggtgcttgagcccagcccgttgagaccgctgagtccgccgagtccgctgagaccgctgagtccgctcagtccgctcagtcccgaaagaccagaggcgccggaggagccggagctacccagactacctagactgcccaggccggggatggaggtaggcaaggtgaatcccggaagactgaagccgcttccagaggaggagccgcctagaccggggatgagcgaggccaaggcaccaagaccagacgaggtggaagagccaccaccgcctaaggtagggaagagagaggccagagcaccgagtccatcagtgccggtgccgaactga

SEQ ID NO: 10353 - DNA, 267 bp, A.fumigatus
agtagaagaagatatctctcaataaagcagcaggttccatgccaatcagtgtcagtcgttgaaagctatacaacacatttgaatcgtggcagctccgcatctccatgccagaatattgtacatctcaagcatgatctatcacctgttgtcggcgacttgtcagccgcgccatctcccagatcccaatttagaaacctcaccattttcgagtcacgatcccatctagtctactccgtactccatagacttgatcaacatccaagttga

SEQ ID NO: 10354 - DNA, 822 bp, A.fumigatus
ctcattgaagcacctagaaattacttcaacaacatccaagatccgttcgctctgtccattgctaattctctcatctacgtcatcactaaaccccaagatgtcgctgaggcgtaccgcaacaccgacactctctccttcaacgagtttgtgcaagccatgatgcgcgcctgcgggaacaccgagtcgtgtgtcaagacaatgtacaagcctctgcccaaggacaagcccgggttccccaatccgcatggcaaaccgctggcgacgctggcccgccagatgcacatccaccaattatatccgggggataatctggacttcctggagaagcagttcttggactgggtggaacctcggctgaccctggacgcgctcagacgcgaatgtccatatgcgatccagagtggtccgccagcggtgacgaaggacgatggtatcgtcttgccattgatgcagtggtgctctgattatttcaccagggccggccagcgggcgtattttgggccggcactggacgggattgatcccaagctgccgcagacattcattgtttttgacgagctgagctggcaggttctgtatcagtatcccgagtttctggcggggaagatgaaatctgcacggaatgcaatccagcgcgcgttgaagaagtatatccaactgccgcaggagtcgaggcagggggatgcctggttcacaaaggcaatggagaacgagatgcgtgccctgggaatcagcgaggatgacattgcgactatgctggtgacaatctactgggggtacggccctgccatcttacttacggatagcatcgaggcaagctga

SEQ ID NO: 10355 - DNA, 615 bp, A.fumigatus
cagcttaggattaacaccaacacgcgcaaagcagcgttctggttactcacctacatcctccactacggtcctgagcactacgtcgacatcatccggcaagagacgctcccggcctttttccctgacaagtccatccccgacctgaactacctacacgacaactgcccccacctggacgccatgtggaacgaaacgatccgtctctccgcgtactctgcctccgtgcgcttcgttacgtccgacaccattatcggcggtaagatcctgcgcaagggaaaccggctgatgatcccctaccggcaactgcactttgacgagagtattttcggcgtagactaccccgtggaggagttccgacacgagcggttcatgcagaagggccgcaatctgacccggagcgacaactggcgaccgttcgggggtgggacgacgcagtgtccaggtcgatatgtcgccaagcggtttgtgttgctgtttgttgcgatgctcttgcggcggtttgatgtggagctggtgacgacgaggatccccgcggctgaggaagggaagcctgtgctggggattatgtcaattaaggatggagaggatgtgctggtgagagtgagaccgaggtaa

SEQ ID NO: 10356 - DNA, 672 bp, A.fumigatus
  unsure (603): Identity of nucleotide sequences at the above locations are unknown.
gacaacatgaagatatcggctactgctgttgtcctcctcgctgggctggctgctggtgcacccaccaaaaccattcaatccaagtttgagaagcgtcagttcggcaccggcactgatggactcggtgctctggcctctctcttccctaccttaggcggtggtggctcttccacctcgtctggtcttggtgccttggcctcgctcatccccggtctaggcggctcctcctctggaagcggcttcagtcttccgggattcaccttgcctacctccatccccggcctgggcagtctaggtagtctgggtagctccggctcctccggcgcctctggtctttcgggactgagcggactgagcggactcagcggtctcagcggactcggcggactcagcggtctcaacgggctgggctcaagcaccaccggttccaacgctgaagcaagcaccagcggtaccgccgccaccaactccaattccaactcgggcggcgccctcttcggcctcctcggtggtgagttccccctctttccccgccaacctagtcgtctgctaagatactcagaccatgttgctaaacgcggccttctaagatccatgaccganaacggggtcaagaccaaagacccctgccacccctcacctttatcttcccccgtgggacctccgaactaa

SEQ ID NO: 10357 - DNA, 2313 bp, A.fumigatus
ggtataaccgactcatcttttctgagcatcgggtattcaggcgtgtcactgttcgtttcccctaacatgcacattgtggcggtggtaatgttaagaaataatgtgatcccaggttgccatgtcatggaaaaggaatctttcatgtcgcaagaagtagcctcattgctgaacgaatcgtttatccctatcaaagtcgacagagaagagagacctgatatcgacgacgtttatatgaattacgttcaagccaccaccggctctggcggctggccattgagtgtatttttgacaccaaaccttgagcctgtgttcggtggcacgtattggcctggcccgaactcatcaaccctctccagacaggacacagttggattcgtggatatcctggagaaactccgagatgtttggaagactcagcagcaacgatgcctcgatagtgcgaaagagatcacgcgacaactgagggagtttgccgaggaaggaacacattcccaacaaggcgatcggcaggcgggtgaggatctggacattgagcttctggaggaggcatatcagcatttcgcttcgcgatatgataccgtaaacggaggcttttcccgggcgcccaagtttcccacgcctgccaatttaagcttcctcctgcgcctaaagacatacccaagtgctgtgtcggacattgtaggacaagaggagtgtgacagggcagctgccatggcagtgagcacgctcatcagtatggcgcgcggaggaatcagggatcacattggccatggtttcgcgcgatacagcgtgaccgcggattggagtctaccccattttgaaaagatgctttacgaccaggctcagcttctggatgtatacgtcgacgcgttcaaaattacgcataaccctgaactcttgggtgctgtatatgaccttgccacatatctcaccaccgccccaattcagtcgcctgtgggtgcttttcactcatccgaggacgcagacagtctgccaacgcctaatgacacggaaaaacgtgaaggtgccttttatgtatggactttgaaggaactcacacaagttctcggccagcgagatgctggtgtctgtgctcgacactggggagtgctaccagatggtaatattgcccccgaacacgatccacacgatgaattcatgaatcaaaacgtgctttccatcaaggtcactccgagcaagctggcaagagaatttgggttgagcgaggaggaggtcgtgaagatcatcaagtcggctaaacagaaactacgtgaataccgtgagaagacgcgggtacgtcctgatttggatgacaaggttattgtggcttggaatgggcttgcaatcggcgcgctcgctaaatgcagtgccttgttcgaggaaatcgaaagctcaaaggctgtgcagtgtcgcgaggcagcagcacgagcaatcaacttcatcaaggagaacttgtttgagaaggcgacgggtcagctctggcgtatctatcgcgacggtagcaggggagaaacacctggctttgcagacgactacgcttatctcatccacggtctgttggatatgtacgaagctacttacgacgacagttacctacaatttgcggagcagctgcagagtatgttccatgatcgcggctcatttggtcgaactatactaacgcaagcagaatatctcaatgataacttccttgcctacgtaggctcgacgccggcgggctactacagcacaccttccaccatgacaccgggcatgccgggtccacttcttcgtctgaaaactggaaccgagtcagctacaccatccatcaatggagtcatcgctcgtaatctgtttcgtctctcggcactgttagaggaaaaagagttccgtaccctggcccgccagacatgcctctccttctccttagagatcctgcagcatcctttcctgttcgtcggtctccttgatgtcattgtcggactccagccgacaccccggagcgtaacgggggtcttctgcactgcaaatcttcctcagagcgttactttagaagggactgatagactcattaataagccagaggagcctgtgtctgtacgggatatgattatcaaaaagatccggagcgaggctgggtcgacgatggtcacttcggctacggtaacatcactagtcgacatcaggccatcccatcttggtgactttgttggcaaccaatctttctggctcaggactcggaacccgcttctcaaagagctcaagccatcggggacggtgaagaattatttgatggtctgcgagagcggcagatgcacgatggttgacgtctaa

SEQ ID NO: 10358 - DNA, 426 bp, A.fumigatus
gcgcattgcgacatatgtatctccctgtatcaaaagtctgtccctcttacgaagttgatgctgggtctgggtagacctcgactcaaagcacgcccctccttgctggacctgattgccagtcgcggcgtggttgatctgtccgaatctaagccgtcatcaccgcccgcaacagacgaactgccaccgctccccgtttcgcccacttcaacgacctctagctccagtagcagcaatagcaacatcgagctcgcctcatccccgccctcttcatctatacacacaccagttgtacgaataatggctccttctggtaaggacaagactggtgaggaccagcatggcatcattttctccatatctggccctgtcgtggtggccgagcacatgatcggctgtgccatgtatgagctggtaggtcattattga

SEQ ID NO: 10359 - DNA, 804 bp, A.fumigatus
ggctaccattcaggtatacgaggagacaggtacagctccgcatctacactgggacgaactgttactggcaactatgactctaacgttttcctctttcaccctctagctggtctaacggttggtgatcctgttatgcgtacgggcaagcctctctcggtcgagcttggtcctggtctgttggaaacaatctatgatggtattcagcgacccctgaaggagatcgctgctcattcgaagggcatctacattccccgaggtattgcagtgaatgctttggatcgcaaaaagaagtgggactttaaacccggcaagtttaaggtcggcgaccacatcaccggtggtgacatttggggcaccgtctttgaaaatagcttgttcaacgaccacaagattctacttcccccgcgcgctagaggtaccattacccggatagctcctgctggccaatacaccgttgaagagaagctcctggagattgaattcaacggtcagaagtcggaacatggtatgatgcactcttggcctgttcgtgtgcccaggccggtcaacgagaagctgccgtccgatgcgcccttcatcgtcggccagagagtgctggactctttgttccctagtgtacaaggaggtactgtttgtatcccgggagcttttggttgcggaaagactgtcatttctcagagtgtctccaaattttccaacagtgatatcattgtatatgtcggttgtggtgagcggggtaacgagatggcggaagttctgatggatttcccagaggtacgggactcgagacctctgttaagatga

SEQ ID NO: 10360 - DNA, 189 bp, A.fumigatus
ctgactggaattcttttgctacttcagtgcagagtcggacacgatcagttggttggtgaggtcattcgactcgatggagataaggctaccattcaggtatacgaggagacaggtacagctccgcatctacactgggacgaactgttactggcaactatgactctaacgttttcctctttcaccctctag

SEQ ID NO: 10361 - DNA, 246 bp, A.fumigatus
ctgtccatcgatgttgaaggtcgcaaagagcccatcatgaagcgtacatgcctgatcgccaacacatcgaacatgcctgtcgccgcccgtgaagcttccatttacaccggtatcacgatcgccgaatacttccgtgaccagggaaagaacgtggctatgatggcggactcttcctctcgctgggccgaggctttgcgtgaactttctggtcgtctggggaaagattgctgccataccagggtttcc

SEQ ID NO: 10362 - DNA, 843 bp, A.fumigatus
atcatctgccgaatccggaatttacacaggacgggaaggatgttcccccaggcacgatctcaagtcgagctcttccaccatgttctggaaacagccaccgttaaacatgttcgttccattcaccacccgctgatcgctacgcccaacgacatatatgcggagagtccgaattctttctacgtgactaatgatcattactaccgcgagggatatggacgtctgattgaggatcttatcccggcagccaagtggtcgagcatcgttcatgtactgatccaagatttgaagtccaaggacgccgacaagggcatcgatgccacggtggctttgaccgggttacacaacaataacggactcggtcatggtagatctaaggacgagatgctcgtcgtcagttgtatgagcgggactctgtatcgcgctcgctcgaacagtgacaaccgcacgatatctgtcttcgatgagattcatccaggtggccaaatcgacaatcccacttactacgcggacccgtaccgtactgctgcagacgacgccagtggctacattctggcgggaatggcacgtccgattgatctgtctaaacattacaatgatcccaatgctaaagatggggccattgtatggtacgtgcggcctaaaactggcacgagtgagagtggagatcaatttacagaatgggagtcgagtgttctcttcgaggatgatggcactctcattcggactgctagcaccgggctcttggttcccagcgaaacaaaacctggggagagaaagaaggcatggttgtttgtgaccggattcgtctcggagagtgttattgccgttgaggtcgacctctga

SEQ ID NO: 10363 - DNA, 339 bp, A.fumigatus
ctgatcttccagtcctacggtggacactatggccccgaattcgcgtcgtatattcaggagcaaaacgccgccatcaaagccggaacggtatctggcgaaaatatcaacctggtcgcactgggagtcaacaacggctggaccgactcggccatccaagaaaaggcgtatatcgagtacagctacaacaacacctacaaacagcttatcaactcgtccgatcgcacgcgtctgctgagcgtctacaacagccaatgtctgccagcgatccagaaatgcgccaagacaggcaccaacgccgactgcagaaatgccgacagcgtctgctactccaataattga

SEQ ID NO: 10364 - DNA, 312 bp, A.fumigatus
agtagaatttggtctccgaggttaacaatgtggtgtcaaaagtggttattcgctttcttggtagcaggggccagcgctgccccggccagcacggccaaagacagtatctcgtcagttgttaagaatggcgtcaagtatactgtctttgaacacgctgcgaccggcgccaggatggagtttgtcaagaactcggggatctgtgagactactcctggggtgaatcagtactctggatatctctccgtcggggataacatgaacatgtggttctggtatgtcctgcacaacagcatgactacatgcagagcctaa

SEQ ID NO: 10365 - DNA, 1011 bp, A.fumigatus
  unsure (447): Identity of nucleotide sequences at the above locations are unknown.
tatggacagggaaaaatggggcttcaccgccagggcaagtggccgaaagggaagatgccgaaagcggatgcaggagttcccgaatccctatattcgaggagggagggaacctcccaaaccttgggccggaggacctggtggtcccattgggggattttggtggggaaaaacggccttgcagcggctgttgggaaccctaacgtgtatgggcaaggtctcaaggattggctgcagtgccggaccatatatatcatgaggcagttcagttttaggggtggggctggggacgcagaatggtttcctggcgtcggtggcggcaacaacggcgcttgtatggaagctgcgcagaaggaactgggcaatgatgcattgctcagcagtacagtggttagcatggagcgtcccgcagaccgtttgcatcggatcctggtccgaactccaactggntaccaactgatcagagcgaaaaagaccatcataactactccgccgaaggtggaaaacctggtgaatttcgatctagacgataccgagcgtggcgtctttgggcagttcgaaaacgccttctactacaccactgtggtcagagtcgctggtctaccagccggacttgacattatcaaccgcgctgctgacacgccgtacaatatccctcatctgccgggagtgtacgccatgctgccgtctcgcgtcccagacatctacacgatcttctatggtggcggggaggccaagaccgaggacgaggtgaagaagagcatccgagacggtgtgatgatgttacgtgaagcgcaattcaccccctccgagcctgagatcctggccatcagcaaccacagtccattcgccttgttcgtttcggccgaccaaatcgcgaagggcttctatagggatctctatgcgttgcagggacagcggaacacgtactataccggcgctgcgttccatacgcatgactctgctgccgtctggagctttacagacaatttgttgacgactatgtttgcttga

SEQ ID NO: 10366 - DNA, 729 bp, A.fumigatus
ctacatgcagagcctaacctgtgcaggttcttcgaggcccgaaacaaccccaaacaggctcccctcgctgcctggttcaacggtggccccggttgctcctccatgatcggtctgttccaggagaacggcccttgccactttgtcaacggcgaagataccccctcgctgaacaagtacagctggaacaactacgccaacatgctgtatattgaccagcccatcggcgtggggttctcctacggcacaaacgacgtaaccagcacggagactgctgctccctatgtgtggaagttgctgcaggccttttatgcacagttcccggaatacgagagccgtgactttggcatcttcaccgaggtaggtcccgtctctgaccttgcaatagcagaaatagctgatcttccagtcctacggtggacactatggccccgaattcgcgtcgtatattcaggagcaaaacgccgccatcaaagccggaacggtatctggcgaaaatatcaacctggtcgcactgggagtcaacaacggctggaccgactcggccatccaagaaaaggcgtatatcgagtacagctacaacaacacctacaaacagcttatcaactcgtccgatcgcacgcgtctgctgagcgtctacaacagccaatgtctgccagcgatccagaaatgcgccaagacaggcaccaacgccgactgcagaaatgccgacagcgtctgctactccaataa

SEQ ID NO: 10367 - DNA, 264 bp, A.fumigatus
gcaatatcctgcatcatcggctggatatctgtatctgcgttgcaccaggtggcgaacgtaggttgcctaagaagtcgactgcaacgaactaagcaggatattcggcctatgtggttcactaacttcttttgtatagtagctgctcgtcgttttctgtttctaatactactaacaatatcgtactactacttcaggagcaggattatcaataacactctgatactagataagctgtgcgcaactagcaactatcgtcccctatga

SEQ ID NO: 10368 - DNA, 1002 bp, A.fumigatus
  unsure (229): Identity of nucleotide sequences at the above locations are unknown.
gtgacgcatcccggtagctgcactgcacaccaaaaactgatcgatgccaggaacctgatcgacggcgtttcggtcaccagtttgcatcacagcatcgcccatccgttccctccggctgtagggggagtgctgattcaacccgggccgctgcctgactgctccttgtctcagctaaccgcggaagtactccagagccgactgcatccggttctgaaggagctgcagctgntagatgaacttcacgaaacccaacccttggacttttgggtgctcatcggatcgatttcaggaacgctgggccacgctgaccaggcactgaccgcggccatgtccgagcgaatggccacactggtccgccaacgtcggtctcggggcaggccggcgagcctggtacatctgggagagatcagcggcattgacatccctgctgacggggcccgtccctggtggggtccgaccgctgtaacccagcgggatattgacgaagtactcagcgaagcagtcctttgcggaggtccaaattccttcgctcgcagcgccgagttcatcgtgggccttcggcatcagagcttgcagactggtcgcatggcgggtccagtgccaaaattgtggccgttctactcttacacagccactgcgagtcagggtcagaagcctccatcattgcctgagcgacgtcagtcagctaaggatctcgtggccgcggcgaccagccgggaggaaaaggctgaggcaatcgcggcctgcctcatggagaagatccgagccagactgaagctgaatgcagatgcaccgctgtcctctgacacgctgatttcggagcttggggttgactcgcttgtcgctgtagaactacgcaggtggtttgcaaaacaattggctgtcgacatgtcgattgtgttgattctcagtggtgcatctgtgggcgaattggcaaatgcagccgcctcaaagctttgcaatggcaacagcgaactttgtactagtagtaatttagtgtag

SEQ ID NO: 10369 - DNA, 369 bp, A.fumigatus
cgttttctgtgcagatccccatcgccgcctccgcagtacgataactttggcagacgtgtaaacactagagaataccgttaccgcaagcgtctcgaggacgagcgccacaagcttgtcgagaaggccatgaaaaccattcctaactaccacccgccctctgactacaggcgcccaaccaagacccaggaaaaggtctatgttccagtgaatgactatccagagattaacttcagtatgataactaaccctctaactcctaaccgttcctgcattgtgtcgttcttggctctctgctcgagtcgggcccgtgagacatcgccttatgatgatgtgtcaaaggctcgcttcctgctaacccttgctacttga

SEQ ID NO: 10370 - DNA, 585 bp, A.fumigatus
aacagtaagtctatgtgccctcacttggacggatcttcagacactaacgaggataaccaggctgcctcgattcccgaaggccagaacgaactcaagagaaaccagttgcgagagttggctgctctcaacggtaccctccgtgatgatgagaatcaggcttgtcagaactgtaagtttttccataaagctctcctcgttgaattgcttatactaactcgcgcaggtggccaaattggacatcgcaagtacgattgtcccgagcagcggaactttaccgccaacatcatctgtcgcgtctgtggcaatgctggccatatggctcgtgattgtcctgaccgccagagaggttccgactggcggaatggcggcggttatggcggtggccgcagagccatcgggcaaggcgatgctgtcgaccgtgagatggaggtgagttccatgtggtttctcaagtatcgacctacaaatgctgattggtacagcaacttatgcaagaattgtccggtggtgctccaggcccagacggccagcctcctcgccggatcgaggctggtcccgatcacggttacgatgatcgtgacgtga

SEQ ID NO: 10371 - DNA, 525 bp, A.fumigatus
cccttgctacttgactaccttgcttccattgctttgctctccttgaataaccatcatgaactaacacttagctctttgctaccttttaaagttggcttactcataggtcctcgtggaaataccttgaagaagatggaggccgaatctggtgccaagattgccattcgaggcaaaggctccgtcaaagaaggaaaaggccgatctgacgccgctcacgctagtaaccaggaagaagacctccattgtctgatcatggcagataccgaagagaaggttaacaaggccaagaagcttgtgcacaatgttattgaaacagtaagtctatgtgccctcacttggacggatcttcagacactaacgaggataaccaggctgcctcgattcccgaaggccagaacgaactcaagagaaaccagttgcgagagttggctgctctcaacggtaccctccgtgatgatgagaatcaggcttgtcagaactgtaagtttttccataaagctctcctcgttgaattgcttatactaa

SEQ ID NO: 10372 - DNA, 504 bp, A.fumigatus
  unsure (33): Identity of nucleotide sequences at the above locations are unknown.
gccgtcggcggtttggaggtgaaaatggcccanaagaagagagtcgcacggcgacgcctgcatctgtcggcggagataatgggatcaagcgtggcagaaacccagttcgaggtacgtctttgcctgtgttgtatcattttcaatcgatttattaacttctcttctttcacagcggacccccctgctgatggtgtcaagaggcgcaagaagcgcaaccgttggggtgatgctcaggagaacaaggctgccggtctcatgggtttgcccacgatgatcatggcaaacttcaccaatgaacagcttgaggcttatacactgcatcttcgtattgaggagatcagccagaagctccgcatcaacgatgttgtccctgcggatggtgataggttcgtcttcgtcccgctttcttctttttttttttttttttttttttttttttttctctttcgccgggagctaacgttttctgtgcagatccccatcgccgcctccgcagtacgataa

SEQ ID NO: 10373 - DNA, 591 bp, A.fumigatus
ttggtacagcaacttatgcaagaattgtccggtggtgctccaggcccagacggccagcctcctcgccggatcgaggctggtcccgatcacggttacgatgatcgtgacgtgaagccatggcagcgcggacctcctcccagcgatgtggctccatggcagcagagagggcgggacaaccgctctcgcgacgactatggctcgcgcgatcagggcagtgcacccccgtgggcggcgcagagccgtggtggcgattatggatacggatcgcatgcaggtggctacggcgcccctggtgctggtgctgctactagtggcgctgctccttggcaccagcaagctccgcctccgccacccggcggagcaagtgcttatgggtatggggcttatcccggttatggcgcagctgtgcctggtatgggcgccccaggtgctcctcccggtttgagtgttccaccgcctccgcccggcatgccttccatgtattacggctctggcagccctccaccacctccccctggtgaaggacccccgcctcctgtatgttctccctttggaccaacggaccagcttgaaatcagacaagattgctga

SEQ ID NO: 10374 - DNA, 198 bp, A.fumigatus
cggtgcagatgggtggacacgcctatgatacatcggtcgatcgagagcggcactcttgactcgcaatttgcgatgattcctctgggccgtcctgcagtggcggacgagattgcccatgcgattctatttctcgcttcgcccatgagcagctacatgtgtggagaagcaatggtggtagatggagggttgtcagcataa

SEQ ID NO: 10375 - DNA, 687 bp, A.fumigatus
  unsure (20): Identity of nucleotide sequences at the above locations are unknown.
ccacagagcaatggcatgcntggtgtccccggcctttggacccctgagcaggccgccggctggaagcgggtcgtcgacgccgtgcacgaacaaggtggctacatctactgccagctgtggcacgcaggtcgtgccaccatcccgcagatgacaggctcgccggcggtctcagcctccgccacagtctgggactccccgacagaatgctactctcaccctcctgtgggatccaccgagccggtgcggtacgcggaccatccgcccatcgagctcaccatcccgcatctgaagcagaccatccgcgattactgcaatgcggccaagaccgccatggagattggcttcgacggtgtcgagctgcacgcgggcaatggctatctacccgagcagtttctgagctccaacgtcaacaagcgcacggatgagtacggtggctcgccggagaagcgctgccggtttgtcctggagctgatggatgagttggcggccaccgtgggcgaagacaatctggctatccgtctctcgccctttggactgttcaaccaggcgcgcggcgagcagcgagtggagacctggacgttcctctgcgaatcgctgaagaaggcgcatcccaatctgtcgtatgtcagtttcattgaaccggtgagttttccctacaactacaacccctggttgccacagctctaa

SEQ ID NO: 10376 - DNA, 345 bp, A.fumigatus
cctgtccagcgctatgagcaaatcttcagctacgaggaaaaggacaacttcctccgcagttggggactgtccgacgttgatctgagcagcttccgcaagatttttggaactactcccttcttctcggccggaggctgggaccagagcaattcgtggggcgtgctggaagaaggtcggtacgacgcgctgctgtacggacgctacttcaccagcaaccccgatctggtcgagcggttgaggaagggcatcccgtttacgccgtacgatcgttcgcgcttctatggcccgtttgaggataatgcgaaatgctacgtggattatcccccggctactgcttcctcttaa

SEQ ID NO: 10377 - DNA, 312 bp, A.fumigatus
cggtttaggtggcccgaccagagcagcagcaccgccaagatgaccatccgcaagctcgacggcgaggagtcgatgctcttccagccactggagatcgcaaacggcaggattcgcctttcgcatcgggtggtccatgctcccatgacgcgcaaccggggcgttccgctcaatcccaccagcaccccagagcagcccaaccgtatctggtatcccggcgatctcatggtccagtactatcgccagcgcgccaccccaggcggattgatcatctccgagggtgttccgccgtcgttggaggttggtaccttttga

SEQ ID NO: 10378 - DNA, 210 bp, A.fumigatus
ccacagtgtcttcttccagtccggcggtcagtaagcctcgctgcgcggcttcctgcggatctgtctaagttcagcttcctcttcatcgtcatcatcctcctccgccgcctggtcctcgtcgtcacccagaacaactgtattcctgttttgtttgggaacggacaagaatcccagctggaattgactcggctgagcgaaagcagtcattga

SEQ ID NO: 10379 - DNA, 666 bp, A.fumigatus
acgttctggcgtgcgctgcactgcgctaagtcagctgcgatgtcctccggcagcgaggactggttaggagcaggagggggagcggccaccgatgatgatatacacacccagcggccgagatacgcctccggaaataacgaaaacttgaatgaagacgcagactacagcatgataatgtcctaccccgccgaagaagaggactactacgccttgctaggcctccgccggactcccacccctagcgacgcggagatccgctccgcgtaccgtaatctcacgctcagcttccacccggataagcagcctgcggagctgcgggaggctgcggagcgacacttcgcgcgaatccaggaggcttatgagacgctgctggacccgaagaaacgggttgtatatgatctccttggggcggagggggtgcggagggagtggggagctggaggggcgatgggaaggggtggggaggcggagagtcagattggcgtgagagcccagactccggaggagtttcgggggtggttcttggagacgatgaagaagcgggagaggaaggtgctgaatagtttggtccagagtagggtgggttctttcccccttgctgccttgctcagattgttgcgtgatatcgtactgactgtgccgtggaacggtaacagggctcgctga

SEQ ID NO: 10380 - DNA, 399 bp, A.fumigatus
cagggctcgctgaccctcggcgtcgatgcgtccaacatgattgaggttgacgagaatgccggggaggtgtatatccatattccctctcccagtctgtcttcctacgctatcagatactcgttcaaggcgccgcttcctacgccgaaagttctcttcggaaaagaagcggatgaggaggacgacgaggacgaagcccctgatggcagatcgacccagcagaaagtcaattcatatcaagaggctcaagggcctgagattacgttcaatgcaggtatctctggcaatctccggcgctcttttcgtaagatgcaattccagtttgaagatggggagacgatgacgcgagcggtatgttcggagatgtactgtcatccgcaaccatgccggactgttccctaa

SEQ ID NO: 10381 - DNA, 195 bp, A.fumigatus
ccagatccaggggacgatcggctcacgactaatatgagaatttcaattagtggccctgacggcgtgtgctggaaaattgcgatcacatttagacccctttctcacggagccaagttgacgccgctcttttcctctccaggaagactatctgatcattttcctaaagcagcagagcgagagagtgcggttccatag

SEQ ID NO: 10382 - DNA, 189 bp, A.fumigatus
agtctatggagacatcgtagaagtcgttccaacgcaatcaagcgatgctctagtccgaggaaatcggtcgcaaacagcatgcaagcgaccatcctgcaagcttgtatcactggcttcctggctctagccgtcggcctgtgcttttcaaagctcccaaacctaaatcaggtccaatattccgttaggtaa

SEQ ID NO: 10383 - DNA, 657 bp, A.fumigatus
caccggaagaagaggctgatcaatcccgagggggatgggtggccgcatcgcacagggtcccacgggatgatggaatcaagatcgattagccgggtggcagtggatagcaagtctatccagcctgcatcttcacatgccgcggagagtcctgcagttcctgattcctcgtttgctacacctatcgaactatcatctacgccaccgcagccgttgcctgaaagaccggacaatatgcgtcgaacctcctggtcgcagggcgccaatggatatgtggagtatatacggccccgatggcaacctgattcggaggtcacgaactgcccgatatgcggaacaacgttcagtttctggtacaggaagcatcactgtcggaagtgtggacgagttgtttgtgctgcttgttctcctcatcggattacgatacctaggcagtttatcgtccgtcctccggagtcgaatcgctcgcctgcagttaatctgatacccccgcgggcagctcaggtcatcaatgtagatggggacgatacatcgcaatcgcccggtggcgatcaatccagctctcggcggtggcgaggaggtacgactttgcaacccgtgtgtgccagacccgaacccggaaccgcttcggggttaccctgcggttcgaggaggtggtga

SEQ ID NO: 10384 - DNA, 993 bp, A.fumigatus
atggggacgatacatcgcaatcgcccggtggcgatcaatccagctctcggcggtggcgaggaggtacgactttgcaacccgtgtgtgccagacccgaacccggaaccgcttcggggttaccctgcggttcgaggaggtggtgagcaagggacgaactggggcagaggttcaccgagccaaggtcgacaccggtcttatcactccatgtcgacgtctacgagacagtttccttatgatgcattcgtaagttttgttaatttgagagaccgactgtcaaacactgacacgatctcgtctttccagactgagtcttcttcttcacgattgaatcggcgatcaataagctcgaatggttacacaggcttgggcggtgctctaggcggcgtgttcagttccagcttacaagaaagaccaatgcgatatgggtcattgcccggttcgcagtattctggccgacatgttagctcgtcggcgcgaccctacctaggctactttcgggcacaccgccatttacctccaccggcacctgaagggacgagtgtatctactgggggatcgttcagtacaactagtgatgatcatgattctcaccggcgtgtctcttatccagcgcggcatcatgttgacgagagcgatatttgtcccatatgtagcgacgaacttccaccgctgggggagaatggtaacgaggatgcccgggaagcacatatccgtgagtgcatcgagagccatggccgtggcacgcggtcgacgtctcgaggagggagtccagtagctgcgtctcctgttccagttcgcatgcttgcattcactgctacggagaaggattgcctaggacaggatggcgccgtgcaagaatgcacgatctgtatggaagactacgaggtcggtcagccactggtacgcctggagtgtctgtgcaagtttcacaagaggtgcatagtagaatggtttgagcgcaagaaggagtgtcctgtgcacaaggtggcataa

SEQ ID NO: 10385 - DNA, 189 bp, A.fumigatus
ctttcactcgatctacagcaactagcctcatacatggcttacagatgcagaaatcttctcttcacacccgaatggatcttccaccttgccaccttgccctccacttgcctccccaatccaacgaagcttcaactcgtcgacggcgtactgcaggaccagaacctacctttcctcgtgcattgtctgtag

SEQ ID NO: 10386 - DNA, 189 bp, A.fumigatus
cttccattagatcatgcggtatctgcatccactgtctacctgattcggtctctcgggactgtctggggcgttgccatcacctcagccattattcagaatacattacgctcaggcctttcgaaggccttgagtggaataccagacaaatggaaagtgacatccctcaaatggagcatcagtgtgagatga

SEQ ID NO: 10387 - DNA, 192 bp, A.fumigatus
attatcgagcagattcgacactccgtttccgccatacaggacctgccccctgacattcagatggctgcgcgtcttgtttactacagaggtatcaggttgtcctttgctgcggctgctggcttcgcatttcttgcgaccattgccgcgttgttttccagaggtaaggggttgcaccggggcagctccgcatga

SEQ ID NO: 10388 - DNA, 939 bp, A.fumigatus
tggaactcacggtcattgtcagctatcatgtcgaatgtctttctctctggattcgatggcaccatcacggcctcgacgtacgcggtgattagctccgaattcaacgccgccaacactgcgtcgtggctcacaacctcttacctcatcactagcaccgcctttcagcctctgtacggtcgcttttctgatatatttggaaggagagtgtcctttttcacggccaccattacgttcattattggttgtttgggttgtggtatcgccgacgatattgtcttgctgaatatgatgcgggcgttgacgggaattggtggcggtggtctaatgactatgggtaagttgccatctcccccagctggagggccgccgcactcacacggtccagctacaattgtcaactccgacctcatcccgttcaaacgtcggggtatgtatcaagccttgcaaaacggcatgcatggcttcggctccatctgtggtgcatcgtttggtggctcgattgttgatacggttggatggagatggtgctttctggtgcaggtgcctataggactattcgcattgattacaggacatcttgttctgcatcttccgcggcatcaccaaacttttggacaagggcggggttttcgggcgatactgcgatacgtcgatctctcaggggctctgctgctcattcttggcctttcaagccagcttattggcctgagtctgggtggaaatgagcttccatggtcgagcatttgggtcatcctctcactcatggccagcttgttcctcttgggcttgttcatgctcgtcgaagagaagaccccggcagttcctttgattccgtcaagaatgctccgtggggtcatgcctgtatccactcagattgccaatgtctgcgttggaatggccgcgtatgcagtgagcggacctcctctcggctatatctag

SEQ ID NO: 10389 - DNA, 396 bp, A.fumigatus
gctacagcttaccagaggcagtttctcttcaccctcccgctcttatttcaagtggtcctgctagacacgcctaccaaagctggggcaagactcgctataccgtccttggccgctcccattggcagcctgatcgctggggtcgtcatgtcccgctggggccgattggcgtacctcgtgcgtgcagggtgtttactgatgtgcattggaaatctgctcgtgatgtctatcaaattccacgatgctgggtggaaatacctcacctacgtgattccagccagtcttggccaggggatcgtctaccccggaatcttgtttacgtttctggctgcatttgaccacaccggtaagcttgggtctctatcttatcggaacgtccgggctcatgacttccattag

SEQ ID NO: 10390 - DNA, 1065 bp, A.fumigatus
aataggtgcgtccgttccgtagatccatgtcaccgacaaaaaggtcctttgcccccagttcgatgtgcccattcaactaacgaatttctgatagcgttcggccaatcgactaccttcctgcttcgctctctcggccaggcactcaagccattgctcaattcggattgtgagatcatcgtctccattctgtgtcacgaaggcagtgcggcggcttgggtggccctcgccaaggatttgggcatcgccatcaaatggtgggccccgccccccggcgacgatccggtcctgtcactcgacacattgcggccgctgttgacgccaaagacccggctggtagcctgcaaccacgtgtccaacgtggtgggcaccatccatcccatccgccaagtggcggacctggtccatcggattccgggggcggtcctcgtcgtggacggagtggcatgggccccgcaccgccccattgacgtcaaggcgctggacgtggacttctactgcttcagctggtacaaggtctttggaccccatgtcgcacagctgtacggccggcggagcgctcagaagcgcgctctggcgggcatcagccacttcttcctcagcgagatgccgggcctggactggcggttgcgtctcggggccaattccttcgagctggaggaggccctggtgccgattacccggtacctgaaacgggtgggctgggacaacatcattgcccaggagacggtgctccaggatgtgttcttggcgtatctccggcgccggcctcgggtgtttcgcatcttcggcgagcagtcctcggacccagcgaagcgcgtgccggtgatcacctttgaggtgatcggtcactcgtcgacggtggtggccaacaaggtcaatcagcgggggcggttccgcgtggtgtctggaaactgctgggctccaagaccaacgcatgatgtgctgggcctgggcgccgaaggtctcatccgggttagttttgtgcattacaacactgttgcggaagtgcaggagttttgcacagagctggactcggtcctggagacgttgaacgcgggcatctag

SEQ ID NO: 10391 - DNA, 1314 bp, A.fumigatus
atacgagcaaaaacgcacgtctacgccttggtccggggatcgtcggagaaccaggctcgagaacgtctcgtgcaaaaggccatctcggcgggctggtggcaggatgcgtatcgcaccagactccacgtttggcacggtgatctaacacaaccgcagcttgggttaagtcagcttcaatggcaaatgctgcagggcaaagcatctccgagtatcgacgcgatcatccacaacggcgccaaggtgcactacagtcaggactacgagacattgaagaaaacgaatgtctctcccacggtcgagctgctgaaagcagtccatgaccgcgaagagcccctgcacagctttgtttttgtctcgggcgggcagcagcttagcttcgacgaccgcgaggacgagaagaatgcggccaagtcgctgaaaggatccggctatgcacgatccaaggccgtgtccgaacagattgtccgtcgattcgccaatcaaaagggctccaaggctcggcatgtacgcatcgtcaaaccggggttcatcatcggcgacgctgagcgaggccttgcgaatcaatccgactttatctggagactgatcgctgcgtgtgtggaactgggtttctacaacggggacgaagcagacagctggctctttatctcggacatcacccgcgtcgcgcaagtgattctgcacagcgtgttcgaggacgactctcaacccgtcacgaaggtgctggatggcctgagattcaaaactctgtgggcccttctccaagacaagttcggatttgagctccaacccctctcgcggcgagaatggctggcacgcctcaaacactccgtggccaccaagaaggaaaaacatgtcctgtttccgctgctctacctgctggaggccgatgaggagccgattggggtgttccagggacccttggacccgacgactggggttgaagcggccctgcacgcaaacatcacccatctggtccactcgcggtttctcgtcggggccgaccctgtgctgactccggtcacatcggtcgcgagtcctgcgcccgtgacggatgccattgatgtgcaaagcctgcgagagcagtttcccgcgctgcaccacggcgtcgtacctttcaacaatgctgccggaacggtggtgcatcgggaggctgcggagagcacacaccgatacatgacctccttcccgtatgagctgggtcgtgatgatccggcgagtgccgcgaagacgcaacgacttcaagatcgattcgccgagctcgcagcattcatgaatgccgacccggatgaaataggtgcgtccgttccgtag

SEQ ID NO: 10392 - DNA, 1206 bp, A.fumigatus
ttgaatgggcacatcgaactgggggcaaaggacctttttgtcggtgacatggatctacggaacggacgcacctatttcatccgggtcggcattcatgaatgctgcgagctcggcgaatcgatcttgaagtcgttgcgtcttcgcggcactcgccggatcatcacgacccagctcatacgggaaggaggtcatgtatcggtgtgtgctctccgcagcctcccgatgcaccaccgttccggcagcattgttgaaaggtacgacgccgtggtgcagcgcgggaaactgctctcgcaggctttgcacatcaatggcatccgtcacgggcgcaggactcgcgaccgatgtgaccggagtcagcacagggtcggccccgacgagaaaccgcgagtggaccagatgggtgatgtttgcgtgcagggccgcttcaaccccagtcgtcgggtccaagggtccctggaacaccccaatcggctcctcatcggcctccagcaggtagagcagcggaaacaggacatgtttttccttcttggtggccacggagtgtttgaggcgtgccagccattctcgccgcgagaggggttggagctcaaatccgaacttgtcttggagaagggcccacagagttttgaatctcaggccatccagcaccttcgtgacgggttgagagtcgtcctcgaacacgctgtgcagaatcacttgcgcgacgcgggtgatgtccgagataaagagccagctgtctgcttcgtccccgttgtagaaacccagttccacacacgcagcgatcagtctccagataaagtcggattgattcgcaaggcctcgctcagcgtcgccgatgatgaaccccggtttgacgatgcgtacatgccgagccttggagcccttttgattggcgaatcgacggacaatctgttcggacacggccttggatcgtgcatagccggatcctttcagcgacttggccgcattcttctcgtcctcgcggtcgtcgaagctaagctgctgcccgcccgagacaaaaacaaagctgtgcaggggctcttcgcggtcatggactgctttcagcagctcgaccgtgggagagacattcgttttcttcaatgtctcgtagtcctgactgtagtgcaccttggcgccgttgtggatgatcgcgtcgatactcggagatgctttgccctgcagcatttgccattgaagctgacttaa

SEQ ID NO: 10393 - DNA, 192 bp, A.fumigatus
ccagccccgtggccattgacgtgcggcagagtaagtgccctgtccttgcaaatcagtctccatgctaatgagacagctgccattacgggggatgaacttcggactggtccctgcgagcccatcactttcatctttgcccggggctccaccgagcctggtcttctggtatgtatactttatgccagtccttga

SEQ ID NO: 10394 - DNA, 351 bp, A.fumigatus
actgacggaaggaaggggatcaccaccggccccggagtctgcaatgctctcaaactcagtcgtccaggccaagtggcctgtcaaggcgttggaccagcctatatcgctgatcttgcctccaacttccttccacagggcacgagccaagttgctattgacgaggcagcgggtctctttaaactcgctgcatccaagtgtccggacacaaagatcgtcgctggtggatacaggtactttccccttcttttcatcacggcaatcgagacagctaaaaaaaaaaactgtgtagtcagggagcagctgtcatgcacggtgccatccgaaatctccccagcaacgtccagaatatga

SEQ ID NO: 10395 - DNA, 279 bp, A.fumigatus
aaaaaaaaactgtgtagtcagggagcagctgtcatgcacggtgccatccgaaatctccccagcaacgtccagaatatgatcaagggggttgtcctgtttggtgacactcgaaacaagcaggacggaggacggatcccgaatttccccacagatcgcaccaagatatactgtgcattcggcgacctggtgtgtgacgggaccttgatcatcacgcccgcgcatctcagctatggcgatgatgtgccaagcgcaacctccttcctgttgtcgaaggtttga

SEQ ID NO: 10396 - DNA, 693 bp, A.fumigatus
ggaggggcgatgctgttgactcgtgtcggatctatggcagtctggagggaaataaggtgcagggtgacttccacattacggcacggggacacgggtaccataacaacgcacctcatctggagcacaagagtacattttctccctttgttcctgggtattcgaattcaactgacgcgcgcagccttcaacttctcgcacatgatcaccgagctctccttcggccctcactatccgaccctcctcaaccccctcgacaaaaccatcgccacaaccgaagaccactactacaagtaccagtatttcctctccattgtgccaaccatctactccaagggcaacctcgcactagacacctacgccaacgctccgccctcaaaccgccgtggcaaaaacctcgtcttcaccaaccagtacgcggtcaccagccagtccagcgtgattccagaaagcccctacttcatcccaggcctcttcttcaagtacaacatcgagcccatcctgctgctgatcagcgaggagcgcactagtttcctgtccttgcttgtgcggctggttaacaccgtctctggggttatggtgacaggtggctggttgtatcagatgtcagggtggctcggtgagctgctgggcaggaggaggagaaggggcaagtcggagggtgttcttacagggcgccacgaggcggacgattga

SEQ ID NO: 10397 - DNA, 1140 bp, A.fumigatus
ggacattcgacgcgtttcgtaagttcccaacacgaaccattaacatgctcaagtgccgagctcgctcggcgggacgtttccgcaatcgtcctcgaaagcggccggtcccaggttatggtgcagatgctgacgatcgtcgtggtgattctagcgaagacaaaacctttttatacagcgccttctccccgcggtgggcaatggacggttctggtattgctcgtctgtaccttcttatcgatatccgagttccgcacatggctcaaaggcaccgagaagcagcacttcagcgttgaaaaaggaatctcccatgacctgcagctgaacctggacattgtcgtccacatgtcctgtgacatgctagacgtgaatatccaggatgcttcaggcgaccgcattcttgccggtcagctgctgaaacgcgagcccacgagctggcagctgtggatggacaagcgcaattacgagacctacggcggtgcccacgaataccagaccctcagccaggagcacgccgatcgtctatcggagcaggaagccgacgcgcatgtgcaccatgttctcggcgaagtgcggaggaatcccaggaagaagttcgccaagggacccaagctgaggaggggcgatgctgttgactcgtgtcggatctatggcagtctggagggaaataaggtgcagggtgacttccacattacggcacggggacacgggtaccataacaacgcacctcatctggagcacaagagtacattttctccctttgttcctgggtattcgaattcaactgacgcgcgcagccttcaacttctcgcacatgatcaccgagctctccttcggccctcactatccgaccctcctcaaccccctcgacaaaaccatcgccacaaccgaagaccactactacaagtaccagtatttcctctccattgtgccaaccatctactccaagggcaacctcgcactagacacctacgccaacgctccgccctcaaaccgccgtggcaaaaacctcgtcttcaccaaccagtacgcggtcaccagccagtccagcgtgattccagaaagcccctacttcatcccaggcctcttcttcaagtacaacatcgagcccatcctgctgctgatcagcgaggagcgcactag

SEQ ID NO: 10398 - DNA, 486 bp, A.fumigatus
  unsure (1),(3),(8),(19),(35): Identity of nucleotide sequences at the above locations are unknown.
ncnccccntatgaacgccngctgcgatgatccccncctcgtggtgaagactaccgcgccagacaccagcaacccggccgccaacgccttcgacgacgtggacctcgtcggcggctcgttcgccgaccacgcgcgccgccgcagcatagcccagcagcactcgtccttctccaccgtcctctcgagtggcctcgcggccttcacgggcagctatggaaaccgcagccgggagtcctcaacccagcagcatccgcccgctgcgcgtggcagtctggaactcctctctgaggagaacttcgatgatgagttcgacgaggcggagtttgcgcgggcgcaggcggaagaagaagcgcggaagcgtgtggagtgggtccgcgagatcaaggggaagctcaaggactggaagggctggcggctggatttggtggatagtcgggctggcgctgagggagccggtgtgggcatgggtgagatatttgagatttag

SEQ ID NO: 10399 - DNA, 375 bp, A.fumigatus
gtcttgctttggttcgatatcactgaccgattctcatcatgtacagcaatcaaccgctccccacttatgcttgcccaaggcaccgatgtcactaccgcggaagcggcagtgatcgcaaagtacaacaacctgatcgcgacatatctcgcccaattcaagtccaagaacagcggtgtcacggcaacagttgtggatacacaagcgccgttcaatcaggcattggataatcccacggcctacggtgcgcccgatgccacctgctataacagcgatggcacaagctgtctgtggttcaatgactaccatcctggcattgccatccaggacctcacggcacaggctgtggcttctgcgctgaaggagttgtttttctag

SEQ ID NO: 10400 - DNA, 765 bp, A.fumigatus
tcaacagcgcttagatcaatgcgtccctggaacaagcactgcaccaggcactgcgccaagtacgacaacaacgacaacaaccacaacaacgagcaccgctacacccaccgggctaaagtacttcatcactttgtgagttaccctaagcttcctaccgaacgttcttgggctcatccagctagtggcgactcctactcgcagaccggattcgacatcagcagcaccaaaccctccgcctcgaatcccctcgggaaccctactttgccaggatggaccacgagtggaggcttgaattgggtcgggttcctcgtctcaaaatataacacgtccctgactctgtcatacaactttgcctacggtggggcgacgaccaacgccagccttgttgctccatatacctcgactgtcctgagcttcatcgatcaggtcaccgagttcaccaacagcatcgcctcgaagccctcttatgcgccgtggaccagtggaaatactctcgtgggcgtctggatgggcgtgaatgacgttggcaactcgtactggctgtctaatatcgacgagcttctccttaagattatggatagctactttgggcagctgcagattctctacgacgctggagtgcggaactatgtgctgctcggtgttcctcgtaagtcttgctttggttcgatatcactgaccgattctcatcatgtacagcaatcaaccgctccccacttatgcttgcccaaggcaccgatgtcactaccgcggaagcggcagtga

SEQ ID NO: 10401 - DNA, 663 bp, A.fumigatus
aaagaattcgcggggggttctgaagaaatgggggagagacaacggacgaacgccatgccacaggcatggccccgcccccgcaatatggtggcatcaggcaattcaatcagtgtcatccatgcgaacaagcagcctagtttatcattatggcgatatttcggatacgatcaagacaatccggacgaatcgcatccccttaacaagcatatgaagaccgtttcgtggatgcaacttttggatcctcatgcagatactatttacgccaatgaaccagaagtgatccctgacgagacccttgccacttttaagtttaacagacgcagcgcgtattacaaaaagcgcagtcgctgggagcgggtacgacgggttgttgatgaagctcgagccggtaactttgacggcctcattgtcgcgacgctaatggagccggcaagtgtactcaaacacaccgtcccactattggcgggttccgctccggtagtagtctactcgcccaccgtcgaacctctgaccgagctggccgatctatattcgactcccagaaggacggcttacattactcgaaaacgagagattatcgcacagcacagcctacaacagtctttgcaaggggcagagccactgataactaataataatcctcatgaaccggacttctcataa

SEQ ID NO: 10402 - DNA, 285 bp, A.fumigatus
ttagataaggatttcgcactcgacccctccctcttgctggcgcccacgatcgagacctcccgagtacgcgcatggcaagtacttcctgggcgtacacacccgctgatgtcggggcgtggtggcgctgaaggctatattttccatgctattcgcgttttcccgtcccatcagaacatccaggctgcgggtaatccaagtcggaagaagaggaaggtggctgcccaacaagaatccgcaacaccagcggagagtggaagcggggtggacgttgaaatgcagtcatga

SEQ ID NO: 10403 - DNA, 471 bp, A.fumigatus
ggaccgggatgttcccgtaataggtacgaacgcttgtacttcttcaccaacctctccgtcaagcaactcatgaatctcgcgccacactgcagcggactcgtcgctaacatcagctctcgccgtctaccctcaggcaatttccctgtcctccccctccgcacccgtactcgcggccccgcatacaccctccccccgctgcccgccggtgtctccgatatagatgtgcctcctgacagcgagtcgtacgactgcgtagacgaaatcctgtctcttttccgcgccaatgtgctcttccggaactttgagatcaacggacctgcagaccgcatgctcatctacggaacgttgttcatcagtgaatgtctggggaaggtcaaacctggcatgacctcccgcgaggctgaaaaggtactattaggacaggaatgcgtcaggggatctgctaatgggcatacgtcaggctttgattaa

SEQ ID NO: 10404 - DNA, 297 bp, A.fumigatus
gacaggaatgcgtcaggggatctgctaatgggcatacgtcaggctttgattaatgtttcactcgatcatttcgctatccctggtgatgtggccttccctctgaaccaggcgttcgagcctccccgagatcgacaggatgcagagacactgagacagtatgttccaatttctttcaaaagcttgagagcgctgagtttaatgcgatttgattcagatacctctcccaagtacggcaggagatcgctattcgactacatgctcggttatacgctggcggtgaagggccttccaaggtag

SEQ ID NO: 10405 - DNA, 399 bp, A.fumigatus
ctcggggtatttgagccctcgcaggcccacgtccaactggggacgatcgtccttgacagggatcgacattcgttcacagatcttccacccgaactatcgtttattttccttttccggtatgtgacagcaaccatgctgctcgacatcagtgccttcgccttatccaccacaggcgtgctgtgcatgcttctgtgtcttgttgtcaagctttttgagacctcgccggtccccaagaatattccatgggtcctgagcaagaagggcttctttggccgagctgcggagcgcttcctcggcgtcaaccccatcggattcatccaagagggatatcaacaggttggtttatgtcatgccgtgctctggcactcgatgtacacacaggtcgggatgattggttga

SEQ ID NO: 10406 - DNA, 903 bp, A.fumigatus
atggctcctcccatggcgaagaaacgcaaggtcttggatagtctgaagaataaggccggtcggcctaagaagaagttcagaaagcagctcgaataccacagcagttccgacgaagcggaagatgaacagcccaccgatttccaagcagttaatctggctgattccgatgcagaggaagaaaggaagccggtagaacggaagccacagaagccagcttcgagcgagacgaggtcgctaggcgcacaaaagaagagaaaagcggaagacagcgacgacagctctgctgctagcgagaatgagagtgacgcggacgacaacaatgggtcggactcgccagattcctctgatatggaggacgacgagtatggagactcggatacctcactgcccacatcgacaaatggacgccgcaggccagtcgctaaacgaaatgaccctactgcattctcaacatcgatttccaagattctttcgaccaaactgccttcatcagctcgagccgatccagtcttgtcgcgcagtaaatcagcagcgcaaactactagcgaactcgcggacgagaaactggacaagcaggcgcgggcgaagctccgcgcagaaaagaaggaggagctagaccgtggtcgcgtgcgcgatgtcatgggcatcgagcgcggccttactggtgttgttgcagaggaggaaaagcgtcttcggaagattgcgcagcgcggtgttgtgaagttgttcaatgctgttcgcgcagcccaggtccgtggagaagaggctgcaagggaagagcggaagaagggtaccattggcattggtgaacgagagaaagccgtcaacgaagtcagcaaacaaggttttcttgagttgatcagcggaaagaagggaaaaccgctgaacatcgaggaggcttaa

SEQ ID NO: 10407 - DNA, 258 bp, A.fumigatus
ttcttcctcataggtgcatgcggagggtcttgcgcttgctcgacgtgccatgtcattgttgaggacccggaggtgttcgacaagatggaggagccgtccgatgatgaaaacgatatgctggacttggcgtttggattgacggagacatcgcgtctgggatgtcaggtggtgatgaacaaggatctcgacggacttgttgtccgactaccttccatgacacggaatgtgcaggccagcgattttgcgcagaagaagtaa

SEQ ID NO: 10408 - DNA, 303 bp, A.fumigatus
gagcgcgttcttttaagcctcctcgatgttcagcggttttcccttctttccgctgatcaactcaagaaaaccttgtttgctgacttcgttgacggctttctctcgttcaccaatgccaatggtacccttcttccgctcttcccttgcagcctcttctccacggacctgggctgcgcgaacagcattgaacaacttcacaacaccgcgctgcgcaatcttccgaagacgcttttcctcctctgcaacaacaccagtaaggccgcgctcgatgcccatgacatcgcgcacgcgaccacggtctag

SEQ ID NO: 10409 - DNA, 192 bp, A.fumigatus
tttatgtcatgcaggcttcatgtgtcattcatcgataaagacggacagaagcacgacttcgaggtagctgagggagacaacctgctagacattgcgcaggccaacgatttagaaatggaaggttcggatttactcctggctgtgtacgcgactgtccgcctgctttttgctcaccttaattcttcctcatag

SEQ ID NO: 10410 - DNA, 1662 bp, A.fumigatus
gacttcgacatctctccgttggaactgcaattcccacttctccatcaactgcgactgctggaagatgaaacgggtgcttcactacacctgacatctttgaaggagtttgtggaccacaatttctcagtgcctattgaccattttcacaatgaatctcgatatgaaccccatactcgcgaccacttcaacctccgctactggttcgatgcaagtcactacaaggaagggggaccagtattcctcattgcagccggagagacgaatggtagagatcgttttccgttcctgtctcacggaatcgtgacccagttagccaagacctataatggtctcggagttatcctggagcaccgctattacggggagagctaccccttcgccgatctcaccacgaagaacattcggttcctttcaacagagcaagcaatggcggattacgcttactttgcttccaacgttgttttccccggactggagcacctgaatctgacagctgacgccgtgccgtggattggttacggaggctcctatgccggagcatttgtggcttttcttcgcaaggtctacccggaggtcttcttcggggtggtgtcgtcgtcaggagtcaccgaggccattgtagattattggcaatactatgagcctattcgccaatttgcaccgtccgactgcatatggagtattgaaacgttcatggatattgtggatactatactgattgagcatgccaagaatgagacactgaaatcgcacctcaaggccgtttttggtgcaacttcctccgatgtcgatgacgagttcttcgctgcggctctctcgagcacccttggagcctttcaaggccggaactgggatcctgcggtcggcgatggcacttttcagagatattgcaagaatctcaccagcccgtcgttgctctaccagcagaataataccatgaaggcgtggacggaggaggtcatctccgccacaaagtatgatgcaaccaactccagcttggtgacggggatgctcaactacgctggttacatgaacgccacgatgttctcccatcttgacgaggttcgcggtacctccagtcacaagtccccacaatcactgcaaaaatcgtctggggttagctgggggtatcaggtctgcacggaatggggatacttcatgccgggatcaagcgttccaaaagatagactgcctcttatctctcgtttgatcacgcttgccggcgaatctcggttctgcaaggaggacttcaacatcaccacacctcctgacaccgaccggattaacaagcatggcgggttcaacttctcatatccccgggcggccattatcgatggactggccgatccttggcgggacgcgacaccgcatgccgacggtacacgaccaagacagtccacggacgaggagccatttatccttgtcgatgtcccggccgaggatgtctgggatgggattcgcggtgcggtgcaccactgggatcagaacggcttgtccgaacaagatgtgcagcaagggaagaccgcaccaaaggccatagtcgccctgcaacaggaaatcatacggtttgttggggtgtggctgaagcagtggagaaaacacgaggatgtctcggatccgacagcgaacacggcagtgagaaatcggcaactggtgctctag

SEQ ID NO: 10411 - DNA, 207 bp, A.fumigatus
gcaaccattcgggcaccgattcatacggttcgattctcgcccaatggcaaatacctggcgtcgggtgcggacgataagatagtctgtatctatacattggatgcgaatcctccttcacatgcgtccacgttcggtaggtgctggctttatttgaccgtgggaagggagctgggtaaccggtgttttcttcgcaaatgcctaggttga

SEQ ID NO: 10412 - DNA, 516 bp, A.fumigatus
tccctcactatggaagtggcgtccaggcagtcatcgagactgcttcggtcctccattcgcggttctaaccgcgtggccctccagaacccttgtctttctagccctcgcatcatatcttccaacaccctgagtgccattcaacggcggaatgtctcctcaacatctcgacggactgcgccagaatcgtcactgctaggcttcggacccggttcggtgcccggcggtgcacccgcgacatacttctcaagtcgctccgcgcttcccatgaacactgttattcgattcgtccctcagcagactgcatggatcgttgagcggatgggcaagttccatcgaatcttagagcctggattggcaatcctaatcccctttatcgatcggatcgcgtacgttaagagcttgaaggagtctgctattgagataccgagtcagaatgccattaccgcggataatgttacgttggagttggatggtgtgctatacacgagggtatttgatgcctacaaggcaaggtga

SEQ ID NO: 10413 - DNA, 852 bp, A.fumigatus
gacaagcaagctgactcgtttcaattgtcgatcagttacggcgttgaggatgctgcatatgccatttcccaactagcacagacaactatgcgctcggagattggtcagctcaggctagaccacgtttggaaggagcgtgccacgttaaataccaatattacgcaggctatcaacgaggcagctcaggactggggtgtggtctgtctacgttatgagattcgggatattcatgctccggaaggtgttgttgcagcgatgcatcgtcaggtgacggcagagcggtcaaagcgtgcggagatcctcgaatctgagggtcagcgacagagtgcgatcaacatcgcggagggtcggaagcagtccgtaattcttgcgtctgaggctctgcggtctgagcggattaaccgtgcttctggtgaggcagaggcgattatgctcaaggcgcaagcgactgccagaggtattgaggtcgttgctaaggccattgcagaaggcagtgagaacgcgcacagtgccgtcagcctcagtgtcgcagaaaagtacgtcgaggcattctcaaatcttgcgcgtgaaggaactgctgtcgttgttcctggtaatgttggcgatcttggtggaatgattgcgaacgccatggccgtctatggcaaggtcaacgagagccaggcgcgctccattgccgcaaaggcccttggagtgcaggagcctactcagattgagcactcacaacaacaaaaggcagaaaagaacacttccgagccggagggtcaggctgcgtctgagactgacaaggccgggagtgtcgccgatagtgtcttggaaggatttgaccaagccagccaacagagaagatag

SEQ ID NO: 10414 - DNA, 189 bp, A.fumigatus
gcgattttactctgggtgcagatggatacgttcgaatatggtcaacggaagcgatctataacacgggggaaccccgagtatgcgaacaagcccaagcagcttgcgtcgatgagcaaccattcgggcaccgattcatacggttcgattctcgcccaatggcaaatacctggcgtcgggtgcggacgataa

SEQ ID NO: 10415 - DNA, 630 bp, A.fumigatus
cgacataatacaggtgcctttctcttcctcctcatcctcgctgcctacatcggcctgctccctcatagcacctcctcctcgatcccatcaaacctccagccaaacgacaaattcctccacgtcgtcacattcttcttcctctccctcgtcttctactggatcccggataccacccgccgccgttctctgcaattgaccctgctcatctgcaccctcgccctcggcatcggctccgagatcgtccaggccattctccccaacgaccgcccattcgaccccttcgacatcctcgccaacctcgtcggcagcctcggcgcagtcggcctgtgcagctggtaccaccggcggatgctggagcggcggcgtaaggcgcgcttcggggcgctcagcgacgagcgcggggatgacatcgagctgggcggtgcgggcggttcggagagtggcctcggaccgcaggaatcaggcgtgatgtccctggagcaggaggtcgacaattgggatgagaatgcggtggatacctgggatacagaggagggggcggatgagtattctgcttctgctgctccggggcgaggtcctgagtctaaggtctcgcctgttaacagcgagggtgcgaaacggattgattaa

SEQ ID NO: 10416 - DNA, 1179 bp, A.fumigatus
acgtggagaaacgagccccctcgcccgccccagaaccggggttttggagcgagcatgtcgctcggtcaccaccacacctggcagccaccgggacatcttcggcacgccgatgatcccaatgacttacggtctgtcaatggctactctaaatcttttcccgggctcaagacgctgcaaatgcgctcctctgccggggccgatggcggtcacgcaggtactttgatatcggagtctgatactgcggccgacgaagatccacgcattgccacctttcgcgatttgtataagcgcagcgaggcgaaaataaacgccttgttcgcgaagaaacatcccgcggaagagaacctcggtgctgctgacgccgagacggaggaacccgagtcccaaatcaaccgcgcctgcgaaccggtgtcgctccccgtcgcgcctaagaaaccggcgagaaaattggatgatgatgactatgacgaatacgacgatgatgaggaggaggagactgaggctcccactccgcccaaatccaagacatcggctttgtcccatgaacctagtggcgtccagtctccgaagcatcgtccaagtatagctgcatcggttgcggccgatagtatgaaggaagtgaagaaggagacgcttgaggacatccggaagaagttggaggaggataagaaagccactgaggaagctgcgcggagaagtttccacaccatgttccacacgttggagaacgacagggatgctatgctggaccaacagcgtctggaagaatccgagaggcaagtagaagctgaaatgtccagtcaagccaatgctggcagcaccaatgcgaatgcgagcacagacggttacggctccctgagtaatgccaacttgggcgcttcgagtctgaccttgaagaacctcattgcgaggatcgatatgaagcgcaacatggtccaagcgtcggatgccgaacttcgaagcttgatgagcgaagtccgcaagaatcgaagcaaatgggccagtgaagacaagattggtcaggaggagctctacgaagctgctgagaaggtgttgagcgagcttaaagctatgacagagcactcatcggctttcctgactcgtgtcaataagcgagatgcgccggattattataccagtaaggaaccaccctctcctttgcacgcgttcctgcagtag

SEQ ID NO: 10417 - DNA, 732 bp, A.fumigatus
ttagaaaaggtctttaaaaaacatactatggctcgtacaattgggaaatatcagcttttaattcttaatagccatgctagccatgaatcagcagagtttgatcttttctacaagaatcatcagattatccctctttatataccttctcattcatctgataaactgcaacctcttaatattagctgctttgcacccctaaaggaggcatatgggatagaggtaataagaagcattcaaaatagcattcatcacattaataaggagaactttctgacactttatagagaagcacaaaaggccttatcatctaaaaatatccacagtggatttaaagcctctggtcttgttccattaaattgccaacaggtgttagataagcttactatcaagcatattacaccaccatctactgcccataggccttcagatcaggaatggactgcaaagactccttatacaactgctaaggtacaaaagcagatgcacctcatcaaacaactaatcaatcacaactctgaaagtcctctaaataaagcaatccgtcagctagcaaaatcagctaaatataccatacataaagtccttctcctagatcaggagataaaagggctacacgcagcaaataagaagcagaaacgaaggcgcacaacccctagatcttttatggctactggaggtgttctgacaggtactaaagggccaagcactaagcccaagaagctatacaggtga

SEQ ID NO: 10418 - DNA, 201 bp, A.fumigatus
gagaaccctttattcatgtctgatgaatttgcctatttgctacactttggggatggcaggaagatttctgagatcaaaggatttttcgacactttgaacgttcataaccaccttgggcgtgaaaagagttattctggcggcgcctactggattgatttattagcttggaccctagaagtatctttaagtattttcatctag

SEQ ID NO: 10419 - DNA, 264 bp, A.fumigatus
  unsure (249),(251),(254),(255): Identity of nucleotide sequences at the above locations are unknown.
ctgtttatactaatgatcgttttgattcagacgccacgagtgcgtcaactggatgttcctgcagtgctttctgacgagggtctccccgctatgagctcacctgaaaagcatcaagggccgaatctgttagctctagaggatgattcggacgaagatatcgttccttactcgagaaatcatgccaccaagttctggaaatctcctaacggggttttctccaagccgctagaaggttcaatatgcagccananccnnacaaatcgc

SEQ ID NO: 10420 - DNA, 216 bp, A.fumigatus
gagatctttgtctttctgctcttctatgaagccggaaaatgcagatgcaacctttacgacaaagctttcaacattgcctttggtcacaagtacctattgaaaatctcggttaggcacaatgatgtgaaaggacatggggaccaacatcgtctgtctggaaatattcgagcgaatcaagttgagggattgtgttcctggttttgttgcgtcagttga

SEQ ID NO: 10421 - DNA, 1359 bp, A.fumigatus
  unsure (871): Identity of nucleotide sequences at the above locations are unknown.
gacaggagggtatctagaagaagagggcatctactcttcctcaaactcttcctcttcctcctcctcctcttcttcttcctcctcttcttcttcctcctcctcttcttcctcctcctcttcttcctcctcttcgccagacgaagcttcacttccatcatcatcactaggcgcatcctccatcatctcatcctcatcggccttcttctccgccgcgcgtcgtttctcctcctcgcgccgtccctgttccagaatagcagccttctcctccctcaacttccgctgcgtcttgacaaacgcacccaaaggtgtcgactcccaatccacatctttcaggaacgactcgacctcggcgcgattgcgcggcgtatacgtgacattcagcctcttctcctcgatccagcgcgcgttggcctcgaccttctgcacaagcagcaagatagcctggttgacctttgcattcttgttgccggtcgtgcgggagccgacctgcttcagccagcgcttcagggcgacgacgatggggacggagagctcggggaaggcgatatgtttggtccagaggacgaagaactcggagagcagctcggcgacctgttcgccgacgccatcctggtagatgcgcgtgcggaggtaggatttcggggcgcggatggcggtgctgaagtcgagttgcttgagggtgctggatttagggggcttgcgcatctcggctgcgttgaggacctcgaggagggccggggctacgggcacgtacgtgcctgtggcacgggagaggcggaggagggcgcgagtgagctggaagcggagtgggaagtacgttgcggtggggatgaggcgcatcgcgccgagggtgatctggaccacggggtanatgaggggccgcaaggcggattgctttccggctttagcttcgacgagaccgtcgcagtgctgggagaggacgcgcgaccagaagtccagcgagtgcgtgtactgccagttgtacatggtcttgtaagattccttggaggcgttggtgatgctgctgcggaggtgcatggcaagttgccggatgaacctgaagcctgtcgtgtacgagatgtcttggtcgatgccccagagctcggcggccgagttcttcatcaggtgaactcccgagagcgtgtggacggttgtgttcctggtgcccttgaccactccttcatacaaggccttgaggacggtctccttgaggccggagtcgccaatgaccatgagtttgcgaagcagcaggaagcctgtgatccgggttgcctccgtcgtcgagacatcagcccagatgccgacaatcgtcttgatgagaactttcaggagttttctgaactgaagcagatagggtag

SEQ ID NO: 10422 - DNA, 792 bp, A.fumigatus
aagatctctctacttcatagtccatatgcatatatgtgtctatcaaagaccgttattgttcccttgatgtgcacgtgtacggtgttcctgaacttcgcaacttttatagatatcatatcaggaattgtcccaagctacaggactagatggaataagcgaaacaaacagaattttaagacaggagggtatctagaagaagagggcatctactcttcctcaaactcttcctcttcctcctcctcctcttcttcttcctcctcttcttcttcctcctcctcttcttcctcctcctcttcttcctcctcttcgccagacgaagcttcacttccatcatcatcactaggcgcatcctccatcatctcatcctcatcggccttcttctccgccgcgcgtcgtttctcctcctcgcgccgtccctgttccagaatagcagccttctcctccctcaacttccgctgcgtcttgacaaacgcacccaaaggtgtcgactcccaatccacatctttcaggaacgactcgacctcggcgcgattgcgcggcgtatacgtgacattcagcctcttctcctcgatccagcgcgcgttggcctcgaccttctgcacaagcagcaagatagcctggttgacctttgcattcttgttgccggtcgtgcgggagccgacctgcttcagccagcgcttcagggcgacgacgatggggacggagagctcggggaaggcgatatgtttggtccagaggacgaagaactcggagagcagctcggcgacctgttcgccgacgccatcctggtag

SEQ ID NO: 10423 - DNA, 1491 bp, A.fumigatus
  unsure (651): Identity of nucleotide sequences at the above locations are unknown.
aggagacggcctcccggaaaagtcagggtgtctctggattcgaagaaattcaagaccctcacacccctcatcaagtcgcatacatcctcagttcatcagttgctcgtcaatctctccgatgcatcgacactcaagttgactctttcgtccattgaaccgatgctaccctatctgcttcagttcagaaaactcctgaaagttctcatcaagacgattgtcggcatctgggctgatgtctcgacgacggaggcaacccggatcacaggcttcctgctgcttcgcaaactcatggtcattggcgactccggcctcaaggagaccgtcctcaaggccttgtatgaaggagtggtcaagggcaccaggaacacaaccgtccacacgctctcgggagttcacctgatgaagaactcggccgccgagctctggggcatcgaccaagacatctcgtacacgacaggcttcaggttcatccggcaacttgccatgcacctccgcagcagcatcaccaacgcctccaaggaatcttacaagaccatgtacaactggcagtacacgcactcgctggacttctggtcgcgcgtcctctcccagcactgcgacggtctcgtcgaagctaaagccggaaagcaatccgccttgcggcccctcatntaccccgtggtccagatcaccctcggcgcgatgcgcctcatccccaccgcaacgtacttcccactccgcttccagctcactcgcgccctcctccgcctctcccgtgccacaggcacgtacgtgcccgtagccccggccctcctcgaggtcctcaacgcagccgagatgcgcaagccccctaaatccagcaccctcaagcaactcgacttcagcaccgccatccgcgccccgaaatcctacctccgcacgcgcatctaccaggatggcgtcggcgaacaggtcgccgagctgctctccgagttcttcgtcctctggaccaaacatatcgccttccccgagctctccgtccccatcgtcgtcgccctgaagcgctggctgaagcaggtcggctcccgcacgaccggcaacaagaatgcaaaggtcaaccaggctatcttgctgcttgtgcagaaggtcgaggccaacgcgcgctggatcgaggagaagaggctgaatgtcacgtatacgccgcgcaatcgcgccgaggtcgagtcgttcctgaaagatgtggattgggagtcgacacctttgggtgcgtttgtcaagacgcagcggaagttgagggaggagaaggctgctattctggaacagggacggcgcgaggaggagaaacgacgcgcggcggagaagaaggccgatgaggatgagatgatggaggatgcgcctagtgatgatgatggaagtgaagcttcgtctggcgaagaggaggaagaagaggaggaggaagaagaggaggaggaagaagaagaggaggaagaagaagaggaggaggaggaagaggaagagtttgaggaagagtag

SEQ ID NO: 10424 - DNA, 846 bp, A.fumigatus
aagcagaatgcctttgcggaaatgaacgtcgacgattttttcgcgggcggattcgaaattgcagacgccgatacagacaagggcaagtctcggaggaaagatgttacccccaagatcggcaaacggaagcggtcagaggaacagaaggaagaggacgaggaagcctcatctgtagcctcaagtgaagaggaggaagatggtggcgtatccgacgatgatgcggcgtctcaggccagcagcgcaccggatgactttgaggcgcacaagaaccagcttcaagcgctgaaggacaaagatcctgaattctacaagtatctgaaggagaacgattcggagctgctggacttcggtgaacacggagatcttactgaggtcctcgagctgagtgaggatgaggcggaagaagggcctgcaaagaagaagaaaaaggcggctaaggatgagggcgaggaggctgcagacaatacgctcacgattgcgatggtcaagaagtggcagaagttgatggaggaacaaaactcgatccgcgctatgcggcaagctgtgctcgctttccgctgtgcagcgtacatcaacgaggcggaaactcaagagcaaaagtactcaatctcggacccggatgtataccatcaagttcttgtgacggcacttggtacggtaccaaaggtgctcgcgcatcatctcccagtgaaggagacggcctcccggaaaagtcagggtgtctctggattcgaagaaattcaagaccctcacacccctcatcaagtcgcatacatcctcagttcatcagttgctcgtcaatctctccgatgcatcgacactcaagttgactctttcgtccattga

SEQ ID NO: 10425 - DNA, 183 bp, A.fumigatus
atcccgcagtcagctcaatgtctcatcgaccccagcacggcagcgccgtattctattgaaatcgatttctatcccctcgttaccgtcggtggtgcggaactcgctatcatgggctggggataccctaaatgcgtatcgcgatggagcctcaagagagcaaaggaaggcgcttacggatattga

SEQ ID NO: 10426 - DNA, 879 bp, A.fumigatus
gcagtttcgtacgaggagtggaggagttgcgcctgcgaactggacgagttagaggacaataacacctggaagcagacattcgaatgttcagaatacagccctcaccttgtgcaagagcgtctcaaacagctggaagaggcccgcatcagttgtgacgtaagccggatgctttttctgattcgcacttcgctgagtcgcgatctggggaatatgagcaatgcggcgctgtacagacattctcatgtcggtacgaaggacttgatcgaccggtacattacgacggcggttgatacgatatcaatgttggtggatctggctggaaagaagtgtgatgtgttggagtcgaggtatatgctcgatcagcttctcgccgcgagacaggcgtttggtcgaagtgctctactattctcaggaggcgccacgttcggaatgaaccatattggagtactaaaagccctatgggaagcaaaactgcttccccgcattatttctggcgcctccgcgggcagtatcgtctgtgccgttttctgcacacgtacagacgatgagttgccagcgcttctggaatcttatgcttacggagatttcgccgtctttgatgaggaagggaaggaggagaatatattgcagaaaacagcgcggtttctgaaatatggctcctttttggacatttcgaatcttgctagagtcatgcggaactggcttggcgacattacatttcaggaagcatacaataggacgaggaggatactgaacatttgtgtctccagtgccggagtgtacgaacttccaaggttgttgaactacattaccccaacccaagggggagatttgttctgctgtttaagtttcattatcgtgatgctcaacttaccgtga

SEQ ID NO: 10427 - DNA, 1278 bp, A.fumigatus
atagcttggccattctgtgatctgacttgtaatagcgtgttctcatgttcagtaccgttgtttttcacgccttttgtgctgatggccaagaatccattgacgggagaagcggtcccttggactgatttccacaagcagtacattgccgcttcagtggatggagatttgcccatgaccagattgtctgagatgttcaatgtcaatcatttcattgtctcacaggtgaatcctcatgtggttcctatctttcctaaggacgatggtcccagtcatgggccaatgcagacctcatcttcacctacctggcttcacaccgtgacacatctagccaaggacgaaatattacaccggatggcggtcttgtcagatcttggtatcttccccacatcgctcaccaaagctgcttccatcatgaaccagaaatattacggagatatcaatatctaccccgagattctctacgcaaatttccctcgaatcctcaagaacccgaccactgaattcatgcttcaggcgtgtctcagcggagaacgggcgacttggcccaaactcggacgaatccggaatcactgtgctatagagctcgcattggactcggctatccagcagatgcgcgtgcgagttgccttcagtcctagcttggttgacttgaggtaccaagggtttaatgggcattcgattgattcgctcgatagcagtggagggcgcggacgcatgctcaaccggaggagctcgtacgatcatggagtggagcgtatggagcgaatgcgtccgaattctggccgtcgatccacagcgcaagtgaggcggtctcgtagcgaatatctcgccgaacagtcacatagcctgagtgttgttcgttcagccgaagctggacaagagattcaagatcgcagtgacgaccgcccgaaggacctgaccgttgacggaacatattgtattgattttgattatgacgaaaccgatctatcctctccagagcgaccagtacttttacgggcctcttcatggggatcgtcagcgggtgcgcagccgggatcgcggcatagtcagcagagcactgtccgaacccggccgctcttaacaacggccgcgtccgtgatgggtccctccgtaagcacatcacgttggccatcatctgcgcactctgccgacaatgccagcccccgaatgtcattgtactcaaagacgatatcacctccacacaacttactgcagatgacacctgcagttcatgggatctccgctgggacgtcaacccgtcactcttacaactga

SEQ ID NO: 10428 - DNA, 1176 bp, A.fumigatus
ttgaagcagagcgccacatttaagcagacctcgggcggcggcggcggagaatatgactacactcgctccggaaatcccaccagaactcacctcgaacgacacctcgccaaaatcatgtccgcgcagcgcgcgctagttgtctcatctggtatggctgctctggatgtgatctcgcgactgcttcgtcctggtgacgaggttgtgacgggcgacgacctctacggcggaacgcatcgtcttttgaagtacctgtcgaccaatggtggcatcatcgtccaccatgtcgatacgacgcagccggagaaagtccgtgaggttttgactccgaagacagctatggtcttactcgagacgccgaccaaccctctcatcaagattgtcgatatcccccagattgccacagctgcgcacgaggtcaacccgagctgcttggtggcggtggacaacactatgatgtctccgctccttttgaaccctcttgagctcggtgcggatattgtttatgaaagtggaaccaagtacctgtctggccatcacgatctcatggccggtgtgattgctgtgaacgaccttgctcttggggagcggctgtacttccccatcaacgcttcgggatgcggcctgtctccgtttgactcctggctcttgatgcgcggtgtcaagacgctcaaggtgcggatggaccagcagcaatccaacgcgcagcgcattgccgagtttctcgaagcccatgggttcaaggttcgctatccggggctgcggtctcacccgcagtacgagctgcaccactccatggcgcggggcgctggagcggtgctgtcgtttgagactggcgatgtcgccgtcagcgagcgcatcgtcgaaagcgccaagctgtgggccatcagtgtcagcttcggctgtgtcaacagtctgatcagcatgccctgtcggatgagccatgccagtattgacgcgaaaacgcgacaggagcgagcgatgccggaagatttgatccggctgtgtgttggtattgaggatgtagatgatctcattgacgatttgcggcgggcggtaagtctctttcactctcctgcattcttctgcattctttcaatgctaattacgtgttcaatagctcgttcaagccggtgcagtcaacattactctagacggattcgaggcgaacgcctctaa

SEQ ID NO: 10429 - DNA, 438 bp, A.fumigatus
ttgcaccgcgctgatccttccagccccgtggtgaagacccctgatggcacgaccatattccccgagttggcgtctccgcaaaaccatactgtcgacccacaactacagatgcaatcgcagttacaatcacaaggtatgcagcaacgtcacatgatggtgaatcaaacgccgcagatgccgggacgtcacctttccagcccggagcttatgtcgggcctgccaccggggatgggcctgcatggtggccagccacagcaagtatttggattggagaatcagcatggatggcctatgcaaggcttagaggcggcgttgaatgccactgggatggagaataccagtcaggatgacaactggagtagcagttcgcgaagtggaccaacggctcctacgacgctgaacgtcgaagactggtatgtttgtatcagagatgcctga

SEQ ID NO: 10430 - DNA, 750 bp, A.fumigatus
aagaatgcagaagaatgcaggagagtgaaagagacttaccgcccgccgcaaatcgtcaatgagatcatctacatcctcaataccaacacacagccggatcaaatcttccggcatcgctcgctcctgtcgcgttttcgcgtcaatactggcatggctcatccgacagggcatgctgatcagactgttgacacagccgaagctgacactgatggcccacagcttggcgctttcgacgatgcgctcgctgacggcgacatcgccagtctcaaacgacagcaccgctccagcgccccgcgccatggagtggtgcagctcgtactgcgggtgagaccgcagccccggatagcgaaccttgaacccatgggcttcgagaaactcggcaatgcgctgcgcgttggattgctgctggtccatccgcaccttgagcgtcttgacaccgcgcatcaagagccaggagtcaaacggagacaggccgcatcccgaagcgttgatggggaagtacagccgctccccaagagcaaggtcgttcacagcaatcacaccggccatgagatcgtgatggccagacaggtacttggttccactttcataaacaatatccgcaccgagctcaagagggttcaaaaggagcggagacatcatagtgttgtccaccgccaccaagcagctcgggttgacctcgtgcgcagctgtggcaatctgggggatatcgacaatcttgatgagagggttggtcggcgtctcgagtaa

SEQ ID NO: 10431 - DNA, 195 bp, A.fumigatus
tgcctgcaaggaattgaaagctacaagacccgccaagaaccttccctgctcatcggattgcaccgtgttgactgttatgtagacgctctcgaagcctgccgtggccgccactctagcgatgggctggcagctaaggctaaattcctgtttgcgaatcagaattccgacattcaccttgcaacgaccaaaaattga

SEQ ID NO: 10432 - DNA, 249 bp, A.fumigatus
  unsure (142),(167),(200),(216),(226): Identity of nucleotide sequences at the above locations are unknown.
gatcgtcagtcgcgctacagggtctcgggggggaacgatcctcaagtgcctcggctcgtggctagtatggagacttggcaaaccccgggccatccgcagaataagtatatctttcgcagtactttcgaaggcaaagtcaacntcggatggaactattcccgcatcantctcatccggggactgtgggaaccccattccantgcgttgggcgtctcngctcgggaanccgctgcaacccgtccggcggtt

SEQ ID NO: 10433 - DNA, 2070 bp, A.fumigatus
  unsure (1965),(1990),(2023),(2039),(2049): Identity of nucleotide sequences at the above locations are unknown.
aaagttctacgctccgtactagtagacgttgactttgcggaagctattcggtctcttaagagtaaatcccccgacgatcaacagacattgctgattgcatcttgggcgggaagtcgccggctggaagccaagtatgggcagtacgtccaaggagatgcagcgaccaccgcaacactcagagcccctggggtggcggtcaaagtccaatttgaggacaatggcaaggatgtgtccgcattgaacgcagaattaaagattgatgcctcgacaaatgtcctgtacccgtcgcttgttcctgtaataaagcagatgaccgccgccatcaaggaggtcatggaaggccacgacaagccaaggaaaccatccagtgccgccatgttacaaccccagaagctaatgcaggaagccccgtttgatacgaaagacgcggcctcaatttttggtcgttgcaaggtgaatgtcggaattctgattcgcaaacaggaatttagccttagctgccagcccatcgctagagtggcggccacggcaggcttcgagagcgtctacataacagtcaacacggtgcaatccgatgagcagggaaggttcttggcgggtcttgtagctttcaattccttgcaggcatcagtcaagcatgtgtactcaaacgagtcgaccgcaagctttgacgtgaagtccatcgtcatgtctctcatgaatagcaaacatctgagcagttcgaagggcatttcagctgtgcttcgagtcagcccagtgcaagtaatgcttaacgcaaagcaagttcaagacctcctactcttccgtgaaatctgggttccctccaacgaagagagcaatggcggcagggcatttcaaccggagtcaaatgagcctcaggcatatatagttcagcgttaccaacaagtggcagcagcgccagcatttccgtggaatagtgcggttgccattgagaagcttgagattcagcttgatctggggtctacgcttggaaaggcacagttcgcagtcaacgatctgtggctgtcatcgaggaagacatctgatcgagaacagtcactcagcattggtttcaagtcttctgaggtagaaagtaaaggccgcatgagcgggtcggtcgagcttcagatattgaagattcgcacatccattcaatggccggaggagaagcccaatgcgcattctgttccactcattcaggcctccatctctttccaacagctacaagccaaggtctctttcgattaccaaccgttcctggtcgccaatatctcaatgttcgatttccttatgtacaatgtccgaggcaccattggtgcgcctaaacagcggctcttcagcattctagaaggagataaagtgcaagtattctgtactagcttgactgcgtcgcaatgtctggcgctgatccaaggctggcagcggttggcccaagacaaacaagcagcgtacgaagcatcactgcgtgaagttgagaggtacctgcgcaggagagcatcggtggctacggaaaaaatggaaccccaagccaaggaactggccaagaaagccaaagacaccaacgatgagaaggcgcctatatctctcaacactggggtggtcgtgagcatcaccgaggtcaatctcggtgttttcccgagctctttcttcgataaccagattttcaaactggaggcacacgatgcacaggcacgattctatgtctcgctgaaggagggcaagatacacagtgcgcttggactcacgctggggcagttgcgtgtcgctctttcggccgtcaaccgtcccacatgtacagacattgaggattttctagtcagtgagatcgtcagtcgcgctacagggtctcgggggggaacgatcctcaagtgcctcggctcgtggctagtatggagacttggcaaaccccgggccatccgcagaataagtatatctttcgcagtactttcgaaggcaaagtcaacntcggatggaactattcccgcatcantctcatccggggactgtgggaaccccattccantgcgttgggcgtctcngctcgggaanccgctgcaacccgtccggcgg

SEQ ID NO: 10434 - DNA, 276 bp, A.fumigatus
tgcttcgagagctctcttttccgacaatcgtcggaattcctcgttctcgactggaaggcaattaaactcttcgctgacacctccgacgagggcggtttgttctgctgcagtgtcagtagggtatttatcgcccccaaccatataaacatactaggcactgttcgccgcacgtatggctcccatttcttcctgcgttccttcttccttgcatcgcgcttcatggcttcgtataacgccgatcgggcttctccgaaaaccaccatgcgattttcatga

SEQ ID NO: 10435 - DNA, 408 bp, A.fumigatus
tgcggaatgcagcaagctacgaagccagtcaaggcaaaagcccaagagaacaagaccacacgtatgccgcagaacgaactactggatcttatttaccagtgcttccgcgaatacaaatactggccttttaagacgctcaaggcgagactccgacagccagaggcatatctcaagcagaccctggagatggttgcgcatctggtcaagtccggcgattttgccatgacctgggaactcaaacctgaggccatggaaagcaactacgcaaatgcactatcctacggcaatgcaaaggaggaacttcctcctgggaccgactacaactttgacgacggctcagaagaggaggccaatgcatctggcatggttactgataacgatgagatgaaatttgaggacgttgtctaa

SEQ ID NO: 10436 - DNA, 1218 bp, A.fumigatus
  unsure (90): Identity of nucleotide sequences at the above locations are unknown.
tgttcatctctgtcactgcgcacaaacgtcttcaatcataccaaagtcatcatgtctgatcctcttggcctcatctccagcaagtgcttncatcggcgcgtcattctggacacagcatatggcccccttaccatcttattcggcgacatcggcggcaccacgggccccgcgctgctcttcctgccgggtatgtttgcctcgcgctatctcagtatccctatgcacgtaatcgcggagcgcgccggagtgcgcctgctcgtggtcgaccggccggggatgggcgcgtcgaccaatgtcccactcgcccagcgcatcgccatctgggtcgatatgctgccacgcctgctggcgcatctgggtattccgcgcgtcaatctcgtgtcgcacagtgctggaaccatttacctgctcaatacgtgggcgcaatgccgtgagcttgtgggccctgtcgttgctttcttaggtaatttccacccctacccctctctctttttttgtttgtttcttggttggaagacgaggcaaagaaacaagacgcagaaaagaagacgtataactcagtactctgttatagcgccgtgggtggatctcgcacactcccgcgttacagtaatgcaaatggcccagtacgtgcctaccaaggcattcgcgatgtggcacctcatcccgcacttcgtcgtaacgcaggcgagccccgtgttggcgtcaagcggggctgtggtccgccggctgtcatcacagagcagccgaggccggcggatcgctcgttcctcgatgccaattggcggcgagtcgaacgtgattacggcgtgccgcacgctgaacaggcggaactcgcgcgtctcgccttccggtttatgtatgaaaaggacaccgttggggcgaatagcgaggccttgcagtgtcttcggaaaggcgacggtagcaactgggggcgcctgctcggactacgctcactgtgtgcaggcactggcagccggcgaacggtcgacaggtggccgagtcagtgtccggacatattttgctgccaaggatgccttggtgggcagcggggggcaaaagtactttgaggagtgctggcgagcaccggggctggaaggcattgactatatctccacgacgatcgacggaacagaccacgacactctggtgcagtcagtggaggtatgggaggagatattctcttcggtaccgcaaatgactttgtatgaccggtaa

SEQ ID NO: 10437 - DNA, 186 bp, A.fumigatus
ctacgtgatgtctctttccccctatgcttaagtttgcccgctgatagaatgtcctcggtttggaatttagtcgaatgcagtcatctattcttcgcaaagaaagattttgtcctgaatgatgaacaacacctagcagaaatggtgtcacttatggggcctccgggcctccccctcaggacttcctga

SEQ ID NO: 10438 - DNA, 261 bp, A.fumigatus
  unsure (164),(170): Identity of nucleotide sequences at the above locations are unknown.
ttgtgtatgttccgcctgttcacctacaccggcatttgcacgtgtaatatggccgtcggtctcatcaagctcagcaccaacaacggaagaccgcgattcgggtcgagtcctatggacacctctttcctccgagtcatggtcttgtactctgagaatttctgtanaagtantggacgtttgccctgtagttttcactctttcgactatgagaaccagcatgacgagatcgagaatcagcacaagaaaatcgagcaaaaataa

SEQ ID NO: 10439 - DNA, 210 bp, A.fumigatus
catttctctctccaggagcgtataatctgcctcaatggcgaagtagacgaaaccatgtccgcgtcgatagtcgcccagctcctcttcctcgaagccgacaaccctcagaaacctatccacctatacattaattctcccggtggctcagtgacagctggtaattccaatgcatccgatatcgctgtcgtttgtacaaaaggactaatctaa

SEQ ID NO: 10440 - DNA, 489 bp, A.fumigatus
ttccaatgcatccgatatcgctgtcgtttgtacaaaaggactaatctaacacacctatacttaggcctcgccatctacgacacaatgacctacattgcatccccagtcagcacaatctgcgttggacaggcagcctccatgggatcgctattgctttgcggcggcgatccggggaaacggtactgcctcccacactcgtctataatgatacaccagccctcgggtgggtacttcggacaagcgagcgatatcgccattcacgccaaagagattctacgtgttcgcaaccaattgaacaagatctaccagcggcacctgacagggaagaaagtgctgtctcttgaggagatcgagaagttgatggaacgtgattactttatgggggctcaggaggctttggagatgggtatcgtcgacgagattttggaccgcagggtaaagccgcaaaatgaaggaggagaaggcgaagggaagccaccagtgccgtga

SEQ ID NO: 10441 - DNA, 381 bp, A.fumigatus
cactatcgatactgggtgatctggcggataccaagtgtccgattcctcgactaccagaaagtgaaagacgcggagcgggcaaaggcgaaggagctatttggtacagccgaagaacccacagctctcgcgtcgaagattatgggcatcaaatctcgtacctttgatgtaccgtctggcggcgctgagcgagcaccggcagacaaagctgttagggtcaagctgaccgagaaggagaggaagcgggtcgaaaagatgatccgtgaggcgagaagtctccaggagatcactagactggagaaggaactgaatgaagggcggatacccggaggcgctctcgatgctggtgaggacagcgaagacgagaatcagatgcagacgtga

SEQ ID NO: 10442 - DNA, 309 bp, A.fumigatus
gaccaagatgcgatcgactttacggataacgatatctcctccctggggaatttccccttctttcctcgtcttcacaccctccttcttgcgcgcaatcgggtgaaacatattcagcccacgatagcttccacaatccccaacctgacgacgctggtcctcacagcaaacaatatggccgaattggcggacttggaccccctccgaaacctgacacgcctgactcatctggtgttactggagaaccctgttacgaggaaagaggtgagctgtcctgtattccgtcgcgtgttccgttttagaattcaatga

SEQ ID NO: 10443 - DNA, 318 bp, A.fumigatus
ttcaaaccctgttctaattggctgccatttgtcatatctgaacgagattgtctacggagtactccagccaaatacctagccttgagacttgaacaacccaatgaccaacttctctgggtgatttatggcgaagaaagttacgcaaataacttccggcctttattggaccaggttatgactgaccaggatggctgcttccatccatccataatattgaatccgaagaacatcagtgaagtaacttcgtacggagtagattctaaattcacctcttatgttatgcttgtatatttgtatttcacaccgtctgctgtatga

SEQ ID NO: 10444 - DNA, 240 bp, A.fumigatus
ttcgcctgtatgagacgaatgacgatcgacaacgttgctgaaaggaatgacgattgtatcaacggcccacagcgaggagtgattcttggcatatctatcttctattctgacagggaagtggctgcctccagcaagccttctgggaaaggtttccttgtccttagtaggctgatcggcttctatgttgctcttcgcaaccaacgaagggctagcgacgccagcttcaagtacatcttctga

SEQ ID NO: 10445 - DNA, 189 bp, A.fumigatus
tctcggtgtagatcgactcgtgttaggatcctggcgttgatgaagagtgttgtcatggccaactactctctctggttaagtgtagagtggtattacttcccttctacggagtatcatcgcgaggataagacaaagcatctaatacagagtaatttaggtactcgacataggcatgattcgcctgtatga

SEQ ID NO: 10446 - DNA, 186 bp, A.fumigatus
atcctgtctcgtccatctcgactgcccgactctggactgattcttactgtgtctatacaagtcgtccatgccatcgaatggattgctgagatcgctgggctctctaagctaggcacatccgcgtgtgacgtgtcaaacctggaatttttcatgaatcatgaatggccttcgctgatccgtacgtag

SEQ ID NO: 10447 - DNA, 336 bp, A.fumigatus
tcacgggaaacagcggcttccaacttccctgatcatcgaggcacagcaactgcgttccccctggcagcatttggcctgagcgccttcttctggtccaccgtgtctgcggtaatctttaagacgaccacggaaaaattccttcttctcttggcccttagaaacttcttattaaaacctgtcgttatacaatttttcccgggtcttgcaacccgtggccaataccaacctttgtccctattgggggaaacttactgggaatccggcccggggggtactactaggtcccctgaacttaccaatttcttaatagaagaagtttgtgaacccagtccccaa

SEQ ID NO: 10448 - DNA, 567 bp, A.fumigatus
gtatcccaccagacgaaccagaagagtaccatgaactcagctcatatgacttcgcagatcaacctcatcgtctttctcatcatctcggttgtatccgttcaacctgtggtgcaggaacataatcctcgggccgggttggcgcaagcggcaatggtgacggtttattgcacgtacttgactatgtctgccgtttccatggaacccgatgaccgccaatgcaaccctttgatccgcgcccgaggcacgcgaacggccaccgtcgttatgggtgccatcgtcaccatggcgactatcgcatataccacgacccgtgccgccacccaaagtcttatgttagggtctcaagccgcccatggccagtacgcgcagttgagaacagacgacaacgagcatgggctcgtcactcagcagcccagtcgccgtgagatgcgtgccgaggctcttcgtgctgctgtggagagcggtagtttgccggctagcgcattggacgagagtgatgatgagtccgatgagtataatacccaggacgacgagaggggctcgacgcaacaccactactctgcctga

SEQ ID NO: 10449 - DNA, 747 bp, A.fumigatus
gtcgctgacgccttgttcgccggatcaaacagtatgatgacacgaatcgcttatgctttcattctcttgatcaattcgattgtttcctggataatgctcacaccatgggcgctgaagaagttggagcatatgacgctagattacatggaaatacggtgcgatgggaaagagagtcatggttgggtggcggtacatcgtatcaacttcggtctcggcctcttccatctcattctcgctctaatgttgcttggcgtgaaatcgtccaggaatggtcgggctgttctgcaaaatggtttctggggccccaaggtcatcttatggattgccctcgtcgtgacgtcgttcttcatcccggagtcattcttcctcgtatacggtcattacatcgctttcttctgtgcgatgctcttcctgctccttgggctcattcttctggtggatctggcgcattcgtgggctgaactctgcctgcagaagattgaggacaatgattctcggctgtggcgcggactgctcatcggctcaacgctcggcatgtacattgcatcgattgcgatgaccgtgctgatgtatgtgttcttcgctaagaagcactgttctatgaatcaagcagctatcacggtaagtatcccaccagacgaaccagaagagtaccatgaactcagctcatatgacttcgcagatcaacctcatcgtctttctcatcatctcggttgtatccgttcaacctgtggtgcaggaacataa

SEQ ID NO: 10450 - DNA, 780 bp, A.fumigatus
ctagcccacccacaccgcttcccgctgtgggtgagctacaccgtaatcaccaattttcgatattttgacctttcgaagctattcccaccacccaacatgcctaaatctattaaatttaatgaatctgacctccttaaggcctgcgaagccgctcaggcccaaaataaaccgaatatctccaagattgcgcgtgaatatggcgttccttattcaacactacgtgatcgcattaaaaagggcagacaggctcgtacagctcggaaaccagtgaataaagcacttgatgggtaccaggaggaagccttaatacagtggatagtctggatgcgagatcataacatgccagtgacacctaagctactagaagagtttgcaaatcagtcacttcaacgcgctggtgaagctagacaggttagtagggtatgggcatatcgctttgaaaaacgactcccagaacacctcaatctgggccctgtgaagcaaaagatgaaggaatcaaagcgtatcaaggctgaggatgctggtttactagcgaattggtataatcagcttgccaatgtggttaaagatacaccaccacgattggtatacaactttgatgaatgtggcttccgacctggcgaaggcaaggcaaggaatgtgattggattaaaaggttcttgccttgatcttgctgaatctgagaagggtgagaatataacaactatcgaatgtattgctgcagatggttggcagatggatccatggtttatctttaaaggcaagctcctactcttttag

SEQ ID NO: 10451 - DNA, 642 bp, A.fumigatus
cctttcttgcttcctaaaggcaacgggatcttcatggaatgttggttaaacgagagcgaggccctaccactaaatataacgatagctacgcaagccaatggctggatatcagatgaactagcccatcaatggcttcaaagctttatcaaggcaacaaatgagcgtacaaagagaggagagaaacgaatacttatatttgatggtcatggctcccatcttactgttgatttcttacagacatgcgaagataatggggttattccctttggattccttcctcatacaacacacctttgccagccactggatggcaagccattcttgagctataagcaacacttccgacgtataaataatgagctatcttactgggctggtgagccagtagggaagtcagaattcttacgggtgattggacctgtacgggagaaagccttcaaccaacgaattatctgtgaggccttcaaagatcgtggtatctggcctgttgatggtagtaagatagtcgacaatcttgctatccaggcatgggaacaaattccagatgtctacgcgcctgatcttgatgcatgccttagagggacaccctctccaccacctatctcctcatctagtgtggatatcacccctccaaggacgatt

SEQ ID NO: 10452 - DNA, 804 bp, A.fumigatus
tcctcctttatacaacctcctatcctctcggaacgatttgctgctaccgccgccttccagtactacagtcgtctcccttccctgcagaatctggtcgctttcatccaacacaagttctgtgaccggtcggacgagaaatgcgttcatcatgcggaatccatactttcggccgactcggtcgatgtcaactacgacagcatctcgcatgcgctgaccgtgtctgggtattggtcgacatcacccggccaaggatggaccgagcagatccggaagcatgccgcagatacacaccaggtcgaggtcgggctgctcggtgtcgagagcgccacggagcccgaggaactgaaaatgggtggtctactcggggtggttggacaggacgaaaagttgagtacgttgggaaaaatgaaaggacagacggagttggcacccattgctgaccatgttccagaaccgaccttgttttcatttccctcgcgccaccatcctctcccagctgatgcgacctacaccgtctccttccccgccccaaccgggctccatcccactctaaccatctcaatgcctcgcgcgtcgctgaggcggccccccgcacccccgggacgccacgtgcgccctccacacatacctgaccctcccgtcgtggatcttcggcgacaaataccagctctcaaccaccgaccgcctcttcctcagctcccacaacctagccgctctccgcgctgtaacaggagaaacagatctcgaagccccagacgggttcttctctcgatggggctcaaactggctgctcgagctccctaa

SEQ ID NO: 10453 - DNA, 480 bp, A.fumigatus
ggcggccccccgcacccccgggacgccacgtgcgccctccacacatacctgaccctcccgtcgtggatcttcggcgacaaataccagctctcaaccaccgaccgcctcttcctcagctcccacaacctagccgctctccgcgctgtaacaggagaaacagatctcgaagccccagacgggttcttctctcgatggggctcaaactggctgctcgagctccctaacccccttcccccgggataccagccagaagagtggaacccctccaatccctttgcacctgccaaacctggaccccccgaattcgggtaccgttctgccgcggttcctcggccgatcgtcttctggccttctcggaaaaaaaaggcccaaaatggtttcaaccctttgaattgggtaatctccgcggaagggcttttttggggcccgaactatttctttttttcccccggccccggcgaaggcaggaacccttcttaa

SEQ ID NO: 10454 - DNA, 678 bp, A.fumigatus
  unsure (54): Identity of nucleotide sequences at the above locations are unknown.
catgacgaggagcatggattcagcaaatggtccgaacaggagggactggatttnggacatcgccaccaccacagatataatcccccctggggaatgttccgcggactaggacgaggcagaggcagaggcaggggcaggggcaggggcttcggccctcacttttaccacttccaccatgcgatgcatcccggcttccacttttttcaccactcacacgacccgaccaggttcacgcccccggtcgatgtcttcgtcacacctacccacaccatcatccacgtctcgctcccgggagctcaaagatcggatttgagcgttgcgtatgatgcatcgcgtgccgtgctccgcatggctggggttgtgctccgtcccggagttgatgaggagatgcgtcgggctttgctaatcggggagagagggcgtcacttgggggtgtttgaaagggagatgccgatctcccacagcgttgccgtcgaggggatccgtgctcgactggttgatggcgttctgcgggttgcacttcctagagtcgagggagacgttccacaacccgacgaggagatggacgaggtggacagggagagtgcaagcagggaattcaacagtgatgggaaagaggaagaacgtgaggtggaagacgaagttgagcgggagtatgtgaaggtggatatccagtga

SEQ ID NO: 10455 - DNA, 195 bp, A.fumigatus
tatatggcccatgggcaggaatcagtaggcggtggccgactcgcttgggtggccgactcgctttggaactacgttaaggcttactcgaccgcaatccagggcagcatcaacagcaggcaagtcttcattttgagcaatctgtttatgttgcgtctaatcggcgttactatccggagtttcgacggagaagggtga

SEQ ID NO: 10456 - DNA, 321 bp, A.fumigatus
ctaattttttttcagttactacaaactcatctaaaagagatgttcagcatcatctacactccaacagaaggagacgccattcaaaactactcacgtttgttcaggaggccagaaggctgcttcctaaatatcaatgaccaggacgcgattgaagagtgcttgtccaatttcggtcgcggtgaggatattgattacatcgtcgtcagcgacggcgaagaggtacccggaccttttcattcccattgctacctcatgcacgattctgacagggtcaactacagattctcggaattggcgaccaaggtgttggtgcgattctga

SEQ ID NO: 10457 - DNA, 384 bp, A.fumigatus
ggaagagccaatttccactatgcaaggtggccaatggatggcatactgatggaggccgtccaggggatgagtgtcatacataatcccaccttcaacaagggctctgcctttactgaagaggagcgaaaaaatttcaagctacacggcttagtacccccgaatacgcagacgcttgaggaacaagtccaccgtgcatatgaacagtacagtagccgagcggatgacctagcaaagaacactttcatggctagcatgaagatgcaaaatgaagttttgtattttagagtaagtaccattatttttaaaggggaagcagatatttgcgaaacattctttacccatgtcacgttcgatattgagttcgaaaatctgcttcgtgactaa

SEQ ID NO: 10458 - DNA, 462 bp, A.fumigatus
tgctttgcccctttgcaacttactcaacctttttccaggtgtttagacaagccaggattgctagtaaagtccttaggtgaccaattgatgccggcacagaaaccttttgcgcgcagcgattatgagtggtctgacggggagagggatctgctatctgtagtgaaaaaagtcaagccccatgcgctgattgggacatcgacaaagcccaacgctttcacagaagagataatccgagaaatggccaagcatgtccacagtccaattgtatttccattgagtaatcctacgcggctgcatgaggcacagcccaaggatatcaaccagtggacaaatggtcgagcgttgatagcgactgggagccccttcccaccagttgatcgcaacggggcaaagtatgagattggtaagtacagattgtcaaaagtttgtagacatgacatgactcattggaaaaccctatag

SEQ ID NO: 10459 - DNA, 183 bp, A.fumigatus
cagggtcaactacagattctcggaattggcgaccaaggtgttggtgcgattctgatatccgtcgccaagttggtaatcacaactatttgcgctggaatccacccaagccggcagcttccagtagttctggactgtggtacagatgtagggctcgcagacatcaacaggagccttgtgtgctaa

SEQ ID NO: 10460 - DNA, 285 bp, A.fumigatus
cgtcccttcgcagtgaagactttggccttcatagatgccaaaagacttctcgatggatttcgaccacacatggcctgcttcaatgatgatatccaaggaaccgggtgtgtcactctggcggcattaatggccgctttgcacgtcagtgacgtcaaattgcaggacgtgcgcatcgtcatctttggttccggttctgctgggactggtattgcacagcaaattgctggtacaattgcgacggagacccataaatcaaaggacgaagcggcaaagcaaatctggtaa

SEQ ID NO: 10461 - DNA, 501 bp, A.fumigatus
tgccgccagagtgacacacccggttccttggatatcatcattgaagcaggccatgtgtggtcgaaatccatcgagaagtcttttggcatctatgaaggccaaagtcttcactgcgaagggacgtcagtcgcatggcttgcggttcaaattgcggccaaagacgagactcaatttcactcacaaatggatgtatgctttggggaaaagctttctagcagtggtgacgaatctattcacaaattgatcatactcctttcctctagctcggggttgtcgaaggccgaggtaaagctcatcgtcaagcagtttttgattctatcaccggtgttagcacacaaggctcctgttgatgtctgcgagccctacatctgtaccacagtccagaactactggaagctgccggcttgggtggattccagcgcaaatagttgtgattaccaacttggcgacggatatcagaatcgcaccaacaccttggtcgccaattccgagaatctgtag

SEQ ID NO: 10462 - DNA, 201 bp, A.fumigatus
ctttctggcggggtcacaaactggaataattatggcatgacgtatgggtggatgatgtctcgacaaaaatcatgccatcgtacctacaggtcaaaatataaggtatgccttcagtatctaaacggcccagctatatatcttgactcggacttcatcaagtgcaaacaatttgacaacacttatcaaagcatcgaactgtaa

SEQ ID NO: 10463 - DNA, 465 bp, A.fumigatus
acacctggaaaaaggttgagtaagttgcaaaggggcaaagcatcaatttcccgcaaggcttaccagatttgctttgccgcttcgtcctttgatttatgggtctccgtcgcaattgtaccagcaatttgctgtgcaataccagtcccagcagaaccggaaccaaagatgacgatgcgcacgtcctgcaatttgacgtcactgacgtgcaaagcggccattaatgccgccagagtgacacacccggttccttggatatcatcattgaagcaggccatgtgtggtcgaaatccatcgagaagtcttttggcatctatgaaggccaaagtcttcactgcgaagggacgtcagtcgcatggcttgcggttcaaattgcggccaaagacgagactcaatttcactcacaaatggatgtatgctttggggaaaagctttctagcagtggtgacgaatctattcacaaattga

SEQ ID NO: 10464 - DNA, 1416 bp, A.fumigatus
aagccattccagctctataggctgatccgcatagacgcggaaacaatccgcatccttgtatcgaccgacaaccatgtcgggtacaacgagcgagatccgataaggggcgatgacagctggaagagcttccatgaggtgatgtgtctggccaaagagcgagacgtggacatggtactccttgctggcgatcttttccatgagaacaagccgtcccgaaaatccatgtaccaggtcatgcgatctatccgaatgaactgcttgggtgacaagccttgtgagctggagatgctcagtgatgcgagtgagaactttcaaggggccttcaaccacgtcaattacgaagatttggacatcaatgttgcgattccgattttctcaatccacggaaatcacgacgacccgtcaggcgagggtcatctggcagccttggatctgctccaggtttcgggactgttaaattactacggtagaacaccggagtccgacaacatccatatcaagccagtgctcttacagaaagggcgtacaaagttagctctgtatggtatgagtaatgtacgggatgagaggctgttcagaacattccgagacggtaaagtgaagttctatcagccttctattcaaaaaaacgattggttcaatttgatgtgcgtccatcagaaccatcacgcatataccgagacgggttatcttccagaaaatttcctcccagacttcctcgacctggtcatctggggccacgaacacgaatgcttaatcaatccaagactcaatccggaaacgaaattccatgtcatgcagcctggatcgtcggtagcgacgtcgctcgttcctggtgaagcggtcccaaagcacgtggcgattctcagcatcactggtcgggagttcaaatgtgagccaatccgcctgaagacagtacgtccctttgcaatgagggagattgtcctgtcagaagaaaaaggcgcgcagaagttagcgcgtaaagagaacaacagaacagaagttacgcgcttcctgatctcaatcgttgaagaactaatcgaggaggcccaagccgagtggctggaaatgcaagatgaggcagatgacgatgaggagcgcgaagttccattaccactagtgaggttgcgtgttgagatatccacgccagaaggaggcagctatgactgtgagaaccctcagcgcttttccaatcggtttgtgggaaaggtcgccaacgtgaacgacgtggtgcaattctaccggaagaagaagaataccaccacacgcaagaaggacgacgaaatcgatgaagccgccatgtctcagctgtccactctggacacagtcaaggtggagcagctggtgcgcgagtttctcgccgcccactcgttgatattccttcgactaaacagaccggactggaaactacgcccc

SEQ ID NO: 10465 - DNA, 2226 bp, A.fumigatus
  unsure (15): Identity of nucleotide sequences at the above locations are unknown.
tatacgcattgcgcnggtcctttcagggcccctgtggtggagacaagtctgtacccactggaatgcacccacaacttcacagcggactatgtctggaaatcaacctctttcgatcgtatgcagctcgccatgaagactttcgctgttgacgaaatgagcgtgtccggttatatcttccatcgcctccttggacatgaagttgccgctgcaccgatgaagactcagctaccgaaaaaattcagtgttcctggcttgcccgagctcaacggaagccagatcaatgcagtcaaaagtgtgctacagcggcccatgagcttgattcagggtcccccaggaaccggaaagactgttacgtctgccacgattatttaccatctcgcaaagatcaacggaggtcaagtcttagtctgcgcaccatctaacgttgcggtcgatcagctgtgcgagcgtattcacaggactggtctcaagacagtacgtgtgactgccaagtcgcgtgaggatgttgagtcacccgtgggcttcctttccctgcacgagcaagttcggctgaacgacagcaacattgaactcatcaagctcaaccagctcaaggccgagctgggcgaattgtcgagtcaagacgagaagcgtttgaagcagctcactcgttctgctgagcgtgagattttgaacaatgccgacgtcatttgctgtacttgtgtcggcgctggcgacccgcggcttgcgaagctcaagttccgcaccgtcttgattgatgaatcgacgcagtcggctgagcctgagtgtatgattccactggttcttggttgcaagcaggtcgttctggttggtgatcaccagcagcttggacctgttattatgaacaaaaaagcggctaaagcgggcttgaaccaatccctctttgagcggctcgttatcctcggctgctcccctattcgattgaatgtgcagtaccgtatgcacccgtgcttgtcagagttcccatcgaatatgttctatgaaggatctttgcaaaatggagtctctgcttttgaccgacttcgccgtgacgtggatttcccttggcctgtcgttgacagtcccatgatgttctggtccaaccttggcaacgaagagatttcggcgtcaggaacttcgtatctgaaccggaccgaagctacaaatgtggaaaaaattgtgacccgcttcttcaaggccggtgtgcaaccagccgacattggtatcatcacgccttacgagggtcaacgaagttacatcgtcagctctatgcaggctaatggcacattcaagaaggagcactacaaagaaatcgaagttgcgtctgttgatgctttccaaggccgagagaaagacttcattatcctttcctgtgtgcgttccaacgaccaccaaggcatcggtttcttgagtgatccgcgtcgtctgaacgttgcgcttacccgagcgaaatatggtctggtcattcttggaaatccaaaggttctgtccaagcatccactgtggaactgcctactgcaacatttcaaggaaaggcactgtcttgtggaggggcccctgtccaaccttcaggagtctctcattcaattcagtcgcccaaagcagtcatatagaggtccacaacggttccagatggcttacaaccatgcatccaacgtcaccagtggaatgatgaacggtcggaacggtcaccgaaatgagttccatgacaccggctcggtgattggctatattcccgatgatgtctcctccgtacactcctctgctcttggaggcgtcagtatcccctcaggatatcccccgatgttccagaactttgcggacgcctggcctgctcttcctggtgccagacgagctaatggggccagaggaaaaggagcacctagcgttgccggcgaatctgtggcagctactgagtccgacattacgggaagtatcatcgatggaaggagcgttgatcagggcggtgttagtcttgctggtttgagcatcaacgacatgagcaagcagcctagtctcagtcaatctgacaggttgaaacgttacgtggaatcgggcggacgggagccgtacagggctggcgttcccgacaacggtagcatctttggaggaagctctgccagcatccgtgtgactcgcggtgttcctggacatgttcacgatgatgatgacactcgcagcgtctccaccgcttttgcgagccaagtcggaggtaactacgattga

SEQ ID NO: 10466 - DNA, 2436 bp, A.fumigatus
  unsure (9): Identity of nucleotide sequences at the above locations are unknown.
cttaatccntttatggcggcgtgtgcacaagccgatattctggtctccttgttacttattgtggttatcagatcccaggtcagacatcttcaagcaagactcctgtatatgcagcacttcatctatatcgacgatgttgacagcggtgaaatgggttatgctttgagcacattcgaggcagtccttacgtacttagtgactgattcagcaggcctcagaagagccagttctcgcaataagcgcctgtggaatgccactagagccggccgagttggcgaaatgaaggccattcttgaacccaaaggtgaccatagctcaatggacgatggcccggacgagccagaagggaaatcagtcttcttcaaaactggtgaggatggagaagtggatgaaccgctacaaggacattcgattcatcgaaggctctcaagatcaaataacgaacctcatgaatttgatgaaagaccttccgatgtgccaccgctggcacatgtgttcccatttcaaacatgggaaaacacctccccgccgaaggaagttcagcgtcctgtgaagaaagtctcaatggatgtacgcagcatatcagagtcgtcagctacttcacttctctctcgcaccaccaccattgaatcaatgaccagtgcaattgaaggggacagctcaatcgagactttgacaaaaacgcaagatcctgcgggtgattcaattcccatgatggccgttgacagtcgccagccggaggctctcaagtacttgctcagcctggaagagtactattcattggaagacatcctcgaggatacaaatactgatggaacgacgttgctcagtgccgcggtgcaactcggtcaccctgaaatggtagaaattctgctcgactttctgttcagtgcaacggacgagcgaacaattgctggttaccttaaaaaagcagacatgcacggacgcacagttgcccactatttatttagtacgccatcagtaatgtatagactggaaagactcgttccttggcgacaacgtgacagaaatggccagacgccgctgtatgctctgtgcagatcctatgaccatcccgattataaatcgatggtcaacgaggcgttgaccgccgctcaaagatctcagggagatggtttgcctttgcggcttgacgatcatgttgattcgaagggaaatacattgctacacatcgtcggtgatccagagatcacaatccgaattctacaagaaagcgattgcgatccaaacgcaaccaacgagaagaagttcacgccgttgatgatggccagcaagtatggccgcgtagatcaagtgcgtatcctctttttggacccccgggtcgacgttcaccttaaggaagctcgtggattgacggctgtcgagctcgccaaagacgatgaagtccgtaatcgcattgacgatctcattcttgtctcgaattcgccctcggcatatgatgatccatctggtcgtgtcacaacggttgtacgctcgtactttgttgaggatgccacagtacgctttgttttgaagtccggcgccccaagctctcagacccagtcaaacgagtctcgagctggctccaccacttataccgtcactacatgtcgtcgcaccctctcggactttgagaatcttgctcggtgcctcgcaatggagcatccggcctcttatatcccttccttttctgactttcgcaatccttttcaaatccattccaaaccatctcggtctgttctccacaacatgcaagagagactagacagattcttgaagatcctgcttacccatccaacgtttgcgacccatgagatgctgtgggagttcttcctggtgcctgagctccagccggagatgatgacggacaggtcccggcgcaaggcgttggtgctttccgagtcgattgcagacgactacgagcctgtgacagctgaaggcatgcgcgagacagaacagttcgtggctcaggcccaggacatggttcgtgcccttcacgccaacacacgcagtctgattcgccgtggtcattccttgcagaatgccgcctcagatatggctgacgcgctgtctctgtgctcgtcagtggtctccactctgcaggagcctacaaacgcgctccctcgttcacatgtggacgctttcgcccgctacgcctcgtacctgtcaacctcgtcctcagactcctctccccttcttcagttcctatccgtcttttcctcgatcgacaacacgactgtcgcaatactccgttcgctctctcgccctattttcgctcatatcgaacttacaatccacaacccgcaatctgtccggcaatcgcacgtctctcatctcatcgtccttgccccggaaattcaacatcaacttccctggcctggaggaatcccgacaaaagtcagttcgcgatctggaacagaagattcaagaggctga

SEQ ID NO: 10467 - DNA, 318 bp, A.fumigatus
agtcggcggcagtgccacccgacccagtcttcgtcaaaactgtcggcctcgcttactgcgtcggactcagcgtcggactcatctgccgctggagcggtagaacatctgtcttcgccgagttcgacgctagcaatcttgggagtttcgtccgctgagccctgctcgccttcgtcattgctggcgatagtttcgggaatgctacgcgcgtcgtcatctgcgcggttgacactaaacgaaggaaccccagtagttacctgcggttccagagattctctagctgatgaaaggtctgtttggttcgaaatatcatggacgtga

SEQ ID NO: 10468 - DNA, 564 bp, A.fumigatus
cctttacttcttcagagtatgtttatccagcagaagaaccgaatgccacacaagactaactcccgacaggccaatctccaaaacctaaccacttcgtcatcagtaacatcagcggtaaactccgctctcgagtcagctggcgtcgatatctcgagtaccgacctggccaaggccctcgacgaggcacaaaagcaactcaagatcaaggatttctacgatatcggtctctggggctattgcgacggagatgtcaccaatggcaactacaagacccagaattgttccaagcccaaggccgagttttacttcaaccctatcacaatctggcaactcaacgataccggtgtggaggacgtcctgccgaaagatctgtccaaggctttggatgtttacaagaatgtctccaagtggatgttcatcgcctacatcgttgcctttatcgtgaccatagtcgagcttgtcgtcggtctctttgccatctgcagtcgctggggtagctgcgtgaccagccttgtctcagctgtacgttcctctttcttcgtctcggtatattcccgtcactga

SEQ ID NO: 10469 - DNA, 405 bp, A.fumigatus
gtctccttcctcttcatcaccgccgcctccgtcacatccaccgccctcttcaccgttctgaaaggcaccttcaactcggccctcaaggactacggtatcaagggctacatgggaaagaacatctacattgccacctggctagcggtcgccttctccctggccggcagcctcttctggatcatttcctcatgctgctgctccggccgttccccctaccacggctccagcaagacccgcggcgtcaccgccgaaaaggcaccttatacctatgagcctcttggtcctcaggccaaccagacccctgctgcctttggcaacacttcgtacccgcctccggctcatggtacccatgttcccatgcagaatatgaggaacaacgcctacgagcccttccgccatgtctaa

SEQ ID NO: 10470 - DNA, 1911 bp, A.fumigatus
  unsure (880): Identity of nucleotide sequences at the above locations are unknown.
tcaaagcacaggggatgcaaggcaggagtcgcaacagtcaggacagttatagttccccgggcggcaaattcgtcttctcaatcacgaatttgcaacacttatcgtagcaatgatgaggcgaaggatcacacttttcaggagatgtccaattcaacgcaagcgcatgggactgcggaatccagtgaagtcaatataatggaaactcagctcagcggtggggagtggtcatttccaggcacgacttccccgaattcagctcaactgtcgaactcctgtggcccaagggaccgtgagccgagcgtattcatcactgcatccccgggtcacgtagaagactcatcgaatccattttcgtcatatcgagaggctcactcttttatgcagactgacgatggaaatgcaacatcaaccggctatcccagcctcactcaagtcacgcctactgattatcgagtgcctcagttgaaacgacgcgtgtctgaaattgacatggagcagacttctcctgcgaaaagaccaaaggtggcgtgcagcgaagacggtgactctgtccaagagcttgcgttcagcgtgatttctcgccgagaaacctacatcaaccgctccgcggagcacgccgaggcacagaaagtttacgagaagttccggagtgactacctcgactacgatggcgacttcaaccatttcgcgatgttgtgttccaaactacaggcactacgagccaaaggacaatttcgaaggtcgttcctctgggatgactttgttatcatgcacctgaaggaatataaacgttacatcaatgaaatcgcggcagccgacctcaagacaatggagtacgaaaatttcttcgcctcctatatattgaagccgtcgtacaaanaacgcagtctcacagcgaaggggattgaaatatctgctgcgcagcatgaaccttcgagggccgccggcgtcccagtgatcccgcagcgtgaaacaaacacttcattcaccggcagtcttgtagacagactttccaatttccacacgcgctcgttaggacctgagtctccagcctcacagtctgcaaccacggttgaccaactatcttggagcacgtcgccagcttctcttagagatccaattcgcgactcattcgcaaacagccggcgcatggctaaggaaacccttgagatggaactggcacctaccaaagtcacccgttcacacgatcctgtccctaactcaccgtccgaagcggtggcttatcggctggagcgacccacgtctcggcatcgtgacacaatacaaaaaggtaaccgcatggtcgacgaggaggaagcacatgatacggaggtgacgcctaaagtcacccgttcagatcacgtccatgatatttcgaaccaaacagacctttcatcagctagagaatctctggaaccgcaggtaactactggggttccttcgtttagtgtcaaccgcgcagatgacgacgcgcgtagcattcccgaaactatcgccagcaatgacgaaggcgagcagggctcagcggacgaaactcccaagattgctagcgtcgaactcggcgaagacagatgttctaccgctccagcggcagatgagtccgacgctgagtccgacgcagtaagcgaggccgacagttttgacgaagactgggtcgggtggcactgccgccgacttcaaagcacagggccattttggtccgacgatcccaacacgccattcaaggtgttggcccgagcggatgcgaatgtgaggtccgagctactgcgccgtgggatggcccgtttccctgtcgacgagagaggagtcatccaaccactagttgactatccgccaatggtttctttgcgcgatttgctggaccgacatcctccaagtcccgcgcgtccctcagatgaaccggaaggctga

SEQ ID NO: 10471 - DNA, 255 bp, A.fumigatus
tacagtaaacatgcaagtgaatactatgacccatgccaagatttcgcagatcgaagtctcaagtgcatgaagcggaacgcctttgacaaagatatgtgtggagactacttccagtacgtttgttccattctttcctgccaatctgtgctggtgttcagttttgtgagcttaaacgaactaatctattttctgaaagagcctaccgtgactgtaaaaaggaatgggtatgttgaactagttaaagtcattcattag

SEQ ID NO: 10472 - DNA, 354 bp, A.fumigatus
aaacatcccaagactctcgctattgtttcacggattgctggtgttgatttggttcccgtcatggactacgagataggacatatcaacatttccgttcagagcgaagaggacaaagccgaatttcttgcagcagtggcggagaagaacagtcaggaggctggtaagaatgtttccgacagtgcttgggaaggcaaggatccgattgtggattggcacactgacggctatcactatgtctgcgtggtgatattctccgactgcgaggacatgattgagagagaaacagaactgagaagaggcaatgacgaaaagatcaaggtccggagcccccagatggtaagtcggctttcatga

SEQ ID NO: 10473 - DNA, 1425 bp, A.fumigatus
cgtcgtggatgcgcatcgctatcgctccctgcaatggttcctcatcggcgctcgtcttcctccgaccaccaccacccttcgctccacgatagttatcagccttcgagttcctccgatgagccatgggatctgcggccagagaatggcacaaagggcggtgaaatgcgtgagttggatgggaatgggaacgctgacttgccgcgaccggagacgcctacaagcgagaccacagaccgggacataaccacgaacgggaacgaatcgcaaacgttgcggcttcagaggccgaaatctatacgtcaagaaacggatgatattggcgagactatggatgataccgctacggcgaatggggcttcggataaccaggagtctcaccacggttacgccgagctgaaagctggacagtttccgccacagcaggctctggggctcgtttttgaacatactaataatggtgatgacgcccaccggacatcgttggtcgatgtgcttcagggggctgaggctggcgccgcgctgaatggctggcctgagaagatgtcgccctcgaaagggcaggatatggagcgagaccgagagaaggttctgaagctgtctccggcgaagatccaggagctcacgtcgtcgccgcagtcaataccgtatcgtcctgtggcttcggagaccgagcaaggccgacgggtgttgtcggatggcatacataccacgggtgcagagtcggacgagggcgagtcgagagctcacgctggccatcttgctagagattaccagtcaggggatggattggggctgggaatctccgctgcgtcgaaaaattccgtgtccaacggtcgtacgcggccacacgcctcgcggactgtctcgactcccacctcatcgcgacgaccgacgctaccgggcaccaacgaacggctagcgcagacgtgggcatcccggtcgaaaccggaccgcccggggatcggtctggggaacagtcgcttggagcaggaatccaagcgccaactcagcccttcgccagtcatcaccgaacctgccttgccctctcccatgccaccgtccatcccgcttcctccgctgtcggtgccgacgtacctgcaattggagctctcgtccggtcgaccatcccctttgtatatacatcgctccgtcacgaatgatttcccgtatgagtcgtcgcgcgtcaaactcgagcgcttgtcaagttttctgagactgccgccggccctggagcaggtgctctggtttggaattctggcgtgcctggatgcgtggctgtattccttcacgatcctccccctgcgcttctgcaaggctttgtatattctgttggaatcctggttagtcaacctgggcatggagtttcgttttgtctcagactttgtcatcaagggaatcgggagagtctggcagaggcagaaataa

SEQ ID NO: 10474 - DNA, 1137 bp, A.fumigatus
tcagccccggtcgcggaagctgaacgtagaccgcgaggtacttcggcagagcgaggaccaagaaccaagtccggggaatcgcgacgacggcaccgtgccgatacacacaagtaccaacatcgccggcaaaagtccataccctctgcccttctgcctgacgacaaggccgatatcctcaagggactgctcatgattgctacatgctgtgttctgatgtactttgacgccagtcgaatgtaccactggattcgtggtcaggcggctattaaactgtacgtgatctacaatgtgctggaggtcagtgaccggctgttagccgccatcggacaagacgtgctcgagtgtctcttctcgcgggaggctctagagcgtcgcccggacgggcgcagcaaggtgtttcggccatttggcctctttttgctggccttgacgtatactgtgcttcacgccacgtcgctgttctaccaagtcatgacgctgaacgtggcggtcaactcgtactcgaacgcgttgatcacgcttttgctttcgaaccagtttgtcgaaatcaagtcgacagtctttaagaagttcgaaaaggagaacctgtttcagcttacgtgtgctgatgtggttgagagattccagctctggctgatgctcacgattatcgcctcgcgtaatattgtggaaaccggagcattcaattttgtgggcacattgagctccagcctgagtagtcgctcgaccagcaccaacagcacgcctctgtcgactcctcccaggtcgtcgtcctcgattctgccgcagagtttcaccttctttccgtcgtcactcatctcctccttcagccacgttaactccttcctgcctacactggcgcaagtgctgggcccgttcttggtcgtcctcgggtcggggagaattgccttcggtgggggaaccttgggggccttttccaaaagggccccattttgggcccaatttaacccccatttttccaaaaaacccaaaaaggggtttttttccaaaaaaccccaaaaaaccccaaccccgggccccggggggcccccccgggggggccccccaatttttcctttaaacccggggggggccccccggggccttttttttttttttttggggggggaattttaa

SEQ ID NO: 10475 - DNA, 192 bp, A.fumigatus
gaacggctcatttgctcaggacgctatgagctaattgacatgcaacagggaagaatcaacaaaggagacaacacaaacgaaagatacgccctcgctcttcttaacaggacacaagccgaaaactccacactatctacgtttgctgagaatgggattttagaacatcgtgtgttgcaatttgtctccgtatga

SEQ ID NO: 10476 - DNA, 726 bp, A.fumigatus
  unsure (223),(229): Identity of nucleotide sequences at the above locations are unknown.
tgggaagggccctttttaccggagatctcagccagagttttgttaagagccgtacccccggattggcagtcaaacatgcagaattccccctctggtgagaccgatcaatgtcgaacacctgaaattacaaatgctgatatcccgcgtgtatcgcaagccgttgcaattggggcagcacatggcgaattagccgaaaggcagtcctttatatttaatgccggantgattnaacaacaaagtccagcgtggttccagcatggccaaccaaggcatcccaggctcatcccttgcgaattccagacacttcagaataagcgccctaggaggaataggaagcgcacaagctcggaaatgggtggtgattcagattcagattcggctgacggcggagccaaacggacgccgattcgagtaggacaaaccgacgtgctgcgtcagttctaccaaaaagcctttgaaaatctccaacagctcaactgcagggtgattgcaaaggcatttgtcaagttggtagaacctcggaagcaagtcaatcacccgtacaatgggcgtaggacagtgatgggaggaccttgtcagaagctggatcctgaattgactaagcccaaatggtggcctacaggcgttcaacacaaggagccagatcacctcctaaagcatggtatgtcaatcgcgttcttccctcgcttgttattttgcaaattcggttcagccaggagtcgctga

SEQ ID NO: 10477 - DNA, 414 bp, A.fumigatus
gcggaaagatcagtatgtttagactctaacaaatcgttcggtggcatcaggctgatcgttaatgacccaacaggcggtgataccgttatctatgtctcctcaatacatctgccggagggaattgagccggcagtagtgaacattaacgaaaagcaaatcactgaggcggattacttgcccttgtccccagtgtccatcagccgcaaaagctcagttgagagcggactatcatctctctcaaagggtatgatttcatccatcagttctagtgagcaaacgcaggcgttgcatgcccatgcagaggttccttcgactggctctaattctttgccgggcttctatgctccgcattcgatgatctggagccatggaacctctgggatcaatgtgccatttaatatgtcgtcaaactga

SEQ ID NO: 10478 - DNA, 474 bp, A.fumigatus
gcccgttataaagagccgtgcatccagatattctcgttgtcgcagtcagaccgtcaacggcgtcaagacgaaatggccgaaccagaccacaaactctccctccaaaaaccatcggaagatgccccagaagacatcggccagggcatcgacatcgacatcaacatcgacattgatttggcaaatgtcgtcctcgacccacaaaaggagcgcaagctgctcctcaaactcgacctcgcctttgtccccatcatcatggtgacctacctctcctgcttccttgaccggaccaacatcggtatgtatccgcgcgcctcacctgtcaagccagctatcctgacactggctaggaaatgtcaaagtggcaggcatgcccgaagccatcggggcgtcgcccagcgaattctccaccgccgtctccatcttctacgtgacctacgtgctcctcgaagccccctgggccgtgctcatgaataa

SEQ ID NO: 10479 - DNA, 669 bp, A.fumigatus
  unsure (172),(205): Identity of nucleotide sequences at the above locations are unknown.
caacgggttcccccaggggtcgcccccatacggcttggtcacttgttgtacctgttccacatcggccagcagatacggccgcatcgaaaccaccatgcaggcgtcggtgaacacgcccgccggcatgagcggaactgtcgtccggtacatggcgaccaggcggccggtcagntggtgtttgggcggcaagccagcctcacacagngcatcttcgaaactgaacgagcagccgagcaggaagcctacgtggtcgggggtgtacacctccttgagatcctttctggatgcgatgtggcggccggactggtagacgcggtactgcgggaagtcggtgcggaggtcgaaatccgggttggtgatgcaggctgctggggacacggtgtgagggttgccctgggggatgatgccgagcagagggcaggggacggggttgcgcaggcagagggcgtggaagtctggggcgtagcgggaggggaggatcaggaggttggcttggaggaagcccggggagaggcccgaggtgtttgtgatgaggttttggcgggcgaggaggcgggtggtgtacgcattgctttggttgttgctggtgttgctggtgttgctggtgttgctgctggtcatatggctactgctgctgctgctggccatgctgtctatttagctagttga

SEQ ID NO: 10480 - DNA, 966 bp, A.fumigatus
cactggctaggaaatgtcaaagtggcaggcatgcccgaagccatcggggcgtcgcccagcgaattctccaccgccgtctccatcttctacgtgacctacgtgctcctcgaagccccctgggccgtgctcatgaataagctcaccccgcggaacatcctaaccggcttgtgcatcgtctggtctgtcacgaccgtcttcaccgggttcgtgacgaatgtccccgcgctgtacgcgacccgcctcattctcggggcctgcgaggccggcctcttcccctgcctgaacctgtacctgacgatggtctaccgccgcgaggagcaagccaagcgcgtctcgtatctgatgagctgcgccgcgatttccggcgcgttcggcggcctgctcgcgtatggactgttgcacatggatgggattggggggaaggctggttggaggtacctcacttcttttactacccttggggttgtctggtcgacagctaatgtaagaatcagatgggtgtacatcatcgaaggcctcttcagcctcatctgcgccgtcctgatctggttcgggctccccaacgacccgtccaacgcctacttcctcaccgccgacgagaaacacatgatgcgggtgcgcaacgcccagcgcgccgcctacatgggcagcagccagttcagctgggccgagatgcgcatcgccatcaccgaccccaagctcgccttcagcgccatcacgcagttctgccaggatatcctgctgtacgggttcagcacgttcctgcccaccatcctcaaggggatcggctatgattcgctgatgagcaacatcctcacggtgccggtgtacttctgggcggcgattgtctttgtgagcgtccctgggccgcggatcgctataatcgcttttgcgctgtttcttgctggttcccaaatgttttcggggctggtgggggtacattctgctcctggccgtctcgaatga

SEQ ID NO: 10481 - DNA, 450 bp, A.fumigatus
tcgcttttgcgctgtttcttgctggttcccaaatgttttcggggctggtgggggtacattctgctcctggccgtctcgaatgatgcggtcaagtacttcgcgacgtatctcatcgggatcgcgacgtataccggcgtcggactgaacatcgcctggctgaatgtgaatgtggcgccgcattaccgccgcgcgctggagatcggcgtccagcagacgattggcaatttggcggggattgtgtccgggcagatataccggacgtcgccgtatgtgcttgggaattcgttctcgttgggcgcgctggttgttgcgcagggggtcgtgctggggcatgcggtctacttgcgacgggagaatcacctgaaagtcaagattggggcgggagagaaggaggatacaaggcgtgtgaggacgggagataaggcgttggattttgtgtatcattattaa

SEQ ID NO: 10482 - DNA, 918 bp, A.fumigatus
gccaatactttgacgaagcgtgcagactggccttcatcgcgagggacgtttcccaccatctctatcaagaccccaaacccgacgccacccaccacgagcagaagagagaactctacgacagactccaggaatgggaagcgcagctccccggctttttcgacccagccggcaaacccctggcccatatcctctcactcaggtaagtccgccttcccacttcaaccctttcgccgccagcctactgacagatctgaggataggatgcgctaccacgccatcatgatcagcctcgcgcgcgatggcttcggcgtccacaccttcttctccgcggaagacggcaaatcccagaccaccgtccctccctccagccagctccctgcacacctgcgcgagaaagcaaccgagcagagtctcgcgtccgcacgcgccatcgcggccctcgtccgcgtccaccgcgaggaatacggcatcgggcgcacccacccgttcacgacgtacgcgatcatggtcgcgcttttcacgatcctcgaccacgcggcgttcgacattctcgacactgacttcctctccctgacgagcgcgttctcggtcatcgcgtgccggtcgcaggtcggtcggaatctgttccacatcttccggcagtcggtaagggcgcaggaccaggagggccgcgtgctccagtcggatcaggtccctgaggagatcaaagagctgtttgggcggtatccgcgctcgtcgaagccggacaagtgggatgactatgaggacgggctggataagctggggacggccgaggggagagacgtggccgcggcggatggcatgaggatgaggaatcatgcagcgtcgggggtgagggacatgttgagcaagtatgagagcttgagtctggggcagcaatcccaggatcgaaagtag

SEQ ID NO: 10483 - DNA, 429 bp, A.fumigatus
  unsure (421): Identity of nucleotide sequences at the above locations are unknown.
ccatatgaccagcagcaacaccagcaacaccagcaacaccagcaacaaccaaagcaatgcgtacaccacccgcctcctcgcccgccaaaacctcatcacaaacacctcgggcctctccccgggcttcctccaagccaacctcctgatcctcccctcccgctacgccccagacttccacgccctctgcctgcgcaaccccgtcccctgccctctgctcggcatcatcccccagggcaaccctcacaccgtgtccccagcagcctgcatcaccaacccggatttcgacctccgcaccgacttcccgcagtaccgcgtctaccagtccggccgccacatcgcatccagaaaggatctcaaggaggtgtacacccccgaccacgtaggcttcctgctcggctgctcgttcagtttcgaagatgcnctgtgtga

SEQ ID NO: 10484 - DNA, 657 bp, A.fumigatus
  unsure (453),(486): Identity of nucleotide sequences at the above locations are unknown.
atagacagcatggccagcagcagcagcagtagccatatgaccagcagcaacaccagcaacaccagcaacaccagcaacaaccaaagcaatgcgtacaccacccgcctcctcgcccgccaaaacctcatcacaaacacctcgggcctctccccgggcttcctccaagccaacctcctgatcctcccctcccgctacgccccagacttccacgccctctgcctgcgcaaccccgtcccctgccctctgctcggcatcatcccccagggcaaccctcacaccgtgtccccagcagcctgcatcaccaacccggatttcgacctccgcaccgacttcccgcagtaccgcgtctaccagtccggccgccacatcgcatccagaaaggatctcaaggaggtgtacacccccgaccacgtaggcttcctgctcggctgctcgttcagtttcgaagatgcnctgtgtgaggctggcttgccgcccaaacaccanctgaccggccgcctggtcgccatgtaccggacgacagttccgctcatgccggcgggcgtgttcaccgacgcctgcatggtggtttcgatgcggccgtatctgctggccgatgtggaacaggtacaacaagtgaccaagccgtatgggggcgacccctgggggaacccgttg

SEQ ID NO: 10485 - DNA, 237 bp, A.fumigatus
tcaaggtcgacggcaaggtccgcactgaccctacctaccccgctggtttcatggacgtcatcagtatcgagaagaccggcgagaacttccgtctcatctacgacaccaagggtcgcttcaccgtccaccgtatccaggctgaggaggccgagtacaagctctgcaaggtcaagagagttcagcttggcaagggcgggatcccattcttggttacgcacgatgcgagaacgtgagtga

SEQ ID NO: 10486 - DNA, 468 bp, A.fumigatus
attgaagagcctgaaactgaccatgaacttgatttttacagtaagaagcaccagaagcgcctcagtgcgccttcgcactggctcctggacaaaatgtccggaacctatgctcccaaggcctcccccggtcctcacaagctccgggactgcctccccctgatcgtcttcatccgcaaccgtctcaagtacgccctgaacggccgtgagaccaaggccatcatgatgcagcgtctgatcaaggtcgacggcaaggtccgcactgaccctacctaccccgctggtttcatggacgtcatcagtatcgagaagaccggcgagaacttccgtctcatctacgacaccaagggtcgcttcaccgtccaccgtatccaggctgaggaggccgagtacaagctctgcaaggtcaagagagttcagcttggcaagggcgggatcccattcttggttacgcacgatgcgagaacgtga

SEQ ID NO: 10487 - DNA, 366 bp, A.fumigatus
acatttggcgcagtttgtgctgaccgaaatgtatctagtatccgctaccccgaccctgccatcaaggtcaacgacaccgtgaaggttgatattgccactggaaagatcaccgactttgtccgcttcgacaccggtgttgtctgcatggtcaccggtggtcgtaacatgggtcgtgttggtatcatcactcaccgtgagcgccacgatggaggtttcaacatcgtccacatcaaggacgctattgacaactcctttgccacccgtgagtccaacgtcttcgtcattggacaggagaagccctggatctctctgcccaagggcaagggtgttaaggtacgaaatcacaccccgaagattataatttaa

SEQ ID NO: 10488 - DNA, 465 bp, A.fumigatus
ccttttcggatttcatttattccacttgatcggctcatttcgcattctcacacatccaggagatctatgatgacaccgatggacgtgatggaggcagagaacagcagggatgaggaacatgatatacatgaagacgtaatcgacgtcgaagaggatgaggaagaaaatttgtccgagcttgatccttcacagaaggagtacctagagtaccaacgtaggcttgatgattttctgtcgcccttggtccttgacgaagcagtcctctacagacttgcgcgccgcttctcgagcacataccgccacctagcattacactctgaccaacagttcttgcccactcccgtcactagactgcccacgggtcttgagactggtcgttatctggctattgatgttggaggaagcaatctgcgagtcgcattcattgttttcaccacgggcatgccaggatccgcagtgaaggtg

SEQ ID NO: 10489 - DNA, 1860 bp, A.fumigatus
  unsure (1823): Identity of nucleotide sequences at the above locations are unknown.
atggccctcgacgaggagcttcttcaccttcatctcggggatggccagcagcgaccctacaagctttccacggtcgctactcctcccgatgaagagcagctcaatcttcaacgcagtgataaggatacagctgaaccgtctcaaactccccgctgtgacactccgcgagaggcccacacagagatcgtacagaacgatacttcctcgctgaatcgaattttccgcttcactcctgtgccgaccctcatcctcgactcgtccttgcgcgtgattgaggtctcggagagccaccttgctttctgcggaaagtctcgagactttgtgctgggtgcctccatctacgagcttcccctcgccactatacctgcgccagacattgcgactctgaacggtgctttgcacgtggcgattacgactcgggctgtccaggttgtcgaaactatccaccttcccagaataagctcttatttttcactgaaaatcacccccattttccagggatccactctactgaacctagttctggaagcgcacaacgtcacaaggacccataccgagtcactgcataatgcctacatcaatgaaacttacaagatcctggttgacacgatccgagattacgctatctttatgctggacgcgcgcggcaacattgtaacgtggaattcgggcgctgcgattatcaagggatataaggcggatgagattatcggtcggcatttctcggtcttctacggacccgaggatcggctggcagacaagcctgggaaggagctcgaattgtgcctacgggacggaaaagtcgaggatgaaggctggcggtatcgtcaggatggtttacggttttgggccaacgtaatgattacgcctatcttctcattcggtcggcacgttggtttcgtcaaaatcactcgcgacttgaccgagcgcaaagcggctgaagcgcggatggtggcagcttttgaagaatcatccaagatgaagaatgacttcctggccaacatgagccacgaaattcggactcccatgaatggaatgcacctggcattgaccatgttggggagcacggagctcgacacccagcagcgtgaatacacttccattatcgaagattccatgtcgattttgcttcaagtaatcaacgacgtccttgattattctaagttatcctccggcaccttctctctgaacacagatgtcttgaacgttgagaatattgtgggagcagtggtacggaattgcaaggccttaaaccctgccgtggagatctcctgttccatgcctccgggcttcccaaatctgctccggggtgatccgcttcgctatcggcaagtgatccagaacctcgtgggaaatgcgatgaagtttaccgagaaaggccatgtcaaggtcacccatcgctttgcagtagaggagcacgatgccaataggtacataatcacgacagaagtcactgatactggcatcggggtgcccgaagatgctataaacactctttttaccccatttacgcgctttgcggattcagccaccaagcgctatcagggtacaggacttggcttgtccatctgcaagagcttggcagagctgatggatggcagtgttggttataaacccaacccagaaggaaagggtagctgcttttggctcaacgtgagaatgcaagctgtcgacattccagcgcctagtaaagacactcccgctgctaccgccgaaaatacgtacgaacccatcgaagaggtcaaggagattgcgcctcacatgcacatattgctggtggaagataatatggtgaaccaaatcgttatgctgaagcttctcanaagcctcggtttcgaacgtgtcgacacggcctgggac

SEQ ID NO: 10490 - DNA, 906 bp, A.fumigatus
ataggctttgtcacaaaccgcagaatgctactgtcctcatcggacgcctttggccgtctcatgttctcctacaaagagatctcagaacttgccggtcacacagcacgagtctcatctcttctcgaggtcatggaggacctgcaagccggacttttcgagaagaagctcgtctcctcggcatccaccgaggaaaacgccgccgttctgtccggccgcggagaggttgaggaagccgactcgattgaattcaccgacgtccccattgtctcccccaacggcgacgttctggtccgcaagctctccttcaccgtgcacccaggcgaccatctcctcatcgtcggccccaacggctgcggaaaatcctccctcttccgcatcctaggcggcctctggcccgtctacggcggcaaagtcaagaagccccgcttcgacgagatcttctacatcccacaacgcccctacctgtcccgcggcactctgcgacagcaggtgatctacccggacggcgtgcgcgaaatgcgcgccaagggcgtcacagatgcagacctatatgagatcctgtccatcgtggagatcgcctcggtcgtcgaccggccgggcggctgggacgccgaggaagaatggcgcgatgtcctctccggcgggctccagcagcgcatcgccatggcgcgactcttctaccaccgtcccaaatttgctatcctagatgaatgcacctcctccgtcacccttgaaatcgaacgggtcatgtacgagaacgcgaagaagctgggcaccaccctcatgacggtctcgcatcgccgcagtctctggaagtaccaccagaagatcttgcagtttgatggccagggcggctatttctttaccgggctggactgggagcgcagactgcagttggaagagtaa

SEQ ID NO: 10491 - DNA, 417 bp, A.fumigatus
gtgcgcgaccttccgccccgtggtgaagactttgtcattaaatatttctggggagctctaggcttgatcttgtgtagcatgcccgttttcttccgcatccccggccaaatcacgcagactatggcagaccgcacagaaagtgagttttggcccacgaacatcttgcctccgtcgaaactgacaggaataaataggctttgtcacaaaccgcagaatgctactgtcctcatcggacgcctttggccgtctcatgttctcctacaaagagatctcagaacttgccggtcacacagcacgagtctcatctcttctcgaggtcatggaggacctgcaagccggacttttcgagaagaagctcgtctcctcggcatccaccgaggaaaacgccgccgttctgtccggccgcggagaggttga

SEQ ID NO: 10492 - DNA, 189 bp, A.fumigatus
  unsure (111): Identity of nucleotide sequences at the above locations are unknown.
tggccagggcggctatttctttaccgggctggactgggagcgcagactgcagttggaagagtaagtctatgtgataacctatttctttcctacgtgatgctgactagaatngtcgtcacagcgagaaagaagaattggaccttcatcttcgtgcagttccggagctacagcgtcgtttggcggagttga

SEQ ID NO: 10493 - DNA, 513 bp, A.fumigatus
ctcatccggagcgcgtatctaggtgaagagacgtctgatggcgctaatgtaagtctgactcgatctaccctcttcgacatgctgctaactggggccttacagatcgaaattacgcgtgagattggggagcaaaatatcttcttgttcgggacactggcagaggatgttgaggagctccgtcatcgccacttctacggcgatttccagctcgatcctcaactgtccaaggtcttcgaggcgatccgcagcgatatgtttggtgacgccagcaacttctctgcgctcatgtccgcaattgccgaacatggtgactactatctggtctctgacgatttcaattcatacatcacaacgcaggagattgtggatgaagcgttcaagaaccaagatgaatggatagctaagtccatcactagcgtggcacggatgggattcttctctactgatcgggtgatcagtgagtatgcagatagtatctggaacattgagcctttggaaatcagagatgattaa

SEQ ID NO: 10494 - DNA, 681 bp, A.fumigatus
tttgctgacggcaattcactccactcagtgtttgcgaaaatgtccgtctcgccgacggcaacctcttctccatgcccatcaccctggacgtgtcccaggccgttatcgatgaaggcaagctcaagcccggctcccgcgtcaccctgcgagacttcagagacgatcgcaatttggccatcctcaccattgacgatatctaccgccctgacaagtgagttttcgtgctcctttggcttctggcgatcttgtcctgttttccagcgcgagcgcagtttaattgccctgcgttgtttatctggaacaacagacgcaacactgcaattgacgacaccaatcgctccaatcaaccagacatccgtgcgtacagtgggcctggctgactggttttcattacgtagggccaaggaagccaagctggtctttggcggtgatgaggagcaccctgccatcaagtatctctacaacaaggttcaggaattctacgtcggaggaaagattgaggccatcaacaagctcaaccactacgactatgtcgctctccgctgtacgtccgataatcgttcgcccgaactgcaaacgagaaatgatgctaatagaccccggttatatagacactcccgcggagctgcgtgttcacttcgacaagctcggctggaaccgagttgttgctttccagactag

SEQ ID NO: 10495 - DNA, 1140 bp, A.fumigatus
ctggtttcaagaaaccccatgcacagagctcaccgtgagctgaccgtccgtgctgctcgcgctcgccaggccaatgtcctgattcaccccgttgtcggtctcaccaagcctggagacatcgaccacttcacccgtgtccgcgcctaccaggctctcctcccccgctaccccaacggaatggccgtcctgggccttctgggcctcgccatgcgtatgggtggtccccgtgaggccatctggcacgccatcatccgtaagaaccacggtgccactcacttcatcgtcggacgtgaccatgctggtcccggcaagaactccaagggccaggaattctacggcccttacgatgctcagcacgctgtcgagaagtacagggaggagctcggcatcgaggtcgtcgagttccagcaggtcacctacctgcccgacaccgatgagtacaagcccaaggacgaggtaccccctggcgtcaagaccctggatatctccggtaccgagctgcgcaaccgcctgcgcaccggtgctcccatccccgaatggttctcttaccccgaagtcgtcaagatcctccgcgaatctagccctcctcgccacactcagggtttcaccatcttccttaccgggtacatgaactccggcaaggacgctattgcccgtgctctccaagtcaccctcaaccagcagggaggccgctccgtctccctcctgctcggtgacaccgtccgtcacgagctctcctctgagctgggattcagccgcgaggatcgccacaccaacatccagcgtatcgcttttgtcgccggtgagctaacccgcgccggtgccgccgtcattgcctcccctattgctccctacgaggagtcccgcaacgccgcccgtgacgctgttacccaagctggcggcaacttcttcctggtccatgttgctactcccctcgagtactgcgagaagaccgacaagcgcggtatctacgccaaggcccgccgcggcgagatcaagggtttcactggtgtcgacgacccctatgagacgccttccaaggctgatcttaccgtcgatgtttcgaagcagaccgttcgcagcatcgtccacgagatcatcctcatgctcgagaccgagggcttctttgatcgttcttag

SEQ ID NO: 10496 - DNA, 207 bp, A.fumigatus
atacacaaaatggccaatcctcctcatggtggtgttctcaaggacctgctcgcccgtgatgctccacgccacgacgagctggagatggaggccgagaagctgcctgccattgtcctcaccgaacgtcagctttgtgatctcgaactgattatgaacggtggtttcagtcctctggagggtaagtttactccccaaatttcgttttga

SEQ ID NO: 10497 - DNA, 390 bp, A.fumigatus
cgacaccaatcgctccaatcaaccagacatccgtgcgtacagtgggcctggctgactggttttcattacgtagggccaaggaagccaagctggtctttggcggtgatgaggagcaccctgccatcaagtatctctacaacaaggttcaggaattctacgtcggaggaaagattgaggccatcaacaagctcaaccactacgactatgtcgctctccgctgtacgtccgataatcgttcgcccgaactgcaaacgagaaatgatgctaatagaccccggttatatagacactcccgcggagctgcgtgttcacttcgacaagctcggctggaaccgagttgttgctttccagactaggtatattacattcccacaatctacgtcaaaataa

SEQ ID NO: 10498 - DNA, 549 bp, A.fumigatus
ttcaccccgttgtcggtctcaccaagcctggagacatcgaccacttcacccgtgtccgcgcctaccaggctctcctcccccgctaccccaacggaatggccgtcctgggccttctgggcctcgccatgcgtatgggtggtccccgtgaggccatctggcacgccatcatccgtaagaaccacggtgccactcacttcatcgtcggacgtgaccatgctggtcccggcaagaactccaagggccaggaattctacggcccttacgatgctcagcacgctgtcgagaagtacagggaggagctcggcatcgaggtcgtcgagttccagcaggtcacctacctgcccgacaccgatgagtacaagcccaaggacgaggtaccccctggcgtcaagaccctggatatctccggtaccgagctgcgcaaccgcctgcgcaccggtgctcccatccccgaatggttctcttaccccgaagtcgtcaagatcctccgcgaatctagccctcctcgccacactcagggtttcaccatcttccttaccgggtacatga

SEQ ID NO: 10499 - DNA, 207 bp, A.fumigatus
cggcaattcactccactcagtgtttgcgaaaatgtccgtctcgccgacggcaacctcttctccatgcccatcaccctggacgtgtcccaggccgttatcgatgaaggcaagctcaagcccggctcccgcgtcaccctgcgagacttcagagacgatcgcaatttggccatcctcaccattgacgatatctaccgccctgacaagtga

SEQ ID NO: 10500 - DNA, 606 bp, A.fumigatus
agcatgttaccacctcgggtctctgctggtcgaataccagcagtgagccggccactactaccgccgagtagccatggccttcgccatcaattccgtccattcacccaccgatcccgacttctacttctctctccaccactaggtcggcctcaggtaccatttctgtctcccttggcgagcactcgccctcttccgccactgtcgattcatctccgtcaacattttgctcggttaatttccactgagcgccgcgattactacaagcgccgcctgtcgcgagggctgcggatcgggctaacattctacgccatcctggtactcttccaggtgatcaagctgggcgtctaccaagaggaaatcgagcaccagtggcccacaccgtcagaatggtcgtggaagagtcgctggtgtctgcggtccgcgcaggcgctgcagaaccccgagcagatcgggaagctcatgaccaactggcccatggttgcggggtacctgcgagaactgctggagcggctggagaacctggagggcgagggtaaagggatcaaggagcaggaggaaggtgggatttatgttgaatgcgtggggaggaccggcttcgatatcacg

SEQ ID NO: 10501 - DNA, 3309 bp, A.fumigatus
tggcagcacccatttgacaagaataaagcctatgccttgggtgcgaatcgacgtcactgggtgacaaaggatcaagccaagacttgggaatctttcgaagtcgacggatatgcagcagcccaacacgaaccactcattttccatggctgggattctgcaaaggtcatcttccaaagcgatgaatgcatggggcgactttgtatagtgaaatcctactatactacagatgatttcaaaaccgtctcgccactacgggtcagtgctggtggatgcttgtgggctgttggacatccacaattcgccgacggattgaaccttgaagacgaactccgtgatcgcgttctctgcatagtgcctggcctgaaagtgccatccgcacatgcaaaccgcctcgtgtactcggacgacttcttcagaagcgacgcggaagggacggaactgaacattcaacatggacgacctgtttcgggtatccttagcgctgctgctgtcaagaagttctttgtgacagcagcaaaatcccaagggacaaatgagctggctctttatgtcactctggataccaaggcctggcatcgggcagactttggaggccatcgagtggaacaagacggttatacactgctggaaagcacgaactatagcatgcaagtggacgtcctgactagcccctctagcaacaccggcgtacttttcacctcgaactctaacggtacctatttcacgcgtaatgtcgaacatacaaatcgtgatcgctttggtcacgtggattttgagaagatagcagatatccaaggtatcgtgctggttaatacagtgaagaactgggacaaagttgaatcagaaaatgagaagaaggttgttagctcaattagttttgatgatggacggactttccagtccctcaaggttggcgacaagcagttgcatctacattccgtgaccacttttgcaaacactggccgtgttttctcgagtcccgctcccggcctggtaatgggtgttggtaacacaggcgaccacctcaaaaaatactcggaaggtagtctttatgtctcagatgatgctggtgtgacttggcgccatgcgcttgacggtccattcaagtatgagttcggtgatcagggttcggtgataatggctgtcagtgacaagggaactacagacgaaattcagttctcgattgatcatgggaaggagtggcattctaccaagcttcaacataagattaaccccaaattgctgacaacgacgcccgattctaccagcttgactttccttcttgttggctcagaggaaagtcgggaacaaaagcatgtggtttactccatcgacttccacggccttcatgaaagaaagtgtgagaaagatgatttcgaaaagtggcggcaaaggttgaacgaaaatggtgaacccgactgcttgatgggacaccagcaatttttcaaccgaaggaaaaccaacgctgactgttttgtggacgaggaatttaaagatccgcagcccattttcgaaccatgcaaatgctcatttgaagatttcgagtgcgacttcaactttgtgcgcagtgaagatggaaagagctgtgtccctacagccccactagtgccccccgtaggcaggtgccagaagcagaccgatacgttcatgggaccgtcaggctggaggcttattccagggaacacttgcactcgggagggcggcgagaacctcgataaagtcgtcgagcggccttgcaaggatgtagttagcgcgccttcacacgacaaaccgatggcacagaagcaggtgtttaatgatgcgagacaatttagtgagcaatattattaccttgaacgtcaggcaagcagcagtggagatgatgagaccgtcataatgcttaccagcgagggtgaattttgggtttctcatgatcatggaaaaaattgggaacaacctctgaagggcgtgaaaattgccgccattgtccctcatccttactacagtgatggggcatttcttcttactcgcgacaaacaggcattctggaccgtcgatcgtgcctatacttttaaatccttcgaagcaccgatcccacctaatcaggagggcctgccggtcctttcttttcacccccattacaaagactggttgatttggactggcgcagttgactgcagtcacggcgactgccactccgatgcttactttagcaagaacaggggggagaattgggatcttctcctccgctacgttggaaagtgtgaattcgagagccgtgagaacagaccaggcagtgaaaagcttatcttttgccagcaatatgagaatgagaacaagaaaaaccacctacagctgctgtctagcgaaaacctattctctgacagccacgttcatttcaacgatgcgatccggtacgctacgatgtccgaatacataattgtagcctcgcgggacccggacaatcctgattcgttaattgccagcgtcagtgtggatggcaagacatttgcgcgagccgaatttccttcaaatgttgatgtacccgtcaaaacagcttttactgttctggatagctcgactcatgccgtttttctgcatgtcaccgtgagtgacgtcaaaggagctgagtatggctcaatcatcaagagtaacagtaatgggacgtcctatgtccttagcctcaacgccgcaagcaggaatgaatggggctacgttgactttgagaagatgcaaggtctagaaggagtagcggttgtgaatatcatcagcaatgtggatgccgtacagaagaagagaccagccgcaaagaaactaaaaacaatgatcactcacaatgatggtggccagtggatgttactccctcctccagcaaaagacgccgatggcaaaaacttcggttgttcagtcaaagatgggaaaggcagtgatcaatgctcccttcatctgcatggctacacagaacgccgagatccgcgcgacacattctcttcagggtctgctatcggcctaatgatggggataggcaatgtcggtgcttatctgtctggcaaggacgaagcggacacattcatgactcgggatggcgggataacctggaagtccgtcaaaaaaggacgctatatgtgggagtatggcgacgccgggtcagtgattgtcattgttcctgagttgcgaccaactaaggtactctattatagtcttgatgagggcgataattgggagccctatgaattttcggaagtcgagatgcatatctatcggctgtcctaccgttccctccgacacttccaagaattttcttctctggggcaaagaaatggagtctaa

SEQ ID NO: 10502 - DNA, 738 bp, A.fumigatus
tgcagatccggccccagttctcgtgttgttcgtattcgccatagaggaccgttcagaaaggtcaattctcatttaaggggaagatatataaagtgcccttcaccctggtcgttcattgttgtttaccaatcgcgcaaaatgactccgctcgtcaaagtcggcagccttctggccgcattgctctgggtcacctttggcatcgcgacagtcagcgccagcatcccctcatccaaacgcttcgatctctctgccccctccgccgatctctaccgtcacaaagccctccgcgatgacacagtccagcaaggattcgcctttgacaatgtcaaccgccgccttttcgtcgcccagcgccgcgacggctcctccgaaacagcgggcgacctaacaatcacccagcttgactttgacggcaactacgtcggacacatgtacctaaagagctttggtcatggcgtctccttcggcgcgcaggccgttgggtccgcaacctacctctggaccgaggtcgacgccaacgccaacggctacggcaagcaactcgcccgcttcaagttcgcctcgggcaccacgctgaccagctcctccgctcaactggcaaagttcaagcccgtcgccgacgcaacggagcatacctgcgccattgacccggtgtacaaccggctgatcgtccggtatcacctcagcgggtcaaagcatatcgcgtcttcaccacggggctggaaggagccgctctat

SEQ ID NO: 10503 - DNA, 750 bp, A.fumigatus
  unsure (6),(20): Identity of nucleotide sequences at the above locations are unknown.
gtggangacatgaaccctantgcttcccaccgtttctttacgaggccagacacggaagcggaccgcgcggctcataaatatcccgtcgaggcgtccgccggtgaggagtacaattttccggataagtggatatcatttatactaaacctaccttccgcatttccccaccaccgcacgcaatgcatcattgaaaaggtcgatgccttatgggattgcattctccgccgattaacccttggcggtgcgcaaagcttcagcgcctggtggatgacgaaagttttctttcacgagatgatgttatggcaggccgaaaagaatggttttatgcgtttcacaccgagcagcttgcaaaacatgagttatggctctaaccagcccggttcgcccagttttctgctgaaacaatccagcggtcaatctgctgggaagaatgactcttttagcgcctctgatgcgcagcaggctaatgaccggtcaaggtccactgcaaggccttcatccgcggatgtgaatccccaaacccggacatcgctcagtcgaccgccgtcagacgcagacccaaatcaagctttggtggagacagaaaagccacctagcatctctgacaacattgccaactttcacgctcccaataatgacgatagtgctattgaccttgatgatgattcaatgctcatgtccgtgggcaaatatggtgatatgatggcttctgacccagcagacgctgaaggagatgttgtcgtcatctag

SEQ ID NO: 10504 - DNA, 291 bp, A.fumigatus
ggttcggcgttggacgatctttgcacgagggatgaaacgagcatcgattcgacagacattggtctggaccactgtggttattcagttgacattcatactcacattaatagcgtgttggatttcgcttcttctttcagccttttctcttttgccttccgattgggaaacacgagaccgttgttgatgtacataggattacggtcaactttgtctgccgggataattcatagctttttgacggtcttggcctttgtttacagcatccacttcttcctataccgctctttctaa

SEQ ID NO: 10505 - DNA, 507 bp, A.fumigatus
atcaatgtcaggccgcaggagctgatggctgacttttcacagtggatggacgcgcatgagacatgggcaactcataatctcgctgaaacctgctgcgcttccatctcactcgacgatcttttggctttcgcagggaacaaggacagagctacccttgtcgacttctctcagaagcagacgtatggaccaatccggggcagtgatgccttgcgctcaaacatcgcccacttgtatcgcagcgaccgatgtgagccgctgtcgaaagacaacattcttgtaacgaatggcgctatccacgccaacttcctggctctatatgcaaatgttgctcggggtgaccatgtcatctgccactatcccacctaccaacagctctactccgtccccgagtccttcggcgcggaggtcagcctttggagagcagatggccagaatggatggcaggtcagcttgaacgacctgagatcgctaatcagaccgaataccaaagtcatcatcatcaagtga

SEQ ID NO: 10506 - DNA, 432 bp, A.fumigatus
caaagtcatagcaatcctcagaatccaactggggctgtcctgagccgtgaagtgctgcaggagattgtagatattgcgcgccagcatggtatcatcatccatagtgatgaggtgtaccggccgcttttccattccctggaaaacgggcaggacgagccgccttcaatactttccttcaattatgagaagactgttgccacgagctcagtgaccaaggctttcagtttggccgggattcgagtaggctggattgcatccagaagccgggaaatcatagagcagtgtgcgacagctcgcgactacacgttgatttcggtcagtcaggtcgatgaccggattgctacatgcgcattgtcagagccaactgtgagtaatatcctcaagcgtaacctcgatcttgcaagaggcaatcttgatctgctcgatggcttt

SEQ ID NO: 10507 - DNA, 396 bp, A.fumigatus
agagcgaagtacaagcgggatgaacgctacaggaagatattcaaccacgtcatttactgcgttccgaatttttccaatcccacgggcgtcaccatgtctcttaggaggcgagaggctctcgtccgtttagctcgcagactcaatggtctagtaatctgcgacgacgtctatgactttctacactggcctgcccctcattcttcaaataatgaaagtgcatggagttccatgctccctcgcgtcctggatttagatcgcacgcttgatggtggtccacgggatagtttcggcaacgtcgtcagtaatgggacatttagcaagatcgttgcccctggctgccgcgttggatgggccgagggagagccccaattagtttatggcttgtcacaagtgtaa

SEQ ID NO: 10508 - DNA, 198 bp, A.fumigatus
aggcggctcgtcctgcccgttttccagggaatggaaaagcggccggtacacctcatcactatggatgatgataccatgctggcgcgcaatatctacaatctcctgcagcacttcacggctcaggacagccccagttggattctgaggattgctatgactttgtcaggtccacattcactttccgtcggagtaacttag

SEQ ID NO: 10509 - DNA, 276 bp, A.fumigatus
aagacagtcctcagcgtcccggtgcaacgattgaattgttccttggcacttgagctcagtagagcattcgttcatgctaaggcgcctggccatacaattagtgacgaagacatctgtcatggtgttgaaagtttctcgttgactggcaggttcgaaatcataaatgaagggcaggtacaatggtttgtggatggggcacacaacgttttgagcttaggagaagctgcagaatggttcgctaggaacgctagtaacgagcaaaagtacgtcgactaa

SEQ ID NO: 10510 - DNA, 435 bp, A.fumigatus
cctgctgtcggatcttcagatagcaagcccgcgccagaaacaaacgcccaatttagcttcttcggacaggatgacatcgaatctgaagaagaggaagaggagtatagggagccgcagacacccttcacaaaaaaagatttactaagtcggggattacgaagtgctgctccaacaccagacacagccttgatcaaccgaaaaatcgactggaacaacgatgattctgatgccatggaagtgactgaggaatatgcagacactcccattactagggctgaaagtaaggcagagtcgaaagaggactccgaatttaccaaatggttttgggaaaataggggagataataaccgtgcctggaagaagcgccggcgtgatgctgccaaagaacagagacagcgggagaaccgcagaacgggaatgaaggggaaatcctga

SEQ ID NO: 10511 - DNA, 213 bp, A.fumigatus
gctcaaaacgttgtgtgccccatccacaaaccattgtacctgcccttcatttatgatttcgaacctgccagtcaacgagaaactttcaacaccatgacagatgtcttcgtcactaattgtatggccaggcgccttagcatgaacgaatgctctactgagctcaagtgccaaggaacaattcaatcgttgcaccgggacgctgaggactgtctt

SEQ ID NO: 10512 - DNA, 189 bp, A.fumigatus
aacgcaaccgcaaaggtcgatgctatcatcgcagaaaaccccggcaaatctctcgacgaactagttgcggagaagaagatcaacgtggaccagaaagcgcagggccctgaagaagcctgcgctccaggccaccgtcgctcaaatcgaggagcaaatcgctcaattcaagagcttcgccagccattatga

SEQ ID NO: 10513 - DNA, 531 bp, A.fumigatus
ttgcggagaagaagatcaacgtggaccagaaagcgcagggccctgaagaagcctgcgctccaggccaccgtcgctcaaatcgaggagcaaatcgctcaattcaagagcttcgccagccattatgaggagcgcctgaacagccagaaggccgcactggagaaggcccacaaggaagaattggatgctgttcgggaaaaggttcgcgcggaggctactgagtttcaccagaaggatctcagacagcgtctgcttagcctgaccaagttcctttgcgctgccgccgccatgaggcgctccggtgacgagacatcccccgagagccgtgcatttgaaggtgttctttaccaagtctacggaggcacccaggacgcagtgagctctatgctcaaactgatcgaaggagtagacgagaaggtcgtcagtgtggagggagaaacgcttgaggtctcctgtaaggaagcccatcataatttcttgattgaaagcgatttggtccagttgattaaccattgtgccttgtctagacggtaa

SEQ ID NO: 10514 - DNA, 258 bp, A.fumigatus
ccagctgtcgaaccacccatctccacaatggcagctatttctgtcaacagccactctcaggctcagtccgaggcctctccaaggccagattatgcagtctctgcttctaaagcagatgcggctcagggaacagccaacggcgtggacaccctcgacaaccctcatttgaaagatcttcagaggtatgtaaacttcaagattgaagctagcgcatctgttgcgatgctgtacttcgattgttccgatcatgaaatctaa

SEQ ID NO: 10515 - DNA, 570 bp, A.fumigatus
ttaaccattgtgccttgtctagacggtaaggtgaagcaaacatccgaggagtatgttcccggggaagctacagaggaggtaactgcagaagcaagtgcaacctctgatcctacgttggcgaatgcggcctacactgaactccaggacggccctcttgacgccggtgctacagcagccaacgagattgactcctctgcgcctaaagctgaggtctctccacccgcgcagactctcgtttccgatgctgctaatcctgtagccgaggcgtcgtgggaacagaacggggctggctcgctcgagtcgtcggcaaatgctgacggctgggttgaggtgcctcgcgacccggcggagacggagacgggcctacaggccacccctgcctttgtcgataccggtctgaaggacaaccagactgtcgctgcggccctcggaccgaatgatgaacatgtctccgtgcctaaggcgcaaggcagcgaccgattcgaacccgttgtgcaccatcagaaaccaggcctaagggccgcgttcgggggccccggttggacttgccccgggaaaagggattcccgg

SEQ ID NO: 10516 - DNA, 240 bp, A.fumigatus
gaccaaatagatttagacttcaactttatcatcatctttattctccttgacgcggccaggtttttctctctccttctatttcctgaccttgtttctccttcttccgattcctctcacgtcaacaagtacagcaaacacctccaaatccagctgcgacgatcgttcagctactggttaccgactgtccgatacactatcaatggacccccgcattccgggtccatcctgctgattccttga

SEQ ID NO: 10517 - DNA, 624 bp, A.fumigatus
ttccttgacgatcaccctccttgcttccgcacggcggcaacgattcccaacgctggtcttgggatcgcgggcatggagccggcctgtccacccccggttcacaaatccccatcgacctccaccgctcctccccggaaacggcgaaagaggactgttgtgagcggcgcagcggatgactgcttcacatgtgcccgggagggctctgtctgtgaccgacggcgaccatactgttcgcagtgtttgaaccgtggacgcgattgtgcgggttacaagaccacgttaacctggggtgtgggagttgccagtcgaggcaaattacgagggctgtctcttccaattactggagcgcaaccagctgcggctggagatagtcgtcgttccgggggcaaggagaatccgtcgggacagccggtcgcatcgccaactacatatacctttgcctctgatgcgtcaccggccgctgcctccgacagtgcagagagagccacatttcaatcgcaggaatcgccgactccggacaccaatgagaatgcaaggtggatgcgaacggccgcaaaccccggaagcctggccgactcccacgaaccgattccttggttggaaacctcccccggttgtaaacac

SEQ ID NO: 10518 - DNA, 195 bp, A.fumigatus
tttcctcccatggctgaaaagatagcagacacctctgcggtgccctctgcagagactgctgctgcgtctggtggtgatttttcttcccccaccgcgaccgacgggacagaaattgcaaggaacaatgacgtcacggtagcggatcaggagaatgcagctcgtctaatccaggtacggagtacgtcttctatttag

SEQ ID NO: 10519 - DNA, 1170 bp, A.fumigatus
ggtaaatgcccctttgaggatcatactctgacaagactccttacatcttctgttcagactctgaaagaagcaagatggcgcgagctctatcgcccctccgtttcgccagagagcgcaggcacagacgcctcaaaacaagtgcaccaaaaatgggaaagagtcgtcagcgtcgccatgcaagctggcagtgatgacggcaagttcaggaacctgaacgagactgattcatcaaaactgcccacagctagtccagtgggtacaggacgaccctcagaaaatgcgccggcgaatgcttcttccactgccaggtcgcgatttccccattcatttcccagacttcaccacggagtaccgtctgagaagagggccaagatgatggaccaacggtactttctcgaaatggttgatctcaagcatcgtcatggcagcaacctgcgcaagtatcacaattattggatgaactgtccctcaacccagaactttttctactggcttgatcatggcgaggggaaagacttagatctgcccgaatgtccccgggcgaagctggagcatcagcaagtgcgctattttagccgggacgagcggctgaattacctggtcacggtagaccaggcaggtctcttcctctgggcaaagcataacgagcttgtgtgcacggatagcacccgcttcaaggatagtctcaagggtgttgtgccggttgccgaggacgcgccacagttcagaggtcattccgaggctggttatccggttgcgtatgcgtcaagctcgtcttccgtatcaactcagtcactgactgatgaagactcagcggatgatagtcccagcgaacagatcaaccaaggttatgaggaggcaaaagggatccacaagttagcccagatcacaccgtcggtggtacgcgaccattttgctcgcaagcctgcaaagagaaaggacatgtggttatttgtgaggccacttcttcctatcatcgagcacctagagcgacccatgactgacaaggacacaggtcgcggacacttcatttcgcctgtacatcggtatcaaggaaaagggggccttccaacattcctcattcctacggggggcgcgcgttgcggcggcaggtttgatcaagatctggaatggtcaactgcgcagtctaacacctttgaggtaaattaa

SEQ ID NO: 10520 - DNA, 459 bp, A.fumigatus
ctgatacaggcggcttctttggcaacaccggtgcaaacagctcctatgccgagtacgacctcgtcatcatccccgagggagacggtctcaacaacaccctcgcctcggaccacgcctgtccaggggataagtcagaagggtaacaccatcctaccccagttctcacatgtcttattaaccaacccaggactacctcgcccgagaaattcatccccaggttcacgaaaacccgccctatcccgtctagcccgcttccttcccccagacttcaacctcaccccgttcgacatcacttccatgatgaacttctgccctacgaaaccgccgccctcggcaccatctcccccttctgtaccctcttcaccgagcaagaatggcacgactacgcctacaacgtcgaccttcaattctacggcaactacggcctcggtgcccccagcggccgcgcccaggggatag

SEQ ID NO: 10521 - DNA, 630 bp, A.fumigatus
cttggccccatgcctcaaatccttgtttttcccgtttcaacagtcgcctttctggcggtcttgggaggagtctctgctgcaccgactgccagctgctctgcgcatgtatctgctccgacgggcgcaactttcgcgtcaggctttgatatcacaactagctggggcaacctcagtccatacaaggatgcgcccgggttcaatgtatcaaacggcgtcccccgaggctgcgagctatcccaggtgcacgtcctgcaccgacatgcccagcggtaccccgtttcttccctcctagatggcgggggcatggaagcgtttgcgcaaaaggtgaagaactatagcaaactgcacgacggcagagtcggcaaagggccgctggatttcctcaatcagtgggagtacatgcttggcgaagataccttgcaggtcactggtgccgccacagaggcgacctctggggccagtatctgggcgaaatacgggaggctgctttatcgcgctgggccaggagtcgccgcctgggattcctccctgaatgtatatcccaacgggactgcaagaccgaaaccgattttccggacgacgtcgcaggctcggatcttggaaagtgctcgatggtggctgagtgagtag

SEQ ID NO: 10522 - DNA, 555 bp, A.fumigatus
ccaatcactcgttcaacgtacaagatggagttccagtctcgcatcgcccaatactctctcgacgagatgatgatcgatgatgcaagcgcatccctagacagctgcatgggcaagcacccttgcgatctcgatgcagcattccacgaactcgacttccccagcccgccatccacagaggaaatctccgacacagagacagaagctgcgacagagatcgcagaagagacagagggcaaaaaggcgctgccctcccgtctagaagtcagcttcaccacgcccttggacggctttgacccattgcagcgcaggttatccaggcttacacacagacttcgccacagcgttctgtatttcttggctctgtacggtatctcgattcaatatgccttgtatcccattgaggaaagcgggattgggggcgtacacaacgccctaccggttgtgctcctggttgcgacagacgatgtgccagtgtcaatgtggaggaaaggtgtgaagcgcgcatatgagtatctgtcttcacgcacgggcaagcgaagggccattctattgtgt

SEQ ID NO: 10523 - DNA, 192 bp, A.fumigatus
gtgagtagccccctccccaacggtgcctgtctcctgcgtctcatactgactgatacaggcggcttctttggcaacaccggtgcaaacagctcctatgccgagtacgacctcgtcatcatccccgagggagacggtctcaacaacaccctcgcctcggaccacgcctgtccaggggataagtcagaagggtaa

SEQ ID NO: 10524 - DNA, 885 bp, A.fumigatus
caccatcctaccccagttctcacatgtcttattaaccaacccaggactacctcgcccgagaaattcatccccaggttcacgaaaacccgccctatcccgtctagcccgcttccttcccccagacttcaacctcaccccgttcgacatcacttccatgatgaacttctgccctacgaaaccgccgccctcggcaccatctcccccttctgtaccctcttcaccgagcaagaatggcacgactacgcctacaacgtcgaccttcaattctacggcaactacggcctcggtgcccccagcggccgcgcccaggggataggctacgtcctcgagctcgcgtccagacttgcgggacgccttattcccaccagcgacacaagcatcaactctacctacgacaacaacgcagcgcaattcccgctgcaccagcccctgtacatggacatgtcacatgacgatgtcatcgttgcggtccttgcggcgctgggactggagtatttcaagtatggagaggatggcctgccagacgaaattgagcatgcgctcgagcggacattcaggcttaacgagatcgtgccgttcggggcgcggctcgtctcggaggtgtggacgtgtccggcggggccgaagatgagattcaaggagttggacgcgacgctgtatacgaatccgtccgtgaggggtacggactttatccggtttgtgttgaatggggcgccgctgccgacacaggggttggtgggctgtgagcgtgcggagaacgggttctgtgctctgacggattttctggggggtgtggccaagttaaaggagaaggcgatgtatcaggttgcttgttttgggaattatacaactgggcatcaagttggggatggacggcctgaatag

SEQ ID NO: 10525 - DNA, 375 bp, A.fumigatus
cggcttgagtacttaccaagatatctcttttcctattgtatagactcctaccggaagcagtgtgtcatcgacgatgaggtcgctttgttggatgtcttagatactgccgggcaggaggagtactcggcgatgcgtgaacaatacatgcggactggcgaaggcttcctcctggtctactcgattacgtctcggcagtcctttgaagagattatgactttccaacaacaaatcctgcgtgtgaaagacaaggattacttccctattatcgtggtcggtaacaagtgcgatttggagaaggaacgagccgtctctcaacaaggtaggcgaacctcccgaagattttccctttctcaaccttggcaatattcttattag

SEQ ID NO: 10526 - DNA, 255 bp, A.fumigatus
gccatctgctatgcagagggcgaggctctggccaggcaattcggttgcaagttcattgaaacgtcggcaaaatcccgcatcaacgttgagaacgctttctatgacctcgtgcgcgaaattcgtcgttacaacaaggagatgtcgtcatatccgtccggttctggtgccgcaggcacccgtgcccctgaaggcaagatggatgtgagcgagcccggcgacaacgctggctgctgtggaaaatgcgttattatgtaa

SEQ ID NO: 10527 - DNA, 204 bp, A.fumigatus
accatatgcagcgaacaagcacttcttcaggaggactacgactttaacctttccttctgttttttggcctgtgattctacatggatgctctttctcttatttttccttgaaggcgtgttttctatccttaattcttgcatatatccttgccgactactttttcttttctcgcgtccggaaaaaaaggcctacatcgtattgtag

SEQ ID NO: 10528 - DNA, 957 bp, A.fumigatus
gtgtcttggtcagggttaccagcagcaggagggctaatttggattgtagtattcctttcagcatacctagccattctagtgacattcccctgcggaaggttgatggaagctgttttgcctgaaagaaaatggaaaatactgagatggacatttacgctcaacccaggacgcttcaatcaaaaggagcactgtatagtggccataatggcgtccctggtgacagcctttgacaacgggtctctcgcaacagatgtctacgtcgcttttgagaagttccttcatgttcctatttccctcggatataggttcatgtttcttctcaccacacaggctttgagctttggcatcgcaggattatttcacaaattcttcgttgagccagaagcctgcgtctggccgggggtgctcccgacctgctccatgttgtatacaatgcaccaacggaacaaacagaacgaagaaactaatggatggaaaattagtcgcatgaagctttttgctgtggttatcctttgtgggacactgtatcaatttcttccggggttcttattcacaggcctcacaacattcgcctggataacttggatttttcccaacaatgtcactatcaaccaggtctttggagccatttcaggaatggatcttctccccatgaccttggactggaatcaggtcactggctatctaggatcacctctccttgtgcctacatgggcactgacgaacgtgttttgcggaagtatctttttcctttgggtcgtgtctccggcattacactggagcaatgtttgggagggaatgtacatgccgttttcttcatcgaagacgttcgataatacaggtagagtaattcttgatacgtctcttaggagttatctaacacattcaaggcaagccatacaacaccagtcgagtgatgaactcagattattcactaaatcagactgcctatcatga

SEQ ID NO: 10529 - DNA, 237 bp, A.fumigatus
agactattcacaccttacaagttatttcaatcaatcaatattgacctgagaagcgtctctccagaggtacgagcgagtgttcctgcagacgatgaggacatcccagtcaataccttccgcgcctggttcctggggatagtcggaactgtggtccttacggcgttgaaccagttctttcaatttcattctccaccacgtgagtgtcttggtcagggttaccagcagcaggagggctaa

SEQ ID NO: 10530 - DNA, 288 bp, A.fumigatus
cacattcaaggcaagccatacaacaccagtcgagtgatgaactcagattattcactaaatcagactgcctatcatgattattctccagtgtttctgtcaacaacgtctgttctttcatatggattgggatttgccgctgtggcttcaatcatagttcataccgctctctaccaccatcgtgagatctggtacggacttcttgccagtattggaaagtcgtctggtgaagagaagccagatattcacgcaagggtaagcaccacgaccccagtgggaaatacacactaa

SEQ ID NO: 10531 - DNA, 390 bp, A.fumigatus
ccaaagcagttgatgaagaagtataaacaagtcccgacgtggtggtatggctgtacctttctaggcatattcagcatcagtatcgcttttctctatgcctatgatactggtcttccctggcatggtctgatcctggccataacgcttcacgtgatactcttgttgccaacaggtatcatgatggcctactgcaatatcaagttgtcgactgccgtgatatcggccctcgtagcggggtatatctggccaggaaagatgatgaacaatgtggtcttcaagatctttactcttgtttcatcagcccaaggactcggatatatctcggtcatgaagcttgcccactacatggtgagccttcctttcaagccggaagaacaaggcttcctctaa

SEQ ID NO: 10532 - DNA, 240 bp, A.fumigatus
cagttcctctgtccactcgctgcaggctacgccacaaatgccaccttctggggcctcatagggccgaaaagactcttctcggaggggtcaatgtaccgacctatgctgtggttcttcttcatcggtgccgcatccccattagtactgtaccttctggacagacgcttcccccgagcaatgctgagaaaggtacctacagaccgcaccacatacaatgtctatgttactgagtgcaactag

SEQ ID NO: 10533 - DNA, 333 bp, A.fumigatus
atccatctacccgcaatcttcgcatccaccgcatcgataccaccagccaccgcggcgaactacatggcctggggtattgtggggctctacttcaatggccatctcaagcacaggtaccgaccgtggtggatgaagtataattacattctatcggctggactcgatgcggcgctggcagtcggcaactttctcatcttcttctgcttggcgtaccctgggattgagctcaagtggttcgggaacgacatcgcggcgcgaaccgcagatgggctgggcgtgccgttgcgaacggtggagcgcggacaaacctttgggccgcggaattggaattga

SEQ ID NO: 10534 - DNA, 441 bp, A.fumigatus
catgtgtcaagatattctgttccctccgccgactcattcatgatgggcatcatggatgatgaattagacattgatactgcgcatacgaaagaagacaaggacacggcgattcgggcaaaagcgagtaaaacttggcgcattctacgtctttctgctaaaggcaaactcgcggcctttgacaagattgatgacggcaagaatctgaaggctctgtttgaagccccgcaacctcttgagagcaccactcctgctcatgaaccggcctcccaggcttctgagcccgcggctaaggcatccggcgatgccggaccggaagccaatgcatccggacaagaagaacagccagttgacaggaatactacagcagtttccgaacagacaccaggtgatctgaatgataacaatcaagaagcagttaccggggctccccaggcgacctga

SEQ ID NO: 10535 - DNA, 1131 bp, A.fumigatus
gtaaagtatggagtgcagattaccaacaacctctttagccttttggtagaccccgatctaattttccttgccttccttaatatcccactagtactccagaaggatgcggtgagactccatgtgaccctacggccgggctccgtattaatcagtagcacaagattttctgacaagaatttggaagagttccagaccctaaggtataattgcagacaggttatccctgttttcagtcaacccttccctgacacccgcacagtcaaaatggataatgcgcatgacctacaagctagcactcaaaactcaacagtcgacttgaaatatgactgcgatgaagaaaacatacaacaggcagatgttaacagctctttatctgcagctgtgacagatagtcttgaacatgtactgccgagagatagagagatgaagacaccgacatacgattatgcttacgagaagtcgatgagccacacagaagcaaaactcttctaccagcatcatcaattggtgtcacgaggtgccgacagtgagtctgatcagggttccggcctcagcggtaggcgttctgcctctggcatactatcaactaaagctcagacggaggggaagccccaaacaggcatcctaggctcgagtaattcaactcagcttggcccgcctacttcgggatacgccgaaaatataagcaccagtgctggtcagcgtccactgcgagatgatgcaatgcatcatgaaaatctaaatgaacaaggatcatcttatatgcaattcaccactgaggttccaggtgctgtcaaaagtgccatgaatatgacgggcagcggcacggttgcatcggaattaaacgtcatctaccgcaagattcgcggactacttgagcgacgtgccgaatatatcagactgtcatcacagggtcctggggataaccccaaagatcgtcccgattggaggatttaccctcccccgccagaaccagcctgggatgctgatggagagaatgggaatcaaggatcctctgctggtgctggaaccaagaaaagaaagatgggccaggatattggtgaggacttcgacatggctgaattaatcccgctcccggggagagtcaagttggacattcaaattggatga

SEQ ID NO: 10536 - DNA, 633 bp, A.fumigatus
  unsure (495): Identity of nucleotide sequences at the above locations are unknown.
tacgctggatatgcatgtatgtatcattcccacaagtctctttctataactctccttctcatcaatttgcaggcgcatacggattccttccatcgctttgacaaattcaatctcaaatataaccccgtcggggagtcaaggctacgcgagatcttcttgaagacggacaattatattaaaggtcgctatctggccgagatcacaaaagaggtcatctcagatttagagtccagcaaataccaaatggtggagtggcgcatatcaatttacggaaggtcaattcaagaatgggacaagctcgctgcttgggtcgttgacaacaaattattctccccaaatgtgcgctggctaatacaagttcctcggctttacgacgtctacaaagcaagcggcatgatggagaacttcgagcaagtcatcacaaacgttttccagccattatttgaggtgaccaaaaatccgagcagccatcccaaacttcatatcttcctccancgtgtggtcggcttcgacagcgtggatgacgaaagcaaagctgagcgccggctgtataaaaaataccccattcctagagaatggaatacaaggcaaaatcctccatacagctattgggatttacttcatgttcgctaa

SEQ ID NO: 10537 - DNA, 531 bp, A.fumigatus
tcccgctcccggggagagtcaagttggacattcaaattggatgaaaatagtgtctaccaagtgtacgaaaatctcgaggctgcaaatgcgaacaagcctaccatcagaataccttcactgcgtgatttttatatggacctcgacgcagtcatagatgtatctacagacggaccagccaagagctttgcgtttaaacgtctttcttatctggagggcaaatttcagctctacacgctgctcaatgaatatcaagagattgctgacagcaaaaaggtaccacacagagacttctacaatgtccggaaggtcgacactcatgtccatcactcggcttgcatgaatcagaaacatctcctcaggttcatcaaaagcaaaatgaagaaatctcctgatgaagttgtattattccgggatggtaaacatctaacgttgagagaggtttttgaaagtataaacctaacagcctatgacctaagcattgatacgctggatatgcatgtatgtatcattcccacaagtctctttctataa

SEQ ID NO: 10538 - DNA, 1137 bp, A.fumigatus
  unsure (10): Identity of nucleotide sequences at the above locations are unknown.
tatggaccgnctaggtccgtgttgaaaacaaggcgtcttgaggctgatggcttcgctattcctagtctccccattgacccggcgctgaccacggcggacagtggccgacggcgagcatcagtaacctctgtgctcaataaggttgtatcggaagttggagaagaagcggcaatagcaaaatcggcacgtcctgctgcacccaaaagaccgaaactgccgccgccaacccctgaacagattgcatcagaggaagctcttgaaaatgagatgacggctctgttatcgaaaggttctaacatgattgagagcgtggcttcgggccgggaacaagagaacaaagtttctgaccgggcagaaattgacgcctccgaattcgaagatgatccggaggtcgccaactgtcttctatctccagccgaagttgaaatcaaagaacgaatttgggtgcacgagaacaaggactacttgcgaacacaacaggccaaggccttgaaacgagccctggcggaggccgattcccagccaggaatgcgtaagcctcgtaaacgccgaaggggcaggctgggagacgtcacctatcttgaaggggacggggaagatgcggatggcagaagcaccagggcatctactccggccgaagcaactcgtcgcatgctcgagcgcagagggtttagtaagaagatcaactatcgccttctggaatcgttgttcggcgatgaaggggccgacgaggctgccaaggccaaggcggagagtatgagcaggagccggagtcgaagccagagtgtggcttcacgccgcagtgccagtgtggaaccacgggcgatttcactggcaactgccaagcctgccgcctctcccgctccccctcggaggtccacacaatttccaggggagaaaccccttcagccgggagtacaggttggcaagattgacagcgcgcataccaacgaggaggtgctcggaccagcacctgagtcaggaaagattccggaggaagaaatggacgactacgacgacgacgaggaggaggaggaggaggatgactatgaggaggacccagacggtgtcgaagctgcctttgcagggcagtatggcgactattacgacgatgaaagtgattatggtagcgattag

SEQ ID NO: 10539 - DNA, 219 bp, A.fumigatus
aggaatctaatccacagtttacagttattctggaatgtttcgaccatggctgatacccaaaaagtggaccaacctgttttctacagagtcgtgggtactgtaccttacagcgactactctggtaaggcaccaagacaggtttacaggtcactggatatccagtgcgttggaaggtggtccccagtaggtaagtacctacctaaggtaggcagcaggtag

SEQ ID NO: 10540 - DNA, 306 bp, A.fumigatus
cacgttcgccaaatcggaggacgatgtggcagagtcagccaagacctcttgaatgtaagtattccacccgtcgctttgtgggatggcagccacatggagtttcattcgccacttgaaatttactcattcgttctcagtagctgtggagccgctatgattggcgaggactcacagactgagtctggcccaccacatctgtcgttcaatttagttagccactctactgtcaaagtcaaaaaggtaggtaagatctcaacttctacagacatagatacacgggctattgagtattcgagcaggtcttga

SEQ ID NO: 10541 - DNA, 198 bp, A.fumigatus
aggtctccggttcttaaaggcttctcaatacccctgcaccttgatttggtaggtttttcttccccatttttttttattaagcgggcacagtcggttggcaccaagtgcttccaatgtttccggtttacgtctgtttgggttttttctatgctcctcacccttgacggcggccttgcatatatctttcttggcttttga

SEQ ID NO: 10542 - DNA, 273 bp, A.fumigatus
agagagaagttctccattcatgcggagatctacgcaacaagcacggccaacctacaaccaccgcttgatgagaacgctttgcttcaagaattagtcgcacagttcctgactcatgaaggctatgtcgacaccgctcgggctttctcagaagaggttgctgcggagtcagcggctctggagaatggtcgaaaggaatcccttacaaagtatgaagcgggagaaggacttgacgcgatcaaccgacagagtaagatcacacctgctttccattga

SEQ ID NO: 10543 - DNA, 735 bp, A.fumigatus
gccagcctgacatctttgcgggtagaaattcgtgccgctatattggagggtgacatcgacaaggctctcaagtacacaaatgcctactatggaaacgttctagagagttatcctcacattcaattcaagctacggtgccggaagtttctggagatgatgcggcgctgcaacgagctctcctcggcagcgtcgaagaaaggcaaagcgtccaacggcctttccgatggcagtgcggtgttcgaccaggagatggaacttgatgagcaactacaggaaggtgacggctgggataccgagggcatggataccgaagaatccgagaactcagggaagtttcacgagcttctcaccgaagcggttcaatacgggcagcagttacgcatggattaccccaacgacgagcgaggcggcgacaagaaggtgctggatgacatcttctcattggttgcctatcaggatccgaaacgatcagtgcacggtcactaccttgatcctgcaggacgcgtagctattgcggaagaacttaactctgccattctaggtcagctgtgcttttctcgtgtgcttcaatgcagccaattgctaacactgattctcttactagtgtcactcgggaagccatcttcagccgctctggagcggctctatcaacagacggaggtgcttgtcaacgagatcagcgaagagggcggcgctggggcgtttatcaatgtgcgcaatgattttttgctttag

SEQ ID NO: 10544 - DNA, 333 bp, A.fumigatus
atggaattagtgcgcgaatcctgtcctatcctgcccaagatggccttcaagaatgggctgagtgaacgcctcgatgagctgcgcttcccttccccacggtctcccccctccgagtccgcgttccctggctataactcgctctctccgggccatacgagtttcgtttcggccttcccacggtcgtcaggcgatgtgcgcgccaacctccaacgacgatttaccacggactcaagtaagctctcttcgtggagctacttgaaccaagtcggaggcccttctcaagtcgccgatccactagatttgctctcatcggtaagcttcccatatcaatag

SEQ ID NO: 10545 - DNA, 456 bp, A.fumigatus
ccaaatcccccagcttgccttctcgctgccgcatcttgtgaaatccactctccaaatcatcacctctcatatagatttccaacatacaatcaaaaagcaaacatgtctcacaaacccggtggctacttctactatcgatacacctacatgtgcccttggacagacacggccgggcaaagcggtacagacaacacataccactctgctgtttacactccggtgcggaagcaagaccacacagcacagacctcttggtataataacacggccatgcccgctgtgaaggccgatatagaaaagaacttttacggtgatgcagatcggaacaagcaaggcagaacctatgagcgttacaaccagcaatatgttaggcaggagcaattcatgtggtgttcgaagcttccgactcatacatccgagggatgggaaacggtgccctttgggaaacaaatctag

SEQ ID NO: 10546 - DNA, 882 bp, A.fumigatus
cgggtgaagcaaacgcgggatggcattaccaaatcagacgaaatcagcacgcgtctccacacgctttcggacttggcacaagcaacaattcgtcgctttgcggacatctactcccagcagcgcagatttggcgggggcactggcgctgccagcattctccagacttaccctggcaaggtcggagtgccaagctcgatttttgctcggatgaacagccacgaagaagctcaggaggtggccgaaaagaacttccttcctgaagacgctgaagaccttctcgatcgtcttgttcgggctgtcatgaaagcaaagaacggatcgacgagtagcgcgcaagtcaagaagagaaaaccagaggcggccgagatgaacggtaacaatggctcggccaagaaagcaagaaaggagaaagagaagacatcacggccccgcagatcctctgctggtacaacctcaaaaacacccaagaaaaagaagaagggtgaggacgggtggtcttctgatgaggaaggtgcccctgcagaagtgacaacatctgctcggagacgcagcagccgcggaacgtcgaagagggtcagttatgtggacaaagacagcgatgaggatgacatggaagtggatgaatggggacaagagaacgacgagcaagaggataacgcagatgacgctgaaagcgagaatggcagtgacgccgccgaagaaaaagtcgacgatgattcagatagcgaagagcagttgagtgaagcggaagaactagaggatcccgaggattcctcagaaccagccgtcgcgaagtcagaaaaggaaaagcccgaggcgaagaacaaacgcagtgagaagacggctaccttgcccacgagaagatcctctcgaagaggctaa

SEQ ID NO: 10547 - DNA, 189 bp, A.fumigatus
aaggataatccgggtgtagatgcttgttatcttatcaatcatgagatcttccagtctactgaaagcacacatatcattcagcgttctaggttaatttttttttttctaaatcttctcttttgggctgagaagaccatctacattgctaaacaatattgcaagctgtatatcgtgcctcaacaccaatag

SEQ ID NO: 10548 - DNA, 384 bp, A.fumigatus
cttgtcaatcttttgatcatgttactgactgctctgcagatcaaagaaaagcttcaaaaattccaggacatgcacccctccgacgcagccttcatgccgatcctcaagtctatgatggcagacctcgagaagcacatcgaggaagaggagaccattgactttgtcaagctggaggacgcaatcacccccaaagagagcgagagcctgcccaagtcgtttggccgaacgaagatgttcgttcccacccggtcgcatcccaacaccccgaacaaacctcctttcgagacggtggtcgggctgctggctgcaccaattgaccatctagcggatatattccgtaaatggcctgatgatgtgatcaatcccaatccatcgtctgaataa

SEQ ID NO: 10549 - DNA, 231 bp, A.fumigatus
ccaagattggtccccataaccggtctggatcaggcttgtcgtcaatccttccgtggtcgggatggtggggtgtctgggtccgtgtacatgtgtactctgtatgtgttcagacctgtcagccctctgtctctaaacaaagttaatggcgtagaatacaacaccgaagctctctgtgactctggcagtccaaggactgtccacattttgttgtcgttctggggttacaagtaa

SEQ ID NO: 10550 - DNA, 279 bp, A.fumigatus
ttcttaacaaacaacatggcccgccttatggatacgatcaaaaaggaccaccgagagctcgaagagtactacaagatcatcgtgagctccagagataccgatgagcaaatccgcttccagaacaagttcacctgggaactcgcccgccatgccataggcgaagagctggtcgtctatcctgcactcgagaaatatctcccaggcggcgcggagacggccgataaggatcgtgaggaacatcagacggcacggcactgttctgacttgtcaatcttttga

SEQ ID NO: 10551 - DNA, 1890 bp, A.fumigatus
tttcctaagcgcgggccctgccagccccgtggtgaagatctggcgctttataaagatttccaaaccctgattgatgcgtccaaagatctcaagacaaaaatcaaacgacataaaagaaagttacagtactggggtgctcaacttaacaaagaagaattcacgcttgtacttgatggccgtgcagtcaaatttaaacaagttccagaaaatactagagatgatatgacacataccccctcagaaaattcgcccctgtgtcccactgatttgccggtgaaggttggaggtgcttctgtacagatacactcaactccaacgtccgacttgactgcatccagagacaacacacaaggcaatggcggattgccgcctgctgcttccatggagccattgtcaacacagtcagaaagttcaatcgacagcgacgaaaccgcttcaactcctcggcccctcgaatcttcgacagaattgcaagctggggcgttgaaaagaaagcgtgatacagttacagaccatgcttcgactaagcgcggctaccacggcactcgggctgacgaccagctggcgcagcccgttctgataaagagcgagagcatgtctagccccatacgaattcaccttgatcaccatgtagctggaactcacgacttggacgacgttggtagcgcaatcgagacgccgacgaaaagaaaatcctatcgtctggacggcctgccccatgagcttccatcagacactaccaagtctcctttgccccgcaatccaacggctctacaattgaatcgccatcagatggaaccgacccggctggctcccaagcggcctacagtacttcaatctgtggacactaatttgccaagcgcaaattgccggaggatatggttggagcaaaagcaatcgaataagccggagagacgtagcgggtgcgccttagactcggtagcagaagatggtgatgagagtttgaagctcgtcccgaggagaggccaagtgaagcaggcatcccgtggccagatgacacggacaagcacgagcatagacgacgtactgatacgtcagcggctggacgatctcctagaacggcctttgcgaatccgacatccattgcacgtacagaacaagaatggaaacattgccgagatcgggcctgaccaacaagacatttcccgtgacgcatctacacaagtctcggggcgtgtcaaggaagcctcagaatccagtgagccaaccgaatccgccattggtaggccctccatatccgccgggaaccgggagaagtcaaaagcctctccacaggaaggaccgcggtcgcattcgttcaaagttactgatacggtcactgcacactcggaagacgcaccttttcgagctcgaccgctccaccaactcggtctcagacattttaagattaatacgaatgctaatcaaggcctagacttcgcgtatgacacagttgtccgcagaaaggatgaacgcaagtgtatcagtggttgcacgcgcccgggttgctgccgagagaaattccatgctatggcgcgtcttggttgcccgccaaccaccacagacggctcaaacgatggagaagaagagcagaaaatgttggaggactacctcggtgaagagaaatatttactcgaccagctgagcgccgaagaacgtcagagcctcctccatgaggccagagcgaggcgcatggccaacctctacagtaaacataggcatgaccatcagcgtcccagcacgcctccaggattttggcgaacggacatgcctgacacacaagaactggaacatgatcgcgaagtagcgaacaatctcgagagggaaaaagtgaaggagcggtatcgagaagcaatgcgtggcggaatctggaaattcgctgatgaatga

SEQ ID NO: 10552 - DNA, 1680 bp, A.fumigatus
tcgatggatatattgttcgctcaacaagctctgaaccatcgagtcaggctatcgccatttcacttctcgagggaggaacatttgcatcagtacatgaggccatcgctcagatcaaaatgtgctatgactttgaggaacagaaaaaaacagcagaaaattgagcccgaaacagcaaaggtgggttggtgtctacatattatttcccaacaaacgaatgtaaagacggcttctttattgctggacgctattgaagatgcacttggtctcgccacttcagaaaaatcccccgatattaaggagttcaggaccagttttatggaatgcttctcttgtccatcaaattcccgtccgccgaatcttgacgctactttcctctgcacctttgatgccgtctctgaattctgcacgagcacaccaccatctaaatggttagttatcagtatcggtactacaatgctcctctcgatccttgctatccaattcactgccctttggctgcagggatggcgttcggcagggtggattgtgatgttttcaggctatgttggaatagcgctcggtatcatttgtgcaggacttctaattcacggatcttgcgtattcctgcaaatgggaagtaggaatgccctaagaaaggagttatggagagacggtctcctcatagcagtcaagaacgttgactccatggacacccgtggcagcaacctcatgcttgggcagtatcacacgcaaaacttcgaggctgcttttcttcgtgaccttgacatgaaacaacatatcgcagcatgggttgttgcagttgaattgtcttttgcctttatcgctcattatcttgggttacgttcatgcaagtggtgggtttccgtcggtgaactgggtgtttgcctcactgcggcctttgcacgatcgttgactaaggaccgtcagcagagatatcgtgtggtcgaaaagagattggataagcgctgtacctctaccggagtgatcaagtgtcaacaagggggtaaaataaacccatccaaccaaagcaacaacgcacttgatattcgagtatattctccgagcctttttacaggtcaaccaatgtctgctgaaaacatctcttggtatgcagcaaaactatgtcaccaggattaccacacgacagcaacacagattctcaaaatcactggcatgttaataaaatccacgaagatggccgggcaactgggccacagagcaatgattgtgtcatttttgggcggcatcttggtaaccgagggtttggcataccccaacgtccgcatgtgtgcaggatttcgagcaacagtatcccagcttgcagcacatacatgcttgctagttcggttgatccttagacaacctcagtggatgacaatgcatcctgaattcggaaatggccgagttccacttggaagcgtttacataccaccaataaattccatcgtggattggtgggcgatgtcagaataccgcaatgatgcgttagaccttcagaagaacttactgtggtcctttaccttggtcaatctggcattctatttatcgctcttgcggaaccacggcgacgacatccagcttatggatgccattaatgccgcgcatcagggtatcgatatggaagcagaaatgatagcaaaacatttggttacgtttgtagatgaaagtttggagggatga

SEQ ID NO: 10553 - DNA, 222 bp, A.fumigatus
tcgggctccaactatggttcagtctggggactttggagcctaatcagagtatttcggctctgcatcatattgtccatcaatcatcgctggagccacttcaacatcctgcgtctggccattcccatccagtctgcagggaatgtggcttacaccacttgggtggaccagctcagtgatggtgtgctgctatttaagtccacaagtcttaacgacgggccggca

SEQ ID NO: 10554 - DNA, 2595 bp, A.fumigatus
atacgcatttcgcggtccttccatgcctgtggtgaagagctacaatcagagagggataagtttgaagccattatccagaagctgcaagcaaagtaccagccgcaacagcttgagattggtgaattgcgcaagaaactgaaagacacagaggccaagcttgaggaagttgaacgtctccaagcggagcatgagtcgatcctggaaatggccgcattggaccgtgaaatggccgaagagacagccgatgcgttcaagcacgagtgtgccgtgctaagggcaagagttgaagagttggagctggagctggaggttctaaaggaagagaacgaggagcttggtcaggtcatgactcctgaagagaaatccagccacggatggctccaaatggagaagacaaatgagcgtctccgcgaagctttgattcgtcttcgggacatgacccaacagcaggagtcagagctacgggaccaaatcaaggaactccagcaggatttggaggattatgctgtgatcaaatcccagtacgaagcaacgaaagagacgctgcttgtatctgagaacaatgttgaagacctcaagcagcagttggaaacagcacttggggctgaagaaatgatcgaagagctcgccgacaagaacatgcgataccaggaagagatcaacgagctcaaagctgctatcgaagacttggaggcattgaaagagatcaacgatgagcttgaatacaaccacatcgaaacagaaaaacaactgcaggaggagcttgattaccgggaaagcctgttcaacgaacaatgccgaaagatttctcagcaagatgaagtcatcgaagatctagaatactctctggtccgctttagggagctggtctctactttacaaggggatctggaggatatgcgagcatctcagcagatttcggaagccgaggcaaacgatcttacggcgcggtcgcgagccatgatggacttgaatatgaaactccaggcgtcgatggccaagacgcagacaaagacaatcgatatcgaactaggtcgtatgaacgcagaagaagctttgcaacatctatccattctcaaactttatttacccgactattttgaaggagagcgaaattcgattctcgcccttttgcgcttcaagcgggtcagcttcaaggcctctctgatgaacaacactatacgtgaaaacatatccgagcaagcctcgatagctacaggtctcgatgacatattcgtggcctacgacgtgcttgagaaactcatgtatatctcgtctcttagcgaccggtttgtcaactacatctctagctgctccacagaaaattttgagagcgtcaaaggagctttgttcgagatggagccagtggagcgcacgctgaatttctggatggaaggcctgaagaaaaatgaactgaacctcagaaaatgcgctgtagaactacagagatccatcgctctgctttcgcatctcgcagaaaccctccttccttcgtcccttgaggcttttgcggatgaactgtgcatgcgctcatcattgacgcagtcatatatagatcatgctgcaacttgcatggcacggttgaaggcattgctacagtcaaagattacagtcccggaggagggtgacggggagtgctctttgctctttaccaaagcggaagggtttgtgtcccaagctcggggattgaaagtcgccctcggtaaggtttatcgtacgctcgaagatcttaaatcgcgatcattgtctctatcacaagatgttgccggtcccttcaagagcgccgaagaagctgccaaggagctctctgcttggacacgtcagcttggggagaacttagtgattcttgttagtgatgaggctcggaccgaacccttgactatggaagaggcatcgaagacgatgtcagaaacctccacagcttattgtctaccgtcggaaggatccgaaaacaaagacaccatgtccctactccatgatcgattacgtaccctgagcggcctccttgaggagctggacgcggtctcctccgatctatctatcaccacagaatttgagaggcgtcccgccccatggattgcaagagctgcagagctcaagtcgaataagacaaagtctccagacgcggatgaggaaatacgtcggctcaagaatgagatacatgaagcgtcgacagccctgggtgtcaaggacaagacaattgaggagcaagctctccgagtagaactggtagagtcgagaatgcgtgaggctaccaagaaagcatccatggccaaggaccttgaaagcaagattgagaagatgcaggcgaagcaagcagacctcgaaggggttattgagacacaacgcaaggacctgcaagccatggaagcggagcgagaggagctcaagaatcggcttgagcgtgtcaaacgactctccggtacaacaggagtcgggactacgacggacggcgttgccatcgataacagtctctccttggccgccatgcgtgagaacgaggctcttcgcgcagaagtcgccagtctacaagcggctgttcgcttcctccgcgaagaaaaccgacgctcaaacatgctcgacccgtactcggta

SEQ ID NO: 10555 - DNA, 201 bp, A.fumigatus
cctacctatagattaataatcctactcttctatattaaggtctcttctagtttaataggtatggcttttagtggattttattaccccctagctttctttattaaatatttagctttttattatctatctaggagttattactatagctcttttacttcctttatagtattactagacctagtaataaagtatttaagataa

SEQ ID NO: 10556 - DNA, 1575 bp, A.fumigatus
tctatgccaaagatgtcaaaggcctggttcacgatccggctgtggaggacaagcacgctcatagccagagttcgaaggacctcgaggaagcaggtgaaagctatccgtcgcggcccttctatcgccgctatagcaggtacaccaagcatgtcgtgtacgctgtcgtgtggctgttgttcaccgggtgagttgtcttccctttcaactgcaccgcatcttctggcagtcctgtttgatcaaaatccaaactcatccgttgtcgtccctcttagatggtggattgctggtttgatcctccatcggtatgacttgggctggctcatcccgttcctgctgtatctgtgcatcaccttgcggcttcttaccctctacgtgcccgtgtccatcgtgaccagaccagcctattgggtctgggaccataccgctcgaccattcgttcgcctgatccccgagaagttgaggattcccggcgcggcgttattgacgattgcggtcattctggtcggctcatttgcgtcggaagagaccgccgataacaccagagccaacagagctgtcagtctcttcggacttatcgtcttcgtcttcgccttgtggctttcgtcaagaaaccgcaagaagatcgtctggcacaccgttattgtaggaatgctggtgcaattcatcgttgctctctttgtgcttcgtaccaaggcgggttacgacatcttcaacttcgtctcgacgctggccagagagcttctgggctttgccgacgacggcgttgatttcttgacggagactggcttcgcaagcaaacactcgtggttcttggtgaccgtcatcccggctatcatcttcttcgtatctcttgtgcagcttctgtactactctggcgtcctccagtgggctattggtaaattcgccgttttcttcttctggagtatgcgggtctccggcgccgaggccgtcgtggctgctgcctctcctttcatcggacaaggtgaatcggccatgcttatcaagccgtttgtggcgcaccttaccatggccgaaatccaccaggtgatgtgctccggtttcgctaccattgcaggctccgtactggtcgcctacattggaatgggcgttaaccctcaagcgctggtttcctcctgtgtgatgagtatccctgcttctctggccgcatccaagctgcggtggcctgaggaggaagaaactctgacggctggccgtgtcgtcgtgcccgaggacgaggaacacaaggctgaaaatgcgcttcacgctttcgccaacggtgcctggctcggcatcaagatcgcgggtaccattggggcaaccctcctctgtatcatctccttcgttgccttgatcaacggactgttgacctggtggggacgttacctcaacatcaacgacccccccttgaccctcgacctgattcttggatacatctgtaatcccatcgccttccttctcggcgtctcccgcgacggcgatctgctcagagtgggcaaactgattggggtgaagcttgtcatggtaagattctatccattcacgctccgctcaccttcagggaggaccagacactaa

SEQ ID NO: 10557 - DNA, 294 bp, A.fumigatus
tccaattattttcagaatgaattcgtcgcctatagcgaccttcaaaccaagcccgagtatcaggaactctccgtccgctcccggatcatcgtaacgtatgctctctgcggtttcgccaacatcggctccctgggtaaccaaatcggtgtgcttaatcaacttgccccccaacgtgcgggcgatgtgtcccgtgttgcagttagtgccatgattacgggcgccctggctacttttaccagtgcggctatcgcgggtctgctgattacggaggagggcaagtaccttagtcagtga

SEQ ID NO: 10558 - DNA, 183 bp, A.fumigatus
gctccaagacaagggctagtacagaaaaggaaagggacctatacagtggaagttctaatcctgcgcgctgctattatgtatttgccttttgtcgaacagctgtacccggcatggaatttggatcatacgttcgaagatgtcggttttattctattccatttgggcctcagaatccttagttga

SEQ ID NO: 10559 - DNA, 1614 bp, A.fumigatus
agacagccgcctccgaaatcctttagtccgcctgtgttgcagagccaatccgtccctaatgtgctgagcgcccatcgggttcaggcttcccaacaagctcattatggagacgcgacggtttcggctgctctaacggagccattcagcaatctggagctgaatgttgacaacaatgctaaggctcctaaggtcgcgccacagacggagaagccgcatgatacgctggatgacaatgaaggcttggcgccgctgcaagccgcttcacaatttacaactaagcgaagccgccggagtggtcggacaggacatcctcaaaatgtcgccggcaatgagcacgatggggcaaataatacaaatccgaaaaccaagggctggcgccagactgcatttgtccagccagccgacacatctgaatttaagaccccacaaaattacaaggaaaatttccccgatcctgctggacgacgtcgcaagaagaagggtcgtgggtacgctgaagaccccaatggctgggcaactgaggacgcaacggatatccaggagatgggcgacttcgattttgaaagcaatctatccaagttcgataaaagaagagtttttgaggaaattagaaacgacgacactaccgcggatgaggatcgattggtcagcttcaataggagaccgagacctggaacaaatggtgggaagaatctccactggacagaaaacgtgctcgacagcccgcaggacagtgataacgcagattcagacctcggacggagcgatgcgaagctcggcagtggtagttattcgggccgcgaacactccaggacatcaggacgtgcgcgagagtctcggaagggaagtgcagctcttggacaacctccggtggcaccgcagatcaattcaattgggcgaagccagctaagctcatcacgtactacaagccctcgccctaataagacacccatgtcagcatcaccaatgaccggtgctgttggaccgggagcttcattgcgccttacaactaccaatcgcagctgccccacagttagcccgttgcaaactctcgaagtggagcaaattgcagtcgcagagctggggttgacggaggatatgattaccgagaatgctgggagagacatagcagaagctgctgtcggtctcttgtcgaatgatgctgctgcccccacgatccttgtacttaccggcaaccatcgtactggagcccgagctgtttctgcctcacgccatcttcgtaatcgtggtcaccgtgtcaccttatgtgttctgggtctggaacacgagaatgagttacttgaaagctgccgcaaacagcttgatgtattcaagaagattggtgggcgtgtctttagatgggaagacctttccgcacagctctcaagctctgactttgcgcctgacctggttgttgatgctctctttggtattcacatctcttttgaggacttacgcaccgacgatcaagctattgctttcgaaatgatcgcttgggtcaaccgtagtaaccttgatatcctgtccgtcgatgttccatctggcctatcggcttccagcggtgagttcgaaagcttcttcctatgcatgcctgccaaatctctgacactttaa

SEQ ID NO: 10560 - DNA, 1188 bp, A.fumigatus
ctgtgtctccagtacgctctacttaccgagattctcaagaaggcaggagtcccttccagccgcctggtccaattgattaaagatttccatattattccaagctggacggatattcctcttccaacaggtatagatatgccggccctctgcttgtctcccgtgttttcatcttttgggtgcgtacgtctcatgtcgtatttgcactgtgttgaggttttcgtcaaggtcagagtgaatggttcagcctggcttctgctaatctactttgttccaggccgttccctgaattcctgtcagttcgcttttcacactatgtgccaagagcagcagcagcaacagcaacagcaacagctgcaacagccacagatgtctgtccctgtcaatccgggtctggtaccgtttccaccgccccgtcatgagttatctgcacccacagcagttcgacccgaggccagtcacatgcgaaaacggccgcttttcctcttggacaaacagcctcttgccccacgcgctatccagcctcggccagctgccagcacggcctcttacagcagcgagagcagcgcttctgcgctcctctctccgagcttggaaagtaccacgaccaaaggtgagccgccccggaaacgaggccggccaagcaaagccgaagcggagcgacgcaaggcggctgccgaggctcgaggcgaagcataccctcctccccgaaggtcggggcctcataggctgaaagctccttcaacaccagccaacccgccagacgttatgtcttcaggaacttcgtttacacctcaggcgggtctccggcccctggaagtccaaaatccggagctacgctatgcaccccctcctgggaggccagtcacactcatggcacctatcgacgatggacgagcaagaggggcaccgactcgtgacaccggaccgataataagagaacttccaagaccaaccgacccacggcagactctaccttcaccccaaccgttacaaatgagccacgcagagtcggtggcgcgaatggatcctggggagagaccatttgagcctcgtccctcagaaaggttctcctttggagacggcagtcgacgtatcctgaccgatcctgcaagcagacggccagaagcgcctgcattgcctactcccgaattacctgctaccactctagccgaaagaaaacccgagtga

SEQ ID NO: 10561 - DNA, 288 bp, A.fumigatus
tgtgttgtagccgagaacaaggtgctcattgttgccctgggaaggctgactcctctcattcgtcagatgatgtcgcccaacgtcgaggtccaatgtaatgcggtcggctgtatcaccaatctagcgactcacgaggacaacaaggccaagattgctcggtcaggagctctaggtccattgatccgtctagcgaaatccaaggacatgcgtgtacaacgtaatgccactggaagccttctaaatatgacgcattctggtaacttgggctgcgtgataaaacggttctga

SEQ ID NO: 10562 - DNA, 201 bp, A.fumigatus
tcttcgaccggcgtgttgaaaacttgcggcaacgacaccccaatcaacgaccattgcctctatgacaaccaatcgaaatcatgcacggtaataatgatatctttgacaggctttccaaactataaggtcgaagctctgaggctaattgactccatgatctcagtagtcgctaatggtgtgggacaaatcactctttcctga

SEQ ID NO: 10563 - DNA, 234 bp, A.fumigatus
ctgagcgaggtacgtcatattgttgctatgaaaccagaagtcggaactgacgttattattattgtcgcagatgtgcgcgaagtcgaccgggacacgctcgagcctattctcttcctgctacagagctcggacattgaagtccaaagggctgcaagcgcagctctcggaaatcttgccgtcaacggtttgtcactcaatctcatatcgtcctcgagtaccgctgatgtgttgtag

SEQ ID NO: 10564 - DNA, 255 bp, A.fumigatus
gctgtgctgattcatcgtcatattgaaatgttcagcgatgagaagaaggacctaccactctcggaggatgacggtttcacaacgttcgccaaaagtaattcaagctcaaagaacaagaagaaccaagaatccaatttgaagatcagcatttggcttgatctggtcgttgaagtcgatatcaagatcaaggcacatctatatagtgatattgtgataagtttgcttcaagtcgctgggatgaccatccacggctaa

SEQ ID NO: 10565 - DNA, 423 bp, A.fumigatus
tcggctaccgtccctcacacctaccttcgctttgaaactgtcgcttccgaggccttctggcctcccatcaccgaaggtatgactgcgatcgcaaacgcgtgtctgtcctgtctatcggcagtcgaccgctggtgtcatatcacggcctgtctcggtcctataggaggtcgctcgcgagatggaatttatgagacaacgctagcagacaatgagcgggaggccgtatccgacctgctcggttacttggagaacgtacgtctagctttgtcgtctatgcccttgcgcttcgcatctaacataattatcaacgtactcgggcctctttctgctgtcgaagctgactttacttgtgttctagcgagccgaaaccgacttcttctccggcgaacctcttcgcgccctgagcaccttggtttattctga

SEQ ID NO: 10566 - DNA, 192 bp, A.fumigatus
ttcgtcaatgtcaacttcttcttgcctttgtttatctgtcgcatccgccccagccatgcttttttatccgccatgaaccacacgagtttcttctactctcccgacaaggctaccagtgaacacttcgcaaattcgcttcaagggcaactatccgcggacccaaacgtcttcattgtcaggtcaataagataa

SEQ ID NO: 10567 - DNA, 1638 bp, A.fumigatus
  unsure (1332),(1401),(1497): Identity of nucleotide sequences at the above locations are unknown.
agactttacctttctgacccggatccgcgcacggtcccccgggactcccgctctgggcaggtcaccccaatcgaagagagagatccggacgcctatgtcgagcggccgacccattatcgcgggggcatcctctcatccctcctcaagctatacgaccagtcttccggcagcagccactattcccgcggccggtatggccactcccgtcagagcagtctgggagaggtcagtagccggggcctctcgccggaccccggttggaaacaaccccagcgacaacggaagtggtacgaaaaatccccgagccaatctagcacctccctctccggctcgacggacaagaactcgtccagctcgcccattgcgatgctcaagcgctcgcggagcagtggtcccatccctggttcgggcggcaaacgctggaccaaaccccggctggaggatgagatccgcattactgtccatatcgccgagctgctctcgcgccagcgatatctcatccgactgtgtcgggcactgatgaagtacggtgctccgacccatcgtcttgaggaatacatgaccatgactgctcgagtcctggagatcgatggccagtttctgtacatacccggatgtatgataatctccttcgatgacgcgtccacgcacaccaccgaagtcaaggtggtccgatcagcccaaggagtcgacctgggcaagctctccgatgtacatattgtctataaggaggtcattcatgatgtgattggcgtggaggaagccatccagcggctggaggagatcatgaagaagaagaacaagtattccgtgtggatgctcatcctggtccacgggtttgcctcggcgtccgtggggccttttgcctttaatgcccggccgatcgacctgccgatcgcctttttgctcggatgcctattgggcgtcctgcaactggtcctgtccccacgctcgaacctctactcgaatgtgtttgagatctcggcggcggtgatgacctccttcctggccagggcttttggcagcatccggtacgaaggcgaacggttgttctgcttttcagccttggcgcagtcgtcgatcgcgctgattctgcccgggtacctggtgctgtgcgccagtctggaactgcagtcgcgcagcattgtcgccggctccgtgcgcatggtttacgccattatctactcaatgttccttggattcggcatcacaatcggaaccgcagtgtacggcctgttggactcgaacgcctcgaccgagtacacatgccccccgagcccaatccgcgacgagtacctgcagcacttccctttcgtcatccttttcactctntgcctcgcgctcgttaatcaggccaaatggcgccagatccctgtcatgcttttcatcgccttcgccggntacgtcaccaactacttcggcgctaagcgcttcgcctccagcacgcaggtttcctccgccctcggcgcctttgtcgttggcgtcctgggcaacctntacagccgcctccgtcacggcctcgcagccgcagccatgctccccgccattttcgttctcgtcccctccggactcgctgccagcggctccctaatatcttcaccacgggggcggaaggagccgcgcaatgcgtgggtaagc

SEQ ID NO: 10568 - DNA, 1302 bp, A.fumigatus
agaaaagcgttaattatggccggcggttatttcgatctaccaatatcctcgtcccggcgttcgagccttgctgatgaattccataatgcgagcagacctgccccaccgccgcgtacttctcctcttgtgactcccaatgaaggctcatctcaggaaaagccgctgggctttatcaatacccccggcaggcaccggaatgcaggtattctgaaaagtgcgaatcgcgttaagttcaccgtcagtgaggctggcctgctcgaggctccagcagcgggatcgacgtcagagacccgttttgacagtaggggttcctcacttcctcagcgaccattgcgtgctgccagcattccagttgcagagagagccccccaatcaatttcttcggtgtatcctggttccaacgcccccgcaggtgtcacgggccttgctgaccactcgcaagcggcctcgtcggagatctcaagggactatgagatcagcggagagaaagggagagccttccagtttgctcaggaacgagcccagcgactggcgtcccttctgggacgtacttccaaatcccctcgaccaagcccacgatcgagcgtgccgtcatcagtcgcttcgacccccacagaggtggtgccgccttcagaggatggtagtgacattcccatgatcaatctttccgagaaacatttcgacgacgactttcccgacgaggatgaagacggccttgttgatggacgcacattgacccgaacgtcagaggcccatcagctcgtgcgacaaatgactcgtaaagactttacctttctgacccggatccgcgcacggtcccccgggactcccgctctgggcaggtcaccccaatcgaagagagagatccggacgcctatgtcgagcggccgacccattatcgcgggggcatcctctcatccctcctcaagctatacgaccagtcttccggcagcagccactattcccgcggccggtatggccactcccgtcagagcagtctgggagaggtcagtagccggggcctctcgccggaccccggttggaaacaaccccagcgacaacggaagtggtacgaaaaatccccgagccaatctagcacctccctctccggctcgacggacaagaactcgtccagctcgcccattgcgatgctcaagcgctcgcggagcagtggtcccatccctggttcgggcggcaaacgctggaccaaaccccggctggaggatgagatccgcattactgtccatatcgccgagctgctctcgcgccagcgatatctcatccgactgtgtcgggcactga

SEQ ID NO: 10569 - DNA, 501 bp, A.fumigatus
  unsure (242),(311),(407): Identity of nucleotide sequences at the above locations are unknown.
ttctgcccgggtacctggtgctgtgcgccagtctggaactgcagtcgcgcagcattgtcgccggctccgtgcgcatggtttacgccattatctactcaatgttccttggattcggcatcacaatcggaaccgcagtgtacggcctgttggactcgaacgcctcgaccgagtacacatgccccccgagcccaatccgcgacgagtacctgcagcacttccctttcgtcatccttttcactctntgcctcgcgctcgttaatcaggccaaatggcgccagatccctgtcatgcttttcatcgccttcgccggntacgtcaccaactacttcggcgctaagcgcttcgcctccagcacgcaggtttcctccgccctcggcgcctttgtcgttggcgtcctgggcaacctntacagccgcctccgtcacggcctcgcagccgcagccatgctccccgccattttcgttctcgtcccctccggactcgctgccagcggctccctaa

SEQ ID NO: 10570 - DNA, 615 bp, A.fumigatus
agatttatctaccccgcccaattctgtctgttgtccattccaaatgtcgagtcttccgtattcccactgacacaattccccgtctcgtggacattattccacccacttccacttggcactgctcatcgtccaatattttgcccctctgccgctttgaatggccgttggcgtcagctagacgcgccagtgagggccatggccacccgcctgcctcctttaaatgatgtggcgccctcgtcggccctggagtcatcgtcatccgtgagcaccactccagctccagctgcagcgtcagccacagtgttagtatcagcaacagcatcaataccactcacctcgaacccgtcctcgactgtcctctccactccgaatcaagatcccgactgcgtcaagcaggaagcctccccgaccccgtccggtttcacctccgccgacggcgacacacctgtcgccgataatggcggatccacggcggccgcgggccggaaacgcaagctcaatagtacctcgtcgcgcggtgtggccaatctgactcccgagcagttggccaagaagcgagcgaatgatcggcaggccccagcgggcgatccgggagcggaccaaatcgcacattga

SEQ ID NO: 10571 - DNA, 1404 bp, A.fumigatus
ctcccgagcagttggccaagaagcgagcgaatgatcggcaggccccagcgggcgatccgggagcggaccaaatcgcacattgagtcgcttgagcagcgggtgcacgagctctcgtctcagaaaccgttccttgatctccaggcagcgctgaagcggaatgaagcgattcaggcggagaaccgggatctgaagcacgggcttaaggcggtgatggatatcatacagccgctggttgcgaagcaggacccaagtgagtgttctttggtattgttcatgaattgctcatgtggattatcgctgacacaatggacaatagatcagcctgctccccctcctgcgccttctcaaccactggacccttccttcagtccgctacggtacaccgagactcatcatttcacctcgaccggccaaagatacgagtcctcctatacgactacgacgtctggggcagacaccccgacgtcgacacactcggcgcctacgatgagtgcccatcgacgggatagcagcagcaatggactagcctcgttccggatcgcattcgactatcagcgtcataacctcgctcatggattggattttgggacggacgagagactgggttttaatttcctgcttgatgcctctcagcaagttcctcgagtggaagggtttcgtcggtcaacggagagcttcaggccgtgtcaggccgatctgcctccagtctacaccccttcgccttgcggtcctgcgccggagcaacccttgcccgcatacaaaactccgatccggaacatagccccgacgtgcacattggacgccatcctgttggattttcttcagagtcgtcggcgcaaagcggcagagggagttcccacgcagaagctcgtggggcccccttatccgagtgtctcgtccctactgaaccccgaaaagagtgtttactcgcatccactgtcaaaggtgtttgtcgatatccttcgcgcattcccagatatttcgtccctgcctgagcaagtagctgtcttatactcaatgtttctcctcatgcggtggcagatctacccgacgccagagaactatgagcggttgcctgactggctcacacctcggccctctcaacttctcacaccccatccggcctggatcgactacattccgtggccgcggatgcgtgatcgactggtcgcctcgtaccaggattatccgtttgagcactggttcatcccattcacccggaccctgtccgtgaactggccgtacgaggcgacagactgcttgctgtccaccagtgatcatgaggatctcatcatcaatccagtctttgagcgacattttagaaatctcgacaattggtcgctcggtccatctttcgcggaagcgtatccgcacatggccgaaaccgcgaggatcaaatcttaa

SEQ ID NO: 10572 - DNA, 201 bp, A.fumigatus
ttcggagtggagaggacagtcgaggacgggttcgaggtgagtggtattgatgctgttgctgatactaacactgtggctgacgctgcagctggagctggagtggtgctcacggatgacgatgactccagggccgacgagggcgccacatcatttaaaggaggcaggcgggtggccatggccctcactggcgcgtctagctga

SEQ ID NO: 10573 - DNA, 1032 bp, A.fumigatus
  unsure (7): Identity of nucleotide sequences at the above locations are unknown.
gccttcncgtgctcctgtcagtgtttgagtttgcctcaattctttttggatgttttgctgattaaaaaactgcagttgctttggctctcggtacccgatcgtcctttccctgccagaacccctcacagacgtcgaaagggtcgcagtctacaaatctcatctgtctcggtcgagttgccttcaaaggaaccgcaactagctaagcaggaggagagactagatgaagagaagccagtccaacagactgtgcaagaacaatcagaaccgcagactccatccccatccgctgctccttcggttgcggattcgacgacgcagcccacgacaccgtcttcagctgttgcttctacaacggcccgccctcaatcacactcaaaagggccaaaacccgccgttcctgtggtgcctgttttgcccgtcatcccaagccctgtagcccaccaacggcagccacctaaagacgatgtgagccgtgctcctgaaactcctaaatcaacaacagcctctgctacctcagtgaacgagacaccaaaagaagatgccgttaaagagacagctaaggcggcttcacctcctcgtgctgcccctaagtcttgggcagaccttgttcgagcaaaaggagcctcgagagtctcgggcccagctggtgctctctcaatcgagtctaacggcctggtcatgcgcaagagcgaatctctggcagatgttctaaccagtcttggggaggacgtttcccagtacagcgacaaaatcgcctttcttgaaccaagagggcttataaatactgggaacatgtgttacatgaactcggtaagttggcacgcgattcggtttgctgatttgcatttactaaacgcgagagaacaggtccttcaaattctagtctcctgcataccgttctatcagttcctggatcatgtcggcagacgaatatcacatagcgtccagagcgcatttcctatggttgacgccatgtcagtttgccctactttgcttcctgccacgcacgacaatactgacatcatatcttag

SEQ ID NO: 10574 - DNA, 1092 bp, A.fumigatus
cgaggccaccagcaggatgctcaagaatttctgggattccttctggaggaaatgcacgaagaatgcgttcgagctgcgaaaaacgcgagcacgacaaaacctgcggcttcaataactgctgaatcgattgataaagaggagcagtctggagatgggtggctagaagtcggacacaaacaaaaggcggcaatcacacgttcttccggtcacatcacgcaggagtctcctatcaccaggatatttggtggcaagatcagatcggagttcaaggtacctggcaacaagacttccgtgaccttggagccttatcagcctctgcaactcgacattggctctcccgatattcacaatatcgttgacgctctgaaaggtctaaccaagccggagagcatccaaggtgactttaactcttctcgtggtcccaatgtcactgccaccaagcagatattcattgagaatctgccgcctgtcctcattctccatttaaagcggttccagtatgacagcgtgaccagaggtacgcagaagatttggaagaagatcgggtatcccttggaccttgagattccccgagaggtcttcgctccgaacaaacgcaatgttatgatggctcatggtggtctgcccaaataccgtctcattggtgtcatctatcaccatggcagaaacgctagcggcgggcattatacggtagatgtacgccgtcaagacggccgcgagtggattcgcctcgacgatacggttattcgccggatcaaaagcgaggatgtcgcggaagccggcggcgaggaagatccgaaggtgctcgctgctgcgcttgagcaacacaagcgagacaatacctccaatgctaacatctttggtcatattgaccaggatgatcaggaccagtctgacaatgaaagaggctggagtcaagtgaatggaacaagcacgggaggccattcgagcaagaagtccacctccaccgtcttgaatggggcatctgccactgcttcgggaagttcttccggcgtcaggactcccatcggccgatatgggtctcgtgataacaaagttgcatatcttctcttctatcaacgtgttgcttga

SEQ ID NO: 10575 - DNA, 237 bp, A.fumigatus
aggtgcttcgcccgccatggcgaaaccagcgtctcccgtgcagagatatgcctcgaagcccgcctctccccttgcaaaggccaacaatccgcttactcgtccttacgtgtctccagcggtctcgccttcagctacgccatttcgaactccgccgccagctcccagcgtgccacccttcaatcgctcctggctatggcactggctaatcatccccctgcgatgaattctgctgggtaa

SEQ ID NO: 10576 - DNA, 1338 bp, A.fumigatus
cacagttatcgttcctacatcagaaatcagcctactggggacacgtcttctcctacaattagcactcggccaacgcctcactccaccacaatggcagggtcgggcaagaagagcaaaggcaaacctggggccaagcagaagaataagaaggggaagaaccaagaaacgtctgagaacccatctgaaaccccttttgccgagaagcaagaccaacagacacatccggagatcgacagtgaaactcctttggatcaagagggccaaccattacaagcagaggttgaagccgaacctcaacctgctgaaagtcaaggatttgaatcaaacgttcctctacagtctctcccggaacctggccccaaccacggacaggccccggaacaagtaccagaactggagcaccctcagcctgttgcagcaacagcctcggctgtgactgaaaattgggaagaccctcagccatcgacgaacctggaccaagagggcatctcgagtcagccgcagactttgaacgatgtgcagaacattcttgaagcgactcacgagtccatcctggaggaattagcggcatcggaccctccgacagaaacagcggccgttgagacgaatccagagcctaaccatggtctgagtggccaaagtgacgctgccgagcccccagaaccgatcccagtcacagcacctcagactcccatgtttcaagaagcagcagctgcttgtccgttaccatcgccatccctgacagaaactgaatacatagcggcgtcttctcactcgaatgctgcttccccagcgcccaatccttccccagaagccgaagccgaagtcaatctcccaaatcctcaacaagagcctactccacctgcggaccaagctgtttcgccagcaccggaccctgcttcgtcctcgcggccgctatctcctgcacctgtagcagcatcttccgaaccaccggcgtcttcgtctgttctccagactgcctctcctgccctagaggcggatgcgtttcatagtgcatctcctgtaaatcatcctgcctctcctgcatttcatacagcatcacctgcatcaaagccctcctcgcctatcccacagtctgcatcttctcactataaaggtgcttcgcccgccatggcgaaaccagcgtctcccgtgcagagatatgcctcgaagcccgcctctccccttgcaaaggccaacaatccgcttactcgtccttacgtgtctccagcggtctcgccttcagctacgccatttcgaactccgccgccagctcccagcgtgccacccttcaatcgctcctggctatggcactggctaatcatccccctgcgatga

SEQ ID NO: 10577 - DNA, 198 bp, A.fumigatus
tcctaccacccaggaagatgcagtctcattttgatgcccaacccacttcacttcaccaagatcgttcaaccatgcaggtcgggaaccgacggcttcggacccatccttacgattaccgctttagcacccaagaccggggcgttgagatcgcctaactaccagtactctggtgtgactcgaacgacccatggatactga

SEQ ID NO: 10578 - DNA, 225 bp, A.fumigatus
acggatacgattgcggcgactgtgggtgtggggccagccgtagatgtgacttacaacagtattgagctgcaaccttgcttcgacactgctcagtcgacatggaccatgaccactctgatgcctctgactcaagctcgaaaagaatacaatctgatcaagaaacagcagtcttgcacaacactgaaaatgtgtctcagccaatcctcagattgggacctggactga

SEQ ID NO: 10579 - DNA, 342 bp, A.fumigatus
ttaaccctccctcaggctatcaatgaactgaacatcttacccttgcgcgcaagaggctcggtttccttcattcgaagtgctgctcaagctttctcgtctttccctccaatcattgcacgtaacgtggggcatgtgataatgtggagtatcacttgcattggccacgaaagggcaaggttgagttctggagtgtatgagaacgagaccaggcaaggcctagctgatgaattactcgtcatggccaaggatctgatgatcttctccggcatggtcaaatacaaattaccgccgagagtctatgagactcttgctcgcgccggagcggatatcggggcttactag

SEQ ID NO: 10580 - DNA, 681 bp, A.fumigatus
agaccgctggtggacccgggcacaaccaacacccccaaacagctcgcactggatcagtccgctcggaaggtttacttctctgaccgggaaggactccgcgtattccgatgcaactacgacggaagtgatcttgagatcatcgtccaaacgggtgattaccaccgaccaggagacatgcaagacgctacaaagtggtgtgtcggcattgcggtttcccctcggttcggcaagttctactggacccagaagggattttcaaagagcagcacgggcaggatcttctgcgcggatattgacatgccaccgggccagactgcggcaaaacgaaatgatatccgttgtctcttagagggtctgcccgaacccattgacctagaggtagacgaggaatcaggcagattgtactggaccgatcgcggtgagcttccgtttggcaactcattgaaccgggtctcgctgaaggagaccggttcggaggtcgaacggactggccatctgggatacgaggttctcacacggaatctgaacgaggcaatcggtttgaaactggatctgggacgtggtcatatctatttgaccgatcttgggggcagcgtttaccggaccgatggggatgggaagcagaaggtgaagttgtattccgacgagagccgtgcttttactggaattgctttactgtag

SEQ ID NO: 10581 - DNA, 1050 bp, A.fumigatus
gctcctgagccagatcagcagctatttatcccccctgcgctgcggacaatatccccacagcgtaagccagaagcacctctccagctcagtcgcacatgtaggcggctccgtgatgtctgccaaccgcttctattccagtgctattaccattcttccaagtccctaacatcgcttctctccttcctccggacactagaggcgcgccctgacctcgcaaaatgcgtgactagtctggacttcaatgggcaaggccaagcggatgccctcagcgacggagatcaacagctgctggagagctgcatcgccaagtttggtctgcccctgttgctagatgactggcaagactgtctgggcgtggaaagacgcctgctcgcggcagaacttgtcgtcgcgtcgtgtccgaatattgaggctctcaggctgcccatgaacccagaatggctggtgagcgtgctcgactcgctgccgaaggactttgtctttgcgaagttgaggaagctagatgtctggctttactatatcagcggtgaccactatggtattgggtaccggaagattagcgggctgttgcatgcgtcaccgaacctggagcatctgtctcttccctccattgaggcgttttatcccggcgaggcgggagtgcctatcctggagaaggtgaggcaccttgatctcggtgacagcgcgccgtcgccgtattttcttaagcgtgttcttgaagcctgtccgaatctcgaaagattcgagctgcattggattgtttcggatggatacgacgaagactccgaagagtggtcacctctggatagacgacgggccttgcaacgcgttcaaagctctgttcgcgagatcatcttcgaggctaccattgagttccgggacgatgacaatcttgaagatagcgttccgacgctgcgcgatttttcgcgcctggagatcctcaaagtcaatgacatcgctctgcaagcgctgtataaagtctggacgcaccctaaccgccacggaactgtggagcaattcgtataccagggggtttccgtctacgattaa

SEQ ID NO: 10582 - DNA, 321 bp, A.fumigatus
cagatatcagtattcagccaccagttgcagcctacttcaattgccattagacaacaacaagagtacataagtctcgtgcgacccgattctaaccccggcaaacgcaacactttgatcaccatggtagttacttccctagaaacactgccagttgagctcctgagccagatcagcagctatttatcccccctgcgctgcggacaatatccccacagcgtaagccagaagcacctctccagctcagtcgcacatgtaggcggctccgtgatgtctgccaaccgcttctattccagtgctattaccattcttccaagtccctaa

SEQ ID NO: 10583 - DNA, 684 bp, A.fumigatus
tatgcaggatgctacggatgccaataccggtgttgcaggcaagaggaaggcgcggacaagtgtcggcgaacggaaatcctatgcggagccagagagcagcgaggacgaagatcagcccttggtacgccgaacctctttacgccgtctccctcgtttcccctaggttgcgacgcttttgtcgctttttggtttcagcgtctgaccgttcgacagagcaagcgccgtcgcacgtccgtgaagcacgaagatcctgagaccgacgaagatgttcccctagctctcaatggaagaaagcttcccaaggcttccgaaaccgctctcggtgccgaggaatctgactccgatgtcccaatcgagcgaaagctcgtagcccagaagaagaaaattcagcagaaggcagaaaaggacgctaaggccagccggaagagcgacgcatcacaggctgcaaaggcgacagctgccagcaaaaagaaacaggttaatggtgtgaagagtgaacctgtcgatgagaagaaaccggcagtcaagaagacaaccaaacaagccaatgcagagccggcagcttctgctaggaacgggaaaacgaaggcgacacctgtcaagaaggaagaaagcactgaagctgaggaaggtgaagaagaagaggaagagtacagatggtgggaggatccgaccaaagggtga

SEQ ID NO: 10584 - DNA, 210 bp, A.fumigatus
gatgaagtacgacggtgttcccgggcattcttcacccgaaagccgaaaaagtggcgggctcttttcggtagcatgctgaatgcgactcaacatgtggaaaacccaaccttccagaagaacttctttatggatttcaaagaggtcttggaaaagacaggtggagcgaaggatccaaaggggcacccaaatcgagatcaaggagttctctaa

SEQ ID NO: 10585 - DNA, 420 bp, A.fumigatus
gttgtcttcactgtggcgtcacatggtgttgaatcttcccaacccttcgcaccaccctatctcctctcatttctcacatttgttctgattcctcaaatttcccactcttatgcctatattcaactcaatctgacctttcatgggatgtcagctacctctacagacgtaaaaatggaggatacgcctgagactaacggtcatgtcgagcctggcgtttctcttcgctttgggcctgtcaagagtgcgggagatattgatatgcaggatgctacggatgccaataccggtgttgcaggcaagaggaaggcgcggacaagtgtcggcgaacggaaatcctatgcggagccagagagcagcgaggacgaagatcagcccttggtacgccgaacctctttacgccgtctccctcgtttcccctag

SEQ ID NO: 10586 - DNA, 354 bp, A.fumigatus
agagtgaacctgtcgatgagaagaaaccggcagtcaagaagacaaccaaacaagccaatgcagagccggcagcttctgctaggaacgggaaaacgaaggcgacacctgtcaagaaggaagaaagcactgaagctgaggaaggtgaagaagaagaggaagagtacagatggtgggaggatccgaccaaagggtgacgggacaatcaagtggacgaccctcgaacacaacggcgttgttttccttcttccctacgaactcttaccaagcgatgttaagatgaagtacgacggtgttcccgggcattcttcacccgaaagccgaaaaagtggcgggctcttttcggtagcatgctga

SEQ ID NO: 10587 - DNA, 1017 bp, A.fumigatus
  unsure (1013): Identity of nucleotide sequences at the above locations are unknown.
atgcgactcaacatgtggaaaacccaaccttccagaagaacttctttatggatttcaaagaggtcttggaaaagacaggtggagcgaaggatccaaaggggcacccaaatcgagatcaaggagttctctaaatgtgatttccgaccgatctttgattactacgacgccaaacgaattgagaagaagaatcttcctccggctgagaagaagcgtcttaaggctgagaaagatgctgccgaagcgccatatatgtactgcctctgggatggtcgcaagcagaaggtcggcaacttccgagttgaaccgccggccctgttccgtggccgtggtgaacacccaaaaactggtcgtgtgaaagcacgagtccagccggagcagatcaccatcaacatcggaaaagatgcccctgttcctccgccacctgaaggtcatcgctggaaggaagtcaagcacgatcaagaaggaacatggcttgctatgtggcaggagaacatcaacggcaattacaagtatgtgatgcttgctgccaactctgacgtgaagggcctgagcgactacaaaaaatttgagaaggcacgcgaactcaagaagcacattgatcgcattcgcaaggattatcaaaaggccttgaaacacgagctgatggttgagcggcagaaggcaacagctgtctatctcattgaccagtttgctcttcgtgcaggcaatgagaagggtgaggacgaagctgaaactgtcggttgctgctctctgaaatatgagaacgtcactctcaagcctccaaacaaagttatctttgatttcctgggtaaggatagtattcgattttatgacgaagtcgaggtcgatccccaggttttcaagaatttgaaaatttttaagaaaccccccaagaaggagggagatgagattttcgatagattaacggtgtgtgctcagctcggtcttttcgtgatcgatgatgataatttttgtcttacacggccgggaatggaaggagtagcgtccccccngtaa

SEQ ID NO: 10588 - DNA, 333 bp, A.fumigatus
gaagacactatcgagaaattcctccaggtcggcgtgtccacgaactaccagtacacaaagactagcaccctcaccggcactgtgaccatgaccattccaaagaacaagtggggagcgatagtgagcaatcctctgacgcaccgcaagagaggctatatcttcactggctcgcctggccggggacagttcgagtactaccaggcagattcattcaccgatgagacttatagatacaaggacggttcgctgaactgggtgaagggagtggtgacgacttgtctgagggatacttatccagtcaagcggtgcgttggacagggtgagctcaaataa

SEQ ID NO: 10589 - DNA, 759 bp, A.fumigatus
  unsure (154),(169),(243): Identity of nucleotide sequences at the above locations are unknown.
gaatcaggcgtccccacttcatgccaaatcagcatccaggaccataaagggagaacacggcactttctcattgcttggactggcgagaaggagatgatcgactcgtttgagagaagttccgcaatggttacggtttccctacagttggcgccanatgagacgagcattntaagtctcgagaagagcggcagctgtgatcttacaaagttgaccaagactgcaagcagcagtacaataaggcantacggcatagctaacctgacacgttgggacctgtcgatcgaagactttcacgctccacacagccgttttcaggtccaaacagccatcacatcgcacaacttctccaacatcgccatcagaccatggagcgctatctctcctgaactggcaaaggtaggcggcatcggtcggtactccacgagcttcactgtaccgagtgtctctcgcatacgcggcaagctatcgctaggtccgatcattcacactgctcgcgtttatatcggaggacagaggcttcccccaattgacccagtcaacccggtcattgacatatcctcatacatccgtcccggtcagacatataaacttatagtggaagtgacaacaccattatttaatcggatcaagacggatgcgaatcacactaagatcgccgggtcgaccgcggtagagctacagccgttgtatgccagtacgccgtatcaggagtacggcttgatggggccggtggtggtcacttggagcattagcacatga

SEQ ID NO: 10590 - DNA, 204 bp, A.fumigatus
aatagaccctgtgtccaagcggagactcaggcgtacccccaagcagtgagcactccatctttggcattcattagcactctcctaatttgcaaattgacgacagaaatcaattttcaaatttccaggcagcttggtcctcagcagcagaccctccggcctgtaggaaactccagagactccattttctaccttactttaccatag

SEQ ID NO: 10591 - DNA, 699 bp, A.fumigatus
tttccgcagagggtcggccacgaactgacatctgtaagttccgcggctcttctcacccgtccaacttgttctcaatttaatactttgatagatcaaaaggtgcgccttcatttcgcatccgcgagtttggaccgcaccgcaatcaacatagtatactcccacgtgctcaaccctatggtcgtcactcgatcatatatgtgcatcgagccgattgaactgtggcttgaccttcgttctctccgccaagggcttgtttgtcccgtcgatgcagacacagatccgacggcgctgcttgtccaggattcagggatggttccggtaaacacacaagtagctattgtgaatccggaaacctgtaccttgtcacatgtcggcgaatatggcgagatatggattcaatcagacgcctgcgccaaggcgttttatggatccaggaatgattttgatgctgagcgattcaacggccggattgtggatggagaccctaacgttgcctatgtgcgcaccggtgacctgggtttccttcacaccgtcactcggcccatcggtccatcaggtcaacctgtcgagatgcaggtgctctttgtcctgggcggaattggtgaaacattcgaggtcaatggattaaatcatttccccatggacatcgagaactctgtggagaagtgtcatcgcaacgttgtgcctggaggatggtaa

SEQ ID NO: 10592 - DNA, 942 bp, A.fumigatus
cccttgcaatttagttgtgtcttccaggccggtggtttgatagtggttgtcgtcgaagtgacaagaaaagcatacctggcatcccttgtccccgtgatcgtagacgccatcctaggtgagcatcaagtcatagctgacatagtggcgttcgtgtctcacggagacttccctcggtctcgtttgggcgagaagcagagaggaaaggtgttggcatcatgggtaacccgcagattgcgcacgatcgcgcagttcagtattcgtgatatggagggatcaatgaacctctttgcagaagctcctcaccatcgttctagtaaaggctcgaaacccggtagcgtcatgggcaacagcctgcgtcggtccactctcgtaccggaagctgattcagctactgttcctcgttctccagctccagtgcttgtggagcagccgcaagaatcaatggtgccccaataccatgacgtacatgaaagagccggaggtgagatgcttgcgccacctcttccagacgtgcagctgtctcttcctcagatagaggatcctgtcccaccaatgcggtcttcgaataatgaaagtcactcggcaggcattgctcaacctgaccttggtttcaacttcggcgatttcgccaatgcgacaggctctactcccatggatgaacacactggtgcgggggctgtcggtgaaactctaccctaccgcgatgtccgtggacaaggctctattcccacccatcagccgccgagaaccagcagccttccaattggcaccgccccagcatccggtcgacccgactcgtcggaccggttatcagaagacaaaatgggagattggccgcaggaagctctcatgtatcaatcggcgcttgggggtgatgatccatacggtcataatgccgtcgattggactccgggcgatgctacgaggaattaccgtgactga

SEQ ID NO: 10593 - DNA, 261 bp, A.fumigatus
ttaggagctcctacctatcttgtatcacccgttgattttgcgcaaaaccccatgacattgttcgtcgccctgtctcgttataagattaaggatacatatgctacaagccagatgctggactacgctatgagcgtcatgcctgcgaagggctttcaactccaagaaatgaagaacctgatgatttccgcagagggtcggccacgaactgacatctgtaagttccgcggctcttctcacccgtccaacttgttctcaatttaa

SEQ ID NO: 10594 - DNA, 723 bp, A.fumigatus
cttccgccatggtgcgtccagcccaaccaaatcctccatatgctggtgttaccgcaactccgcagcaccctcatcaacaatatcaacaaccatcgcaactacagccacggcccttgcagacgctggagacatcacagacatcacagacatcacagacatcacagacatcacagacagtccctgagcagagatcctcatctcaacccaattctcagaaacaagtacaacctccctctgatccccagcctcggtcgcacccttcgccccaagtacaactgcaagcacagcccccgtcgcagccgcaaccaaagcccggaccctcgattcaaattcgtacaaagacacagccgcctcctaaagcaaagtcgtcaccgcgctcatcaaccaatatggtcgggagaagacctgggcgaccgccagcgagctctaagattgaggttacaataccaatcacttcccagattccgtataaggtctacacgtgtggctgggagaagtgccaagcggagctgcacaatcttgaaatgctcaagaagcacatttttaaaattcacgtgccttacacgctcacgtgtcaatggaaagactgcacatttcgcgagaacctaccggcggtgcaattgtacaagcatgtcctttcagaacatgtggtgtctatcgcatggacgctgggcgatggaccatcagtgcctgcaactggtgagagaatatcgagatgattga

SEQ ID NO: 10595 - DNA, 1638 bp, A.fumigatus
actgtcccctcaattgctccgcagcgccattgtctgcccaacatggcgaacgattacttcgaacggcttcagaatcaccgagagacgggcccttctcagtttcctcagcaaaatcaatatgcctctttccgatcgccgtttcagaggtacccagatgctgtcttggatttgccccctacatatcaaacgccattgagtgacattcaccaaccgtaccattatcaaacacattatgctcctcttgagcaatatgtgaggccgcaagacacaacatattcctcattgactacctatcctttaatcccttatcaaggaggacagcaataccgagcaaacccacctgcgactacacatcaaccacctcctgcccctcctctttcgaccctctcccaacctctaccctggaaccacgctcaaacacaaccgcaaaatactttgtcatatctgaactatccaccttctacgcgcgcggccgaggtcgttgatgttgatgttagtgggcatgatgggaagagacgtcgtcttgaatcatccgcgactgtgaccttgtcgaagccgacgatgccacctcaaggaagactctcgaaatactcatttactccgcaagacaccacggacaggagctatctgaagacgcgtgcggacatagcaaaacctctggatgtgactgacgcggcggaaaagctacaatacgatccgaaaacaattgcccgagatgtcttaattgcatctgggcgccaccctacggaagctcctttgaatcatcatctgttccgccttcgagatgtcttcactgggctcgacactgcttcagatttggaaacctttcgctgggatcttgtagacccggacgacaagcaagccaataatacaaccacagcacgtgacgtacaactgttgtccgcgccagcgcatgtgacttccgccatggtgcgtccagcccaaccaaatcctccatatgctggtgttaccgcaactccgcagcaccctcatcaacaatatcaacaaccatcgcaactacagccacggcccttgcagacgctggagacatcacagacatcacagacatcacagacatcacagacatcacagacagtccctgagcagagatcctcatctcaacccaattctcagaaacaagtacaacctccctctgatccccagcctcggtcgcacccttcgccccaagtacaactgcaagcacagcccccgtcgcagccgcaaccaaagcccggaccctcgattcaaattcgtacaaagacacagccgcctcctaaagcaaagtcgtcaccgcgctcatcaaccaatatggtcgggagaagacctgggcgaccgccagcgagctctaagattgaggttacaataccaatcacttcccagattccgtataaggtctacacgtgtggctgggagaagtgccaagcggagctgcacaatcttgaaatgctcaagaagcacatttttaaaattcacgtgccttacacgctcacgtgtcaatggaaagactgcacatttcgcgagaacctaccggcggtgcaattgtacaagcatgtcctttcagaacatgtggtgtctatcgcatggacgctgggcgatggaccatcagtgcctgcaactggtgagagaatatcgagatga

SEQ ID NO: 10596 - DNA, 390 bp, A.fumigatus
ttgaatttgtgttttttcttttcttttctttttttttgttttgttgcccaatgggttcggtggttaacaactttcatctttacctgccatctagaggaccgtgttgctggcgaaagtcccttgcctaaaacaatcccggagtctacccagccagggggcgaagactctctagtattccctgcaagttacagttcgattcgcgcattcaatcgtgtccatggcaaccatacgcaaatcgagaaagcccgggaaatcttcaaggcagtacagaggctgaaggaacatatcgggtatggattagatcccggtggatgccagctggctacccccacaaggattgggagggtgagcaacgatgaggatgtctatgcagtgaggcatgagtcttag

SEQ ID NO: 10597 - DNA, 243 bp, A.fumigatus
tatcatgattcgagcatgtggagagtgtctgaagccatgctcttgggcccttcgaacaggcttcccggatacctgtcatggaagctggaggaagactcgctcagttcagtgtctcaggtgcaggaatccggcatgatcataattggttctgtctcaagtagcctcgatgactacgacctcgttaggcggacggagccaaacagcttgggaggttgtcaagacagagctatctcaccatcatag

SEQ ID NO: 10598 - DNA, 411 bp, A.fumigatus
ccccctctgcaacggctgccaggaggattcggcgttcacctggctccgcggcgacttccacatgcacaccgtctactcggacggcaagtacacgcccgaccagcagatccacaacgcgctggcccagaatctctccttcatcttcttcagcgaccacaacaccgacaccagcaaccagatcatcggcgcctaccaggcctctctcgccccggatctgctggtcggccgcgccatcgaggttaccacccgctccggccactggcaggccgtcggcctcgaccgcggccagatcatcgagtggcggtacaagccggacgacaaccctggcttcgcggccgccgcgcaccaggtccaccgggtcggtggcttcgtctcagcgaaccacccgtttgcgacgtgccccgcgtgtaa

SEQ ID NO: 10599 - DNA, 1173 bp, A.fumigatus
caaagtagaaacaacttcaccatcacgcccacctgggccacgcccggctacaatcccggcgccatcgagccaggcatctggaacgtcgtgctcggcccatacgaatccgtccccgacggtatcgactggcagctggatatcgaaatgtccttcgaccccgtcgactcgtggttcgccccagactacgccaccaccgaccttgaccccctctgcaacggctgccaggaggattcggcgttcacctggctccgcggcgacttccacatgcacaccgtctactcggacggcaagtacacgcccgaccagcagatccacaacgcgctggcccagaatctctccttcatcttcttcagcgaccacaacaccgacaccagcaaccagatcatcggcgcctaccaggcctctctcgccccggatctgctggtcggccgcgccatcgaggttaccacccgctccggccactggcaggccgtcggcctcgaccgcggccagatcatcgagtggcggtacaagccggacgacaaccctggcttcgcggccgccgcgcaccaggtccaccgggtcggtggcttcgtctcagcgaaccacccgtttgcgacgtgccccgcgtgtaactggagtctcgggtgggaagagaccgacgccgtggaggtgtggaacgcgcagtgggacgagcaggatcaacaggccgtccagaagtggcaggagctgcttgtagatgggaaattcctgaccgctattggaggcagcgattcgcactctccgccgtcgctgaacgggtggccgacgaccatcgtcaaagcgaggggacgcagccaggcggcgattgtggagggcgtcaaggccggccgggcgtatctggttcaaggaccggggatggacctcacgttcgaggtgcgcgttccctcgctggatgcgcctgcgcagattggcgataaggtccggaggactgcggcgggggccaaggcggtcttggtcactgacgggatgtcgaagctcaaggcgtgctttgtctcggacaaggggtacttctacaataccaccattgaagatggagtacgggtcaaaacgggtgtgctgtcgggggcccggtttgtccgggtggaggtccgcaatggcacgacagacgaggtgctggccttgacaaatccggtttggttcttgggtccgtga

SEQ ID NO: 10600 - DNA, 1071 bp, A.fumigatus
  unsure (163),(339): Identity of nucleotide sequences at the above locations are unknown.
aagcaattccccaagatgaagcacatctgttctattgcctggctggttccgcttttggaactggccatcgctgctcgagcaccgataaagaaaaccttgaccggccacattgacccctcgcaggtcttctcctttgtctatgtgccttttgaagtggaagtcngaacaacctccatatatgttgtgcagaactactcgaacaagggacgggggaatgcccttgatcttggcgtcttcgatcagcgaggataccagatgatggacgcacaaagtggcaccacgggctttcgaggctggtctggcggtttcaggtatgtctgcccgagattgtctcttacntggttcctgcttgacaaagtagaaacaacttcaccatcacgcccacctgggccacgcccggctacaatcccggcgccatcgagccaggcatctggaacgtcgtgctcggcccatacgaatccgtccccgacggtatcgactggcagctggatatcgaaatgtccttcgaccccgtcgactcgtggttcgccccagactacgccaccaccgaccttgaccccctctgcaacggctgccaggaggattcggcgttcacctggctccgcggcgacttccacatgcacaccgtctactcggacggcaagtacacgcccgaccagcagatccacaacgcgctggcccagaatctctccttcatcttcttcagcgaccacaacaccgacaccagcaaccagatcatcggcgcctaccaggcctctctcgccccggatctgctggtcggccgcgccatcgaggttaccacccgctccggccactggcaggccgtcggcctcgaccgcggccagatcatcgagtggcggtacaagccggacgacaaccctggcttcgcggccgccgcgcaccaggtccaccgggtcggtggcttcgtctcagcgaaccacccgtttgcgacgtgccccgcgtgtaactggagtctcgggtgggaagagaccgacgccgtggaggtgtggaacgcgcagtgggacgagcaggatcaacaggccgtccagaagtggcaggagctgcttgtag

SEQ ID NO: 10601 - DNA, 207 bp, A.fumigatus
cataccatccataggctagtaaagatatgtcatataaggaaggaatctaaagggaataacactataatcttcacaaagttgcaagaattcaacagtgagatgagagccatggccatcaaatataagtatctgtttctcccccttctttatacactcatttattacattaataaaggtcttcaccacggcctcgacatccgcattacg

SEQ ID NO: 10602 - DNA, 192 bp, A.fumigatus
cgtaatgcggatgtcgaggccgtggtgaagacctttattaatgtaataaatgagtgtataaagaagggggagaaacagatacttatatttgatggccatggctctcatctcactgttgaattcttgcaactttgtgaagattatagtgttattccctttagattccttccttatatgacatatctttactag

SEQ ID NO: 10603 - DNA, 189 bp, A.fumigatus
gaagctgaatatccatatctcaacccctaccccccctccgagccgtgcatcaaccaactcatcttggcttgctacacctcatacacttcggcaattacacaagcaagcatcctcagtcaagaagctcctaaaacaacgatctcaaagccctttgacgccttcaaaattagctatccagcagcttattaa

SEQ ID NO: 10604 - DNA, 252 bp, A.fumigatus
atactatctagggatctgcgcggagtgcctcctaggccatctcatgtgcaggaaatggccaatattctccttcaaacagataatccctctggattcaaacctattggcaagaactgggtgtctacctttatcaaacgacgtgacgagatcaaaactcaatatgctcgacgatacaattatagtcgagctcaatgcgaggatccaaaggttattaaagggtggtttaactgcctacaacagatccaaatgtaa

SEQ ID NO: 10605 - DNA, 873 bp, A.fumigatus
aaggtctttattcctgcaacagctagccgtacggttggaagatatcgtctactcattctagatggccatgggagccatctaacgcctggttttgataaggcctgcagggataatgatattatcgccatctgcatgcctgctcattcttctcatctcttgcaaccactagatgttggttgttttggccctttaaagcgtgcttatggaggccttgttgagcaaaagatgcgcttaggatacaaccatattaataagtttgacttccttaaagcatatccagcagctcatctagaggtctttacacctctaaatatccaaaatggcttcgcggcagctggaattcaccctttaaagccagagagggtgcttgagaagctgaatatccatatctcaacccctaccccccctccgagccgtgcatcaaccaactcatcttggcttgctacacctcatacacttcggcaattacacaagcaagcatcctcagtcaagaagctcctaaaacaacgatctcaaagccctttgacgccttcaaaattagctatccagcagcttattaagggttgcgagatggctatgcataatgccgccctactagcaaaggaaaatcatgatctacgcgcagccaatgagaaggagaagcagaaaaggaagcaatctagacgtcagatgactcctaatgaaggactcagtatacaggaagctagggatctcatccaggcgagaaatgagcaagggaatgaggttgaggggtcatcaattgattctgcgcctttacctttagaaccaccaaaacgcgcgccaccaaggtgttcaaattgctttattatagggcatacgagagttagatgccctacacgcaatactagctag

SEQ ID NO: 10606 - DNA, 2259 bp, A.fumigatus
aaaaaagacactgaacggcctagcgaccttgtcaaatccgccacagccagacatagaaagggtaatcatgcgacaccaatagtccagattgagagtaatgaaccatcaaaatctgcaaaccccacaactaaagcatcggcgaagcagtctccagggttaaaacatgagcatttcccatctaaggatgaaccccctgttcctgagcctgttgataagatgctttgtcgcttccaaggccagagagggaaagaataccattctgctcaaaacaaacgcaggaagcttgacgtctcccagaaaaaacaaggtctggaccaagatgtctcacatctgctgcaagattctagttctcggatagcaccaagagacaagagagatttgagtgcagtcacagacatgagttacacagacgaaaagcgctttgtcgatcagagtgacctcaagctacaaattggtggtcagaatctccagcaagcgaaatcttatggtagttctgggagaaacaaagtatctactgccatgccttatttgcagtcaacccatatggagcagacgaaatctaagaacaaaacactctcaatcgccgcagactttgctacttcacgctctcaatttcaatctaattcgaaggcagagaccagcacacaagtaactgcacgaaggcgattagtggattcacttggccccctggagccgacagtcgaagatgcagtgcgagcatccagaaccaacgacgacaccgaagtcgacccgcttccccgccacagccctcgtagagactcttcatcaaactctcagccacaaacgagttctcggcctgttaagctggtgactgacagtgcaaacaagggcactgctgaaacatctggcccagtctcatccagagtgggaggctgtaaggtcacttacgcgcgacagcggtctttcttggatgacacgtctattgttgacagtcgtcgtccttccgaaacactggcttcaacagcggacagctttgttcaagggcaccgaaaatacggaccccagattctctccaatcatgcgtcgcatcttggtgacggagaaacaagcgacagcggtcctgttcgtgggattcacgagcttaggcaagctggagacaactcccgctttcgaagcgcgattgaattaatatttgaagacattgaggatgcatacaataccacatctggtagatgcagtagttttgtccagatatgtgaaaagctactggaccgtcagtttgtccgacgcttcctcgaacatggcttccacgaacgactcgtcgggtgcatagatgatcgccttgatgtggtatctgcatcgttcgccctttgcgcatgcggattgatcaatctatgcgacaagttatctcacatctcattaatcagccactggtcgaatgtgctggttctatctcctgtgctactgcccgtgaaacgtgatcttttgtctctgtcacaatcaccagctactgggttatcaagatcggtacaaatgtccatcaagcaagttttaccacgtttatcttctagcatcagtggagacgagccggctttcgaattatcgcctcaattcgtggctcttagtagcatccagtcttgcctagtaagtttgaacaataagggcggcagcattgaacccattccggcgactttgtcagaccacattgtcaaattgttactcccagaaagaggcaagactatcaaacttcctgtatcgcgggaaaggttcaagacactggccttgattttctcgatactggagtcttacgcgatcgtattcagcgcagcagaccacgatcagaactacctgtctctgagaacactttctcggcttcatgaaattctcaatctgagccagtgcaaccagggtaggcaacttcgcatgtactatattcgagcaatattgaacctcaccaataacgaccccaacctctgtaacgaatatgcaacaccagagctggtgatgggattggtcaacatcgtgatgtcagatattcgcgacgcatccgacaatagttctacaggggacgacagctccttgaacacattaatcttggtcttgggggtacttatcaatatgacagagaaaagcgagtcagcgagggatcttttccttcgcctgactctcgattcgacacctttaatccaatcacttttggaacgattttacgaaatggtgaattcggtcagcgaggtatggaaaagaagcaaacaacatgtcgctttcaaatttgttcttctaataacaatgtcatag

SEQ ID NO: 10607 - DNA, 372 bp, A.fumigatus
acgatggcgtcctctcaacgccagtacaatactctcccaagttccgggagtattgctgcgcctccgttatcggagaacggttcgaatgtttacgaagatgacatccgcagaccattgctgggctcttcatcgtcgacagatctagatggcaacggcaagaaaggttcccagtcatggctacgagctgtatacggggaagggaaagagatttggctccagggtaagggcatgattctggtgacgttggcgcagttctttggtgcttctatgaatgtcatgacccagatcctcgagcttgacagcgggttacatcctttccaggttggttctatctcagcaacgtctgcggggtgctctgcaacgcattgctga

SEQ ID NO: 10608 - DNA, 963 bp, A.fumigatus
atcctgtttgcccgcatgtcggtcactgtcgtggcaagctacctctacatgtggtataccaaggttccacatccttttgggactcgtcctgtgctgggcctgctgatcttccgggccatgggcggtttcttcggggtctacagcatctactacgcggtccagtatctacctctgtccgaggccaccgtcctgacctttttggcacccatcctctgctgctacgcctgttctctctttattcccaacgagacattcacccgcaggcagcagctggccgctctggtttccatggtaggcgttgtgctgatcgcgcgccccttctcgtcgtcagcaatgcctcccaacccggaaaagctagaagggcggaagcccggcaccacggatgaatttcagcatatcgtggcaattttggcgatgatggtgggagtcctcgggtcaacatgtgcgtacacgtcgatccgcatcatcggccagcggtgccatcccttggtctcggtcacgtatttctcactgttcactaccgttatgtcattcctggccatgttgctggtcccttccgtgccgttcaagttgcctgaaactggcttggaatggacgttgattgtgggacttggggtttgtggtttcttgctgcagttcctgctgaccgctggattgtcatacgtgccgccccctccgagaagatctcagagggtctctggaggagcaggcagtgagtgtaagccggcgagatcctcctctggatcacgtgccacctctatgatctacacgcagatgttatttgcactgttttatgacaaggtggtctggggtaacacactttctcctttgagctgggcaggctcggcgttgattgtgggaagcgcactgtatgtggccttggtgcgtgacggcaagaagaatgctgccgcagcagttgcagttgacgagactgcagaagaagagagggaaccggtggcttga

SEQ ID NO: 10609 - DNA, 222 bp, A.fumigatus
cttccgcacgcgtgtcgttccagccccgtggtgaagatatctatccaggaagggcaggagatcattcaacgcagggatcaggctgctgaagctatcccaactatccctccagagcaggtagtagatacagaacaacgccctcaacgggcacccccacgctgcagtgactgccatattctaggccataggcgattgcaatgtccgcagcgcaagaataactag

SEQ ID NO: 10610 - DNA, 186 bp, A.fumigatus
aatttggccgcggccgaaattggaggctattttgaacccctaaaacatgattttattactaaatctagttattcttgcgctgcggacattgcaatcgcctatggcctagaatatggcagtcactgcagcgtgggggtgcccgttgagggcgttgttctgtatctactacctgctctggagggatag

SEQ ID NO: 10611 - DNA, 1167 bp, A.fumigatus
gttacatactattttcgtcccgtcttgttagaagacccctctggaaaccgtcctttctaccgttgcgttctcaccgatcgtctttttcttgtcagatttcccgcctcttcggacactccagattcccctccgctctcggaccatccaatatcacccttgcttctatatccctccggtttttcaaagttcgatcagaacagtgagaacaatcagtcaaccgagatggttcggaatattgttgttatcgggggcacctcccacccccagttgactcagacgatctgcaacgtcttgggtatcccccctgccgatgtattactttccaagttcgcagtgggggaaactcgggttgaaatcaaagagtctgtccgtgagaaagacgtctatatcattcaatctggcgggttgaaagtgaatgactccctcatggaactgctcatcaccatttctgcctgtaagactgcctctgccaagagagtcaccgctgtcctcccgttgttcccatactctcgccaaagtgatatcccatacaacaaggctggggcacctcttgtcaaatcatccaacgctgcaaagccgggtaatggctacactttcgagagcaccccgccaaccccgcaccctggaaaaccggagagtggaggtctcttgaacaatgtcgatagcttgcaaaagggtttggcaaatgcgcaacttgatgattacaacaatggcagcccagttaagaaacgcattcctaatggacctcctcgcagcgacaccactgagtcactgaagtcggatgttggccttcgatccactgttgtcaatggtcaggcaaatgacgaaaatattcagtccaagatcagcagcttccggcctcgccctggctacaagcaatgggtggctcaggcaggtaccctggtggcggatcttcttacctgcgccggtgcagaccacattatcacgatggatctgcacgaccctcaatatcaagggttcttcgacatcccggtcgacaacttgtacggcagacctttgctcaagagctatatccagcagaatattccgaactacaaacatgcggtcattgtcagtcctgatgccggaggtgccaagcgagcaaccgcgattgcggattctatgggaatggaatttgctctcattcacaaggtaccgttcacttaa

SEQ ID NO: 10612 - DNA, 366 bp, A.fumigatus
gaacgacgcccaacgaaaattacagaccgccaaaatgctaccatgatgttggtcggtgatgtcaaggatcggacgacgattttgattgatgaccttgccgacacatctaacaccatcacgagggctgcaaaactgttgaagaaggagggcgcatcccaggtttatgccttagtcacgcatggtatcctgagcggtgatgcgatcgaccgcatcaacgctagcgctctcgacaaggtcgtcgttaccaacagcgtcgatcagtcggaccacttacgccgatgccccaagctggaagtgttggaagttggccatgtcttcgcggaggtaagccggttctcttttctaactaatacgaatatgtcctaa

SEQ ID NO: 10613 - DNA, 471 bp, A.fumigatus
aaccaggcggaccatgaagaagaggaggaggaggaggagcatcatattctgagcccattggccgccaccattgctctggttgtcgtcacgattcttgtcgccatctgtgccgactacctggttggaagcatcgacagcatcgtggagaagaccagcatgagccggactttcatcggtctcatcttgatccccattgttggaaatgctgcagagcatgtcaccgccgtcgtcgtcgcgtggaaaggaaagatggatctggctatcggtgtagccgtcggcagtagcttgcagatcgcattgttcgtgacaccgttccttgtcatcatgggctggatcctaaacgttgagatgactctcaacttccacatctttgaaactgtcgccttctttatctccagcttggttgtgaccttcctcatccaagatggcaagtcgaattatctcgagggtggactttgcttgggaatgtaa

SEQ ID NO: 10614 - DNA, 417 bp, A.fumigatus
gacggagggacgttgactgatgggatagagctcgcctacgtgatccgacgtgtggaacccaataatagtccgacggataaaggagtgtgtccatggtcgatacgtcaaacgggagtttaccacaaaatgttatatcccaaccaacatagtcaaaactcattacgcagcacgtctgtcttcatcctcattgctccttcgcatgcggtggaaaaatctatcccgtaccgtctctccgaaaacgtgtcacaggatgacacatttcgccaggattttcttatccatgaatacatcgtcggtgacagtttgaaaggctggatggactatcaggcctggctagaggccgagtccaaacaaatagtatgctgttggcttctactacgtattatcagaagccaatattacaaggagcgacactga

SEQ ID NO: 10615 - DNA, 273 bp, A.fumigatus
caggtgttcaactacctcgtcggttccctttctcgaatctttaccacgttgcaagaagtcgacgacaagctcattctttatgggttcattgctgggtttgtcctgaacgttatcctggcggcacagatggtctactactggaagagccccgcgcagcccaaaaagcgacctgctcgagcctctaggccactggaaaagattcctgctgctgaaagcacaggagtatcgaccaagccctcggccaagtcgcccaccacacgcagacggggttag

SEQ ID NO: 10616 - DNA, 285 bp, A.fumigatus
agttcccaccccagttcctcctcctcgcctcctggttcgcctcgacaggcgcccaatcccacagctccgccagcgcactctcactcaacgcaccccggtcctcaagcgcggacgcccccgcccgccgaccgcgcgatacccagtcctcaacccttggatcaagtttcgtgcgcaggagttgctccagtgtcggggcctgcgtgcggccggggtacgaggggcccgggtaggcgacgagcgcggagaggaggtctttgttatcggcgagatgctcggagatgctga

SEQ ID NO: 10617 - DNA, 639 bp, A.fumigatus
agcaggtcctcgctccaatcccaagcaggcatcatctcaaataacctcgtcagcatctccgagcatctcgccgataacaaagacctcctctccgcgctcgtcgcctacccgggcccctcgtaccccggccgcacgcaggccccgacactggagcaactcctgcgcacgaaacttgatccaagggttgaggactgggtatcgcgcggtcggcgggcgggggcgtccgcgcttgaggaccggggtgcgttgagtgagagtgcgctggcggagctgtgggattgggcgcctgtcgaggcgaaccaggaggcgaggaggaggaactggggtgggaactttacgttggaagagagggagatggggattcagaatgtcgttactgggttgaggaggcagttggaggatgaggatgaggaggcgagtgaaagtgaggaggagggggagggggagggggaggaggaggagatggaggttgttggggtacgacgtaggtctggtgcgggcgctggattggaatttgatattgcggcgcctgcgccggggtcacggcagcagcagcagcagaaagcagctgggcctgcggttcctttggaggatattctacggtatatgactacgggaataccgccgacgcagcgctga

SEQ ID NO: 10618 - DNA, 315 bp, A.fumigatus
ctgtgggggtgccgaatcgccaaccttccagctattcggcctacttattcgctgtctgctggcacctctccgtcaccgtcccagccgctttacctcaacagcatcgcggctcagtccgaacttctaattcaaagcaagatggcatccctaaaccaagaccaaatcaaaatcctcgaacaatcccgccaacggctcgtccagctcacccgctccctagcctctctaatcggcagcttaaaccaaagcgaaccgcttccatcatggtttaaccccaccccagctcaaacaaccgcatccaagggcaaaatttgctaa

SEQ ID NO: 10619 - DNA, 1203 bp, A.fumigatus
  unsure (1202),(1203): Identity of nucleotide sequences at the above locations are unknown.
ccccccagaattccccaccaaaagaaatttccccggttaatctgcgcaagctcggaattttgttggaacttggagcggggaacacaaaatcaacttgtcttctatatgggtccttttggtccgatacccgtggctcgtatcggcatctattgcaacgatgcctctggaatcagaactagggattcaactgaccgaaggagaggggtcgagcgcatccgatggcgacatagcgttcatcaggcgtggcttcggggaagtacaagcggtccggcaaggcctgtaccagcggcacctccagatgattgccctggctggcacaattggcaccgggctcttcctcagctccgggcaagcacttgtaatggggggccccctgggtgcatttctggcctatacaattgttggccttggggtttcgagcgtcgtcctgactgtcggagagatgggtgcgttggttcccctgagcggcgggctcgtccgatatgcggaatacttcttcgacccggccatggcctttgccaacggatggaatcaagtctacttatacacagtcactatccctgcggaaatcgtggcagcctcagtgctggttcaattctggatcaccgtcaacaacgccatctggattaccgtcttcagcttgctggtgctgattacggcgctggtgttcgtccgaatctatggggagctggaatttgcattcgccatcttgaaaatcctgctcatcattggggtgaacatcatggcgctggtgattacttgcggcggaggaccggatggacaatcgattggtttcagatactggagagacccagggccttttgttcagtaccttgggatcaaaggctcccttggccagttccttggtttctggacatgtctcaacaatgccgtcttctcgtactcgggaatccagaatatcacgatccccgcggccgagaccaggtccgcccgacggtccatcccagaagcaacccggcgcgtcttggtacgtatcttcctctgccatgttctaacgatctttatgattggcctgggtcgtccctccgaacgattcccctcttctgccaattgatgggacgggctctcactccccatttgttaatggttgcttccccgggcagggatcaagacggcaccctcgatcatcaacgttattatcctgacttccgcgtggttccgcggggaattcaaatatcttnn

SEQ ID NO: 10620 - DNA, 1035 bp, A.fumigatus
tctgcgcaagctcggaattttgttggaacttggagcggggaacacaaaatcaacttgtcttctatatgggtccttttggtccgatacccgtggctcgtatcggcatctattgcaacgatgcctctggaatcagaactagggattcaactgaccgaaggagaggggtcgagcgcatccgatggcgacatagcgttcatcaggcgtggcttcggggaagtacaagcggtccggcaaggcctgtaccagcggcacctccagatgattgccctggctggcacaattggcaccgggctcttcctcagctccgggcaagcacttgtaatggggggccccctgggtgcatttctggcctatacaattgttggccttggggtttcgagcgtcgtcctgactgtcggagagatgggtgcgttggttcccctgagcggcgggctcgtccgatatgcggaatacttcttcgacccggccatggcctttgccaacggatggaatcaagtctacttatacacagtcactatccctgcggaaatcgtggcagcctcagtgctggttcaattctggatcaccgtcaacaacgccatctggattaccgtcttcagcttgctggtgctgattacggcgctggtgttcgtccgaatctatggggagctggaatttgcattcgccatcttgaaaatcctgctcatcattggggtgaacatcatggcgctggtgattacttgcggcggaggaccggatggacaatcgattggtttcagatactggagagacccagggccttttgttcagtaccttgggatcaaaggctcccttggccagttccttggtttctggacatgtctcaacaatgccgtcttctcgtactcgggaatccagaatatcacgatccccgcggccgagaccaggtccgcccgacggtccatcccagaagcaacccggcgcgtcttggtacgtatcttcctctgccatgttctaacgatctttatgattggcctgggtcgtccctccgaacgattcccctcttctgccaattga

SEQ ID NO: 10621 - DNA, 207 bp, A.fumigatus
ctttaccgtccgtcaagatctcctcctcagcttatagtcagccagctagacgaagctgtgcgttacagtggcatgtcaaaatctaatattatggagattggagcttacagatacattcgtgtatatttggagaaattctccttgagataccctgatattattattattgatggaggtaccgagtctccgacagattcaaatctgtag

SEQ ID NO: 10622 - DNA, 630 bp, A.fumigatus
  unsure (36),(37),(74): Identity of nucleotide sequences at the above locations are unknown.
cttccgcgtggttccgcggggaattcaaatatcttnntcgcatcccggattctttatggcatggcggtccatgnccatgcgcatgccgtgttcgagaggctgaatcggttctctgtcccttatgtggccattagctgtatcgggttcttcatgagcttgggatatatgtctctcaccgagtcatccaccattgtcttccgatggctgcgtgatgtcgtgtcagtcgccacattagtggactggatcatcgtctgcatcgtctacctccgattttactacggttgcaagaagcaaggcgtcgaccgacacaaggagcttccatgggctgcaccgttccagccctactttacctgggcatcgctgatccttttcgccctcttgcttattaccggtggctatagcactttcattcacggccactgggataccgaaacctttgtctcatcgtacatcaacatcccgattgtcctcggtctctattacggctacaaattctggaagaaaacgcacatcgtcacgttggagaatatgccgctggtcggtctactccagttctatctaagccaggatgaagacgaaccggaaccacggcctaggaaggggctcgccaagttgaacattctctggtag

SEQ ID NO: 10623 - DNA, 189 bp, A.fumigatus
aaagtattacctcggtttcatgttgataggttctcattagtccgagtctttcgtgagacaggtccgctgttgtcctgtccttgggaaataagctataactcccccgagactgtcataaagcaatcttgcattttcacctatatgaggtataactttaccgtccgtcaagatctcctcctcagcttatag

SEQ ID NO: 10624 - DNA, 387 bp, A.fumigatus
  unsure (191): Identity of nucleotide sequences at the above locations are unknown.
tgcgacgaagtaaagcccaattgcggcaactgtctgcgtcactccattgagtgtgactatacattgaacacagaaggaacttccaccccatccacagaggaagagaatcggactcctacatcactcaatgacaactacaccttcatttcctcgtctcagtccaatttcactcccccaaggagaaggcgtanctcacgtccgctcccaacgcaagaagatatcgagccaaagccccagttgcatctaccggttggcaaaaaactgttccagttcacaaccaacgacatgggactcttccatcattttatcacctcggccgaactgggaaggatcttcaaaacacttgcagaaccaactgtctccactaaggattcacctcccattatg

SEQ ID NO: 10625 - DNA, 213 bp, A.fumigatus
agctctatccacgtgcttacggtgcttaccgtgattaactttctccaaggatcatcccttgcagctgacactgttggtcacattattacctacgaggtagttactctgggtacctatctgctctacacacataataaaatagtactcgcgagggtaggcagcaggcgctcctgtcatctatgcacagaagtcctgaattcgatcattcactga

SEQ ID NO: 10626 - DNA, 207 bp, A.fumigatus
ctccatgctgtccgtccttgtctcgatcactttctcttttatcattgtatagattgctcgttttctgtttctggacaaactaagccttccctttttcctgtgaacttccccctttacagtcgtcgtcaagacttcgcacttgtgcgattgaacgccgtaaagctctcccctccctcctttggccttgaaacaacttatgtcttctga

SEQ ID NO: 10627 - DNA, 513 bp, A.fumigatus
atgacggcccttcagactgcacgcattaccctcgctggtgaacagcttggattcatgaatgtttccaatgctggtagcactgtattcaactggttcctgaatatctccggcgtggcaggctggattacatgggcatctttgaatgcttgtcatattgcgtttatgcgggctctaaaggctcgcaacatttctcgtgacctccttccctacaaggcattgtggcagccatggtatgcctactatggcttgttctttaacgtcctgattatcctcacacaaggattcactgcctggattccaactttcagcgtcaccgattttttcgtcgcctacctcagtgtgatccttttcgttgtgctctacttgggccacaagatcatcttccgaccagcatttgtgcgaccaatcgaagcagatatcgatactggccgtgtcgctttggaaaatgagatgtgggagacagtcactcccaccaagtggtataagaagttgggcagcgcgattctgggatag

SEQ ID NO: 10628 - DNA, 336 bp, A.fumigatus
ctgcgacgctttgcttggccattcagctgctcggcaatctccaagccccagtctggagtcctacctaactcaggtaactaccccatcccgaggggcgatttggcagactttccctggcccggagtggcagggaaccccagtggcttttttttttctccagatatttatttctctatccgtcggacaggcaagagaaaggaaagaacaagactcgcacgaagacgtcgctttgtactcataaggagtttggccagcttccccctctcccctttcacttaccctgactccatgctgtccgtccttgtctcgatcactttctcttttatcattgtatag

SEQ ID NO: 10629 - DNA, 447 bp, A.fumigatus
tctcggggacgactactgcgtggtggtgtgcgtgtagtgacaagggaggaagagcgcccaaccttcgcgagatgcgccgggaatcataaagggcccgtttactccccgttcaaccctcgcggaagtgttaaaccaccccaatactcgccgcatcagccgggtccgcaccaaccgcatcgttcgccagcaccgtcgtgcccacttggttcccaaacgccgcgacccccgtccccaccaccggcgccacggtccacaccccttgcgtcgcgtgcgccgtgcacaccaggaagacgaccatcccggcaatggtcagcaggaacccgagatagctcagccagaggcggaattccggcggcgggcggcgggagatgcggcgcgcgcggaaggccatccaggagtcggaggcgtggccgccgagctgctcgcccaggagggagccgacgatga

SEQ ID NO: 10630 - DNA, 198 bp, A.fumigatus
accaccccaatactcgccgcatcagccgggtccgcaccaaccgcatcgttcgccagcaccgtcgtgcccacttggttcccaaacgccgcgacccccgtccccaccaccggcgccacggtccacaccccttgcgtcgcgtgcgccgtgcacaccaggaagacgaccatcccggcaatggtcagcaggaacccgagatag

SEQ ID NO: 10631 - DNA, 411 bp, A.fumigatus
  unsure (27): Identity of nucleotide sequences at the above locations are unknown.
cacgagattcacaacgggcgaggcttnttcgtcttccgcggcctcgacgtcgatcggtactcccgcgcagacgacatcctcatttacccgggcgtatcctcgcatattggaagcatccgcggccggcagcaggaccaacgacaagcagacgggacgtcagtcgtgctcgcacatatcaaggacctgactcgcaccgatcaagcaggcaacatcggcgggcccggcagcacagccgacaagcaagtcttccacaccgacgccggcgacatcgtctcgctgttctgtctcgagacagcggccgagggcggcgaaagccagatctccagtagctggctggtgtacaacatcctcgccaaggaacgaccggatttgatctggacgttggcaacggactggccggtggatgggtga

SEQ ID NO: 10632 - DNA, 630 bp, A.fumigatus
agaaaacagagaatagccaacctcgtcctggtggcattccacgccttcatgggcaccttcattgcagccggcatcatcgccgcgtacgaagacatcgcggtcgacctggatgtgtccatccaaaaagtcagctacctcacctccttgcagatcgctatactgggcggcggcccgctggtctggaaaccgctctcgcagcgcttcggacggcggccgatcttccttgtctcgctggtgctcagctgcgtgtgtaatatcgggtgcgccacgagtccgggttatgcgtcgatggcggcgtgtcgggcgctcgctgcgttcttcatctgccctgcgatggcgattgggagtgcggtcgttgcggaaacgttcttcaagcgcgagagagcaaggtatatgggtgtctggacggtcatggtcacgctgggggtgccgactgggccgttcatttttgggtttgttgcgcagcgcgtgggatatcggtggatatactggattttggcaattgtacatacattctctactaaccctacgtatgagccaccactgacagaagcgtatagaccaacgccgtccagttcatcctctacctcttcctcggccctgagacccgctacatcggcaccgacatga

SEQ ID NO: 10633 - DNA, 531 bp, A.fumigatus
ccaacctcgtcctggtggcattccacgccttcatgggcaccttcattgcagccggcatcatcgccgcgtacgaagacatcgcggtcgacctggatgtgtccatccaaaaagtcagctacctcacctccttgcagatcgctatactgggcggcggcccgctggtctggaaaccgctctcgcagcgcttcggacggcggccgatcttccttgtctcgctggtgctcagctgcgtgtgtaatatcgggtgcgccacgagtccgggttatgcgtcgatggcggcgtgtcgggcgctcgctgcgttcttcatctgccctgcgatggcgattgggagtgcggtcgttgcggaaacgttcttcaagcgcgagagagcaaggtatatgggtgtctggacggtcatggtcacgctgggggtgccgactgggccgttcatttttgggtttgttgcgcagcgcgtgggatatcggtggatatactggattttggcaattgtacatacattctctactaaccctacgtatgagccaccactga

SEQ ID NO: 10634 - DNA, 570 bp, A.fumigatus
gacccgctacatcggcaccgacatgacctcccaaaccacctcggccttccaacgggaatacctgtctctccggcgcatcgatcccaccccctttacgctccacgaattctaccacccgctcacgctcttcaccaacatccccgtcctcaccgccgcgtgcgcctacgccatggtcttcctcttcggcagcgtcctcaactccgtcgaagtgccccagctgctccaatccaagttctccctcaacgcgcagcagctcggcctgcagttcctcgggctcatcgtcggctccctcctgggcgagcagctcggcggccacgcctccgactcctggatggccttccgcgcgcgccgcatctcccgccgcccgccgccggaattccgcctctggctgagctatctcgggttcctgctgaccattgccgggatggtcgtcttcctggtgtgcacggcgcacgcgacgcaaggggtgtggaccgtggcgccggtggtggggacgggggtcgcggcgtttgggaaccaagtgggcacgacggtgctggcgaacgatgcggttggtgcggacccggctga

SEQ ID NO: 10635 - DNA, 285 bp, A.fumigatus
aatcaagatagcaagatgggggaaattcagacacttcgtcagcctgatatccagtatcatccagactacgaaaagtatctcgcgcgcgtgcagcgtcgcaaggcaaccgaggatctgcccacgtctcttcctccgggcttccccgagaagctttcttctcctcttgtctgggagggcaaggagatagaaaaacagaatgactggatctataagcttgatgacgcgcagcgagaggagatccacgctgcgttgtctcacttcaagggtaagttgccgaaccggtga

SEQ ID NO: 10636 - DNA, 432 bp, A.fumigatus
  unsure (130): Identity of nucleotide sequences at the above locations are unknown.
cagggcatgactaacgtccacagccctgaacctcgaacccggctacatcagtcaagagacattccccctcccaactctccatcctatactgcgggaactatagcacgagattcacaacgggcgaggcttnttcgtcttccgcggcctcgacgtcgatcggtactcccgcgcagacgacatcctcatttacccgggcgtatcctcgcatattggaagcatccgcggccggcagcaggaccaacgacaagcagacgggacgtcagtcgtgctcgcacatatcaaggacctgactcgcaccgatcaagcaggcaacatcggcgggcccggcagcacagccgacaagcaagtcttccacaccgacgccggcgacatcgtctcgctgttctgtctcgagacagcggccgagggcggcgaaagccagatctccagtag

SEQ ID NO: 10637 - DNA, 438 bp, A.fumigatus
  unsure (346): Identity of nucleotide sequences at the above locations are unknown.
ctggctggtgtacaacatcctcgccaaggaacgaccggatttgatctggacgttggcaacggactggccggtggatgggtgagtgtgcgtcttctcccccagttactctcctgcttaccgcgtagcttcaataaccccgagcgcccgtatacattgcgtcccttgctctaccaccaggacgcaacggcatcaacacccgagcgcgtcctcatccaatacgcccgccgttacttcactggcttcctcgcccagcctcgctcggcgaatatcccgcccatcaccgaggcgcaggccgaagcgcttgaacgcggtgaattttcttggccggaggagcacagcgccgcgntggatttccagaagggagacgtgcagtatatcataaacctgagtattttccatgctcgcaaggggttccgggatgggccgggaaaagagtaa

SEQ ID NO: 10638 - DNA, 639 bp, A.fumigatus
accaacgccgtccagttcatcctctacctcttcctcggccctgagacccgctacatcggcaccgacatgacctcccaaaccacctcggccttccaacgggaatacctgtctctccggcgcatcgatcccaccccctttacgctccacgaattctaccacccgctcacgctcttcaccaacatccccgtcctcaccgccgcgtgcgcctacgccatggtcttcctcttcggcagcgtcctcaactccgtcgaagtgccccagctgctccaatccaagttctccctcaacgcgcagcagctcggcctgcagttcctcgggctcatcgtcggctccctcctgggcgagcagctcggcggccacgcctccgactcctggatggccttccgcgcgcgccgcatctcccgccgcccgccgccggaattccgcctctggctgagctatctcgggttcctgctgaccattgccgggatggtcgtcttcctggtgtgcacggcgcacgcgacgcaaggggtgtggaccgtggcgccggtggtggggacgggggtcgcggcgtttgggaaccaagtgggcacgacggtgctggcgaacgatgcggttggtgcggacccggctgatgcggcgagtattggggtggtttaa

SEQ ID NO: 10639 - DNA, 273 bp, A.fumigatus
agatgtcttggagaatcttccacaattcgcgacggccctgcgacaactggcatcgtattcaagggcgacatggcggagaacgaagcttttcgtttgagagacatggcctcctcgtgcgctacaaacaatgatacagaagtcaacgtcatcaaagtctccgcgctaccaatcggccggttccgcaaatggcgaatttgtagaacaatggagaagcagtatgacgaagaaattcacggtagcgcgagttcattcgcagaagaacgcagaagataa

SEQ ID NO: 10640 - DNA, 417 bp, A.fumigatus
caagggaccttttcgcgaaatcacaggtcgtcattgtccagcctaacgacactggctccaaggcgcaccccttcccctacgccatccgtcgccggtatcgagcgctaccccctcaaggtcacccgccgcatgggcaagaagatggtcgagaagcgcagccgcatcaagcctttcatcaagattgtcaactacaaccacttgatgcccacccgttacactcttgagcttgagggcctcaagggtgccatcagccaggagaccttcaaggaagtctccacacgcgaggacgccaagaaaaccgtcaagaaagccctcgaggacagatacaccagcggcaagaacagatggttctttactcctctgcgtacgtgcaatctttgcctatttttaccttgctgtgagagggttttgtgctaa

SEQ ID NO: 10641 - DNA, 414 bp, A.fumigatus
gaaggtacgacaaagccttttcttttcctacgtgttctagcgaaaatttggatgagggtggagggtctggttcgacacttttcgatggtcgacgttgagaggaagaatgagagagacgttctggacgaattggggaagagagagatcggtttggggcgggatcatttggatattgagaaggatgtgctgacaagggaccttttcgcgaaatcacaggtcgtcattgtccagcctaacgacactggctccaaggcgcaccccttcccctacgccatccgtcgccggtatcgagcgctaccccctcaaggtcacccgccgcatgggcaagaagatggtcgagaagcgcagccgcatcaagcctttcatcaagattgtcaactacaaccacttgatgcccacccgttacactcttga

SEQ ID NO: 10642 - DNA, 1047 bp, A.fumigatus
gaaccccgacgcacttctttatttaacgagagactaatactcagcagcgaaaagtcccgcatccctgcatggtgcgatagaattctgtggaaaggatcaaatatacatcagttgcattacgactctgcctgtttacaatgctcagatcatcgccctgtgtgggcagttttctcctgtgacatcaattttgttgatgatcacctaagagaaaatatcaggagcatgatctacgcaatggaggtaggggattcacccgagacaccggcaaagtcaaagacccaagcaaaagtgcgtaagcgagagtcagccgaactggactttcatacacttgaccttccatcagccagctcagacgatcggagatggtggttggacaatggtatgacttcccaaatcttgaatcggctcctagaaaatatcttcgtgtctggctactctaaccactcatacgtggcaggtatgccggtgaaatcaattatacaacccccttcaaatggatggtcactgaacatgaatcgcgagtccaacccattttcttcaagtaatgcccctgattgggtacctgcaagaagattaacggacagtcaaaaggctgtggttgataacatagatcccatcacatacaagcctccattgcccccacgcggtgggaatggagctgcggattcttcggatttaatttacgaaactgacatgcaatcttccagagcaaatggggcaaaaaaagcaccaccaatccctcgaaaacctgttgctttacgcaacgatcataaggccttgtctggccaagctggatggcagtccggtatgaaagcactggggagcgttccgtcgcagccaagtaatcgacttgacgttccgaggttcgatttgggcgaccaaattaaacctccacctgctgtgcacagggttccaggtagtcaagactctctaagcgttggatccaggcaccttggtggatttgagcgtcatacagacatcaccaaggacctacttgatggtgaggtagactcagaaatcaagtgggagcccttgttaccaaaatga

SEQ ID NO: 10643 - DNA, 555 bp, A.fumigatus
gctttactgcaatctgctgacccttccacccccgtggtgaagacccggatcgcccgaggtttcttccagccgggcaaagtcaaaccagacatcgtagttccgggggttctccttgagctgttcctcgtattgcacccggcgcttggacagaatcacatcctcaacgccctctcggtcaccaaactgcttctcaaatgtcgtgtaggccttgtgaagcgccatcgccttggaacggggcagccggtccaaggcgtatttgtagattgctcgcgcccgctcatactccttgagctttgcctcgaatttcgcgtacgcgatgaagagcttctcgtccataaaatcctcacccagggtctcgattgccatcccgtacacttcccgcaccaggtcactcgtcccgtactcctcctcaaaccgggcccatttgatccagttccttggctccgggtggacgatcgtaaaccgctggaagattgcgcgcgcgcgctcaaactcattgtaccgcttctcaagcttgatatacgcactccacgcgccctcgtccggctcccatga

SEQ ID NO: 10644 - DNA, 441 bp, A.fumigatus
catccaccgctcaaacacctgccgcgttccctggatattccccagcgtctcctccatgtacacgtacttgtaccagaacttgtccacgcggggcaggatggtgaccgcccggtccagcaagttcctcgcatggttgatgttgcgattccgcatttccgactcgatataccggatccagagtaccaccgaggtcgggttgacgtccagcgcccgttcgaagatcgatcgcgcccggcgaaattccttctgctccagctcccaagatgcataccgcatccagttgttcatgttcagccgattgcggcgcacatagtcttcaaactcctttctcttgcggccctggtactcgtgcagttcttcgaggtccgcgaatcgctgtgtcggcgcctgcaacgccggctcctgccgatcaacagcctcgcgaagcagctgctccgctga

SEQ ID NO: 10645 - DNA, 1611 bp, A.fumigatus
  unsure (1563),(1594),(1606): Identity of nucleotide sequences at the above locations are unknown.
ccagctgcctcacttgcctcagcagttgcctgtggttacattgctgtcatcatgtcgaacgcggaggaattcttgcgagatttcgaggaggaggatgacgaggtattccaagccggtgaggaggttgaagaggatgtcggcgaagaggtgcaacggccaacgccggaggtcacgaacgagtttgacgtcgccgtgtcgaccaccgacgaactcacacgtcttcacaagagtctccgagaccattactcgatcagatttccagaactagaaacacttgttacaaatcctattgactacgcaaaaaccgtcgccatcttgaaaaatggccctcttaacgatatcaaggccctctcgtcctcggcagataacatggtcggcgcgccactaaagtccatcctggatggcccctcgctcatggttgtcgcggtggaggggacgacgacacgtggacgcgaaatgaccgaggccgagctcaaagtcgtgctagatacttgtgagaggattctcaagctagatcgcgagcggacggcgcttacgcagagcatccagtcgcgcatgaaccagattgcgcctaatcttgccgctctaataggaccggagactgcggcccagtttctcaaccagaccggcgggttgagggagctggccaagatcccagcgtgcaatctggccgcgcagggctccaagagatcggaagggctaggatttgctacgaatatcggtatcagatcgcaaggctttctctaccactcgcccatcattcaagatattccgaatgatctaaagaaacaagcaatccggatcgtcgcagctaagatggtcctagcgactcgagcggacgtggccaagtacagccccgatggttctttgggcgaggaattgaaacaacagtgctatcaacgcttggaaaagctgaccgagcctcctccaaacgctggcgtgaaggcgcttccggcgcctgacgacaaaccctcgagaaagcgaggcggacggagagcgagaaaggccaaggaagcaatcgctatgactgagctacggaaagcgcagaaccgggtcgcattcggcaaggaggaggcagaagttggctatggcaccggcgaaaccaccgtgggtctgggtatgctggggcagcagaacgacgggcggatccgggcgactcagatcgaccagagaacccgggccaagctcagcaaatcgaacaagggctggggagcggccactccgatcagcggaaccgctacttctctgcgtgggtttggttcgggcgcaggcggcactgcgagtgtcctccaggccaaggggctgcgaacgtctggagttggtccttcatttgcaggcattgccggcacggccagtacgattgcctttacgcctgtgcaaggtctcgagctggttgatcccaaagcgcaagccgagctccagcggaagcggaaggcggaggaggaccgatggttcaaatcaggtacattcacgcaggtaggcggccagagcagtagtaccaacaacagcggtgcgaatggcgggttcaaagttcctcgcactgcctgcatggaaaaaggtcgnacaccgttgagggcagatgcgccaccgccgncacccgtgcagncatag

SEQ ID NO: 10646 - DNA, 300 bp, A.fumigatus
attacgtttgcactccagaagttaaatctgccacctccgattgttgatacccaacccatcgtacctccaacacaccatccattgtcaccatggagtcatcccgcgggccccctagggtcaagaacaaggctcccgcgccgatccagatctcagcggagcagctgcttcgcgaggctgttgatcggcaggagccggcgttgcaggcgccgacacagcgattcgcggacctcgaagaactgcacgagtaccagggccgcaagagaaaggagtttgaagactatgtgcgccgcaatcggctga

SEQ ID NO: 10647 - DNA, 1095 bp, A.fumigatus
tacccaacccatcgtacctccaacacaccatccattgtcaccatggagtcatcccgcgggccccctagggtcaagaacaaggctcccgcgccgatccagatctcagcggagcagctgcttcgcgaggctgttgatcggcaggagccggcgttgcaggcgccgacacagcgattcgcggacctcgaagaactgcacgagtaccagggccgcaagagaaaggagtttgaagactatgtgcgccgcaatcggctgaacatgaacaactggatgcggtatgcatcttgggagctggagcagaaggaatttcgccgggcgcgatcgatcttcgaacgggcgctggacgtcaacccgacctcggtggtactctggatccggtatatcgagtcggaaatgcggaatcgcaacatcaaccatgcgaggaacttgctggaccgggcggtcaccatcctgccccgcgtggacaagttctggtacaagtacgtgtacatggaggagacgctggggaatatccagggaacgcggcaggtgtttgagcggtggatgtcatgggagccggacgagggcgcgtggagtgcgtatatcaagcttgagaagcggtacaatgagtttgagcgcgcgcgcgcaatcttccagcggtttacgatcgtccacccggagccaaggaactggatcaaatgggcccggtttgaggaggagtacgggacgagtgacctggtgcgggaagtgtacgggatggcaatcgagaccctgggtgaggattttatggacgagaagctcttcatcgcgtacgcgaaattcgaggcaaagctcaaggagtatgagcgggcgcgagcaatctacaaatacgccttggaccggctgccccgttccaaggcgatggcgcttcacaaggcctacacgacatttgagaagcagtttggtgaccgagagggcgttgaggatgtgattctgtccaagcgccgggtgcaatacgaggaacagctcaaggagaacccccggaactacgatgtctggtttgactttgcccggctggaagaaacctcgggcgatccgggtcttcaccacgggggtggaagggtcagcagattgcagtaa

SEQ ID NO: 10648 - DNA, 204 bp, A.fumigatus
acaactcacctggttcgtgtcaggtacatcaatgtttttgacggcggggttatggcgtcataccttatgttccaaagtgcctcaggcgtctcaggccacaacatcacatgggcgcgcctggctcttggtcatgtgatcacatcacagttatgcccgacaatcatcaacacaagcagatgcattgctatgatctttggtggatag

SEQ ID NO: 10649 - DNA, 492 bp, A.fumigatus
agagtacctgatgaatactcaaacctacctaaggaactatatcaaccacgcattatgactgatactttccctgctgccctggtagggccgtcttcgaaggagaggaagtacgatcgccaactacgtttgtgggctgcgagcgggcagcaagctcttgaagagtctcgtgttttattagtcaactccgatggttcctggggggatcaaggcactggagtatcgggcgtggctggcgtcgaaaccctcaagaaccttgtgctccccggcattggtggcttcaccattgtagatcctgctgttgttacagagcctgatctgggagtgaacttctttctcgagtcagagagtctggggaaatctagagctgaggaaacctgccgcctgttgagagagttgaacccagatgtcgaaggaagttttcgtccaaaggtatatatgactgccacttctagcttggctttgcgaataggcggcgctaatctaaactactag

SEQ ID NO: 10650 - DNA, 621 bp, A.fumigatus
tactggactcccccacaccggggtttgttttctggcgattgtgctccagctgggggccctagaaaaccttctcaacggatgcatgccctgtcagctctgaatctaacttgtctatctatgctttgtaggacacggcccttgttccgtttctcctcatttatctcgtaccctcgatcccatcccatctatcctaccctttcccccatctatcaccctccaactcgttttcagtccaatatggccagtgtaatcgaggccgcaaagcgcgccgccggtaaggccgctgtcgccaaccactaccccaaagatgccaaatttgtcggtatcggtagcggatctactattgtatatgttgtcgaggctatcaaagaatctggcattgatacctctatgacaagatacgttcccaccggcttccaatcaaaacagctcatcctttccgccggcttgacagcagtcgattttgattcactacccgaaggaaccgtacttgatgtcgcctttgatggtgcggacgaggttgacgatgagctcaacttaataaagggcggcggcgcctgtctttttcaggagaaaattgtggctctgcaggccaaggagttcatctgcgtggcaggttag

SEQ ID NO: 10651 - DNA, 390 bp, A.fumigatus
  unsure (334): Identity of nucleotide sequences at the above locations are unknown.
tacttacgtccagactcgcgcaaactccagtctcgtctcctcacgaattggaaatatattcccattgaggtggcacctattgccgcccctcgtgtcctaaccaagctgcgagagttgggcagcattcagcctgccattcggcccagcggcacctccaagggacccctgaagactgatcaggacttctacatcattgacgctcctttccctccattgctcaccaaggctgacgtcgccgctggtaaagatgggagcggaaagggaggaatctgggaggttgatgccctggcgcaggcgattaagatgattgcgggcgtactggaggttggcattntctccggtgtgacgggacctcaggctcaagcgcttggaggtgttggaggccagaaa

SEQ ID NO: 10652 - DNA, 330 bp, A.fumigatus
ctaccccagtccaccatgctctacagaaactcggttgcccgctctgtgctcagggctatctctagctccaatgcttcggtcgcccgctcgactttgtccaacaatgtgttcaaggctcatctgacatcttccgctcgttttcccgctcgcgcatccagcttggcactgactacccgtaagcccgtcaccactgcgcttgtccgctacgcctccagcgtcccgggttctaccaacgtacccaaggtcagtatcactcatgttgtgagttctggtcgatcgctgatctttgtttgcaggaagccaaggttgccgaggaggaccatgacatga

SEQ ID NO: 10653 - DNA, 345 bp, A.fumigatus
accttggcgtttggcgaccttcagaaagttatcaaagacacttttagccttgagggcacccccaaggaggctctctacctcggaatggctggtgtcatcccctacctggctacttccctcgagaccgtctatctttcctacgagatcaaccgtgctaccgccaccggtgatggtctcatcttctccggccagactgccgagctgatgcttcacatgctcgagcctatccaggttggctatggtgctgtggtgagtttgaatttatcgtgctgtcaagctccctgtctgacgcgaagcgaccctccagatcctctccttccttggagctattcactggggtcttga

SEQ ID NO: 10654 - DNA, 447 bp, A.fumigatus
cgcgaagcgaccctccagatcctctccttccttggagctattcactggggtcttgaatgggccggatacggtggcaagcacggttacaagcgctatgctgcgggtgtcatcgcccccgctgttgcctggcccaccctgctgctccccgtcgaatatgccttgataagccagttcctcgcgttcaccttcctgtactacaatgacgcccgcgctgctgcccacggccgtgctccccactggtacggcatgtaccgcttcgtcctgaccttcgttgtcggagccagcatcgtggccagcttgatcggccgtgagcagatcgccaacaccatcagcactgagcacacgatcaccgacaagatcaacgcgctgctcttcctgcagaagaaggagaaggaagaggccgatgctcgccgccgcgccgagctcggcgaggaggagtctgagtaa

SEQ ID NO: 10655 - DNA, 330 bp, A.fumigatus
  unsure (99),(123),(289): Identity of nucleotide sequences at the above locations are unknown.
tgctttcagctactcgcgtacgccatcaacaacatggacggtgtcgccgggtacagtggctggcgctggatcttcatcctcgagggtctcgccaccatngtcgtcgcggtcatcgctaagttnatcgtcgtcgattggcccgagaccgcccggttcctgaacgaggacgagcgagcgctgctcctccgccgtctagcacaagaccagggtgaagcgaggatggaccgtctggataagaagtcactgcgacgtgccttttcagatcccaagatctacttggggtatgtcntatgtccaccgtctttcgatctcagagtgatacagaactga

SEQ ID NO: 10656 - DNA, 441 bp, A.fumigatus
gttgttatggtccgttccgtactggacccagctaacattcttatctcagacaaaccctcttggggtgcaactgtgtggatttggacgtcggaggtattctcgatgaacgttcgtgcccaggccgtaggcatggcctcacagactcagaacgtcgccaatgccattgtccaacaattcttccccattttcctgaagaactgcgggttctacgcgttctacatgttcgcgggtgtcaacttcttacttgccctcttcgtctggttcttcattcccgagaccaagcaagttcccctggaggagattgacgctctcttcggcggcgccaaccatgttacccacggtgagcggatgatgattggagagaaggagaaacattttgaggaccaggccaatgagaagggtgatgcagtgactattgaaaacctcgaggctagacggtag

SEQ ID NO: 10657 - DNA, 618 bp, A.fumigatus
  unsure (315): Identity of nucleotide sequences at the above locations are unknown.
ggctatagtctagctgctgcttgtcttactccagtaggtacgagtactggcaccggcaccatggacgaaaaagacgactgcacacacgccaccatcgaggacatcaagtccgcttccctcctgccagatgaactcgatcgtgcagcggagagacggctcctatggaaatgcgacttgcacgttgtccccattctcactgtcctgttcatgtttgcctttctcgaccgcatcaacatcgggaatgcccggttgatggggctagagagggacttgcggatgaccgggcatcagtacaacatcgccctgtttgtgttnttcgttccgtatattctcttcgaggtgccgagtaatatgctcttgaagaagatgaggccgtcgtggtggctgagtgggattatgtttgcttggggtgtgtttagctcttcttgtgcggtggccgaggtggtgagcgatgctgacagtgccacagggattctgactgtctgtcaaggcgtcacgaagagttttcaaggattggtggtgtgccgggtcctgattggggttttcgaggcgggtttcatgcccggtacttgctttttcttgtccgcgtttcagagctcgcatgctgacttctcatga

SEQ ID NO: 10658 - DNA, 732 bp, A.fumigatus
  unsure (53),(147),(187): Identity of nucleotide sequences at the above locations are unknown.
gaagtcactgcgacgtgccttttcagatcccaagatctacttggggtatgtcntatgtccaccgtctttcgatctcagagtgatacagaactgatggtaaatttcctacgaagaccactcatgtactttggcattgtcaataccggntacgcagtctccttttttacccccaccatccttaaccagntaggatggaccgccgtccgagcccaggtcatgagtattcccatctactgcgtcgcgacggtcatcgccttctccgccgcctataccagcgatcgactgcgccaccggtacctgttcacgttggcaggctgtctcattgcaaccatgggctatgtgatactgctctgccaggcctcggtgcccgtcggggcgcgctactttgcggtcttcgccattacaggcggcggatacctgacccaaccgatcctcatgggctggctgagtaacaacatggcgggtcattacaagcagtccattgcgtcggcaatgcagattggatttggcaattgtggagggctggtggccagtaacatctttttcaaggaggaggctccacgatatactaccgggtacggggtaagtctggggatgacctggatttgcggagcggcgtgcgccttgttcttgacttacttggtgagggaaaatagaataagggatgcaggtagaagaaactggaggctggaactgccccaggacgaagttgagatcctgggggctgaccat

SEQ ID NO: 10659 - DNA, 261 bp, A.fumigatus
  unsure (50),(122): Identity of nucleotide sequences at the above locations are unknown.
ctcgaagttgaccaagcgatcgatctcggcagcgaaccctctgagggtanggctacggaagatggcattcatgctgatgtcgattccgcgccacctgcgtctcagatcgaagaacatctgtngggccaggatactgtgtcctcccagatcgaagaacgaatcgtctggcccaatcatgcgagcggtgacgttggaaatacggttagcccagatctgggccaaagcctgctcggtctcggacagagtctgcaagacggatga

SEQ ID NO: 10660 - DNA, 588 bp, A.fumigatus
  unsure (553),(560),(573),(577),(578),(579): Identity of nucleotide sequences at the above locations are unknown.
gtgctcccgagcgtcatcgcgaaggggccggaatcgtctgagcatgccaaccattccttcggcagaatcatcatccttgaggcccttgcttgcgagccaggcgggccacttgttcatatctggcacgaagtagctgaccaaagtcggctcctcgaacttgtcccttcgcaccagagtgacgttctcccggacaagaggatgtcgagaaaggtgcgtatcgatctcaccgagttcgatgcggaaccctcggatcttgacctgatcgtcagcacgtccagaacactcaacgtcgccagaaggagtgtatcggcccagatatccactgcggtacaagcgatctctgggtccgacgtagaactgtctccagggctcgttgccgccctgactttcagccttgtccttctcgacccacttctgcggatcaacaaaccagttggtaaggaatttctttgttgttcaattcctcattgctcaggtaaccctctgccaggccacccgcacgcacgtagatttcaccaacttcgcctttggcgcagatgctccttaatcgacngagtcgngagttatgccgtncatnnnaccatatgg

SEQ ID NO: 10661 - DNA, 1011 bp, A.fumigatus
  unsure (520),(592): Identity of nucleotide sequences at the above locations are unknown.
gggtacacccaatggaccagagcaccgttgtggatcacagcatccactcgttcggtcagatcattccacaacgcctcggacaaaccgaaccgtggatttcccaggtcaccgcagacgcactgcagcctgctagtccatgattcatcccagaagccgtacgctctgcatgtagaccgaatgcgatcgagagcctgctcgtcgcttttaccacgaacgagtgccacgactctcgccataggcgacttgcgagtgagaaggtcacggaggatgtgtgcaccgagaaatccagttgcgccagttaggaacacagtgggttcgcccaccagcatgtcctcgattcgttcagggaaagacctgggcagggtttcaaccagcttcctagcatctttggaatattcgtcatcagcttcattggaagtggccagagtatctgcggtggcatcagcctcattggcgttactggcgaatgactcgaagttgaccaagcgatcgatctcggcagcgaaccctctgagggtanggctacggaagatggcattcatgctgatgtcgattccgcgccacctgcgtctcagatcgaagaacatctgtngggccaggatactgtgtcctcccagatcgaagaacgaatcgtctggcccaatcatgcgagcggtgacgttggaaatacggttagcccagatctgggccaaagcctgctcggtctcggacagagtctgcaagacggatgatctgcggcgaggtgctgccgcactgagttcggcagtatctgggaacggcaatgcaggcttgtcgatcttgccgttgggattcagaggcattcgcttcagaggaatgaagaccgtgggcactgcgtatgcagggagcttgctgcgtaagtgctcccgagcgtcatcgcgaaggggccggaatcgtctgagcatgccaaccattccttcggcagaatcatcatccttgaggcccttgcttgcgagccaggcgggccacttgttcatatctggcacgaagtag

SEQ ID NO: 10662 - DNA, 387 bp, A.fumigatus
tcccgagtcacagcacgcactgtaagttaccctatcgagattattacaacaggggcagaacacgtactaacttgccacctcagtatgcccctctatcactttgtgacggcagacctgccgtccaacactaaggctcctgagttggatgacgttcacgccgctgcttccctgcgtgcggacgccgcctggtccggcatcgatgcctccgctggcgctggcgtgaccgaagagcttgtcggtctctacgcgtcctacctcgttacgatcggattcctacccccgccctctgtctctacgatcggggtgcgtccattgcccaaggtccaactcagcgaagaccagaagaaggctctggcgaacgtcggtggacgtgggggcacttcttga

SEQ ID NO: 10663 - DNA, 384 bp, A.fumigatus
cctgaccagtggctgcactcgagattgaaaagattgactaacattccctctttagccaccaacacggacgatttcctcattcgaatgatgaagggatgcattcagctctctgctcgtcccaacatccacaacactgtcaacatggtgcccgtcgaccacgttgctcgtgttgtcatcgccggtgccttccagcccccttgcacgccgatcggtgtcgcacaggtgaccggacaccccagacttcgtttcaaccagttcctgggtgctttgcagacctacggatacgatgtaccccaagtcgactatgtcccatggaagatgtctctggagcattacgtcaatgacggaaagcacgatgatcccgagtcacagcacgcactgtaa

SEQ ID NO: 10664 - DNA, 1704 bp, A.fumigatus
  unsure (743),(815): Identity of nucleotide sequences at the above locations are unknown.
acaacaaagaaattccttaccaactggtttgttgatccgcagaagtgggtcgagaaggacaaggctgaaagtcagggcggcaacgagccctggagacagttctacgtcggacccagagatcgcttgtaccgcagtggatatctgggccgatacactccttctggcgacgttgagtgttctggacgtgctgacgatcaggtcaagatccgagggttccgcatcgaactcggtgagatcgatacgcacctttctcgacatcctcttgtccgggagaacgtcactctggtgcgaagggacaagttcgaggagccgactttggtcagctacttcgtgccagatatgaacaagtggcccgcctggctcgcaagcaagggcctcaaggatgatgattctgccgaaggaatggttggcatgctcagacgattccggccccttcgcgatgacgctcgggagcacttacgcagcaagctccctgcatacgcagtgcccacggtcttcattcctctgaagcgaatgcctctgaatcccaacggcaagatcgacaagcctgcattgccgttcccagatactgccgaactcagtgcggcagcacctcgccgcagatcatccgtcttgcagactctgtccgagaccgagcaggctttggcccagatctgggctaaccgtatttccaacgtcaccgctcgcatgattgggccagacgattcgttcttcgatctgggaggacacagtatcctggcccnacagatgttcttcgatctgagacgcaggtggcgcggaatcgacatcagcatgaatgccatcttccgtagccntaccctcagagggttcgctgccgagatcgatcgcttggtcaacttcgagtcattcgccagtaacgccaatgaggctgatgccaccgcagatactctggccacttccaatgaagctgatgacgaatattccaaagatgctaggaagctggttgaaaccctgcccaggtctttccctgaacgaatcgaggacatgctggtgggcgaacccactgtgttcctaactggcgcaactggatttctcggtgcacacatcctccgtgaccttctcactcgcaagtcgcctatggcgagagtcgtggcactcgttcgtggtaaaagcgacgagcaggctctcgatcgcattcggtctacatgcagagcgtacggcttctgggatgaatcatggactagcaggctgcagtgcgtctgcggtgacctgggaaatccacggttcggtttgtccgaggcgttgtggaatgatctgaccgaacgagtggatgctgtgatccacaacggtgctctggtccattgggtgtacccttactctactctcaagccagccaacgttttggggactattgacgctctgaagctttgcgctagtggaaaaccgaagcagttctctttcgtcagctcgaccagtgtcctcgacaatgaccattatgtgcttgagtcggaacgtatcattgcggccggtggtgcgggtatcagcgaggacgacgatctggagggcagcagcgttggactgggaaccggttatggacaaagcaagtgggctggcgagtacctcgtcagagaggccggccgaagaggattgaagggaaccattgttcgtcctggttacgttcttggtgattccaagaccggaagtaagcatcataacctgaccagtggctgcactcgagattga

SEQ ID NO: 10665 - DNA, 1836 bp, A.fumigatus
ccgcatgcgttgtccttccggcccgtcgttaagacctcgcgctcaggcacgtcgagtgtcgattcaggaactacccgaaagagacagagttctgttcgcggttggcaggattacatcttcggcagcggtaccgccagtcggaaaactagtagagcgagcagtatcatggacgacgttggagaagtcgaggagggcgcccataatcctcgtgcttcaaacaacaatcgccggaaagcgctggacgagcagctctttcaacctcctagcgaacgttctgggggtggcatagctgcaaaacatgcagtttctgggttagtcagtggagacgatgctagtactcattcccgcaaatcgtcaaagtcaattacgtcgtggacggtcaggctgtttgctggagggtctcacaatagccgagacgagaatgacgcgggatccgtccgcagcagaacttcctccatccatcaggacaagactagaggctcctcgtccacgtccacaaatcccaaaacggccctctcagcggtcgcagcgttaaaacggatcaacagcaacactagcatacacagtgcgcctggcagatctaccaatgggtccactgggcccggcagaacagcggctccttctggtcgacgacatgcggcctcaagcgtatctcaagtcgcaagctccgaggcaggcgacaaaagctccactaatctagggccagtcgaaatggatgccattctccccatggaatctcgtcccccaaccctttctcatatgtataacaactatcagcctggagagctactcaccgatcggtttggatttatctatgaccagcgtcggaaaaagaggcagagagaagctgctatgtccaagaataatagcaagcgtctgagcatcgctgaaacactcagcagcttccgcaccgagacatcagatggagatgaagatgctgtgcaaggaattgcggagcctcagcgctcacccttctcggtttcgcccgaggatccagaagctggagctgtggctatacggaaatggcaggattatctaaagtttccaacgcgaccgaccgaattactatctcacaccccatcagccggccctattgtgtcacttaccaccacaagcgaacctccgccgcgtagtactgcagtagcggttgaccgacatggttcgctttctgtcaacccaaatgctccgccatctgcatctacatccacggtcgtcgctgatcgcccagaatttgcgggaacatccgccgatgagccaacgactgcagccacgcagagtgcgtccacagagaatgaaccagtcaaattgcttcttgagcaattgacagagctccacgatgctctccaacgggacaggaccgtcagatggaacgagttcatgcgcaaggtgcgcgcagaacgcaggaaggagggagaagctgctgctgctgctgctgctgctgcgatatctactagagctgcgcagtctgtcgacacgccagaagcatctctagcagtcggcgaagtagttggaatagctaatctagggaacaagggcaaagtcggtcgtgccaagtggcgggagttccgatcgctcgtccttggggggattccggttgctctgcgggcgaagatttggtccgaatgcagcggcgcatcctccatgcgagtgcctggttattatgatgatctggtggcaggtatcggtggtagcgaaccggacccatcggttgtagcgcaaattgacatggatatcaaccggacgctaaccgacaatgtgttcttccgtaaaggtcccggcgtgtctaaattgagagaggtgctactggcatactcacgccgcaacccagaagtatga

SEQ ID NO: 10666 - DNA, 186 bp, A.fumigatus
aaacatcctcccccagcattattgacgatcaccgattacttgcttcacaacccgattgggtcgtgctacgaaagtttcatctccgaggtgcctcctaaactaaccgcacaccttgaatccgtggggcgtccaactccaaaccctgaacttccatgggtccctcctcggctttcccggatggcttgt

SEQ ID NO: 10667 - DNA, 585 bp, A.fumigatus
ccaggcactcgcatggaggatgcgccgctgcattcggaccaaatcttcgcccgcagagcaaccggaatccccccaaggacgagcgatcggaactcccgccacttggcacgaccgactttgcccttgttccctagattagctattccaactacttcgccgactgctagagatgcttctggcgtgtcgacagactgcgcagctctagtagatatcgcagcagcagcagcagcagcagcagcttctccctccttcctgcgttctgcgcgcaccttgcgcatgaactcgttccatctgacggtcctgtcccgttggagagcatcgtggagctctgtcaattgctcaagaagcaatttgactggttcattctctgtggacgcactctgcgtggctgcagtcgttggctcatcggcggatgttcccgcaaattctgggcgatcagcgacgaccgtggatgtagatgcagatggcggagcatttgggttgacagaaagcgaaccatgtcggtcaaccgctactgcagtactacgcggcggaggttcgcttgtggtggtaagtgacacaatagggccggctgatggggtgtga

SEQ ID NO: 10668 - DNA, 861 bp, A.fumigatus
caggatcagcttattcacaaccccccatatgccgactggcaatgttgtttgaacgctggtagcacatatgggtgggatacagtactccgaatgctctgcaccagaggcgactacatcctgatggaggagtacacattctctagcgccaaggagaccgctcttccgttgggagtcaaggtggcatcggtcaagatggatgctgaaggtcttctgcccgagtcgctcgacgaggtcttgagcaactgggatgaagcttctcggggcagccgcaagccatttgtgctgtacacgattccaactggccagaaccctaccggtgccacgcagcagctggagagacgcaaggctgtatacaaagtggcacagaagcacgacttgattatcgtggaagatgagccttactacttcttgcagatgcagccatacaccggacccgaccgcgagcctgttcctcctcctgccagccacgatgaattcatcaagtctctcattccttcgtacctgagcctagatgtcgatgggcgtgtgctccgacttgaatccttctccgaggttctttcacccggctcacggaccggttggattgttggcccggagcagcttgtcgagcgattcatgcgcaattgcgagacaggtgcccaacatccaagcggcatctcacagattgttctgttcaagcttctggacgaacactggggccattccggctacttggactggttgatcaacctgcgtatgcagtataccggtcgcagagacgccattgtcaacgcgtgcgagaagtatcttcctaaggagattgctaagtggaaccctcctgccgcaggaatgtttgtgagtatttctccacctacgatttga

SEQ ID NO: 10669 - DNA, 618 bp, A.fumigatus
tttttaccttatggctccaatccggaaatttttccccagaagaaaccatgtgggcccatggaagcggtacccttaccgccaattgagccgacccagatcaatcccacctaccccaattcctggatcaactgcggtggtggtggcatgggatggtccggtggcggtgcttgggaatcaagctggctacggacgatcagcacgggggaaaagaacaagggtaaattcgtgtgccaggtggtgggcgacgggacgatcctcttctcagtacctggctccgtttactggattgcccggcgctacaatatcccagtgctcacgattgtgctagacgacaggggctggaatgcaccccgcagaagcatgcttgtagtccaccccaacggagatggctcgcgtgcaacaaacgaagatctcaatatctctttcgctcctaccccagattactcaggcatcgcaaaagctgcagctggaggtgagctttgggctggtcgcgtggctacagtagctgagctgggcaagcttctaccagaggctatccagagtgtgctcaatgggaccgcagctgtcctggaagcccagctagacgggaccactggaaagtatgttgagaagaaatag

SEQ ID NO: 10670 - DNA, 294 bp, A.fumigatus
caatctacattgaagggtgctgcgcgttaccttaagactccaggtatcccatcccgtcaatctcttcataaccgcgatattggtccacatgaaatgctgatcctgactactgtaggtctcatctcgttgggtggtggtctgccgtcgccagaatatttccctttcgaagagattagcgtgaaagtcccaacgccgccgggattctcccctcccgagacccaggaatccggcgctgtcctgactgccaagaaaggggatgtccaagctgccagaagtctttacggtacatactga

SEQ ID NO: 10671 - DNA, 1110 bp, A.fumigatus
  unsure (1110): Identity of nucleotide sequences at the above locations are unknown.
ttgatatacttcaatcttgctgctcgttatcctaaaatcactaatgataaactgacattcgtcgcgcagatgtctcgcacattgacaaatgttatccgtctggacagttttccaacattctgtgcacttttagtcgcgggctcaactgtcttacccgttcttcttctgcgactttgtgcacttgtcagcagtagaattggtaaaatatccggaccggtcaagtctcgggtctttttgcgcttcgttcgcttcgttgctgcttttgtttctgcctggtttagctttcagctgctcaataaaaagcctatcaggcagcagggcagcgatgttatctcgagccacaaaactggtagcggagccaatgccggccatagtcccgaaaagaagatcacccctcaatacagtcctgatcttgccgggaggactatggacctcactcttttcactttcactagagcaatggatgctcttgtctgtttgggatggtcacgctggcgagcttcgcggagaggtcagaaccgctggtctttagttgagactgtcgctcctgtgcttgccgacacagggcttttcgctgccagctctgctgtagtaatgtgggcatggttttacctcccggaaaggcttcctagatcttatggaaagtggattggcgaggtagcgaaggtggacatccgactcattgaagcacttcgacgggccaggcgagggatattcgtatatggaaaagaaactggccaggcgcgtcttcttgagtctatgtgtgaggattacaactggcctagagagtggggagacccaagcaagactattcctatcccctgcgaaatggtacacatgggttgcggtcccaactgcgaaaaacacgctgtttggcgatttgctaaaacattcaaattcgcttgtgcaacctatatcccgctgcaagttgtcttccgtgtgcggtcaatgaaaacgatgtcgtctctctggcgggccctggccgacgccctacggtcatctaccttccttgcttcatttgtgagcattttctactattctgtgtgcctggcccgaacgagaattggtccaaagatctttagccgggaaacggtgacaccacagatgtgn

SEQ ID NO: 10672 - DNA, 249 bp, A.fumigatus
  unsure (26): Identity of nucleotide sequences at the above locations are unknown.
tcaaacctcaagtccaggaatgtccnacatttgcatgccccggttaatggttggctgggaacctattcccccgggtcccaacctcccttaacaggccgaaaaaaatccgctccccaattctcggaatggaaaattaaccaatttggaacaattaaatttaatttccccgaacaagccttcagaaagccccctaattttccccccgccgttctcctctgttcgggccccaaaaaccctcccctccgcggc

SEQ ID NO: 10673 - DNA, 1197 bp, A.fumigatus
  unsure (1143): Identity of nucleotide sequences at the above locations are unknown.
cgtgtctctcctacagctgctggtatcaatgcgattgttggcccttacattggaccctccgatgctctgcttacctaccttcctcaagcgcacatcctggagttcatgtttgagaacctctgcttgttctggggtggcacaatgggttacggaaacccccggactctgtcggatacctcgatgcgcaacagcaagggcgatatccgcgaattcaagccgacgattctcgtgggtgtcccggctgtctgggagtccgtcaagaagggtgtgctcaacaacttgaacaaggccagcttcctcctaagggggctgttctggggcgcaatgactgctaaaaacttcctgttgacaaatggattctcgggagccagcacgagtgcttccattctggatgccgttgttttccgtcagttgatggaagctaccggtggtagactgcgtatcgtactgaacgggggtggcccggtctctaaggagacgcacaagttcctctctatggccattgcccccatgatcagcggctacggtttgaccgagacctccgctatgggcgctctcaacgaccccatggcctggaacccggatgccctgggtgaaattccgggatgcattgaaatcaagctggttgatttcccggatgccggctacttcaccaagaacgatccgcctcagggagaaatcctcatccgcggtggtagtgtgacttcgtactattgggacaatgaggaagagaccaaggccgcctttaccgaggacggctggttcaggaccggtgatattggcgagtttgacaagaacgggcatctgaagatcattgaccgcaagaagaacctggtcaagacgctcaacggcgaatacatcgctttggagaagctcgagtctgtatatcgctcctcgcccgtggttggcaacatctgtgtttatgccgccgaggaccaggacaagcctgttgccatcattgtgcccgttgaggtcgccttgaagaagatcgccagtgagaatggcattgagggtgacagcgtcgagtcgctggttcacaatgagaaattgaagtccattgtcctcaagcagctccagagcgccggcaaggctggcggtctcaggggtattgaggtcatcaatggcgttgtgttatctgatgangatggacactcagaatgtagtcttaccaccctcctctttcaaactacgagctga

SEQ ID NO: 10674 - DNA, 624 bp, A.fumigatus
gattattcttcgaatatatcctgtgaggttgcggtgattgtggtgattgtaatagctgttgacaggttcggtcgatcaaacaggagctatcagtacctttttctttttcatacagctccccggatcttcgtgatcgcagttcaagatgtcgaagcgagacatccacctccaacccacggatgtccaagaagcctcccattcacagtggaggcttctggctacgagcccgtaccgggtgagaccatccctcgtagattgccacaggccaaggacaacctcatcctacggcccgcggaggacgtcgcaactacctacgatgttttcagacggtccgcgcgtgtgttcggtaacgcaaaggccgtcggtacttgtcgccttatcaaaacccatgtggagaacaagaaggtcaagaagattgtcgacggtgtggagcaggaggtcgaaaagaagtggacatattttgagatgagcggttatacctacaagagcttcgttgaatacgaacgccttgccctggaattgggttgtgggttgcgcaagctgggattggagaaggataataagattcacctctacggcgcaacaaggtgggctttaccagcggtctttataacagaggaatga

SEQ ID NO: 10675 - DNA, 564 bp, A.fumigatus
atccaaacaggggctgcatctcaatcaatgaccatcgttactgcgtacgacacgcttggggaggagggactgaagcactcgctggtgcagacgtcgagtcttgctatcttccttgaccccggtcttatccattctcttgccaatgttctcagcgatgttaagtctatcaagcacgtcatctacaacaccgaccaggaagttaagcaggaggatctggacaagctcaaggctgatttcgactacttgaacatcatgagcattgaggacttgcgcaaactgggagaggagaaccctgtcgaaccagttcccccgtctcccgaggatctctgctgcattatgtacacctccggttccacgggtccaccaaagggtgtgcctctgatgcacaagaatgtcattgctgcgagtaagttagctgatttgatgatatattgcggctcggcgaagttaacgtgtctctcctacagctgctggtatcaatgcgattgttggcccttacattggaccctccgatgctctgcttacctaccttcctcaagcgcacatcctggagttcatgtttga

SEQ ID NO: 10676 - DNA, 846 bp, A.fumigatus
cttgcagtactgagtgaatgcaggtattgcgattggcatgatgttcacgatttcgccgctgtggataggcgagacgtgtcggccggaacttcgagggttcttcctttgcttcttcaatacgagtattgtctttggacagttcgccatgtcagtgctttctgtaggccagtctacacacgggctaattcacgtacagtgccgccgtggctagaggaagcagctacctggatggcaaatggtgagtcactccacgacacccgcaaagtcactgtacacattgtaaccgccacaacaggcaatggtggctccccgttgttgggatgtatatctttccaggtaaagccccatcccactccgactgtacggaatactgctcacatcacagccattctcacatttggctggctattcttcccggagtctccatactggctggttcgacaaggaaagaccacccaggcccaaaatgccctccggcgggtctacgggttcaagaatgacgccttctacaatgtcgaagtccgtcgcatggcaaccgagaataaccaagccctcgcattacagcgcagtctcacgcagtccacccgtcgcacatttctgggcctcgacctctctgccgaagccgagtgcttcaaccgcatgaaccgcaagcgcaccctaaccgccatcttcgccgccagcggccagcaaatgatcggcgcgactttcgtcatcgggtacgcgacatacttccttgacctaatcggggtgaaggactacttcgatgcgtcgatcgtcctctacgtggtaatgctgctggccagcatggccgccttccccctgaccgaaatcatgggccgacggacg

SEQ ID NO: 10677 - DNA, 384 bp, A.fumigatus
cgggaaggacttttgataggcctctgggtatccagcggggtcatcatgcaaggcttcgatatcgtcgcaggaggccagttagcggctctcccggagttccagaaacaattcggccgtctgcagccggacggttcgcatatcatccctgctcactatctgtcggcgtggaattcgattgctcccgcctgcgagatcgcgtcgacttttatctatgcgccgttactggagaagtatggccgtaagcctggtatcttagttgcctcggccatctctgttgcgggagttctcctccagcagctagcgacggattggagggtccatctggctggtcgaggggttaacggttggtttgtttcggtcttcttgacttgcagtactgagtga

SEQ ID NO: 10678 - DNA, 261 bp, A.fumigatus
tgtcgcatgtatatatttgcgcgcacctttctttttctttcccgcgcttgtttgagactcgtagtacaacaccccttgaacgctgaagcatctgctttgtaccttatagccaagggaaaatggactcgtaacgaaacaaccctccgtgtggctctcccatgctcaactttctccgctctttctggcgcatcaaacgcccatcaaccatggagcccctcattgccgtcgtcggtgccacgggcaccggcaaatccaaggtga

SEQ ID NO: 10679 - DNA, 327 bp, A.fumigatus
cttgcagtggatttagccacccgattcaacggcgaaatcataaatggcgacgctatgcaaatgtatcgtggcctacccatcatcacgaatcaaataccattcgaggaacggaatggcatcccgcatcacctgatcagttgtgtcgattttgaagaacagccgtggcgcataaggcatttcaaaatgggaatgcctgcgacttataaaagggacatacactcccgaagggaaagcctcccattccaattcggaggaacgcactacgtacacactagacgggtactcttcaaaggattaactgggttgaaggagagcccctttctcggg

SEQ ID NO: 10680 - DNA, 216 bp, A.fumigatus
aataacactgccttaaccgtcgccgtagtccctcctcgtccagacatggcagactcggacaatcatacgggtccttcgatcaatgtgaatggcctaaattataagttcccggatggttcttcaggcttgacaaatgtgtctctcagtctccccgcagggagccggacattgctcattggaggtgatttcgtcccctccagcctagatgagtcgtga

SEQ ID NO: 10681 - DNA, 633 bp, A.fumigatus
ccgattgttaacgccattccagcaaatggtgccggcaagaccactctcctgcgcttgctggcaggcaagcgcttggccccgacagatacagtttctgtttctggcagggatccctttaagcacggcctcgaaggggtgacttacttaggtgttgagtgggttctgaacagcattgtccggacggacatcgacgtcccaacgctcctagcatctgtgggtggagacgcctatcccgagcgcagggatgagctagttgagattctcgacattgacctccggtggcgtatgcacgccgtgtcggacggtgagcgccgccgtgtgcagctggcgatgggtctgctgcgcccttggcaggtgctcctgctggatgaaatcaccgtggacctggacttgctttctaggagtaacttcctttccttcctcaagcgggagacagagacaagaccctgcacgattgtctatgccacacacatcctggataatctgtcgcagtggcccacccatctcgtgcatatgcacctcggaaacgttagccaatggggccctatggaaaacttcaaaagtgaggttacagagacatcagagaacagtcaactcggtgagcttgtgctcaagtggctcaaggatcttcac

SEQ ID NO: 10682 - DNA, 882 bp, A.fumigatus
ttaatgtctctcctaatatacatctaccgcaaagtattggcggtgctcatcagagctgttgtcacacgtggcaagcgcatatctgcaaatccagatgatgtccttcagataacgtcacgagacgcgggcagacacttgagagctcacctctatcggccagcaacttcgttgtcgccatcgcctgtcctcatcaacttccatgggagtgggttcttgctaccgcttcacggaagcgatgacgaattctgtcgacgagtaagtcgagagacagaatatacagtgttggacgtccaataccgactggcgccagaatatccattcccagcggcccttaacgacgtggaagatgcggtcaagtgggtcctgcaacagccagacaagttcgatttgactcgagtggccatctccgggttcagcgcaggagggaatctcgcgatcgtggcagcttcggtgctctacccacgagagacgttccgatctgtcctcgcattctaccctccgctcgatttgtacacggaccccggagccaaacgcccgccggatccggcagggaatcctattcctgcacctttgtgtcggttgttcgacaagtcctatgtcccttccgcatatgatgccagagacccacgtatttcaccatgctatgcgcagcctgagaggtttccagatcgcgttcttgttgtgacagcggctggcgacagcctggccggtgaagctgaagccctcgctgcaaagatagccaaattgcccggtcgccaggttgtgtgccagagaatgcaaggttgcaaccatgcctgggacaaaagtgctcgtccgggaaccatccaaggtgatgccaaagaaaaagcctatgccatggctgttgcaatgttgatgcgctaa

SEQ ID NO: 10683 - DNA, 231 bp, A.fumigatus
tattactccgtgggtcataagccaagactggccctccccgctccaatgactttcgaagcacgccccaagcctctaccgcaacgcaccctgattgcacaggaatggcaacactgccgtcatctcttctgttccatcgccatctatctaaggtactccgttgtatttcaaggcatcctagatattcaacactatcttatcgcatttaatcattcacttgaaaagaacagataa

SEQ ID NO: 10684 - DNA, 990 bp, A.fumigatus
ctctatgatgaagggataatcataaccgttgcagcactcgtcgctgctggtatagcggtctatgaatcgccacagttccaagaatgggtgaacaactctcgtcgtaaaattgcgctggctttacacaatctcggagatgaaattcaacctcgagactctacatcttcacccagggaagatatttctatgatggaagaggtaggtccggcggcagaagaacggagaaggattgctcgcgaggaaatccagaagagagctgctgctctcgaagaacgtcggaagcgaggtcagggtggttcgtttggcactttcgatgcccttgtggacgaaaatggaaacctgttgcggccggacagtcgggagcccactgacaggacgcttgcaaactcgaccgctgtggatttgccgtcatcgcagcttgtccaccgtgggcccaaagagccagatgtgtcggcttccgtgagcgagattagaccagccggcatcgtgaccgacagtgataaactacatttagagattccatctactggcaaccattcagcgtctcttgtcgatctcactcctacttctgatgatacagatatagacttctttgcctcaactggtgacaaatcggaagaagccgagcggtctgtgcattcttccgcaacggatcaagaacaaatgtctgcgtcgagtcacaccgaggaaggatctcaaaccatctttgagcaccctgaatcatcacttatagacagcaatcgtgagctccgatcgccgttctctgacctgtcggaactgaattccacgggtttcgagcagcaagaacgttcatctacgccgtctactgctgatagtttcagccacgtttatgagtcggccgaggatgcaacgtcagatggcactctcagtgacctcggaaggtccatggatggtgcagccactcccgccagttggtcggaggttggtagtgtcgttagcaacgaagacttgggccaccacagattttga

SEQ ID NO: 10685 - DNA, 672 bp, A.fumigatus
  unsure (293),(537),(579): Identity of nucleotide sequences at the above locations are unknown.
ccaacggctagcacacagaagaaccccgatgacgttgtcatcacccttgcgctgcggacgccacttaccaaggccgccaagggcggcttcaaggacaccgacctggactacatgatctacgctctattgaaggaggtagtgcagaagtcgaagctcgatcctgccctcatcgaggacgtctgtctgggcaatgtatgtttcctacttttgtttcaattctacgcaggaaaaaaaaacccaattaacaggtaccaggtcaacgacggcaaagcggcctacctcgtgcgcgcggncgccctcgccgccggcatcccccacacagccggcgcgtcgtcggtcaaccggttctgctcctctgggctgaaggccgtgcaagacatcgcgaaccagatccagctgggcgcgatcgacgtgggcatcgcggtcggcgcggagctgatgtctgcaggcggcgaccggctgccgcggccgttcaacgaggaggtgctcaagaaccaggaagcggcggactgcatgcagcccatgggccagacgtcngagaacgtgggcgcggacttcaacatcacgcgcgagatgcangatacgtacccggcggaatcgtttccggcgggccaagcggggcaaaaagcgggctgtttcgataataaaacgtccccatcacgactaaggtga

SEQ ID NO: 10686 - DNA, 1497 bp, A.fumigatus
  unsure (854),(1352),(1363): Identity of nucleotide sequences at the above locations are unknown.
agacaatttgcctgccaagagtctcagctcagcgatgaggcaaagaaactcatggagagcgtgcgtgaggatgtcgccaagatcaaggcccaaatggttctggaaaaagacaaacaagatgctgcggatcgtggcgccgagggactgaaaggcaaagaccgccgcattgcacagcccaagggcaagtccggccgctttagtagcgctcatatggcggagttcaagaagatggactccatcgccaaccatccctccgcgttccgagctgcgccaggccgcttccagccagttggggcgacactcaagcggaccaactcgaaagcgggctttaacgaagccgactccaggcgccagtcgcctctcaagtcgacggcgaagccttctcctgcctcagtcgcgccaagtgcgaaacgtgtcaagcaggacaagaccgacgacgtttcgactcggcatccgaccactgacgcagacaaaaagacccccaagacgactcttccacgtcctaggtctgctgttcgcagttccttgatgacccccacgcgagcctctgctgcacgcacctcatccgtaagcctcaaaccacctcggaccagcatgatcccttcgcttccacgttctccggtctcgaagcctgctggcatcccacacactccccagaccgatttcaacccgcgtatcaagagcaacttgcctacactgggtggtctcaaatccatctttcgccgtcatcagcccttattctcccacgaccctacgaagatcgctgcaggcactcatgtagccgctccagacttcacctccaagttccttctgggggcatctcgtgagccttcagtgtatgaagagcccgttcngatactatcgcccaagaagcgggtcgagtttactcccaccaccaagtcaccagtcgccaaagtcgacagcgagctggaccagccttctccttcgccatctaagatcacggtgtctgtttccaaggccacgtcggacattgtgtatcccaccttgcccgttctgacaccggagaagacttctgccgctgctatcagatccagtcaggatggcactccaaccatccgtcatgtccgcccatcgaatgtcaacacccagtcaatcgctcttcccgacgttgctggtatgccgcacggaatgggcaataagaagcctaccaccttaccggacattgcgggtgtgccccatggcattggtaacaagaagagacaccgcgcgactgaggatgaagcggacaccgagaatgtgcctcctgcggattccacttcagatcctcgcagtgctaagagactcaaattcagcgccccatctcgtgcaaaggccctcctttccttcagccntaccaaggccngtactcacacccctgtccgcaattcttcgatctccagccgtacgggtacacctgccagcgccagagcgaaaagccgaggcgtcctcagcatcagtcgcctgaacatgctcgctcagcccaagcaccgtcgttga

SEQ ID NO: 10687 - DNA, 714 bp, A.fumigatus
gatcagcctttcatggtagccaggaaagagtcgaggttgtactcctcttggtactgccggtcgtcccagagttcgccgaggtcgtcgagccagcccttcttgcccttctccttgacgttgccgtcgatgtcgaccatgtcaacctcgttgccagccgcgtcgctaggcttctcggctgtttcggccgtctcgcctaggttgaaaaggtcaaggagttggtctgtgtccattgtgccaaggccagcattttgctggttgaccactgtggaggcgacgtcgatcttgaatcgttgcaggctagaagaaatggttagttacgagtttctcttgaggcagtcggatggggacttagacttacttcaggatcttctcctccaaggtgccgcgagtgatcaaccggtagacgttgacgaccttcttttggccgatacgatgggcgcgatccatggcctggatgtccttctgtgggttccagtcgtgctccacgaatatgactgtatcggcgccggtcagattcagaccgagaccaccgacgctggtcgtcaaaagcaacacatcgtagctgggatccgtgttaaaccggttgacaatgtcctgacgcctggtagcttccacgctgccgtcgagccggaggaattgaacggacggaagcagcttgttaaacacttcgctttgcacgatatccagcatctccttcatctgacagaagattag

SEQ ID NO: 10688 - DNA, 606 bp, A.fumigatus
  unsure (96),(225): Identity of nucleotide sequences at the above locations are unknown.
tcaagaaaatttcttcagccctcaagacatgggttgttcggcactccccggggttgtcgtcaagaaggccccaagcagtccacgaggttcagcatnacttgctgccaagcatttaacattcgagacgttgcccatgcgcctaagctcagcgcattgcgcgacctgctcatcgactgcggtattggtgttgactcgccaagcgagggcgatttgagcggcgccagntatgtcagtccccaccgagccctaatcttctgtcagatgaaggagatgctggatatcgtgcaaagcgaagtgtttaacaagctgcttccgtccgttcaattcctccggctcgacggcagcgtggaagctaccaggcgtcaggacattgtcaaccggtttaacacggatcccagctacgatgtgttgcttttgacgaccagcgtcggtggtctcggtctgaatctgaccggcgccgatacagtcatattcgtggagcacgactggaacccacagaaggacatccaggccatggatcgcgcccatcgtatcggccaaaagaaggtcgtcaacgtctaccggttgatcactcgcggcaccttggaggagaagatcctgaagtaa

SEQ ID NO: 10689 - DNA, 312 bp, A.fumigatus
ctaaccatttcttctagcctgcaacgattcaagatcgacgtcgcctccacagtggtcaaccagcaaaatgctggccttggcacaatggacacagaccaactccttgaccttttcaacctaggcgagacggccgaaacagccgagaagcctagcgacgcggctggcaacgaggttgacatggtcgacatcgacggcaacgtcaaggagaagggcaagaagggctggctcgacgacctcggcgaactctgggacgaccggcagtaccaagaggagtacaacctcgactctttcctggctaccatgaaaggctga

SEQ ID NO: 10690 - DNA, 255 bp, A.fumigatus
gactgcgcaccagacgcttgcttcgatccaatcagcctccactcacccccctcattccagtgccaaacctacctgtgttacatgatccacctcgaacgacgtttgactctcaacatcaaagtatcggttcccttctatcttgttgaattcactgacgatgacctaagcccagtcaccttgtcaaaatacggcctcttgaaggttgcacgcaacgacgacccacctcctgactcgctccgggtagcttcacggtag

SEQ ID NO: 10691 - DNA, 186 bp, A.fumigatus
accacttcgtccacgacagatatcaaggctcttacctcggacggatcggatattatcccctctctcgcgcctgcgtttgaaagatacaatgagaagcaattgactaccgtgaagctacccggagcgagtcaggaggtgggtcgtcgttgcgtgcaaccttcaagaggccgtattttgacaaggtga

SEQ ID NO: 10692 - DNA, 366 bp, A.fumigatus
cgagggacacgctgtaggaacggtcgcttccgctccatctaccgagtccccgtgtccgagtcgaccaccgtgagcggcaagatccttgtggatgtgcattactatgaggatggcaatgtggctctcaacacgaacaagcccattaatattgccattccctcgatctctgctgagagcatcatctcccgcattgcggctgcagagcgagactatcaggaggagctcaatcgtgcattcgtgcagatggccgagggcgcgttcaagaacctgcggagacaattgcccattacccggcagaaggtggaatgggagaaggttggagggtaccggctgggacaggatatttctggtggaaagggacggtaa

SEQ ID NO: 10693 - DNA, 1422 bp, A.fumigatus
caatgtactacagaccagatcatttccaacctggctttggatatccctcctaatggctatacaccacggaatgtcgacctggtgtcgtgtctcctgacctcgcgtacgttgcacgctgccacacttggtgtgttgtaccgaaacatgaccttcccgcattccatcatcttctccaaggctctcaaccacatgtcgcagtatcccgcgctcggaacgctcgtgcgtcgtctggacttttcccatttcacctccgtaggactcgggcgcaccaagcagatgaatgcagaaatccagaatctcacctccaccacgctgttgaaatgtttggatcttctgccaaaccttaaggaatgtctgctgcaggagcatgtggaaggtgatatcagcgtggacatcgtgcggaagatattcaccggcctgcccaacctacatggcgttgacttttgcggctgcgctacccagtcattctcggcggttttccaccaagctttgaccacagaaccgggcctgcctctgactctaccgaatctcaaacgggtgtccctacacgagtgtagcagtctgcctccgtctacttttgaggttcttcttcctcgtctgatcaatttgacgcatctcgatgtcacgcacacgcagatcagcgaggcggcgctcttctccattcccgagaccgcccagattacacatctcagcctttcgcggtgcactcggctgaagggtccgagggtggtcgagtttctgaccacgcatccagctgtgtgcaatacactggtgtaccttaacctcctggccgaccccactcgctatcggattctcgaggaggacgatgtctctgctcttcttcctcggttgcccaaaaccctccgctcgctgaacctggggggcgccaagatcacctctgctcatgcgcctgccctagtacctttgaccaagcatctcgaggagctcggcttgagctcggcggatttgtcctgcaaagatctcaatatgttcttcgcgccgcctctcgtgtcggaccatacgggctcagccgaggggccggaaccgtgggtgccgtcctcgttgtgctacttggatctcaacaaggtcccgcagttgtcgattggcactatcttcaataccaatacttgcttgctcctttcgcagcagagttatcctctgcaagtcattgaattcagtgacaagatcattgctccgctgagggagagagtcaagaataaccgtgcctccagcggctggaccgtccgggagctcggcagacgcggctggtacgtgcgtgaccctgcatctatgccaaaccaagtccccgacgacggctctcgtccctggaaaatgggcgcccgttggtgggggatgaggaagatccccgttgcagttggagacgttggaggcatctatggccattacatgttcaagaaataa

SEQ ID NO: 10694 - DNA, 318 bp, A.fumigatus
ctttggcaaggaactcgttatataaaccaactaagtcgtgctctgaacatcccggagagtgccatgaaagccgctggtcaggttttcaagctcgctgtcggcttaaacttcatccaaggtcgtcggacgaagacggttgcagctgtctgtctgtatatcgcctgtcgacgacaagatgggaacactgtcatgcttattgattttgccgacgtactgatggtgagtaatttacggcaattagaccctgggtccgtacactcgctaactctgttcaggtcaatgtatttaaactcggtcgaacctacaaggccctcctag

SEQ ID NO: 10695 - DNA, 987 bp, A.fumigatus
cgcgtacaaagtcgccccccagcaatctcgtgtattcttctcattctttcttcatcatcttcccctgcgatcgaggcttccgtccctattttcatttgctaccggggtctactgctagtggctcttcgatggtctcaatatatcccgtatacaatcattattcgttctggtcgacctcgaagcgctcactcgtctcctccccagtgtctggacatttttccttcccccagcccactatttttcccttttttggaagtccagactcgatctccttttcgtgattggtccaatcaacatcgccatataagaggcttagatcacaattgttgtactttactacaaggactgatctatacccgcgctgtttgcttcttcgtaaacccttgtccgttatgctcagcacccagcctatctgaggtacagcctccagtcgaaggttatttggccgagtttcagctcagcctctcctccgatatcaccacgttgtgcatgatgtctgcctttagacccaacatgcgtccctccatgccccctaggagtggtccgagagctccgccggtaggccgtctggcgagcctcaaggctcctactccgactccgattaaacggcctcaaccagttgcacgaccccaggccgccaggccgactacccatcctaagaccactacatgccccaatcctggatgtccagctcctcatattgtggaggatgacggccaaaaggtttgctcgggctgtggtactgtcattagtgaggcaaatattgtctccgaagtcactttcggtgaaacatcatcgggtgcagcggttgttcaaggaacgttcgtcggtgaagaccagacccatgtccgcagctatggaccgggctttcaacgaggaggtgctatggagagtcgagaaattacagaacaaaacggtaggtatcccttctcccccctctctgttttactagctcgtgctgactttggcaaggaactcgttatataa

SEQ ID NO: 10696 - DNA, 381 bp, A.fumigatus
tttacggcaattagaccctgggtccgtacactcgctaactctgttcaggtcaatgtatttaaactcggtcgaacctacaaggccctcctagatgaactacgtcttggcggtaatgtcttcttgatgaacccgattgatccagagagtttgatctatcggttcgccaagcaactcgaattcgggactgcgacgatgcaagttgccagcgaggcagttcgcattgttcagcgaatgaaccgtgattggatgactaccggtcgacgtccggccggtatttgtggcgctgctttgatccttgcagctcgaatgaacaattttcgtcaaacagttcgtgaggtcgtttatggtggtgaaagtcaccgagatcaccatcaaccagcg

SEQ ID NO: 10697 - DNA, 285 bp, A.fumigatus
ccaagtggaggcagttgggttcccccgcacatcagatatctctcagcaaccattctcatgggacgcctccacggagacaatatctactcattttcaaggacaggatacacattgcatggtttctatgatcaggtcgttagatatgggtttacctacacgccgctggattatactcatctaggaacaatcatatctactttcctacagacaagtacgcagacaacctggtcgacactacagccgcttaaactcctgccctaccagctgctcactctgcgtccataa

SEQ ID NO: 10698 - DNA, 489 bp, A.fumigatus
aaagtcctcttgaccggagtcagtgggacaggactgtcagcagcaaccgccgaggccctggcaagcggcgatgcagccgccattatcctgatgggcaagtcgcaggccgaagcgcaagcgatgattgacgatatcaaccacaaacatcccaaggcgaagctgatattcatatcggtggatttcggccggttggcctctgtgcgcgaggcggcggaagcgattaggaagcttgaggttcccatcgatgggtttgtggggtttcccacggtagtggctggaccgtggatgaagacggaggacggaatcgagtctcacttccagtgcaactatctcagcaatttcctcctgatcaatttggtggttcacttgatgccggcaggttcaagggtggtcatcgtttgctctagtatccggcctgaagcgccgccgccggcctgggatgaccccaatttcgcagtaagtggtttgctctggtttgagttaggatag

SEQ ID NO: 10699 - DNA, 186 bp, A.fumigatus
gctaaatgctatcctgcattataccttgtccatataaagtcttcccgcgctctccgagtcttatctgctggcaagagcgtgctgatgcaggctgccatgggtgagcccacgctatgtatgagcctacgctatcagaagatcatatatagcctacgccaaggtaaaatctgggtctcgccagcgtga

SEQ ID NO: 10700 - DNA, 192 bp, A.fumigatus
aacattctccatgcatcgtcctgcaatttcttgtccccagtgatgcggtacatgatgaaaaccgactcgatggcctcaggtctagaacaatatcagctctactacacccgatgcaagacggaaattaattctcagcaaatcacttaccgcagcaaatatctgggatccgtgatctcagttagaccaggttga

SEQ ID NO: 10701 - DNA, 273 bp, A.fumigatus
  unsure (34): Identity of nucleotide sequences at the above locations are unknown.
cgcccccacgctatctttcattcctgcgtgtcanagtccatagatgcgttgcacgctattgacagcattgattttactacccccgatgccacccagatcaatatattcgaaactactatccgatatgtaggagggttacttggtgcctacgacctgaccgacggtaaacacccgatccttctgaagaaggctgtagaactggccgacatgatctacgatgcttttgatactaccaatatgatgcctcagtctcgctggcaatggagcaggtaa

SEQ ID NO: 10702 - DNA, 894 bp, A.fumigatus
tactaccaatatgatgcctcagtctcgctggcaatggagcaggtaagccggccattgcttctggaaccactcaaagctgctgctaactatggccatagatctgcccgtggcctgagcattcaaccaagcagacaaactatcctcgcggaactgggttcattgaatctagaattcactacgctatcccagctgactcatgatcccaagtactttgatgcggtccaacgaatcacgaacgttctcgacgatgctcagaataagaccaaaatccctgggctgtggcctatgatggtcaacgctgaggatttagagtttacagatcctcgcttcactgtgggtggaatggccgactcaacgtatgagtatttgccgaaggagcatatgctactgggagctcggacggatcaataccgcaagatgtatgccgctgccatggaggcgatcaagaagcgcttattgtttcggcccatgaccaaaaacggcgaggacctcctcttcgccggaaacacccacacgggtctcgcaagcaacgcgcccccggagcctcaatgggaacatctgaaatgcttttttgggggcaccgtggggatcggggccaagatcttcaaccgcccggaggagctctcaattgcacgaaagctaacagatggctgtatctgggcatacgatgtcatgcccacgggaatcatgccggaaagcatgcatctcagcccttgccagagtatggatcattgtgaatgggacgagcagaagtggtaccaagatgtccggcggcgactagccaagggatcaaaggagaaagacacggttcaagaagccaagacaattatccgggacagtgggcttcaacctggtctaactgagatcacggatcccagatatttgctgcggtaa

SEQ ID NO: 10703 - DNA, 429 bp, A.fumigatus
tattgttctagacctgaggccatcgagtcggttttcatcatgtaccgcatcactggggacaagaaattgcaggacgatgcatggagaatgtttcagagcattgagaaagcgactcggaccaagtatgctcatgccgcgatcgacgacgtacgagacgtaaaggcaacccagttagattacatggagagtttctggttggcagagaccttgaagtacttctatctcatcttctccgaacccgggcttgtcagcctggatgattacgtactgtatgtgctgttgtcgtatgaggttttcgccaaagctaacgatcaagcaggaacacggaagcacatccattcaagcgtccctctgctcgtacataggcttctcagccaaacccttcctcttcatctcaatatgtcgaggcttatgctttcgcatggttaa

SEQ ID NO: 10704 - DNA, 1182 bp, A.fumigatus
ccgctcaatgtgcattgttccttcggtccggccgtgtgtgaaaacagatccctgtcagggtctacaccatcagcgcgtgaaaacatcactgccaagctgattccctatggagctcgactgatatctctgatggtcccggatcgcgatggcaaggagcaggatgttgtcattggctatgatgaccctaacgcctacctgaatgatacagagacagtccacaccttcttcggtgctgttgtgggtcggtacgccaatcgcatcaagaacggcacgttcaccatcggcagtaatgagtaccatgtcccgaagaatgagaacaacggcatcgacactctccacggaggcaaggtaggctacgaccaacggaactggactgtgacagcacattccaagtcttccgtcaccttcactctctacgatcaaggttgggaagactttcctggagacgtcatcacccacgccgtctacagtgtcgacacggctgtcactccacaaaacccaaagggtctcccccagctgaccaccaaactgatctcccttgccctgacggaggcgactccaattatgctctccaaccacatctactggaatctcaatgccttcaaggcccctaatgtcctaaatgacaccttcctgcaactcccttactccaaccgcctcatcgccacagatggcatcctcatccccaatggcaccatcctcacggtcgacgcgttcaacggcgcccccgatttcaccgagggcaagctcatcggcgccgatctcaaggatacctacggcatgtgcggcaccgactgcaccggctacgatacctgctggctcgtcgaccgaccccctcaatacgctgctccggactcgctcgtccctatcgttcgcatgaactccagcgcaaccggtatcagccttgaagtatcgtccaacatgccagcgcttcaaatatacacctgcgacaacgccaagatggactacctccccatcaagccgtctcaggagaagcgtaacaaggaagagggcaaggaaggcgcaaagaatgtcatgcaatatggctgcgtggtcatcgagcccgagggctggattgatggcatcaaccaccctgaatgggggcaattgccactgcagatcttctctcccaacgatggtccagctgtcaactgggctacttatcaattcggcactgtctag

SEQ ID NO: 10705 - DNA, 1692 bp, A.fumigatus
  unsure (1243),(1331): Identity of nucleotide sequences at the above locations are unknown.
gaagcaatggcgaccccgtccacagcctctcttgatgatgagaagcgctcagtttccgccaataccagtttccccctgaacttacgccacaatcaaaccggccgaccgtcgtcacctcatacacctcaacagcaattgcggtccagtaactcttcctttgcgagcaccggctcggggggtagttctttccgcggagaagaggacgcaattatttttgaacttggatcccggtggtttcgagctggatttgagggcgaaagcacacctatatgtgtagtgggatatgggccaaatgactggaggagagcgggcgactatagagggtgggtgaaagggatcgacaatacgagcagctcgcgagcagtcaatgcagatccatggactggtgcatacgaactgtggaggatggatttacgtgatgtcgacctgggactcatcgaggacaaaatcggacgggtatttcgggaaacatataacaaatatctgctgacagatgcgggcacatcacgattggtgctggtcatcccgtctatcatgccacatccgttattatcttcgattttgtcgactcttttcagtcgctggcgattccccagtatcacccttcttccgagccctgcaatggccgcggtagcagcagggctccgctcagcattggtggtagatctgggatgggcagaaactactgtaaccggtctgtatgaataccgagagatttccgccaagcgaagtacaagagccatgaagtccttgcttcaggagacagggaggatgctcactcgccttgcctcggacgccagtcgggaatctgaagttgcggacgacataaccgtcagcttcgagtactgcgaagaagtcgtcagtcgttttgcctggtgcaagccccgggtaggtgacaaagtagcttcactatctgaatcgcgcaacatgcaatcaccgactggaaacgtccccgaatccataggcaacaggatggtgtcgattccatctccatcgaatcctcattcgacctatattgatattccattttcggcgcttgcggagccggttgagaagatccttttcgccaaggaatcagcggagcgcgatttggacgacgaagaaaagtcaatacctttgttggtttacaacacgctactcggcctgccgcccgatgttaggggcacatgtatgtcgcggataatattcgttggaggtggtgctaatattcccggcatacgacggcgagttatcgacgaggtgncggcgatggtcaatgcatatggctggagcccagtccgcggcgaagcatttcagaaagtagaggagaagttcctagcttcgaggctganaacgccggcgcccgtgactggcagtcaaagttcagcggtaccggataatcaagatcaagaggcagccgaagaagaggtagatttcgttgagcagaagctacgccgtagcaaagacaaggacacgaaacaccaggtacatggtatactacgcgaggtggaatctctgggtgcctgggccggagccagtcttgtggcaagcctcaagatcaggggacaggtggagattgagcgggagaaatatctccagcatggtcttgctggtgccagccgggacttggaacatggccatgttcctgatcgacgttctggtcttcgagcaggcggggatcggtcaagctggacactagcagcctggggttga

SEQ ID NO: 10706 - DNA, 216 bp, A.fumigatus
catgaacacttcgctctcctcgacgagactgtcccctcgtcttccttttcggacatccaacagcgcggagtcgccatctcaatccggtggttctgcatcggtattacatctctagccatttcttctatttctgaggcttcccagtctccgcaagacaatcaaatggctatcaatctgtgggagaaacgattcgagaagagacatttttcttcgtaa

SEQ ID NO: 10707 - DNA, 213 bp, A.fumigatus
  unsure (57): Identity of nucleotide sequences at the above locations are unknown.
tgctgtattttctctccattattattcccttctttctctctcctctcttcccttttntactttctgagtgactcgacttacatagtaactatttacctatcagtcccctccttgtccgacctttccgcccaacaactgaggaagagaggtctcaatcatctgcttggcgggtcgttccgttgcaataaagtgcacaacatgcgattgccatag

SEQ ID NO: 10708 - DNA, 1683 bp, A.fumigatus
agaagtatcagggtcattgtggtcaatacgatatcacttggctgcgccattatgtcgaattttgtccttttgtggggaatggcgcgacgcatcgcgttctccattgcgcagcctataatcataattggatggtacatttcatcgttgctcttgacctgcctgctgtgtatttttgcagcgtcgaaagtacaaaacgactcggatagcggtaggcatcggtggctcactggatcctactattacggagcttttgcagcagggctatactttgtgctctcttccctcctcctaattaccgtctacggggcttgtcggggccattacagccgcgaatttcgactgacaaccagccagcggagtctgatgctgcaaaccattctctttctcatctacctcctcggtggagctgccgtatacgcaaggatcgaaggctggaggtatcttgatgctgtctattgggcggatctcacgcttctaactattggtatcggtgactttgttcccgagacgcataaaggacgggggcttttgtttccgtatgccgtcggaggtattctgattctggggttgatcgtaggctccatccgcgcccaaatgctcgagaagggacggcagaagatggcagaaactgtggcagaaaggacacgccggttcctcgtacgcgaagcagtatctgaccatcgacacctgcgggatgtggtcccacgcttgcagccggagagggatgagagtgaccgagaccgacaactgcgggagttccagttgatgcgacgtgtgcggcagattgccacgctcgagcgaaaatggatctcgctcgccacggcgttgaccgtgtggacgatgctctgggtcttgggagcgatcgccttttggctccctggacagaatgaaaagttaacgtattttgaggcgctgtattttgcctatacaactttgttcactatcggttatggggactttcacgctacttccgaatgggaacggccattctttgttttttggacgttgctcgctgttccgacggtgacgttgctcattgccaacgttggtgacacgttggtgcggacgatccgcgatttcaccatctaccttggggagctgaccattctgcctggggataaacctatcagggaattgatcaaagatctgttccgcctttcgtgggcagagagattccttaccgaagcagttgcggacaagaagcctgacgaggaggatgttgaggagtctgctgccaccgctactgccacagcagtcaggaacgcaaaccagggtgaccagggagaagagcaggagcgcaacgcgattgaggcagacgggcacaggaaagaagaatcggctcgggcacggggagacgtcacagtggaaacaatacatcaccaccactacatgctatttcgggaagtccgcaggatgatggactatgccacgcgcaatctgcacaaggagttcgattaccaagagtgggagtatttccttaatctcatagccagcgatggaggtgaaaccgatggagaggaagggaattcgaaatgggattggactgggtacaagagtccgttgttaggacagaagacggaggtgcaatggttactggaggcgcttaccgaagcgctggagagggagttgaggaaggccagccggggttatcacttgtctgagcagagcgagtttgaacaataa

SEQ ID NO: 10709 - DNA, 210 bp, A.fumigatus
  unsure (180): Identity of nucleotide sequences at the above locations are unknown.
tatctagttatagagatagtcctagttaatagcactgacctctttatattatatctactagtagaagagcttaatattatttatctagagggagtctctattaaatataatctaattagcctctttattataattcttattatcttaattagaatagcaagtcgtaccagtagtaatatnagacctgacacgccagggaatggaaagtaa

SEQ ID NO: 10710 - DNA, 231 bp, A.fumigatus
tatatactagtctataacttcttcctatttattagttttaaatatatatatactaattattctgtctttattaaatatagtattactatactactctatatagataatattcttatacttttaaattctaataatcttattaataacttccttaagcagctaggaaaattatttaaatatattaataatagcaaggtttctgtctacctagggattgatatactatattaa

SEQ ID NO: 10711 - DNA, 186 bp, A.fumigatus
cttatactaggaacctatctagatattacttttactatatctaagcttacttactttactaggaatcctagccctaattacttcattatagtaaagtatatattctgctatctaatagagacacttttactcttattattctatctttctatacttagtaataatagttttattaatactaattag

SEQ ID NO: 10712 - DNA, 888 bp, A.fumigatus
ggtgccggcatgccccttcgggccaattatggacctgatagaggtgacattgtgggaccacgcactccaaagaaaaaaagggttaagacaaaggccaaaaaggacgtgcatatggacgcgctcgatcccgccactcccatcagagaatccttgcctttgactccacccccgtccatgccaggtccctccgacaatcttggctcttcgttcggtcagagtgcagcttccccggagtcgatgactgccattttcagttctccttctcctatcccaagctccccttttccgttttcgcctgtctttagttctcctcttctttctcctgtcctttctccagtctcctctcctgtccccggttctccggttcctacttttactgtccctgaggaggacgacctcgactctcctctggaggataccctctataatggagacatgtgtccttgcaacttcgactttttgatcaagggagaatcgcgtcaaggactcgactggctgcatccttgcgaggaggagcttttggacctacgcagggatgtgcccaaagccttgaagacgtcccgacggcctcaaatgaagcgccagcacacggccttcaagaagtcactgcctttctgcaataccgattccctgtatgccaaatttgccaacaagttcgacctcgacgacatgatcaacgttgttccaaagtctcgcacgactgcgccgccattgccggatccactaattccatccctcgtctgcgagcccatgacgttgcgtccaatattccacccacgtcctaacaacgagagcgtattgaaatcggtatccgacgtcgcgctcaacgagtattacgccgggcagaagttccttttcgaaatgccttacgtaaagggcgtcatgtga

SEQ ID NO: 10713 - DNA, 198 bp, A.fumigatus
agtaaaggagtcaacgagcacacgcaagcttgcgagaactgtcgcgtcacctgtcttgaaccgactaagaatatgcatgccaaatcgggctcgatcatcgtaggggaccaatccaagaaacttggtaacggaaagaaggtcttcaaggcgattctggatgggagtaccggtcacggaccagcgtcgctgagcgtttag

SEQ ID NO: 10714 - DNA, 2622 bp, A.fumigatus
gcggaagaacggactatggcgtcccacgccgccatgctcctggatcccaaggcctacagaaaacaacttcagaagaatggtaacgacccagagatttcatatgcgtcgccagattcccacataagcgcgcagaatgaagcgcctgatgaacccttgtttttcttcccatcatccagtcgatgctcctctccgccagaggaccccgagtacttggatccaaatgacttacttgtcgacggaacaggccagcaaagtaccagcgcatcacctcgtagtgccccaacgactgccgcgccagctgggacagtttccgctgcacatcaacttctcaacccgcagcgccgcccacggtcatccaaggtcagtccgaaatcgaactcggggtcgcagacggagtcggtccgatcgcaagaagagggcagtgcgagctcatcgccacgccggccagccaggaatgggcctgcaccagagattgagtttatgagcgcacagtccgaggacgataatgactggaaacggaactcggatcacctcgatagtgacgttgaagcgcgccacgccagcctcatcgaggatatgtacggggtggagaaacgggtccaccagccttacaaaaagatcaaaagggagaatgacaaggaagcatcgaagacaggcaggaatgggccgattaccatcaccggggacactcagttgggcaaatatatgaaagaggacaaggggaagtctgagtattcctccccggcgacaccaagtgtggttgatctgaccatcggtgagaaaatatcggacggttctgagaagagagatgattgtatgctgacagggtcatgcacagataagactggtgctactaatgatgacgacgacttgcaggtcaccgggtcgaacaatctcagtgtccagcgggtatgctatgaaaggttggataatgcgatgatacaagcacaaattgtgcccaaacctgctgcacaaaatatctttggcgactcggcgcacgattggccttcaataaagctgggcgtacatagacacccagatcggaacagctacagaattgatgtttcggatccgcatgggaagatctttggtgcagttgacgcgaaaactgcagctgtgattgtcccattgctcgactcgcaggctctcaaagttgacatgacagcgcgattagacgttcgcagaaggctgcctggtgaaatgccatgggccccctgctctgctctctatagagcgtcgatcaatctctacggtctgaggaaagatgctgagctggttggcaagcacctcgggcagcacaatgtttggcttgggacaccgttctctgttgaacaaggagtaccagtgttcaatccgcatgctgagcggcggcgagctcaggcggcctccttcttaccatcaatagctgcgaggggccgaacgggtgttagctacgaggttcggaccgcggaagaggtcaacgatgcggtcatgaagatgttcgatcagcttcagagcgcgcagaatcttccggaaatggagcccccggattcggtgttgacgccactcctccgccatcaaaagcaagctctatggttcatgactgagaaagagaagccacgcaagtttggtcccaaagaggaggataacaattccctttggaggatagaatatcgcgcaaatggggtcaagcggtatcgcgaaatcatcagcggcattgtcctcgacgaagagccgcctcagagcttaggaggcttattagcagatatgatgggtcttggaaagacattgagcattctttcgctcgttgtttcctctttgcatcaggctcatgaatgggcgacgaaaataccggagcccgacattgtgcgaagcctacctggtattcgcaactgcaagaccactcttttagtcgttcctctcagtactgtcaacaactgggtttcacagatcaaagagcatttgaaggaaaatgccatctcatactacgtgttccacggctcctccagaaccaacgatgtggacgaactgtcgagctacgacgtggtgatcacaacctacagcattgtgctatccgaactgtctcagagaggatccaagcggggcgtaagtcctttgacgaagatgaatttgtttcgtattgttttggacgaagcgcacaacatccgagagcaaagtgctgcccagacgcaagcaatattcaagctaaacgctcagcgacgctggtccgtgaccggtactcccatccagaatcgccttgaagaccttctttccgttaccaagtttcttggattggtcccctacgatgatcgagcccgatttggcatgcatattcttagtcggttcaagacaggtgacgcgacagttctcgcaagcttgcgtgtgctcgttgactcctttactctacgtcgggtcaaagataagattgacattcctcctcggcatgacaagattatcacgctcgacttctctgaaaaggagaagcagctgcatgaattcttccggaaggagtctaatgtcatgatgagggtgattgcaggagaggacaagacgaagatgaagggacgaatgtaccatcatattcttaaaacaatgatgatcttgcgacagatcagtgcacaacggaaaagagcttctcgatag

SEQ ID NO: 10715 - DNA, 207 bp, A.fumigatus
ctcaatccggcgacctttgtatgcaacgatcgcgttgccgctgtcggttacgaatccaaccccaaagtttccggcaccaaagacgttcacctcgatcccgtaatttgttttgtctgtctgaccgtactcgcctctcacgtcacggatttcggcccacgactcgagctcttcccgactgagggtgatcagccgtctcaatgttcttga

SEQ ID NO: 10716 - DNA, 789 bp, A.fumigatus
agtaaagaggcaaaggtgagttaccatgaccctttacaatcttccgaccctttatcgcacgctgacggactgctgtctagtcatgagggactctattcggacaaggaaaatgcgcctgctgcaggtgactctcttgatgtgctcaagaaccctaagaggcgtgccaacgcggccggtccctcacgcgtcgtttctcaagaggtccgaggcgcagactatcggatcctctcaccaaagtctttgaactccagaacgtacccacagtcaccgttccgtgcctctcctgagaaacctcataactcatcatatctctctcgtcccatgtcgcccctgaaaccatccagccccctcaaatcgacgtcagccagtgcagcgggaaacgcagataatgcacggtcgcggaccaccaaggccaatacaacttccacaagggacacgaggccaccatcccaaactaagagacccgccagccgagctgccacgacaacaaagactgtccggtcccccttgtcccgtcctgctacccaactcgaccgcagggggagcatctcctccaccgcttcctcgggaacgacggtgatgaagccaggcagaccaggagcgggtactaggaaagcaaccactgtttcttctgcaagtgctcccgttaagaggacaacgattgcccgcaaccaagcgccttccgtggcctccaaaagaagcacagcgtctgcgaccaggaaggccactgcccccgcaggtaacgaggcttcagccacaggacgtcgagtgctgcgcaagcgagcgtga

SEQ ID NO: 10717 - DNA, 252 bp, A.fumigatus
tcatgcgggcgcgggggatgcgaattggcgcctgacgccggaacatctggccaggcctttcgggatgaagtggtgcgcttttcttggagcatattttcgaactacaagtataccaacttcatgcctaaaagtctagtctcaactgagctgatcgttgtgtataatactgagataaatattttatctcatttctctacgtcgatagatgccacggatgtatataatctcgtcaccgtggctagatcattttga

SEQ ID NO: 10718 - DNA, 228 bp, A.fumigatus
tgtgtttggattgcgcagaccgcgaaaatcggttcgttagtagatgtgaccgagtctgcagaccccgagggtctccgagttttctactacctcgttcaggatctgaaagcgctcatattttctctcatctcgctccatttcaaggtacttttccgagattttttcgacctccagacaatctacttactccttcattacttctgcagattaagcctatctaagtcatga

SEQ ID NO: 10719 - DNA, 417 bp, A.fumigatus
cgtcctcttgcacctgtaggtcttaccgaggatcatcctactctgacaacgttcttcgaaggagaaatcattggtaccaaacacactttcaagaccagaaatgaagcgtggggtgcgacggagaagaccgacatgcaccattgggccagatttcctgcctggcggcctcttgccaaacaggcgaagaagcctgatttcacctactggaacttcgcagagcgtgagcacatattcatgcgatggaaagagtactttcttgttcctgatcatcgggtgagaacgatctcaggcgcgagcttcgagggcttctattacatatgcttcaaccaaataaaaagaagtgtgactggcatttactttcatgcgaagagtgagaagtacgtatcagtcaaacagctaaccgttctgggatcctga

SEQ ID NO: 10720 - DNA, 456 bp, A.fumigatus
ttagcctcaatgccgacaccgagtgacaacacatctcctctgaacgttgcatcaatcaccgaggacatatctactcatacaacctgcccacctgaagttgagcgattgtcctcttggagagactctccggagccctctgccacggagagcgatgtccccgacaatgcttcgtcaccttccattcgatcagcgcataccctcttgactgcccaacctgatggaaccatcaatcagtccaacacagatgtctcaggagttgcatccggccataccgctcctgaaaaaggcacgatgagatccgatgacgaagttgcattgggcagattgagccctacgaggggaacagcaagctccgcaaagccaacgtcgactgttgcatcgccatccactgcttcacttgtaagctatgaattttctcatgttcgggttagtgagccagctctcttgcgccgataa

SEQ ID NO: 10721 - DNA, 1749 bp, A.fumigatus
aggcttttgtcaagaaccagagttaagccagccgtccagagaagattttttgctccatcccgatctggaccggctcgaaaccggttccaacggaaacaggccaacctgaaagatgtggttcgagtaaatcaggttgcgattcgtctgcctggctttgtcaagttcgctcgagaatgtcatggacgagcaataccagactctttggagacggaatacaccagcaaggtgcgcagccactcggacagcgtagccaagctggaggaaatggtggagactaccgtcgacctggctgcgttagagaaccacgagttcatcatcaagccagagttcgatgacagtctgcgcatcattcggaagaaattggataagctgcgacatgacatggacgtggagcatcgccgggtggcgaaggacctggatcaggaggtagacaagaagctgttcttggagaatcaccgcgtgcatggctggtgcttccgtctgacccgaaacgaggcgggctgcatcagaaacaagagagagtaccaggaatgctccacccagaagaacggagtgtacttcaccacttcaacgatgcaagctctgcgccgggagcatgatcagctctcatctaactacaaccggacccagtcagggttggtgaatgaggtggtgaacgtggctgcatcctactgtcccgtgctggaacagcttgctggtgttctcgcccatctcgatgtcatcgtcagcttcgcccatgctgctgtgcatgctccaaccgcatatgtccgccccaagatgcacccgcgcggcacgggaaatacgatccttaaggaggcgcggcatccctgtatggaaatgcaggacgacatctccttcatcaccaacgacgtatccctgatccgcgacgagtcctccttcctcatcatcaccggtcccaacatgggtggtaaatcaacctacatccgtcaaatcggcgttattgcgctcatggcccagacggggtgcttcgtgccctgttctgaggctgagctcacaatcttcgattgcatcctcgcccgtgtcggcgcaagcgattcgcagctcaagggcgtctcgactttcatggccgagatgcttgagacgtccaatatcctcaagtccgcgacctcagagtccctcatcatcatagacgagctgggccgtggcaccagcacctacgacggctttggcttggcatgggccatctccgagcacattgtcaccgagatccgctgctttgggctcttcgcaactcatttccacgagctcacggctctcgcggaccgataccccaaatctgtcaaaaacctgcacgtggtggccttcatcggagacggcactaacgacaatgcaggagaagaaaggcctaagaagcagcaggtgactctgctttaccgcgtcgagcccggtatctgcgaccagtccttcggtatccacgtcgcggagctggttcggttccccgagaaagtagtcaatatggcccggcaaaaagccgaggagctcgaagattttacgtctgcagaggcccaggggcagcaggctggcgcgtctatcgatggatattctcaggaagaggtggaggagggcagcgcgctactcaaggggatgctgttgaagtggaaggcggagattgagtcgcatgacaggaagttgacggtcgaggaaaagagacagatcatgcgtgatcttgtcaatgctgatgagaagctccgggccaacaaggtcttccagagtatcaaggctttgtga

SEQ ID NO: 10722 - DNA, 804 bp, A.fumigatus
cacttgaagcagctaacatataccctcaggggcttggcaaccactcctaatgggatagagttccagggcaaggtcatcgcgtgtggtgctttcccaattggcattgaccccgagaagtttcaggaaggtctcaaaaaggaaaaggtccagaaacggatagcacagctcgagcagaaattccagggcgtgaagctcatggtgggtgttgatcgtctcgattacatcaagggagttcctcagaagctgcatgctctcgaagtcttcctcagtgatcatccggaatgggtgggaaaagttgtgttggtacaagtcgcagtgcccagtagacaagatgttgaggagtatcagaatttgagggcggtcgtgaatgaattggtggggcgcatcaacggtaaattcggtgggtgctcagcagccgtcgttctatcttgggcatcaatatctgacctgggagctataggaacggttgaatttatgcccattcatttcctgcacaagtcagtcaacttcgacgagctgattgctctgtatgctgtttctgatgcatgcatcgtatcgtcgacccgagatggcatgaacttggtggcatatgagtatatagcttctcagcaaaaacgacatggcgtgctagttctgtcagaattcgctggtgcggcccagagtctcaacggcagtataatcatcaatccttggaatacggaagagttagccggtgcttaccaagaggctgtcactatgagtgacgagcagagggccctcaacttctccaaactggacaagtatgtcaataaatatacaaggtga

SEQ ID NO: 10723 - DNA, 405 bp, A.fumigatus
  unsure (333): Identity of nucleotide sequences at the above locations are unknown.
gatctcggagaggagatcatttcttacacaaaaatgccccccagcaatatcataagggcaatgcagcccctccgagcctgcatcccccggtcaacaatcaccaactcctcaatccaagcgtcgtccctccagtcaacacggtcaagcaacttcgtcagacgcaccgcttcaaccacagccccagtcgccaaacaaccacaacagacagcccccgaactcacaccctcgtcgaccatcgcacccccttccctgcgcaagtatccctacaccctcaaaattggcaccgtcgtctccgtcggccgcatggagcgcaccgtccgcgtcagccaccgncatacaacctgggacccgtaccttcgcaagtcctaccccaagatcacgcactaccttgtcgcggacccccgc

SEQ ID NO: 10724 - DNA, 204 bp, A.fumigatus
ttatttcccggattcctgcagttctggctgtcggccaaacacctcattctctcctcgaccagctacctgctgtcaacgcccctgcagcgtcgctgtgacattgtcgatcgcctcgattatcgctccggtagtgatcgagcatgtcgtttcctgcagatacctaattacgggaacctttttgcgcttgcaaatcgatcgacctga

SEQ ID NO: 10725 - DNA, 885 bp, A.fumigatus
  unsure (179): Identity of nucleotide sequences at the above locations are unknown.
tctcaaggattctcagccggagaagatcaccaagactccggtgcgaaagaaagacgatgttcctggcttcagaaacctacaagtcatgccaaaatcggcagtcgcagtcgaaagtcaggcaagccgaatggccacgccgcggatgcggggaactcgcaaggccatttactgacgactcntatatcttccaatgccaagcgcaaggcgcaagctctgccgtctaagttaaactttcgcgcctctcataaagatcctcagatgaaacgcaagtctctggctaccgaggccgagctggccaacgcatttagagacaaatccggctcgaagtcctcgaccatggctcctgcaacaacgcaaatcgatcgcaaggcaagaaagtctatgcctgcaaagctcaacggtgtgaccgacaagaaagagactgtccatcctaagtcgtctgccaaactatccgcttctcgcccttccactccgcttcgaattgatcgtaaaaccaagtcaacatctcaagccagcgtcaaggcgaccaagtctgccaacaaggtggctcaagttacatcagccaaagctgctactcccgttgcccccaagactgaaaaggctgaaacagccgactcaacaactcccgccgctcaggctaaaacaaattcacgggactctactgccagatcccgtcgtcgtgatctcaagtccaagaccgggacggatcgcagccttggggatcatatccaagagtcgtcgactaagcacaatcccaaacctcctgtccaaatttacgagactccatcccagcctccctctgccccagatactaccctcgaagcagctcaacttctttctcaacaacataaacacgtcttcacgacggggctggaagatacgcat

SEQ ID NO: 10726 - DNA, 843 bp, A.fumigatus
cggtacctgctgggaggtcagctcccaatccgccctgacccacaatggcggcggcgacagcaattccatcgccaacatggttacctggaccatcagccaatacaacgccgacaccagcaaggtgttcgtcacagggtccagctccggagctatgatgacggtgagcatcacgcgagaatcaaagcagaccacatacatactaacccgaacgacagaacgtcatggccgccacataccccgaacttttcgccgccgcgacagtctactccggcgtccccgccggctgtttctactcctcctccaaccaagtcaacgcctggaacagcagctgcgcccagggcaacgtcatcagcaccccagaggtctggggcggtatcgccaaagcaatgtacccggggtataccggcccacgtccccgcatgcagatctaccacggcagcgtggataccactctctacccgcagaattactacgaaacctgcaagcagtgggcgggtgtcttcgggtacaactataactcgccgcagtcgacccagagcaacaccccgcaggcgaaataccagaataccatctggggcccgaatctgcagggcatatttgcaacgggcgtcggacatacggttcctattcatggggagcaggacatggagtggtttgggtttaccgggggttcgtcgtagacgtcgacgacgattactactacaacgcctccgacgacgagcacgacgacatcgtcgggggggtcgtcgaccagcactggtgttgcagagcactggggtcaatgtggcggcaatgggtggacggggccgacggcgtgtgcgagcgggtatacctgcaccgtga

SEQ ID NO: 10727 - DNA, 663 bp, A.fumigatus
gtgcagcacgagtcatgcaaccaggtgcgaaagtcgctgacactctcaggcaccggaaccgcacaagcatactacacaggatccccctatgcacagctggccgagaagtatggcttcatcgtcatctacccccagagtccctatagcggtacctgctgggaggtcagctcccaatccgccctgacccacaatggcggcggcgacagcaattccatcgccaacatggttacctggaccatcagccaatacaacgccgacaccagcaaggtgttcgtcacagggtccagctccggagctatgatgacggtgagcatcacgcgagaatcaaagcagaccacatacatactaacccgaacgacagaacgtcatggccgccacataccccgaacttttcgccgccgcgacagtctactccggcgtccccgccggctgtttctactcctcctccaaccaagtcaacgcctggaacagcagctgcgcccagggcaacgtcatcagcaccccagaggtctggggcggtatcgccaaagcaatgtacccggggtataccggcccacgtccccgcatgcagatctaccacggcagcgtggataccactctctacccgcagaattactacgaaacctgcaagcagtgggcgggtgtcttcgggtacaactataa

SEQ ID NO: 10728 - DNA, 366 bp, A.fumigatus
tttgaaaacccgggtaatcaggtcggcgaggataaaacccagcccatcggcctgaatgtactgtgtttctttcccactactcgaacggaattacctgctcctctgaacgacgccatgcgagctctctctgttttcgttgcactcttctctttcctggcactatcatccgcctctccagggcaagatgtggccaagcgagtcaccagcggatcgcttcagcaagtgaccaacttcggatctaacccctcgggcacgctcatgtacatatatgtccctaacaacctagccactaagcctggaattgtcgttgctattcattactgtaggtgcagcacgagtcatgcaaccaggtgcgaaagtcgctga

SEQ ID NO: 10729 - DNA, 477 bp, A.fumigatus
cccgaacgacagaacgtcatggccgccacataccccgaacttttcgccgccgcgacagtctactccggcgtccccgccggctgtttctactcctcctccaaccaagtcaacgcctggaacagcagctgcgcccagggcaacgtcatcagcaccccagaggtctggggcggtatcgccaaagcaatgtacccggggtataccggcccacgtccccgcatgcagatctaccacggcagcgtggataccactctctacccgcagaattactacgaaacctgcaagcagtgggcgggtgtcttcgggtacaactataactcgccgcagtcgacccagagcaacaccccgcaggcgaaataccagaataccatctggggcccgaatctgcagggcatatttgcaacgggcgtcggacatacggttcctattcatggggagcaggacatggagtggtttgggtttaccgggggttcgtcgtag

SEQ ID NO: 10730 - DNA, 192 bp, A.fumigatus
acgtcgacgacgattactactacaacgcctccgacgacgagcacgacgacatcgtcgggggggtcgtcgaccagcactggtgttgcagagcactggggtcaatgtggcggcaatgggtggacggggccgacggcgtgtgcgagcgggtatacctgcaccgtgataaatgagtggtattcccagtgtttgtag

SEQ ID NO: 10731 - DNA, 327 bp, A.fumigatus
cttgatctgctccattctctagacttctatacgtggactcgggatgcggcgttgactttcaaaggacttgtcgatatcttcattgggggcgatacatttatcgtcgtcaatctcgacggtcttgaaacccacatccaggactacatctcttcccaggcagttttgcagaacgtgtccaacccatccggaagactttctgacggctctggactcggcgagcccaagttcgaggtcaatttcaacccatactccggcggttggggccgtccccagcgcgatggtcctgcccttcgcgccattaccatgttgacctatattcgtcactag

SEQ ID NO: 10732 - DNA, 189 bp, A.fumigatus
  unsure (32),(62): Identity of nucleotide sequences at the above locations are unknown.
ctctggctgagagacggcctagaatcagaagntgtggcattgaaagagtctaactctttttntgagttctttttaaacatgtacctgaatattaaatcacaaaattatgcaagtttaaatcatttcctgatgcatttggactttagaggtttgatatgcatgtctttggatatgtacagtctcagttag

SEQ ID NO: 10733 - DNA, 1047 bp, A.fumigatus
agaccaactagcccaagttcatgccttacacaatatgttacagaatacatactctcagttcagcaggcagaggatcattttgcagcttttatctctgttgcttatatggctattgatgtgaccactcttgggcctgggttcacccacgggcctggccttggctttccctcgcggactggtctgcgcccagaagattttggcttaccctcggcacctactctacccatacgacccggaaacgatttcattaatgtgcttaacaaactacgttcgcaagtaggcgttggcgtatccccagcaaaattatatcttgccatcaagagtttaagcgcaagtgatacggcgacgcttacaagccaatttctcagcctgaaacccctggctgagcacgaacaaggagagtttaccacgaaagtcagtcaggcgctctcatcggaggaaggtagaaccacccttgaggacgctgctcttgctgctgccagagcttgcaaagatattaagcaccagtttattgaattacggcttgcattaaaggccattggcgatgcgcagccaggcaatcaatcggcaattcaaggtttacaggaaaggcttcaaaagtgtgagaaagtacgtacacatttccagaatactccgagcacgactaaatataaccagaaatatgatggagtcatcgaaaagtgcaaagaattatccatgcaaatcagcgtctactgcgagcagtttcagggctcgttaatgccatatgtgcaagccccaatcgaaacaaatgaaaaggaagattttatcaacaaatacatcaaagtaggtgtacgctgcgatattggactgccagagctaatattttataagaaaatggaggaattcggcgatttgtctaagaaaatcgaggaagaattaaatagcctccacagtaacttcggatatctgatgactgagttcttgaacttcaccaacaaccaacaaccggatttggcggggagtatccagcaaatcgaaagcaaaattcaagaactaaataagaggctttgcggtttgaaaagttag

SEQ ID NO: 10734 - DNA, 186 bp, A.fumigatus
agtctccatgcctaccgtccttcaagtacttttgcttctagcacatttcactgttacggtgcagagattcaatttacaatggagaaagtgcaatggctggatttcaagacgaccggtaatctagatcagatgatctctgttgtccttggacatatcggaaaagaaattctctggttccgtggctag

SEQ ID NO: 10735 - DNA, 573 bp, A.fumigatus
aaacacctcagctccggtagcgatcccaccgccggggatgccattccggatgaatgcatcatagtcgcttcgtccatcaaatgggatgtaggtgaagttcaatccgtgcgcctcatagaactcggtgtagaggtcccgcagctgttccgatccaaccgggttgaccgcgtttgtggcgttgtagacctggtaggcgaagttgggcgaggccagcatgtcatagtccataaacagccggatcttcaggttctcggcctcggacagcaccgagacatagtagtccgatccgagcagtccttcttcctcccccgcccaccaggccagtcgcacacagttgttgacccggtaatgaggcagcaaagaagcgatctccagcaaggtcaaggaacccgatccatcgtcgttgatgccaggtccttccatcacgctgtcgctgtgtgcaccggccatcacgcaattgtcggcatctccttctttggtttgcgcaatgatattggtggtggtgatggtctccaccgtggcatccatgtaggcgatcgcatcaacctttcggccgcgcctgagttgttctag

SEQ ID NO: 10736 - DNA, 1392 bp, A.fumigatus
caattgcacagcacaccactactgatgtccagaatggtagcatcgacaatacaccttttatgcaccgcttttgctctcacagcagaaggggcggctctgcagctccctctcttcggtgcctcggaaccccaaattccggtggctgggaaggaattgatcagctcctccgcgctgcaaagccagatcgatgtcggcaagctcctcaacagagccaagcacctgtatagcatcgcagagcttgggtctgacgagtataatcatcccacgcgcgtgattggcagtaaaggttcgtttggagctgtttggcgtcacgtatcacaagggagactaactcacgtgacctcagggcatctggggacactggactacatctatgcgactctgacggaattcgacgactactacaccatctccaaccagaccttccctgcagttaccggcaatgtgatggaatcacgcttggtgctcggccacaccgtgccggagtctgctcttcccatgggcttgacaccccccaccaagaaccacgaaccggtgtacggaccactggtgcttgtctcacgcctgggctgtgaggcagcagactaccccccagagctccagggtgccattgcattcatcagccgaggcagctgtccctttggcaccaagtccgccttggccggaaaggccggagccgtggctgcggtgatcttcaacaacgaaaaaggcggcctcgggggcactctgggcactccgtctcccgaccacgtcgctacctttggcctttccgacagtgatgcggcgcccttcctagaacaactcaggcgcggccgaaaggttgatgcgatcgcctacatggatgccacggtggagaccatcaccaccaccaatatcattgcgcaaaccaaagaaggagatgccgacaattgcgtgatggccggtgcacacagcgacagcgtgatggaaggacctggcatcaacgacgatggatcgggttccttgaccttgctggagatcgcttctttgctgcctcattaccgggtcaacaactgtgtgcgactggcctggtgggcgggggaggaagaaggactgctcggatcggactactatgtctcggtgctgtccgaggccgagaacctgaagatccggctgtttatggactatgacatgctggcctcgcccaacttcgcctaccaggtctacaacgccacaaacgcggtcaacccggttggatcggaacagctgcgggacctctacaccgagttctatgaggcgcacggattgaacttcacctacatcccatttgatggacgaagcgactatgatgcattcatccggaatggcatccccggcggtgggatcgctaccggagctgaggtgttttcaccaggcggtcgcgatcaacgtaca

SEQ ID NO: 10737 - DNA, 576 bp, A.fumigatus
aatgagcatgtggccgcgacaatggcctacgtcttccatatcgacaacgtggaagttccgtcgctggaattccggcaaatctccgaatccgccagcctggccgaggtcgaacacgaccccgacgacacaatctggctgaaacaagtctacggcctggaagacggagaacctattgtccaaactgtcggcaggatcagaacgcccgtcggccgagttatcattgtgccggcaaccatccagcaccgtgtgaaccactgcgagttgattgacaaaaccaggcctgggtccgttaaggtgctctccctattcctagtcgatcccaacattcgtatcatttcgacggccaatgtcccgccccagagactggattggtcctttgacgatatcgatccccaggaactggaagggctggatcgaatgctgcaacagctcaccgttcggttctcggaaaggaaggacagtctaccaatctctctgaacgaggctaggaaactccatgacgaagttttttgggagaggtttcagttcaccaagtatgagcaggttgcctttgaatcaaacgtagtcattctttga

SEQ ID NO: 10738 - DNA, 909 bp, A.fumigatus
cgcggatcttggctccctgttgagaacactatgcccgatcacgtcccatcgggcttgaaattctataacccggggagtgactatgtgcaacgcgaccttgccccgattgcattgtttcctcttgtgtatgggcggactcgtattctcaaggatcgaatcattggactggatgatgcattggacagcatgggccaaggggaggtgatccctgtccctccggaaacaatcacgcgcgaagacatagcatggagagtcgctgctcacgctgacattgaggcaaagcctttcagtcgcaggttccagattctcccatttgacctcgagttgaaggacgacggcaggtggcacattatcagttatatcaacaacctacatccagtgcgtcaccgcaacatatacaagctgatcgaggacgtgttcaacatgacaatccctcaatggaatgcgtccctgactccgctcaaggatatgcttcactcccgtgcacggcttgagtacaaaaaggcccagtaccatcctattgcaaaagaggtcgaggaacaatcgcctcagccaaaacccagcgaggcggaagtagattatcaagatagacttaattcatggaggatggagcactgggaagccgtccaacccgatgctgggagattcattccctgggctgtaccaccctggatgatgtgctttctgccagcggatcttccgaccccggttcgaattgagcagggggttgaactgaacagagattatgggaaacgggggctacaaatgatttgtagaatcacctgttacgatctgacgcctgaacatccgtatactgagacgggctatcactgcgaagggcagatggtgagattctttcgcaattgcacatccagtgcctctcttttactgatcgtcaccgtagaatga

SEQ ID NO: 10739 - DNA, 267 bp, A.fumigatus
gttatctttatttacacttcacagatcgccgaagtccgtaattacttccaaacgtgcaagaagcagtacgaggagcaagccgaaaaatttaatacatccaagctgccgagcgatgtcccgggctccacgctgctccttggggccatgaagcctgcgagccgcgcagagattatgtcttcctttccctcgagatatacatcagatatgcttattgctcgctatttcaatagctatgatccagcgactcgtgagtaccgacagaactag

SEQ ID NO: 10740 - DNA, 825 bp, A.fumigatus
ccttctccgcagtataacaaacattgggaagatccttcgcaatcctgcattgtctgggtgggtatgctgttcgccatgatgcgacttgctatgctgtcatataaccatgaaggagatgagccacccgagtttcgagggaaatccctggatatggctggaagttttcgaaatctggtcgctcaatgtccgactctggccgattataccaaaccttatccctacttaatcgagacattcatcttccatcttcatggcgactttcgccaaacgaaggaagcagatatttcggtgtgggtgctcgtcggtgtcgtcgcaaggctagcgatgagaatgggataccaccgggactcgaaagttttccccaacattaccccctttcaaggggagatgcgccgacgcgtatggactttcgtgcggcagtcggacttgctcttttcatttcaggttgggcttcccagcatgattcgcactgtggatagtgatacggagctcccgcggaatctatatgatgatgatttcgacgaaaactgcaaggaacttcctccctcacgaccggcgaatgaaccgacccctatctcttacctcattgccaaagcacgtctggcgtacgtatttggtcgcgttaccgagctcacctcgagtgtgcaaagtgaatcgtacgacaaggtgatggagttggatgctgagcttcgccgagcccgggacctgattccggagcatcttgtcattcgtccttttgaggagtgtcagttggacccgtccaatctgattatgtcgcgctttggtgtacgtcaatcacttgccagtcataagcgcgagttgtag

SEQ ID NO: 10741 - DNA, 402 bp, A.fumigatus
tatgcagctgaacttggattgggtacgcttgccccttttttcatccctttgacaccactgggcattactaacaccggcgaacaggattcttgggacacttatattcagagttcgaatctcgacatacctaaccaatggtggccaacgttcgatggacagcagcagcaaccatcaccacaaccatcgcttcacccatcgttacaagctcaggggtccttgtcatctacgcaattatcttccatgcagcaaggcaacactgtagataatatgcggtcgttgcctcgattttctaatgtcttctcttcagacccggtgaagtacgagggcctgggtattaacgggccttacgacaacaactctcctcaaaaaagcaataacgcttcaggcgagggtaccttataa

SEQ ID NO: 10742 - DNA, 375 bp, A.fumigatus
  unsure (145): Identity of nucleotide sequences at the above locations are unknown.
gcgtcaagttccccggacgatatgcagaacagaatagacagactcgagagcttggtactgtccctgatgaccaacggatcacagtccgcaggtccagcagcggcaatggcagcaatttccggaacgagcagtagtggcggctccntcaatcaaacccacgacatcgacctggacgaggagacttcaaatgctccggaggagagcgatacggagcaagttacaaagtcatttggtatcatgaaagtcgacaacaataaatcatattatatcagcgatgcgcactgggcttccctgctcaacgatgtgagtcagcacttgaccatgcgcttaatgagttatctttatttacacttcacagatcgccgaagtccgtaa

SEQ ID NO: 10743 - DNA, 987 bp, A.fumigatus
tcagttgttgccccgcaatttcctacaaatttctccatcttacgattacgtgcaataacagagccaagatcgatattaggatcagcaaaccccctcagaatggcaaaacagcttcgggtcagtctgacgacgactctcactctcctggagcaactgcaagctgctctttcagctcccgccgaagaccccaagcccgctgaactttctggaaaggatgcccttcccctcctttccacgtcagctaccgcgttgaaatcccaggtcacaaagctatccctcttgacgataacttctccattcactcactcggcggttggcaccgttctgtcggcattaaatagttccgtacttccgtctctcgtgacgggggctctccttgtcactcctgccgaccatacaaaggctttccacgcggaggtacacgctttgacgaagactacgttgagggaattgacttctttggtaaccgaggttcaagctgttgccgaaaaggcggacaaggcaaaggaaggtcaaaggaaaggagggaaacttttgcaggcagagaaggatcctgtgacagtcgcaactgggcgtgtctgggattcgtgcgacgcgttgattgatgttgcggctaaaggggtagttggattcgtgatacggcgtgtggaagagtggcgggatctggtacgtgatgcagtggaggagattgaggagtgggatcccgaagaggacggggacgaattcttcgatgatcttctgagtgatgatggcgagaaggatactcaggatgaggaagacgaggataccgaagaaagcagcgctacgctacatgcgcagaagaaatcgaccctccggattttgaagcctattgcacagatataccctgccattgtcgcgaatcggctgaagggcgctggcgatgtgccgtgctcatctccttctgggattggtagattgcgaacgcttgatgacgaacttacaacacatcccggagcatatagatga

SEQ ID NO: 10744 - DNA, 324 bp, A.fumigatus
agggcgctggcgatgtgccgtgctcatctccttctgggattggtagattgcgaacgcttgatgacgaacttacaacacatcccggagcatatagatgaagtcgcgggagccctgtacgaggaggatttgggtaaatgcgctcaatatctcgacaaggctaaacactgtgctatgaacgctgttgactctgttaaaccgacgtgggatacggtggacgctaccgacggtcagcagaaggaagataagttcgcaatatggtcgaaaacatggatgaatgtcttggatgaagtcagcaaatctgtggaggcggacaatcaagaatga

SEQ ID NO: 10745 - DNA, 504 bp, A.fumigatus
gcacgaccacagttgccgataatttccaatatggtagcaacattttcaccgcatcgcgatgcgggcggcacactgcacttgccctcacactcagggatccatcacgtcgatgcaggctccgcaatcagacagttgcgccggtcattatcgcgatcaccttcgaagagctccaatttcacgattctcgcgtctcgaagtcattcgccatcgaaaagcacgccatttatctcgtcccctctctcaccatcgcgacgatccacacagaacaactttgtactcttccccagctcatcccatccatctccgttcgcgcttccgtaccaaaccagcgccaaaatcacaaggcctgtcgtgcgacgggcgagaacatcaccgcgaagtcccgtcaagcgcgccctcaatatctcgacagaccaagggaatgccaagcctgctcagccggctccaatcatggcattatcgcctgtcggcgcggagaacacacctgcggcgcccagcgcttga

SEQ ID NO: 10746 - DNA, 183 bp, A.fumigatus
actgtgtttcccgaactaatcgatcacgcaggcaaatcgtctcttaccgtccgatttgttgaacatcattttgtcgagagctattatcctaccattgagaatacgttcagtcgcatcatcaagtacaacggtcaggatttcgccacagagatcgttgatacagctggtcaagtgagcatatag

SEQ ID NO: 10747 - DNA, 249 bp, A.fumigatus
atatcttcattcattattttttctactggattatttcttgttatccctcttatcatagacttaaagatgcttgatcttgccgactttgtctccgatcgcggtgggaatccgaataagatcaaggagagccagcggaagcgatttgcaccagaaaatgtggtcgacgaagtgattgctctctatgaggaggctcgtcgaggtatacatatctctgtattcgaccacgggctggaaagatcccgcgctccg

SEQ ID NO: 10748 - DNA, 294 bp, A.fumigatus
gcgttcggcaggttgccagtatggctttatttctctatgctaattgaagagcagggagcggatcacgttcctctcgtggttgtcggaaacaagagcgatctcaaatcggaacagcgtcaggtttcgctggacgagggtaggcaattgggcgaagagtttcagtgtgccttcactgaggctagtgctcgtctcgactacaacgtcacaaaagcgtttgatttgatgattggcgagattgagaagtcccaaaacccgtcccaaccagcaggcggcagcaagtgcatactaatgtag

SEQ ID NO: 10749 - DNA, 237 bp, A.fumigatus
tcagttctatttgttctcaagctgatgggagactcgatgccaacagattcaggcagcctctggtccttgtctatcgatggtgcaaacagcacgaacaagcctaagtcccgtgacctcgggtccagagtgcgatgcatcgacgtctcttccccagcctcccaacccatgtgtcagggactccatgttacattggactatacctacatacaacctggggttgtactggagcctagttaa

SEQ ID NO: 10750 - DNA, 213 bp, A.fumigatus
agccatccttcagctctgctggcacaggttgcaagaaagttggccagagtccatccgttgcaattcaacgtacaaaaagtgtataacaagacaggtaagaagttgaaagtgaacccagatcgagacacggaaaccccaatcgctatgctaatatatcaaatcaatgtgtgcaagagtgccaggcacttagataccagagcacaaggaacatga

SEQ ID NO: 10751 - DNA, 621 bp, A.fumigatus
gagaggttccttggacatgggcaaccctgcgtcatccaaggaaattggtcccgcgcgggcgcgaaagtatcacggtcgatcgggttgaaccttaaactggaggaggagcgtcggaaagaccacgtccggcgcacatcgggggagtccaagaaggacaaggaatctggcctgttttcatcgattttcggcggtgggaggaagaagaacagtggagatggtcatcacaaaaagaactcgtcgcggacattgtcccctgacccacccgtccgcgagctacggccagatgtcgattatccgtggacaagattctcgatcctcgaagagcgagccatctaccgcatggctcacatcaaattggccaatccccgccgagcactctattctcaggtcctgctcagcaactttatgtactcttatttggccaaggttcagcagatgcatcctcacatgttgatggcgtcgtcggcatcgcaaaaacagcaaacttcaagggatcagaacgatgagtattcacaataccagaaataccaagaggtaagcagactttcggttttgcaggtggtgttgggcgcagttattctaacccagaatacagtctcagcaggagcagtacagcgatag

SEQ ID NO: 10752 - DNA, 183 bp, A.fumigatus
ctcgggaaagtggcagtatgttacctgctggcctgtcctcagggattccattgcccgtcctcggattttctttttatggcgcatttcgtctttgacaccctggcggcatggcacttgaagtgccttattgtcatgttccttgtgctctggtatctaagtgcctggcactcttgcacacattga

SEQ ID NO: 10753 - DNA, 219 bp, A.fumigatus
cccagaatacagtctcagcaggagcagtacagcgatagttcctacgacgatcctcagatgtacgagtacggcgacgaccagcgcgataattaccggccacattcaaggggtagtaagtacgaaaacgggaatgtatatggtcctggacatcgtcaatatgggcattcaacgtttggcgatgacgtccagctggacgacgatgatgacgatatgtggtga

SEQ ID NO: 10754 - DNA, 195 bp, A.fumigatus
agcctttaccttttccctatgttctggtctccttccgtcaatttgtccctgcctatctatcttgtctgctgcgcgaagagcgcaggatccctctatctgactcgggaaagtggcagtatgttacctgctggcctgtcctcagggattccattgcccgtcctcggattttctttttatggcgcatttcgtctttga

SEQ ID NO: 10755 - DNA, 210 bp, A.fumigatus
aaaaggctaggactttcaaacagtcccaggactctcttaaagagtttgataaatagttacaggactctcttaaaaagttggatgaacagtcccagggctctctcaaagagtttgatgaataatgctattactactctcaatgccaaagtaaacacagtcctgtttcagcgtacctacttagatgagatcattgccttcttttccctgtag

SEQ ID NO: 10756 - DNA, 342 bp, A.fumigatus
ttgattctggccctggcgcatggcacattcatcttcgcccatgccccggtttacggatggtacctggcctccagcgccatcggactcatcatatcctggtctctccacaacgtcgttgcgtggatgaagaaccggccgttcatgggtcgcaagctgtctcttttctacatcggcacgatcatcttggtccagccatactgggtggccgagatctacgccaactttgcctactttaacgacatcaaccgtacggtttacgagaagatccgcccatgggaggcattgttccggtatgatgctgccctgatggtccacttggtcttcattgccgaggggtgttga

SEQ ID NO: 10757 - DNA, 183 bp, A.fumigatus
acagacatcgtatgctcgtaccaacccctctcgacccgctcatcgggaatgacttcggtttgcgatgagtgtcgcctccgcaggagacgatgtgaccggatccggcccaagtgcacgtcctgcgtcaatcagggggtggcttgtgtgtacaggcaagccactgagtctccaccatcacagtag

SEQ ID NO: 10758 - DNA, 198 bp, A.fumigatus
aaaattattcccatgcctctttgcccctgcccaaacttcctgaagccgactcgatcatggaatacttgtccttccattccttctatgaccattctttacttggtctgtgttttcctgtccctgggcgacaagccatctatctccgacgctacaataatgtttaagcgagcaagcagtaggcaaaagattgatagatga

SEQ ID NO: 10759 - DNA, 192 bp, A.fumigatus
tcagattatagctatgaagctaccgtcgtcttcaagatttacagaacgacccgtcaaagtattgataatgaagcacaatatcctacgtgggatatatatatcaagttgaggaccgcgggatcctatgatttgtacaaatatcccgctgacatctgctcatccacagagtttgacactctgaagttgtcttga

SEQ ID NO: 10760 - DNA, 951 bp, A.fumigatus
cgatcctgctctttgccgatgatcctgctggcctcctcccgtagagcctgcagtttagcctgcagtagcctacaacctgtcgcaagagacagatcgctctcttttgcaacatctaccgcaacatggtctcgacacttaccggactctctcttctcccttagcagccagcgattatcttcatcctacctcccacgattttcgcgaaggacttttcatgcaacgtcattgttcagtctcgatgctccacgcatctcctaccgtgtggccgcctcgtcgtctcccaagaatcgccgtttccacccgcccaccaatttccacaatttccagcccgagcttcacgatgctatcggcgtggtcacagaagaaattgacgccgccaccagacgcaagaggaggccagatagtggggaagatgccttctttgtgagcagagttggaagtcaggactccggcgccatcgccttcgcagtcgcggacggagttggaggctgggtggagtccaaggtcgacccagcaaacttctctcacgctctgtgcctttatatggcgctcgaggcgctatcttgggactcgtcgacagacaaattgcgggccaagaacctgcttcagtcaggatacgaccagctcgtggcggacaagtcgattcgggctggtgggagtaccgcatcggtcggggtgggcttggaggatggtcaggtcgagttggccaatctaggcgactcggggtcgatgctcctccgtcttgcggctgtgcatcattactcggtcccacagactcacggcttcaacacaccatatcagctgagcatcatccccccgagaatgcgcgctcaggcttccatattcggcggctctttcttggaagaatcgccgcgcgacgcggttgtcccaaacctccatatgcagcaccggcgacgtgctcatgctaccgaccgatggcgtctacgataa

SEQ ID NO: 10761 - DNA, 336 bp, A.fumigatus
cgcctcgagcgccatataaaggcacagagcgtgagagaagtttgctgggtcgaccttggactccacccagcctccaactccgtccgcgactgcgaaggcgatggcgccggagtcctgacttccaactctgctcacaaagaaggcatcttccccactatctggcctcctcttgcgtctggtggcggcgtcaatttcttctgtgaccacgccgatagcatcgtgaagctcgggctggaaattgtggaaattggtgggcgggtggaaacggcgattcttgggagacgacgaggcggccacacggtaggagatgcgtggagcatcgagactgaacaatga

SEQ ID NO: 10762 - DNA, 222 bp, A.fumigatus
aatcgagagtggatcagattcaaccctatccaggctccgccttctagcttcaatccccacagtgccctttttttcgcctcaaccactcagcaagtgactggcgaccgggacggactgactaaacgacgactcccgcctggacggtcgtcggattttcttttcgattcatttcttttcctcccctcacttgggcgggttttcttgcttttattatttttttag

SEQ ID NO: 10763 - DNA, 864 bp, A.fumigatus
catgaaggaccaccacattttttacccgagcattcggccaagggcaattttctggactgggccagccttagtccaactggtcttgccttgccgcccggtgattctaccacccatgaacctgtccttctgagcgatgaggatctccatgtcctcgatcctgcttttctttccaagcacacagacaccagcatcgataataataatagacccccgtacgaccagcgcccgcagctaaatccagcttccaccaaccagggcgcttcaaatctccattctgctcgaccctcgcgctcatccatcaccagcatttcttctacaacatctacttctacgtccgccactacaggatcagacatcacttctcccaaaaaggcttcaaaatccagcaaacggaactcgaaaccaaaggtatatgacaagaacgacccccgtcgcgagagatatctcgagcgcaaccggcgcgcagccagcaaatgccgccgccaaaagaaagagcgcaaccagcaactggagaacctgtatcgcaaacagtctgcagagcaagagcggcttctctcagagcgcgaccggatgcgatcggagcttctttctctgaaggatgaactgctgaagcacgcacaatgcgaagacccgccgctcaagttctacatcgcacagatggtcgaggaggctggtgcggctgttgcgccaggtagaccgatcaatacctactctcctgggtactctgagcagcaggcgcagcctctgatgttcaacgatgatgatgtcttgcaacagcggtccccgacaatgaagatgtctatggttgcagatgcaccttggagcacatcgggtggtgattttgtggattttgttcaattgtga

SEQ ID NO: 10764 - DNA, 231 bp, A.fumigatus
ttttgtggattttgttcaattgtgatcaatttcattacccctcctcgtaagttattttcatggagttggatcctggcgtgcatcgaatatgtttatttaaagttgaactctcgtgtggagactacactgtataagcagaaatttatggcagtgcaaagagaagctgctagtgtctgctattctagacctcctagtcagcagagcacatatgtgtcacggcgaagtgaatga

SEQ ID NO: 10765 - DNA, 876 bp, A.fumigatus
tatcgggctgagcgccttgatcgggcagatttctgccatctatgcttcgctgagtatgttgatgacacgttgcgaattgcgctaaccctggcaggctccgatgcgacagcacacatgtctgaagaagtcaaagacgcaggacgctacgtcccgatagcgattgcgtggggatattttagcaacggggtgatggccattgtggtggtcatttccttcctttttgccattccctccgtcgaagacgcactggatgacgccaccggattcccgttcatctacgtgttcaagaacgccacgtcggtcgcgggggtcaatgggctgacggcaattatcctcattcccgtcatcttcagcaacatcctcttcaatgcttccacatcccggcagaccttcgcctttgcccgagataaaggactgcccttcgcccgctggatcgccaaagtcgaccccagacgcaaaataccggtgaatgcgatcgctctatcgtgcataatcagctgcctcctctctctcatcaacatcggctcgctaaccgccttcaacgccatcatttctctgaatgtagcagctctcatgtacacctacatcatctccattagctgtattatctaccgcaagatctggcatccggataccctgcccccgcggcggtgggacctaggccgatgggggttgaccgttaatatcgtcggtttgctgtactgcatgttcgcactgttctgggcgttgtggccgagtgagaccccagtcacagtggacaattttaactggagcgtggtaatctttggggttgtgttcgtcctcagtttggtcatgtatgccgtcaagggacggagggagtaccatgggccagtggtgatcgtccggagagattag

SEQ ID NO: 10766 - DNA, 501 bp, A.fumigatus
ccagaaagggccccgacctctggcggacaataccactgggtgtccgagtttgcttcgccgcgatatcagaaattcctgagctacctcactggctggatgtccgttctagcatggcaggccggctctgcatcgggctctttcctgaccggtacaattatccaagggctcatcagtgttcgctatcccgactaccaaccggaacggtggcaaggaaccttgttcgtttttgccatgattgtggtcatctacgtgttcaacgtctacgccgcggacatgatgccgttgttcaataacctgctgatgatcctgcatatcctgtcctggaccgtcgtcgtgattgtactgtgggccatggctccgcaccaatccgccaaggccgtgttcacagagtggacgaacggtggaggctggtctagtatcgggctgagcgccttgatcgggcagatttctgccatctatgcttcgctgagtatgttgatgacacgttgcgaattgcgctaa

SEQ ID NO: 10767 - DNA, 207 bp, A.fumigatus
tgcctaatactatacctacagactcgttgcagacgagctccgaaatacggccttcagagccgaatattgacctaccacccgtacgtcagcatgcatcaagaccaggatgccggctcctatcggcctgtgatcatctacaatcggggccaaatggagagagtcatgcggcaatatcgtgaatttgtccttctctacacggacaactag

SEQ ID NO: 10768 - DNA, 504 bp, A.fumigatus
atcatgcctctctcacaaataaccccatgcctctggttcgacggccaagccgaagaagccgccagattctacgtctccatcttccccaactccaagatcacagcaatccagcgttacaccgaagctggaaaagtgtaccacgggcgagaggcaggcagcgttatggttgttgaattcgaattgaacggacagacttttacgggattgaatggcggcccccagttcaaattcacgggggcgatctccttccaagtcgactgtgaggatcaggacgaggtcgaccactactggaaccacttgaaagacgggggcgatgaaacgaaacagcaatgcggatgggtgaccgataagtttgggcttacgtggcagattatcccaagacggctgaaggagatgttgagtgattcggatttggagcggaaatcgcgcgtgacgaacgagatgatcaagatgaagaaattggacgtcgggcttcttgagaaggcttatgagggggcattataa

SEQ ID NO: 10769 - DNA, 414 bp, A.fumigatus
  unsure (245): Identity of nucleotide sequences at the above locations are unknown.
tgcccgaatgtcggaccaggacctaacacaacgacagaccgtttgcagaccggctacccagatcaaagcattaataagacatcatcgtatcttgacttgtcgactctgtacggggataatcaagatgagcagaacatgatccgtacgttcgaggatggcaagatcaagcccgactgtttcgctgagccgcgtctgcacatcctgccagcggcttcgggagtcattttgatcatgctgaacagatntcacaattatgtcgccgagcagctggccattatcaatgagaatggccgattcacaaagcccaaagctgagataattgaaccagtcgaagccgggctggctgtgctaaatatgaacacgaactcttccaaactgcacgccccatcactggcggcatgtatatcaacataa

SEQ ID NO: 10770 - DNA, 600 bp, A.fumigatus
ccgattctacacagtgagagacgagtcgcattcgagctcagtagcaagctaacagggaaccagaaggaattcaatgcccgaaacctgacgaactggggtttcagcgaggccaaatacaacctggaaatcaaccaaggttgctcgttctaccgacttgcgttgcgggcatttcccaagtggttcaagtacgactcaatctacgcccactatcccatgacgatccccagtgagaatcgcgtcattatgaaagcgctgggccgcgaagaggacttctcttgggatcgtccatcgtatattccgcagcgaataagtgtctttgactatgccaacgttcgtcatatccttcaggatgcgtcgaatttccgggtgatgtggggtgaagcaaccgcatacgtatttgggtctaagggctgggactttatgctctcaggcgacgcgcccactcatgcaaaccagcgcaatattatgtcgcgtgcgctctatcgtggccagtggcacgacgctgtcaagcagttctacctcgacattacccaacagcttctcacagaaaagtcatgcaggataggaaacgtaaaccaggtggatatttcgcgcgagtga

SEQ ID NO: 10771 - DNA, 864 bp, A.fumigatus
accagtcgaagccgggctggctgtgctaaatatgaacacgaactcttccaaactgcacgccccatcactggcggcatgtatatcaacataacctggttcgactacgtgcgcacaattatcaacctcaaccgtgacaacagtacttggaatctggatccccgtacccatgatgaccaggatgaaattcccaccgcacagggcaaccagtgctcagtcgagttcaatcttgcgtatcgatggcactcgacgattggccgccaagatgaggcgtggacggagaaaacttaccgagagattgttgggaagcccggacaggaagccactttgcaggatcttatggacggcatgaggaaatttaatgcgaggatggacaaagacccttccaagcggacattcgcgggtctgcagcgccagggagatggtacttttagagatgtagacctggtggacatattgactcgcgccatcgaagaggtctccggttcgttcgggcccaacaacgttccaaaggtcttgagatcagttgagattctgggtatccagcaggcacgcaagtggaacattgggtcattgaatgagttccgcaagttctttgacttgaaaccctacgaaagctttgaagaaatcaaccccgacccttatgtcgcagatcagctgcggcacttgtatgagcaccccgactatgtggagctgtaccccgggatcgttgcagaggagcccaaagaacctatggtccccggggtgggtattgctccaggatacactgtctcccgcgcggttctgtcggacgctgtgacgttggtccggggtgaccgattctacacagtgagagacgagtcgcattcgagctcagtagcaagctaa

SEQ ID NO: 10772 - DNA, 195 bp, A.fumigatus
cgtcatggcacatgtgcctctttctcccacggatttatccataaagttctggggagtctcagcgtctcggaccaaatttcaaatatgtatgatcaattcaccggcctccatcctgcgcaagttagcgatgcattcggagggaatgtccaaacccagtaccatgagctcaagacgccgtattccatctataattag

SEQ ID NO: 10773 - DNA, 348 bp, A.fumigatus
gagtttactttgcaagtacccatggctttgaccgatgagcttctcgaacaaaagcaattcgacaaagccctggaaatatgccacttcattttcagccccatggacagccgcgacccgtctaaatgctggaagttccgccttttccaggagattatggccaaggactatctcgataacttcttccagtcactcattcctaaccaggggaactctcaaatcactggacgccgcaataacccgttcgcaccccatgtggttgccaggtcacgcactgttgcatatatgaaagcgaccgtgatgaagtatatccaaattcttattgactatgggcatcaatacttccgttaa

SEQ ID NO: 10774 - DNA, 357 bp, A.fumigatus
ctagccaattttctaagcctcaatggcaacctccagatcgctgtgtctatgccttccatcgaagttggcacaatcggcggtggcacgattctcgaagcacaatctgccatgcttgatatgctaggtgtccgtggttcccaccctaccaatccaggtgacaacgctcggcaacttgctcgaattgtcgctgccgctgttcttgcgggagagctgagcttgtgctctgcacttgccgccggccaccttgtcagagcacacatggcgcacaaccgcagtgctgctacgacacggacttctacccccgtctcagcagccgtgagtgctgctcggggattgacgatgtcctcctcggagtga

SEQ ID NO: 10775 - DNA, 828 bp, A.fumigatus
gcgcttttgcttctagcccagccgttaagacctgtgggagtggctggacccttgaccattgatggccagagctactttattcccatggctaccacggaaggtgtgctggtggccagcacaagtcgaggcgccaaggcgattaacgcaggtggtggcgcggtcactgtcctgactggcgacggcatgactcgtggcccttgtgtcggtttccctactcttgcacgcgcggcggctgctaaggtctggattgattcagaagagggtcgaagcattttgactgcggcttttaactctaccagtcggtttgcccgccttcaacatcttaagacggctctcgctggcacttatctttacatccggttcaagaccacaacaggtgacgccatggggatgaatatgatctctaaaggtgtcgaaaaggcgctccacgttatggcgactgagtgcggctttgacgacatggctaccatttccgtttctggtaacttctgtactgacaaaaaggctgctgctattaactggattgacggtcgtggcaagtccgtggtggctgaggccatcattcctggtgatgttgtccggagcgtgctcaagagtgacgtaaatgccctggtcgagctcaataccagtaagaacttgattggaagtgctatggccggaagcgtgggtgggttcaacgctcacgcatcgaacattgtcactgctgttttcttggcaacgggtcaggatcctgcggcaaaatgtcgagagcagcagctgtatcccgaccatgaaaaagtgagttgtcatacattctcaatttgttttcgttgctcgagtactaactag

SEQ ID NO: 10776 - DNA, 186 bp, A.fumigatus
gacgggggtagaagtccgtgtcgtagcagcactgcggttgtgcgccatgtgtgctctgacaaggtggccggcggcaagtgcagagcacaagctcagctctcccgcaagaacagcggcagcgacaattcgagcaagttgccgagcgttgtcacctggattggtagggtgggaaccacggacacctag

SEQ ID NO: 10777 - DNA, 486 bp, A.fumigatus
ctaacggtgtgtcccaggtacgtacggaaaccacgaccaggttttttccgtattaccaagacgaaccacaacattttgcaagggttctcaaaccctggagagcggtgtacagaggaggactgggcaaaggtcacggactggattcaagagaacgcgaggaggtactggttgattcctggagggccgttgcggcctccatcggagggaggtgcagatgtaattatcatggacgatcctcagatgccagccttgattcctatcgcgaaggagatggcgccggatagacccgtcattttccggagccacattcagatccgaagcgacctgattgccaaaccggacacgcctcaagcagaagcatggggccgaatgtgggaactgatcaagcaggccgacctgttcatctctcacccggtgagctcattcgtaccgaggaacgtgcctaaagagatggtgggctatatgggagcgtctacagattggtga

SEQ ID NO: 10778 - DNA, 726 bp, A.fumigatus
caaataacagacgagtacattatccaaatcgcccgctttgacccctccaagggcatctttgatgttgtggaatcctacgagaaattctacaatcgtctgactgctgcactgcctgacgagaagcctccgaagttgttaatttgcggacacggctcgatcgatgaccctgatggttcgctcatttacgatgccgttgtgtctcacattgagcataatatcccctacttgattgaacaaatctgtgtaatgcgactgggcccatccgatcagatactgaatgcgcttatgtccaaagccaaagttgctttgcaattgtctacgcgagaaggatttgaagttaaggtctcggaggcggttcataagggtacgcctatcattgcgactagggcgggcggaatccctctgcaggtcgagaataacaggagcggtttcctggtggatgttggagacacggacgccgtggccgagtacctgttcaagctgtttacggacgaagagttctacggagagatgagccgttacgagatcaagaacgtctgtgatgaagtaagcaccgttggcaacgcgttgaattggctctacctcgcgtccaagatgtccaagcacgaacctgtccggcccaatggccggttcatcaacgatatggcacgcgaagaggcgggcttcccatatgagcccgacgagagccggttgaccagagcagttgaggtggagaatatgggttga

SEQ ID NO: 10779 - DNA, 756 bp, A.fumigatus
aaccccgaatggcgctccaaggtcaagaaggatcccggtatccccaatctgttcccatttaaggacaagattcttcatgagatcgaggaaaagaagaggttgaaggcagaagagcaacagcgtctcaaggaggaagcacgtgctcgacggatggccgagaaacagcagtcacaggatggaggatctgtccccaacgctatgatcgacgatgatgagattgatgaggatatggatgaggatgatcttgactcgtcgaatcctatggctgctctgcttgcctctgcccgtgcgcgggccgccgagtacgaggacgaacacggtgatgagagtgatgaggatgacgaaatggacgaggacgacgacgaggatgatgacgatgatgtggacggcatggacgaagacgagaaagaaggcagtgctacgcttggcgagaacatccctgagctggtctcacaacccatctcgaaagaaaattcacggcgggcattcgacaaggtgttcaagcaggtcgttgatgccgcggatgtgatcttgtacgtgctcgatgctcgtgatccggaaggcacccggtcgaaggaggtcgagcgtgaagtgatggctgcagacggaggctccaagagactgatcttgattctgaacaagatcgatctggtcccccctcctgtgctcaaaggctggctactgcacttgcgacgatctttgcccacgctacctctcaatgcggccaatgggctcggtcaacgcacacacctgtga

SEQ ID NO: 10780 - DNA, 903 bp, A.fumigatus
acaagatcgatctggtcccccctcctgtgctcaaaggctggctactgcacttgcgacgatctttgcccacgctacctctcaatgcggccaatgggctcggtcaacgcacacacctgtgaccacaagcagctgaccgtcaaaggcaccttggagacgctctttcgcgccctcaagtcattatgccgcaacaagcagctgaattggtcaatctcggtctgcattattggataccccaacgtgggcaagtcgtccgtcatcaatgcgctgactgctcgtctcaacaagggctcgagcaacgcatgccccactggcgccgaggccggcgttaccaccagtctgagacaggtgaagctggacagcaagctcaaactcattgattcgcccggcatcgtcttccccaactccagcgataagaagaagagcaagagcaagaaggacgagcatgctcgcctggttctgctcaatgccatcccgcccaagcagattgaggaccccatccccgctgtcagcctgctcctcagacgtttgtcatcatccgagcatctcatgtcgaagatgctccagctctacaacatcccgccgctcttcccgtcgggtaacgatcagaccaccgactttttgatccaggtcgctcgcaaacgcggtcgcctcggcaagggcggtatcccaaatcttgagagcgccgccatggccgtgatcaacgactggagagacggacgcatccagggctgggccacccctccagtcctgccttctgtcgtgatgaccgcccagggtggctcgacttctcctgtcgagtcaggtgttgacacaaaacagattgtcaccgagtgggctgcggagttcaagatcgagggactctggggtaatggcgagggggacgacgaggagatggcggagtag

SEQ ID NO: 10781 - DNA, 213 bp, A.fumigatus
gtccggccgatatacgaccacctgcgaactgtatctaaaacccgttccagaatcggcgccgagctaggcgtggaccccaagaccatcctcgccacatcccacggccgaaggagtatcgataccatcaagctgtatgacccctccaaggccaactgggaatgtaagtactcgccctacgctatctaccaaccatcgacccggcacccaatctga

SEQ ID NO: 10782 - DNA, 663 bp, A.fumigatus
ccgagcccattggccgcattgagaggtagcgtgggcaaagatcgtcgcaagtgcagtagccagcctttgagcacaggaggggggaccagatcgatcttgttcagaatcaagatcagtctcttggagcctccgtctgcagccatcacttcacgctcgacctccttcgaccgggtgccttccggatcacgagcatcgagcacgtacaagatcacatccgcggcatcaacgacctgcttgaacaccttgtcgaatgcccgccgtgaattttctttcgagatgggttgtgagaccagctcagggatgttctcgccaagcgtagcactgccttctttctcgtcttcgtccatgccgtccacatcatcgtcatcatcctcgtcgtcgtcctcgtccatttcgtcatcctcatcactctcatcaccgtgttcgtcctcgtactcggcggcccgcgcacgggcagaggcaagcagagcagccataggattcgacgagtcaagatcatcctcatccatatcctcatcaatctcatcatcgtcgatcatagcgttggggacagatcctccatcctgtgactgctgtttctcggccatccgtcgagcacgtgcttcctccttgagacgctgttgctcttctgccttcaacctcttcttttcctcgatctcatga

SEQ ID NO: 10783 - DNA, 294 bp, A.fumigatus
  unsure (145),(170): Identity of nucleotide sequences at the above locations are unknown.
ggttcgcggggtttggagcatatagaatcatacagatactccatagggaggtgctattatttgtacagaatcttctggctgttgtatagtcgttcattatattttggacagttgttacggttgacgcattgcgagcgcctctgtnttagtatcactttctctcgactgtntatcaactttcaactcaacatggcccattccgaaggctcattttctgcccctccacaagcccatacttttgatggactcttgtccgatttcgatggaacgatagtcgattcgaccgatggttag

SEQ ID NO: 10784 - DNA, 378 bp, A.fumigatus
gcgtggaccccaagaccatcctcgccacatcccacggccgaaggagtatcgataccatcaagctgtatgacccctccaaggccaactgggaatgtaagtactcgccctacgctatctaccaaccatcgacccggcacccaatctgacaacgtggtccaaacagacgtcagctacatagaaggccgtatccccaaagagtacggttccgacgccgtcgagatccccggtgccagaaccctcctcaacgcgctggacgaatccggagcacgctggggcgtcgtgacatccggcacccgcgctctcgtcgacggctggctgggtgtcctcaacctcaaacatcccaaggtgctggttgtcgcggaggacgtcgagctgggc

SEQ ID NO: 10785 - DNA, 762 bp, A.fumigatus
gggaatgagaaccctcggagaagacttctgtcgatctcgtcgatcgatagccgcaattacatcctgggccttgccgatccccagcgaccaggggctagccccaacgactcgaagcgtgtgcagaaaaatcccgcaacgtttcagtgcaacttgtgtccgaagcgcttcactcgggcttacaatttgcggtcacatctccgaacccacacggacgagcggccatttgtctgcactgtatgtggcaaagccttcgctcgacagcatgatcgcaaacgacacgaagggctacactcgggcgagaagaagttcgtttgtcagggagaactctcccgcggcggacaatggggctgcggtcgccgatttgcccgggcggacgctctggggcgtcatttccgttcagaggcggggcggatctgtatcaagccgctgctagatgaggagtcgcaagaaagggagcgttcgctcatggaccagcagcaacatcatttgcaaccacttccacaacaagtgatggtacctgtggacaacccacatgctggtaattttgtgctgcctgccgcgcttctggctcaatatcccgctctccagaccttgcagtgggaccagattgctgcatcggcggatgatcccagcgacatagggggccgtagcagcttcgacgccagctccggcaatgaatttggcttcgaggatgacgactcggggctcagtagcgtatctggtattaatgctgggtattctgctgccggtaacttctattga

SEQ ID NO: 10786 - DNA, 663 bp, A.fumigatus
attcggcccattccttgtcgtataaggacctcgaagggcaacccgggaaccccttcatccttttatatcgccccaattcgggccggagaaaaacccacccgtggtcctgggtttggttcgaccgtttccttcagtgagcgggaagaggaaccccacctgggcggccctccccccagccaaaattggtccctcatgggttccgtcattcactccagccccgtcgaaacccacatctataacctccgcctgctggcccacgagctccgcatccgcgaccataccaccttcgtctgcgacgcgagctggccgaccatcctgtcgcatctacggtccgcttcagtcggtgttaacgccatgtggaacgagcactttggcatctgcgtcgtcgagtaccaggccgcaggcctgatcagcgtcgtccacgactccggcgggccgcgcgaggacattgtcatcgaccttggcgacggggcgacaggcttccgcgcctcaagcgaggacgaattcgccgccgcgtttgaggccgctctggccctgccagcggaggagaaagtcgcgatgcgccagcgtgcccgcaagtccgctctgcggttcactgaggaggagttctctcagaaatggatcgaagaggttggaaagctggtcgagatttgccgccgatga

SEQ ID NO: 10787 - DNA, 726 bp, A.fumigatus
gcaacgcccgagaactatagaagaggacgcaaagaaagcactaaactctctactagtgacattaccttctctggcagcttcaatccttccggaaatgcttacctgtccgtgtatggatggactaccaaccccctagtcgaatactacatcctcgagaactatggcagttacaatcctggctcgggcatgacgcacaagggcaccgtcaccagcgatggatccacctacgacatctatgagcaccaacaggtcaaccagccttcgatcgtcggcacggccaccttcaaccaatactggtccatccgccaaaacaagcgatccagcggcacagtcaccaccgcgaatcacttcaaggcctgggctagtctggggatgaacctgggtacccataactatcagattgtttccactgagggatatgagagcagcggtacctcgaccatcactgtctcgtctggtggttcttcttctggtggaagtggtggcagctcgtctactacttcctcaggcagctcccctactggtggctccggcagtgtaagtcttcttccatatggttgtggctttatgtgtattctgactgtgatagtgctctgctttgtggggccagtgcggtggaattggctggtctggtcctacttgctgctcttcgggcacttgccaggtttcgaactcgtactactcccagtgcttgtagtaccttcttgcagggttatatccaagtga

SEQ ID NO: 10788 - DNA, 264 bp, A.fumigatus
caagggggattctatcctttaattgcggagggtatctttccatggagaattgcgagtgtctggctggcgctgttgtgggctttcagcttaggtgctctgatctacagtcttctccagaacggcctcacatcatcttgggtttttggtcaattactccctgtcttcatggccgtgctgccgatcgtcagcttggtcacttctataattggcgataggagtgctgagtcgcattctgacggggtgcatttacatttctgcgtctga

SEQ ID NO: 10789 - DNA, 330 bp, A.fumigatus
caagccattgttgctctgctgctactcggtacctacagaattgatagagcgacttatctgataatttacgagttagaattccccgatcaggcggactgcgcgaacacagaacattccgctatctccgccactcaactccagttcaacctgtcaagtcattccgctctctgcgctccctcaaggcaaacggactggatccaattgtgggcccttttcggtacttccacccaaatgcctgatgctgtgcacgatcctgtccccaacgccatggagtgctctacactaatttccatttgctctactgaaaaagccgcttctcgacagatttag

SEQ ID NO: 10790 - DNA, 417 bp, A.fumigatus
agactcctgccgctccctggattcgacgtggtctacccagccaacgagatgaccagcttttacaagcgcttcatgggaagcgagcaaggcggtggtctcgatccctttgatatgcgccgcaagtggaaggatatcagtcttagcggtggctatcgcaaggtccttagccggatgggcgccgactactcagtgcatgtgaagctgtattcccaggacgacgagcagttcgtgcagacggatctggacaggctcaacggcaaggaagcggctattgagtctaatgccgattctgctgataagatcgctgtgattcttaagttccagctcggatcgagccagtatgccaccatggcgctgagagagctaatgaagggcagggtcgtggcttacaagccggattttggaggtggacgatag

SEQ ID NO: 10791 - DNA, 678 bp, A.fumigatus
atcattcgagggagtgcttgtcttattatatcccggaaacgtgagacggccacagataggtataacagaatgattgatcgtgaaaggcctaatttcctggacagcgccaatgagcacaatatacaaccgctgtctcctggagaggagcaaccatcgccatggtacagcgagccagtctctacatcttcgcagacacctctgttcgggtcagactggacggctaccaatgtgcaaacaattgccacgacaaatgagccgacatccctcgcatcatcatcaactacaaacgttctcgcgacgacgaccgcagtaatctcttcaatctcatcatcgactgggacttctccccaaccgggagacagcagctcgggaagcagcgacacgaagacaatcgctatagctgtcccagtatctgtagttggcgccgcattgctcatcggagcgttattccttcttttgagacggcgccgtcggaaaactcaacaagagaacccatcggacctccaagtggatatgtttcagccaactcgaacaaacctgtgctcacaaaacgatactccatggaacgaacacgcgagatcccatgaaatttttcttagacgggccggtatctttttcagaccgcgtcaaatgatcacattcccattcggccagcacagcctttcaatcatcaaataa

SEQ ID NO: 10792 - DNA, 507 bp, A.fumigatus
caagccaggccggcgtggactcctgtcctgaatgcgccatcctggaacccgtctcgtcctggcccgacctcgactccgccgctgtcagtcgcagcggtccctgcgggtacaatgcccgcgatagcatcgactacaaccagccgagcagtaactggggcaccaaaccagtcgccacctacaccgccggccaagagatcgaagtgcagtggtgcgtcgaccacaacggtgaccacggcggcatgttcagctatcgcatctgtcaggaccagagcatcgttgacaaactgctggacgcgtcgtacctgccaactcaggcggagaagcaagccgcggaggactgcttcgaagccggcctcttgccgtgcacggatgtcaatgggcaggagtgtgggtacagtgcggactgtgtcgagggtcaggcctgctggcgcaatgactggttcacctgcaatgggttccaggcagcggagagaccaaagtgtcagggtgtggataatgcggcgttga

SEQ ID NO: 10793 - DNA, 582 bp, A.fumigatus
caaagcaagggagcatccccactcacaagcctggaactgcatgatcccaaggcatcgattgagataacggaatgtttccttcgatggcccgctcggctgcgggagatcagtctcttgtcactctgctacggaccgtacgagagtcactacgacgcccgtagcatccagcgactgctttcgatccacaaggactggctgcaaaagatcaccctgggccctattccaccccaaggggaggatattcccgacctttcagactttcatcgccttagcgatatccatgtaactctgtacaattcttcgtccaatgagcgtcagaccccggatgccatctacaagaagcttgcagcacccaatctccgacgactcgaaatcgatctcggtaatgaacgtcagccacatgaccaatgggtcgctgagttcctcgctcttgtgcgacgtggacggaagggctcccccccacaaacatgtgtccaatgggtggatgtcaagttctgccgatggggtgacttggcattggggctcgcgcggagaagcagtatcaactgcgagagtgtgcgatatcacatcgaatcgctgtga

SEQ ID NO: 10794 - DNA, 711 bp, A.fumigatus
gaaatgaggtatgccagcactcctaccactttctccctactccagctaacaagccaggccggcgtggactcctgtcctgaatgcgccatcctggaacccgtctcgtcctggcccgacctcgactccgccgctgtcagtcgcagcggtccctgcgggtacaatgcccgcgatagcatcgactacaaccagccgagcagtaactggggcaccaaaccagtcgccacctacaccgccggccaagagatcgaagtgcagtggtgcgtcgaccacaacggtgaccacggcggcatgttcagctatcgcatctgtcaggaccagagcatcgttgacaaactgctggacgcgtcgtacctgccaactcaggcggagaagcaagccgcggaggactgcttcgaagccggcctcttgccgtgcacggatgtcaatgggcaggagtgtgggtacagtgcggactgtgtcgagggtcaggcctgctggcgcaatgactggttcacctgcaatgggttccaggcagcggagagaccaaagtgtcagggtgtggataatgcggcgttgaactcgtgctatacctccattgcgggtgggtataccgtgaccaagaaagtgaagattccggactatgtgtccaatcatactttgttgtcgttcaagtggaattcgttccagacgggtcagatttacctctcttgcgcggatatttctatttcttag

SEQ ID NO: 10795 - DNA, 390 bp, A.fumigatus
aaacgtccgttcattctaggtaagcatatcaccgaggtcgatttgagggcgtacacgaccatcatccggtttgaccccatctacgtccagcactgcaagtgcaacctggggacgatccggcagaattatccgaccatcaacaactggttgaagcatctgtactataacgtggaaggattcagagaatcgactaatttcaagcatatcaaggaaagctgtaagtataggtcgaggggtctcattattctttgtcggctgacctgcatagatcctaagaaccaagcggacatcaatccaaagggtatcgttcctatgggacctatacccgatatcgagtctggtgtggatcacaattggggtctggtgagagttgggtctatttatgtgtag

SEQ ID NO: 10796 - DNA, 1857 bp, A.fumigatus
ctttggaagatgaaatacaccaattcgatgtttaagcagagaatcgaaaacgtttatctgcagaagctgggtccgaagtgcggcagtgcatttcttcacgttgtccaactgtgtctggacgctcccaacttccatctatccacgcagccattcgaggattttaacctgagagttcctcagacgtatcattatcctgttttggatctttctgcaccagacagcatcttttctttctccatgaacttcctttatacaatgtgcaagatcgtttggtcttgctgcagaattgatattttctccgcaccggctgctgaggagttggatgattgcctcccccttgccctcgttccccgaactgagacaaagcatgtgcacaagagccctcaagagtatgagcctgaacctcagcgactgacacgtcgcaatggttcgtatcctgctcttccagtgcaagagatgcgagtcttgagggagaagatgggattggaggagaggaaggctaagaagaggacgttcaaaaagctcaccaacgtcgagattcctcaagaccacctcaacgaatggaacttccagatgcttccacgattgagaaaacttcttcagaaggtcctgaaagattcaagtgaatcctgtggtgtcactctaatgatgactggcgattcggctgaaaccgccaagacgaccatctgtgttacctgcgcgagtgcaaagaaagtaagagccgccttgaagaagtattttgtgctcgatgacagggaagattgggacatcatcgtgcttcgtggggatatccaacgctctaaagttccgcgaaagaaacggcgcaggcctgcaaaatcgagatcgcagacggcgggcactccggcgttccctgagcgagatctcaatccctgctatcagccacgaccgctttgtggcgcgtccattggcgcctttcagaatgatgagcatctccctcctgtctcctacggaggtgccatcttggtcgacggtatgccttatggtatgacagtccatcacatgcttgaggcacctagtgatgacgaggcagaggaggaggtcgtggagaatcggaatgtcggagggccatttcgctcggctgggaattggcacggagaatccgccccctcgaacaatgatttcatgtacacctggtgtgatgaggatccctctgaggttgacctggaatttgagatctcggaagacgaggatggcgacgacatctccctgtctcggagcttggaaggaacgtacgacgatcattggctctcagacacttattcttcggacgaagagggctttgatgttgatgacccctatgaggatgaagacgcggcttcgatcggcgacaccgccggagtcgagccaggtgatgagccgcctctgtttgttactcaaccggcaatcgatgacgtccatgaggatttcttcccatcgcccgaagatcgggatgatgagcacttggcgtctcattcgctcgggttcgtccatgcatcatcgggagttcgccgctggactcgaaaaggcatcaagcacgaaattgactgggcgttgatcaagatcaacgatgaccggttagacgcgcgcaacattgtctttgacaagacgccgccatcgtctcgaggcctcccgaggcggggacctggaggacagccttcacagacaggggaagccatctttctcaacgacgtagcacggatggaggagctcggtggactgaaagttcactgttgcggccggacaagcggtctgcaaagtggacagatttcgcgggcgatgaccatcgtcaaactgcacggacgacaaactttctccactagtttctgtgtggatggaaactttggaggtaagttgtga

SEQ ID NO: 10797 - DNA, 201 bp, A.fumigatus
ggcatatcttttctactttattgcatatataccctacctctgcctcatgttttcaacgactataaaacagtgcatggagatatctacatctcccgagcgtctttggatgattatgagacgagatctccgtttgccacattgaataaacacaagatatatatcatcatactcccgtcatgggcatgtcctatcggagactag

SEQ ID NO: 10798 - DNA, 666 bp, A.fumigatus
tggcttgttgtgcaccccacgtacgggcgagctccgttcgtgttccttaggaacccttcccctcaccaagaaccagctctcaaaaattcaaggcccaaaatgcccgctcccgaaaaaccagttcctttcctgtttacctgcagattcgctggccaattgctgattcttacagaccgcgctgaccgcatggtggccaagaattccatccgcaaggccctgacctggaagaacgccagacgcttcttctatgggggtgtaccccgccgcttgagcaaggagctcattctcaagcgcatggcctctgtcgccccggccgccgtctccggcgaggccaccggcgccatccctgccaccggactcgtcgacggccagaccccatccaataagagccctcgcgctaagcacctgcgcaccctgcactcgtggaccggcttcctggacgaggaactcgagcacgacgaccgcaaggtagccatgtggtacgaggagaacagaaaggccatccagatgaagatcgaggcccttaagaccgactctgtcgccaccgagatcgcccagctgctcatcagcaacaaggagggcggtctcaagggtgtgcagcaagttctcagcatgctgcctgtggaggagaaggaggccgtgctcaagtacctgggctcaccatga

SEQ ID NO: 10799 - DNA, 402 bp, A.fumigatus
  unsure (212): Identity of nucleotide sequences at the above locations are unknown.
aagcaagaccccaccttaacccgtaggttggggctttgggccagcttcgccctccccccgataaccccgggggacagcccttccccattttccctatttcaatcgagaacgttaacccccaatccaaccccgggtaaaactccatttccttccagcagggtcttcgccccacgcaaaccatccatcaccgtccttgtctcctgcaccccggntcccaggggacccaacccaatccatccacggctgaacatccaactacctcctcgccctctccgcatcctcgccatagtcccgccacccccacggcgtcacgtacccgctcgccggtcccaacgccagcctgactgggcggcaaaatccacgcccacctgcgccgcagccgcttcaaactcccactcatga

SEQ ID NO: 10800 - DNA, 525 bp, A.fumigatus
  unsure (136): Identity of nucleotide sequences at the above locations are unknown.
ctgggcggcaaaatccacgcccacctgcgccgcagccgcttcaaactcccactcatgagtaaatgcccgctcgtcatggtcgcagccggcacggggctggcccccttccgcgccttcatcgccgagcgccgccagntgagcctcatcggcaaggaaatcggcgagatgatcctttttttcgggtgccgggccccgacgcaggatttcatctacaaggaagaactggaggaattgcaggccgctcttggcgataaactccgcgtcatcactgcgttctcgcgagaagtcggcagccagaaagtctacgttcaggatcggattgcggaacatgccgccgaggtgatccggctgatcgacgagggcgcgagcgtgtacatctgcggccgggcggggatggcccgcgaggtggaaaagacagttggggaggcaatgcgagcggccaacaggtggagcgagaccgaactatatgagtggagtacggcgatcaagatgaacaataagtggcacgaggatgtatgggggtag

SEQ ID NO: 10801 - DNA, 432 bp, A.fumigatus
tcttgcatgaaaccgctgcatgatacccaccgcatcgtcttttccttgccagcgtcgatgactgctgtgatatccgggatggtgatacctgagaagtcagcaatgattatcgtggcagccttgcaagcatacctgtttctgccccctccgtcccccctcacatttttcctcatgccccccgggaaggccgacgaaaggcttttttcctggtcctccgctggccacccccccactcaccctgcccctcccccccccccccccccccgcaccatgggatttgaagagaatcgggtgggtccggagaacgagttctccgccctgcccgccaccccccacccccacccccccgccgtcccccccccccctccccccccccacccccccccccccccccccccccccccccccccccccccccaacccgcccccctc

SEQ ID NO: 10802 - DNA, 291 bp, A.fumigatus
tcattgctgacttctcaggtatcaccatcccggatatcacagcagtcatcgacgctggcaaggaaaagacgatgcggtgggtatcatgcagcggtttcatgcaagactatgctgacacattttaggtttgacgaaagacgacaactttcaaggctcgtggaggcctttatctcgcgtgcgaatgcaaagcaacgccgaggaagagctggacgggtgcagagcggtatctgtttccacttgtttaccaagcatcgacatgataaactggtatgtccaaattcctgtcattag

SEQ ID NO: 10803 - DNA, 405 bp, A.fumigatus
aaattcacacaacgcagagcccgatccggcggccgccaacgacaattcttcaccatccccgaagactacgacacaaacagcagcaacgacgtcgtcgtcaattcggtcatcgcctggagcttctaccccaaactactcacccgcgaaggcaaaggctggcgcaacgtcgccaacaaccaatccgtcactctgcacccaacctccgtcaacaagcacgccgacgcctccctgaaatggctctcctactaccacatcatgcaggcccgcaacaggaactacaacgcctttgagacaaacgccgtcgatgactttgccattgcgctgctgtgcggagaggccgagttcaaggtacgcgcccactgcccaccattctacagctttgcaaagatacgaattctgatttga

SEQ ID NO: 10804 - DNA, 231 bp, A.fumigatus
acgcagatgtactctgggattatctccatcgacgcaaaccgcatccgcttcgcggtccgcgattggaaggccatgctcgcgctgaagatcctcagtgcgcggatccgggagatcctggcgggcacggtccgcgacccgcagaaggtgctgtcgtataaacagcagcaatgggttgggatctggcagcagattttctcccaggcgtggaaacggatggctgagaagcggtaa

SEQ ID NO: 10805 - DNA, 591 bp, A.fumigatus
cacattttaggtttgacgaaagacgacaactttcaaggctcgtggaggcctttatctcgcgtgcgaatgcaaagcaacgccgaggaagagctggacgggtgcagagcggtatctgtttccacttgtttaccaagcatcgacatgataaactggtatgtccaaattcctgtcattagtcctttgatactaacatcctcacagctcgcagagcaacagactccggagatgcttcggctatccttgcaagatcttgtactgcgtgtcaagatctgtaaactcggcgaagtggagcaaactctcctcgaagcactggatccaccatcgtccaagaacatacgccgtgcgattgactcgctgaaagaagtcaaagctctcaccaactcggagagcttgacacctctgggcatgcagcttgccaaattgcccctggatgtcttcctcggaaagttgattatccacggcgtgttcttcaagtgcctagacgcttgcattagcattgccgccattctctcatccaaatcaccgtttgtcaatactatgggatcccaacaaccagaaagatcttgcgaggctatcattcaagaagggtag

SEQ ID NO: 10806 - DNA, 252 bp, A.fumigatus
gtgggggggtggccagcggaggaccaggaaaaaagcctttcgtcggccttcccggggggcatgaggaaaaatgtgaggggggacggagggggcagaaacaggtatgcttgcaaggctgccacgataatcattgctgacttctcaggtatcaccatcccggatatcacagcagtcatcgacgctggcaaggaaaagacgatgcggtgggtatcatgcagcggtttcatgcaagactatgctgacacattttag

SEQ ID NO: 10807 - DNA, 210 bp, A.fumigatus
atgctacgaatgtcaaggctatcattatacctagaagcgggtggtaccatccagaactcctctgccagcgattttctaagttttcttcccattttccttccacccaagttctcttcctttcttttttcctttttttttgttcctttttttttgttttttaagtcgggagcttcgttcatccgagatggaacaagccctgtaaccatctga

SEQ ID NO: 10808 - DNA, 1008 bp, A.fumigatus
ccacagtccctatcggaactcagatccttgattgaagatccagagaccgacgacgaactaagatctcttgctcttgaagacttaaaaagtagcgaccgtactttgccagccatatcaaagaccctgaaaaacgctcttgttccccgccacccctttgcagatcttccctgcctactcgaaattcgccccggcgcgggtggagacgaagctggcctctttgctttcgagcttttgaggatgtacactgccttttgttctcgacgtggtctacagtccaatgtgatcaagctcgatgtgcaagacgggccttcagatgatcgcctgagcgaagcagttgtagagatcgacgcagacggagcttatgatcttttgaggaccgagtctggggtccatcgggtgcagagagtgccggccacggagactaagggacgtacccatacaagtgcggtcagcgtgatggttcttcccagcttcccagaggcaggtcccagtatggacagtgctttaaatttcgacgacccaaacagtgactactatgttgatccccaggaagtccgcaccgagaagatgcgcgcgagcggagctggaggtcagcatgtaaacaaaaccgagtcagccatccggttaactcatatacccactggaattgtcgtttcaatgcaggattcccggtctcagcatgcgaaccggaaaaaggcatggcaagtgctacgagcaaaactggccgaggctagacaagaagctcgtgagcaggaacttgttgaattaagaagaggtgttcttggaggcgtcgctcggatgggccgtggtgataagatccgcacatacaattatggacagagtcgttgcactgatcaccgtagcggcattacagtgcacaatctggataatgttcttgatggcggcgaaagtcttgagactataatggatagtgtcagaacttggctggctgatcaggagatagcagctatatctgcagaaaattcgataaatgccgtcgggaagtaa

SEQ ID NO: 10809 - DNA, 240 bp, A.fumigatus
  unsure (82),(84),(170),(171),(180): Identity of nucleotide sequences at the above locations are unknown.
acgccgaaaggtggcggcgaatcgcaaaacaccctgaaaagccaacccttggttttgaaacaatggaaggtatgtacaattnanaaaaaaacactcgaaaaaaccaacattaatgggaacggaattaggccttttacaaaatcaaatgaatcccttgaaggtatcggctnnaagaaaaancccttatcctttaaccaattttttctaaccgttaaaaacaattcaaaaaacctgctttct

SEQ ID NO: 10810 - DNA, 264 bp, A.fumigatus
tcaaattgtgcagtcgcgaagacaagatcgcagctcaatcgcaggctccctgatgccaaaaagctcccatggccaccgtttggaatacaatggtatgccggatgcacgactttgattatagggaattcgcttaaggctggcatccgtaagtttcatctggtggtgctgcgctaccattgtccaaactttttgatagaaactcacgctagaatattggtaaggcttcgttgccttcgacaccttcaaatctctacttcaggatga

SEQ ID NO: 10811 - DNA, 249 bp, A.fumigatus
ggcttcgttgccttcgacaccttcaaatctctacttcaggatgaaaacggcaatatatccggtccaagaaccgtgatcgccggcttcggggctggattcacagagtccctactagcagtgaccccattcgaaagcatcaagacacagttgttcgttgtcacctttattgaataccctaccccatcctccaactatttgggtcacaaactgttaccagggtgcgccgtgcaactgacacacgggtattag

SEQ ID NO: 10812 - DNA, 255 bp, A.fumigatus
cacacgggtattagaattgacgatagaaaatccccaaatcctcgtatgcgtggattcctgcacggcagtaagatcatctttcaggagagaggtcttcgaggcttctttcaagggttcgttcctacaacagcgagacaggcggccaactcggcaaccagattctcaagctacacaatgttgaagcagttggctcagggttacgtcgcacccggcgagaagctaggaactgccagtacgttcgctcttggtggatag

SEQ ID NO: 10813 - DNA, 267 bp, A.fumigatus
gcctttcagaacttgaaattttcgcctatagattggtacttagccctcagcagaatgcaatcgctcgaagctagtaaaaattacaaaaacagcttcgtttgcgccgcgcgaattttcaaagacgaaggtttgcttacgttctggtcaggagctgtaccacgtctagcaagattgatcatgagtggaggaatagtcttcacaatgttcgttggaatacgtccatctcgtccacactttcgggtgctaattcatcacaaccaggtatga

SEQ ID NO: 10814 - DNA, 252 bp, A.fumigatus
aggacaactttacttcccgacggcatttatcgaattttctgcagatatagctgctatctcctgatcagccagccaagttctgacactatccattatagtctcaagactttcgccgccatcaagaacattatccagattgtgcactgtaatgccgctacggtgatcagtgcaacgactctgtccataattgtatgtgcggatcttatcaccacggcccatccgagcgacgcctccaagaacacctcttcttaa

SEQ ID NO: 10815 - DNA, 744 bp, A.fumigatus
agacgatcaacccgtcattcaatggatattcacaaagacatcagaacaggcagactgacggctactggtctccagcagtatcttgagacccatggcatcaacgacaccgatagcaaaggctggacattacttgcaacagccgtcagagcgggacacttgaagatggttgaactcctgctgaagcaacacgccgaccccaacaccaagagccatggatttgcccccatccatctggcagtgacggcaaaagccgaacgtctccagataattagcttgctgcatagcgcaaaggcagatctgaacgcccaagaccctgatggcaatacagctatcatcagtgccatcgagcagacgcaggatgataaagtcatcaggctacttcgcagactaggtgccaatctagatgctcaaggacgctccggtaagacagccaagcagctagcggagagctcgaacaatatgctcgttcggcaagctgtccagccggatcggcctatccttgacaggctgagaacggtgacctggattgttaatgttgttgttggagctttccgctatgtcgtccggacatttatccagaaaccagtttacaaaatcttcgatgtcttcaaaggcaggcgtcaagctcccccgcagccagctcaagccgggcccgtcggaacggacgcagactttgcagatgcaagcaaaccccccccccccccccccccttgtccctctgaatcgcttgagattcgactctaa

SEQ ID NO: 10816 - DNA, 426 bp, A.fumigatus
  unsure (411): Identity of nucleotide sequences at the above locations are unknown.
cggagattccaggcgatcaagcatccccaaaccgaagcaggcttcaagaagagcctcgatagctacatcgaggatagctgtctggacaagttcttttcccctggcagcaaattcctgcaagaggtgtctcagaaggcggccaaactgaaggatgaccctagaaataaatacaagccagaccaaataaaggacctcacgcgcgttgccctctaccaacccgttctctactgtggtaggtactaccctccccgaaccacaacacacacccgacggcccggagccccagctaatccgcagcagacgacagctcgtcgatgcgagaggaaatgcggtgggaggctcagcgggagcttgtcaagcgcatcacaaacatcgccacccaactggtccgtgccgacaagggcgttctcntacgcttgcctttaa

SEQ ID NO: 10817 - DNA, 447 bp, A.fumigatus
ctcttagccaaacagatccttctgcttagcgtcaaggacaacgatcttctcaactgccatcgttttcaaccccacagcgaggaagagcgctggattgagcacccgctcgacacgaccgagcctatcatcctgcacaagcagagcaagatgaccagtgtctcactcgtatccggggcccacgtgttcttccaggtgcccagtggcgctcttgtggatctgcagtatcagcacgacacgaaccgctggacggcccagataatgcgcacgcaggttacagttcaacctgggagcccgctctgtgctatccaggggccgtcaagcgtttccctcttctttgttggggacaataactgcatctactatgttacccgatccactgtacaggatgcctctgaatgggagggtaactttgtctcgtttctgtttccttccttctctatgatttaa

SEQ ID NO: 10818 - DNA, 690 bp, A.fumigatus
cccatctgtttcactctacctccactgaaagacgtccttacggcccccgccgcccaggcccttccctacatctttcaccgggtcatgggcagccccggcggcgccctcgcgctgaccaccctcgtcctcgtcatcacgctcttctgctccatcagtattaccgtagccgcctcgcgctccacctgggccttcgcccgcgacgatgccattccgctcgccagcctctgggcccgcgtcgacccccgcctaggggtccccgtctggtccctcctcctactcaccgtcatccagatgcttctcggtctcatcaacctcggcagctccagcgcctttaccgcctttgtctccgtcggcgtcatcgctctcgccgtcgcctacgccatccccatcttcctcagcctccggcacggccgcacagaggtctccaaggccctgtggaactgtgggcccgtcgtcggtcccatcgtcaacatcgtggccctgtgctggatcggcttcgaactagtcttgttcagcatgccgaccgtactgcccgttacgagggtctcgatgaattatgcgtccgtcgtctttgtgggtttcctggccatcgcggccgcttggtatgctgtatatgcacggaaatgtgagtttgctgtctgcttcgcgtatctatgggacgtttgctcattcgttgtccgctccctgtag

SEQ ID NO: 10819 - DNA, 222 bp, A.fumigatus
attcttatgcgcggatgcgccactcccgtggtgaagattctcgacgctggggttctggaggaatgtgtgcgggcaaacctgggcgatctgaccttcgaggaagcatatgcccggtcgaaacgaattttgaacatcactatagcgacatcaggcaagaatggcacccctaatctgctgaattacctgaccgcgccgaatgtcgtaagtacatttaacgcttag

SEQ ID NO: 10820 - DNA, 756 bp, A.fumigatus
ttgatctggtcggcggcagttgcctcgaacgcatccacgggttcgttataccagcctgtcacggtatactgcaaagatgaaacagggtcgatagtcccctggccacacgctcaggacgccacctttcagtcatggcgccacgtccattatagcgacggggagtcaccactttcccgcatcgccgagttattcaatgtcaaccacttcatcgtatcgcaagcgcggccgtatctcattccattcctgggcccggacctgagcatgttagaccgccatcagacaggccaatggaacatcacacggccgctgatgcgcctggtcgtcgcggagctccgccaccgacttcgccaactggactacctcggtctcctgcctcaaatcatcggccggctcctcatcgaagagacaatcccaggatccaacctcacgctcgttcccgatctatctctgagcgactttacgaagcttctacagaacccgagcaaggacaatttggcatactggatcttgaagggcgagaggggcgtatggccggccatcagcgcgctcaaggttcgctgtgtggtcgagatcgagctcgacaaggggtatcagcgcgtgcggcgacggcggccgagcgagagcgtcgcgttgcaccggcgtggtccgaatgaaggtgtacccaggagacgaagggggtatagtatagacaacggacgggatctgagcagtttgcttgggagtgcggattatcagccagatatgctgaattcatga

SEQ ID NO: 10821 - DNA, 561 bp, A.fumigatus
  unsure (545): Identity of nucleotide sequences at the above locations are unknown.
cgagtcgtctaccgctgctgcaatcagatcatcatggccgtccgatcgaggccatccctgcgcttctcagtgcgacgggatgacaatgcctctggtcatgatgacgacgaccaccaggacaaccacgacaacactttgctgtcttctcctccccctgcaaagaggcctcggcttcagcagcaacagcaacagcaacagcaacgtcgtcagccaccttcatcccgccgtcgcaagagctctcccgacttacttgacgcaactattgaaaactccagtcatcgtgctcccccgtcatccaaaccccctcaggtcgtgcgaccgaccgctcattcgcccgtccctccgccgccgcacttatctacgcgccggccacctgctccctccactgccggcgacagcgtctctttctcgtcctcgtcctcgtcgtccaactccgcctgtgttccgctccccggcaccccgcacactgcgggacgatctcatgagcaccgtcatactccgctttcggcttctgccgcgctgtatatgcatggtggtggtggtcncaattcccccgatctt

SEQ ID NO: 10822 - DNA, 216 bp, A.fumigatus
aggattcgaggtcagtctatatcagatgatcatcgacagcgacagagacacttcttgcctgctggcagttgcaagttacaacaatatcccccacccccacacaacgaggggaagatgagcgacaagtcgagagagggattcctcaacctcaaagatgactcccctgctgcattcatcggagttcttgccgatcagaaagatcattgtttctcctag

SEQ ID NO: 10823 - DNA, 483 bp, A.fumigatus
ccacaaacggaacaacaacaagaagacgacccctcgtccccggcatatacgtgccaaccgtcgccttcttcaaggacgacgaggaagtcgatctccccaccgtcgagaaacacgccgcctaccttgccgacgccggggtcactggcatcgtcgtccaaggcagcaacggcgaagccgtgcatctcgaccgtgacgaacgcaaactcattacatcggcgacccgccgcgccctcgatgccgccggagccacctccatgcccctcatcgtcggctgtggcgcatcttccacccgcgaaaacatccagttctgccaggacgcccccgacgccggaagataatacttccttgtcctgccaccctggtaataacaagttctctcgtgaacaaagccgccctcctccactaacttccgcgaagttcgcttccggctcttccgattcccgtcctccatctaaaattccccggggccccttccggccctga

SEQ ID NO: 10824 - DNA, 195 bp, A.fumigatus
tggtgcctcaactcatcttgtgttgctcaattaattgactctattgccattgcacctggaatggaaggtgaatcagacctattcttctgcttcgtcgccctgtcgtcgtcgtcgcgttcttttttcttgtttttttccgcggtcgccattaattacagggatgtggtatggcccaatacaggatttgcggaatag

SEQ ID NO: 10825 - DNA, 396 bp, A.fumigatus
aatcatcttctcacgaccaccacagaaaacaactggtatacagcaacagacaaaatgaccacaaacggaacaacaacaagaagacgacccctcgtccccggcatatacgtgccaaccgtcgccttcttcaaggacgacgaggaagtcgatctccccaccgtcgagaaacacgccgcctaccttgccgacgccggggtcactggcatcgtcgtccaaggcagcaacggcgaagccgtgcatctcgaccgtgacgaacgcaaactcattacatcggcgacccgccgcgccctcgatgccgccggagccacctccatgcccctcatcgtcggctgtggcgcatcttccacccgcgaaaacatccagttctgccaggacgcccccgacgccggaagataa

SEQ ID NO: 10826 - DNA, 255 bp, A.fumigatus
ggacctgaagtagcaaaattaaaatggcagctgagtgctaagaataaccctctctgcactatgctgtggtgcaacactgtgatgaccaaggacatgtttgttctttggggtcattatccatggtcttcggtaataaaatggtgtccaggattttctcattggaattattgccattatccccttacagacagagattattcagtgcttaccagcaaccttgaagggattcaatattatccccttacaagcccctga

SEQ ID NO: 10827 - DNA, 243 bp, A.fumigatus
ataaacgtcgagagaaagataaggacgatgttcatgggacgtacctggctgaatcgcataatcgaggatttcatcaactgtttcgactggtttatcaggcggcgcatgcagaacgatgacaacggagccaagcaaacacaaggcgcagcccagtttccccagaatgccaagtctttcatgcagaaaataggacccaaggacagcactttgagggacgcggtcagccaggcgcggaggacttaa

SEQ ID NO: 10828 - DNA, 486 bp, A.fumigatus
ccgaaacgacatacaatgaccactattgtctttgttcccggtgcgtggatcaccccggagttctatcatccgttcttcgatgctctcaccaaggccgggtgtcctgtccgctgtgctggatatccctctctggaccctgcggaccccaccagcacagactgtaaagcggacagtgatgccatcgccagcgtcattcgtccgctagtcgaaggcgagggccgcgacgtccttctggtcatgcactcctacgcaggaatgccgggagctgcggccgccaagggacttgccaaaacagaacgaatgcaacaaggcaagtccggcggcatcgtaggactggtgttcatcgcggctttcctggttccggaaggactaagttgtgcgggattacagggagggaatcttcccccgtggatcttgatggacaaggtactcccccctcttcctccgacttgggatgaatcggaccagatgagtaacgccctgtag

SEQ ID NO: 10829 - DNA, 363 bp, A.fumigatus
  unsure (289),(315): Identity of nucleotide sequences at the above locations are unknown.
ccgtacgacaaagtgaacatccccgatgaccctgtcggcaactttgctgcggatgttgatgaagacgtggcccaaagtcttgaagggtccatccggcctcattccacggtggcgttccacactccccaaccggctcctgcttgggcagacccggcgtatgccggacgactggcatttattgttcctaccctggacaaggctattcccgaggcagctcagcgtgccatgattgccagtactcagacggattggatcgtagagggaatggtctgcagtcactgtgcgccgnttgtccatcggatcgacgagtgtgtncgactggctgcaggatttctcggcgtgtttgaggttacgaagcactga

SEQ ID NO: 10830 - DNA, 276 bp, A.fumigatus
gccatggcaactggaaaccaggtcgacatggtcatttgggtgtatcgcggcgtgggaacacacatctacccccttgggatgaccggcttctccaacttcttcgtcaacctcttcgtctgcgaaatcttctatacgctgtccatctgtgagaccaaatactccatcctgatgttctactggcgcatcttcggcaccaccaacattcgcatcccaatatatgtcatattcttcctggtcacctgctgggggttgggcatcgtacgtcggaccatatga

SEQ ID NO: 10831 - DNA, 1584 bp, A.fumigatus
tttccccgggcccgtgggacaagatccaccgccgacagcggggccagcgccaggcgttattccgcaatgacacgctggcgttcgatgcatatatccgcatcattgacgaccccacccggttttcggtggtggcatgctagcgattctgaaccgacctgggacagtctgggcttgactggatatcggccgctgggtgattctgtcatcaatcacagtgccgaggttgcaggactggcctcctggctgcatctcgcaccgctgtgcaagataatccagaatgccaaggtcttggaccattacacaaactgcgatgtgaagcccaaaccgctctgcgatgcgctacagaagttcctttggcgtcttcgctctcgtggtcagtccctgcaatatgtggatacggacattatcacttccattctgcgcaatctgcatgaatactcgggcgatgtctgcgagttctgggagcgcctgcgtcggaccatcgagtttgaattgtcggacaccgatgctccgaaggagctggccaaaatcttcgacagcccctcgccggactcccttgccgtttctggagtggacgcggtaaacaccatcccaaaggatttcaactcacgcatttgtgtgcctgccgaacaggccaaaacgatgcgcgaagggttgagctggtacctgactcagaaacccggtcgttgggcattgccacctgttctccatgtcgaactgtaccgccataagttggacaaggcggcgcgtcagtggcgcctggtctacaacaaggtcgatcttgatgaggaattggatctgactccatacctggttgacggccagtgtggaagctatgtcctctatggctacattgtccaccgcggacggcgcacgtcgggcaaatttttcagcattcttcgtcccggtgggcccggaaccaggtggcttgcattcgatgatggcagcgataatcgtgttgaatgcctcacacgcaagacagccttgggaccgcatcttggtctggacgagtctcagaaagtagaccacaagactggtcatgatgtcgcgattgccgtcatgtatatccgaggcgatgttgtctcggagtttctccctggtcctcagggtccgtgggacgtctcaccgtcgctcaaggaatactatgagaccggcatctaccctctatcatccatgtccgctggaaagcccgcagagaaggaaatccaggtagaggtttatgctccgccacagtatgacaagttgccgagtctgtttgactcttacgatttgatgtcccaagccaaggcggccaacaaagtgatgtatatgactgttccccgctccgagaatattgtcgagctgcgcaagaagatcgctctctgggcctctgcgggcagcgagacccaggccagtcccgagaatatccgtctctggcagattggacatactcgtgatcgattcggaccaacacttgcgttcgagcggatctcggatctgaaatcgaccctcgatctgcctgttccagttgctcggttgtggatgcaggtcgtctctgatggtaattttttttttttttttttttttttttgccccctagattga

SEQ ID NO: 10832 - DNA, 732 bp, A.fumigatus
attgacagttgtgggacacgactaatgcatgggtctatagatgaggcaaaatactttgctatcagagatccccgcgacgctgtagtcgcccagcgcaagacagaagaggcggtagtcgaacgcgccggttctgaatcttcggacgacaggcaatatacacctgaagtccgaagtggaggggctgaggccagctcatctggtaacgtgaccgaaagtgatctcagcaatggtgacagggtgtcggtggaacagcctctgccacgggcgagtgattccgaggtctccgagagctctagtcaagagactcccgactcctctgagattcaacccagcaacgcgagtactgaagatgatgcggccatagcggcaatcatcgcacaggatgtccagcagatggacatccagctggctgaggaggctcaacaatcacctattcgggctgagcagtcctccaatgacactacccaaagcgaaccagcagagcaacgagctgcttctccagctcccgaggctatgtctagcacttcggaagagcctgatgtcccactgcccgtcgagcacgtttattacttcattcaaattttcgacgtcgaggcacacagcgttgcgtacggtgggctccttcctctcccgaaaggaggagaaaatcaagaccgctctgcggaagcacttgaagtggccgaagaaaaagggatttttcgatctggcagcgggttgatggcaccactgtga

SEQ ID NO: 10833 - DNA, 696 bp, A.fumigatus
tcgcgttgctccagacttactactgtgtgttttgcttgccgtacgacagcccatcgcttgcggtactcggtggcgctcgcatatcggttcaggatcccccataacaggcgttcacacggctctccctcatctacgggtcgtcttcattatttaactgacagaatcaacatgtgcttcctcgacattgacgacagaccggggcccggcgtgcgagtcgtcgaatatcgcccggggacccttcgagtctccatgccaggtcctcgtcggcgcagaagcagctgcagtagcggtagtagcagtgacagtggcagctccagttccagcccaagcagcagcagctcgagctgtcatagtagcagcaacagcagcagtagcgatgataccaccgttgtcattgcgccaagtcctttgcatcaccatcatcatcgataccagcgctactcctggtatgcgcgctcaaagtcaccagaaccagagtcatcatatacaaccgtgcaaagaacgagagtgcgcacgcggtctgagtcgatcattcctttcaggagaagattctttgacagcccgcctcgttcgccgtctccggtgtataggtgtgtgagatatgttgagcccgggggctggggacgatcgcgtttgcaccatccggggagagtctgggaggaggaggtgagatttgtctctgggaggggaggatga

SEQ ID NO: 10834 - DNA, 594 bp, A.fumigatus
aaatattctatcctctacgtggctaagcgcactaggaaccgaaccctttccatccgaaagaaggaaccggcccgccaccgcttcaggatgtcgaccttccgcggtctgcaggcggcgcccgagctgagcaggaagatgagccgcatcgtcaaacaagagaactcggtcatctccgcccacgaggcagccggccgcgagcgcgtcaacatcgccgcccagctatcagaatggggcgaaggcaccgaggacgacgccgtctccgacatttccgacaagctcggtgtgctgatggcagagatcggcgagcaggaggacaactttgcgcagagcttggaggactaccggagtatcttgaaatcgattcgggacacggaaacttcagtgcaaccatcgcgcgatcacagggcgaagatcgcggatgatattcagcggcttaagctgaagggggagcagagcaatgccaaggtggaagttctcgagcaggagttggtgcgggctgaagcaaataatctggttgcagaggctcaattgaccaatgtggtacgtatggcctcacgagtgtacctgatcgcgagcgcggggctgagatttgtc

SEQ ID NO: 10835 - DNA, 306 bp, A.fumigatus
gcgcgcataccaggagtagcgctggtatcgatgatgatggtgatgcaaaggacttggcgcaatgacaacggtggtatcatcgctactgctgctgttgctgctactatgacagctcgagctgctgctgcttgggctggaactggagctgccactgtcactgctactaccgctactgcagctgcttctgcgccgacgaggacctggcatggagactcgaagggtccccgggcgatattcgacgactcgcacgccgggccccggtctgtcgtcaatgtcgaggaagcacatgttgattctgtcagttaa

SEQ ID NO: 10836 - DNA, 1590 bp, A.fumigatus
gtagacccgacctttacggacagcatgggccactttacccggcgattcgagcagctcctcaacaacttggacaagaagaactcgatgacagactgctgcatcgagacttacctgatgaagagcgagcggaagttttacaacatgtacaacgatgcgcagctgaagaaacaccatgctaaggagtctatttcttcttcggccagtccagagcagcttgaccatgagacgcagtataaccgcctctcaaccgccacggccggttcggacccgagcgactccgatgaaatcgatcgctggctttcccggctggggtacaggcgccctgtggccattcagcgattcatgcgacgacggattggaacctggcccgtatacgctctgttcctaggccttggacagatcatcgcgaccaactctgctcaaattaccttgctggtcggccaggtaggcgagacggcgaccaagttgtatgtgatcgcagcgatctattgcgtctcgtcaatttcatggtggttcatgtacgcccgtctgccagcggtgattgtcctcagtctcccatggttcatatactgcttggcttttattgtaattggcgtgtctccctttggactgtcggaagtcgggcgaggatgggctcaaaatgtcgctgcaggcgtgtatgctgtggcgtcgtccagcggttcgttgttcttcgctctcaacttcggtgaccagggcgccgtccctgtcaaggattggatgttccgcgccagtctcatccaaggtatttcacagctatacactgttgcactatggtactggagctccaaggtcaccgccaccgaaattggaggcgtctccaccttcgcattgagtacctggaggctcacggccgtggtgatgccaattgctgcgctatgcttcgctatcggcgtgatcctcgccctgggcctgcccaaatactaccgccaagcacccagtcggatcctcttcttctatacgtcgctcttccgccgtcgcatcgtcctctggttctttctcatggttatcgtgcagaactggttcctcgccgccgcgttcgggcgcaactggtcgttcctctggtcctccaagcacgccaagacgtgggaggttgtcatcctcgtagtcggcttctttatcatcatttgggtgctcattctctttgccttccgcgcactgtccaaggagcacagctggatcctccccgtcttcggtctcagcctgggctccccgcgttgggcacaaacgtggtggggaacgtccaacatcggctactatctcccttgggcagggggcctgacgtctggtgccatcgtctccagatgtctgtggctctggctcggcgtccttgatgagatccagcaggttggcctgggtatgatcctcctgcagaccctgacaagagtgcacgtctgctttgtcctcctggctgcgcaggctgtgggatcggtcgctaccatctgcgctcgtggatttgcaccgaatagactcggtccggacggtatctcgccgaatatcggcacatcggtagataagattgccaatgcgtggttctggattgccttgttcttccaacttttagccaggtaa

SEQ ID NO: 10837 - DNA, 441 bp, A.fumigatus
agtccatctttatcatcagaacactcagagacaacattcataatgtcaaaacctctcagccacatcaagatcgcactccgtcgctccagtgagcgcggatatgctgagcacggcggctggctgaaaacataccacaccttcagcttcgccgactacttcgaccaccgcttcctcaacttcggttgcctgagagtactgaacgaagaccgcgttgctgctcggaatggattcccactgcatacgcaccgggatgcagagatcttcagctatattctcagcggtgagctgacacaccgcgatagcatgatcaagaaaggagcggaaggtgcacaggggaagcaattctaccggatgcgaaggggtgatgtgcaattcacgacgggggggactggtaagtaccagctcctgatgcattatgatgtggcaatgtgtagactctaa

SEQ ID NO: 10838 - DNA, 534 bp, A.fumigatus
actctaaccaggctatcaggaattgcgcactctgagcagaatgaatcgagcaaaccggtgcatttccttcaaatctgggtcctgccctggaagcacgggctgaaaccgcagtatcacacgatgtcgttcagtgaagaagctaaacggaaggccttcgttccaattctgtcgccgttagcagcagggccagaggcgaaccccgcagaggaagaggctgctcgtcccaaaattccggacacaattcccatccacgcagactttctcatgggagctggaatcatcgcgcctaacacgacgttcaaatggaatgttggagctggagatgtagtcagctcgaggaagaagaggaatgtatatatccacctgcccatgactaaacagggcaaagcgaagatcaagctagatggaagggaagacgcggtgttagaagaaggcgacggtgcatttgttactggagtgaacgctggggatatgcttgcagtggaaagtattggggaggctgaggctgaggtgattgtgctggacagtaattga

SEQ ID NO: 10839 - DNA, 516 bp, A.fumigatus
acgacatcgtgtgatactgcggtttcagcccgtgcttccagggcaggacccagatttgaaggaaatgcaccggtttgctcgattcattctgctcagagtgcgcaattcctgatagcctggttagagtctacacattgccacatcataatgcatcaggagctggtacttaccagtcccccccgtcgtgaattgcacatcaccccttcgcatccggtagaattgcttcccctgtgcaccttccgctcctttcttgatcatgctatcgcggtgtgtcagctcaccgctgagaatatagctgaagatctctgcatcccggtgcgtatgcagtgggaatccattccgagcagcaacgcggtcttcgttcagtactctcaggcaaccgaagttgaggaagcggtggtcgaagtagtcggcgaagctgaaggtgtggtatgttttcagccagccgccgtgctcagcatatccgcgctcactggagcgacggagtgcgatcttgatgtggctgagaggttttga

SEQ ID NO: 10840 - DNA, 219 bp, A.fumigatus
ccgctaaccaccgccgcgctcgcccttccgcgcgcgattccactttacgccaaccaagttaccaacagccagagtcgattccctaacagaagactgctcgattttcgggaccttttgataccacctctcctcaaccatcaaatcaacatcatcatacatacgaggccctatatacccactgcgttcggaacagaccttttccataccccagatttctaa

SEQ ID NO: 10841 - DNA, 1293 bp, A.fumigatus
  unsure (1245): Identity of nucleotide sequences at the above locations are unknown.
gattgccatatgtctgactccagacaagggagtgagagttctgccgcaacctatcacagtcaaccagagtcagaaaatacccaagattctgttggtcccgaaagccccggatcaccgccggctccgccaggaagtccacggtcgcctgaacagcagagccaggatggagacaaccaggaaattcccaatatagagaccaccccgaaaagcggggaaaatggagaaggatcacagaagagacagcgggttcgcttccggtccgccatcagtgtcgactacccacagcccggtggtcccgaaagcagcgaagatgaacgctctattcaggagaagcaaaaggctcagcgtgaccaagcgcaacgccagggccagccacatctcatgtccacgccctacgttcatggatccctagacgtcacagaaacccctctcaaggagcggaccacccaagaagaccttcagcaagcggaaaagactccagtggataagaaaccggacggtattggcgcagcagcagccgtcggcgatgtcagtcgcacagctaaggacaaactgcgatggctgtgggatacagtgcacggcaagttgtccaagtggagtgatcggctgggacgccctgaacgaggtggggatgacctaggacccggtgtctaccacaatgaatggacatcaggcggcaacgcgcctctgggagatttgactgacaacaagcacaagactcacgaagaaaagaagtcacatcaagcaacgtccacgtctgaagcgcaccgccttgtgcgtgagctgacgcaggaccagtctggtaatcggcgcaagacgcgggggaagccatacccacacaccgacacgcagggcggacagggcggccaaggaaacaatgcaatcgagtcggggctgcggtatcgagccgggggtgggggtgttctggcgcagctgatgaaactgaatggtggcatgcaacaaggagggcaagctggacaagctggacaaggtgggcaacggtcaccctctgacaccgggacctcagggaccacaactccgaagaaggaaaagttaaagtggtacaagaataaacagcatacccggtccacgtcgacgctggttggcgcttcggggagtatgagtggcgcgagcaccccggtgtctagcgaggttctctctgccgcgtcgaagcgccttggtggacagcagttccagcatgggggaaggggccgactggaggaccaaattcaagttgacgtgcanatcgcggagatcatgcgcgcccgcggtacattatgcaactggtgttag

SEQ ID NO: 10842 - DNA, 528 bp, A.fumigatus
ggtcggacacaactaccaagcaagagtccaagagacaccaatctcattgattgcaacatgaagctcgtctggatagcccagcgcctcggccggcaaggccaacgacgcaaggtagcccggatcgcttcatccctcttcttcatagtcgccctcacggccttatgtctctatatcctgctcgcatatttcctggcaaatgacccacggctggtgcccgtggcgttccaaacggcccggagtatcctcctcgtaaccgcccacccggacgacgaaactctcttcttcagcccgagcattacctaccgccgcgatgatccgcacgtgcagcgggctttgctggtgatatcctctggtgggttagacattcattcctaccgactgatgctgacttgtctaggaaattatgagggaataggcgagcgtcgccagcaggaaatccacgacagctgctccgtgctggggatcgttccagatcgctgcgtcgtcctgggtcttcaccaggggcggaagggtccgcgccatccacgc

SEQ ID NO: 10843 - DNA, 510 bp, A.fumigatus
ccacgctgcggaaccgcgccctgcggcccctcgacgagccgaaccacctcacgtacgacaaactcctctacctcaacgacgtctacttccaccccgtcgacgccctccagctcctcttctgcacaaacgcgcatcccccgcgcactgccccggcctaccgcgccgcctgcgccgtcgacttcagcaaccccttcaaattctacgatagctacgccacccgcgatctggccgggtacggcatcggcctcccgttcttcccctggttcacgagcgcagggcacggacggagtcgggaagacgtgctggcgggccgggacgcggtgcgcgtgcgcagctgctggggcgggatggtcgcgttcgatgcgtcgtatttccagcgcgcaaaccccgtgcgcttccgggcggatgacgaggtcttctgggatgcgtcggagtgctgtctggtgcatgcggatgtgcaggatgcgccggaggatgtcgacgcgattccggccacgggggtgtatatga

SEQ ID NO: 10844 - DNA, 435 bp, A.fumigatus
cgcgctggtacagctaatcgaccttctcggcccagacaacgtcttcctcagcctgtacgaaaacaacagcgggccaaaaggccagcaagcgctggaggccctcgcgcagcgaatccaaagcaacaagtccatcgtggtggatgtcgacaagcacaccgcgttcgacgccttcccccgcgtcacgctccccgatggccacaaacgcatcaagcgcatcgactacctagccacgctgcggaaccgcgccctgcggcccctcgacgagccgaaccacctcacgtacgacaaactcctctacctcaacgacgtctacttccaccccgtcgacgccctccagctcctcttctgcacaaacgcgcatcccccgcgcactgccccggcctaccgcgccgcctgcgccgtcgacttcagcaaccccttcaaattctacgatag

SEQ ID NO: 10845 - DNA, 1848 bp, A.fumigatus
ttgtgtccgacctcaaacgacgaattcatgaatcattccacggccagggtgttgccctttggccgttccaggttacatacaataccggacattacacgttatacaattacagaccccttggggccgttggctttgcatttggctagaaaaactcaccaactcttgcagagcttgatgagttttaagttagcgcttccgaatgtctctggatgcgccaatccagcagcgcaaaatccgtctgcctacaggaccctgtcgtttgactttgatggcgttgcgcacataacagactgtcttggttgccctgcagtagctcggccgccaaagagaataccctcaaaattgcgactaaatcggtcattttcggtgcagaaattgcgcggaggccgtgttcaaccgccgacaatggcatggctgcgtgtcgagtttcggctgctggtctccaggctgctcccgttcccctcgtcagggtattccgttctgccccagtcctcacgctctggtagagcagtctcctttgcgcagagtccccgggccgcgtgccgctgtctcaccctgcttgtccggatcggtctggtggtcctgctgtgcaacatcatattgacacccatcttctggccttcgtacacgcaccttccaccttgctatgagaatctccagacgatagcctcaaactcggacacccccggacggggcaacacccacaatgaaaaggtattcatcgccgcaatcttatacgaccgaaccggcgagctcgccggcggcccatggggtgacgcgctggtacagctaatcgaccttctcggcccagacaacgtcttcctcagcctgtacgaaaacaacagcgggccaaaaggccagcaagcgctggaggccctcgcgcagcgaatccaaagcaacaagtccatcgtggtggatgtcgacaagcacaccgcgttcgacgccttcccccgcgtcacgctccccgatggccacaaacgcatcaagcgcatcgactacctagccacgctgcggaaccgcgccctgcggcccctcgacgagccgaaccacctcacgtacgacaaactcctctacctcaacgacgtctacttccaccccgtcgacgccctccagctcctcttctgcacaaacgcgcatcccccgcgcactgccccggcctaccgcgccgcctgcgccgtcgacttcagcaaccccttcaaattctacgatagctacgccacccgcgatctggccgggtacggcatcggcctcccgttcttcccctggttcacgagcgcagggcacggacggagtcgggaagacgtgctggcgggccgggacgcggtgcgcgtgcgcagctgctggggcgggatggtcgcgttcgatgcgtcgtatttccagcgcgcaaaccccgtgcgcttccgggcggatgacgaggtcttctgggatgcgtcggagtgctgtctggtgcatgcggatgtgcaggatgcgccggaggatgtcgacgcgattccggccacgggggtgtatatgaatccgtttgtgcgggtggcgtatacgaccaggacgttggcgtggctggggactacgagacggtttgaggggttgtatgtgcgcgtgcatgatctgctgaacagggctgtggggttgccgcgggagaatccgcggcggacagaggtgccgggatcaaaagtgaagcgggaggtttgggtgccggaagagggattacacaatggtggctcgtttcgactggtggaggttacggcgggcaatgatgggttctgtggtcgacgggggatggaggtggtggtggaagatagacgacctgggcaggatgggttcgaagctgtaccgctcccttctcgatag

SEQ ID NO: 10846 - DNA, 195 bp, A.fumigatus
acacacttgtcaactctgctcgccattatgcagctcaaactcttcgctctgaccctggctgcggccgtctccatggtcaatgggtaccccatcactggcaacggagtcaactgccgtgccggtccctcgacgaacgataaggtgatcaagtcatacgccaaggggaccgatgtcacgctctcttgccagacctaa

SEQ ID NO: 10847 - DNA, 369 bp, A.fumigatus
cttggatacttgctctacaggaaagcaaatgctattggtcgttccagcaagactgtgcgcgagttccttgagcggaatcaccaggacgatatggaccgggaacagacgatccagcttaccatcaagtcgctgctggaggtggtgcagaccggcgccaagaacatcgaggtggctatcatggctcccggtaagacgatcgagatgttgccggacgaccagatcgaggcgtacgtcaagagtatagagacggagaagcaagaggaggccgcgaaaaagaagactggccggaccggaaccacaacggcggccatcctgacgcggcccggtggcggagagactggggagtcgacccgggagtcggccgactga

SEQ ID NO: 10848 - DNA, 450 bp, A.fumigatus
agactcccctcccccatggaccctccagctgggttcggcatgggccccaactccatgaccagcacccctgctcctggtccctttacttcggcagccggtggatttggtgggttcaaccagcaattcgcagcgccccccaacaactatgctttaccgtcgggtcttggtagcgcccctggggcctatccaccaatgggtcagatgaatgccgcctatggctccactagtgcctcacacaccacctcgtctttctccaaccctgccacccaggctgctttcagtggagctgatcacaccacctcgacgagcacctcgaacggcggattctatgcgacagacggatcgaatgatccctttgccttcctttcaactggtttgggcggcttgaccgtatctgacgatgcccactctcgccgtaatggcactggcgccagcaagtcccctgcttaa

SEQ ID NO: 10849 - DNA, 423 bp, A.fumigatus
ataggaacctgcgctgtcggagtcaagggcaaagatgtcgtcgtcctgggttgcgagaagcggtctgccctcaagctccaagatacccgcattacaccatcgaagattgcccagctggacaaccacgccgttctcgcttttgccggactgaacgccgacgcccgtattctcattgacaaggccagattagaagcccagtcgcacagactgaccgtcgaggaccccgttactattgaatacatcaccaaatacattgctagtgtgcagcagcggtacacacagagcggcggtgtccggccttttggtatcagtactctggttgtaggattcgatccaaatgataaggtgcctcgactatacatgaccgagccttcggggatctactctgcttggtatgtggcttcttggctgggaggcgagtga

SEQ ID NO: 10850 - DNA, 498 bp, A.fumigatus
ccaggactaatcctcgcctccgtcgcggcaaggaaccgcgtgcccatcaccacccccgtggccccaaggcagagtgccgccgccgcgccacgcccgtccgcgattcccccagctgcaaacacagggatatgcgcgggaagacagtccatcatctcggggaggagggccataacccccagaccgtcattggcccgcccgtgtccgccggcttctgccccctgcacgacaatcacgtcgggttcttcactcccctgtgcgagctccctggcttcggcgagcgtgccgatctggatccagatgcgcgtggatggggatgcatgccggatccgccgggaccaggtatctaggtctttttgtccgtggcggggggcgaagagccaggcggcgcagggcttgtatttgcttatggtggacatggcgacttcgaggtcgtcgctccacagttggaagccgatgcccacggggagaatgggttggttttgtagtgccgatggttga

SEQ ID NO: 10851 - DNA, 1128 bp, A.fumigatus
cttgtatccgcccacgaaccacttctcctgcgcaaaccaccaaacaagatgtctccactcattacaaccatctcgcgttcatatccatggatgaaaacgccattgatcgtcagtgccccgatgcgggtcacgtccggccccaccctggctgttgcagtctcccgcgcaggcgggctaggattcatcgggccgggcgtcaagactcaggatatcagctccgatctccaaacagcatcaagcctgatagaatcgctgtctgcatcccagtctcaaccatcggcactacaaaaccaacccattctccccgtgggcatcggcttccaactgtggagcgacgacctcgaagtcgccatgtccaccataagcaaatacaagccctgcgccgcctggctcttcgccccccgccacggacaaaaagacctagatacctggtcccggcggatccggcatgcatccccatccacgcgcatctggatccagatcggcacgctcgccgaagccagggagctcgcacaggggagtgaagaacccgacgtgattgtcgtgcagggggcagaagccggcggacacgggcgggccaatgacggtctgggggttatggccctcctccccgagatgatggactgtcttcccgcgcatatccctgtgtttgcagctgggggaatcgcggacgggcgtggcgcggcggcggcactctgccttggggccacgggggtggtgatgggcacgcggttccttgccgcgacggaggcgaggattagtcctggttaccagcgggagattgtgcgggccagtaatggggcggtctcgacgacacggacgttgctgtacaaccggcttcggggcacggtgggctggccggaggagtacagtcctcggacgattatcaacaagtcgttcatcgagcatcaggcgggtcggccgtttgaagagctgaaggcgcttcatgatgaggctctcaaggcgggggatgctgggtgggggccggagggtagactggcgacgtatgctggggctgccattgggctgattcatgatgtgaaggacgcggagacgattgtccgggatgtgcaagaagaagttttacagaggctttcgaatgtgcagaaggctaattcggcgcagtag

SEQ ID NO: 10852 - DNA, 189 bp, A.fumigatus
gcatatctgtttgtttactgggtttgggatacaaccaacagccagaagaatcgttttcgtcagcaagagcgtggtaccatgttctctcggaagactttccctcagctcccatggcagaccctcaagaaccccaagaccatcactgccgccgatggttccaagatcctcgttgatggatggtgtaagtga

SEQ ID NO: 10853 - DNA, 297 bp, A.fumigatus
  unsure (32),(52): Identity of nucleotide sequences at the above locations are unknown.
acgccggtaaccgagatgcagaaaatagccgnttatgacaaggattcttccntgggcgtggattacttgctctccctgcccacttgcaatggccgggtaggcgcaacgggtatgtgcttgggtggtcatcttgcgtaccgatgtgcgttggacagccgcgtcaaggcggctgtgtgctactttgcgacggacatccacagcaagaccctcggcgcgggcaagcacgatgacagtttggctagagcgggcgatatcaagggagagcttcttatggtgagtttgatttcatctagttga

SEQ ID NO: 10854 - DNA, 477 bp, A.fumigatus
catatctgtttgtttactgggtttgggatacaaccaacagccagaagaatcgttttcgtcagcaagagcgtggtaccatgttctctcggaagactttccctcagctcccatggcagaccctcaagaaccccaagaccatcactgccgccgatggttccaagatcctcgttgatggatggtgtaagtgatttgtctcgtcaaaggagcacccagacaaacatgctgacttttggcacagatggcaaggctcgtaaaatccactacacatgcgatctttatttcgccttgaactggggcttgattaccggcttcagcagtccattcccctggttctatcctatttttttcgcgtgcatgatcactcaccgtgcgctgcgtgacatccagcgctgccggaataagtacggcgaagcctgggtagagtacgaaagacaggttccatatttgttcatccctgtaagctattcctcatcttga

SEQ ID NO: 10855 - DNA, 267 bp, A.fumigatus
tacgcagcggcttttcgggtcaagaagagcaatattactaactcacctacatctgctccttactttacagcaggaaactttatattctcgatgtccatcggcggttcacttcgattcatgtatatcattagattggctaccaccggccgtcacttggtttccttcctgttacttttctccttctgtttcgattattcttatctctgtcccttgataaagaggtttatgaccctagcgagactctatcgcttgaatgataatgtataa

SEQ ID NO: 10856 - DNA, 213 bp, A.fumigatus
  unsure (94),(203): Identity of nucleotide sequences at the above locations are unknown.
tgttcagcgagatctaccaaggtgcgtacacggcttcgcgcgattgacggcgccgaaactgactgtgagctagtgactggacctgtctcgcggntcgccagacagattgcgggccaggggtacatctgtgctgcgccgtccagctatcacgaattcaccggtcctgagccactgcaatacaatgctgaagatactgacaaggngaaccaatga

SEQ ID NO: 10857 - DNA, 840 bp, A.fumigatus
  unsure (78): Identity of nucleotide sequences at the above locations are unknown.
ctcaacgttgttcttcatatagatttcagcatgttattctcaaggtctggtcgatcgatatttcctcttctgccaccntacgcagcccacgccccgaatccgaaccaggggcatataatcgctttacctccggatggtctcaccccttactttggcctcagggctcgcttatcgcaagtatggatcaatcgatggacgatcctgctgcttcttgtgctcgtcagagttctgctggctgcttcaggtctgcaggcagacatgagcacagcgaaacgggaagccttatccgcttgcacgagcgtcgaatccatgggtagctcgatggcttctatgccccattatctatcccaaggtgtcaacgagctaacggcaaccggagtcgaaaaggctgtgagcggcctcaaatcgatgctgatgcttaccatcactggcgtcgaagaactggtcctcttcatcatcaaagtgctgtaccagacttatctgtgtcttttcacactggcggttagaggcagcgtgcatgttgcggtgggcgtgattaaagaggccgcggactttttgaattccactgttaaggaggtcggagacgacattggcaaagccgtcagcacgtttgaaagtgcattcaacaagtttcttgatggtgtgaacaccgtcgccagtgcttttggagccagtgtaccaacgttggacctcaacagctcgatcagcactctggagaaccttcagctgccttcttcaattgatcaagggcttgacaagctcaatagttcccttccgaccttcgatgaagtcagtcttcaccacggggctggaaggatccgacggaggacgaaagtctat

SEQ ID NO: 10858 - DNA, 486 bp, A.fumigatus
gaccttctgtatcgacaacgaggtatggatgctgtgattgtccagaaaacaacgcggatactgactggttcacaggctctgtacgacatttgcatgcgcacccttaagctctctaacccctcttacggtgacctgaaccacctggtctccgccgtcatgtccggcgtcaccacttgccttcgtttccctggtcagctcaactctgatctgcgcaagttggccgtcaacatggttcccttccctcgtctgcacttcttcatggtcggcttcgctcctctgaccagccgcggtgctcactctttccgtgctgtctccgttcctgagttgacccagcagatgttcgaccccaagaacatgatggctgcttccgacttccgcaatggacgttacctcacctgctctgccattttgtatgttactacacctgcggccattatgcacgatctctgtactgaccataatttagccgtggtaaggtttcaatga

SEQ ID NO: 10859 - DNA, 276 bp, A.fumigatus
aggaggtcgaggaccagatgcgcaacatccagtccaagaaccagagctacttcgttgagtggattcccaacaacatccagaccgctctgtgctccattcccccccgtggcctcaagatgtcctcgaccttcattggtaactccacctccattcaggagttgttcaagcgtgtcggtgatcagttcactgctatgttccgtcgcaaggctttcttgcattggtacactggcgagggtatggacgagatggagttcactgaggccgagagcaacatga

SEQ ID NO: 10860 - DNA, 471 bp, A.fumigatus
gccaacggtgacaaatatgttcctcgtgccgttctggtcgatctcgagcctggtaccatggacgctgtccgtgccggtcccttcggcgagctattccgtcccgacaacttcgtcttcggccagtccggtgctggtaacaactgggccaagggtcactacaccgagggcgccgagttggtcgaccaggttatcgatgtcgtccgtcgtgaggctgaaggctgtgactgcctccagggcttccaggtcacccactctctcggtggtggtaccggtgccggtatgggtactcttctgatctccaagatccgtgaggagttccccgaccgtatgatggcgaccttctccgttgttccctcccccaaggtttccgacactgtcgttgagccttacaacgctaccctctccgttcaccagctcgttgagcactccgatgagaccttctgtatcgacaacgaggtatggatgctgtga

SEQ ID NO: 10861 - DNA, 366 bp, A.fumigatus
tttagccgtggtaaggtttcaatgaaggaggtcgaggaccagatgcgcaacatccagtccaagaaccagagctacttcgttgagtggattcccaacaacatccagaccgctctgtgctccattcccccccgtggcctcaagatgtcctcgaccttcattggtaactccacctccattcaggagttgttcaagcgtgtcggtgatcagttcactgctatgttccgtcgcaaggctttcttgcattggtacactggcgagggtatggacgagatggagttcactgaggccgagagcaacatgaacgatctggtctccgaataccagcagtaccaggacgcctccatctctgagggtgaggaggagtag

SEQ ID NO: 10862 - DNA, 603 bp, A.fumigatus
gagaccgagcagacgtacggaatccccactatatccggcctcctgaccgcgacgagccaattctcgaaccctgagacatccctcaagcgctacaccgataccagcgttctgattcaggagttcatgggaaatgccccctcctcagagcgcgcctgcattgccctcgcgcgcacccgcttcctgcacactggctaccgtgccgcgggcaaaatccaagaagacgacatgctgtacacgctcggcctcttcgccattcagcccgtgcgtttcatcgaaaagttcgaatggcgcacgttgagtgacatggagaaatgcgccttgggtaccttttggaagagcatcggtgacgggctggacatcagctacgagaacctcccgtcaagcaagacgggattccgcgacggtctccactggttggaggagatcatggcctggagcgacgagtacgaagttcgaagcatgcttccggacgtgaagaaccgcgagacagccgaccagaccactgccgtgctgttgtacatgatccccggcccgttgcagcctatcgggctgaagttcgtttcgttcatgatggacgatcgtctacggaaggccatgctgtaa

SEQ ID NO: 10863 - DNA, 1884 bp, A.fumigatus
cggggggggaggccattagagagatccgaataccatatttccaaccagcagcatggggcggatgccgaaatccaagaaacaaaacccccaaaccatgaacctactccatctcagattcttcggtatgcgttgatgggaactacagaactgtcgcgacaagaaccgtcaaagcaggacctggacgaccatttgaacgaagtgttcttaggcgaatggcgcctgtctgctccacctttgtggagctctttccgcccaaaagccgccggacttgatagggatgtgttttccaaaggtctcgaggatgatgtgcagaatcttcatcagctacatatcttcatagaaagacaccttaatggacaagggtttcgtggattatggctggtagaacattgtggtcttctggcacaggcgctggaacgttgtcaacgacaccactcggcggcagagatccttgtcgctatcaatgcactcgtttcaagactacggagattgcagacgattgtaccttgggagttacacctactgggcatgtactacgcatgtctttcttactctgcagctgccctcgaacgacatctgagagatttacgtgctgtcaagctgaatccgtttggtttggccacgagtctccccctggtagatgcgctttacatgtccatccgatccttcgagcttcagggagattatccagataccggttcgatgctcaaacaagtgactggcgagccttgtgtcaatgatgcctcagaagtcactttacactccttcttgtcctgggctagtcggggaaaagcgaaagttggacgttattttagattgctcgtcaagctaaagagccttgaattgcttcagagcgtatggggggatcttgtgcgccttttggagcccaaagcacccgagcgccgtttccacgatgcttattcctgtataatggctctggttgtcgaaggagatgtcaccagggccaccaggtatctggaagaaatctcgaagcgcgctggtaacgtccttccttatatatcagggttcaaagacctgaacgtacttctcgccaatcaagaagtttgcgagttgctatctcgtctctgtggcggggatgaatacctcaagatactcgaagtctacctcgaacacatggagaggaggctagggatcaaatggctgcccgaaagatctcttcacactagtatatctaatctcagttacaatgcgaccggacagcctcttcttacaatggatggagacagtactggatacgaaagcagcgaacgcttgattgccgaaatgcacgctttaggttgttctggatcgctttcagatctcatcagacttgccaattgcttagatgagcatggaggtgaacatattccggttgttcaatcatcggctgaaaatacacctctagagctggcctgggtacctcaacgctgccccgtcgatgtcctaaactcttctgaggtgagatctggggaacacacgacgaactcgccttcctccctaggtttgattcggctcgaccctgaaaatgccgggttgtcaccggcagatactcgctcgctgcacttgatgcagttgggatatctgattataaagcccaaagcatccaatgcggagcacgaatggagagaatcgggccatatagtagccctggaccgctcttcaggccaactcttcgcagtttttgtggggaaaggtcagggcccaataagcgcgggcatccagtcgcatatcccacgaatgccattcgatctcaaatcgataatgaaaatcgaactgcgaagcgacttaggcggaactcatcagggggacaatcattcgtcaccgatatttgatatcaccgaatgctatcttgatgtggatccttgtaaagatctggtgatttga

SEQ ID NO: 10864 - DNA, 276 bp, A.fumigatus
accgtcggcccggtgaggtatgagatctgggatgtcagcggcaagcagaaacccactgttctggcttcgagggaattcgatgacatcgatgccgcgatcatcatgttcgatctgactgatcgggtttcgtacaacaatgtgcccaattggtatagtatgtacatcaccaaccatgttgaggtagcgctgacggaattgtgcagagagcctcgtaaacaaggacggcatgcgccttgggaagtatattcccatttgcatctgtgggaacaaaaatga

SEQ ID NO: 10865 - DNA, 1218 bp, A.fumigatus
  unsure (1197): Identity of nucleotide sequences at the above locations are unknown.
tgggcatacaatggatgtttggtatctgactggttcgctactaaatcctgtgcaccatcaatcaatgctgggctcgacctgaaaatgccgggtccaacaatcctgcgtggtcaaaagcttgtagcagccgtcagggatggtgttgttgacgaaaaagccgtcgatgagtgtgtttctcgagttcttgctctggtcgagaagacacgagagtcgcactcactggaacccgaaaggtctgagatcatcccggagacgaacgcactagccctgaaaatcgcatcagagggcattgtccttctcaaaaatgagcagggtgtcttgccgctggacatgcgtcgtgctccgaagattgcagtcatcggtgtccccgccagtgagcccgtcgtgagcggcggaggcagtgccagtgcgccgccgcagtacctacaaaagccactggactatttgagagacgctcaccccttcccttctttggtgaaatatatccgaggggtcaatacaaacagaatcatcccgatagtaccgctagattgcactacgtccaggaatggcagccccggttttgacgtcgcttattataacgaggattctgatatacctgtgtacacggaacaccagaagactccggtggtcgccatggttcgaaacttgaagcccggtctgacggagccgggcttcagctgcgagatctcaactaccattacccccaagacaaccggcccacacacattagccgcccgcgttacggggagtttctctttatttgtggagagcaaagctgttctttcggtcccaaaacaacatgaagtgacaatggaagattttcttttcgagcccgctcgcctggaacaccgcacttccgttttcatggaggctggaaagccttacttggtgcggcttctgagtcgggctcgtatcccgagagaaaatgactatgaacccactcctcacggtgcaacgctgtgctatgaggaattcagtgatgagcgcgctgcgatagccgaagccgtccaggctgctttttcagcagatgtgagcatcatatttgctggtcgaaatcaacaatacgaatctgagggcttcgaccttgagtccatgagtatatccgaaccccaggtaaggctcatcagagctgtcacagcagtttccaagaagaccgttttagtccttaactccggcaatccggtttttaacacnaggccagaaggaaccgatctc

SEQ ID NO: 10866 - DNA, 558 bp, A.fumigatus
ctcgtcgactcggtgaacggggtcaagggttctgaacttcaccacggtgtcccaacggccatttttccaagctcgaccttgtacggtgccacttggaacaatacactcatggaggagctaggaagggcattggcgtaccaagcgaaattgaagtctgctcaagtcattcttggaccaacaatcaacattcaccgcgatcctcggggaggaaggaattttgaatgtttcagcgaagaccctcttctgtccggtcagcttgcggccggcgtcgtgcgcggaatacagtcacaaggcgtcgctgcttgtccgaaacattttgcttgcaacgagagtgagttcaagaggcgggagtacagtgtggcacagtctcataacagccgtgctgttcgggagatatacttggctgctttccaggagatgttgaggagaagcgagcctcatggcttgatggtaaggtacgtatcaaggccgtcttcctcggtgtacatattgctactacacgtcttcgatgtttattggatgatttttctgatgcctgccatagctacaataaactga

SEQ ID NO: 10867 - DNA, 402 bp, A.fumigatus
tctatcagctgggggttgataacaactgggtacagctgtccaaatatgcaggtcaaatcagaatcctcagtccccgtaatgggtaacctcaagactgtgaacgccacggtcgatgaagtattcgacctctctcgagctgggacgccaagctcccaagatgagagtgctagagaggacgctgcaccctcagtgcaaccgaactttacctctctgctaccgcaattgaccctggaggagaaggttggcttgttgtcgggaacggatttcgttcactctagcggagtctcgcgattgaacattcctcctttaaaggtatatgaatcctcagccatggccaggcctgtgcgttcgattgtacagctaacatggcttccacgatcgtctagctcgtcgactcggtga

SEQ ID NO: 10868 - DNA, 2064 bp, A.fumigatus
  unsure (1837),(1903),(1944),(2041): Identity of nucleotide sequences at the above locations are unknown.
tgcaacggggaagtggatatttcgtctctggagcttatcttctggttttggagcgcagggttcatgcttgacgaaatcgttggcttcaacgaacagggctttagtctatatctcatgagcttctggaacctgtttgacctcgggattctattcctgctcttctgctattattgcatgcggctgtatggtgctctgatgcccagcccatacaatcacgcgattgccgacagagcatatgacatcctcgccgccaatgcggttctgctctttccccgactcttttcggtcctggatcactaccgatatttctcacagttgcttattgcgttccgcataatggcttcggatttggttgcagtgtttcttctggtcgccattacgtgtagtgggttctttgtcgccttcactctatcatttggcaacattgaagagcatacccctgcgtctgttgcttatgccctcttccagatgttgatgggattcactccggctgcgtggacgctctgggacgattacaacatcctaggcaagatcattttgacactcttcctgtttatctgtcactttgttgtcgtgacgatccttattactgttctgaccaattctttcatggcaattgtgcaaaatgccaatcaagagcatcaattcttgtttgcagtcaatactatttcgatggtcaaatcggacgcgcttttctcctacgtcgcacccactaatatcattgcgtggctggtgacgccgctccgttatttcatgcctttaagacaattcatccgactcaatcgcactatgatcaaaatcacacattttccggtcctcttcaccatttgcctttacgagaaggcgatccttagtcccagagttaatgagccgattgatctcatagatcattcgaatcgtcccgacgccttgtctcgcagtcgggcccgtcacggtcgtttcaaatcattcaatcctcaagctcctcgccttgtacgagaaccatcagtggcaacgtatcagaaagaccgcgctcttgaagaagttttccggaatccattggaggagacaattcggcgtccgccgaggctgatgcaacagagaaagagcaacaatattgttagcaactggatgcaagctatgggatctggccctgtacaccctcccgacgagcaggactcggatgaactcgatcgattggagagaccccctcggaggtctcgatttccctttcgaggaaggaccacaggaagtctccgcgattttaccgattccaaccgttctgccacatcagatcctgaagggcatttgggtcatattgtctcatcacctgccacgccacgtcgtgagagagccaacgtgtctccggccaggatacgacagctttctcagcacacggacattgaaggcgacgatgagttaaccagcgatgatacagaagttcgtcgttcgaatccttcaagttctgacagaaacggcggtgtgagtccaggtaaagcaacaccgaagttctacagctcccggccctccacggcgagagtcaaatcacgcaaaaacagtccttctcggcgtcctaagtttcacacgcggaattactccgccgcgacaatgctttacaaccctgtcccctcggtcagcaacgacgaaggaaccgacgtgtctcctgttcccatcagaccgagagcggagacgccttcagcaggggatgatgcagccactgcaacttccgtagaccaatggatgcacagaaggcatagtttggatgttggagtttctcaaaacgtggctttggccaggtcaaatcccatgtctgtacctgacttgggcagcttcttacaaaccaaatcccaacaccggngtcgccgtcaggcatcccatttgtatggactgggctctgaccttggcgacaatcgggcaattgcanatggattcttgggctgctttgcctgcagcttcacgacgcanatggaatatgctgcgggtggcatccccagacctgacagctctggtagcaatcaagacatgctcagcaagcttgtcttggctcgcatgaacaatatcngagagggatccgtgagatgttga

SEQ ID NO: 10869 - DNA, 333 bp, A.fumigatus
  unsure (84): Identity of nucleotide sequences at the above locations are unknown.
ccttcatcattcgtcatccagccttggcgttcccatctctctgccgcgccatggaaaagttcccggcaaagcggctttatgcantcggtggaaaccatcggcacgcatgataccaacttgaccttgaaatggacgcgaatgctttacgactggtgcctggagcaccccgacctgccgggtaaccccctggtgctggatgcgcaagatatcatcccacatccgcacgtgaaggtccggtactgcgaaaagacggttctaacccccaatcctttgaattttgattgcgaaaacaaaccgcaaccgaaggggttgaaactgaaactgtccaaataa

SEQ ID NO: 10870 - DNA, 246 bp, A.fumigatus
ctgggattgctcgacatatggatacccctcagcggcaccaagccgctcatcaagtactacagcatctggccggtagatcaccagtgtggcctcacctcgactgtgggaggcacacagcccctgatcgcctgggagagtctgcccacagtcgcccagaccgcactggaggacaccgactttggtgatgccaatgtgcctttcaagaatgccaactttgcctccaacctggccaaggcgactttttga

SEQ ID NO: 10871 - DNA, 618 bp, A.fumigatus
  unsure (592): Identity of nucleotide sequences at the above locations are unknown.
tcctttttctggtgctattctactagtttgcccatcatggccgacggcaacatatcgccatctcggtcccgtttgctcctcatcagtgtcccccgcacggcatcaaatctcatgctcaagctcctcaatgtcccttgtcagaagttggtcacatccgagcgcggcgggtatttcttcttcaacgcctttctcaaggtctccggggatggccaccgatgtgtacccatcggagagcggaacgaagccgagaagcgggagatccgcgatgccttccaggaagccgttgatgctctcgaggactgttcggagcgagcagagcgagaggggaagattgcattcgccaaagagcatgcgttctggttcacgaatcccgccgtgttggggaatgtgaccgaagacgccgccagcttccgaccgcgcattcctgacaagtacggtccctcgcacacgttctcctctcttaatcacacggtgctcccggacgaatacctgcgcacctggcgattgaccttcatcattcgtcatccagccttggcgttcccatctctctgccgcgccatggaaaagttcccggcaaagcggctttatgcantcggtggaaaccatcggcacgcatga

SEQ ID NO: 10872 - DNA, 363 bp, A.fumigatus
gaagagattgcggctatgaagagacgggtagccgagatggaatccgaagcagcaaagttgcgggaaatgcaagccacccttgatcaacagtccgagagtctacgcgaggacaaagaggagattgatgctcggagtattttcgttgggaatgtggattacggcgcttcgcccgaggaaatccaggcgcacttccagagctgcggctccatcaatcgcgttactatccttctggataaattcacaggccaacccaaggggtgcgttatgccgatctcttcgaagaaagatggcggctgtctgcgtcgctgtcttctctcctggatatcgactcctaaaatatgtatcatggctgctgactgctga

SEQ ID NO: 10873 - DNA, 291 bp, A.fumigatus
ggtgtaactaagggttcgacagccgtcttgacattgggggtttcttgtggcagagtacggagcataacattcattgcatctggcgggattctgaagcacatatctgctcatgatactcaagggtgctttcgaatacgatggatggttagctgtctagaaaagaagaccaaaaataacatgaagttacatgagccatcactgatgaagattgactccatcaacggtctactccgtatctaccgatcgtctcaggcggcagcccggtcccactatttttgggtggtgccttga

SEQ ID NO: 10874 - DNA, 1446 bp, A.fumigatus
cgcatagggttgcccacgataggctcgccacctgaacaagaaagaccacccccgccccctccaacaaaaatcgactttcccgtctatgacctattagatgtcccgggtgacgcatcggaatcgtccctgagggagatagccgaccttctagcgtcgatccgccggccacaggacctctcgacagagaagttgaaggccttcaatctccgaatggaaacaaacattactgcggatcgcattgtcccccagggctcaaaactctttcctccgctcccttgggaggcccgtgtctgtaatgaaaccgaagatggcgagcccatcttgatggacaatggtaacccataccccgcggcggaccgattcgagattctcaagaaggaactgctcttggataatgatgatgctttccgggaagttacacgactaccgcccaaggagggccgtcagcgggttcgagtggccaatgcacgcaaattttggatgggcctggagcgaatgtcgcagtggtgggattccagcctggacaattatttcgagcgccttgccattcctgaagaagcgtccaacgaagacaagatgcagacagatggcgaaccacagccgtcagggatacaggaatcaacaactacgccgatggaggtcgacagcccacccacgacacagaccgttgacggaacgtcttcggatccggaagaggggcagcaaccgactgttcaaagatataccggccgccggataggtaacggacaggaaatgccagaagatgttcgggaggagacggtgcgagcgctggctgagatggccgcctggccatttggttgccaagtcactgtcccaatgctcccaccgcgactcaccgtcaagaaaatcctcttccccatccgacagtccttccaagctgcccgatcgcccaaagaccgccaattggcccgtaacggggtcatggaaggtcctgttttcgttgcccaatgcaggccggagacctccttccgaggacctggagacgcaccagggaccggcgtgggggaggtatgcgacctgtttcaggagctcggtgccatgcttctggccgcacaggaacgcgcgaggcaagggacgacggaagtgaaagccggtgagggcaagtggtgggcgaccaaaccccgatggggcggagcgacccaggacacgcaggacaacagcaattgcgaggaccagtctgtgagggatggcaatgatcgcaagcgctctaagtacgagcatccatttgttgcatcccggcgcccgggctcggggcggaagcttagcaatgccgagaagtggaagattgtgcagccaggccccagtctttgggacaaacggatgaggtacattcagattgggaaggacaaggacagtcctttcgacgatgtatgcttgatcaccgatggcaggtgcgaacctatgctaatcctgaatctgatctag

SEQ ID NO: 10875 - DNA, 198 bp, A.fumigatus
tctacggtaccatttacccaaaacggacctcttacacgacgccgcgtcgccgggagggactccccccagcccttaggatctggtaatcctttaggtatttctggtaattatgatagattacctttcgctccttactttgtattagcgtcggtagtggccggttcgttactccaatcaggattcggagatggcaaatga

SEQ ID NO: 10876 - DNA, 606 bp, A.fumigatus
ttatccagcgcttggaccagattgaatcactcctgcgaccaacacaacgaccacgaccacagaaaccaagcgaggactcatggccggcccttcgaaacagcaatgcactggacacaattaggcaccccccagctgcgggagaacaacgggtggactaccggcaacagcagccctgtgtaccagacgcacggttctgacttgagtcgactgactatcgagacgatcctctcctggagcgtgtttgaagggaaatacgacgctggcccaagtctcacagacctgctgtcctcgccaacaaccctgtcgcaggagcctttcctcgccagcattgacccccggcacgaacgcctcgacctggacctgaggacctgcacccggttgctccacacctttctcgaggaggtgcatattgccaaccccatcctggacggtcccttagttaccggttacctgtaccaggcatgtatccatggaatcggctgggatgcaccctcgtgcctcgtggtaggactgtccttcccatccgaagcagcacactcactgacccgaaccgccctcccagctgctcatatgtgccttgggcgcaatctccgaaagctttcatga

SEQ ID NO: 10877 - DNA, 426 bp, A.fumigatus
cgaggtgactctttggcgtgtctgaaagccaaatggattacggggttgtatatggggtcattcgccactaaccccacacgctggactctgattgatttaagacctcccccccctttgtgtcagacgcggagtgtcggtttctcttcccccctttactcgtggactctgctgccgtttctgctcgctgtggacaccggcatggcaaccaagcagccgagcagaggacctgcggcatacccccgtcgcagggccgtgagagcatgccaggtctgtcgggctcgtcggacgaaatgcgacaacaagacgccggcgtgctcgttttgcgagaaaataggcgccaagtgcgtggtcaacgaccccaccgacatgtcagtgcacgctacccgagttgaggatctctgtgggtgcttttctttccaacgctaa

SEQ ID NO: 10878 - DNA, 741 bp, A.fumigatus
gcgacaacgtgttcgagcatcaacagacggtccggccaggtgattttcggcccacccagtgtggatctggtggtcgttcttcttcaacgtcagtgccatcggatggtacgtccaagaaacccaacagtcgttcggcgattcctgtctaatgccgtgacttctaggggatttgacccccaggtcaatggagccgtcctctccatcccgtcattcggacgcgactttggtgagcagtatgacggcggctttgtcgtcccggctccctggttgagcgcgttcaactcgatctcgtccgtcggccagttctttggcggctttctttgcagcacgattgcggaccgagtcggtcgaaggctggctctcgccgtcggcgtggtcatcacctgtggaggcatctttggagagctcttctcgacagcgcgagcagcattcctcatcagcaaactgatcctgggagtgggtctgggcttttaccttaccatcgggcccttgtactcttccgaggcgagttatgtccaataccacgattcgagaatcatgtcactaaccaggtcacaacaggtttcgcccgttgtgctgcgcggcatcacgactgccggtgtgaatctcgggatagtcataggccagctgctctccaacgcggccattcggggcttcggggagcgaggcgataaatgggcataccggggcccatttgcgattcaattcttcttcgtcggtatgttcagcggcgtttattaa

SEQ ID NO: 10879 - DNA, 474 bp, A.fumigatus
tctcggcgtcggcgtgaccgcctgcggcgtcgtgggcaccatcatctcctggaccatcgtcaaccgcctgggccgccgcatcatcttcaactccggcatggccatcctcagcacgatcaatctgctcatcggcatcctcgacgtcgtccccacccgcggcgcgagctggacacaggccgcgctgaccgtcgtctgggccttcttctaccaggtcagcatcggcgccgtggcctttgtgctgctcggggaaacctcgtcgccgtctctacgagccaagacaaccgccgtggcaaccgcaacgcaggccgtcttcggcatcgtcatgaacattgtgcttccgtacatggtgaacccggacgagggcaatatgcagggcaaggtcggatttgtctttggcgggctcggggtgatcgccaccgtgctgtgctacttgtacattccagacttgaagggtcgcactttcgaggagattga

SEQ ID NO: 10880 - DNA, 822 bp, A.fumigatus
caaggcccgaaaccgctcttgaagggactatacggcgccgaccgaattattaagccaaagctcgtggccatccagatgaccgtggcccaggatctcgcagccaaggagtccaagtggtccgacgccgtccgcggcaccaaccgcgtgcggacgctgatctccggcggcgtgttcgtgtgccagcacctggtcggcatcatcttcgtcctcgggttctcctcgtacttcttccagctcgccggtttacctacagagcgctcatttgatctcggcgtcggcgtgaccgcctgcggcgtcgtgggcaccatcatctcctggaccatcgtcaaccgcctgggccgccgcatcatcttcaactccggcatggccatcctcagcacgatcaatctgctcatcggcatcctcgacgtcgtccccacccgcggcgcgagctggacacaggccgcgctgaccgtcgtctgggccttcttctaccaggtcagcatcggcgccgtggcctttgtgctgctcggggaaacctcgtcgccgtctctacgagccaagacaaccgccgtggcaaccgcaacgcaggccgtcttcggcatcgtcatgaacattgtgcttccgtacatggtgaacccggacgagggcaatatgcagggcaaggtcggatttgtctttggcgggctcggggtgatcgccaccgtgctgtgctacttgtacattccagacttgaagggtcgcactttcgaggagattgatctcatgtttgacatccgggtgccgccgcgcaagatgggcgggtatgtgtcttcaccaggggctggaaggagccgcgccaat

SEQ ID NO: 10881 - DNA, 252 bp, A.fumigatus
aacatggcgatcgaaacgtctgccgatcattccaccgtcgagactgtccatgccgactcggctgatgttgcagcagatcccggggccaaatcggctctggtgagcgacaacgtgttcgagcatcaacagacggtccggccaggtgattttcggcccacccagtgtggatctggtggtcgttcttcttcaacgtcagtgccatcggatggtacgtccaagaaacccaacagtcgttcggcgattcctgtctaa

SEQ ID NO: 10882 - DNA, 585 bp, A.fumigatus
ttcctcgctttacttgcaaatatgagtacctcccataatgagccagcggagccaattccggatggcatcatcgccaccgcgaagcagtcctttggcgatcttttccgatggaaacagcgtgtcgtcgtgaccaacgagtctggcgagactcacgccgagtggcaagcacctgaacccatccagaaccctatcagcctgcttatgcagctcggtgcacgggactggcgtttttttctcgttggcttttttgcatggacggccgatgcctttgattttcatgccctatctatccagactgtcaagctgtcaaagtactatcaccgctcaaaaaccgatatcagcactgctattactctgactctgctcctacgaagtgtcggtgccgctttcttcggtctagctggcgatcggttcgggcgtaaatggcccatggtaatcaacatgattgtgcttggtattctacagatagccaccatctacagccgtacgttccagcagttcctggcggttcggtcattgttcggactttttatgggcggtgtctatggtaatgccatcgcgatggcattagaacattgcccgtaa

SEQ ID NO: 10883 - DNA, 195 bp, A.fumigatus
  unsure (150): Identity of nucleotide sequences at the above locations are unknown.
tccgagctggaagctgatgaacttacagctggcgcctcaatcggtgttggtctcgttcgcatatgcttcccaaaatccaagcaattcctggaagccaagaatgccggcaagaaagccactgaccccggcgcattttggcgtgagacgaancagatgcttgggaaggagtggaagatgtgcatttactgcgtcttc

SEQ ID NO: 10884 - DNA, 765 bp, A.fumigatus
caactgccacaagtgagtatcttttgttcctgcttgcatgtcccacgggatgaccattcgaatgcaacgcataggtggctttttgttccacgcagctgttgcgtcctctatgttcctgaacggcaccagcatctaattcgcacaacaattcccacgtcatggggttacatcccttcccctgacgccccggagactactccctctatcatgaaaagtgatgacccgtccaaaaccccgttcgagagcctgtttgagtttgttgctaccaatgatgacgcaccctatttctgtgtccctgcggccttgaagttccgcaacgagatctgtggtggcgaagagcgcatttacacgtacctggaaaccttagcaaacgaagccgcagatcttctggcagctgtcctggacacagaggtcttacaggaacccaaccggaagtcaggagtacctagccaactacgacgctgcggcatgtcaactgtccagctacctattgctattcaggggagaccagggcctattaaaccatcctacctcgtcttacaggcagacaaggttgcctcgacgatcaattggttccaaaccaccctggcgcacaagtacggaacgtttgtgcccgttttcgcccatgggaatcgcctttggacgcgactcagtgcgcaggtgtacttggaaataagcgacttcgcatggttggctggagttctgaaggagatgtgtggcgagctgaggagcaagcaaggaggtgttgatcagcggttgcgatga

SEQ ID NO: 10885 - DNA, 1326 bp, A.fumigatus
cgctccagcgagtcgcctcgaccgatgacaatgtgtgcagggttgaggaaaggatcgttcacgctgctggtcaacttcctggataaacaccctcaggtcgagttcatacgataccagtggattgattatgccgggatcatacgggcccgtgttgtgcccgtctccaatgcactgaagctggcttccacagaatcgcctctctgtggcggacgaatatgtctcaccgcgacaaatgtcattcgcatgatggaaaatcggtcccatgtcggcgtcgactccatctacccggacttctcctccctacgcgagtgccactatgcgccgggccacgccagtgtcatgtgcttcatctccgaaggggacatgggattcgaacgagatccgagaaccctcctaggctccatcgtggccagtgcaccgcaggtccagttccgaatcggatttgaagtggaattccgttgcttgacgcccgaggggaaagatctcgatgacaccttgtattcctggtggaccacaacggggctacggaaccgttgcgcgcccatcatcgatgaagtagttcgccttctgcagcgtgaaaagattgaggttttacactactgttccgagtcggggctggggatgtttgagatcgccacgggtccgctctcgccgttggaatcgatcgacgcctgggtgtatacgcgagaagctgtcaagtctctcttttgggagcatggcatgattgcgacactgtacccttcgccggtggaggtccacaccggtattggggcgcactttcatctttccatgacgtcggacttggaggtggatgaaagtgcgttcctggcggggatgctagggcaactaggcggattatgtgccctggcgatgccgttcgaggacagctacaaacgcgtcacggatcggaagtcagaggccggttgttggatcggctggggcacggagaatcgagactttccaatccgaaaagtgaagaagagacactgggaagttcgatgctgtgatgctaccgcgaatctctatctcgttgtggcagggttcatcaacgccgggctgggaggattgcagacaggaaagcagctggtgtggcaggattgcaatagtaacccagtggcgctggatgaggaaactaggagagagctgggcattaggcagcggatgccaacagatctcagtgagagtctgcgtgaattggaaaaatgggacggtggtgcgatgggcaagtgtctcaggactttctgtgagatgaaaaagcaggagattcgggacttaggagaggtatcagacgaaaggaggttaagggacatgattaggcacttttag

SEQ ID NO: 10886 - DNA, 615 bp, A.fumigatus
tatttacggtatggctcaggctcctttggaacgtatccaacggcggtgcgagaagccttgagaggatttcaagatgcagctgaagcacgcccggatccatttatccgttatacgaccccaaaggctctcgatgcatctcgagaagcaatagccaagatgctcaacgttccccgacatgagtgtgtctttgtgaaaaacgccaccactggggtaaacacgatcctgcaaaacattcccttccagtccggtgatgtgattatttactttgaaacgatatacggagctcttgagaaggggattatcgctcttatggagtcaacccccctccaggcacggaaagtccaataccagtgtccaatcagtcatggtgacttagtggagcaattcctggaggttgtgcgaaacacaagagccgagggattgaacgtgaagattgcgcttttcgacgtagtatccagcctgccggcgatgcggtttcctttcgagcgattaacagacgtgtgccgggaagaagggatcctgagtctgatcgacggcgcacatggcatcggccagattccgctagatctggggagactacagccggacttttttactagcaactgccacaagtga

SEQ ID NO: 10887 - DNA, 249 bp, A.fumigatus
agacaggacttgggctgcgaattcgtcgaggcgtccgccaagaactgcatcaacgttgagaaggccttttacgatgtcgttcgcatgctccgacagcaacggcaacagcagcagggaggacgagcccaagatcgtcgaccgactggcttgggccctatgcgcgatcgggacgccggtcctgaatatccaaaaaccttccgacccgaccgtgccagacaccgaggtggcatcaagtgcgtcatcctgtga

SEQ ID NO: 10888 - DNA, 645 bp, A.fumigatus
gttcggctagtttcgttctgcttcctttcctccgtgatcctttttctgcagttctgctatccaactactcctcgggtttggttaggctttagaatactgcggcgtgcatttatactttggattcgtcacatcgtagaagtcatcccatcccatacgcacttttccccttctcgctgcactgtttcttgcttatcggatcgcgaattatcattcccacgtttaaacaaaaagaaagggagaatgtctacccaacaaacagtccacgctcagtccctgcactcccccgaaagtttttggtcgtatcacgcgaccaagctgcactggcacaagaagccatcacaaacgcttgtccgacgccccaagaccctaccaagcggggtcacgcacgagcactggtcctggttccccgacggcgagatctccacgacgtacaactgtgtggatcggcatgtggcggccggccgcggagagaatgtagcgattatctgggactcgccagtgacgggcgtcaaggagaagtatacgtacagccaattgctcgatgaagtggaggtgctagctggggtgttgagagaggaaggtgtgaggaagggagatgtggtgatcatctacagtatgtatctcagctcgggacccggcacatag

SEQ ID NO: 10889 - DNA, 297 bp, A.fumigatus
ttcatctgcggtgtctttacgccgtacatgctgaacccgggagcttgggactggggcaactataccggcttcttctggggaggaatctgcttcctctgcatcatctacacttacttccgtgttccggagcccagaggccgatcgttcgccgagctggaccttctgttcgagcgtaaggtcagcgcaagaaagttctccagtacgcacgtcgatgtcttcgacgagactgtcgaaagccaggtggtgagcgactaccatgcccaacagatggccgcggccggtgtgacccaaaagtag

SEQ ID NO: 10890 - DNA, 399 bp, A.fumigatus
ctcctcatgcccaccctcgacagccttggccgcaacaccccactgctccgcctccttgccgctgaagttcttccccgtcaggatcagctccatcgccttgctcttgccgacggcgtgggtgagacgctgcgaaccgcccgcgccggggatcactcccagcttgatctcgggctgcccgaaggtggcgctagcggtgcagtagatgatgtcgcacatgagggcgagctcgcagccgccgccgagggcgtagccggagacggcggcgatgacgggcttgcggacggagttggcgaagtgcgaccacggggcgatgaagttgttggtgtaagcgttggagaaggtcagtggggccatttccttgatgtcggcgccggctggacggtatcagcaggtttgtag

SEQ ID NO: 10891 - DNA, 231 bp, A.fumigatus
ctccgatcatatcaataccaaacgtccctcgatgctctgacaccctacacaacctaccggtggatcggctccgtcgtcctcctgcttatcttcttcctgagaatcatcctcgctcagggatggtacattggtatgcgactgtccctctcgtctgttcagcttcccaactgcaaatttactaacatctacccatgttcgcagtcgcatacaccctcggcatctacctcctga

SEQ ID NO: 10892 - DNA, 363 bp, A.fumigatus
tccttgcttccaaacaatccatggaacagccgcctctcatactccacgccctcccggagcgaaagctcctggcttttattcaccacctccttggcagccagaacactcacccgactatatcccgcaattgtctctgcagtcttaagcgcctcagccagtagctcctcatgcccaccctcgacagccttggccgcaacaccccactgctccgcctccttgccgctgaagttcttccccgtcaggatcagctccatcgccttgctcttgccgacggcgtgggtgagacgctgcgaaccgcccgcgccggggatcactcccagcttgatctcgggctgcccgaaggtggcgctagcggtgcagtag

SEQ ID NO: 10893 - DNA, 291 bp, A.fumigatus
catctacccatgttcgcagtcgcatacaccctcggcatctacctcctgaacctcttcctgctcttccttcaacccaaattcgacccctccctcacccaagacgaaggccttgaggacggtgacgcctccgccagccttcccaccaagcaggacgacgagttccgccccttcatccgtcgcctccccgagttcaagttctggcactccgctacccgggccatcgccatcggcttcgtctgctcgtggttccccgttttcgatatcccggtcttttggcccgtcctggtggtc

SEQ ID NO: 10894 - DNA, 579 bp, A.fumigatus
taccgtccagccggcgccgacatcaaggaaatggccccactgaccttctccaacgcttacaccaacaacttcatcgccccgtggtcgcacttcgccaactccgtccgcaagcccgtcatcgccgccgtctccggctacgccctcggcggcggctgcgagctcgccctcatgtgcgacatcatctactgcaccgctagcgccaccttcgggcagcccgagatcaagctgggagtgatccccggcgcgggcggttcgcagcgtctcacccacgccgtcggcaagagcaaggcgatggagctgatcctgacggggaagaacttcagcggcaaggaggcggagcagtggggtgttgcggccaaggctgtcgagggtgggcatgaggagctactggctgaggcgcttaagactgcagagacaattgcgggatatagtcgggtgagtgttctggctgccaaggaggtggtgaataaaagccaggagctttcgctccgggagggcgtggagtatgagaggcggctgttccatggattgtttggaagcaaggatcagaagattggtgagtttctttctggtgattga

SEQ ID NO: 10895 - DNA, 327 bp, A.fumigatus
ggcatcaccgtcaccctgatgcttcgatcagtcggcgccttgatctccggtttcttttcggatagatacggaaggaaatggccgttcataatcacattgtcggcttttatagtcctggagcttgtgtctggattctgccagaatctgccacagtttctgggtgtccgtgcgttgtacggaatagcaatgggaggtatgatcgccttggaagaccgtatctattcctgtcctgttgacaagtgtgtcaggtctctttggcccggccgctgccaccgctctagaggaccttccctacgatgctcgcggagtgttatcgggttgttttga

SEQ ID NO: 10896 - DNA, 279 bp, A.fumigatus
tattcgctgagatattccaagaacaaaatccgcaatcccatttctgtcctgcgagaactgaccacccaccaatggctcatgtttctggttggcttcttgggatggacctgggattcattcgactttttcaccgtatcgatgacggtgactgagattgcaaaagactttgatacctctgtcaccagtgttacctgggtaagctcgtcctctttggtctaccctgaacgacagcacgctgacatctgttgctcgtctgctagggcatcaccgtcaccctga

SEQ ID NO: 10897 - DNA, 396 bp, A.fumigatus
tcgccttggaagaccgtatctattcctgtcctgttgacaagtgtgtcaggtctctttggcccggccgctgccaccgctctagaggaccttccctacgatgctcgcggagtgttatcgggttgttttgaaatgggatacgccgtcggatacctccttgcagctgcattctaccgcgccctggtccccacgactagccacggctggcgcagtctgttctggatcggcgctgctcccccagtcctcattatcttcttccgctggatgctccccgagaccaatcacttccaggtcatggtagccgagcgcgaggagcgcatccggctggcgcacgcaggggacgaccacgtccgcgcgaatggccttcgctcgttcctgaaagattccggcacgcgttga

SEQ ID NO: 10898 - DNA, 231 bp, A.fumigatus
cgactactcagagccggctttcttcctggtgctgttctcgtgatctcaaaatggtatcttccgaacgagacacagacccgcatcgctattctttacacatctgctgcttctggtggtgccttttcaggcctgctggcattcgcgatcgccaaaatggatggcacggcagggtacgaaggctggcgttgggttagttcttcctggttatcattcgtaccctcttccaactaa

SEQ ID NO: 10899 - DNA, 885 bp, A.fumigatus
cattcacgccagatatttatcatcgagggccttgtgactgttggcatgtcggtagcttgctatttgctccttctagactcaccatacttatctccaggttggcttactcctgatgagatccgcttccttgaagtgcgtcaactagcctccagcagtcacagtgcccatgatggagccttcagcaaacgggtcatcttcagcgttcttactgactggaaaatataccttctcatccttgccaactggtccaacgcagttccaaactatgcgctcaaattcagcatgcctgagatcgtcaaatccatgggctacaaatcagcaaaggcccagctcctgactatccctccgtacgccattggtgctgcgtcagcttacggcttttccgtatttgctgatcgctcctcgtggcgaatgccattcatcgtcgtcccacagatgtcactcattgtcgcgttttcaatattattctccaaagccgccgatatcgagaacaacatagcactctgctattttggcatctgcctcgcatgcttcgggatgtatcccattcttcccggtgtcaactcttggaatatttgcaacataccgaatcctcaaaagcgcgccgtggccattggctatctcatttgtactggtaatgccggtggtatcattggcagctacatttacaaagccgatgaaaagccgcggtatcccacaggttatggcacttcatttgcgttcgctgctgctggaatcatggcctgtctggttctggaattcagtctctggaccgcgaacaaaaagaaaggtcggatgtctagagctgaagtcgaggagatatataatgaagatcagctccgtgagatgggtgagaaaagtcctcacttcagttataccctgtga

SEQ ID NO: 10900 - DNA, 333 bp, A.fumigatus
gactcagttgatcgatcctcgccttctcaacttggtggatcacttcgtgtcatccgtgaaatttcacgccgtgagggcggtatcaccgcattctaccgagggttaacacccaacatcatcgggaattctaccagctgggcgctgtactttctttgctatgggaagacgaaagatctgatgcggaggctccgcggctcccgagtgctggagctcacctcggctgactactttgttgcatcaggactggcaggtatgatcctgcgcccatctgtgtttcattggacttcaatgctcacgaaatcacatttgctaattgcactatattcgctttag

SEQ ID NO: 10901 - DNA, 675 bp, A.fumigatus
ctactttgttgcatcaggactggcaggtatgatcctgcgcccatctgtgtttcattggacttcaatgctcacgaaatcacatttgctaattgcactatattcgctttaggacttgccacatcgtttttgacgaatcctatatgggtgatcaaaacccgcatgttatccaccggttccaacgcccccggagcctatgcgtctttcaccactggtgtaacacagatctatcgctcagagggtatttctggcttctacaggggccttttgcccgctttattcggagtcagtcatggtgctcttcaattcatggcgtatgagaagttgaaagcgtatcgtacaaggatgagttcggcttcgcgtaccagtggcgatagcataggtttgggggcgacaccggcacgacaattggggaatatcgatttctttctcacctcaagcctttcaaagatcttcgcaggctgtgtcacctatccataccaagtgctgagatctcgtctgcagacatacgatgctcacctcgtgtatcgtggtgttcgtgatgcaatggcgcagatctgggctcaagaagggtttggtggtttctacaagggcttgggtccaaacctcctccgcgtgctaccaagcacatgggtaacttttctggtatatgaaaataccaagtcttgcctaacttaa

SEQ ID NO: 10902 - DNA, 366 bp, A.fumigatus
tggactggaaagtcgcaccagaacaagttccacgccactacgctaagaacgttgactctgaagttttctcaaatgtccgaaacgcaactcatgaaccctcaggatcgccagctttgggagtactttgccaacctctataaaaacagcaacaaaggcatcaagggtcgtggcaaggatcggaggatctcccccacatccaagtccagtgacagttctgcctcgtgcacacgaatgcagtctttagaaagtgatgaggacctcaaggcgtcatgcggcagtcgcgaagcctcgtccgcctatactagcagctccagcggagaagaagaggaccccgaaatctactacactgatagaaaaggtcattga

SEQ ID NO: 10903 - DNA, 273 bp, A.fumigatus
acacatcaacgacgccatacaggcgaaaagcccttctcctgtgatatctgccagaagcgattcgcccaaagaggcaatgttcgtgcccacaagatcactcaccaacatgctaagcccttcacttgtctactagatgactgtgggaaacagttcactcagctgggtaacctgaaggtatattgtctcatgaaacaggtggctctgatcccggaaactctttgggctaatggactggaaagtcgcaccagaacaagttccacgccactacgctaa

SEQ ID NO: 10904 - DNA, 198 bp, A.fumigatus
tcgctgacttgttctgggaatccgcaggtcgtcattgacggcaagggacaccttcttggtcgcctggccagcactgttgctaagcagctgcttaacggccagaagatcgtcgttgtgagatgtgaagccctcaacatctccggcgagttcttccgtgcgaagcgtacgtcatccgattcgttttttcatcccctatga

SEQ ID NO: 10905 - DNA, 486 bp, A.fumigatus
aggcgcaagaggagggtggagcagagacataccgagacgtggagacatttggagatgttgcgactgtttgacactggttcggagcaaagagctgacatcgcaacttctgatgatatagtgaagtaccacgcctaccttcgcaagatgactcgttacaaccccactcgtggtggtcccttccacttccgtgccccctcccgcatcttctacaaggccgtccgcggaatgatcccccacaagacccctcgtggtgctgctgctctggagagactcaaggtcttcgagggtgttcctcccccctacgacaagaagaagcgcgtcgtcgttccccaggctctgcgtgttctcagactccgccccggccgcaagtactgcaccgttggtagactcagccacgaggttggctggaagtaccaggacgttgttgccaggtgtgtaatcatcgctttggattattggtctttctggtgttatggacatggctaa

SEQ ID NO: 10906 - DNA, 189 bp, A.fumigatus
atatatgcacctggggagtgcttggcttctttgacccttaagatttatgaatctggactcttttggttggctaccgctaccgaggcctttacccaggtcatctggtcagggtttcgctgtccggtcttaatgggccccatttgcattcccccgaagtcaagggaccttgctccgaaccatgcgaattaa

SEQ ID NO: 10907 - DNA, 270 bp, A.fumigatus
tcacgtgaaccacctcttttgcctctggtcaattccagcccagttggacgttttctgggcccagaagacaaattgttccttgataggccagtctcagactgttccgcaaaaaaggagcatttagttgttctttcattgattgtggtttatctactccgtactctgtggattgtcgccggtgatgtcagtatcttcactcggcaggccgactccggcgtgaaattcatcctgatcaaatttagtcaaggaatgacattgacagccttataa

SEQ ID NO: 10908 - DNA, 240 bp, A.fumigatus
caacaaagcagacttatttacagccttagacgactgatgaggcttcaaaagacacgctttgtttgcgtgtctgacacgcacggctacgcgccatcagaagcagggttcaagctaccagcaggcgatgttctaattcatgcgggagatcttacaaaccaaggcagtctaagtgagttgcgcaaaacgatcgaatggatttccaaggccgactatgaggtcaagataattgtctgcggttag

SEQ ID NO: 10909 - DNA, 843 bp, A.fumigatus
gacctgtgttctggacacgaatttgtccacgaccagtacatgcgcgacactatcgccaacgacgaggaattgcagtccaggaaaagagcccgctacgaggatgactcaacccagtcaacacagcaattcatcagcgtggacgctagcatcgacggcagccctactgtcatgcctaatgccggcgagcctgaagtccaggcacgccgtcgtccaacgactaccctctcctcccgtgaaactgtccctgacgccaccatagacctcaaagtgaagaaagcctccccccaacccctcccaatccccacatccaccccggaagcggccaaagcaaaacgcaacgagatccgtcgcgcctggcacttccttcgtgcagagggatcccaccacccggagatagaactgggcgccctcccatcctcctggcccacaccggaagaagatggattccacctaccgaacaggggcagctctgaaacaggggatgaaacacgcacacggacgcaagacaatatgcagttcgctcacgaccacgatgatgataacgaagatgatatgcccaacagccaagtaacagccaccctctccatctcctcgtccgcattcgcctcgcaggaacaaacgctcggcccgctccagcaggatggccccttcgacgtcggcgtcgatataccgctctcctcggagggagcaccgggacgaccccggacgttgggcagatccagctcgtctcgtgcgcgacgcgcggcatatctcgctgcgcgggcggatagctacgacgcgtgggcttgtatggggcttgtttcggcgggggataatcacagcatggaggagactgaactgtag

SEQ ID NO: 10910 - DNA, 441 bp, A.fumigatus
caacgggctcgatggtggggatggaaccgttggggtcgccctgtgctcgactcgttagtaaagaggtctacaagacacaggtgtggggggtggggagggtaccatctgcgaggcgacgatcatgccgcttttcaggacctgggcgggcttggtgccaaaggtgctagggtgccagatgaccaggtcggcgagcttgctgacctcgacgcttccgatcaggtgcgacatgccctgcgcgatggccgggttgatggtatacttgatgatgtagcgtttgacgcggaagttgtccgcgccggtgccctcgtcctccttgaggggcccacgctgtgcattgttcttgtgcgcggtgttccaggtgcgcaggatcacctcgccgcagcggcccatggcctgcgaatccgtcttaaccgacggcgatggaagctcatgagtcgggaa

SEQ ID NO: 10911 - DNA, 387 bp, A.fumigatus
ttcccgactcatgagcttccatcgccgtcggttaagacggattcgcaggccatgggccgctgcggcgaggtgatcctgcgcacctggaacaccgcgcacaagaacaatgcacagcgtgggcccctcaaggaggacgagggcaccggcgcggacaacttccgcgtcaaacgctacatcatcaagtataccatcaacccggccatcgcgcagggcatgtcgcacctgatcggaagcgtcgaggtcagcaagctcgccgacctggtcatctggcaccctagcacctttggcaccaagcccgcccaggtcctgaaaagcggcatgatcgtcgcctcgcagatggtaccctccccaccccccacacctgtgtcttgtagacctctttactaa

SEQ ID NO: 10912 - DNA, 270 bp, A.fumigatus
caagttcaggccttcgtcccaagtacctccattatgtgggtctcccaggcctccatcgacgacggcatcgtccagtcctacggcctcaagaaacgcatcgaggctgtcaggaactgccgcaatatcggcaagaaggacatgaagtttaatgatgtcatgcccaagatgcgtgttgatccggagagctacgtcgtcgaggcggacggggtgctctgcgacgcggagccggcggaggcgttgcccttgacgcaggattacttcgtttactag

SEQ ID NO: 10913 - DNA, 549 bp, A.fumigatus
ggaaatcactttggcattagttctcttgttttgcggaaatttaagatgcgtctgacttctattgtgctcttttccctggtctccttgggctttgccagggatccctccgatattacgcactccccaaaccgctcgaaggccaaaggagcacaacttgagtcatattgccctgggcaagacgctgatgaagacttgcaacgcgaaatattcaaccaatttatccaaacgctctacgagaacaagaatgtgccggaggctttcgagacatatgtcgaccccgatctgacggagcatggtccctatgaacaaagccgtgatgaagtcgtggaaagtctgtctcaaatcatccccagctctacgttcacggttgtgcactcatcttatggtggagacattgggttcgtccacgtcagaataggagacgaaggcgcgccgccagctgctgctcttgcggacatatatcgtatggacgggacctgcattgtcgagcattgggacgttctccaaaatctcccggaaaattccacgaacccgaatgccctgttctga

SEQ ID NO: 10914 - DNA, 1155 bp, A.fumigatus
taccgagggaccgaaacgaggaggactttaaagagacgaaatcaggcaggccgtctcgctaggagtttgttaaatatgatgtcaagaagtcagtcaagtttgggttacatggatacaggcagggatgaaccctccacgtctggggcctctccaggatatcaacaaccgccatctacagccggtccgatcaatctgtcgggcctagtctgcaatgtacgccggacgacaggcagagaaccacacccgctggtgggagccaccaccactatcctcggcgacaagctctacgtgttcggaggccgcgttctatcgaagactcgcccgcagctgacgtcggatctgtatgagctggacttgatccggcggcactggacgaagatcgaagccaccggcgatatcccccgcccgcgatatttccacagcgtatgtgctcttggtgataataagctggtctgttatggaggcatgtcacctgccccgaatgcgtccaaggagtcagcgagcaatggcgcatcagggcaggaagggcagccggaagttgtggtcatgtcggatatacacatcttcgacgtaccgtctcgaacgtggacgagagtccccgctacagactcgcctcagggtcgatatgctcattgcgcgactatcctcccgtcaagcgccttcttcacctccgctagtgctccactctccgctatccaccataaccccgcatcgtccaacccccatcaggggactattggtgtcgacatacatggatttggtggtgccgaaatggtactggtaggagggcaggatacttcgaatcactatatcgagcagatcagtgtattcaacctccgcaccctgaagtggacgaacacaagctcgcccggaagaaactgtggcgcctatcgtagtgttgttgctccgttgaatgaaatgaaagtggcagacatcgggtctgctgccgccgaccgggaaacgcacgagccattggaggaatccgacgttgaaagctgttccatgccgatattttcccagctaccactccctggatgtcaagcttggagctccacgtgcgtttgcccggatggtccccttgaattgaaaaagcctatggcacagtgccaacgttcccctccggggcttgaaaattcccccaaccggcaggggtga

SEQ ID NO: 10915 - DNA, 249 bp, A.fumigatus
tctactaagtgtctatattcgatacttcgtcaaaacacttacaacaccccacctggccaacgcgcccgcttgggccgcatcatcaccacaatcatggacgtcgttgctgcagtatccgggtacatctccaagatggtcaccacgggagatacagcatcggctacaggatcttcatcgtcagccaagatgaagatcttgctcctcgacagtgagacagtgggatctgcgttctactgccgagtgcagtga

SEQ ID NO: 10916 - DNA, 294 bp, A.fumigatus
aagctcaatttggaggctgactcttataatgcacagatgcccattgtatcgaccgctatcacacagtcagcccttttgagtcatgaagtatacctgatcgatcgcttggaaaatgccgcccgcgaaaagatgcgacatctgcgctgtctgtgcttcgtgcgcccgtccccgacttccatccaatttctcatcgacgagcttcggggagcccaagtacggggagtatcatatttacctgagcaacattattcgcaagtcttccttggagcgactggcggaagcagatgggcatga

SEQ ID NO: 10917 - DNA, 315 bp, A.fumigatus
ggtcgaccccggatttttgcgtgtggagattccatcaacctccgtcatccctactaccccccacctacagccatggcatggacacactcccctgactcccatatcccggaacaacaatattactcctcgatggatattcatccttcaccacccaagccgataaatgccctgtcgccttccgcatccgccgcccgagaaccaaaactccagctcccctctacaaccgatccaccaggacctcagaacccgcccaagcagctcgtatggttggtacgtctaccactactcttgttcgaattgcactgtgcccactga

SEQ ID NO: 10918 - DNA, 990 bp, A.fumigatus
tcgatcgcttggaaaatgccgcccgcgaaaagatgcgacatctgcgctgtctgtgcttcgtgcgcccgtccccgacttccatccaatttctcatcgacgagcttcggggagcccaagtacggggagtatcatatttacctgagcaacattattcgcaagtcttccttggagcgactggcggaagcagatgggcatgaagtggtacgcgtggtgcaggagcactttgccgacttccttgtcgtcaaccctgacctgtgctccgtgaacctcgggtttcctaaccagcgattgtggagccactcgccggacctgtggaatgcggacgctttgcaacgagcgacggaaggagtgattgccctgttgctggcgctcaagaaaaaccctctgatccgctacgagaagaacagcttgttggctaagaaattagctacagaggtccgctaccaggtgacccaggaggagcaattgtttaatttcaggaagaccgacacgcctcctatcctgcttattctggaccggagagacgaccccatcacacctttattgacgcagtggacgtaccaggcgatggttcacgaattactgggaatcaccaacggaagagtggatctgcgtggtgtgcctgacattcggcccgagcttcgggaaatcgtcctttcgcaggatcaggatccgttctttaagaagaacatgtatcagaattttggcgacctgggtcagaacatcaaggagtatgttgagcagtatcagacgaagactcagaacaccatgaacatcgagtccattgcagacatgaagcgcttcgtggaagattaccctgagttccgtaagctctccggtaatgtgagcaagcacgtcacactggtcggcgagctgagccgacgggtgggggaggataacctactcgacgtcagtgagttggagcagagtttggcctgcaatgacaatcacgccaatgacctcaaggtatgtcgtgacctgaacctctaa

SEQ ID NO: 10919 - DNA, 639 bp, A.fumigatus
acactgcagagaatcattcagttacccacggtaccggcggataataagatccgcttggtagccctatacgccctccgatacgaaaagcagccttccaatgcccttccggtcctgcttgacctcttggtcacagcaggggatgttccctcctacaaggtcaatatcataccgaagcttcttgcctatcatcactctctccaagcgccccctgttgcgggcggcttctcggatctttttgaatcagcctcgttgttctcgggggctcgggaccgcttcaaggggctcaaaggtgtcgagaatgtatacacacaacattcaccacgacttgaggtgacactacaaaatctcatcaaaggccgattgaaagagttgcagtaccccttcctggaaggcagtagccacactcgggagaagccacaggacatcatcatctttatggttggcggtgcaacctacgaagaggccaagatggtggcccaagtcaacgccagctcacctggagtgcgtgtggtattaggaggcacgaccatccacaacagtacttccttcttggaagaagttgacgatgccgtgagcgggtggcctgagcccggcccttccacagccgctggacggcttcgaagagaaattggacgatag

SEQ ID NO: 10920 - DNA, 969 bp, A.fumigatus
atcttcggctccacaggccatatgggccgttcactcgtcaagaccgccctttgtcgcaatgacctcgtcgcagctgtcggacgcacattcgagaacagccccgaatcaatgaagaagctcgaggaggaacacgagaactgcctagggctgctatgcgacgttcgcgcgcgcgaaacagtcaagaaagtcatcgaccggacgatcgagcggtttggtcgcatcgacattgtcgccaactgcgctgggtacggcgtgatcggcgcttgcgaggaccaggacgagtacgagattcgcgaccagtttgagacgaattttacggggaccctgaacatgatccagctgtcactgccgcacttccgcgagcgccggtcgggccggtatctcatcttcagctcgacgtcgggcgcgctgggcgtgccggggttggggccgtactgtgcgtcgaagtacgcggtggagggcctgatggagagcatgctgtacgaggtggacagttttaatatcaagggaacgcttgtggagccaggtcatatgcgccgcgacgacgtgggagatttggtctcgaacactgctaccatgcccagtaacgaacataaccttgcgtcgccgctgccgctctacggccacttctttgtcaagcagcccagcgagccgtataatacccccacggcgcctgcggcgcatgcaaggcgcatgctgatgtggctcggcgataagcagcctgccagtgcggtcaaggcggcccatctggtttggcagctgggccattgctcctatcctccactgcgactggtcctggggacttacgcggtcgagagcatccgcgacagactcaagtgcatcatcgaggagatcgaggactggaagtatctcagcttccctgtgggcgatcagccgggctcctctactgggaaagacaagccatcaacggagggcggggacaaacaggatcgagaaacggccacctga

SEQ ID NO: 10921 - DNA, 186 bp, A.fumigatus
tggaatctccacacgcaaaaatccggggtcgacctcaacgatcaccctgtatacaggcatagaatggccagcttatttccgcaagtaaacaaaatcgacatttacttatttatgcgctctctcattctattcatgaactgtgagattaatggcatcaccaggggatataataagtatttactttag

SEQ ID NO: 10922 - DNA, 339 bp, A.fumigatus
  unsure (32),(39),(146),(173),(200),(204),(212): Identity of nucleotide sequences at the above locations are unknown.
ataaaaagggccagtttgaggtggacgagcangcgtggnggctcctggggcttgtgtggcctcgtcctggtgagtcggccacttttccccgatactggtttaaaggcgtgcgtgttgacttgtggattacttcgtgtgatagactngcttcttattggtatggggggcttggngtttcctttatctcccgaaacaagacngctnatcaaatncctgggtaatccggttgaggtgctggatactcggaatgcggctgcgcagtttaatctgcttgcgaccgagagaggcgtttcggaaattgctgcagctatgattcctattgggtggaatgggaagtag

SEQ ID NO: 10923 - DNA, 732 bp, A.fumigatus
aatatcctgcctagtatggcgcgagacgagcctcttttggctccgcgcccatcttcggagaacaactccattcggaatgcggaagaggaggacgcactgttgaccggggagcggactgggcgtggccaggagcgacggggttggactttctggcgagaagtcggtctcttcagctgggcgctcctagctacaattgctgttatcgtgctcgcagtcgtctaccagcatgaaacgagcaacccgaacggtggctcgagacccccctggggtcccggagggaagccgaccggcaagcgcaacctaatcttcatggtgtcggacggaatgggccctaccagtcttaccatgaccagaagctatagacagttcgtggagggattgccgattgacgacattttggtgctggatggccacatcattggaacttccaggacgaggtcgagttccagtctggtaacggattcggcggccggtgcaacggctttctcttgcggtttcaagagttacaatggtgccatctctgtgcttccggatcattcgccctgtggaaccgtcctcgaggctgcgtcgttggccggttacaagaccggacttgttgtaacgactcggatcaccgatgccacccctgcttgttttgcgtcgcacgtgaacttgcggcaatacgaagatcggattgcccagcaagaaattggcgagcacccactcgggcgcgtggtcgatcttatctttggg

SEQ ID NO: 10924 - DNA, 333 bp, A.fumigatus
  unsure (6),(113),(120): Identity of nucleotide sequences at the above locations are unknown.
gaagcnagtctatcacacgaagtaatccacaagtcaacacgcacgcctttaaaccagtatcggggaaaagtggccgactcaccaggacgaggccacacaagccccaggagccnccacgcntgctcgtccacctcaaactggccctttttattcaacatgtcggatttcatgcccgcattgactttccagggcctccaggcgaatgctttccccgccaacgagcagcaccccatctccaccggtcaccttgaccccactattcaggtggaatccggtatcaaggcaggcatcaatgcgtggtggtcggcgcaggaatgttaccaagcacattga

SEQ ID NO: 10925 - DNA, 402 bp, A.fumigatus
actccgctcccctggtggcccttcggctacggcaagagctactccactttcgagtatgggcctgtcaccgtcgacaaggcgaacgtcactgcttcagatactgtcaccgttagtgtggatgtcacaaacacccacaagagcatggatgggacggaagttgtgcacgtgtacatccaggatgagatttcgtcggtcgttgtgccgaatcgccagctcaaggggttcgagaaggtggtcatccccgcgaagaataccaagactgtcaagatcaagatcaaggtgcaggatctggggctgtggaactcggcgatgaaatatgtcgttgagcctggggcgttcactgcgctggtggggagcagctccgcggatattaggggcaatgctaccttttatgtgcagtag

SEQ ID NO: 10926 - DNA, 213 bp, A.fumigatus
gacggtattcctcgtgcagaggccaagttgctggcaatggaggaggtttctctagccggtaaccgagtgttgccaaccaacctaggcggcggcggctgctgctggtgctgcgcttgctctggcaaggtcggggatagcttggtcgtttctgattctccagctcccgtctgcgcagtggcagcggatttagtactgactgggttctcatgttga

SEQ ID NO: 10927 - DNA, 1611 bp, A.fumigatus
gccttgcgaactctccaactgcttgagcagcatcataagaagctcgctcaaatccttcgctttcaacatgagaacccagtcagtactaaatccgctgccactgcgcagacgggagctggagaatcagaaacgaccaagctatccccgaccttgccagagcaagcgcagcaccagcagcagccgccgccgcctaggttggttggcaacactcggttaccggctagagaaacctcctccattgccagcaacttggcctctgcacgaggaataccgtctcaacccctccgtccttctcccgtctcccccactgtatcctcgcaacaggcaggggcgaggatgaccgggggtcccagcaagctgaagaccggagagtcaagattacgaggaacgcaagcccacaatttaagggaccgtccgagcggcgtatctgcgtcaaaacaaccctggtccccaccggtcaccagtcctaccggaatcacaactcagcaattcgtgccgccggaagcggtcgaatcaagtcggcagaagagcaagactgcaccatccgaggagcccttccaacgattctattcgacctttgaaggcctcatctccaagatttccgcgcctctagcatttgccggtctgccgcttggaacagaggcatccacgcagtccgactctgcaagacgcaaatcatccgctgccgacaccaaagtcgatcgccatcaagcaacttcagatcgactgggtcagttcaccgagccagacgtcagcaggattttctcccgcgccgccctccgcgcaatccgggactcaaatggcaatggggcggggaacaccgcagaatcattttacgttgtgcctaccacaggcggcacagtctcatatgccggcatcctcacccgagccgagaaggaagcccgacgcaacagcctcgatgaggcggacgatgactttgtcgatgcgcgcgagactcccgcatctcctgagttacgccagagtctaacgggctcacggggccgggcgagtcgtgctgcggacaaactcaccaccctgcataaccccaagaccatggaggaactacagatggagaatcaggcgctcaagcatctatccgataccctttccaaacggctgcacatgtgggaagtcaacgcgcaatcgtcttccatggctctgcagcagtccctgaaagcaatgcaccaccacaccggcccgtggcccgaccacccttacggtgctcagggctcctccgctgctgtgactccctccgctgcaatggactccgaccagcgtatcaaggaactggaagagcgcatgcgccgcaacgagaaagagctggagcgcgtccgccgtgagaacgagaaactccgggacgtcttgggtcgctaccgagaacgatgggagaaattgaaggaaggagcgaagactagacgggcggagggtagggctgctgcgggcccttcttctacagcgggtacagtcgagagcagtgacaagcccggagctactcctaatccggattccaatccgcaggagcaggctgagagcgccaagtcaaaatcggatggcgacatggagaatgaaagtacagggccggaggcgaaaggggatgcctctgatagctag

SEQ ID NO: 10928 - DNA, 192 bp, A.fumigatus
tgccttaggctcataccgaattcattcactttgtggcggtctgcgtatggcgtcacttcctctgagcatgttatctcttccagctcttccagtcatctcgctgagctgctgttgacaactgcttacaggaccattattacatacagtctgtatccatgcagccatggagactgcaccgctcaccttggttag

SEQ ID NO: 10929 - DNA, 1176 bp, A.fumigatus
tatgggattcgggcggggagtggtggagatggtggcggggggggggggggggggggaggcggtgtggtgtcggccaccttccctcggaacatggaggctttggctcgtaagtcgttgaccaagccgatcgagattgttgtcggtgggaaaagcgtcgtcgcgcctgagatcacccagatagtggaggtgcgcaacgaagacacaaagtgtgggcggctagtggagattttgggcaacttgtactcggatgacgccaacgaagaggggcgtggggggatgttggtggaccgtcaggaagcggcgggggctctccttcgagagttgatgcgcaagggttatccttgcatgtccatccacggaggcaaagaccaaattgaccgagattctacgattgaagattttaaggccggaatcttccccgttttgattgccacctctgtcgctgctcgaggtctagacgtgaagcagctgaagctcgttgtcaactacgatgcgccgaaccatctggaagattacgttcaccgggccggacgaactgcccgtgctggcaatacgggaactgcagtcacgttcctgaccgaagaacaggagcggtattcggtggacatcgccaaagctttgaggcagagtggacagaaggtgcctgagcccgtccaaaagatggtcgattcctttttggagaaggtcaaagcgggcaaggagaaagccagcgcgtctggattcggaggaaagggtcttgagcgccttgaccaggagcgagatgcagctcggatgcgggaacggcggacatacaagacaggcgaagagggtgaagatgaagaagataaagaagataaggccgagaaggcggacgagcggttcagcaaaattgtatcctcggtgcaatctgccgccgccgccgcaacaactcccttgcccggtgttcccaagggtatcgatcttgatggcaagattacggttcacaggaccgagaaagacccagcgggcgcgtcgaagaacccattggataaggtgggctcggcggtcgctgacatccatgcccgtctcagccgtgctggagtcatgcggtctggtgtgccgatcgataatcgcggccctgatgcgggagctttccatgcaaccctggagatcaacgattttcctcgtaagttattccctgttatggtccgttattag

SEQ ID NO: 10930 - DNA, 1023 bp, A.fumigatus
agaccagaatccgagaaaatggaggttgatgcagcggaggaggaagttgacccactggatgctttcatgtcggaactggccgagaccgctccgccaaagaagacaactggcgccagatttaccaaagcgaaggatcagcagcccgaggcgatgttcggcgacgaacacgatgtggatttgaccgctgtgggcgagggtgacgctgatgattttcttgcgattgctaacaaagcgaagaagaagaaggacatcccgaccgttgaccatgaaaagatggaatacgagcccttccgcaaaaagttctacaccgagccttccaacttggctgaaatgaccgacgaagaagctgccagcctacggctggaacttgacggaatcaaagtgcgcggtgttgacgtgcccaaaccagtcatgaaatggtcgcagtgcgggttgggcgtgcagaccttggatgttatacagaagctcggctacgagaatcccacctcgattcaatcgcaggccattcctgcgatcatgtctggccgcgatgtgatcggtgtggccaagactggatcaggtaaaacgattgcttttctgattcctatgttccgacatatcagagaccaacggccgctggagaacatggaaggacctattgggcttatcatgacaccgacacgcgagcttgcgactcagatccacaaggattgcaagccctttttgaaggcgttgaatcttcgggccgtttgtgcttatggcggcgctcctatcaaggaccagattgctgaactgaagcgtggtgccgagattgttgtatgtacaccgggacggatgattgacctgctggcggcgaatgcgggcagggttactaatctgcgaagagtcacttatgttgtcttggacgaagcggatcgcatgtttgatatgggattcgggcggggagtggtggagatggtggcggggggggggggggggggggaggcggtgtggtgtcggccaccttccctcggaacatggaggctttggctcgtaagtcgttga

SEQ ID NO: 10931 - DNA, 399 bp, A.fumigatus
  unsure (254),(261),(270),(284),(305),(312),(333): Identity of nucleotide sequences at the above locations are unknown.
gctttttgcgccgccagtttcgaccctaatttacctttttgggccttcgccgccgactcggctcgtttctggcactctccagttagccagcgaccacatacaagagcagctccgcttcgctccacagtgtcacttacctgcgccgcaatcgcagcattcgtccgcgcatcggccctctccgcacctggaacctccggcgcagcctcgcctagtgatctccccggtgatttgaacggcgcttttgatttcgcggngagcggngcgcgcggngcggcgttcggcgngggattggcggctgagccgangacgcgngccgggcgggagaagggttcngcttcgtttttggaggtggagcaaaagattacccatttgtttgggttgggggttatcgcgttgtaa

SEQ ID NO: 10932 - DNA, 756 bp, A.fumigatus
tgttttaagcacgcggaaactattgatattgtcatcatgaccctgggatacctttcgatgcaccttagcttcgtgtccctcttcttctcgatgcggcgtctcggctctaacttctggttggctgccacagtcctcttctcgggcgtttttgcatttttgtttggtcttctggtcacaacggagcttggcgtcccgatcaatgtccttttgctgtccgagggccttccattccttgttgtcactatcggtttcgagaagccaatcattcttaccagggctgttctcactgcggcagcggacaacaggggcagagctggtcaagcttcgtcaagcaccacaaagtccattcaggactctattcagaccgcgatcaaggaacaaggttttgagattatccgcgattactgcatcgagatcgccattcttattgccggggccgcttctggagtccagggtgggttgcgacaattctgttttctcgcggcgtggatcttgtttttcgactgcgttctacttttcactttctacaccaccatcctctgcatcaaactcgaaattaaccggatcaagcgccacatcactcttcgcaaagctctggaagaagatggtatcacccatcgggtggccgagaatgtcgcttccagtaatgattggcctctgaccgaatctgagagcagcaacaagactagcatctttgggagaaagctccgctccagcagtgttcgcagattcaagattttgatggtaggaggtttt

SEQ ID NO: 10933 - DNA, 480 bp, A.fumigatus
aactcttgtacgctgactttttattggccgcagggcgtcaaccatcttgccttaacaaccttcatcttctcggattccctgtccaagtcatcttcaatcgctcctgccgcaacagaattaccgattccttccaatgcctctgctcaaccagtgccatttacacctaacttgttctcgcccttctcccatgactcttctcttgcattcaccttgccgtttgatcaggtcccacaatttctgaaagcggtgcaggagatcccggacacctcctccgatgaggacgacggggaacaaaagaaatggatcatgcgggccgctcgtggcccggcttatggctctggtggtgctatcaagctctggttggcagatgcgtggggttcattcgtggatttgatcaaggtaaatgtttttgccttacgttatgctaccatatttgctgatgttttaagcacgcggaaactattgatattgtcatcatga

SEQ ID NO: 10934 - DNA, 228 bp, A.fumigatus
actgtcctccacctgccatttccaagatgtactctcacccaaccgaagattccggctgccctgaagcagagtatcgacgtccacttgaccagcaatattcctggagttcctgacgctgtcgaacaaactcccttcaaggagaccgacgtacgtcgtactggcgagcaatgcaataaccacaatggtgtgtatagggtgctgacaagcgtgactcgagatggactgtaa

SEQ ID NO: 10935 - DNA, 348 bp, A.fumigatus
cgaagcttgaccagctctgcccctgttgtccgctgccgcagtgagaacagccctggtaagaatgattggcttctcgaaaccgatagtgacaacaaggaatggaaggccctcggacagcaaaaggacattgatcgggacgccaagctccgttgtgaccagaagaccaaacaaaaatgcaaaaacgcccgagaagaggactgtggcagccaaccagaagttagagccgagacgccgcatcgagaagaagagggacacgaagctaaggtgcatcgaaaggtatcccagggtcatgatgacaatatcaatagtttccgcgtgcttaaaacatcagcaaatatggtagcataa

SEQ ID NO: 10936 - DNA, 489 bp, A.fumigatus
gcctgcttgggagcaatcgggcttacatgtatgtgctgtcaaagagccctgaatgtttacactactgacacatcgctagaatcgctggcatccagatggtacgtctgctggaatgacatcgtcgaagtactccccttattcaatatgaacattcttacagtgccggcctatggcaagatcgccaacaacgaagtggtcaagatcgaatgtctcgattggaccggtggccagatcaagaacaatgactctgccgacgatattaagaacgtcgatctaacgcaaatccactatctctccggtccatttgaaattgagacggccgaacccggagatgtcctgcttgttgaaatccaagacgtccagccgtttgaggaccagccctggggcttcacgggaatcttcagccgccataatggtggagggtttctggacgagatctatcctgagccgtgcgcttgtcttctccctacactgcaccactgcacatag

SEQ ID NO: 10937 - DNA, 333 bp, A.fumigatus
ctgacttctctaccctatagcgccaaagcaatctgggacttcgagggaatcttctgttcttcacgacacatcccccacgtgcggttcgctggcctcatccacccgggtatcctgggctgcgctccttcagccgaggtcctcgccgagtggaatcgtcgtgaaggcgaactgatcgccacgaacaccaggggccgcgatgtcgcaaagccccccgaaccgaagaatgtccatgccggcagtgcggacgaggacctaaaagccaagatcggcagagaaggcgcaaggacaatccccgttcgtatacaccttacccccagcatcccatggacatga

SEQ ID NO: 10938 - DNA, 192 bp, A.fumigatus
  unsure (129): Identity of nucleotide sequences at the above locations are unknown.
ggccgccccgaacacggaggaaactgcgacatcaagaacctctcccgcggttccaaagtctacctccccgtgcacgtcccaggggccaaattctccgttggagacctccacttctcgcaaggtgacggngaaatctcattctgcggcgccatcgagatggcgggcgtcataacactcaaattcacagtcatt

SEQ ID NO: 10939 - DNA, 369 bp, A.fumigatus
cttgagccctacttttgccggatccacttcacacccgaacagaaacgccgctggtttatggaccgtcaaggtgttctgttcggtttcgccttcgccttcaccgtggtcctgaaggcaccctacatcggagtgctgatgtacggcgttgcacaagcatcgactgcatacttgatcacaaagtgcacagatcccccgcccagtcccgccgagagtgaaggtttcgccgagagccaagtcacctggaagaacaagcacgacttcctgcggctgtcattggataacctggacaaactgaatctccctttacagagtgagggggaagtgcaggagacaaaagtaccccaaagtccgggacggaagttctcttga

SEQ ID NO: 10940 - DNA, 186 bp, A.fumigatus
agtcaatcattctatatcttgataaaatcaatcatgttgcaaaaccaagcgctcaatttctgcgcataccgcgtcgactaccccttgagtattcgcggtccctccaagatctggagtcaggacgccagcagcacacaccctttcaacgcatcccatcaattgttttgcagcgtccttctcgcctag

SEQ ID NO: 10941 - DNA, 420 bp, A.fumigatus
gtattcgcggtccctccaagatctggagtcaggacgccagcagcacacaccctttcaacgcatcccatcaattgttttgcagcgtccttctcgcctagccaagaaagcatctctgccgccgaccagaacgtcgctacaggattggccactcccttgccagtgatgtcgaaagcgcttccatgcacgggctcaaacaaggacggattcttccttgttgggtctagattgctagagggagcaactccaattgatccggccagcgcggcggccaagtctgacagaatatccatgtgcaagttggtgccgacgatagtgtccagggagtcgggcttgcccaccatgcgaatcgtcatggcatccacaagcatcttgtcccaagtgacatcaggaaattccctggcaacctctgcagccacttga

SEQ ID NO: 10942 - DNA, 303 bp, A.fumigatus
aagcaaatggcatctacagttccaattacctaccgtgttgcgtccattccaggagatggtattgggccagaagtcgttgaagcgacgatccaggtcgttaggaagctctgccaaaagttccaaacattcgacatcgacttcactcacatcccatggggcacggaatactacaaggcacatggtcggtatgcatcggaagactgtctggatacactgcgacagtttgatgcagtgctattcggcgctgtaggcgctccaggtaagattgtcctgagcgatcgactcgggccaaccagcaactga

SEQ ID NO: 10943 - DNA, 891 bp, A.fumigatus
gattgtcctgagcgatcgactcgggccaaccagcaactgacctggttagatgttcctgaccacatctctctctggggtcttttgttggccatccgaagacctttgcagttgtacgccaatgtccgcccggtacgcaccttccctggcacaaaatgtccgcttaatacagcgacaaagggcatcgactgggttctcgtgcgcgaaaactcagagggcgaatattctggccagggcggccgcagtcacgtcggccagccgtgggaagctgcgacggaggttgccatattcacacgggttgggatcgagaggatcatgagatttgcattcgaaacagcacgctccagacctcgtcgtcacctgacagtcgtcacgaaaagcaactcgatgcgcaatggcatggtcctgtgggatcaagtggctgcagaggttgccagggaatttcctgatgtcacttgggacaagatgcttgtggatgccatgacgattcgcatggtgggcaagcccgactccctggacactatcgtcggcaccaacttgcacatggatattctgtcagacttggccgccgcgctggccggatcaattggagttgctccctctagcaatctagacccaacaaggaagaatccgtccttgtttgagcccgtgcatggaagcgctttcgacatcactggcaagggagtggccaatcctgtagcgacgttctggtcggcggcagagatgctttcttggctaggcgagaaggacgctgcaaaacaattgatgggatgcgttgaaagggtgtgtgctgctggcgtcctgactccagatcttggagggaccgcgaatactcaaggggtagtcgacgcggtatgcgcagaaattgagcgcttggttttgcaacatgattga

SEQ ID NO: 10944 - DNA, 750 bp, A.fumigatus
gacattcgagtggcgtgcatggcattcacaaagccgatcttccctttcgtccgctacgctcgtccttctgggcttacgcttataccccctagcaaagatcatgctaggactgcatcgcgtttgattcagttgtttgagatacccggcgtctttggtgaacccatgtccaaggcgatatacgacctgactgaactcatctggtatgcggagtggatcaaaggcgatccaaagtcatcgcagagctttgacgacgaaacggaggattacttcaatacagaagtgctctacgtcgagtatgccctacacactgaccgatacacgccgaccggtgaaacaaagggggacgcaacgatcgagggttgcgtccggctggcgtgcttgctgttccacaactccaccatatgggaattctacccggcgatgggtccggtgttttcgaagccgattgtcggactccgagtcgcacttgaaacgacgatcccggccgggtacttcaacctgtgtcgggaattattgatctgggttctgtttgtgggggcttgcagctcgcggctcttggcccgcgagcacacgttcttcatgactgaattgactatggccgtgaggaaccagggattccactcctggcaggacctgcgagagcttctgctgggatacttttacgtggatcgctgttacttgacttcactgcgcgagttgtgggacgagattcacattgatgccgatgccagtcggttgaacctgtgttaa

SEQ ID NO: 10945 - DNA, 453 bp, A.fumigatus
gctgcatcaacatgggtgctcgcgacatcactgctcccaacattgttgttgctcttgctttcggttatggtggtcttgttcagttgcttgctggcatgtggtaggtgctttctgtcttcgttggagctcgaactccatgatcgtatactgttgtcgcggccgctcacacagttcagggaaatggccatcggtaacacttttggtgccactgctctgtcctcttatggtggtttctggatctccttcgctattgttttgacccccggtggcttcaacatcgagtcagctctcgtcaaggccgacaatggcagcacctccatgtttgacaactctttcggcctgttcctgatggtgagatcttctgctcgggttttgtcctcttgtcagcgaccacagctaacaacccacagggctggttcatcttcaccaccatcctgctgttctgcaccctga

SEQ ID NO: 10946 - DNA, 228 bp, A.fumigatus
tcaagtcgagcccatcaacggagcacgtttgacggactcgcgcagcagcgacacgatagtaaaaaaaacaatacacaaaagaacaagaacaaaacaggagctcgggctgaaactgggcaccacaccctatatgtaatctaccttgaggcattttttttttttgttttttcttcttcgctggcagcaggggtagtgacccggtgtgggtcagcagcagtagttcggtga

SEQ ID NO: 10947 - DNA, 417 bp, A.fumigatus
agcaccatgtctaccgagcagaatgcagcccttgaaaaggatgtcggtccggataacagcatcaacggcactcctgaaaataccaatgctccgcagcttacctcgcagatgacccacgaggagcacgaagtggccaaggccgctgctcgctttggctatggtcctctggccaagcccaatcccaacgagtacaacctccctcccttcggaggagagttccagcctggtctgtacaagtccgttgagaagcgcaagtttgccaaccctgctcctctgggtttgtgtgctttcgcccttaccacattcgttctgagctgcatcaacatgggtgctcgcgacatcactgctcccaacattgttgttgctcttgctttcggttatggtggtcttgttcagttgcttgctggcatgtggtag

SEQ ID NO: 10948 - DNA, 408 bp, A.fumigatus
caactctttcggcctgttcctgatggtgagatcttctgctcgggttttgtcctcttgtcagcgaccacagctaacaacccacagggctggttcatcttcaccaccatcctgctgttctgcaccctgagatctaccgtggctttcttcctcctgttcttcttcctcgatctcgctttcctcctgctcggtatcggctacatccagcgcgacagcgcgggcaagcccaaccctcccgtcatcaaggccggtggcttctttggtctcctggctgccttcactgcctggtacaacgccctggccggtattgccgacagcagcaacagcttctttgtcattcccgtcgcccacttcccctggtctcctaccggacaggcacggagaaccaagaccgagcgcgagaccgtctaa

SEQ ID NO: 10949 - DNA, 357 bp, A.fumigatus
tttgtcgattcgttgattctgatgcgagtgttgcgtaacgaagcccaccgtcgcatttcatggctcattgcagagaaatccttcaagcgcaaatttatcggattgttagctaggggaataggaactgtcccggtggctcgagcgatggataatgtgaaacctggtgttggaactatatacctgcctgatcctgttaaccagccgactcttttgcgaggggtggggaccaactttgaagggcctgagtttgaaaaggaaggcacaatctctctccctaccatcaatggtacttcgcacagtgctgccattgctgaaagtcttcaccacggggctggaaggagccgcgccagtcgaaca

SEQ ID NO: 10950 - DNA, 201 bp, A.fumigatus
aggctgctgcgagaactttcttgttgtacccaccagggggaataccgatgcaagccgtttgagggacacattatcaacaccaacttatcattgcatcttgaagcttctcatctgagtccgatcaacacctattcatcagctttgcatagtatcaagctaatgcgctgttttctcccaagtctgtcttctaagtctgcttaa

SEQ ID NO: 10951 - DNA, 336 bp, A.fumigatus
gccatcgccgcagctaggcgcaaagagggacgattggctcaagggcatttcgaactactctacgacatcatggggaagaaacaaccatatatcccccctctaattgggtggctatatgatttggtcttatggtcattctcggtgctaattgacctgttcttccgggaagttcatcctcgcggttcttggaagatcccccggaggggtccgttgatcctcgttgcagcacctcatgcgaatcaggttggtttctgttcatctttccatacatatatatttgacttcggttgtagtgcttgctttatgctcctacttgttatatcttccggtcgctga

SEQ ID NO: 10952 - DNA, 819 bp, A.fumigatus
  unsure (174): Identity of nucleotide sequences at the above locations are unknown.
agttcgtcgctgatatgcttgtcacagatccacttcggagaggggaagtcgaatacccataaccgcgtaattgcaacgaacccgccgcccaacctggcacagcagttggccaagcctacaaggtcgggacagaggctgcctcaaaactcgattcgccaactgcaagaacacaantacgccgtgactgtgatggttgtcaacatcctgtatgagaatcccaatctcctccccgtcaagggattcggctacttgatcccacagtctgttccgttcgaacacaatcccgagatggctctaggggtgatcttcggttccgagtctagtgtaggtcaggacactgtgccctgcaccaagctcaccgtcatgctgggcgggcactattgggatggctggaagacatcagactacccagacccggataccgccattgggatgtgccaaaccctgctccatagacatcttggcatcaccgagaagcctcttcaggctgctgtcaaactgcaacgtcaagctattccccagtacacggtcggccatctctcgcgcatgcgggacctttcacaaacagtgcgccaggatttcaataaccggctgactctggctggaaattggtacaatggcgtcggggtgacggattgcgttcggcaggcgtacatggctgcctcgtacggcgttggtgcacttaagctcgatgcaccgagcgttaatgttccctggattaggtacaactggcagggatgggaattagaggggggtataccaacctctcctgtgcgaataacagagacttacaggtcggaacgcaattatttcttctaa

SEQ ID NO: 10953 - DNA, 744 bp, A.fumigatus
ccccttgttgattttatcttacagctggtcgagctcgaattactcgaggatgtgttgatcacgaccaagtcgtcccccgcagcccaaaatcgctacatctactaccccgatcaccttgttcgcatgcctggtcgcgatcccggccgtagcctgttctcagagctttactcgaactttcggacattgcttacggaacccgtctttgacaaactcgtgcgaagtgttgtgacggagccagcgaggttgcccccggggcccaagtcagttgactccgacgagtctgtgagggactttatttctcggcgacttgcccccgagatcgcagataacatagtctcggccgtgtatcatggtatctacgccggcgacattgaccgcctgagtgcgcagaccctgctgggaacctaccgggaccttgagcatgatgaccgccgcgtaattgggggccttgtacatgcagccacctcagatatcacgtacaatctgatggatgattggctggcgctgcattcgctggctgcgacaaagcagaagagctattggagtagtctgaagacgctggtcagagacgccagtgttatcaccttcaaaaacggcgtgcagcagcttactgatgccttggctgcgacattgcgcaaatccaggaaagtggacttgctgactggtacagaggtgatggttatcagtacaaatcctgccaattccgatctgaccgtaagtgtaacttttctgagggagaggtga

SEQ ID NO: 10954 - DNA, 675 bp, A.fumigatus
atggcgtccacaaattccggcatcaccactgacgccctaactggggaacgctacatcccctcttcagtccgcccagacggttccaagcgtcgcgagatcaaagttcgacctggttaccgcccaccagaagatgtagagctgtacaagaaccgtgccgcagcggcttggcgtaatcggggttctggcggggttccaggcgctgagggattgagcgaagcgagtgagaacaaagcaaacacagcagccagcaacaagaacgcgaagcggcgagaggcgaagaaaagggccaaggctgcgcaggagtctgagccgacattgacatcgacacaggccaatggacagagtgtgcgggatttggagaactggcgttccggtgcctccgctgctgagaagaaagtttcgaccgctgaagcgcagcccaaagtcgatcctgaggcggagaaggagaagaaagcacggaacctgaagaagaagctcagacaggcgcgcgatctgcgggacaagaagaaccagggcgaggcgctgctgccggagcaattggagaaagtgatcaagatccaggagttgattcggcagcttgatgcactgggttttgatgctaatggcgacaagaaggactcttctgaagagaaagagaaagagaaggagaaggagaaggagaaggagggtgcctga

SEQ ID NO: 10955 - DNA, 582 bp, A.fumigatus
tggaggcatgagcaactcaaacctggcgatgcatgtgcagaacatgagccctctcacattcagttaccggaactaaatatcccacagatccaagcagatctcatctcgatcccggtgtaccgtcccaagatgcgggaaaccacggcacttggtgcggctatagccgctggtctggcggtaggggtgtggagaaattttgctgaactgcgagacatcaaccgtgccggaggagccgtctttgagcccaagatcagtcgcgaagaaagcgctaagtcattcgcaagatgggaaaaggctgtcgcaatgtgcaaaggctggtctggagatgcgccgccacctccagtgcaacctgctcaaaaggaggcgaagaaaaatgctcctgaggttataacgaatcacaacgctatcaatgctacgcctccaaagttcaacggagagcttaccacacccaaattccctttgataagtatttctggagacttggataatgctgacgaggaagagctttatctggagctgcgaaagattgagatcctgcagcgactcaagaaactccggaaactcaagctttctttttactga

SEQ ID NO: 10956 - DNA, 1050 bp, A.fumigatus
cttagcggcattgatgctgatcaactgtccaacagatggcacgagcacgacccatttgagctggtgtcttccgttgagaagtgcatcgaagaggcggtcaaacagtttgaatcggagggctactcccgatacggtatcaaggctatcgggatcacaaaccaacgggagactactgtcgtttgggaccatgatactggcgagccactctacaacgccatcgtctggacagatacgcgcccgcaggctatcgttcacgagctgaagcaaaagcgcgagtcatcgcaactgcaagcgatttgcggtcttccgctgacaacatattcttccgccacgaagctcctctggatgatagaacatgtgcccaaagtcaaagatgcgtacgagcgaggcacattggcgttcggtacggtagatgcgtggcttgtgtatcgtttgaatggcggcgcatcggcgaacgtgtttgtatctgaccctacaaacgcatctcggacgatgtttatgaaccttgagaccctccaatacgacaattttctcctagacttctttggcatcagaaaagtccacctacccaagattgtgccgtcttcagacgccaaagcttacggagcaatggcatctggaatacttgctggcgttccgattatgggctgtcttggtgatcagtcctcggcgcttgtagggcaaaagggcttttcgccaggaatggcgaagaacacttatggaacgggctgcttcctcctgtataatgttggagaaaagccagtcatctccaagcatggacttcttgctactgtagcataccacttcgatggcaagccggtgtacgcccttgagggcagcattgcagtcgccggatctggtatcaaattcctacaaaagaacttgagctttttccaagagtccaaggaagtgaacgatttggctcagacggtagaagacagtggaggttgtgtgtttgtcactgcgttcagtggtctttatgcgccttactggattgacgatgcaaaggggacaatgtgtaaggcaacaaggtctaatgctcctttttga

SEQ ID NO: 10957 - DNA, 231 bp, A.fumigatus
tcggcgctgacttcccggacagttgggatcacacagtacacccaaaagggtcacattgctcgggcgacgctagaagccacctgctttcagaccaaggccatcttggacgcaatggagaaagacagtggacatgcgctgtccgaattggcggttgatggaggcatgagcaactcaaacctggcgatgcatgtgcagaacatgagccctctcacattcagttaccggaactaa

SEQ ID NO: 10958 - DNA, 249 bp, A.fumigatus
gatcctgcagcgactcaagaaactccggaaactcaagctttctttttactgagcgtctcatgcgcccatgttctagcgtttttcttttgggatctgtacctgtacatgttcatgttacagtcgtggcgaaataacgaaatatttgtttatggaagaagcgacgcttactggaccattattgctatgcgcctcctattgtttgccctcaaatcacagctaaacaagtgtcaagtctacctgtctgactag

SEQ ID NO: 10959 - DNA, 201 bp, A.fumigatus
cttagcgctttcttcgcgactgatcttgggctcaaagacggctcctccggcacggttgatgtctcgcagttcagcaaaatttctccacacccctaccgccagaccagcggctatagccgcaccaagtgccgtggtttcccgcatcttgggacggtacaccgggatcgagatgagatctgcttggatctgtgggatatttag

SEQ ID NO: 10960 - DNA, 213 bp, A.fumigatus
atttcaatgcggttgctttgcgccccacagatctgtgggagtggatttcggggagagatcgcccagctccggagagcaactcaagacttagcggtcttggtcggccgatctcgcatcaaattatccgatgtcaactacggagtactccgtagactaactacctacctagatttgaccagtttgctcttaatcgacgcacagtggagccattaa

SEQ ID NO: 10961 - DNA, 420 bp, A.fumigatus
ctgcgcgctcacggtatcgcaggggtataccgcggcctctgcgcgaccatcctcttccgatcatttttcttcttctggtggggctcctacgacgtcctgacgcgatggatgaaaaacaacaccgcgatgtcggcgccagtaattaatttctgggccgggggtatatcagctcaaatcttctggctgacctcgtacccgtccgatgtggtcaagcagcgactgatgacagacccgatgggcggatcgcttggtgatggggagagaaagttctaccggtggaaagatgctgccagggcggtttatctggagcgagggtggagagggtactggaggggttttgtgccctgcttcttacgagcattcccggcgaatgcgatggctttggttgcatttgagggtgtgatgcggtcgctgccgtga

SEQ ID NO: 10962 - DNA, 345 bp, A.fumigatus
tccgggtctgatccatggggtagcatgctcggttccctgacgctgtaccgacgactactgctcgagaacgtcttttcgagacccgctattaggtctctcacgccttttgcgagttatcaacctgatcccaaaacgctccccagttttggacatgggatagccggtatcctggccggtacgactgtcagcttcgtagcggctccggtggagcatatcaaggcgcggctgcagattcagtatgcggcggataagtcaaaacgaatgtacagcgggccgatcgattgtttaacaaagctggtaggtcattgggaggtctcgagagtgttggaggcgattgtcggctga

SEQ ID NO: 10963 - DNA, 252 bp, A.fumigatus
ttcggagggtctcatgctgacgggatgggtgcctgcgtaaaggaggatgacaagcccttcacagtcagactctccgatgagagcttcgagacatacgagatcgaccctcctccatatgacctcgaggtcaccaagaaagagttgaagcagatgtactatgatatggttgtgaccaggtatggactgcgcggagaggagtttatgttgctatgccactcgtatctaacctttgacggctcttgctttgtctag

SEQ ID NO: 10964 - DNA, 513 bp, A.fumigatus
tttatagataacaagtatggtatgggtacctccgccgctcgttcctccgccttgaccgactactacaagcgtggtcagtacatccctggtatcaaggtcaacggtatggatgtccttgccaccaaggctgctgttcagtacgccagagagtacaccatcgccggtaacggtcccctggtcttcgagtacgtcacctaccggtacggtggccactccatgtccgaccccggtaccacctaccgtagccgtgaggagatccagcgcatgcgcagcaccaacgatcccattgccggtctcaagcagaagatcctcgactggaaagtcatgaccgaggaggaactcaaggctttggacaagtctgcccgtagccacgtcgacgaggaggttgccattgccgagcagatgcccgctcccgagaacaacccccgcattctgttcgaggacatctatgttcgcggcagtgagccccgctggatgagaggccgcactgtcgacgagaccttctactactaa

SEQ ID NO: 10965 - DNA, 510 bp, A.fumigatus
cctttgacggctcttgctttgtctagacgcatggaaatggccgccgaccgtctgtacaaggaaaagaagatcagaggtttctgccacttatctgtcggtcaggaagctgttgctaccggtatcgaacacgccatcacccgcgacgacaaggttatcactgcctaccgttgccacggttatgctctgatgcgcggtggtaccgtccgttcgatcatcggagagctgctcggtcgccgtgaaggtatcgcctacggaaagggtggctcgatgcacatgttcgcccccaacttctacggtggtaacggtatcgtcggtgctcaggtccccgttggtgccggtctcgctttcgcccagcaatacaacggggagaaggctaccagcattgttctgtatggtgacggtgcctccaaccagggtcaggtcttcgaggccttcaacatggccaagctgtggaaccttcctgccatcttcggttgtgagagtaagttgatcttcattgccacctactga

SEQ ID NO: 10966 - DNA, 1731 bp, A.fumigatus
  unsure (35),(160),(194): Identity of nucleotide sequences at the above locations are unknown.
ttggcattccccttgacgcgtcagggcaaattctntacagacccaagcactgtatttctgccgaaagacaccgtaactggtccgatctcagtcattctatccgaatactcgaacaagcatatcgcagacgtcgctcaccggacttttggaggcaggttgntgcctcactttaccacaaccccccctccgcgcgntcaggtacatcagcttccgattcctatcgaggcttctcagcgccacatgagccagatggaagggaatgtgtacatggcagctttataccccggcatgtacgcgtctgccttgagcgtacttgtcgaggttcgaaagcgactgggcacaaactggatacgtcgactgatggcacagcaggacggtccccatgtcttggatgctggcgctggtggtgccggaattctggcttggagagacgtccttcgtgcagaatgggaggccatggtcccagatcatcccgagacggatcctattccactgggtaggtcgacggtggtcacagcctctgaagcgctccgcaatcgcgcgagtgtcatggtccacaacacaacattttttccacgcttgcccgactatattcatgtccgtgagaagccaactctcgacgacgagcggcctccgccgccgcgcaaacaatacgatgtcattatagcgccacatagtctactcggcctggaggaagagtatatgcggaaagaacatgtcgaaaatctttggacccttctaaatccccacggcggagttctgattcttcttgaaaagggtcaccagaagggattcgaagcgatagccggcgctcgtgagatgttgctgaaaagctatatctcaagtcccggttatacacaatacgatgaactaaccgagtctcctaacgagaacaagcatattgacaaagaggaaggcatgattattgcaccttgcacaaaccatgcgaaatgtcccatgtatactgttgctggccacgccaaaggacgcagagacttctgccatttcgagcagagatatatcagacccgctttccttcaacgaatcctaggcgccaaggatcgcaaccatgaggatgtcaaattcagttacctagcggttcaacgcggcgtggatcttcgcaaggagatgaacatcgtccaaggtcccgaggccgctgaagcagcctttgccggctacgagcaccttcacgatatggagtcggaagatgcccaagtttcagatgatgctgcgactagcgagccctcggccgcccaagacggccgagatttccatacgttgtctctccctcgcgccgtctacgccccaatgaaacgccgtggacacgtcatttttgatttctgtacaccagcaggaaagattgaacgctggaccgttcctcgttcctacagtaagcaagcttacagggatgcacgcaaagcccgctggggagatctgtgggctcttggtgcgaagactcgcgtcccacgaagtttgaggcttggtgcaaagcatggcgagggaaagaaagagcgattggagaagcgagctgcttcaaaagccgctcttggtgaatctgaggatggtggtctggaatctgctccgtctgataactgggatgtatttacaacccctgtgagaaagaagggtcaaacaattcccagctggaagaagcatcaggacaagaagaagatcagacaagcctcgaagaagcaatccactgtcaaattgacagaccatgatcttgattga

SEQ ID NO: 10967 - DNA, 285 bp, A.fumigatus
aagcggccggacatcggccttccgggcaaacctcgttgctttccgcttctcctcgttgcaccgttctcaagctctatcaactctctgaaccttccgcaaccagaagtcagcttcaaattgcataataagtcgcaatgtctctcctcggaaagaagttccctgcccctgtgggtatgttataagacccctactacgctcgtgcgatggcgatcggagtatgtcactaaccactcaatcacagccaagcctatggctcctttcttcgctgccggtatgccatcttga

SEQ ID NO: 10968 - DNA, 243 bp, A.fumigatus
ggaacagcaggcaagaagacagcaacacatctacacccagacaattatactagtaacggatacttcaatatggctgcatcacttcaagcctcagttgactcacttcaatcctcgctgcaaacactcgattcatccatctctaccctcgactctgctgttagcgactttccccgattgtgtaaggtcttacaaacaacgcgggtaagagatatgacagtacgacaagcctatcactttctttga

SEQ ID NO: 10969 - DNA, 240 bp, A.fumigatus
  unsure (162),(201): Identity of nucleotide sequences at the above locations are unknown.
cccccgtcccctacaacgaaggaggataaccacccaaactacacataccaaatcatcatgtatctccgcgccgtccacgccgaaacacacatcccgctccttcagcaattcatccgcgacaatcccctcggaatcctcacaaccgccatcaaatctcccaantaccccctcctccaatccagccacgtccctttcgtcctngacatcccaacttgccaacgggtcggaaagtccggtaaa

SEQ ID NO: 10970 - DNA, 600 bp, A.fumigatus
cataccacaatggacacaaccaaatccctcctatccaccctaatagcgataatgatccccctgtccctggggtcagtctcctccccaaatctccttcctacacccccaatgggcttcaacaactgggcccgcttcatgtgcgacctcaacgagacactcttcctcgaaaccgcctccgcaatgatctcaactggccttctagaagcaggctacaaccgcgtcaacctagacgactgctggatggcctacgaccgcgccgcggactcctccctccaatggaacaccacaaaattccctcacggtatcccgtggctcgcccgccacctcaaggcccaaggcttccacgtaggaatctacgaagacgcaggagacctcacctgcggtgggtatcccggctcgttcggccaccaagccctcgacgcccaaaccttcgcaacctggggaatcgactacctaaagctagacggctgcaatgtcttccccgagcactctcgccctttagaagaaagagttcaaagcccggtacgcacactggcccagcatcctaaagcagatgccccacccgtttatttcttggaaagcgcccctggcgactttgcc

SEQ ID NO: 10971 - DNA, 324 bp, A.fumigatus
atatacacgtatgtccataccccctggacaagagcgcttgctaagtgtaattacctaggcaaacccgcattcaacgacgagtacacctaccaagtctcctcacgacatctgatccttgcctctccattcttccgcgcagcactaacaaaagggtggaaggagacccataccctaggcacacacggctccgtctcattcaccgtctacgactgggacgatcaggcgctcttgacttttctgaatattatacacgcgacaacaccgcgatctgccatggaaagtagggttagagctatttgcgaagatcaccttcatcgtgaataa

SEQ ID NO: 10972 - DNA, 219 bp, A.fumigatus
ccacgttctgtatcgctttctgaatcttcttaccatactcacaccagcatgatgcctctttcacaggacagccacccttccacaaaggcactccatgccgacggccgactcaacttggtgacagacgtcgcacctccaatccatctatcgaccacatttcgataccccaatgatcctgaccaattgattccgtccgaggatcctattgtaagcctctaa

SEQ ID NO: 10973 - DNA, 1038 bp, A.fumigatus
catcccaaggccgaattcgatggcaagaactacgtctattcacgggagttcgcacccaatgcgacccgcttcgaggccattctctccaccttacttggtagccatgccgtcagctatgccacgggcctagctgcactacatgcagccctggtccttctgaacccacggcgcatctccgttggcgaaggctaccacggcagccacgaagtcatcggtgttctcacccgtctcacaggactcaagaagctcccgctggactgtcccgcagaagacctgcaagaaggtgatgtgatcctcctcgagacacctgtgaacccactcggcaccgcattcagcatcgaagcgtacgcgcaaaaggctcattcgcgtggagcctacctcatcgtcgacagcacgtttgctccgccgggcttgcaggatcctttcctctggggtgcagatatcgtgctgcactctggttccaagtatttcggcggccatagcgatatgctctgcggggtgcttggtgtcaagcgtgcagagtggcatcgtcagttgcttgaggatagggccgcgcttggccatgtcatgggaaatttggagagttggctgggtgtgcgtagtctgcgtacactggaggttagggtgcagagagcgagtcagaactcggccaagttgatttcttggctgaatgatgcgttgacggctgcgtcgccgacgccggggagtgaagaggagatcgtgcaaaaggtactggtgaagatctaccatgccagtttgcaggatgaggagtggttgaagaggcagatgccgaatgggttcgggcctgtgtttgcgattgtcatgaaagatgagagacttgcgaaaacgctgcccagcaagctctctttgttccagcatgcgacaagtttggggggcgttgagtcgttgattgagtggcgggccttgtcggattccagagttgatcggaagttgctgaggatcagtgttgggctggaggattggcaggacctgaagatggatcttttgtcggcttttaagtctcttcttgaggtttag

SEQ ID NO: 10974 - DNA, 630 bp, A.fumigatus
cgagggtatactgactccagactccccggagatacttccactacagacggaattcgtggcatcgcagcagaactcaccaaagccgaatcaaaagggatcaacattctcatcaacagcgcaagcgttaccagcgagccccgcgcgaaaagcacatcctccgacaccgacttcacagacccagacgccgtctcgagatggatgacctgtgacggggcggacgcatggcgcatcgcgtacgccggcaacgtctggtcgcaccatttcctcacagctgcgctgctgccgctgcttgtgaagggagcgaaagcggcaccaggccattcgagcgtggtgctgaatgtggcgagtgtggcgggattgacgaagacgcattcgcagggccagtttgcttattcgtcgagcaaggcggccctgatacaccttacgagggagtgggcgcatacttttctgccgttgggggttcgtgtgagttgtattgcgccgagcgtgttcccgaatgagattagtgtgggcaggtttgatgaggatcggaggtccacgcaggaagaagagttatggaggaagattccggctggtgagtcttgctttattgcagtcggtggttgtgctttgcgaactggagtgagctga

SEQ ID NO: 10975 - DNA, 495 bp, A.fumigatus
atccgtagcgagatggatacagccccccgatacaacttcaaagacatcaacgtccatgacctcgaagcagccacccttttcgaggtcaggggttatgtggccgtcgtcacaggagcaggcaacggcgttggcctcatggccgctcagacattagcagcaaacggcgctcgagtctacatcatcggtacgagggaggagatcctcgacacgattggggagaaatattccttcaaagggcagatcacaccgtgcgtcctgtcccactccatcccatcctccaccgcccctactgacgagggtatactgactccagactccccggagatacttccactacagacggaattcgtggcatcgcagcagaactcaccaaagccgaatcaaaagggatcaacattctcatcaacagcgcaagcgttaccagcgagccccgcgcgaaaagcacatcctccgacaccgacttcacagacccagacgccgtctcgagatggatga

SEQ ID NO: 10976 - DNA, 642 bp, A.fumigatus
tatttcacccttgatttatcatttttgtttccttgctccgtgactcataacagacttgcgtccccaggtgactatgtcgaccgtggctactactctgtagagacggtcacactccttgtctgcctcaaaatccgttacccccagcgaatcaccatcctccgaggaaatcacgagtcccgccagatcacacaagtgtatgggttttatgacgagtgcttgcgcaaatacggcaatgccaatgtctggaaatactttaccgatctcttcgactaccttcctctcaccgctctcatcgagaaccagatcttctgcctgcacggcggtctgagtccctccatcgatactctggacaacattcgctctttggatcggatccaggaagttcctcatgagggacccatgtgtgatctgctctggagtgatcccgacgaccgatgcggctggggtatctctccccgtggtgctggttacacctttgggcaagatatctcggaagcatttaatcacaacaacggcttgacccttgttgcacgagcacatcaattggttatggagggctacaattggtcgcaggatagaaatgtggtcaccattttttcgggtatggcccctcttcccattcttatttgtacccaccactaa

SEQ ID NO: 10977 - DNA, 330 bp, A.fumigatus
cccttgttgcacgagcacatcaattggttatggagggctacaattggtcgcaggatagaaatgtggtcaccattttttcgggtatggcccctcttcccattcttatttgtacccaccactaacatgtccttctcagcccccaattattgttaccgctgtggtaaccaggccgcaatcatggaaattgacgagcatctgaaatacacattgtatgttccattgaaagcaaatgttcgaccttggttcatccgtactaactgtttctcaaagcttacaattcgatccttgcccacgcgcgggagaaccgatggtctcgagacgtacacctga

SEQ ID NO: 10978 - DNA, 480 bp, A.fumigatus
gtcaaagatctcagaggcttcgtgaaaaataacttcaaaatgcagcttgatttttcaaccagacgtccacaagtgtcctggaatgatgacaagagagtattcctatgttgtctctataaattttttgagcgagacggcactgcgtttgagaaaatcttcaatgctagatacaaaggggacctagaggacagcggcttcgctgatgggagaacttctagcaaaacattgaacactcaatgggtggacatgaagcgacatggggatcctatctggggccgtgtccataagtctcctctcaaccaagacgattggttaccaatcaaaaacataatcatcgatgttgctcagtcacttggagtcccccttgctgagaaggaaatcgatgatatagacacgtcaaactaccgctcaagggccgctaaatctggcaggaccattacttccgacccagttgttccaacctcaagttctgtaagttaa

SEQ ID NO: 10979 - DNA, 753 bp, A.fumigatus
gctctctgcgaagcgattaccttccgccgcttctatatagatgatcgaacgccgactcgcaaggcatcaatactcggaagcggtacatcgccggcttatttgctgactctgaggtcagcaaattccttcctgacgaaatttccctggaagaattcgatggttgtcctgaatcatgtcagtatcgcaagccatccaagccccttcatctccacatttcagtctatcctagcccccatccaccgagcactgtggggaaaggaaggagctatggtctcgatcatcgatacaaggaagcttacaggcccagtgtacttcgccaaatcccttgtacagcagaacaagatccgaatccggggctataatggcgtaggagaatatcttatatggggagagatccagacacctgcgataatttgctctttcaagatcactacactcatccagattgcgcacaagaatgaagatatcggcagaattctgcaacttgacaaaatcgcctcctgtaaacgtgttcggggaaagctacgaacagttctttccaacgagaccgacagtatgaatttggatcatgcttctggtgtcagcttgggtaaattactccgcctgatcaatgtgccccaggcatattatcagatggtcggtgagggtatcctcaagtcatggcagctacagaagcacggagattggcaggaatttctccaaggacttgaagttgggtttttcacctggttacgtcaaacaaccctcaactga

SEQ ID NO: 10980 - DNA, 534 bp, A.fumigatus
tacccagacaacttggatgcaaggcctacaggaacagctctggctaaggaaattggaagaaatcatcttgttcagcatggcaccgttgtgcatgaagaagaggaagagagattcgaagagatagaggaagacaaagatgaagacgaagacgaagacgaagacgaagaggaaaaggaagaggaagatgatgatagtgacgactttcagtctgtcattggcacgccttgtccagttcgactagcacatactgtctcatctatcccaccaccggaccctcggcctgtcaatcgaattgagctctacaatcccgctaccagaaattggtctctggccgaagaatcatccactcctacggagatcgaggctttctctcgagaattcagcgtgattttcttggatgacttcgaagaagaaattgaagagctcggggatacgatcatggggaaggatatttctgatctgtctacacccgagcatccacccaaggatcaattcgcctcagatcgcgagaggattaagcgttttctaaagtga

SEQ ID NO: 10981 - DNA, 366 bp, A.fumigatus
  unsure (123): Identity of nucleotide sequences at the above locations are unknown.
tttgaaacagacaagaagtgccccttcaccggtatggtctccattcgtggtcgtatcctgaccggccgtgtcgtctctaccaagatgcaccgtaccatcatcatccgtcgtgaatacctccantacgtccccaagtacaaccgttatgagaagagacacaaaaaccttgccgctcacgtctctcctgctttccgtgttgaggagggtgactgggtcaccgtcggccagtgccgtcctctgagcaagactgtatgtggaaatcctccaaggaacggctctgcgcgatatttccggcagcggttgatgctgaaatggaaattatcatggagcggtcgtcaatccaccctcagtatcaatcctgtctaa

SEQ ID NO: 10982 - DNA, 261 bp, A.fumigatus
tcgaactggacaaggcgtgccaatgacagactgaaagtcgtcactatcatcatcttcctcttccttttcctcttcgtcttcgtcttcgtcttcgtcttcatctttgtcttcctctatctcttcgaatctctcttcctcttcttcatgcacaacggtgccatgctgaacaagatgatttcttccaatttccttagccagagctgttcctgtaggccttgcatccaagttgtctgggtatcagttgagggttgtttgacgtaa

SEQ ID NO: 10983 - DNA, 1689 bp, A.fumigatus
gtgctcttctatatagacaagccaatcgttcggcggaaggaagtgaccacgtgggctcctgagcttgctcggcatggcagaggatctgatgctcgctccattcagacattgggtgttcccatgcatagagacccacgcaataaaaacacctgtgtagagacaacctccatggcaactcccagcagcgatgttcctgttccccatttagcgtcgcggcagactcggcgtgaccgagaggatccagacccagctgcgccgggcgtcaatgacagcctggcgtcggaaaatctgctacgtaacttgcaaagaagcgagagttcagccgtcagtgctaacagcagtgtcccttccaacggtggccgatggggaaatatcttttccggtttgtggatctcgcgccatgagtcgtccacagccgaaggcaatcccaccgtcccagttgcggaacctcgaaagcgttcggtgtctgcttatgtcggcccctctaagcgaagccctccaacgctgagtcagatggtgaaagaagtttcgggcgagacacccggagaagtctcagagactaccacgagtggcactatctcgattcctcgatcctcaagtcagcaagggccggaagaaaatactccagagccgtcgtccgtgccggagcagaacagagaatcttccttgaaactgtctgtgcggggtgatgatggaatcgtggacgtggaacttccgcttcccgggtttctttccctttcgtcgtcaggcgattcgaccatagcgtccccgaagaagacacgaacgtcggtcaccagtgttgatgctctagcgtccacacacagcagcaattccggatttcactgtggcggccccagggacaacgacggacctagcgtgaatgttgctggatggctgaagaatttccacgaggactttttgcttcagggcgtgcgaccttctgccagcgtagaagccgacatcaagcgcgcaatgcaagccgagcctacacctagttccgcgttttcctttgaacctgaaggacaaggaaagtgggtggacgtcgcaacaaccttgattgcagataccaggaacttcacagtcaagcggcttcgtctgaggcgtaaagttgtcgggaatggctcttgcaggagtccatctacacctggagctgcctctcaaccggggaccccccgccatctgtttggtcatcccacatctgcgtcacagcttacaagctttttctctaacgcgcccgcttcgagcggggcgtctgcgaactctgtggcagaagcctttgatgcccctgaatacgaagagcgatttgttgaggagcctgtcatggatttggatggtacacttgttgatgcgctcgagcgtgttctcgcacagagtggtcagtcatcgttggcgcactcgagagcccagtcgccgtcgcgtggtcggaggggcgaagataaaaacacttctgatactgtctctcgagatgaggttccatctattgaggttccccgtgcggagtgccgcaagatggtgcttggtgctctcgaagaagtggtccgcagtgtgacagccgagcattgccgcgaggacgtcgacggggaagtcggccttgctgatagagagcgcagacgctcgttggcaggggcggacaataccctgagagaaggtattcgcaagtggctacttgaagttgaggaggcttggtga

SEQ ID NO: 10984 - DNA, 2556 bp, A.fumigatus
ccctctgaatgtatggcagacaagatggatgtcgacaatccaaatacccccacctcacgcgatcctcgcctcgtcagtcgaaacaggccagcgccagctaggacagcatctctagatgctggcatatggggttctcctaatggttataagttagaggcacggtcaccgaacaatcctccgcctattgacaggcaagatgaggctcctggagatcaattcattcgcacgctctcagaattgattaaagctgctgttgacacagctgctcgagaagtcgaaaaggataagttgctgaagaagaaggacatgacagagggtctgttgcgaaaggcaaaagctgcgccaaacttcccatcaaccacagcatttttccagcaagctcgcaaggatgaagattctgagttgacacgaatggatgagactatctctagaacacaagcacactatcgacaactagaaaattctctcacgaccaaatgggtgcctttgcttctgcgcaaccattctgattcggaccagaagataaacaagctacaggatgaaattcgggcactccagaagcgagcaggagattcagaattaggtgcaagtcgtgagaaatatcagttgctagagaccaagatgaagatgcttcaagatcgtgtcgtcctactcgagaagacttccgacaactatgcgacttccatcaacactcagatgagatacgaaaaagagaataaggaacgtgttgataaattgagttcagatattgctcaatttgcctctcaggaaaccatactgaaacacttttcaacagaagttgaggagttgaaaaggatcacgattgccttggatgccaagctgagctctttgcaaaaggcacaggaggaatattcgggttctctcggaagagtaaatgaaattatcgatgcgcaacggaaacgtctcgatgccagcaacgataattctgctacttttgagaaaaaattcaaggagatccacgagcgcctggccccaatagaaaaggtccatgtaatcccgccggagggtccagcaacagttccaattgacgcatctaaaattgagttgcgtttaaagaatgtcgaagacaatttagccaagattcccagacctgactcatccttgcggtcgacagtccagaatctatcagaacaactccagcaattgcaaagccttcaggcgatgaaagacgaatttcatttcgcagaaatggaggagattaagaaatcaaccgtcgacaaagccgacataaaatcattgaaagacaactacagccgccttgctgacgaaacacggagaataagccagttggaccgtgcaggagctgtaggacaagctgagatacagtcattgaaagacagctacagccgcctcgcaggagaaatacaaaaaatccagtcggaccgtgcaatagccgtggataaagctgagatacagtcattgaaagagacctgcagccgtctcgctgaaaatatacagaaaatgagccagtggaaccccgcagcagcccttcagcaaattcacacggtagacgtgaaaatcaacacagtcgatgcggcactgaaatattctaatcgcctactcgagagtgtgcgcgttggcctccattccctggagacacgttacaaccatctctccactgaaatggtcgtaaagaacatggttgttgccatgcaagagatgtacccctctgcaggccaattgacagagcagatcacaaccttgaaaaatcaagctgagaaagaaatatcatccctgaaaaagaccattgagcagctcgtccagacccaaaatagtcagaaggctttggtaaattgccttcaagacgacgtcggccagcgttcagcagaaataacccatctcagggacctttttggaaaggttgctcatcaggtctctgctctcacggaacagctagaggaggtacgtgctttgccagataaaaaaggcaaagaggtttccgatggtcaaaacagaattgagttgaatgaatccttccgcgaattgaaagaccaggtccaaaacttatccagtggcctcaaccagatgaaagtcgtgatgagtgaaatcaccctaaataaaaaggatttgcaatcgctcgatgatcggttccgttgcttagaggaatctgtgtcggtcaatcatcgtgttttgtcagagcagattaatacactcaaggattctttggaaacccataaatccatagtacaggcgctagattgtctcccagccagtgggatgcaatcactcaagcgagaacagagcccttcgggatcagatgccgccccacacacgaactttgttgagatgaccgagaccaatcctgcgttggcattgcgcgagaagaaaagaaagaagaaacgaccacgccctccaactgtatccgacaatgaaaatgagaggtcatctggttctagaaacgagtctcccatgatattctcttcaccagctcatacgttggacaatgaagttgcatcaccttcggagaacaagagaaagaccaagaagaagaaaaaacgcaggttgatcacggagggtcccatcaccatagactag

SEQ ID NO: 10985 - DNA, 300 bp, A.fumigatus
aatattgcctggagaacatcctggacccaactgcggtatcatatcaatacatcccctgtattatttcaatttgttctcgcctctgatttgcctgacggacccgactcggaggtcctgagcttcttcagcaagcgcccggacattactttgagacccacctggtacgcttttgattcacttcaagatcttggaagacatcctttcttctctcctgagatcctgttgctctctcacattgtgatttcaaggagctcctcgacctggctgtcctataccaatagcgaatcttgcctgacgtga

SEQ ID NO: 10986 - DNA, 618 bp, A.fumigatus
cgaatcttgcctgacgtgagaagagccctctctatcatgtcaatcagtgggccttgcgtctggctgtcgtcgttgtcgcctcctgcaacatcccatctctctgcgatcacgaaccatttaccggcaacttcctggaatagcgagcaggtactttcgcgatcaagggtgagcccgccaaggttgccctacccgggggagaagggaggccattcggttcagaagctggcagtcgacatgcaaccgagtgctgtgcttaaggctgaaaatgccttatcagcatcaaccgttgtggcaacgtctaaccatgtacggagttctgaggcagagatgccgccaccaaaggaagcagaaagcagaagtacagaagagacgctgtcacgaatgaggctggatcagctgaaccacagcgaatctcatccttctggggtttcaacgccagccagcccctctgtttcaaaagcggcttcgctggaagcaaagaagcggcctcaggaagagacacgaggggatgagaaggacgatggtgaggcaatgggcatatcgtcagacgaaggaggagatcagaagaactcctctgacgcaaagactgacaagaagaagatgaagcggttccggtaa

SEQ ID NO: 10987 - DNA, 1401 bp, A.fumigatus
  unsure (1236): Identity of nucleotide sequences at the above locations are unknown.
cttgatgggcgctttggacgtgtgccgcatggcggatttcgttgtgcttgcgttatcgtcggaggtggaggtggaggagcagggggagcagctgttgagatccatcgagggccagggtatttccaatgttgtggctgtcgttcaggtatgtcgggatccttcagccttgggattgtcgggctagtaggactaaccgtgggtttattttctaagggcctcgacaagatcaatcctcccaagaaacgcccgcaggtggcctcttcccttaaatcattcatcaaccacttctttccttctgtcgagaaggtcctgtctgtcgactcgagacaggaatgttccaacgtcgtccggtcgctgtgtaccgcaacaccgaagggtatccgctggcgggatgagcggagctggatgctggtggaggaggtgaaatggcccgaggccacaacagaagtcgtcgacgatgttgttttgacaggcattgttcgcggaaagggactgaaggccgaccgtctcgtccatatccctggatggggcgacttccagatcgactcgatcacggcagcaccactcccgaatgcccgagcgaaacgcgacgatgccatgaatgttgatgagaatgaagccccacaggttttggatgttcccaccgctgaccgcgatgacctcgccactgtggctcccgaggagattgagatggaggaggatgatatctctatcgccgagacggagcgcaagggtgtcctcctagacgaccaccattacttctccgatgacgactcccatctgcccgcgcgccccaagagactgccaaagggaacgtcagagtaccaatcggcgtggttcatcgatgatgtctccgactctggctccgacattgaggaagaagaggagcaggacgaggctatggcgatggataccgctggaaaccccgaggacggcgtattcccggatcgtcaggatgctatgacagaagctggaccttctgagtaccctcagtccgagatgttccttgacccttcgccggaagacgaagctcagcaactggaggagtatcgggccagtcgccgcaaggaagcgtcggaggacctggagttcccagacgaaatcgaacttcatcctaatgtgcttgcgagagagcggctggctcgctttagaggtctgaagaatttcaagactagccattgggagactgcagaggaccgtccgcatgaaccaaaggactggcgccggctgctgcanattgtggattacaaaggctccaaaaacaaaactctccgtgaagctctggttggcggtgttgaacctggcataagggttgatgtccccttgcgtggagtgccatcgtccctccgtaatcgccggcagcccctgtctctcttctcacttctccgtcacgagcactaa

SEQ ID NO: 10988 - DNA, 504 bp, A.fumigatus
tcaggcaaggtcgagcggggtactcgcaaaacccctcaccagcaactcatgtcgaagctcgatcgtcggaaccaggctcgtcaaaaacagcagctcaagcatcaggagaaggcgcaggccaacagtatcttcaccggagcgaacggtgccccccgccatgtcgcagtcgtgccgctttccgtcgatgtcgatgtcgctgcaatcctccggtctttgaatgaaagtgtggacgtttcggccgatgtttccgcggacacgatctctcgtgtgcgcattgatcgcttcagacagagcctgcagtatattcctgcgaaatatgacttgatgggcgctttggacgtgtgccgcatggcggatttcgttgtgcttgcgttatcgtcggaggtggaggtggaggagcagggggagcagctgttgagatccatcgagggccagggtatttccaatgttgtggctgtcgttcaggtatgtcgggatccttcagccttgggattgtcgggctag

SEQ ID NO: 10989 - DNA, 792 bp, A.fumigatus
tggtggtcgtctaggaggacacccttgcgctccgtctcggcgatagagatatcatcctcctccatctcaatctcctcgggagccacagtggcgaggtcatcgcggtcagcggtgggaacatccaaaacctgtggggcttcattctcatcaacattcatggcatcgtcgcgtttcgctcgggcattcgggagtggtgctgccgtgatcgagtcgatctggaagtcgccccatccagggatatggacgagacggtcggccttcagtccctttccgcgaacaatgcctgtcaaaacaacatcgtcgacgacttctgttgtggcctcgggccatttcacctcctccaccagcatccagctccgctcatcccgccagcggatacccttcggtgttgcggtacacagcgaccggacgacgttggaacattcctgtctcgagtcgacagacaggaccttctcgacagaaggaaagaagtggttgatgaatgatttaagggaagaggccacctgcgggcgtttcttgggaggattgatcttgtcgaggcccttagaaaataaacccacggttagtcctactagcccgacaatcccaaggctgaaggatcccgacatacctgaacgacagccacaacattggaaataccctggccctcgatggatctcaacagctgctccccctgctcctccacctccacctccgacgataacgcaagcacaacgaaatccgccatgcggcacacgtccaaagcgcccatcaagtcatatttcgcaggaatatactgcaggctctgtctga

SEQ ID NO: 10990 - DNA, 1443 bp, A.fumigatus
gagacagcgtccttggctcattccgatacagcggactccttatcagggattccacagggaaattcgatcaggatgatgggatacgggggtcatcagtatcatcctcagcgtcaagcgcagcaaaatgcccatccccagcagcagcagcatctgcaatcgccatcgctgagcggggccgctgcgcattcggtccatagcagcaatggcattgctgccaacagttccctgctccggggccagcagcagtcagacctggcgagtaattcgcccgatctgaggaagatgactccctcgtcgtccgcgtcgatggtcgggtttaccgcgggaggaggctatggcacctacggtcattatgcgcctcagggcacttcagatcttttgtccagacataccgactccgtcggtcaattgaaagatccgtatctctcgcagatacagagtttgcaaagaaacatgaatcccatggcaaaacttccgtccgcacccagccatgaaccctcaagccgccatgtcgccacatgctcaggcgatgagtatttcgtctccgcagcagtcatacgagaggttgcaacagcatccccatctgcagcaccggcagacatcccatacgcatccctctgtgacttcgcctgcggccgcgtcgcccatgcttgcgactactcaaccccagcaaactcagcaccagtaccagcaagcgcaacagcagcagcagcaaccacagtatccgcaatcctcacagcagaccgcgtatcagcagacccaggcgcaagcatctccgtaccaacagcatcagtcgtctccgttccaacatcaccaggcgcaggcatcgccataccagcacacgcagcagacttatcagcagcaagctcagcagacgtatcaacagcaacagcaagctcagcagtcacggtaccaggcacagcaaccgcagcagcatcagttccaacagtatccgtaccagcggtaccagcaggctcaacaagcccaacaggtgcatgcacagcaagcacaacagacccaagtacaaccaacacagccagcacagcatgtgcagcagcagactcagcagcacaactgcccggaagcgacacaaacccagccgtctcaacaaccgcacgaacaagcagtgcagcaagcattgcagcaacatcgccaggctcaacagcaagcccatcaacatcagagacagtcgcagcagccgagtccctacgctcaacaggcacagcaacatacgcagcagcatacgcagcaacatacgcagcaagcccaagcccagcaaacgcatccgcagcaaacgcatcagttccatcagcagtcgcagcatcagcagccacagcaaaagcaagcgacgccatcaatccaaccggctgctttgagcggagcaaaacctgctactcaagaacccagaaaggaggaaacgaaaccaacgaagaagcgtggtag

SEQ ID NO: 10991 - DNA, 603 bp, A.fumigatus
  unsure (283),(301): Identity of nucleotide sequences at the above locations are unknown.
gtcggagacagccccaggcacaacccccaaacccaaaacaccgcgcaagccatccaccacgaaacccggtggcactggtcggccacgcggtcgtcctcgcaaggccgacgtggaagcacggaagcgagccgaagccgaagctcaagccaaggccgaggccgaggcgcaagcccaagagcacggacaaggacagggacaatggcatggacaggcacaggtacatgcacatggacatgcacatggacaaacacctgttcaggtgcaggttcaacctccggcccanccgcaaccacaagcgcantcgcaagccccggctcaacctcaaattcagattcccgtgcagcctcagcaccaagttcagccgtcacctcagcctcagcctcagcatcttcatcatcaggcgtctccgcaactgcaagcaaacgcgcataccagcattggcaacattgcgaaaccgcatcagcatgggcaaccaacaaaaacattccacaacaacagcaacaaccctccgaatcccatgaagttgaccccgcccccaaaaacgcggcccccccaatgaacgggaaacaaccccgcaaaaagcgtcttacctccatgccccat

SEQ ID NO: 10992 - DNA, 2271 bp, A.fumigatus
  unsure (1995),(2013): Identity of nucleotide sequences at the above locations are unknown.
atcccatggcaaaacttccgtccgcacccagccatgaaccctcaagccgccatgtcgccacatgctcaggcgatgagtatttcgtctccgcagcagtcatacgagaggttgcaacagcatccccatctgcagcaccggcagacatcccatacgcatccctctgtgacttcgcctgcggccgcgtcgcccatgcttgcgactactcaaccccagcaaactcagcaccagtaccagcaagcgcaacagcagcagcagcaaccacagtatccgcaatcctcacagcagaccgcgtatcagcagacccaggcgcaagcatctccgtaccaacagcatcagtcgtctccgttccaacatcaccaggcgcaggcatcgccataccagcacacgcagcagacttatcagcagcaagctcagcagacgtatcaacagcaacagcaagctcagcagtcacggtaccaggcacagcaaccgcagcagcatcagttccaacagtatccgtaccagcggtaccagcaggctcaacaagcccaacaggtgcatgcacagcaagcacaacagacccaagtacaaccaacacagccagcacagcatgtgcagcagcagactcagcagcacaactgcccggaagcgacacaaacccagccgtctcaacaaccgcacgaacaagcagtgcagcaagcattgcagcaacatcgccaggctcaacagcaagcccatcaacatcagagacagtcgcagcagccgagtccctacgctcaacaggcacagcaacatacgcagcagcatacgcagcaacatacgcagcaagcccaagcccagcaaacgcatccgcagcaaacgcatcagttccatcagcagtcgcagcatcagcagccacagcaaaagcaagcgacgccatcaatccaaccggctgctttgagcggagcaaaacctgctactcaagaacccagaaaggaggaaacgaaaccaacgaagaagcgtggtagacaacccaaggccgcagccgcagccgcagccgcttccgcgtctcctgcgattgcttcaggcaagatcaacggaacgacacaaccaacgccagccgcctatcgtcccgaggccccatcgccgatccaattcgtacctcagcatccacaccttccacagactcaagctcacgctcaggcccacactcagacgcaagcgcaggctcaaccctatccccaagcccaacctcagccccagtttcaaccacaagctcaggtgcctaaccagctgcagaaccccacagctatgcaaggccagaaccagggccaaggccagaaccaaggccaaggccagggccagaaccagggtcaaggccaaccgcagacccaaggccagacgcagagtcaacagcagggtccagcgaatgcagcgggctctggtactcctggtgctccaggtgcttcacagcaacctgctcctacaccccggaagcgcggccgtccacggaaaaatcccttgcccgatggagcacagcctccaaagcctaagcctaagaaacccgcttcgaccgctgcaagtgcacccgccgcggccgccgctggtggtgctccggctggcaccgccgttcctggtcaaggaaccaatgctgcccctggcacagctaccgctccaggtgctgccccggttcctggtcctgatggttctgtccctgccgttcctgtaaagcgaggccgcggacggccccgtaagtcggagacagccccaggcacaacccccaaacccaaaacaccgcgcaagccatccaccacgaaacccggtggcactggtcggccacgcggtcgtcctcgcaaggccgacgtggaagcacggaagcgagccgaagccgaagctcaagccaaggccgaggccgaggcgcaagcccaagagcacggacaaggacagggacaatggcatggacaggcacaggtacatgcacatggacatgcacatggacaaacacctgttcaggtgcaggttcaacctccggcccanccgcaaccacaagcgcantcgcaagccccggctcaacctcaaattcagattcccgtgcagcctcagcaccaagttcagccgtcacctcagcctcagcctcagcatcttcatcatcaggcgtctccgcaactgcaagcaaacgcgcataccagcattggcaacattgcgaaaccgcatcagcatgggcaaccaacaaaaacattccacaacaacagcaacaaccctccgaatcccatgaagttgaccccgcccccaaaaacgcggcccccccaatga

SEQ ID NO: 10993 - DNA, 753 bp, A.fumigatus
cttcgcctgcggccgcgtcgcccatgcttgcgactactcaaccccagcaaactcagcaccagtaccagcaagcgcaacagcagcagcagcaaccacagtatccgcaatcctcacagcagaccgcgtatcagcagacccaggcgcaagcatctccgtaccaacagcatcagtcgtctccgttccaacatcaccaggcgcaggcatcgccataccagcacacgcagcagacttatcagcagcaagctcagcagacgtatcaacagcaacagcaagctcagcagtcacggtaccaggcacagcaaccgcagcagcatcagttccaacagtatccgtaccagcggtaccagcaggctcaacaagcccaacaggtgcatgcacagcaagcacaacagacccaagtacaaccaacacagccagcacagcatgtgcagcagcagactcagcagcacaactgcccggaagcgacacaaacccagccgtctcaacaaccgcacgaacaagcagtgcagcaagcattgcagcaacatcgccaggctcaacagcaagcccatcaacatcagagacagtcgcagcagccgagtccctacgctcaacaggcacagcaacatacgcagcagcatacgcagcaacatacgcagcaagcccaagcccagcaaacgcatccgcagcaaacgcatcagttccatcagcagtcgcagcatcagcagccacagcaaaagcaagcgacgccatcaatccaaccggctgctttga

SEQ ID NO: 10994 - DNA, 768 bp, A.fumigatus
gcggagcaaaacctgctactcaagaacccagaaaggaggaaacgaaaccaacgaagaagcgtggtagacaacccaaggccgcagccgcagccgcagccgcttccgcgtctcctgcgattgcttcaggcaagatcaacggaacgacacaaccaacgccagccgcctatcgtcccgaggccccatcgccgatccaattcgtacctcagcatccacaccttccacagactcaagctcacgctcaggcccacactcagacgcaagcgcaggctcaaccctatccccaagcccaacctcagccccagtttcaaccacaagctcaggtgcctaaccagctgcagaaccccacagctatgcaaggccagaaccagggccaaggccagaaccaaggccaaggccagggccagaaccagggtcaaggccaaccgcagacccaaggccagacgcagagtcaacagcagggtccagcgaatgcagcgggctctggtactcctggtgctccaggtgcttcacagcaacctgctcctacaccccggaagcgcggccgtccacggaaaaatcccttgcccgatggagcacagcctccaaagcctaagcctaagaaacccgcttcgaccgctgcaagtgcacccgccgcggccgccgctggtggtgctccggctggcaccgccgttcctggtcaaggaaccaatgctgcccctggcacagctaccgctccaggtgctgccccggttcctggtcctgatggttctgtccctgccgttcctgtaa

SEQ ID NO: 10995 - DNA, 735 bp, A.fumigatus
caggttttgctccgctcaaagcagccggttggattgatggcgtcgcttgcttttgctgtggctgctgatgctgcgactgctgatggaactgatgcgtttgctgcggatgcgtttgctgggcttgggcttgctgcgtatgttgctgcgtatgctgctgcgtatgttgctgtgcctgttgagcgtagggactcggctgctgcgactgtctctgatgttgatgggcttgctgttgagcctggcgatgttgctgcaatgcttgctgcactgcttgttcgtgcggttgttgagacggctgggtttgtgtcgcttccgggcagttgtgctgctgagtctgctgctgcacatgctgtgctggctgtgttggttgtacttgggtctgttgtgcttgctgtgcatgcacctgttgggcttgttgagcctgctggtaccgctggtacggatactgttggaactgatgctgctgcggttgctgtgcctggtaccgtgactgctgagcttgctgttgctgttgatacgtctgctgagcttgctgctgataagtctgctgcgtgtgctggtatggcgatgcctgcgcctggtgatgttggaacggagacgactgatgctgttggtacggagatgcttgcgcctgggtctgctgatacgcggtctgctgtgaggattgcggatactgtggttgctgctgctgctgttgcgcttgctggtactggtgctgagtttgctggggttgagtag

SEQ ID NO: 10996 - DNA, 651 bp, A.fumigatus
  unsure (64),(82): Identity of nucleotide sequences at the above locations are unknown.
cggctgaacttggtgctgaggctgcacgggaatctgaatttgaggttgagccggggcttgcgantgcgcttgtggttgcggntgggccggaggttgaacctgcacctgaacaggtgtttgtccatgtgcatgtccatgtgcatgtacctgtgcctgtccatgccattgtccctgtccttgtccgtgctcttgggcttgcgcctcggcctcggccttggcttgagcttcggcttcggctcgcttccgtgcttccacgtcggccttgcgaggacgaccgcgtggccgaccagtgccaccgggtttcgtggtggatggcttgcgcggtgttttgggtttgggggttgtgcctggggctgtctccgacttacggggccgtccgcggcctcgctttacaggaacggcagggacagaaccatcaggaccaggaaccggggcagcacctggagcggtagctgtgccaggggcagcattggttccttgaccaggaacggcggtgccagccggagcaccaccagcggcggccgcggcgggtgcacttgcagcggtcgaagcgggtttcttaggcttaggctttggaggctgtgctccatcgggcaagggatttttccgtggacggccgcgcttccggggtgtaggagcaggttgctgtga

SEQ ID NO: 10997 - DNA, 450 bp, A.fumigatus
tggcgtcgcttgcttttgctgtggctgctgatgctgcgactgctgatggaactgatgcgtttgctgcggatgcgtttgctgggcttgggcttgctgcgtatgttgctgcgtatgctgctgcgtatgttgctgtgcctgttgagcgtagggactcggctgctgcgactgtctctgatgttgatgggcttgctgttgagcctggcgatgttgctgcaatgcttgctgcactgcttgttcgtgcggttgttgagacggctgggtttgtgtcgcttccgggcagttgtgctgctgagtctgctgctgcacatgctgtgctggctgtgttggttgtacttgggtctgttgtgcttgctgtgcatgcacctgttgggcttgttgagcctgctggtaccgctggtacggatactgttggaactgatgctgctgcggttgctgtgcctggtaccgtga

SEQ ID NO: 10998 - DNA, 522 bp, A.fumigatus
tggcggatcatactttctctgcttggcggccgtctagtaaaaaatggtaggaggttcctgctaccgagaaacaagcgcttgaaaacggccgacgggcgcgcctcggtaaagcaggaatcgggtgaaaagaaatatctcccttatcctgccggctatcagggctatccgacggtcgcgatgattactgccgcagtgaacgaaagtgggatcacacccgtccggctcggggaggagagcatcatacaattgctggagatgctctgctatgacaagaaactcgttgcgctgaacaatggccaattctacaaatctgtcaagaatcccgcagctgtgaaaatggaaaagaaccggaaaccggagggtgatgtggaggacgtgggtgataagctggtcacgaatggcatgaccgaagtaccctgcggtccatgccctgtcttcaagctctgcgtccctggaggcgcggtgagtccggagacctgcgagtatttcgatccttggctgcaaaaggccctcggtttttag

SEQ ID NO: 10999 - DNA, 210 bp, A.fumigatus
gtacatatccagatacgtatgtatgcatcgatacttaaaggaaaatttacctcttgtaagaactccttccatttcgataatctagctctctacaagtcacagatagtcagtgtcccctcaaaaattctggtactattatattacctcgagggctgcctgctgtgccatttaatttctgtccgtggagccgggatatcctccacagattga

SEQ ID NO: 11000 - DNA, 438 bp, A.fumigatus
ccttcctacgaccagcaacagcaccaccctcaatattccggtcctcctccttcatacggccaacaggggtatccgcctcaacatggcgctcctcaccagcagggcgggtacgcaggtgatcaaaactacgggcaaggcgcgccgatgaactatccgccacacgactgcggtcactctccgtatcccccccagcagcaacaatacaatccccaaggagcaagcgcatcttactatggcgctcctcacccggaacaacaccagcagggggcgcatgctcctgttcccgtcggacaggagggcgaaaggggcctgggctcgaccttgcttggaggtgctgctggtggtattataggcaaaaagcttggtggtggacttctaggcgctgcaggaggagcactagcaggcgctgcaggaatgaacatggccactaagatgtaa

SEQ ID NO: 11001 - DNA, 330 bp, A.fumigatus
gcagatgcagaaatggcgccgcaaataaaacacaaatccggtgattcagttcattcacaagcaccacagctctctgaccatcggaggtggcagtccttttgggaatggcttcaaggtcaatttcacttgaggcctcctgatgatgatgagcctcaagactggtggcttgcatctaccgcggtacctttagtcgccgctgccactggcccccttgcaaatgtcatgtcagttgttgctttggtcatgccatggagaagtcacatatccttcgaccagaaagactcgcttggaaacccattgcaagttggtttctctgaccctcgatggtaa

SEQ ID NO: 11002 - DNA, 1647 bp, A.fumigatus
ttggttgcggcaactgttgcgctgcatgtatttgcaagcccgattgcaccgaatgaactttactcgcaggcttactggagtgccgttattgcggcaatcctttattttattctcagcgtcatattgatcatcaatatgttgggatatatccttggccattatccccagtacttcgctcttaccgatggtcagcgaactctgatcctacagactttgtcatttgtcatctggctattgatcggtgctgtgatcttttccagggtcatagacatatcattcgcagatgcgctatacttctcggatgtaactatcttaaccgtgggattcggtgatattgcacctacaaatgccattggaagaggcattctattcccttacgccgtgatgggcatcatcatgctaggtctagtggtcggtagcattcatcagttcgccaaagatcttcagtatgacaatgtcattcgcaaacatattgagcggaagcggctagcaactatcagacgtgctactacattagaaaaaaagtgtactggcccagcagagaacggggctcacacgagtggctctggaacagcacagattggctatcggcctcattattcacgtgaacatcccatcatcagcagtatcagctcctggactcagggactggcgggtcggtcaaagcttatacttatgaaagaagaaaaggaccgatttggtgccatgcgcgctattcaaaaagaaacgatcatcttccgtcgaacatacaatctattattgagcatcgctatttttgggatagtgtggacatgcggcgcagtggttttctggcagttggacgaggatctttcatactttaatgccctatattttggattttgctcacttattacggtgggatatggtgattttactcctacaacgaacgccgcaaagccgttctttgtggtatggtctctcattgctgttccaacgatgactaccctcatctcggagatgagtgacacagtcgttgcctggttcaagaatgccacggataaagttgcagactggacggttcttccacaatcatccaagtatcaagcttttctccaaaggctgcctgtgatttactccgccctcgagcggcgagcggaaaagaaacgagttgctcagggctttcctattggcgacttagagccagggcaaccgcagaatgatgcggccgactttagccatcgcccgagaccactcgaagatctagctcgcgactcaaatccttctcgtcaagatttggcccagcaactcgcatttgcaatacgacggacagcaagacatgccctcgcacgccgcccgaagcactacagctatgaagagtgggttgaattcacgcgtctgatccggtttactgacaacagtcctgagggggtggtgcttgatgaagatgaatatggtgtgctgaattgggattggattggagagaccagtccgatgcttgcgtcacagacagagccggaatggattctcgatcggctctgtgaaagcgtgatacgatatgtggatggtcaaggtcgcagacagccttctgaccaggacgtaaaacctttgagtgtagccaacggtgacgaggatgtcgaggagcctacgctgaggaaggaaagagacatccgttttgaggatgattag

SEQ ID NO: 11003 - DNA, 441 bp, A.fumigatus
ctcaaaaaatactactccctgctcatgtggctgttgacgcgtacaactgcacagcgaaacaaccaccatccccaaaacctcgaactcaccagtcaccacctcccacaagtgacacaacaccatgctctacagctgctaccgccgccgccgaaaactcaagcgtctcgtcataatgctcctccccatcctcctaaccgcccttttcctctcccccctgtatctgatctacaaaccgccaagcctcctcatccgctacctccaacaccgctacccagacgtcctcttccacgtcccgcgccccagccacaagaagctcgtggcgctgaccatcgacgatgccccctcgcaatatacaccgcagatagcagcaacgctaaaggcgcacagcgcatccgcgacgttctttgtgattgggtcgcagatggacggggacgggcgtga

SEQ ID NO: 11004 - DNA, 792 bp, A.fumigatus
cacaacaccatgctctacagctgctaccgccgccgccgaaaactcaagcgtctcgtcataatgctcctccccatcctcctaaccgcccttttcctctcccccctgtatctgatctacaaaccgccaagcctcctcatccgctacctccaacaccgctacccagacgtcctcttccacgtcccgcgccccagccacaagaagctcgtggcgctgaccatcgacgatgccccctcgcaatatacaccgcagatagcagcaacgctaaaggcgcacagcgcatccgcgacgttctttgtgattgggtcgcagatggacggggacgggcgtgaggccgtgcttgcggacctggtgcgcgcgggacacgagctggggaaccatgctatgcgggatgagccgtcgcgtgcgctgagcgatgaggagctctcggcgcagattgcggaggtgcaggcacggataagtcgggtgtatgcgcgggctggggtcgaggaaccgcggcttaggtggtttcggccgggaagtgggtttttcagtgagaggatgaggaggttggtggggggaatggggctacggattgcactggggagtgtgtatccgcatgatccgcaggtcccgtacgcgtggatgaatgcggcgcatatcctgagtatggtgcggccggggagtgtgattatctgccatgatcggaggagttggacggtgccgatgctcggcagggttttgccggagttgaggaaaagggggtatcgggttgtgacgctgagtgagttggtaaaggatgcggagaactcataa

SEQ ID NO: 11005 - DNA, 768 bp, A.fumigatus
acatgttaccagcagataacccggcccccgccgggaagcaaaccatccacggaaccattcttcacgaatcatttctgtacccgaatcattgacccagaaacaggcatgtacctgccaaagttcaacgtctgcgccgcgtgtattcgcaatctgcgcattcttatgccgcaacaccgcgagacgttcacaagaagcgccaccatgcaggaacaggtctgtgatttcgtggcggacagtccgcggttcgtccaatacattgacctgctggacattgctgcaaatcgtgccgagctcgaacgctcaccacggcccgacatgactgcgttcctggcttacgctcgtcgcaaggtcgtactacgagactgtcgccgggatcggccggttcttggtacgtggtactatatgccgcagctgcccgagttcacggtgtgtgaggattgctacgacgacgtggtgtggccgctggtcaaggcgaataagcccatcgcgcggcaattcttgaccaggatgcggctcgcaccaggggatgcaccgactcgatgccgggaagccagctgccagctgtactcgccccggatccgggccaagttccgcgacgccgtgcagcgaaacgatctggcgtacctgaagctgatcgcgctgaagcgctacgacgttgagcagcacattcgagaacggcgagaggagttattggaggaggagagcaagggatatgactgtgacgctgagctgcggaagaccttgctcgagtggaggaggtgggagtga

SEQ ID NO: 11006 - DNA, 414 bp, A.fumigatus
aatcatcgcgccatgtctgccgcacgcgcgaagttggcagagctgcgagctcttcgtgcagcaggaaagaaacgtctatcaacatacgagattgaagaacaagacgacatcttcgaagaggtcgatgacgaaggttacaagaaaattatccgtgaccggctggatcaggatgattttgtggtcgacgacaacggtgaaggatacgcggatgatggacgggaagtctggaacgaacgagtagcggactacaacagcgaaagcgacgatgaggagttaccaggacgcaacaaagctgccaaaaggaagcgggaagaggacaagcagaggaaagaaagaatcaacaatggtatctcaaaatacttcaacactggacctgctgcgtctgctccgaagccgaaagtgagtcttatttga

SEQ ID NO: 11007 - DNA, 1644 bp, A.fumigatus
  unsure (1531): Identity of nucleotide sequences at the above locations are unknown.
cctgttgtcacagcagaagatgaagctttcatggcagatctccttggagaagtcgataccaatgtcgtcgcgaaccatgtccctatacaaaatgtgatcaagtcggaaactcgacgcaaagtccgcattctttcgcctccgttagcctcgaagccacgaaatgagaggatcagcggaaaggacgagaacagcgagccggtctcgcaggttaaccaagcaccggatctcgagttcgaagacgacgatggaccgctccctacaatggatgacggcgacgtggccatgagtgatcctatgccatcttcgcccattagcaaagtagttgagaggaaatcgaatgtcaacgtaaagaaggaagaatctgatgaagaggacaacgatctcatggagattgctccagcaacaggacaaagtgaagccaaaatgactagcgttaacatggctggaagccgtccgcctccgaagataaagaaggagaattatacaactcctgcgagttcttctcccgcgaaagcacctgtggacgttctgaacgcttcttggaacgacgtccggagtaaactgaacgtccttagtagtccagcaacggaatcacggactttcggtaagcttcgtgcacaggatgtgatcgaagaagacggaagtttgcggatgttttggctcgactatacggaagtcaacggcagtttgtgcttatttggcaaggtgaagaacaagcacaccggttctcatgtcagcgctttcgtcaaaattgacaatatcctccgaaagctttttttccttcctcgggagtacagatataaacatggccgagtgaccgatgaggaggtggatatgaaagatgtttatggagaggttgatgagataatgtccaggctcaaagtcgggatgcataagatcaagccgtgcacacgcaagtatgcgtttgaattgcccgatattcccaaggaagcagagtacttgaaattgctctacccgtacgacaagccggcattaccgatggaaaccaagggcgaaacgttctctcatgtcttcggaaccaacacctctctcttcgagcaatttgtgctttggagaaacgtcatgggtccatgttggctcaagattgaggatgcggattttacagctgtcagcaacgcgtcatggtgcaagttcgagtgtcaggttgcaagacctgcttgcattacacctgtgcctgacaccgggaatctggagccgccgccccttacactcatgagtcttgctttcaggactcaactcaatgtaaaggagaataagcaagaaattttggtggcaagtgcacgcgtttacgaaaatgtctcgctcacggacactactcctcctgagaaactcccttgcaagacattcactgtcatgcgaccagttggctcttcataccctcttcatttcgaggctgagacgcgcaagcaacgaggcactttcatgctggaaaagagcgagcaatttctgctgagcaaattcctggcattgttcgaaaaaatggatcctgatgtccttatgggacatcagntacaagaagtcgacctcagcatttttctcagtcgcttgaaagaaaagaagacccccggctggcatcgcattggacgtctagtcttcaccacggggctggaaggaaccgcgatc

SEQ ID NO: 11008 - DNA, 195 bp, A.fumigatus
cggtggatctgcggatggaaaaaagaaaaaaattacatacagtgtctaaattattacaaacagaggaaaagaaaaacacacgatttcctcccctcttggatttctttcatatccattcacgaagctttctctctttttacgctcttcctttctcaccatctcctcttttccctctttttctataccaccttctag

SEQ ID NO: 11009 - DNA, 306 bp, A.fumigatus
tttcttatatttaatattaattattcacttgagtacaagatcactagtctaattcatcagctactctatactattaagtatatatacttaataggccttgcttctatctctactgttattattcttgtgttatctttagttgtctttaacccttggttgggtcattatatcactgtgttatcaggctatctggtcaataggcctcaggcaagtattagatatagtctagggactatatcaccccattcccaaagtagtagactagcagagaacagcagagatggatcccagggtgtgacaaattaa

SEQ ID NO: 11010 - DNA, 279 bp, A.fumigatus
cttgcagccaagtctgttaagattagactacctaaaccatttgatggtactcagactaggttgcaatcattcctcacgcagctggacacgtacattcaggtcaataaggaaaagctcacgaatgaagctgacaaggtcctctttgctaccacatatctcacgggaccagcattcaattggtttgaaccattcatcagagactaccaaaccaatactgtgaagaagcaggacgacaatactaaggaaatattcgccagttatgccgagttcaagaagtaa

SEQ ID NO: 11011 - DNA, 195 bp, A.fumigatus
atacaagccacaaaggagctcagtaccacagctggcagagatggttataacaccactagcatcatcacaccaaagaaagtagataaacaactcaggaagttgtacaaggaatatatgaacttaagtgacaaagaaatcaaggaggaacttgagaaggaagaccccactaactatgaaagcacaaacaatgattag

SEQ ID NO: 11012 - DNA, 267 bp, A.fumigatus
ttcttaagctatggaatccctaacaccacatcataccatcctgttggcataatattaaagtttagatgtttaatatgtcctaatataaccattaggactagtcctgattcagttatgattgagagagttcctaaattttctctatttagacctataattagttcaggtactgcctttatttttcctagaatccctagcttccttataaagactgggtttataaagttacctattactcctgagttaattattacttcagctaattaa

SEQ ID NO: 11013 - DNA, 666 bp, A.fumigatus
agagtggatacatcgtctggtgacccaggcccagagcaagatgaccaatttattctggacgattatgatagtgacgctgatgaaaggatggcttcttccaagaaactgagtgatatcagtggactctcaactagtacacttgaactactggagcgcttcaaggagcagttctcggctcccgtcgaggatgaaattggacatgaagacgatgatgttaagatcttctattgttcgagaactcactcccaactgtcccaattttcaagcgagctgcggcgcgtcaaaatgccttccagcatgccagcggagctcagcacgagcgatgcaaacactgacgacgtccaagaacgcgtgaaacatcttactcttggttcgcgaaagaatttatgcataaatcccaaggtaatgtccctaggaaacgccgctgcaatcaatgagcgctgcttggaactccagcagcctggcatagctgccgagaaaagatgtccttacttgccatcaaaggaggatgaggggcagattctacaatttcgggatcacactttggcgacaattaaggatattgaagacatgggaaagcttggtaagcggatgggaatctgcccttactacgcatcccgctcagtactcaaacacagcgaggtatgttttggatatgccttctga

SEQ ID NO: 11014 - DNA, 597 bp, A.fumigatus
acgtcacagaatgtcctgctgaaagcccagaagattgtgacccttccttatcccttactactccagcgctcggctcgagatgccctcgatctctcaatcaagaatcacgtcgtcatcattgatgaggcccacaatctcatggatgcaatatgcaatatacattcagtaacaattagactatcgcagttgcagactgcacttctccaactaacaacatatgcacacaagcacaaggcgcgattgaaagggaagaaccgaagctacatcgctcaaatcatcagactcgtcagttcgattagagaccatcttcgctcaatcttaggccaaaacctgcctgcagaaggcaccgtggatccgtcagatttgatggctggtaaaggcgtcgatcaaatcaacccctacaagctatctcggtatctacaggaaagcaagctggccagaaaggtcgacggctacgttgaatttttgaaaaacaagaatcaacaatcggacgacaaaccttcatcacctgtccttttccttgttcagagctttcttttatcattaatgaatccctccccccgaaggccgatttttctatctaaagtgccacgatga

SEQ ID NO: 11015 - DNA, 222 bp, A.fumigatus
atgagtgattatcgaaatcacctattttcctacattgccccaagccggctagacactttcagttatggccacgttattccccccgagaacctcattgcacacacgcttgtcaacggcgttctaggttccgaatttgactttacttacgactctcgcgattctgaaaagatggtaagagacggctttctcgcgcgtggctacttgaactttggaactttctaa

SEQ ID NO: 11016 - DNA, 237 bp, A.fumigatus
  unsure (56): Identity of nucleotide sequences at the above locations are unknown.
tataccaaagtcaacctggtgaagcgagtaactggaggcacctcgagcatcatggngtctcaactacaaaacttcaaccatccttactctccatatgacatacagctccagttcatgcgcgctctctacacttgcctggaagaaggaaaagttgccgtgttcgagtctcccaccggtaagttcagcttcacctgccgcttggtacccgcaactaatcacatgctacaggcacggtaa

SEQ ID NO: 11017 - DNA, 276 bp, A.fumigatus
attcttgatctcggacggactgtggctaccttgtgccaggctatcccagatggcgtcgtcgccttctttcccagctacgattatctcagccgaatagtggccatatggaggaagcctctcgagggcgagaagggagagactattctcagtcttattgaacgagaaaagtctattctatacgaaggccgggacatgggcccgaagacggatgatttgctacaagaatatacaagaactagtcttcaccacggggctggaaggagcagcgccagtcaa

SEQ ID NO: 11018 - DNA, 423 bp, A.fumigatus
gcgatgccacccgcgccgcccgccgcgtcctcatatccacaatccccagcacgaatctgctgtccgccgcggcccgcggcgcccgatccgtcgacgacgaagaaaacgaccgactcctttctttctccccccgcctcttccactccaacacgtactctccagcctccccccgtccctgaaaccgataccagccttcagccgtcacactcgcggaccacgcgcgcctcgtcagcgggaaatgcacctccgcctccgcctgcgctggccccggcccctcctttctcgcttttgtcttctgtgcgggtgggtggtagatcactccgacgactgcttcaaggctgctggcctccgcctctgcctctaagcctgaattgggatggtggttctcgccagataacgaggcgtatgcctcgctctgggtaa

SEQ ID NO: 11019 - DNA, 951 bp, A.fumigatus
aaagcagtggacggtcgttctggatatactactctcccactgctccgtctagaagcctacctttcatccgcagcacgtcatccaagccaccggccactccggaaagaagatcttccccggttcaaggggatggagtcgttcaaaggtgatcgcctctgccacagctccgattttaccgaagcgaatcccgcgtccaagggcaagaaagcggtggtcgttggatccggtaactcgggccacgacattgcgcaggagttttacgaaaagggttacgacgtctcgatggtgcagcggagcactacatgtgtgatttcatccgaatcaattgtcgagatcgggctcaagagcctctacggggagggtgggcccccgaccgaagactcggacctgtacctgtggagcatcccgaccgagctgttcaaggcgcagcagatcaaggtgactgccgctcagaatcaacgcgatgccgcgatcctccaagctttggacaaggccggtttcaagctcgatatgggctcggacaacgccggtctcctgatgaagtacctgtcgcggggcggcggctactacatcgacgtgggcggcagccggctcatcgcggacggcaagataaaggtcaagcagggccaggagatcaccgaggttctcccccacggacttcagttcgcagatggcacgcagctggaggcggacgagatcgtctttgccaccggctaccagaacatgaagacgcaagcgcgagccatcttcggtgacgaggtcgccgatcggatcgatagcgtctggggattcaatgaggaaggcgagatgcgcacgatctggcggcagagcggtcatcccggattctggtttatgggcggcaacctggcgctctgccggtactattcgcggttgttggccctgcagatcaaggccctggtggaaggcatcaccacccatggagcgaagtag

SEQ ID NO: 11020 - DNA, 666 bp, A.fumigatus
accggcccaatgaccgttcccatcactgatcatccttccaaggatcggatcgcaccaggctctgtcaatgtgcccgttggaaagtttccccaaactgcctcctccacatctgttgatgctgccaagctcgcttcagaggcgattgatcaactgaatagtgctctaaagcagaaaaactacaaggccgtctcggatctgtttctcgaggacgcctactggcgggaccatttaggtctgtcgtgggattaccgaaccatcaaaggtagagagaacatcgccagcttcctcgagcattccacacggctggtccaggttgagattgaccagtcatcacccttccgtgcgcctcatgtcggcccaattgatgcgttcggcgatgtcaccggtgtggagttcttcactactttcgcaaacgatgtagggaatggaaggggtgtggtccgcatggcggagaaggacggcgtctggaaaatcttcactatcttcacgaccctccaggagctcaaggggcatgatgaggccgtgaacgccagtcgaccactgggtgttcagcatggggcgcaagtaggtataaaaaactggcatgatatgatgacctccgactttgagttcgaggaaaagaccccagtggtcctggtcgttggtatgtcgccatttctggactga

SEQ ID NO: 11021 - DNA, 372 bp, A.fumigatus
caagaccttgtactgacttggaaaggcgctggtcaatctggacttacggtcgccgctcgtctcaagatgctcaatgtcgacacactggtcattgatgaggaggatcgcatcggagacaactggcggcggaggtatcatcagctcgtgctacatgaccccgtgtggttcgatcatatgccgtacctgcccttcccttcgagttggccggtcttcaccccgaatgacaagttagccgagttcttcgaagcgtatgccaagcttcttgaactcaacgtgtggactcggacgacgctcaaatcgtcttcgtggaaccatgataaaaagcagtggacggtcgttctggatatactactctcccactgctccgtctag

SEQ ID NO: 11022 - DNA, 201 bp, A.fumigatus
acgccgtcttcaggcacctatcctttgaagccttgtcaggtgctgcaaatgcttgacgaaagtaaggtaatacctccgtattacatttccagcgcactggctgcagcaatgacgcacatggtgatcctgctgaagcaaaatggaccgtatcaacaagacaagagtgaaactatcgaaggatctataggcacaatgaaataa

SEQ ID NO: 11023 - DNA, 549 bp, A.fumigatus
cctcttcctctcaaggccgaaccccatgtcaacgagcaggcaccgcagtcattacatgatcccaccgtctacacccgtcaccagcatcccgtccggctcgctcgcggtccattcccacgtagagatagcgaccccaatcctccggcgggcggaaaagtggcaggtccgagggaagccgatccaatccagcaacgcattgacgagatcgtttcgcagaacatgccgtcgcacggtgctccaccagtaccaccaccatccggagccggagcgcgaatccccaacagacgaaactcagtcgatcgccgcggacccgatcggtaccgcgggtacgaagatcccgcgagacgacggcggtcgtccttcggaaggaggtcgcagtccttcgaggaacagcctccaccgctcccaggacaccctcatcatcaacctttacccccaccgccaccacctcccgatattcctcagccaccacctccacccccgccctcccaaacgcaacaagctgctcaggaagacgaaggcgggggcagtgaagaaggagagctttga

SEQ ID NO: 11024 - DNA, 1656 bp, A.fumigatus
ttgttcgaacgttgccgtcgctgtcctcgaccgggattctttgccgaagacatggatgcaccgatgcatgatgatctttccgtgggagatgtctttgcaccccaggcggacatgtcgcaaccttgcaacgatgccctgctcggcaataatcctgatactcgcttttgcatgagtggtggcagtcctagtcgcaagcaagttccggtcaccaaggatgtcaatgaagttgatccttttccagcacacaatctcaacattgaggccttgtccggcagaccagaccgtcgcaaaaagaagaagaaatgtcagacaagtgaagctccccgggccatatccaccgttcgcggatttactccacttgcctctggcgacgaagactcggatttctcgaccacaagcgctaaggctcgtccttcgtcacgagcagccgcttatgcagagagcgatggaaatagtcccatggtccagcctgctggatgtggcgtgagcgctctgaagcttcaactcgattcgctcagtctgtccggcagcggtagcgctcaggctgcgcagagtgacctgtgctctgaaactccgagcaatgcaagcgtttgctcggacagcgatcagacagaggtcctgactagttacgaagtacccctggaacatgatttcgtcagctccgatgccgcagcggaagaaacgtctgcgagtcttcctggtgcgcaggatgtccgcactcagctatgccgcaagatgacaaccacagactttgagccgttactctggctgggcaaaggctcctttggaaccgtactgcttgtacgtcatgcgctcactgggaagttgtatgctcagaagcagttccgtaaggcatcgctcaccgttcacaagaaacttgtggagcagaccaagactgagcgcgccattttggaaagtgtgaaccgtcatccatttgtggtgaaactgttctacgcgtttcaggatcacgaaaagctgtacctcatcctggaatatgcccagggtggtgagctgttccaccacttggccatggaacgcatgttcgacgaagatgctgccgcattctacatggctgaaatggttctcgctctcgaacatctgcaccagaatgtgggtgtgatctatcgcgacctgaagccggagaactgtctcctggaccgcgatggccatctgctcctgaccgacttcggcctcagcaagatcgcagtccacgatgacgatcgctgcaactcgtccctgggcaccattgagtacatggctcccgaagtcattcaaggcaaaccgtacggcaaagcctgcgactggtggtcacttggcgcactcgggtacgatctacttaccggctccccgcccttcaaggccaaccacaacgccaagctgcaggaaaaaaatcgtcaagcagaagctcaacgctgccctatttccttggtccggatgccaaagactttctcacccgcctgttgcgcaaggaaccttccaagcgactcggttaccacatgcccaaggacgtgcagaccatcaagaaccatcgcttcttccgcaagattgactggaaagcgctcgagcgtcgcgaggttgctccccctatcctccctgtggtcacggacccggctctggcggagaacttctctgctgactttaccacccttccgctga

SEQ ID NO: 11025 - DNA, 597 bp, A.fumigatus
gtacatggctcccgaagtcattcaaggcaaaccgtacggcaaagcctgcgactggtggtcacttggcgcactcgggtacgatctacttaccggctccccgcccttcaaggccaaccacaacgccaagctgcaggaaaaaaatcgtcaagcagaagctcaacgctgccctatttccttggtccggatgccaaagactttctcacccgcctgttgcgcaaggaaccttccaagcgactcggttaccacatgcccaaggacgtgcagaccatcaagaaccatcgcttcttccgcaagattgactggaaagcgctcgagcgtcgcgaggttgctccccctatcctccctgtggtcacggacccggctctggcggagaacttctctgctgactttaccacccttccgctgagtccggtcgtcaccagcaacggctttgacgattattactctcttcgccaacgccccagccaacgcgcaatgtcaacaggtccggatgggatgagttgcgacaatgacccgttcggtggattcagctttgtggcttccagcagcttacttgacaacaatggagttggcatcacgacccaatgttaccgataa

SEQ ID NO: 11026 - DNA, 903 bp, A.fumigatus
ccattgagaacaataggagacgacgcagagaaatcccgtttggaagagctagcccaatcgtatgatccagtaccgtactggacaaatatccatccatatctgctatccacgattcagcatggtttacgagcttccaaggccctccctacaccctccgatggcgaccaaaccaaaggcgaaccgtcattagataaatacctgctcgccgagatcccagccacaacactgcgccgcaatgcgcgcagcccaagagaacccgtcaacgacttcctagcacgcctgcctccatctacgacaaaagagagagacgtcgggccatggatatacgtgacgaacccgcaccgtaaaatcgatccagacgagcaggctatcgcaaaactggtccgtgagggaaccgaactacttcacagattcgaggaccagaaagcagagctggaagcggagcatgatcgctcgaggtctaaatccaaggcagcgctgacgcgcaggctgaacccgttgcggcggacattggagcaggatatcttcgcgctggcgcggagaacgggtgtcgtgtctgggaaatggatgatgtttataaacgccgatcaagtggataaatattgggaggctgtcgcgactggcaccgtgtctgggaaattgggcgatgcggccaaagttgcgaccgacgatggcacagggaggccgcggttgatcgcaatctacacgaaagattatgcggataggcaggacgtgaaacgtgtgcttgaagggatggtacatctgggacttgtaaagactgacgacaggcctatctactaccactgtgatgcatgcacgtacctgcgcatcctgagcgataacccatacggcctcaaggcgagcatggcctccactcggaatgtgttggcacgtaaggagtga

SEQ ID NO: 11027 - DNA, 234 bp, A.fumigatus
agatatatggggactcatcctttgattttcacagagatcggcattccgttcgatatggacgacagacatgcatacaagacaggagactatagcggtcaagtcagtgctatggacgcgaaccacttcgcaatcgaaggcagcaccgccaacggcttcacattatggttatatacaacatccgtaagtatttccatgctaccgcgcaccaaaagttttcatacattcagcaactga

SEQ ID NO: 11028 - DNA, 657 bp, A.fumigatus
cgcatacgtcagaacaatcatgaatggggtgacaactggaatggggaagacttgtcaatatactctgtggacgatctagagctgccaagtggcaagcttcttgcgtttgagaacgaatcccaacgcgatcctcagtctccagcatactctgaaagccagcgcaacaccgaaagctaccgagtgggtccacgcgatttgaagcaggctcttcaagcaccctctatatcatccgaaatctctcaatcatcccaggacaagctagggtttcgagctgcagaggcatgggttcgtccgagtccaatcataacaaacggccagatattgcagtacgggttcgacctcaaaagttgtgtgttcagcatgagactacttggggaaaagaaagggttgggacaagaagcagcaacggagatttttctccctgactttcacttcccagacactcacactgtagttgctgtcagcgctggagagtggacgattgactatccagagatacattctgtcaaatttcagcgcctacgctggtggcatcccgagggtgatcataacataaagatccagggcgtcaaacgcaagcctggcgacccaacagtctctggagaggagctatcatatcttgagcaatgccagggaggcggatgcagtgtgatgtag

SEQ ID NO: 11029 - DNA, 981 bp, A.fumigatus
aatacagaaatggaaccattgccagatgctatttcggctgatgcttcgcagttttcttgtactttatccaatggcgccattcaatgcagtgaacttcaggggcagagggagcataggattgctatagatgatgtgatctgcatcctaccacatgctagccaagatggaaaaaagtacaacatgctctatctacgaaatggtcgaaatgaggcgacgtctgttcagccgggagattgtggatcgtctctgacaagtgtacaactggtttctccaccatcgacactactatcacgatatttctgtgcggaacttccccaacatctcaagccttcagtggaccacgcgattgatatttatgtcattatctcgattccctcagggacagggaaggctaagaatttcttcaaaaacattttacaaccgttcttggcacatatcggattgacggagtatgaggtccatgagacacaatcagcgcgatctatactcgaactctgtcaatcaaggcttattcctcgtgcaaaactcggtgttgcccaaacaattattcttctttctggggatggtggcctgaacgatattgtcgattcgttccatggcgctgttggtgttccaattgtgcctccaatcgtcgctctgataccgatgggaacgggtaacgccatggcaagctcattagggctgctctctcgcccggcagaaggcttgactgtcttgctgaaagggtcaccgaaacctatacccaccttagtcgctaatttttctcctggcgcgcaatacgtcacggatgagggccacactctgattcctatgcttgatagctccaagaccaagtcctcagtgaattcaattcacggcgtggttgtcgcaagctggggtcttcacgctgccttagttgctgacagtgacacttctgaatataaaaggtttgggggccgagaggttccagatggcagccaaggagctccttttcccttctag

SEQ ID NO: 11030 - DNA, 522 bp, A.fumigatus
ttgctgacagtgacacttctgaatataaaaggtttgggggccgagaggttccagatggcagccaaggagctccttttcccttctagcggcgccgagacgcacaggtataaaggcaatatcacattatttcggtctaacgtagcgaccaatgaaaactctgtggacacactagaattcggagaacacatgtacgtactcgctacactcgttccaaggcttgagaaagacttcctcatctcgccggagtcggttgcattggatggcagattgagaataattcgttttggcgctgtctccgcagaaaaggcgatgcaactaatgtctctcgcgtatgatggggggcggcatgtacacgaaagcagcgttctctacacggaacttgaaggattcagaatcgattttcgtgaggctgagcagaagtggaggcgagtttgcatagatgggaaaatcgtcatcattgaggaagacggctggatggaagtgctgaaaggatctacgggtcgcgtaaatatactggtctaa

SEQ ID NO: 11031 - DNA, 1119 bp, A.fumigatus
  unsure (941),(986): Identity of nucleotide sequences at the above locations are unknown.
actatcggactgaacgacaagctcggcgtgtctggattctgcataatggattccagctgtctttattccaaagaactacaacttgcatgcctcacggtgcaacgggctgcactattgacgaagaaattgctcgaggctgtcgacaaaggatctttcgacaagagtgattccacgcctgtgaccatcgccgactttgctgcccaagcacttatcattggcgctatccacaaagcctttcctgaagatgagtttgtgggtgaggaagactcaaaggctcttcgtgcagatccagaacttcttgagcgcacatgggaactcgcgtctactactcatctcgatgacaaggacagtgaagcccttctctacgctcccaagtcaaaggaggaaatgcttgacttgattgatcttggagctcgtggtaggtgtagcctggagaatcgtgcctgggttttggatcctgtcgatggtactgcgactttcatgcagggccagcagtatgcggtatgcctggcactggtggagaatggatgccagaaggtcggcgtgttaggttgcccgaatcttaatcttgctacgggccgtcttcgagaggatgttgtggatcgagatggctacgggtctcaagtctttgcagttgctggtcaaggcgcctggatacggaagatgggacgcgggggtctgctcgctgctgagagtatccctcagaggccacagattacggacccgaaggacctcgatttcgtggattgtgggtccgctacatcatctaatacctctttgcatgctcgagtggcatcgaaactgggtgctccgtggccgtacagcactgatctctgggctgcacagttgcgctacatagccattgcggtaggaggctgcaacgctttgatcaagatcccccacaaggcattatatcggtcaaagatttgggaccatgcagncggcatgttgattgctgaagaagtcggcgttaaggttactgatcntgctggaaatcctgtcgactgcagcttgggccgaaccctagctggatgctacgggatgatcgtggctcctccttccattcatgaacggatcgtcgaagccgtaaaggaggtcatgcaggaacagactaagtga

SEQ ID NO: 11032 - DNA, 852 bp, A.fumigatus
  unsure (772): Identity of nucleotide sequences at the above locations are unknown.
tattatccatcactcaatatgattggcaatccaggagcgttacttgtcgatatgaagaaacaaggcttgtttgagagttttgataagtcttaccatccaacctacggaataggcacaatgtctggcaacatatacgatacatcgtggatctcgatggtgagaaagcccacggaaggtggatctgtctgggcgttcccagctgccttccaggctattttacaagagcaaagtccttgtggcagttggggtggaagtacttcggaattggactgtattgtaagcaccttagcggctcttctttctctccagaaacatgcaggcgactgttgtgaaatggagtttgaagatttgcactcaagaatcctcaaagcaaaacaattcctacagacagcgttgaaaggcttggatcgcttgctggcaacttgtacgttgtctgtgggcctagaagttcgattaccagaaattctggatctcctggaattggaagggcatactttcaactttgatcgaacatacctgactgagattcagtcgaagaaactttcgaaaattaacctggaaacaatcttcaacggcccacaatcgtctcttttacactctttggaagctgtgataaggaaggttgacattaaggccctgggacaccagaaagtgctcggcagcatgttagcatctccatctgccaccgcagcatatctcatgtattctcctgtgtgggatgatgaggctgaagaatacattcggcatgcaatctccaagggtgcaggtcganggtcaggtcttgtggccgcaggatatccgaccactgtattcgaatgggcatgggtaggtttgaacatgttatggcaatga

SEQ ID NO: 11033 - DNA, 300 bp, A.fumigatus
acagttcccaatgcatgtgctgatgccgatgacacagccaaggcgttagtacccctgatgctgcaaggaacacgctactcgccccaggcattagtcgatcggtttgagcgagaaaaccatttcgcaacctatctgtacgagacgcatacaagcgtaagtacgaattctaatgtcctggctgctctggtattgctttcgaccgatggccactaccaaccgcaaatcgaaaaatgcattcgctacctgtgcgaggcatggtttaactgtaacggaatgctcaaggataaatgggtatgttga

SEQ ID NO: 11034 - DNA, 906 bp, A.fumigatus
accttgactttttcgattgtttcgcctgtatttccccctcattgcttcattattcctgtcctattgtttttctatacccttggagcttttgcttgccaagttatattgggttctcgcaggtctctcggaaccatgtcactgcaagtcaaagacccacggtcgcgcggtcgttccaagtctccgagcggacgcatccgcgatcgttccaaatctcgtgacagccgattaccctctaccgctcccgacgctgcgaggtcatcggagagaaagtatctcgctaccgatgcgagggacgaccatctgcgctcgagatctcgcggcccgcgagatagcaacacttcagtatctagtcatcgaaaccgttctcgatacgatgtttcggactcagcgtcagaacgggatgaccgcaaggacagatatctgcgcagcgagcgacgtcgcgaccactactaccaatcagactcgggagaaagcaagcttgcaaagcgtgatgacagaaaggactatgcgcggtcgccaaatcttcgaccagtgacgtatgagagtccctcggatgacttctactcagatacggacgacgaggcgctggcctacggcgatgcgcctagcgatctggagcgtgatttctacggatacagaaagccagcgcgtgcgtcctcgcctcgcgtagatggtccagttatgtccggggcgctcaatggtgctcctccagccaagcacgattcgtcgcgttcccgtcatgcttcagatgaggacattcccggtcatcatcccagctatgccagacccggacagttccagtatgtcatgccgtcacagtatggccaattccagcctagctatcctccgacatcatctgcacgtcttcaccacggggctggaaggaccgacggtggtactacggtc

SEQ ID NO: 11035 - DNA, 570 bp, A.fumigatus
gggggttgcagtgatatcgtcagcatgcttctgaataagggtgccgacacagatctgggcgataacacaggcagtactccacttcatacagcagtatggaaaaaacactgcaaaatcacccagctcttactagaaagaggagcagccgtgggctcccgagactcttatggacgcactgcgctggacatagccatgacacacggctctcagcgatggctgtctctgtttctgaagcatgcgaaaataaatgctcaggattgccagccgctgcatcctgccatatctctgaacaagaccgctgttgtcagatggcttctcgaaaatggtgccgacatcaatcgcaaagattcaagaggccaaactcctctgctctatgctatgctggaggcacatgaccatctcgccgaacttctgttgctttacgatgtggaccctgacgccgaaagatacgacgggctgacaccgttgaagctagccagtgaaataaaccgggaagattgggcgcaaaaactgagggcgaagcgtgataaacacaagtacctcagtcatagtctccattcgacttcctga

SEQ ID NO: 11036 - DNA, 531 bp, A.fumigatus
cgggtgcgtattgacagtccacatgcagacagtaaagctaaattgcaattcaggtccattggcatgctccttgggtatcatctcctctggtcgactacagccaatgtggtcggcaccgccgaacaagccgatcgtctgcagaaactgattatcacgaacaacctcttcgtcggaggagcagtcaaccctcgcgacaatgacttgcagatcacggcggatggcgactcgatcgtcttcaacggattcaagcatttcaataccggtggtgtggtttccgatctcacggtcctagaaggcgtgctggacggaacacaggaccatatattcgctgttgtggaaaccaaccaaccaggaattcaattcgcgtacaactggaagaatattggtttgcggttgaccgagtccggaagcgtgaagatcgaaaatgttcgtgcatcttggacggatgcactgggatgggacgcaacaaccaaacgacctctggcggagattctcaccatcccttttgcctcgttgtttctgcctacgtaa

SEQ ID NO: 11037 - DNA, 456 bp, A.fumigatus
tcgaacttcccacaaatggcgcaagcaaacgtcccagcaacagaccccgcagtgtacgacgcctacaaggagatatgggctgctctccccgactccgcagacgcatggctcgcacgggcgcgtgaagtggcagaagttctggcccaggacgcagctcaaagagaccaagacaacaagtctcctcgcgcagaggtcgccttactgaaacattccggtctgttgaagcttctcgggccgaagaagtacggaggcggagaacagccgtggcgggtagggtacaaggcgatccgcgaagtagccaagggtgacgggtgcgtattgacagtccacatgcagacagtaaagctaaattgcaattcaggtccattggcatgctccttgggtatcatctcctctggtcgactacagccaatgtggtcggcaccgccgaacaagccgatcgtctgcagaaactga

SEQ ID NO: 11038 - DNA, 657 bp, A.fumigatus
aggaggccatgtactcccgtgcaaaggtactctctatcaatctcttcaggttcctatacttatgaccttgacagtgtatgtataataatgggggcgatgataaaatcacgcagatgcaatctgccctgctactcggattctggcactcggagtatgaacaaccacgcccagccctggtactggacgggcattgcaatcaacctcggccagatcatgggtctccatcgcgatcctgacgcagtcaagtttaatccatccattacaggccgtcggcgagctttatggcggcgcctatggtggtcatgtttctttcgagaccgctggctcggcctcaccctcggacgtccgctgaggatcaacctgctcgattgtgatcttccgatgccctcaaccgcggatgtgatgagtgacttatccgaggtgtcgccgtcggtggcaagtctgttcatcccggaggacctggcgcagttaagtgagtattggattctcctgctgcgcttgtccaagatcctgggggatgctctgaccctgatctaccacccaaaaaggccgaaccctactattgagcaatttgaatcactagagtctgatcttcccactctcgagattccgcacgagtgttgctctgaccacaccgagtgcgcccggtttgccgtc

SEQ ID NO: 11039 - DNA, 753 bp, A.fumigatus
aataatatcatgcaaaaagggctatttcctgactgtcacagccagcagacaaggaatcaaccattgcgcgagattcgcgcgtttcctcatccgagatccagcccgaggcggaacgacaggacatcccaagtcggttccggtgagacggtcggtggccgtacggtttcgaatctcgccagggacatgtcgcagtccggacgggctgtctcagagccaacggctgcgacaggaactacgaccccgtattccgagcaaagccggatcgaagacgaagagcgcagtgcggcggactttgccacggcttcgctggcgccccgggatgccgaagcaaatgatatgcctatatacactggtctgcttgcttgcatgacccaatgtattcggagacagctaactgtagtaggcgaatctttgggattctctgcggttttggatgttttagccacacatgcggtccccagacatgtcttccggccatcgtcgcatcctagtctgaccgctcaagatgtcgagtatctcaagttcaaaggatgcttgacattgccatccagtgatatatgtcgcgagcttcttcgtgcttatttccaccacgtgcatcctattctaccggtggtggatgctgcgcaggtgttgaagtttgagcagcagcatgaccgaccagccgaatggaatttgctgcttttgtggagcatcttttttgtggcagtcaatgtcagtatctccccacgggaaccacatcatctcgctcactga

SEQ ID NO: 11040 - DNA, 408 bp, A.fumigatus
ctactgatactcttcacagctgtttccgttgctgtcgtctcccagtgctctgctgccggccacccaatctctgtgccccctgttggcgctgccagcaccacagcttcggagacagccaccactacggagtcatcaacccagaccacaactggcacctcatccactgcctctaaaacctcctcctcggcagcctcttcaaccccctcttcctcctcggcctctagctcacaccatcactcatctagctctgcattgaccactcgcaccttgacgagcacagaaccaagctctcaatctaccagcgccagtgctgctgcaactaccactctatccggcaacgctggttccgagaaggcaaatgtggcaggtgttgttgccgtggcggccgctgctctctacttgctgtag

SEQ ID NO: 11041 - DNA, 1233 bp, A.fumigatus
ccaggtttcggacgaatcacttttggatatttcaggaccattccccggaaatgggaaaagtgggtttggaaaggaggacacagatggagaaacctaaagggcggaccacggtttgaacgttctcaaacggacctgggcagtgttggcgcattccgaggcgcgaccagatggtaccacggtttatctttctttcgtggcattttctatctcatcttcaagtggagcgcatatggattggacagaatactggaccgaatcggcatcagtgcgggaccacaatggctgaaggttctactggggtcacgccgacggggccaagagggaaatagtagcagtcgggcagaatcgctggatttctggatcctgactgatgaaggcgaacttgagcttcctggagactatgagttcgacgtagaaaaggaaatgcgaaagagggagctttccattgcaccgaaatgggaggaatctgacgagaagcgtctcgatgagaagctctatggttggtggagagccggcggctcgtggggtaaccaggatcaaagtcccgactatgtaccctctgacagcgacgatctttgtgataccaccagcgtcgtatctatgtcaacaaatgctgaatcagagtgggaagacgaatctgatggccgacgtacacttattcaacgcagcccatacccagcaggtgtctcgcgggagagcacccctgttgacgagccgttggtggatgttggctctttagcgcgcctcctcgaccttcgtgaccaggaaagccgacatgaggcacgtatcctagctgctcatctagctgccgggcgagatgggcgcattatgacgcgacgtcaattccagcaaaagatggagcgcgagagagcgcaggttcttctatcctcccggttctcagggagttctgggcagcagacgggtaaagagaagcggaaaccgactccggaagaagaatctgagatgctcgagaagttcattctgactcgtcgatcggaagccaatcgtgccaatcctgaggcgcagacgtgggaatcaggcgcctcgggcctcggaccggacggtccaccgtgtgttatctgccaggccaatccacgttcgatcataacatggccatgccgatgcctttgtatatgcgaggaatgcagagtgagccttgctatgaacaatttcggcagctgtgtgacctgccgccaggaggttggagggtttgtaaggttatgggtaccatag

SEQ ID NO: 11042 - DNA, 354 bp, A.fumigatus
tggagccgagtgaggaaaagaggcccgtacaacgaaaaggcagtgatgctaccagccccaagactaaatgaccaggcctactgtcagtatatttacaacgacggtcaaacgatagcatctacggattgtgaggaagaggacggccaaccagctgatcacccccaccgcaaagctgcatacacgcatcacttccatcgccattttacgacggtctctctcgacgatctcgtcaaccacatcgttcaagagcccgtcactaccaccgtcgagatttcggaaggcagacagtctcgaatcggatcgcagccgtccgtcttcagtcccatcgatgcccgtgtcaatgtcatggagtaa

SEQ ID NO: 11043 - DNA, 666 bp, A.fumigatus
ttaggcacaatcattcagacactcacgccggaattacaccctcccaatgctccatctccagcaggcctgccctctacacatgtgactataatagcgctcacgtcaactatagcccgactgctgaccggatctctctcggacttcttcgcgcccccggccactcatctgtttccggcaaacatagaaagtggccgtcgctcctcgcaatcaggtccgaccgcaaagaggcccaccctgtcgcgactcgccttccttctgccttcagccctcctcctctccctcggctatctcctcctctcatcccccttacccctccagcacccaggtctttcacacgtaacaaccgcgctgataggcctaggttacggcagcgccttttccctcgtccccatcatcatctctgtcgtatggggagttgagaactttggcacaaactggggtatcgtggccatggtccctgctgccggtgccgcgatgtggggagtcatctattcgcgaggatatcaggacgcgacggacggcgggaacggctcaccggacggacagtgtcatggctggcggtgctatgggttctgggccgtcggatgcacgctcagtgtgtgggtggctgtagttgcgtggatacttgcctggaggggttggcggcgaagaggtgttgttgtttga

SEQ ID NO: 11044 - DNA, 1407 bp, A.fumigatus
gcctggtcatttagtcttggggctggtagcatcactgccttttcgttgtacgggcctcttttcctcactcggctccattacagtcagcttcaggtgaacgccgtttccatcgcggcggagatttcgatgtaccttcccgtgccattgttcggctacctttgcgatcggtacacgccctccccgctggcgttgttatcagggcttgtctttggaggaggttaccttctggctgcctttgcatataggagtggcccgcttcctgaggcgggcggagaaggatggccgccctgggtgatggttgtggcattcgttgctatcgggacggctacaagctgtatgtacctggctgcggtgacaacgtgcgctaagaattttggtcgcggaaaacacaagggaatcatgcttgctgtccctattgcggggttcggtctgagtggcatgtggcagagccaggtagccacatacctgttatgtgaacgccgcgaggacggaagccgtggtgacgtagatgtcttccggtactttctgttccttgccttgtttctcttctgcctgggagtcattggcactttcgggttgagaattgttgacgaggaagaggaccagtacattgatgaggctgtcgaggagctcgagcgcagcggcctcctggaggaaagcgagttcttccggcctcgaagcgaagtgcaggcggcttatggcacgttttccgatgccgctgacggtgatgcgcctggcccagagctatcattgaccctctccgaagaagaacgtgaagcggcgagactggagaaggaaagggaggaggaggaacgaaggaagaagaactggctgctgaacttcgaaacgcgactatttctgcaagatcagactatgtggtggcttgcagtcggcttcttcctggtcaccggtccaggagaagcgtatatcaacaacgtaagtctacttccaactattccagtggacgataaattaatcttcctcctagttaggcacaatcattcagacactcacgccggaattacaccctcccaatgctccatctccagcaggcctgccctctacacatgtgactataatagcgctcacgtcaactatagcccgactgctgaccggatctctctcggacttcttcgcgcccccggccactcatctgtttccggcaaacatagaaagtggccgtcgctcctcgcaatcaggtccgaccgcaaagaggcccaccctgtcgcgactcgccttccttctgccttcagccctcctcctctccctcggctatctcctcctctcatcccccttacccctccagcacccaggtctttcacacgtaacaaccgcgctgataggcctaggttacggcagcgccttttccctcgtccccatcatcatctctgtcgtatggggagttga

SEQ ID NO: 11045 - DNA, 1692 bp, A.fumigatus
attaccacaggacgtctacatcttgaaccttaccattccaaattacagactgcctctgagtacatgctcaacgccgcggttgctgccccgcgatgttttgtatatcccactgatcgcgcagcaatgcgcttgggctttgctcttcgtctctcctctcctgcacctctcttctcaacagcacctttccgtcgacagttgcatgcttccggcgtccgatcaattgaacctgttatctttcgaaatagccttgaaaagactcttgaggctcatcgatcctccaatcgagccagtctgatccgcaaggtgattaaccacgattgtcctgctgaaacgccccctccaattttaccacttgagaatcgtgctggtcatgatcaatcatctcaaaaggcctcctccgtgtcaaatgcagagtcagagtccccccggtcttctgcgcctgcgagacgagcgcagaggaaggcccgttcgcccagccaagtagccaccccgcagccccagacaacagaatatccacaactgcaatggcatgcagatgaaaccaagggccgaccggcacaaagtccttggctgaagtacttgactaccgattggaaaacgcccgatgccgtttcgcgtctcgacgcggagatccgcgctcttgagctctacatgacaccgaccccgtcggagcggactgagatagatcggctggttgcagatatgggtaggttgctagcgggaatcgtccccagcccgccccaggtaaccggttcatggcggacgcgatttgccttgagccactcgggtctcgattttgtcttacctgtcccggattcagaccgatccacccgtgacgttcgcaagccgagtgccacacggcccaaggtgctccagacttacaaaaagctcttacatgaagtgaaacatgcgcttcagcagtccccctcgttcgcggagcgagtccgcatcataggcagccgtttccccgtcctctcagccatccatcgccccacgggccgcctgctgcagttccactgcggtgaagggctaccggcctctgtcgaatacatcatggattaccaggccgagtatccctcgatccggccgctctacgtgaccgctcgcctgatcctggaggcgcggggtaggtatggccgtactcagatgtctattgaatccgatgccctcgtaatgcttctcgtggccttcctcaaaatgaaccacgggcgttttcagcggcccgactgtctcggcgagcagctgatcgcgtttctgcgcgcctacggcagcgatattgacctgaccaccaccggtgtgtccgtcgatccccccagttggttcaatgccagtacggtcaaacgcgccagcgccctgtacgcgcccgatgatctacccgcgcatctgcgcggccagcgctccctcatcagcctcaagagaacagcagccgccagacgcaatctgcctgccgccagccggctgtgcgtgcaggaccccaccaattacatgaatgatctgggccgcagctgcgtgcgtacgttggaactccagcacacgttctcgcttgctcatgaccgtctcggcgcaagtctcaagcgctgggatgacagtgaaccggccgcgaacgttagtatcctgacacgggccctgcaagcaaacttttctgattttgaaaatctacgcgccaaatcgcttaagctcaacgcgacctag

SEQ ID NO: 11046 - DNA, 912 bp, A.fumigatus
  unsure (909): Identity of nucleotide sequences at the above locations are unknown.
gtctggagggatgatagcgcctggctggggcttcttgtcgctgacaatctttccagacgagatcagtcgcttagtctgatcatgagcaccctccatcgcctggagacaaagctcgagcacatctcttcggcagttcgtgataatatgcaacctctccatcaacagatgctccatgcacttgagggcctgcgagatgctgctaccccgaaacagagtagccgcgccagtgacaagcatccgtccctgtcaaactcgcagtcgcagcatctcacccccgaaatggggcagccggacgactttgtgtttgatgagcggcccaatacaaccgactccaatggccatgtgtcgatctctttcagtcaacatggcgtgattctctggcctggagctcgagagatcttgccccgaaaacttctcgaagcccacgagcgactggggaggaactatgtgattgacctggagatgaagcgtccccatctacctatgtatatatatccgtatcccccgcaggccggtgaggactggctggaaacactgccgcttgctatgatcaagggtctttcggacgcattcttcgctactttcaatccgttcacgccaatcatggacaagacattctatttcgctttcactcttggtgcggcgattgaaagcgggttcggctacaccattgaaacctgcctcgttctcaatgtgatggccttgggctgtctggctgtcctgagccatcaggaaggaaactatcctctgccaggcactcgaagcagtcgctttgaaccgccggagtggatgggggtaatccacgaagagccgccaggtttacggttcttcaatgaagcccggagacggattggcttcctgatgtgcgacaatgacattcaaagctgtcaattttacctcttgtcctantaa

SEQ ID NO: 11047 - DNA, 234 bp, A.fumigatus
aaagcgaaaatgagttccatccggcgcgtgtccccaacggacctcctctccctcaacctcaccaacctcgacccattgaccgaaaactacgacctgggcttctacctcaactacctcatgcgatggccttcactcttcagcgctgtcaaagatcgcacagaaggcatagtcggatacagtacgtgcaaaaatcatcgcagccataccacctctgcaagaccctcgcatcgctaa

SEQ ID NO: 11048 - DNA, 669 bp, A.fumigatus
tggtcatttcctataaaaagcgaaaatgagttccatccggcgcgtgtccccaacggacctcctctccctcaacctcaccaacctcgacccattgaccgaaaactacgacctgggcttctacctcaactacctcatgcgatggccttcactcttcagcgctgtcaaagatcgcacagaaggcatagtcggatacagtacgtgcaaaaatcatcgcagccataccacctctgcaagaccctcgcatcgctaatgaaatcaaaaacagtcatgggcaaactcgaggaacaacatccttcaatgcgccactccgaacactacaccccctggcatggacacatcaccgtgctgaccgttgccccagcctggcgacgtctaggtcacgcgcgccgcctgacagagcgtctcgagcacggctccgacatcaacgatgcctggtttgtggatctgtacgtgcgcgcggggaataaggtcgctgtggggatgtacaaggggatgggatactctgttttccggcgtgtggtcaattactacagcgatgatccgacagggatgtcggattcgggcgaggatgcgttcgatatgcgcaaaccgtgcagtcgggataagaatttgcagcatatacgcgagaatggcgaggagtttctggtaaatccggaggatgtttcatag

SEQ ID NO: 11049 - DNA, 267 bp, A.fumigatus
gcagcaataatgaattttatccgtcttttcactggccaatgcttttgctctatgtttgctaatgccaacatgctttataaatctgtgaactgcctcccccccaaatcaacactacgtactccgtacttatgttcacttgaagccttccctttgattcaagataccattggcaatgactgtttcaaccatggcagatgtcagcggtgctcagaaaagccctgctgttgctttacccgagtacacgctgaaggaagttgcgctgcataa

SEQ ID NO: 11050 - DNA, 1368 bp, A.fumigatus
gtcgcatgcacccctcaggagagtgcaagctttgaagtcttcagttgcttagacttgacagtgtacgatgtgacaaaataccagaaagaccatcctggcggcgcagatgttctggcggaagttgccggctcagatgcgacagaagcatttgaagacatcggccattcagaagattcgcgcgaaattctcgaggaattcctgatcggaacccttcagggcgcgaaagaatatgtcgctccgaagaaagttcgcatcattgctcagagccccgtcgagactcctgcttcttcatcagcaacccgatacgtaggagcggtcaccagtctgctgggagcagtcgcctccttgatctatgtctaccgtcgcggttccctgtactcacttgacaccacggggtcactccacagatatctgtctcagcccttaaggggggtaaggttgccgcaggggggcttcgccaatggatttctcgcagctactctgatttgtgcggcagcaggtggtgtgatcgcacgtaaagccgccaaactaaccaagatcgagtcgggattcctgcagtatccaccgcatatcaaggcacgtaaggtgcccagggctgacccgcacttgcttaaagggttccttgattcaaaggagtttcagcgcctgccgctcatccagaaggatcagttatcttcaaacgtataccgcttcgtgttcgggttaccggatagcaatggagtgattggtctacccatcggtcagcacgtcgccattcgcgctgttatcgatggtgtcaccgtgagccggtcgtatacacccgtttccaacaacctagaccgaggaaggctggaattagtcgtgaaatgctatccggatggcgtgctctctggaaagtacctagcgaacctgcaagtgggtgacgaggtcgaattcagaggacccaaaggcgcgatgcgctacaaaccagggttctgcaagaagctgggaatggtagccggcggaacaggaatcacacctatgtaccagctgatccgtgctatctgcgaagatgagcgtgatacgacggagatcagccttatctacgccaacagaactgaggcagacatcttactgcgggatgaactcgagcagtttgcccgcaaataccccaagaatttcaagctgtggtacatgcttgacacggccccggagaattgggcgtatggaagcggcttcgtcaaccaggaggtcctcagcgagcgactattcgcgccttcgcctgacactaaggtcctcctctgcgggcctccgggcatggtgagcgctaccaagaagatgctggctgcgattggattccagaagccagggccagtttcgaagatgaccgaccagattttctgcttctaa

SEQ ID NO: 11051 - DNA, 207 bp, A.fumigatus
ttcaagataccattggcaatgactgtttcaaccatggcagatgtcagcggtgctcagaaaagccctgctgttgctttacccgagtacacgctgaaggaagttgcgctgcataaccgcaaagacgacaattggattgtgatccacggacatggtaagtcgcatgcacccctcaggagagtgcaagctttgaagtcttcagttgcttag

SEQ ID NO: 11052 - DNA, 198 bp, A.fumigatus
catgggtatctgtcttcgaattcgccgaagggtgtgcataaaattggccggaaattgtacaagatgtcgactgtctttaccgtcgtatcgacttcactcaaaggccgtctatttgacgcgacccatgatgtcctcgacatctttctgattgacgactacaccgccttcagagcatctggctttggtgcgcaattctga

SEQ ID NO: 11053 - DNA, 384 bp, A.fumigatus
  unsure (10),(12),(20),(56): Identity of nucleotide sequences at the above locations are unknown.
cgcccaactncngagcccanccagaacctcaatcccacaccggcccatgcctcttncggtagcttcagtgtttctccccccagtggtttggacggctcggtgaatcagtcaactactttcggctacgaagatagtccttacctggatctgaatttcgacttcgaccttgattttctgggcaacgagagcttgattggtgatctgcccccgagcttgccttcgactgaagactatgagcctggtgataagcgaaaggatatcgatggacaagtaaatgacaaagaggattcgggcaagaagcgacgggagagcgatgagaaagcagccaagaagcctggtagaaagccactgacctcggaacctacttcggtatgttttctgtga

SEQ ID NO: 11054 - DNA, 216 bp, A.fumigatus
gatatggtatgcttaatctcatcccttaccgctctccactctcttgctaactacttgtgtcgtagggatcgtctgcaatccatggagaagttccgtaatggcgagatcgacgtggacaatctctgttcagaattgcgcaccaaagccagatgctctgaaggcggtgtagtcgtcaatcagaaagatgtcgaggacatcatgggtcgcgtcaaatag

SEQ ID NO: 11055 - DNA, 1236 bp, A.fumigatus
cctgttggacagaagcgcaaggctcagaatcgcgcagctcagcgagccttccgggagcggaaagaaaagcacctgaaggatctggaggccaaggtggaggagctacagaaagcttctgataatgcaaaccaagagaacggacttctgcgcgctcaggtggagcgtttacaactagagctcaaggagtatcgcaagcgtctctcctgggtaacgagcaccagcggcctctctcctgttaatgctatcccaggtgcatactccaaaggcatgtatggtctgaacaataatgagttcatgttcgacttccccaagttcggggatctgcccggttcacacttgttcaccaatacgcaaacaagcaagtcgaatcagaacaaagcgaaggacaacccgacagcaactccacgtatcgaagctcaggtccccggtgtcctcaaccgcaacgatctgaaaatctcgagccccaacggcctttccaacggaccatcacccgccaagtccacaccaagcggccagacaccgaattcgcaaacatctacacgacctggctctggtacattgaacggagccgttgataacaatggagctgccaggggctaccaggtcaattcgtcgtacagcgcgagcacaaagcaggcaacccacgatacccctagctcagactctccatcgtcctcttcagattcgcaccagagccagctgctctcttccaatgggacctcacctgagccatctttgcactcgcctgccgtaaaggcgactgagagtagcactccccatgcatgcacctataccaccatcaacggtgaggaatccttctgcgctcagcttagtatggcatgtggcaacatcaataatcccattccagctgtcagacaaaatagcgaaagcgcgtcaaacacccctagccatgccaatagttccgacaaagctcttggtctggattttttcgcccaacagaatggaggtcagttcgaccctgtcctgttcggtgattggcgtgagcctcaagatgctattttgtcgcaagactttggtacatttttcgatgatgcgttccctctccccgacttgggaagcccatcccacaattttagcgaggcgaccaagcaaccagcagcgccaaagaaggatcttatcgctgaaattgacagtaaactggatgaagatgaggaggttgtgcctggcgaggacaagtcgcaaatgctcacctgcaataagatatggtatgcttaa

SEQ ID NO: 11056 - DNA, 435 bp, A.fumigatus
acacagcgtgccggggaaattggaaggtggcaaggacataacacagaagaacaggcaaatgaggaaatgatatcacgctcaggactctccaccagaaggggtgggcttgtcaccggagggtgtcgatgtcgatgctgcaggagagtccgaggtgcctcccttgccgaagccaccacggccacctcttccaccacgtccaccgcggtcggtaccacggccgcgtccgcgtccactgaaaccaccacgtcctcggcctccctcgctgtcactagcacctccgctctggtatccgcgctgggatgtgttggtgcctctgttgctaacttgccaggtgccggcattaccacggtggggaagccgcggtcctcgaagaacttcagattaggcttgccaagttggccccgggggctgggcttcttgtgttcggctggttga

SEQ ID NO: 11057 - DNA, 1389 bp, A.fumigatus
cccaccccccgacatatgtattccagcggcggggctgaataccagtctccaccggtcgagggcgcacatcggacagatgttcagacagagaccacggagaagtcggtggagctaagtcaggctactccaaatgaaaatatgacccaggaggtagccgaggcgggtgatgtagtaatggaggactctgaagccgttgcatcagctcctgcgactgagccgattccgttgagagaaactatggctgagcaagctcccagttctgcagtcaaacctcaaccggccgatactgagagagacagcaacgaggttgatcttcttggtagcttagaagctagtctgggtggcgcggtccgcgatgcacagactggcggatcagcctcgttgcaaactgatgcacaagtaggagccatagctgctgagagcacctcaacaaatgccgccagagaagttggagaaacagtcacagatgggcctctacaccagccatcggaaaacgttgaagagcaacatgcgaaagagagcccagagcagattgtcgaatctgctcctgttgctgcagagcaaaaggcaatcgaacagcccagtgaaccttccctggaacccagcacgatgtctattccagaacagcctgagcaggagatgacagagcctaccgcggaaactgtggcgaatgatactccagaagagcttaatcaagaagcacctacggcacagcctcgcgaatcaacttacaaagcattgtcagctgtagatacagagcctgttgctcaacccgcagagaacgaggctcccaaatccgccacaccacaggtgatcgagcctgcaacagattccagcatagtgccttccacagaaccttctgctgaagccccttcagatcaatcaactgcgccgcctacagaccaacaaccccccggtccatcctctgagccgcatgcagaaaaaccggcgcaagcttccccagagcaatcgactcgaccaactgagccgcttcccccatctaccacagagcagacaccaacgcaaccgacacagccctcgccagaacacatggcaccaccaacagagtctctcacccctccaagtccggaatttgaacaaatcgaggaatcatctcaagaccaaccccagaatcaggcacccgtaacggacattcaaaaaccacaacctgctccgctcgataaatctcaaactcccgaggctccttcagctcctgcaccaagtgcacccgaaattaccgagccaccgacacaaccgagcgacgctgctccgtccgacaacgatgctgctccccagcctgtcgccgagcaggaaaaggcagaacctgaaagcaaggagggcggagaggaggcacctgcaccgtccacctctgacctcaccgcagcatag

SEQ ID NO: 11058 - DNA, 1701 bp, A.fumigatus
  unsure (127): Identity of nucleotide sequences at the above locations are unknown.
cgtgtggcgccacttacctctacagccattggcaacctcaagacgactctttgtgaagagatgaaacgagctgatgctgagcgaaggttgtgtggaagatccctgggctatagctctctgaggcttntgccaaagacaacaggcgtccggccgattctgaaccttcgacgacgaaatctccagccaggatgggctggcaaggctccgttcctggggccgagcatcaattcgaccatgacaccgatattcaatgtcttgaagtatgagacggcacgtaaccctgcgagtctgggttcgaccctgtcttttgtcggcgaaatacacactcgtctcaagagcttcaaagagcgtctgtctcagagtcactcgagtgatcgacggcaacgactctattttgtcaagcttgatattcagtcttgctttgatactattcctcaaaaggagcttatccctctggttgagagcctgttttccgaagaaggctaccagatcggaaaacatgtcgaagttcggccgccagacgagttcagcagcatgtggccagttcaagagtcccaacagagcaaggctctacgcaaatacgttggcagagcagcgccggtgtcgaaagcgcaggctctgacggatgccattaccgatggtggcatcagccataggagaaacaccgtcttcgtcgatacgccggctcacaaggagtattccggcgactatctactggacctacttgatgagcacattcgctacaacttggtgaaggttgggaggaagtatttccgccagcggaacggtatccctcagggatcgatactatctagcgttctgtgcaacttgttctatgctcaaatggagcgggaatctctaagttttctggatcccagtgaagccgttctcctgcgtttagtggatgattttctgcttatcacgatcaactcgaagttggcgatgcgttttctgcaggtgatgcttaagggacaacccaagtacgggatttccatcaatccagccaagagccttgtcaatttctcagcaatggtagacggggtacaaatccctcggcttgagggcagtcacttgttcccttactgcggaagtctgatcgacacccggactttggagatatacagggaccaagaccgtatcctcgaggggacggactcggccgcgggcacaatctccagctcgctcaccgtagagttcacacgagcccccggtcgttctcttcacaggaaagttctctcgtcattcaagctccagatgcatccgatgtacctagatacgaagcacaactcgctcaccgtggtgctctggaatctgtacgcaaatctggtgacctcggcgatgaagatgtaccgatacatgaaggctctgcctcatcgggcgcatcccactccagaggtggtaatccgagtcatccgggatctgatcgaactcgctcatcacatgatgcgcgcccgacgggagctcaagtcgagggattcttgttcgccatatatgtgcctcgtacagcagcaacaggtccggtacctcgctgcagcagcgttccggtttgtcctaggccggaaacagaccaagtacgcaaaggtactgcggtggttggagcaggtgtggaaagcagcgcggccgcaatccgatggaaaagccgctcggctggctgaagttgttcgaaatggcaactctgtgtttgccagttggcggttctga

SEQ ID NO: 11059 - DNA, 198 bp, A.fumigatus
gggataaatgagtctcctcccactgcttgggaccattttactcttctcagcgactacagcatacctttcaggagtacctggaagtacgggatttgcctcccccttattgatgtgtacattgcgccagtcatgttccattatttgcagcccacttcaggttttccgtggtatgtgagcttggaacgaaccatggagtag

SEQ ID NO: 11060 - DNA, 288 bp, A.fumigatus
ttcttcctacaccacgcaacgtacacttacttataccctgacagtattgctactcttctcttgactttgcctttcaggttacttgactcttgttgcattcaatacttgattgactgtaatatctgcgatatgtcttcgatagagaagcacaaaggccatgtcgatgatgacgcccaacttgcggccatgggccacaaggccgagttggatcgcaatttttccatgctgtatgaattttttttctttttagatgatgataagaaggcttgtcttttgagtgattactga

SEQ ID NO: 11061 - DNA, 810 bp, A.fumigatus
cccccacaactcctccattctgccagccgcccgtgcttcgtagcgctgggctctgtgggattctggagtgagtttgacttcacatctcccttgaatctgaagtgctctaaaatggtcttcgctcttgatacagccacagaagccgatgctcctcgcatcgccgatattcacatggcggcatttcacaccaacggcatgctgctggcccagtttcccacgccggccgtgcgaaagggtctatggacgtcgctcgtcgacaaagtcgtcaaggagattcgagatccgcaatgggaggtactagtggctagagaggctgatgatcgagttgtcagctttgccaaatggtgtcttcccctttctgagtcgacggtatatgaggaagagccatgggtatggcccgagggcaccaatatggctattttgaacggttgggcaaagaaggtcgagcaggcagcgaaggaaataatggggaaaacaccatgttatcgtacgttttgtgcgatccggttatctgattgcgattgcttacaccctccaggcctcagctttattgcgacggacccatcttatgccctgcgcggagcagggtccctgttggtcaactggggaattgagcgtagcaaggaagagaacattcctattgccttggaaagcacgctggatgctgtaccattctaccagagattggggtttcaaacagaggcgcgtatttccatgcccctggaaggcatcggaaaggatggtgaggccatcctgtacgaggaagaatgtcttgtatacagacctaaggctagaatatcatgcgaataa

SEQ ID NO: 11062 - DNA, 615 bp, A.fumigatus
ggaagttcaatgtccgacgactcccattggctctccctaacttccacgcattgtcggtcacgtgcacccagaagccgcaattttcccttcccaagtgatatctcaggaactgttggtgatccacaattggccattgctaggacagcatcattcaagatgcagaaaattatccggaggacagccctagcgaggaatcaggctcagcgaaaggctattcgagcggccaaggccgctgagcgcgaagaatttaaagatgcattgagacaacgcttcgcctttaaccgcatagaactcgacaatgtccgcgccgagagaatacgacgccgggaagactggttgcgagggcctctcgctccaaagcgtgatgcaggtctcgatgcaaagaccttcggttccctcagcccacaggcgatgaatcctccgacgatacccaagcacttgcgcaggaagtacatcaatattgctgcgggtgaccgggtgtgtatcatgaagggcagagacaagggcaagatcggcgaggtcatcaaggtggacccaaacaacgagactgtgatggttaaggacctcaatatggtgcgttttcacggttgcatacgatccatgtctacctactaa

SEQ ID NO: 11063 - DNA, 228 bp, A.fumigatus
  unsure (78),(101): Identity of nucleotide sequences at the above locations are unknown.
gttaacattaatattttccctttaacagagaataccccgcaacatgtccctctcttcgaggatatcgctaaatatacntccagccccctggccaggcaagntatcccacccacccagcccgtagaggccgacgaagcccctgccgcgaagaaacggaagctccagaatggcaatcccgcaggcgatacacaggtcttcaccaggggcttctacagcgctcaacgttaa

SEQ ID NO: 11064 - DNA, 372 bp, A.fumigatus
aagatgaggaatgggacacactccgtttgggaagttgagacaccgacatggattctttcgctgcacaaccccccgttccctcctagcgtcctcgatgagctccgcaacccattctccaagtaccggacgaggcacgatcccgaatgggttgaatcgaagaagatggaggacctcagaaaggagtatcttcaaagcaggtctttgatgacgcccaagggtgaattcctcgccatgttgcgggctaagaaggccgaaagaatgagcgccagacgggacgccgacggaaactacattatggatgaccagacggctggcttcatcgcgaatttcatgcaacagaatgcggcgaagaaagctgggtcttctgcttaa

SEQ ID NO: 11065 - DNA, 222 bp, A.fumigatus
tttatcgtcatgtcttttgctacaatcaaccgatctgctacgaagaccctttcaaccagtatccctgcgattgaagatgccttcgctgctgaaccttctttgaagaaacgagtttatgatgcgattggtacgcacattcccacaatctttggtttctgtcaggcttctgcagttacgagatgctgctgtgattataagttaacattaatattttccctttaa

SEQ ID NO: 11066 - DNA, 882 bp, A.fumigatus
aactctgcgtacgccgctgtggtggactttataagaaaggtccatcgtacgaattccactgagcgtcttgcgaagagagacggtctggacaaccagatggatagtatcacccagctggaagcccgggccaacgaggtcgccgctgcggccagaaggctagccgaatactgccgcaatgccagagtggatggggcatgtctaccagccgtcgtcccgtcagaggcgcctcgggccatccgcgagatccaacggttgctgctgagcaatgtcgatcacctgcagatacttcttacggagccggcagacctggtgcagcgactggcggtgcagtcgcaacttctctcgtgtcttcaatggctaggggagtttcaggtgctggcctgtctgcctctcaccgacaccgtcagcatcgcagacctcgcacgcctctccggcgtccccgaggcgcagctagcccggatcatccgcttcacaatcaccatcgggttccttcaggagccccagcgagggcatgttgcgcacagcccgctgtcaagcttgttcgtcagccgaccatccctacgagacgcggtgatgtttctggcagattcggctgcccccacggcgctgcagatggcctctgcgaccggtcgatttggcgatacggtggccagcgagactgacaccgcctacaacattgcctttgaccatcgagaccccttttactttgcatgcgagcagcggccgaagttgcaacggcgctggtcggcgtacctgcaatatacaggaggcgatgcccgcgacctcacccagcaggtgctcagccgcgtggactggttcaatctgaacaatgcttgcgtcgttgaggtgaatacagccgggatgtggtcgcagtgggtataa

SEQ ID NO: 11067 - DNA, 996 bp, A.fumigatus
atcctctctgatgcggccagccatcttgttctcgaacggaattggatgcggtccccagcgtcttcccgtcgggcaagtgctctccacagactgtgtgacagctgtcgtgcctgcgggctgtccaaggtcagatgctccaaagagaaaccgacctgctcccgatgccgccgacggggcacggtctgtgagtatgttgtgaccaaacgtcccggccgcaaaccagacagtcgatccgaggtggagccagagcccggccacttgtcgcaccccttgccctcgccggagtcctcgaccgcgatctcgcaaggcaatcttccggatccggacgccttcgatcccctcttcgccttgccggagccgttcgacagcacgcccgaactgcattcgggccccttgtccacggttgactcgagcttgtcctctgcactgaccacctggtgccccgactttgacgactttttctcctttccagtctccaccgaggacaccttgtctggagaccgtggtgcggtctatgacgggacgatcaaacacccgccaaacctgcgtcgccacagcgagagccctccggctgttccagacgacacgatctatctgtttggcaagccggtggatcccgcccctccagaccagtcgctgcctgcgacaacgacaattggcaggagagcttctcccccttcgggtagagaatcggaggccggttcccgtcgtttgtcctgccggtgcctaatccgcgcccttgacctcctcaagcattttgaggtcattcgaagggaggcggagatcgaatcctcgttaccctcgatcgacgccgtcgtggaagtgaacaagcagaccacggaggctattacgggaatgttacaatgtccatgctcgcaaaaagacggctacctcctcgtcctgctggccttgattgtctgcaagatcttggaccggtacgccgctgccgcgataccgttttcaccaccccgggtcgaaggatcaacgctatgcgta

SEQ ID NO: 11068 - DNA, 492 bp, A.fumigatus
  unsure (78),(119),(149),(196),(248): Identity of nucleotide sequences at the above locations are unknown.
cttccaggacggggcgattttcggcatggtcgggggatcaaatttcgccaggatcctcgtatcgtgctcaatggattnttctccgccccggatgcggatgccagaaagtttacgcctgntacttccgcgcctgcacctgcacttcctgntggatcagaggccctgcagcccaaagcggcaccggccagtactccgnccgctccagcatcagccgatgcgccgaccaccaacggggtgaaggcagccgntgagcccgacgccaacagtaccgccgccaaagcgatcgctctggtggctacggaggccggactcgggctgagtgacctcaaggacagtgccagtttctctagcctagggatcgacagtctgatgagtctggtgatttccgaaaagttccgggagacgctgggggtgacagtgacgggcagcctgttcttggagtatccgactgtaggggatttgaagagctggctactggagtattacagctga

SEQ ID NO: 11069 - DNA, 243 bp, A.fumigatus
caacctctcgaagatgattttcgggtgtacgtcttacctccatcatggatgacatggtataagatgggattgagcacttacaacgtaacagcaatgggagcggcgtatggaacggcaaagtctgggattggtatctctggtgtaggaacgtttcggccagatttgatcatgaaggtttgcagttttcaccccgcaagttgcggggaaatcattccaagtagatgttctaattccttgacatag

SEQ ID NO: 11070 - DNA, 192 bp, A.fumigatus
cattttcttgagggtgttcgtgcttacatgcagcaatcccgagtctatgtcgggatgattcttatcctgatttttggcgaagttctcggcctttatgggtttgtcttcccgccaatcgacaacaaagacatatctgtgctaactgctgtcagactaattgtcggtctcatcctcaactcaaagagcaaatag

SEQ ID NO: 11071 - DNA, 909 bp, A.fumigatus
  unsure (437): Identity of nucleotide sequences at the above locations are unknown.
agggataggatggccgatctcggtggccaacagggccggaactacaggccttatggacatgcgtcctctttccagcgcgatgctgcattctcagagatattcggcggggcaccgccacctggacgctcccagacaatgaactcgcagacgccccagttttcccaagatcgcgcccacacaatgtcatcgcatgtgccacatcctcaaatgcaaaggccacccccgcagcccgctcgtcagggaccgaatggttacacgccggcagctccgaacggacactatcaagcatacccggggcccgcagctatggctcaacaatcttcgcacaatcctccgcgaccatatcccggacgttatgtttatcctcaaccccaacggctagattcgagacccgctcctggcccacagtatccagatgtcaagggatacggtcggcntatgcctcccccagccctgaattcggatgcatacagatcaaggtcaatggcgcgaatgggtggcccgccggggtatcaacaaccgccactaagcagtttcaatcacacttccgcaagcgctttccgtcaacaaccgtatagttcgacaactccggtaaccgatcaaggacgggttgtgccagtgaggcatgcgaatgaacgcgcaatgtcgctgacatcctactccatggatcgcgaccattctcacaccacgcagacaggtcgggtgattcctacaaggaggcagccatctggcccaagtcaacccccgacgcgccacttcgaagaagagcctgcaatcgttcaccatgtgaacggaagaccgcgaccgccaagtgatgggtcaacaaattcccgcgttatgtctatggcgtcgaccatcgtaccagatcggatgctcaccacgggggtgaaaggatccgcgctatgcgta

SEQ ID NO: 11072 - DNA, 1425 bp, A.fumigatus
attacatctacgactctaaagaagaatcatattctgtcacatataaccatggggtctatcactccatccttttcttctttgccgcgaacgtccgagtcatacttctccaagcgtggccagagtgcccttgaccagggccgcaagagaataacatgggacgtcatcagcgacatgtggcacccccagaggaatcattcaggaatcctctccattggaatggccgagaatacattgttacatgacactttgctcgaatatatccacgccaatattcgtctctcagccgaacaccttacctacaacaatggaagcatgggctccaacgcccttcgaaaggctgtgtctcattttctaaacagacagttcaaacccttccgacccatcgagccttcccacgtgctggtcacaaatggatgctcctcggcgatagaacacctgagctggactttcctgaacccgggagatgctgtcctcctcgcgatgccatattatagtacctttattgccgacctttcgctccgaccagaggcagtggtcgtacctgtccatttggcaggttttcaggatcccctggatccaaaaacaatcgacaaatacgaggaagcggcggtagaatttgaagcccgcacagggaagaaagcgcgggctgtcatgctctgcaacccgcacaacccgctgggtcggtgttacccgcgtgaaaccgtggatcgtctgatgagactatgtcaggcacgaggaatgcacttgatcagcgatgaagtctacgcgctgtcagtttggaacaaccgcctagacaaccccaacaaagtcccatttacgccctttaaatctatactatcgagagatacgacaaacctcatcgactctagtctcgtacacgtactatggggattgagcaaggattttggtgccaacggccttcgagttggtgccgttatctcgcaatcgagccccgactttcacatcgcccaaaaatgcctatccctttactcatttgtgtccagcttatcagatcagatcactacctcaattcttaaggacgataccttcaccgacaattatatcaagatgaatcaggagaaactctccgagtgtcatgagtttctcgctctgctcctcaataaacaccggattgagtatatgcacgggtgtaatgctgggttctttttatgggtgaatctgggcaagaggtacctcgaggcccatcctgacgaacaaaaagtcagacagagagagggacaagatgaatggggaacgaagctcacggatgttatattccagaaactactggacaataaagtatatgtggctcatgggactgcttacggatcggaaaagccaggatggttcaggttggtgttctcacatcctcttccttggctggaggaggctatggcacgaattatccgtgctatcactcaatga

SEQ ID NO: 11073 - DNA, 195 bp, A.fumigatus
  unsure (195): Identity of nucleotide sequences at the above locations are unknown.
gcgataacccgagcctccaactatttgccccccttcataaccactcgccgattgaccggatgcaagaccctcataaacatagaagtctcttccaaaggcactgttgggcttttactatgggttactactaatttgtcccatttctctccatccaacactcaggccatcttccggttccaaatccaattcgagtan

SEQ ID NO: 11074 - DNA, 480 bp, A.fumigatus
ggttgccgcgaatatcacatactgtccttattactcaaaacttgtgctaactcattgcagatcgacgtctcggtcaatgcgcccgagtctgggactataaaggagctcctcgtgaacgaagaagacactgtgacggttggccaggacttggtcaaactcgaattaggtggtgctcctgggccaaaagaggagacagctactgagaagccaaaggagcccgcagatgtcgggaagcggcctcctgttgaatccaacaagccacaaccgtcagaggcccccaaagcttcatcgcctccgcctgaacagcctcctactgccaagcctcagccccctgctcctaagtcagactctccttctgacgttaaacctagcttcgaaggtcgtgaggaacgcagggtgcgtttacagttcccttcaacgtctgcgttgtctctctggcactcgctaactcgcggctgttctgttactcctttgggataa

SEQ ID NO: 11075 - DNA, 411 bp, A.fumigatus
gtgaaaatgaatagaatgagactgagaatagccgagcgcctgaagcagtcccaaaacaccgcagcctcgctcactaccttcaacgaagttgacatgtcatccctcatggaatttcggaaactctacaaagatgatgtgctgaagaaaaccggtgtcaagcttggcttcatgagcgctttctctcgtgcctgtgtcctagctatgaaggacgtccccgccgttaatgcatcaatcgaaggccccaatggtggtgataccattgtttaccgcgactacgttgacatcagcgtggccgttgctactgagaagggtcttgtgacacctgtcgtccgtaacgctgaaacaatggacctcgtcggaattgaaaaggccatagcagaccttggcaagaaggtcagtggcattatgtga

SEQ ID NO: 11076 - DNA, 501 bp, A.fumigatus
tttgcgatctccaacatacagtctctttattgcctgcaccggggagaagtatccacagcctggacgtttatttcaagagcctcacttatgtgcctgggcttggggttgcatagcagtcacgccatggtaatggaacaagaaaatgcagggcagcgaaagatgtgtcttttctgggctgtgtacgccctggagaaagctgtggctttacggctcggcaggccatcgactattagagaccaggatatcaccatcccacgactcactctggaccgcaaaatgacctcgctagcatttaatcggctgcctgactggattaatatcgctagcctctacggccgcttgtacgatagtctgtatagcccgactgcgttgacacaaccaggctccgttcgcgtttctcgcaccagcgcactggcttctgagctggagcgtatgatagcggcgagaactgaatattatgtaagtattaaacagcttgctctgtgttcccaacagagttaa

SEQ ID NO: 11077 - DNA, 828 bp, A.fumigatus
aaacccgccatgaagtatcgcggcgttgtctacgatgtcggccttaatttcagtggcactggattctccgtcgagccattcaatcctgctctagtcaaatacgacatgaaaacaatcgccgacgaattgtatgccaatgcagtccggattgaaggagaggagttaagtcggctggagatagccgcacggtcagcgcactccatgggactaaaggtgtttctcaatccatggaagatgaatgcgaccattgaggagacccgcgcatacttcgaagaggcggcaataattgcagaaagattacataatgaaggcattgatttggtctttatcgccggctgcgaatacaccatcttcaacaaaggtgttttcccgggagattctttcaacgaccgtgtaatgttcctcggccggcactttcccagcagccacatgatcgaggatatttcccagactctgcgtgacaagtctgttgagttgaataaggcgttgcggtcttttgttgaggtgattcgttcccagttcggaggaaaggtcacatattcagctggctcctgggaagtcgtggactgggatatttttgatgttgtcggcatagactattatcgccgaggagagactgcggagaagtatgtctcgtgccttgaccggtacaggatcggcaagcctctcgctgttttagaagtcggatgctgcgcgtacgagggagcagcagagcgcggagatggcgggttcgcactcttgaagggcacgaatccagacggcactggcatcttcgagaacgatattgtccgtcttcaccacggggctggaaggggctgctcattctaa

SEQ ID NO: 11078 - DNA, 213 bp, A.fumigatus
atagcatccgggccgtccttaaatgcgcgtttgcgctttttaggtcgctcttctagctggacagactttgggtcgtctgggtttggcgaggacgattcgagcgctttcagtcgagagtactctttgtatttggcagctgttgataacgccgtgtcagtttctcttctacttaaattaaaaggtagtcttcaccacgggcctcaagaaccatca

SEQ ID NO: 11079 - DNA, 1518 bp, A.fumigatus
agactaccttttaatttaagtagaagagaaactgacacggcgttatcaacagctgccaaatacaaagagtactctcgactgaaagcgctcgaatcgtcctcgccaaacccagacgacccaaagtctgtccagctagaagagcgacctaaaaagcgcaaacgcgcatttaaggacggcccggatgctattcagaattcctctacgccacgaaaaaccgccaaaggtgctttggaaacgccatccaagaatcgactctcgagttcccatccttcccaggtggatccttatatttcgcctacggcgttgcgtagactcttcagtccatcaacgcaccgcacaccactgaaaacagccatcggtcctacccctcaacgcgacggaaaggccctaggtcttttcgatctcttgtcagaatctggcggaagcacagcaacaccctcagcagatcgcgtggcaagcgtacgtgccgcaaatgtccggaccccgtcgaaacgaaagaccatggacacaatcatggaagaagacgaagacggagaagaggagagcccaaggctcggacggacccccgcatcgtccggaaaaaagtggatgctatcagcgctattcgcgaccccgactacattgcgctattccgcaatggttgaggatggcaatcatattactgagaggaacctgggtcctccgaccgatcccgagggcactgccagggacgtggccgggcccgagaccccgtcattcctgcgacggtcaaactcagcacgatacgctacctctcactctgccaatcccagcctgagtccgatcgctgtgcgcaaaccaccgcaattcgtcggaaagggtctctctgcgctcgtgcaaggtctgcgcgacatggaagaagaacgcctggaagacgatttggacgtccttcgcgaaattgaggcggagcaggcagcgctgaatgttgaagttgctgatagccaggcgcccgctgaaatcatcggccggcactggaaaaagaaggggcagaaacgtacaacgcgcagggtgcgcatgaagcctgtcatctcgaagccggcctcgaagccgcagtcggcgtcggacgatgaaaacagacaccaggctgctggtgaggaacccgccgagcctgcagcagtccccgaaacacaacagccgagggctctcgatgctgtctttagtgaaaaacaaaatgaggagttcgatgatgaagatgatcaagtctcacttcacaccatttcggagccagaccttgattccgatcctgaatatggggaggatatcaaacctgttactaagagcaagagcttctcggagaagatgaaagaagctatcggagttgcccaaccacagccaacagaagatccggcaaaacagtccaagccagtgatagaagcagaggagaccaagaaggttcgtgcgcgcaaggtgaaccccgaggcgcacgcaaactaccgctctttgaagattcgaaacaagaacagtaaaggccggggcgctggacgctttcgcaggagatag

SEQ ID NO: 11080 - DNA, 411 bp, A.fumigatus
ttcagagggaaaatcccagtttggccccttaaggagcccttccaccagtccttgtacacggactcaagcaccgcaataatgtcccctttcctgaattgtaattcacccggttcggaaggctggaagtcgaacaaagctctgacccgggagacggtagctgcggaagtacctggcggtaccgcttgcgatgtcgctgtctgggtctggctggccggttcggagacagaagtgcttggttccgctttaggctcaggggccgcgctgggtttttccctgatggaaagagccagcgccatctgcagttcttcttcttccttctgccgatctgcctctgtaatctctcgtttcccgggtttagacggaggctgtaggttgggatctgagaaaaagagatcagtccttgcatcatag

SEQ ID NO: 11081 - DNA, 708 bp, A.fumigatus
ggctcacgggacaccaacgctggctatgatgcaaggactgatctctttttctcagatcccaacctacagcctccgtctaaacccgggaaacgagagattacagaggcagatcggcagaaggaagaagaagaactgcagatggcgctggctctttccatcagggaaaaacccagcgcggcccctgagcctaaagcggaaccaagcacttctgtctccgaaccggccagccagacccagacagcgacatcgcaagcggtaccgccaggtacttccgcagctaccgtctcccgggtcagagctttgttcgacttccagccttccgaaccgggtgaattacaattcaggaaaggggacattattgcggtgcttgagtccgtgtacaaggactggtggaagggctccttaaggggccaaactgggattttccctctgaactacgtggagaaactgccagatccaacggtagaagagctgcagagagaagcccaaatggaggcggaagtgtttgggcaaatcaagaatgtggagaagcttcttacgcttttgagcacccgtagctcggagttgaatgtgcaagacaacgaggaaatcacgtctttgtaccactcgacgttgtcaattcggcccaagttgattgagctcattgggaagtattctcaaaagaaaggtatgtcaaagaagaccccgcgctgcaattcatttggctaa

SEQ ID NO: 11082 - DNA, 789 bp, A.fumigatus
tatagattagatgagtttacgcagctcaatgaaaaattcatcaaagcccgacgagactatgaatctctactggaagcatccatggcgcaccctgcacaaccccagtacggtcggcccggccaggccccgtacggatatcctggacctgccgcgcctctaggttatccacaaggtcctccgcagtcggatcctcaacggtacttcagcccaaggccgcaggaccagacgcacatgtatcctccaacgtcacactcacctgatccacgcggccgtacgccacctgctggtccatccttcccacagcaccagcaaccaccgccagactcataccagcctgtccaccaccgcccagaatctacatatgacaacccacaagaattaggtacttctgtatatgattcacccgtcgaacatccgtcttcaagtcagcggttaccctatcctccctctggcgcacaagttccacctggtgtccaccagcagttccagcatcagcaacaagagtacccgccttcaggctatccccccgaggacgcctccaagcctcctgctgccggcttcgccttacaaccgccgcaacagacactacaacaacctccttaccctacggcaccgggcgctcatcaaccgactccatcgcaccagccaccaccagtccccagtacggcgtcgaagccaaccccctatccttcattgacacctggaacacccagtggaggggagtatcaggcctacaatccatcacaagctggcgcagccaactcgaaccctaactcctattaccgataa

SEQ ID NO: 11083 - DNA, 315 bp, A.fumigatus
gtacttctgtatatgattcacccgtcgaacatccgtcttcaagtcagcggttaccctatcctccctctggcgcacaagttccacctggtgtccaccagcagttccagcatcagcaacaagagtacccgccttcaggctatccccccgaggacgcctccaagcctcctgctgccggcttcgccttacaaccgccgcaacagacactacaacaacctccttaccctacggcaccgggcgctcatcaaccgactccatcgcaccagccaccaccagtccccagtacggcgtcgaagccaaccccctatccttcattga

SEQ ID NO: 11084 - DNA, 540 bp, A.fumigatus
  unsure (534): Identity of nucleotide sequences at the above locations are unknown.
attctcccgaggcctcgcgatgacgacctgatcatccgcacccagaacggcacctggcaggatatcgtcctccaggtgggtcactcgcctctttggccagttgacttcccgcacgccgtgcacaagcatggcaatgagttctggcgactaggttctggtcagggattgtggaagtactcctcggtgtccgaggccttcgccgatcatcccgagaatttcaatatggtcaacccaccctaccgtgatacctttctgacagagttcacaggaacgatgtgggtggtgctacggtaccaggtgacatctccgggggcgtggttgctgcactgtcactttgagatgcatctcgacaacggcatggccatggccattctagatggagttgataagtggcccaaagtgccggatgagtatgccctgggttcccatggatttcgtgtggatggcaagaatggactgcagcattatttcttccagcagggtcatggaccagctaatcaacctaatgtctgcattgctgttggggagctgcantcataa

SEQ ID NO: 11085 - DNA, 336 bp, A.fumigatus
cagcgccgcgacgccgaatataaattgaagataactattgctacacaggctgggacgctaaggagcgttgagatccttgtcttcgatctagactcggcacctcgatcccgcagcatctggatcacccttttgttgccgtgcagtaagtacaccctactccggcctccctggcatgcatgcagccaaagaggagccgaatcggggagcaagggatatgttcctttccttgatatccatatatttagtcttaaattttatctggactgtgggcctgtggctatcatgacggccaagtggaatgaaagaattttctatcacatgaagataaatatttga

SEQ ID NO: 11086 - DNA, 402 bp, A.fumigatus
gggaacggcgagttgagagcaatgacggcgactttggccgcaatacgcggcagtgatgcatatgaggtggctgaccctgagccgtcgggcaggaggaacaggatcttctccgaattccgagaggagcttgcagggacaatagatgaggcgtctggaatgccagcttatgcccgcgatcgatgggtcagtatcaactggattggaggctggacgttcaaaagcctgcagcccacgatcgacgagcacgagatgtggatctatgaggttgatggccattatatcgaaccacgccgggcagagacgttcctcatttgggccggggagcgatactcagccctagtccagctcgataagaaacccatggactattccatccgcgtgcctgacggtggctatttgtaa

SEQ ID NO: 11087 - DNA, 339 bp, A.fumigatus
atgatatcagcttttgggatcttacaatacaaaaacagcaacctagacgctcatcggcctcctgattggtttagcgtcaccacaatctcacagccttttttcgactacaatgcctggccgacctgggacgggatcgtctttctggacaaacttgatcttcctccctggcctcccaaggctcccttcactggcgacggcgacacaatgcatgtcctctacctaggcaaagccaactcgacctgggaatttactttgagtgggaagaaaaaatacccttcggaccgctcggcgtaccaccctctattgtataacgtaaattctcccgaggcctcgcgatga

SEQ ID NO: 11088 - DNA, 363 bp, A.fumigatus
cccatcgatcgcgggcataagctggcattccagacgcctcatctattgtccctgcaagctcctctcggaattcggagaagatcctgttcctcctgcccgacggctcagggtcagccacctcatatgcatcactgccgcgtattgcggccaaagtcgccgtcattgctctcaactcgccgttcccttaagaacgatgtcgacgtgcactgcaccgtcgacgagcttgtcggaagctatctgaaagagatccgcacccgccagcccaccgggccctaccacctcgccggctggtctgcgggcgggattctggcgtaccgagccgctcagattcttcttgcccgtggggaacaggttccctgctga

SEQ ID NO: 11089 - DNA, 417 bp, A.fumigatus
gtcttgctcgatgcgcctccaccgatgggactggggacgcttccacagcatttcttcgatcattgcgacgcaatgggcatcttcggccaggagggcaaggctccggaatggcttataccacatttcaagaagaccaatgccattctcagtggatactatgcgacgccctttgtggctggccagggccccgacaggacaggaatcatctgggcaagtcagagcgtctttgatagtaaaggatgtgctcgaccggcgccgcgccctgaggacatggaggatatgaagttcctcactgaggcacggactgatttctcggcggggatttgggggtccttgttccctggagctgaggtggttgtggataaggccgacggggcaaatcatttctccatgatggtgagggcatcagtactttga

SEQ ID NO: 11090 - DNA, 546 bp, A.fumigatus
ttctcacccacccggccgtcgtgtgggcgactgtgctcctctccaatttcaaccgcatgggatgtcgtggtcagttttgtcgtggcgcagatcttcactgccccaccatactctctcgacgctgtggatattggctacatgtcggccggccctgtcatcggcggcacacttggatcgattgtgtgcggtctggtgtcggatcccgtcgctcgcgcgctcgcgcgccgcaaccgtggtgtctacgagccggagttccgcctcgtcctgatcattcccatgctgatagccagcgcgcttgggtggtttttgtttggaaatctcgtggtcgccggcacgtcaccgtcggtcgttgccgttgtgtgggccatcacgacgatctcgcggcagttcggtatgaccaccatcggggcgtatattctcgatggggtatccaagcatctcgtccgaggtgtttatcatcgggatggtgacgaagaactttgtgttctttgggctttcgtgtgcgtacctttcttccttgtccattggattttaggatgttgctaa

SEQ ID NO: 11091 - DNA, 324 bp, A.fumigatus
gaaatatggggtgagcctctttctgaacagggactcgttccaacaaacgctacacaatcggttccgcgcaagatggcctttggaatcctaagtccctcacatggaccgcagcatgttggcggcacaagcctcttggacacgagcggcgtggacgaggctccatcggttgctgagctggagcgtggaaccggaaaacatgcaaagacggttctgatcccccagccttcgaaggaccccaacgacccacttcggtggccgctatggcaacgcgacttgatgtttcttatgcacatatactgcacgattctgtgtgttggcgggtga

SEQ ID NO: 11092 - DNA, 291 bp, A.fumigatus
ataatatacacaagaagtgcttacaacatgttagaagccttcgaagtcttgacaacatctggggtggtgctgtggtcgaagtcgtatgcgccggtcggagcgcatgttgtcaacagcctaatcaacgatgtcttcattgaggagaaggttcgagcgcagaatcaggcagcgagcagtgcagctcctatctacaagaaggaaaagtatactctgaaatggaagcaagtaaaggatttcaatctgatatttgtggtatgttcacgccgctcgttgattcaatggcgccactga

SEQ ID NO: 11093 - DNA, 663 bp, A.fumigatus
ttcaatcgctatgtctccatcccagctctcaagcattacttcaacgtatcaaattcttacgtcctgaacaagctcgcactcgtgctcttcccctggcgacacaagccttggtctcgtcagcaagcacgtctaacaacatcgtcggccggtcccaatggtcagattgcacagcaacaatactcatccatgttcctcccccctcgtgatgatctgaactctccagatatgtacatccctgtgatggcacttgtcacgtatattcttctttccgcggtgctggcgggattccgaggtcaatttcatccggagctacttggctcgataactacgacggctattgcggttatagtttttgaaatactgtgtctcaagctggccatgtacattctcagcatcaacaatgaatcccagcttttggaccttgtggcatactctggctacaagttcgttggcatcatcgcaactctggttatgtccgagatcttgacaccaggaagggggactggcggttgggttggctgggttgtgttcatgtacacattcctagccaacgcgttcttcttggtaagtgataaattttttgtcacttcagctttccagtccgttgacaagcttccagctccgctcgttgaagtacgttctactcccagactcaaccagtga

SEQ ID NO: 11094 - DNA, 507 bp, A.fumigatus
aagacaagaagacgagacagaatagtcgcaagtcttttgttcatcactagcttctcacttattgtaacaagggaaaaaaaaatcaacatgtaccgccagtctttcgcaccaccgcctgcgcagtcacctccactccaccatcctgtgcctcagcatgtatctaccgttcccatgatgcgctcgcctcctcccccagcatcccagcagcccccgtcgtctggatatggcaatccttatcagccctctcctgcgcagggcggcagcggaacatatgcgcctggttttagtgggttcatcaatgatcccacagcacagatgggattccaagttgggaagacggcgatggctgctggccaggagtatatggaacagaacgtgagttggctaacaaagaagcctactgcaccacaaacctatgagcttctgctgatttttcatagttcaatcgctatgtctccatcccagctctcaagcattacttcaacgtatcaaattcttacgtcctga

SEQ ID NO: 11095 - DNA, 342 bp, A.fumigatus
ggcacttttatcaaatgttccattctgtgtcaatacttgcgcatcttccctagccgccggtttcgatttgcttgccacaccgtgatgggtatcgtcgcattgtactcgacatgggctattgtcagcgcattcgtgaactgcattcctgtagcgaggttctgggaccgcgatattcccggctcctgcctcagtttcgaagctgtctggttctttaacgcgtccatgaacatcgctaccgatctgaccctacttatcatgccgatgccgctcatttctcaactccaacttccccgcatgcagaaaattgcactcatggctgtctttgctgtgggtttactgtga

SEQ ID NO: 11096 - DNA, 216 bp, A.fumigatus
ctccgatcatggtatgtctgtcagctgtaccttgccagcttcttcattatcgaactagcaaggatgatccttgcacgaattaaactacagcaaaagaacgaccagccatctgaagctcaatccagccacaatgcactaaatcacgctatcaccaactctgatagcaaggttactacatcagtgtgttcatcgaatggaaacagtcagtcaatctga

SEQ ID NO: 11097 - DNA, 987 bp, A.fumigatus
agatctgagtggcttcggatcggcccgccaggtcgatgtcatgatgacccgaccaccttctacaagcacaatggccaccaacacactcacatgcactcaggatccaattctctctcaacagtaccagcacagggagagtccatcgacatgccaagcgccctccgcaccttcaccctcaacttcgtcggcgacgtcatgctcggccgcctcgttgatcaactctggccccagcatgtcgacaacgcccacgaacgccgcgtcgtctcctacttcatcgagcgctacccctacctaagcaagtacacccatcgcgacccctggggctccgcgctaccgctcttccacaactccgacctcaacctcattaacctcgaaacctcagcaacaaccaccaacgacccctggcccagcaaggcctttaactaccgcatgcaccccgcgaacgccgccgccctgcgcgaagcccgcatcgactacgccaccctcgcaaacaaccacaccctcgacttcggcaccgacggcctagtcgagacggtctggacaatgaaggagtccaagattgcgtttgcgggagccggcgaaacaacagacgagagccggcggccggcagtcctgcgtcttccacgctgcgcagaagcacacgcacaggatagccacgagcaatcttccaaatcgtacagcgtgcacgtctacgcggcctcggaccacccgcgcgactgggccgtcgtgcccaccttccatctaatcgactactcggcgcgaacacgagagcacctgcgcacgctgctaacatcacctccagcatccaccgacacgcccgagaaacccgcgctcaagatcttctccgtccactggggtccaaattatacgtggcagccggcagagaagatccgctcgctggcgcatttcctaatcgacgagtgcggcgtggacattgtgcatggccactcctcgcaccatgtgcacggtgtcgaccggcaccggcag

SEQ ID NO: 11098 - DNA, 366 bp, A.fumigatus
tctactctggtttgttcttacattcttacattgtgtagactgcccgttccttcgctgtggctcgatgtctttcagaaaatcaaggccctggggttcaattgcgtttcattctacgtcgactgggccctcctcgaaggaaaacctggcgagtacagggctgaaggcaactttgccctcgagcctttctttgacgtggctaagcaggcaggaatctatctcctcgctcgtcctggaccttatatcaatgctgaggcttcgggcggtggtttccctggatggttgcagagagtgaacggaaccctgcggacatccgatcccgcgtacctgaaggctactgataagtatgtcgcgtacgattgtttgtag

SEQ ID NO: 11099 - DNA, 276 bp, A.fumigatus
atcagctacattgcccatgttgctgctactattgccaaaggccaaatcacaaacgggggccccgtcattctttatcaaccggagaatgagtacagcggggcgtgttgtgatgctactttccccgatggggactacatgcaatatgtcatcgaccaggctcgaaacgccggtattgttgtaccattgatcaataacgatgcctggactggaggacacaatgcccctgggacgggcaagggcgaggttgacatctatggtcacgatagctatccgtga

SEQ ID NO: 11100 - DNA, 306 bp, A.fumigatus
ggacacccaagcgtttggcccaagggcaacctgccaaccactttccggacggatcacttgaagcagagcccgacaaccccgtactctcttattgaggtgtgtgtgtgtctcaaatgccctcggatccggacaccactaatcgtcgtgcagttccaagcaggttcctttgatccatggggtggacccggctttgcagcatgcgccgccctcgtcaatcacgagttcgagcgagtattctacaagaatgacctaagctttggagctgctatcctgaacttgtacatggtatggaaggatcccgcttaa

SEQ ID NO: 11101 - DNA, 1239 bp, A.fumigatus
  unsure (1019),(1218): Identity of nucleotide sequences at the above locations are unknown.
tttcgagcagataggaactctgtctacaattactgggtgccacaacttgacaaggacgactcgtcaacgggctacagctccgaaaagactactgcttcgtccattattgtcaaggctggttaccttgtgcgaaccgcttatactaagggctccggcctctatcttactgctgacttcaacgcaacaactcctgtcgaagtgatcggagccccgtcaaacgtccggaacctgtacatcaacggcgagaagacccagttcaagaccgataagaatggtatctggtcaactgaggtcaagtacagtgctcctaagatcaagcttcccagcatgaaggatctggattggaagtatcttgatactctgcaggaggttcagtcaacctatgacgattctgcgtggccagcagccgacctggacaccacacctaacaccttgcgacccttgaccacgccaaagtctctgtactcgtcggactatggcttccatacgggttacctgatctaccgcggccactttgttgctgacggcagcgagactacatttgacgtgcgcacgcaaggaggctcggcctttggcagttccgtctggctgaacgaatcattcctaggctcctggactggtctcaacgccaatgcggactacaactcaacctacaaattgccgcaggtcgagcaaggcaagaactatgtcctcactattctcattgacacaatgggcctcaacgagaactgggttgtcggcacggacgagatgaagaacccccggggtattctctcctacaagctctccggccgggacgcctccgccatcacctggaaattgaccggaaacctcggcggagaggattaccaagacaagatccgcggccctctgaacgaaggtggattgtatgccgaacggcaaggcttccaccagccccagccgcccagccagaagtggaaatcagctagtcctctcgatgggttatccaagcctggcattggcttctacaccgctcagtttgatctggatatcccaancgggtgggacgtgccgctctacttcaactttggcaacagcacgaagtcagcctaccgggtgcagctgtatgtcaacggataccagtacggcaagttcgtcagcaacataggccctcagacaagcttccccgtcccgcagggtatcctgaactatcagggaaacaattgggttgcgttgactctctgggcactcgagtcngatggtgccaagtttggatga

SEQ ID NO: 11102 - DNA, 183 bp, A.fumigatus
  unsure (4),(7),(13): Identity of nucleotide sequences at the above locations are unknown.
ggcnccnattttnacatgcaccaccgtcggatccttctcagccccgtggtgaagacggatgagaagtcactgtttgtcaatggcgagagaatcatgattttcagcggcgaagttcaccctttcaggtgcgacacagacgcggtgatctactctggtttgttcttacattcttacattgtgtag

SEQ ID NO: 11103 - DNA, 675 bp, A.fumigatus
acctttggcggcacgaactggggtaaccttggccatcccggtggatacacatcctacgattatggatcgccgctgactgaatctcgcaatgtcactcgagagaagtacagtgagctcaagttaatcggtaacttcgtgaaagcttcgcagtcttacattctggttacgcctggcaatttgactacctctggatatgccgacaccgctgatttgaccgtgactcctttgctgggcaatggcactggatcgtactttgttgtcagacatacggattacaccagccaggcatgtaccccgtacaaactcagcctcccaaccagtgctggaagactcacagttccccagctcggcggtactctgacgctcaatggacgtgattccaaaattcatgttgtggactacaacgtcgcggggaccaatatcatatactcgactgccgaagtcttcacctggaagaactttggggatagcaaagtcctcatcttgtatggtggacctggcgagcaccatgagctggcggtttccctcaagtccgacgtccaggtcgtcgaaggatctaattcagaattcaagtcgaagaaggtgggggatgttgttgtggttgcctgggatgtgtctccatcccgccgtattgtccagattggcgacctcaagatattcctgctgggtgagtag

SEQ ID NO: 11104 - DNA, 1509 bp, A.fumigatus
acctcaaccccttattcgaggtattgtacccctcgtcaaagaacagaaatactgatcttggccaaggtcatgtcctccgagaaactactctttcccaggcctcatttttttgagggaagcaaactaaactttgcggaaaacctgctgtacccggcaagctcaccagctgaagatactactgcagtgatttctgccacagaatctgatagggaatttgtttcctggaaagagctgcgggagcgcgttcgcaagtgtgccaactccctcagggaggcaggcttgcaagcaggtgatcgtgtggcaggcttcctcggcaaccatgctaacaccgtcattgcaatgctggcgacgacatcaataggtgcctactggaccggcgtgtctcccgatacgggggtccacgccgttctggagcgccttagacagatcgagccgaagattttatttgccgataacgcctcgttatataacggcaaagtgcatagtgctcatgaaaagatccgtcagattgtctctgagctgccagagcttcagctgctggtagtctttgagaccatcaagtcgcatcaattcaatgtcgatgaagtcaagccaacccaagggaaagcgtgcacatacgatacattcctggcttctgtttcaaacgcatctgctgcccttgagtttgccagccttgatcctgatcaccccgtttacatactttactcatctggcaccactggtgcgccgaaacccattgtccatggagcgctgggaacgttgctgcagcacaagaaggagcacgtgctccattgcgatattcatccaggagaccgcttgttctattttacgaccacaacttggatgatgtggcactggttggtgtctggtcttgccagcggtgccaccatcgtcctctacgacggttctcctttccgacccttggacccggaaggagggaacggggagatggccatgccgcgtctgatcgatgagctgagtatcacacatttcgggacatctgcaaaatacctttccatcttggagcaggcctccctcaaaccaacgcagcatcctcaccggccagtgactttgcgaacactgaaggctattttcagcaccgggtctcctcttgcgccctctacattcgaatatgtgtactcttccattcatcctgacattatgctgggttccatcaccggtggtaccgacatcctctcactcttctgtgcgtgctgtccaattttacctgtttacaaaggcgaaatccaatgccgctgtctcggaatggcggtgtcggcatacgactactctggaagtgatatcagcggcacgaatgagcccggtgacctcgtgtgtacattaccatttcccgcccaaccggtgatgttctggccaccaggcccagttggcgctgaaaaataccgcaagagctatttcgacatcttcggcccatccatttggcatcatggcgactttgtccggatcaacccacacacgggaggtgtgcacatgcctgggccgaattga

SEQ ID NO: 11105 - DNA, 291 bp, A.fumigatus
tcaccccgtttacatactttactcatctggcaccactggtgcgccgaaacccattgtccatggagcgctgggaacgttgctgcagcacaagaaggagcacgtgctccattgcgatattcatccaggagaccgcttgttctattttacgaccacaacttggatgatgtggcactggttggtgtctggtcttgccagcggtgccaccatcgtcctctacgacggttctcctttccgacccttggacccggaaggagggaacggggagatggccatgccgcgtctgatcgatga

SEQ ID NO: 11106 - DNA, 492 bp, A.fumigatus
gaggatgtcggtaccaccggtgatggaacccagcataatgtcaggatgaatggaagagtacacatattcgaatgtagagggcgcaagaggagacccggtgctgaaaatagccttcagtgttcgcaaagtcactggccggtgaggatgctgcgttggtttgagggaggcctgctccaagatggaaaggtattttgcagatgtcccgaaatgtgtgatactcagctcatcgatcagacgcggcatggccatctccccgttccctccttccgggtccaagggtcggaaaggagaaccgtcgtagaggacgatggtggcaccgctggcaagaccagacaccaaccagtgccacatcatccaagttgtggtcgtaaaatagaacaagcggtctcctggatgaatatcgcaatggagcacgtgctccttcttgtgctgcagcaacgttcccagcgctccatggacaatgggtttcggcgcaccagtggtgccagatga

SEQ ID NO: 11107 - DNA, 663 bp, A.fumigatus
caatcaaccatgtcctcaaacgtcggcctctccaccccccgcggaagcggtacatcaggctacgtccaacgcaactacgccttcatgaagccgcgcaatgcaggctacggcgcgccgtacccgcccgtttcaggcgcaaatgccaacgattctagccgtgggttcaagcagcggcagcccgataagcagattttggagcatgatcggcggcgcgcggttgaggtgaaggttatggaggagagggagaggcttgaggaggagaacgagcggattgagcaggagggtaaaggcaaaggcgagggcgaagggaaggtgttgtcggaggaggagattgaggagcggtgtgaggcgctcagggcgaggttgttgaaggagatggaggaggaggagaatcgcaagggtgatgcggcagatggtgagagggatgaggggagggagcgcagggggtggaagcgtgggcctagggatagggagcgtgatctgccgccgagagagaggaggcagttcaagacgtatcaggtgcatgagcttgcggaggcgaagattgaggagagtgagcggtttaagaaggcgttggggattcgggaggatacggagacgggggagatctcgagcgggaggaaggattacgaacccaggaagagggatagagagcgttattga

SEQ ID NO: 11108 - DNA, 411 bp, A.fumigatus
tacgtcttgaactgcctcctctctctcggcggcagatcacgctccctatccctaggcccacgcttccaccccctgcgctccctcccctcatccctctcaccatctgccgcatcacccttgcgattctcctcctcctccatctccttcaacaacctcgccctgagcgcctcacaccgctcctcaatctcctcctccgacaacaccttcccttcgccctcgcctttgcctttaccctcctgctcaatccgctcgttctcctcctcaagcctctccctctcctccataaccttcacctcaaccgcgcgccgccgatcatgctccaaaatctgcttatcgggctgccgctgcttgaacccacggctagaatcgttggcatttgcgcctgaaacgggcgggtacggcgcgccgtag

SEQ ID NO: 11109 - DNA, 546 bp, A.fumigatus
ttaaaatgttttgtagcagaagcattgaacctccttaaatcatacgatacactcgtgaaatcgtgctctcataccacgtccgaagaagcatatttttctcgtccgcatgcccatccccatcaagcccctcttcccctcattccctccgaatcggagctttcagagctcttaccgccctgcgctctcccttgtgactcaacaacctcggcagccgacgtccggggtacatcgattgctctcttctctcccattatcatcgggtgcatgccaactcaggttcccatcgcatttccagttgtatcaattggattctctgggttaataaagcgcgcacaccaggccgtctggcctgtatttgaagacgacatgtggaaaccgtcggagagactgatggaaaccatcagacactatgcgagcttccccgccacaggtgtctctctccggcagatggtccagttcggtgacaggccatcgacaggtatgtgtatccatctagttcttctagaataccttgaagtgtttcaattgggccgcagccagggctga

SEQ ID NO: 11110 - DNA, 705 bp, A.fumigatus
gtgaaatgccctcgatcaagaaggtgcaggactggtatgcgcagtcgttcgaggtatgactccacgcctcacccctcttgcagtagaaatagttgctcacgtgctccacaggaaatcatcaacctgccccgaccaactctttctcaagaagtcaaagctcgccttttacggcctgggaagatgagtggcggcttttcaaagattctttctgaaactacacaaaaccccagcatcaaggaggggcagtatcggtcgtcccccacgaacgggaatgggaacgggaagggacatgtcagccgaagatacttctacccatccgatgaccagggccattggccacccgagttgaacgactacaaccaacggtttgcgaagacgctgcagcatatcaaacggcgacacgacagcgtcgtgaccaccgtagcccagggcattttggaatggaagcggaaacgccaacgtttacaaattgattccaccgtccaatcgttcctagatcgcttttatatgtcccgtattggtatacgaatgttaatcggtcaacacatcgccctgacggaacagacgcatgttcgccacccgaactacgtcggtatcatctgcaccaagacaaatgtccgagaagtcgccctcgaggccattgacaatgctcgtttcgtctgtgaggtcttcaccacgggggtcgcggcatccgcgcttaggtat

SEQ ID NO: 11111 - DNA, 1017 bp, A.fumigatus
  unsure (580): Identity of nucleotide sequences at the above locations are unknown.
ttccgtgtgcctggctcatcagacgcagcaccatcgccaacgccacagttgccttcagagccgtctttgcagtcattgtcgcaagagcctccagtttcatcctcccagtcgttgccagagcgtccttctcagaccaagactgtcgattcgaatcaggatgctacccagagtgacaaacgctttcgccgtcgcttgagtgagcagccgcccagcaaacgccagcgcaccttgtcctactccctcttcccggctccgattgaccgtgctcgcttccttggagatctgactactactcctaagaaaatgtcccaagccgttcagccagaatcacgtccagatgaagcagagaagccatctgcggcacaggaccaacctccatcgacttctcaggtgacggatgtcagtgaacaggggcccttacttcagacggctgaggacactactcaaaagaagcgaaagcggtccccgtcgcctgatgtcattcccaatccggctggatgcagctatggattggacctggattatttctgctatagctctgacagcgaagaggaggccgatgtgcaaccccagcaggctntacctcctacgaaacctgatgctctagtcaagtctgccgttcgcagtgctatgcggtcggaacaagcgtcagcgaagagggtgcgtttcgatgccagccccgaggataccccttctaaacttcgcacgcgtcctcgtgccacggacccctatacgggaagacactttatcggcatgggcgatgctgctcgagtgacgacgcatggttcccttgccgctgcgcccgcaacaccaacgcctgctcctcgtgtcgatttgtctactcctcagcggtctccgggtttcattcccaacaaacaaggcacgttccagctggattacgatgctttctctgacgattcagagtcgagcggcgcgccttctccaaaatcacccgctgccaagtctgtcactgagactcaaaccaccactaccagtacagaagtacaagaaaggtaa

SEQ ID NO: 11112 - DNA, 261 bp, A.fumigatus
ggcttgtgggccacacaaccagcggcagaacgggctagtttagggcttaggcgggcaacgttggttctgctcctccatcctcgagtgctgcgattttatctcaggcccagagtcaacgacaattgctccgcccgcgttcatcctcctccctcctctcgcggccccttcatcgtcaatatggctgagcagatggttcttcgtggtacccttgagggccacaatggctgggttacttccctggctacctctctggagaagtaa

SEQ ID NO: 11113 - DNA, 234 bp, A.fumigatus
agaaacgtttgttttggaagactttgggcattgattgagcacgtggacaaattgattctgacttggatgtttctttcgaatagccccaacatgctgctctctggcagtcgcgacaagaccctgatcatctggaaccttacccgcgacgagcaggcctacggttaccccaagcgcagcctcgagggtcactcccacatcgtctctgactgtgtatgctacccgaaatcccactga

SEQ ID NO: 11114 - DNA, 471 bp, A.fumigatus
cgagattggctgaccgcgtgtgtgttttgttccgtgcaggtcatctcctccgacggtgcctacgctctgtctgcctcttgggacaagtccctccgcctgtgggagctcgctaccggcgagaccactcgtaccttcgttggccacaccagcgacgtcctctccgtctccttctccgccgacaaccgccagatcgtctccggttctcgtgaccgcaccatcaagctgtggaacaccctcggcgactgcaagtttaccatcaccgacaagggccacaccgactgggtttcctgcgttcgcttcagccccaacccccagaaccccgtcatcgtttccgctggctgggacaagctcgtcaaggtacgtttatcccgatctttccctgacgcgatgtatacccaattcgaaaccgtctgcccaaatgatgttttgcataatacgtatttgctacttcagagccttctatggccatga

SEQ ID NO: 11115 - DNA, 540 bp, A.fumigatus
tggacacttcgcaatcttggttttgcacctttatgcatgggaccaactcatctattcccctgggggattgaagctaacccaaggataccctttaggtttgggagctcgcttcctgccgcctccagaccgaccacatcggtcacaccggttacatcaacaccgtcaccatctcccccgatggatccctctgcgcctccggtggcaaggacggcaccaccatgctctgggatctcaacgagtccaagcacctctactccctccacgctggcgacgagatccacgccctcgtcttctcccccaaccgctactggctctgcgccgccaccgccagctccatcaccatcttcgatctcgagaagaagagcaaggttgatgagctcaagcccgagttcatcgagaagagctccaaggcccgtgagcccgagtgtatctctctcgcctggagcgctgatggccagactctgttcgctggttacactgacaacaagatccgtgcctggggtgtcatgtcgagggcatagagggttgacgagcgtttag

SEQ ID NO: 11116 - DNA, 855 bp, A.fumigatus
ccgcgtgtgtgttttgttccgtgcaggtcatctcctccgacggtgcctacgctctgtctgcctcttgggacaagtccctccgcctgtgggagctcgctaccggcgagaccactcgtaccttcgttggccacaccagcgacgtcctctccgtctccttctccgccgacaaccgccagatcgtctccggttctcgtgaccgcaccatcaagctgtggaacaccctcggcgactgcaagtttaccatcaccgacaagggccacaccgactgggtttcctgcgttcgcttcagccccaacccccagaaccccgtcatcgtttccgctggctgggacaagctcgtcaaggtacgtttatcccgatctttccctgacgcgatgtatacccaattcgaaaccgtctgcccaaatgatgttttgcataatacgtatttgctacttcagagccttctatggccatgagacaaacaatcaccaatgccctgatggacacttcgcaatcttggttttgcacctttatgcatgggaccaactcatctattcccctgggggattgaagctaacccaaggataccctttaggtttgggagctcgcttcctgccgcctccagaccgaccacatcggtcacaccggttacatcaacaccgtcaccatctcccccgatggatccctctgcgcctccggtggcaaggacggcaccaccatgctctgggatctcaacgagtccaagcacctctactccctccacgctggcgacgagatccacgccctcgtcttctcccccaaccgctactggctctgcgccgccaccgccagctccatcaccatcttcgatctcgagaagaagagcaaggttga

SEQ ID NO: 11117 - DNA, 426 bp, A.fumigatus
gtttgggagctcgcttcctgccgcctccagaccgaccacatcggtcacaccggttacatcaacaccgtcaccatctcccccgatggatccctctgcgcctccggtggcaaggacggcaccaccatgctctgggatctcaacgagtccaagcacctctactccctccacgctggcgacgagatccacgccctcgtcttctcccccaaccgctactggctctgcgccgccaccgccagctccatcaccatcttcgatctcgagaagaagagcaaggttgatgagctcaagcccgagttcatcgagaagagctccaaggcccgtgagcccgagtgtatctctctcgcctggagcgctgatggccagactctgttcgctggttacactgacaacaagatccgtgcctggggtgtcatgtcgagggcatag

SEQ ID NO: 11118 - DNA, 957 bp, A.fumigatus
ctggcaagcatcctttctcagaagaggtggtgggaatccatctcccaggtatcgaggatgttagagaaggccgggctggcgaaacccgcgatccaggttctcgaacgcacaaagaccgagtgcctaaagtgggtggaagaaggtagaaagaagaaggatgcacagaggccggaagccgaagcggtgacggagtccattcagatcgacgaccctgacgcgctagtaatgcatcagaagatgaaggagctggacgagtacgaagaccgccagcgggacaaggtcctaaagaaagttgtcggcatccacatgaagctcgcagagctgtacgcaagcgactacatccaggatgagaagaaggccgaaggctaccaggaagccgcggtggaactgtgtctgaaagagcttcgccgccgccaggagctcggactccctgtcgggagcgcctcacaagactccacagcctggctgaacctatccgagattgccactgcactcacagatctgggacagacatatctaaagcaggagaagaacgagctcgccatgccactcttgctgcgcgcgctggacctcctacgcacagacgaaggcagcacaccctcctgcaagcaggtgacgctcctcgcgaatgtgtccaccgccatcacgggtgaactgcataagaagactccttctcgtgggtctactgccgcacctcaacaactcatcgactcaggcaaccagtgggcgcaaaaggccctagacgttgctgctaatctgcagcctcctatccgcgacgaggaatgcgatgtgtcctgtatcgcggcaatgtataacctgggagaaattgcccatcttcagggcaagcggaaggaagccgaacagtattggaaggaggccaagtctctggctcgcgggctgggactcgaagagaatgccgcccatgtggaggaagctctggcgcaattgacgaaatga

SEQ ID NO: 11119 - DNA, 555 bp, A.fumigatus
actccaaaacgagctatactaacccacgaacagcaccaattaggcacaaaagtcagccctgcggacttcaagcccgagtttcgtgccgagacttatcctcctggcaccgctcccgccagcaattcatacaccccgaacaccaccggggagtccggcggccaggccttgaaccccttggtcgagcgcagccacggaaaggaggctgtcaaaaccactgccgagtcgaccctgaggggagccacctccaaggatgtccacaggggtctgggccaccccggctctggccagaccaagaccgaaatcaagcacgatggccagcaccaccggaagcacgagggtgccggcctcgagggcgttggcagctaccgtgaagacaagtttgagcgcacattggctgaccagcgtggtattgagcgcgaagaggccaggcccaacgaccacggcgacaaaggcgtttcggcggccgaagatatccctccacagtcggcagagatggcggctcacgaatggaagtatgagcctggtaccaagaaggataacgctgccagacactag

SEQ ID NO: 11120 - DNA, 426 bp, A.fumigatus
tatacctgttcaatagtactccagaaactgatcgacggcggtcacaaagtcattattatcactcatgcatataaagggcggactggagttcgatatcttaccaatggcctcaaagtctaccacatccccttcttcgtcatttatcgcgagtcgacaatgccgacagttttctccttcttccccctctttcggaatatcgtgatccgtgaacaagtacaaatcgtgcatggccacggtagtatgagcagcttatgccatgaagcaattctacatgcccgaacgatgggtttgcggacggtctttaccgaccactctctatttgggtttgcggatgccggctcgattttggcgaacaagatgctcaaattcacattgagtgacgttgaccatgtcatttgcgtcagtcatacatggtacgttcgttga

SEQ ID NO: 11121 - DNA, 1032 bp, A.fumigatus
gtcttacctggggacagcaaggagaatacggtgctccgagcgtcattagacccattgatggtctcggtcattcccaacgccgtggtcgcagaaaacttccgccctctctctcacgatgctcaaaaaggcgagaggacatcgggagaaatcgaacggcgaccatcacctgcaccgatcgggccggacgatactatcacaattgttgtcatctcgcgtctcttctacaacaaaggaactgatctcctgattgcagttataccaaggattctggcgtcccacccgaatgtacggtttatcgtcgcgggctcggggcctcaggcaatcgatttagagcagatgctggaaagaaacgtgctacaggacaaagttgaattacttgggtcgattcggcatgaggaagtccgggatgtgatggtccgaggtcacatctatttacatccgagtctgacggaggcatttggtacagtcattgtcgaagctgctagctgtggtctttacgtggtctgtactcgcgttggtggcatcccagaagtgttaccgcagcacatgacgacttttgcgaagcctgaagaggacgatttagtcctggccactgaaaaggcgattgccgctttgcgttcgaacaaagtgcgaacagatcgattccacgatcaggtcaagatgatgtattcatggacggatgtggctcaacggacagagcgcgtctacaaaggcatcactggtgatatcagcccggaggaattctatggatattaccccggtcagggctgggaagccaacgccgacagggtgcggagttttgctctgatcgatcggctgaaacgatactacgggtgtggtgtctgggccggcaaactgttttgcctctgtgcagtaatagatttcctgctttacgtgtttctcgagatgtggtttccgagatcgaacatcgatatagcccgcagttggcccaaaaagctcggtccaaatggcgagaagagtcaccatctcaacaacagagctcgaactagccaggagcgtcttgccccatga

SEQ ID NO: 11122 - DNA, 1764 bp, A.fumigatus
ctcccccgcagcgagggtccttccagccgcctggtgaagacccagaacagagattcgaactttgacgtgttggactatgttgacccgctcattgggacgtcaaatggtggccattccttcgccggagcgacactgccctttggcatggccaaagcagtagcagacacgcaaggcgagaatcaagctggcttcgcatacgacacccaggtggtgaccggctttagccatatgcacgacagcggaactggtggatcaccatccttgggcaatttccccctctttgctcatgcgagctgtccgggggatgacctcaatcaatgcaagtggcagcagcctgatcgggcggttgcgtgggtgccaaactcccccaaagcccgaccaggctactttagcatcgcattggagaatggcgtaaatgccgagatgacagtgacgaaccggtcagccttgtatcggttcaaattcagcggcgcctccggaccgctcagcccggtgattctagtcgacttgatcgacctgccccagtcccgcacgaacggtaccgcctcggtggacccattgacgggacgattgaccggtaacggcactttcaatccgagctttgggataggcagctacgttcttcacttttgtgctgatttcaaaggcgccgaactccgtgacacgggcgtgtggctgaaaacccgggcgggtacgaaccaaacgacagtctcggtgactccggatggcacaaacaccgcgtcgactctttctgctggaacttttgcccgattccatgccccagccgacaaaaccattttggccagggttggggtgagcttcatcagcgtcgaacaagcatgttccaatggagaaagagagcagccggactttgactttgacggcacggtatctgcggccgagaaagcatggagagagaagttgcaggtgattgaggttgacgcagagagcgtctctgctgatcttcagaaagtgttttggagcggagtgtaccgtaccatgatcagtccccaggattacacgggagagaatccgctgtggcagagtgaggagccgtactacgacagctactattgcatctgggactcatatcgtggggtgcatcagttgctcacattgctcgaccctatctcgcagtcacggatgatccggagtctggtagacatttaccgccacgagggatatctcccagactgccgcatgtcgctgtgcaaggggttcactcagggaggctccaacgccgacgttctcattgctgacgcatatttcaagaacgtcagtgatgtagactgggctaccgcttatgaagctgtggtcaaggacgcagaagtcgagccagccaactggaatgtagaaggccgagggggcctccagagctggaagaccctcgggtatatcccgaccgatgattatgatccgtatgggattggcacgcatacgcgcagtatctcgcggacggtggagtacgcgtacaatgacttttgcattgcggcgctggccaagcggctgggccatgacgccgactttgaaaagtacattcaacgctcgactaactggcagaacatgtttaaagaggatcagaggtcgtacatcaacgggttggacacaggctttgccgggttcctacagccgcgctacctcaacggaacatggggattccaggatccgatcttttgtagtccgctgtacaactttacctcgtgctatctcaatcccgctggacacgagacctacgaggggagctgctggctctacacattgtga

SEQ ID NO: 11123 - DNA, 351 bp, A.fumigatus
  unsure (345): Identity of nucleotide sequences at the above locations are unknown.
cccgctgccctcagctacgtaccgcacgatatggcctctctcatcacccgtctcggcggtccagagacattcacctcgcgactgtcttacctgcatgattcggggattctctacgtgggcgacgaacaagctttcctgccggttttccaattccactattccggccgacctggcctctccgctgcgcgagcacacttctacatcccatcccagttcaacgcaaccatcccaggaatcccggggaacgacgacggcggcgcgatgggcgcattcgccgtgctgagcatgatgggtcttcaccacggggctggaaggatccgacggtggcgctatgtctatcaaacncagcag

SEQ ID NO: 11124 - DNA, 951 bp, A.fumigatus
catgctttgagcacagatgtcaagttacaactcgctcctgcctatggcgacttcctcgccgcactgcctcccaacccctccacatctgcccttgctggtaagatgacggacaagcttgtagcggaatttcgctacctccttgcccaggccacggggtctaccgccaagttcttgcaatacctgacatacggatacatgattgacaacattgcgcttctgatcaccggaaccttgcacgagcgggacacgcgagagctgctggagcgatgccatcccctaggctggttcgaaaccttgccggtgctatgcgttgccaccaacatcgaggaactgtacaattcggtgctgatagaaacaccattggcggattatttcaaagggagtctcagccaccaggacttggatgaattaaatatcgaaatcgtgcgcaatacgctctacaagaactacctcgaggacttccacaatttcgtcaacacccatccggacttcaagggtactcctacgcaagaggtcatgtctgagctgttgcagttcgaggccgaccgtcgtgcaatcaacatcactctgaactcattcggcaccgagctctcgaagcaggaacggaggaagctgtaccccgagttcgggaagctctaccctgaggggtctctgatgctgtcccgcgccgatgacctcgaaggcgtgtctttggccgtgagtgtgaatgccgactacaaggcgttcttcgacgcagttggtctcagccagggtggtggtggaggcttcgggatgggtggcggctcagatgggaagagcctggaagatctattctaccaaaaggaaatggagttgtgtaagattgtcttcacgcgccagttcaccccggcggtggtatacgcgtggatgcgtctcaaggaacaggttcgtcgctcgagctcgatgacaatattcccttcacagcgccgctga

SEQ ID NO: 11125 - DNA, 735 bp, A.fumigatus
agagcttccagaaattcgacagtgctgctacagctctggaagaagtggcttcgcttgtggaaggaaaggttactcctcgccttgccagcttgctggatgagattaaggatgagaagaaggtttctctggccgttgccgatcccaagctcggtacgtgacatgaacattttgagaagtcaaattactcagtttctaatcctgtgtctaccgaaaggcaacgcgattggcaagcttcctggcatgtctattcaattggtcgcggactcgaccacgaccgatatcttccgtgctattcgcgaacatcttcccacactcattcctggccttctcccccaggacatgtctaccatgtcccttggtctgtcccactctctcgccagacacaagctgaagttctcccccgataagatcgatactatgattgtgcaagctattggtttgctggatgacctggacaaggagctcaacacctacgccatgcgtgtgaaggaatggtacggctggcatttccccgagctcgctaagattttgaacgacaacattgcctatgccaaacttgtactcaagatgggcatgagatcgaactgggagaccgcggatctcacagaaatccttccggaggagcttgaggccaccgtcaaggccgctgctgaccgctccatgggtacagagatcagccaggaggatttggagaacatccaagcattggctgagcaggttgttggtttcgccgaa

SEQ ID NO: 11126 - DNA, 405 bp, A.fumigatus
acgcatatcgcggatccttcgagccccgtggtgaagatcctgccacccgtccctgccaacttccgcgtcgccaacaaggacacgaccttacctgttggaggtgggccggatcaaaagtcccccgtctacatccgcaagggcacaatagtcacctacagtgtatatgccatgcaccgccggacagacttctatggtccggacgcgaacgagttccgacccgaacgctgggaagaaaacggcaaacgaggatgggagtatcttccctttaacggcggtccgagaatctgccttggccgtgagtttctcctttctctcacgaggcctcaatttctagctaacatctgcagaacaatacgcactcacggaggccagcttcacgattgtcaagttacttcagcgatttga

SEQ ID NO: 11127 - DNA, 1023 bp, A.fumigatus
  unsure (974): Identity of nucleotide sequences at the above locations are unknown.
caagtgcagattcaccaactacggactctactctctgggcgtctcatagagccaataatccccatcatcaaccccaaggtggcttcgaggaggccactgccaaagtcaccgcgtgtgctctttgaacagctctcgcagacggcacgcgcgagcgtcgcagaggtccaggagttccaggctatgtggcgcagccctgagatgaaagccatctgggaccatgtggatgcgcggatcaagcagaatgggggccagctgctccagccgacggggatgtgggagcaggactacgatgttcttcttgaggaacttgagaaggaggaacaggcgcaaaaggagcagcagcagagggctaaagaggaggaggaacgcgccaagattcaaggggttgagggcggctggaggacgatcgtggagacgttcactcgacgaaatctaccaggtattcgggtgatggctcaccaggaccagcccaggatcactgttgtttcggtcaaggctggcatggcatttcaactgcaggctgtcaatggagatggacatgatatggtcgattggcgggttcaggaactggcggctcctgggaggccgaagacaaagctggaaacggcggttgcagcttgtctgaatgctcgtccgcggcaatgggatcttgcatatctactggtaagttcaaatattgacattaacaacagatacaacgggacacgtctaacccttaattcaggacatgatagcctcctactccgacgtcaaacagacgccgtgcgtgaaatgcggcaaaatgaccgacaacgccgcgcaactgccctccgtccgcaggcccaaccccctccaatcgtcccaaggccaaccattcctctgggaagcataccaccccacctgcatcgatcctcccccggtctctcgccctaccttcacctaatcatgcaccccatgcacaacatcatgcccgccggatactcccccccccccanatcccaatatcccccccggaaattaaatgggcccctcctcctccctcct

SEQ ID NO: 11128 - DNA, 183 bp, A.fumigatus
ctaacatctgcagaacaatacgcactcacggaggccagcttcacgattgtcaagttacttcagcgatttgatcggattgagaacggggatccggatctgattgagccaatccagcagacgaatctcactctggcgcatgatagaggtgtatatatcagactgtactcgtcgaaggcactctga

SEQ ID NO: 11129 - DNA, 237 bp, A.fumigatus
  unsure (189): Identity of nucleotide sequences at the above locations are unknown.
ccgacaacgccgcgcaactgccctccgtccgcaggcccaaccccctccaatcgtcccaaggccaaccattcctctgggaagcataccaccccacctgcatcgatcctcccccggtctctcgccctaccttcacctaatcatgcaccccatgcacaacatcatgcccgccggatactcccccccccccanatcccaatatcccccccggaaattaaatgggcccctcctcctccctcc

SEQ ID NO: 11130 - DNA, 1590 bp, A.fumigatus
agactagatctattcgatctcgaggagttctatcagcggctcgccaactgggtcgggaatccgactgtcgatgaagatactgtcagctcaatcttctatcttgttctcgccatcggagttcaggtttcggaggttaatcaggatctcgccgaacagtacttcgtcagcggccgccagctcgcattctctgctttcaccgaaacccccagcatatacacgatccaatcttacgtcttgatctcaatgtatatgcttggtgcgtgtcgtcgcaatggtgcgttcatgaacctgggaatcgctttacgggccgcatatgccgttggcattcatcgaagggatgcgaatgctcttttctgcactcgggagcgtcgggcccgggagcgggtttggaaaagcttacggatgatagatctgttcctgagcgcttccttaggacgtcccccggcgacctcggattttgatcatgatgtacgcgatccggcgacacttgcaggggagcaacagctaccccgacctgaagcgcagttatcccaatgcgtggttgcattatgccgtatctttgaccgcatcctaactgaagtctacatgaagcaagttgtctcgatcaatgttgcggaaacgatctcaaatcagcaccgggcttgggtccggtaccttgcaactttcttcagtggccagacggagcggttgagctcaaagaatcttgagagtatgctggctgcggctcacgtattcggcgcatattactggtcaatcatcctgttaactcgacctttttttatatttcgtgtgtctcaatacgtcaagagtaaaagtgatccgggtatcagctccaacgatccgagagccagcgcctctcgcatcgctatcttctctgacgcttgtgtttactctgctttacgctgtctcaatattgtggacgatctgtctcgattcgaagctctgcctcggagactaccttttctaattaattcagttttcaactcggccgtcgtgctgggagccgcgttctttgctgagtatgacaatcttctcccacttgaggaaggtatggacaagtccgaaaagtttctggggctatttgtgccacatgatccgcacgcctgtcgattttaccagatcatcaaatacctgcgaggtgcggtggccgaatatgttcgtcgtcgaaaccgtcagtggatggaacgccgcagcaaacaggtcgaccagctgtttggccaagttgggcttagaagcgaaccatcagcgtccagcgacgacgtggttataagccgcaatggcgagccgttagctccttctccctcatctcccgaaaagctcgctacaggctcgctttcagctcaaggtgcccaacccacagcctccacaggtgaatcagagaatgacatttggaacaccctttgtggtactcaaggagcgactgcactgccgtatgatagtactatatccacactgacaacaacggggatacccattggttgttcaccgggaggaaccctcacgaccgctcaaccgggaatggacacagatgctggaggcagacgcccgtcttttccacgaggggacgaaggtgccgcgaaaagcgctcta

SEQ ID NO: 11131 - DNA, 216 bp, A.fumigatus
gcaatctattatttttctctactccgtaatttactagacatcaacgacaacggggacaaaacgcatcatctcagtccgttctccatcctatggtcaaccgtcatcgtcgtaaccaagtacagcgcgaccagctcatcgttgttagtccttcctcgtggctctctttttgccgcctccgacctccaatactcattatttcttcccttcccgccttga

SEQ ID NO: 11132 - DNA, 279 bp, A.fumigatus
  unsure (258),(259),(261),(262),(263),(271),(272),(273): Identity of nucleotide sequences at the above locations are unknown.
caatatccgcatacaggataccagcgcaactcgtgtggttactgcaagtctgataatggaagtgagtgtgtcttctttatcacctgccccacttcctctcacctgccatcattctcttcgctctgcttcaatgcctttgctgatcagtatatgcaggtgctgcctactacactagttctgtttcagtacgcccggaacattacgatatcctcgtcaatcgcggctgtcttcaccacggggtggcaaggacgtgccagnngnnngtctattnnnacaccc

SEQ ID NO: 11133 - DNA, 3183 bp, A.fumigatus
  unsure (3179): Identity of nucleotide sequences at the above locations are unknown.
ggctacctctcgtcggacaaagacatggccatcccccgcactcctgtcaagagcgggcaagagctatatcaattgatcgaaatcctcaatcaacagttccatcttgaaatccccaatcctcgaatctattcgccgtcagttggtcgcaatgagcagacgcctcgatggcgcacgtataaaggcctcaaacggctctacttcaatcgcgaggttggccttggccggatcttgaatgatttcgaggaatgggtccattctcgcccaacgtcgcacttgagaacgcacagtggcgtgggccgtatatcgcagagtcgctcagctttgtcaagaagggatcaattgatggtcgaggatgccaccgtcatctctacgcatgagaagaacgagcgccttgagtatctgttgaagctcgtggatgacgaaatatacttgctgagcagagggtcggtccgcgtctgtgcggatgacaatcgtatgcaaatatcaccaagtacggtgctcaggccacctaagagaagaatccctgaagaagaggaggatgacgaagagtatcacaccgcgcccaactcgcctgtgaagaaccccaccgttcaagatcacgtcgctgtagatggagatgagcttcagcccctagctactgacagagacaattggaacaccggttcctcgctaatggtcaacgagtccgtccatgtctttaagacccctatggcattggatagaggcaaagaaccatcccgatttctcgagaagcttaccgctccagacaatgttcatcgatacgacacggcgccgagtgcacatgcaggactgagctttaccttctccagtgttgccacgtcatttggccgtgaatccaggcgccagcttgatacttccttcacctcgacggttaccgacgttactgagcccatggtcgactctgattctatgtatgaagattcagttgtggggcatctgatcagccacgagttggacgtgaccatagatgatataggcccgatgactgaaactcctcctgaagaagcccctcattcaattgagggacgaatcatggaacagcttctgcacagtgggccgttctcactagaccaaccatttccaaagtcgattcctctgcgatatcggtacgagctggaacgggttggtagagcatggggtgtgcctttgggccgcatgctagttgggagcagcatgtccttcaaatcatatggtgagttttggaagtggattgaaggccataatcagcgatgtgggaagccactcccagaaaagtcgactagtaaagcatgggaagcggttactggttcattcaagacggacaagcactcggaggtcgtcatcctctcaggcgacctggactggtgcagtgagtcggaaccgggcatcctcaaattcaagttgaatcccctcaagacggagcgaacctgccggtttcgtcgacgctttggatccgatcgatatctcagcttgacaatgcctgcgccggcacggccgccacgccatttacgcttcagctcgcatccaacacttttgcgtgagagtctagccctgtggctcacccagcatgtccatcgatgcctagggcggacatggcggcccttctacgtggaagatgtcaagacaaagcgcaaagtcaagacgaccgagccaaggttcagagtggagttctttgcaatcgatggtgtcgattttggacacagcccgggcacagtgccatccattgctcctcagggccaagacagcgataatcatacaccgatgagtctagaagcgctgatagactggcacatgcccctggaggccaatgtaaatcagtccaactgcaagttgtttcagcggatctccctaggtctgtccaaaacttatgctacagttaccttgaaaccatggcagatcttgcacctcagagatgtaccgaaccgtccagtcatgaacgatggttgcgctctcatgtctagacctttagctaatgcaatctgtgatcagttaggaattactggaaacacccctagcgctttccagggaaggattgcgggtgccaaagggctatggatggtggaccgccacaactctggcatttctggagggggtgatgatttctggatccagatatcagactcccagttgaaaatccagccgcatccccaggcgtggcggggaccggttgatgatgagaaactcacatttgaggtggtcaagtggtccaaacccttgcacccggtggaactgaacacccagttgcttgccatcctcgagcatggtggccaggtcagggaacacattgctgagctcacccgagctggcattagggcgatttctcaagactttgccagtgtgctggagtctaacagcgctgcattatgccgtagccttatccagaagatcaagcccatggccgatgacggcttatcggggataaaccagaggatgaagcgtctggagcagtggactgctaacgatgcggaagccatcatcaggcttaccgaagctgggttcgctccacggagcttttaccccctacgcaggcggctgggaagatgtctgagagacttgcttgaccgctatgtggatgagttacatatcgaagtcccactttccacttatgccttctgcattgcagacccgtacggggttcttaaagaggacgaggtgcatttcgggttttcgaacaactggcgcgatgcccggggccaattcgaggacaacctccttgacggcgtggacgttctggtcggtcgtctccctgcgcacgtaccctctgatatccagcgtcgacgagctgtgtggaaaacggagcttcggcacttcaaggatgtcatcgtctttcccactacgggtgacattccactggcacatatgctgtctggtggcgactacgatggagatacgccgtggatatgctgggaccagaacattgtgcagcgctttcaaaattccgacctgcctacagaggagtacccgccagagcattttggactcacaaaacattcggtgtccatgagggacatacagtcgacggacgagtttcttcagagtgcctttacttttaacctgacgacctcgaatctatgccgatgcaccgtagagcacgagaagaatgcatacgacgagtcgattgactcggccagagccaaggagctggcctgtctgcttagccatctggtcgatggccgcanatga

SEQ ID NO: 11134 - DNA, 516 bp, A.fumigatus
ccaagaaagctatggcaaggtggtttgagcaattttgaggcctcagttaacgaacggattgatgctgctaatgtgacccgacgttgtgagcaacctcaacagtctcagcaacagcaccttccgccgcccaatggaccacagctgaacaacccaccggcgagtaaccttctattacccgctatgacaaatggacactggaaaactgaagagcttggttacttctggcctgatatgccagaagatgctagcattaagcagtacaatacaagcctgttctataaggatgtgaatgtgtttaccgaccgtgtgaaagatgtaattgattataaaggtgaaccccttgtcaaagcaaacttacaagtgagtcttcgaggcgccgcgttggactggttcaccaacgaactcactgagttggaaaaacagtccctttgtgctcttccgttagaccaaggatggttacctgagctggtaaaacgttttaggccacgtgctgctgatgctctggtcaagttataa

SEQ ID NO: 11135 - DNA, 231 bp, A.fumigatus
tccctttcttatggatacaacgatgttaggaatgacaggacccctcgcgcctttgcacaagatgttatttgtcatgcccgcgctgcccaagttaatgatatattcaaccagatcacaatggtttggacccggcttgagccatatctccggcgtgatattcccaaacctacccctactaccacattgacccagttcctcgagcagttggagtcccgctccggcatcgtcttc

SEQ ID NO: 11136 - DNA, 2088 bp, A.fumigatus
cttcccggttctcttaaactttctgaggttgagatggaaggaagcgtggttgaaggtatttctacctctctcccgacatgccctctattttcgcaaccacatgactctcagagcctttttgctcctgagggtctaccaactcccccatcttaccatgacatgcatgtgaatgatctggggcttacacctccccctgggtcacagctgctacaacctaccaatgccactggaccgaaacccttgcatgacgagcacgggtcatccagcggagatgtgaggatatccatggccggtcagcccacagggtcgaaccacgatcatcagacgagaggctcgcggaagggcacgtccgacgatccgtctccgttgaaacggaggcgttcatcgaaccccgaagttgggccattttttcctgatggtcctgccgccagcccaatcgggtcgattgaggttgccgcaaatgccgcagcgcagaccagacttccgcagcccttgagctcgaacaatacgccaaatgcagacaatctgctctacgatcctctctttggtccggactttatgctgcccaatttcgacgcgaatccttcttctttgaaacgaaccgccgacgaagccttggctgatgatttccaagtgtggcacaggcctgaaaaacgactgataccggattcactacaatgctccaatgctccttctctggatgcaacaccgtctctctcctctcctgacactattcagttagatcattttgaaacagtgcccaatacaccaggcggtattgcagactcgcaattacccgcgcctccttttgacccctttggttctctgtttgaagatcctgccttccatattccatcggacctatcgaaaattgagtattcttctgagaatagacaagcacctcactctgcagacgcggagccttcgtatgatgcgtcttgtcccccgagcttcaatgtccaggtacaggctgctgaccctgtgactttcgatcatgagaccgagagcgtatcactttccacaagtgaattgaccaagcgtcagttctctctggatactcaagatgttcttgccaacgcagaccgtgaaactctgcagcgagttgaccatgtacctgaatacacatctccatatccgatgtaccatgggcctttgggctatcttccctctgctccgggaattcacgtcaagtgcattcagatcgccaacgaccaagtcaacgcccgtttttcgcacctcaaatacaaagtccaacaactcaaatatgaaagagacaaatacagggatgcgtggtcgaaatggacagcactggaagcatcaacagggaagccaagggcacagatactcgaagaggaaaacgcgacgctacggcgcgtgtccacccaacaccaaagaagagcggagcagtacaagcaagaaatagaggtgtggaaaggcagactgcatgatctcagtgttatatacaacaacctcctctatgagatacaggttcagaagaaaattcctgcagtggcccccattccgcgcgggtaccggccccggtatcagccacaggctgctacacatgtgcaatctgttgcacccggtcagcagcttgcgagcactccttatatccctgtgcctcatcaaaattcgcctcccagcaattttccacctagtggcatcacaaccggatcagtgcaacacccctctccggcggagccactgccagaaacgatgactattgatcttactgacgaagcgcccaacgtctcacccaatccatcttcgatagctccatcgaagccaatgcaggaaagcggggagcttcttcaatcattgcagaaaaagaagtacaattggctcgaaacagcgaaattaggttccgcacagcctgtggtagctcgagcgggacctcgacctctgcctcgcccggaatccgcgcctcgagcttctcaactgcctcccccgccacgctcaagtagcaatcagcagcccagcatacctcatcccgtgactcaggcagcaagcagtgttaatcatgacgatgagatagatgtcgaggacgatttacttcacgagatggaggaggagctggcgcgaggctga

SEQ ID NO: 11137 - DNA, 198 bp, A.fumigatus
tgggataggaagagagatggcaggacgagacatagagacggacagggactcgggaccgctactggctgtaatttcatttccgtgtatcgatggtggactattgttcggtgctggattcaatttcactatttgagcacatctgaaggacgtattacacgtcgtaacaagactgcattcaccctcaaggtaatttattga

SEQ ID NO: 11138 - DNA, 1461 bp, A.fumigatus
cagacgcccagaatgaacatggccaaaaaaccagccacccgcctgatgctcactgcagcgctgttgtccgcagtgatcctcgtcgccaaacttcaatccaaccatttcgacttgcaaacgagttttctgtcctcgtatcactccacagctggccattatgggcagtcacatatcaaggccggtgaatccaagaccgcttgctcaggcggccccggcagcgaagcctggtctcactgtcaggatggacagtccgcagacgaggacgaaagacgtgctgaacaactcgcaaaagaaatgtcttcaacgcaccatatattatactccgtatcgagtgccgatcgcaagtacttcaagatcgactttgggagcagatcggtgatgaatcccagtatcataccccatccggaattgctggacacctggatcatcaccgcgcaacttcataaacccccgtcggctcgaatggcgtcggtctggtttgctgaactcgtctgcaacgcggcgttctcggcggacaagcgagttctacgctgtctggaaccaccactgcaattgcccatcccagcgacggttggggactccagcaaatgcgtcggcgacctctcctactttagtctcagcgtggggccgcatgatgcgagggtcttctacgggcccgagatcccgtacaccatctacggctccaattctttctttacgtgctttggacaatggatctccgattttcgaatcttggtggactggggcatcgacaccatccatgagcacgagttccgccagccgcgcgagctccaacggcccgtgccctggaatgctgtggagaagaattggttcctgttctgggacgacgatggacagatgttcctccaccatgacattgcgccggtgcgagtgtttgcgaaagtcgagctcgacggctccgtgggaccgaacttggctctggcgacggcgacggcggaccaagcgtgtctcacgcgattcctgcccctgagtacggggccctcggagagcatccatcaagcgaccaactcgctcgccgtcactctctgtgcccgatcggacccatcgtgccatccggatacggcccatacctttgtgctgttcgtcgtccaacgaaagaccttacatggtcttcaccccgtgtacgagccatatgtcgtgcttactcggcgttctacgccatatgagatttacgcggtctcgtccaaaccgatttggattttcgggcgcaatcctgctgccaagacgacagaaggagcttcttccgcattggtggcagcagactccgagatgctctacatgacgagcatcagctggaaaagccacggccagaagtatcatgggcacatcgatgacacgctgttcctggcattcggcagggaggactcggccgccggcggtatcgacgttgccgcgagagacctcctctccgagctggggatgtgtgcagggcctgattag

SEQ ID NO: 11139 - DNA, 1110 bp, A.fumigatus
tggtttccaggtgacctcctcttgcgccatcgacgacggtgtctgcgatcggacgaacccgcaatgcgccgcaaggcgtgtaatgcatgcgtgcaggccaagaccaaatgctgctacacacagccgacctgctcgcgctgtgccaaacggggcctcgtctgcgaatacatgtccatggccaagacagccgccaccattgcgtcggcctcttccgcctcttctgcctcggcctcttcctcgtcgctctcggccaaagacccttcccaaccggacgagaccagcgtgagcgcgaccgacctcccgttgttgctgtggagccgtcggagcccgctggacgatcccggcgcggatcacgcagactcctggagctcccagaacttcctctgggccctggatacgatcaatctcccgtccctgccctccgcatcgaccagcatggtcaacgaagtgactctgggccccgcgccggcgatcccgaccagacatccgagcctcacttttccgctgacctcgccttcgtcacaaccgtcgtcgtacaatccgctggtcgaggagaccatcgcgccgccggcttcagggatccccgatctgtccaccacgcggaccgggctcggctcacaggaggacgccacgaccgactcgcctccggcaccgttgtccaagccagacgggcagggagggcgcccagccaactatgcgagtctccttctccagtacccgaaacgcctgctgcaggatgatttctactgtccatttctgcaccgcaccctgttcaatgacgatatgccggacatgacgattcttccgcatacatccatggccatatgctgcggaagtgcgttgggcaacagagacggggtgggctatatcaagcgagccatggatgcgcaacggcaaagcctgattgagtcatatgtaagcaccgtggcgatgcgtgagagattagttacctctagcgggctgacaacgagactgtccagccaacctaccactgtctggagcagtgggacgcgctgcatgcgatgctcctctatgagatcctggagatgggcatggcgcccatccacgaatcggagagctggaaacgaaagcgacgcaccagagggctga

SEQ ID NO: 11140 - DNA, 213 bp, A.fumigatus
ataggacaagatattgcacataaacctggcgttgcccacgctttgctggtcatttcctaccgggcaatccccttcgatgccgcaacttcgaccatgcccggatccgagccgcccaaccaggcgcacgtgtgcgactcctgtttcaagagctaccaacgacgtgtgtcttgtctcgtctctatcgtcgtgcatgcctcgggtgctgacatctag

SEQ ID NO: 11141 - DNA, 753 bp, A.fumigatus
cgggctgacaacgagactgtccagccaacctaccactgtctggagcagtgggacgcgctgcatgcgatgctcctctatgagatcctggagatgggcatggcgcccatccacgaatcggagagctggaaacgaaagcgacgcaccagagggctgaagtcccccttcctctccaaaatgacccagtgtttctcgcggtcctacctggagtgtcacgacgtggcactcctgcccgacaccgaccccaatcgctcctgggtccaatgggccgtcacggaaacggcccgccgcaccatgttcctggcgaacattgtcaacttcttcagcaaccgcgatctggagtccgggcgccaattgccctactacgagcccctcaacgacgagctcatcatgaagatgcccctgccctgcaatcaagcgctgtggagcgcccgcaccgaagacgagtggcgcagggccacgcagatggccaacaagcaggcgtccccggcgggctccccaggcacctccgacgcttttgctcccttgggcgctgctgcggccgcgagtgctgctggtcccgccgcgggtccgcccaacgccgtgggcgagccgctcccaaatcaccaccacctacacctactctcgctccagtcgctgttctccaagttcgccaaggactatctgcgggcgaacttcacgacgaatgcggggtttggtgactccaatgagcttcggtcgttcatcattctctgtgcgctcgagcaattctcgtga

SEQ ID NO: 11142 - DNA, 198 bp, A.fumigatus
tcgcttggtatggcgtgctctgctgctgcggttggcgtcttattcttcctggaagacgaccaatgtaacctcgcctacttgtctatctattgtggctgctcttcgtctgagcagatatcagtcccatcacacccaatcacggccgattacagcaagctcgtgaacgattacgggccaggcgagatgatctcccagtga

SEQ ID NO: 11143 - DNA, 888 bp, A.fumigatus
tcgtatccagggcccagaggaagttctgggagctccaggagtctgcgtgatccgcgccgggatcgtccagcgggctccgacggctccacagcaacaacgggaggtcggtcgcgctcacgctggtctcgtccggttgggaagggtctttggccgagagcgacgaggaagaggccgaggcagaagaggcggaagaggccgacgcaatggtggcggctgtcttggccatggacatgtattcgcagacgaggccccgtttggcacagcgcgagcaggtcggctgtgtgtagcagcatttggtcttggcctgcacgcatgcattacacgccttgcggcgcattgcgggttcgtccgatcgcagacaccgtcgtcgatggcgcaagaggaggtcacctggaaaccatcagcctagatgtcagcacccgaggcatgcacgacgatagagacgagacaagacacacgtcgttggtagctcttgaaacaggagtcgcacacgtgcgcctggttgggcggctcggatccgggcatggtcgaagttgcggcatcgaaggggattgcccggtaggaaatgaccagcaaagcgtgggcaacgccaggtttatgtgcaatatcttgtcctattcacttgcagactcgtggcagggcgcgagccataggaatcgacatgattgtcttctcgatccttcgatatctgcagcctgggctggacggcaggcaggggtagaagaaggactggatggaacccagggttttaggatgaacacaggaggttcgaggcgcattacccgcgccatcccatgtgtgggtaaggcgcggggcctaatcgcttggtatggcgtgctctgctgctgcggttggcgtcttattcttcctggaagacgaccaatgtaa

SEQ ID NO: 11144 - DNA, 225 bp, A.fumigatus
aaactccaacgagtgagtaggcgcggccatttctctccagtctcgattttgtttctttttctgggaccgtgggagagggctaacttgcattttcgcgcctgcagagtcggcgtttttgcccgcctgacaaactcatatgcgattgtcgccatcggcgcttcagagaacttctacaggtgcactactcatgctcccgttattcgccttgtaagcgggatcttctga

SEQ ID NO: 11145 - DNA, 267 bp, A.fumigatus
gttgctgcccgctgggcaactaccggacccttttgcggcccgaaacggccctccccaactgccccctcctcctggttccaactttcaacgtcctcccctgcctggcttcctatccggacctcctcctccgcccctgtactacacacacccgcctccgccgggccctacgggcccgcctccacaggggccccgaccacccttctaaacggcaatgctggagaaaaggagggaaggagtagcagtgagtttcgtttcccacaggattag

SEQ ID NO: 11146 - DNA, 321 bp, A.fumigatus
cagtccgatgattcaaacagtaaccgtaaaggccttctcgtccccacaacgacaacggaccaggaactgcaacatctgcggaatacgctgccagacgatgtgaagatccaacggatagaggagcggctctcggcgctgggcaatgtcatctgctgcaatgaccatgtagcactagtgcatccggatcttgagcgggaaacagaggaaatgtacgtttttgaggccctcttccgtccttactcgcgggggaatagaaagagagaaaacagcgggaataaactggcacgcgacgctaacactatccaaaaacagaatagctga

SEQ ID NO: 11147 - DNA, 759 bp, A.fumigatus
ctcgttgtcgtgcagacggatgaatccgaaaccgaaactgaccgtggacgtattcgtccgctggccagagatatgaagcggggatactattcatcctttgtgcgcaaccctgctggtgctgctctatacgagcgtgccctgaatggctgggaggattttgttcagcgagccaagctgggaggcgacattgagccgcagatgaacgacatggaagaagcggtgccgttcaaaggtctctcagcacatgatgttcttaacatgatcattgaagcaacgggagtggttcaaacgcgaggcgacactacggcagagagtaacaaggtattcgcaccggtacctgagtcgcgggctgaggctttatatgccctggccgacgctgcaaccgcttcacccttgcccttgcccagagcggccataacgccgcgaaccccagcacaccgagctatcctcccgcaacctccacaacatcctcagcttcctgcaatccaggctcccattgatccgcgagcctttgtgctaccgcctccaaatccgcagcggcagcagccgcgtaggttgctgcccgctgggcaactaccggacccttttgcggcccgaaacggccctccccaactgccccctcctcctggttccaactttcaacgtcctcccctgcctggcttcctatccggacctcctcctccgcccctgtactacacacacccgcctccgccgggccctacgggcccgcctccacaggggccccgaccacccttctaa

SEQ ID NO: 11148 - DNA, 273 bp, A.fumigatus
cttgcattttcgcgcctgcagagtcggcgtttttgcccgcctgacaaactcatatgcgattgtcgccatcggcgcttcagagaacttctacaggtgcactactcatgctcccgttattcgccttgtaagcgggatcttctgacagataaattcaacattaccagtgtatttgaggcggaactccaggatgtcattcccatctgtcatgctactattgccggcacccggattgtcggccgtctaacagcagggtatgtctttctcttcatttaa

SEQ ID NO: 11149 - DNA, 471 bp, A.fumigatus
tgcatccggatcttgagcgggaaacagaggaaatgtacgtttttgaggccctcttccgtccttactcgcgggggaatagaaagagagaaaacagcgggaataaactggcacgcgacgctaacactatccaaaaacagaatagctgacgtcctcggcgtcgaagtcttccggcaaaccatcgccgacaacgtgctgacgggctcgtatatggccctctccaaccagggcggtatcgtccatcccaaaacctccatccgggaccaggatgagctctcctccctactccaggtgcccctcgtcgcgggcagtgtcaaccgtggcagccccgtcgttggtgccggcatggtcgtcaacgactggctggccgtcaccggtctcgacaccaccgcaaccgagttgagtgtggtcgagtctgtcttccggctgggcgagtcttcaccacggggctggaaggatccgcggtggcgttat

SEQ ID NO: 11150 - DNA, 201 bp, A.fumigatus
tacgagaacagttttaaggatctatctatcaagtatagtacatcttttattccagagaacccccatatgagtacagagaacaagatcagccagcgtctcagattgatcgtagcacacacgctctctcattccaatgggcccgccatggatgacaccctctggtcggagattaaaaaacgtatcaaacacagaatatgctag

SEQ ID NO: 11151 - DNA, 210 bp, A.fumigatus
agcagcgtcgtacttggaccaagttccctcgtgacaggcccagacattgatctctccaccaaagcctacactgactgctctggagcctttgccatttgtcactatgtggtgacagccgactttgtgggcaccatcaatggattgcaccaacgggaaatcaggatctcttgtagaatgaatcttgagcgcagttgctccagaagccgatag

SEQ ID NO: 11152 - DNA, 237 bp, A.fumigatus
agatgtacccctatgataatgacgaactcgatgacgaagagcgtgcggttaatgcccaaatcaaggtcagacctactacccgtgccacttgtatttcctgcccgcctgactctaaaccctccctttcaggacattattccattcgccgtcgtcggcagtgagaaaactattgttgttaatggtcaacaagttcgcggccggcaaaaccgctggggtgtgatcaatgtggaagacgaa

SEQ ID NO: 11153 - DNA, 288 bp, A.fumigatus
tttgactgggaagctataaccaacgagagctcagttctcaagatggccaccacagccaattcaaattcgaccaacccagccactgtttttcctcgcagtcatgttggctttgacagtatcacatctcagattgagcggaagctcttgaagcgtggctttcagttcaatgtgatgtgtgttggtatgtgggctgcaactgtccagttgttccttgaacgaactcacattgactgtgtcctttactctaccaataggccagacaggtctcggaaagtcgactctgattaa

SEQ ID NO: 11154 - DNA, 273 bp, A.fumigatus
tgtgtgttggtatgtgggctgcaactgtccagttgttccttgaacgaactcacattgactgtgtcctttactctaccaataggccagacaggtctcggaaagtcgactctgattaacaccatatttgcttcccatctgatcgattctaaggggcgtctgacgcccaacgagcccgttcgatcgactacagagatccagactgtctcccacagtgcgttggtgccggaggataagatcttcgacaggaacgccttgctaacgattgtttactag

SEQ ID NO: 11155 - DNA, 324 bp, A.fumigatus
ttctgcaaatgtagtctcaaaccaattgacattgtcgtcttgaagaagctctcagatgttgtcaatgtcgttccagtaatcgccaaggcagactcgctcactcttgaagaacgccaagcgttcaaggagcggatcaaggaagaattcgctttccacaatctgaagatgtacccctatgataatgacgaactcgatgacgaagagcgtgcggttaatgcccaaatcaaggtcagacctactacccgtgccacttgtatttcctgcccgcctgactctaaaccctccctttcaggacattattccattcgccgtcgtcggcagtga

SEQ ID NO: 11156 - DNA, 288 bp, A.fumigatus
ctgatacacaaaatcctatcggcttctggagcaactgcgctcaagattcattctacaagagatcctgatttcccgttggtgcaatccattgatggtgcccacaaagtcggctgtcaccacatagtgacaaatggcaaaggctccagagcagtcagtgtaggctttggtggagagatcaatgtctgggcctgtcacgagggaacttggtccaagtacgacgctgcttcaggtatcacaatccaagtccttgtcaatctaccggactcgtttcattacttcaagacttaa

SEQ ID NO: 11157 - DNA, 240 bp, A.fumigatus
cctgtaggtctggtcaagccagtacggactgttgcattctctcctggagggaagctgcttgctgccgctggagattcaagggtgattgtgctttatgacacttcatctggagagcaggttgcaaatctctcgggtcactcagcctggattctttcactttcttggagccatacaggggagtacctgttgagcaggtcggttgacatgaccaatttaaaaacctttagaatttacagctaa

SEQ ID NO: 11158 - DNA, 582 bp, A.fumigatus
cgaatccagctgtacgttggcaaacttgccaatgcttatttctacgacaccgtgattgcgggcgagaccgactttctctatggctttggcacggcattcatcgaaaagacgactctctcccttcgcggctgcggtggcggcattacagcctggaagggcaccaacacgactttcgagaacaagtacggtgtgtacattgccgattcccaggtcctcgcagccaatgcatccattggaaatgacatcaaggaacggtgctcgctgggacgcccctggaataacctccacagatcgatcttcattgatacatactttgattccagcattctccctgcgggatacacagtgtggaagggagcccccaacaacaacttcaataatgagaccttgatggctgtttatggtgtctacgggcctggatacaatccggccgcggagaagaatggcaatgtcacccggatattgcacagaagggaggtgatgccgtatgctcgtcccgtggatgtgttcatgacgccggacggccatcagcccaacattgcctggttggatccgatcgcggcgagctctgggcggccttag

SEQ ID NO: 11159 - DNA, 801 bp, A.fumigatus
accatggccaacaatccagacactctggagggagaaaagccccggccgctcgcggagggcaagaaggccgcccgcaaagagcagtccatgactctctggcaagcggtccgcttgtatcccaaggccgtgggctggtctgtcctcctctcgtcgacactgatcatggaaggatacgatttggccctgctcggctccatgtacgcgtctccggcattcaatcagaagtacggggtgcagtctgcgtccggcaaatggacggtcccggcgtcgtggcaatcggcactctccaacggggcccgagtgggcgaagtcatcggcttgctcatcaacggtcttatttcggaacggctgggttaccgctggaccatggtctccgcgctggcggcaatgaacgccgtgatctttctcttcttcttcgcggttgacatcaaaatgctgctcgcggcggagatcctggccgggattccctggggcatcttccagactctgcccgccgcatatgcctcggaagtgtgccccgtcgttctccgcccgtacttgaccacgtttatcaacatgtgttgggtcatcgggcagttcgtcgcggtgggtgtgaatcgcggatccatccaacgccccgaccagtgggcgtaccggatcccattcgcagtccagtgggcatggccactcccgatcctcattggcatcctcttcgcgcccgaatccccctggtggcatgtccgacgcggtaatctccaggggcgccaaacgggccctgcatcggctgacttcgtccaaggatcccaacttccacccggatga

SEQ ID NO: 11160 - DNA, 402 bp, A.fumigatus
accatgcgcggatccttggctcctgtggtgaagacgaatgcaggtaaccacaatgccgcattcccggacaatgtctacaccggcgttctgactgtcggtcccacttataacgcgaccatcaccggcgcaggcccaaccggatatccagtgcctgccgacaccccttttggatgctccgacttccgcgcgtacaacattgactttcgcaacgagtatgttccatattcagatggacccgcccacgccgttggcttgggttatgcgaacgcggggttctactcttgcggcctctacagttaccaggatactgtatgtagtgaaagaaaccttgagagaccgcccgctgacgaatccagctgtacgttggcaaacttgccaatgcttatttctacgacaccgtga

SEQ ID NO: 11161 - DNA, 684 bp, A.fumigatus
cgagacaccgagctcgccatgaagttttttgctcttgcagctctcttcgcgagcacagtcaactcaattgcagttgatggccttattcctggagcaagagtcatccctgctaacgacgtggtagccctgaagaaggttggggcctaccatcaaaagcaccaccaccgtcgcacagtgatcatccgttcctctagcagtgatgaagacgacgtctctgctgacttcttgtggggtatcaagagggccaatcgtggtggaaggctgttgctgcagaaggggaaaaagtatgtcatcggcaagaagctcgatctgaccttcttgaaggatatcgaggttcaattggatggagaactaaaggtactttggcccaagatcctagacccagtcctagctggtgttaatactatagaaaagttcaccaatgacgtgccctactggcaagcgaacaatttctattatgacttccagaagtccattagcttctggcgctggggtggtgaggacatcaagatctttggttctggtgtcctgaatggcaacggacagcgctggtataacgagtttgctggacaagagatcctggtgagtttgccggaaagcttgtcaagatccctatacagacttgtactgagaagcctaggatcccaacaacaagtactatcggcccattctcttcgtgactga

SEQ ID NO: 11162 - DNA, 447 bp, A.fumigatus
gctaacggtggcccacaggcgctccccaaaaacacggatggcttcgacacgctcaacgtcgatggattgactgtcacgaacactcgggtcgacatcggcgacgattgcctctcaccgaagcccaacactaccaatgttttcgtgaagaatctctggtgtaacggcacacatggagcgtcgatgggaagtatcggccagtaccccggagtcctggacataatagagaatgtttggatagagaacgtaaccctgctcaacggtgaagtaagaaataccctccccttaagctcgaggtccacatctaattctatcagaacggtgctcgtctcaaggcatgggctggtcccgatgttggctatggccgcatcaacaacgtcacttacaagaacatccacgtcgagaacacggacaatcctattgtcctggatcagtgctactttaacataa

SEQ ID NO: 11163 - DNA, 279 bp, A.fumigatus
gatcccaacaacaagtactatcggcccattctcttcgtgactgagaacgccacccgggtctcggtcgaagggattacgcaactcaactctccctgctggaccaacttcttcgtccgcaccaaagacatctcgttcgacaacgttttcatccatgcctattcgactaatgcatcggtaggtttccattcacttgtggaagcagaggataagctaacggtggcccacaggcgctccccaaaaacacggatggcttcgacacgctcaacgtcgatggattga

SEQ ID NO: 11164 - DNA, 417 bp, A.fumigatus
ttctatcagaacggtgctcgtctcaaggcatgggctggtcccgatgttggctatggccgcatcaacaacgtcacttacaagaacatccacgtcgagaacacggacaatcctattgtcctggatcagtgctactttaacataaacgctacacagtgtgctgcctacccttcgcgcgtgaacttcacgaacattgtctttgaggacatctatggaacctcgtctggaaaacgcggtaaggtcgtcgctgacctcacctgctcgcctaatgccgtgtgttcggggatccgtcttaagaacatccacctcaccagtcctgcgggcagccctccagtcattgtttgtgatggaattcaaggggatattggagttgaatgccagtcgtcaagtaattcgacgactaagcgctcggttgatttg

SEQ ID NO: 11165 - DNA, 228 bp, A.fumigatus
atgttccaccatcacagtattataagagtcattctgagtcatacacttggtagttctgtcttctgtaattcacatgatatctatatcaccggcagcttcatgtgcttcttcccctgcctaccactggagcctgaaattgtaatctatatgagtcaatcctactattgccactgtggctcagatgactgcgatcacagtgacattggagaagatccagctggagcttag

SEQ ID NO: 11166 - DNA, 891 bp, A.fumigatus
tcgcaaacttttttttttctatttgctttgatttcactatttacaagcgtttatatccaatcgtggccacagtttattagggcctcgattttccatgctttggcgataatgtatcactacgcctcaccaccacctgggtggtcctcgttcgattacatgaactctcctcccacgtctcctcactacgcctactacgcgacacaatttgcgaatccttacgtttctcctcgaggcacgtcaaagcgccacaatcgcaaggccagctacgccgcccccagggaatcaggagcatggcattccggttatggccagagcttttatgaagcgatgccggaatatggcacgccgccacgcaagcacgagaatgtaagtgctttttctggtggctattcatcctgtcgtcgtcctcgggccaggtccgtcgcgaccggcctctgggataagaccggttatcacttccatgagacaccgtattcgtcggcacaatgtcgcccctccatctttgtggatgtggttgatgatgtgttcgatgaccgaccgcccgttacacccaaacgggacagttacgcccagtcgcgtcgccagccgtcgttgtctcaacgcaaggcaaggccacccactgattcttatttctcctctcctcaggtccccgcgtacgacgatcaggattcccccaagcgatcgcgggcgcgccgccagtcgacctccacgcgcaccccatctaagcctaagccgtccgccacccccaaggcaccacccaaggcgacggaggaggacgccgcccgtgccggaattccgccggggtactcgatcaagaactgggacccgaccgaggcgcctatcattctgttgggaagtgttttcgaatgccaattcgatcggccagtggat

SEQ ID NO: 11167 - DNA, 432 bp, A.fumigatus
gccggtcaattctacagtgcttcatggtggatcatcatgcctgacccttcccaaggcggcttccgcgctccttctgccgcggacatccgcacaatgttgtctgacatctgcaccaattcgggcgccgaagtcagctttgacaatctcacttttaccatcaatgggtcggacgacgcagtgaaatcagcaatgatggttgtcaaccaaattccatttgtgaagcgaagccagtaccaaatgcgcgtcaagatcgagcttgcaaatgagcacaaggagtttgtcagtggaaagaagaacggcaagatcaataagatcatgggccagagtaagtcctatttccaacagactgtttgctgcaacgtctcattgaccttcttcaggcaacgttcaaatcatattcgatggcttcaacgagtacaacttctacattga

SEQ ID NO: 11168 - DNA, 666 bp, A.fumigatus
gatcgatccctcctctcctttctcttcaccaaattccttccggatcaacttccgccatttccctcctgctccctctcctctctttcccctcgacttgctcaaggggtcagagactcgatctattctggtgtcatgcacaagatctccaattttacgggccaggcccgtcatggctgggagcggatgacgcctacctttggcatgtctagacctcacactgacatgacctctcacactcttcggcggccgcatggcgctcctcctatgacccctcctaccggaatcgatcccacggtcaacctgtccttcaatgtcccattctcctcgaccctcgctggcccggatatcgatgacgtgattcatgcgagtcccggcgcccttcagcgctggtcttttcctgaaggcactccggaaggaaccccagtctacaacctacccgtccacgccaacaacgtcgaatctcttcgcagattatgccgtcagattacggagtccagtaacggtcgcgttgaagcggtggttacatcgtcagaacccaaatcggttccctcattacagagacgaccccaaggcctggtgaccaacgtctgcattacgggtgatggagaaactgtgcgcaagatgcgggccaaaattctcaacgagacacccatcctactggtatga

SEQ ID NO: 11169 - DNA, 534 bp, A.fumigatus
tcttgggcactaatgcatcgccagctgaaacgtcatgtggatgccatgagattggagttgaccatgcatactttggtctgcggtcggacgcgcaagaacatcaagctcatcgaagcggctactggcacggcaatttacttccccccacccttccctcgaattttcggctacacccctccaggcgcccatcgccgcagtgaagatgaggtgtacattacgggtgatacccaggaacagattgcccgtgccaaacagaagttgcgagagttggtgatgggagtcaagatctacgtcaaggatgtcatcgtcaattccaacaagattgacaacattctgcttgaccgcctcgacaaggtccggaaggtgatggaaatgaacggctcctatgttctcttcccgcagctcggcagccaacggggcctggtgcgtatccagggcaccgaggttctgcacgttgagcgcactgtgcgggaaataatggctctggtgcgtcgagccgtaccatctctgatcccaattgcattcactttctaa

SEQ ID NO: 11170 - DNA, 624 bp, A.fumigatus
ccttcttcaggcaacgttcaaatcatattcgatggcttcaacgagtacaacttctacattgacgtctgtggcaatcaatatgagtccacaaagaacggtcttgatcttgttgagcaggagatgcctgcttcgatctctttccacgtgccggatcagtaccacaagcggatcatcggaatcggcggacagcacattcaacgcatcatgaagaagtattccgtcttcgtcaaattctccaacgctatggaccgcggcggtatgggcaaggaagatgatgacatcaaggttgacaatgtcatctgccggacgccagcccgcaatgcccagtcgctcgatctggtcaagcaggaaatcatggacatggttgagaaagttgtaagtggtcgatcttgtcgtgacagcccgtcaaaagttggtttgctaatagccatccaggatgccgaatacgtttctgagcgtgttgtcatcaatcgtttgtatcaccgtgaactgcttgcccgcatggccgagatcgatgagcttgagaagaaatggaattgcaagatcgagtttcctagcacagaactggcttacgacgtggtaacccattttggacccccagtatcaggtccctcaggcttgtga

SEQ ID NO: 11171 - DNA, 2154 bp, A.fumigatus
cgctgtaacgaaggggaacacccagaaggggtgggaaaacggaaaagttttggggggttaacggaattcaccgggcagggccctttgtggggtagggggtcaatttatgggacccgatggggaatttccgagtggatgattgggaagctactattgagttcacgctttatgggagctgacgatgaaatatttcgtccttcctttccatcaagggatgccaatagaagagcttccaatgctgaaccggggtcggcgccgttggagaaaaggaccgttgaggaaccagaccctggtcgtgcatatggaagcttatcaaccttccatcatgtagggcctgcgacgggcgcaagtcgtatatcagccctccgggctgcaagagaatctgttacatcgtcaccatcaccaccttcttcggcttataggaggcctttatcggctgccagagctgcaccaactggacgcgctgctgctctcgctgccgaagccagtcctagtcctcttaggcgaccttctatctcattccagccattcaaagcgccgcctctttctgcttcaccttctctaattgatccgcccctcggggcgtctcctcgctctaggccgatagttagtgcaccaagctcagagcctaaacacatgcctcctccatctgtagcggcctctgggcgtaagactgggcaggcagcttcagagaatgtgattgcatcgtccaactcggcgtccccaagacccgcacctattgcaagatacagcagcgccttcagtcaccgccgcggtagaccttcttcaggaggaataaacaaaatcgaggatgacgcttctagtggtaaagccagtgcaacatcgtccggcgctcagcccggctctgggttacttgcggaggtcactggaacgagcgcagattctcttcacgcagatgatgagaacatttccgaatttttgaagatgctcgacttgcggaaggacttattgagcccttcgaatttgtccaacctcgatgccgttgctcgcaggacgacggtaacaagtgcagcgctaactcgattccaacgtatgcgtgactcaaacgccgctctctcagaatcaatgtcatcgtccctacttctgcaacgttcatccaacgcctcgagcaagcaactctcaggagtgccaccaatggtagctggggcttccgtttccacggcctcttcacctgggaagcctatatcacctcataccccccataccccggctatcccttctcgtctaagttcaaacagtattgtcgattacaatgatcacgggcacagcgacggaaggcttcttcatggaggtcctacctcgctgcctgaggataccacgggcgaagagacagccttggtgcatcggcctcccacggttactgcgatcgatattccgacatccccgcgcctctttcctcctacataccgtcgctctagctctgctgctcagaatcggcgttctgtcgtggctgatgaggaggaaatctttcctttcaatatgcgtagtgtcagccttggtgcggaggagcgaaccaatgtcagtttgagcacgctgcatcggcggcacgaataccataatgccgccacaaatcccgaacaacaacaggaaagtcagcgtgcttcatcatcatcggaccaaggcccgactgcgctcccgagcccggccaagcgtgaaacccgctcacagggggatgcgactgtgtctgggcagacaccagacttatcctcgtctgctaatcacaacttgtatcaaccgcgcttgggtcagtttcgtagccgaggatctttcggtggcgcccattccctgagctccggctctagcagcttagctcgtggcggtggtatccccacctacctcactgagcgcgacaatgaccgggatggcaacgcaagcggtagcaatagtggcaactcaacgacagaagagcgacgaggatttggccgccgtgtcagtgcaggccgcaactatccgccacatccgtcgcaggtcgaagaggacgagcctttgctgtttgccatgagtgatttcggggcttctagaagaagttttgaagagggcagacagggtaatcatggtgctgactttggtggttcgcgacgcggcagcggcagacgtggtgccggcgtcccggggtttcacgtttggtcttga

SEQ ID NO: 11172 - DNA, 192 bp, A.fumigatus
atttcaagggaccttttccgatggtccataagcgctgcgcgcttcgatcgcatattcagtttctacaagtctctttcttctctacccttcactatcatctgtgaagatgataaatcttctatcctccatcatcttggtttgatttcatgcatacggcattgccgaatcgcatactccaagttctggaattag

SEQ ID NO: 11173 - DNA, 216 bp, A.fumigatus
ctcaaacgccgctctctcagaatcaatgtcatcgtccctacttctgcaacgttcatccaacgcctcgagcaagcaactctcaggagtgccaccaatggtagctggggcttccgtttccacggcctcttcacctgggaagcctatatcacctcataccccccataccccggctatcccttctcgtctaagttcaaacagtattgtcgattacaatga

SEQ ID NO: 11174 - DNA, 2121 bp, A.fumigatus
ccaaggacacggatactgaggaattcctgccttgtggggtcaacacggcagattctccgtgtcgtatgctctaactgggatatcaaggatgatatctccgtcatggacattgacgaagagcctgccaaggacgctgtggagtctgctgatgaggaggactggcttgcggagaccacccgtccagcaaagaagcgcaagctcggaagagatcccatggacgttattgcgctctcccacatcgacctgcctctgctcgacgaccctgagcaagctaccatgcggatcgctaagaaggtgacaatcgacatgaacgacccattcatcctcctcgatgagcgcggccccgaggccgttgccccgaaaccgaaggctctggcccatctcaatcgggaagaaatggatgtcaatgtcacccgccgtctaacatcacgctacaacatttccaacgatcaggcatatgatatgctcaagcagaatcatcagaacaaaattcgcagcacgcttggcaatgtcactctcgagcacagtatgcccgcccttcgtttgcagtggccctactacaagaccgagctggccaaagctgaagccagatctttccaccgtccggccttgtccttccggcctggtcagacctgttggttcaaaaatcccgcgtacatcaagcgcaagcatcaaaagggcaaggacgccaagactctgtacgactcgaccaaggctttgtctatggccgacaactccaacgtgctgctggtagagtactccgaagagagtcccctgatgctctccaattttggcatgtccaatcgattcatcaactactatcgcagaaagaacatggaggactcaacccgtccaaaagccgagataggcgagacggtcgttctcctccctcaggacaagagtcccttctccatctttggtcacgttgatcccggagagatcacaccgactatctccaactccatgtatcgtgcacctcttttccagcaccagccaagatctacagatttccttgttgtacgcagcagcaccggcgccggtggtagtgactactatctgcggaacattgagcatctctacgtcgcgggacagcagttcccctccgttgatgtccctggccctcactcgcgaaaggtcaccactgttgcaaagaatcgcatgaagatgctcgtgtatcgactgctcaaaaagagtccggacatgaggctatccataagcgatgtcactgcccatataccaggcacaagcgacatgcagaaccgtcagaaagtgaaggactttcttcagcacgacaaggactcaaagtactgggtgcccttggagccagtccccgagtctgatacaatccgctcatgggtccaaccggaggatgtgtgtctccttgaagccatgcaggtcggccagcagcacctccatgatacgggctacggaattgacgcggagactggaggtgacgaggatgaggacggcgaaggcgaaagctttgagcagcagatggcgccctggaaagcaactcgcaactttctcttggcgtctcagggcaaggcaatgctgaaactccatggagaaggtgatcctaccggccgtggcgaaggtttcagtttcattaagacctccatgaagggagggttcaaggccattggggagagcgttgaagacaagttggatgcccagcgattgaaggagctgggcggtcacagctacaatgtcgcaagacagcaaaagtcgtatgagacatccatccgccgaatctgggacgcgcaaaaagccagtctgtcctcaactgtggagcactccgacgacgaaagcgacatggatcgcgaaatggaagaggatttcagcaaacccacacctcactcggaagctccgaccccagcgcccaatcgtcgcgatgacgaaacaaccagtcagtttagcaagatgagcatggcagaccaaaagggcaaggtcctgcgtatcgttcggcagttcaaggatgaaaggggcgaaatcgtccagaaggagacgacagtgtgggatccgcgtgtcattcgacactacattcagcatcgtcataagatggaagctctgaccaccaagtacgcttgcccccattatcttcctactctcttcatacactaa

SEQ ID NO: 11175 - DNA, 867 bp, A.fumigatus
tcattgacagttgcacgttcagcacataaaatccgtaacaggtcatctcaaaactttaaagcagtgacttcaataaaagcgcatctgcgatggtgcctcactggcacacccatccacaattcgcttgatgattacggtgcccttctgagcttcattggggtgccggctctcagcgacaagcccgcatttgatcgttggattgcaagcccagtgaaacagaaacaaacgggcagtcttcaaagacttcaatatctggtggctgctacagcgttccgccgtaccaaggccatggtcaagatgacggttgcgttgccgaaaaaggtagagaggatcgagtcaattcagttcactggcgcagaccgggagttatatgaattcttcaaggtcaaagcatccaggttagtgggtcaactcactggattcagacaatctatggctgcaaccgcggacaacaagaaagagagcacgctttccttgattaacttactgcggcttatatgcaaccatggcgaacacctgctacctgcgtccgcaattaatgagtggcgaactcgacagaatgagcagataacaagtgatgtgtattttggcagacaccccgggcaatccagtcaacgtgcatctgtcccggtggatagaaaaaccccagaaagtggggtgctcaccaatggcgagcggattaccaacgtaaacactccttacccatcctcacaggaattcccaatgataccggacacggcatccagtccattggcaccctatgaagtacgcctttccccgtcagccaaggtcaaagctctcctgaagaatctggagcgggagcaaagtgctgatagaggcacgtcttaccaacctgtaaagaggtaa

SEQ ID NO: 11176 - DNA, 213 bp, A.fumigatus
cagcagctaatacgtagaatcgacagcgtcgacctaaccgcagcgaattacgtccatctcctcgagccacattggaatccaatggtagaggcccaggctgttgacagagttcatagaattggtcaatcacgcgaggtcgttgtcaccaggtacttcattgagaactcgatcgaagatgtacgaaatctggtttcatgcagcgcaccaatttga

SEQ ID NO: 11177 - DNA, 234 bp, A.fumigatus
aggagatcattcaatcctgaccaaacatcgctaacacgggatagtgttatcttcagccaatggaccaggatgcttgatctggtcgcccaggcccttcgaaaacatagctacaagtacgcacgcatcgatggtcactcgagtctagcggaccgtcggtccgcaattcagcatttcaacggggataacaactgcacagtaatgcttgccagtattggcagtgctggagaagggtag

SEQ ID NO: 11178 - DNA, 396 bp, A.fumigatus
  unsure (142): Identity of nucleotide sequences at the above locations are unknown.
ttacgccaaaatctagtagttttccaatggtattatgtttttcaaagagaagatagtgacgggcgaagctattcacggctggaaggaacagattctaaggtaggactaggtacagtcaccatgaggactggtctgattggtnttaggcacattcatcctggccaggtgcgatatttggtgtatcacggtcgtaagcgacgagtaacacagcaagcactatcccgggactatgatattgtcatcaccacgtatgacaccttactgtcggattggcgcgcaggcagtggtctgcatagtgaaatttggtatagagtcgccctggatgaaggtaagtacgacgttaatggcgaaagctatttatcaatgatcattgacagttgcacgttcagcacataa

SEQ ID NO: 11179 - DNA, 423 bp, A.fumigatus
tcggtttcaggtgcttcgggtggcttcaagacggataccgatatttcaggaaacttcgcgatgcgtgaacgagctctgaaacgatgggagcctgcagctgacaccgaggttgacttatctctcgaaagtacacacgatacggctggatgggatcaattcgagaccaacgaaaggctgtttggcgccactagcagttatgatgagaatatttataccactcgcatagaccgttccgatccttcatacaaacaaagagaggcagaggctgcccgtatcgctcgggagattgagagtaccaatgttgacaacattcatgtcagggaggaaagaggcttggctccggtcgacgacagtgggttggacgaggaagacaaatctcgcggcgtccgccttttaatcaggccgccgctggcagttagtggg

SEQ ID NO: 11180 - DNA, 498 bp, A.fumigatus
ctaacgctagccagctccgagaatctcgcccggatcgccgtcaaacaccagccgcattcaactattgtagcggacatcctgaatctgccacatccagattcgttatttgacttcgctatctcaattgctgttgtacatcatctgtccacacctgaacggagaattcgggccatccgcgaaattctccgcactttgaaacctgcctcagataaatcgtccggaggcagagtcctgctgtatgtttgggccctggaacaaaagaccagccgcaggggctgggacaaaggcgacaagcaggacgtcatggttccttgggtcctgaaaccgaagtctgccaatggtagctctgacgacgagccgaggactttccatcggtactatcacctctatgaggcaacagaactggaacgtgacattgaaagagcgggtggccgtgttctagattcgggctatgaaaaagacaactggtgggcaattgcgacacgatccgaagagtag

SEQ ID NO: 11181 - DNA, 444 bp, A.fumigatus
cgtggatccatcgccccgcgtggtgaagacgccggcccggtgactactacgtccgccttcccttcgaggaccctccctccagcttccatgggccaagcgatgcctgtcgcagcctcgacgcctttgtcatctgcgccgcctcttacagcgaaaatcccagcatccgtccctgccaagcgtctgcagccagcccatacagccgagtccccggccaagaagcaatcgaagtggtcccccgaagaagatgcactcatcatagagctgcggggtagtggcatgaagtgggaggacatcagtaaacggctcccgggccgaagcgctatcagctgccgtctgcactatcagaattacttggagcgccgaagcgagtgggacgaggacaagaagaacaaacttgcaaggctatacgagaggtacgtttctgaaaagaacggccctgtctaa

SEQ ID NO: 11182 - DNA, 714 bp, A.fumigatus
gacattcatgactcatatgaacttccactgacgcaggcaggattcgacggggccatccacatgagcgaagaagtccacaacccgaccaccgtggtccctcgcatcctcatccaaaccattcttatcaacggcactctggcattcgggttcattctggtcatgctgttctgcatcggagacattcactccatcttacactctcccaccggcttccccatcatcgccatgttctaccaggccaccggctccgtccacgcaacaacagcaatgcaatcggccatcaccctgatcggctccgtctccaacatcgccgtcgttgcgtccgtctcccgcctcacatgggcttttgcccgagacggaggcctgccctattccaagttctttgctcacgtggatggcaaataccacacccccctccgcgccatctgcctcgtctgcttcactgtcgtcctgctctccctcgtcaacatcgcctccaccaccgccctcagcgctgtcctggccctcaccaccagctcgcttttcatctcatacatcatccccgtcgtcatgatggcccggaagcgtatacggaaggagccgattgcgttcggcccatttgcgcttggccgatggggtctggcgaataacatctatgctatcgtctttggcgtttttaatttgtactttcgtgtcatatccgaccgaaattcctgtgaccggtaccaatattga

SEQ ID NO: 11183 - DNA, 249 bp, A.fumigatus
gctgccggtaatttgtctttgcctagcggatttgctcccggtttgatgaatggaggtcctgcggctttggtttgggggatgttgctatccataacagggacgatggcactggccttgtcgctgggcgaaatggcctccatctgcccacttgcgggagcacagtaccactggaccgcgctgctggcgccgccacggatccgggcgttcagcacttggatgcaaggtacgagctacggaaaagcagtctga

SEQ ID NO: 11184 - DNA, 435 bp, A.fumigatus
tcatcactgacttatgatgcaggctggatcacagtatttggatggcaggccgccgtcaccagtatcagcttcctcgtggccacgcaaatccaaggcctgatcatcctgaatcgcccagagtatgaaccgcaacgatggcatggaaccttgctcatgtgggcggtgatgctcttctcgttgagcatcaatgtctttgccgttcgaatcttgcccttccttcagctgttgggcggccttatgcacgtcgtattcttcatcgttctgatcgttcctctggtgctattgtcgccacgcagtacgcctgaatttgtttttacggagctgctgaaccagggcggatggagtagcgatggggtgtcctggtgtctgggaatgttgacggtgcactattgctttaccggtaagacattcatgactcatatgaacttccactga

SEQ ID NO: 11185 - DNA, 609 bp, A.fumigatus
acttccactgacgcaggcaggattcgacggggccatccacatgagcgaagaagtccacaacccgaccaccgtggtccctcgcatcctcatccaaaccattcttatcaacggcactctggcattcgggttcattctggtcatgctgttctgcatcggagacattcactccatcttacactctcccaccggcttccccatcatcgccatgttctaccaggccaccggctccgtccacgcaacaacagcaatgcaatcggccatcaccctgatcggctccgtctccaacatcgccgtcgttgcgtccgtctcccgcctcacatgggcttttgcccgagacggaggcctgccctattccaagttctttgctcacgtggatggcaaataccacacccccctccgcgccatctgcctcgtctgcttcactgtcgtcctgctctccctcgtcaacatcgcctccaccaccgccctcagcgctgtcctggccctcaccaccagctcgcttttcatctcatacatcatccccgtcgtcatgatggcccggaagcgtatacggaaggagccgattgcgttcggcccatttgcgcttggccgatggggtctggcgaataa

SEQ ID NO: 11186 - DNA, 246 bp, A.fumigatus
accgacatggcaggcacattaccaccattgttccccatctccgatgaggaccacagcgggtatgtcgctgtcactgtctatactttgctaagtttgactgtgaccactgtttttgtgcgacttttcacaagatggtatatcgcaagggatgtctactcggatgatgtcttgctcacaggcgccacggtatcatcgtccacgtgccatggcttattcctgacgggtctaacttttgatctcgtataa

SEQ ID NO: 11187 - DNA, 492 bp, A.fumigatus
ttgactgactattctttcgctccgactaaaatatacctgtctctgactctctcccgtccgccgctggaaggccccctgatcacctttgcgcagtttattgtgactgctgtatttactttgccaaatttcgtctcgctgtcatgtgggccccggtcattattcctcagtccacgtgtcatcccattaagatcatggttggtatacacggcgttcttcgtgacagtcaaccttttaaacaattgggctttcgcatatagcatatcggtccccctacacataatattgagatcaggcggccctgttgcttcccttatcgtcggatactcgttcaatggaaagaagtattcttatggtcagattttggcagtagcggtgcttactcttggcgttgttacagcagcattggcagatgctcaagctaaaggcgaaccattaggcattgggcatggtggatcttcaccacaggggccgacggacccgcgcaatgaatta

SEQ ID NO: 11188 - DNA, 276 bp, A.fumigatus
attgttgattttccagccgccgtggtgaaaacctcccttgaccctggtacagaatctatcattcatcatatcattaacaatgaatttaccaaacagggccacactgtcatcattatggcccataaactcagcactttggagaagcatatgaaagctggaagggatgccgtggcaatgatggcagatggtcgattagatgaagtaattaactacttaggaccagagaccttccagtattccatgcagatgggacatcggctcactggaacttcctaa

SEQ ID NO: 11189 - DNA, 225 bp, A.fumigatus
tatatatgtttcagctataagttagcgatgacgcagagttttacgggaactagcaataactttcagctggttattgctgttgctattacaatatttagagcagacagcagccaggctattgcgtctacagtggggccattagatgagatgccagtattgttggggtttgtctctgctgtgaaagctgtgccaaaccgactaagttggaagggttcgatttgctga

SEQ ID NO: 11190 - DNA, 339 bp, A.fumigatus
caatcgtcagtactaaagtcttttacaatggctgagaacacctatcaacacgtgcggtcccgctatggagacatcgctaaacgcacaggcaccaccatccatgacaaggaagacgacattgcattagcctttgggtacagtgcgcaggacctacatgctcttccagataaagcaaatctaggattgagttgcggcaatcctgtggcacatgccaatatcaaggaggtacctggtacattgtatgcggttgtagactcccagaggctaactcttaacaattgcattagggggagacaattgtcgatctcggaagtggaggcggcatcgatgtccttctag

SEQ ID NO: 11191 - DNA, 402 bp, A.fumigatus
ctcaaccaggacatgatcaatctcgcgaagaaaaacgccgaagcggctggtctgtccaatactcgttttattgaggcgaccatcacctctatcccgcttccggatgccagtgtcgactgcattatcagcaactgcgttatcaatctggtaccatcaaaggataaaccgactgtattccaggaaatcgctcgcttgctgaagccgggtggaagggttgctatcagtgacatcctcgccaggaaggagctcccagcgaagatcgtcaacgatatatggctctctatgttgggtgcattgcgggggccagtcaggtcgcagagtatgaagaatatctcaaacgcgcgggatttaagagtacgtacttcaattccacgcagatattgctcttcgttactaatatga

SEQ ID NO: 11192 - DNA, 936 bp, A.fumigatus
  unsure (662): Identity of nucleotide sequences at the above locations are unknown.
gggtttgggttatttggcagacggggcaacgaaccggtgggatttaatatacggtacaaccacgcagattcaccatcactgtcaggagaccatcgtatccatcaactcatcataaatgcggatgcagaatggcgatcgctacttggaaaggaggtaaaaactttcgatgccgcaacagagcaatatcgtcgccgtcgggatcgacatccgcccccaggcttcaaagagtggttcgaattcgctcgatccaaggacgcgctcattattgaggacttttttgaccaaatctatgatgacctaaatccattttggggcctccaaccgaaggagatccgacggcaagcgcaaagcctcaaaccccgcatcgctgttcgcaaccacaaagcgaccgctatcacggaccacggagcactctggttagactcatggctcagtcttgtgggaagcatcgagcagtaccttcctgacctcgacatgccgtttaaccccatggatgaatctcgaatcgttgtgccttcggaaaccattgccgaatacatggtcaaggaacgtgtaagccgacagtggatgcgagataaaagtcctgcggagtttatcacagaatacacagctgttaagaatgaatccgaatctgggaaattcgaacctcgcttcctgggtcncgacgatggtcagttctgggatatggctcgtgtctgctgcccgccaaacaatccgtcgcgcaaaaatctctccctcaacccagctacagtcctgcatgtggcaatggagaaatttctgccacactcgcagaatggctatgtgcgcaactggacccagtcccaagatatttgctgggcgtccggagatgcaacctctccttggaaacttttatccaacccgttgtcatattccaccgccccacgatttattccccttttttccgaaggttcccaa

SEQ ID NO: 11193 - DNA, 195 bp, A.fumigatus
tcatggtcaaggatcagcagcatcaacatcagcgatgatgtgagtactgagttcaaatcactacaggacatgttgccgatcgtgctctctacactctatgacgagttcgacggagaatggggagactgttcccgtcttattcagcctgacacgaaaggtaccaactgtgagcacaatctcaatttgctatattaa

SEQ ID NO: 11194 - DNA, 561 bp, A.fumigatus
  unsure (392),(504),(519): Identity of nucleotide sequences at the above locations are unknown.
ccttgctcaatccaattgcactcgactctttcattcaggtgcgagtcaaaattctacggatatcgactattattgactctgtcagccgttgtcaacaaccaaacactattcattgatggcggggaaatgcacaccctcttgccaaatggcaccataatcacctttgcaagtccgtttcactcctttggtctgtcgtcctccgctaattttgcagtcaccgatcttgagacaatcgacctgtcaaagtcgtggcagaattccgaccccggtctcttcaactacatcgcaaagccgtggaacgcatccgacccggctgattatcccccgtacctgaacgaaggcgcttctttctctaatggcgaaagcctctttttctacggaggctattccancgggtggggagggcctccaatccctcctctcgcgacatggaagtacgacatcgcaaataacaactggactagagatggcttctggggcgttcccctcgtgagactcactcanggaagcgcggtccantcgtccgtccataaaaaagcctactatctaagcggcactttg

SEQ ID NO: 11195 - DNA, 3087 bp, A.fumigatus
aagccagctcggcaccgtccatcccctagtgaagaactgagtgactgtcagcctacaatcttccgtgtcgataccggtgttgtagaggagactaccttcataaaccgaaagcttcacgccggcctagctaaacttgaacggcattcagccgacttgcacaccactgttccatctctgatgcaagccctgttcgcgcttctcctggctgatagagtcaactcgtccgacgtcacttatggacttgtactctctggtcgagctgtggcagtccctgatgcagaatccgtgctcctgccttgtattacaaccattccggctcgattgaataccagtggcttgaaaaccgtctctgatgttgtccggtccgttcaccaatcaactgcccggtctcttgagtatcagcacacctctctgcgtcatatccaacgttggttgaagtcggaaaagcctcttttcgactgtctgttctcctacatccgaagcacaccagcacccaagaacactctctggggacagctagagagtaccatgccatccgagtacccgcttgctgtcgaaatcgaagcgaatagtgagaaggacgaaatgtatgttcactgtggcttttcgccatcgttcggttcggccgaccgcgggcaagaatttcttgagaaactagacgcgttgttatcggcttttctgtttgaagatgatattgcattggacagcttcagccttgctaactctgggaatcccggctcacgcgcaactgaggtcaaatgggacgcaacaacctggtctgcgaccgagacgaaaattcgtgacctcactgctactttctgtggacttgacgtggtgaacgtgtccaagggaacgtcattcattagcctcggtattgactcggtgacggccatccagtttgcacggaaactccgcgagctgcagtttgaaatcgtgccgtcagatatcatgcgcttcccttgtgttggtgctttagccgaacacgtagatgagcgttcaagtgaggggcggcagtcggcacgcgttggagacaaaaagcccagagtttcgcttgctgctcatcgtgacaacgtacctcttcttgatgatggagattccgtggcagcaatatttgaaagcacgcccctgcaagcgggcatgataactcggaccctgggatctgacgctcaggtttatgtacatcctcacattgttcgacttaccgaaggtgttgatattgatcgtctcagtaaggccatttcagaggttgttgcaaaaaacgatattctccgcacctcgttccaccccatcgctgagaatggagtgacctgggttggtgcggtccacacaaatcctcctctacagtggaaggagatcacactgccttcgaacgcggatgtcatcgcggagctaacctctctttactcttttcgggaagtcgccgatttcgagactccaccagtcaggtttgtgctagtgcatcgcaagaacgagaaacttttcgttgtcatcatgcatcatgctctttatgatggtgtctcactgcctcttctctttgaggagttggccgctacttaccacggccaaactacggtaggtcggcctcaattttctgagattgcccactacatcgtggaaggtcagaacgactcttgtgatttctggacgaagaaactggcaggctatgagcctgtggagattccggcgctctcctcatccgaagctactgagcgcatgcttctttcagagcgcaaaatcggccttgacgtggagaaggtcgttgagagttgcaaggccatggaggtaaccgttcaaagcgtcgccctcttggcatatgcaaaggtcctcgcttgcctgggcgggaaacgcgatgttgtctttggtcaagttctcgctggacgctcattaccagttcccggtgccgaccagactattggcccgctgttcaacactgtagctcagagggtcttgtttgagccaaaatttttgagcaaccgcgagatggcgcaacgagtccaacaacttacctccgaatcacaggcttttcagcatgcgcctttaaaggatgtgcagagggctctgaggcaggaacatggcatgaacgccgcctcgctgttcgacacactttttgtattccagaaaagtgcagatcttacaactgacacgccgcatgagcagcagatatggacaccctttgaaacggaaggatacgccgcgcaggctgaacataaactcaatgtggagatagatcacggtcgggaggctattatcgtcagcggctccggcgacggacgctacatttgccaacaggcgcttgatgagttcatggcggatttttgtacagcattccaagatatcattgaacatcccagcagatgcgccactgctgcaccagagcggctgggaggcctgccactccgactgtctaatgctgaggaacctgaacgaggtcacagcgagtccgatgctcctgcacacgagtcgattattcgtgacgtcctcgctgaagtctctggcgtttcagtcgacagcatcactccaagcactagcatttacaacattggtttagactcattgtctgccattcgaatcgcttccatttgtagaagcaggggattaaacgcgggtgtggctgatgttttggcaggaaataccctgcggggtatcagtgcacggattatatcacccgtcgaggcacccatccaagctcgggagcccttgatcaaagatcatgaagccattgaaaaggcggttcttcagcggctcggactaaacaaggatgaagtcgagactatcctgccctgtctcagtgggcagctgtaccatcttgtcagctggctaaaatccggccgaaccttgttcgaacctgcgtggtcttactacagcattgaacgtatcgatagtgggaagcttgaggaggcgtggaaccagctccgtcaacgacatcacattctcagaacttgcttcgtggcgacttcaccatcaatggctgtacaggccgtgcttaaagacgcgccacagaacgcggaaatcttcaaggtcattgagtctcctgcatgcattgaagaagcagcaaaagcccaagctagggaagaggggctgaatccc

SEQ ID NO: 11196 - DNA, 834 bp, A.fumigatus
gaagacatcatcgcccaatgggaaggagacctgcagccaatccagcaggaaatcgagtcctttggctgcctcgccaacggcaaagtcgtccgcatgtcccatgccccagacgatcacggcaacgccaacgccctctccagccgcctcacaaacggcctcaacttccgtcgtcgctcaaacggacagggtgcaggtgcaggcgcatcacatccagtgccaccactgcagccagctgcgccctcgatatgccgcgaccacgatcgtgagcgtgagcgtgggcttgaacgcaccagtaacggcagagtcccatccgccccaaggccaaattacgaaactaagcccctccccgtctatgagacgaaaccccgcctgaataatctgaccccgtcctccctgtcgcctaatctagccgttcctaatgcgcatctctccccctcagcgaccccacacagcgattctcatctccccgtcccaggctcagactatgcccagacaccgctgagcgggccttcccctaactcctcgcgatcggactatttcagcctcaacctccgaaaaccatctagtggctcgacggttacctctcccggttttgctgccgctgcagccgcgaagaagaagccgccgccgcctcccccgcctcgcgcgggttcctcgaatggagccctgtatgtcactgccctctatgactttgcgggtcagagtgccggtgacctggccttccgcgaaggtgatcgaatccgagtcttgcagaagacggatagcaccgatgactggtgggagggggagctgcgtggggtcaaggggagttttccagccaactatgttcaataa

SEQ ID NO: 11197 - DNA, 276 bp, A.fumigatus
tccccttctacaatgccctcttatttatatcactctcaagtgtctggttccgtcatcgctaatgcccatttccccactaccaacctcgttgccagtcctgtacagctgtactctatacacttcattttgcgactctgtatacttagtctgactttcttttactgtgatctgcaactaatccatctttctaagcgaattggaagtttgatctcgcgcattggaccaagtcgcagctgccgatttttctcgactgcctatctgcaagccgaaatatag

SEQ ID NO: 11198 - DNA, 465 bp, A.fumigatus
gccccatacatacattcacatattatggccgctcgtcattctcgcaagttcttgagacctctgctctacacatctgctgcggcagcgacaggagctggtgtgctctacatctcatatcgcccccgcaatatccctggctcggaagcgcccgccgtaccaccgcctggctaccatgaagggaagcttgtccctcccagcttccctgcgataaaatcgcggctagagcagattgaagacctcaaacggagttcctctggtaacgatgatgaatacgaccttctcgttatcggcggtggcgctactggctcgggaatagcgcttgacgccgcaactcgaggtctgaaagtagctgttgtggaaagagatgactttagcgctggcactagcagcaagagtacaaaacttgtacacggcggggttcgatatcttgaaaaggccgtgtgggagctggattataatcagtaa

SEQ ID NO: 11199 - DNA, 1185 bp, A.fumigatus
  unsure (1167),(1168),(1169),(1175): Identity of nucleotide sequences at the above locations are unknown.
tgtcctgcagatggagcgcacaatgattctcggatgaatgtgtctctagccatgactgcagctttgtacggaagcacagtcgtcaaccacatgcaggttactggcttaaccaaagatgaatcaggaaagttgattggggcccgcgtgaaggacttgattccgggaaagaatggtcaagaggcagaggaattcacagtcagagctaagggaataatcaacgccactggtccattcactgattcaattcggaaaatggacgagcccgatgttaaagagattgtagctcccagtgctggcgttcacgttatccttccgggttattacagcccctcgaaaatgggcctcattgatccgtccacttccgatggacgcgtcatcttctttcttccgtggcagggcaacactatagctggtacaacagatcagccgacggagatcaccacccaacccgaaccttctgagaaggacatcaactggattctctctgaagttcgcggctacctggccccagatattaatgtcgaacgaagtgatgtgcttgctgcttggtccggaatccgcccgctcgtccgtgaccctaaagtcaagagctccgaagccttggtccgcaaccatctcatctccgtttctccatctggattgttgacttgcgctggcggcaaatggaccacgtaccgtcaaatggccgaggaagccgtggacgaggcgatcaaggtgttcggcctgaagccccgggcggtttctcaggttccggacatcagtggtgtcggtggaagtggtttggtctccgacggtgccgtacttgatggtagctgccagacccaccaagtccgtttgattggagcccatggatactccaagactctctttatcaacctcattcagcacttcggcctggagactgacgtggccaagcacctgactgaatcttatggcgaccgcgcatggcaggttgcagctctgtctgctcccacagatgctcgcttccccctccgaggccgacgtatctcggctttgtatccgttcattgacggtgaagttcgctatgctgtccgccacgaatatgctcaaactgcagttgatgtcattgctcgcagaacccggttagctttcctcaacgctgcagcggcactggtgttcacaacgccgtggaaggacacaggctcnnnccaccngaaggggggg

SEQ ID NO: 11200 - DNA, 414 bp, A.fumigatus
aatgaccagcagagatccgcaacttggctctttcagccactaacgtcctggcttgattgcagatataaacttgtgaaagaggcattgagagagcgcaaatacttcctaaatacagcgccccatctctccagttggcttcctatcatggtgccagtgcagaaatggtggcaagcgccttacttctgggccggtacaaaggcctatgactggttggctggctctgaagggatagagagctcatattttctcaccaagagcaaagccattgatgcgttccccatgttgagaagagacaacctcatcggtgcgatggtctactatggtatgtgtcaacccacgccacatctgatgcttgcgtttggcgagctacatgctaatgtcctgcagatggagcgcacaatgattctcggatga

SEQ ID NO: 11201 - DNA, 408 bp, A.fumigatus
gaagccaactggagagatggggcgctgtatttaggaagtatttgcgctctctcaatgcctctttcacaagtttatatctgcaatcaagccaggacgttagtggctgaaagagccaagttgcggatctctgctggtcattttatgggtgcactgagggcgtccttactgattataatccagctcccacacggccttttcaagatatcgaaccccgccgtgtacaagttttgtactcttgctgctagtgccagcgctaaagtcatctctttccacaacagctactttcagacctcgagttgcggcgtcaagcgctattcccgagccagtagcgccaccgccgataacgagaaggtcgtattcatcatcgttaccagaggaactccgtttgaggtcttcaatctgctctag

SEQ ID NO: 11202 - DNA, 183 bp, A.fumigatus
aataccttgtccatgacattctctagcgatgcaggacagtcgatggcaaagcagacgaacaaaagatctgtttcgggatatgagagtggccgcagtctgtcgtactcttcctgtccagcagtatcccagagagccagttcgactgtctttccggaagctcgatgggtggtttgcgtgatataa

SEQ ID NO: 11203 - DNA, 609 bp, A.fumigatus
atttctccctttctggatccgccgggtacctcgtggcagatttattctcctagattcatggacatgtcaggacacatgtatgaagatagtggctacgcagcctctcgacgccgttcgattgcaactccaccaccctccatgactccaagacacaatcggacccgtagtcagagtgtgagggtgagtaacggaactgtcagcacaaataccagtgtctcaagtggaaggatgtcggaagccacaaacatcactcaaccgccagcgtattcaaaaaagtttgtggtggtgggagatggtggctgtggtaagacatgccttcttatcagttattcgcaagggtatttccccgaggtaagtgttttatccttgaacgtcggattcgatgagactcatccctcactccttgaatttccgcctttcagaaatatgttcctaccgtgtttgagaattatatcacgcaaaccacccatcgagcttccggaaagacagtcgaactggctctctgggatactgctggacaggaagagtacgacagactgcggccactctcatatcccgaaacagatcttttgttcgtctgctttgccatcgactgtcctgcatcgctag

SEQ ID NO: 11204 - DNA, 342 bp, A.fumigatus
atttccgcctttcagaaatatgttcctaccgtgtttgagaattatatcacgcaaaccacccatcgagcttccggaaagacagtcgaactggctctctgggatactgctggacaggaagagtacgacagactgcggccactctcatatcccgaaacagatcttttgttcgtctgctttgccatcgactgtcctgcatcgctagagaatgtcatggacaaggtattttactcgcctcttgtcttcccacaacatctgaccaacatgaacagtggtatcccgaagtactgcatttctgtcccaccgtcttcaccacggggctggaaggacgaacaggggttctag

SEQ ID NO: 11205 - DNA, 330 bp, A.fumigatus
tcctgttcaataatggagcccagacaaataccctctgtgtttccttcttccttttcttctttctcttcgtctcttgttcttttcattctcttccttactctttcgtctacggttcgagcgacagcgtcttcggctggctgtattgtactgccgtcgaatagctctgcggatctgtcgttcaccaaccaaaagaggttccatctgcagagcgatcaatacactgttccgtcggacgccattgtcgctcctttgacccaacatctggtcaatttaaacggtactgaccttcaggtgggtcatgtcttcagacagagattcgaagtcagatga

SEQ ID NO: 11206 - DNA, 456 bp, A.fumigatus
tatcacaagaggttcaatgtcactgggaatccggttgatgctgccgcatacaattcgctcagtttgagtacaggcgatattgcttttgtcagctgtgacacgtctctgtaccctggcaatttggatgccagtgcaacggtatcgaatcttcttacagcgcaagagaaggcatccgcggttcttctgtacagcacttctgcttcccattgcaactatactgtgaccaacgacgctgctgcccaatataccaacgttttcaccctgttgaacccagcctttgccgagtcgcttagggttcaactcagtaggcagaacggaaacggctctctcagcattgtctacaacatgtccttcgtggggacagtcaccccgtcgacccaggatgggtcaacggacagccccaacaccggtgcgtttgtctccctcctcgaagctcgtctcctcctaaccaattga

SEQ ID NO: 11207 - DNA, 2856 bp, A.fumigatus
  unsure (2743): Identity of nucleotide sequences at the above locations are unknown.
cttgttctagacactcccaagcagatttatcgatgcgactttcctgactgctaccggacctttgtacggcaagatctatgcgttcggcaccgtgaacggcacacgacgcagggctctcagcttcagaaacgggaccatttcgcgcaagcggcttcgcagaataaacaacaaagccagttgcctcacaatgtggccaataacaatgttccgcaaatgggcagtacccagaagccgccaatcttgcccgccactaccgttgatttgacatcggcgcgctccgcaaccactttccctgaaggcggggtggagactctgacaccccagtcggctaatggttccagcaagcatatatcagtctcatcgtcgacgtcgatgtcgctcggccgaccgctcaactaccaaccgctgattgctcagcatggtgtggggacaccagactcgactacatcgaggtctaacagtctgagcaatcatagcattaattctcctcctggtcaagcaaatgctcccttcagccctccagacctgcaaaagccagcgtatgtgccgctcaccggccgccactccatatatccgtcgggcagccccagtgatcagacatatcaactgaccggactgaatcccatttctaggacaagacctcaagacgctacagcatactccatgtcagccgatgtcaacggctcttcggtagttcagtcgctgccgtatggctctcccacgggcctacagatgcctgtcggtggattttccgatctttcgatgaataccgtgccgccctccacccaggcgtcgctggacagatcaaccagcattactggattagattccctgtcgggtatgatcacttccgcagatcctgcattcgatccgatggcctcttgcgtctacccgattttcggcggcgaaacatacaacaaccgctccccctttgcgatggccgatgatttcaccgcgtggctgttcaatgaacctcttccgggatcgtcgtccctgacctatcctcccacggcctccatgatgccgaattatctggatccgacacagctgcagaatcagttcctcatcagcgagccagcgttcggcagtttcctgaacggcgttcttccgcaacatcccatgagtgtcaccagtatcttagatcccggttcgccccaggcgatcatgtcggaggagaagcgacaggagttgctgcatctcatggccactcgatttaacgaagccgcctattcggcagtggcaaagcgcaaggatgctctgatggatggagacgttgacgatgacagccatgttctgagcttgcgcatgatgcagacatatatcggctcttactggtaccactttcactcgcagctccccattctgcaccaacctacctttgtcgcggataaggcgccaaatctccttctcttggccgtcatggccattggagcagccacccttgacaacatccatgggcaagaggtcaccgagacggctgcggaactggccaacttcatagggtggcatctacggtgggagattttcatggatgctgatttccgaccgcccgccaagctctgggttttccaggctttactcctgctcgaggtcttcgaaaagatgtactcgactcgcgcattgcacgagcgcgcgcatattcatcacgacaccaccctgacgctgatgcgtcgcggcagctcgttgatcggccgctccgcactcgactcacccgcaagcttcagagacgaccggcagactagatccacgacaggatctggttcgaactcggaattcgctgcagacgattcctggacgcactggatcaaggcggaggccaccagacgggttgcatttgcggcctttgtgctggattctacccatgccactatgttcgggcattcggcgaagatggtggcccatgagctccggctcccactcccctgcgacgaagccttgtggtccgccaccagtgccgccgaagttgcccgcgtccaatccagcctgcatgcaaatggagtgaagccgaccatgtttctcgacgggctcaaaaagacgctcaacggacagcgtgttaccacgaatgccttcgggcgcactatcctgatggccggtctgcttagtgtcagctggcacatgaatcagcgcgacctgcaagtcagctcgctgggcgttccgcaggctctcggtggacgggacaaatggcgatcagcccttctgcgagcttttgataactggcggcgcgactttgacgaggccctggctcaggcaggacctcctccgttccctaatcagtaccgacggcattccctcgaagacgatggcgtctccgagtctcgggatgtcctgcatggactggctcacatggcctcgcatgtcgacattgtagactgtcagatatttgcaggagcgggccgactcatggggcggtcaattactccacgcgactacagcgctgcccgtgagaagatgaccgaacgatgggccaccaaggcctcagcgcgagacgcgacgtttcacgccctcaagtttctctccgaatgtctgttgaataaccggagtgtatccgaagaaaccggaacctactccggacgcgatgactatctgctcaaccggccatgggtcatctatgttgcagtgctggtcgtctggtgctatggatatgcgctcgacgggccgatcgcctcgcctcccgcgctggaaacggtagctgaccagcgacgcgacatggaagcctttctccgccgggtcggcggggtgcganagccccacgagctggcgacgatgaaaggtcgcaaccagtgcctcggcctgttgatgattctgcgagatggcttcgccaacacccggtgggagctcctctcggaaagcatctaa

SEQ ID NO: 11208 - DNA, 348 bp, A.fumigatus
tctatgcgctttactggtccttctggccggcctggtgagaagttctccgcatctgtgcacgatatgacatttgctgttgggacggtaaccgggtccgatcagcaactcgactacaagcgaaaggaaccgggcgataaggaagagaccatggagaccgacgccttgcgagcggacggcgcgccgcgcaaacgcaagagggcccgcaaggtgaactcggatcggaagtttgaatgtacacatgagggctgcggcaagagttattcgcgtgcggagcatctctatcgccaccaactgaaccgtatgtcggacgtcttccaaccacaagcccgtttcggtggatgccaatga

SEQ ID NO: 11209 - DNA, 1212 bp, A.fumigatus
gggaccccaggagggagcaagatgaaactgctgactgaagcacgacatttgcgtagaactgtcagcatgtttaccatgactggaagcaaagatcactcggttcgcaagaggatgttatccaacatctacagcaagtcgtttctgcagtcgtcacctcatatgcgtcttatctcgaggactatagtatatgaccgtcttctaccaattctatacgatgcagcgacttcaagtagacctgtcgatgttcatgacctcaaccagggactgacaatggacttcgtatcagcatatctatacggcgtcacaaatggcaccaatttcctccaggacgcgccttataggcaaaggatgctccatttataccagagcaggaagccatttgagttctatcaccaggaagttcctaatctcctttcttggacaaagtctttgggtatccgcttgataccaagatattgcgatcaggccaacgagatccttgactcttgggggctgggactgtgtgataaagcagaggagtcgctaaagtcaaacagacttgaggatgagccggccgtctataaacaccttaagcagatgatatcaaagcacctgcccgaaaacaagaatgacgtggaatacgcacggatcctcgagcagcagcggcttgatattgcctgcgagatgtacgaccacctgacggcgggtcatgaaaccagcgccgtcgctcttacatatctcctttgggaactctcgaagcaccctgaattacaggacgcacttcgggcggagctctccacccttgagccgatggttatcttccctcggccgtccgaatctgcggagttgcctccggcaaaatcgattgactccttgccgctgcttgaagcaatagtcacggagacactgcgcctccatgctccaattccaggaatccagcctcgagtcacgccgtatccgtcttgcactttggcgggatacaacaacatccctcctaagactagggtcaatgcgcaagcttattcccttcaccgcaatcccgaggtgttcccagatcctgagacttgggaacctaagcggtggctgaaagacgtcaatactccttctgagttggaagagagaaggcgctggttctgggcttttgggagtgggggaagaatgtgtgtaggcagtaacttggccttgcaaggtaagggagcatttaggtcacaccaaagcctcaaactgacgtga

SEQ ID NO: 11210 - DNA, 198 bp, A.fumigatus
ggtaatggtcgtcgtcgaaacgcctttcgtcgatgggcgcatgatttttttgcccctattcttaccaagggcggcatggctgcggatccgttttctcgccgcatcattgtgactgagatcgttgtgattatcaatgaactcgaatggcatttcgaaacgttgcggatcaccagcaatgacagtgtgatgcctaagtag

SEQ ID NO: 11211 - DNA, 192 bp, A.fumigatus
tgtttaggtcttctagttgagacgaaatccgcttggcaggccgtcatccgctttcaaggtgggttaggtgtgtgcttgagtgatgtaaccctcaatgagctatctttgcctaaacttagcgatttcgacgaatctaatttgaccgacgcttacaacgcagctctgacccagaagaagtctaaatattgctga

SEQ ID NO: 11212 - DNA, 183 bp, A.fumigatus
cacaccttggcaggaacagttacctcaatgacagccaaatcgtatcgccattatatcgttctattcgttcgcaccatgcacctgaaatggtttagcagcttttcttctatcgcccctctctccggtccagccgatggaataggtacaaccccatatgagatagtaactataaaagggctatga

SEQ ID NO: 11213 - DNA, 1086 bp, A.fumigatus
cctgccaccgggatcagtcgtagcatcctcaactttatcaccctttgtatgagagctttcggaaatcgtcttgcgcttacacatttgccagccatggtggccacctacaaccaagggacccgagccagtgagcttgtgcgccagtacgccccccaaatcgctggaaagattattctcattacgggtgtctctcccggaagcctgggcgaaagctttgtaaagcaagtcgccgtggcacagcctgctatgttcatcctcgctagccgctcgatctccaaggtgcaaaacctcatcgacgagctagccacagcatacccaagcgtcaaggtcaagccactctacctcaatctcctctcgtttgacgacgtccgggaagcggctgagacagtcaattcctggactgacgtgcctcacatcgacattctggtcaataacgctggcattatggcggtgccatacaagctgaccgaggacggttacgaaagccaattccaaacaaaccacctcagccacttccttttgaccaatctcctcatgggaaagatcctggcctcgaagaccccgcgcattgtggttgtctctagcagcgtgcaccgtattggccacatccactggtccgatccgaacttcaacgggggcaaacactaccagcggtggctaggatatagccagtcaaagacggccaatgctttgatgggtgtctcgctggccgagaagctcggccaccgcggccttctcgcctttccgatatgtccaggggtcagtctcacgaacctggcagcacatgggagggaagatttggccgcgttctccgcggacctcactgatatggataatatctatggcaacaagtggttgtggggcatggccgagataaagatcaaagacttggatcagggagctgccacacatgtttttgctgcgtttgacaccagtattgcgaaccagaatggggccttcctaagcgattgccatgccgcagatcctgatatggaagaagtgcattcgtgggcaacaagcaaggtcgatgcagagaggctatggagaatgagcgagaagcttgtcggtcaggagttcaaatattag

SEQ ID NO: 11214 - DNA, 780 bp, A.fumigatus
gccattgtcgtcaaatcggagccatctatcatgtcgctttttgcatttggctcgaacggatcaggccaactgggcattggacatgatgaagatgtctctgttcctacaagatgcctctttgaagaaggccagacaccttctgaagaggaaaatggcacacaggcgaagactatctcctgtatcgttgcaggcggaaaccataccctcatcttgtatcaagacggatcggtatatgccgccggctgcaacgaggatggcagatgcggacaccaccccgcaactgcatcgctgcagaagttcaggcaggtgattgtcaaaagtagagatggcacttgctatcatacgttcaagcacttgtctgcgacatgggaggggacgttcctggttgttggatctgaagatccgtcagccgaggcggacagtatatttgtaattggttcaggagcaaagggagagctgggacttggacagggatgcacgaaggcagttgaaccgacaagaatccctaactttcctcctcaagggacaaaagttgtgtcgattgccagtggcatgggccatacggttgtggtattgtccaatggggaggtttatggctggggaggagcaagaaagggtcaacttggggaatcagccaggggaatgaagattgtatggtgtcctacaaaagtggaaggaattccctttcaagccaagggtgcggtttgtggtcgcgagtttacggtagtttcgggcaacaagtccgcaggggaatatgccattattgggtcaatgcgataa

SEQ ID NO: 11215 - DNA, 438 bp, A.fumigatus
tttcgggcaacaagtccgcaggggaatatgccattattgggtcaatgcgataataagtggaatatcctgtctgatgctcctgcatcccaatcgttgacatactaccgaggtatagcagccagttggcatggtgtctatgtacatcagaacgacttctctgtcatcgcctggggacggaatgatcgaggccagcttcctcctccggacctgcctcggtctcagaaactggctgtgggaagtgaacatgttctcgcacttcttgatgagcacactgttgtggcatttggttggggcgaacacggtaactgtggtcctgatatcgatgtgcaaggcaatgtgaatggaacgtacaagccagttccgctagagatgcttcagggctctaatgttgtcggcattggtgcaggttgcgcaacgagctggattataacatcatga

SEQ ID NO: 11216 - DNA, 453 bp, A.fumigatus
agactggtcctgacctaccttttccttcccgataccactggtcttgacctgaaggagcaggagcgtcgctgggctttcatccgctctggtcgtgaacacgagtaccatggtcctgctgttcatcccaagcacttgtccgtctgggagcgtcttcgcggaaagggcaagtactacgacgccgaactcgactacaagcagaaggtcgaagaattccgtgccgagtgggaggcagccatggcccgcaaggtttctgagaacgataagggagaggatttcgcgattgacaccgacgattctctgcttgagggccacgtccactcttacttccaccgaaccagccccatgttcaggggtatggaggaaaatccctccaaatcggataacttcgccttgccccctgctgcgcaggaaggtgactctactgattctttcaatgagaagacacaacaatag

SEQ ID NO: 11217 - DNA, 1485 bp, A.fumigatus
  unsure (56): Identity of nucleotide sequences at the above locations are unknown.
tcgtctaccatcgcgttcctggactggtctcttagtctgtattctctcataattgntatgccgtctttcttcaccgctggcctccagggccttcctcccactcctcctcacgtcctgtccggtggcaggattgaaaatgagcctttttacatcgtcaacaactctgcctttccgccacgctatacgcagaatggttgcgaattcattgagcagtactctcaatccgcccactactcaaagccggctccgatgaacttgcacccaccatccgcccaccatatgcacaatggcagagatttgaccactgctcaccccgcgttgaaccaatcgttcggccccctgcccaccaccaatgtactgcctccgattcgtaccggcctacaattgcccccgatggagagtgccattccaccgcagtatcgccgccaagataggttgatgcagcccgaacaacagcaacgcaaagaggagaaggccaccggaggtgtagccgcccatttggattatgagatggaacagatgtccgactttgtggccgagatggctcagggaatgtatgctttgtatatcaccaagatcaacatagcagatattgacttcgcgcgaagcgtctacccaggaacctcggtccctccccagtttcggaaatacgtctaccagatcctttcttcgacccgtcttcccagctccacgatcctcttgggtctctactacttggccagccgaatgcgtatgctttcctcggccaacgtgtacacctctggcagtgggcaggtttatcgcatgctgaccgttgccctactgctgggaagcaagtttctggatgacaataccttccagaataagtcatgggccgaggtcagcaacataccggttggcgaattgaactccatggaactggagtggctcttcgcttttgagtggaagctccatgagcgcatccatgacaagcaggacggcttcgcatcgtggctctcccactgggagacgtggcgtgcaaaggctgttgctagagcccaggagtcgcttcacaaccttgcccccattgatactaatgtctcgcggggccacatggtgtccaagcctctcttgtctcccgagggaccgattcctccgcagtatcagcgaagctctcattatgagaattcctggctcaaccccgccgcgtctgagtactcgcctccttctgctccccatagcggccctaacacccccgattactacgctgtcggaccctgggcgtatgccaaccctccgccgccatacacgcgaacttggattcttccgccgcagcagtacatgcctcagtccgcccctcggtcgcaacctccgtcctaccaccatacgccgtcctacgcgttaccgtttgcacagagtgtgtggacaggacatggttcatcctgcggatgcttgtactgtgccaagcatgtcgaacactacatgtgtgcaaatgctttcggtcccatgcaggctatggtcgcctag

SEQ ID NO: 11218 - DNA, 231 bp, A.fumigatus
ctgaccgtgtgcatgtgcaaaatgtggaatagggagataatgatggagggtgaatgcataaggattcgatcagtaaaagctccctcggatgctccggtcatgctgtcgttcggcctcaagttcggcgtcggcgttctcttcagcatcttcgccgtggttattgtcttcttgcgcgtgttcgttatggctggttctgttgggaaaggttattccagaaagggtgttacttat

SEQ ID NO: 11219 - DNA, 810 bp, A.fumigatus
catgctgacaggaagcagatgttctctatcttaaacgaaattagcaacaacagtcacttccgtgtgacaggtgttgtgctagccagtatcggaagctccgcagcgacctacattctcgtggctatcacaggctatctctctttcggagacaatgtcgggggtaacattgtgagcatgtatccgccaggcgtttgggcgaccgttggacgtgccgctatcgtcatgcttgtcatgttctcatatccgcttcaatgccacccgtgtcgagcctctattgatgcagtgcttcgctggagacctaagcctgccgctggaaacgacaacttgcctcaccatcaccctctgcttgggccaaggggccaccgggctcccgagcccatgagcgatctgcggttctcactcattacgacgaccattcttatcctaagctatatcgtggcgatgaccgtttcctcgctcgaagcggtattggcctacgttggtagcaccggaagtaccagcatcagcttcattcttcctggtcttttctactacaaaatctcatctcccgactcaccaacccatcagcgactcatgaaagaagatgacgaagcagttgacaacattctttctgatgacgacaactccgacgaaaatggtattgagggcggccagaaccttccacttaccgacagcgcaattctccgacttaccaaccgacactggcgccgtggcttgctgcggaagttgagcttagcgctcgtggtatacggcatccttgtcatgatcgtgtgtttgattgtgaatacattcttcatagcttcacaatga

SEQ ID NO: 11220 - DNA, 327 bp, A.fumigatus
gatggacctgtgctgaccactcctccaagggtaatggtcatccctctctcttatctccgacgtctggactcactgaagtatacgagtatcgccgctctggtgtcaatgggttacctggtcatactggttgtctatcattttgtcaagggagacacaatggacgaacgaggccccgttcgtctgattcactgggctggtcccgtcccggcgctcagtagtcttccggtcatcgtctttgcattcacgtgtcatcagaatgtaggccgcctgcacggttttgactgcagacatagcatgctgacaggaagcagatgttctctatcttaa

SEQ ID NO: 11221 - DNA, 471 bp, A.fumigatus
gttatactgattggggcatcggggtttcttatatttccggagctgatagaaccgtgtctcaacagtcatcggtgccggcgttctggcgatgccgctcgccatctctcgcatgggaatggccctcggtatctgcgtcattctctggtctggaatgaccgctgggctcggcctctacctttaggctcgatggcgcacagtaccctggatcgaggcagcttggttttttttcgcccttacgaagctcacatatcccaatgccggccgttgtttttgaacggtggtatcgcgatcaaatgttttggagtgggggtcagttacctcatcatccttggtgacctgatgccagatgtggaacaaggcttggattggtaccactcccggcagatgacttgttggaggaccggcatttgtgggttactgccctcatgttcgttgtatagccactcccaagttgagatggacctgtgctga

SEQ ID NO: 11222 - DNA, 189 bp, A.fumigatus
aagaataattattactatatatctaggacttgctttcagttccttatatttaataataattatttacttaagtataagtttactagtctaatttatctattactctctactattaagtatatatacttaataaaccttacttctatctctattattattattcttatattacctttagactatccttaa

SEQ ID NO: 11223 - DNA, 1407 bp, A.fumigatus
acttttaacgacgacgatcttacaagaacgcattcagccttcctctgggcattccgtgcaagtcgaaactggaaactcgtgaaggatgttgttccctttctgagaagtcgaatcgagtccgagaaagctgcggaacagcagttcagcccgcaaggtggagcgaccgacggagacacggagatgcaaggcgattttgacggcttcttcaaacaacacttctgtgtatccgctcaggacctggccgacgaactgcgacagcctcttcaggacatgggcgtcctgtatgatgactttctgaccactacgacaccagtctcgcgcttttctcgagcgatgggatactcgcggctcagtgccaataagggccgaatgatgtatactgtccggcaattgagtatgctcgatgctgcccgcctatcagcttctgggcttcgatttacatcaattgagaacgtcatccccgtgctatctcgccgtgtccatataccgtccatgactttggccgctcatctcagggatatgcgagactattccatctccggtcgaaattttgaaccaggagttcatttggtctcgtttgttatgcgtcccaccgtgcatgacaattttgaagtgctcactgccaaaggcgtcagcaacccgttaccgtccgcatcactgccactgaaacgtctccagattgctcatctggaatcgttgtcacatatggaagggtggaccgtttcaacgtgcctgaactggctgacgtcggagacagcgcgcggatacagggacgttgacgcatttcgccaacagctgatacaagcgatgagggacctttcgtctgtcatgccacctgatatcaattcagcatctagattctcggcacgccctcttattgccccgtgtcgtccttcacggcattccgacggaaacaattgtatcattcttccattctgcgttgtcggcacgctggacacccaaatctccaaccctgactttaccttcacgcctctgcgtcttttcaaagcgcagcagcaagtgaacgatggtttcacgggaggcgatggattcgcaaaagagctgagtcaagagctctattattccaacgcccgctccagttcaaccaccgaccccgaaattgcaccctctgttcgtgctcttcgtcgcttctggccgtcccgcaaacagcccagcgataaaatgagcgcaacgtcccaggaaactcttatggagcattcgccgttcggagaaaatactgtccgcaagggaagtgaaagtggacatcacaaattcacagaattgtcaaccgagccccgccctgggtcagcatgcctcacagattaccataatggccggcgactcggcctctcggcacatatgtggacgagctttaccatctttgctactcccctaagatacggttga

SEQ ID NO: 11224 - DNA, 657 bp, A.fumigatus
cttagcgcggatccttcgccccccgtgggtgaagacgtgcaggacttcaaccactactcttcagtgcggcatgtggatggccctcatactggactgccacgtatcccgaaagatttaaagtcggatactcggtctttaaacacctcgccaccttcctacgctggcacgaagcgctccgctgatgaaagtgaggatgaagacgctcgcccggctgttcgccgcaagaaagtcagagttggggcatcagagagcaaattgaccatgaagttacgcagtcggtcttcctcgcgggccttgtctcctcttgtgcgcacagaccgctccgccgaggaggctgctcatgaggatcctcgccctgcccttggagcaaagcgccccgctgatgaggctgcgaataaggattctcactctatccttggatcgaagcgctccgctgacgacagcgaagacgaagatcctcgcccggctgttcgccgcaagaaagtccgacttggggcatcggagaacaaattgacgatgaagctccgcagccggtcctcctcgcgagccttgtctccttcacctgctagcatgaagcgctccgctgatggaactgtggaggaggacccgcgccctacccttcgaaggcggagacttcgcaatcgcattagcacctaa

SEQ ID NO: 11225 - DNA, 204 bp, A.fumigatus
acacccgggtttcttcaacatgctgactctttgttcaaagaaagtctagactccaagagaccctcgggatctgggtataccagcaaagtacgggtccgtgacaagtatcacatcgtcggcttcatcagcagtggtacttatggtcgcgtctacaaagccatcggaaaagatggccggaaaggcgaatatgcgatcaagaagtga

SEQ ID NO: 11226 - DNA, 1269 bp, A.fumigatus
actccaagagaccctcgggatctgggtataccagcaaagtacgggtccgtgacaagtatcacatcgtcggcttcatcagcagtggtacttatggtcgcgtctacaaagccatcggaaaagatggccggaaaggcgaatatgcgatcaagaagtgagtcgaattcccccctttatttttttcctatagtggctgaccaaataagattcaagcccgacaaggagggtgaaatcatccagtacacaggtctctcgcaatcggcaatccgggagatggctttgtgctctgaattagatcaccccaacgtagtgcaactggcagagatcatcctggaagacaaatgtatcttcatggtattcgagtacactgagcatgatctgcttcagatcatacatcaccacactcagccgcaaagacatgccattccggcaccgatgatcaagtcgatactgtttcagctgctgaatggcctcctataccttcacacgaattgggtgttgcatcgagatttgaagccggcaaacattctagtgacttcgagcggtgcggtgcgcattggagacctgggccttgcgcgtctattttacaagccgctcaactctctttattccggagacaaggttgtcgtcacgatctggtatcgtgctcctgagctattaatgggcagccggcactacacgccggcggtggatctttgggcagttggctgcatattcgcggaactgctctctctcagacccatcttcaaaggagaggaagctaagatggacagcaaaaagaccgtcccattccagcgcaaccagatgatgaagattattgacatcatgggcttgcctagaaaggaaacatggcccggtctcgtatcgatgcctgaattttcccaactccagtcgttagcaatgtcgacaggatacatcaacagacagtgcaatctggaaggatggtaccaaagttgtctgaagaataatgggtattccccagggtctgcggcaggcacgccacgcgccgaaaggttcgacttactatcgcggctgctcgaatacgatcctaccaaaaggatctcagcccgggaggcgttggagcacccgtatttcaccacaggtacaccagtcacggctaattgtttcgcgggctacgagggcaaatatccccatcgccgagtcactcaggatgacaacgacattcgctccggcagtttacccggcaccaagcggagcgggctgccagacgatagcctcatgggtagggctgcaaagcggcttaaagagtga

SEQ ID NO: 11227 - DNA, 948 bp, A.fumigatus
gttgcgacagatgatgtcgaagccgcgaaggaggatgcaaacgacgatgaggatacacttctgccccccggattcccggctgaagatgacttcgaaacattcttgtgttacaagtgtgtcgaatcaaatctgtggttgaagcgatatgcaggaactccagggttccttccagcagtctacaaggatggcggtctgtcaaaagtctccgaagaggagcgcacaggcgcagaccctttgaatgcgtcttctaatcaattggccaacaccaagaaacgtaaggccgatgaggatgacacgacagaggcaaaggagacagtcgaactagctgcaaagcggacaaaatcagaagtcgatggcgaacaaagctttacagaatcaaaatcagagactacccaggccgaacccgccaaacccaagcacgaatccctacctaacccacccccatccggaacattctcccttttcctcaaagaagacttccgcgagcacttctgccgctgcccagaatgttaccccaacctagccaaataccctcaactccgtgaagaggaggaaacatatgagccccctctctcggaggatggcgatgccaacggcggaggcagcaccggaacgggcagcatctacgagcgcggcgaggcagcccttagtaacatcgaccgtgtccgggctatcgagggtgcaatggtgtacaaccacctccgtgataaagtgaaggagttcctaaaaccctttgcggagtccggcacggcggtcagtgcggaggatattaaggcctactttgagaaattgcgtggcgatgagaagccgatcaaggatgctgctgctggtcaggcctccgcttcttccgggaatggaggcaatgagaaggacgagggaggagatggtcggaaagaacaaagtggtatgttacgcttgagaatatatgttgcctcaggccttttctga

SEQ ID NO: 11228 - DNA, 1113 bp, A.fumigatus
  unsure (87),(121),(159),(195): Identity of nucleotide sequences at the above locations are unknown.
aagagccagggcttcaagcactatgatgatctgattcagacgttccttgacgctggcatgctgcccatggtaacatttctccatttngacagcccctggatgttggtggccggcggcaatntcacggccaagccggatattggctacaacaacggaggntaccacaacgagacattcgtggatgcctttgtcaantacgccaaaatcgtcctcactcactttgccgaccgagtgccgatctgggtcaccttcaacgaaccccttctctactcgttcaatttcaagggcgccgacaacgtcgttcgcgcgcacgcacaggtgtaccacttctaccacgacgtcctaaacgcgaccggcagaatgggcatcaagttcaacgacaattttggcgtgcctcgcaacccccgcaatgccagcgacgtccacgctgcaaaccgcttccaggagatgcagctggggctgttcgcgaacccaatcttcctcgggcagcagtacccggattccatcctgaacaccctccccggcgccgaaccgctcagcaagaaggacctggcgtatatcgcgaacacgtctgatttcttcggcatcgacccttacacggcgacagtggtctctccggccgcagaggggatagacgcgtgcgcagccaacacctcgagcgaactcttcccgtactgcgtggtccaggaaacgaagaatagatatggctggaatctcggctaccgctcgcagagctacgtctacattacacccacctacctccgggagtatctgaactatctgtggaatacattccgcagcccggtctttgtatcggagtttgggttcccggttttcggagaggccgagaagacagacctgtcggatcagctgtttgatactccgcggagtatctactatctttcgttcatgtcggagatcctgaaggcgatccacgaagacggggtgcgcgtcatgggggcgttggcgtggtcctgggcggataattgggagtttggggactatgaacagcagtttgggttgcaggtggtcaatcggacgacgcaggagcggtattacaagaagagcctctttgatttggtggattttgtgtcatcgcggatgtccaagtag

SEQ ID NO: 11229 - DNA, 621 bp, A.fumigatus
  unsure (362),(384),(444),(549): Identity of nucleotide sequences at the above locations are unknown.
atgagacagtgcggtgagttggcagtaggcaagagtggatcagaggagacctatgctaatgactacagctttgccacttctgtaccgaggcccacgtccacccatacgtatgggcctccttatgcgcatgccgtgaaacatctcagccccgttcccgcgacgacaacatggggcaattggcttccttatcagaccgtcatcacggccactgataccactgacccctatgggcaagccgcctggtcgatgctgtggcagcaggccggcatcgagaactacacgacgaccggtttgtactcgacgactgtcagtccgacagcggtgccgagcagttcactggtacctgccgccgctgactactntggcccaacggactgctatagncttcacgccgacttcgtcttcggagtggcaggtagtgcggcacaagtcgagggagcagtncgcttggagggccgcagtccgacgatcctggagaaactagccaacgcgactcagccaaaggactacgtcacgaatgagaactactacttgtacaagcaggacatncaacgtctggcaaccattggagtcaatactacaagtttctccaattccggggacgcgcattctttcctttga

SEQ ID NO: 11230 - DNA, 243 bp, A.fumigatus
gtcgcttggcaatcaaccgcacgagacgcctggtgcctggaccctctggcccctcaaaaaaactccattgcctctttctgtggcatcccccgtaggtcgaatcgcagttcgcaacaaagggacaaaatggtgagcggaccccggccatattcccacctgaacatcaacaatgtgtcaatgaacagtgtggccaccaaagtacacatcgataatcaagagctggagatcggtaggtccctgtga

SEQ ID NO: 11231 - DNA, 207 bp, A.fumigatus
gctgaactgaatggacagattcccctgccgccggatgcggtgctcaatatctggaaggctatcaaacacacagagttcgatgatgctcacggtgcctttgtcggttgggacacgcatggcgacagcaagaagcgggttctggagagtgcgaagatctacgttcgggcaatgggttatctggaccacgccatacaccaagaacagtag

SEQ ID NO: 11232 - DNA, 630 bp, A.fumigatus
agccaatcctggacaaccctccgcactctacaatcagcaaaccaataccacaacgacttcgcccccgatccggattacccagactcgctgatcaccatccacaccagccccaaagtcggcatcggccagcgcgcctttctctgccgcacagcctacggcaacgtcctctgggactgcctttcctacatcgacgaggacacaattcgccagatcaacgagctaggcggcctcgccgcgatcgtcatctcgcatccgcacttcttcggcgcgaatgtgcactgggcggaggtgttcggatgtcctgtttacatcgctgcggaggatgaggagtgggtgatgcgcaagtccgagaggcaggtgttctgggaggggagggagttacggatccccttgccgggtaaaggtgatggcgatgcggacctagttgctgtgaagacggggggtcatttccccggtagctcggtgctgtggttcaaaccattgaggaagttgctggttgcggattcgatcgcggtcgtgccaagtggcgtttatcataaggatcgactgccgggtacggcgtcgtatacgttcatgtggtcgtatcccaatatggtttgtggttcttgcttggctactggcataggctga

SEQ ID NO: 11233 - DNA, 627 bp, A.fumigatus
tatctcgacctagctggtcttgctgctggtgtgaccgaagccgtcgctgtggtaaaccccatggaagtcgttaagattcgtttacaagcacagcatcacagtctggcggaccctctggatacccccaagtaccgcagcgcgccccacgcactgttcaccgtgatccgggaagaaggatttagcgccctataccgtggtgtctccctgactgctcttcgccagggtaccaaccaagctgccaacttcaccgcatacaccgagctgaaggctttccttcaaagagtccagcccgagtacagcaactcgcagcttccctcatatcagacaacggtcatcggattgatctccggtgctgtcggtcccttctcaaacgcccccattgacaccatcaagaccagactacagaagacacgcgctgaacctggtcagtccgccatcaaccgaatcatggtcattgccaaggacatgttcaagcaggagggtgcgcgcgctttctacaagggtatcactcctcgtgtgatgagagttgctcctggtcaggctgtgactttcacggtatacgagttcctcaagggcaaacttgaagagtcaaactgggccttcgtgggtggcaaatatgaggaataa

SEQ ID NO: 11234 - DNA, 315 bp, A.fumigatus
tcacgtttcataacccagtcattcgccatggccgccaaatctgtggagggaaacaagggcaaaaagcccgcttccgcagctgtgaacttgatcggtatgatgacgcttttgtggtgcatggatacttcgttggcggtgatgctaacatgtgacacagctggtggtggtgccggtatgatggaggctctcgtctgccatccccttggtaaggctataattcaacgatatcgggttctgaaagccgagctaacaatctcccacataccatcaaagtcagaatgcagctctcgcgacgggctaaggcccctggggtaa

SEQ ID NO: 11235 - DNA, 207 bp, A.fumigatus
gtaaaacctcgtgggtttatcaccaccggtgtcgacatcgtgaagaaagaaactgccctgggattgtacaagggtctgggagctgttctaggcggtatcatcccgaaaatggctattcgtttcacctcctatgagtggtacaagcagatgcttgcggataaggagactggtacagttaccagcaaggccaccttcctcggtacgtga

SEQ ID NO: 11236 - DNA, 447 bp, A.fumigatus
agaaatacgctgacttgtctcctcccagtctcgtccgagctgcatgatgcattcaacaacttctcctcggactcctccatcttctgtctccctgtaaccatcacagcagagagcctgacccccctctcccctatccgattctcctcccccggcgcattctacccctccctctcgcaactctcgtcggtgctacagccgaaaactcccctctatctgctcttccgtcgccccgaatcgggttcctcgtccctctgcgcattgacatacattccatcgaatgcccccgtccgcgccaagacgcttttcgcctcgactcgtgccacgctggtgcgagaactaggcagcgagaaatttgcgactaccatctttgcgacagaggaggaagaaatcaccagcgaggaggcgtggcgcgagagagatgcggagaacaaagggtctggtagctag

SEQ ID NO: 11237 - DNA, 324 bp, A.fumigatus
tgcaggcataggtattgtaacagcaaaaaaaaaacagagcccaatgtgcaaaaatggggggatcctgaagaggccctacgccaggcgtcgaacaacgacctgtatcggttcttgggctggtccctcaaactcaagcgaggaaagaacggtcgacgtaacaagggcattcacaagtctagctcgttgaatacggactggaagaaccttcgtggttactaccaaaaactgaccaagagcaaaatcgacgatatagatgggtcggaggtccggagggtcagtagcatgaatcattattctttcgatttgtttgaccgtcttgtctaa

SEQ ID NO: 11238 - DNA, 327 bp, A.fumigatus
ggtatcaagtacttggtggtagagcatgggttagatacgcaaccgaaaaagaagacgccagtctacattgaagatatcggcccgttgaacgaaacgattctctcgactcagctaaagaagttctaccttggcttgcagcgtatccaagtgtgcctgttcaactcgctggctctgttcactgtacaccgcaggagcgccctattgagtctccagttcaaagacctacaaatctcgctgcagaaggatcctcgcggcggacctcctatccctttggttgaactgacggccgatggatgtaaaaagttcctcgggcagactaaattgtaa

SEQ ID NO: 11239 - DNA, 372 bp, A.fumigatus
agaagaacaggcagagaaagtcgagagtttcctacgggagaacacatctttgtctggagcatcgctggagaatgcggtgctcgacgtcctttggcgacatcggaatcgcacattacccgactcttctcctccccctcctcgtcatacggtgattcgccggacctcgccagcaccatggcagatggcacgctcctctacacctttatcccctccctccaacctcggcacaagccctggcggctcatcttggttccaaagctcccgaggcttccctcgcgcacctctttcatcgaccgtatcaccattcacctccccgcgaccatccccaagattagctcttgcgcaacctatcccccattcgccgaaccttaa

SEQ ID NO: 11240 - DNA, 897 bp, A.fumigatus
  unsure (645),(667),(672): Identity of nucleotide sequences at the above locations are unknown.
ttcatagcttcatcgaagcctctactcaggatgatatcagacgacctccttgacagttgtctccagattcttcaggacaaagctctcgatgaagaagaacaggcagagaaagtcgagagtttcctacgggagaacacatctttgtctggagcatcgctggagaatgcggtgctcgacgtcctttggcgacatcggaatcgcacattacccgactcttctcctccccctcctcgtcatacggtgattcgccggacctcgccagcaccatggcagatggcacgctcctctacacctttatcccctccctccaacctcggcacaagccctggcggctcatcttggttccaaagctcccgaggcttccctcgcgcacctctttcatcgaccgtatcaccattcacctccccgcgaccatccccaagattagctcttgcgcaacctatcccccattcgccgaaccttaacgcttacgaattctcggaccagagtcaagtatcggacttttacagtgactttggcaacgatagtaatgtggattggcttgttgcagacgatgcgcagagcaccacctcctctgtggggacaatgagcgcctccggtgccctcagcgccactgcccccggattcgttcccgatatgagcccncacgatattttgcgcactgtgnctggnagacatagattcaatgaagagatcgaggctgcattggaagcaaatggctatgatctcggcgcgactattgcatctttctcgcaggatcagagtggaggcagcttcagtcaagtcgatgatggtcgtgtcctcgtccgccaaattatgaccattgagcaaccgagattaagcacgtcaccggattacaaccgaagccctgttgtttgtaaatattggctggctact

SEQ ID NO: 11241 - DNA, 219 bp, A.fumigatus
ggcgctgaaggcctcaagctactggctcccaacaaggaatctaggcatttctactatgctatgtacataaatcctgctgtgacgagggagttgccttttctttcttacgaaaaaaaaaaaaaaaaaaactgtgatttatttctctcattctttcctaatctttacaagatcaccccccaaagggtcgagacactacggagtaaattcacggctatttaa

SEQ ID NO: 11242 - DNA, 477 bp, A.fumigatus
aagatgcccgcagactatacgtccactgcgcgggctctttcgcttccaatgtcgcctgcagaatccctgtcgcccgcagaagaagatacacgaccattatggagccatctggcctccagcaggcgcaatactgccagtccttctgtccgggaatcaactggtctccgtgatcaagttgtcaatcaagccacgaagatgctgcgacgaaccaaaaagacatggcggagactaacattttggcagagaattggggctattggagcagcgttgcttgccatcttgctgggattgtctttcatgatcttcacgggacaagtgttcttctggctggggcctgtagctgaaaaatgggaacagtcatggttggcatttttcgtcctgtggctgtgtgttttctttgtttctttcccaccattggtaggttggtccacgtttggaacgatatctggtttcatttatggcatatggaaagggtag

SEQ ID NO: 11243 - DNA, 483 bp, A.fumigatus
tttatttttctattttatttgatcgattgctctgaacctagatctaacacatatcttagctggatcctctatgccactgcaaccgtgctcggatccacgtgttcattcatcgtgtcgcggacaatcctgtcgaaatttgtgaaccgcatgatggaacgggacaaacgatttgctgctctcgcgttgacactcaagtacgacggacttaaactcttgtgcatgattcgcctatgtcccctaccttactctgtttgcaatggtgccgtctcgacctttcctacagtgcaccctttgatgtatgggctggcaactgctctcatcacacccaagttgcttgtcccagctttcattggaagtagaattcggattctttccgagaaaaatgaggatatgagctcggcgtccaaggctgtgaatatctgtagtattatccttacaattggaattggtgtctttacaggctggtatatatacaagaggtaa

SEQ ID NO: 11244 - DNA, 426 bp, A.fumigatus
gtctccctggtaattgactctgccttgactccccaagatgctaacaactatggttataggacattggctcgcgccaaagagttggaagctaaagagagagctgatatacggaggtcgttgcaagccgatcatgctgctcaccgtccccatggttctttctccgaagacccagatgtcaacaccgctgccactacgctcgctcgcgacgaggaggaaaggatcgagttcaacgactttgatgatgataacgttgatcttgttattgacgacgacagcggcagcgagatttcgcccaacctcacgaaaaagcagttcccgggaccctatagggacgaattcacagacaatgattcagatgttttcggggatggcgatggacctgacagtcagatgttccgtctccatacacacgtgcgatcgggttga

SEQ ID NO: 11245 - DNA, 192 bp, A.fumigatus
tgcactggatatgcattaagagtaagaagcttgattatcaccccttcaagcgggcccattgtgaataagtccagcgatcggcagatcgcacagaccgccacagacatcaacctggcaggatacgacgaagcgactaataatagatatttctggcttgtacagagtacagagtaccatgacttaacctactaa

SEQ ID NO: 11246 - DNA, 225 bp, A.fumigatus
aaggtctggtcggccgttagcaatgaaagagggggagatagaataccttacaaggtttatcatcttatcaaggcgcaagataccttgtgccatgcagttaataaggcagggggtggccatactaagtatggggcccgcggttcccgctgtgggtgggctagtcttggatatactctgaatagaggcgagaaactcacctatacctactacctaatagagttgtga

SEQ ID NO: 11247 - DNA, 411 bp, A.fumigatus
tggacaatacgctggcaacgtaagtgcatgtcccggtcaacgttgttttaccgcaggcttacatcaatatgcagtctgagcaacctgatcggtttcaaaggccacctcaacaactcagccgattttaggccagatgaatatgaggtcgagtggatcacggatcgtcggtatgccgatttcaagttcagcaatgagtacaacaagacttgcgactatccgaaattctggaatgagactggctttccgttgtattccggcggggttgaggagttgaagggttgctataatagtgattttgatcagtatggagaactagaggcatttggcaacttccctgactggaagcgccagctcaccaagttcgcctcggtacaagatcggttgcgtgaatggcacaagccccgttcgtga

SEQ ID NO: 11248 - DNA, 261 bp, A.fumigatus
aggcatttggcaacttccctgactggaagcgccagctcaccaagttcgcctcggtacaagatcggttgcgtgaatggcacaagccccgttcgtgatatcatcaccaggcattactgcattcaaattgccagtctggatatcgacggtttccgctatgataaggctgttcaggcgaccctggagcccctgggtgagatgtcggcggcattccgggaatgtgcaaagaaatatggcaagcataatttcttccctacctggcga

SEQ ID NO: 11249 - DNA, 456 bp, A.fumigatus
tcgactgactctgttcacgactctcgagagcttgaaggcacttcagaaatgttcacggagacgcagcgctcagtcgctctcatcctgtcactgctgagcgtcagtgcactgtgttggccttacaccgagtcgctcgttgattataacttaaacgaaaacagatcggcggaatcgccgattgactactggggagaatggccgaaccataagtaccacccttcgccggacaactggcgtttccctgtctacacgatctttctggaccgaatcgcgaacggtgatccaacaaatgacgatattaacggtaccactttcgagcatgtagtgaattccaaccagatgcgccatggaggggatctggtcgggttaattgatacattggactatatcaggggcatgggtttcaaggtgtgtttgaaatcgcttccgtgtctgatctgtcacttacaaatctag

SEQ ID NO: 11250 - DNA, 1020 bp, A.fumigatus
  unsure (134): Identity of nucleotide sequences at the above locations are unknown.
ttgcaaggtgccatgttccaactgtccatgttcctccgagtattctcgtcgttaagcagctttgggcaaccaagtcgattccaagaaacaatctctgcagagcatcgcatttgcaacatgacctcaaccgaaanacaatttaccgtcgcaatagtaggcggtggaatcggaggcctcgcgctggctgcaggactcttgcgccgcaatgtgcctgttcaaatctatgaagctgctcccaaattcaaagagatcgggctgggtttgacgatagggccagcagctcaccgtgcgatgcccttgattgatcctcagatccgccacgtatatgattcgctcatcacgacccatgccgacagtcccgggtatgagcgattcaagcaaacttggtttgaagttgtctgggcctcaggtccaaaatcgggacaggttctcatgaacttgaaggccttgccgtcagggcaaaccaccgtacggagagcggatttcttggacgccttggttgggctggttccgcctgagattgcgcacttcggaaaaaggctgatcaggctagtcgaatcgccgaccggtgtgaatctgtactttgaagacggcacctctgcaagtgcagatgtagtggtcggttgtgatgggatccattcaaaagtcaaggagtttatgctaccagatgagtatgagcagaccatgccacggtacagcggaatgtacggatatcgcgcagtcttggatatggagacgatggtcgaagcggtcggtgaccaccgtgctcgagtagcgaccatgtatgtcggagatggtgcatatgggatttcatatcccatcatgcacgcgaagaaggtcaatgtaggtctctatgtcctgcacgatatgtgggacgacgcagcgtgggttcgtcaagctagcaaggagaatatggcaagggacatgaagcatatgggggaatatgtcaaccggctggtcgaggtatgcggaaaacaggaatcgcattttacagcgcctccagctgatagtggaccatga

SEQ ID NO: 11251 - DNA, 444 bp, A.fumigatus
cagtatatgccggatccctcgcagtgggccatatttgatcatccacattcgtccaccttcgcgagatcgcgtatcgcgattctcggggatgcggcccatgcttccaccccacaccaaggagcaggagcaggacaagcaattgaggatgcacacgtactggcagagcttcttggggatcggagggtaattgaagcaagagacgtccttgcagcatttcaggcatacgatgaagtacgacggccacggagtcagagggtggtaactagtagcaaagagaacgcatacttgttgtgtttacacctggatggagtagaacatgatgaggagaaattgagaacaacttttcaggagcggttacggtggctttgggatatcgatatccaggaccaagcagagagggcaaggcggatcatgttgaagaagatgcagaacagctcgagttga

SEQ ID NO: 11252 - DNA, 597 bp, A.fumigatus
atcgcccaggggaatgttccagggaagtcgtctattttgacctctcgtggtcactttttgcagtattccaccctcacctctgccttcccgcttatcatccgtccagccatggcttctctccgcccctctgtcaaaaggttattacgacagccgccctgccggttgtactcgggcgctccgtcatcctcatcacgactcaatctacccatcgactacaaatctacaccccttctgcatcatacctcgtcctcactatcgagcgcactagaactacctggctcaaccaccagcaaatcactaaatctataccaagctatcaactccgcgttgcgaaccgcccttgctacggataacagggtgatgctgtttggcgaggatgtagcattcggcggagtgtttcgatgctcgatggacttgcaaacggagttcggatcggagcgtgtatttaataccccgttgacggaacaagggattgttgggttcgccattggagctgccgcgcaaggcatgaagcctgttgccgagatccaattcgcccattgtcttcaccacggggctggaaggatcagcgtctcagttgaaatttcaagcgtcaac

SEQ ID NO: 11253 - DNA, 609 bp, A.fumigatus
tctgtggctaagctactagctaagtcaggtccagtacgcgtgcttttcacgcacgccatcgactcgcataatgcgtttgaggcggtcgattgtgggacgtttacccagctgccgaacggagatgatctcgagactgggtcgatgccgcgctgggacttgcctggtaagccggttagggagtatgaggaggtgtggcgggagttggccttcagagaggggccggaggggccggggaggggagtttcgtgggtgctggaggcgaggggggatgtgcagggcgtcagcggtcaggatgcgagtacagtgacgaggatgttcattgcgaggatttgggggacttatgttgcgctgcgccaggagcagatgcactccggtggagactcggaggctgaaatcaaggatggaggggaggttagcgctagacgcgaggagtgggactctacgtctgggtggaagacgaagtacgtccttggcccggatgccgataagttaccctctatgacgacgattggcactggagatggagattggagcatcggcagcgaggtgctgctgagcgaccaaccctacattgtacgagcgtgtgaacgaattgatcaagaatattag

SEQ ID NO: 11254 - DNA, 258 bp, A.fumigatus
gaagcccccaggtcgtcaatcaaaatgaccgccaaccaaaccagcagcagtagtagcagcagcagcagcagcagcagcagcctctcaacccgaatctccctccgttggcctcccgaccccgccttcgaaaataccgacaccatcgtcctgtccctgatgggttggtacgtcgacctccgtgtcgacaaatccaccggtaaaatcgactgggcgatcgccggccaacgcatcgtagaaagccaagagccgcgtacgtaa

SEQ ID NO: 11255 - DNA, 636 bp, A.fumigatus
tctatacgtcatgcaggtatatacattaaagttgttattttactggtcgttaacaaggacgtagcggtagcgggccttgccatcgttcatgtcgacaacagcctggttggcatccttcatgggtctctcctggatccaggggtgaacacccttctcagcggcaagctggagcatctcccggatctcactagggctgccgatcagggaaccgcccatcctgattctgcggccgatcagagcatgcgcagggatctgcagagcaccgtcctcgggagcacccatctggacgaaggcaccgttggtgcggagaagagagcagtattggacaatgggcatctggcgatgtcagaccatggcctcgttacccagacagagagtgatgaacataccttggaggaagaaacagtggaaacgatcagatccagggaacggttgtgggtcttagcccaatcaggctcgtcatcagttgcaatgtactcatcagcacccagcttgagggcgtcttccctcttgttggccttgcgggagatggcgacaaccttgtccgcacccagggccttggcgaacaaaataccaaagtgtcccaatccaccgattcctacaactccgaccttcttgccgggaccgcagccgtag

SEQ ID NO: 11256 - DNA, 537 bp, A.fumigatus
ccgctgacgccctgcacatcccccctcgcctccagcacccacgaaactcccctccccggcccctccggcccctctctgaaggccaactcccgccacacctcctcatactccctaaccggcttaccaggcaagtcccagcgcggcatcgacccagtctcgagatcatctccgttcggcagctgggtaaacgtcccacaatcgaccgcctcaaacgcattatgcgagtcgatggcgtgcgtgaaaagcacgcgtactggacctgacttagctagtagcttagccacagattacgggagcgttacgtacgcggctcttggctttctacgatgcgttggccggcgatcgcccagtcgattttaccggtggatttgtcgacacggaggtcgacgtaccaacccatcagggacaggacgatggtgtcggtattttcgaaggcggggtcgggaggccaacggagggagattcgggttgagaggctgctgctgctgctgctgctgctgctactactgctgctggtttggttggcggtcattttga

SEQ ID NO: 11257 - DNA, 306 bp, A.fumigatus
catcgccagatgcccattgtccaatactgctctcttctccgcaccaacggtgccttcgtccagatgggtgctcccgaggacggtgctctgcagatccctgcgcatgctctgatcggccgcagaatcaggatgggcggttccctgatcggcagccctagtgagatccgggagatgctccagcttgccgctgagaagggtgttcacccctggatccaggagagacccatgaaggatgccaaccaggctgttgtcgacatgaacgatggcaaggcccgctaccgctacgtccttgttaacgaccagtaa

SEQ ID NO: 11258 - DNA, 843 bp, A.fumigatus
  unsure (34): Identity of nucleotide sequences at the above locations are unknown.
atactattccggtgcggcgcctcccgtggtgaanaaccgagattcattttaaccagtgagactaaactactccagggccccaccatgtacccctgctgtgtcggtcacgaaatcgtcggtatcgccgtccgcgttggttccaaggccgagggaggcatcaaggtcggtgaccgtgttggtgtcggagcccaaaacgactcttgtctgggccgtaagggcgactgcgaggagtgtgcctccggtatggagcagtactgtaaacatggaatggttggcacgtacaatggcgtccactacaacggcgacaagtcgtacggtggatacgctctgtaccaccgtgctccctctcacttcgtcattaagatccccgatgccatcccctctgctgaggccgcacccatgatgtgcggtggtatcacgctctactctcctctcaagcactacggctgcggtcccggcaagaaggtcggagttgtaggaatcggtggattgggacactttggtattttgttcgccaaggccctgggtgcggacaaggttgtcgccatctcccgcaaggccaacaagagggaagacgccctcaagctgggtgctgatgagtacattgcaactgatgacgagcctgattgggctaagacccacaaccgttccctggatctgatcgtttccactgtttcttcctccaaggtatgttcatcactctctgtctgggtaacgaggccatggtctgacatcgccagatgcccattgtccaatactgctctcttctccgcaccaacggtgccttcgtccagatgggtgctcccgaggacggtgctctgcagatccctgcgcatgctctga

SEQ ID NO: 11259 - DNA, 639 bp, A.fumigatus
  unsure (195): Identity of nucleotide sequences at the above locations are unknown.
tgtgatctctgtatctgctcgacttgcaccatttatcttctttcccactctaatgcgagcgctgtgatgtactcgtcgtcgaactccttcttgggcggcgtcaacaacgcccgcccaggacaaccacccttcatgcagcaacctccatactcgcaattaccccagggtcagcaacaaataccacaacagagtggnttccaaccacagccgaccggatatggatctcaatcagcctctcatctgcaacctcagccaacgggattccctactggacaactgcaacctcagttcacaggcttccccggcgcagcgcctccacagcagcagcaacagtttggcggctatcaggcgcccgcacaacaaccgcaactcacgggttatcctcctcaaagtcaacctccatcgctgcaggttccttcgaccaccggcctgcccactcggcttgctcccaggacgtcttcggagatagctaactcatttagcgatggtgccggtgtggcgcctccaccaccccccaagtcttcggggagtaaaattcctaacatacggctatcgttcatcactgcgcaagaccaagctaagtttgagcaacttttcaagtccgcagtgggagatagtcagacaatggacggtcggtag

SEQ ID NO: 11260 - DNA, 1686 bp, A.fumigatus
  unsure (1668),(1669),(1677): Identity of nucleotide sequences at the above locations are unknown.
aggatgatcgtgaagctaattactcaatccagggtcctgtctgataccactaagtctgggcaattattcttccctgaatttgctttggccatgtacctctgcaatttgaggatcactggtcgagaacttccatcgactctaccggacaagattaagaatgaagtttcaggtatggtggatatcatctcgttcggggtccccgacacagagccgcaaggcgctgcaagaacgaacgttcccagcttcgacgctccattattggagaacaaatctgctccgccggctccccagcatcctaagccgcagcagccatcgaatgcacagtttctatcgcaacttgctgcgcagcccacaggcttcggtcctcaagcaactgggttgcagcccaatcaaccctctcttcttggagcgaacgcaactctcgccccacagactacaggcttccccggacagtctcagcagcagtatctccattctcagccaacaggtctaatgaccaatcctcaagctacaggctacaatggtccccgtcccccacttccgcctatgcctaccggatttggctcgaaccttagttcaatgcagacaggcggattggctgctcagccaactggcattcccggccaatgggggtttgttaacgcaccgtcgtcgggtttgcccaacatcgaggccttgaaacagcaactcatgcctcagcctggtcgtgagggcgggtttacgacagcgggtctctccggcaatgttagtattccctgggcaattacaaaggaggagaagaaaatttacgatgatcttttccgagcatgggatggcttgcataagggcttcataggcggcgataccgctatcgaaattatgggacaaagtggcctggatcgcaaagatttggagcgaatttggacgcttgccgaccccaacaatcgaggccgtttgaacatggacgaattcgccgtagccatgcatcttatctacagaaaactcaacgggtatccagtcccgaatcgtctaccccctgagctaattcccccgtcaacgaggaacttgaatgattcaataggcgcggtcaagtctctgctgtctcaggatgcagagagtcgcaaagcttctggcgcatttttgcaacctcagaagacgggtgtgagttacctcaaggagcactcattccgtggcggtgcaaggtctccgggattcggccgcaaggatgccactctctttaaaaataatgacgaggctgctgctggttaccggtctagcgctcgtcgtcgtgtgggtaatgatgcccggccatcatccccccctacctctcaggcatctgaggaggagctgtctgttgagcagctgaagaagaagatcagggagactcagatcatgcttgatgctgtagatttcaaagatgaaaatcgagccgaggaggatgaggtcttggatcgccgtgatcgtctggaagcggaaagcctcatggatcgaacccgtcgtgttcaggacgatatcgatacgcatcctaatgcagtgttccgtaagctggataatggcgccgaaaagagatccttgcgtcgtcagcttcaagccttcgaggaacaggttcctcagattgcctcagaagtccgccgtattgaacgtgagaattgcgatgccaaacttgaacttttccgcttgaaagacgcnnaaggcgcncccaaataa

SEQ ID NO: 11261 - DNA, 420 bp, A.fumigatus
  unsure (142): Identity of nucleotide sequences at the above locations are unknown.
tgcgagcgctgtgatgtactcgtcgtcgaactccttcttgggcggcgtcaacaacgcccgcccaggacaaccacccttcatgcagcaacctccatactcgcaattaccccagggtcagcaacaaataccacaacagagtggnttccaaccacagccgaccggatatggatctcaatcagcctctcatctgcaacctcagccaacgggattccctactggacaactgcaacctcagttcacaggcttccccggcgcagcgcctccacagcagcagcaacagtttggcggctatcaggcgcccgcacaacaaccgcaactcacgggttatcctcctcaaagtcaacctccatcgctgcaggttccttcgaccaccggcctgcccactcggcttgctcccaggacgtcttcggagatagctaa

SEQ ID NO: 11262 - DNA, 309 bp, A.fumigatus
ggcaatctgaggaacctgttcctcgaaggcttgaagctgacgacgcaaggatctcttttcggcgccattatccagcttacggaacactgcattaggatgcgtatcgatatcgtcctgaacacgacgggttcgatccatgaggctttccgcttccagacgatcacggcgatccaagacctcatcctcctcggctcgattttcatctttgaaatctacagcatcaagcatgatctgagtctccctgatcttcttcttcagctgctcaacagacagctcctcctcagatgcctgagaggtagggggggatga

SEQ ID NO: 11263 - DNA, 192 bp, A.fumigatus
gtaattagcttcacgatcatccttcagaacgattggcgtttcacccaccatattttcgacaattcactgccgggaagtctcgaacgtagaagtaactccttagctttttcccctgtatgtgatacacttcagcaaatcatcctctcgatcaacgcgatgtcatctgaggactaccgaccgtccattgtctga

SEQ ID NO: 11264 - DNA, 873 bp, A.fumigatus
  unsure (149),(268),(279),(509),(524),(675),(730),(757),(759),(775),(776),(781),(786),(787),(788),(789),(790),(798),(800),(807): Identity of nucleotide sequences at the above locations are unknown.
cggagagggacaaaccaagaggaaaaggggaagccaagcgagaagggaagagaagcgcagaggagagaagcggggggaggagagagaaacgacggaaggcgagggaagacaaggagaggggagaagaagaaaaaagagggagaaagagnggagggaggagcaaggagaagaggagagagagggagaggagggagagaaagaaagggaggaaaaaggagaggaagggggaagggaaagggggacaaagagaagagaagaagggagaganggggaaaaaanaggaggaaggaagggaaaggaaaaagagaagggaaaagaggaagggaagggaggagggagggaggaaaaaggaaaggagaagggagggaaaaggaaggaggaaagggaaaaggaaggaaagaggagagaagggaagagaggaagagaaggaaggggagaggagagaagaaaaggaagaagaggaaaaaggaaaagggaggaggagagaaagaaggggagaaaagaggganaaaggaagaaggganaagaaggaagagggagggagaggaagagaaaagaggggaaaggagaggaaaaagggaagaagagaaaaagggagagaagaaaggagaggaaagagggagagaagagaagaaagggaggaaagaggaaggaggaaagggggagaaggaaganaaggaaagaaaagagaagcggaagagaaaggaaaaaaaaaggaagagagaggaancggaagacaagaggagaggcggaagangnaggaggaaagtaaggnngagcngtagnnnnnggggtcgngngagcgcngaccctgccatctcaatgaaaaatatcatctcaacgataaagtttatcaacattcaaatatcatga

SEQ ID NO: 11265 - DNA, 771 bp, A.fumigatus
  unsure (148),(267),(278),(508),(523),(674),(729),(756),(758): Identity of nucleotide sequences at the above locations are unknown.
ggagagggacaaaccaagaggaaaaggggaagccaagcgagaagggaagagaagcgcagaggagagaagcggggggaggagagagaaacgacggaaggcgagggaagacaaggagaggggagaagaagaaaaaagagggagaaagagnggagggaggagcaaggagaagaggagagagagggagaggagggagagaaagaaagggaggaaaaaggagaggaagggggaagggaaagggggacaaagagaagagaagaagggagaganggggaaaaaanaggaggaaggaagggaaaggaaaaagagaagggaaaagaggaagggaagggaggagggagggaggaaaaaggaaaggagaagggagggaaaaggaaggaggaaagggaaaaggaaggaaagaggagagaagggaagagaggaagagaaggaaggggagaggagagaagaaaaggaagaagaggaaaaaggaaaagggaggaggagagaaagaaggggagaaaagaggganaaaggaagaaggganaagaaggaagagggagggagaggaagagaaaagaggggaaaggagaggaaaaagggaagaagagaaaaagggagagaagaaaggagaggaaagagggagagaagagaagaaagggaggaaagaggaaggaggaaagggggagaaggaaganaaggaaagaaaagagaagcggaagagaaaggaaaaaaaaaggaagagagaggaancggaagacaagaggagaggcggaagangnaggaggaaagtaa

SEQ ID NO: 11266 - DNA, 783 bp, A.fumigatus
  unsure (147),(266),(277),(507),(522),(673),(728),(755),(757),(773),(774),(779): Identity of nucleotide sequences at the above locations are unknown.
gagagggacaaaccaagaggaaaaggggaagccaagcgagaagggaagagaagcgcagaggagagaagcggggggaggagagagaaacgacggaaggcgagggaagacaaggagaggggagaagaagaaaaaagagggagaaagagnggagggaggagcaaggagaagaggagagagagggagaggagggagagaaagaaagggaggaaaaaggagaggaagggggaagggaaagggggacaaagagaagagaagaagggagaganggggaaaaaanaggaggaaggaagggaaaggaaaaagagaagggaaaagaggaagggaagggaggagggagggaggaaaaaggaaaggagaagggagggaaaaggaaggaggaaagggaaaaggaaggaaagaggagagaagggaagagaggaagagaaggaaggggagaggagagaagaaaaggaagaagaggaaaaaggaaaagggaggaggagagaaagaaggggagaaaagaggganaaaggaagaaggganaagaaggaagagggagggagaggaagagaaaagaggggaaaggagaggaaaaagggaagaagagaaaaagggagagaagaaaggagaggaaagagggagagaagagaagaaagggaggaaagaggaaggaggaaagggggagaaggaaganaaggaaagaaaagagaagcggaagagaaaggaaaaaaaaaggaagagagaggaancggaagacaagaggagaggcggaagangnaggaggaaagtaaggnngagcngtag

SEQ ID NO: 11267 - DNA, 819 bp, A.fumigatus
  unsure (13),(20),(22),(30),(31),(32),(33),(34),(39),(44),(45),(61),(63),(90),(145),(296),(311),(541),(552),(671): Identity of nucleotide sequences at the above locations are unknown.
gatggcagggtcngcgctcncncgaccccnnnnnctacngctcnnccttactttcctcctncntcttccgcctctcctcttgtcttccgnttcctctctcttcctttttttttcctttctcttccgcttctcttttctttccttntcttccttctccccctttcctccttcctctttcctccctttcttctcttctctccctctttcctctcctttcttctctccctttttctcttcttccctttttcctctcctttcccctcttttctcttcctctccctccctcttccttcttntcccttcttcctttntccctcttttctccccttctttctctcctcctcccttttcctttttcctcttcttccttttcttctctcctctccccttccttctcttcctctcttcccttctctcctctttccttccttttccctttcctccttccttttccctcccttctcctttcctttttcctccctccctcctcccttcccttcctcttttcccttctctttttcctttcccttccttcctcctnttttttccccntctctcccttcttctcttctctttgtccccctttcccttcccccttcctctcctttttcctccctttctttctctccctcctctccctctctctcctcttctccttgctcctccctccnctctttctccctcttttttcttcttctcccctctccttgtcttccctcgccttccgtcgtttctctctcctccccccgcttctctcctctgcgcttctcttcccttctcgcttggcttccccttttcctcttggtttgtccctctccg

SEQ ID NO: 11268 - DNA, 858 bp, A.fumigatus
  unsure (54),(61),(63),(71),(72),(73),(74),(75),(80),(85),(86),(102),(104),(131),(186),(337),(352),(582),(593),(712): Identity of nucleotide sequences at the above locations are unknown.
atgttgataaactttatcgttgagatgatatttttcattgagatggcagggtcngcgctcncncgaccccnnnnnctacngctcnnccttactttcctcctncntcttccgcctctcctcttgtcttccgnttcctctctcttcctttttttttcctttctcttccgcttctcttttctttccttntcttccttctccccctttcctccttcctctttcctccctttcttctcttctctccctctttcctctcctttcttctctccctttttctcttcttccctttttcctctcctttcccctcttttctcttcctctccctccctcttccttcttntcccttcttcctttntccctcttttctccccttctttctctcctcctcccttttcctttttcctcttcttccttttcttctctcctctccccttccttctcttcctctcttcccttctctcctctttccttccttttccctttcctccttccttttccctcccttctcctttcctttttcctccctccctcctcccttcccttcctcttttcccttctctttttcctttcccttccttcctcctnttttttccccntctctcccttcttctcttctctttgtccccctttcccttcccccttcctctcctttttcctccctttctttctctccctcctctccctctctctcctcttctccttgctcctccctccnctctttctccctcttttttcttcttctcccctctccttgtcttccctcgccttccgtcgtttctctctcctccccccgcttctctcctctgcgcttctcttcccttctcgcttggcttccccttttcctcttggtttgtccctctc

SEQ ID NO: 11269 - DNA, 1074 bp, A.fumigatus
atagttactagagagttcaagaagccttctttctctcctagtaacactaatcaagagtatataactgttgtggaagcaatcagcgcagatggccactttattccaccctttattatcttcccagggaagtgcatcttagcgggatggtttgatgtctgtgatgagccagattatataattggagtgtcagattctggctacataaatgatatccttgccttccaatggattcagcattttaagcatcatacacggcgtcgaatgctaggggtaaaacgcctacttctctgcgatggatatggatcccatatgacctacgaattcatcaatttctgtgagaaaaacaacattctcttatacttcctccctcctcatacaagccatattcttcagccgctggatgttggtgtattccatgcctataagcactggcatagtgaagctattgagaatgctacccagacaggctgtgggaagtttacaaaggtggaatttctatccgccctctttgagatacaacacaggactttcaaacagcgtactttaaagcatgcttttaggctgactggcctaaatccatggaacccatcagtcgctcttgaaagattacaggattccaagctctttaccgatgagtcgtcaagcaattcctccttctcaatcaccaataccccccaaacagcgcgtcaaattgatcaatttaatcgtcatcttcttgatctatcccccactgaagaagattcattccataccactctttctaagctggtaaaggctgctaaaacacaggcgattctagtcgaacatcttacggagcgggtgagggaatcagacactgcaaaactagcccgtcaacgccgtgcgcaggcttctagagctcatctacagataggtggaatcatgcggaaggaagaggtcacacgtatgaagcgaattaggcaagattatgatgagctggtagagaagaatcgcttacagcctcagtggaggaaggtaatggcggaacttcaagagtactgccttgccaaaggaataattgttcgaaagcggagaaaagtgcgaaaggtagtttaa

SEQ ID NO: 11270 - DNA, 831 bp, A.fumigatus
  unsure (26),(33),(35),(43),(44),(45),(46),(47),(52),(57),(58),(74),(76),(103),(158),(309),(324),(554),(565),(684): Identity of nucleotide sequences at the above locations are unknown.
tatttttcattgagatggcagggtcngcgctcncncgaccccnnnnnctacngctcnnccttactttcctcctncntcttccgcctctcctcttgtcttccgnttcctctctcttcctttttttttcctttctcttccgcttctcttttctttccttntcttccttctccccctttcctccttcctctttcctccctttcttctcttctctccctctttcctctcctttcttctctccctttttctcttcttccctttttcctctcctttcccctcttttctcttcctctccctccctcttccttcttntcccttcttcctttntccctcttttctccccttctttctctcctcctcccttttcctttttcctcttcttccttttcttctctcctctccccttccttctcttcctctcttcccttctctcctctttccttccttttccctttcctccttccttttccctcccttctcctttcctttttcctccctccctcctcccttcccttcctcttttcccttctctttttcctttcccttccttcctcctnttttttccccntctctcccttcttctcttctctttgtccccctttcccttcccccttcctctcctttttcctccctttctttctctccctcctctccctctctctcctcttctccttgctcctccctccnctctttctccctcttttttcttcttctcccctctccttgtcttccctcgccttccgtcgtttctctctcctccccccgcttctctcctctgcgcttctcttcccttctcgcttggcttccccttttcctcttggtttgtccctctcc

SEQ ID NO: 11271 - DNA, 231 bp, A.fumigatus
tactttgcaccggactacgagctggatgtgcgtccgtcgaacatggacaatgccaacacgaaagattatctcgacaagatccgagctcaggtggtagaaaatctcaagcggacggcttttgcaccctctgtgcagatgaccgacgtacctcgcgaacctcttgttgaaggcatggacgatgaagcagacgccatcctggatgaccttgacgaagacgaatacctggactaa

SEQ ID NO: 11272 - DNA, 576 bp, A.fumigatus
cctggttatgaactatggcctctacaagaagatggagatttacgtgagtgttcatggactttcaaggctaggttcaagcagaacactaatgggttatcggcgcagcgtgcgaaaccggcctcaaagtatgaaatgacacaattccacaccgacgaatatatcgacttcctttcaaaagttacaccagacaatatggaccagttttccaaagaacaaggcaagtataacgttggggatgactgtccagtttttgacgggctgtttgagttctgtggtatcagcgctggcggcagcatggagggtgcggcacgccttaaccgcaacaaatgcgacatcgctgttaactgggccggagggctccatcacgcgaagaagagcgaagcgagtggtttctgctatgtaaatggtaagcttatcttcctggcggcgattgtcattatccaacgacatcttctcactttttacagagatcgttcttggtatcctcgagctgttacgtttcaagcaaagagttctttacgtcgatatcgatgtccaccacggcgacggtgtcgaggaagcgttctacacaactga

SEQ ID NO: 11273 - DNA, 318 bp, A.fumigatus
caaatacctgtgcgtttatgcacagtctcatttacaatggctgctcctccgattgacctgaatctcaatggctccggtgatcgcagcaggaaggttgcgtacttctacgattcggatgtaggtaactacgcctatgtttcagggcatccgatgaagccgcaccgtatcaggatgacacatagcctggttatgaactatggcctctacaagaagatggagatttacgtgagtgttcatggactttcaaggctaggttcaagcagaacactaatgggttatcggcgcagcgtgcgaaaccggcctcaaagtatgaaatga

SEQ ID NO: 11274 - DNA, 651 bp, A.fumigatus
atggtaagcttatcttcctggcggcgattgtcattatccaacgacatcttctcactttttacagagatcgttcttggtatcctcgagctgttacgtttcaagcaaagagttctttacgtcgatatcgatgtccaccacggcgacggtgtcgaggaagcgttctacacaactgaccgcgtcatgactgtctcattccacaagtacggagaatacttcccgggaactggcgagcttcgtgatattggagtgggacagggcaaacactatgctgttaactttccacttcgcgatggtatcgatgacatttcgtacaagagtatttttgagcccgttatccgaagtgtcatggaatggtaccgcccagaagctgtcgtccttcagtgtggtggtgacagtctctcgggtgatcgtctaggttgtttcaatttgagcatgaggggccacgcgaactgtgtgaacttcgtcaagagcttcaatttaccgaccatgatcctcggtggcggtggttacacaatgcgcaatgttgcgcgaacgtgggcgtttgagactgggattctgttaggggaaaacttgggtccagaactcccttacaatgactattacgaggtgggtttagactggttcaaatgcagaatgcccgcagattgctaa

SEQ ID NO: 11275 - DNA, 258 bp, A.fumigatus
gacaccccgaacctgatcgataactccgagaccgtacacatttcatcactagctttgctgaagatgttaagacatggtcgggctggtgtgcctatggaagtcatgggcctgatgctgggagaattcgtcgatgaatacacagttcgtgtggttgatgtttttgccatgccccagagcggtactggtgtcagtgttgaggccgtggaccccgtttttcagaccaagatgatggagatgcttcggcaaactggacggtag

SEQ ID NO: 11276 - DNA, 510 bp, A.fumigatus
  unsure (480): Identity of nucleotide sequences at the above locations are unknown.
gtctcggcagggcaaagcaagcttgaaagttgcaccgctgatagatcttcaaaactcaggccggaaacagtcgttggatggtatcactcccatcctggttttggctgctggctttcgtccgtggacatcaacacccagcagtcattcgaacagctcactccccgagcagtcgcagttgtggttgatccgattcaatccgttaagggaaaggttgtcatcgacgccttccgactaattcagcctcagaccgttgtcatgggccaggagccccggcagacgacatctaatttgggtcacctgaacaagccatcaatccaggcgctcatccacgggttgaacagacattactacagcatcgctatcaactatcgtaagacggggctgggagagaacatgctgatgaacttgcataagcacgttttgacagaggcattgcaaaatgaccgacttccgttgaggaaggccaccacaatgtggaancggattgaacagctagtgtacccttgttga

SEQ ID NO: 11277 - DNA, 1062 bp, A.fumigatus
tattacctcccattcactcgcatccccgcttcacctgctagaatcttcagagtcaggcatcgtcgacgcattcaccctgccagcttcttcccatcaactctcttaaactgtcttcaattgttgcttaaatcacatcgcatcactggatttaccactacaacgctcttcccttcatcgtctttcctacccctcattcctgttttccatcatataatttcggaaaagtctcacttgttttccttggctatgtctacacgtcgctctcttcgctctcgtccaatgcgggatgatcaatcaagcatcgattctgacttgagtccaagacgtaccagatcgacacgtggtgtcccacctgcgccactagtaacagtcactcggtctgtttcaggcagcgcagagaaccccatcagatctcttttcctgactgtaaggatgccttcgagcaagcttcgcgaagttactgggggtagtgcacggggtatcacttcaaccaggcgctcccacaatgtcttcactgaaaaccccatcatcaccggaccgcggtctagccggcccaagaggaagctcgtagaggtcagcacaagtgagggggatgacttagcagaccaagaggaggatgaagttgacgaggatgcacctggtgaggatgacgttgatgcggatggcgatttggaacttgacgatgcgcctccccgcccaccaacttcaaaaagaaacgccaagggtactgccacatcaacgggaaaatctgtgaagagcgtggaggagaaggagatggaactggaagaggaagacgacgaagatgatgacgagctgtcggagctggatacggatgccgagggtgagcctgatgaccaggacgagagtgggcttggcaatggaaatggaggagacgaggacctggatgaagaggatgaagaagacgaggaagacgatgatagcgaagaggtcacgcccggaggcgatcttagccggttaaccaagcggcagagaggaaccctcggcaatgactttttgcagcttcccatgggtgagttttccttctgtaagtgtttccagtga

SEQ ID NO: 11278 - DNA, 441 bp, A.fumigatus
agtgccgctgctgaccgaattccagaacctcaagtgaagaagcacctaacggcagaggaacgtgctatgcgtcgtgctgaaatggctcgaagaagaaagaacctcagcgagaagcgaaacgaggaagaaaaggtacggtgggccggtgaagcagcctttcttggtctcgaaatttctctatctactggctgtatcacgtcgctaacgtgtaaacacagatggatacgattaataggttgttgcgcaaacaggctccaaaacgtcgtggtcgtattccagttgctgaagcggaagccaacgccgccgaagcagaggcagaagaggcagagaaaccacagccaacgatggtccgatgggtcagtggtcgcgagggcagtcgtatcggtgtgcctgaagaatggctcgggactcctgcgggacgcgtctttgggaaactcctag

SEQ ID NO: 11279 - DNA, 240 bp, A.fumigatus
ccggctaagatcgcctccgggcgtgacctcttcgctatcatcgtcttcctcgtcttcttcatcctcttcatccaggtcctcgtctcctccatttccattgccaagcccactctcgtcctggtcatcaggctcaccctcggcatccgtatccagctccgacagctcgtcatcatcttcgtcgtcttcctcttccagttccatctccttctcctccacgctcttcacagattttcccgttga

SEQ ID NO: 11280 - DNA, 801 bp, A.fumigatus
ggttctggaattcggtcagcagcggcacttcactggaaacacttacagaaggaaaactcacccatgggaagctgcaaaaagtcattgccgagggttcctctctgccgcttggttaaccggctaagatcgcctccgggcgtgacctcttcgctatcatcgtcttcctcgtcttcttcatcctcttcatccaggtcctcgtctcctccatttccattgccaagcccactctcgtcctggtcatcaggctcaccctcggcatccgtatccagctccgacagctcgtcatcatcttcgtcgtcttcctcttccagttccatctccttctcctccacgctcttcacagattttcccgttgatgtggcagtacccttggcgtttctttttgaagttggtgggcggggaggcgcatcgtcaagttccaaatcgccatccgcatcaacgtcatcctcaccaggtgcatcctcgtcaacttcatcctcctcttggtctgctaagtcatccccctcacttgtgctgacctctacgagcttcctcttgggccggctagaccgcggtccggtgatgatggggttttcagtgaagacattgtgggagcgcctggttgaagtgataccccgtgcactacccccagtaacttcgcgaagcttgctcgaaggcatccttacagtcaggaaaagagatctgatggggttctctgcgctgcctgaaacagaccgagtgactgttactagtggcgcaggtgggacaccacgtgtcgatctggtacgtcttggactcaagtcagaatcgatgcttgattga

SEQ ID NO: 11281 - DNA, 1266 bp, A.fumigatus
ttggctcagggaactggtatgcttatgactgctggttgcagctcgaatgcgaaactggaagctgactccatcttcttgaataggggtactgctatcgctaagattgtcgctgagaataccgccagcaacgactccctcttcgagagagatgttgaaatgtgggtattcgaggagaaggtcgagattcccaagaattcccggcactacgacccatcttcgcccttgtgtcagggtccccagaatctgaccgagataatcaataagacacatgaaaatgtcaagtacctacccggaattgcccttcctgagaacatccacgccaacccgtctgtggtggatgctgtgaaagacagcaccatcctcatcttcaatctccctcaccaattcatcaacaagacctgtgaacaaatcaagggcaaaattttaccctatgcccgcggtatttcctgtatcaagggcgtcgacgtgaccgaggagggcgtcagtctgttttccgaaactatcggcaagaccctaggaatctactgcggcgcgctttctggtgcgaacatcgccaatgaggttgcccaggagaagtggtgcgagtcgagcatcgcttatgatcccccacacctggattctaaggccccgtctccgaatcgatccccctctgcatccactgtggatgtagttcactttgagcacaaggatgtctctggccagctttcgcaggttaaactgcagccactaccgtccgaatatccgccaattgaccacactgtcctgaagaccctcttccatcgcccctatttccacattagggtagtgagtgacgttgcaggagtctctctggggggggctttgaaaaacattgttgctctcgctgcgggatgggttgatggcatgggctggggtgacaacgccaaagctgcaatcatgcgagttggccttcttgaaatggtcaagttcggtgaaaaattctttggtgccactatcgacacgagaactttcaccgaggagagcgcaggtgttgccgatttgatcacaagctgcagcggtgggcgtaatttccgctgcgccaaacttagcattgagaggaagcagcccatcgacaaaatcgaggaaacggagctcaatggccagaagcttcagggtactttgaccgccgttgaggtgaacaagtttctgaaaaagcaaggtcttgaggacgagtttcctttgttcactgcagtttatcgtatgagcccctctcctttctgtgctgcattattcgttcgcaattactaa

SEQ ID NO: 11282 - DNA, 2199 bp, A.fumigatus
agttcggtcgggactttgaggaatttagggttgcccaaggaatttaagaccgtgaataatttgctagctatcaggaccgcattacaagagaaggtaatcagtggcatccgtctctgggagtactatgtcattgatgtcacagcaaacgctgggcatatcctagagaactggaaagcttctgaattgaaacactccgcgtccaagaaatatgcggaagtggatatcagcggattcaaagataggcctctgaagcagcaggcagatctcatacgtcaacatgccattcccacaatcaagcaggttttgggacggttcggcagagcgcttgaccctgaattcgggtctctggtcttgactgctatgttcgggaagtatgactcttcaaactccgatattgcctcgattgagaaggcgctggtaactatactggatgaggtcaatgtgccattctacgaggagtacaatgcagacgtctctgaaatcatgaatcaactgtttaaccgaatcaagtacatcaggattgacgatcacggtccgaaacttgggcctgtcacggacgaaaatcctttgattgaaacttactttaccaggttacctctcaatgatatcacaaagaagcatagtcccaaagcactagcccttgtgaacaacggctggatctggaatgcggatgctatgcgtgataatgctggtcctgaatcaaaagcctatttgcgtcgtgaagtcattgtttggggcgattgtgtcaagctcagatatggctcatctcctgaggataatcctttcctttgggactatatggccaagtacacccgccttatggccaaacacttctccggcttccggatcgataactgccactcaacgccactggcagttgcagaatatctgttggacgaggcgcgtaaagtccgaccaaatcttacagtctttgccgagctctttacggggtccgaagaagcggactacatcttcgttaagcggcttggtataaatgctttgattcgtgaggctatgcaagcctggagtactggcgagctaagtcggttggtccatcgtcatggcgggcaccccataggcagtttcgatgttgagctgccgtcagcgggaagcagtcatgcaattgcctccgccggggtcaaccaaaaccaggaaaagatttctcatattcgtccctgtcctgttcaagcacttttcatggattgtacacatgacaacgaaacaccagcacagaaacgtgatgcaagagacacgttgcccaatgctgctctggtttcgatgtgcgcctctgccgtcggaagcgtcatgggctatgacgagatatatcccaaactcgtggaccttgttcacgaaaagcggctatacttttcggagttctcgcaatcggccgaggttcgtcatgactgcgaaagaggcggaattgggggtgtcaagaagctgttgaatgaacttcacgcgatgatgggagtggagggatatgatgaaacgcatatccaccatgacggagaatacatcaccgttcacagagtgcatcccaaaacgcgcagaggaattttcctgatcgctcacactgctttcccaggacatagtactaatgcggttcttgcgcccactcatctcgttggaacgcaggccaagcacatcggaacgtggaacctggaagtagacgcaagcgatagcatgagagcagtaatcctatcggacaaagatcacctgcgaggactgcctagtcgaattcggaaattcgaaggcacaaaggccgaacagcaaggcgatgataccgttatttcagttctcgatacgttcgctccaggatctatcgcactctttgagacatccatcgccaaggctgagcatgcagcaggtttggagaataacatcactgagggagtagacgaagcttttgcagagcttagtctggtcgatctcaatttcgtcctttaccgctgtgacgcggaagaaagggatttgagcggtggccaggacggggtttacaacgtccccaaccatggaccgttggtctacgctggtcttcagggatggtggagcgtcattggaagatatcatcaagtacaacgcactaggccatccactttgcgaccatctccgtcacggccagtgggccctagatttcatcgtcgggcgcatggagagagccgcaaagaaggaaggatacactgcactggagaagcctgctaa

SEQ ID NO: 11283 - DNA, 1629 bp, A.fumigatus
gcggtggccaggacggggtttacaacgtccccaaccatggaccgttggtctacgctggtcttcagggatggtggagcgtcattggaagatatcatcaagtacaacgcactaggccatccactttgcgaccatctccgtcacggccagtgggccctagatttcatcgtcgggcgcatggagagagccgcaaagaaggaaggatacactgcactggagaagcctgctaaatggttgcacgagaagtttcaggcagtccgtgatttaccaagctttctgttaccgaggtacttcggtatcattatccaggtagcatacaatgctgcttggaagcgtggcattcagctgctggggcccgatgttcggcagggacaggagttcatccatcaattgggcatggttagtgtgcaggtaactggccttgtgaaatccgcatctctttggcctacaaagactgtccccagccttgcagctggtcttccgcattttgcagtggattgggcgagatgctggggccgtgacatcttcatatcccttcgtggcctctttctttgcaccggccgttttgatgacgccaaggagcatatcctagcatttgccagcgtgctcaaacacggcatgatcccgaatctcctaagtagtgggaagttaccccggtacaactcccgggattccgtgtggttcttcctccaggccatccaagactacaccaagatggcacccaacggcattgagatcttgaacgagacggttgccagacgttttgtgccttatgacgatacctggtttgcgtatgatgaccctagggcatattcaaagcattcgactatttcggaggttattcaagaagtgctccaacgacacgcgcatggattgtcattccgagagtacaacgctgggcccgatctcgacatgcaaatgaagccggaaggctttcagatcgatgtcaaagtcgactgggagacgggaataatcttcggtggtagtcaacacaactgcggtacgtggcaagacaagatgggagaaagcggaaaggcgggaaacaagggcgtgcctggtacgcctcgcgatggtgccgcaatcgagatcaccgggctgctttatagcgctttgacttgggtcgcccgcttgcatgagcgcgggctctacccacacgataaggttgacattgcggaagggaggtccattactttcaaggaatgggcggcgaagatcaagcagaactttgaacgctgttactatgtcccagaaagccccgaggaagatggtcagtatgatgttgaccccagcgtagtcaatcgccggggtatctacaaggatctatacaaatccggcaagccatatgaggactatcagctccgcgccaatttccccattgccatgaccgtgtctccagacctttttacgccgtcaaaagcgttgggagctctggctctcgcagactctgtcattgtcggccccatcggtgtcgctactttggatccatccgatctcaactataatccaaattactacaactcggaagactcggacaatttcgcgactgccaagggtatgaactaccaccaaggaaccgaatgggtctggcaacggggattcttccctccggctttcctgcactttggatcttga

SEQ ID NO: 11284 - DNA, 255 bp, A.fumigatus
cgctccagtggaccttggccgttcttgtcgttctgtaacgcgacgtatctgtacgcagaaaaagcaccaggcaagacggaaatgaaaccaaaagctgattccagcggcttatctaggatgttgctgagcttgtattcgaagttttgcccagccactaacgggttgagcaatttcttgccatgcgacagcatgactttgatctcaccacaagctcctccgcacatgggctcgacgtcgaatgccttccatagctga

SEQ ID NO: 11285 - DNA, 1092 bp, A.fumigatus
tgtgaatcgcagggcaacttcttcttggtctttcacattctcaccacctaccttggtgacgccgaacttctggggactacgggtaaagtccttggtgtggtcttcgagtggctctatcttgcgaccctggtgacctgcttcgttctgtccctcggcaaccgccctggcggttcaaacaagttctacatgaccatggtctacttctggattggcatcatgatctacctgacctttgcagcaatctttgtgactgtcaaatctattcagaaggaagtcgccgataactcgtttagcgttggacaattgttcagcaacagccaattcttctcgatctttgtctccttggggtcgacttatgttatgtggcttttggcttcacttatcttcttcgacccctggcacatgttcacctccgtaagtctcctccgaacattggctatatgcgaagctaacctgtaccagtttatccaatacatgctgcttacgccaacgtacatcaacgtgctcaatatctacgccttctgcaacacccacgacatcacatggggtaccaagggagacgacaaggccgagaaattgccttcagccaacatgaaacccggcgggaaggttgacgttgatatcccacaggacgatggagatcttaacgcgcagtatgaggcagaactggccaaattcgcacagaaaccacccaaggagaccaaagtcatttcggaagaggaacgtcaggccgactattacaaagggttccgaagcgcggtcgtgctcgcttgggtgttttgcaactttgcactgggcgctgttgtcctgagcgcagctggtctggaccgattcaacagcgacaaaaatgcgacggatgatgacagggccacaatctacatggctgtcgtgctctggagtgtggctggtctctcgatatttaaattcattggagcaatgtggttcctggtcgttcgcatggtatgttcaaggatattcgacttttccatactgctttcacacgctaatgcttcgcacagttccgaggcgtttgatgttatttctctagtcttttccttcccatgtgattgtacgcaccccgctctatactga

SEQ ID NO: 11286 - DNA, 210 bp, A.fumigatus
acctttggaacaggggctttcatagcagttttcggaggttaccaggttggtatggcgaagcagcgggtgaacggcaaggacgtggcgcaacatttttacgagtatacaacgcaggttggtttcgagttcagaggaactcgggtacacataagagggcgatcggcatgcccagtccagatgatcttctgcttgaaggaaaagaaccagtag

SEQ ID NO: 11287 - DNA, 885 bp, A.fumigatus
aagatcaactcccatcgttggttattccaggcctttggccgtgtattggaccccaatatctgtgtgcttctggacgctggaacgaagcctggacgggactccatctatcagctatggaaggcattcgacgtcgagcccatgtgcggaggagcttgtggtgagatcaaagtcatgctgtcgcatggcaagaaattgctcaacccgttagtggctgggcaaaacttcgaatacaagctcagcaacatcctagataagccgctggaatcagcttttggtttcatttccgtcttgcctggtgctttttctgcgtacagatacgtcgcgttacagaacgacaagaacggccaaggtccactggagcgctacttcctgggtgaaaagatgcatggcgccaatgcgggtatcttcacagccaacatgtacctggccgaggatcgaattctgtgtttcgagattgtgaccaaacgcaattgccgttggctcctgcaatatgtaaagtcatcaactggagagaccgatgtgcctgaccgaatggcggaattcattctacagcggcgcagatggctgaacggaagtttctttgctgccgtttatgcgatcgcccatttctaccagatctggcggagcgaccacagcttcatgcgcaagttcatgttgttggttgagttcatctaccagactatcaacatgatctttgcgtggttcaatattgtatgtgctgtcttctcctcgccggaatggacaaatgctaatgtgaatcgcagggcaacttcttcttggtctttcacattctcaccacctaccttggtgacgccgaacttctggggactacgggtaaagtccttggtgtggtcttcgagtggctctatcttgcgaccctggtga

SEQ ID NO: 11288 - DNA, 360 bp, A.fumigatus
ccctgggggacgtatttccttcctgccgccctgtttgaaaacagcatgttgcttgtccgcattatggttggaaaggtagcagacggaaatcacctagtcaaaattttgcgggatacgcctattcgccaaggccaactaggctggaactgtgtctactgggtaaaagaggctttagagacgctgaaggccaatcccaaggctttgggtacgagcattattaagtgggaaaaggtgcgcagtgaggcgatggattattatcagcggaaaaaagaccagcaccgttttgacggccaaggcaattttaatatgagaaaggttccaacctatgacctgatggagcggaaggagattattatctga

SEQ ID NO: 11289 - DNA, 864 bp, A.fumigatus
aggggttacctcaacgatgcgctaacgggttctctccagagcaacgacggtattttaggctttgatgtcggacacaaagttcagccgactcccacgctgattccttctctcaagaagattaagcaccttgcatgtggtgataaccacgtcctcgctttggatgagaagggtgcagtattctcctggggatccggtcaacaaaaccaattgggccgccgcatcatcgagcgcaacaggttgaacggcctccagccgcgtgaatttggcctaccaaagaatatcgttcatgtcagctgtggtgcctttcattccttcgccgtcgacgcgactgggaaggtctatgcatggggcttgaatagctttggtgaaacgggtattcgtgagggagctggcgacgacgaggctgccataattcacccaactgtcgtggattcactttctgggaagaacatagtccaactatgtggtggtgcccatcactcgcttgctgtttccaaggacggtcaatgtcttgtgtggggacgccttgatggctttcagaccggcctgaaagtcgatactcttccagatgacgcggttgtgaaggacgaacgtggacggccgaggatcttaattgagccgactcctcttcccggtatcaaagcatctgttgttgcggctggctctgaccattcaattgctatcgacgtcgacggtcgcgcctggtcgtggggcttttctgcaacctaccaaacaggccagggcactcaggatgatatcgaggttgcgactgtggttgagaatactgctgtacggggtaagaagctgaactgggctggtgctggtggacaattctccgtctttaccgaacctgcaacggtgtaa

SEQ ID NO: 11290 - DNA, 1194 bp, A.fumigatus
aaaaaaagcaactattcaagaatctccaagatagcctttttaatatttttgtggcggccagtgtttcaacaaatacacactcttctctgcatctgcataaatctcttcccctcaataaaaacagcttccgagatttttattatgtttgtcagtctgctatcacctctaatgcattctgtacactatcccccttccccctttccgcttgaaaaggtattttggtattccaataaacaaaaaaagaaaagagagttgcctcccaaaaaaaggggtcccaaggccgccgcaaagccttcaacgtccacaaccaagactaccactaccaagaaaacaactgttgcgaaaactgcaaacaaaggtcagcctgcgaaaactactgcggcttctcagcttaaggcaacctcgaaaaaacaatctcaagccactgatgcatctgcaaagtcgcgcaaatctaaggccactagtgccagtgcggcagctgctaccaagaagcgcaaggctgaagaagttgataaggagcccgatgtcaagactaaaaaagcgcgagttactcagcctccggtcaagaagccgaaaccgaaggtggtcatcaaccatgcgcccactacacgattgaacgtctatgtttgtggtgaaggtagctcaggcgaactcgggctcggtacggcgaagaatgcggtcgatgtgaagagaccgcgtcttaatccccacttgccagcggaccgggtgggtgtggtgcaggtagctgtcggcggcatgcactgcgtcgcccttacgtatgacaacaaaatccttacttggggcgtcaacgaccaaggagctcttgggcgcgacactacgtgggagggtggttataaggacattgatgacaacaaaagtgatgcggactcggactcggactcggatgatgacagcggtctcaatccctacgaagcaactcccactgccatctcgtccgacgcatttcctcctgagaccgtctttgtcgaagtcgctgctggtgacagctccagcttcgctctcactgatgatggtcaggtctatggctggggaactttccgagtaagttacacgcggcgtcttcttcctactaatttctttttctgttcttcctctctccctcctgtaaaggggttacctcaacgatgcgctaacgggttctctccagagcaacgacggtattttaggctttga

SEQ ID NO: 11291 - DNA, 345 bp, A.fumigatus
tatacgcttagcttcggaccttcgaccgctggggtgaagaccattgggcctactaacggcccggtttacggtccgatcatcgggggttttgtgttcgagaacctaggatggcgatggacgaattggattgtgctcatcatcggaggtggtgtcctggttttgatggcctctattaaggaaacatatgcgccagtcattctgagaagacgcgcagcacgcaaaaggaaagagacgcaaaactcaaggtggtggacacgttataacggtgagcaggatttcaagtcatcgctgcgagccaatctcagccggccattcagaatgcttctaaccgagccgatttggtaa

SEQ ID NO: 11292 - DNA, 663 bp, A.fumigatus
cgatctaacagtatattttgggacgtttacgttgctctcgtatatggcgtgctctacctatgtttcgttgcgtatccgatcgctttccagcaggagcgcggatggtcgccaggaattggtggtctttcattcattggcatcggagtgggggttctgatagcaattgcgtgcgagcccatatttcgcaaaatcatcaacctccatcggaaatccgaggatggcattgtggaaccggaggccatggtcagcatcgttggatttggtgccactctcctaacggttggacagttatggtcttcatggacctggactcccagcgttcactggattgttcctatcctggctggcgttcccttcggagctgggaatgcatgtgtcttcatctatgcctccaattatctcgcccgttcctatggcatctacgctgcgtccgcactcgcggggaatatgcttttacgaagtattgtaggagcctgtcttccgcttgcaggtccgtccatgtacggcaatcttggactgaattgggcgagtacgcttctgggtcttttggaagccgcgtgcatctcaattccggtggttttctatttctacgggcataagattcgggaggcgagccctcttttgaaaaaattgaaagatcacacactttcaccgcaccattga

SEQ ID NO: 11293 - DNA, 2211 bp, A.fumigatus
gagcgcgtctccttccagccccggccgtgtagacgatttatcctgtctcttggcagctgcgattcgtgcttggtggttgatgatgagttgaatgtccttccaatctctggtgggaagaacgtgaagcctcttccaccgccagagacccttgacgacaacacaggcacgaagaaggaattgaaagagatcaaggatagcttagcagacactcagccagtaggctccttggtcagcctagctcgcactgttgaccaggcaaaggcgctgttgaccttcgtcgacgtgatcgccgagaagacccttcgcagcaccgtcaccttgactgcagctagaggtcggggaaagtcggcagctcttggtgttgccatcgcggcagcggttgctcatggatacagtaacattttcatcacttcccctagcccggagaacttgaagaccctgtttgaattcattttcaaaggtttcgatgctcttggatatctcgatcacgtggattacaccatccttcaatccaccaacccggacttcaataaggctattgtgagagtcaacatccatcgtcagcatcgtcagaccattcaatatattcaaccccaggatgcgcacgttctcggccaggcggagcttctggtcattgatgaggctgcagccatccctttgcccctggtgcgcaaactgatgggcccatacctggtattcatggcgtccaccatcaatggttatgaaggcactggccggtcgctctccctgaagctgatccagcagcttcgcgagcagtccaggggtggcctgaaggccaacggtcaggacgatacagatatcgctgatagagccacaggcaaggctgccaagagcgcagagaagaacttgggtggacgctcgcttagagagattactttgtcagaacctattcgttacgcccctggggattcagtggaaaagtggctaaataaagtcttgtgcttggatgccacgctgccaaagtccaagatcaacacacagggctgcccacacccgtcacaatgccaactcttgcaagtcaaccgagacacattattctctttccacccggtctctgaaaagttcttgcagcagatgatggctctgtacgtggccagccactataagaacactcctaacgatctccaactgatgagcgatgcacctgcgcatcagctcttcgtgttggtgccccccatcgacgaggaggctaccaagcttcctgagcctctctgcgtcattcaagttgctctggagggtcgtatcagcagacaaagtgttctgaacagcttaagtcgtggccaacgggccggtggcgacttgatcccctggcttgtcagccagcagtaccaggatgaagactttgccagtctctccggcgcccgaattgtgcgcattgcaaccaacccagaatatatgaacatgggttatggatcccgcgctctggagcttctgattgatttctacgagggcaagtttacggacctctccgagaaaattcccgacgtgcaggaagagatggttagggtcactgatgaagagctcgccaactcatctctccttgatgacaacatccatgttcgggacatccgctctatgccccctctgttcggcaagctctccgagcgtcgtccagacgcactggactacgtcggcgtcagttacggtttgacaccgccgctgcacaaattctggaagcgcgcttcattcgttcctgtctaccttcgccagactccaaacgaattgaccggtgaacattcttgtgtgatgctgcgcacactcgcctccgcagccagcgacgctagctggctcggggagtttgctcgggacttccacaagcggttcatagctttgctctcctaccaattccgagaattcccctctgttctctccctcagcatctgcgaatccgtcactgcaggcgctaagctcgacacctcgtacaccccctctttgctcacgaagagtgatctcgacgcggccttctcccccttcgacctcaagcgccttgacagctacgcaaacaacctgctggactaccacgtcatcctcgatatggttcccaccattgcggagtactacttctccggccgcctgagcgggaaggtcaacctctccggcgtccagcagtccatcctactcgccattggcctccagcgcaagcacctggacgttttcactcacggaggcgccgaagggtcccgcgcatag

SEQ ID NO: 11294 - DNA, 300 bp, A.fumigatus
  unsure (295): Identity of nucleotide sequences at the above locations are unknown.
ttccggctgcagtggattgaggaagcaaacgagcgatgtcccggcgtacctatcattcttgtcggactaaagaaagatttgcgcgaagatcctctggcgattgaagaaatgcggaagaagtccctacgctttgttacttcgagggaaggaagcgaaactgccacgcaaatcggcgccaggaaatacctcgaatgctcgtcgttgacaggggagggagtggacgacgttttcgaagccgctactcgagccgcccttcttacattcgataagcggaagagctcatgttgcatcgtgntatga

SEQ ID NO: 11295 - DNA, 324 bp, A.fumigatus
ccatatcaccaggttcccacagtattcgaaaactatgtcacggattgcagggttgatggtcgatctgttcagctagctttgtgggatactgcaggtcaagaagactatgaaaggttgcggccactcgcgtattccaaagcgcatgttattctgataggattcgctgtggacacaccagattccttggaaaatgtaaagcacaaggttcgttcatgctggaattcgttaattttcgctactggtcaactcactagttccggctgcagtggattgaggaagcaaacgagcgatgtcccggcgtacctatcattcttgtcggactaa

SEQ ID NO: 11296 - DNA, 342 bp, A.fumigatus
  unsure (37),(44): Identity of nucleotide sequences at the above locations are unknown.
ttaattcatgcgcggatccgtcgggcccgtggtgaanatcatancacgatgcaacatgagctcttccgcttatcgaatgtaagaagggcggctcgagtagcggcttcgaaaacgtcgtccactccctcccctgtcaacgacgagcattcgaggtatttcctggcgccgatttgcgtggcagtttcgcttccttccctcgaagtaacaaagcgtagggacttcttccgcatttcttcaatcgccagaggatcttcgcgcaaatctttctttagtccgacaagaatgataggtacgccgggacatcgctcgtttgcttcctcaatccactgcagccggaactag

SEQ ID NO: 11297 - DNA, 306 bp, A.fumigatus
tacttctcgagatcccctccttgtgattccggagcgaccgacctccatccattacggagtatattcttctgtcgcctaacctggacattgcccgcctcccctgcgtgcggccaaagggttctcttccacccctcttccgccctcattttccccattttgtccgccctggatctcctcctctctctatttaactccccacctcctagctcgcaagtgtctcactcttgtgagggactgctggcattggatattctcttcgttcagctctctcgatcgcactttactccgcttgctgctcgccggtga

SEQ ID NO: 11298 - DNA, 654 bp, A.fumigatus
aatcggaatggctgcgcgtcatcaacggcgcgtgtcaacttctcctcggcgctcatcaagggtttcggcttcaacggcatctacgcaacccttctccagctccctactggagtcacccaagccgttgtggtgcctatctgcggcctgatcgcgacctacgtccgcgactcgcgctgcctcgtcctcgccgcagtatgcctcatcccgttcggtgggctcctcggcatccgattcaccagcctcgaccacagatggactctggtcggctgcacctggctgcagtacattatcggcgccccaatcatcgtgtcgtggaacctcttagcgacaaacgtcgccggacataccaagcgctcaatggccaatggcatgtggttcaccatgttcgcagcaggtcacgtcgctggcgccaagatcttcttcgcccgggaagcgccccggtaccactccgctttggcaggtctgctgatctgttatgctggcatgattgtcctagcgcttgcttcgtacacatatatgaaatgggagaatctgcggagagatcgcaagccatcgccggacgatgatgtctcgcggcgcgaggaagccgccatccttgatgggttcaaagacttgactgacatgaagtcaaagaattttcgttatgcgttatga

SEQ ID NO: 11299 - DNA, 192 bp, A.fumigatus
ccctaccttgatcataaatttaggtctcgtgtcatccctctgggtggccggaatgaccctgtcaatgaaaagggtctccagcactatgtcaagttcgtcgacgacttgctcgcggcgggtattactcctctcgttaccatcttccactgggatcttcccgacgccctcgacaagcggtacggtgtcttctga

SEQ ID NO: 11300 - DNA, 336 bp, A.fumigatus
cctccccgtggaccagatcgtgaacgacgacttccgtgtgcaatatttccgcgagtatatcgctgccatggcggacgcttacaccctggacggtgtgaatgtccgcgcttacatggcgtggagcttgatggagtaagttttgtcttcgactcagaggtaccggtccacctggctgacaaatcttctttcgtatgcagtaacttcgaatgggccgaaggctacgagaccagatttggcgtcaccttcgtcgactacgcaaacaaccaaaggagaatacccaagaagagcgccaaggtcctccgcgagattttcgatcaatacatcgagaaggcttaa

SEQ ID NO: 11301 - DNA, 252 bp, A.fumigatus
ctaattgtcgctgttatttccttatctagctaccaaattgagggagctgtggatgaagacgggcgaggcccgtctatttgggatacattttgcaaaatccccggcaaaattgccggtggagcctctggcgaggtggcttgcgactcctaccaccgcacccatgaggatattgccctgctcaaggagtgtggtgcaaaggcataccgtttttctatctcatggtacatcttttgcacagcgtccgggcactaa

SEQ ID NO: 11302 - DNA, 669 bp, A.fumigatus
gattggcattaccttgaatggtacgagttctggcctccatgtgcacagcttgatgaagtagttactgatcaagtcccaggtgactgggctgagccgtgggaccccgagaaccctgcggacgtcgaagcctgcgatcgcaaaattgagttcgctatctcctggttcgctgaccccatctatcacggcaagtacccagacagcatggtcaaacaattgggggaccgcctgcccacctggacccctgaagatatcgccctcgtccacggcagcaacgatttctacggcatgaaccactactgcgccaactacatcaaggccaagacgggcgaaccggaccccaatgacgtcgccggcaacctggagatcctcctgcagaacaagaacggcgaatggatcggtcccgagacacagtcaccctggctgcgtccccaccccatcgggttccggaagctgctgaagtggctcagcgatcgctacaaccagcccaagatttacgtaaccgagaacgggaccagtctcaagggcgagagtgacctccccgtggaccagatcgtgaacgacgacttccgtgtgcaatatttccgcgagtatatcgctgccatggcggacgcttacaccctggacggtgtgaatgtccgcgcttacatggcgtggagcttgatggagtaa

SEQ ID NO: 11303 - DNA, 468 bp, A.fumigatus
  unsure (266): Identity of nucleotide sequences at the above locations are unknown.
aaagggtctccagcactatgtcaagttcgtcgacgacttgctcgcggcgggtattactcctctcgttaccatcttccactgggatcttcccgacgccctcgacaagcggtacggtgtcttctgaacaaggaagaatttgtcgccgattttgccaactatgctcgcgtaatgttcaatgctttcggctcaaaagtgaagtactggattactttcaatgagcactggtgcagcagtgtgcttgggtacaatgtcggccagttcgcccntggcaggaccagcgacagtaccaagagccccgtcggcgacggttcgcgcgagcgatggatcgtcggccacaacatcgttgttgctcatggagcggcagtgaagatttacagagaagaattcaagcccagagacggtggtgagattggcattaccttgaatggtacgagttctggcctccatgtgcacagcttgatgaagtag

SEQ ID NO: 11304 - DNA, 1260 bp, A.fumigatus
  unsure (1217): Identity of nucleotide sequences at the above locations are unknown.
cacagactgtgcccatgtccctcccactattctccaggcctccctctccccccaaattttaattataatcgcctccattattattgttttcacctcaattcccacaactttctcccttctccatcattattccatccaccaactcagtcgcatatctcggaaactattctattcaacagcgctcatttcaaaatctaccgtccacacatttttatttttctctcgcgtttgactgctgactggaactcccccggcgcaaaccacttcgcgcctggcgcattcctctggtgcgcgcacacaaagccattcccttcattcaacaccacgactatcagatctatctatactatccttcattccgtgtctctgatacattggatatccaaatacgcaactatgttgctcccttccgcgcttccctgcgacatgcgacgctcctcaacccggtcgcgcttcacacccaatcgcctcttctcgacacctcctccgtccgacaacgacttctttccatcaagcaatgggttactaggaacctgtcgcgcccttcaatctcttctaagtggctctcccgcgccgccttcgcgacgagccaaaccagaacgtctccagagccccttccatctcgcatcttccacaacctcctcatcctccacgcggccgcgaaagccaaagacacaaacacgctctcaacgttcctctgctaaaacatcgtcaaaactcgctcgcgccgcaaacaagcgcacgcgcgccagctacgaagccgacagcgacgcggactcagaagaccacactccacgctctcgattctccaccccaaaacgtcgtcggtacgtcccttacgatctccccctgggcctatcgcaatcagacttttatactttgaattcaccaccaaccacacaatccccgccttctcctgtaccgcgccgacagcaagggctctgcgacgaggtgcgcgcaccgctgccgccctcgccatcgccctcctcgcagtcgcagtttgatcccgatgcagcgctaccgtccattgaagaaatagggccagaaacttggacgtccgaagatgaccaacaacttgtggaggtggtcctagaaaagtttcagctttccaagcgcgactgggacgagtgcgcgcgccaactcggcaaggatcaggatagcattgggcgcaggtgggagacgctgatcggagagggcaacgtgggattgcgacgcgnacgacggatggtccgtggtcgaatcgatgagagttggctgtag

SEQ ID NO: 11305 - DNA, 270 bp, A.fumigatus
cttatcgccgtttgcggaactccacactcagactgtgacacagactgtgcccatgtccctcccactattctccaggcctccctctccccccaaattttaattataatcgcctccattattattgttttcacctcaattcccacaactttctcccttctccatcattattccatccaccaactcagtcgcatatctcggaaactattctattcaacagcgctcatttcaaaatctaccgtccacacatttttatttttctctcgcgtttga

SEQ ID NO: 11306 - DNA, 264 bp, A.fumigatus
tggtccttccagccgcgtggtgaagacctgacgagcatgacgaatcacaaggcgtggagccggccgccgctgagtctgtcgttcagtctgttgatgttcaccagtagtgggttgctggtgcggtatctcaaagtgtttgagaagagcaactacagtagtgtcaagtgggtgcggtatatgactcgtgcgggcagctatgaaatcaggtactttacctcctccttggttccccctgtttatatgcgactctcagagcgtgactaa

SEQ ID NO: 11307 - DNA, 216 bp, A.fumigatus
tcgagaccctctcttgcccgacttcgactcggccttggagtcttggacatcacagacacaagtgttcacttgctttatccagcagctattatgcgctccaggtactctgtcagtactaagacaggcaatccagtgggcgatattgaaagcttagacaccatggccacactttctaagatcaacattgacttacacacccgcattcacagctgctga

SEQ ID NO: 11308 - DNA, 807 bp, A.fumigatus
  unsure (36),(286): Identity of nucleotide sequences at the above locations are unknown.
acaatttccgggccgccatggaggtcgtctgcattntcaggcatctctcccaggccaacaatcacgctttggggatattctgggggaagtctggcgagcggattagctgcagaacttcggggttggtatgcgccagagctcaacattgccggggcggcgcttggagggacagttccaaagatcatgccgttgttcaacacagtcaacaagggcatatatgcaggactccttcctgccgggatgcaaggcctctttaatgaatacccggccatcgaaaaaattcttnatgatcatctcgttcccgctaagaaggcagactttgtgaagaccaagaacctgtgcatcgttgaagacctcctcacatactcattccaggacttctacagatacatcacagatgcgaatatgctaaaagatcctgaagtgacacgagttcttggcgaaaatgcaatgggacagcatgtgcccgacatcccgttgttcgtctataaatccaccaatgatgatgtgagtccggtcggtgatacggatgccctggtttctggttactgtgctgccggtggaaaagtcgaatattacagggatgagctgtcgaatcatgcgacaatggcagtcatcggagtcccgaatgcgctgttgtggctgaaggatcggatgaacggagttcctgctcgtgctggttgcaagacgcaaaccgccctaacaggactgctagatccccgaaccttagccgtcctgggtattgatctgatcaaggtcctcctggccttgttgtcggcacctgttgggacatttgtaattggatga

SEQ ID NO: 11309 - DNA, 273 bp, A.fumigatus
cggttgtccgtcaggctcataaagccatgcaaaggatcaatgacgccagggcgaggctcaactcagtgcaaggatagtttctgggggcttgaagaagtttgtaaaatactattactgactagggacagaaagaccatatattttggagacatcggccggaatgcaaacactattaaggaattctttggttgccatataaccccttgtccacctaaagcaaatccagtggagcatataaatgatgtggtgacagggatgggaggtgatggttaa

SEQ ID NO: 11310 - DNA, 381 bp, A.fumigatus
gtttctgtcatacatgtcatatgcactcggcagacggctagtgcatgtcactcagcgcggcaaatgctaactccactcgcattgcaggtctctcccattcaaaatgcagtgtacctcatgtcgatggctatcatcgccggcgcgcgcaccttgcaccaggtccgcgcaaccgttaaggccggcttcatgcccgtgatgaaggtcagctggatcacgtcgcctctggcgctcgctttcgcccagaagttccttcccgaacacacctgggtgcctttcttcaacattatcggattcttcatcggaacctacgtcaacactcacaccaagaagaagcgcctggaggctctgagaaaggtacagtcaacttctcgtactaagtag

SEQ ID NO: 11311 - DNA, 204 bp, A.fumigatus
agcttagatgcacccgaagagaaccctgacggtattggtattgaaggtgccatgaggttccttggggatatccaagtgcagctagacgaggtggcatgcttgggaatcgcagagcttctcaaatcgccgtccatgggtgagttcacgagagaaggctttgtaaatggctggagaggcgttgggtcagtgagcagtcaatcttag

SEQ ID NO: 11312 - DNA, 1593 bp, A.fumigatus
gccgacatcacgactccttgcacgatgtcgtctctaaagcttcgtgagcccacatctgcggactcgacgaccctgttatcaccgagcaatggcttaacagcactggttgggatgggcgatctgaccataggaccgacgcagaccaaagtgttcaatctaacatctgtcccccgcgaagcaggagattcaagggtggcatcaataaccttacttattgaagacgagaggtttgacttagcctgcgctataacagatctgacccaacgtgactccgtttggtggcagcagaccacgagcggcgtagcccgaaaacgtgtgggcaaagaccgggatacctgtcggtgcaagatcatgcccaaaccgccaaaaattcgaatctcaacaccgaacatcagagagacttactacacaaacgagcgagttgttctcgaattggacatctacaacgaagaagatgaggcggcagacgtgtccgcagaggtaaggctcttcggacatccggattcggcagcgcagattctgtggcttgatgaggagggtgaggccatatctcctcgttcacaggatagttcgcccatacagggggcgcgtcatgtcgcaaaacggtccattggtatcatggacaggtcatccaggcagcagttgatgcttgtgctgacagacacgcttgaaccgtcgacgcacgagcttcaaattacttgcgtatacaatttgctatctgactttcagaccccgatcatcgcgacacacagactcggattatcaatcgtacgaccatttgaggcaaactatgatttccttccgcgcctccatcccgaaccctggcctgatttctttattattgatgatgacttggttggagacgaaacgctgtctaaacctcgaggcttgcggcaacgatggtgtttgaattccaaggttgtctcgtttgccctggagccgcttgtcatcgaaagaattacgctagtgctactgagccttggaggcggagccgtctgcgacattggatctgaaatagtcgccgacccacatgcgctggaaattcgtcccgaggagcttcgcgagtccacctttatactggaggttcagaagttggtcttgggagaccgacggccgacagctctgaatctagccctagagattcaatggcgtcgaataggcaccgacgccgctgcatcaactgcggatagcgctaacgtcaccacaactactctacccattccgcgctttgttatccccgcgggagagccccgcgtccttgcctcggcattgaattcagaagctatccccggtctgattcacctggactacacgctagagaatccttcaatgcactttctcactttcaatctcgcgatggaggcgagtgagcaatttgctttcagcggaccgaagacggcggtcgtccagcttgtgccgttaagcagacacacagtgcgatataacctcctggcttccaagcgggggctatggatccaaccccaattgaatgtggtggatacgtatttcaacaaggccctgcgggtacagccaactgaagacatgcgatcagataagaaagggattttgatctgggttgacgctgacgactag

SEQ ID NO: 11313 - DNA, 630 bp, A.fumigatus
agacatgttaatcgtcatcttcgttggaacctgaaccagagagtgtgcgctacttaccgggctagggtagtcagatctgttgatgaagactgttcccgcctcgacttgctcaatgagatcctcagctctagggacatccttcgtccaaatgcttgctgtgagtccgaactcgctgtcgttcatgagcttgactgcctactcgtcgctctcgaccttcatcacgggaagcacagggccaaaagtctcctccgtcatgacacgcatattgtgattgacgcctgtcagcaatgtgggcttgacgtaattaccatcggcaggaagattgtcgaacgtctcgttggcaggggtttcgtcccgagcgcccttctcgaccgcctcagcgatatgtgccaaaatcgtctccttcgcgcgcttcgagatgacaggcccaatctgtgtagtcttctccgacggatccccaacacaatatttgctcaacaccctcttcacttctgcgacaaacgtctcgtagatgttcttgtggacgtacacccgctcaatcgcgcaccagctctgaccactgttgaagattgccccatcaacaatcttcctccgccgtccacgccacattcacggtcgtcccggacataa

SEQ ID NO: 11314 - DNA, 183 bp, A.fumigatus
tgccaagagttaggcccctattggcgaactattgagatagacctaggtaataataatatcactggaaactctcacgacggacaagaatttgagggatggttattcaagatctcgaccctcacgaggcatgcccgtcccctatctcctgtcacagggcggctaaggattgcgcgccaacgataa

SEQ ID NO: 11315 - DNA, 414 bp, A.fumigatus
atgtggcgtggacggcggaggaagattgttgatggggcaatcttcaacagtggtcagagctggtgcgcgattgagcgggtgtacgtccacaagaacatctacgagacgtttgtcgcagaagtgaagagggtgttgagcaaatattgtgttggggatccgtcggagaagactacacagattgggcctgtcatctcgaagcgcgcgaaggagacgattttggcacatatcgctgaggcggtcgagaagggcgctcgggacgaaacccctgccaacgagacgttcgacaatcttcctgccgatggtaattacgtcaagcccacattgctgacaggcgtcaatcacaatatgcgtgtcatgacggaggagacttttggccctgtgcttcccgtgatgaaggtcgagagcgacgagtag

SEQ ID NO: 11316 - DNA, 396 bp, A.fumigatus
gcagtcaagctcatgaacgacagcgagttcggactcacagcaagcatttggacgaaggatgtccctagagctgaggatctcattgagcaagtcgaggcgggaacagtcttcatcaacagatctgactaccctagcccggtaagtagcgcacactctctggttcaggttccaacgaagatgacgattaacatgtctctaggaccttgcatggaccggttggaagaactctggtcgtggtgtcacgttgagcaagttcgggttcgagcaattcgtcaagctcaagagctatcatgtcaaggattatccgaagtagattgctcatacgtgacttgttatcctttgacaaccattaccatcgtgatgccaagagttaggcccctattggcgaactattga

SEQ ID NO: 11317 - DNA, 1284 bp, A.fumigatus
gggttactgcgcggacccttccagccccgtgtgaagaccatattaaaacgccatctcgtcccttgcaccagacatgcatcaagtcggaaaatatcattcaatatgaggttctctcaagccatgtcgaaggcagcatcgatagtaggacaatacacaggaagatacatctatcccgcagaaacctctcgtcatctcgctacccttctgggcttcccatccagacactcgatctcctcggcctactatgacaacgcatgtactgacatagctaatctcgcgtctgcgatctcggcctttgagcccgtccggttgtattcgcgacccgaagatctcccaagggcccagtcgatggtcaaccaggccattcccaagtataccggcaacacgtcgaatatctccttcatcccatttcccaccaatcatctctgggttcgggacacaggacctgtatatgtgctcggcactggagatgcccgctcccgccggttcgccatcaacttccgcttccgcgagtggggaaagagagacgagatggagagccaggaacgcgcggccgatgaacaggactggccgattatgaccactgcgcaattggacgagaacgccacctttgccaggcgagtcatcgagactgacgtctctccttccccggtgacactcgtcgagtccagagtctgtctcgaaggcggcgcactagtcgtggacggggaaggtaccctcctggccacagaaagcagtatcatcaacgacaaccgcaatgcaggcctgtcacggagcgagatcgaagcagagctacaacgcttgctgggggtggagaagatcatctggttccctggccggaaaggtctcgatatcaccgatgtgcatgccgatgcggaggtgggctttatccggccaggtgttgttgttctctcgaggccccatgcgagcgtgcctcgggcctggctcgacgtttacgaggaaatccgagagattctcactcggtcagtggatgcaaagggccgtccgtttgagatccatacagtggacgagccggaccctgctcttctcggggatttgtcctatgacgaaccggcgaccaactacgtgaacttttatttcgtcaatggcggcttgatcctgccccagtttggcgatgaagtaacggataaggcggctgtggaaacatttcagaagctatgtcctggccgagtgatacagcctgtatatgtgcatgcgcttccattagctggcggtgtgattcactgtgcgactcagcccgttatcgctgtgccgcaggactaa

SEQ ID NO: 11318 - DNA, 498 bp, A.fumigatus
atcttacccttccgacggccatataccatacgcaacaagatgctatcgctcattctgacgatattctttgtccacgtcgccatttacttggtgaatactgtcggagcaactaccattgatactctggtatgttcctgcttagtcccctaccggcatagcaccgcagctagtttgccacggccccagaccgagcgttcaaccattctaaatgacatgtttttacagctatggattctctacctcaagctccctacatcgacatcgaggaatgcacgccagcagagccgactgaagcgcgaagtcgtccagctcaagcgcgagatgaacaacaccagctcgcaagatgagtttgcaaagtgggctaagttgaggaggaagcatgacaaagctatggatgaatatgaggcaatgagttcgtatcctgctctatgcactgaaatactatgcttcttacttcacattgtcgaggttcaaatccagctgattgatcgcttctaa

SEQ ID NO: 11319 - DNA, 444 bp, A.fumigatus
tggagctggcgccgataccacggcttccgactcttcatctctaccatctcgggtgaatccagaagagttggccgagttcatcgatgtacagaaccccgccctacagagtcacgagggagtagaggtatactgaaccaaagctactgctacagttcctcgcatcagaaaccttccccttccctaccagcagacctccaaaccctctcctattcctccatccagcacgaccccgtcctcgcagacaaatacgccgccttcccggttccccggttcctcctcgagtctacaaccgccaccattcccgtcgccgtgtccgagtccctctccgtctatggccttgttcccgatcccttcgacgtccctgacttctttttgcctgtgcttagcgaatacgtaacccagtgtgacagccccgccgccggtatgggcgacgacgcgcactga

SEQ ID NO: 11320 - DNA, 972 bp, A.fumigatus
attgagcaccgcctcggcggaaccgccaacatcggccttgatgatgaaatgcaccggtttgggtccggatgcatcctggtcaccaagagcttccgctacctcgttctcctcttgccgtcgcttttcttgctgttctcggcgtgcttcgttgatggccgatgtgtcctcactcagtctctgagtctccgatttctcctggcggtactccacgacgtccttggcatgctgctcgtcctccgcctgcagaatctcggtaccggcggtaggctgttccctccaaccatcaatttccaccggcatgccgggagtagcttcggagacggcgacaccggcttcattgcgaagcgcacgaacacgagcccacgttgtacctgcaacgaggatatctcctggtcgcagggtaccacgtcggatgagagccgtcgcaacacgtccatagctcttcgttgtagcttcaatcacccatccctccaccgcaccgtctttgtcggcccgatggtcaagaacttccgagagtgtaacgatagcctcctcgagttccaacatgccctgaccggtttttccgctcaccccgatagcctggacatcgcctccgtagtcctccacatgaacaccatgtacagaaaggtcttgcttgaccttttctgggttgataccttctttgtcgattttgctgatagcgacaatgatcggaaccttggattcggttgcgtgcttgatggcctcaatagtctgcggtttgacactgtcgtccgcagcaaccaccagcacaacaatgtcagttacattggcaccgcgacgacgcatatccaggaaggctgcgtggccaggagtgtccaagaaggtgatagtcttgcccgaaggcatagctacggagactgcacccatgtgttgtgtgaaacccccggtgctccgaagcgggcacagcacgactttcggagccgtccccaaaatggtggtcttggcccatga

SEQ ID NO: 11321 - DNA, 258 bp, A.fumigatus
gtctccgatttctcctggcggtactccacgacgtccttggcatgctgctcgtcctccgcctgcagaatctcggtaccggcggtaggctgttccctccaaccatcaatttccaccggcatgccgggagtagcttcggagacggcgacaccggcttcattgcgaagcgcacgaacacgagcccacgttgtacctgcaacgaggatatctcctggtcgcagggtaccacgtcggatgagagccgtcgcaacacgtccatag

SEQ ID NO: 11322 - DNA, 1470 bp, A.fumigatus
ggccaactggtaaatgacccattaagggttcacgttcgttcatgggccaagaccaccattttggggacggctccgaaagtcgtgctgtgcccgcttcggagcaccgggggtttcacacaacacatgggtgcagtctccgtagctatgccttcgggcaagactatcaccttcttggacactcctggccacgcagccttcctggatatgcgtcgtcgcggtgccaatgtaactgacattgttgtgctggtggttgctgcggacgacagtgtcaaaccgcagactattgaggccatcaagcacgcaaccgaatccaaggttccgatcattgtcgctatcagcaaaatcgacaaagaaggtatcaacccagaaaaggtcaagcaagacctttctgtacatggtgttcatgtggaggactacggaggcgatgtccaggctatcggggtgagcggaaaaaccggtcagggcatgttggaactcgaggaggctatcgttacactctcggaagttcttgaccatcgggccgacaaagacggtgcggtggagggatgggtgattgaagctacaacgaagagctatggacgtgttgcgacggctctcatccgacgtggtaccctgcgaccaggagatatcctcgttgcaggtacaacgtgggctcgtgttcgtgcgcttcgcaatgaagccggtgtcgccgtctccgaagctactcccggcatgccggtggaaattgatggttggagggaacagcctaccgccggtaccgagattctgcaggcggaggacgagcagcatgccaaggacgtcgtggagtaccgccaggagaaatcggagactcagagactgagtgaggacacatcggccatcaacgaagcacgccgagaacagcaagaaaagcgacggcaagaggagaacgaggtagcggaagctcttggtgaccaggatgcatccggacccaaaccggtgcatttcatcatcaaggccgatgttggcggttccgccgaggcggtgctcaattcagtgacagccattggcaacaacgaagtctacgccaatgtgcttcgctccgaggttgggccgatcagtgagttcgacattgaacatgcggccacagcaagcggcaacatcatctctttcaatatgccgatcgaccctgccatgtcccggatggcggaatcgcggggagtcagaatcatggatcacaacattatctacaagctcatcgatgatgtcaaggcggcgctcagtgagcatctggcgccatcggtcacacagcgtgtcacaggtgaagcagaagtcggtcagatcttcgagatcaccctcaagggaagagagaaggttgctatcgcggggtgcagagtccgtaatggcataatccaccgggccaaaaaggttcgggtgttgcggggacaggacacgatctacgatggtacgcttattcatttttgggcgacacctcacttacggcatagatga

SEQ ID NO: 11323 - DNA, 189 bp, A.fumigatus
agacttgctgtggacacagtgagctttccactgaattctcctgtgttatggtccttcgtatgctttagtgagtctgtgggtgatttagcggctatcaccgttaagtggctactctggggacttgacattgagctgctgctcaatggtggtgccaccgtccgatccagcccttcctcgtctgccaagtga

SEQ ID NO: 11324 - DNA, 1581 bp, A.fumigatus
ttcggcgcgctcttttgtcaggggaaaagccttgcctttctgtttgtctccatttcgccgcatccaacgtttctgatccgacataacacaataatgccacgtccacctacaaagcgcaatcgtctcacatcgcgacatgtccaggcttcgccaaaggtatcgcagaaaaccaaagatcctgaaaccaaggctactgccaacaattcaagtcctctacacggaactgagaatgacaaggggctggaggcacagccggcacctagtgtcgacgatatcaaattcgcaagacaattgaggggtcagacacccatgaacaataagcaagaacaagcaattgcgtcctcgcctatgggagaacgtggagctacgggcagccggccacccacgagagctcgaggctattcctctacgctatcagttggcagacgaggggctgatatgagctccaaaatacctggcactccagtattcgagagttcgatattgagcaattttaggagacgacctcggcaagcaagcattctccagatgatgcaagcagatgacggatcttcggatttcggagaccttgacgacgatgattttcttggtggactgagcccagaagatgagtcgactcctcttaatgtttccagaagaaaatccctcgttattagacatccctcttcctcgcctctttcagactgttcgcacccgtccaatggaggatcgcgaaagcgcaagcgcaccggggaggagcttcaagttccccagtcacctttggctgttgtggaatactcacctgctggctcaataagcccggagcgtggagatgaagagcacggcgtccctcgcgagattttacatcacttggcagacgaggaagggctggatcggacggtggcaccaccattgagcagcagctcaatgtcaagtccccagagtagccacttaacggtgatagccgctaaatcacccacagactcactaaagcatacgaaggaccataacacaggagaattcagtggaaagctcactgtgtccacagcaagtcttcaagacagattgcttcctcgacgtcataaaaatcacagacgcaatggggtacccggtgatctaattctagacggtgaaagcgaagtcgactattctgtcgatcaggatgaagatgagttgtcatacttgcccactaggaagccagcgcaaccacgacggcgaaagaacaaaccaaagccattggaggttgttcgagcaaagcacaggaagcaaggtgcaactaaagctctgagcggtgaactcatcagtcaaactgagtcagctggaatgaaggatacgaggcagaagagagttaatggtccacgaagcaaccagactgctgatgccgacaaggagaaccaagcaatcgaggtgtcctcacctctgtcctcaccgctcgacacggatgcattcgatctagaatcatcgccggtgccaataccagctaagaattacctgagcgaggaactcagattgcaagccaagaaattcgaagagattgacagatgggagatggattttgaggatgtggtaacaacaggcagtcaaaccagcccatgcagatga

SEQ ID NO: 11325 - DNA, 858 bp, A.fumigatus
acatcaagggcgaaacaaccctccccgcatggggctacatcgtctccctccttctcggcgccttcatcgcccccttctcctgcatcctctatgggctgtacgggactggcgttgcaaccaaccagctctcgaaaatggtcgccggcgcagtccatcccggccgacccctcgccaacctctacttcgccaggctggtcccaccaggtcattctgctttccgtcaatctcgccaactggctcaaggtagggcagtacaccaaggtcccgcaccgcattatgttcgccacccagatatacggcactttgctcggggctggtctcaactacgccgtcatgactaccatcgtcaccaaccagcgcgagatcctcctcgacccagcgggcaacagcgtctggagcgggtccaccgtgcagagtctcaactcgcaggcgatcacctgggccctagcgcgggacgtctacggcgtgaatggacggtatctcattgtgcccctaggtctggtcattggtctggccttgccggttgtgcactgggggcttaacagggtctttccgcggatgcggtcctggccgctcaatacggcgataattgcttcatacgccgggcagacgtattacggcatcacgtcgtggatttggtcgtccgttgcggtgggcgtgttctcgcaggtgtggcttcggcgtcggctgccgcgcatctacaacgagtataactacctcattggggccgcgttggacggggggtcgcagattgtgattttcattctatcgtttgcggtctttggggccagtgggaaagaacacccgtttccgacgtggtgggggaatccggctgggaatcctgatcattgcatctag

SEQ ID NO: 11326 - DNA, 1497 bp, A.fumigatus
aaagagcatgtcgttgcgtctcttatcgcatcatcgggtaacaatgggctttccggagtagaggtttacgccgtcgagcgcctgttctacaatatcagcgtgtcggcgacaaccgctgtgctgggaacattctccatctcactctgtggctttgtgcttgcgggagttctccggccgctgattgtctacccagctgaaatggtgtactggtccacgctcccacaggtggtgctgtaccagactctccattttgaccagcgtgccaacaggggccgcctgatcaagtttggctgtgctctaggactggctgctgtttgggagatcttccctgcgtatataataacctggttcggcggcttctcgatcttctgcctggcttcaatgggcgcgccccagcatacccggaagatcttttcaagagtgtttggggggtcgtcatctaatgaaggcctcggtctgttgaacttcggctttgattggcagtatattcagagcagctatctgtcattgccattgaaacagcagctgaacagctggatcggctatgtgatattttatccagcgatgttgggcctctactaccgcaacacatggagcgcaaagtcattcccattcatgtcaacgtctttgttcaccagcaacggcaaacaattctccaccacttccatcctctccgatagatgcacagtcgactacaacaaactgaaggaagtcggcatcccgtacctgacctctagcactgtctggggctacctcacacaaaacctcgccatcggcgccctaatcacccatgtcctcatcttctacggcaaggacatgtacactgcctggaagcaggcgcgcagccgaacccaaccggatccacactttcaggccatgctcaaatacaaggaagttcccatgtggtggtaccttgccctcttcgttctcgccttcttcgccggtctcatcgtaaacatcaagggcgaaacaaccctccccgcatggggctacatcgtctccctccttctcggcgccttcatcgcccccttctcctgcatcctctatgggctgtacgggactggcgttgcaaccaaccagctctcgaaaatggtcgccggcgcagtccatcccggccgacccctcgccaacctctacttcgccaggctggtcccaccaggtcattctgctttccgtcaatctcgccaactggctcaaggtagggcagtacaccaaggtcccgcaccgcattatgttcgccacccagatatacggcactttgctcggggctggtctcaactacgccgtcatgactaccatcgtcaccaaccagcgcgagatcctcctcgacccagcgggcaacagcgtctggagcgggtccaccgtgcagagtctcaactcgcaggcgatcacctgggccctagcgcgggacgtctacggcgtgaatggacggtatctcattgtgcccctaggtctggtcattggtctggccttgccggttgtgcactgggggcttaa

SEQ ID NO: 11327 - DNA, 939 bp, A.fumigatus
  unsure (26),(140): Identity of nucleotide sequences at the above locations are unknown.
ataggtcgttttttcggtggtttttntggatcgtgccccattgctgttgttgctgcggtatctcttgacatatatgacaaccgccatcgagggctcgcgatcacggtctttaccatgaccgtctttacgggcccgctctntgctcctttcatcggtggcttcatcgttgaaagttacctaggctggcgttggacggaatatctcactggaatcatgggtgcctcagcttttgttctagatttgttctttctggaagagacatatcctccagtagtgctagttgggaaagctgctgagctacgtcggcgaacgagaaattggggcattcatgcgaagcaagaggagatcgaggttgaatttggagagctgattcgcaagaatttcagtcgtccactacggatcttgttcactgagccgatcgtgctcctgctaagcatctacatggcattcctctatggcttgctatatctatttttgaccgcatacccaattgtctttcagcgcattcatggtttcaataaaggcgttggagggcttccttattttgggataatcatcggcgaatttctgggcgggatatttattatgctgctccagccatggtataacagacaactgagtgcatataaggacatacccatccccgaatggcgtctacccccggccattataggtggggttgccttttctggcggtcttttctggttcggttggtcagggtacagatctgatatacattggatcgtgccgactctgtcaggtctcctaaccagcttcggacttttttgcatttttctgcaatgtctcaactatattgtcgatgcctatctcgtattgtacgtctctccttcccatatctctccctcaggagctatgctgatgtcttgtcacgtagtgctgcttcagccctggctgcaaacagtgttttgcgttctatag

SEQ ID NO: 11328 - DNA, 321 bp, A.fumigatus
tgctgcttcagccctggctgcaaacagtgttttgcgttctatagctggtgcaggattcccacttttttcaacctatatggtaccttcggccctccttgctactcccgccttttgaacgcctcgtttcgttggctaacacgcgcacagtttaatgctctaggcgtcaactggacagggactcttcttggatgcgttgctgccatcatgatgccgattccactcctgttctatttgtacggacccaagatccgtgagaaaagcaagttcgcaatggaatatatcgtagccgctcaggctcacaacgatgagcgcgcggaatga

SEQ ID NO: 11329 - DNA, 1158 bp, A.fumigatus
atactaaccgacttcaagacctacagaggtttatgggtttctcccaatggcttgccgtaccaagcgagatgcgtcgctgtgatcgtgaacctcgtattctgtcagccttcagacctcggtctctttccccctgtcacacatttggagtcggcaaagatagtagccttccagtcagagagcaattcaagattgagagccatcatcaccacacgcaataggatgtctcgcatcactccccggacccatcaaacatatgactacgagcccctgcccagccccgcatcaatccgactcctacgggtcgatcacaaagaccccgatggcctactacactgcaccatcaagaacgtcgatctgagagatgagccgttataccatgccatgtcctacacctggggcaacccccatagcgaactcgcgcaggtccaggaaacccgggacagatattcagacaattatcccccagagcacagagaatgtgtatctgtcaaaggaaagttgttatacatcactcgaaatgcgtacgatgcgcttctctccgtccccagagacgcatgggcgcaatgctgtaacagaggtgatcggaggaaacttctccggacctcgcttcattgggcgtctattgccgggaaggaagacctgattgagccgcttctctgctccggtgtggatgttaatgtgagagatgaatggggcgttacgccgttgagttacgcagcgcaggtgggaagccgcgaaggggtcgagttgttactttctgctggtgcggatgcgggcattgtggataatcgggggaatactccgcttgattatgcgaggcaaggtaactaccaggggattatccagtccctggaagaggttatgcagaagggggggagactcgagccgcgagtggattggccggaaggcccagaacgatggtgctggattgatcagatttgtatcaatcaggatgatatcgcggagaggggcgcacaggttgcgatcatggatcagatatacaacaacgcagcgtttactcttgtctggcttgggcccgaggatgcctacaccgatacggcgataaagaccatcgagaaactggataccgcggcaggagacttcatccaaagcaaggagatacatccatatcgagagcaacctgaggagatctacgct

SEQ ID NO: 11330 - DNA, 270 bp, A.fumigatus
cccagatgcaaccagcaccgattacacccggaagaggatctaccaagcaacgtgccaacaacggcccaattgcgacaccacccaacaatagtcactcgaagcgttccgcgcttggagagattgaccacaatgagggtgctggaacgcaaagtgaagagtaccttcctgctccgactcctggccaacctcgcaagtcccatcggaaggactctcgtcatcatccctatgcacgcaccacgtctggaactctccttctggacaaagacatga

SEQ ID NO: 11331 - DNA, 567 bp, A.fumigatus
ccacttgaggtcgcagatcgcctgtacctcgcttcctacgactccccacctgatccaaaggctccgttccccttccctctcgaacaagccaaatctcccagcaaacgatccacgcgaggccagccccagacgcctagcaaaaagcggtaccctgtatatttcaccgcagacgatactctattttataactccttccatgcagacttcggacctcttcatataggacatctgtatcgctttgcggtccatttccacgagattcttggcgagcccgcaaacaaagatcgcgcggtggtgttttactcgaagagtgattcacgaagtcgtgccaacgcagcatgccttgtcgcttgctatatggtcctcatccagtcttggccgccacatcttgccttggccccaatcgcacaggctgatccgccgtacatgcctttcagggatgcggggtacagtcaggcagatttcactttgaccatccaggacgttgtgtatggagtatggaaggcgaaggaacagtcgctttgcagtctgagcagcttcagccttgaagagtatgtatatgggtga

SEQ ID NO: 11332 - DNA, 1290 bp, A.fumigatus
cctttcgatcccgcactgacaggccttgctagatacgagaagtttgaacgggtcgacatgggcgacttcaactggataacccctcagttcctcgccttcgcctccccgcagcatgaacctgtcgcactaatcccttccaatacccctgaatatgctgcgttgccatcaacagtttcccaagtaatctcgtcgaagctgccacttccattcaagaatgtactggcgcatttcgcgacgcgcaatgtgggtctggtcgtacgactgaactcagagctgtactctccgtcatacttcacggctttgggaatcaaccacattgacatgatatttgaagatggtacttgccccccattgccgttggtacgaaggtttatcaagatggcacatgagatgatcacagtcaagaataagggaatcgcagtccattgcaaagccggtctgggtcgtaccggttgcttgattggtgcctatcttatctaccggtacggattcacagccaacgaaattatcgccttcatgagattcatgcgtcccggcatggtggttggtccacagcaacattggctgcacctgaaccagggctcattccgcgaatggtggtttgaggatagcatgaaagagaagctagcccagatgcaaccagcaccgattacacccggaagaggatctaccaagcaacgtgccaacaacggcccaattgcgacaccacccaacaatagtcactcgaagcgttccgcgcttggagagattgaccacaatgagggtgctggaacgcaaagtgaagagtaccttcctgctccgactcctggccaacctcgcaagtcccatcggaaggactctcgtcatcatccctatgcacgcaccacgtctggaactctccttctggacaaagacatgaacaagactgaggagcagaccaggcagcgcagttcccgtctcagtaatgacagtagcgaaagtgaagaggaaatccaactgcgcatgttggccaagcgttcctctcgatcgcccgtggcatcaccaagccagcgatccgtcagttactctgctacagtgactgccagctacacattgacagatgacatccacgaggacagagagaactggggtgaagctggacatgctgcaccaaagactcccctgagcagtaagagcgggagtggcgccatttcggtcaccaaagttcgtacaagccctcggcgagtgaccgacagcagaagcgcctccaaaggcgttcgcaagatcagtggccgaatcggtagcacagggagtcccacacgcgtcaagtga

SEQ ID NO: 11333 - DNA, 207 bp, A.fumigatus
agatatgccgggtacagtacatgctaccgaaaggaggccggtgctcatggaaaagatgcctggggtatctttcgcgtccatcaatttgagaaggtaacttctgataaccctgtcatcgttcgtctacttgcttgctcatgcatccctaggttgaacaattcgttcttaccaagcctgaaaactcatggcaagtttttgaggagatga

SEQ ID NO: 11334 - DNA, 450 bp, A.fumigatus
catttttcaaacattaaattcaccttggaacctttcctctctagctttaattgctccatacctctatcttcactaaattacttgctttttaattgctttctctcggttattgtcaaaatggcgacatctgctcgagaaataaatatacgccgagacctcaacgtctctcagaatccgaacctttccacatccccaacggcatcctttcagtctgcaccctcgagtcatggagggtctgcatttgcaggccgcgccattccattagccaatgcaaagcatttaaaacctttcgctacagaggacatcaaggtgttgcttctggagaacgtaaatcaaactggccgcgatattcttacgggacaaggctatcaagtcgagttcctcaaatcctctctcccggaggatcaactaatagagaagatacggttcgtttggccgaaccttttgtga

SEQ ID NO: 11335 - DNA, 405 bp, A.fumigatus
gttgaacaattcgttcttaccaagcctgaaaactcatggcaagtttttgaggagatgatggccacgtcagaagagttttatcagtcgctcggtcttccatatcaggtcgtagccatcgtttcaggcgcattgaacaatgctgcgtcgaagaaatacgacctcgaggcctggttcccgttccagggtgaatacaaggaattagtttcttgttccaactgcaccgactaccaggcgcgagctctggaaatacgctatggcacaaagaaagccactgatgtcaagaaatcctatgtccacgcgctcaatgctacgctatgtgctacagagcgtacgctttgttgcatccttgagaattatcaaactgatgatgtatgtgtcgaaacgagccatctaatatggcattga

SEQ ID NO: 11336 - DNA, 246 bp, A.fumigatus
atcagtgatgtgcatgtgattggcatccgctcgaagacaaagctcacatcccgcgtcctcaaggaagctcgcaatctaatcgtcatcgggtgtttctgtattgggactaaccaggtcgaccttcaatacgcagccgagcatggcattgcagtgttcaattctccgttcagcaactctagaagtgtggccgaattggtcatagctgagattatgtcttcccacagggggccggccatccgcgcatag

SEQ ID NO: 11337 - DNA, 957 bp, A.fumigatus
cttggctcacgtccagcatggattcgatcttacgaagttgcgaacgatgaagccgaggcgtcgggtacagcaagactcctacccccgcaacccggtgatgccctcgttgcccaacataaccactccccttatacgacaacgagaccagactataccggagagcaaggttttgacgaagagactggcttaggcccacgtcgcgaatcccggtggaaatctttctcaaaggcaatcgcctatcccctagaacctggccttgaagagaagctggtaacgcctgaatggctgaatcagaaccatacggacttctcgcagccatggcgagggcaattggagccgagtgaagataccgaggatcctctcaaaatgaaacgacgcagacagatctggttcaagcgcttccaccgcactttgttgaagagccctatagtacctctgatctttcggctcaccatctggtgcttctctcttactgcccttgcccttggaggatctatacagcatctctcagacaagtaccaacaccctcaaggtccgtccgccttgatggctattattgtggatgcagtcgcgctcgtctatctaatctacatcacatgggacgaatacactgccaaaccactagggctacgctctccggctgccaaggcccgactgattctcctggatatattttttatagtgttcgactcagcgaacctaagtatagcattcgaatcattgtccacggtcagtggcgcgtgtacgctggcagagatcaatcagcagatttccaagaagaataatgcaatatgtgacaggcaaatagcccttgcctgcgtcctgctggttgctctgttggcttggctcataacattttcaataagtgttcttaggtatgacacaccttattctaataaatgcgcagtgttaacggtctttcttgataacagactcgttgagcgggttgcccagtga

SEQ ID NO: 11338 - DNA, 198 bp, A.fumigatus
ggtctattagctatggtcattacggcatatatatttccagattacctcaacaactttggcaactcatccacactaaccttaccatcgaggattcctgtcttggtcagcactgtcttctcatcccatgcgactattgacttaaaacttacgattgactgcattgaacaatggaaaatcgtccagcttgccatgcgttga

SEQ ID NO: 11339 - DNA, 486 bp, A.fumigatus
aacttacgattgactgcattgaacaatggaaaatcgtccagcttgccatgcgttgacagaaaatcgcacacggcgcgagtagtcgatgtcccctgtaacttttgcccgttcagctccgactgctcaagctcgtcgacgctcacacccttctcgacggagtgcttcgcggaccggaaattacgaccggcggagcacgaggcgatcagatccgcaacaccggcgctctcctcggtaaaggtcttctggttcacggagtcggggaaccagaagcgcccgaagcggatcatctccatcatgccgatccggatgatggccgccttggaactctcaccccagcccttacccgcgacgaagccggccgccagcgcgacgatgttcttcagggcgccgcacagcgccacgcccgccacgtcggcaacgacctgcacatggaagtacgggcgctcgaagaggcggcgcagcagcctctcgtcgacgcaggggtag

SEQ ID NO: 11340 - DNA, 468 bp, A.fumigatus
atgcctagctgttccatgatgagctccgagaagagcgtgacccgcccgtttgcgacctcgacgcccttgacgcacgagacggcgcgtgcgtatggcaggtggtggcccttcatctgctcgagtgtcttgtcgatgaactggtgcgggaggttgaagacgaggatcgtggcgtccttgacggcagcgcgcaggtctgggttagccacgacgttgctcggcagcgcggtgccagggaggtacttgacgttctcgtggacgtggttgatgatgtccgtcaacttgtgcgtctggtcgccgagggcctcacggtgcggcgagtctttggggatagtcacccccttctcgaacacccacatctgcacctcttcttcgaagacatcgggatgttcgcgagtgttttcggccaggattttggcgatcgtcgatcccctttcatcatcagccactgcaatcatttataaaacttaa

SEQ ID NO: 11341 - DNA, 315 bp, A.fumigatus
gcatctactgcgggtcgttgtccggcgccaacatcgccccggaggtcgccgccgaggagttctgcgagaccaccatcggctacagcccgccgcccatggacctcgacgcgaaggacgagctctcccccgataaccgccacgtcatcaacaagcagcgccagcgcaagatctcatctacctctgctgagctgcagcgcgtgccggatgactacccctgcgtcgacgagaggctgctgcgccgcctcttcgagcgcccgtacttccatgtgcaggtcgttgccgacgtggcgggcgtggcgctgtgcggcgccctga

SEQ ID NO: 11342 - DNA, 600 bp, A.fumigatus
ccaagacagacgaatctccgcaccgacgcttacggcggctccgccgagaagcgagccaagttcgtcctcgacatcctctcccaaacccgcaaagtcgtccccgccaccttctgcatcggcatcaagttcaactccgcagaccactcctccgcctccttcgaagacaccatgacccagatcggcctgctcgtcgacgcaggcatcgattttctcgaagtaagcggcggatcatacgaggatcccaaggtgcgtcccactcccctctccccccaccctaccacaaggaatacaaccctgacaagaaacacagatgatgggcaccaactcccaaccccagccggaaaagagccagcgcacgctcgcgcgcgaagccttcttcctcgaattcgcccgcgaaacccgcaagcgtttcccgaccctcatcctcatgctcacaggcggattccgcagccgcgccggcgcagagcacgccctgcgcgagaacgcatgcgatctgatcggcatcggccggcccgccgctgtggaaccggctttcgcgaaccggctgctggacgagagtgtgcctgccgacgaggccgagatgcacctgggcaaggttaa

SEQ ID NO: 11343 - DNA, 216 bp, A.fumigatus
aaagctaaatggatgtgggctaacgtatcgatgacgtcgatcttgaacacggctgcagcggataacctcacgcatcctgttttgaatgtgactggcaaggtgatttcatcaattgtcacgttaaagttttattgtttgtatatatataggcgggtctgtcctcgctgtgtctttctaggttgcaacagcagtaatgattcctcctatgcaaaatga

SEQ ID NO: 11344 - DNA, 204 bp, A.fumigatus
acgggattatcagccggctggggttccccggccccgagggagatgacgcagcaggatattgataccgtgacgaggcagtttgtcgataccgcgcggatgatggccgacgcggggttttcggggattgagctgcatggtgcgcatggctatctgataggtatgttctgttctgccgttcttccgtttctgaggcattgtaactga

SEQ ID NO: 11345 - DNA, 414 bp, A.fumigatus
caagaaacacagatgatgggcaccaactcccaaccccagccggaaaagagccagcgcacgctcgcgcgcgaagccttcttcctcgaattcgcccgcgaaacccgcaagcgtttcccgaccctcatcctcatgctcacaggcggattccgcagccgcgccggcgcagagcacgccctgcgcgagaacgcatgcgatctgatcggcatcggccggcccgccgctgtggaaccggctttcgcgaaccggctgctggacgagagtgtgcctgccgacgaggccgagatgcacctgggcaaggttaagccgccgttcttgctgcgtttgctaccgattaaggcggttggggcggggttggagagtgtaagttttgtctctctgtctgggtgctctgatgctaatgttgggtggttgtag

SEQ ID NO: 11346 - DNA, 1149 bp, A.fumigatus
atgattgcagtggctgatgatgaaaggggatcgacgatcgccaaaatcctggccgaaaacactcgcgaacatcccgatgtcttcgaagaagaggtgcagatgtgggtgttcgagaagggggtgactatccccaaagactcgccgcaccgtgaggccctcggcgaccagacgcacaagttgacggacatcatcaaccacgtccacgagaacgtcaagtacctccctggcaccgcgctgccgagcaacgtcgtggctaacccagacctgcgcgctgccgtcaaggacgccacgatcctcgtcttcaacctcccgcaccagttcatcgacaagacactcgagcagatgaagggccaccacctgccatacgcacgcgccgtctcgtgcgtcaagggcgtcgaggtcgcaaacgggcgggtcacgctcttctcggagctcatcatggaacagctaggcatctactgcgggtcgttgtccggcgccaacatcgccccggaggtcgccgccgaggagttctgcgagaccaccatcggctacagcccgccgcccatggacctcgacgcgaaggacgagctctcccccgataaccgccacgtcatcaacaagcagcgccagcgcaagatctcatctacctctgctgagctgcagcgcgtgccggatgactacccctgcgtcgacgagaggctgctgcgccgcctcttcgagcgcccgtacttccatgtgcaggtcgttgccgacgtggcgggcgtggcgctgtgcggcgccctgaagaacatcgtcgcgctggcggccggcttcgtcgcgggtaagggctggggtgagagttccaaggcggccatcatccggatcggcatgatggagatgatccgcttcgggcgcttctggttccccgactccgtgaaccagaagacctttaccgaggagagcgccggtgttgcggatctgatcgcctcgtgctccgccggtcgtaatttccggtccgcgaagcactccgtcgagaagggtgtgagcgtcgacgagcttgagcagtcggagctgaacgggcaaaagttacaggggacatcgactactcgcgccgtgtgcgattttctgtcaacgcatggcaagctggacgattttccattgttcaatgcagtcaatcgtaagttttaa

SEQ ID NO: 11347 - DNA, 213 bp, A.fumigatus
cgccccagagtcgactttggcaagggagataacccgggttaccgcaaggagtctaacgagccttgcgaaacgcttgatacggatttcgattctattacagaatcaaaaccaatgatgctcgacgatagggatgttgtatgtagtgaaggtctgttgtgttgtgatagcggacccggattcggaaggatagccgggattgacagtgtgtgttga

SEQ ID NO: 11348 - DNA, 189 bp, A.fumigatus
aaccgaaaaaagaaaaggaaaaagaaaatagtaatgaaaatcaaaaagggagatactccatactacaaagaaaacgtgctcgaatcagctctgctcacactgtacaagatcattcagacaatatatcctggaaaattatctgcaaatttcttctccgacttttcctttgcacctactgtatctccctga

SEQ ID NO: 11349 - DNA, 282 bp, A.fumigatus
catgtactcgcatcgcgtcaagcgttcgagacccaactctcccaactcgacagctccctcttcacctacattctctcacgactctctttctccgacccccgaccacactccgctggcgacgcccgctcactctccgcggctaaggcccctcggtaccagcgagttacaactcccttcaattcgtcacttgtcacttcatcatacacccgccttggctccaatggaaccacagcccgaaggacccaactactacagtcctactcagccccatgtgggtcctag

SEQ ID NO: 11350 - DNA, 1239 bp, A.fumigatus
gtcaagcgtcacatgccgccaccagcatcctctatgggtttttctgatctactgaaccctcagaacccagagtcaactccttcgacacctgcgagcaagtcgtcggctccctcgaccccatcaactgaacagtcgaactcgaacatggcctcctctgtaagcctgctgccccccctgatgaagggagcgcgtccggcgaacgaggagccccgtcaagatcttcctcgaccttacaaatgtcccctgtgcgaccgcgcattccatcgtctggagcatcagaccagacacattcgcactcacaccggcgagaagccgcacgcctgccagttccctggttgcacaaagcgcttcagtcgatctgatgaactcacacgccactcgagaatccataataatccaaactcgagacgcaacaacaaggctcagcacctggccgctgccgccgccgccgctgcagcaaatcaagataatgctttggccagcaacgctgcgtcaatgatgcgacctccaagcaagcccatcacacgatctgcgcctgtctctcaggtcggctctcctgatatctccccccctcattcgttttccaattatgcgggccatatgagatcaaatctgggttcttacgctcgcaacagcgatcgtgcatcttcgggcatggacatcaatctgctggctacggctgcttctcaggtcgagcgtgacgaacattatggattccacaatggcccgcgcgggcatcatatcttcggctcacgtcatcacaataacaaccgcctgccgtcgctctcggcgtacgctatctctcagaacatgtcgcgctcacactcgcacgacgaggatgacatgtactcgcatcgcgtcaagcgttcgagacccaactctcccaactcgacagctccctcttcacctacattctctcacgactctctttctccgacccccgaccacactccgctggcgacgcccgctcactctccgcggctaaggcccctcggtaccagcgagttacaactcccttcaattcgtcacttgtcacttcatcatacacccgccttggctccaatggaaccacagcccgaaggacccaactactacagtcctactcagccccatgtgggtcctagcatcattgacatcatgtcgaaacccggactggaagcagcgcaaactccccgttccccaagttaccaaatgtggcccgtccaagtacctattgaattcctgggtttcccaatctgt

SEQ ID NO: 11351 - DNA, 519 bp, A.fumigatus
tatggagtatctccctttttgattttcattactattttctttttccttttcttttttcggttttaccctttccattttttgccgccccgaatttttacaccccacacaacacaaagtacgtcgtcattttttttccttttttttttttctttcttcttcctttgttttttttttttttttaccttggtctccgattccgataaaccccctccattctatactcccttctgctttttctcccctcctgagtctccatttctctcttcttcccctccattccttattattctcttccggctgttcctttttattccccttctctctcccccagaccaacttctccagactttttccctcatctttctttcgactctagtctctttgacttcacctactcggctcaacacacactgtcaatcccggctatccttccgaatccgggtccgctatcacaacacaacagaccttcactacatacaacatccctatcgtcgagcatcattggttttgattctgtaa

SEQ ID NO: 11352 - DNA, 330 bp, A.fumigatus
gccacggctataaaatacatacacacacacacacacacgtaccttgtggactgttggtacttttacaatgatgacggagcacatgccgccactcccacagcccctaaaagttgcccccactgcgctatccctagtatagtaaatttaaaatattccatagaggacggagtataccgtcctatatattcggagtatattatagtaagctataggataaaattaaataataagttaaggagtttgaagtatgtagactactctaaagtctactctagggggacattaaatggtgaatcacaccacgtgatagacaactgcaggccagggtag

SEQ ID NO: 11353 - DNA, 705 bp, A.fumigatus
caggcttgcgtgcggtttcatatatcttcttctgcccttccgctccttttatcttctgctctttcccactcgaggggttcaatgtccaacaacacaatggtcaacatgtcgatcgaaatgaaatatgacaatgatgacactaccagcccagaccaaaagctccccggtctggaagctctcgaaatggtcaaaggcgcagccagcgtcgtggccgaaattgaaccgagttccagtgcgagctccatcatgggaagcagagagcatcacgagaggatgctggggccgctggaagtctgtgtccatgacctcgtccaggagcaatccaggcaacatggccaaaccattgccgttcactcgattgaaaaagacctcacatacgccgaactggaacggtatgcagattggatggcgaagtacctaatggtcaagagggacatccaagctggccatataatcccgttctgtctcaaaaaatccgtttggacggtggttgccatgctggcgattatgaaaacaggcgcagcttgtgctgccctggacccgtcccaacccgtgtcgcggatcaagcgaattctcgacgacacggaagcgcctctcgtcatcgtccaccgcgactatctcggtttagccgagacgttggatgtgccgagcatcgtgctcggcccggacctgtgggaagggacctcgtccggagacactgattag

SEQ ID NO: 11354 - DNA, 528 bp, A.fumigatus
cctctgcctgtcgtggatgcgacgcagccggcctatatcgctttcacctcggggagcaccggagagccgaaggggattgtcgttccccaccggtccattgcaaccagcatgcgagagcatggtcctgcaaccagagtcgatactgagacccgagcactgcagtttgccagctacacctttgacatgtcctttcaggagatgtttaccaccctgactcacggcggctgtgtctgcgttccgtcggaggcggaacgttggaacgatctggccggcgccatggaacgacttggggtgaactgggcccaattaactccaactgttctgggactcctgcatccggagcaggttccctccccgcgggaccttggtccttcggcgggggacccgatcactcaagtaaattattccaacgttgggggccacggcgtgggacctgatcgtctcggtaggggccaacaaaaggcctccatcctgggccgccggcctctgaatcccctggggccccccctggtcctccccccgggttga

SEQ ID NO: 11355 - DNA, 402 bp, A.fumigatus
tacggtagcacccattattttgtacggtcgtcaatcgacttgaacatgggttggaggcttgtaggttcgttgcttgcgttcttcgcggcgacctcgatagcatggccttacgacgaggccctcgttgactacaatcttaacacgaacaagcaagcgagcaatcctgctgaatactctacggatggacctggccacaagtatacaccgtcgccagacaattggcgtttccccatgtacacccttttcctggaccgttttgtcaatggagatccaaccaacgataacattaatggtaccctcttcgagcatgatttaaactcgaaccagatgcgtcatgggggtgacgtcgtcggcttgatcgatacactggactatcttcaaggaatgggcatcaagctgcgt

SEQ ID NO: 11356 - DNA, 255 bp, A.fumigatus
atattactactaagtaacttcatactatccgttttgatgatagatcaaacagaagtggctcaccactatcagccaccatactcatatatggagtatgatattgtctcagaagacactgtgtattccgtagcattcaacaacctaatgcatcatgtcaatgtcattaggcaagtattcaatatacagtgcaaaggagaaggaggtaaaggaaaacaaaaacaaaaaattccggcatgtatcagagcatcagcgtaa

SEQ ID NO: 11357 - DNA, 861 bp, A.fumigatus
gagccggctgggaagggcgtatcagctgcgtgggcacgcgagacggctacgcgtctcaggtgtaaggtctgcgtggggtatcccgagattgaagtaactgcagacgaggagagtagcgcacaaccgcaggagaagtactataattctttgcttgttgtgagtgaagagggggaggtgttggtaaattaccgcaagacgtttctcttcttcacggatgagacgtgggcgtccgaaggctcggcagaccgaggcttccatgagcttgtctttaacaattgttccgctgagcaaggatatgtgctgtcgtctagggtggctacttcgtttggaatatgtatggatatcaacccgtacaaatttgaggcgccgttcacggcttgggagtttgcgaatcgggtcctcgactccaagtcgcagctagtgattctgtcgatggcctggacgacgtttatgagtcgggaggagctggatgcgctggctgataagccggatttggatacgtttaattactggatacagagattttggcctttagtcaggcagaagatgcggcacgatgttgatttgggagctgatggccatgacgccgaaggcgcaaaagaaaagaagattgtcattgtgtttggcaataggtgtggagaagagggatcggtgcgctatgcggggacgagcgcgattattgctattacgcagcgcccggggttggtgcaggagggcgatacttctggagaggagttaccgttcgatgtgaagatcctttgttgggatatactgggtgcgacgacagagggtatctgctttgctgatactacagctgatccgaagacggtgtttggattggttaagaggtcgcaggcgtga

SEQ ID NO: 11358 - DNA, 228 bp, A.fumigatus
gagtggcagcctcttttactatacaatctggggcatttgccagtgtacctgatgagacatctactgctgaacattggcgagaaagactttcacattggtaaaacgctttcgactctgatgtgctcgatttgttggaatacttcatacgatatcaaaactgtcgaattctacacactaatctttgcatatctggatctcttcgatgtaaagctgtcgagaagtcgatag

SEQ ID NO: 11359 - DNA, 183 bp, A.fumigatus
accacgaatatgagaatctactgctctcgcagacccatccaggcaagtatgcgcgagagattcatctatgccgatcccttgagtgaacagattaatgctacctaccgatgcaagactggcatccataccctacttggacggacccggatggcggcgatgatggcctatctcatgaccaattga

SEQ ID NO: 11360 - DNA, 207 bp, A.fumigatus
  unsure (62): Identity of nucleotide sequences at the above locations are unknown.
agagtgggttttggtcacctgatgcacactatcatggcggatgctgactgggccaaactgcnaggtgaccacaccacgttctacatcatgtctgacccaatcgtgggtgcctcggatagcaatataacaaacaagcgcaagcgcgagggtgatgacagcgcgggcccggaaccccaacggcctgaaccgctctttccatggaagtag

SEQ ID NO: 11361 - DNA, 1374 bp, A.fumigatus
agactcttcaccccaaagccttcttttcttctcaaccctaaggcttataccaagttgacgtctccagcagagatccagtggatggttcgcgcccttgtggctgtctcgtctggatccaagttcgagggcaccgaagttgcagccaagattgcatgggctcatgcattcatttacgctgtcacggctcccgggcttcgcacaaatttgcgtgaggaagctgctcacgcgcttatgggaatttatctacgaaggtcggaactgatgggtcgcgttgtcactgaagctctgtggacgtggattctcgccctgagaacggcggagaaagagtctgctgcatcgtctgcaggaccggcgagtgagaagctcctgcacctcgtagcgaaggccatctgtccttctgccgccaatatacagtccgataagattcgatctgatctgaagcgtcaactcgttcagcttcttgtactttgcaggcccgaactgatccccaatgtttcatggatcgcactgtgcttaaggactggtacagatcctggagatcttgtgcgtgaatatccggatgactttatgaagcaattaacgcaagcgcatgaggttggtcttctagttttcatccagagtaggattcaacaagctgatttggcgcaagaccccatccaatcaaaagtccctggaattgatggagctatctggaatgctgcaggggacttggcatttgtcgcaccaaacactatggtccctcgcctgattcggcagatcagagacgatttggatgcatctcgtctttctaggtttacaccaaccgatgcggccattgcccgcacaccagaggggaccatgtttgttgatgtccttaacaccaagtcgaagcagccagcattcgacaagaatactaaggactacgacacccttaaatgggaagaagagctgcgggcgcaattagctcagaagaaaggtcaaacgcagaagaagcttagcgcggatgaacaagcgaaggtcaaagctcaacttgccaaggaatctaagatccgtgacgaggttctacaggaagtgaagagaatcgaaagaggagctggcattattcaggggcttgcgagcgggcccgccgttgatgctgatgggtggatcaaccccgctgtcagctcgctgctgtccctggcccgagctggcgtgggcttgttcgcgggtgacgtcgtttccaaagcgtacgtgaaatgctctgagaaagtctcctcgcgcctgggtcctcttcgccccttcgttggtgttgcgacactacgagcaattggcaggtcccatctgccgcctgagatggaagccgagccacttggtggtgagttttcacatatcattagcagttcaggcatctattga

SEQ ID NO: 11362 - DNA, 378 bp, A.fumigatus
aatgctctgagaaagtctcctcgcgcctgggtcctcttcgccccttcgttggtgttgcgacactacgagcaattggcaggtcccatctgccgcctgagatggaagccgagccacttggtggtgagttttcacatatcattagcagttcaggcatctattgaccatgttacagggcttgtcacaagaattctttatcgccttcgaattgcttctgagcaacgcccattcgacatgacatccctggcatatatacttcccttgatattcatggttctgacccgcaatggcatcgaagaagtcaaaggggaagaagaaggagagcagttgcttctggcgctggagttcctgtcattccactccggctcatgtgagttctga

SEQ ID NO: 11363 - DNA, 1638 bp, A.fumigatus
ttaggactgagaatcgctaacacttcatgcacagtcactgacaaccgtcttccacgcgttgaggttttgaatcacctgcttactgccatgcagaagtttacccagcactacaagctgatcaaggatactctctttgatttctgtagatgcatttcgtccaacatcaccaatgaggagcttactgtccttctgcaaggcaccatcattccagatacatccgtccgaacttcggtgctgcaggttattgagtctgaaattgatctgactgacctggacttctctgaacacatctggttgggctgtcacgatcaggtggaagagaacgcggaaatcgctgaaaatatctgggaagaaaatgccctcgaggtcgacgagacttcctacgggaaactcattccgtatctttcttccaaggactcccaactccgaggcgctgctgcccgcgcgttgggccatgcagtggaactcaatccgtcggtcttcggggacattgtccagcaattgcagtcgatgtacgaggaggaagtgaagcccaaagagcctgcgaaggacaagtacggaatgccgctcaaggtggatacgaccgaccactgggaatgccgcagtggcatcgccctcgcttttggtgctatgacaaatagtttcgaaggcgatcagattgtttcgttccttcgctttctgattgaaagagggcccttgatcgacagaaactctgtggtgagatcccaaatggctgacggtggcagatccgtcgtcgtctcacgcggccagcagcgggtggaggagttgatggaaatactggaaaccactctagaaacttcagacaaaggaagcaaaacatccgaccttctcaatgaagcagtggttgttctctacggctctctggctcagcatctcaaggcggacgatccgcggttgcaaacagtaatcaagcgacttctagcaacactcccaactccgtcggaaactgtacaatcggctgtctcgggatgccttccgccactcattcgtctctgcgggccaaagagtggagagtatgtacaagagatgctggatcaattattgcagaccaagaattacgctacccagcgtggcgcggcttacggtctggctggtatcgttcgtggaaggggcatcttcactctgcgggagtaccaggtcatgtctcacctgaaagacgcaattgagaataagaaagaggcacatcagagacttggtgctctgttagcgtttgaactcttcgctaccatcctcgggcgcacatttgaaccatatgtcattcagatcgtgccgcagctccttgccggtttcggtgaccctagcatcgacgttcgcgatgcttgcctcgacgcagcaaaggcttgcttctctaatctcagctcctacggtgtgaagaagattctccctactctcctcgatggtcttgacgacacacaatggcgcagtcaaaagggagcctgcgatctccttggggcaatggcttatctcgacccccagcaattggcagcaagcttgcccgacatcatccctccacttactgtggtgctcaataatactcacaaggaggtgcgcaacgccgcaaatcgtagtctgcagcgatttggtgatcttcaccacgggggtcgaaggatccgcgct

SEQ ID NO: 11364 - DNA, 423 bp, A.fumigatus
attcgagcgcctccctcaggggtgccagcaccgggttctcgagattggagatgtgcaacggatccttggccgggttgtaatgcagcgggggaggacgacggcgccgatgcggcggcctgtgatgcggtccaggaggcgggggatgatcgtcctcgaatcccggataccaatcctcgaacccggggatcggatcgctcggcagccaatcccacctgggcgccttatccagcgccgagcgaccctccagccagcggtagtcacccggcatcacgtcggcatcgatcggtgaccccccgcggttcgcgggggcgaaggggacgacgggcagcgccccggacaggaacatgtacgaaggattgggggggcgaaggcaccggaggagcacgtaggcgccgaagaagacgaagacggccagacgtttga

SEQ ID NO: 11365 - DNA, 237 bp, A.fumigatus
cgagagcagagcagtcagttatccgatgcttcagactttttttttttttttttttttttttttcccgacggaacggttgatatctacctgaatggcacagtgcatcctgcagcgacaatggcaacaggtcgccaagggatagtctgggtgagcagccggacgacgaggataaagatgacatcctggaaaaaaaaggtcgggccccacagaagcagtttggcgggcggtaacgagtag

SEQ ID NO: 11366 - DNA, 303 bp, A.fumigatus
ttaatattcagcacgagaagtgaaggctgcggtcttgggattttaagtgctaggatggagcctaccacccagacagatcccatgacggtcacgccgaagcatgagctcgagaacggtgctgcagttgctgccaacgatgaagagcatccgtccaagaaacaaagattggaaagcatctctatcaccgagcaggaagtgagcgacggtgctcccaagcgtataaagggagtagccccaatcaaggctgagtacgcatgcccgtgtcttccttctatcgttacaccgttaatcgtgactaaatag

SEQ ID NO: 11367 - DNA, 417 bp, A.fumigatus
aacgatatgatgtccgagatcggtctttcagacaatcatcatgactctgcatctacctgtcaactgtcaatgccagacgaggatcaatctcatagcgcagctcccctcttacccaagcctgaagactatgaaaccgcaccagcagacgggatgaaagagctcgaaatgggagacatcaagaatcccagcctgagcccgagccccaggccaggctctatcttcacggttgacgatgatgaatggaccccaaggttcaagcgaagccatactcgagccagaagggccagacgggcctgtctgctgttccttctcaaggctgttctagctgtttggttcagtgcagtgctttataatgtcattcggtattgtgcaaaggtgagtctacctgcatctatgatggtaaacactactgactga

SEQ ID NO: 11368 - DNA, 1047 bp, A.fumigatus
ctgcagcagtcgcccaaaaccggtgatctccccgacaccagcaccaataccagtgacgggggtagccccgcgtctacacctacatccaatgaccggagaatgaaaatcgactccaacgccgggaacatacacggcgtgtaccccctctacgactccctaaccctcaccacaacaacaggtaacatcaccgtagccatcgccccgcagcccgcacacccagaccacccattcgagccagcgcggctgcacatccgctccctctcggggacagtcaccatctcattcaccgcgccagaggcagccgtcctcccggaccttgaactagccatggagctggagctggagctgcaccaggacggtaacgactcactgccacatgacgagatcatgaaaacctgcgatctaccggcccggccgtacgagctcgacatacagacagactcgggccccattgccggtcgaatggtcttttcgcgctctgcgcggctggtttcgggcagtggcgatatcactgctatgcttattccggtcattggtggggttggcgaggattgtagcagggagatgtggcggaatgtgtcgatcgtgacggggacggggaccggtgcgcagcgggttcatgttaccgagccttatatcttgcgctccaaagctggcttgcgctccaaggctggtgacgatgctgtggccaattacttcgtggcagggtgtcatgttggggggcatgggagcatggaggttgcgtatccggctgcttgggctgggaatgtgcatgtgcgtactgaagggggcagtgtaaggctcggaggggagggagtggaagttgtggagtcgggagaggggatggttgatgcaacggttgggacgaggaggatcaatggtgatgaggaagacgatgacgatgatgacgatgaggaaagtgatgatgatgaggatgaggatgatgatgatattgaggaagatgacaacgacaaaagacgactaggaggatggatggacgtaagcttcagatccaaggaggggtcaatcctattttatgttgggtga

SEQ ID NO: 11369 - DNA, 231 bp, A.fumigatus
caaagactatgcaacgtaaccaaggttccccagcagcgtccggcattcatttccggccatgcccaacacgcccagtgctctggcctgtgtgcctttgcgcagacgctgcaggcccacggccaccttccacccttcagtctcctgcagaacgaagacgtaacggcgaccttcctggtcgcggatgctggcccggaggacatgcagccctccattttcctccgcgtcaggtga

SEQ ID NO: 11370 - DNA, 216 bp, A.fumigatus
gtgccaggtaaggctgcctttctcccgtggaaagcctgcattgcagctaacatgtgtaattgtcagatcctcgaagccattggcgttgaatacatcgacgagttcgaagtctttacccctgccgatgatgtctaccacgtgaagaaacacgaactacaaggtcctttcgtctgtggttgccgcaacctgtgcgatgcctttcgtcggatcgcctag

SEQ ID NO: 11371 - DNA, 882 bp, A.fumigatus
agacacggctcgaagcgtcagcttcttaataattttgcagactggctctaccagagacacggcgcctcgcctccctctgtagtcgtcgtgaacggtcatactgcgaacctgtcaattaggtctatcttcgccaccattgtgaccgctgttctgggtgcagacattccatcgaaaatggggtcccagccactagaggtattagaattgttgcagtctagcctcaagtctcgaccatctcagaaaccaatcaccgtgctgatcaatgcgatcgacgcccctctcctccgccgggcaacgaaccaagccctccttgcgcggttggctgcgaccccaaagatccatttgcttgccaccgcagacactccgaattttttgctgatgtgggatatcagccttcgagatcatttcaatttcgttttccacgactgcacaacatttgccgctttcgataccgagtttgatgttgtggaagaggttcacaacctgcttgggcgcaagggccgtcgaattggcggtaaagatggtgttggcttcgtgttgaagagtcttccggagaacgcgcggaatctctatcgattgcttctcactgaactgctgtgtatgatggacgaagatcacaattcggatgatgagatgaacggccatgcaggaagagaaaacggggtcaacgatgagatgggcattgaattccgcatgctctaccagaaggctgccgaggagttcattgcatcgtccgagatgatgttccgaacactgctaaaggaattccatgaccatcagatgatcacatcgcggatggactcgggcggaatggaaatactaagagtacccttgtcgcgagaagaaatggaggggctcctggaagacctggtattagggtga

SEQ ID NO: 11372 - DNA, 330 bp, A.fumigatus
cttctacaacaggcccgcattgcggaggaggccggtgccgctgccgtgatggccctggagagagtccccgccgacatcagagcccagtgtggcgttgcccgcatgtctgaccccagcatgatcaaggagatcatggctgctgttaacattcctgtcatggccaaagctcgtatcggacacttcgttgagtgccaggtaaggctgcctttctcccgtggaaagcctgcattgcagctaacatgtgtaattgtcagatcctcgaagccattggcgttgaatacatcgacgagttcgaagtctttacccctgccgatgatgtctaccacgtga

SEQ ID NO: 11373 - DNA, 222 bp, A.fumigatus
  unsure (187): Identity of nucleotide sequences at the above locations are unknown.
agccctggctctggcgcgccggataccctccttctcaactgctccgatgatcgcagttccctggccggtggaagtgctcttctcagaccgaatcccagccatatcgccaagcttgcagtaccagccgccgagatcaaccccaacgtccacaatgtcccgagtggtgccctcctcggtgctgacaatngttatacaagcacgatggaaggagtaaacccgggt

SEQ ID NO: 11374 - DNA, 897 bp, A.fumigatus
  unsure (36): Identity of nucleotide sequences at the above locations are unknown.
acccgggtttactccttccatcgtgcttgtataacnattgtcagcaccgaggagggcaccactcgggacattgtggacgttggggttgatctcggcggctggtactgcaagcttggcgatatggctgggattcggtctgagaagagcacttccaccggccagggaactgcgatcatcggagcagttgagaaggagggtatccggcgcgccagagccagggctctagaatcggacgtggttgtgttggtcatctccctggaggaagggaccaatggctcgccttaccgactatcagtggaccaggaggtaatcgatgcggtcaacgattgtgtacaagctgggaaatgcattgttgtggccatcaacaagtgcgatcggcttcctgcagcagatcggttcggccagtcactgcatgacctgaggacgaagataaggacactgtttccagccgtcccggagaagcgcatattcgacatatcctgcaacgaggcctcggaagagactctgtccgagcaatctgatccggggaacctgcaaagattcctacgaggcttgatttcaactttcgaagaaattgcatccccagcaagaatggacggggatgagaatggacaatacgatctttcctattgggaagattcattgggagtgacacatcgacaaagctctaatctacagagatgcatgcaacacttggacgatttcctgaacgagactacccaagcccaaacgctccaaactcccggctatgctgatgatcgaaatattgagacggaaattgatgtcgttatggcagccgagcatctgcgattcgccgccgacactctcgccaagatcaccggcaaaggcgagagcggggacgtggaggatgtcttgggcgtcgtattcgagaagtag

SEQ ID NO: 11375 - DNA, 561 bp, A.fumigatus
acgagaccgttcagttctcataatttgacatcagactctccctacttcaatatggacaccgattccccgaccgagacgcgctctaccgagccttcaaccttattaaagatcctccactgggacaagcttttcgaatctgatactccaccaaggttaggtattgaggttgggaagcgattgccgtttacagctttgtcggctttctctgttggtatggcaattggttcatcgcatggaagcaaaaaggccgcataccgttttcgcgctgaaaatgcgcaccgctttccgaccacatcgacggggtggtttcaataccacaagaccaaaaattacatagcgatagttggaggtgtgaaagagggtatgaagatgggatttaaactgagtgctggtgcgcttgcgttctgcattttcgaagagactgtggactatgctcggcacgacaggagggatttcctctcgactgtcacggccgggctgtccttttctggcatttacagtttgctaggtataatcccgtttggcgcagtgtacccatataataagatcacagctaactga

SEQ ID NO: 11376 - DNA, 228 bp, A.fumigatus
ctcaccacagtagaatattacatcgtaaccaagatttcacgctcatatgttatcgctgctgtccttaataggcgcagcgattttgtgaggagagaaggccggtcgagtgctgaagacaacggtcgtcgaacctgggaaaccaagaagtattctgataagatcttttgcaccatccatgttgaactcggcaataacaaaggctcttggctgtggctagactctgtcttc

SEQ ID NO: 11377 - DNA, 840 bp, A.fumigatus
gtgccagaaccaatcacaagtgtgtatctactgcttaagctaagtctgctttcgacagatgaaacggttgtcaatggcgctcagatcttctacaagacgcaattcggcattgacgatgaaacctcgcggtctcgctggctgctggggttggtgaacgccgcaccatatttgtgctgcgccgtccttggttgctggctggcagtccctttcaacgcgtggtttggtcgccgtgggaccatcttcattacatgctgtttctccgccatcgcttgcctgtggcaagggttcgtcaacacttggtggcatatgttcatctcccggttcgtcctgggcttcggcatcggccccaagtctgcaactgttcccatctacgcagccgaaactgctcctcccgccattcgtggtgcattggtcatgcagtggcagatgtggactgcatttggcatcatgttgggctatgcagcggaccttgctttcttcgaggtcccagaccctccaaacattgtcgggctcaactggcgcatcatgatggcctctgccatgttcccagcgatcttggtctgcttatttgtattttcctgcccggagtcgccacgttggtacatgtcccagaatcgctattataaggcgtatgaatcgatgtgcagcctgcgaacgcacaagatccaggccgctcgagacctttattacatgcacaccctgctggaagcggagaaagggatgaagctcggccagaacaagatgatagaacttatcgctgtgcctcggaaccggcgcgccctaatcgcatccgagattgtcatgttcctgcaacaggtaattaacctcccccggtcatag

SEQ ID NO: 11378 - DNA, 753 bp, A.fumigatus
ctgtgtggcgtgaacgttatcgcgtattattcatcggaaatcttcatcaaggtgacatcagcccgaaatgccctagccacatccttcggctggggcgtggtgaactggctcttcgccatccctgcggtctacacaatcgacacattcggccgtcgcaatctcctcctcaccaccttccctctcatggccctcgcctggttcttcaccggctttagcttctacatccctgcctcggaacacaataatgcgcagcttgcgtgcgtcgcgctaggcctctatctcttcggcgtcgtctactccgtcggcgagggtccagtgccattcacctactcagcagaagcctacccactctacgtccgttcgtacggcatggccttagcaacggcaacaacctggctcttcaattttctcctggcgatcacatggccgtcactgcatgattcattcaaggaccagggcgcgttctgctggtatgcggcgtggaatctgatcggattcgttctggtgcttctgttcatgccggagacgaagggcaagacgctggaggagctggaccaggtgttttcggtgccgacgcgatttcacgcggcgtatgggctgcgccagatcccgtacttctttaagaggtatatcctgcgtcagcaggtgaagccggagatactgtacgagagggaagatccggtgggctattcgagtgattttgttttcaacactgcggattggagcaggacaaggtatgtgcggggacattga

SEQ ID NO: 11379 - DNA, 525 bp, A.fumigatus
gcagaccaagatcgctgggaacatggcagaggccatcatgatgcgccagttgagcccgacaatgtttggagggtctgggacctcgaagaaagcaaggtccgctgcatagcccaacatgatgccaaatgcagtccacatctgccactgcatgaccaatgcaccacgaatggcgggaggagcagtttcggctgcgtagatgggaacagttgcagacttggggccgatgccgaagcccaggacgaaccgggagatgaacatatgccaccaagtgttgacgaacccttgccacaggcaagcgatggcggagaaacagcatgtaatgaagatggtcccacggcgaccaaaccacgcgttgaaagggactgccagccagcaaccaaggacggcgcagcacaaatatggtgcggcgttcaccaaccccagcagccagcgagaccgcgaggtttcatcgtcaatgccgaattgcgtcttgtagaagatctgagcgccattgacaaccgtttcatctgtcgaaagcagacttag

SEQ ID NO: 11380 - DNA, 438 bp, A.fumigatus
atggttcacatttggtacatacctgcgcagagccccactgagaatcaaccagcaactggccagtggcagccgtcgcgactcaattacaagaaaaataataataccaacgagatcgagaatagtttctatcccacagcaacatataaggagggacagcgggaacaaagcgacgcgatttctagcacgaagccaatcagtttctctgaccctggcactggaaatctgcagtggaccgtcactactggagtcgtcagtctccctatcaggtgtaggacggacttcgtcggatggaccgtcgtattcttgtctggcaatttgagtaggtacttgcgggccatttccgtggaagtacagtatcgacaatcgtccggaaactcgctccggtccagccaaaatccagttattgtccctgtgattattatgttatttatttattga

SEQ ID NO: 11381 - DNA, 213 bp, A.fumigatus
cttttttccgccatacagatgtactccaagctcgttcaacgctgcttcgataactgcgtcaacgacttcaccaccaagtccctcatctcccgtgaagaaggctgtattatgcgctgtgtggacaagtatatgaaggcttccagccgcttgaacgagcgcttccaggagcagaacgcggctatgatgcagggtggacagctgcctggccggtag

SEQ ID NO: 11382 - DNA, 222 bp, A.fumigatus
  unsure (146),(165): Identity of nucleotide sequences at the above locations are unknown.
cctcaggcaatcactgtgctttcaccagagcgagcatggagtacttctctagactatgaaatgatacgtcattgtgcagactttgaacagagtgaacagttaatctatcagtacatcgatttcatgcgctcttttaagaaccgccntaatcagggctgttcaggnttttacttcacctccaacagaaggaagcaatccacacacggtcacaacccggcttga

SEQ ID NO: 11383 - DNA, 246 bp, A.fumigatus
agagcctgttctgttcaacatcatcgtatcattcttagttatcgagtacattgctgtgccgttctttgtgttcggcacctggcgactaggtcatctggtcccaagggtctcggattgcttgggggaggtgactattttattgcttttccccttccagaagacctagtccgtactaggtaccttagtatctaccacctttggtttagtgctaccttttacttggtcgaaactagccacacctgctaa

SEQ ID NO: 11384 - DNA, 336 bp, A.fumigatus
ctctgtatttattgtgcttgctacatccattctgcctgcaattgctatgtgcctatcccgaaagctgctctgcttgatgcttggatcctttccgagacctgttccttgcgtgaggctaatccgccttgtcttacaacagaaaaacctcagggtatattcggtgttcccctcaacgtcagtatcaaatatgcgaatgtcgccatctccctcacgaacgataacggcgaaagtttcatctacggttatgtgcccatcgtggtcgccaagtgtggtgtctttctgaaggaaaaaggtacgaacaaacaaccttcttcgcccaggcgatcggcctactga

SEQ ID NO: 11385 - DNA, 840 bp, A.fumigatus
gttcattttgatgtccttcccattctacaccttcaagcgaaggttgcccgcgggaagattgggacaagcaggctgatggaggcacaggacttttggcgtgtaatctgggagcaagatgttcgaattgtcgtttctctcacagcagaaattgaaaggggccaagttaaatgtcaccggtattgggagtcagggaattatgggccttttcgagtcaataacttttctgagcgacgcattccaatgaaagcgtccgggtcccgccagaaccagggtcagtcaaccacgtcattgtcggattctagcgaagaacccagcgaaccatgcattatcgtcagacattttggcttgtcacactcggcttttccatttcaaccactacgagaagtcacccagctgcaatatccctattggccggattttggtactacgtcgcaaccatcacacctccttcagctggttgatgaatgcaacgcaatcatacgggcaacaagcaatacgtgctttgatactcgcaaggcaatgccaactgaacatcgacctgtattggtgcattgcagtgcgggatgcggccgtactggtaccttctgtacagtggatagtgttctggacatgctaaaacggcagcactctgcacgaaagaccgaacctcgagaaatcagtgaacggcctgatactgggtggatttataacgataacgtggaccttattgcaaaggcagtcgccgactttcgaacccagcgacctagcatgatacaaaatttgagccagtttgtcttatgctatgaaagtgtattggagtggatggtggttcaaatggacgaaggatgtgaaaatccttga

SEQ ID NO: 11386 - DNA, 222 bp, A.fumigatus
gatgggagtgatgcaaggctgatgagaacgataatcttgtttcccaagagacaattgttagcggcttcgtccaacttctgtcacgggttgttctatctaaacaccaaccaagctctgagccatgttgctcaatcttccaccggagctaatccagctcgtccttcaaagttcgactacgccttcctttctacaagtggcattttcctgtcgaactttgtatga

SEQ ID NO: 11387 - DNA, 837 bp, A.fumigatus
agatcgtttgacacgcggaagttggccaacaccttcacgagcgacattgaccgaagatcattctcaagatggaaacaatgccgctacatcatcgtttatgacgctgctacacttgacatgaaagatgcggtgccaatgatcaatatgttgaacaagtttacggctgagggatggaacggcgaaggttcgattcttcggggtgggttcaaggtcttctgcaatcagtttaatgcgcttgttcagcagcctgaatcatcgaaccctggaatatcttcaaataagcctaattcgatgcagattagccttccgccatttgcacctatcgctggtggctgtgctttgccggagtcttcttctgccgccatccccttctttgggaatattcgccagcatatggatcttatgggcggtgttggtcagattccgctccagctcccacagaatttaacagactccaaaagacgattgcttccacgatggctccgtgacgcttccgatgttgaagatggaggtcagaaggtgtcagagaagttcctggagctcgagaagaaggaattagaccgtatgaaacaagctctatcatatgaaatgaccggagtttttacgtctgcgcaagccccgtcgaagaagtatcgagttgcagggatcgagaagggcaacaagaacagatataataatatctatccctttgatcattccagggttcgcttgcaggatgttccttcaggaggttgtgattatgtgaacgcgaattacatgaaggctgaatacagcaataagcgctacatagcaacgcaagctccagtgcccgaaacattcgatgtaagttcattttga

SEQ ID NO: 11388 - DNA, 189 bp, A.fumigatus
agatataggcctctacctagcttctttatgaagagtactagtactgctactgggccagataattccctaatctaccctttcttaaatattttattaaggtatttatacagagcctctaactctagctataatatagtaaatagggggctatatagcagcaacttcctattaagtagctatattttatag

SEQ ID NO: 11389 - DNA, 504 bp, A.fumigatus
acaatttctgattctcggcaggaagaggactttgtcactcagctatacaatcgcagtttactgtcacagttcgatgtgacgcattttcaaaacctcctagatgaggcggtctcctggactgaaggaacagccgatgctctcgatcaaaacttgcgtgatgcgatcacatcccggctgagctttcgacgcgagttcctcctcgcattggcccatgacgccgatatcttgcagaataagtcaaccggctactttgcgtcttgcttatcccagttgtcctcgcttactaaatctgtctctctcggtaaacctgtgcccgatgccttcagtgtgaagattcagcggaggctggccagcacggttccccctcggcctatggtgaagattagtttcgagaatgcgctggcgcatctgcgacggttgtgtcaagatgcaattgacctacaggaactcgttgaatacgggggcccgtacaatttcaaggtattccaggcctttcccacataa

SEQ ID NO: 11390 - DNA, 396 bp, A.fumigatus
cgaattcaggtcgccgtttggacattgctttctcgaaaacctcaaccatccgtttatatccgttcgcttacccaaactttcatcctcagcaacatgactgtcctcggaaaagtctcgcttaagggacttctgtacgacgagttgtccgaatttgtcctcgcttcaagcgtgcttcttgatgccaacatggacaatactgaggtgccctcggaccctcgattccagattgcccagcggatggacgcttttgtgaaacgtttcgctcaggtgacatcctgccgcttctttcgcgtagtccgcatttctgaccattatatagccctttgtagacacttttcgaagtgcgtgcctgaaccgttgtcgcattcgtcggacactctgccatacaattattga

SEQ ID NO: 11391 - DNA, 204 bp, A.fumigatus
gaaccctccgacataaaggacccatacatcaagtcccaacccctgggccgcttcggctctgtccgtgatatcgccgatgctacggtctacctcttctcaaataccggtagttatgtttctggccaaatccttgtcggtaagttatccgaccttcttatgcggatcaaaatcaactctagaaccctcaggctgacgcagtggtag

SEQ ID NO: 11392 - DNA, 1248 bp, A.fumigatus
gagcctgagcccatccttgaccgcaacttcgactctattttcattttcccagctcgaccaacactctccagatttcaatccaaccttggctacacatctatatactactgtatactgaagacaccgaagcagacaactatggaacccctcgatcaactcgccgatttcgaattcctcctggaacaggtaagacaagtcaagaacgacaggaatgtcccgattcaggaccaagctgagtattttcaaaaaaccttagtccaccagattgaatccttctccgaaatagagaaaaagcacttgtacagatacctcaagctcagccgcgataatgatgagctccgggcttcctacgatgagctgaacgaggcgctcagcgaggagctgcgcaacgtcgagcgcaagaatgcggaactgcaggaggtcaaaactgccctaagagagacgcagaaagactgcgaggccaaggaggagtatatccgtgacgccgaggcagcgaatgctgccctcaacgagaagaacaacgagcagagaagcctgatcagatcgtacaagcaggactggaaagctatgaaagcagagctggagctccgcgacaaaacaattgacgatctgcagacgaccttacggagcaagggcgcccttgtcgacaaatacgagcgcgaaatcgagcaatatcgaaagcagcgcaaagaatgggaaaggcaagtggatgaagccgctcaatacctgaacgacaagagcgaaatcttgaaatggctcaatgaagtgagcaggcctttgaaagccaaaccaaaagcaccagcctctcaagtgtcaggctcaggatcatcaagttctgaagcgtcaagctctgacatacgcaaggtgtcagactctgtaatgagatcaacaaaagatgacggagcagatgacgagacacagtgtactacagattcacaggagggcaaagcaccctctgcgacaggttcgcctaaagaccggcaaccggacctgcaggggagtgcaatggactgttcaaatgaggcgatcagcgaggacgaaatgagctcaatacgtggtgctacacttgaggaagaaatgatgtgcctgtctgacagtctatcagctctgtccatcgaacggggaggcatctccagcgggatgctatatgaccgattatcacgagacactatctcccgcaagcatgtacgatttgcattttctaccgcaacggcgaaagcgacgaaagcggcgcgcaaaggcagttga

SEQ ID NO: 11393 - DNA, 261 bp, A.fumigatus
  unsure (227): Identity of nucleotide sequences at the above locations are unknown.
ccgcacggttaccgatacaatgaaggaacagcggatctttgcgtcttctcgcaccatcatggaacgaaagtggtggctactcttcgtgacgatgttggtccttttgctgtccatagtctccataccctctccagacgaagcgtgtcgatcgtggaatactgtcaatatgatgccacacgatcctctgacaaaattacgcaactgtgtacactcgcgatgtatatttntaacacggccgcggccggaaggtttattgaaacg

SEQ ID NO: 11394 - DNA, 228 bp, A.fumigatus
ggacaacgtagtgaaccaggaggtggtccttcggtatggtcatccgctggatcttccaagacaatgctaacaccttgcagcatgcttcggttagaagaagtatatgatgtaacggtcgtcaaagacggccaagaagcctacgacactgtcaaggcgaatatggaagagggcaaagtatttgacgtgatcttcatggacattcaggtatatgcaaccgtcactatgtag

SEQ ID NO: 11395 - DNA, 543 bp, A.fumigatus
gagccttttgtgcagggcaatctcggaatgaatcggaagtatggaggtaccgggttggggctcagtatctgcgcccagttttctcgcttgatgaatggcaagatcacttttgaaagcgagccgggcaaaggcgccttgttcactgtggagattccgttgaaatttgtcaaggaagcagcgccgagcacccccagttccagtgcagctggatcgcgcacacctagcgttttctcgcttgacgatcttcccggtctcgcgcgaccgccgtcgaacaatggctctgtccgcagcgatccgttgaccaacttcgagaagcaggatctgcaacctcggcttgttggactcagtcagcctttctttacccttacaccgtcatcccccgcaccgtcgactcccagagctactccggccgatggagccaagccagaagtgaaagataacacgtctggcaaggtgcgcgtattggtagctgaggacaacgtagtgaaccaggaggtggtccttcggtatggtcatccgctggatcttccaagacaatgctaa

SEQ ID NO: 11396 - DNA, 186 bp, A.fumigatus
cacaggcagatgcccaaccttgacggcctagagagcacccgtctcatccggggcatgggctactcggcgccgatcgttgccctcagcgctttctcggaagagagtaatatcaaagactgcatggactcgggcatggacatgttcatcaggtatgtctaccgcatctcggcgaaaatgctatactaa

SEQ ID NO: 11397 - DNA, 624 bp, A.fumigatus
tgtcttaaatgtgtcatagtttggaatataaataccacgcttcttgcagaagaaaaccagtttaccaagtctttctattctccctacctactccatcgactctatagcatctgccatatcaaaatgagcaatttcaaccacgcaccaaactacaaccccaacagcctacccaccatcaacaacggtatggacgaaagcttctacaccaacatggaccacaccatgaataacgcccacaatctaggaatgcattacctggccgcagcccctcccacaaacaccagccacacggccatcgaccaccccctctacacttccttcaactactgcatggtcttctccaatgtccccgaccagccctggccatcctacaacctcctccaacaatgcctcgacaaggttcgcgcccgcgatgcaaaagtctactcctccattgatgcaatcctgcgctacgacggtgccaaaacgggggatttgattctctcgttcacggctgcggccttgacggacggggttatctggacgagtgccgagggggttattctccgtcagatgagaaattgggatagggatagcaggatggaagggtggacgcttgtgggggagtttgggctcgcgcagtga

SEQ ID NO: 11398 - DNA, 603 bp, A.fumigatus
acaggattaacggcgtaccgggaagtaactggtgcacggggcttccagattgtaaagtacccatggccttataccatgattgaacaggtggacccgcgacagtacgcggcaaacgatcgtaaccacattggcaatcccaccaccacagatatcatcggtgacgctcacaccagtgacttcaagacgttcaccaagccgcagacgtacattgaccacgagacgagcacgatcatcgacgtcagcatcctccgcgtcgacgacgacaccttcgtccgcttttacgtcagcggcaaggtttccggccccgtggtcgaagtgagccgcaacggactgttcggtgactgggtcaccccttcaggcaccatgcaggacagcacacactttggaggtccgtatccattctgggacaatgtgcaacccggcaaggcgtatctgctttgcgataaggtcggcagcgtcactggtttgtcgccatgggtgtcgacggatgtgacttcgggaacgtttacgcctgcttcgggtggtaatctgggggcattgagacatggctcggtgctgtccgtgaccaagcagcagtacgatgccttggctgcgctaggctag

SEQ ID NO: 11399 - DNA, 219 bp, A.fumigatus
cgaccgttacatcatatacttcttctaaccgaagcatgctgcaaggtgttagcattgtcttggaagatccagcggatgaccataccgaaggaccacctcctggttcactacgttgtcctcagctaccaatacgcgcaccttgccagacgtgttatctttcacttctggcttggctccatcggccggagtagctctgggagtcgacggtgcgggggatga

SEQ ID NO: 11400 - DNA, 1212 bp, A.fumigatus
aatggcggaagaaaaacccactggcgcttcgcccccttaccacgaccccgaggccaacatcaaacatggcaccatccaggccctggtcgagcgcgatctcctggacgaacgatacaagatcaccgagcgaggactgaaaaaccgtcatgtgcagctgatggcactgggtggcaccatcgggacgggtctgtttgtcgggtcgggacaggcgctcgccatcggtggtccgctgtcgctgctgctcgggtacgtctttatttccgcgctggtgtatgcgctggtgacggggatggccgagattggcgcgtatctgccggtccatggaggcaccatgagttaccacgggtttcgctatgtgtcgcgcagcatgggtttcgccatgggctatctctactggtattcgctggggatcctggtgccgtacgagattgtcgccgcgtccatggtcatcgattactggcaccccggcgtgcacatcgccgtctggatctccatcatgctggtcatcattgtgctgctcaacttcatgcccgtcaaagcctacggcgagaccgagttctggttcgccgggatcaagatcatcacgctgatcggcctgctcttcctctccttcatcctcttctggggcggcggccccaaccgccagcgcctgggcttccactactggaaggacccgggccccatgaacgagtatctggcgcacggcgccgccggccgcttcgtcggcctgctgcagtgcatcgtcaagagcgccatcgccttcatcttcgccccggaactgatcatcatctccggcggcgagatggagtccccccgccgcaacgtccccaccgccgcccgccgctacatctaccgactggtcttcttctacatcttcggcgccctcgccatcggcgtcatctgctcctcccaggccaagcagatcatctccggcaacggcgacgcctcctcctcgccctgggtcgtggccatccacaacgccggcatccccgtgctcgacagcatcgtcaacgccgccatcctcacctcggcctggtccgccggcaattcgttcctgtacatgtcctcccgctcgctctactccctcgccgtctccggcaacgcccccagcgtcttcaaggcctgcaaccgctggggcgtcccctacatggccgtcggcgtctccgccctctactcgctccgtcatcacccggggcaaaaggtctacgactc

SEQ ID NO: 11401 - DNA, 1344 bp, A.fumigatus
ccgacctcgggccgccagaaaaaatccctacttaacctcccgtccccccccggtctgtcctcttccctcgtttcgtgccgtcttcacttcctgtgtaagtgtaacaccatgaatcaagaatcatcaaataaaatggcggaagaaaaacccactggcgcttcgcccccttaccacgaccccgaggccaacatcaaacatggcaccatccaggccctggtcgagcgcgatctcctggacgaacgatacaagatcaccgagcgaggactgaaaaaccgtcatgtgcagctgatggcactgggtggcaccatcgggacgggtctgtttgtcgggtcgggacaggcgctcgccatcggtggtccgctgtcgctgctgctcgggtacgtctttatttccgcgctggtgtatgcgctggtgacggggatggccgagattggcgcgtatctgccggtccatggaggcaccatgagttaccacgggtttcgctatgtgtcgcgcagcatgggtttcgccatgggctatctctactggtattcgctggggatcctggtgccgtacgagattgtcgccgcgtccatggtcatcgattactggcaccccggcgtgcacatcgccgtctggatctccatcatgctggtcatcattgtgctgctcaacttcatgcccgtcaaagcctacggcgagaccgagttctggttcgccgggatcaagatcatcacgctgatcggcctgctcttcctctccttcatcctcttctggggcggcggccccaaccgccagcgcctgggcttccactactggaaggacccgggccccatgaacgagtatctggcgcacggcgccgccggccgcttcgtcggcctgctgcagtgcatcgtcaagagcgccatcgccttcatcttcgccccggaactgatcatcatctccggcggcgagatggagtccccccgccgcaacgtccccaccgccgcccgccgctacatctaccgactggtcttcttctacatcttcggcgccctcgccatcggcgtcatctgctcctcccaggccaagcagatcatctccggcaacggcgacgcctcctcctcgccctgggtcgtggccatccacaacgccggcatccccgtgctcgacagcatcgtcaacgccgccatcctcacctcggcctggtccgccggcaattcgttcctgtacatgtcctcccgctcgctctactccctcgccgtctccggcaacgcccccagcgtcttcaaggcctgcaaccgctggggcgtcccctacatggccgtcggcgtctccgccctctactcgctccgtcatcacccggggcaaaaggtctacgactcc

SEQ ID NO: 11402 - DNA, 429 bp, A.fumigatus
tcatcatctccggcggcgagatggagtccccccgccgcaacgtccccaccgccgcccgccgctacatctaccgactggtcttcttctacatcttcggcgccctcgccatcggcgtcatctgctcctcccaggccaagcagatcatctccggcaacggcgacgcctcctcctcgccctgggtcgtggccatccacaacgccggcatccccgtgctcgacagcatcgtcaacgccgccatcctcacctcggcctggtccgccggcaattcgttcctgtacatgtcctcccgctcgctctactccctcgccgtctccggcaacgcccccagcgtcttcaaggcctgcaaccgctggggcgtcccctacatggccgtcggcgtctccgccctctactcgctccgtcatcacccggggcaaaaggtctacgact

SEQ ID NO: 11403 - DNA, 1221 bp, A.fumigatus
ggagtcgtagaccttttgccccgggtgatgacggagcgagtagagggcggagacgccgacggccatgtaggggacgccccagcggttgcaggccttgaagacgctgggggcgttgccggagacggcgagggagtagagcgagcgggaggacatgtacaggaacgaattgccggcggaccaggccgaggtgaggatggcggcgttgacgatgctgtcgagcacggggatgccggcgttgtggatggccacgacccagggcgaggaggaggcgtcgccgttgccggagatgatctgcttggcctgggaggagcagatgacgccgatggcgagggcgccgaagatgtagaagaagaccagtcggtagatgtagcggcgggcggcggtggggacgttgcggcggggggactccatctcgccgccggagatgatgatcagttccggggcgaagatgaaggcgatggcgctcttgacgatgcactgcagcaggccgacgaagcggccggcggcgccgtgcgccagatactcgttcatggggcccgggtccttccagtagtggaagcccaggcgctggcggttggggccgccgccccagaagaggatgaaggagaggaagagcaggccgatcagcgtgatgatcttgatcccggcgaaccagaactcggtctcgccgtaggctttgacgggcatgaagttgagcagcacaatgatgaccagcatgatggagatccagacggcgatgtgcacgccggggtgccagtaatcgatgaccatggacgcggcgacaatctcgtacggcaccaggatccccagcgaataccagtagagatagcccatggcgaaacccatgctgcgcgacacatagcgaaacccgtggtaactcatggtgcctccatggaccggcagatacgcgccaatctcggccatccccgtcaccagcgcatacaccagcgcggaaataaagacgtacccgagcagcagcgacagcggaccaccgatggcgagcgcctgtcccgacccgacaaacagacccgtcccgatggtgccacccagtgccatcagctgcacatgacggtttttcagtcctcgctcggtgatcttgtatcgttcgtccaggagatcgcgctcgaccagggcctggatggtgccatgtttgatgttggcctcggggtcgtggtaagggggcgaagcgccagtgggtttttcttccgccattttatttga

SEQ ID NO: 11404 - DNA, 1584 bp, A.fumigatus
cacggtggattctcagatgtagcggaggcaacaggtatgacacttgctgaacaggaggagcgtgaacttcaggaagcagtggctatgtcattgaaccagaacctgggccatcaagagatggggatcaccagctcaaatcaatcgaatttcggcaaagccacgcgggatcactatgatgaaggcgcatgggcaatgactcttttcaattcgagtgcgcaagagataatcatcagcccagacccagcggaccgcagaagagtagcagatgaaccggcgttccttcgcccatcccaggataatctgtacctgggtgggctgttgactattttgcattcaatccctttggcgcgggaggctcttcttctacgaaataaggtcctcccgaagtacggtcatgacccgcagtggtggaacggccagccgatcaatttacctaaaatagtcacaatgcaagatgcgcaagacggtgacacggcctgggacgacatcctttacgaaactcaaagacttgttgcttttctagatgcgacaaatcgcgcattcggtagtgtcgatgctctttcaagcctgaaaagtatggtatcttacgactccgaaagcggcatcagtcaattcttggagaaatggcaggaagccgccgtcagagcggaccctggaaaccaattggcaacagtgttctcgtcaaacgcattcaaatgtcccctttcagtgtatgacacgccaatccaaaaagagttctttatccttgacccgttcgtggagcccgatcacggtcaaactctctacgatgtgctagatcggaccatctggtccgacagaccaggggaagagctagatgacgtatggctggaacatgtggctgaagttttgatgatcaaattggatagctctgactcagcgaaatctgtggatgtgaagataccagcggtcttctacccggatcggtacctcgccacttgcaaggacctagcgcgtgatttccgtgcgcgacggcttcaagtttacgaagagattaacaagttagaggcgttgatgaatcgcttctctgtctcgaaatcggtctttcatagagggcttggatctagggagatactagaaaaagccgctgttgctgcatctttcactttgcccaagagtcttgccaatggaagaggtgacttggctttgacaccggaagcagcaaacgccgaggcgcaaagattggccgcagagttgagagatctctcaagcaagatcgaagacaagctgaaaggtaagtgtacaagtttggtttcattgtataagctgacaatgtacattgcagatttgcagaacaggagacagaaagctgttaaaacgcttcgaaactactccaagttcctcactgaaccttcggaatcacctacagagccaccacaacatcggtacacgttgcgcggcgtgtgtacggagccacatattacttatgttctcagacccgtcacatcccacaactctgagcaagcgacagatctacagccgagcgcaggagatcggtggcaatggtggcgaaataacctcctctatggacgaagccaaggtccaataaaccaataccccctataa

SEQ ID NO: 11405 - DNA, 195 bp, A.fumigatus
gatcatttgactggaagattatataagcagtacgtccgttccctgccttgctctaacccccttcagactagcggactcggtaaaattagtttgggtcgaagaagcttgaaaaagttcgcaacagattttcttccgaagactttttacacactcaacaacaacaacaacaccaaacaaagattctggcatcactga

SEQ ID NO: 11406 - DNA, 648 bp, A.fumigatus
gtcttagtatttccccattgctactattcttcatctgtctctgtcatcccaatccaattccattgccaccaatcgtcctgtaccacgatttgccgtcagtctagtagacctttctccattctcccgtctttctgctgtaggtctctactggaactctcctggtttctccgtcgaaccgaggttatacgttgcattatatcggttctgctctccttcagaactattctagcaacatcatctcaattgtctcccatctgccatatacatcaccacatccgtccacattcagaatgtcttcaagcggcaataacggcgctgtgggccaggagaacatcaacccagatatcattaccctcactcggttcctcactgaagagcaagtcaaggtaccggaagccactggtgacttcacgtgagtttgtccgctctacgaattggaattcttgcgccgaaactaaccgagctgccatgtctgcgaacagattgctctgccatgctcttcagttctcattcaagtccattgcctactacatccgtcgtgcgtcgttgatcaacctgaccggtctggcgggctcgtcaaacacaaccggcgatgaccagaagaagctggatgtaatcggaaatgacatctttgttttccgcccatga

SEQ ID NO: 11407 - DNA, 186 bp, A.fumigatus
tcggaaatgacatctttgttttccgcccatgagagggctccggccaagtgccgcatactcgtctccgaggaggaggaacaggcgatcgtttttgatgagcaccccaacgcccgatacgccgtcgtctgtgatcccatcgacggctcgtccaatcttgacgctggcgtcttggttggcaccattttc

SEQ ID NO: 11408 - DNA, 276 bp, A.fumigatus
gtctctactggaactctcctggtttctccgtcgaaccgaggttatacgttgcattatatcggttctgctctccttcagaactattctagcaacatcatctcaattgtctcccatctgccatatacatcaccacatccgtccacattcagaatgtcttcaagcggcaataacggcgctgtgggccaggagaacatcaacccagatatcattaccctcactcggttcctcactgaagagcaagtcaaggtaccggaagccactggtgacttcacgtga

SEQ ID NO: 11409 - DNA, 297 bp, A.fumigatus
acaaggtcggccgttcatcgttgtccgagagtatgttgcgggagccccctaccatggctatcttgtcttttgtggagtatgaatgatggcgcccagacactgatccaaatctacttgcatagtcaaggaaagaagaagagacagcacggcaccgaggccgtgaaatcacacattgtcgctgccaagaccgtcgccaacattgtgaagacttctttggtatggtccggaggttctaagaaaatcggaacggcatctaagaagtattatagggtcctcgcggtttggacaagattctga

SEQ ID NO: 11410 - DNA, 423 bp, A.fumigatus
  unsure (341): Identity of nucleotide sequences at the above locations are unknown.
tatcaccgttaccaacgatggcgcgactatcctctcccaggtccgttcttcaaccgcttcggcgaccatcgattcggcgtgtcactgacttgcgactgtccgcagatggaaatcacaaacaatgttgccaagctcttggtagagctctcaaagtctcaggatgaggagatcggcgacggtacaaccggtgttgttgtcctggcggcggctatgctcgagcaggcggccgagctgattgacaagggaatcccccccatccgtattgcagacggatatgatcaggcttgtgagattgccgttgctcccctcgacaagatccgcgacgagatccccttcccccngggacgatacggagaacctactccatgttgcgaaagaccattcctggtagcaaaatgtttaatccgattgggcaccccctaa

SEQ ID NO: 11411 - DNA, 189 bp, A.fumigatus
gttgacttgtgcgctggaacccgtcaggtccggctgactttgcctgtagcccctgttgaggatctctcggacgacgagtcgactggcggatctatcccttacaacaacgctgaacatgacaaggacatcgctggcgacgtgaaggaggaagaggaggacgatgacgagaatgaggaagaggggatgtga

SEQ ID NO: 11412 - DNA, 441 bp, A.fumigatus
ccagtcggagtgttattgggcttgattgtcttccagctagccgtaatcggcgtactcgctctgcgcagagcgataactcggtcgttgctgcttgtaccccttcttggggcgactctctggttcagctatttttttgcgcagcactacgaacccctaatgaagttcattgcattgaagagcatcgaccgtaatcgtcctggtggcggagatatctcgccttccccatcgtcgaccttctcgcctccttctggacttgagcgtgacgctcttcccatacagatcggcggacaacaacttggcctgagattgaagaagtatgtcaatccgagtctcattttacctctggatgatgcgtggcttccaggacattctgctactcgtgaatatcagggggcttttgacgcgcatgagacacgtaacggcaatggttccgcggtctaa

SEQ ID NO: 11413 - DNA, 612 bp, A.fumigatus
ggcgtgtcccttacggctggtgcaaatatgctcaaacgggctgcgccttactgcaccgaaattctccggctaaaaccacattcattggctgcccttctattcaaaggtcagatagcgctcgacgaggagcgtttcgaggacgctattcgcaccctcaacgaagccagagaacatcacccgggatctcaggaagtccagacgcttatgcagaaagcacatgtgctattgaaacgcttcaagcataaggactactacaaagttctgggcgtcagtcgtgactcagatgagcgaacaatcaaaagagcttatcggcagttgacaaagcagcatcaccctgacaaagccgtctcgcagggcgtctcaaaagaggaagctgagaagaagatggccgctataaacgaggcatatgaagttttgtcggaccccgaacttagagcacggtatgacaacggcgacgatcccaatgaccccgagtcgcagaggggcaatcccttccaaggaaacccctttggtgcagccgggggccagcaattcttcttccagcaaggcgcgccacacttcaaattctcgggtcaaggattcaacttcccccgaggctttcccttccgttag

SEQ ID NO: 11414 - DNA, 600 bp, A.fumigatus
  unsure (1),(48): Identity of nucleotide sequences at the above locations are unknown.
nattccaaggtcgatcgcgcccattacgcgccttcgaggccatactcngactcaccgcaacctatcggacatggagcgacgatttcggcgccacacatgcatggccatgcttgcgaatacttagttgagttcatcaagcccggatcccgggtactggatatcggctcaggatccggttatttgacgcatgtcttcgcaaatcttgttacagataggtctaccaatgatgccagtggtcaggttatcggagtggaccatatcccagaacttgttgacctagccctggcgaacatgagcaagtcagagcaaggtcgcactctcctcaattccggaaaagtgaaattcatcaccgccgatggtcggcttggctggagggaaggggcaccttacgatgcaatccatgtgggcgcagcggcagataagttacacccggttctcattgaccagctacgtgccccaggacgcttgttcatacccgttgatgtggaaaatgacgacgggcccctaagtagccttggacttggtggtggacagtacatatgggttgttgacaagaaagaggatggctctgttcacaaggagaaaattttcccaggttag

SEQ ID NO: 11415 - DNA, 243 bp, A.fumigatus
ggataccctcggcactcagcgtctgcccgcggctccccttccatggcaccgtatcaacaatatccctcagattgtcctcctgagccatttgccccagctcatcatccagatcctccagatatcgcctcgccccctcatcatccccaatctggaagaactggacaccaacctgccacggcacagcgcgacatgcatccaaccgcttggcaacttccacaatcacactctccgcatcatccgtaa

SEQ ID NO: 11416 - DNA, 1158 bp, A.fumigatus
cttcattcacaaccagggaaagggcatcataatttccctctttttgtgggccgattgcataccaccagcatcatccagatcccaatctcaatgccgcttctctttggaagattcaagtctcgatctccttgccttcctcgttctcctgttgaatctctcacgccggaacctatacagcaccagccgttacccgcgtatagtatcaacgacaagccagaactcacaatgggccatcgtcactcccgtgtagcaggcagctcaagcacctcatcctcaagaaagaccacctaccgaggaacccagtcgacaccccacaagggaaacacgtacgtgcaaaccggcaacgtcgacgtctggtttccgcctccatacacccctcaagcatcagcaccagccgcacatactcccggctggacagcctccttcaccagtagcacaggcgactcgccctacgccttcctccgcgagttcgacacactcttcgtcgtcgacgacagctccagtatgctcggggcacgctggaaggaagccgaggaggccctggcggccatcgcgcccatctgcacgcggtacgaccaagacggaatcgacatctacttcctcaaccaccgccgtgaggcgactgccacttccacgggcgcataccacaacatcaccaccgcggcagacgtgcaggagatcttcaacagcgtgcagccgcgcgggcccacgccctacgggaaacggctgctgcagatcctgaccccgtacctgcggcgcgtggagaagatggcggccgcgacggatgaggacgggaacctgcgcgatccggcgaggtttgtgaagccgttgaatatcattgcgattacggatggggtgtttacggatgatgcggagagtgtgattgtggaagttgccaagcggttggatgcatgtcgcgctgtgccgtggcaggttggtgtccagttcttccagattggggatgatgagggggcgaggcgatatctggaggatctggatgatgagctggggcaaatggctcaggaggacaatctgagggatattgttgatacggtgccatggaaggggagccgcgggcagacgctgagtgccgagggtatcctcaagtgcacgatgggtgctgtgcataagaaatacgataagcggaaggcgttttag

SEQ ID NO: 11417 - DNA, 492 bp, A.fumigatus
caggcagctcaagcacctcatcctcaagaaagaccacctaccgaggaacccagtcgacaccccacaagggaaacacgtacgtgcaaaccggcaacgtcgacgtctggtttccgcctccatacacccctcaagcatcagcaccagccgcacatactcccggctggacagcctccttcaccagtagcacaggcgactcgccctacgccttcctccgcgagttcgacacactcttcgtcgtcgacgacagctccagtatgctcggggcacgctggaaggaagccgaggaggccctggcggccatcgcgcccatctgcacgcggtacgaccaagacggaatcgacatctacttcctcaaccaccgccgtgaggcgactgccacttccacgggcgcataccacaacatcaccaccgcggcagacgtgcaggagatcttcaacagcgtgcagccgcgcgggcccacgccctacgggaaacggctgctgcagatcctga

SEQ ID NO: 11418 - DNA, 231 bp, A.fumigatus
attaagtcttatcattgccctatgctgtcgccatcttccactagtccgagcaatttctctcatctcttccaatccttttctccctcttcaagattcgacgctcggtttccttcccccccccccccccctgcaaatatcggcctacagggctgtgatgtggttctcacagcagccaatggatcctaccttataatcaaagtgcatttcaagtctgttgattgtttaccatga

SEQ ID NO: 11419 - DNA, 339 bp, A.fumigatus
cccaaccgcaacttgacatcaattcccaagtccatcctaccgcagccgaaccaccaatcattgacgatcaacaagtatatacctgtctctttcgtcgaaatgtcgactgtcaagattaccagcgacgttgcgtcatatctggctttactccgatcgtatctagccagcgatgacatcgcttcagctcgacttgaggacaaagaaaatcaaggccactcaaaatcaggccagctgcctgcaacattacaacagccccaaaagccacgagaatgcaggccatatgaacaagtccgagtcaagggctctactgcaaacaaaaatctgtcccagcttcggtag

SEQ ID NO: 11420 - DNA, 375 bp, A.fumigatus
gccacccctgatcgcaaacgagaatgctttcttaggcgatgtgtactcgaggtatttgaatctaccgattctcccaccatggaaactaacatgatctcctccgcaagcgagaaagagaaccctgacaagcccatctcggctggcttataccgcctggaaaaaggaaccccgctggtgtatgaatacacctacgatgagatgaagattatccttgaggggcaatttgaaattgccgacgaaaccgggcagaaggtgacggctttgccgggggatgttttttattttcccaagggggcgaagattacgtttaccacgcaaacatatgggttggcgttctatgtgagtttttctttcgttgtggtgctacccttttag

SEQ ID NO: 11421 - DNA, 549 bp, A.fumigatus
ccagaaatgccctcagaaccagctagtgatttggccaagcgtgtattgatactgctagctactgttcctccgggttcccgaacgataatcgttcagatgtttcctctgatagcagctggatgcgaggccgaaccaggagaggatcgccagtgggttttgactcgatggagggcaatccaatcccgtctcatgatagggtccatcgatcgatgtattgaagtagtccaggaagtttggtctcgccgtgatgccatcgaggcagagaagcaacgacgccaggagcgtgtgctcagcagttctagtcggcagagcaaaggcggaccggggttaagctcccagggaacgagagaacaattcatgagcagtcccgccatcccttccgacttagcagtgtcgtctagacccccattcgtaggcactcgaagaagctcggctgtatcgccactggaaaacatcgaattcgagaagacagtcagaggcagattacattgggtcagtgtcatgcaagaatggggatgggaaggtgagtctttatcttgttccgtttga

SEQ ID NO: 11422 - DNA, 2163 bp, A.fumigatus
gaagacggccagcaagcggacgggttgcgttcccaagaagcaggccagctcgtggtgcctgccagttcttcccaaatgaatcaacagccatacactgctcctcagaacatgtttcaagtgggccagcagatgggtcaagggggtcagaccaacctcaatggcgcctctatcagccctcagtttctcgcggcacagcacctgcagaatcctcagaacgtccagcaggatcgaaatcagcaggcggcacagttccagcctcagccccaagcgcaaacccaagcgcaagcacgagctcaagcagcccagaaagcgcaaatggcgatatcgcaagcagggcaggctaatccacaaatgcagcaacaactatctcaaagccccgctatgccgatgttgaaccgtcccatgccgcctgggcagatgtccccaaggcaagtggctgcacaagtccggccgccgtcgcgggctcccgggatgggacaacagcccaatggcgtgcagggtcttgcaggacagcccggaatgcaaagtcgaccccagattccccctggtctgccacccgcggcgcacgaacagctggctcaaatgacccctgaacacctcaatgcttttcttttaaatcagcagcgccgtgctctcgcaaataaccaagctctcgcaagagcaaatgctggtcagcaaccgttgcccatgcagcagaatttgtcgcaacccggccagaatcagcagatggtgaacaatcagatgggtaataatcagaacatgcgcgcgtctctcggactgcaacagcaactggccggaatgaacaatggacaaatgcccaatcagatgctcgcggggcagcagatgtcggctcagcaacggcaacaacaacagaggcagcacgacttgtacaaactgcaacttctgcggcagcagagtgggagcatagagatgacgcctgatcaggtcaaggagatggatcgcattcaattccctcctgcgatcctagctaacaacccgaatatggtttccccagtcccgaagcatatcaagacctggggtcagttgaaacaatgggtggccgcaaacccgcaagctcttgggggagttgatttgcagaaactcatgactttgcagaagctacatcttgcccagattgtagctcaagggaaagaaggagccgtccgtaacgtagatcagaatggccagggcaactggggacagatgatgactttccagggacagccccagcagtttgtgaatccacaagcgtttcaggcgggccagcagcaagtaccaatgaacatgccggcgttgaggccggtcaccgccactgaaatccaaatggctcgccagcgcttgggtgctcaagtggccaactactccgacgaccagctccgcgagatcatccttcggaacaggcagaaacaactgatgcagatggcccaaagccgagcagcccaggctttagccgcgcagaatatgaaccaaaaccagcagaaccaaacggtgcaacagcctccattgtcaggcccttctaccaatcctcaggcaaagcagggtcctcagcagcccaccccacctcaaaaccaacaaaaccaaactgtcaaggctcaaaatacggcggctgcgaagggtgtaaagggctcggctcccaaacagggcaccaagcgcaaatcagccgctgatgagcctacagaagcccaagcagcaccagtctcaaagacagcccagcccactactactcaaggaggagtatcggcgccgccttctagacccaatatgactatcacgcccgagcaactggctgcaatgacccctcagcagcgcatgcagttagcgcaaatgcgtagacaacaaggtcaacaacggcttccgatcagtcgagcagcggcggaggaagcatggaacaacctacccgagaagattcgacagctctacaacgatattgcgaagaatgcgcctgcagcggaacctgttgccctttcaccggagcagaaagctgccatgacccagcaacttcgtgaatgcaccgacatgcttggtagaatggacgctcttgcccaatggttctcaaaaatccctggccaggagaagaacgttcgcagtttacttgcaatggtatgtccgcagtcgaccctggaacccgctcctcccgggatttacatactaactcaatcttga

SEQ ID NO: 11423 - DNA, 1023 bp, A.fumigatus
cgtatacaattaatgaggcaatttaaacccggtccggactggacgatcaatgaccagtttaccattgctccagaatatcttagcggcaccatcaattacatccgaaagctgttccacgctatgatcactcgggtgaaccaacagcaaaatcaacctcctggccaccggccgagtagcgtgccacaaggatcctctaccatgccgcagcccaatcaaaacaatatgcctgctctaaatgcaagtaacttgcagcagcttcaacaacaggaagaggctctccagcgagcccgaagagcctcaagccaggccgcttcggcaacatctgcagtgccgcagccaccttttggagcgccatctccccaaggagttccacacgtttacggtccgggaagcattccgcccgagaagttgaagattcctccttcgaagaaaaggaagcagtctcatcctggcgggactccaacccaaggtcaagctcctggcacaccagtctcgaagttgcaggcggctaagcaggccgtgcctgaggctaagccagctggtctagtcctgggtggcccattcaagtgcagcgttattgagtgtcagtatcaccatctcgggtttgcgactcaggatgcacttgataaacatgtcggagaaagccacaaggtggaggagccgatcaacgatcctctcgagtttgccattgaaagcttccacactagtcttgtgaaggacgaagagggagcccaacctcaggatctcacgaaggaccttcttaccaccggtatcgtttcgtcttccgcaaagcatgaagtcaagggtgaaccaatcgctcctaataccaccggtgtgggtcgcgcgcccggaccccttggcactaagcccgcttctcctggttcgactcagcagactcctcgtacaactgcggccaaagttcccaccttgtcggcgctcaagccaagcccgagtaaggatggtaagaaggaaactgtaaagccggtggatcagtcttccgccggccggctggaaggatacgaa

SEQ ID NO: 11424 - DNA, 288 bp, A.fumigatus
ttctcgcgcaacgactgcgcaccagccatcactccatccaaccacgccctttactccgatgcatacttcctcgtccactcccgggcaatctcctcgtaccgcttgggatcattcttgtattgctccgcgatccgtccttcaaccgcatcgtccggcatgggctctttgagcaactgccgcgcgaactccagcacagccgaaatccgcgagctgggtttccattcgtcgggccgtagcatgcctagacacatactccccttgtcgtcattggtgacattcggatggtag

SEQ ID NO: 11425 - DNA, 318 bp, A.fumigatus
aaaggcaaattccatgtcaagctcgtccttcccaccgagtatcccttcaaaccgccgacagtatcgttcgcgacgaagatctaccatccgaatgtcaccaatgacgacaaggggagtatgtgtctaggcatgctacggcccgacgaatggaaacccagctcgcggatttcggctgtgctggagttcgcgcggcagttgctcaaagagcccatgccggacgatgcggttgaaggacggatcgcggagcaatacaagaatgatcccaagcggtacgaggagattgcccgggagtggacgaggaagtatgcatcggagtaa

SEQ ID NO: 11426 - DNA, 222 bp, A.fumigatus
tcatcacataatattccccgcaattcccgtgctgtgatggacatcgaacacatcaaagccgccgattcggcctcggtggaccagagcgtgcaggatgcgcgcgatctcgccacaatggggcacgaccaggccctgacccgcaagttcgatctgtggagtatgctcgcgctggcgttttgcgtcctaggtattcccttgccattgccccttcttactgcatag

SEQ ID NO: 11427 - DNA, 1236 bp, A.fumigatus
  unsure (642): Identity of nucleotide sequences at the above locations are unknown.
ttgcgagtaggaacgtactcgactttcgcgcagggcctcagcagcgggctgaccaacggcggtcccattacgatcctctggggtctggtcctggtgacggtctgtaacctttgtgttgcggtgtcgctgggcgaattgacgagtagcatgccgacggcgctcgggcaggcgtactgggtgtacaggctgtggcatacgccgacggggcggttcgtgtcgtacctgtgtgcgtggatcaacacgttcgggtggtggacgctcacggcgtcgcagattgcgtttatgaccgagtttctgctggggatgaaggtgatgtttgatgagaagtggggcggggccggggtcggctggctgcagtttgtgatttatctcgggctggtgttggttctgacgggggtgaatgtggtggggtgtcggcgggagaagatcctgccgtggctgaatgggtttgtgggagtgtggttcaccgggttgtttgtggtgctgtcgcttgcgctgttgatttcggttggcaccaaggcggacctgtcggttcagccagggggggttgtctttggggcctggatgaaccagacgggttggagtgatggggtcgtgtggtttacggggctggtgcaggcggcgtatgggcttactggcttngacgcggtcatccatatggtcgaggagatgccggctccgcggatcaacgcgccgagggtgacgtatctggcggtgctgtcgggtgctgtcacggggtttggcttcatggtcgtctgtctgttttgcatgcaggatgtggataggattgtggactcgccgagcggattgccgtttatcgagctgatgctggagacggtcggcctcaaggggggcgctgctctgatcgcgctgttcatcttcaatggagtcggccagggcatcagtatcctgacgactgcatcccggctgacctgggggtttgcccgcgacggcggtctcccctggagtcggtacctgacagtggtggatcccgcgtggaaggctccggtccgcgcgctctgggcgcagggggtcttgattgcgctcgttggggtgctctacctctttgccaacacggtcctcgaggcgatcctcagcgtcagcaccatcgccttgaccatctcctacgcgctgcccattgcggtactgcaacgtgtgggccgggaccagctgccgcctggtccttttcgtctcggccgctggggaacggcagtcaactgggtcagcattgtatag

SEQ ID NO: 11428 - DNA, 453 bp, A.fumigatus
cggcgcaggggctgcacgggcgaggcgacgcatgtcacggtccacacgccctactcgactgtgacgctcggggcgccgacggatgcgaggactacgcgtacgagtacgaggacgactacgacgacgacggagcagatgtttactgcgatttcggtgacaaaaagcgcgactgcgactgccactgccactgccactgccactgcaaccgggtcaagaagcacgaccacgagggagactgagactgcgactgagggtgaaacgggaagtagcccgcattctcatcttgtatcggtattgagcacaagtgtagcggccgagaccacgtctagtactagccaccgtagtgccgcgaccacggcagcattctcgccgaataacaacggagcctctgctatgggagtggaagcgcccgttctggctgggatggttgcgttgggtgcggttttgttgtga

SEQ ID NO: 11429 - DNA, 1293 bp, A.fumigatus
  unsure (598): Identity of nucleotide sequences at the above locations are unknown.
agactatacaatgctgacccagttgactgccgttccccagcggccgagacgaaaaggaccaggcggcagctggtcccggcccacacgttgcagtaccgcaatgggcagcgcgtaggagatggtcaaggcgatggtgctgacgctgaggatcgcctcgaggaccgtgttggcaaagaggtagagcaccccaacgagcgcaatcaagaccccctgcgcccagagcgcgcggaccggagccttccacgcgggatccaccactgtcaggtaccgactccaggggagaccgccgtcgcgggcaaacccccaggtcagccgggatgcagtcgtcaggatactgatgccctggccgactccattgaagatgaacagcgcgatcagagcagcgccccccttgaggccgaccgtctccagcatcagctcgataaacggcaatccgctcggcgagtccacaatcctatccacatcctgcatgcaaaacagacagacgaccatgaagccaaaccccgtgacagcacccgacagcaccgccagatacgtcaccctcggcgcgttgatccgcggagccggcatctcctcgaccatatggatgaccgcgtcnaagccagtaagcccatacgccgcctgcaccagccccgtaaaccacacgaccccatcactccaacccgtctggttcatccaggccccaaagacaaccccccctggctgaaccgacaggtccgccttggtgccaaccgaaatcaacagcgcaagcgacagcaccacaaacaacccggtgaaccacactcccacaaacccattcagccacggcaggatcttctcccgccgacaccccaccacattcacccccgtcagaaccaacaccagcccgagataaatcacaaactgcagccagccgaccccggccccgccccacttctcatcaaacatcaccttcatccccagcagaaactcggtcataaacgcaatctgcgacgccgtgagcgtccaccacccgaacgtgttgatccacgcacacaggtacgacacgaaccgccccgtcggcgtatgccacagcctgtacacccagtacgcctgcccgagcgccgtcggcatgctactcgtcaattcgcccagcgacaccgcaacacaaaggttacagaccgtcaccaggaccagaccccagaggatcgtaatgggaccgccgttggtcagcccgctgctgaggccctgcgcgaaagtcgagtacgttcctactcgcaattagcccgtccgccactatgcagtaagaaggggcaatggcaagggaatacctag

SEQ ID NO: 11430 - DNA, 534 bp, A.fumigatus
ccaggcttgaaaaacaaaaaccttgataggattacaagatcttgggaaaatgaagaaggcggaagatttcctcgaacaaaaccagaacttcgcaaaccaggagatttctgtattcctcggctacggggtttgagctttccagaaaggaccaaatccaccaaaaagcacctggccgaaatgtgtacccttcagaaaaccagcataaacaaccaattttacccattacaaaaagttgataacgcccacgaggtaacagaagcctccagcaaatcgttcgtggtcgtccacctcacatataccagcgggaacgtcgagtcacgggtcctgtccgacctgtggcgtcaactagatatgaaatacggtgacattaaattctgcgagatccgcggcgatatgtgcattgaagggtacccagaacggaatacgccgacgattctggtatacaaggacggagaaattaggaggcagcttgtcacactacgggagctcaatggacccaagactaagcttgaaggtgcgtttactaatgattaa

SEQ ID NO: 11431 - DNA, 750 bp, A.fumigatus
ccatgcggagcctggatccgtcgaagccggcgacgaccaacttcagcatcggagcagcagcgaagaaaaggacaatttgactccagcacaaagcaagcgcaaggcacagaaccgagctgcgtatgtgattcattcgttcctgtgaaagtgttagggctgcaatacatgcccgcgctgaaagcatactgtggaataagagcgactgacatatcccccatcgatgccttcagtcagcgagcgttccgcgagcgaaaggagcgccatgtccgcgaactggaagagaaagtcagcgcactcgagcaagaatccaccaccctagccgccgataacgaacggctgaagcgggagctggccaagttcgcaactgagaatgaggtcctacgggctaccacgggccaattggcgagctcgcaaggccgtcatctggactcggagccaaccatcacaggtccgatgaagtacacccctactgacttttacacgaacctcgtgccgaagggggagccggcgcctacacatcgagtgacggtctgtgagaagacgggcgagaggctcctcgatgccggggcgacctgggatctgatccaggggcatgagctgtacaagcagggtctggtcgatatcggggatgtctctaatcgtttgaagggaatggctcagtgtaatggacagggtccggcgttcagggagggccaggtgctccaggccattgaggcgagtgctgcggcttgccgcgatgaattgatatga

SEQ ID NO: 11432 - DNA, 192 bp, A.fumigatus
agctgccatcatacccaccaacccatgttgttccgaagtgcttttaatatctacatctacatctacatcttcatcattatgattacgcagaatcatgccatgctgcttagaagctggtgtcaattattgggagcggccaaattaacggttgctttgcatctatgttattctaagttgttcctttccttgtaa

SEQ ID NO: 11433 - DNA, 1128 bp, A.fumigatus
ttacgcctccgcggatccttccagccccgtggtgaagactctgccggcgaacccgttatccctgcagctcctccgaaaacagaagcgattcttacaccccttcagcaggctatgcggcagaagttgatatcttcccgtttccgtcatctgaacgagacactgtatacaacaccctctaccaaggcccttgaactgttcacctctaaccccgagcttttccatgagtaccatgcgggattctctcgccaggtcaaagagtcgtggccttccaaccctgttgatggctacattgcggctatccgcaagagaggaggcgtgtcgtcaggttccaagaagggcaacaaacctgaccataagaagaatgcacaggctttgccgcttccccggagacctaacgggctctgtacaattgctgatcttggctgcggcgatgcccaacttgcgcgggctttgacaccctcagcacagcaattgaacctgaagttgctcaactttgacttgcatgctccacaaggctcactcatcaccaaagcagacatatctaatttgcccattgccgacggatccgtggatgtggctattttttgtcttagcttgatgggcactaactgggtctccttcgtggaagaagcgtggcgggttcttcgcagcgatggcaagggcgaatgctgggtcagtgaagtcaagagccgctttggcaaggtcgttcgcaagaaagctcagattggcgcacgcaaaccgcttagcaagtctgagaagaaaaagcttaagaagaagcaagcgggcgaggacgatgctggctccgatgtagacgatgcagatatctatgcagaagacgctcgtaaggccgacgatgacgaaactgatatctcggccttcattgaagtgttccgcacgcgtggcttcatcctcaaaccggaatcggttgacaagtcgaacaaaatgttcgtgaagatggaatttgttaagcaaggtggtgccccgactaagggcaaatatgcctcggtcgcttcagcaggaggacccgggaagaaaagattcatcgacaaagcgactgatgttggcgctggcatgtctcctgaggaagaggcacgtgtcctcaagccttgtgtctataagactcggtag

SEQ ID NO: 11434 - DNA, 324 bp, A.fumigatus
ctggttctgccgttgaatcgtactaatctgggtttacggttcaggtatcacgccgagccatctggcacattttacagatatgatgcaaaggccattgggtccggaagcgaaggtgcgcaggcggaattacagaatgaataccatcgttccttgacactgcccgaggctgagacactggtattgaaaacactgaaacaggtcatggaggagaagctggatgcgaagaatgtccagctggctagcgttactaaagagaagggctttcatatctacaatgacgaggagatgggccgggctgttgcgcaattgggcggtaatcaataa

SEQ ID NO: 11435 - DNA, 414 bp, A.fumigatus
gtagctacctcggaaggtgtcattctaggagtggagaagcgtgtcacatctacgcttctcgaagcgtcgtccgtcgaaaagattgtcgaaatcgaccagcacattggatgtgccatgtccggtctgcaggccgatgcccggtccctcatcgagcacgcccgcgttgaatgccagaaccatgcctttcactatgcagagcctctgagagtagagagcacaacccaagcgatctgcgaccttgcacttcggttcggcgagaccggtgatgacgatgaaagtgtcatgagcaggccctttggtgttgccctattaatcgcgggttatgatgaggatgggccacaactgtacgttgtacactcgcagcatctcacagtcatgtgttctaagccgcccgttgactggttctgccgttga

SEQ ID NO: 11436 - DNA, 1002 bp, A.fumigatus
agtccgatggatgccaagaacccctatacccagccaacggcatgttctcctgccggcggccacgagcaggtcttacccatgctaggtaaaccagctgcttgggattccgccattcctactacctcgaatacttcaggtggtactatctttaataattataattatcctcatcatcaccaccaacagcaacagcctcaacttgtccatcacccttttgttgccgtctcgtcggctgggacaactactgttcctgctgtcgctccctcgtcatcctccttatcacataaccccgacgaatccgtagctgcagcatcgcgctctgccgactcggattcaaaaaatcgtcaagatgtaggcaagggcgccctctcgaagcttcgcaagactcgcaaaaccaccaatgcgtccaatggccggtcaacgttgttctgggtccataccgatccgcagtcggtctcagaaggaacgcgagaagagacgctgaaacgtattcgctcccatgtgatgtcggagcacaatcgcaagaagagattggagaacactaagcgttacaagagcaagacatggaagcatcttgcatttcagcctgttgagaccaccagctccaattcctccagcgcaactgcggcatcagcgcctgctccgagttcggcctcgtcgtctccggcattcgaacagaatactaccacctcttcacccaccattccctccacacagcacgaccaacgggccgaacaggaacacgatcaaggtcaaccacagatcaaggaagaggagggacaatttgagcttgctgtcacgaagaggaatgacaacgtggagagctacggcgtcggtgcgccttcacagactcaatcagttgaccccgaacaatcaagatcctctcccccatgggatggattaggccaaggagggaaagatcccttcaatactttgcatacgcctctctcggataggatgtaccgacatctgcagcactgtaagccaactcgtctgagctga

SEQ ID NO: 11437 - DNA, 1563 bp, A.fumigatus
aggagggatgggtccagttccataagatacgaagggctcgccgatgaaaggagctactcccggacaggaaaccggggagcgacgtcgaccgagccggaaaagaaggacatccagcaggagaccatggacatcaaggaattgatgaaggtactgccggatgcgagatgtattgccgtctatcccgtctgggactttcagcggggccgctggttcaccgtctgcgtggtatgggccaatgacccgggcagagtgttgttcgaacccaaggacttgacctacctggcggcctttagcaacaccgtcatggctgaggtgtcccggctggatctggaggccgccgaccgagccaagagcgacttcatttcgtccatctcgcacgagctgcggtcgcccttgcatgggctgctgggcacgatggagttgctgcaggcaatggtcaatagctacgcgcagaagtcccttattgagacggtctacagctgcggtcgtacactgctggacacattgaaccacctcctggattacgccaagatcaacacgctgactcggccgcgtccatcagagaaggctatcgcgcaagggagcgacatgtctcagccccagagcgccgtgccggggtctcttcagatcgagaacctgagcgtgctggtgcaagaggtcgtggaaggtcttcttgccggcgcagagtatcagcgacgcggcgccagtggggatagtgacgcgctggccaagaaggaggatctcggcctcaagaaccatctcatcacgatcgtcgatatcgagtggcaggacagctggcgctttagtgtatatgccggtgcctggcgccgagtcgtcatgaatctcttcgggaatgcgctcaaatacacccaggctggctacatccggctgcggatgagacgggacaccttgctggtggatggcaagagaacccctgcgattcgcatgaccttcagcgactcgggccgcggcatgtccaaagactttctcacaaatcatctctacagcgcatttctgcaggaggacacgacctccccgggcctcggagtgggtctgcatctggtccatcaaatcatcaagtcactcaagggacagatcaagttcgccagtgaagtcggcaagggaaccgacgtcgatgtcgtgctgccaatcgaactgcccgaggtgcccagcccttcctcccctcgctccttcgcctccttgaaggagcggctgagcggtatgacggtttcgctattcacgcggagctccaagttgggcgatctgggattcgacccgcgggtgttcgaccgcatccgcagcagcctcgggcgcatggtatccggctggttcggcctccgcgtcctgacccctgacgagctcgattcgaccaagcccgattttgccattgtgacggaacacgagtaccgcaactactatgtcaaaggcacgaacgagcccaagccagacagcggcgagatccagcctgcactcccgttgattgttctgcccgcccgcacgagtagctggaaaaccttgggcgagagcgtcgaggattcggtcattttcctcacccagccgtaa

SEQ ID NO: 11438 - DNA, 819 bp, A.fumigatus
ggactctcaaggagcctcggccacgtgatggatcatctgctgtgtcagcgagcgatgcgggaggagtaccgtgaagagcgcatggtgcgggcgctgggattgttcgtcaagggcaagtcggatctcaatgagtggtttgacagtggcgatgcgcgcgataagaaatacggcgggcagatgggtcttctgaacaagagactggagaagcgacaggttgcgaggtctactcgcgaggatagccagggcgccagagacaacaaggatagcaaggatgacaaggatgacgatgctggccagtaccaggacaatgaattgtcagaggctcgctcaaaacacaggcgcggcatgcatggatcccccgtccaaaggttcaaacaaggtggcgagcacgaggcagacgaagcagggaacgacgacaagcccgacgaaaagcctcgcaagaagcgaccaacgctctctcccacgactagccaactgcaggattctctagcgcccaccaacgtccggtccgtagtcaaccgcgccgcttcgatgatctaccaagccctcgacgtcgaaggcgccatgttcatcgacgctagcgtgtacgcccggcggcagacagtgggatttaccaaatctaaacttgataaccctgaagcttaccacggccagcaatccccggacattgccggcgcagaggaaccggccccatcgatatccaaccccgagtctcgttccgataccgacgcttcggacgacgactcgcagtcccgaagtctcgtgctgggtcattatacctcgactacttccgaggctggagtcaacctggaacaataa

SEQ ID NO: 11439 - DNA, 216 bp, A.fumigatus
gctttcttcgtcgccatcattttcatcacgctcgagatctgcttcatcaccctcttctccatcttcgccttcaccttcttctaccgtggtctcgcctcccccttcagcttcgttcaggtcagcatcgccatccccaacctcatctgccgcgtcaccatcaatgctggcaggcacggacatctccgaatcaggatctggcgaaatacgatcccgtag

SEQ ID NO: 11440 - DNA, 312 bp, A.fumigatus
tttgcgctctgccgcaagcttcgacaacttctcatcatcaatttcgctgagctcgctctcatcgtcggcgctatcttgaatgctctgcgggatatcgctctgctgacccatttcgaaactggtcttgttgggctgatttccagaaggcgcggcaggctcagatgtagcgggtggctcggattccgcaggcacagatgcctttgcagccggcgcgcgcggggtgagtttgcggccgacgatagtttcggctcgcttttggacgtcccttcgggcgatgcccttggtgcggcctcgaggggcgggcgcttctga

SEQ ID NO: 11441 - DNA, 468 bp, A.fumigatus
cacactcagattggccgcaatgatgaacatcttgataagaagattgaattgttgtctcgtggcttccaaggtaagaacgtcacccacgaccacattgcctcaaactcggctaacatctataacccagtgtatgaagaccccggctcagctaccgatcagcgagtagaagaactggaactggagaatgatcagctgcgaagcaggattgctgccctcgaacgtgaactcatgggccgctcacccaccaagaagccgaaatctaagaacgcattggagccttcgcatggatccaatcaccttggtcgtgaaagtgacatcgagagcgcactccgtcgtatggaccagctgaaattagctgacagcatgttctctcctgccacttccggcaactcatcccccagcaagaagcacagaaagatggcaactcgcaagtgggattttgcccctgaggaagatatctacgtttaa

SEQ ID NO: 11442 - DNA, 489 bp, A.fumigatus
cagttggagcaaggtatgcgatgttgctggcgcagacactgtgctcatgtctccatgggctcaggctcggaagcattctcttttggcggatcaccctcgatgacctcgggttcttctgcctcgtcttccatatcttgcgcgttttctgtgtcttccccgttaccttcgccttcttctaggctttcttcgtcgccatcattttcatcacgctcgagatctgcttcatcaccctcttctccatcttcgccttcaccttcttctaccgtggtctcgcctcccccttcagcttcgttcaggtcagcatcgccatccccaacctcatctgccgcgtcaccatcaatgctggcaggcacggacatctccgaatcaggatctggcgaaatacgatcccgtagattggggaagagtagtttgcgctctgccgcaagcttcgacaacttctcatcatcaatttcgctgagctcgctctcatcgtcggcgctatcttga

SEQ ID NO: 11443 - DNA, 690 bp, A.fumigatus
ccgccttttcagccagcggaaggaagccaaactctcatggccacccccttggctcgtaaagtccaacctcctgaagacaaggccggatggaaaccatacattttggaggtactccggcgcttgaagcatgcggataaatcgaattggcatcaccgcatggctgttcgggcagcacacgtcacctacgatgacaccagggacactgtctcagcagcagcagccaaaaatgaacttacgcagcagatattcaccaagactatgactattcaggtctggaggcctgagttcgagcgtcctggaagacatttcgtgtacactacccgatatgtatacttcttcgttagtctgcttgatcaactcaatgaccgagccaatctggatcagctattgcgtcgcgtgagaaagaagcaaggtgacttcatcaaccacaccaagctatgggaggatgtctgccttacctacgcaaaggtcattcgaagagcaggcagtatcaacgagggacatgaagagaatgtattcaagccaattggatgggaagaattcgtcgccaacacagcccgcctgggagaatcttccccagctagcaccgggcagccaagttctactggaactgcttcgcgacgctatcgaactgaaaaagctcaacaacaacctcatgaaagtgtctttgctcgaagacctcatcgctga

SEQ ID NO: 11444 - DNA, 1116 bp, A.fumigatus
gaaagaagcaaggtgacttcatcaaccacaccaagctatgggaggatgtctgccttacctacgcaaaggtcattcgaagagcaggcagtatcaacgagggacatgaagagaatgtattcaagccaattggatgggaagaattcgtcgccaacacagcccgcctgggagaatcttccccagctagcaccgggcagccaagttctactggaactgcttcgcgacgctatcgaactgaaaaagctcaacaacaacctcatgaaagtgtctttgctcgaagacctcatcgctgatctatactctcgcctctacgagatcaacatgccccaagtcctcgagcaagccaacgaggagaacaaagagaaaatgaaagtcgaccacctcctaatggccagcgacggagcggcagatacccccacccctccgaactcggcccctgcctcagaagcgcccgcccctcgaggccgcaccaagggcatcgcccgaagggacgtccaaaagcgagccgaaactatcgtcggccgcaaactcaccccgcgcgcgccggctgcaaaggcatctgtgcctgcggaatccgagccacccgctacatctgagcctgccgcgccttctggaaatcagcccaacaagaccagtttcgaaatgggtcagcagagcgatatcccgcagagcattcaagatagcgccgacgatgagagcgagctcagcgaaattgatgatgagaagttgtcgaagcttgcggcagagcgcaaactactcttccccaatctacgggatcgtatttcgccagatcctgattcggagatgtccgtgcctgccagcattgatggtgacgcggcagatgaggttggggatggcgatgctgacctgaacgaagctgaagggggaggcgagaccacggtagaagaaggtgaaggcgaagatggagaagagggtgatgaagcagatctcgagcgtgatgaaaatgatggcgacgaagaaagcctagaagaaggcgaaggtaacggggaagacacagaaaacgcgcaagatatggaagacgaggcagaagaacccgaggtcatcgagggtgatccgccaaaagagaatgcttccgagcctgagcccatggagacatga

SEQ ID NO: 11445 - DNA, 186 bp, A.fumigatus
cgtttggatgtcgtttttgcttcgaaatcgccatccgaggcgttcccggaaatcaaatctaaggcacaatactcgaccatccacaaaactcatcgtaatacagtcgcctcgaatatccaacctgtctataagcctggcagggttggctttttgcttgaggcaccacaccattgccaaaatccatag

SEQ ID NO: 11446 - DNA, 582 bp, A.fumigatus
tgtccagaagcaatatgggtaaatgctcacacttgcccctgcagattcatacaaattctcatctatagccaccggaggttactcttggttaccacttacaccatctttctccttatctcgattggttctctaatgattatcaattctatccctgactatggagctcaaagactttggtcagcaatcttttacggcgtgcacttgatctgcatttaccctattctcacggcgctaggtgttctggggatcttctgtcaagctcgtgagattatggttgcaccatttccaaatgcgctgagtctacagggtctggctctgcaagctctcatcttcactcttatctcagtaacatggataccgagtcttccatttccgtatgagaaattggagggtcgttacaattggaatacctttactgtgtggtacggggctgttggttttatcattgttaacagctttatctttgccctcggccaggctgtacttctgttactagccttgcatcgctcctctttgagcaaagccactatacagcggggcactgagacagagccgcttttggggcatccagctgagatgtga

SEQ ID NO: 11447 - DNA, 222 bp, A.fumigatus
ccaggactcaccaggcatcagggctacaaattcatcttgctcgttgcggccgacatttactgggacggacttggaaaatctgtacctgtgatatgtaaaactgccgggaagttcatgtgggctccagtggtcctgttctctgaagtaaagcctgaagcccccctggcggctatcgatatctttgaatatgggcgtatgaaatgtgactggctttctgtctaa

SEQ ID NO: 11448 - DNA, 267 bp, A.fumigatus
gaagatgcagataggcattcattagccaggtcagtaattactacaacatacacctccattatctgtgccgcctccctgtatgacagccggtcctcccccgtcgatctgacaaaactccagaagggcattgaggtgcacctatatgacgtgcaatgtatacgcccatctcgatcatgttcaatattgcagttccttcccttgtcgaggcactggaaagaagctcagcggtggatacgacctcgaagtggttctgcagagccaaggtga

SEQ ID NO: 11449 - DNA, 384 bp, A.fumigatus
catcgacaggtgagctttgccttgcttctccttcaggtcaagttgaagaccactttgggaagtgtatctgaccgtagtagacatggaatcggccgcgtggttgaaatggcgctcgctcacatcggcaacgacacccccatccatctctcgttcgacgttgacgccttggaccctcaatgggctcctagcacaggcactcccgtccgtggaggtctgactctgcgtgagggtgacttcatctgtgaatgtgttcacgagactggcaatttgatcgccatggatctggtagaggtcaaccccagcctggacgaagtcggtgcttcagagaccattcgagccggttgctctttggtgcggtgcgcactgggcgacacactgctgtga

SEQ ID NO: 11450 - DNA, 297 bp, A.fumigatus
cacccaactatctttgtttccccaaacggagtccctctcagaatcaacgggttattcctacgagtgtatcgctctattcctccatgcatcgtcactaagtcctatctcgaatacactactccgcacctcccaccaacaatggccgcccgcgtccagcgccgccgccgataccgctggcccgaactccaactcaacatctggatcatcatcgtgctcgccggctccgcaatctgcctaggcatcttcgcctggttcatggcggtacagtcgcagctccgtctggggactccatggtag

SEQ ID NO: 11451 - DNA, 588 bp, A.fumigatus
  unsure (108): Identity of nucleotide sequences at the above locations are unknown.
tgcaaagtaggcgtcgaagcagccccgctcgcattgattgaagccggtcttttgaatcaagtgcgcgacgacctgggctatcaacttcactatgacgacactgtgcantactacgagagcctgacccccttgagcgaccccgaccaccggggcatgaagaagccgcgcgccgtcagcgtcgtgacggagacgctcagcaagcaggtctacgactacgccaaggacggcaagttcgtcctcacactaggcggcgaccactcgatcgccatcggcactatctccggcacggccaaggccatcagggagcgactgggccgggaaatggcggttatctgggtcgatgcgcatgccgatatcaacacgccggagatgagccccagcggaaacatccacggcatgcccatggccttcttgacccggctggcccgggaggacaagaaggatatcttcgggtggttgcaggatgagcacatcatcaacaagaacaagctggtgtacatcggcctgcgggatgtggaccgcggcgagaagcagctgctgcgggagcacggtatcaaggcatttagcatgcatgacatcgacaggtga

SEQ ID NO: 11452 - DNA, 501 bp, A.fumigatus
  unsure (12),(300): Identity of nucleotide sequences at the above locations are unknown.
gacatagtgcgngacctccagcaggaacaagaacggccagtactcgtgggggttttgcccggaatggctggcaactgggtgctgcacgagttgggagccttttgcaccaagccgaacttggcttgggatgcgcaacgagtacctgctgaaacctttgcgcaaatcatcgatcagctgcagcgaaaacgcattacgggggctaccgcaaagcaggtgctcgcgatggtcttcgatggtgatcgccgacctgatcctcagctcctcgaggaagaaaatttactccttcggccgctgtcccgngacgagtaccttgctttggcggaagccgccatcggtcagaacccgcagatggtcgagcagatccgcgccaagaaccagctgggtaagctaggctggtttgtcggacagatgatgcgcatgggcgagaagggccgggtagaagctcagaaagcggatgagattctacgagagctcatcctcggaaagtctgaccagccgtag

SEQ ID NO: 11453 - DNA, 363 bp, A.fumigatus
attgacttgactctcccatttcgagagtcactttcactctcattttcccatctcttcccagctatcaatagtgttgcagcttgtacttggaaccgaactgactcgcggcctgaggcatctcatctcggatctaatctccaccgcgcgcaatctttatcttatcgctttagttcttctagaacagtgtcttttttccgttatcaagccttgatctttgctctggaccttaacgtcgttatacaaattaaatcctccccactcactttcaaaatgacagcgccgtcgactatcaagcaaagattcctgtccaagccaaatgagctgggcgtggtcgctgtcggatttaacggtggtcaggtatga

SEQ ID NO: 11454 - DNA, 1332 bp, A.fumigatus
atccttcgtggtattccagctgcattagtccagttgagcgtctggcaccgagtttcccataaatccagcaacgagaaactggccaacgtgttcgtgtccgtgttcactaccgccatgccgtctattcaggttggccttgccgtgggcaatggcactggtcccgagctgacagtcatctttgagcgtgttattcaatcgctggctgctcgctacaatgtcagcgtcaccttcctgcgttccccacgcatctacaattcctactcctcgctattagctatcaacgacacggacgccgtgacggaagaaacattggcagacgctgcccactatcgccaattctgcagagaagccgtcccatgcggcgtgcgtgcgatattccgcacttcgatcagcgcgcaagccctctatctcgtccgcgagcagctccaagcgatcaagatcgaacacttcactctgagtcccacctcgtcgatcctcctcgtccgcgaccaggcacagggcttctactcgggcaccaacagcgtcaacaccagcaaggatgccgtctcccgcaccgcgcacttcagcaaggcggtcttcacccgcatcctctccttcgcactcgtgcgcgcgaaccagctctggggaggaaccaactcggtcaccatggtctacaagttccacctcttcgacggactgttccacacctgggccacagaatgggagcggaccttcggcgtccgtatccggttcgtacagggggacaccatgaaccgcgatctgctagccttcggggtgagcggccacaatctactcatttccggcaacgagtacgcagacatcatgcagaccatcctgctcgataggtctgggctaggagcgcaggagtccgcctgcgcggagaacgtctatctgcacccggacgtgtggggcctgagcgagtaccagaccgcccacggatccgcggatgatctggtagggaagggcattgtgaatccgacggcgacgatccgcgccgcggccgctgtgctagaggatcaggcgggctgtgcgggtgcgacacagagggtcgatgacgtgttgggggatttgggggccaagggcattcggacgcctgatcagggagggaccgctacgacggaggcctttgtggaggcttttctgcaggggttaggtcagccactggacgcgcacaacggcgcgtcctcctggttttcgggggaagcgaacggccgtggtggtcgtggatttccagaacgattttgtcacccagtccaagaaccaatcggccatggcacgggtggcagcgaacatcccgcgagtggtggaatgggcccgacaggctcgtattga

SEQ ID NO: 11455 - DNA, 648 bp, A.fumigatus
  unsure (525),(574),(609): Identity of nucleotide sequences at the above locations are unknown.
caaggcatccgcaaagcttgtcggcctcttgtcgctctcgtctgtctcaccatggagaccatctcctctggtttccacctcgccgacggcaatggttacatgctcgacaaaggctatgctgccagatgtcgtctgaacctccagttctatctctggaagaactcgttggccttcaacctacacccatcgatccccatcccacatacccacggctcgccgccactgagaattgccgaccttgcctgcggcacaggcatctggctcctcgatctcgcctgtgagttaccggaacccgctgtcctcgacggcctcgacatcgatttgtccaaagccccaccggctcaatggctgccaaacaatgtcaccgtccacaactgggacatcctcagtcccgtcccagaacatcttgtcgggagatacgatatagtccatctcaggcttctgatcctagtggtcgagcacagtgatccggtccccattatccagaatgcgtaccgcatgctaaaacccggcgggtacatccantgggatgatctcaaactacctgatacccatgttcagcaaggcaatccangcgcaaacaccccggcattcgatcggctgcttcanaatttgtccgctccaatggaagaacttgatgggtgctga

SEQ ID NO: 11456 - DNA, 702 bp, A.fumigatus
ggaactaatacactgcagaggccctttctccacttctactctccggtcttcatcctttacgagctctctagccccttcctcaacatccactggttcttggataaagtcaacatgaccggtagcaaactgcaatggtataacggcatgctcctgctcatcgtgttcttttgctgccgcctcatttggggcacgtggcaatcagccgcagtgtacaaggacatgtggtacgctctcaagaagacctggtctgcatcagaatccgccgcgcttaacccagtcgacatcactacggacgttttccagatccgcgatgggtccatctgtgtcaatgaagcctgtgcgagggctcaggcagagatctccaagttctccaaatacaccgccggcggtgtgcccacctggctggttgtgacgtacgtcgtctcgaatatcgtcctcaatgggctcaactactactggttcaccaagatgattgatgcggtcatcaaacgcttccgtgcgcctgcgccggcgggtaaggcgaaggaagaggagctcaagcaggatgtggttatcgaggctgctaccaagctggaaaaggaggagggagctttcaccactggcgatttggctagcgagaagattgcttctgccgtcgaggtagggccgagcgaagagttgcggcagaggaatcctaacgtgcccaccgcagcccgctcttag

SEQ ID NO: 11457 - DNA, 588 bp, A.fumigatus
cgagccctcaccagctggtctgagtcggcagacttagcaaaaacccccaactggggtcaatacgtcgacatgatagaccctattccgccgcctccaaggtggcttcgagacttggtagaaccgtgggccgtataccttaacatcccggccgtaaccgaccatgtccacgagatcatcgccgccttcgcgttctaccagttcatccattcatacctatcaccgtggttgtctccgcggctattccctcgccattacccgaacctcaataatcggacccagctcaactgggatgtccatgttgtgtccttggtacaaagcgttttgatcaatgcggtagccctatgggtgatgtttacagacgatgagcggaagtcgatgagtcccgctgagcgggtttatggatactcgggggcttgcgcgttcatatcggcactggccgcgggctacttcatctatgatctgtacgtcagtactgtctatgtgaagatttttggcatcggaatgctattccatgccgtcagtgccctgtgggttttcagtcttggcttcgtgagtggctcgttatttctttccttgcccgcattctga

SEQ ID NO: 11458 - DNA, 525 bp, A.fumigatus
atcttcggacgggaccagatgtttttccctcagatccccgaaagcatcgggccacacaccagcccactagatccgatcaagcttccttacacgattcgcgtcgacgaagattttcacaaggaccctacgccaacggtctacgacattcaggtcgcagtggaggaccctctacgtgccaaaatgcttgccttgacccaaaaccctcaatatacagcgggattacgccaaattgctgctctagatgaccagctagcccttattgtccaagctctaacccattcgagagccaagcactctttctacaccgccctaagtaaagaccctgccaccttcttgcggcgctgggtcaactctcagcgcagagatttggaaaccatccttggcgaggcaacccgcggcggcggcgaggatggcagtgggccggaattcaggagaggaggagccgagagtgtttgggatacacaggtggccagggaggctgtgcggtacatgcttgccaaaccggatgcagcagcagcacgatag

SEQ ID NO: 11459 - DNA, 918 bp, A.fumigatus
gcctttccatctcatatcaacgtggcgatacttgaaactggcttctctcttcaaattctgaatgctgatctgtctttgcgcatcttcttagattccacatccgtatccgcgcgtactacttccaatcctccgaatggcgatgccgctaccgccgaatggtcctcagccgttggccatgcgaccacaggcaaatctggccgcgtcatacataaccttcaagaggaaatcgcacgtttgacacgcgaatgcagtgtatatcgctcacgcgcggaagagacccagcggatgaacgatgcttttaagatgcaggtacagaacatgaccgagcgccttcgaaaccttgagcacgccaacgaaacgaatctacaatcgatccgacgcaaggacaagaaaatcgaggagttacgggccgaagtacagagcgagaaagaaagacgacgtcgagcagagggagagactgataaattccagcaattgatgaacgaggcccgggacgaattcaatcgaaaatgcgcggagctgcaggagattgccaatcactctcggacacagtacgacgtgcttgcgaaagccggacaacgtgaacgcgcagatcagcagaggaaactgaaagcgatacgggatgatttcctcgccttgaaagcagaacatgaaaaaagagacgtacacctagaacgcctggacacggtcatttcgcagaagaatcgtgaaatcgagataggtagagagagatttgatcagctcttcgaggactacgaagcatacaaaaaggctcacgatgaggaggtgcgggccttgatcgagaggaactatcagggcgcagccaacattgacagtgctctcgcctctctcaaggagactgaagaaaaaatgaaatgggctatccaagtcaaaaacgagattaaggacgcccaatga

SEQ ID NO: 11460 - DNA, 207 bp, A.fumigatus
ggacgcccaatgagcgagcgatacattttacgtataatcaatcctgcagaagaagcaccaaacaagcaagatattcgccttctagggacgcagtccgtggacaaaagtcttcgtggatcctggactcagcgaactaagatcgatcctctagattacttcgtgctgtgccattctgtcttcaccacggggctggaaggagccgcgcca

SEQ ID NO: 11461 - DNA, 285 bp, A.fumigatus
ctacaattaagtacgttgatcgtcctcgtttcatcacttctgtcttcgttatcaacctcctcttccttttcccctccttttatttcggcccccttggtctctctgggtagtatcgcgagtggacagtcgaatgctaacgaagttcttttcactatctacaggtgtgtcgtcgttggtgacggtgccgtgggaaagacatgcctccttatctcttacacaacaaacaagttcccctcagaatatgtccccaccgtcttcgacaattatgcggttactgtcatgtaa

SEQ ID NO: 11462 - DNA, 447 bp, A.fumigatus
cccggattcgcgtgctataggatcggtgatgagccctataccttgggactgttcgataccgctggtcaggaggattatgaccgtctccgccccctttcctaccctcagaccgatgtctttcttgtctgcttctcggtgacctctcctgcgtcttttgaaaacgtccgcgagaagtggttccccgaggtgcaccaccactgccctggtgtgccctgtttgatcgtcggtacccaaacggatcttcgggatgaccctgccgttcgtgagaaactcgcccgtcagaagatgcaacccatccgcaaagaagatggcgaccgtatggcgaaggagctgggtgctgtaaaatacgtcgagtgctccgctttgacacagtacaagcttaaggatgtctttgatgaggttcgtatcggctgcgatgccaatcagataagccatatcggacgctga

SEQ ID NO: 11463 - DNA, 225 bp, A.fumigatus
ccattcctttcagttgccatcatctacatctgcaactcggttggatgttgtcatatcatacagaacccatcaagcaagactgatcgtaacaaaaaaaaaaccccttttattctgtctcgtcatattagtttcatcgtcaataggtatcatcgatctattatttcgaagcattttatccgcctttttgaagagaacaaataccactcgattgtggccccatactaa

SEQ ID NO: 11464 - DNA, 222 bp, A.fumigatus
agctctaagtggcgaatctggctgtactgcatcactagaaaatggattgcgagaggattctatgaaattgacagtatcaacaaagcttcctgcaccgttgagacctttaatatggactatttatctttcgaaggaaccgcaatcttctacatctcagcatcttattctcccattacttcgggcagaagccggatgggagtcgcgccagcgaactctccttga

SEQ ID NO: 11465 - DNA, 627 bp, A.fumigatus
cgttcagcaaaaacaactgctgcgactgaaagtctctttaacaaaaccccaggcgatcggaccacgaggatgtcgtcacgactgcctgacagaacaggctctaagcgaagccgctctcgttccccttcatcaatgcgccagccccaaaaatatcaccgcaaatacgacgagagagaccgacaccgggacggtggaaaatgggaggatggaaacagtcgatcatcgcagccgccggtaaggaacatgcgagaccaggtgcgtctcaatcagttacaggaagacgagcaagtgcgtgaatgggtggcgcaggaagacatgtttgttctcaagcaagcgaaaaagaaggccgagatccgcgtcaaagagggtcgtgcgaaaccaatagattggcttacggttactctgcgagttattgatccaacgcgtaatcctcttgacgacgagattgcggactcagagctggatctggtggaccccgatggtgttttcgaggggttatctcaaagtcaattacttgagctggagaaggatatcgatacattcctgagtctggagaagaactcaaaaaatagggatttttggaaagtaagccctatctgcgtctcgctctcattcgctcgagactaa

SEQ ID NO: 11466 - DNA, 594 bp, A.fumigatus
tcccgctgcgcctccgttcagacaatgaaggttatctgtcgagatcgccagaaagcgactgcccctgaaggacgtgccctcagctccgttgccgctgacatcaatcgattgttaaccccgaaaacatacgagcaactcgagacccttgaggtgcaggtcaggaagaagctggactctaacgagcctattgataccgattattgggaggagcttttgcgcagcctgacggtgtggaaagctcgcgctaaggtgaagaaggtccacagggccgtgatcgatgagcgtgttagagggttgcgcaaacaacaatatgaagaggctgaatctatccgaacgaagctcgctcctcttgcgcccgtgattcagacctatcaggaacgacctcaacagctttgcgaaaaagaaattcgtgatctagatccagagccactgcttcagattcgtccagaggataaagggttggaaatattggatgaaggggcttttctcaatcaagtcgtaagtttcccttgctcttatgtctgtggtcccagtttgttgctgactacgcttgaaggcacgagagctcttcaccagccggctggaagatcacgc

SEQ ID NO: 11467 - DNA, 1383 bp, A.fumigatus
gtacctaggccttgtaaggcacggaaagtcaaatggtatgtttctgtttcctgctacttttcctctgctccacatcatcagaattctccatctgacaatggatttagtgacgaagagaagccatcttgtctcaactgccgccgtcagaatgagagttgtgactacagtatcaggctgaattgggagggtagaacaaggcggaagtcatccgttagctccccaagttctcagtctagtggtcactctgctcatcttgtctctttggctgtgctgccttcagatctcgcacaggtagatccccttgaatcaggtcaaggagagggcagtccacaggagttggctccacacaacacaatttgggccaccgcttgtggatcatctctggtagcgaagacatcgtgctccagggagcttgagaatggccttgaaattttgacctcttctgcttattcagatcatttgggcaatagcttcccatatatgagctatagaactcctccagcaacgtcatcacaaatgaccgattcgatcaactcacggcccgatacgacgccgcaaatgatggcaacgccacaggagacgctttcgcccttcacgtccccagcccttcacggttctggagacgttgcctacccagatgcaagcttgaatatcgggtctcctgctacgctaaacttcccacagtcctccattctatcatcatcgctctcttacctacgggaatccgccaaggagaccgatccctacgtgcgttctttggtagtgcatccgcgtcagacggggagccgaggagagcgaaattcagtcgcaagtggatcgcataagtattttccctttgacaccgatgacaacagccgacaggcagggataccttttccgcgccaccgattctcatgcacacacccagatactgttgataaagattctctcagtgcagtacgaactgagactaccacaaaaactcccggctccgctcctacagacacctattttaccgaggtcatgaatggccccattgcctctgaagactacatatacagcttgcaacgtgatgctgaaggaatttgtcagcgtaatatataccaaccttccgaaatttcatcctcggaacgaaagtggtctgcctacttgactagtgtgactgataattacggcctcgaccatggccgtcccgacttggatttgaatcaaatggacgatcattcggctgtcgacatcaattacgctttagacctgatcattccagaacgccagacccggactactttcgaatcagcatctgccgaccatggacttgcaactagtgttggatgcgggtattatgcgtccccggttcccatcaacattcctcggtacctgtcaccattgcctttggccttgtag

SEQ ID NO: 11468 - DNA, 246 bp, A.fumigatus
cagatacctactccggagtactcctatgatagcatggaattatggacttggatcgactattcctcgcgcgccaccgccagctttcgtggtgctttctcgaccagtagttctatccctgccatctgtaccgatccctgtcagctcgctcatcctggctggcttcttcttctcttgcagcctcttgtgcgacatggttctttctcacttgctgacatatttctcttttctttttctattttggtttag

SEQ ID NO: 11469 - DNA, 228 bp, A.fumigatus
ctggatgcagtcaatgatctcggcccacaaaccaaattccccgtcccggagggtattctcaactacaacggggtcaactatgtcgccgtatcgctttgggcgctcgagtctcaaggggctttgatcggtggtctggaccttgttgcttctactcctatcctgtctggataccgcaagccggctccggcccctcagcctgggtggaagcctcggcggggcgcctactga

SEQ ID NO: 11470 - DNA, 1587 bp, A.fumigatus
caaacattacccagaatgacgtcaaaaggtgaaatcgagagtctctccgcgtatggagtcgctcggtccaccatccaagggaccccgctgagccaggacgagctccgcaagatggatgcgtatttccgtgcgagcatgtatctttgtcttggcatgctatatctgcgagaaaatcctcttttaaaagagcctctcaaggtggaacatctcaaggcccggttactgggccactggggttccgacgctggccaatccttcacatggatccacatgaaccgcttgatcaagaaatatgacttggatgtattgttcatctctggccccggacatggtgctcctggcattctctcgcagtcatacctcgagggggtatacaccgaagtctatccggacaagacgcaaaatgaaaagggcatgcagcggttcttcaagcagttctccttccccggcgggatcggtagccatgcaactccagagacccccggaagtatccacgagggaggcgagctggggtactcaatctcccatgccttcgggaccgtctttgatcacccgaatcttatcacgttgaccatagtgggtgatggagaggctgaaaccggccctctggccaccagttggcacagtaacaagttcctcaacccaatcaccgacggcgcagttcttccggtactccatctcaatggttacaagatcaacaaccccactatcctggcccgcataagccacgaggagttggaaatgctcctcagggggtacgggtgggccccatactttgtcgaaggaagcgaccgtgagagcatgcaccaggccatggcggccaccctggagcattgcgtgttggagatcaagaaaatccaaaaacaagcacgcgagtctaacaaagcctttcgccctctctggcctatgatcgtccttcggtcgcccaagggatggtcggcgcccagggaaattgacggcaagtacctcgagggcttttggcgggcccaccagatccctatcaccgatgtgcagagcaagccggaacacttgaaggcgttggaaaactggatgaaggcatacaaaccagaggaggtcttcgacaaaaacggtacactgatccccgaactgaaggaactggctccgacaggcagctcccgcatgagcgccaatcccgtcggcaacggtggtctcctgcgacgaccgttggatctgcctgatttccgccagtacgccctgaccgatatcgagccaggcgtcaccatccgtcccagcatgaccaatatgtcgaagtatctgcgtgacgtggtggcccggaacatgaccaccttccgcgtcgttggacccgatgagaccgagtccaataaactcgccgaaatctacaaggcgggtaagaaggtctggagggctgaatacttcaaagaagacgaggcgggtggcaacctggacatgcacgaccgtgtgatggaggttctcagcgagcacacctgcgaaggatggctagagggctacgtcctgtctggtcgacatgggatgctaagcaggtacgagcccttcattcatgtgatcgactcgatggtcaaccagcattgcaagtggcttgaatag

SEQ ID NO: 11471 - DNA, 867 bp, A.fumigatus
tgtctcacggttgaatggcgcgccaaggtttcctcactcaacattctcctgtccgcgaccgtgtggcgtcaggatcacaatggattcacgcaccaggaccctggattcctcgatgtagtcgcgaacaagagccccgagatcgtgagaatctacctccctcccgacggtaacaccctcctgtcgaccatggaccactgcttccgcagcgtcaactatgttaatgtcgtcgtggccgacaagcaggagcacgtgcagttcctcaacatggaggaggcgatcgaacactgcaccaagggagtcggcatctgggactgggctagcaacgatcagggctctgagcccgatgtggtcatggtatcgtgcggcgatgtctctacgcacgaagcgctagccgcgacggctctgctgcgcgagcacctacccaagctcaagatccgttttgtcaacgtggttgacctgttccgccttatctccgacaccaatcatccgcacggtatgccggaccgccaatggggggccatcttcaccaccgacaaacccatcatcttcaacttccactcgtacccctggctcgtccaccgtctcacctacaagcggccgggtcagcacaacctccacgtgcggggctacaaggaaaagggcaacatcgatacgccatttgagctggctgtacggaatcagaccgaccggtacagcttggcgatcgacgccatcgaccgtattccatccctgggcaataccgcgtcgggcgtgcgggagcatctgatcaatctccagctggccgcaaagaacaaggcatttgatgacggcatcgacccggattatattcgcaactggacctggaattacccacgaaagaagtgttaa

SEQ ID NO: 11472 - DNA, 726 bp, A.fumigatus
tccttcgacccccgtggtgaagacggaatcccattatcaccggatggaaccctgatccttcgattctccgtgtgggaggcgagtatttcctcgcaacctcgtcattcgagtactggcctagcacaccgatctacaagtccaaagacctggccaactgggagctcttctcccatgcattcaccagaccggagcagcttcagctatacggaactccgacaggtgcaggttagtatatgcttgtcattacatcttgaccgtctaatatcaggtggaccggcaggtgcttgggctccaacgctctcctacatcaatggaaaatactacctcgctgcaatgacgcgatggacatacgacccagtcgcccgagtgtggccacgagtgatgtgggtgtcgtcccgcgacctcaggacctggtcggaccccatctggggtgacccatggggcattgatccctcattattccaggatcctgtctcgcagaaagtgtacttgaacctgatggcccccaacaacaacaaggaccgcatttggggaatttaccagtgtgaagtagatatcgacagtggtcgctgtatcggagagtatcgctccatgtggaatggcacgctcccgcataacgccagtgctcgtcctgaaggcccaaagatgtttaagcgggacaaatggtactatcttctcattgcagagggcaagtatctccctatctccgaagcggcagacgactga

SEQ ID NO: 11473 - DNA, 930 bp, A.fumigatus
atatcgacagtggtcgctgtatcggagagtatcgctccatgtggaatggcacgctcccgcataacgccagtgctcgtcctgaaggcccaaagatgtttaagcgggacaaatggtactatcttctcattgcagagggcaagtatctccctatctccgaagcggcagacgactgacaaccggccaggtggcacagacgaccttcaccgtgccagtatcgcacgctccctggctccagaaggtccctgggagcccgcgccgcacaatccgattcttttcaatggagcgtacggctatgataacctcaccgtacaatccactggccatgcgaccatcttcgaggcggcaaatggcgacagttacgtggtttacctcgcgcggcgcaagatcaatggctcgtcgcctctgggccgggaaaccttcatgtcaccagtcacctggaaagatggatggccgatgatcaatggcgggaatccagtccttctcagtgaatccttcggtgcttcgcacgaccagaaaccaccaccaccacgtttcatcgacacatttgaccagaagacgcttgatccctcctggtacacattgcggactccgtacgcgcccatctacgacctgaaggacggtggccgaaagaagtctcatggaattgtcttccgaccgaacgttttcggtctaagcgaccgagacaccccagcagcaattctacgaaaacaaaagtcgctgaatatgacctttagcgcgcagttgctacccacgacgtccgggctgggttacggcgagactgtcgggatcagtgcctatttgagtgagctgcaacatcaggacattggagtgtcgggctgtgtgaatagtactggcatgtgcatcttcactcagttgatgatgaatgggacaactgaggtaattggccttcgtgatgagttgacaagataa

SEQ ID NO: 11474 - DNA, 210 bp, A.fumigatus
agacggaatcccattatcaccggatggaaccctgatccttcgattctccgtgtgggaggcgagtatttcctcgcaacctcgtcattcgagtactggcctagcacaccgatctacaagtccaaagacctggccaactgggagctcttctcccatgcattcaccagaccggagcagcttcagctatacggaactccgacaggtgcaggttag

SEQ ID NO: 11475 - DNA, 675 bp, A.fumigatus
ttggaggcctacaacagctacaccaaggccgacaacagcgtcattgtcgctaccgactcgatcaagaacaccatctacatcctggccaagcagcaccccgtcactcccccagagctcttcggctccatcctgggaacccacttcatccagaaatacaagcacatccacgccgcgcacgctcacatcatcacccaccgctggacgcgcatgaacattgacggcaagccccacccccattccttcgtccgcgacagcgaggaaacccgcaacgttcaggtggacgtgaccgagggcgccggcatcgacatcaagtcctcaatcactggccttaccgttctcaagagcaccggctcgcagtttcacggcttcctgcgcgacgagtacaccaccctcaaggagacctgggatcgtatcctgagcacagatgtcgatgcctcgtggcagtggaagcgctttagcgaccttggcgaagtccgcgcaaatattcccaagttcgatgccgcctggtctgcggcccgggagatcaccctcaagacttttgcccaggacaacagtgctagtgtgcaagctactatgtacaagatctccgagcaaattctggcgattgagcccttcattgagactgtcgagtattctctgcccaacaagcactactttgaagtcggtgagtattga

SEQ ID NO: 11476 - DNA, 894 bp, A.fumigatus
cctccaccaatgcgcggtctcttcgaccacctgtcgtataagacgatcttggcgtatgtctggatgctatcagtggctacgacgggaatagacgacagatcgctcggcagtcccaagcccggatccacaacgttttctacgacacttcaagaagaaccaacgaggctcgacggcttcaggattgccctgctgaaagaatgctttgatcacgcggctgtcgatcccgcggtcagggagtgtgtcacgatggccgcccagagattcaaagcgctcggtgccacagtggatgaggtctctctcccagaccacttgcaagggcccgccatctggacaatccaacagcgcatagcaggctccatgaacctcctgggacatgcccacggaagaagaggcctgtatctgaccgaaatggagcgtgcaaggctcccgtggacaaacgagagctatcagagagcgttccccgcgacgaaaaacgtcatcatcaacggactgtacctcagctcgcgcttcccggatctctatggtaagaccatgaacatcggccggaggcttcgagatctctacgaggcgatcttggagcagtacgatgtggtaatcatgccgactactccggtcgttgcacctcggcacgggaagcgtggcctgccgttggagtcgctgaagcccagcatgggtctcacgataaatactgcgatctttgacgtaaccggccagccggcaatgtctattcctgttggatttgccccggccagggacgatgcgaatgtccaattgccggtcgggatgcagattgtaggaggactgtggcaggagtcgaaagtcttgcgagtcggtcatgcatgggagacccatttcaactggaaggagaattgttacagtgaatgtctaaactag

SEQ ID NO: 11477 - DNA, 243 bp, A.fumigatus
ttaactgtattgttatgcaccccaaatgtcttgatgttgtctcagtcgtcgcagcccacaagcggccctcgccgctcgagcgttggagcaaagactcgcgtatgcgtccactgtggtcggaatttcaggagaacggagcatctcgagcggcatatccgtactcgtaaggacctctccgagcatctccaacgagcgttcgctattttgtctattggcaactatactgtagacgtgtcttgctga

SEQ ID NO: 11478 - DNA, 489 bp, A.fumigatus
gacttcccagggattggtgcggcagttgcaaaagcttttgcctctgcaggatgcgagcgagtagccatcacagacatcaacgaatcatctctagagaagacgcgagacgctatttcctctcttcaccccaatatccgtctggtagtgagagcagggaatatggccgacgagcaattcgtcgaggcctttatgaatgaagtggtgagcacattcggtcggctcgattacgcagtgaactgcgtcgggatacttggggactcgggccgatcgacagagacaagcacagaggattttgaccgtatcaccaatatcaattacaggggctgctggctgtcgtccagagcagagttgaagcagatgctcaaacaagatcctctaccgagccatgatccgagtcgtgagccgcaacgagggagtatcgtcaatatcgccagtcagctggggattgtctcgcgtcctggggctcgtaagcgctcctgtgtcccttag

SEQ ID NO: 11479 - DNA, 306 bp, A.fumigatus
aatataacagctgcatactgcgcctccaaatccgccattatcggcatgactcgagctgatgcaatagattattctgcggacggcatccgtgtgaattgtgtctgtcctggggtcattgagaccccgatgacaactggcaatgaggaggtacatgcgcgcttacagcctgccgttgatattgcgccaatgaaaagaatgggcaagccagaagaggtggcagatgcggttctctttctatgctcgacctttgcctccttcgtgcagggccatgctttggttgttgatggtggttatattatcaactag

SEQ ID NO: 11480 - DNA, 192 bp, A.fumigatus
  unsure (57),(158): Identity of nucleotide sequences at the above locations are unknown.
cttgcgtgtgtgattgccacgaccaggattgcgcatcgactgcgcgacatccagaanctgccgtatgtagttgtagcaaatccacatccttcccttgtatacgagctctactacaaggcctttgaacggtttcgcgtcctaccggaaatcagaatctngaagaataccaaagatccggtaactcctgcgtaa

SEQ ID NO: 11481 - DNA, 249 bp, A.fumigatus
attcttgttacagaaattgactatcatttgaaagccgtgtaccaaattccaacagaggcagaagcgacgcgagataacagtgcctggacactccagaggctcttctacaaccttcaaacgagcgaaagctctgtctcgacaacagagctgaccgcatcatttggctgggaattgcggcaaatcttcgaacagaaagatgtccaggaacttttccagaaaagcttatggaaagattggaagaagagatga

SEQ ID NO: 11482 - DNA, 435 bp, A.fumigatus
cattgggtaacaggcgggtactcttcttcccttacggtaatcatgtcgattatgcgtcgttctatttggagcatgcctgggaaaaagagcctccggaaaactggtatgcatgcgtccagtttgctctcgtattgtggaacgtcaatgacccatcaatctacgtgtctcatggtatgtacctcggtggcccttatgctcccttctcttcgtccttctgaccgaatcgtagtcgctacgcatcgttttaacgccgacgagggcgattggggctttaccaggttctgtgagctgcgcaggcttttcaacatgccgtgggaaggccgtggagtccccctggtgcagaatgatgaagctaaaatcactgcctacgtgcgtgttgtgaaggacccgacaggggtactctggcacagtttccaaaagtatgtgctgccttga

SEQ ID NO: 11483 - DNA, 195 bp, A.fumigatus
ataagtcagcgtcgtacgaggcttactcgatctagttacgactcgaagaaggagactggcatggtggggttgaaaaaccagggcgcaacgtgctacctcaactccctgctgcaatccctgtatttcacaaatgctttccgcaaggtaagggcttccattcttagattcttgttacagaaattgactatcatttga

SEQ ID NO: 11484 - DNA, 192 bp, A.fumigatus
gtcaagtttctaatgcatcaacaggtggggagcgggttgaaccagttctttagtctgcgacagcccagcgtcagcatcagtgctctggttgcgcaactcgtggcatatcctgtcggttgcgcgtgggcaaaatgggtgccattgggctgggcgaatccaaccggtgtttcaacatcaaggagcatgcgttga

SEQ ID NO: 11485 - DNA, 195 bp, A.fumigatus
cagcacctgctgtatccgagattgatccttttaaacacaaactatgaccccatcaccgttcagatgcattgcagctcattcctttatatcctccagccacaaacctcctcgcaaaaatggctcctgacatctgtgttggaattggagagcgctcaggtccgactgtcggctctacccgctagtcgaggacgatag

SEQ ID NO: 11486 - DNA, 192 bp, A.fumigatus
caacaaccaaagccgttcgctacactgaacagtggaaatagccaactcctcatccattctatcccattcccaaaaacatacatcatcgactgcatcatctctcgagtccaggaaacaagctacctatggtgtcgtcagatgtcatgcaactggagtttcacctacattagcccatccactttttctgattga

SEQ ID NO: 11487 - DNA, 234 bp, A.fumigatus
ggaccatctgcaacggcactccatgagcatacaagtgtccttagcgactatgatgctcagaaaatcctcccatatgaagcagacgattctccatttcctgaggtccgcgccgtggtgcagccagttgacgacgtgagtctgcctgtcaacacagtgcgtgtgtggatcatcggcatcatattcactattgtatgtcatacatctcttgcaacgaagtgtaggtcaagtttctaa

SEQ ID NO: 11488 - DNA, 453 bp, A.fumigatus
tcagtgacaaacgattcgagtctcaaatctcaacagaagtgccagcaaggtctcacgcacaaaatgggggactgcgataaaaatctccaaatgcctcctgtaccgttctcacaacgtccaatcatcattctaggcgcagggatcattgggtgcgctacagcaagacagcttctcttaaatggctttcgcgttgtggttgttgccgagttcctgccaggcgatcaaaatattttctacgcatcagcctgggctggagcaacatggcatgctgctggcgggatcagttccgaatatcgataccttcaagctgttacgcatcggcatctgttgaagatggcgcaagaaggccccgaatccggagtttgtcttgtggatgcgcgcgaatatctcgaagaagcgccatctgagaactcctcaatctggggtaagactgtggtcacaaatgttaggtaa

SEQ ID NO: 11489 - DNA, 672 bp, A.fumigatus
attatgtctgatgtttcagaagagacagctgcaaatgagccaccagcacaatcctcgcagacgcggtgggcgttcatcgatgcttcaaacgacagccgaagcaatctcacccgagtcaaacgccatgtgatgcaagaatatatgcggcaaaaacgcggtggcgagccgcaaccagacaacgagaatggcgaatccgtgaaggaaaaagaagaatcacagccaaagggtcgcaggcgaccgaggaacaagactgcgggaaagagtaccaccgagaaggagaagaagggcgctggtaagggctggaggaaaaaaagcccggacgcgtcgacagatacacaaagggggttggaatccatgcgtgaggattccttaggggagggttcatcgacagggattggagagagacatgcctcagccgctgcaggccagacgaagacagatattatcgtctctgtttcctcctccgacttacccaaattctatgcatctggtgaccagagcagcacctccgagtctgacagccggtcaccgttatcctctgccccaacaactccctacgagctaaccctctctcccaaatcgattctcagcgcagcgcgaactgaccccttcaacacgttgcctatggatttgtcttcaccgacgggccaggaaggacacgcaattgcgtaa

SEQ ID NO: 11490 - DNA, 474 bp, A.fumigatus
agccgtcaatgtttcgtagccgaaggagagtcaggtcattcgcatgtttctcggtttcggttatatttggcgcaaaggcaatctgcgcggatgcaccacccatatccaagaacccataagtatgatggcccttgccatggtcatgaccctttggttcatcgaagctgcccagcaaataattggtcgcgatccatccgtagagggcctctgtcacccccgggattacctgaatgtgcacgccgcaatcaggaagcagaaaatcatagttcttgctggcgtaggagcagatctgttgtaaaagaagctcgcgctcatgattgggtaagagtcgcatcccagcagtggctagtaaaaagatcggggtatcctttatctgatcggcggggacgatcttgcgtgcatgatcgagaagttccgcaagatgctcggggccgactacctcgggtctgtcggcgaacgatgacacgcctataa

SEQ ID NO: 11491 - DNA, 189 bp, A.fumigatus
gcaacagaatacaatatcataaggaacaaatctctactggaccctgtaactagtcttttccagaatacggagatctcaaatgatgatacgtactccaggcgcagcgtcagacgttcacagaatcacgttcccatcccccacccccctttaactgaaaatagttttgaaaagtgcgctaaagagcactag

SEQ ID NO: 11492 - DNA, 1200 bp, A.fumigatus
aaacattaccggagatcaagactaaatctgaatggacgaaaaagatacaccctggtaggtgatatcagaggacatgtctgtctgcatcttcccttcggtgttctggctgacagtcgcattgttataggcgtgtcatcgttcgccgacagacccgaggtagtcggccccgagcatcttgcggaacttctcgatcatgcacgcaagatcgtccccgccgatcagataaaggataccccgatctttttactagccactgctgggatgcgactcttacccaatcatgagcgcgagcttcttttacaacagatctgctcctacgccagcaagaactatgattttctgcttcctgattgcggcgtgcacattcaggtaatcccgggggtgacagaggccctctacggatggatcgcgaccaattatttgctgggcagcttcgatgaaccaaagggtcatgaccatggcaagggccatcatacttatgggttcttggatatgggtggtgcatccgcgcagattgcctttgcgccaaatataaccgaaaccgagaaacatgcgaatgacctgactctccttcggctacgaaacattgacggctctacccaggagcatcgggtgtttgttacatcctggcttgaatttggcgtgcacgaagctcggagacgttatttggaggccctacaacccgcagccggaaccgcgaaggaacttcccgacccgtgtctccccaatgggcttcgaaccacaattgacggcaaacctctgcggaccggcgacacctcggagttatctctgctgggaactgggcgattcgacgaatgcttgcgacagacatacccgctcttggacaaggatgcaccctgttcggatgaaccttgtcttcttcacggggtgcatgtccctgctattgactttgatgtgaatcatttcatcggtatcagtgagtactggcatacgacgcatgagatctttgaaatggcgcacaaggacaaaacgtacgatttcaatacttatcaacagcgggtacaacaattctgtacacaagattgggaagccatcgaccagggtatacaaaaacagtcgtggggaaagaaggtcgattgggaatcagcttccgaggtctgcttcaaggcttcatggatcatcaatatgctgcacaacgtcttcaccacggggctggaaggatcaacggctggtcaatcc

SEQ ID NO: 11493 - DNA, 408 bp, A.fumigatus
atccaaggtccatggtttggtggcatgttcggcgggttcctgcggggtccgttgccaattaaggaattctggtcccttaagggtttcaccttctcaagtggagcgatcgacggaaatggaatccaagttggttaccaactggctgaaatgtgcgccatctcgggttactcgttagtgatctcatgcgtcttggtatacattctcaaattcatcccgggaatgaacttgcgagtcgatgaggaatccgaaatgatgggacttgaccaggcgcagctttttgacgaacagattggagactggagcttagtgcacaacaactcctttccggtgacaaccccaaccattatcggggtttcgaaccagtcatcagtttcgacggatgaaactcacgcggggaaagcaatgtag

SEQ ID NO: 11494 - DNA, 720 bp, A.fumigatus
  unsure (18),(58),(92): Identity of nucleotide sequences at the above locations are unknown.
ccggatacaaacagcttngtttcagagtcagccgagccccaatatgattttgtggggnacgagaacatcctgccatcccagcgacgactcgntgagattaccgaattaatccacaccgcatcgcttctccacgacgacgtgatagataatgccgtcagccgccggtcgtcgaactctgcgaacctccaatttggaaacaaaatggctgttctggccggagatttcctgctaggccgagcctccgttgctctagcacgcttgagggaccccgaagtcaccgagctcctcgccactgtgattgccaacctggttgagggcgagttcatgcagttgaagaacactgtagcggacgagaaaaatcccgttttcaccgatgaaaccatctcgtactacttgcagaagacctatctgaagaccgctagtctgattagcaaatcatgccgtgcagctgcattgcttggtggtagtgcgcccgaggtggttgaagctgcttattcctatggtcgcaatctcggcctggcgtttcagctggtggacgatctgctggattatacggtgagcggggtcgagttgggcaagcctgctggtgcagatttggaactaggacttgcgactgctccgctgctcttcgcttggaaacaaaaccccgagctgggtcccctagtaggccgcaagtttagccaggaaggagacgtacaaagagtaagtggtgactcctag

SEQ ID NO: 11495 - DNA, 186 bp, A.fumigatus
gaccgaaagctgacaactcgccaggcccgtgagattgtgtataacagcgacggtattgaacagacgcgcgctttggcccaggagtacgctgataaagccgttgctgccattgccgatttccctgacagtgaagcgaagagtggtctgatccagatgtgcgagaaaaccatgaatcggaggaagtga

SEQ ID NO: 11496 - DNA, 1413 bp, A.fumigatus
ttcgacttcccattactcaactgcagctctacgattaaggattgcgcacacctttcgctttatgcgcctccgggcgagagctcacctgtcgctccagctacactccccttcaactcatccctccgtccacgcgctgccaaagacaccgtcacccatccgtcgaaaatgggcaacccgtccgttcccgatctcgatgctgtaggcatcaaagccgaacccgagctggcggatcagtttcgccgcgaggtcgccgccttgctggggcgcaataacctcaatttccccggcgcgcagcccgtcagttttgcgaaacgacatctcctcgagctccaacgggaagactactacgtgtgcgagaaaacggacggcatccgatgtcttatgtattttgcacgtggtgaagaggactccccagtaccggaaatccactacctcatcgaccgcaagaatgactaccgctatgtgccgggcctgcacttcccgcagccggacgacgagacgttccagtccttccatgtcgacaccctgatcgacggggagctggtcaacgacacgtacgaggacggcacgcagcagctcaagttcctcgtgttcgactgtttagtattggacgggcagaagctcatgcaccggacgctggacaagcggctggcatatttcaaggagaaggtgctcaagccgtacaacgcgctctacaaaaaattcccagaagaaaagaaacaccgcgcgtttgctgtcgaggacaaatctacgcagttcagctacggcatcgagatgatgttccgcgagatcatccccaaggtcaagaaaatccacggcaacgacggcctcatcttcacctgtcgcagcaccccctaccgcatcggcacggacgagcacatcctcaagtggaaacccccctcggagaataccattgacttccgcctgcggctcgagtttccagtcctcgaaccggacacggacgacgaggccgacggcatcacagagccgtacccggactacgacgccatccccatctgccacctatttgtgatgctcaacgccaacgaataccagcactggggcgagatgtacgtcaccgagtcggactgggaggccctcaaggccctgcaggtccccctggacgactcgatcgtcgaatgcttcaaggacgagcaggggaggtggcggttccatcggctccgcgacgacaaggcagacgccaaccatatctcgaccgttgagaaagtgctggaaagtatcgaggaccgtgtaacggaggaggatctcatccgcgccgcaccggccatcaaagccgcctggaagaaacggcaggctcaggcggctgccgaggaggaagaccgcagacgccgtgcgagacagatgccccccagcgcgaacgggaatggggtgaagaggaaattcgaggagtag

SEQ ID NO: 11497 - DNA, 237 bp, A.fumigatus
  unsure (64): Identity of nucleotide sequences at the above locations are unknown.
ttctgcttagggcgcggaaaacgtccagtaccaggttctgaaggagcttctagcaatggtctcnccagctcgagccagatccaatctcacatttcaaagcagaagacttacatggacactttgggccgcacagtgttgaccctgacggtcgagaacctctcggatgaggctcgcgattctcagatagtggtaagttctagccccgtgctcgtcccttggaacttcttggcaggctga

SEQ ID NO: 11498 - DNA, 489 bp, A.fumigatus
gtccgcgcgaaactgagaagggccgtctcagtcttggatccaatgaatgtcattgttccgtcctgctcgccttcgaatgcagtggaattaataacgatcgaatcaagcagaagcgccttcaccggcgacgcgagacttgatgcaaactcagatggcgacatactgcctgacgagttggtcgcatcatggactccattggcctggccagaagacgctccagctgacttttctccaaacttcgtggaagtccccagagtagcggcaacggcagtcattttattttccgtgagcgtgccggtcttgtccgagcagatggtagttgcattgcccatggtttcgcaagccctcagcaaacgcaccaagttattgtccttcaacattcgcgtcgtggcgaacgcgagcgcaagtgtgacagcgagaggcaatccttcgggaacggcaacgacaatgatggtgactgcaacaatgaagatctggaggaaggcctga

SEQ ID NO: 11499 - DNA, 264 bp, A.fumigatus
ctaaccctttctgtaacagcaacggatcctccgactcctcacatcctcgaccgcagacctgagcctatatcagcacccctcatcaacctgacgatgtggaaaatgatcataggacaaagcatctttcagctggtcgtcactcttgttctgaactttgctgggaagtcgatatttaaactttcttcagaggacgacatggaacggctcaagacgacggtcttcaacacttttgtctggatgcagatcttcaaccaatggaagtga

SEQ ID NO: 11500 - DNA, 3003 bp, A.fumigatus
actagcgctctgttatataacggctctccatcgccgacggatctgcgttcgtcggcctcgatccgctcatcagcttcgtcggagggccgggaccatgagagtaggccgacgtcaccacacaacgtatcgtctcccacgtcgaaactggccgagtcgatgtccaattccaacttcctttcagttcctggcacgaggtctcgtggaaattcacttgaatctgaagactcgagccagtctaccagcacctatggaggagacacgtatgttggctcgccatcgcaaggtgcccgtcctgaacatgggaataaaaacggcaccaacggtaaaattctcagtgatgaggaggctctcaagccggaccctggtcgcgaggccgaattccaggtggaggataacaaattcgccttctcccctggtcagctgaacaaactcctgaaccccaagagcctcggcgcgttccacgcactgggtggcttgcaaggattggagagggggttacgtacgaacttgcgcagcggcatgagtgtggatgaaattaccctggaggggaccgtgagcttcgaagaggtcgcatcttcgggtgctcagaatacccttcccaagtctgattctgacccgcccaatcaggggtcacctgccagatctaacacggctcctgcgaggcgacatgatgatgcgttttcggaccggaagagaatatacggcctcaataaacttcccgagaagaagcctaagagtattttggaacttgcgtggattgcatacaacgacaaggtcttaattctgctaaccattgccgccgttatttcgcttgccctcggtatctaccaatccgtcacagccacagatggggaagctcgggttcaatgggtagaaggtgttgccatcattgtcgctatcgtgatcgtggtagtcgtcggtgctgccaacgattggcaaaaggagcgccaatttgtgaagttgaataagaagaaggaggaccgacaagtcaaggtcatccgttccggcaagacagtggagatttcaatccatgatgtgctggttggtgacgtgatgcatctcgaaccgggagacctcgtcccagtcgacggtgtcttcatcactggtcacaatgtcaagtgcgacgaatcctccgccacaggtgaatccgatgtcttgcgcaagacgcccggcagcgacgtctaccaggccatcgaacgccatgagaaccttaagaagcttgatccattcattgtttccggtgccaaggtgtccgaaggtgtgggaacgttcttggtcactgcggtcggtgttaactcaacgtatggtaagactttgatgtccctgcaagacgagggccagacgacaccactacaatcgaagttgaacgtgcttgcggagtatatcgccaaacttggtctggcagccggtctgctgctgttcatcgtgctgttcatcaagttcttagcccaattgaaggatatgtatggtgccgacgccaaaggtcaggccttcctccagatcttcattgttgcagtcaccatcattgtcgttgccgttcccgaaggattgcctctcgctgtcacacttgcgctcgcgttcgccacgacgcgaatgttgaaggacaataacttggtgcgtttgctgagggcttgcgaaaccatgggcaatgcaactaccatctgctcggacaagaccggcacgctcacggaaaataaaatgactgccgttgccgctactctggggacttccacgaagtttggagaaaagtcagctggagcgtcttctggccaggccaatggagtccatgatgcgaccaactcgtcaggcagtatgtcgccatctgagtttgcatcaagtctcgcgtcgccggtgaaggcgcttctgcttgattcgatcgttattaattccactgcattcgaaggcgagcaggacggaacaatgacattcattggatccaagactgagacggcccttctcagtttcgcgcggacttacttgggtatgggctcgattagcgaggcgcgatcgaatgctgaaatcgctcaaatggttccgttcgactcgggacgtaaatgcatggcagtggttatcaggctcgaaaatgggaagtaccggatgctggtcaaaggagcgtccgaaatcttactttcgaaatctacacgcatcatccgtgatcctaccaaagaggtgtccgatacatctctctcggaaaaagaccggtccgccctggagaacatcattacgcactacgctacccagtcgctccggaccattggcctggtgtatcgtgatttcgaccagtggccccctcgtggcgcgcctacctcagaggaagaccgttcgctggcccagttcgaccccttgttcaaagacatggtactgtttggtatttttggtattcaggaccctctgcgacctggagttacagagtccgtccgtcaatgtcaaaaggccggcgtatttgtgaggatggtgacgggtgataacattatgactgccaaagctattgctcaagaatgtggaattttcactcctgggggcattgctatcgaaggacctaagttccgccagttgagcaatcgtcagatgcgccaaattattccccggttgcaggttctggcaaggtcgagccccgatgacaagaagattctggttactcaacttaggaagctcggggagacggttgctgtcaccggtgatggaacgaacgactctcatgccctgaagaccgctgatgtcgggttttccatgggtatcaccggtactgaagttgcaaaggaggcgtcagacattatcctgatggatgacaattttgcatcgatcgtcaaagctatggcttggggtaggactgtcaatgacgcagttaagaagtttttgcaggtaaactctggcagcttgacagattgcattggttctcgagctaacgttttatcgttcagttccaaattacggtcaacattactgcagtcttgctcacattcatctcggctgtggctagtggtgacgaagagtcggttctga

SEQ ID NO: 11501 - DNA, 1803 bp, A.fumigatus
  unsure (1338),(1341),(1345),(1346),(1354): Identity of nucleotide sequences at the above locations are unknown.
acgaatttcatcctcatgtcgtcttacatttacagagaacgcgagcgagatcgcgagtgggacgagcctcgttcctccagtgtatcaatcaagcgttacgtcataccttcagaggaggatcgagagcgtgatattgtctaccgtcgcgaagaccccgtcaccggtgatcgagaattggtaatccgccgctctaccgagcgagaagaacccgtcatggtgcaacgttacgagcgagaggtcgactatgacacgcgcccgtacgactaccgctccgaaagagactactatgatggtgcgtaccaatgtacgagtgtaggtcgagtaaatctgactgaccctatttatgtagcgcgagggcccctcgtcgttcacccccgtgaatccgactacgaggttgtccaccgctccgaggtagaacgggagccggcttactactatcatcgccgggtccgcgaatatgatgatgaccgtcgcctccgccgcgagcttagtcctggcgactccatctctcagaccagtcgtcgtcgggacgaccaagactacagcagtgatgatagcatggtctatattcgcaaagagacccgtgaatacgacgatcacccccatcatcgacgccaccttgcggagggtgcgttggtcggtatcggcgctgcagaactgattcgcaatcgtcgaaagaaggaaggtgatgacgtgtcttcgggcctcagccgtctcggtcacgacgtgggtgccggcgccttgggtgctgttgccgtgagtgctgcttcacgtgctcgcgactactaccgcagtaagagccgtcaccgctcccactcctatgatgatgagcgcagctcccgtcacaatcaccatcatcactacagccacagccatagccatagccgccacagccgccacagccgtcgcagccgtagtcgcagccgtagtcgcagccgctcgcactcgcactctcgtgccaagacgctgacggagatcggccttggtgccgctgccattgccggtgccatggctctggctcgtaagaagtcgacgagcgacagacgaagccgctcccggcaccgccggtcctccagtgccgtccgacccggaaacgacgccgagagtgagaaacgcagccaatcccggattcggaaacatatggccgaagctggcttggcgggtgccgcagtggccggtctggtcgagagagctcgcagccggtcgcgctctcgaaagggctctcgttctcacagccgactcagacaggcgcttcctgtcgttgcggccgggttgggaaccgcagccgtcactggcctgtacgaaaagaataaggagaagaagaaaaaggaggaggangangaannaggcgganagcggagggagcgacgtcgttccagatctcgaagcagggccccgtccgaggcctactcagatcccgcccacgatccggctggtctgatcgagtacggccaacatccggttaccggaagcatccctgcagcccattactatggccggcctgccagtcaacagggttactactcggatgcttctgaccgagtagcccgggacgcagcaggattccgtggtcgcggtcgcagtcgcagtcgcagccgaggcggcaggtatagcacgagctcctcggataccgacagagacggccatcgtcgccgaagcagccggcgccgcaagcaccgaagccgttctcgtgaattggccgaagccgctttggctgccactggagtcggctatgccgctcataagtacaagcagagcagggatcgcaagaaggaagagagagaacggtcaagtgagttttaa

SEQ ID NO: 11502 - DNA, 426 bp, A.fumigatus
ctcaagaaatgcacgaacaatctgctggttcgggagactaacgaccggttccttctagagtacgacgatgactcgtacccttcatcgtacccttcggaccttccatacccgccgtcgcccctgccaccgacacagccgggagagcatccttactatcccaactccaactacttccctccacctcctggctctacaccagctccccctgctcccgccgcgccatacaatccggccgattaccctcctccaccaggcgcagtccctccagcgcaaccttacggttatccccccgagccaggaccggaccggtacgcaccccggccccggagggcggacgagaatgtgagtgctgcatggaactctcccccttctgctgcccagtatcccatgcatgatggtgggtctagggatagattcaaaatctga

SEQ ID NO: 11503 - DNA, 522 bp, A.fumigatus
ctggttgctaaccaacaaccctcaggtgtagagaaacctccgtcaccgctgagaacaccgcgtccgcggacaccccgagatcgcgcacgcgcagccagccaaccccctcagcccaagtctgttgcctttgacctcaatgcggaggagcgtccaatcgaccctggttatgaaacggacgatagcgacacaactatcgactctttgactcctcatcatcatcgtgatcgtcatcgctcctccgacacctcgtttgcccaccggcgccgccactcttcctccgatccctactttaccccccgcaaaccccaatttcaacccagctcgtcccaagcaaagattgatcgtcccggtcactccaaggacaagggtactaccgatctgcaggagccggattccgactccaccatcgacctacctgatcggttcgactcgcatggccgactgcttccagagcgggacaatgatccgctggtagatgggctggagaaattactccgtgggatcaatcgcgtgtttgtctag

SEQ ID NO: 11504 - DNA, 534 bp, A.fumigatus
gtcggctgtgagaacgagagccctttcgagagcgcgaccggctgcgagctctctcgaccagaccggccactgcggcacccgccaagccagcttcggccatatgtttccgaatccgggattggctgcgtttctcactctcggcgtcgtttccgggtcggacggcactggaggaccggcggtgccgggagcggcttcgtctgtcgctcgtcgacttcttacgagccagagccatggcaccggcaatggcagcggcaccaaggccgatctccgtcagcgtcttggcacgagagtgcgagtgcgagcggctgcgactacggctgcgactacggctgcgacggctgtggcggctgtggcggctatggctatggctgtggctgtagtgatgatggtgattgtgacgggagctgcgctcatcatcataggagtgggagcggtgacggctcttactgcggtagtagtcgcgagcacgtgaagcagcactcacggcaacagcacccaaggcgccggcacccacgtcgtgaccgagacggctga

SEQ ID NO: 11505 - DNA, 234 bp, A.fumigatus
tggcgaacctcaacaagaaccgagttaaccacaggacgccaccctgtctcagactcgaatcaaagacgcaagcacgtcgttcgctcggatacctacaaacagccaggccctattagcgtctcctccttgcgtctgcagggccctgcctgggtctcagccggcggaggcatctatgccaccttgtttggggtgtaccggatgctgcgctctatgcgacaactaagatatatctag

SEQ ID NO: 11506 - DNA, 921 bp, A.fumigatus
  unsure (875),(876),(877),(878),(880),(890),(898): Identity of nucleotide sequences at the above locations are unknown.
atccatctgccaatcctcaagatcatgccgccgagcgatcgcacatttctcgccttccaacacaatgccaagctccacaatctccaaaccatcgtgaggggaatctaccctttcgcaaccctggaagaatccaaccgccagctcttcaagcaaggcaccgatgaagactatgcgatcatcacagagcagaccattttccatccccagggaggcggacagccgtccgacgagggcaccatgaccagtgcctcgggtggagcgttcacggtcgcagccgtgcgcatggacgccgtccgcgagggccaagtcctccacttcggtcggtttaatcaatcctccgtcgtcttctccgagggagacacggtcgaacagacgatagacgccgagaagcgtctgctgtactcgcggctgcacacggctggccacgtcctcggcgcggcggtgcggcatctcctggaaaaggaggtggaagggttcgacgagctcaaggcgtcgcatttccctgacgcggcggcgtgtgagttccagggcgcgatcgatgggaaatggaaagattcgatccaggcgaaagtgaacgagtttatcgaggccaagttgcccgtcgaggtggactggtgggatgaggaggagtttcgcagacggggcctggagcgattgctgccggaccgcggtgcagtcgctgttgctcccggcgagaagtttcgcgttgtcaacatcgtcggagctgaggtgtatccctgtggaggtacgcatgtcgagacgacggacctgtctggatcaactaccgtgaaggaagattaccaagaaaggtggccagtcaaaggtcacctataccgtaaccgattgaatccatccaattgccgtcttaaattttnnnnanaaaaactatntaatcccnaaaaactccttttttttgatcta

SEQ ID NO: 11507 - DNA, 360 bp, A.fumigatus
  unsure (118): Identity of nucleotide sequences at the above locations are unknown.
ggtgcaccagaatggataaagctgaccggggtctttgatggcaatacgaccaacacaactttgaacgatggatacctaaccagtggggaaaccggtagtacggggtatgccagtcatntcgcgcagtactttgtcaagtacattcaggcctataagaatctcggtgctcacgtcgacgcgattaccatccagaacgagcctctgttcagctcagcgggctatcccaccatgtatgtctacgattatgagtcggcacagctgatccagaactacatcggccccgctcttgccagcgcggggctagatacggaaatctgggcttatgaccacaacacaggtctgtggttatcgttgaattga

SEQ ID NO: 11508 - DNA, 534 bp, A.fumigatus
caaattacagatgtcccgtcgtacccccagactgtccttaaccaggccggtcagtacgtcaagtcggtggcctggcactgctacgctcccaacgtcgactggaccgtgctcagccagttccacaacacaaaccctggagtgaagcaatatatgaccgagtgctggactccagcatctggcgcatggcatcaggcggcggacttcaccatgggtcccctgcagaactgggcctcgggagtggcagcatggactctgggaaccaacgctcaggatggtccgcatctgtccactggcggctgcgcgacatgtcaaggcttggtgaccatcaacaacggaggatacacgctcaacaccgcatactacatgatggcgcaattcagcaagttcatgccgcttggtgcgattgtgctcaatggcagtggcagctacacgtactttgggcggaggcggtatccagtccgtggcttccttgaatcccgatgggaacccgcactgtggttattgaaaacacttttggcaatgatgtctatgtga

SEQ ID NO: 11509 - DNA, 468 bp, A.fumigatus
tcttccttcacggtagttgatccagacaggtccgtcgtctcgacatgcgtacctccacagggatacacctcagctccgacgatgttgacaacgcgaaacttctcgccgggagcaacagcgactgcaccgcggtccggcagcaatcgctccaggccccgtctgcgaaactcctcctcatcccaccagtccacctcgacgggcaacttggcctcgataaactcgttcactttcgcctggatcgaatctttccatttcccatcgatcgcgccctggaactcacacgccgccgcgtcagggaaatgcgacgccttgagctcgtcgaacccttccacctccttttccaggagatgccgcaccgccgcgccgaggacgtggccagccgtgtgcagccgcgagtacagcagacgcttctcggcgtctatcgtctgttcgaccgtgtctccctcggagaagacgacggaggattga

SEQ ID NO: 11510 - DNA, 207 bp, A.fumigatus
gtagaagatattgatttcgaattcgtctacgctcttcacaactttgtcgccacggttgatggacaagccaacgctgcaaaaggagatacaatggttctccttgacgatagcaacagctactggtggctcgttcgaatcgtgaaggatggcagcatcggtaacattcttcgctcgcgcttcccaaaaacggttcctgacagtctctag

SEQ ID NO: 11511 - DNA, 849 bp, A.fumigatus
  unsure (693),(694): Identity of nucleotide sequences at the above locations are unknown.
cagaaacagttgtcagcgacgatgctgggtgacaattcagagaaatccaaaaacccgttaaagaaagcaatgcgccgcagaaatgcaaaaaacgtcaccttcaccgctccgacctacattgaagcgtcggatattgattggtcgaccgaggatgagattgacgacggagactctcttatcgacgccggaaatatcatacgtgatggcgatgatctgcaggatgatcacaatgatgatatcgttgttgagccgctcagaccgaagtcaaatcgtgacaaggccactgatgagtcggaaaacgtggaagaaactccccagtctggctctacgagccccgacaagcaaccctccagccaggagttgtttgaggtagcaagtgaacctacagtcagcagatctcggaatgggaccgtgaggaacacagattcgttcttcaaagacgacactgttgagactaagaagatatctctgacgccgaatttgcttcgtgacgaagtgagcagtggcgggctttcaagcgagacaaaggagggccgctcaagctttgacaatatcgacaaagcactgggtgcaaacgacaaagggcgggatgacaagaagagaaaggataagaaaccagggatgctgagtgggctgttcaagcggaaggataaaagaacaaaatctatcgaagatgattcccatgagcccgannatgtctcggggcgaattatctcgaacgtcacccataccccgggacgtcctctgaatccgggtcctccccccgagtcacggccaacgaaagggaatcccgcccccaaagccggacgactaaagtcccccgaagcaaaaatttggccctgttcccct

SEQ ID NO: 11512 - DNA, 606 bp, A.fumigatus
attgctccgcgaaccgacgcacgtctaagaatgccttcgagacagtccgccgttcccaatctagacctaagctccttcaccctgcaggcgaatgcgaagaactcatccccacttacccccggcgcccaaagctccgacagagccagtcccttaacaccccgttctcccaaatcatcgaccagctcgccattcttcaagggagcgaccatctgccctgtaacacaagagtccaatagcaagtcgagcagtcctactttcccactctcttctgctcaatcggcggaacccacgactcctggtttcacagccattcctccatatcctccttcgccaagggattcgcccaagcacagtcgcgaaccgtctcgctctttctttgcaaacctcaaagcgccgaaatctgcacacagagcacaacgctcagacggttcgggaagttcaaacgacaagcccaagagccggggcagttctagggatcgcagaacacagatcgcttccaagtcgtacgagtcgacgccagatcttcctggtacaatagatcgcgcagctcaagaggaaaaaagtaagcgtctcgcttcatacaacgtcctgcgtcttagtttttag

SEQ ID NO: 11513 - DNA, 192 bp, A.fumigatus
tcgatatcatactgtcagaaactgatgtctctcagattgtctttgtcgaataatcatctcttccacattccttatcgtttcgccgagtgctctcacctccgctatctgaacatcagagcgaacaattttcgggaattccccaggggagtacgtgtcatcaaagaatctgtttataaactatccaagtcctaa

SEQ ID NO: 11514 - DNA, 468 bp, A.fumigatus
gtgtacaaactgccgctgctcgagatattagatctcagtcgcaacaaaatcagccacatccccgaagagataaagagactgtcttcgcttcgtgtactgtcgattatgcagaatcgattggatgatctgccatttggaatttcggaaatgaacaaactccagatcctgaaggttgcgggtaacccactacggtatcccttacgacgagttctcgagacctcggagaccgaaatcgccccgtccaccatgacagacaatgagaaagaggtcgccgtaaccgcagaattgaaaaggttcctcaaaactcgacagttaaatgagcaagaccgaggaaacgagtcaaggtactgtggattttcaaaatgcgcctggcgacttctggcgacttcagctgacagttttcaagcgagtgtgttctcgatactccaaagcctgtcagacgcaagctcagcagccggttcccagtga

SEQ ID NO: 11515 - DNA, 318 bp, A.fumigatus
aacaagtttcccgatatgacaaagagcgctgcgtatgatattgccgttcgtgaattttaccgactacgactacaagaagatattgaacgacgggtcgctgcagaggaggcggaagcaacgggagcgaccttcgggccctctcttctggaagttggtatggagctggagaaccaagagtacgagcgttggaaggcatgggccaagatggaagcgcaattactggaccagaaaacggcagcatttactggtgctcctgagattgccgccgccgatgatgctgtggaagagctggaagaaaaggtgccagtgccggtataa

SEQ ID NO: 11516 - DNA, 597 bp, A.fumigatus
ccattattaccgctctcccttgtgtcaatcatatcccttctccttcaccaccatcaccaccacacaccacacaccacccacaccatgtcgctatctctatcacggtccctacacagggcccttctgaggagatcctatggcacagtccaagctcctcccagtgctgcctcacttgcagccaaccgcattcctcccgccctccaagaagcaaccgccgccacggccccgcgcaccaactggtctcgggaggaggtccaacagatctatgagactcctctcagccaattgacttatgctgcggtaggtcgatctctcatcagttatttttctatggatactgacttctgcaaggccaccgtccaccgtcgcttccatgaccccgccgccattcagatgtgtacgctgatgaacatcaaaaccggcggctgcagcgaagactgctcgtactgcgcacagtcctcccggtacaacaccggcctcaaagccaccaagatgagccccgtcgacgaagtcctcaaggccgcccgcatcgccaaggacaatggcagcacccggtttgttttacaccagccgggctggaaggacaccagtggcggg

SEQ ID NO: 11517 - DNA, 666 bp, A.fumigatus
gacgccgcctccttcctcaatgtccaccctgatgtcgccgtcaacgcgaaactcctgacaggtggactggtccctctttgcaccacgcttgccagcgaggagattttccaagcattctccagccccgaaaagagcgacgccctattgcacggacacagttatactgcgcacgccgtcggctgcacggtcgccgtggattccctgcgagccatgacgaagatggaaagcagtgggtcatgggatgcgtaccgcggtgactggaaagcagttgatgtgtctggggaagataattccccggaggtctggtcggtgtggtcccgcgatctgctgcgggatctgtcatacgcggactcggtcgagagcgttttcgctcttggcactgtgctcagtatttcactgagagacgcccaaggcggtggtaagttctcacacgaagatcatttttcgcccgattctagccggctaacatgtgacctcgtccccactactctaggctatacctccaccgcagctaagggcctgcagcagagattatcggcgggcgggccacaatttaacgtccattcgagagtgctgggaaatgtgctctatctcatgtcgagcatcacatcgaagcccgagactgtgcgaggtttggaggagctgctccggtcggcgttgctttaa

SEQ ID NO: 11518 - DNA, 414 bp, A.fumigatus
ggcagatccctgaatggccgtactcggatttctggtttaaccattccgcgacggaccagctcaactgcttccatgcattctttgagcgagccaaccaggttgccagtgatcctgagccctttgatgacaatggtgcagatgggggtctccagcacaggacgccctggaggaatgccaacgcagctcagagtgccaccgacacgcagcatgtcgcatgcatgggcaaacgcttttgcattgccggctgtcacaactacggcgtgtgcccctagtccggtgatgtcgtgcacacgctgcacagggtcgacagatttgaagtcgacgaactcgatagcaccaagtcctagaacgaagtctcgtttatcgccagcgtcgactccgataaccagcgcgccatgggctttggcgtattga

SEQ ID NO: 11519 - DNA, 279 bp, A.fumigatus
  unsure (194),(214): Identity of nucleotide sequences at the above locations are unknown.
caactcaagctgtcaagcacgcaggttcctgactgcacaatgagattccttcgccttctggccctcgcgcctctggccctggccgcaagtgtccctcgggccaaaatcccaacctacaatgcggtgaccgtcttccaacccccggctgactacaacatcccgcgcgtcctgtacgcgcgcaccctaaagctgcncaacggggatctcctgtgcnactgggaagaactactccaaggaccccccgcaagtgtacttccccatctaccggtccaaggacca

SEQ ID NO: 11520 - DNA, 228 bp, A.fumigatus
cgattgctccagagacggtgtatctacatggtgacgatgcagatcccacagactcagactgtagctcttgtctccgaacttggaggcaaggtggaatttgacgataactatcctgtccctgtccctggtcaaaacgaggtactggcgaaggtcctctataccggtgtttgtcagagtggtaagtttacccagtaccagtaccagaaccaactggagccattctcctga

SEQ ID NO: 11521 - DNA, 666 bp, A.fumigatus
ctcttgtctccgaacttggaggcaaggtggaatttgacgataactatcctgtccctgtccctggtcaaaacgaggtactggcgaaggtcctctataccggtgtttgtcagagtggtaagtttacccagtaccagtaccagaaccaactggagccattctcctgagcaatcagatctccacaccaagaatggaactgcagccggtgccgacggaaaccccatcacaaacatcaagcgtcctcacgtgggtggacacgaaggagtcggtcggattgtggcagtggggccgggttgcggacccggcttgaaggttggaggcctcgtagggattcgcttcgccagtcgtgtctgcagacgatgcgagttctgccttgccgggacagaacagtattgcatcagaagcaccaatcatctgcaccacgaggatgggagtttccaaatgtacattgctctcgacgcggactacctgacgatcctgccggacgacatcgatccgcaggtgattgggccggtcttatgcgccggggtgacggcttacaaggtttgcaatcccccattggttccgtggtcttctaacaggttaggccgttctcaacgccaacatcagagcggggaactggctggtcgtggtgggtgctggaggtggcctcggacacctcgcgggtag

SEQ ID NO: 11522 - DNA, 531 bp, A.fumigatus
gatcgtacctttggccagactacaggacagctggctgacattgcatcagttcaatacgccaaagcccatggcgcgctggttatcggagtcgacgctggcgataaacgagacttcgttctaggacttggtgctatcgagttcgtcgacttcaaatctgtcgaccctgtgcagcgtgtgcacgacatcaccggactaggggcacacgccgtagttgtgacagccggcaatgcaaaagcgtttgcccatgcatgcgacatgctgcgtgtcggtggcactctgagctgcgttggcattcctccagggcgtcctgtgctggagacccccatctgcaccattgtcatcaaagggctcaggatcactggcaacctggttggctcgctcaaagaatgcatggaagcagttgagctggtccgtcgcggaatggttaaaccagaaatccgagtacggccattcagggatctgcctcaagtgtatgaggaaatggagaaaggtgatatttcaggacgcatcgtcctcggggttgcagaatga

SEQ ID NO: 11523 - DNA, 198 bp, A.fumigatus
ttaacacagagatataggcctctatctagcttctttataaagagtactagtgctgctggtaggatagataattccttaatccaccccttcttaagtattttattaaggtatttatatagagcctccagctctagctataatatagtaaataaggggctatatagcagtaacttcctattaagtagttatatcttatag

SEQ ID NO: 11524 - DNA, 183 bp, A.fumigatus
ggagggttttactcaggtctgatgcgccgacaggacttttggcccatcatgtttgctggattcaagctctggccttttgtctcgattctcaacttcacggttgtacccgcagacaagcgattgcttgttggtagtttgtttggcgtcatctgggcggtttatctgagtctgatgtctgggtga

SEQ ID NO: 11525 - DNA, 441 bp, A.fumigatus
gcagccgccgggttggccaggttgatcatcacctgggtcttcacaggcggcaggtccgccagatccaccgtctgggttgtgatctccgcgcgaccctcatataccaggcccgtgttcccttcggcgcaggagaccgttacctcctggctggtgtgcagcacgtacgtagcattccctgtgcccacaaccgccggaagacccagctcgcgactgacgatcgccgcgtgcgaggtgcggccgccatggtccgtgacgatcgcggccgctcgcttcatgatgggcacccagtccgggtctgtggtgggagtcaccagaatcgacccatctacgaaccggtcctggtcacgagccgattcaatgagacagacgcggccagccaccgccgcttctcctatagaaaggcccgtggccagcacccggcccttgccgcggccaacctga

SEQ ID NO: 11526 - DNA, 1119 bp, A.fumigatus
gtagtagcgagacgcgccccgaaagccaatcatcgggttatcctcctgtggttcgaattccgcgccgccaatgagcccggcgtattcattggtcttgaagtcgctcatgcgaaggatggcgggacgggggtagacggacgcacaaagagctgcgaatccttgcgccaactggtccacaaaatagtcgcaacggtcgtgctcataccccgtcgtcagccgcgcaatctcggctttggcctctgcatcctgcatccggtcgaagtggaccagtgccattgggtgcaccctgatcgcgttactgacgacaaactccatgcgcgccaacccgatgccgtccgccggcagccgccaccagcggtaagcagccgccgggttggccaggttgatcatcacctgggtcttcacaggcggcaggtccgccagatccaccgtctgggttgtgatctccgcgcgaccctcatataccaggcccgtgttcccttcggcgcaggagaccgttacctcctggctggtgtgcagcacgtacgtagcattccctgtgcccacaaccgccggaagacccagctcgcgactgacgatcgccgcgtgcgaggtgcggccgccatggtccgtgacgatcgcggccgctcgcttcatgatgggcacccagtccgggtctgtggtgggagtcaccagaatcgacccatctacgaaccggtcctggtcacgagccgattcaatgagacagacgcggccagccaccgccgcttctcctatagaaaggcccgtggccagcacccggcccttgccgcggccaacctgatacgtgtggagacgggaagtcgcatcaccccggcgcgaatgcaccgtctctggcctggcgtgcacaatgtacagccggccagtgatcccatctttggcccattccatgtccattgcgcccgcataatggccctcaatggtacaggcccagcttgcaagctggagaatctccgaatcgctgagcacgaaagccgcgcgctcagccttggacgtcggcacgttatgcgttggttgctgcggatcatcactgtaaaccatcttgatagccttatccccccgctttttgctgataatgggccgcagcccggccttgcctag

SEQ ID NO: 11527 - DNA, 246 bp, A.fumigatus
ccaggaccggttcgtagatgggtcgattctggtgactcccaccacagacccggactgggtgcccatcatgaagcgagcggccgcgatcgtcacggaccatggcggccgcacctcgcacgcggcgatcgtcagtcgcgagctgggtcttccggcggttgtgggcacagggaatgctacgtacgtgctgcacaccagccaggaggtaacggtctcctgcgccgaagggaacacgggcctggtatatga

SEQ ID NO: 11528 - DNA, 1995 bp, A.fumigatus
ttaccttcctatctcggagaggaacaaaggtatgaaggagaaatggcaactaacaaacagaacaacgatcttctggtgtgcgactttgaacaaattcggcgccatgatggtgccattgtgggaggtaagaatgcctcactaggtgagatgatcaatacccttgaggcaaagggaattgcagttcctcctggctttgccacaacggctcaggcctactgtgtctacgtggacgctaatgggatccgtgacaagatgggcgcgctgatagcggactgggaagcgggaaagacaaccctagccgagacgggcagggcaatgcgccggctgtttcttcatgggagttggccagaacatgctgccactcgcatccgggacgcatatcgcgccctagcgactcgagtcggtgtctctgaaccgagtgtggccatccgctcaagtgctactgccgaggatttgccggacgccagcttcgccggtcagctcgaatcttacctcaacgtgaccggggagagggccgtgctagacgcctgcaggcggtgttacgcctctctcttcacagaccgggccatcagctaccgccggacaaagggctttgaccagatgaacatcgcgttgtccgtcggagtgcagcagatggtgcggtcggacgcaggcgggtccggcgtcatgttctccatcgacacagaaagcggcttcgatcaggttgtgctcatcactgccgcgtggggtctgggcgaaaacgttgttcagggcgcggtcaacccggatgaataccaaatcttcaagcctctgctaggcaaggccgggctgcggcccattatcagcaaaaagcggggggataaggctatcaagatggtttacagtgatgatccgcagcaaccaacgcataacgtgccgacgtccaaggctgagcgcgcggctttcgtgctcagcgattcggagattctccagcttgcaagctgggcctgtaccattgagggccattatgcgggcgcaatggacatggaatgggccaaagatgggatcactggccggctgtacattgtgcacgccaggccagagacggtgcattcgcgccggggtgatgcgacttcccgtctccacacgtatcaggttggccgcggcaagggccgggtgctggccacgggcctttctataggagaagcggcggtggctggccgcgtctgtctcattgaatcggctcgtgaccaggaccggttcgtagatgggtcgattctggtgactcccaccacagacccggactgggtgcccatcatgaagcgagcggccgcgatcgtcacggaccatggcggccgcacctcgcacgcggcgatcgtcagtcgcgagctgggtcttccggcggttgtgggcacagggaatgctacgtacgtgctgcacaccagccaggaggtaacggtctcctgcgccgaagggaacacgggcctggtatatgagggtcgcgcggagatcacaacccagacggtggatctggcggacctgccgcctgtgaagacccaggtgatgatcaacctggccaacccggcggctgcttaccgctggtggcggctgccggcggacggcatcgggttggcgcgcatggagtttgtcgtcagtaacgcgatcagggtgcacccaatggcactggtccacttcgaccggatgcaggatgcagaggccaaagccgagattgcgcggctgacgacggggtatgagcacgaccgttgcgactattttgtggaccagttggcgcaaggattcgcagctctttgtgcgtccgtctacccccgtcccgccatccttcgcatgagcgacttcaagaccaatgaatacgccgggctcattggcggcgcggaattcgaaccacaggaggataacccgatgattggctttcggggcgcgtctcgctactactcaccacggtacagagaggggttcgcactcgaatgccgggcaattaagcgactgcgagaagatatggggttcaccaacgccatc

SEQ ID NO: 11529 - DNA, 192 bp, A.fumigatus
acatcgcgttgtccgtcggagtgcagcagatggtgcggtcggacgcaggcgggtccggcgtcatgttctccatcgacacagaaagcggcttcgatcaggttgtgctcatcactgccgcgtggggtctgggcgaaaacgttgttcagggcgcggtcaacccggatgaataccaaatcttcaagcctctgctag

SEQ ID NO: 11530 - DNA, 1344 bp, A.fumigatus
gaagacgatgccttgaggctggttactagtgatcgagaaagattgcggggtcaccaacgcagtagcagccggcgtcctgacaagggcgggccgagaagggacgcgtctcttgagagcagacactcgcgagcaccatctcgcaatcgtcaagagcaggatacgaacctaaacacgaccaccgaacagccgacgaacaggttaatgacgagcgataattctcagaccgatgcatccttacaagagagagcccgtgaaacagaaaaagtgcagatgcaagctcgaaatgcaagcgctgcagccttgtcatctaccgcactatcagaacagagacgaaaggagctcgcagctgccgaactggaggcccggcggctttcccttgcgcgcaacccttcagccccaaatataccgtttcctggagagctgcagtacagccgaagccccctagatagcccaccgttttccagaagctctgccaaccagcgtacgccggcgagaagaagagtgtcgaccagcaaggcctcgccagactatcctagcagttccgattcgaattcgtcgaggtcaggaggccctcttggtctgccggcgactcctaaagccatgcgtcacccaaaataccccaatggttatgaagagaccgtctcccctggatctagtgtcccagacaacgtcataaccctgagtgatgccaggtaccaaggcgaaggcgagagaatcggccgttcaatgtctgttccagttccggagcatcaccctggtcccatgcccgtcgacctgccaacccatccgaggttcaacccccgtctcccgcgaagcagatcgaccagcaggagccggaacatcggtcaccggcgagaaagttctcgagagctgggaggctccggggggtatccttacggctcttctccagtcaccgtcagcatcgaggagacgatcgaagattccgtgagcctgaaggaggccgagaatcctccaatcctgccagagctgcagcatctgaacactccaccgcctcctccgcctcctgctccccttggacctgtctctccacgcacatcttccggaactatagacattgctattgacaacgagaacctgggcaaattgctccctcgagcgatgacagcagctccggcaatcactacggaaacgcggcctagcatcgagcgcaggcgcacatcatttgaccatcgacgaggcaagagcgtcaacgagagcttcacgaacaagattcggaatctaacgcgcatgcgcagcaacagccgcggactagacaattggacatcttcccgtgagacgggggtcccctatgaaagtgtacaaatgtcggacggccggatgtaa

SEQ ID NO: 11531 - DNA, 843 bp, A.fumigatus
tacaatcctactttgatctacgcaaaagctcatctgatatttaccgaggcaatcagttgcactgcctttttactgctatcccattttgcacatacgttacgattgacgacacgactcattgacttacgaattgaccttgcagagccatacttcgacgtgatccgatattcgttcagcattggttcccaattgacttcgttgaaacatagcttcaactatcccttttatacctcccagtctcccgagcatatcgattctcacccaaaggccaacgaaatgtcctcgccaagcgttcgtaatcccgtccagagaaaccctggtaccacccacaagtctcgcaagggttcgggttccagcgctgcgtcctcaaggccggagatcactacccccaagaacaagaagactccccgcaagctgcagaccagaacgccccaacccgtcgaggaagacgttgacgacgagaagcctccaactccatctcctcaaccgacgaagaagaagtttcagcccgagcccgtgcagcctgaggtatcgcctgcaccggaaggcaaccgggacgagccagagcagcaagaggaggacaagacggcactccctgccaggccgaagaagaagaggtccaagcccgaggctgagcagcggggcatttcgtcccccctcccgggtgatgtccagccgcaagcatccggctctgcaagccgaggcgataaggccacggacttgacaggcacagccaaggcccttggtggtaaggtgaaggatactgcgcaagacaccagagaggaagtcaaggaggacgttccctctacccctcttgacctgtccgccttgaagggcctttga

SEQ ID NO: 11532 - DNA, 522 bp, A.fumigatus
aacatagcttcaactatcccttttatacctcccagtctcccgagcatatcgattctcacccaaaggccaacgaaatgtcctcgccaagcgttcgtaatcccgtccagagaaaccctggtaccacccacaagtctcgcaagggttcgggttccagcgctgcgtcctcaaggccggagatcactacccccaagaacaagaagactccccgcaagctgcagaccagaacgccccaacccgtcgaggaagacgttgacgacgagaagcctccaactccatctcctcaaccgacgaagaagaagtttcagcccgagcccgtgcagcctgaggtatcgcctgcaccggaaggcaaccgggacgagccagagcagcaagaggaggacaagacggcactccctgccaggccgaagaagaagaggtccaagcccgaggctgagcagcggggcatttcgtcccccctcccgggtgatgtccagccgcaagcatccggctctgcaagccgaggcgataaggccacggacttga

SEQ ID NO: 11533 - DNA, 528 bp, A.fumigatus
aaaggcagtgcaactgattgcctcggtaaatatcagatgagcttttgcgtagatcaaagtaggattgtattatacaagcgtcaattagcatcgagtacctataggtctttctgtgcgaatatctattcatctcagcgcagcattcccttcaactcatttaaatgcacacaagcaacaatcacttgcgcctattatcatcctacgtcatggactattgacatcatcatgcaccaagccaggccaccgctagcagtatcaagctgtagcttccattgggcccttgtcccgccattcgcttccttcctatcaagcaagacaatcaccggaggacacatctgtaatgagggcaacgcaaaaaggcagccacagtcgattgggacaggacggtggcttgagcccaagggtcaatccgtggatggccaggctagtatggaaaactggacatcgaatcaggtgggagaagagccaggcaacaggcttaaagaaattaactatgactgtatatccggtcgaaaaggacccgcttga

SEQ ID NO: 11534 - DNA, 507 bp, A.fumigatus
ctaattcatgttcagatcatcaaagctcaggaagagtccgatctccagctgtgctggacctatctcgctttggcgttcaatatgtgtcaaagcatgggcctccaccgaagtgccgccctgaaacacgatcccgtcccgatcgctgacgccaaacgtcatgccttctggtcgttgtataccattgacaagaatctgtcattgaatctcggattggcttcgcatttccagaaccatgacatcgatgcagagttctttgcaccatcagacaacccgcattaccgcccctgggacctgatgactctcaccacgattgactttgcaactctacaggggcgcatctacgatcggctttactcgacctcggccactcaggctactgagtcggaaaggttgaagtcaatagaagagctatcgagtgacttgatgctggttcgcgaacgccttctgggggtaagtgtctcgatcattgacgatgtactcttaccaaccttggccagatcgatgtga

SEQ ID NO: 11535 - DNA, 1233 bp, A.fumigatus
agggtggtctgtgctccgcggaggagaaaaaaaagttgtcgctcacttaattccgcgccgagtaacctcacgccttgcggagtcagctcttcaccaaaacttcacctaatcacacatatatgcttctgttcggaaccgaaaaatattgatttgcttgtattttgcaaatataccttgagcgcagtcagcaggccgaggctgcaagtcccgaacacaccgcatcgtaatctcaaacactctttgacagacggctctgtcgaagcacaatggcgccagccaagtcaattaagaagacttcctcgggcagctcgagcatctcgagcagcagatcgacatcgccggaaccaacaacaaagtcgaaatcggatcgcgagactgaagattcggccagctccgattctgagagtgtcccttcgtccccagagatcaaggcttccaatatgtaagttctatggcttacgttgctctcggaagactgtcaagctcacaagcactagctcgtcttcaaacgactccctctacccgaaaccttcctacaagccaccgtcaggcttcaaggctgcgaagaagcaattaccgccatcttctaccacatcctccctcctttctgaccttcgcggcaaacaactcttccacatcactgcgccctccttcctccctctctccaaagtcaaagaggtgtcgctggcgaagatcttacaaggggagccgatacttgagcacgagggcgtgcaatatggtatcccatccgagaacattggccacggtgatttgggtggaaagagtctccttctatacgattcgaagacacagacatactacagcgcacctgccactaccatgcctacctatcacgtacagcaactgatcgacctccctaaaagcttagggaccgaggatgcagtattggcagcagcacaggatcagatcaagcctccacggaagcaaccgaaacatctgaagatgcggtttcgcccggtcggtagtgaagagggtccaccagagacgatcggttcgagttcggaagagtccgagggagagggaaagccgaattccaagtttcccagagaatcaaagaccgagcgcgaggaaagaaaacggaagcatgccgaagaagtggaaggatcccaatcggctggcttgcccaggaagaagaccaaaaagcaaactgtcgatacatcacaatcaagcaaaaagcgagatgagaagaaacggaagaaggagaaggcgtga

SEQ ID NO: 11536 - DNA, 246 bp, A.fumigatus
acaacgtgcagtgattccaagcaagtatgtacttacaaagaggaacaagcccaacgccctagcttagcttctggcgtcacttgtctgtatcagctgttcacaagttcccagccccaccaatcatggagatcacatgtgattgaaggacagtattcttccaatcagaagcagagtggcatcactcaactggcttatgtcatcgctctcttaatcggcctgtattttacattaccgtcgcatctctga

SEQ ID NO: 11537 - DNA, 432 bp, A.fumigatus
aattctgtcttagctccggtcagcgcttttgcagcgcgcaaagctcggcaacagcaagcacggcttttagagccagagaagactgcgcagaatgaacccgccgtcgagccgccatctaaaagagcgcggcggtcacctgaggaaggtgccgcaaggcaggccgctaacgaaaatgatcgggtacagacgaggcgctctgcgaggacgaaggcagagaccttgagctctgctgagcttgctgaaaagcagcctcaggagtctgctgccgctgcaagagcacagaccgcagagcggacaccagctccggagaagggagatgcggataccttcgacgctgccgaagaagaggaggaggaggagaaggaggaggatatactggagcgagagaatggcgtaggagtcattgctgtggaggacgatgctgaagggtga

SEQ ID NO: 11538 - DNA, 189 bp, A.fumigatus
tataaaatcaactttaacgcacatacccgtgtactcagaatcaaggtcatgccgactcgactccacgacgtccaccagcggtgggctacagctgctatggcgacatgggctcttaatggtctcttaaatcaagatgaagttgacctcctttgtggttctgtcggctcgagtatgtactacttctgctag

SEQ ID NO: 11539 - DNA, 186 bp, A.fumigatus
ctcgggaagctgcttgtcagcttcgatctcactcatatgatggaggccattgtcaaccgtgccatttccgatcagaaacagtatgccgagataagcacatgttctacaatcaagagcaacaagtcagagacgaccattggcagaaaatggcaagccgaggttcggacaactccgtactatagttga

SEQ ID NO: 11540 - DNA, 240 bp, A.fumigatus
cctcctttgtggttctgtcggctcgagtatgtactacttctgctaggttcttatggtactaataaatacatcttagcttttactggttttgctggaaactaccgaggttcttccaaagaaccagactacagtttctgccctaatagcagtgctttcccctcgcttgttattgaagcaggttgggctgagtccttcccgcattgtcttcacccggggctggaagggtccgcttcagtataa

SEQ ID NO: 11541 - DNA, 240 bp, A.fumigatus
ccccatatggtatcagtgcccttatgtctggaggctcagtatggatggattatggtcagacctgacattgacaacttgcggacaaaattcttttcggactacgttacaggtctcgagggcttaacttccttaagaacgcttctttgccgcctacttttggttaagtcgtgtgagcagactactggggggcttctgggagtgcagcaaatggattatattgcctggccaggggaggagtaa

SEQ ID NO: 11542 - DNA, 1053 bp, A.fumigatus
tttcctcaaggctattgcttcgattctgggcgtttagaaagcctgcagtcggccctggaagctgaatccagtctgaagcgccggcgtcagagttctagcggagatcttaactttttacggccacagaagcgagcgacagacgacagacgtccctctagctctagcacagcgtcgtctagcactcctcagagccaattgcatgatgagtctgaggaactgaagcgacttttggggttagacagtgacgatactctgcgcgcactccaggaagagcagagaaaagcagagaagtggctcgaagagcggaaggagcaggagcgtcgtgacgaagagtatgcccgtatgctcatgaacgggatgtatgaacctcctcgtccagcctcagctcacagcaccgcttctacgaattattcaaggtcgtccatccagcttccatcagaagcttccctggtatatcgcggcgaagcgggaccatcttccattcctgagcatcgttccatcaatacgccacttgtggatcgtcttgtggatcgttcgcggtcatcctacagcattccgtcaacgcctgaatcgggacattcggaagtacagcatctaccacttattaccttgcgcgatagtgatgacagcgatatagcagagatctcgccccaagattttcacagtggtcagtccagaccccaaagccatcacagactgtatccgagctacaatacccatccgggtcattcttcaaaccgtcggagcgtggcaaccgagctgggaagatacgtcccggttactcaaccttctattcgactgggatatagtgcgcctcaaggttctgtgtacgggcccaatgtcttgcagaatactatggcaaggcttcaagcaagccggcagatgttacagcaggcgggaagatcagtctttgaaggattttcgtcatacttcttaccctcaggctcttccggcttgcccactggactttctgctgatgattactatgcttcgttgaagggctacaggtatgctgccctgcgccttgatataacaactgcatcattaggctaa

SEQ ID NO: 11543 - DNA, 540 bp, A.fumigatus
gacttcacccgaccactcaagggtccgcctggcgagtctcgcgacaaagctatgcaacaactgcaggttctggtgaaggcggttctgcttagacggaccaagacatcgaagattgacggccagccgattctacggcttccacctagggttctagagaaggtgtatgctgtgttcagcgaggatgaacaggccatctacgatgcgcttgagagcaagactcaggttcagttcaacaagtatctcaaggctaacgctgttggaagaaactactccaacatcctcgtcctgcttcttcggcttcgtcaagcttgctgccacccgcacttgatgactgattttagtgtcgaggtcaatgctgctactgacgagttggaccttgtcgccaatgcgaaagctttcggagatgaggtcgtggtccgtctcaaggagaacgaaaaccttgaatgccccatttgtattgatgcagttgacaatcccattatattttttccgtgcggtcttcaccacggggctggaaggagccgcgccacaatgacagca

SEQ ID NO: 11544 - DNA, 858 bp, A.fumigatus
tataacaactgcatcattaggctaacaatagtctttcgatccagtgatttctatgagcctggtgtggatcccaagcaagtccaggaagagatcaaacaattgctggaaacgatcagaccagacaccgaaattgccaaggaaaagcgggaaggcaccccagaggctcttaggtacactttgctggagcatcagaaactggggcttacctggatgaagaccatggaagagagcgaaaagaaaggcggtatcctggccgacgacatgggtctcggaaagaccatacaagccattgctctcatagtgtcccgcccgtctacggatccagagcggaaacccacactgattgtcgctccggtctctttaatgcagcagtggaaacgagagattcagaaggctgtcaagccgggtaggcatcaactttcagtctacgttctacacggtgacaagcgagtggtcagctacagagacatgaaagactacgacgtggtccttaccacgttcggaaccttatcctcagaactgaagcacagggaaaagtatgacgaactacagtcggctggcgcgaatgaggaggctctgtcccgaactttgctgaagaacctgccatgcctcggcccgagcagtctgtggcaccgagtcatcatagacgaggctcagtgcatcaagaatcgaaatacgagatccgcgcaagcatgttgccgtctcaactccacctatcgttggtgtatgagcggaactccaatgatgaacactgtggaagaactacattcattgttgaaattcctccggatcagaccttattccagccttgatcgtttcaacaaggtaagtgtcggtgatcacaccgtgtttggctaa

SEQ ID NO: 11545 - DNA, 321 bp, A.fumigatus
tcaagcatttcacctcgactgactagacgatctatcccctgtcaactggagattccagtcgagtcacgattattgtttctttataaggattcgatcattccagggcgatcggtgttgggagcccaactaaacacgcttcgtactatcctgaccgcctccacagcccacatcccaagctatcgctcacagacgcacgatcttcccaaccatctcgtttttcttattggtttttttttttttttcgctatcttccctcctctactcattctcattgagactccgatcttcgccggcttggtcctggttctcggatctctgtaa

SEQ ID NO: 11546 - DNA, 579 bp, A.fumigatus
tctgccaccgcgtgggcaagaccgacgttcaagcaaaactgcaacgttgacaagctcatcaacattcttgatcaagcagtatctgcatatgacgcccaggacctcgcaacgaaggccatccctcttctccacacacttgtgaccatctacgaagtggcacctgatgggccacgtaaatacatgcagtggctcctcctgccggaagacagtgatagaaaacagccaattggcaaatcagatacgctatcttccaagctgctgcgactgtcaaccacgccataccagaatctgaaaatcgcgatctccgagctcatgttcgttctctccggcaaagacgcagagaacctgacaaagaacatcggatacggttttgccgccggattgctagcctctcgtggtattgagataccacaatctgcgagtgaagcttttgcaaccaattcgaatagcttcgacccagagattaaccctatcactggccaacgatgggatgccgagaaacaggacacgggcccgccaatgtccagagaggagaaggaaagggaagcagagaggttattcgtgctttttgagaggtaa

SEQ ID NO: 11547 - DNA, 405 bp, A.fumigatus
ggagggaccaggaatggttcgaaacacacaaggatggttcgaatgctttcttgtcttatcttcaagcgtaggtcatttttctcaaatgtcttttgtgttatgcttcgtttatcttacccccatcatagccaaatttccgaattgcagatagcaacgtcgcagccgttagggctcatcatgcaatacaccttcaggactatcatcgcgctgggactggcattctatacctcgtggagtcttgcattcattactctagccgggattccggctttctcagccatcgttgcctttctttcttcgcgaatcaagcccagaatcgaagcccagcaggttgagcttaaccgtgcctcaaaagttgccaataacgctacgagtttgattgacacggtcaaatgtctcaacgga

SEQ ID NO: 11548 - DNA, 381 bp, A.fumigatus
tactcccatcgatacttacagtttcccggtttagccgtcgaacacttgatgacatactgggcgattctcgagaaagtccgcggttcgcagctcagattaacaaagatggacgacgatatctacgagcacttcaagagggaatttcccgacttcgatcctgcggcacccatcgacgaggatagtatgaagagcaaggagggcaaggaaaagtggcggaaatttatcaaggagtacgagaagaagattagcgactacaacttcggaaccatactcagagtcagtcctggtgtcgagtacgatcaagacacaaccattttcggtaggttgctactctgtgctaattcttttggcaaggtgcgaatagctactaaccgtcactga

SEQ ID NO: 11549 - DNA, 534 bp, A.fumigatus
tggtcgtttctcacacttctgatctcatccgaaattactgagaatcctggtcgaggacgattttcaatcagcctctacaagatgacattcgccttgtcaatatcacttcccagccttagacgcatattgcactggagatggagttggatgtcattgtttagctttaccaccaagaaccatttgcccactttgagtctggcgatggcgcttgctctccttgctagctctgttacgcctatattcgccatccttctgggagacattttccactcgttcacatcgttcggtggtggtgatattagtggcgacgaccttctccgaaaggtaaagagaaacggcatcgcgctttcaggcttaggtatcgctagctgggtactcaatggaacgtacttcagtctcttcattgtttttggggagctacaagtatcgaacgctcgaaccaggatcttcgaagaacttctaaggagggaccaggaatggttcgaaacacacaaggatggttcgaatgctttcttgtcttatcttcaagcgtag

SEQ ID NO: 11550 - DNA, 321 bp, A.fumigatus
cgtttgaatgtcaatgcggcatcaatcgtcgccattcaactcttctacttacaatgggaaaaaaaggccccggacacgtttcaagtccctcttgaaacgctgccaaccggcttttttgctctgatcggaaagaaccgaagctcccaaaagtcgttcctgctcgtcgaaagtcgcgtcacggtcgccctccatgaactcgcgttcctccgcgagctcctctctttcctcgacagcacggtacccagcgtatgcggccgaaataggctgcagaggagatcttggcaggaccatgaaaaagctgactaccatgaccgctggtag

SEQ ID NO: 11551 - DNA, 213 bp, A.fumigatus
cgaactaacctacctcccccgtcttcctttgttatgcctgctgctgctgatacagaggaagaacaacctatgctgccacttcctggtgctccatcctcatcatgggctcaattctgccagcgattccgggccttgttcagtggcgcggaccctcgcgtctgcgtcgccttttggctctttggtgagtcgatgcaaaccgaggccttcccatag

SEQ ID NO: 11552 - DNA, 783 bp, A.fumigatus
attgaagcataccttgacgctgacaattatgcgctttgcctgatcattataggtctaattaacaatgtcctgtacgttgttatcctgtccgccgccctcgatctagtcgggcccagtgtccccaagggagtcgtccttctggcggatgtgataccctcgttcgcaacgaaactcatcgccccgtacttcatccatatggtgccctaccccgtgcgaatcatcatattcgtcttcctctctgctgctggcatgctcctagttgcgctgagccctccgtataccgatggggggacgatagccactaaacttgctggcattgtgctggctagcttgtccagcggaggtggagagctgagcttcgttggattgacacatttctatggccctttcagtctggctgcctggggaagtggaacaggagcggctggtctggttggagctggtgcgtacgccctggccactacctcgttgggtctcagtgtgaaggccactctgttggcatcttcatgtctaccagcggtcatggtagtcagctttttcatggtcctgccaagatctcctctgcagcctatttcggccgcatacgctgggtaccgtgctgtcgaggaaagagaggagctcgcggaggaacgcgagttcatggagggcgaccgtgacgcgactttcgacgagcaggaacgacttttgggagcttcggttctttccgatcagagcaaaaaagccggttggcagcgtttcaagagggacttgaaacgtgtccggggcctttttttcccattgtaa

SEQ ID NO: 11553 - DNA, 240 bp, A.fumigatus
  unsure (184),(210),(212),(213): Identity of nucleotide sequences at the above locations are unknown.
atctttactgttgtgtgtggattccagagctttcagaagaagtatcctgatgttatctctgagattcgcggcggtggtttattcctgggtgttcagctgtccaagtcgcacacaaccaaagcgtcggacctggtcaccgcagttcctgagcgaggattgttgatcattactgctggcgaaggangtcttcgcttcgtccctcctccgacnannaccgaggagcagattaaaagtttttga

SEQ ID NO: 11554 - DNA, 522 bp, A.fumigatus
cattcaaacgctagtatgcttccactacttctggtctatgtcgcggagtacacgataaaccaaggagtgtctccgacactgctctttccgcttgacgaatcgccttttgcgcatttccgtgcgttttatccagcatacaatgcgatctaccaggtgggggtctttatctctcgatcctccacaccttttttccgtatccatgacctctacctcccgtctttcctgcagattctgaacttggtactactgacccttcaagccgttttcaacttcatccccagtgtgtatatcatttttataatcatcttctgggagggattattgggcggtttggtctatgtcaacacatttgctgagatcggagatcgtgtgccaaaagaagaccgcgaattctccctaggagcgacaacagtcagcgatgcagcaggtatctgcattgctggcttcgtcagtatggtcttcgaagtctggctttgtgactggcaagtcacacatgggcgggactactgccggagaatatag

SEQ ID NO: 11555 - DNA, 849 bp, A.fumigatus
  unsure (193): Identity of nucleotide sequences at the above locations are unknown.
ttaataaataccttgatctccttcattatcatcttgatctttgccttcattcacctgttctcttcatccccatctttccttatcttctcggtaagccgtttagtgaattcttccagtaacactgatccggcccaccctcccccatataagagtgatatcatctacttctcttctcttatcacccactcatctnccttctacgttaatcttaccttactctacgtctacatactctctcgactctcatctttagctaccatgcctcgctttgatgatgccgactttggtgtcgagcccgctcctgccggtgctcgttcgcccagagatgctcgtggcagtgcttctggctctctccccatccccaacgaggccggcaacactgtcgaaatccctgccaccagaagctccatcagtgatgccgctcagttcatgcacaacctgagcttgtctccttcgatgcgggatcgtcggggttctcgcaactctttcggcacttccctccctatccccagatcccctcgtgtgtctcgcctatcgtctgttcgtaaggccgacgccgcctctgtctctcgtgatatcctggcctctcaggtccaggacatgtccaaggagaaggtggctgccgccaagaacatggcgttcgctttcgacatcgacggtgtcttggctcacggcaaccacgccatccccgaagccaaggaggccctcaagatgctgaatggcgacaacgagttgggtatcaagatcccttatatcctcctcaccaacggtggtggcaagactgaagccgcccgttgcgagcagctttccgagatcctggaggtgcctatctcgaccgaccagttcatc

SEQ ID NO: 11556 - DNA, 642 bp, A.fumigatus
gcttcttcttgctgcactgttacccctccgtctcaaaaaccgcccaataatgcccccccttctcccacttatccgtcatcacattccaatacccctgaacatcttgtttcttttgatcagtttcccattgttcaatttcatcgatcttcttctacctcaaccacctcaattgcgcctctacctctgtgcaaaatgtcggccggtgtcactttcactctcagcaacggcgttaagatccccgctgttgggttcggaaccttcgccagcgagggtgctaaaggcgagacctacaacgctgtcacttgtgctctcaagaccggatacagacacttggattgcgcctggttctaccagaacgaggacgaggtcggcgatgccatccaagatttcctcaaggagaacccctcggtcaagcgcgaggatattttcatctgcaccaaggtctggaaccacctgcaccgctacgaggatgtcatctggtcgcttgagaactccctgaagaagctcaaggtcgactacgtcgacctctacttggtccactggcctattgccgcagagaaggagacgcaagagaagcccaagatcggccctgatggaaaggtaattctgcgacccagagtcttctgtttgaaccgctactaa

SEQ ID NO: 11557 - DNA, 570 bp, A.fumigatus
tacgtcttcctggaagacctcaccaagaaccccgagcccacatggagggcaatggagaagctctacgaggaaggcaaggccaaggccattggtgtctcgaactggaccattgaagggctcgagcagctgctcaagttcgccaaggtcaagccccacgtcaatcagatcgagattcatcccttcctgcccaacgaggaactcattcagtactgcttcaagcacgatatcctgcccgaggcctactcgccattgggctcccagaatcaggtccccaccaccggcgagcgcgtcagcgagaacccgaccctgaacgagatcgccaaaaagggcggcaacactctggctcaggtgctgatagcctggggtctgcgccgcggctatgttgtactgcccaagagctcgaacccagctcgtatcgagtccaacttcaagagcattcagctgtcggatgccgactatgaggccgtcaacaacgtcgctaagggccgtcacttccgattcgtcaacatgaaggatacttttggctacgacgtgtggcctgaggagacggccaagcagatgtctgcttaa

SEQ ID NO: 11558 - DNA, 369 bp, A.fumigatus
gtgaggtggaaattatgctttcatcctctactattgtccagcgctaaactttctacacacggcagattcgaacagttcaaagaactcactgacggtgacaagcctgttgtaatcgacttttgggcaacatggtgtgggccgtgcaaggctatttcgccccttttcgagaagatgtcggataatcccgaatatggcaatgtcgggttctacaaagttgatgtcgatgagcaggagcaggtctctcaagaggtcggcatccgtgcaatgccaacctttgttctctttaagaacgggtataagattggtgaagctgtgggagccgctccaccacgtctggaaggacttctcaacactgcacgctctctatag

SEQ ID NO: 11559 - DNA, 534 bp, A.fumigatus
tccaccaacgcccctgacttggcaacagctgtcagccaccacatccgccgccccgcaagcatgagagaggtgggagagatgtggaagaacatcctggtgggattctttcccaacagagagtatgctccgttccccttccgagacacccactactacatcaatctcgacctgaacactcacggctacttgggcctaggctccgtcgtgcgcactcagggtttcaacgcgggcgtccactttctccagctcaatttcacggcagctccagccgacggctctcctttctcctgggagggaaatgagcactttttgaagcgggagatgagaggctcgctgcagagtgttcctgaggaccgcaagcgcgccatctatggactgattgcgattggaacatatgtgcgcctctaccggtacctccctgacggtcagtttgctcctgtcaccttcgtggttggcaagcagacactgcatgtccgcgctgaccaagcagtcatccgagaattcctcgccggcgttcaggaggagtggatgtga

SEQ ID NO: 11560 - DNA, 333 bp, A.fumigatus
aggcacgtcctgcttatctctctccaaaagcaattagtcatcatgcgtgtcacggtcttttctttgctgactgccctaagcgcatcactggtgtgtgcccagggatatagtaaagaatgttctgatatctatctccaagaaggttggctagttgcaacctgtcccaaggacgacaacaacggcagaattaccagcagcgtttacctgccgaacaagattgccaacgataatgctgtgctggaggtgagttctcgactgccgtcatctcctgttctcttacccggactaacagaaatacagtgggctgttgagtatgtctgtcgtgcttggtga

SEQ ID NO: 11561 - DNA, 507 bp, A.fumigatus
acgacggaaattccacctccagccctgaaaagcgatcatcggaccgcgtcgcttcgatctggacacaacagtgcaggcgcaaactcacctcgtcccagtctatcgcgacgctcttcgtcctccaacttcgcgacctcccccacttccacagcaaatatgccatccaaaagacctcaggagcaagctgcgcccactgcagcttctgtcgccgcggatttcttccaacgagaagtcgatttgcaccaatccaccgacctacattccaaagtcgtggtagtcgttcatgacgcgtgctacggccatcgtttctcgcggccgcgaacgtcgaagaccgctttgagttacatcgtcgaacggcccgagagaatacaagcttgtgtggtgggagtatcggcagcttatgtcctcatggccggccgccatgctggaaagcgctttgcccctcatcctgagcttgatttacatcagctccccgcgccgccgttccaaatccgcaagacgtcgcgg

SEQ ID NO: 11562 - DNA, 360 bp, A.fumigatus
cccgatgaaatacagatggggatcttcttatgtatgcggtgtgcagctctgcatcgtaagctgggcacacacatttccaaggtcaagtccttgaccatggacacttggacggctgaacaggttgatgtaagtaaatcagttcaacaacgtgaagaggcacaagctgattgcctatgggacacagaatatgaaatcacacgggaataccctcatgaacaagatcttcaatcccaagaacatcaaacctccggtccccaaagatatcgacgaggccgatgccagcatggagcggtacatccggcagaaataccagtatcgttcgctggaggatggaaaaccgaaaccaccaagccgtcatga

SEQ ID NO: 11563 - DNA, 519 bp, A.fumigatus
gtaaatcagttcaacaacgtgaagaggcacaagctgattgcctatgggacacagaatatgaaatcacacgggaataccctcatgaacaagatcttcaatcccaagaacatcaaacctccggtccccaaagatatcgacgaggccgatgccagcatggagcggtacatccggcagaaataccagtatcgttcgctggaggatggaaaaccgaaaccaccaagccgtcatgattccagttacggcatgtctccggagggctcaccccctccactacctccaaaatccggccggtttccgggccctgggttacgatccgcttcctctacctcgaacctccagcggccgtccaacagaccctttgcgacctcacctcgatccgaaagacccgattcccctccaccacgaagcgtttctacttccggctctcaagggtttggactttccatccgtgatacaagtgatgcatcatttgagtcgaagctggcccagctgagagaaatggggttcaccaacgagcgt

SEQ ID NO: 11564 - DNA, 1017 bp, A.fumigatus
  unsure (563),(565),(571),(572),(573): Identity of nucleotide sequences at the above locations are unknown.
tgttgcctcgtcgatatcatgcaggttgctaatgtcgtccagaccaccttcgacgaatacgctacccccgatctcaccccagatcgaatggccgccttctatcgcaaagtcggcggcaactacgacatcctcttcctagagacaaagtactcagccctgtcattcatctatcagcgtctgggatgcttccacagcattcagcccacgaacgatccatttaagccgccgtccatcccagcattgcagcccaacggctttgtcagatggcagacgatccagctgcttctggaccccgatgaacatgcgcgatatctacagaatgccgttgcgctgtgggacattgagagtcccaacggaggaacttttccaaagatgatccctcgagacgctttcccatcggagccggacccggagatggtggagtggcatgagggagtgagccgacgctttgaattcgactactggcggaagaatgtcttgcgatcctctccgcccaatttccgcacataccactggcaattcggccacaaggatgcaccgcttgaaccaagagggggaccatncntgtgtnnnccaaaaagtaccggcctccaccaccacagcaccgacgacacacagagccagaggatccgcctccgaggagtcgccataacaggcggcggagcggcgagcttcccacatccgcaactcgaagagtcaaatcaacctattttccccgtgcagaggaggcgcctgaattcgcgtctcctcgagcgccatcgccggcctttcgaccccgaccagccacaaaatcgaggggccgcgaacggccgcactccttcgtctacccaacaagcacagagccccaccgtggccacgacacctcagacgcctcgtccgaagactcaggatccccaatccacggacaaccgccaagatcaggacgacacagccgttcgcggaacctatcacctccccgctccgcccgcgctcgacgccactcgcacgaagcatacgcccgcctacccaaagaagtag

SEQ ID NO: 11565 - DNA, 753 bp, A.fumigatus
atttgtactacccgatgggaatgggttggtgacgaaggattagacaccccttatagtaattctatgacgttagagatttctggttatactacgattcatagagaccgatcacgattactgctctggattcctcaccaccagtttcgatttgtggatatgttcgtacgactgggcgggtctcctacagagcccgtcaacttgcaagctatgtacaaccattctcaatctcggtcaaaaggcccgctggaaagtaaatccatactcctcgaacaccctgcacttgttcgtgccatgtggattctgcgtccaggtcggcggcatatcgagcagactgacattgcgctgctcgggatgatacggagggatatagtacccgttcttcccgaagatctcgtaggtcgcggcgtaagcgggcccccggacgcggagcatctccgggtcagggttgggactgcgggttcgaaaaaaggcgccgaagacgtcgtcgaggagctgcgagtggagaaggtcggtggtatcgtagtaggggtctacgttgcgggacttgctgttgagggtgccccagacggggagcacgtcggcggcgtggcaggtggcgttgtagttggtgtttggggaacagatggcggggacgccggcgttggtttggatgtggccgtgggtgatttcgagttcgtagagggcggggaaggcggtggcgccgccgttggcgaggaggtgggcttgtgggcacgtccactcgctgtaggttag

SEQ ID NO: 11566 - DNA, 567 bp, A.fumigatus
cgaccagttctacaccctcctcgccgacaacacgctccccaaccgcgtcccaaccatgttcaccaccgtcaccgacgaagccgccctctacgttggcggatttatcccgcaaatcgaggcatccaccgaaaacctcaacctcctcttcggcatcgcctacccccccggcctagccaacgccctcgcggcctccaacgccttcccgctcaacccctccgacccagacaccgtccgcaacgtcggcgcccaagccctaacctacagcgagtggacgtgcccacaagcccacctcctcgccaacggcggcgccaccgccttccccgccctctacgaactcgaaatcacccacggccacatccaaaccaacgccggcgtccccgccatctgttccccaaacaccaactacaacgccacctgccacgccgccgacgtgctccccgtctggggcaccctcaacagcaagtcccgcaacgtagacccctactacgataccaccgaccttctccactcgcagctcctcgacgacgtcttcggcgccttttttcgaacccgcagtcccaaccctga

SEQ ID NO: 11567 - DNA, 1200 bp, A.fumigatus
ccccatggggaaccattagcggaccttccagccggttgtgaaaacatcttcggccaggcaccaggcggccagagcgtgacggccttgctatcatccagcgcagccaaaggtttattctccggtgccattgttcagtcggctccgctggatctgccatggtttacccgcgaggtatataaagaagttgtcaccccgggggttgccaaggctgtcggctgcaaccaaaccgtctctgaagagaaactgctggcctgtctgcgctcggtgcccgcatcggccttcctcgacaatgcgaccgagttccagtccgcgatgacggccgtgaacaagaaagtcgccgacgagttcctgcacgtctcgacaatgctcgcctccattgagcccctaatgcccatggtcgacgactcgggcagcggcgtgattgacgaccagttctacaccctcctcgccgacaacacgctccccaaccgcgtcccaaccatgttcaccaccgtcaccgacgaagccgccctctacgttggcggatttatcccgcaaatcgaggcatccaccgaaaacctcaacctcctcttcggcatcgcctacccccccggcctagccaacgccctcgcggcctccaacgccttcccgctcaacccctccgacccagacaccgtccgcaacgtcggcgcccaagccctaacctacagcgagtggacgtgcccacaagcccacctcctcgccaacggcggcgccaccgccttccccgccctctacgaactcgaaatcacccacggccacatccaaaccaacgccggcgtccccgccatctgttccccaaacaccaactacaacgccacctgccacgccgccgacgtgctccccgtctggggcaccctcaacagcaagtcccgcaacgtagacccctactacgataccaccgaccttctccactcgcagctcctcgacgacgtcttcggcgccttttttcgaacccgcagtcccaaccctgacccggagatgctccgcgtccgggggcccgcttacgccgcgacctacgagatcttcgggaagaacgggtactatatccctccgtatcatcccgagcagcgcaatgtcagtctgctcgatatgccgccgacctggacgcagaatccacatggcacgaacaagtgcagggtgttcgaggagtatggatttactttccagcgggccttttga

SEQ ID NO: 11568 - DNA, 219 bp, A.fumigatus
tactggagtcttggtggtgttctgcatatctgcaagtacttccggtgcatctctcccagatgcgtgtttttcaccttatctccctatgagaagttcggaaacaagagcgacggcgctgcttctcatgaagccaatcagctaataggcaccccctcattggtcatgctactgaatgtgttcatgagcaagcttcatctgaccatcctcatgcaaccttag

SEQ ID NO: 11569 - DNA, 1014 bp, A.fumigatus
caaatatcttggggtcgcgttttgcaagaggatataagcgaagtcttgcttcgtggagcatttgatcaagagtttcaatggttgagaaggaaaaatggtaagtgctcgacactccgactcggtgagcaggcaattgacttcggagtacaacagaccatgaagagcaaaatggcagcaaaagaccagaaacgcctcgataatgcctcctcatctgataccaaaattgaattcgagttcggcggtgcccccggcgtgaccctgatcatgatcggcttcccgctgctgatgtactacatgtacatcggtgcagtcctctacgatggcctccttcccacccctgaggacggacaatcctgggcagacttcctctctcacctcgtcagcctcgcatacacccatgcctatcctacccggaaagcgtggacgatctactggacctttctcatcctcgaaggcgccgggtacctgtacctcccgggcgtatacggcaagggaaagcggttaccccatcttggtgggaagcagttgccgtattactgctccgccgtgtcgtcgtggtatctcactattgccgccgcgttgatactgcacttcaccggtgtattcaagctgtacaccctcatcgacgagttcggacccctcatgtctgtcgcaatctgttcgggaatcttcgtatcgatcgtggcgtacatttctgctctggtgcggggagtggagcaccgcatgacaggatcgcatgtctatgacttcttcatgggtgcggagctcaacccgcggctgttcgggtggttggatttcaagatgtacttcgaggtccgcattccgtggttcatcctgttcctgttgacgttgggaacagccctgaagcaattggaagagtatggcttggttgctggggaggtgctcttcctgctcatggcccatttcctgtatgccaacgcctgcgccaagggcgaggagctgatcatcaccagctggttcgtttgctttcctcgtgaagccatagagtgctga

SEQ ID NO: 11570 - DNA, 423 bp, A.fumigatus
ctttccgacagggacatgtactatgaaaagtggggattcatgctcatcttctggaatttggccggagtccccatgagctactgccactgcacgctgtatttggcataccatgacccctccacttaccactggaacccctgggttctggccgtgtgggccgttgcgtacttgttcatgtattgggtctgggatacctgcaacagccagaaaaattatttccgcgcccaggaacggggcgtcaccgttgaccgcaagacgttcccccagctaccctggaagtacatcgagaatcctcagtccatcccgacaaagaccggcgattcaatcctatgcagcggatggtgtaagtcattatctccgggggcaggttacgcagctgacgagggtagttggcatggcgcgcaaggtgcattatacatgtga

SEQ ID NO: 11571 - DNA, 207 bp, A.fumigatus
caaatgcacagaaccatggcgtcccaagtgcaaggaaccgccttcatcactggcgccgcatcaggcatcggcaaagccaccgcacacgtcctcgcaaagaacggaatcagcgcagtagccctggtagacgtcaaccgcgcactcctcgaggagacgaaaagcgaactactgtctcatattcaccaccaggttggaaggacacgcgct

SEQ ID NO: 11572 - DNA, 219 bp, A.fumigatus
agactccatgacttcatcagagctgacgttctcttccgaatagggagtgctggatatgacagacacattaccattttctcagaccagggtcgcctgtaccaagtcggtatgtgcatttttcgatggcacgccagttttcttcaatctgcggtcccggccctcatcgttggcaatgccgcaaatgccatcatcgctcggctaaacaacgctgattattaa

SEQ ID NO: 11573 - DNA, 480 bp, A.fumigatus
aaaattagaatatgccttcaaggctatcacagctgcaaatattacctcaatcggtgtgagggggaagaactgcgccgtggtattgtctcagaagaaagtcgctgtaggtcatttcatccacttgcaggatattgcagcaatctaatcgaaccatcaaaggacaaactgattgacccgtcgtctgtttcgcacatctttcggctttctccctccgtcggttgtgtcatgactggctctattgctgatgccagagcttctgtcgaccgtgcccgcggagaggcggctgaattccgatacaaatatggctacgaaatgccttgcgacgtccttgcaaaaagacttgccaacatcaaccaagtgtacacacaaagggttggtctttctgtggttttttgggtgattgtcaagtcgcagactaacagaacatcttcaggcttacatgcgtccgctaggcgttgctatgactctgatttccgttga

SEQ ID NO: 11574 - DNA, 219 bp, A.fumigatus
catatgagaaaacgggacaaattggccactgaccatcgaccgttcgatatccattattctgtggagtggttctctatcaattgtttagtttttatccgctcctttgactcccctgctccaatcactctgctgcataccaaattcatcatttttcgagcaggagccaaccttagtctcacgcttagctttcggcttctgggcttcgggatacgacaatga

SEQ ID NO: 11575 - DNA, 420 bp, A.fumigatus
ttgtcaagtcgcagactaacagaacatcttcaggcttacatgcgtccgctaggcgttgctatgactctgatttccgttgacgacgagaaaggcccacaactctacaaatgcgatcccgcaggatactatgtcgggtacaaggcgactgcatccggtcccaagcagcaggaggcgctcaattacttggagaagaaactgaagaacaaggattatgctgagggtagttgggaggaggtggtcgagctcggtatcacggccttgagcaacgtgttgagcgtcgacttcaagaagcacgaattggagattggtatcgttggtggtcctcgagcagacggcagggagggaacagacccttcgttccgtgccttgacggaagacgagattgacgagcggctacaggccatcagcgagaaggattga

SEQ ID NO: 11576 - DNA, 2331 bp, A.fumigatus
atacaaacccccaagctcgttacctcctatgccgttccaccgcaatcctctttctcctgtcgaccatgctcagtgcgaagaaagctcgcgaaaaagtccgttgtgaagcgacaaactttcgtcgccgtggaccgacctggacgagaaatacaagcttttgttgaagaaattgggggcactggatcaagtgcgcctgtcatttcgtcttcgtcattctccgtgagcgactcgagcagccctacggttttcgtcggcatcgtccctatcgctcctatggaagatgacgaacaggactcattcgatgtcttgactgtgcatcaggatggccttgtacgaaggttgacgtctgaccttaagactcagcggtggagtgtgaaccataccgaaatcgcgaagcttcgctcaactcataaagttaattcctgctttttggtggactttgatgatgcaaagaaatatctgttcaaaaggcgacaagatctggtggctatggctctcggtgatttgaccgactctggagtagacgaaccttccgtgctggtgcttgtctcacatccgacaggttcgaagcagatcgctttgagtgatgttcaggttcaaattttctctgttccctcgagtgcaccttcggaaggacggattcttgacgaaagccagaagttgagacatcttcaaacagtaaccttgcccaacatcgatgagctcaagacattcgatagcagctctctgcagtggtacttccatcccgggtccgcgggattgaatttgtcattcgagaagggttttgtcaacattgatctctcacaatacgcgccgactgtgacaacgcgcttcatccttgaagatgagagtttctcttctctgatgcgcacctctcctcaatcagtgattgctgctggcaaatcaattgtcgctttgttcgacacacaataccaatccatccagcgcagtatcgcagtggacagtgtcccttctggtggctccacgtcgcgcacaatgttcgtcagctactttgctaaacttggtgtcgctgttgcgatcaagggcaacgcactatttgcatttgatttgagctcgtcgattagttcccttaattctaccctgaaacggccaagggatggccttctcattgatgctattgggcgcggcattggctcgcccgcgttccaattggatgcgtcttcgaagaagaatcgcaccgaaatcatggcatcgctaggtcttacttcggctgaacaggttagcaagtgggaggagtttacacagaaggtcgaaaaatccgccaaatccaacgataacgctgcgtttgacgacgcggtccttgattacttcggagtcggcgctcccaaggctttgcctgcggcgcaacactacgtgaacccagaaatggtactctttctgctatccaagatcttttctctcagagaagcaagaagcaaggacaagctgtcggctacgtcagactcgcgcttgaccattggcatttggccggagatgacctgcagatggcttattcaactcggacacttttgcctaagcagtgttgagattgctctgagacgagttcagaagccgcatattctgccgccactgccgactggttcatttacccaagccgtgatcgattctgatcgttcactacatcacttcattgacgtcctccaagggtcggtactcctcaatgcagatgagctggcatatgccctcaaggtcttgctgaccatggctcggtcgcattccatggtcttagaagaagccaccaagtctgtgacatatgatgatgagaactcgaatcatacaagcaaggaggtcaccttacacaatgctgaagcaagcttgcaagatatctttatcgggttcaacaccaccctgcagaaaattcacaaccaacccttccccacgatcgtcagctccttccgctctgccctctccagatccgaattgctctccatcgtccatcatctccgcctttgcctcgcgactggagggtatacctcgcgcttcaccgaaaacccgcccagccccttctcccccgaacagactacaccgtcactttccttggacaccattataaatctgctgaacgccgctgtcgatgccattggcccttcgggatggatcaccgcggcaggtatcgacgacgcgagcacacgagaccttgacctcatcgccgatatgaagtccgagatctccgctgcgcttgcgggagtagaggaagctacatacctcaagggtatcctgcgcgagtacctccgcttcgcaaacagcttcacacattcctccgccacgggcaagacgggcgatgtggccaagcaagccgcaagtcaggag

SEQ ID NO: 11577 - DNA, 636 bp, A.fumigatus
gctctcttcaatccaacgttacggtatgcttacccctgcacaattctaacgccaacatctccaggcttcctctccagtcaatggcacaacacctcccgcggcatgttcgccggctcttgcatcggcgtcatctgcctcgtcatctgcctcgagttcctccgccgcgtcggccgtgagtatgacgccttcatcgtccgccgcgcccgcctaagaaatcagtacctctccacaaccgcctcgtcccaaggcctaacccgtgccaccgatgccgacgccagcgccgaggactcccccaactccacccgcggcgtcgtaggcgcagcatcaaaaggtgcagggcggacgctctgtagcgccttcgaggacaagacgcccgtccgacccacactgatcgagcagctggtgcgcgccctcctgcatatgctgcagttcgcggtggcgtactttgtcatgttgttggccatgtacttcaacgggtacatcattatctgtatcttcatcggggcgttcctgggctccttcatcttctcctgggagcctttgaatctgcagaaggagtatgttattccactccccttaccttaccttcctcagatgatatgcaaggagctcggtttgacttgtgttcttgtttag

SEQ ID NO: 11578 - DNA, 477 bp, A.fumigatus
gcgagcggatcacgcaaccgagcggatcaccaaacgcgttttgacttctatttcaaaagctgcagtgctcagccagccactatgccaccaaaagcgcgtataaactcaaaaaattcagttgagcaggagggaagggtcctacttgcagtatcagctttgaaaaataaggaaattctcaatattcgtgaagctgcgcgtgtctataatgtgccttatactaccctccagcggcgcctaaaggggcatacttttcgagctgaattacgcgcaaatggccataaaatgactcagaatgaagaggattcacttattagatggattctatctatggatcaacgtggagcggctccccgaccgtcccatgtacgagaaatggcgaatatcttgcttgcgcagcgtggttcaactcctacccagactgttggagagaaatgggtatataacttcattaatcagcatgatgagatcaaaacctga

SEQ ID NO: 11579 - DNA, 321 bp, A.fumigatus
atcacaataatacagcatgggattacactggaagatatctacaactttaataaaactagctttgcaatgggcttagtagctactactaaggtagttacaagagctaagatacttagtcagcccttccttatccagctagggaaccgcgaatgggttacctctatagagtgtattaactctactggctgggtgcttccactatgcattatcttcaagggaaaggtccatattaagggctggtatcaagatacagccttaccagcagactggtggattgaggtcagtgagaatggatggacgactgatcagattagattataa

SEQ ID NO: 11580 - DNA, 525 bp, A.fumigatus
ccatcctctagagcagcaaagaccgctttgcttctcgatcaaacccaattgggaccctccacagtgcaagttaccgctgctcacactattgacgagatcgctggagaccatgtggccacagccggagaggccaaggacgagaataaccaggacctcgagcaagaggacaagcccaagtcccggattgttgcagagtaccttgcccacggctatgtgattagcgataatgccatccagaaggccattgccctggacaagaagcacggcttttcttcccgtttcacatcggccctggccaacttcgaccagaagtaccatgccaccgatcgtgccaaggggattgatgaaagctacaagatcaccgacaaggcagccagtggctggcgcggtctccactcatactttgagaaggctttggataccccttctggccggaagctccgcgagttctacgtgcagacggacaaacaggtgcgggacatccacaacgaaggccgcagacttgcaaacttgaagagtggatag

SEQ ID NO: 11581 - DNA, 738 bp, A.fumigatus
aaacaaacgctgcaccgttctgacaccatgggcttgttgcaggtaaaccggctttccagagaactgtctatgctacgccagcaaaccgcctctgttgcatcgaccacctcctccacttcaaccacgctcaacgattgcttggacggatatcacagtacaccgtacttaattagctcagcacatccgacggcgtcgcggcgacatcgttcctcatcgagcctaagctcgtcttatgtcccagtagttcaaggatcgagaacaggaaatgggcccgcaattgcacgatctcgggagcctagtttgtcattcccatcggcacgtccaaacgacctttcaaagcccgctcgtgccttgtcgaccacatcgcggcagccagatcaagtcctgccatccttggctgcattgatacaaccgcaaccacaacaacagggcgagaatgtgccaagcaacgtccccggaccgcagaatgcccgtcagaggtctttctccccacaacaagtgccaccttctggcaacccgcctcgccaggaaatactggtccagcgaggagaattggaagctatgaagcgagaaaacgaggctctgcgtcgtcgcatacgggacctcgagcttgttgttaagaaatatcgagaacgcgaagtcgcctccccagaagaaccaacaaacgaccaggagacgacactgagactgggaaaaccgtccatttccttgagggacgacgcgaaggatggtccttga

SEQ ID NO: 11582 - DNA, 192 bp, A.fumigatus
ttacttaagcacatacttttatactcatctcgaattatcgatcaaatcaaaatgacggaacgcaccactgtccatgtgtcgggaatctcatccgccaccactgataaggaggtcaaggacttcttcagcttctggtatgagacggctgttcaccgcgaccttttgactagcttggaaatactaatctactaa

SEQ ID NO: 11583 - DNA, 201 bp, A.fumigatus
cagcctctgattagtctagtctgctctcaggcatacagtttctgctgtttgatagtctactattctaccccatactccagccaaatcatcacagatcctaccacaattcaggccttttttgttctttctcttttctcctctcacctccttctcttccatgcttatctgcactgtccatgtcttcaatcatggattttgtag

SEQ ID NO: 11584 - DNA, 393 bp, A.fumigatus
gacccctctttcttgttatatattattgataagatgcatttgacggaatgtggtatccctcaccaagtgaataaggcgttctgttacagtgccacacacttaatgttccagtcctttgtgattcaactagactgggaaggtcaggcaggccactttccctttatcaaaattgaagagctctgctgcaatgacaatgctcactacctccaagcaatagttattgaatgtcatgatcatctttacaaagatgcagctgctcagaatcttggagagtttactggctcttataaacagttcacgcttcattttaagcaattcccatctttaggatgcgttgttctgattctatacaagtattatcatggttgtcatgccatggaagcagccgactaa

SEQ ID NO: 11585 - DNA, 249 bp, A.fumigatus
tatataatccggaacaccttatgggctagtggttgtcacatgctgtccgattcattgtcccaccaaacacgggaagcacatcatcccgcccccgggttttcctccaattccattcaatcttttgagattcaaaccccctttttacctttcctctggggaatcatcctgttcctgcccaatgtcccgggcgcgtttttccgggaaacccggggaggtgtacccttccggattagtttttcttgtctcccc

SEQ ID NO: 11586 - DNA, 189 bp, A.fumigatus
ggtatcatagctggcaatctcatctccggctcccggatacctctgttcttctttgtggccctcatcgaaacccagtcagacaaaggcccgttggtcgccaagcctatgatcgccccaaccataatggcaaagttgaagaacccgatggtctggctgttgaagttgtacggaggagcggcaaaggcctga

SEQ ID NO: 11587 - DNA, 1068 bp, A.fumigatus
tacctcccacgacgcgtgcgaccaattgaaaccccaggcaactcacagaacgtacaggtaggaaccgaggatacactcagaatgaacgtcgagtttcaaaagactctttcgaatctggaagataaactcaatgccctcataacgagccttacaacctcgccgaccgcctcaggagctcctgcagcggcccttgcacttcttgacgcggacgactcgctcacatctgccattgagacgcttcgccggcaccaggagaactacgccagaattctgaaacttcgcgcggaggctgaaagtctggaggagaaggtcaagggcattgtgagagacgttgtgggctacgagaaggagattcggaggatctgcggcgacgacgagccaagtgattcggatgcagatgacgtttccgatgatgatgatctggactctggcggcgatcgagtgcaaaccaagccaggcggtctacgaaatacaaaggaaattgattacaaattgctgctggactttgcgcgacggattagcaagtacaaccaccaagccgccgcggatgcagctgccaatgccacgcaggccgccaaaggacgggggagaagtctacaacccggtgaccaggacatggcgatgacgggtgtcaatggcggccctggtgctgaggaaggcgccgaaccggtctcatccgtcacgaaggaagcgacatcctggctggatgagtcagcgaagatgacccgccaggtttacatgatcccatatccgatggaggaccgtattcgaatgggtctgatgggtcagatacagctggccgctgctgaaggtcgaccggggttcaatcccgatcaagaggtggaacgattgatacgcgaggccgagggtctggggtctacagagccagtggttcctgcttcacagcctatgggagaggagagaagacatgcaaacgaagccgccgaggctgcagctcaagcaggcgcggcgagcagcggaactatggccgcaccagcgcctgcccctaagcccaaggcaactctggaccttgatctctacgaccctgacgacgacgaaatgatgtga

SEQ ID NO: 11588 - DNA, 441 bp, A.fumigatus
cgtccgcagaattggaacaggttctggaagatgagcgccatctgcatgtccacggcagtgtcgttcagccagggtctgggaccattggcgctcgcgccgatgtttccgcaactgatgaagtcgttcgacgccgatctggcgtccgtggtcaaattcaccggcgtttgcatgctcgttcttggtttcagtaatttcttctggtgcgtcctcgagattctcgatagtgacatgtggctgacgagtcgaagggtccccatccaggcagctttcggtcgacggccggtcctcatcttttccacccttatctgtctgttcagtaatatatggcgagcgctcgcgacgtcgtatggaagttacatgggagcatgcatcctgaacggtttcggggctgggcctgccgaggtaggaacactcgcaacgacacaaggcttcgtgtgttaa

SEQ ID NO: 11589 - DNA, 750 bp, A.fumigatus
cttccgcaacaggtcggcccagtcattgccggtcccatggcagaacacgtcggctggcgcagttttttctggctcaacaccggcgttctcggcatcgtccttgtagccctcatcttcctgttccccgaaaccaaatggcaccgcgcccacccctccgaggtgcacgatggtcaggaaccggtcgagacgccctcgtcggcctctgagccagagaagccggcagaggtcatcatgcagcgggaaaatattgcatcagagagcggagcagaccaagacccctggctggggaagggttatccctccaagcagcagttcatgctctggcagccgtcggacaactatctgaagaccttgtggacctgtttctggattccgtggaaactgctcacgttccccatagttgaacttgctgcgttcaccgtctcgtggtccgccagctgcatgttgaccttgaacctcacccagagtcaggcctttgccgctcctccgtacaacttcaacagccagaccatcgggttcttcaactttgccattatggttggggcgatcataggcttggcgaccaacgggcctttgtctgactgggtttcgatgagggccacaaagaagaacagaggtatccgggagccggagatgagattgccagctatgataccctatgtgatcatcatgatgatcggcaacttcgtcgtggcattcggctacgaaaacaaatgggattggaaggtcagtttcacagcattctgttga

SEQ ID NO: 11590 - DNA, 315 bp, A.fumigatus
attattgtgataatcggctacacttgcgctggcattcaggtcagcgctcttccagccattaccagcacctacgctgtcgacagctataagcccgttgccggcttagtctttgtggcgatcacagtcaacaagaacctgtggggttatggattcgctgaattcatcaccccgtgggtgatcaaaagtggtttcgttaggcccatcatgatgaacatgtctctgaccaccttctggtgtctttgcgccattccggtctatttttacggaaagcgtttccgcaagtggactgccaagtcgtcagttcacagtatgtag

SEQ ID NO: 11591 - DNA, 1974 bp, A.fumigatus
actattctcacagtttccactttcacctcaggtttcggcatcgaactgagaccccacgtcagtgaaacattcgactcctggctggcggccttattgtgttggcagccgatccgaccgaaaggcgtgcaaaacaagatgacgaaacctcagtcggtagcgatcggagtacgtcgcattgcggaccgtcggagaaattctgagagcaccgttcagaaagatgcggccattatcaaggtcggtaagatgctcctgtgggacagacctagtacgtctggtccccgtcccaattccggccatcgtgtttcgacctatcgccagcaaagggcgctgtcttcgtcgtggcagaaagtcagttgcacgctacaagaaaatggtgcattcaaactattcacagaaacagacatcactttagtcacttgcattcaattgtcccaattatctcgttgtgcggtgcagcaattaaatgagtctgttcttgaggacgatttctgcattgccatctatcctcaatatgcggcgcattctgcatccgggttgacccggccggtctatcttgcgctagagagtcgagtgctctttgaggtctggttcgttctcctgcgcgcttttacgattccggaactctacggccctgaactgcctgtcgaggagaactcgacaaatgcagcagggtcaagtgatgcgagctcgccacccacaagggacatgtttcgaatcgaaaggatgctctcggtcagagtgaccgaggcaaagctgcaacgtgacaggccaagtgaggagacaccgaggagccggaagccatcaaggtctcacagcaacccggtcccggcgcccgctgtcagtgactactacacagaagttctcctcgatggcgaaatccgagcgaagacagccgtcaaattccgcacatctaaccctttttggcgtgaagatttcactttcaatgatctccccccggtcctttcgcaggtttccgtccttgttaaaaccctcaacccgacccagaaagattggacgctcattgcccacgggtcctatgctcttcaccaggatgcaaatgccctgcatgctttggatgatgtggagatttcgtcacacgatgccacatacggacgggtggagatacgattggatgacttggagtccggcgtggaaaccgagaagtggtggaccatattggatgaacgggatcagtctgttggggagatgctgatgagagctcggatggaagagacggtcgttctgatgtcgcacgaatacacccctatgtccgagatcctgcatgcctttaccaatggtcttacaatcaacatggctcaaatcatctcctccgaactcaatcaactctcagaggctctgctcaatatctatcaagtctcgggtcagacggtcgaatggatatccgctctggttgaggacgagattgacggcgttcacaaagactcgactgcgaatagactcaggtatactacaagaatccattcaaatgactcaagggaatccggtcaagatcgagaagtccttgtcagggatatgggacgaacggcgaccgtggaggcgaatcttctgttccgaggaaactccctcctcaccaaggcactggacttgcatatgcgtcggctcgggaaggaataccttgaagaaaccatcggagaacggctacgcgagattgacgagagcgatcctgaatgtgaagttgatccttcgcgagtccatcgatcagacgacctggaacgcaactggaggaccctcgtctctcttaccacgagtgtttggaaatcaattgctggctccgcttctcgctgtcccgcagagttgagactcatatttaggcatatcagagcttgtgcggaggaccgctacggcgacttcctgcgaacggtgacatacagcagcgtttctggattcctgttcctgcgattcttctgtccagcaatcctgtcttcaccacggggctggaaggagccgcgccat

SEQ ID NO: 11592 - DNA, 189 bp, A.fumigatus
  unsure (179): Identity of nucleotide sequences at the above locations are unknown.
gcattctggtattttcagggggatttgcaacagaacaaagtcctttcttaccaatccattgatacttacctgtcactatcgatctaccaaacaaaggaaaagaagccatcaaataaaaagcaggccgatgaaagtgtgtctatctttttccaaatagaaaatgatctgtccaacctagntataacctag

SEQ ID NO: 11593 - DNA, 684 bp, A.fumigatus
ttcacacttgattcagagagacatctaggggttctgagcgacaaagtcacgacccttctgaatgttcttcttgagatcagtaagagcagcctggatgagcttctcctcgtaagcgttgaccttgccaacttcaaggatcttctcaacaccgttgggaccgagctcgacacgggaggcgaagaagtcaacaccctggtccttgtaaagagggctctcaacgaaggtgggttcgatgacacccttctcgccctgagcggccttcaggagggactcggcgaagcgagcgccggccatggccatggagagagtagcggaaccggcaccgtccttggccttgacgacctcatcaccaccgaactgaatgcggttgacgagcgtatcgcgggtctcgccctcaatatcggggtggttggactgggagagcagagggacgatggtgactccggagtggccaccaacaacggggacggcctccttggcggggtcggtcttcttaatctgggagatgaagcgggaggcacggacgacatcgagggtggtgacaccgaagagacgcttagggttgtagacacccttggacttgaacacctcggcgacaatggggacggtagagtttaccttgttgtgacgttagcgctgctgatcagatataattgtttgggatacgtacggggtttgagataa

SEQ ID NO: 11594 - DNA, 417 bp, A.fumigatus
caggaattgttcttcactaacttgttcttgtcattgacaaacaacaacctgactgtcccactgattggtttcttgcctaggctattttatgcgttctctggagaacctaaacaactgaccaaatgtactaggaccgaattccctccagcaagtcctgtgagatcaattgcaggcaaaaatgttgtgactatccatttaaacgactcagtggatacctcagcctgtcatctggtagcaccgggggaaaggaatcatctaggtcagaaaccggcccgacgtgttgcaacgcgagctggagattggcccatcagcagcggcctggagaaactcgactacatgctccctttcgccctttccatccgttcataccctatcagtgttgtctctacagtttcaggttttcaacaacgcggctag

SEQ ID NO: 11595 - DNA, 537 bp, A.fumigatus
gcctccaaggtcgctgttctcggcgctgctggtggcattggccagcctctatatatcctgctcaagctcaacccccgtgtttctgagcttgccctctatgatattcgcggtggccctggtacgtctccggacatccgaaacttgcgttttcaaagtttcaaagcccagtatatgctgactcgagatcttttgacaggtgtcgctgctgatctgagccacatcaacactaacagcactgtcactggctatgaccctactccctctggcctccgcgatgctctcaagggctctgagatcgtcctcatacctgccggtgttcctcgcaagcccggcatgacccgtgacggtatgtgcattggccttttcaatgatgcaaggacaattactgacgctgccatgcagatctcttcaacaccaatgcctctattgttcgtgacctcgccaaggctgctgctgaggcatcccccgaggccaacatcctggttatctcaaaccccgtacgtatcccaaacaattatatctgatcagcagcgctaa

SEQ ID NO: 11596 - DNA, 606 bp, A.fumigatus
cgtcacaacaaggtaaactctaccgtccccattgtcgccgaggtgttcaagtccaagggtgtctacaaccctaagcgtctcttcggtgtcaccaccctcgatgtcgtccgtgcctcccgcttcatctcccagattaagaagaccgaccccgccaaggaggccgtccccgttgttggtggccactccggagtcaccatcgtccctctgctctcccagtccaaccaccccgatattgagggcgagacccgcgatacgctcgtcaaccgcattcagttcggtggtgatgaggtcgtcaaggccaaggacggtgccggttccgctactctctccatggccatggccggcgctcgcttcgccgagtccctcctgaaggccgctcagggcgagaagggtgtcatcgaacccaccttcgttgagagccctctttacaaggaccagggtgttgacttcttcgcctcccgtgtcgagctcggtcccaacggtgttgagaagatccttgaagttggcaaggtcaacgcttacgaggagaagctcatccaggctgctcttactgatctcaagaagaacattcagaagggtcgtgactttgtcgctcagaacccctag

SEQ ID NO: 11597 - DNA, 465 bp, A.fumigatus
ggtgacgaagctgccgctgccggaggtggaggaggaggggtcgatcgtgccggtgcgggaggaggcggtcgtggtgctgaagatgccggcggaggaggaggtggtggtgcagctggactcgaaggagcagggggtggaggtggaggagctggcgagggcggcttcctcgacgtcaacgggggaggtggcagtttcgccgaaccaggcaaaggaggaggtgcacgtggaggtggagcatccggagcagttttaattgatgtagaggatgagacggttgaggaaggccttgaggctggtctcggcggaggtttgcgcagattagcaactagcgggttgagcggaggggcagacggcgattctgtagaagacgggggcggtggtggcggtggacgagcacctggaggctttggagcagaggcgacaggaggtggtggaggtcgcgaagcctccgagtctgacaggtaa

SEQ ID NO: 11598 - DNA, 1221 bp, A.fumigatus
ccccgcgaactctcccatctcgccatgaagggcttgaatcttagcggccagaagacttttaggtctcaagctctggtttgtcaattttgccaactacctaccaggccaattgcccgtcaagcgccgtttgcgcgatactactcattctcgacgacaaccgcttcccgcgcccaatcgagacaattgcggccaaagaaggattcaagaaattcatggatcactaacaggcttacacctggccgattggcatcgacttcatcgaacacatcttcctccttcgacccagagacgtccttgcgacaagtctcctatgagtcttccgaacttctcaagctcgactccgtaccctccaacgagtcagttgtgaagcttttacagagatgtgaacaaatagcagaggctcttgttagccgcgaacaagacaaagtcgagaagtctccttccgctcgagaagagggaagtgcaatctcctcgttactggatctggaggaaaagaacgcatcaaagaaacatttcagatcaatccgcgacgcgcaaccccgactagccgagtcactgtcgcagatcgttacagggcttctcaaggacgaaaaagtctttatttcgccagaagcaatggcatgctacaccaagattcacacccttttgaagatggccgaccattttcccgagatgttctacctgtacgcccacaagccagttcccgaggagaacagttcccctgtcaaataccacaaggcaaatcccaagagcgtgaacagcgccattcccaccgaacttgccaacatggccctggacattgccattgaacagcgaaatctcccgctcgtcctggccatcatcgataacaccttttgcgccccggcattccaccgtgcaaagctcttcaagaaagctgctgtgccactaggcggtcttgcagccacgccagccgcgtgttacgtcatcgcttcctgggcctctagtttgcaaaccaccatggatcccagcacagcgacgggcattgccttcgcggccaccctcgcctatgtcggaggcacatcgtcgatcggccttttggctattacatcggctaacgaccaaatggaaagggttgtctggcagcctggtgttcccttacgacatcgttggctgcgagaggaggagcgcgccgcactggatagggttgccgtcgcttgggggttcaaggatatctacatgaggggcgaggaggagggataa

SEQ ID NO: 11599 - DNA, 258 bp, A.fumigatus
ctttttaccctactttatcccacttgtatatttatctttacggacggtactgtttatgttctctatgcagcggacgtatatcctagaatagatgaagattggaacatgtgcagtatgccagcacacactacggaattcccgaaaaaaaagaattatgttccagtcgtggacatcacatttcctatctatggcatatacaatcccacatctgagcgcctaaaaacccctgtcacaaagctaattgcgcagagaatctag

SEQ ID NO: 11600 - DNA, 276 bp, A.fumigatus
tcttacgggggattgaacccatcctccctttatttcattcctacacatctcaacccagactggattgtctttatcctttccattactgctcctcgaaccaagatgcgtccaccaccaccacgtccgccgccgcttggagggatgggaggccctcctcctccccctcctccgtctgggagtctgccgagtcggccagcgaaaggtgaagttaaagatagggtcagctggaaacccgttttcttgtcttcccaagttcctctgctaatgtcctggtag

SEQ ID NO: 11601 - DNA, 1248 bp, A.fumigatus
agcgctcttctttcagatatcacgaaaggaaccaaactgaagaagaccgtcacaaatgacagatcggcgcccatgattgcgggaggaggagttaaatcagctgcacctccagttgcaagtgcacctcctgttcctggcatgcccaaaccaagtggcctggcaccccctgttccttcggccaaccgattacgaagcagtagcgaaagcggcggtggtggagatagcagtacatctcatgctcctcaactggcaggacttttcgcaggagggatgcccaaattgcgtagtcggggcggagttgacacaggagccaaccgtgactcgccttacctgtcagactcggaggcttcgcgacctccaccacctcctgtcgcctctgctccaaagcctccaggtgctcgtccaccgccaccaccgcccccgtcttctacagaatcgccgtctgcccctccgctcaacccgctagttgctaatctgcgcaaacctccgccgagaccagcctcaaggccttcctcaaccgtctcatcctctacatcaattaaaactgctccggatgctccacctccacgtgcacctcctcctttgcctggttcggcgaaactgccacctcccccgttgacgtcgaggaagccgccctcgccagctcctccacctccaccccctgctccttcgagtccagctgcaccaccacctcctcctccgccggcatcttcagcaccacgaccgcctcctcccgcaccggcacgatcgacccctcctcctccacctccggcagcggcagcttcgtcacctcatacaaatggggtagcggcagcttctatcgcggtgcaagctgccaggaacgctctcgggcacagtaaccatgcgccgtccgtacctcctccacctcctcctgcagcgtctgccccatcagcgcctccaccaccacccccgccatcagcgccgccaacggcaccagcagtacaccccagtcatccgccaccccctccagcacaaaccccaacaccgccgcctagccagcctgtgacccgttcgaccttggatccgagtgcttataccctaaccaatggcggcttgtcgccgggtcatcagaacatgggctcgcaccaaataattcgagtggaagacaatcggttcaaattccagagtgaagggctgcttcccaagccgcggccgtttgtgggaggtcccccggcgataccgtgctgggtcttcaccacgcggctggaaggtccgcagcttgcgata

SEQ ID NO: 11602 - DNA, 195 bp, A.fumigatus
ggtaaaaagttactgcattccgggcataaggtccgtcttgtcaagtatcatccctctcataccgataaactcacgcaggctgtcccactattatccctcctcctcgcccctcatgtagatatccttgaacccccaagcgacggcaaccctatccagtgcggcgcgctcctcctctcgcagccaacgatgtcgtaa

SEQ ID NO: 11603 - DNA, 273 bp, A.fumigatus
ctcggcgcagctggtaaattccctacccccgtctctcacagcgaggacatggccaacaaggtcaccgagatcaagtctaccatcaagttccagctcaagaaggttctctgcctcggtgttgccgttggcaacgtcggcatgaccaaggaagagctcgtcgccaacgtcatgctggccatcaactacctcgtctccctgctgaagaagggttggcagaacgttggcagccttgtcctcaaggctaccatgtctccccccaagcgtctctactag

SEQ ID NO: 11604 - DNA, 318 bp, A.fumigatus
aactgctccggatgctccacctccacgtgcacctcctcctttgcctggttcggcgaaactgccacctcccccgttgacgtcgaggaagccgccctcgccagctcctccacctccaccccctgctccttcgagtccagctgcaccaccacctcctcctccgccggcatcttcagcaccacgaccgcctcctcccgcaccggcacgatcgacccctcctcctccacctccggcagcggcagcttcgtcacctcatacaaatggggtagcggcagcttctatcgcggtgcaagctgccaggaacgctctcgggcacagtaa

SEQ ID NO: 11605 - DNA, 225 bp, A.fumigatus
ttaatccaagcaccagaggaggaggagaaatttctccattacttacgtagaaagagccaccaagtcccctggctggaggaattcatttactccctctccttcgtccccgatattgtggaattccaagctctcctcatctgcctcgcgtacaacatcactaccggcatcaaacggctccatgccatcgttgagcatgtttcccacccaaggagccgatggatctga

SEQ ID NO: 11606 - DNA, 756 bp, A.fumigatus
acttctctctgtccgtatcaagctttgatctggctcgacacaaccagcaattggaaggaaggtgcaacctcatttcttaccagcccactgcggacgggatcctggatgatatcctcggtacctgtgatccagcatcgggcaggtcttgcccttagacagcctcacaagcttcgggaacgtgccgcagaagaggccgacacggatggccccaagccgtcagaaagaatggtgcaaagtgcatgccttctccatcttgattatggccttgacctagacaaggcccttgccgcagggaacagcttctatgccctgcatgagattctggtattcgcagcgttttcggagaatcagtttctcaatatgcttgaaacgaaactactcaacgaactcgaccccacatttctggtccatcagaaaaacccgactctgtctaatctgctttaccaccaacggatattggacagacatatccaacgaatcaaggacaacctggccgcattcaaaggcaatggatccctcggatggcccagatcggctttagagccaggaaagcaacgaattgtcgacgacgttgctgaaacacttattggtgattatcaatacctactttctcgttcattgactttatccgggcagtgcagtcgcggcatgcaggttgtcatgaataatgccatgatcaaggagtcccgcgatgccatgagtcaagccgaaggcgtggtaaagctcacacgccttgcttttatctttgtacgtctt

SEQ ID NO: 11607 - DNA, 459 bp, A.fumigatus
  unsure (283): Identity of nucleotide sequences at the above locations are unknown.
ctgatttatgaagcacagcttgacctaccaaccgctatcacctcccttgccaccgtttttcaactgggccccacggagacgccgaattcaacctggctccagaatcaaatccaggcatggctacatatcgacgatatattccaaccagagtttctttcgggtatcatcgttgtgacggaagacaacggcattcagccaaatttgtcagcgtttattgaaagcctacccaaggagtggaaaccagattggtggatctttttcaacaaggaggttggcggccagntacacccaggtcctcgcatggtctcctacgggaagattcacactgtctacaggatatacgatgatgtgaatggggcatttatggttgccatccagccaccgatcaccccagggtacgtcaatgggactcaaaaggagccgcaatggaggctgcggttacagaggataacattttaa

SEQ ID NO: 11608 - DNA, 183 bp, A.fumigatus
ttgggggttctagatttgtttcaagttattcaggagaatgcgccagatgctatcaaggctggggatatcaagaaccactttggccgaaaggtcgccatcgtatgtagtctttttctcccaaacctgctagccagcccggaaacacatttgaaggttgcagtgatacttacaagccatggttga

SEQ ID NO: 11609 - DNA, 222 bp, A.fumigatus
ctcacatcttgcaggtctatgagtatctacagttttttgatcgccgtccgctcggagggccaacagctcatgagcgagtcgggcgagacaacatcacatttgatgggaatgttttaccggacattgcgcatggtcgataatgggattaaacctctctatgtctttgatggagcgccaccgaaactcaagtcttcaccgcgagttacaatcaacctctatgta

SEQ ID NO: 11610 - DNA, 303 bp, A.fumigatus
agatcttcgagccgcgaccaaagacaatcagaccacttgctcaagtccgctatcagcgcttacgctacgtttacactcggcgattcctacccagccgggatggtcacgatgatcgtgatttactcatgccacgttctcacccacctgagcgcatatgattggtttattgggagggggtccttgactctctttttcagggatatttccgcacaccgcagtcgatctctgcagaataagtcagcgagacaaggaagtgatcgttccgagtgtgctcattcccctgacagacaattagttgcctga

SEQ ID NO: 11611 - DNA, 669 bp, A.fumigatus
ccagaatcaatagacatcaacattctgcctgcacccgtggagcatgcatgcaacattatcaatgaagaactttgtgggtttgtgctacgggatccgttcactcttgtcctggacttgtggatcgccatccagctggtctgggttactatgctctgtgctgttcaactcgtccaaatatctcggaatcagacgacatacgagaacatgaggggccattcgatagatcgaagctacccaagctctcgtgcctttgcctcggccatcactgcggggacgacatcgctcgaggccgctggcctgtcagcaacggggcaaggtccgaaccccgcgctcgcaaggggccattcgcaccggggacggagacatgggtgcttacagcagtggtcatctcttctcggcatcgacacatttttcgccactgcccgtgacgggctaagggatgggccccgcgctgatcggcctaagaacccgttttcccgcggtatcatcaccaactgccgcgacttctggtgcgatcctgctccgtactttgggaagcgggagccaggcactgcgatgctcggcggggaaatcgtcaactataaccaaatgtacgaggttccgatgcgcatgtacagtgatggcaggtaccaaagcgtcgcacatgacgatccggagcagcacgtctga

SEQ ID NO: 11612 - DNA, 972 bp, A.fumigatus
agaaacatgtctgctcgccaacgtcgtcccgctgaaagctatgaaaatacatcaaattcgtctcagcctgccgctatagcttctgcggttctcgagaagcctccgaaggttatgaaaaaacttgttcattgggacgacctaccgcattggcaacgtgataatcaccacatccacacgggataccgaccagcctcgttctcgtttctcgtgtccttccagtctctcacgtacctccacaacgaaacagttaacatttatactcatcttctgccatcactactgtctattcccgctgcgtacttactgtaccaggagcttgttcctcgttatgggactgccacaagggacgatatcattgcctttagttgcttctttgcaggagctgccttttgcttggggatgtcggcaacatatcataccatttcaaaccactccccgctagtcgctcgcataggaaataccttggactatatcggtatcataggccttattgtgggaagcttcgtgccaagcatctactatggtttctactgtgttcctgccctccaacgactgtactggacgatgatctgcgctattggcctgggctgcattattgtctcaattctccccaagttccggacgcctcagtggcggcctttccgcgcagccatgtttgtcggcatgggtctgtcggcggtgtttcccgtgctccacgggttgcaaatgttcggattcgaccagatgacgcgccagattgggctcggatggcttcttcttcaggggttcctctacatattgggggctacaatctatgcagctcgagttcctgaacgtctgcggccaggcaagttcgatatattgggcagctctcaccagatcttccacgtactagtggtttgcgctgctgtggctcatttgactggcctactcaaagcattcgactaccgacatagtggggttgcaggaagctgtctgttagaggttaactga

SEQ ID NO: 11613 - DNA, 672 bp, A.fumigatus
cccgtaatattgggctcacagtgttccctaacgcggagggaaattgataccccttggattcaaaaccaggaaaagatgttctggaggggttccacaaccggaggtttctctcgagctggtggctggcggcggcagcaccgtcagatttttgtcggcaacatcaatagcctggacaatgtcaaagttcttgctaagaccactgacggtcaatggcaaaccaaggaagtcaatcgtgcagattatcgtgatctgttcgacgtcaaattcacgttcatcgggcaatgtgaccccagcgactgtgatgctcaaaaggaattctttgaggtcgtggatgcggttggtcagcaggatgcatgggcgtacaagtatttggtcgatatcgacgggaacgcattcagtggccgatattacgcctttctgcacagccacagtctagtttgcaaggtggctatttttcgcgaatggcacgacgagtggatcaaaccctgggtacactacgttcctctgactttggcgggtgacgagtccgtagagacgatgcggtactttgtcaccgaagatgaagggaaaagcacggcggcaaagattgcgggaaaaggtcgggattgggcactgaaagcactacgaaatgacgacatggaagtgtggttcttcaggctcttattagagtaa

SEQ ID NO: 11614 - DNA, 480 bp, A.fumigatus
tcagtatcctgcactgttgcagcagcggtcagtcaatatgccgtgtccacttcacgtccccccccccccccccccctccaagctaatgggagagatcctaggttcggctaccctcttgcattcttggatcgacagaagttgctgcagatcctcgcggcggggccggttcaatccggccgagtgaaactgggtcaccaagtcgtgaacatcgagagtactccggacggagtcactgtgcgaacaagccacggacacgtctaccagggcgacctggtcgtcggcgcggatggagtccacagtcgggtccgtgcagagatgtggcgattggccactgcctcacagggggagatctttcggagtgaatacaatagtagctatccaccccactgtggctttgtcgtttgctttttccccccccccctttcatttttccttctttgggccatgcacttgaaaactaacgcaccatttggctcatag

SEQ ID NO: 11615 - DNA, 288 bp, A.fumigatus
tttgggtgtgagggtggggcgagactgattgcatcggtagttctgcaggttctggctgttcatcctgactatcaaggtcgagggatcgggacgaggttgttgatggttggggtggaggaggtgaggcgcttaggtttacctgcttggttggaggcgtcggaggctgggtatagtgtctaccggaggtgtgggttccacgatgctgaacggatggagttggattttggcaagtatgggcttagcgggatggagcaggtctattgtatgttgatggatgatgagcactag

SEQ ID NO: 11616 - DNA, 498 bp, A.fumigatus
aaacatcccacatcatcatcgcacgatccatcgttcctaagaaacatcataagcatgctccaaagcaagatcaccctccaccccgccgtccaagccgacgccctccccctcgccaaactccacaacgccgcgttcgccaacgacgccctcttggaggccatgtacgggcctctcacgcagaacgacccccccttcgccaatgacctgcgccaaatcatcgccgacgatccccactcccgcattacaaaggctatcgataccgaatcaggccagatagtagcctggtcatggtggagtatctaccccgatgccgaggcgcatgcgtcagcagcagaagtggctagggaacggtggaccacgccgccgccgacatcgctttgtccgcggttgtatcttgattttcaggatatgaaggcgaggatgagggagaagtggattggcgggagggctgctgctagtaagctcgctagtttacttcaatgtttgatttgggtgtga

SEQ ID NO: 11617 - DNA, 1677 bp, A.fumigatus
  unsure (15): Identity of nucleotide sequences at the above locations are unknown.
caaccagccactggngacgtccacgttgaccgtccttcgttcagacccggtgataactggcaggaattcaagcaggatttttatcctagggagcccgttttgattctgctcgaggacaacacccgtctccatggcatgatccgagacaaggcgaatttcgcggagcagcgatatcccgacggaacgctcaaagctccagcatatgcaacataccttgtgaaagttttggatcgtcccaatgaggaggctttgttagaccaggaccacatcactcgtgaccgcaagacgttcacgaagcaaatgttacgtgctttcatcaaaaataacgttactagggagtcttggaacggagctccgtggctagtcaaaccgtccgtcgcggaagagtacaagataccgaccgaggtccccaagcatttgcagtatggtgcaagggtggctgagaaaaaggcgcagaaaaaggctgatcaggaaggattttttgggttcttttcatcgcagcaattgccggagttgaagcctgcagccaagggacaaaaaaataaactctcgcctcaggatttggcgcggtcgaaggaggctcagtacttggagtatcaacgctcgctcaatgggaatcccacctttgttgtgtcccataagctccccaacgctccctcccgcccgctgaagccccaagacgaaaagaagtcacaacctgttcctacagtcatcgtcaagaccgagccccccaagccgccgactccacctccaattaagtatcccatcgaagatctggaaattccaccggatcgcgagaagaagaagcaacgaccgccgctgaaatttcttgcagccgatgaagatgatgatcctaatgatgaagagctgttgcatgacaagatagaaatgcaatcagtgggcctgctattggagacttggaacactctcaacgtttactgcgaagtattccagctagactcgttcacatttgatgatttccttcaggcaatgcgcttttcgtcggatgaagtggaatgcgaactttttgtggaaatccattgtgctgtcctgaagaagctcgtcaacgccgagaatgatgacgaaggggccgtacaagtctcattgccggaccttcctgatgttgaatcagatgattctgaagctgatgaggagaatgaggaggaggaggaaaaggagccgtccccggagcctgaacctgttgtgacgagaatgaccacgcgaagtagcttggccaaagcggaggcggaaaatttgaaagcacaggcgaatcgtagtcgtgcaaactcagaagatattaaaattcatcgtgcagcggagatgtttggagattacgggtggatcgaacgtttacgaaaacgagatttccgtcacggtggatggcagatggtgatggtcggccttctgcatcaactgtcagcccgaccacggatggaaaaggtttgcaacgacattttgaagcatctcgcgccacttgatgccgagcctacccaagaaacagtgcaatcccagtacgccacgttaaacgtcaatctgcgcgtccaggctcttcaaatcatctgcattctcagcttggaaacgaaggctattcgaaactacctggaggagtgcagcaatcagatgaccgagttccgcaaggaaaagatcgagtatcagagggctcggaaagtagcgtaa

SEQ ID NO: 11618 - DNA, 456 bp, A.fumigatus
ctaaccatcttcctccgttgtaggctcgaggaactccgtcgattgcatcaagagcggaaggcgctccaaccggagcaagaaaagtcaccgtccccagtgcctgaattagaagctttggaagattctaaaatgtcaggcgtggacggcgactctgagcaggtcatggataccgaggatgacgatgtgccacagcaacggtcgctccgcggaggtttagacagaattcttgaacgaaagcgaaaacaggaagaggagcgggagagaaaggagcaactggccaagcagccaaaaggatcgaagcagtaccaaagggtcttgaagaaaatcgaagaccagaaagctactgttgagaaactggagaagaagattgaggtggtggataatgatctaagagaagccgtttgtccgcggagtacgtgcgttcggaaggttcgtgatgagaccaaacagggctaa

SEQ ID NO: 11619 - DNA, 186 bp, A.fumigatus
tcaatattccgacactcatcccaccagcttctcaacatgtcgttgttccaacccgacatccgtccccaagacgtgggaaagcatcaagacaccgagaatgtccgggaaccatcaacggatactcagaacgatgttgaatctggcgatgagccgagcgtcgctgagattgagcgcatctatcggtga

SEQ ID NO: 11620 - DNA, 588 bp, A.fumigatus
ggtttgcaatttctgatcacgttcagtctcctccgtcttctgctcggcatcttcattgccggcatgtggccgggaatgacttattatctcaccctcttctaccctccttcccgcacgggtaaacgcatcggccaatacttcactgccgctcagatctctgccgctgttgtgggcctggtctcggctggcttccagaagatggacggcgagcgcggcctcgttggcttccaatggatgttcctcgtctacggcatcatcaccatcgccgtcggcatcgtcctcctctggtggcttcccgaccggcctctggctcccggtgtcgaacctccccagcgcaagtatttcaagtggctgcagcgcagcccgcccgccctcacaggccgggacgcagagatccactaccacgacctgcggcgcgtctaccaccgtccgcagtggtccgtccgtgacctcctccgcgtgttcctggactggcgcctgtggccgctgctggtcatgtactttggcgtggtcggcgtgggcattggcgtccagaactacgccaccgtcatcatcagggggtatcaacccatccctgaatgggattga

SEQ ID NO: 11621 - DNA, 504 bp, A.fumigatus
  unsure (414): Identity of nucleotide sequences at the above locations are unknown.
cctcagtcttctcacagccccaatctggcttgtaagtattcccccctccttggctgtttgtccgccttgggctgcaaaactgacaaaaagcagatggacctcctcggcatcctcgtggtcacccccttctcggaccgcttccacaaacaccgcgccctcttcttctccttccccgtctgcctccagatcgtcggcctcctcctaaccacattcgccggctccgcctccaactcctggccccgctacggcggccttctcatcgtcggcttcggtcttggccccacagtccccatcaccatgtcctggacagccgaggtcttccagccccgccacggtgaagtcggcgtcgccgccgcctcggccgtcgtctctggctggggaaacctcggcagcatcctcaccacttacgccctntacaccggctggcccagcgacagcgcagcccccggccgcgccacggccgcaaggttttctatcacgacgaagcccgaatcaaatacaagg

SEQ ID NO: 11622 - DNA, 336 bp, A.fumigatus
gtaagaagctcacaatcatccagaaaactagactatcgaatcatccctgccttctgggtcctgtactttctctgctctgccatccgatccaatgtcggtctggcgcagacgatgaacatggacgtaggccacgacctagggtctgtgctgcacttgactcctcatcagatctcgaccggtctcgccttgttctacgtctgctatgtggtctttgacttgccgtcgaatctggtgatgaccaggctcagcccgcatgtctggatgagccggatcgtgatcagcgtggggatcattggcagttgcatggcggccatgaaagcagcgtggagcttatag

SEQ ID NO: 11623 - DNA, 714 bp, A.fumigatus
cttattatctcaccctcttctaccctccttcccgcacgggtaaacgcatcggccaatacttcactgccgctcagatctctgccgctgttgtgggcctggtctcggctggcttccagaagatggacggcgagcgcggcctcgttggcttccaatggatgttcctcgtctacggcatcatcaccatcgccgtcggcatcgtcctcctctggtggcttcccgaccggcctctggctcccggtgtcgaacctccccagcgcaagtatttcaagtggctgcagcgcagcccgcccgccctcacaggccgggacgcagagatccactaccacgacctgcggcgcgtctaccaccgtccgcagtggtccgtccgtgacctcctccgcgtgttcctggactggcgcctgtggccgctgctggtcatgtactttggcgtggtcggcgtgggcattggcgtccagaactacgccaccgtcatcatcagggggtatcaacccatccctgaatgggattgacctcagtcttctcacagccccaatctggcttgtaagtattcccccctccttggctgtttgtccgccttgggctgcaaaactgacaaaaagcagatggacctcctcggcatcctcgtggtcacccccttctcggaccgcttccacaaacaccgcgccctcttcttctccttccccgtctgcctccagatcgtcggcctcctcctaa

SEQ ID NO: 11624 - DNA, 1818 bp, A.fumigatus
ctgtggatagctctactccgtacttcaattctctttcctccgtacctccatgttcttcaagcagctgatgactctcatccaggtttatttttactcattgtggtagcatttgatcatttatcactatatttcccattagggggcgcaaattttggttatggcgagtttccatatggcgctttactattgtcccgaagcggcgtaacacatatgaaaaccctcgggcttttcaggtctctacttcaaccatcaaacagccatttcttccgtctttatcattggaacatgtccgagaagaagagaaatggagcaccgcggactttccctaagagggaaaagaggcctcctctgacacactttctgtgccttccgctagtgaacgacatatcactccctcagctggaatcttctctatcaactttcaaagctgccattccgttggtttcgcattcagatgaggagggctccgtacaacagcaagtctccgccgaacggccgctcatcccctatggcgcggtgcgtcccgtcggcactctccatctgacactcggggtgatgagtcttcctacgaaggaacggctggaagaagcaatcgagttctttcactcactcgatttggcgtttattatgcgtgaggcagaggagattgcaaagaaatcgaaatggtcccggaaaagaagttcgtcgcctcgacaacagtccgactttacaggcgcagtgggagagggtgaggaaactcacccatcaaggcgactagagcaggaagatgaccctgcttccgtgatcgtgccacgagacaattacgaaccattgacaatttctctcgagtccttacatgcgcttccgagggggcgcgcggctaccgtccttcatgctgctcctgtggattctacgtctcgcctctatcccttttgcgtgctgttgcggaacaagttcctagaagcagggttcttgcagtgcgaacatatcaagaatagaccaggctcatatcacattgagccccagaagccacccaaatacgtggaatcggacaccggcgacgcaacgagtacaatacaccaagccaagccaaatctagatcaaggccatcaatcccttacgaatatactaatccagaatcgtacaacccttcttcaagaaatgcccgtggatttggcgggcgagttaacacaagtacattcgcaaactcgcgaacccattacgaccacggtcggcaccgctgtgcaaacgaagtctaagctcaaagttcggccgcttctccttcatgctacggtggtgaacactatctatgtccgtggtcgacggcgaggaggaggccctcaaaacagcggtagccgccgaaacagtcaatacagctttgatgcacgggatattcttgctcactaccgagacttttacatcgattgtcaaaggacaatgccacggtctacctcagtcacaatggcctctcaccctaacgaaatagaaaggcaacaaatcgctaaccacgacactggtaccgaaagtgcatcaaattccgccagcagtaccgacggcagtggcaacgaggctcgcaattcgccctcggagaagagacagaaaatgtcgtccatgaagagagtacacgcattccctttcgtttgggcaaaggacttcccactagagacaatctgtatatgtgagatgggcgcaaagaaacttgatcctgacgatagtgggatgaatgcacgtttgggggaaaaataccgagttgtggcagaaatgagtctggatttcacatcttcggggaactcaaaagtggtcgctgaaggcacagcttgccaccgggataacctctaa

SEQ ID NO: 11625 - DNA, 600 bp, A.fumigatus
ccttctccatccttcatctgttcggcactcacgcatcccctttatagtcgattgaaggtcagctgtacagctcgaaaaccacccaaaatgctttcgcgcatttctcgatctgctgcctcgtccgccgcccgtccttctctccgtgttggccgtatctcagcaacggcgcccgcagccattcatcttcaaccccgattgaacggcgtcaacaactccgcccaggcacctcgtcgagggttccaatgcaccagttgcatccgcaagggcatcttccctgattctgcagaccctcctgcccccaagccgcaatcgaataatgtcgccggcgcgtccacccatgtcacggaaccctcgccattgactgacgtgcagtatcacgaattcgcggagcactatctcaatgtaattcagaatgaagtggagaaagcccaggaggagggatctgatattgaggcagagtatagtgtgcgtattgcgggcctgcgttctatattttttttttttcttttccgtttcttcttcgggcaactttatgccgcccttataatttacaaggcatctttggctgatttgcggtgcgatatgcgatctctaactcta

SEQ ID NO: 11626 - DNA, 2121 bp, A.fumigatus
cttgagttttactacaggtctaacctatccgcgctgcgcgctttctcgatccagcacgacatgcaatcggcctaccgtttttccaccctgtcgtcaactttcagaatcaaatcgggcgacgcagcagctacagcgctcggatgtataactgtggatatcacaccggatcttggaacttctttgaagaacactctagcctacgtcccccttgtcatccttgtgctggtcggaatcgccacaatatctgcagcaatgtacagcccatggggcacgactaatttcttccactggacaagcaattatggccgggacgaggatgttctgcggcttgtgacgccgggttttggggactgcatgcagtatatacagttcgcggtcttgacgggtgcgctctcattgaattaccctggatactatcagccagtaatcagccaggtggcctggtccacgcttatgttcaaccagagctttgtccattcaggacaggggcgaggtcctgtaatcgatggggtttatgccgtcaatgccacctatgggcttgagaggttggagcaatatgtcggcatgtccacagccagtgacatatggcctgggatgatgatctggttgctcgtgatcctgggcatagtcaccgctttgatccagcttgcgttcgctttccgttggcttcaccacgaactggcgaatatcccggaggaggatcttcgttcgaaaaatatgccgttcaccgtgggaaatgtgattcggatagtttttaactttctgttcctccccgtggtgtcattatccttcttccagctggtgattgcggccgactccccagcatactctgtggcgctcgctgttgtggttattgtcgcattattggtgttttccatttggaccgtcagattgatcgtgagcacgcgccccaagtcacaccttttcgacgacctaccaacggtgctattgtatggacctctctacaatactttctgcgacgatgccgcagcatttgcggcagtaccaatcttcattacttttgctcggggtgtcgctattggtgctcttcagccatccggcatagcccagatagttctcctcgccatctgtgaagttgtatatgttctcaccctcgtggccttccgaccatttccacatcccacgtccatgaacctttatcatgcttgtttcgccatcgtgagattcctcacgatacttctcagcgtcgttttcgtcccttctcttggagtatcgcaggccgcgcgcgggtggattggatacatcatactcctcctccacgctttggtacttgtctttggatttttcctaaacgcactacagactttgatcgaagtgatagctcgactcgctggcgctggcggttacgagggtggtgccacccgcggaggactcgtcaaggtgttcggtatgcgccaactctcacggcgtctaccgagacgcgatgctgcggggacacgtcaaagcatggcctccgacgctgccatgcttgcgcacacggacgatcgaatgtccgcgcaatttgacggatcaagaccaaggagcctttcaggcagcttgctcttgaacagggcaaccgcaagtgacggtagggccagtggaattttcgaatcaggaagtgcacatggaggaacgcatagtcgtgccaacagcagtggattgtatactcctactacccttggaggttttcagggtgctggctaccagacgacaggaagcaactcacccaagagcggtctgatctacgccatgcaaccacatgacccctattatagaccacctcggccccgtaggaataacgaacgaggtacatcttttgagaatggcaggacagtctcccacacagtttcaaggtcgggtaacttgggcgatatggacgacgacctcatcgagggtccctcagtctccggaaggggtacgcctgtgcctgcgtatatcccggcacccaaggacgatcttgactacgatgattcaagaccgtcccggaaggaatatgccgtccgtgaagtagacttctactaccgagtgcgagggcctccactttcccaatctgggacaagaaagttgaacaccggccgtcttctaccacgaaggcgaccggcacggcgcaagattaaggca

SEQ ID NO: 11627 - DNA, 1638 bp, A.fumigatus
ccttttacttcttacagatatgccttcgtcgagttcgagacccccgaacaagctgtcgccgcagtcaagcagctgcacggcactccccttgacaaaaagcacacccttctcgtgaacaaattaatggatatcgaacgctacggtcgcgaagggcgcattgacgaagagtacaagccccccgccatcgagcctttcaaggagaaggagcatctccgctcgtggcttgcggaccccaacgcgcgtgatcagtttgccctttaccgtggagacaaggttggcgttttctggaacaacaagaaccatccgcccgagaatgtcgtcgaccgtgcgcactggacgcagctttttgtccagtggtctcccaaggggacttacctcgcatccgttcatcctcaaggtgttcagctctggggtggtcccgctttctcgaaacagaagcaattcccccatcctttcgtccagctcatcgagttctcgcccggtgagagctatctgacgacctggtccgcgcgccccattcaggttgaagagggccagtctattttgacttacgaggaggaagggaagaacattatcgtgtgggatattgcgactggaaagcctctacgttccttcgtctctcacgatctcactgctggtcctgcgggagacgccgagcccaagaagaaggtgcagtggcctgcattcaagtggtccgccgatgaaaaatacgtcgctcgcatggtaccacaccagtccatttcgatctacgagcttccacgaatgaacttgctcggaaagacatcggagaagattgacggcgtcatggactttgagtggtcacccgcaactgtgactcgggagggcgtcaaacaatacgaacagttgctctgcttctggactcatgaaatcggcagtagccccgctagagtccccatgatgagcgtgccatcaaaggaaattgtacgaacacgtaatttgttcaatgtttccgacgtcaagcttcactggcagtcccagggtttgtatgtctgcgtgaaggtggatcgacactcgaaatcgaagaagtctatggccaccaacctcgagattttccgggtacgcgagaagggtgttcctgttgaggttgttgacagtcttaaggatactgtgatcaatttcgcttgggagcccaatggcaatcggttcgttctcatcacaaccggcgaggctgtcgctggtgctgctgtcgcacccaagaccgccgtgtcgttctttgcccctgagaagaagggcggagcaatcggtaacttcaagcttatccgcaccatcgagaagaagaacagcaacgcgatctactggtcgcctaagggtcgcttcgttgtcgttgctaccgttcactcccagaccagctttgacatggacttctgggacatggactttgagggagagaagcccgaagccgagaaggactttgccgccaaccttcaattgatgaagaccactgaacactacggtgtgacggatatcgactgggatcctaccggtcgttatgtcgtcagcagtgccagcgtgtggacacaccaggtaagaagccttttgccatcttttttatcgatatttttagcattgctaagttcttctaccacaggggccggagcgacccgcgctatgcgataa

SEQ ID NO: 11628 - DNA, 2472 bp, A.fumigatus
  unsure (70),(156),(2318): Identity of nucleotide sequences at the above locations are unknown.
ttgtatacccgtgatatggttccagttcgagtcggagcggacaatgctcaagggagctctggccagctcnccatactccgggaaatggttcaaactgtttcccgggagtgcgaaccacgtctgggcatgtctgccagtgctatccaggccaaagcnccgactatcgatacgttctttgacgcaatcgcggcggaacgtttgaggcgcatgccaccagacggaagccggctcgacgcggctcttcgacgtgcatccagcctcgcctttgccgtggcctcgttacgcgatgcggttgtttcttttatggacggggcggacgaagccactaagttggtctggggtgggcttctgctgaccttagaggtaaggcacatccaagtctctcggactaaggctaaacaattccagatgggtatcgagcaggtggatatcctggatgccattgtcagtcgctatgggcgagtcacgctccagatttctcttttgctacagcaagagagcgtctttacagagtcaacttcgctgcagaacgaggtggccaagacctacgccagtttgctgcagctggtgctacacgttgccatggagtactctgacgcctcgcgctctttggcctggttgatcatgggcgaacacgtcgatgaagctttttttcagttccacaacagctgcaacaccaattggcggaaactgtcagagctggccttatccaagaggacgacgatggatgttgcttccatctatcagttccttgatctgcaggatcgtccactccagatgattctcgaaggacacaaccactccctggcggatggttcgtttgcgtggtttgacccgcatctcacgacattcgctctcagcaaccgtgagatgatggtaataacgggcagtccaggggcgggaaaaagtgcgctggcgcaatggacggtggagcggctgcaggtctcatccgagtgtgacatctggaacgtcattccctgctgggtgcgggaggatgtacctatcaccacgttgacccttaccatcctcaaaggcattctcctgcagatgctggaccgatgtgtcagctcatggaagacccaagagggtattctggcacccgttcaacaggctgcggacatggcctcaactggtgctacagactcccaggtggaggacgtgctctggtccgccgtgcggacggcaacgcagtcacacatgcacttcatcatcgtcctggacggccttgatcagatcaagaatgccaaagccaccatggctgggttccttgcgcgcctacaaggttccatctccggcacgtcatcgaagctgatcatcttttccagagagcttcccgcgcagcagcagctgggggagagcactcaacagctctcgctgaacccctcattgacccaatccgacatgcttgcggctgttaccgacgctatcaggtcagacggccagttctacgggctagcgggcgatcagattgacatgatggcccaacgcatcgtggcccgcgctaagggatgcttcgtttgggcgcagctcactctcgaatctatgaagcacgagtcgaccttcaagggcatgatgactgcaatccagcaagcaccaggcaacgttagcgagctgattggcaaccatctaagcaccacggacatcgcacggcctgacatccgctgtctcctcgcgtggctggtggcgtctgagcgtcctctgcgcgccaaggaggtggaagagctgctttcagtggacgcggagagtctcaagctaacgccacgtcctgccggggccgaacggaacatattcaaacccctgggccgtctggtcatggtccgtgatgggttcgtggcattccgccactccatgatccgtgagaacctccgccaacgagccatgtcggcagacagcaactattcggacaaccagggattcccattcaaccttgaggaggcgcattatgatctccttacccgatccctggcctggacccgtatctgtgtcaaggaagaggttgcaatctccatggacaaactgcccgtgcagcagcgcgacggtctcttcgacgcgtatatcctcctggaatatacttcgcgctactggttcgcgcatctactctcgtccccgatgaccaccgccgaccgtgaattcgcctttacgccggtcttcaaaagcgccttgcccagttcagttctcttcgcgcagctggagctgaccggccgggagtcccagttcactcgatccaacatcctagagctgtaccggctatcggtcgcggtgcgccgtgtacctctgggtgagaaatctccggcattcttgcaaagtcttatcctcancgctcgtgcggccaacctggccaaggctaatctgggctcacaatcatctgtacgaagcatggatgctcagtcggtcgcaacttgggacgtcctctccgatctccatggagttggagcagctgatgctgaccgctcctcagcaagcaggccgtag

SEQ ID NO: 11629 - DNA, 198 bp, A.fumigatus
ctgcaccccctcgatccttccatagacagccctgtcgatcctagcagccccgcggagaagacggacttggagagttacatctattgtgggagaagatcactccacactcgcaatatgtccactgacatcaatgtcactgggtacgaatggacagactctcccaaaagacatggcaaggacaatactcttaatccatga

SEQ ID NO: 11630 - DNA, 432 bp, A.fumigatus
ttgctgtctgccgacatggctcgttggcggaggttctcacggatcatggagtggcggaatgccacgaacccatcacggaccatgaccagacggcccaggggtttgaatatgttccgttcggccccggcaggacgtggcgttagcttgagactctccgcgtccactgaaagcagctcttccacctccttggcgcgcagaggacgctcagacgccaccagccacgcgaggagacagcggatgtcaggccgtgcgatgtccgtggtgcttagatggttgccaatcagctcgctaacgttgcctggtgcttgctggattgcagtcatcatgcccttgaaggtcgactcgtgcttcatagattcgagagtgagctgcgcccaaacgaagcatcccttagcgcgggccacgatgcgttgggccatcatgtcaatctga

SEQ ID NO: 11631 - DNA, 348 bp, A.fumigatus
cgacgaagacgacgacttcgattcccaccgaaaggcagccgtcgtgtaccagacggaatacgaactgcacctcccgtccgggaagagcgtcggccaccgctctctcgccaaatactaccgccagaacctacacaactacccttcgatggaggagcggatcgcccgccaactcgccatcgagaacggcgaagtcgaggaagagcggccccgcggccgcaaccccacccgcgcccttgtcactcgtgccaacggcggcctcggaatgctcggcgctacggaggatcagaaacgggtcgctgtcatgtcggaacgcaaggaccggacgcgcgccattcggcaagaacttag

SEQ ID NO: 11632 - DNA, 201 bp, A.fumigatus
cggcggtttatcatcctgctcttcgtgaacggcttctggaatgtccagttcgacggcaccgttatccgaggttcgatggttcatggtaccgtagcccagcttgactgcttgaacaccgtctcgggcgtcaatgccagaatggaggagtccagctcctatgcctccggtcaagccggaagatgtattgttcacaacctgtga

SEQ ID NO: 11633 - DNA, 1191 bp, A.fumigatus
accaaaattctgccagaggactcgtcatccgtgatgagctccacgttctctctgggcgaaccgatcaacaagtcacaagaaggcgattcggaagttgccaaggttgccgacaatctcaagacatcaacgatcgaggaagaggaggaggaggagatcgaggacgagtctgaatactcgccttcccgctgtctgttctgtagccacaaggcttcagaccttcaggagaacacagaacacatgcgcaggagccacggcatgttcattccagagaaagactacctcgttaacctcgagggtttgatccactacctctaccgcaaaatcaacgagaacagtgaatgcctctactgccatgccatccggaacagccctgccggcattcgcactcacatgcgggacaagggccattgcatgatcgctttcgagaccgaggaggaacagatcgagattggccagtattacgacttccgcagcacatactccgatgacgaggccgggtcagtaaccagcgagacaccagaggacggcggagtcaaggtaaccagctcggacggcgacgacgacgggtgggagacagaaacctccgcctcctccctggatgacgacgaagacgacgacttcgattcccaccgaaaggcagccgtcgtgtaccagacggaatacgaactgcacctcccgtccgggaagagcgtcggccaccgctctctcgccaaatactaccgccagaacctacacaactacccttcgatggaggagcggatcgcccgccaactcgccatcgagaacggcgaagtcgaggaagagcggccccgcggccgcaaccccacccgcgcccttgtcactcgtgccaacggcggcctcggaatgctcggcgctacggaggatcagaaacgggtcgctgtcatgtcggaacgcaaggaccggacgcgcgccattcggcaagaacttaggtaccgagaccgggtcaaccgggctgcgaacaaccagaaacacttccgggtatgtacatcctttttttttttttttttttttttgtccgatctgtttaacaaaaagctaaccttgacttctaggaccctctcctgcaatgatcacagagctggcttttcttttctttcatggttcaatggccatttggtcgtcaagtcgatgactgggagttattcaggtgcatgcatgatacatggatga

SEQ ID NO: 11634 - DNA, 519 bp, A.fumigatus
ccagctcggacggcgacgacgacgggtgggagacagaaacctccgcctcctccctggatgacgacgaagacgacgacttcgattcccaccgaaaggcagccgtcgtgtaccagacggaatacgaactgcacctcccgtccgggaagagcgtcggccaccgctctctcgccaaatactaccgccagaacctacacaactacccttcgatggaggagcggatcgcccgccaactcgccatcgagaacggcgaagtcgaggaagagcggccccgcggccgcaaccccacccgcgcccttgtcactcgtgccaacggcggcctcggaatgctcggcgctacggaggatcagaaacgggtcgctgtcatgtcggaacgcaaggaccggacgcgcgccattcggcaagaacttaggtaccgagaccgggtcaaccgggctgcgaacaaccagaaacacttccgggtatgtacatcctttttttttttttttttttttttgtccgatctgtttaacaaaaagctaa

SEQ ID NO: 11635 - DNA, 1038 bp, A.fumigatus
caacgaacgaacagggaaatcatcgacgagtccgatgtcttcattgatgtacacaaagcaattaggcgcatggctccggctcccaagtcccgcgttccgaaaggccgcattgtcgaggagccgcccatgctcactctcgagtccacgggacctctgctggaaaccgacggtcaatcccgtatgccctccgttgatcggcgtcgcagctccgtggaagctcctcctcctcgcttccatatgcgcctccaaacttccgacaagaattcggactcgactgatggttttctcacccaccgagggaccactgacgagatccgcgaacacctgaagcacctcggtccgtccaacctggccagccgcccccgacaaactcgctaccagaacgtgaagatcaagcgagcaagcggctctcccagccgatcgggccacactgatatggattccgggcacagcacctcgggttcacaggttgtgaacaatacatcttccggcttgaccggaggcataggagctggactcctccattctggcattgacgcccgagacggtgttcaagcagtcaagctgggctacggtaccatgaaccatcgaacctcggataacggtgccgtcgaactggacattccagaagccgttcacgaagagcaggatgataaaccgccgtcaacgagcgtcgccaccagcaccacatcgtccaaccgacccgaggaccgggcccgactaggcagtagttacctgcacaagggacctgcccgcagcggtagcattaccgaacaagtcgtcgacgtcaacggaatccgcaaagtcatcctccacaccaccagcagcaacacttcttccgatgacgaaagatcgtccaataaccaagccaagttccccgttcgtcaggacggccagctcatcaaccttgatgacgaccaatccgcccccgctgcacaaccgaatgggcacaaaaagaagaaacgccgccgcaagcacaagtctcgcacgaagaactcagacggcccgcctgacgaagaagcacccctgttgtcttaa

SEQ ID NO: 11636 - DNA, 1677 bp, A.fumigatus
  unsure (1645): Identity of nucleotide sequences at the above locations are unknown.
ggctgcattgcgccggcaatcccagccgcaatgtcgcccgtcgcgcctcagctacctacgcgattcccgtgctggtgtcgtgcgatttactcatggggaggtgaaacaaaacgcgatctcggttttgtggagggtgatcttattgagtgtttgaatgctggggatgggcaatggtggatgggtcgtctgcgccgtgacaggcgcatggtcgggcttttcccatccaatttcgtggaggttctgggtgaagatttcgtgcctgtcactagagcaacaagtcccatgatgcctgccggacgctctccaatcacgaatcccacttctgctccaaagaagcagaagactgtatttagaaagccctttcaggcccacaaggaagctttggcccccgcggagctggcccggaacgcgacgacgacgacacaagcttccagttcaattccgcaaacgccacctcgaaacggcagcagtgtgcggagtgtcaaacctctgcgcacaccaactactgcggtgaaaaaccagagctctctttccagacctccctcgcaacatagaccttcttctggtggaggctctccccatgcgccgccggttgcggatcctccaccacaaagtcccactccagccagagagagcatctcgcgctccaggcctccctcccgcgcgccgtcccctcgtctcccatatgatatggatcttctgccgccgtctgtgcctgtcaggcacaccccgctagctcgacctccgtcagtccaccctccatcgcacgagatctccccgttgcagcttcaagagcgcgaagagtcgccgccaccgcctcctccccctccgcatcgaattgcagtgaaccggcgaccttccatggacatggatgtccccatgcacctggacatgaatgaccgctacgcgaccatgtcaaggacaccgtctccagcagctcattcggacgccaatggaaacactccgtcccctcttcgcgacgcaatggaagatgtcatgacatccttggaagatatgggactgtcgcggggagcacattcaccttcgccagccccagtttttgataatccttggtctccagaagcctttgatagccttcgcgacagcagacctgcccggcatggtcaccgaccgttgacatctctcggttttgaaggtgagcaagatcatcaattccccgacagtcagatacatcgaaataccatgtacggccatgaccattaccttgacgggccgccgcaattgaacaactacgtgcagagaatggaaagccggttgcgccagatgcaggagcaaagtcgcagaggatcggaagacatactgcctccggaggatgccgaagggcctccacctccgccacctaagcacctcgctcaccacgggaggcatacctcagtccctgcgcagtatccatacctgaggagtcaaagatcagggcaggacttgagaggagacgctctcaatagaagtcacacgaaatccagtaccacgacttcttcaagcggagtgcaaagtatcagtacggctatgacagctagcacagaacaaacgagccagagcttgatgagtgggccgtcggcgggcgcattcagcgcaacaagtgcaggaagctatgccaggcgaggactgacgaccggcaatgatntacactacgaagtggccggaccgcgcagagct

SEQ ID NO: 11637 - DNA, 375 bp, A.fumigatus
acagaacagtttcgcgtcctgcgcgaaaaaggcacagagcccccttacacgggcgaatatgactcccatttctcgtccaagggtgtctacacctgcgccggctgcaacgccccgctctacaaggccacgcataaatttaagtccgggtgcggctggcctgcatactttgactccatccccggtgcggtgaccagacatacggatcgctcgtttgggatggagaggacggagattgtgtgtagtaactgcgggggtcatttgggccatgtctttaagggtgaggggtatcctacgccgacagatgaaaggcattgcgtgaacagtattagtttgaagtttaccgaggatgaagaggcagcgaagtcgaaggcatga

SEQ ID NO: 11638 - DNA, 204 bp, A.fumigatus
cgatatattctgctagatccgcgatgggcctcatggaatttgggaatcttcatatgtatccgttgctcgggcatccacagggggatgggcacccatatcagccgagtgaagtctgtcgatctcgattcgtggaccgatgaacaactccagagtgttatcaaatggggtaatgccagagcgaacaagtatgtgtcgagccgttaa

SEQ ID NO: 11639 - DNA, 1092 bp, A.fumigatus
catccctttcagcctcttgcagtcgtccaggaaaaggcaaagatcgagcgttcctcgtctcagcgagtagcgaatacaagccaacctccgatcacgcatcgcccccaagcatctattgacttcttcggtgataacgagccaattactcccccggttcgccctagcaccacagatcccacgccgcggatcgctgcgcccaggcaacagtcgcaatcacagcctgccacaaagccggctcgaccgggtgattcgttgctgggactcgatttcttcgggagcgctcagccggcgtccaccagccgtccagccagtaccgcttctacccctggtggctcggccgggatgtctcgacctgatttgaaacaatccatcctgtctctttattccaagccccagccccccgtacaacatgagcgcgagtcttcgtttggagatttagcatctccggccccgcaatcgtcgtcttccaacttgggcggattgaccgacgcgttcagcggactgagcttcccctcgaccacttccccgccttccaagccagccgaaaagccctcgccttttgccaacttgacgacctttgccagcgcaaaatccagtccggctgctcccaagatcacgtcacccaccgcctcagccagcagtggcctcggtggcggtctctttgacagtcttacctctccgactatcccacctgcgaagcctcagccccagtcgcgtaccgattccatcccacccagtagccatgatttgggctttaccagctttgccactgctccctcgcccaagccgaatcctccacggtcatctttttccaatgatctcttcggactctcttcgaccccggctcctgcagctcctgcagctgcaccgcctacgatggcgtcgcctcagcaggagctcaaatccgctttcaacctgagcagtccggctcctgccccagctcctgccccagctccgaaaccggttaactcaacatcaacagtctctggttgcaacctgatccccaacttggaaccttggggcggtaacaattggattatcccgaaccggttgcccttgcctcatccacctcaagcattaataaaggtcccc

SEQ ID NO: 11640 - DNA, 351 bp, A.fumigatus
  unsure (71),(287): Identity of nucleotide sequences at the above locations are unknown.
ctaccctgctcccacagaagaagaaaaggcctccctgcgcaaagtccccgcgtctctccctctggtgtcgntctcgctttgtattgtcgaattcgcggagcgcgcatcctattatggcgcaaagaatatcttttcgaacttcatccaatttcctctgccaaagggtatactccctgtgctcatctaaagaacaaaagctcaccgaagacaggtggaaatggagccggcgctcctccgaggggcacacaggagacggccggtgctttggggatgggcctgcaggccanctcagggctagtccttctgtttgccttcttggcttatgtcctgcctattcttggtggatggtaa

SEQ ID NO: 11641 - DNA, 432 bp, A.fumigatus
  unsure (316): Identity of nucleotide sequences at the above locations are unknown.
cgcgaccagctgagggtcaataaaaggggaccatccatctcgtcgtctgaggagctgtcaaccagtctcatcgtacatcaagatgtgtatgttcgtccggccccttgcctagctctactgacaataccagctccaccaggtgattccattaccggcaacacgataacctccgattcgatcaacgccaaaggcgaccttgaaaaacacgactacgaaatcacagctacatcgacggaagttgatgactaccctgctcccacagaagaagaaaaggcctccctgcgcaaagtccccgcgtctctccctctggtgtcgntctcgctttgtattgtcgaattcgcggagcgcgcatcctattatggcgcaaagaatatcttttcgaacttcatccaatttcctctgccaaagggtatactccctgtgctcatctaa

SEQ ID NO: 11642 - DNA, 375 bp, A.fumigatus
cccttccaaatgctaagccactctaacaatcagaatcgcacagtggctactgaagttttcttctactttctcatctggctcctgaacgaacgcggcatcggctccgtctccactaatcaaggtgcctcgatgaccaccaatggcgcccccaatgatctcctgaacaatttcaacgccttgacaatcatcgttacgattccattcctcagccacgtcgtctaccccactctcgcgccgtacaagaattctttggccccgcaagccggattacctttggattcatcctcgcaaccatctccggcgtcatcgcagggatcgtccagtggcgcgtgttcaatacctcacctgcggctatcaggcttcaactgctacgac

SEQ ID NO: 11643 - DNA, 687 bp, A.fumigatus
cagtgtaggtgggccgacgtctatgtgggccggtacaaggcaatttgcgttggtgtagcaatatgcggtgtcgcacatattatccagatcatcggcgccataccctccgtcctccagaaagggccagcgcatgctgcacctccgtttataatcggccttctccttctggcgcttggggctgggatcttcaagcccaacatcgcacccacgatcctcgaccagaatcgccagaagaagcagtacactaaggttctgaagacaggagagaaagtcattgtcgatccggagttgaccaccacgcggacgatgctggttttctacgcgttcgtgaatattggtgctttctacatgcttccgactgcgtatgcagagaaatatgttgggttctggttgtcgtgggtgctggctggagcgatatacttcctcctcccggttgtgttggcgttggtctataagaagacgtacaagcagcccccgagcggcagttctgatctcaccaaggccgtgaaaattatctcgaccgctctccgacgcaacaaataccgcgtttggaagaagaatttctttgatgccgcgaagcctagggcgcttgccgcggagggcattgaggtagattgggacgagaagctcgtggacgatgttcgacggaccttaggcaagtcaatttctaacccttccaaatgctaa

SEQ ID NO: 11644 - DNA, 348 bp, A.fumigatus
agagactccagaaaatacatctttgcctctccatttcttttctactgtgtcggccggatcgtcatatttctccttacccttcacttggaaccattggacaaattgttatatctcatttctgtccaatctatatacttcaagttatactgtgcaaacaatgtcttcgacagacacctccgacccatcgactatgtcgacaacctcgaccgccgccaacacggcttcgtcatcttcggcggcttcaaccccttctccctccaactccagtgtcaccacggctccttcaacatcaacatcgcgccggccgccccggaaaagcactttgacccaacagcagaagaacaataa

SEQ ID NO: 11645 - DNA, 564 bp, A.fumigatus
atcctctcgcgcttgacgctgcttgaagagactccagaaaatacatctttgcctctccatttcttttctactgtgtcggccggatcgtcatatttctccttacccttcacttggaaccattggacaaattgttatatctcatttctgtccaatctatatacttcaagttatactgtgcaaacaatgtcttcgacagacacctccgacccatcgactatgtcgacaacctcgaccgccgccaacacggcttcgtcatcttcggcggcttcaaccccttctccctccaactccagtgtcaccacggctccttcaacatcaacatcgcgccggccgccccggaaaagcactttgacccaacagcagaagaacaataagcgacaacgggcaacccaggatcagctggttactctggaacttgagtttaacaagaaccctactcccacggcagccacgcgcgagcgcatcgctcaggagatcaatatgactgagcgttcggttcagatttggttccagaacaggttggtggaagatggatttcgccgttttctaaattgtatgtactaa

SEQ ID NO: 11646 - DNA, 213 bp, A.fumigatus
actctgtcctctctccactggggctctgagtctctctcacaactcactccactcgtttgtttccctcgtttctcactcgtcttcttcctctcgtcttcctctttcctcctaacccccccagtcagctgtcagccttcccttttcttttccttccccctctctcttttctttacccttcactcttttgtttcttccattctttcactctgttga

SEQ ID NO: 11647 - DNA, 1104 bp, A.fumigatus
tgtagccaagtcatccatcacttcacctgccgttccctgaccattggaagctggcggcgcatcgggcaaaacgcaatggacctggttgtcttctactcccctgaaaaagcctgcatgacatattacatcaataacgattctgccggatacaaaatcgagtaccccttttcctacatcaagaacatcacgctcgaatcgggtgatgccaacgcccagcccaacggggttcccaccaggccggctggcctcctcgtggaactcaatcgtcctccgttgttctacatggattcgtctaactcaggtggattctatcagtgcggtgattttacagaggatcagcaagcgagccagatcctggtgcatcatctaggaggccatccgaaggttctcagtgtccagttagccaagttggtgtcgctggagtctttccagaaccgtctggcgtacagcaaccttacgatggcaccgccaatgtcgcctcatttcatccagcgccctgcctcgcagccaaaccaattcgcgccggcattcatgaacatgtatcaggatcagtcgaccctaaacattccagtcgctcgcggacacaaacgacaaaggagtcgttccgttccggttgctgtggacttttctgccatgcagatgtctcacttcccgtcttacaacatgccccagactccaaccccataccataacgcagactcgggcatttttgcgcctgtgccgcagtcggctcaaccgctagccctgaacctgcgcattgacacctccccttcgtatgggttcgatcctcggggccatcctatgtctgctacgacgaccggttctccgtccgactttgcgagcccgtccatcttcgctaccagtgcgaccggtgagtctaccccagtcgctacgcacatgggcccttcattcagcctgccttttgtagcgccttcggtggattcgtccagcatggggcatgcagctccttcctactcgaatgtcagccatgccgatcctatgatcgctgaacattcgcctcccctgtcgaacatggcgcataccccacaggatatgcacaccctaagaaccgatcttaacagcggcgtgaaggaagcactcccc

SEQ ID NO: 11648 - DNA, 654 bp, A.fumigatus
tgccttcaagtaacagcaacctttgtggacgaaacggaagaggtcgccgacctataccaggtcacagatgcgagcatcgaggtctcgagcgtcgcattagaccagcgtccgtcgccacggcctggactgtcaagccacggtacccccatcacggatgccactgacgcctttttcctctggcgatacatcgacttcatcgggccgcgcttcgacatgttcgacgatgcaccgcggtatttctcgaccgtcgtgccgcagctcgctctcaaggacccgcttgtcctgctcgcctgtgtcgccgtggcagcccgccagtactccctcgtcaatgaccagcagcagcacagtcatgagcaggctttgacatactacaacgctgccattcacctgctgtccaaacggctgcacgatagcgggccagacccagcggtatttgcgagctgtctgctgatagctcattgtgagatggtcgagagcaaggcctcagcctgggacttgcatctcaaggggaccggcgatcttctcaagatgtatgggtggcatgggatgagcggcggtttggctcaggctgtatgtcccatctctgtatgctgtgatcatgtggctaatctgcaaccgtctatacatagtcattctggatttactgcaggatga

SEQ ID NO: 11649 - DNA, 444 bp, A.fumigatus
gtaggtggtgtatggaaatgccattgtgttcataacagaaacgctgatattgggtatgaagcatgcgatcagtgtcgtagaagccacgtcaagtgtgatcaatcacggccttgcgctctatgcaagcgacgagggatcgagtgttccctttgtcaagaggtcacttttaccgcgctcgagtttaaagcacccgccgctggcctttcaaggagctttgtctcaaatacagtagatagtccaggtgagcagagcccacgagacggcagcagaaacactctaatgccttcaagtaacagcaacctttgtggacgaaacggaagaggtcgccgacctataccaggtcacagatgcgagcatcgaggtctcgagcgtcgcattagaccagcgtccgtcgccacggcctggactgtcaagccacggtacccccatcacggatgccactga

SEQ ID NO: 11650 - DNA, 363 bp, A.fumigatus
actgtcacttccacgcgggtgttgagtaggtcttcctcggccttcagtttcccgcttctactactgactcaccttagacactgtataggcgcgggagaatcagaaagtggaagtagccaaaaatcctgtggtctccgaacccgcgactacgatgtgcccctgcgcatcgggaccctgttcgtcgtgctcgtcaccagctccatcggcgtgttcctgcccatgctcttggtcaaattgccttcggccaagatcaacggcgttgtctcgacggtgatcaagcagttcggaacgggagtcatcctctccactgcgtttgttcatgtatgtctcttctccattcagcatgacggacggagcaactaa

SEQ ID NO: 11651 - DNA, 813 bp, A.fumigatus
cccgaacagctctacacgcacgccaacctcatgttcaccaacgagtgtctcggcgaactcgaatacgaagccaccacctccgccgtcgtcatggccgggatcttcctctcctttctcttcgagtacatcggccaccgcatcattctcgcccgcgcaacgcggtgcgcgtcgccctgtcccgagcagaccggcgacatgtccccctcatccacaagcaaagaactaccggccagccaaccgccgccgccgccgccgcagcagcaacaaccaccgaccctcgccgcgctgggccaccaccacggccctcccctggaccccaccaatcccaacaccaaactctcggtgctcgtcatggaagccggggtggtcttccacagcatcctgatcggactgaccctggtcgtggccggcgactcattctacaagacgctgctggtggtgattgtcttccaccagttcttcgagggtctggcgctcggggcgcggatcgcgatgctgccgggcccgctgctggggtcgaaggcgctgatggcggggacctttgccgtgatcacgccgatcgggatggcgatcgggctgggggtgctgcactcgttcaacggcaatgatcagagcacgcttgtggcgctgggaacgctggacgcgctgtcggcggggatcctggtgtgggttgggctggtcgacatgtgggcccgggactgggtgatggatggcggcgagatgatgaatgcgcgactgagcattgtggcggttggagggttctcgctgatcgcgggaatggtcttgatgggggtgttggggaagtgggcgtaa

SEQ ID NO: 11652 - DNA, 474 bp, A.fumigatus
tcaagcagttcggaacgggagtcatcctctccactgcgtttgttcatgtatgtctcttctccattcagcatgacggacggagcaactaacccgaacagctctacacgcacgccaacctcatgttcaccaacgagtgtctcggcgaactcgaatacgaagccaccacctccgccgtcgtcatggccgggatcttcctctcctttctcttcgagtacatcggccaccgcatcattctcgcccgcgcaacgcggtgcgcgtcgccctgtcccgagcagaccggcgacatgtccccctcatccacaagcaaagaactaccggccagccaaccgccgccgccgccgccgcagcagcaacaaccaccgaccctcgccgcgctgggccaccaccacggccctcccctggaccccaccaatcccaacaccaaactctcggtgctcgtcatggaagccggggtggtcttccacagcatcctga

SEQ ID NO: 11653 - DNA, 510 bp, A.fumigatus
tacatagcacatccatcctccattgtaaacagaatgaccaccaccatacgctacgccaccgaagccgacgcgcccgcaatcgcagagctcaacatcatctgtttccaagatggccccatgtaccgcaacatgctccccaacatcgaccctctctccgccacgcccatgaaactctcccgcacctacgacaaactggcaaacccccggatgcacgtcctcgtcgcgaccgaccccacctcgaatcaaatcctgggatgcgcacggtggctgatgcccgacgcgagtgcgcactggcgagacgagagtgagatggcgatcctctccgacgacgcaagggccaaggcagcgcagatgacgcagctgcggccggcagggatgaatgtcgctgtctacgagggactgttcaaagcgctggaggagatgagggggaagtacgttagggagggggatatcggtgagtgcacttttccacctttttttttatctcagtatctggaagacgccgggtag

SEQ ID NO: 11654 - DNA, 624 bp, A.fumigatus
cggacggagcaactaacccgaacagctctacacgcacgccaacctcatgttcaccaacgagtgtctcggcgaactcgaatacgaagccaccacctccgccgtcgtcatggccgggatcttcctctcctttctcttcgagtacatcggccaccgcatcattctcgcccgcgcaacgcggtgcgcgtcgccctgtcccgagcagaccggcgacatgtccccctcatccacaagcaaagaactaccggccagccaaccgccgccgccgccgccgcagcagcaacaaccaccgaccctcgccgcgctgggccaccaccacggccctcccctggaccccaccaatcccaacaccaaactctcggtgctcgtcatggaagccggggtggtcttccacagcatcctgatcggactgaccctggtcgtggccggcgactcattctacaagacgctgctggtggtgattgtcttccaccagttcttcgagggtctggcgctcggggcgcggatcgcgatgctgccgggcccgctgctggggtcgaaggcgctgatggcggggacctttgccgtgatcacgccgatcgggatggcgatcgggctgggggtgctgcactcgttcaacggcaatga

SEQ ID NO: 11655 - DNA, 420 bp, A.fumigatus
atagcttcagagcaaacaaggttacgcccacttccccaacacccccatcaagaccattcccgcgatcagcgagaaccctccaaccgccacaatgctcagtcgcgcattcatcatctcgccgccatccatcacccagtcccgggcccacatgtcgaccagcccaacccacaccaggatccccgccgacagcgcgtccagcgttcccagcgccacaagcgtgctctgatcattgccgttgaacgagtgcagcacccccagcccgatcgccatcccgatcggcgtgatcacggcaaaggtccccgccatcagcgccttcgaccccagcagcgggcccggcagcatcgcgatccgcgccccgagcgccagaccctcgaagaactggtggaagacaatcaccaccagcagcgtcttgtagaatga

SEQ ID NO: 11656 - DNA, 189 bp, A.fumigatus
tcattgccgttgaacgagtgcagcacccccagcccgatcgccatcccgatcggcgtgatcacggcaaaggtccccgccatcagcgccttcgaccccagcagcgggcccggcagcatcgcgatccgcgccccgagcgccagaccctcgaagaactggtggaagacaatcaccaccagcagcgtcttgtag

SEQ ID NO: 11657 - DNA, 228 bp, A.fumigatus
gtgctgtttttttccactgaagtacgcagcagctatgattgttggactcaattaacccaagtgccctgtgcgcagtttcatagtccagttcctactaagatgggtagcaagccatcatcttttccacgtggctattcggtcattctgaaacaaactgttatattgaacaacgtcatgatcattgaggtgaatcgccatttgcactattccaagaactcggacctctag

SEQ ID NO: 11658 - DNA, 531 bp, A.fumigatus
cgaacgaccagtgacctcttgcgccggcatatccggatttatcacccgaatagagcgcctccggcgtcgcgggcacagaaggcttgcgctgcgtgtcacgcccggaaagaacgctgttatggtggatttccctgcagtgcatgtcagaaacggggtatcgcctgttctcctgggaagggaaaaactccagaagagcagattgtcgacaacaacgttcagatctcgcaacaaccccatccgcctcggtggatcgctcttgactacgtcgatatttattttgataatttccatccaaaatggccatttctgcaccgagggacatttgacgtgaccaaagaaccttgtgtactgattcaatctgtggtcatgataggactgtggatagaggggagcaagaagtcgcgggaggcagctaccgatcttcaccgtagcctgtctactgcgattcgtactcagatggtgagagcatacaagaatccagggaatttgcccttactaacaacatttttttttcttttccatccatcttag

SEQ ID NO: 11659 - DNA, 576 bp, A.fumigatus
aagaccgatctcagtctcctatcagacaccatgccaccgcagccgctttctggctcgagtcttccaccgtttcaatgtgaccaccctgggtgtggggcgaagtatcgacgcaaggagcatttgaatcggcatgcggcgagtcattcccgaggagattgcttttcttgcccgtattgtgagagcaccttgaccaggagggacgctaaaccttgcatcctgttagcactcatagatcggcatactaacgaacgaccagtgacctcttgcgccggcatatccggatttatcacccgaatagagcgcctccggcgtcgcgggcacagaaggcttgcgctgcgtgtcacgcccggaaagaacgctgttatggtggatttccctgcagtgcatgtcagaaacggggtatcgcctgttctcctgggaagggaaaaactccagaagagcagattgtcgacaacaacgttcagatctcgcaacaaccccatccgcctcggtggatcgctcttgactacgtcgatatttattttgataatttccatccaaaatggccatttctgcaccgagggacatttgacgtga

SEQ ID NO: 11660 - DNA, 252 bp, A.fumigatus
gcagtgatgcacccttgttggatgcctaggtcaatagacataatgcccctggggggatctcgtccggatgagtataccttactatctgttagagtggtcttctccaggcgaccgacttcggccggctattataataatactatatatcagcttttgcccattactatacgtgctcagtataaaaccacttcgtcttactcctttctttcccctatggcctttggtgcctccacccgaatgcctctattttaa

SEQ ID NO: 11661 - DNA, 924 bp, A.fumigatus
atttgccaccaaaacgttaccaacgcgcaggcatatatcgaattggccgctggtgatcgcattcaactccactggactgcgtggccagaatgtcatcacggacccgttattgatatgctcgcatcttgcggcgagtcgtgtacgaccgtggacaaaacctcactgaaattcttcaaaatcgacggagtcggcttggtggataactcggcggtgccgggcacttggggcgatgaccagctgattgccaacagcaatagctggatggtcgagattcctaaatgtattgcgcctggcaactatgtccttcgccacgagctgatcgccctgcatagcgcgtttgagacaggcggggcgcagaactacccccagtgcttcaacctcaaggttactggatccggtactgactcaccagctggtaccttgggcacggagctgtacaccgagtccgaccccggtctcctggtggacatctacaagtcaatcgcctcgtacgccgtccccggtcctgccatgtacaccggcgccgtctccatcacccagtctacctcggccatcaccgcgaccagcaccgcaaccgtcggctcaggcgccgacagcacccccgtgccctcgtctgctgcgtcctccgagtactcgaccgtcgccgtgcaggttcccaccaccaaggcccagtacacccctgtcccctccagctcgccttcgacctttgtcacgtcgcctgcgcctaccacttctgtccccagcggcagctccgtccctgtcacgtctaacaccgcggctcccctgcctactgctgctcctggcggtactcagactgtctatggtcagtgcggtggacagaactggactggacccactgtttgtgcttctggcgcgacctgcaagacctggaacccttattactcccagtgtgtgcctaactag

SEQ ID NO: 11662 - DNA, 609 bp, A.fumigatus
tcgccctgcatagcgcgtttgagacaggcggggcgcagaactacccccagtgcttcaacctcaaggttactggatccggtactgactcaccagctggtaccttgggcacggagctgtacaccgagtccgaccccggtctcctggtggacatctacaagtcaatcgcctcgtacgccgtccccggtcctgccatgtacaccggcgccgtctccatcacccagtctacctcggccatcaccgcgaccagcaccgcaaccgtcggctcaggcgccgacagcacccccgtgccctcgtctgctgcgtcctccgagtactcgaccgtcgccgtgcaggttcccaccaccaaggcccagtacacccctgtcccctccagctcgccttcgacctttgtcacgtcgcctgcgcctaccacttctgtccccagcggcagctccgtccctgtcacgtctaacaccgcggctcccctgcctactgctgctcctggcggtactcagactgtctatggtcagtgcggtggacagaactggactggacccactgtttgtgcttctggcgcgacctgcaagacctggaacccttattactcccagtgtgtgcctaactagatga

SEQ ID NO: 11663 - DNA, 306 bp, A.fumigatus
ctggcatatcgtgccgtgcctctgtgtcatgtacttgctcgcctttctcgaccggtatgcaatcctcaaaacaaaacccctagccccgtgcatgaactgagctctgtaatgcgccgtcacagagtcaacatcagcaatgccgcgattctcgggctgcagaaggatctaaatatcgaaaatactaagtacaacactgcgttgaccatcttcttcgtaccctacgtcctctttgagattccatccaacatattactgaagaagctgaagccccacgtatggtgtatgtccttcgtctttctgcgatag

SEQ ID NO: 11664 - DNA, 369 bp, A.fumigatus
ctgtctgtgccagcgatcaaaacccaactctactccgtggccccatgggcagccgcgttcggcttctccatgctgattgcaaccctttctgataagttcaggcaccgctacatttttgcgatgattcccatgttgattgccatgggcggctttgggatcctgctgaatgttcacggcgtggctcaccggaatgttcagtatggggcgctcttcatggtgaccggtggttgctacagctcaatggccgtagttgtatgttggtacgccatgaatctgagtggacaccgtcgacggggcgtgggaacagcatggcagatcggattcggtaacagtaagttgcaatttctgcaatgcgttcggggtgcgtaa

SEQ ID NO: 11665 - DNA, 228 bp, A.fumigatus
ctcctcttcggatacataggcgtctccgaaacagataatggtaaagccgagggcgagatctatagcgagtccgcggacctccctccgctctctaccaccacggagcggaagctgatggccaagattgactggcatatcgtgccgtgcctctgtgtcatgtacttgctcgcctttctcgaccggtatgcaatcctcaaaacaaaacccctagccccgtgcatgaactga

SEQ ID NO: 11666 - DNA, 249 bp, A.fumigatus
  unsure (127): Identity of nucleotide sequences at the above locations are unknown.
ccagttggcggtatcatcgctacctattcattcctggcgaaagacgcaccgctgtaccgaaatgggtatatcatcagtctttccttcctctgcttctccgcagcatgctgtaccgcttatcttgcancggtctggtacgacaatcggaagcgtgatcgcgccatggctaacggtgctaccattgagcttacggaacaggagcaagagcagctgggcgatcttgcgcccaattaccgctatacttattga

SEQ ID NO: 11667 - DNA, 561 bp, A.fumigatus
gtctgtttcctccgagaacgattgacccagtcaatgaccaatcgcgacgtggcaggcttctatctgctgggaatgtggtataagcgcagcgaggcacagaaacgattcagcttcttcttcagctctactaccttagcaggcgcattcggtggtcttctcgccagtggtcttggagagatggccggacttcgtggctacaatggctggcgatgggtcttcatcatcgaaggcgtccttacctgtgttgtttcgcttgtctggttcttcgtgcttccagacttcccagaagacgtcaagtggctgaatgatgaggagcgagagttcattcgtgcgaagcttgccaaggacgtcggcgccgctggtagagatgtcaagctgaccgtgcgcgatgtgctggcagtctttaaggactgtgagtggcgcgccagccttggggttttgatcttcgctgactccttcttagataagatcttcattggtggcttcatgtactttggccagatcgtcacggcatacggtgagcatgactcaacatggctcttgaatgggttccattcttaa

SEQ ID NO: 11668 - DNA, 249 bp, A.fumigatus
acgatggaaaaagaacagatcaaagtcgatctaggagattcgcagagaatcaccgcaatggacgagaagcagcctgtccccacggagctgggagtcatgggcgacactaccctagagcaaaatggattcaagatacatcctcagccgacttcagatcccttggacccgctgaactggtcaaggcttgagaagcatactatcttaggaatcgtcatgttcaagtcagtcctcgcaaagctcaacgtatag

SEQ ID NO: 11669 - DNA, 378 bp, A.fumigatus
gaatcgtcatgttcaagtcagtcctcgcaaagctcaacgtatagtcagccgttgctaatatttgatggaagatatttcctcttcacttacatcacaacgacaacagttccttcattccctgagctccagtctcagttcagtatcagttactcggaagtcaactggaccgtcgcaatccctgcccttgggctttcagtagggccccttttttggacttcgctcggcgatatatacggccgtcgcactattttcatcactggaaccgtcattgctctcgtgtcgacgattggagtagccgtggccgggagttatagcggatatatggccgctcgattcttccagggattcggggttagcccagcggcgacggttgggatg

SEQ ID NO: 11670 - DNA, 192 bp, A.fumigatus
attgatgagtccttgatgatggctcttctggtcctgagccgatgcgccaagttccagttgttctacaatgaagtcctgacaatctactcgttaactgaatctactcaatctgggttcgattgtaatcacttgtcatccttcttttccaaccggagtgatgttatattcgacggcatcatcgacagcccctga

SEQ ID NO: 11671 - DNA, 303 bp, A.fumigatus
gtgaaactcgtcatatttgtctgcagtccaccgactttctcgttgctgacctcgtcttatttcccaaagtacagctggaatattagacccacagcgtatgccctacatcctactgatctgccagaggtcgaagcaacaatggtagcccttcaagccgtccaagcccacaatgcggctctcacatcgctagcctcaggtcccgtcgcggtgtttggtatgttcgccttctacattattctcccctctacgatggaacaattgctgcagatattcctctttcggaagaagccctcaagccgctaa

SEQ ID NO: 11672 - DNA, 978 bp, A.fumigatus
taccctccagtcggcggtacctctggtatcgccctctcaacggccctcgccttcacccgttacaccacatcgcccaagatctacctcgttggccgcagccagtccgcagccgatactgccattgcctccatcaaaagaatcaacccctccgcgcagccaacctttctccaagccgacatatcccttctcaaaaatgtcgacagcgtatgcgctgagctcgcatcaagagaaaaatcgatcaacctgcttttcatgactcccgggtatttgacgctgaaaggccgggacgagacggccgaagggctggaccgaaaattcgtgctgcactactacgcgcggatgcgattcatcaccaatctgcttcctcggttgagcgcagccgctcaagatccctctgtcgacgccggtgccagactatcacgagtagtctctgttctagacccaatggtctccgtccgcgccggcggcgctggcaccctcgacttctctgaccttagtctgaagcacacctttaccctgcaaaaatgcggttggcacgccagcctgatgggtaacttcttcctggaaagtatggcagagcgacacccgcatacctcctttgtccatgcatacccctctggagtggccacgggcgtgatgcgtgaactgccagctggacgagtgctgtcggctgtactgacgccgctgttacggccctttatggtccctcttcatgagagcggggagaggcatttgtttgcggcgacaagtggaaggttcccttcgaaagctgagggagaggggagcgaaggggatatcgctgctggcagtgatgggacgaaggggagtggttgctactggttgaattgggacggtgaggtttttccgccaaacaagaaaatacagaggacgaggatgcaaggcgcggtggacaaggtggtgcagcacacagaggaggttttcaagcaggtgtgcgaagagggcaacacgtacccgtaa

SEQ ID NO: 11673 - DNA, 786 bp, A.fumigatus
cgatcttgtgttccagagactaatctggaacccgcagatacaaatcgctccaacagagccgctgagggtccacagacactggtcggcagtgactcgcctcattccagtgctcccagtacacctgaggattcgtctcgagctggtaaccgacggtccgaggccgtcaagatagctggcgaagactacttcttaccggatgggcgaattcccgaggctcgaagctcacctgcgacgccgcaacccgtggtgacaaagactcttgtctttagtcctcgcattcagtttcatgagacatggcccagtggagagtacgatcgtcgaggagacattgcaacctgcaaccgcttgacgccacttctcgctcaacagatcaaagaagaactcaacaatttcaagatggttagtcctcacagagacaagtccattccagcacttgtaccgacctgtattctaacgctcaatcataggaaatggaagttcacgagacctcgaagatctacactcatttcttgtgaggctctcgcccgcgacgacattgtctggcacgtctcatattgcacatcagccatcgtaactagacctccgagtggtgtggctttttgcaactggcattttaaacctcaagcactggcatgtgtttcattcttctttagacctatgcatgatggtcgagcgttcgcaaaacgtgccgcacttgtgctattccgtcttccgattattccccgtccttgcgtattccccttggttcctgcgtttgtgggtgttatgccgacacaaccattctag

SEQ ID NO: 11674 - DNA, 198 bp, A.fumigatus
  unsure (5),(91),(103): Identity of nucleotide sequences at the above locations are unknown.
cgccntacctctccaggcaagcgggcggaagtctgccatttcaactcggcctatactaacttatatcattcggcacacatagaccgacgtnccacccctcaanattgtaccaccctcggaccttccagccccgtggtgaagacaaaagaaaacaaggacatcatgatgcagaaaaaacgagtcagacacgccagatga

SEQ ID NO: 11675 - DNA, 1053 bp, A.fumigatus
tacgactcacactttgcttttccgtgccactacgacttcgagtggccggcagccgagatgatggagcccgcggtatcgaacggcggtcctgtcgctgaggacaatattatcaaccgtcgcggtggtgaatcgatctatcagagctgtgtaaacctcaaaaaacggctggctgaggtgccaaatttcgaaccccacttgcgagagatggaggaggaggacgagagactgggcaacactgaccctgtcgcatcgctttggaattgccttcgaaatggataccccttgttgaccatctacaatgcctctgatcctcccgagctcctcgagatcgatccctccaaggttcccgaggcgaaacgtcccaaagccgccaccttcaagtttctacaggcgtcgctgcaggagctggcctttccccagcaggattgcttcttgatcaccgatctatatggcgacagtacgactggctttatcaaggtgatcaaaatggtgaatcgcgttttggatatcctggagatgcagggccagttgaagcggtctttggattccacaacatcggctccagcgaaaggggcggtgaagctcaccaagagggagttcattctcaaggagttactggagacagaacgcgactacgtccaccacctacagaatctgcaggctctcaagaaggaactagaggagacaggggctctgactggagatgctagccaccagatttttctcaacttgaacaatctcctggatttcgcgcaacggtttcttattcggatggaacaacattacgccctacctgaggataagcaaaactggggcgagcttttcattcagcacgaggaagcttttcgacaatatgagccattcatctcgaatcaaatgcgctgtgatgaagtctgcctcaaagagtgggataagattcggtcagcaccgcggccgctcgaccttcagcagatggtcgctcagcctgcaactctgaacagtttctttgtcaagcctttccagcgcatgacaaagtaccccctgatgcttatggtgtgttgttttcagatctga

SEQ ID NO: 11676 - DNA, 285 bp, A.fumigatus
tgtgtgcgcaccgtcattaacctctggttacaggaactgcgcaaacaaaccgaggatcctgatctccaagctgatatcacaaaagcaattgacaccatccagtctgttctcgactccgcaaacgacgcgatcgacaaggagcacctagcgtcggcctttctcgatttagatgaacgagtagacgactggaaggctctgaagatcgactcgttcggcgaattgctccgctttggcacattcaccgtcttgcaagtcttcacaacgccgagggcatccatgtgcgag

SEQ ID NO: 11677 - DNA, 366 bp, A.fumigatus
tttaaggtgcttggtggtatcgcagatacggtggcccagttgatcacagccttcaaggcccgttcgacagtacgaaccaggcaagatggtgatctcatctcgatcgagatccacgagatggacaaggagcgaccaccaccagtgggagagctgggacatgcgaagcacattcctcctccgcttgatttcgagcgtctcacccgattcatgtcctacggtttcttcatggcacctatacaattcaagtggttcggtttcctgtcccgagcatttccgttgaccaaaaagagcccgacgctgccggctttgaagcgtgttgctgttgatcagctcatgttcgctcctttcggtatggacatctcttaa

SEQ ID NO: 11678 - DNA, 348 bp, A.fumigatus
tcagctcatgttcgctcctttcggtatggacatctcttaacttcgaagataagagcttgggctgattttgataaaggtcttgcgtgcttcttcacattcatgaccgtcgccgagggtggaggcaaaagagccttgacccgcaagttccaggatgtctacttaccgaccctaaaggcaaactacgtcttgtggcctgctgtgcagatcctcaactttcgggttgtgccaattcaattccagattgtaagtgaagtctctgcaagactaatatgcatggtgctaaccattatatgtcacagccatttgtatctagcgtcggtatcgcttggaccgcatacctgtccttga

SEQ ID NO: 11679 - DNA, 291 bp, A.fumigatus
caaacaaaggccacctaccccgccgtcggaccgaagttgatcgaagaggctcaccgtgagcatattaggtcaggagatttcagtctctattttgtctgtttagtgtacccaaaggtatactcattgtgctcttcgttccccagggcttcattagctgacacggcctacaatctgatagaaacaccatacacaatgtctctcaccaacaagcttgctatcaccgatgtcgacctaaaggacaagcgtgtcctgatccgggtacgttgtgctgaaaccgcatccatgagctaa

SEQ ID NO: 11680 - DNA, 348 bp, A.fumigatus
catgtcccccgtgcctggcaggtcgatttcaacgtccctctcaatgagaagaaggaggtcaccaacccccagcgtatcgttggtgctctgcccaccatcaaatatgccatcgagcaaggtgccaaggccgtcgtcctcatgtcccaccttggccgtcccgatggcaagaagaaccccaagtacagcctgaagcctgttgtccctgagctggagaagctgctcggcaagagcgtcatcttcactgaggactgtgttggcaaggaggtggaggagaccgtcaacaaggcctcgggcggtcaggtcattctgcttgagaacctgcgtttccaccccgaggaggaaggtagc

SEQ ID NO: 11681 - DNA, 2121 bp, A.fumigatus
tcgggtaccgagggcagcccttcttccaggaaagattcaaacttctcccagcacgtggcgtcaacgtttgccggctcgctacgaaatttatatcttgccgacaatcgtctagaagacgatattttccgagagctttccttgattccagagttgcgcgttgttaacctgtcgtacaatgaattgaccgaacttccgcagggcttgctcaagcgctggccgttcctgaccgagttgtacctttcgggcaatgagctgacttcgcttccttctgatgatctcgaggaaggcagtaacctcaaagttctcaacctgaatgcgaaccggttccaggtactgccagcagaactctgcaaggtcagcaaacttgcaatcttagatgttggcagcaacgccttgaagtataatgtgtccaactggccgtacgattggaactggaactggaatcggaatttgaaatacctcaatttctctgggaacaagcgcttggagattaaaccaaacatcacctcggcgggaacgaccaccgccaatggaaccgacttaactgatttcaactctcttacccatctccgtgttctcggtttgatggatgtcacactgacaacacccaccattcctgaggagaacgaagatcgacgtgtcagaacgtctgcttcacttgctgggtctctggcttatggcatggccgactttttgggtaaaagcgagcatttgtccatcatcgatatgatcgttccacgtctgaagccggacaatgtggaaacgcttgtagggttgtttgatggccaagcccagtcaactgggggttctaggattgccaagtttctgcatgagaatttcacctcaaccttctcttccgagcttaaaaggctacgagtggaagaagaagaaacaccgcttgatgcactgcggcggacattcttggcgctgaacaagaatatggctgctgctgcctacaaatctatcgacgaccgtagtgttcggcaatttcacagaggatccccagctacgaaacttctcaatcaagacgatatacggtctggtggggttgcaacggtgttgtatctgaataacatggatctatatgtcgccaacgttggtgatgcacaggcaattcttgtgaagtcagacgggacgctgaagtacctaaccaagaatcatgatcctgcagagccccatgagcgggcgagaatccgggctgctggaggatttgtctctcgcaacggaagactaaacgacattcttcatgtgtcaagagcctttggacactttcagctgatgcccgcagtcgttgcagcgccccacaccatgcatgtgcagttgactgaacaggatgagatgatcatactggcatcgaaggaattgtgggactacgtgacgccagacgtggtggtcgatgtcaccagagcggagcgtagagacctcatgattgccgctcagaaaatccgggacctggcgatatcctttggtgctaacaataaactcatggtgatgattctcggcgtgagtgacctaaagaagcgggagaagttcaagtttcgtggaacaagcctctcgatggggcctcctgcttttcccgaggaacaaatcatccctagcacgaagcgtaccaagaaaccgcgtgacatgcctggcgattcgagactcgcccgcttcgattacgtggatgcccctattggggagttggccatcatcttcacagatattaagaagtccacaagtctgtgggagacatgtcccgacgcgatgcgctctgcaattcagatacataacgacatccttcgtcgacaacttggaatcattggtggctacgaagtcaagactgaaggtgacgcttttatggtcgctttttccaccaccacagcagccctactctggtgtttcaactgccaaacccagcttttggaggccgaatggcctaccgaaatccttgaacagcctcagtgccaggtccagtacgatatggagaacaacatcatcttccggggtttgtctgtccgcatgggtatacactggggagagcctgtctgtgagaaagatcctgtcactaatcgcatggattatttcggacccatggtcgaccgcgcattattcactactaggaggcggcaccgaaaataa

SEQ ID NO: 11682 - DNA, 270 bp, A.fumigatus
acaagaaaatactctataatttttagatatctggctaccatttatattcatcatgtcccgttcgacgcatcgggacgacttctttcaaacctcgttcgtgatatttactaccgggttgctatgtgttgctccctctcactaattgtgcctcctaattttgcagggctgccttggaagagcagaagcgaaaagacgctaaatctcggaacacacatgggagccccatcaagttgcagagtaagatattggccattgcagcagatcctgtga

SEQ ID NO: 11683 - DNA, 717 bp, A.fumigatus
atcaatatttcatttcttttaccatttttgcagacaggtgaaactgctgccgttttcaaaggcccgactgccccagttacaagcgtctgcttcagtcccgatggcaggctgttgtttgccggttgctgggataagaccatttggagctgggatgtggcctcaggacagccgcaacacagatatgaaggccacaccgacttcgtgagatcggtcatcagctcaagcctgcgtgggcaagatcttctggtttcaggaggcgccgatgcgcaaattctagttttcgacatcgccagtgggaagcgtctttatacgctcaaaggccatgccaagggtgtccaggacttgattatggatccgacttccctcgacttggagagcaagtcacttgttctatttagtgctggcagcgatcgagaaattcgttggtttgacatcacctgcggcagtcaagatctcaccgccatggatcctcttttggcgcatgacacaagcgtatacaagttgttcttcgacagcgacggagatctatggacagcttcggccgataagacagccaaatgtctcgtgagggaggatggttggaaagcgaacctgacgctgcctcatccggattttgttcgagatgttgtagtttacgagcagggtggttgggtcattaccgcatgccgggacgaggaagttcgagtatggcatcgctcggtcagtcaatgtctatga

SEQ ID NO: 11684 - DNA, 204 bp, A.fumigatus
aattcacagaccggccaactttatcatacattttccggacacttcgaagaggttacggggctcgttctcatagggtctaccatcgtcagcgtcagcattgatgctactattcgccaatggtctttgagacctgacgacctacgaacggcagtggaaaaagccaagagagtcaaggctgaagaggaggagcaatctgagcaaaac

SEQ ID NO: 11685 - DNA, 471 bp, A.fumigatus
tcaacgaaacccatgcaatgcgttttttttctttgttacagacatgactgtggcaacttggacaatttgctgacttcaatgaaacagagcatgtctcgcccaggacccgcccctcaaggaccttctcaatctcaaccaccacaacagtctcaggctcctcgccccaacccccctggatatcctcagcagccacaattcccaggcttctacccaccttatggacaacgctttggcgctcctggcttcccacctggacctggattcccgaacatgccgtatggtgctccaccgggatggtaccctcctcctggtcagggatttcctccaggaccaggacaatttcctcctcaaatgcctattactgcccctggaccccaaagtcctccccagaatcgagctggagccccgggcgcgggtcctgtaaatgtacccaaggccacgtcagagctcccggtgggtgaccggcagacg

SEQ ID NO: 11686 - DNA, 396 bp, A.fumigatus
accgtcttgcttgcccggccattgactaacttgcttatccctagttatgttggtactttacatgagatcaaccctgaggcctcgacgatagcccttgagaatgtcgtctctttcggaacagaaggcagacgaggaaatccggctgaggagatccctccgtctgccagtgtctatgaatacattgtcttccgtgggagtgatgtaaaggacattagcgtagctgaggagaagaaggagaatgcacagcctgaacctcctcgggtgccagacgatcccgccatcctaggagtaagttcaaccggacctctgaattctttcccccttcccttcatttcatgggaacccatgcttgcaagtcgctcgaacttgacacggtcgggttggttgatcaggtga

SEQ ID NO: 11687 - DNA, 1299 bp, A.fumigatus
aaactggcggacagcgcgatccctgcaggactgtcttccacaaagtgcagacatcttatgcccccggaaaatgatccatcctatcacaacataggggtgacgctgtctgttaacatgcctggtctaggccatgaaaccggtgatcgcgcgaggaatgcttccggaattaagaatctgtatgcaaagaccgatgccagccactacaagcaaatcgatccggagactctggagcccattggactcgctgcgcagaaggatctgcatcctgagctaaccggaccattgtcggcggcccatgcaagatccgatccagtcactggaaacgtatataacttcaacctagcattcggtccggaaggatccatctaccgtatcttctgtgtgtctgcttcaacaggcaccacgtcgattctggcccaattccccggaactccggcgtatctccattcgttgctcatcacagatgactatgttatcctctgtgtatggaattcgcacgtcaatccaacgaagctcgagaattctttcgtagaagctatccaaccatttgacgcctcgaaacccgcaacttggtacgtcgtcgatcgcaagggcagccgagggctcctcgcgacgtacaaaagccgcccctttttctgcttccataccatcaatgcatggcaggaaccttccgctgatgatcccaaacaaaccgacatcgtggccgaactggtcacgttcgatgacctcaccatcatgaagaaagcctactacgagaacatgctttcgtcgtctcccagcgcaaagacctttgttcaggggaagcgggatgggtgtcgttcagcgctgactagcttccggctggcgaggattccgtcagctccaacttcggaggttcaagaggcgtccatcaactggacagcatgccagggctatgctcctgagctgcctaccatgaacccgagatatgtcacgcagaagcatcggtacacctatgccgtgactgactgcggcgaatcgactttcttcgatggcatcatgaaatacgacagcgtggccaaagagactattgtctggaaacagcatggacactcgcctggagaagcaatctttgtcgctaatcctgcgggcgctgatgaggatgatggtgtccttctgagcgttgtgctggatgggaagaccgggaaaagctacttgctctgtctggatgcccgcgatatgtctgagctgggtcgagcgcatctcaacggaccggtaggctttggttttcatggccagtatgttcctacgggtggagggctgcccacgggggattactag

SEQ ID NO: 11688 - DNA, 204 bp, A.fumigatus
aaacaacctcgtaaaaccttcgaccctgcagccattttgaaggctcgtgatctgatcaagttgttgtcgagaagcgtacccgttcagcaggtgagttttcgcagtgacacggcccccaaccccagcgtcacaactgaccaccgtggtccaggccctgaaaatcctcgaagacggcgtcgcatgcgacatcatcaagatccgtaa

SEQ ID NO: 11689 - DNA, 666 bp, A.fumigatus
tacggtcgcggcgatgggtccgtacaaggggctgaaggaggtccgccgggtggtcaacgactgcatggccaacatccacccaatctaccacatcaaggagctcatgatcaagcgcgagctggccaaggaccccacgctcgccaacgaatcctgggaccggttcctgcccaacttcaagaagcgtacgttgtcgaagcgccgcgttccctacaaggttacggacaaatcgaagaaggtgtacacaccgttcccaccagcgccggaaaagagcaaggtggatctgcagatcgagtccggcgagtacttcctgtccaaggaggccaaggagcgcgcccagaaagaggaggttatggagcggcagcgccagaagcgcgaggagaagatgaaggagcgggcaaagtcgtttattccccccgaggagctagaggccgaggagaaaaagaaggagaagaaagagaagaagaagcggaagcgcgaggccgaggcggagcccgaggacagctccgagaagaaggaaaagaagaagaaaaagaagagcaagtcgaaggacgcctcttcggacagcgaagcatagaggcactcgtaccacaactgcctttgtgtttcatacggcgttcacattcagctcccgctatcttttttcgtctgtttgctcttcaaatataa

SEQ ID NO: 11690 - DNA, 801 bp, A.fumigatus
gttttcgcagtgacacggcccccaaccccagcgtcacaactgaccaccgtggtccaggccctgaaaatcctcgaagacggcgtcgcatgcgacatcatcaagatccgtaaccaagtccgcaacaaggagcgcttcgtgaagcgccgacagcggctcctcggtccctccggttccactctgaaagcgctggagctgctcaccagtacctacatcctggtccagggtaatacggtcgcggcgatgggtccgtacaaggggctgaaggaggtccgccgggtggtcaacgactgcatggccaacatccacccaatctaccacatcaaggagctcatgatcaagcgcgagctggccaaggaccccacgctcgccaacgaatcctgggaccggttcctgcccaacttcaagaagcgtacgttgtcgaagcgccgcgttccctacaaggttacggacaaatcgaagaaggtgtacacaccgttcccaccagcgccggaaaagagcaaggtggatctgcagatcgagtccggcgagtacttcctgtccaaggaggccaaggagcgcgcccagaaagaggaggttatggagcggcagcgccagaagcgcgaggagaagatgaaggagcgggcaaagtcgtttattccccccgaggagctagaggccgaggagaaaaagaaggagaagaaagagaagaagaagcggaagcgcgaggccgaggcggagcccgaggacagctccgagaagaaggaaaagaagaagaaaaagaagagcaagtcgaaggacgcctcttcggacagcgaagcatag

SEQ ID NO: 11691 - DNA, 222 bp, A.fumigatus
tcaacaagcccgagtcatggaggcggcatggtactgaaggagggcgagatggatattaccggaatggcaaggattcacttttactttttgtcaggagaaaatcacgacgatcatctacagatgaaggagaaacaagataacactgtccaagtggctttagttttattacaatgtgacgagtatgatgaatcaaattgcatccatgtttgcaacacttcatag

SEQ ID NO: 11692 - DNA, 1275 bp, A.fumigatus
gatttcgagcatcttgctgaccaagatgatgtcgctgatacgcaagcactgggacaggccagtgaagaacaagcaaaggccttagaccagaataagggcgtggagtcggacgtcaaacctggtgataatgatatgttaccggacgctggcgaagagccgcaagatgttgcggaggagaatagattggaggatgacatgcagatagatggagaaggagttcctaccgaagggcagaccgtaggcgcattgatacctgacagatcccgtacacaggagcgaacaacggaccctaccggtcaacttgaggctaacgaggggctggatgaggtggacgcccatcttgcggcaattcacctgtcatccacgctaccaccactaactccacgggaagaagcccagcgcctttggtcgcactacgaaaatgccacaaacaacctctctctgtctttaacggagcaactacgtctgatcctggcccccacacttgctaccaagctgcggggcgatttccggacagggaagcggctgaatatcaagcgcatcatcccatacattgcgtcacagtacaagcgtgacaagatctggatgcgccggtccattccctccaagcgcaactaccaaatcatgcttgcagtcgatgacagcaagtctatgctggagagtggcagcgggcagttagcgttcgagaccctggcgctagtcgcgaagagtttgtcgatgctcgaagtaggcgacctgtgtgtgctcgggttcggtaatgaggaccatgtccgagtcgcccacgagtttggcaaacctttctcctcggaagccggaacacaagtattccaacatttcagctaccagcagaccggcacaaacgtgcgcaaactgatcgccgattctattgccctcttccgcgaagctcgctggaaacaatcgcccgcaggaggcaacgccgacctgtggcagctggagctcatcatatccgacggtatctgcgaagatcatgataccatccgtcgccttgtgcgtcaagctcaagaggagcggatcatgatcgtgttcatcattgttgacgccgtcaagggcagttcaatcttggatctcacccaggcaagcttcgagcctgatacggagagtggaactggggagatgaagttgaagatgaagagatacctggagggattccccttcccatactacctggttgttcgtgacgttcgggagttaccggctgtgctggctacggcgttgaaacaatggtttgcagaggttgttgatgtatcatcgtga

SEQ ID NO: 11693 - DNA, 246 bp, A.fumigatus
  unsure (19),(84): Identity of nucleotide sequences at the above locations are unknown.
agtttattcaaggaatttnttgcctttgagtgggcccgttcaagtgaaaaggggccatgttggagtcgatatcgacaccatgtntttcaggcatcaaaagagtttcttcaattgggcacgtgcggaactctgtatcatgatcgcggccctatcgtcatcttccgcaacgcagttctaaattcctatcaagacaacgcccagccagtccaccccaaacatggctcttgtatcgtactcagactctga

SEQ ID NO: 11694 - DNA, 1278 bp, A.fumigatus
attcctatcaagacaacgcccagccagtccaccccaaacatggctcttgtatcgtactcagactctgaagcttcggactcagagcaagaaaccaaggtcactcaaccatcaatcaaaagtcaagctcccacacctgcgaatccacccaagtcctcctccggcgcaaacttcgtcgtcgaccgcagtaatccccgcaaaatccgcgttgctttaccggatatcaagcccgagaaccataccgcagatgatgaagacgggccggcccggaaaagggtcaaaataggcggaggcggggcattttcaggtttcaatgcccttttaccacctcctaagagagccaacgtcacggtggagaaggataagaagacggctgcgccagctcggaaggtcttcagcttgaagaccggtgcggctcctggttttgatcgcgaggctgatgaggactttcggagggaacaggtgttcgatagtttggcgggcaatggcgatggtgatgatgagatgatacccaagccaggaagtcttcggagtgagcagcctagcaacaacgatgccgcggaggctcgggtagacggggagaggaaagaggagatcaagttgaagggaaatccgatgatgttcaagccactgtcagtgggacgagcgtcgcagaagaaaaagaagcaaccgacaaaacctgtgtcgactcctttgccaaccgcgaacgagacaacagctttgcaatcatcgcaaccgcccaatgagcaaccagcacagccagccacgcctgtccctcagaagccaaaaatcagtctgttctccttgtccacagaagaaactacgacttcgaagatgccagaaccccaagcacaagccgctacttacgagccattggtgtacaccacagacctagaaaccaccccggccggcccagaaccggagcctgaacccgtgacagccccctcacagccaccgacggatcaaacattgggtaacatcgcagacgatctcaacttgtcccgggcccaacggcgacagctctttggacgcactgccgacccgtccaagtcacgaattctgcacttcaatacagacaaggaatacattgccaaccaggagctggcccaccagacagaccttgctgctgcccagcataatcctgttcgggccattgccccaggcaaacacactctgcaacagctggtcaatgcagccagcacacaacgggaggctttggaggagagttttgccgctggacgaaggaacaaaaaggaggccggatcgaagtatggatggtga

SEQ ID NO: 11695 - DNA, 222 bp, A.fumigatus
caggtgaattgccgcaagatgggcgtccacctcatccagcccctcgttagcctcaagttgaccggtagggtccgttgttcgctcctgtgtacgggatctgtcaggtatcaatgcgcctacggtctgcccttcggtaggaactccttctccatctatctgcatgtcatcctccaatctattctcctccgcaacatcttgcggctcttcgccagcgtccggtaa

SEQ ID NO: 11696 - DNA, 324 bp, A.fumigatus
aggctagttgagcggcccgtcgtcttgaactttcgtcagattttgcagaaatttaatcagatcacagccccaattacactcgtatgcgccggaaacagacgtaaggagcaaaacacagtgcggaaatcaaaaggtttttcttggggaccagctggtctttcaactgccctttttaccgggcccttgatggcggatgttctgcggtatgcgaagccactgcgtcaagccaagtacgtctgcatggagggagcagataagctggtcagtattcctcctggaattgcccatgccattctctggtccactgacttagctatagcctaa

SEQ ID NO: 11697 - DNA, 981 bp, A.fumigatus
ccacttgctgagcgttgcaccagaacgaccgtctctcccgaaatggcagcttcagatccgatgtggtggcgtgacgagcgctatgcaatttatgatctcaatgtgaattctgctgctgcgtaccctcaacacaacgaagttcttgatcttgcgacggctgggccatcctataccgccaagggttatgcatatgctggaggaggccgaagagtcactagagtcgagatctcgctgaacaaaggcaaatgtatgctatccaacctttatcatttcttaacgaagctgacctgtcttgcagcttggcgtttggcgaacattcagtatgctgaagacagataccgcgactttgatggcgagttgttcggcggcaaagtggacatgccttggcgtgaaacatgttactgctggtgtttctggtctctggatattcctgtacctgacctagaggctagtgacgccctgctagtgagaagtatggatgaagcaatgagcgtccaaccgcgcgacatgtactggtccgttctcggaatgatgaacaatccttggttccgagtgacgattacaaaacagaatggaaccttgttgttcgaacaccctactcatcctgtcatggctggcggctggatggaacgcgtcaaaaaggctggtggcgatctgactaacggcaactggggagagaggcaagaaggagagatattggcagaacccgaacctgtgaaggaaatcaacatgaagaaggaaggcttgaatcgaactattagtctcgaagagttcaaaaaaagcaacgaagagggcgcccaatggtttattgtgaagggagaagtatacgacggcaagccgttccttgaaggtcaccccggaggagcacagagcatcatctcttccatcggattggacgtgactgaggatttttctgaaatccgtgggttctccaacagctgtcttttgagaaaacgcagggctaacatcatttacagatag

SEQ ID NO: 11698 - DNA, 240 bp, A.fumigatus
cctaatggctactatggcacatcagtcaagctcaattgggccatggatccaaacaaattgatcatgcttgcgcataagatgaatggcgagcctcttcgtccggatcacggtcgtcccttgagagccgttgtacctggccaaatcggcggccgaagcgtgaagtggatcaagaaactgatcttgactgatgcacccagtgacaactggtaccacatctatgacaaccgagtattaccgtaa

SEQ ID NO: 11699 - DNA, 327 bp, A.fumigatus
gaaaacgcagggctaacatcatttacagatagcgagacggcgaaagcaatgatgcctgactatcacatcggcacaatggacgaggcgtccctcaagatgctcaaagaagctcgcaaggaagaagagcccagcaagcctcgtgcactcttcctccaaccacggtcatggacaaaagcgaaactcgcagcaaagcgggatgtttcctgggatacgcgcatcttcaccttcgaactggaacaccagaagcaaaagctgggcctaccgattggacagcatatgatgatcagagtccaggattctacaaccaaagaaaaaattattcgatca

SEQ ID NO: 11700 - DNA, 222 bp, A.fumigatus
tctagaaggtcaacaaagcaaaggatgaaaaatatcatatcagaaagtctagcctcacactcgagggtattgaccgctcgaagaaggggcccctcaagagtaagtccttaccttttgcacaagttctatggaggaccaacgtacatgaattggatcgctggcaagattttgaactcgactcaggaaggcgcgacaggcgcaggagaattcctctggagttag

SEQ ID NO: 11701 - DNA, 288 bp, A.fumigatus
gtcattttttcttcaacggcctcgccactgctcttaacacggtgtaattttcagaaaattgtctatgccaagggcacatcggatgtgatcgccaggctacgagggacctacaacgtccccacaactactgctacccaagctacaggtgcttccacagatctccagaaatcgatcttcagtggtccgcctggatccacagcactgcccccgaaacccgcggggcaggtcaacggcgaggcccaggcagctcatggaactaagcggcctcgtgaggaagaaagtgactag

SEQ ID NO: 11702 - DNA, 477 bp, A.fumigatus
tcgtctgtcaagccaaaatggtacacactcaaatcgaagcggaagccggccaagaagaaggacagcaccgtctctggagagatcctccttcagtttgcgctgatcgacccgtcgaacgcatcggcacccccgactgagatctaccaaaggttccggagcttggtctgctctagtgaggaagatgatgaccttccgccagtcccaacaaatgagtcggatgaagccgacagggacgaggagacctcggatgagactgatgacctgacgaaaccggagattgtggaaaagaggagaaaacgactccggctcgctcgcttgaaacggaaatcactagcagctcgagcgtatcagttttctggagtgggtaacggagtccagggtatcgtgttcatggagattgtgcaggtaacagatcttccgcccgaacggaacggtatgtcactcgacctccctagtttaaggcggttgctgatctaa

SEQ ID NO: 11703 - DNA, 1368 bp, A.fumigatus
ctcctggccgttacttacccggaactgaaacaggccgagcttaatgccccccaagctgttattacgtgcgagcgaaaaagcatccattctaccgcttcagcattgttcagaactctgcctcaatgtattccaatgaatccttcccaattcggtctggtgtcctccatatacacccttggcggtctgctaggtgccctgctggcagggccagtttccaccaaacatgggcgactattcgccttgcgagctacaacgattttctttattctgggcccggcagccgaaacctttgcgccaggtataccgatcttgagtgtcggtaggttgctgagtggtgttggtgcgggcgctgctattgtcgttggtccaatttatatatccgaaattgccccgcccaacgccaaaggtttcttcggcgcctttacgcagattatgaccaatgtaggtatcctatttacccagacgctcggctactttttcagcaaaggaaatcaatggagggccatacttgccgtagctgggttgctcgggggttcggaactccttggtttattcttcgtatcggaaagccccacttggctggctgagcatcaacaggcaaacctggccaggcatgtgctgcaaaggattcgcgggaaaggttcagatattgaagaggagattgaaggatggaagagctctgagaggcccacaggaccggaggaggagtcactgctcacccctccttctggcaacttgccccctaagcaacctccagttacgatcctgcaagctgtgacagatccatactaccgtccggccatcgttgctgtcatcggagtcatggtggctcaacagttcaccggcatcaacagtatcatcatgtatagtgtctcgcttctgcaaagtctccttcccacgggagcggctttactgactgtgatgatttccgccctcaacctggtcattacccttgcgtgctcacctttacccgataagattggccgaaagacctgcttgcttctgagcatctccggcatggggtgcaactccgtcttgcttgcgtttggaatctatttcaatcaaaaaattttgtccgcgatagcagctttgttatttgtggccagcttcgctgttggattaggaccggtaccttttatcttagcctctgaactagtcggtcccgaggctgtgggtgcgacgcaaagctgggcgctggcggccaactggaccgccacgttcatcgtggctcaattcttccccgtgctcaatgacgcattgggcggccgtggtaagatctactggatcttcgcggtattggcttgccttcttgggagcttcatctaccgatgggtgcctgagaccaagggcaaggctaatgccgactag

SEQ ID NO: 11704 - DNA, 1491 bp, A.fumigatus
  unsure (1320): Identity of nucleotide sequences at the above locations are unknown.
aagggttacagaaccactgtcaaaatgcaacccaaagcagttcaagatgcacatgcctcatttccggcagggaaacatgccgcggacgagacggagcatctgctgccgcatgatcccccagcggagataaatatctgggggtcgcgcagacgaccccgttcctggtgggctctcgtcgccatctcgctgctgctgttgaccatgactgtcctgtcgctggctgttttcttcacgctgggctttggcgcaggcgcggcgcctcatgtgccccacggcagactgtccagtccgatcaagaatgtcgtggttctggtgcaggagaacctgtcgttcgacaactatgccggcggcctcacatatagccccagtattgacgggcttgtgaaccgcaagtactgcaacccggccaatatctccgatccccactcgccaatggtgtgcgcacagcccacggcgaagaacatcgccccggatgatccggaccacagtatcaccggcgggaatcagcaagtgtacagcacctaccatccagactccgacttcgacgcccccaacatgcaaggcttcgtcgcggagcagatcgccgcatacggcatcgacggcaacctctcgcgcgccggcgaggtcatcaactactatacccccgagcacatccccgtcttcaacgccatggccgagaactttgtgctcttcgaccgctggttcgctgctgttcccggcccaaccaaccccaaccgcgcctatctgacgtccggcacctcccacggccacggcaccaacgacccggacttcgacaggtcggccctcccccagcgttccatcttcgagcagctctccgaacataacatcagctggatcaactactccaacacgaccggcttcctccccgacgcgctcttctaccgctggaccgccgtgtcgggtctcggcgagaccaatgtccgccccatcgaccagttctaccgcgacgccaaagcaggcaccctgccccagttcacctggatcaacccggaatgctgctcgtacatgtccttccacccgccgtcgcccatcaatatgggcgagggctggatcaagagcgtctacgaggcgctccgctcgtccccgcagtggcacgagactctcttcatcctgacctttgacgagcacggcgggttcgcggaccacgtgccgcccccggagaacgtccctgcgggcgatgatctaacctacaccgagacggcgcgggacggaaagccctccacctttgcgtttgaccggttggggatccgggtgccgacggtgctgatgtcgccgtgggtgggtaagggggtggtgcanaaccgaccagcagatgggaacggcgagttcacgcatacgtctatcctgaagtttgtggctgatctgtgggggttggagtacctgtccccgcgggtggcctggtctgcgagttttgcgcatttgattaccgatacgttttcgggaggatacgcccggcaaccttacccttga

SEQ ID NO: 11705 - DNA, 582 bp, A.fumigatus
  unsure (19): Identity of nucleotide sequences at the above locations are unknown.
tatacggcctttcggatgntcggaattgtcttttcttccatcggcgccggtatgctcaccactctcggggtccatacgtcaagcgccaaatggattggttttcaggtgctgtatggttttggcctcggcacgtgcaaccagataccaaacatggcggcgcagacagtgctcccccgcgagcaggtggccatcggcgcgtcgctcatgttctttgcgcaacagctgtttggcgccgtctttacgtcggtcggcgagaacgtgctcagcaaccagctggccaagcgtctggcgatcagttcgcaaacggtccagaataccggtgccacccagcttctggagcacgttcctgtcgacgaccgtgttgcatcgctgggggcttataatgactcgctgcaggtagttttccaggttggtctcatcatggcttgtcttgccatcctgggtgccgtacctatggaatggcgcactgtcaagaaggagcagctgtcttccacgtctgaccgcaacgatggacaggcggaggagggcgccccgggcaatgcccagtcaacgatggactacaagcaggggacggtgaattga

SEQ ID NO: 11706 - DNA, 363 bp, A.fumigatus
accgcaagtactgcaacccggccaatatctccgatccccactcgccaatggtgtgcgcacagcccacggcgaagaacatcgccccggatgatccggaccacagtatcaccggcgggaatcagcaagtgtacagcacctaccatccagactccgacttcgacgcccccaacatgcaaggcttcgtcgcggagcagatcgccgcatacggcatcgacggcaacctctcgcgcgccggcgaggtcatcaactactatacccccgagcacatccccgtcttcaacgccatggccgagaactttgtgctcttcgaccgctggttcgctgctgttcccggcccaaccaaccccaaccgcgcctatctga

SEQ ID NO: 11707 - DNA, 417 bp, A.fumigatus
  unsure (36): Identity of nucleotide sequences at the above locations are unknown.
tctcccgcatcgggtaatatacggcctttcggatgntcggaattgtcttttcttccatcggcgccggtatgctcaccactctcggggtccatacgtcaagcgccaaatggattggttttcaggtgctgtatggttttggcctcggcacgtgcaaccagataccaaacatggcggcgcagacagtgctcccccgcgagcaggtggccatcggcgcgtcgctcatgttctttgcgcaacagctgtttggcgccgtctttacgtcggtcggcgagaacgtgctcagcaaccagctggccaagcgtctggcgatcagttcgcaaacggtccagaataccggtgccacccagcttctggagcacgttcctgtcgacgaccgtgttgcatcgctgggggcttataatgactcgctgcaggtag

SEQ ID NO: 11708 - DNA, 957 bp, A.fumigatus
cacattgctctcctcgctatccataccaggggaacacacaattctcctacgtgccatgtcgcggccccgtctgtccgctgccaagctgtcagtccgcgcgaacagcttcgaaatggtgtccgtttcttcgacatccgtgtgcagccccagttcccagaggacccatccaaagatgagcttatcctagtgcacagcgtgttccccatctccttgacgggcaacaagtactttcgcgatctgatgcgagacgttaatgagttcctcaatgagaatccatccgagacgctcatcatctctctgaagcgagaaggcccaggaaaccataccgatgaacaattgagtcggattgtgcgcgaccattatgctcgtccagatagccggtggtacacagaacccaaaatccctactctgggcgaggtgcgcgggaaagtcgtcctgcttcgccggttcaacatcattgaagagctaaagcatgaacacgacggccgcggctggggcatagacggaagcgattgggcagataatactccaaacgctacctgcagcagtggtcaactctgcatccaggacttctacgaggtcctcgagacgaagaacatcgatgtcaaaatcaaatatgtaacggagcactgtgagcgctccagcgggcactgttacccgttcggtgccctcccggatcccgaagctagcaaagcgcatccattctatataaatttcctcagtgcaagcaacttctggaaggtggggacgtggcccgagaagattgcagcaaagctgaacccggcaactgttgactatctctgccggagacacagtcacctggacggtgactggtcgactggtattcttgttacggactgggttggccacgaaggcgactgggaccttgtgcgttgcattgttggcatgaatgctaagctgaagatgagacagatgagagaggagcaggaacactaa

SEQ ID NO: 11709 - DNA, 231 bp, A.fumigatus
gacgcactaaacaccgccgtggcatacttggtcgctgcaatcccactcttacacggactctctgccagcgccgccttctgctgcaacgccatcgcctcatccaccttcccagccctgtacagctcatacaccctcgacgccgtccgcggaaacacattcgcaaacgccgcaatgcagccagccgacccgacactcaaccccgcgagcaggaaatccgactgccccccataa

SEQ ID NO: 11710 - DNA, 279 bp, A.fumigatus
  unsure (21),(37),(44): Identity of nucleotide sequences at the above locations are unknown.
cggagggcatgcgaaaatctncgctccctgcgcgatnacagatncgggattcgggacccaattcgcgaagctcagaacgggggcagtggggttgttatatatttccggaaggaaggccgtgctctgggtgaagtggtcaagtaccttgtgtacaatgctcgcaagcggggtggtgacacggccgacaaatatttcactcggacagagaacatcgctggtgtgcgagatgtgagatacaccgttcagaatgatccggagttcgtactaatgatcgtatag

SEQ ID NO: 11711 - DNA, 378 bp, A.fumigatus
atgcgcttccaagccctcatgcccgacatccttcattggcttgggatcaagaagatcgaccgcatgttgtccatgtcgaacatgaagcacgacgccatcgtccagtcaggaatcaagatcctcaagcgcgtgccaattccggaggagttgatacctagcgattcgcgcgttgagattgatgcaaagatcaatgccggctacttcacaaccggtaaacagtatacaatggaagaactggcctcggtaaggggacgcggctgggagaaatgggaggatgtcacggtaagtagagctctttctgtggacgaagcctcactaactctgtcaagcattaacctgctatatattcgtctattcacaagctcaaccttgtcttga

SEQ ID NO: 11712 - DNA, 1119 bp, A.fumigatus
agctataccgagtataaaacccctgctctgccactttctgccactcctctgacactacagactatatctctcacactgagcttccctgaatctacgctccaacaggcaaactgcaactctaccatgggctcctcacaacccccgacagtctcaccccaaccccacgtccccaaaccaggcgtctggtgtcccgccgtaaccttcttcgaccacaccactgacaccctcgacctcgactcccaaaagaaatactacgcctacctctccaaaaccggcctcgccggcctcgtcatcctcggcacaaactccgaagccttcctcctcacccgcgaagagcgcgcccagctcatcgccgccgcccgcgaggccgtcggcccagactaccccctcatggccggcgtcggcgcccactccaccaagcagacgctggagctagcagccgatgcggcggccgcaggcgcaaactacctcctcgtgctcccgcccgcatacttcggcaaggcgacgaccatgagcgtcgtgaagcggtttttcgcggacgtagcggcgcgggctccgttgccggttatcatctacaatttccccggcgtgtgcaatggagtcgacattgactctgagacgatgacggcgatcgtgcgcgagtccgcggccgcgagcccgagcggcgtatcgaacgtggtcggggtcaagctcacctgtgcatcggtggggaagatcacacggctggcggcgacgttctcgcaggacgagtttgcggtttatggggggcagtcggatttcctgctcgcggggttgagtgtcgggtcggctggctgcattgcggcgtttgcgaatgtgtttccgcggacggcgtcgagggtgtatgagctgtacagggctgggaaggtggatgaggcgatggcgttgcagcagaaggcggcgctggcagagagtccgtgtaagagtgggattgcagcgaccaagtatgccacggcggtgtttagtgcgtctcaggcagggattgaggcggcaggggagaagctccggcctcggacgccgtatgaggagccgggtgaaggggtgaagcagttggtgcgggaggtgatggcggaggtggcggagattgagagaagtatatag

SEQ ID NO: 11713 - DNA, 258 bp, A.fumigatus
tacgtcgcagacaatccttccgagattgttgcaggtaatcagcactggggccacgcaaccagcaaggatttgtaccagtggaccaaccaccccattgccatcgcccctagccagccgggcgagtggatctattccggctcggctgtgatggacagcaacaacacctcgggattcttccccgaccaggacgacggtgtagtcgctatctacactctggctactgagatggtgctaacgccgggcagagtagtgcgtacg

SEQ ID NO: 11714 - DNA, 369 bp, A.fumigatus
ttgatcctgcctagcttgttgaccgtggggactggagtaccccgtctgggggtctttgcagctgtactaaccatccggagttcagacccctgctgggggacggtgggatataaatacccctccatcctcctcatacatccagggtggaatgtcaagcatcgttctttcaatcagacaatcaaaatgcgtgcttctttcattctcttctctgctgcagtggcagcggcccaaacagccaaatattccgggcctgtgcggcctcaggttcacttctcccctccttctcagttcatgaatgaccccaatgggcttttctatgatcacaagagggaggtttatcacctgtattaccaatgtgagcttaattga

SEQ ID NO: 11715 - DNA, 483 bp, A.fumigatus
ttaaggtcacaaacgtcttcgactccaaacggagtagtggccgcgttcaaaccggttctcattgaaggaaccatgctgcgagcgctgtcccatgattcactgcaccgtctccgagaagaacagcctcctaagttgacctattgcgaagatgagtctgatgacgagtctgatggctatgggtcgaagtcgaaaaaaagcaaagcaagcgaaccatcaaggggacaagccatcggaccccggctgggtgaggcccccaaaccgaatcatgtgtacctccagtgggaggcccgagtggttgatgcgtacatcaaggtcgaccagggcgacaaacacaccggatatctcgactttgacgcttcaaaggcaaccgctcacggagaatgggcctacccggcgatgtggagtaaagaaagcaagcttgcttcctcgatctataaccgtggagatcaacctcgagagaacccgacgacttggaattactga

SEQ ID NO: 11716 - DNA, 402 bp, A.fumigatus
gtcaacttaggaggctgttcttctcggagacggtgcagtgaatcatgggacagcgctcgcagcatggttccttcaatgagaaccggtttgaacgcggccactactccgtttggagtcgaagacgtttgtgaccttaatcaagttgcactcgataaaagacgagaggtttatgattctgctaatgccaagggtgatgttctctctggtctgcagggcgccgagactgtctgtggtattaccacttctcagagcaccaatgagaccctggaagattccaagggcatgaagatcaggagctacaaggaacccctgggagttgtcgctgccgtcttccctttcagtgtgttacccgatatgcattcttctatggtcggcactgatgagcgtagatctccgccatga

SEQ ID NO: 11717 - DNA, 348 bp, A.fumigatus
tactcgccgagttggccaaggaagccggctttcctcccggcgttattagtatcatccacggatattccaaggccgtcaacctcatcctggatagcccctcacgagctcacggccatgatcagctttcttggaggttatcgtgctggagagtacgtctacactcatgggtgcgccactggcaagcgtgtacaggccaaccttggtgtcatgaaccacgctgccgtgcttttcaacgcaaacagactatcaatgccttatgtggagcttcttgcagcgtctgcacgccagctttgcatggctctcggcacagtggtcatgattggcgtgagcgataagtggctgccttag

SEQ ID NO: 11718 - DNA, 366 bp, A.fumigatus
aaccctcgagcgtgtcccggcgcaaccatgatactcgccgagttggccaaggaagccggctttcctcccggcgttattagtatcatccacggatattccaaggccgtcaacctcatcctggatagcccctcacgagctcacggccatgatcagctttcttggaggttatcgtgctggagagtacgtctacactcatgggtgcgccactggcaagcgtgtacaggccaaccttggtgtcatgaaccacgctgccgtgcttttcaacgcaaacagactatcaatgccttatgtggagcttcttgcagcgtctgcacgccagctttgcatggctctcggcacagtggtcatgattggcgtgagcgataa

SEQ ID NO: 11719 - DNA, 411 bp, A.fumigatus
gggctaattggtttgatagcctttacgaatcagaatatctccagcgcaagcggcaatggggattgcccaaattccgacggcgattataggctcactctcgtggactcgaacgggttcgtcaacgccaatggatcgagtaatctgaagaatatggttctgggcgctacgccgattgtcacggtcttctatccagagtcgaatttgtctcagccggacatccaatacgtagctgtgaagccagaggacacgagtggcttgttaggacaagtcagcggctcgttggcatccggttttactgcacccaccgtgtttgccttggggactctggtcattacccttgctttcttttccggaatatttggatttagccctcgacacatggaaaggctgtcagaggtcattcaggattga

SEQ ID NO: 11720 - DNA, 189 bp, A.fumigatus
agtttattgatattggccaccccctgctcattgataccacagaacattatttgcacccccgatcagacctcttttgtatccatgtcacagccatgggattacatcgctaagctcgtctgtattggagactccggcactggaaagtctagtgtgagtgtgtcacactcatttacccggttattatattga

SEQ ID NO: 11721 - DNA, 663 bp, A.fumigatus
aactgtgctgacctgcgtgttgttgtaaagttgactattcgactctgtgaaggacgcttctcctccagtcatgatgttactattggcgtggaattcggatcgcgtattgttccagttgggcctccagcatcaaagagtctgggggtagattccgatgtttctgactcttctgctctaacactttcaacggcgagagcaatggttgcatcccacgagtctgttgcctcgggcctccccagccctccacgaaaaccgctaggagatcgatcacagaaaaaaatgaagctctccctttgggacactgcgggccaagagacttacaagtcgataacgcgctcatattttcgcggtgcctcaggggccctcctcgtttttgacatcactcgtccctctacattcacctcttgcacccaatggttgcaagatcttcggcaaattgcagaagatggtattgttgtaattttggttggaaataagagcgatctcgcggaagtgaaatccgacgtgaatcagaggcgtgtcaccagacaagaagcagaggagtggtgccgcatgaacaatgttgttcgctacgttgaaaccagtgcaaagtccggtgaaagcgtcgaacgcgctttcctcgaagttgctgagaggatttatcgcaatatcgaggcaggatag

SEQ ID NO: 11722 - DNA, 1452 bp, A.fumigatus
agagctaccccgctatcctttgcatcattcctgctggtctctgtttgcctgactcacatcggtaacatagacgcctcgcgcttccttgctcagtcacagtcacgactgggccctcctatcgatgatgcacggcataatggcagtgatcgtctcaatgcacgatctgggattcctcgcctttcttcatcgcgagcatttttccgaatgacactagatccttaccaccaagccacatcccaggtctctaatcttcctttcggttcacgaaatgcccctcagcacgcgcctctgttcttcagcgccacggatgatttccgtgacgaggatgatgaagcagagcgggagcgcgagattgcggacttctacgccttgcaaaggtcacgacggcattttggcagcagccagctcaaagaatcttcggaaattggaggggatggcgacagttcgatcagccttgagcagcagcttctccaggatgacagatacgtcaagcgcgggaggatcagaagctcttggcgtgcgagaagtaagtctatggacagggaaagcgggcgtgcatttgagtcaattgcgatgacggccgatgaccatggaggtcccgatgaagtccgacgaagtcgtagtctcaaagagaatttggtcaatgttcgccttgaagatacattgagatcagacgaagatgttgacaaggccggctcagttgagggtcttgatgatagtcctccatccgtccagctgttccgggaacaagcaagctcagagccaaggattcttggtatcgagacgttcctcgggccgagcgaggtagataagcaacaacttttcgatgaccatgaaccatcaagcatagcggactatggtcttgagccttattcagtaggggagacgcaatctggcgcccatgacactttctgggggaagctctttttgatatctcttggctgcctacttgctacctcatttctcatttatttgcacacatctgcgccttccggtgacaaatcgagatggggcgacaccatatatcacactgttcatggatccttctatctcctcggcatctatacggtagtctcggtatttatatcacttctttggctggcgtcgctgcggtattacgtgcgccctttggtctatgcaatgatctttgcagttcctgttatcctatatgctttctcgctttaccccttcatctcgagtttcaaaggaatctggcatgggactagcattcaggacaaagccatgagggtcgtctctctcctaccgttcattgtctcaagtttttggatatataatgttgtccggagccgccacgcaattgccaaagccatcgacatccttgagttcgcctgccgaattctcgctgcgaacctggaattattacttcttggccttggcattctgatttgtattgtctcctggacgtgggtctggatgctgatgttcgtcttc

SEQ ID NO: 11723 - DNA, 369 bp, A.fumigatus
  unsure (24): Identity of nucleotide sequences at the above locations are unknown.
gctggttccccctgtagccccaanacctttcacaccacttcgacgatcgttcaggtcgtactatcctgcctcgatattgcgataaatcctctcagcaacttcgaggaaagcgcgttcgacgctttcaccggactttgcactggtttcaacgtagcgaacaacattgttcatgcggcaccactcctctgcttcttgtctggtgacacgcctctgattcacgtcggatttcacttccgcgagatcgctcttatttccaaccaaaattacaacaataccatcttctgcaatttgccgaagatcttgcaaccattgggtgcaagaggtgaatgtagagggacgagtgatgtcaaaaacgaggagggcccctga

SEQ ID NO: 11724 - DNA, 231 bp, A.fumigatus
tgctggaggcccaactggaacaatacgcgatccgaattccacgccaatagtaacatcatgactggaggagaagcgtccttcacagagtcgaatagtcaactttacaacaacacgcaggtcagcacagttctatctgaggttcaatataataaccgggtaaatgagtgtgacacactcacactagactttccagtgccggagtctccaatacagacgagcttagcgatgtaa

SEQ ID NO: 11725 - DNA, 1317 bp, A.fumigatus
gattgctgcttatcgatccttcaagcattgtgtcgattacggaggtgcaactcaggcaatatgatattacctatatcatcattcctatatctctgtgttctatttatacaatctggggccattgcgctggcgcaagtacctcaggacgtcctttccccgaagcgaccatttccacaggagtcaacggtgcctgggatatcatctgaagaatggcctttgacgcccccaggtctgattggagagacagaagactccattcgaagcacgctgagggatctggtggatgccttgaaggtaatgcaagaggagtattttgagttgtggcaaggcaaatggccgactgcgattgactggacggctgctgtcctggggactcatgtctccgctaccctctcgtcgctcacctctaccgtgggcgatgttctgctctcaagtctttccgcagacaccgaaaacgccgagggagaatgccagtccgccattcatcgctcattggcgttcgagaactttatcaaccacttcttcggccaatccgtttcgttctactacggtgaagatgcgatttctctgagagggcaagcttatgacgacatgctttgggttgtactggaatggctggagaacatcaagtttcaggttctacactccgagttgcattacgatcggtcgaacgcaagcacagagcatcgctggcatggagttcagtttcagattccagcggctcatcgagcgcgactcttctacgagcttgcgtccagtggatgggaccgttcgctctgtgggggcgggatgatctggagtccgtatctcggtccctacaagaacgcaatcacgaacgagctctacatatccgccagcattggcatgtatctttaccatcctggagacgtaatcaattctccctttgcttcgccgtcaagaactagcgaagttgcgtcagatggatatcctcacaatcctgcccatttgcaagctgccattgagggttatgaatggctcaagtcatcgaatatgataggcattgggggcttgtatgctgacgggtttcacattagcggctggcggagcgtaacacaacctggtacgcgcagatgtgatgttctcaaccccatggtatacacgtacaatcagggagtcattctgagcggacttaggggtctctggcttgcaaccgcatcacaggattacctgcaagacgggcacgatctggttcggaaggtcatccgtgctaccgggtggcccaacaaggacgccagggagtgggctggccttggtcgcggtcttcaccacggcgccggaagatccgagcaagcgtta

SEQ ID NO: 11726 - DNA, 234 bp, A.fumigatus
ttgactgagctcccaccactgaccgtgagattgctgcttatcgatccttcaagcattgtgtcgattacggaggtgcaactcaggcaatatgatattacctatatcatcattcctatatctctgtgttctatttatacaatctggggccattgcgctggcgcaagtacctcaggacgtcctttccccgaagcgaccatttccacaggagtcaacggtgcctgggatatcatctga

SEQ ID NO: 11727 - DNA, 201 bp, A.fumigatus
aatcagtctaccaatcagagactttgtttggcgagagttcgtcatgtcatgattatgagcttcaggggttcgtgcttctattcctcggattggactagcgtattacgattgtacttgtatttgttagttcccctgtattgtattctaaagacggatggtaatgtcatgccgcccacatacctaggtacctacgactcctga

SEQ ID NO: 11728 - DNA, 429 bp, A.fumigatus
gcaggtctttgcttaatagcctgtcgttccttcctaacttacttgattcccctcgcagactcaatcctctggcctatcctccactaccagtctggggttgtctacgacgatggtccatggcaggcctatcggcgtgtcaatgagctgtttgcagatgctgtagctgaggcagctacaagggggagcttgatttgggttcatgactatcatctcatgctcctcccgaagcttctgcgtcagcgactcaacaaagaaaaaccatgcgctattgggttctccttacatacgccatttccagcgggagatttctggagagcgctacctgttcgaaatgatctgctcgagggaatgttggccagtgacctgattggattccacacggacgagtacaagtcgaactttatccagacttgtgctcaggttttgtaa

SEQ ID NO: 11729 - DNA, 798 bp, A.fumigatus
atggacagaggcgctcgaacagagatacccggtcgaatccagtacaaggatcgattagtcgagacagataagttcattgtcggaatcgatccgcaaaagttcaaggatacgttgcagaagcaagaggtgcaggatcggatcaagcagctggaggagaaatacaaggggattacggtcatcattggggtagaccgactggactacatcaagggccttacgcagaagctgaagggatacgaccacttcctggatcgtcacccagagttgaggaacaaagttatcttgatacaggttgctgtcccaagtcgcgaggatgtcaaggaataccaggagttggagacagagttaagtacaattgcagggaagattaatggaaaacattgtatgtgcatgtcctattctatttgcgggcgagttattacacagatactgaactatgagctcctgacagccactcctgacggagttccgctcctctacatgcatcgctctgttcccttcaccgagctaacggcgttatactcgattgctgatgcttgccttcttacatctactcgcgatgggatgaacctcgtgtcgtttgaatacattgcctgtcaggaacaacggcatggcgtcctggtgctctctgaatttgcgggagcagcttccttcatgaaagagggaagtatcagtttccaccccgcaaacacaacggaactggcagatgctgtctataaagctgtgatgatgggcgaggacgagaagaagaagaaatacgagtacctgcggaacttcatcgagactaatacaaggtga

SEQ ID NO: 11730 - DNA, 195 bp, A.fumigatus
aaaatggcgcccgacagttcgcaagtgaagcgcaacctcattattgtttcgaatcgccttcctgtctcggtcaaacggaccgatggctcatataagtctagtctgtctagcggtggtctggtcacatcgctatctgggttgacaaaatccactgaattccgctggttcggttggcctggtctagatgtcctctga

SEQ ID NO: 11731 - DNA, 1011 bp, A.fumigatus
cacagagaagctccaactggagatcttcgcccattccaagcagctcgagaaggtgggatttccccaggtgaagttcagcgtcgaggacaggccaggcatgcagggccgcggcgtgattgctcggatcagactgtcacagggccagagcatgaccttcatcatccacagccccgagaagatcctgcccagcgacgccatgatggaatcctacctggacaaaatggaagaggagacgttcgactactggaccgggtggacccgccagtgcaccttccgcgggcactaccgggaaatcgtggagaggagcctgctcattctgaagttattgacgtacaagcctacgggcgccatcgtggcggcgcccacattttccttgccggagaacgtgggcggcagccgcaactgggactaccggtactcctgggtccgggacacggcgttcaccctctacgtcttcctcaagatgggctacagcgaggaggcggaggcgtacgtgaacttcatcttcgaccggatcttcccgcacgcgcagcaggaggccgggccgggctcgaaacgtcccttcctgccgctcatgttcaccatccgcggcgagtacgagatccccgaggtggagctgagccatctggaagggtacaagtgcagcaagcccgtgcgcatcggcaacgcggccgtcttccacacacagctggacatctacggcgaactgctggacagcatctacctgtacgacaagcacggcaacccaatcacctacgaccagtggctcgcgatccggcgcatggtcaactacgtggccgaggtgcgccacgaaaaggacatgtcgatctgggagtcccgcggccagatccagaacttcctctactccaagatcatgctctgggtggcgctggaccgcggcgtgcgcctctgcgagaagcgctccagcctcccctgcccggaccgcctcagatggatccacgtccgcgacgagctctacgacgagatcatggagcgcggctacaactttga

SEQ ID NO: 11732 - DNA, 258 bp, A.fumigatus
tcagctactaagaagaggggaccaaaccaggccgccaaatacaacgtgcccatccccaacctctggaaactcgccctcgcgcacttcgacaatatcctctcctactcgaaccacctgggcatgttctccgaggaggtcgcaatctccggcgagcagatggggaataccccgcaggcgttcagccatttggcgtgtgtcagtgcggcgctcaatctcgagaggctgggtcgggatcaagatgagccgaattcttcatag

SEQ ID NO: 11733 - DNA, 1566 bp, A.fumigatus
aaccccgatggcccaacgaggaagggcgtggtgactttggtgggaaaattcccccgggtccccccaaaaagcccggccagttcaggcaggatcttgtccggggattggtccctgcaacgagcccggggtcacccggttcaagtccggggttcggccatccggcgtggtcagaaagctgacttgcagcgggggagatatgccctggcaagtgaagtcttccctgcgttcaattacgccgggatcccccacgccacccggtgcaagctcagcaacgatctgagcaagcatcaactccagacggtccacttcgagagtgacacagagaagctccaactggagatcttcgcccattccaagcagctcgagaaggtgggatttccccaggtgaagttcagcgtcgaggacaggccaggcatgcagggccgcggcgtgattgctcggatcagactgtcacagggccagagcatgaccttcatcatccacagccccgagaagatcctgcccagcgacgccatgatggaatcctacctggacaaaatggaagaggagacgttcgactactggaccgggtggacccgccagtgcaccttccgcgggcactaccgggaaatcgtggagaggagcctgctcattctgaagttattgacgtacaagcctacgggcgccatcgtggcggcgcccacattttccttgccggagaacgtgggcggcagccgcaactgggactaccggtactcctgggtccgggacacggcgttcaccctctacgtcttcctcaagatgggctacagcgaggaggcggaggcgtacgtgaacttcatcttcgaccggatcttcccgcacgcgcagcaggaggccgggccgggctcgaaacgtcccttcctgccgctcatgttcaccatccgcggcgagtacgagatccccgaggtggagctgagccatctggaagggtacaagtgcagcaagcccgtgcgcatcggcaacgcggccgtcttccacacacagctggacatctacggcgaactgctggacagcatctacctgtacgacaagcacggcaacccaatcacctacgaccagtggctcgcgatccggcgcatggtcaactacgtggccgaggtgcgccacgaaaaggacatgtcgatctgggagtcccgcggccagatccagaacttcctctactccaagatcatgctctgggtggcgctggaccgcggcgtgcgcctctgcgagaagcgctccagcctcccctgcccggaccgcctcagatggatccacgtccgcgacgagctctacgacgagatcatggagcgcggctacaactttgaccgcggccacttcacccagagctacgagagccgcgacgtcctcgacgccgccgtcatgatcgccccgctcgtcttcttctgcgcgcccaacgaccctcgcttcatcagcaccctgcagaaaatcctccagaatcccaacgagcagggcctctccagcgcaaagatggtctttcgctacgaccacgagaaagctcgcgacggtaacccttccaattcctccgccctctctcatccttaa

SEQ ID NO: 11734 - DNA, 450 bp, A.fumigatus
gccatctggaagggtacaagtgcagcaagcccgtgcgcatcggcaacgcggccgtcttccacacacagctggacatctacggcgaactgctggacagcatctacctgtacgacaagcacggcaacccaatcacctacgaccagtggctcgcgatccggcgcatggtcaactacgtggccgaggtgcgccacgaaaaggacatgtcgatctgggagtcccgcggccagatccagaacttcctctactccaagatcatgctctgggtggcgctggaccgcggcgtgcgcctctgcgagaagcgctccagcctcccctgcccggaccgcctcagatggatccacgtccgcgacgagctctacgacgagatcatggagcgcggctacaactttgaccgcggccacttcacccagagctacgagagccgcgacgtcctcgacgccgccgtcatga

SEQ ID NO: 11735 - DNA, 354 bp, A.fumigatus
ggaccgtttgattctgaaaaaccgttcaacaaagcaattatcgatgcatatcaatcgaaggcaccgaaacggcaaattaagaactccctggcgggcatgctttcccatgaaaagcaccggatcgtgttcacgcatggggacctacgccttcagaacatcatggtcacggatggatacgtcagtggaattttggactgggagtttagcggctggtatcctgagtactgggagttctcaaaagccctctatgtttggaaatggcaaaacgattggatcgaaaatctggtgcaggttcttgaaccgtattatcctgaatacgcagtccattccttcttgaccgagacactatggtaa

SEQ ID NO: 11736 - DNA, 405 bp, A.fumigatus
gcgtctgccacgattccttgtcgtgaagctcaagctctccgccagggtttcggatctcttgtccttcagcaactcgacgaaagaatggctgactttggcccacgtgctcctcatgggcccgatatgacgggaactcatgaccctttggaggacatggatgttcatgagaagggcgccttcgatgctctcattcgtccggatgacagttacactccggatggtgtctactgggcagatcttcccctggtgaagaagatcaagttcgttggctcctacgatgccaaggaggccaagcgtgagctcaagggcatctgggatatgaccaagaaggaccctctgtcacctgtggcttactatttccggaacatggtgcttcctggcgctggtcttggtctggaagggtaa

SEQ ID NO: 11737 - DNA, 222 bp, A.fumigatus
atctgcggggaacggtcagatgctaacttcccggtgtcttctccgattagttatgtgcttttttcgatcggaaacgtcaagccactcttccaagccgccttcaagtcgtgttggaaggaccacaagatttgcaaccctcagtggatcaacgccgttgaatacctggagattgtcggtattattgttggtcagattctcgtcggagttcttggtgactggtag

SEQ ID NO: 11738 - DNA, 669 bp, A.fumigatus
cttgcaacaataggcggcgagtacccgatgacggccactagcggcatggaaaatgccgttggttctggaaaagtttccaccaaggaggatcgtctgcatcgtggtcgcaaggtcaccagtgctttcttgatgcagggttggggtcagttcttcaaccaggtcatcctcattatcttgctactctgcttccatcatggaagtggcaatcctccctattctagcgtcgccgcacagtggacttatcgtatttctttcgctatccctgctgttggcacactgtggctcgtctactatcgtacctaccacatgaaggcggctagcaagcagctcgcggccgctaagaagaaggcctccgttaccggctatgatgtaacgtctctgaagctggccttcactcactttggcttccgtatcgtggctaccgctggtggatggttcgccaacgatgtctttttctacggtaacaagctcttccagagtgaattcatcaaggtgatcagccccgagactacatcgattatgcccacctggctctggaatctggtcaacgtcggcgtgtcgctagctggttactatcttgcctccttccttatcgacaacaagctctacgggcgtaagtggatgtcttccccacggggccggaaagagccgcgcaatgcgttagggcgg

SEQ ID NO: 11739 - DNA, 318 bp, A.fumigatus
tcagctctatacccaagcacatgcaaagacctcctacagccttggcaatctccatattgcattgctttttcgatagatctctacgggtcgaaaaacaatgacattacctacctggagcttgggtgctccgaaaactccctggatgcaaatgcccctttcagccagccaaaagcgagttacgttcctgccatcagatgtggaagcatttcctcaaggagatggcctaactcccgttcagaggcgcttttcgggaacggcatctggtgtctagcctaccctgatattcccaaccactggtgtcaccctggtagatcttga

SEQ ID NO: 11740 - DNA, 339 bp, A.fumigatus
ctacagcaggatgtcttcgacggctacatgcatcgcgcaaagtattacggctatgatcgcaaagacactgtgttcgtcagccagtactcactcttgaatgggttgacctataccattcgaaagctcggcgggggggaagagtctccctgcaaggtcttccttgaagccgatgatctccggaccctcgttgacgcgaagtgcaagatgcgatatgcgatcggcgctattcctggtgggggggtggaactgcttaaactgcggtttccaggctacggagaatatactgaagacagaatggatcgaggtgaccttgatcttcgcattgtgtacaagggttga

SEQ ID NO: 11741 - DNA, 300 bp, A.fumigatus
cgcaaacataaaatgaaactcccttttgtgctcttcacagccttgtacgccagttgcgctctcgctgcggctcttccccctgatcatgtcgatgccgacaaggccatcctgctcctcgctgatgggactaccaaaaccatcgagaaaacggatctcgcctctcacctcaatggcaccttgctcgaggctcccaccgacaacttcccgcggtccatcaaatccgtcaacttcaacagcttggaggcgcggggagggcgtcttcacccggggcggaagagccgcgcaatttccattaacccg

SEQ ID NO: 11742 - DNA, 255 bp, A.fumigatus
ctgctggaaactgatactcaaaagcaacgaaccaccaaggttactacctacttcggagatcagaatccccttatcattgcttatcgagtatcggaattcaatattttcaatccctttcaaggcgcgtcgttatcgctatcacagaatctccggattgagatcctgattctgccttatcccccgcgaaaaaagccggagaacaagtcggtgggtcaaaaaactttaacctcaggtttaattgctccagtactttga

SEQ ID NO: 11743 - DNA, 3102 bp, A.fumigatus
aagatcgaagtcgatgcctccgcgctccagagctcgaaggaactgggaaaacggaaaagagaggacgagaatattgtgcccacaaccaccacaaaggatgttagtacgtcgcataatcagaattcggattcggaattgtcaggcgacgagacagacgactcctttgtcgattcaaaagggactactaagcgaaagctcgccgagactgctcctgcaccaccgattcccgccccagtcattggtggcggcctcaaacgtcctctggaactcggtccggacggcttcccagttctaaagaagcggaaaagagcgcccaaggccaaaccggcggccgtatccgtaccggaagttccatgggaaggattcaattccgatgataaaaatgatagtgctggtagcagcgatgaagagcctgaagactcggaaatcgatgccgaaacaaaaaatgtgcaggatggagaaaaagacgcatcttccgacaatgatgaaagcgatgaagaggatagtggcagtgataatgaggaggaggatgaagaagacgaagacgatgaggagggggtggtggatgatgaggaagctgagtcgttagcacaactccgaatcaagcctcgccagtccgcgttcaaagagtgggcaagacaacaaatcaatgaggttgtcggctttaaaccttctggtcccattacagcagaggagcagccgttcgttcgtgaatccaagcggcccgtcaggaacaccgtcgctgaagaggagccgcttcccctagagttgcaagtcaccaaaggcgatccaaaccgcaaggcattcagtgtgcaagttgaccgttcggaagaggttcaaaattcacgcttaggtctgcctgtggtcggtgaagaacagaagataatggaagctatccacaacaattcatccatcgtcatctggggtgctactggtagcggaaagaccacgcaacttcctcagttcctgttcgaggccggttatggacaccccgatagtcccaacccgggtatgattgcagtgacacaaccccgccgagttgctgctgtcagtatggccaagcgtgtggccgatgagctgggacagtatttcgaccgggtcgcttaccagattcgattcgaaagcaacgtctccagcaaaaccgcgatcaagttcatgaccgacggtatccttatccgcgagattgccgaagacttcgctttgaagaaatattctgttatcgtcatcgacgaggcccacgagcggagcgtcaacactgatatcctgattggaatggttagccgtatcattgacctgcggaaagccatgagcgaagaggatccctccatcaaacccctcaagcttgtagtcatgtctgccactctgaggatctctgatttcactcagaatccaagtctcttccgtcaaggcccgccgccgttcgtacaagcagaaggccgtcagtaccctgtgaccgtacacttcgcacgacggacacatcgagactatgttgaagaagcctacagaaaggtctgcaggggccaccgcaagctacctcccggaggcatgctcgtgttcctcactgggcagaacgagatcaggcatctggctaagcggttgaagcagaccttcaagcccactcaacggggagaagctacccaggcaaaagtacaactctccgcaaatgatgcaccactcgaagcggaggatctggacctaggaggtgcagatttgtctcatcttggcaacgaggatgatgaaagtgacctcgaaatcaccggcttggatgagaatcccgaggaagacgaagagttcaacctcggggaagaggcgatggattcctcaactcgagtgcatgtcttgcctctctactctcagctgcccacaaaggaacaactgaaggttttcgagccgccaccggagggttcccgtcttatcgttctggcgaccaacgttgccgagaccagtcttacaattcccggcatcaagtatgtctttgattgtgggcgagccaaagaaaaacagtacgatctagagaccggggtgcaaaaattccaaatcggttggatcagcaaggctagtgcaaaccagagagctggtcgagcaggtcgaaccggaccaggtcactgctaccgactctattcgtccgcgatttacgaaggcgagttcgcagaatacaccgatcctgaaatcttaagaacacccattgaaggcgtcgtacttcagatgaagagcatgggcctacataacgtgatcaatttccccttccctacacctcctagtcggcaaggactggccaaggccgagaagttgctgaagaaccttggagcactctccgcgaacggtaagattactcagatcggccatcgcctgtcgacatatccgctatcaccgcggttcagcaaaatgcttcatattggccaccagcacggctgtatgccctacgtgattgcgcttgtctccgcactggccgtgggagacttgttcatccctgaaaaccagatcgatccagctacgtcaaaggaagaggacaagagtgatggggtttataagaactccgatcgtttagaggacacggctcgagaacagcgccacaaggactacacgagagcacagcggcttttcagcaagcacgatgatacttctgacgctatgaagtatctgtcggcgatctgcgcctatgcttatgcttcgaatggggactcattctgcgaccagatgttcctgcgggcaaaggcattcaaggaggccacgcagcttcggcaacagttgaccgatattgtgcgcgcaaacaaccctggtctgattggagcgtacgaaccccgtctgcctgagcccaccgataaacagattaaagcgctgaagcagattgtgactgctggattcatcgacaatgttgcaatccgcgccgatctggcacctgttccgcccgagatggaccgcacgccaaagagagccatcgatgtcccgtacctgacgctcttcaggtctcgagaaggacgagcaacagagctgcgggagaaagccgtctacgtgcacccgtcgtctgttcttgcccgcctttcgccaaaggaaatgccgcaatacctggtctactctcatctccaacagtcagcaccttcg

SEQ ID NO: 11744 - DNA, 624 bp, A.fumigatus
cttgcggtggcccctgcagacctttctgtaggcttcttcaacatagtctcgatgtgtccgtcgtgcgaagtgtacggtcacagggtactgacggccttctgcttgtacgaacggcggcgggccttgacggaagagacttggattctgagtgaaatcagagatcctcagagtggcagacatgactacaagcttgaggggtttgatggagggatcctcttcgctcatggctttccgcaggtcaatgatacggctaaccattccaatcaggatatcagtgttgacgctccgctcgtgggcctcgtcgatgacgataacagaatatttcttcaaagcgaagtcttcggcaatctcgcggataaggataccgtcggtcatgaacttgatcgcggttttgctggagacgttgctttcgaatcgaatctggtaagcgacccggtcgaaatactgtcccagctcatcggccacacgcttggccatactgacagcagcaactcggcggggttgtgtcactgcaatcatacccgggttgggactatcggggtgtccataaccggcctcgaacaggaactgaggaagttgcgtggtctttccgctaccagtagcaccccagatgacgatggatga

SEQ ID NO: 11745 - DNA, 294 bp, A.fumigatus
cgactcagcttcctcatcatccaccaccccctcctcatcgtcttcgtcttcttcatcctcctcctcattatcactgccactatcctcttcatcgctttcatcattgtcggaagatgcgtctttttctccatcctgcacattttttgtttcggcatcgatttccgagtcttcaggctcttcatcgctgctaccagcactatcatttttatcatcggaattgaatccttcccatggaacttccggtacggatacggccgccggtttggccttgggcgctcttttccgcttctttag

SEQ ID NO: 11746 - DNA, 720 bp, A.fumigatus
acctcttccgaacggtcaacttgcacactgaatgccttgcggtttggatcgcctttggtgacttgcaactctaggggaagcggctcctcttcagcgacggtgttcctgacgggccgcttggattcacgaacgaacggctgctcctctgctgtaatgggaccagaaggtttaaagccgacaacctcattgatttgttgtcttgcccactctttgaacgcggactggcgaggcttgattcggagttgtgctaacgactcagcttcctcatcatccaccaccccctcctcatcgtcttcgtcttcttcatcctcctcctcattatcactgccactatcctcttcatcgctttcatcattgtcggaagatgcgtctttttctccatcctgcacattttttgtttcggcatcgatttccgagtcttcaggctcttcatcgctgctaccagcactatcatttttatcatcggaattgaatccttcccatggaacttccggtacggatacggccgccggtttggccttgggcgctcttttccgcttctttagaactgggaagccgtccggaccgagttccagaggacgtttgaggccgccaccaatgactggggcgggaatcggtggtgcaggagcagtctcggcgagctttcgcttagtagtcccttttgaatcgacaaaggagtcgtctgtctcgtcgcctgacaattccgaatccgaattctga

SEQ ID NO: 11747 - DNA, 198 bp, A.fumigatus
aacgtcagcttcttctgctggaaatcaaacccgaaccactccggccccgtcgacaggctaaactcgtaccagaagccacaaaccagcgccacccacgtcgacaccccagtggcttcgatctccgcacaggcctgccgcaccggctcgcccaccagcatctccttccgcagtttctcattcgtgatatcgcagccgtag

SEQ ID NO: 11748 - DNA, 222 bp, A.fumigatus
  unsure (28): Identity of nucleotide sequences at the above locations are unknown.
gaacaaagtcaattattcaataaattgngtagaaccagcctaaattccgttaatttccgcggtctggcccagagaatgagcaataggacaaccagcgggtatgatgcgggccagatcaaacagctgcttgtgggcatcggtctaactttctctcctctctattatctccgtgagtcgacctgttcccgaacggtattatggcccctgcgctcagacatataa

SEQ ID NO: 11749 - DNA, 237 bp, A.fumigatus
actatatggccggccttcagcatgacccagaacgacaccccccgaaccagctattcagacccatcgcacccgatacagtaccttgacaacatggcccaaaagtacgccagagaccagccgtctggcttcaccaaccgcatcgaacgcgtcgccatcgtcggcgtaggtctgcttccatcctcctccgagaacctcactaacaacaccaccaccaccaccaggccggcggcaccgtag

SEQ ID NO: 11750 - DNA, 354 bp, A.fumigatus
gtctgcttccatcctcctccgagaacctcactaacaacaccaccaccaccaccaggccggcggcaccgtaggcaaatacatcacccaggaactcctcaagacaggccaacacaccataaccgcgctcacgcgcgcagacagccaaagcaccctccctgcgggcgtccgcaccgccaccgtcgactaccaggacgagtcgactctggttgcagccctgcaagaccagcagttcctcatcattacgctgagcgtctcagcgcccaaggacacgcagagcaagcttatccaggccgcggcgaaagcgggggtcccgtacgtgatgccgaactgctacggctgcgatatcacgaatga

SEQ ID NO: 11751 - DNA, 960 bp, A.fumigatus
caacaccaccaccaccaccaggccggcggcaccgtaggcaaatacatcacccaggaactcctcaagacaggccaacacaccataaccgcgctcacgcgcgcagacagccaaagcaccctccctgcgggcgtccgcaccgccaccgtcgactaccaggacgagtcgactctggttgcagccctgcaagaccagcagttcctcatcattacgctgagcgtctcagcgcccaaggacacgcagagcaagcttatccaggccgcggcgaaagcgggggtcccgtacgtgatgccgaactgctacggctgcgatatcacgaatgagaaactgcggaaggagatgctggtgggcgagccggtgcggcaggcctgtgcggagatcgaagccactggggtgtcgacgtgggtggcgctggtttgtggcttctggtacgagtttagcctgtcgacggggccggagtggttcgggtttgatttccagcagaagaagctgacgttttacgatgagggaacggtccggattaatgtgagtacgtgggagcagtgcggaagggccgttgcggcgttcctgaagttcaaggagttgccggaggatgagaatgatacgagcccgacggtgcgtggctgggcgaaccggccactgtttatctcgagctttctagtcagccagagggatatgtttgagagctggaagaggattaccggggataaggaggaggattggacaatcgagtatgagcccaccgcggtgcggtatcagaggggcattgagaggatgcacaagggtgaccggtacggctttgcgcaggccatgtatgcgcgcgtcttctatccgaatgggggcggtgactatgagagcagccggggactggataatgatgtgctgggactgcctcaggagggcctcgatgagcggaccaagcatgcgaaggagatgattgaggccggttattcttacttttga

SEQ ID NO: 11752 - DNA, 336 bp, A.fumigatus
tgtctgaaatcgatggatatccgacccacaaatgacagctacagttataccggtaccattacgaaagttctgaatgaagatctcccccgtgtatgcctaaccatcgcgggtaaagggactcaccctctccaatctcctctggtgttagcggataccttcgtactctttcagaccactcttggaaccatgagtattatcattgcaagtgcggcaaagcttcgtcccgcgcaatgttcagactcctgcattcgcgccttctcagctttgagctccgcgattcaagtcgccgtttctaacgccacaagggccctggataagcctggggtttccctttga

SEQ ID NO: 11753 - DNA, 486 bp, A.fumigatus
gcattctcgagacgtttctacaacgcgtacagcgtctgggttcgcacgagccttatcaccaacgtagtacgtctcattgagatcgccgtggaagccgttgtgatacagggtaacatcaatgttgatgatgtctccatcctcaagagggcgctgatcggggatgccgtgacagattgtctcgttgacggatgtacatacggatttaggaaaatgcatgtagttgagaggcgaaggataggactgagacatattagactgggaccgtttcctttgctctttccgaacgaaaagacagccacttacattacgctccaagcatgccttgtgcacaacttcatcgatgtagtcggtcgtaacacctggtctgacctccctcgcggcaatgtccagcacctctcgagccagacggcagaccttcctcatcccttcttgctgttccttattcaagatggtgatgttgtgacggcctacaaacttctgctctga

SEQ ID NO: 11754 - DNA, 1191 bp, A.fumigatus
ataaggtccacacgtgctgctcgattcttatttctgttatgcgctgactcgtccgatcagagtgaacacaaggctatccataaatcgaagagtaatatcctgtccaacctcttccctccgaaggtagtttctgaacctgatccagccacgggacatttcaatccatttccttcgttccaatttaccggctctctgagacccgtctatcctctgtctcccatgcgaacggttcccaagtctatccctcaccccgattacgccaaggatggtatccctcgctcagagcagaagtttgtaggccgtcacaacatcaccatcttgaataaggaacagcaagaagggatgaggaaggtctgccgtctggctcgagaggtgctggacattgccgcgagggaggtcagaccaggtgttacgaccgactacatcgatgaagttgtgcacaaggcatgcttggagcgtaatgtaagtggctgtcttttcgttcggaaagagcaaaggaaacggtcccagtctaatatgtctcagtcctatccttcgcctctcaactacatgcattttcctaaatccgtatgtacatccgtcaacgagacaatctgtcacggcatccccgatcagcgccctcttgaggatggagacatcatcaacattgatgttaccctgtatcacaacggcttccacggcgatctcaatgagacgtactacgttggtgataaggctcgtgcgaacccagacgctgtacgcgttgtagaaacgtctcgagaatgcttagagaaagcgattgaattggtcaagcccggcatgctcttcagagagccaggcaacgtcattgaaaagcttgcaaagagccggaattgcagtgtggtcaaatcctactgtggccatggcatcaaccagctgttccactgtgctcccaacgttccccactacgcaaagaacaaggctgtcggaacggccaagcctggcatgtgcttcaccatcgaacccatgatcaacatcggtactcaccgtgaccggacatggcctgacgactggaccagcactacagcagacggttccttgtctgcgcaatttgagcacacgcttctcgtcactgaggatggtgtggaagttttgactgctcgtctacctgattcacccggtggacccattccgatgcccgtcaccgaggatgcgaagacggctgagaattga

SEQ ID NO: 11755 - DNA, 300 bp, A.fumigatus
aaacagatcttcctgtctgcagccgatcagacgatcattgtggccagttatgggcagatcggttccgacttgaaagccctcaatctgaccagttgggtggctacctcttatttcatcacgttggcaagctttcagccattgtatggcaagttgtccgatatctttggcagacgagcatgtctcttattctcgtattttgtgttcggtcttggctgtctattttgcggcctagcgcgaaacattcatgagttgatcgctgctcgtgtaaggcccatagaatgcttgtcagatctggaatga

SEQ ID NO: 11756 - DNA, 462 bp, A.fumigatus
tccgaatttagctacctcatcaaagacgacatctgttttttgtgtatttgcgatcgctcatacccccggaaactcgccttcacctatcttgaggatctagcaacggaattcaccaccacttactccccgtcacagtatcattctccgactctgcgaccatatgctttcgtggagttcgacactttcattcagcgtaccaagaagatttaccaagatagccgcgcatcgcagaacctcgaccggttaaatgacgagcttcgtgatgtgaccaaggtaatgaccaagaatatcgaggaccttttgtatagaggtgatagtttagaacgcatgggcgagctatcggggcgtctgcgggaggacagtaagaggtataagaaagccgcagttcgcatcaactgggagctgttgatcaagcaggtgagttgtctccacaccagggagatccgagaaatacccttctaa

SEQ ID NO: 11757 - DNA, 189 bp, A.fumigatus
aagctactttttgatacttcgttagattcgggggaggctactcaggctacctatctactctgtacaggtacggctttcttatccatcagtctctctattcagtctgacgtgctcctaggcttttgtcctcatcagccaagcagtacttggtacattgcacagatatgtgagaatttaagtattagttga

SEQ ID NO: 11758 - DNA, 636 bp, A.fumigatus
  unsure (245),(252),(288),(296),(327): Identity of nucleotide sequences at the above locations are unknown.
acccaggagttcgcggaggtgcaccctgggacggaagtttcccgcggcccgagagtctttcccaagacggagaatttccgcgagagatatgatccgctgctggagcagtttacgaaattgcttatgcgggacgggaagttgagcaaggcccagaaggtttgtacatcgctcgaaattcgacaggtggccggtgctaatctagttgatgttcagaacatgtccttcatccttgaccaccttcgaantgccctncccccccaaccgcacccgaagcgccgtctcctcctnggtcctcntagccctcaactccttttgaaccccgtcctntacctcaccttgattgtcgactcggtcgcacctctgattaagatccgtcagcagaagggtattgccggcggaggtgccgccgtgcagatacccgttcctttgatgcagagacagcggcggcggacggcgatcagatggatcatcgatgcctctgacaagcggcgggacagcagtttcgctcagcgagttgctcacgagctggtcgctgttgcggaaggtcgtagtggagtgtgggatcggagggaagcggtgcataagcttggtgtcgctggtcgttcgaatcttggtctggtcactcagcgcaggtaa

SEQ ID NO: 11759 - DNA, 837 bp, A.fumigatus
aatcctcgctatccccaattcagacaaattgtgagtcttgctgcaaggcacccccctggcagcgtaaacgtagtcgttattctatgtactatcgaccagcattatcctcacaatttcttcatttggccttctcatctttccaatcaaagtgatgctcgcacaccacaaacggactccaacgccccaatccttcaacctccatgccgctttgtccttcgtccaacgaggcaaccactcatatcacccgcacagcagctctgcggggacccgccccagcccagacgccgcagtccagctcccagctccagttcacctaccactaacgacgtattatcaataggtcgagtcgcaacttcggagtctgttctttttttttcccaaaattctttgccagtcgaaaccgtgccgtcgaatgctgttgggcgcaccgtggcacgcatcgcatctgcgactggtgcctacgaacaagaactcgaacacgacggccacgatcaaagcttcgagctcgaagagttccacacccgcaatcgctacccgcttgtaacacgcgaacgcactagctccaaccattttgtttccctcgagtcggactcgcacgaacaagtacaggagagcgagaaatacacgccgccgggtgaaaagagcggtcaagaccacagagcgaacaaccccagggtccgcttttgggcagaggctctccggcgtcgacaatccccaaaagaaagtgcacggggacaaaggacagcaaagatgaagttctcgcacagtattcagttcaatgcggtgccggattggagtgcttactacattgcgtatagtaatttgaagaaattgtga

SEQ ID NO: 11760 - DNA, 1617 bp, A.fumigatus
  unsure (994),(1037): Identity of nucleotide sequences at the above locations are unknown.
tatattgctccagctaatgctaatgcgtacaggatatattctctcgagcagcaagctcggaaagcaaacggacaggcacagtcagatgtcgagtccgcaccgctattaagcgagacacctacgcccgaggcggtgttccggcgggctctgaacgcggagctcgagaagatatgcagtttctacgaagtcaaggagtccgaaatactcaaggaggtggaggatgttgttcgcgatacggaggagtactcgtccaagacggacggggctgacgtggaccccatgagtgacgctatgatcaagtcgcggaggatgagctcaaactcacgcccgcgcacgagcggctcgtaccgcgattatgcggaggaggagacagaagatgacgatgatgcagcggatagcgatgacgagcatcacccgccgaccgggcagggaggggttccgtcatcgggtcggtcgcgctcggacctgagcgattcgagattcatggctgactcgaggattttggggtttgatcgacgagggagcggcggacatgatgagcattgcaaagatccagggtttttggaattgtacaacgagggcttgtcgctgcggcagcgggccgtgaatgcctatgtctcgctgtgcgggctcaagtcgtacatccagctgaacaagaccgggttctccaaggcgttgaagaagttcgacaagatcctcgactgcaatttgcggcgcgagtacatgagctccaccgtttctccagcgtatccgtttacagattcgaccatgaagaagatcgatgacgcgatcggccgggtcgagcagctctacgcggacttgattacgggtggcgacctggcgctggccaagcgggagctgcggttgcatctcaaaaagcacgttgtctgggagcgtaatacagtctggcgagagatgatcggtatcgagcgcaaggcccaagctgcgaatgttggcattcgtcggacactgctgggaatggatgaggacccanccaccgcacgacaacagggcgattatccagaagctgctgcccnaaagatcaagacgccgtttggtcgctatagcgtgcccgagtggctctgcagcttgagtttcgggactctgatcgtcatcctggcggtgtttatcatcttgctctatgctccgattatggataaaccggagcagcagaactgtttggccatgcttgtgtttgtcagtctgttatgggccacggaggttattcccctctttgtgacgtccctcttgatacccttcctggttgtcatgttgcgcattatgaagtccgcggacaagccttaccaccgtctgggcccgaaggacgccactggcgcggctttcagtgcgatgtggacgccggtgatcatgctcctactgggcggcttcaccatcgccgctgcgttgtccaagtacgacattgctcggcggatggccatgtttgtgctgagcagagccggatccaatcccaaagtagttctgctgacgaacatgtttgtgagcatgttccttagtatgtggatcagcaatgtggcctcgcctgtcctttgctactccattattcaagtaggtctccttttccaggaaaagatttttttttgtcttggaacatgctaa

SEQ ID NO: 11761 - DNA, 183 bp, A.fumigatus
aatccatatttgtccatctatacgtacctactccctttaccattgggtattcactccatgaaaatcaccaggggaagtttcgttagtatgtttaacactgaagctgtctcaaggtcatactccgcacaggtcattgcatcaacgccgactgccttcggctcccttggcattggtactacctag

SEQ ID NO: 11762 - DNA, 555 bp, A.fumigatus
acatcctttggcctttcgtcccggccgctattgccatacacttcgctcggaaggatcttcacatttggaattttcgctttgaactatgttgccatggtcccttcagcaaacttgcttggctttgcagggcggagagttgacaaggaagctgccccaaggttcctgggaatactattggacacaacactgagttctgtcgtggagatcgtactcttcagggttttgatccacaatgatagagggggaaacctgatccctgtcatccaggccgctatcctgggctcaattctggcgaatttgttgctttgcttggggttgtgcttcttcttcggaggtatcagacgccatgaacagtcgtttcatgaagctatcagtgaggtcgggtcggggcttctgctcgttgcaggttttggtctgttaataccgagcgctttctacgcggccctaagctcgagctcaaccaaagcgatcatcactccagaagatttggatcactccactttggtaatcagtcgatctacctctgttattcttctcgtcgccttcattatgtaa

SEQ ID NO: 11763 - DNA, 534 bp, A.fumigatus
cacaggccagtcattcaacgcggtcgtctcgacagacggagacagcgatcgtccactcctcctcgccccggagggagacaaactccgcttcttcggcggcgacctgctaggcatgatcgtcgcggagttcctccaagccgactcggtcgtggtcccaatcagcaccaacgacgccatcgatcgcggcgctctggccggcgctctggagccaaaaaccaagatcggcagtccgtacgtgatcgcggggatgcagagcgccgtggaaaagcgccgccagcgcgtctgcggatgggaagccaatggcggctttctgacaggctccgacatcgagcgcaacggccaggtgctccctgcgctcccgacgcgcgatgccgtcctccctctcctctgtgcgctgtttgccgcgcaaagccggctgatgaccctgcctgcgcttttcagcactctgcccaaacgattcagccgtgctgcgttgatccggaactttcctcgtgccacaagcctgaaaatcatcgaccgcttttcagtgcgtga

SEQ ID NO: 11764 - DNA, 1494 bp, A.fumigatus
  unsure (81): Identity of nucleotide sequences at the above locations are unknown.
tcattgcagctctcagagggaggcattcgcaaaggcgacgacttctatttcgcatacgacctccgacccagctccactggntatgtagagaacaaccgcggtggactttgtcaagcggtcgtgcaagccttgaaagatggaggcatgaaccctatcaatcttggggctattcatacgcctgcactcaccttttttgctcttcaaaaggccaagggaagtatcatggtaacggggagccatatcccgttcgatcgcaacggctacaagctcaatacctccaaaggagagctcctcaagaaagacgaacaacccatcaacaatgtggtcgaggttgtgcgcgaggagcttctctctcagccctttgccgattctttgttcaatgaacaaggcatgcttcgtggttccccatccaaccttcctccagttgcgcccgagggtagagctgcctatatccagcgctaccttgacttcttccaaggcgaatcgctaaagggcatgaagatcctcgtgtaccagcattcggccgtcggtcgcgacgttgtggttgagattctggagaagcttggtgcggaagccacttccgccggtcgcagcgagacctttgtcccgatagacaccgaagcaatcgacgaggcgcaactcagcaccgtccagaagctgtacgatagcacaggccagtcattcaacgcggtcgtctcgacagacggagacagcgatcgtccactcctcctcgccccggagggagacaaactccgcttcttcggcggcgacctgctaggcatgatcgtcgcggagttcctccaagccgactcggtcgtggtcccaatcagcaccaacgacgccatcgatcgcggcgctctggccggcgctctggagccaaaaaccaagatcggcagtccgtacgtgatcgcggggatgcagagcgccgtggaaaagcgccgccagcgcgtctgcggatgggaagccaatggcggctttctgacaggctccgacatcgagcgcaacggccaggtgctccctgcgctcccgacgcgcgatgccgtcctccctctcctctgtgcgctgtttgccgcgcaaagccggctgatgaccctgcctgcgcttttcagcactctgcccaaacgattcagccgtgctgcgttgatccggaactttcctcgtgccacaagcctgaaaatcatcgaccgcttttcagtgcgtgagggcggagcgcagaccgcggaagagcagtcccgtcggattcgtcaggagctggaagggattttctctgcccggcatgggttttcgtcaatctctcggatcgattacacggatggggttcgcgtcattttcgaaaatggtgatgtcgctcatttccgtccttcgggaaatgcggatgaacttcgaatctatgctgtggcggatacacaggagcgtgcagaccagatcgcgacggagggggttgctgaaccggaaggtttgctacggaggctggagcggttggttcaggcgtag

SEQ ID NO: 11765 - DNA, 387 bp, A.fumigatus
  unsure (42),(51),(121): Identity of nucleotide sequences at the above locations are unknown.
cggccatgtacagtccgcctgaccgtcattgatacccccggnttcggcgantatgtcaacaaccgtgactcctggcaaccaattatcgagttccttgatgaccagcacgaatcgtacatgnttcaagagcagcaaccccgccgcacagacaagatcgatatgcgtgttcacgcctgcttgtacttcatcagacccacgggccacactttgaagcctcttgatattgaggtcatgaagcggttgagctctcgagtcaacctcattcccgttattgccaaggccgacactcttagccctactgatcttgcccgtttcaagcagagagtgagacttccggataaatggcctcccccactggtagatactgactctcccaatctgttttag

SEQ ID NO: 11766 - DNA, 567 bp, A.fumigatus
gtcaaagctgttgtcgaagctcaaggcatcaagatctacacccctcctatcgaagaggacgacgagcacgctgccgcgcacgctcgcagtctgatggctgctatgcccttcgctgtaattggatccgagaaagatgtgaagaccaacgacaaccgggtagtaaagggtcgccaatatgcctggggtgttgctgaagtcgagaacgaggaccactgtgacttcaagaagctgcgctctatcctgatacgcactcacatgcttgatctcatccacaccaccgaggagcagcactacgaagcctaccgcgcacagcagatggaaacaagaaagttcggcgaggccagaccgagaaagctggacaaccctaagttcaaggaagaggaggaggctctgcggaagcgtttcaccgagcaggtcaaggtcgaagagcagcgattccgccagtgggagcagaagctcatttccgagagagaccgcctcaacaaggacctggaggccactcacgctgcgtatgtgcacctcttcttacatttcttgttccatagagaagtatggagacaatgctga

SEQ ID NO: 11767 - DNA, 1011 bp, A.fumigatus
ttagattcaggaccggtaaatgcggttactttctctagctatccaggcacatatgtcctcaccggttcctctgatcgcgccattcacctctcgcgtgccatcccgaacagctctactactggtcacgagacgacttccccgatccaaaagtatgaggcgcacggttactcagtcctagacgtggctgtcgcagcagacaatgcgcgatttacaagcgtcggcggagaccgccaggtatttctgtgggacgtcgaacaagggataactacgcggcgatgggccggacataacgccagggtcgaggccgtacaatttgctggcgagggcgattccgtggtggtatctggtaagagcccgtcttcggtcactcctgtctgttcagtagtagaagcatccggcattctgacctttctttcaggcagtgcagatacaactattaatctatgggacacccggtccaaatcacacaagcctatccagaccctcactgaggccggcgataccgtctcctcgctacacgtacacatgccgacgtattccattgcaagtggaagctacgatggccgcgctcgcatctacgatgtccgcatgggccggacaactgttgacgtccttgctcaccccgtgacgagtgtccggtgctctgcggacggtaatgccctgctggtttctacactcgacagccggatccggatgctggatcgggcagacggcaagcttctcaaggcttttgggggcgaggagggtctcgagcaaagcactactggtgcgagggtaacgtatcgcaatagcgaacttaggattcggtcggtctttgccaagggagacgctgtcgttctcagtggcagtgagtcggagaaaggagatccgtcaccgcaggctcatgtttttgcctgggatgtgcttagtggagaggttatcgcaactgtccgagcggggaatggagtgaaggttgttagctgcgtagcgtggcactcttcaacaggggtagaagcgccgcgcttgcgaaaa

SEQ ID NO: 11768 - DNA, 789 bp, A.fumigatus
gctaagcgcgtgtcctgccagccccgtggtgaagacaagaaatggtgggagtatcgggagctgttcaacacgcactctgcccgtcggcggctgatctgtgtcgttggtatggcatgcttcggacagctgtcggggaactcgatcacgtcgtactatctgcccaacatggtggccaacgccggaatcacggacgaaaagaccaagctgatgctcaatggcatctacccggccatttgcctgatagcagccgtcaccggggcccggttgaccgacaagattggccgtcgtcccctgatgatttactcgctgctgttctgctcggtggcctttgcagtcattacgggaacgtcaaagatggcgaccgaccatcctgataacacggacgctgccaacacggccatcgcattcatctacctgttcggcatcgtcttctcgtttggctggaccccgttgcagagcatgtacattgccgagactctcacgacaaccacccgcgccaagggcactgcctttggcaatctcatgtctagtatcagcagcaccatcatccaatatgcgtccggcccggcctttgacaagatccactactacttctacctggtgtttgtgggctgggatctggtcgaggcagtggtgatctggttctacttccctgaaaccaaggaacgaactctcgaggaactggccgaggtgtttgaggcgcctaatccagtcaagaagagtctacagaagagagatatccactctgtcttgaacaccctggaggttcagggggataccaaagcgtag

SEQ ID NO: 11769 - DNA, 201 bp, A.fumigatus
tcaacaggtgtcctcaaggctgtcaagaatgtcaacgagaccattggccctgctctcatcaaggagaacatcgatgtgaaggaccagtctaaggtcgacgagttccttaacaagcttgacgggactgccaacaagtccaacctcggtgctaatgccacccctcgtgtcagcttggctgttgccaaaggctggtgctgctga

SEQ ID NO: 11770 - DNA, 198 bp, A.fumigatus
agaggtaggccggagataaaagctctactctctattagctctctatataaatatctgaatctgtacatctcgatgatggaagagaagattgttagctactcaatgcttatctacattactgccattagcccgttgcatctcaggagtcatggaataaacaaagtagcatgctcgtggccagaagcgtaccaagactag

SEQ ID NO: 11771 - DNA, 507 bp, A.fumigatus
tcaagggtatgcttggaatcacctcgtccatcaaccactaacctgctgactcttgtcgtcatagctctcgctgatgccttcatccagtctagcgtgaagaacggctccagcccattcaaagtcgcctggtacaagagcgacaccaccgagtccatcaactacctcaaggacgacaccattgatgttggcatcacctatacccccgctgctgaagagatcgccatcaagcagggtgtcgctaaaagccctgcatggtacgcctggcgcgaccactttttgctagttggaccaccctccaacccggccggactcaaaaaggccgacgacatcaagaccatgttctcgcacatctacgccgttgcatcggcaggcgacgccgccaacgtcgccattcccgttcgcttcctcactcgctatgacaagtcagcaacaaacatcaaagagtcccagctgtggatcgagattggacaagtcagtcatccatttcacctcgatctaacgccttga

SEQ ID NO: 11772 - DNA, 363 bp, A.fumigatus
gtcccctgggcgaccaagtactccacctggtatcaccagtacattgcctatcccatccaagccttgactgcggctattctcctcgaggaatacaccattaccgaccgcggcacctacctctcaatcgaccaggcgcttgcccacaagaccaccatctacaaggctgccaccgacgaccctgccgatcctctgctcaatcccgcacacatgctggtcggcaagaaggcgagcaacatgaagatggctgacaaattcactcagtgggtgatcagtgccgaaggtcaggctgtcattactggcttcaagaagaacggaaagcagttgtatactgctgcgcctgctaataagactgctcctttttag

SEQ ID NO: 11773 - DNA, 399 bp, A.fumigatus
agactatcctttgtgtacaacttcaacatgattgacgacacgaacgatttccccgggctgccacctttcccaagtgatataccaaccgctcccctgctccgtctatctctccagaagctgcttgcgcgtgaggcgtacgaggtccagaggctggtgcaagcatgcgaagacctaggattcttctacctcgatctgggaggctgcgaagagggccgtggcctcctcaatggtgcagacaagctgttccaaacaggcgagaacctactgaatcttagcctggaggagaaactccaatatgactttagcagccttaactcctaccacggttataaagcacagggtgcagcggtcgtcgatcgtcaagggaatcttgaccggaacgagttttacaatgtctga

SEQ ID NO: 11774 - DNA, 648 bp, A.fumigatus
  unsure (545),(577),(579),(583),(633): Identity of nucleotide sequences at the above locations are unknown.
gtctcaaagaacgacatcctaggcatgaccccacagctaccagccccagcaatcctccatcaagctcgtccaactctcgaatcattcatccgcgcctcccactcaattgtcacgctgatcctcatcctcctaaacgacagtctaggcctcccgccggcgactctaccaaatctccaccgtctcaacgccctcagcggcgaccaagtccgcttcatcaaatcgccaccccagccggcggacgacagacgcaccgccttaggagaacacaccgacttcggcagcatcacgatcctcttcaaccggctcggcgggctgcaagtttttccacccggtgcagacgcgcaatgggtctacgtgcggcctctccctgggcacgcgatcgtcaacctgggcgacgcaatggtcaagttcacaaatgggctgttccgctcgaacatccaccgtgtggtggcgccgccgggccagcaggctgattggacccggtatagtcttgtctacttctcgcggccagaggatgatgtacttctcaagcggtggaagggtcngatcgattccgagctgaaaaaaagggatgtcnangaanaaactaataacagggagttggatatccgcgtgcgttggggaaaaaggtcnattggggggaggtga

SEQ ID NO: 11775 - DNA, 243 bp, A.fumigatus
gggaacagaagaaatgctatttgctttccaaaccttctcatatttcctgaaaaaaaaacctggatactcctcttccaaccactatccggtttaccccggatttctcccattgaatataacaattgctcattccaatccaccttgaaaccacaaatctcccccccctggtgtggccgatatttcaattcccaaaaatggaacacccttttcaattcttccccccaacataaccaggttttcatt

SEQ ID NO: 11776 - DNA, 690 bp, A.fumigatus
agaggtcttccgcatggacagttgaaatactcctccatcgttatcaccacatcccataatcctcattcaacttttctgaactcaggtccggtcatcggaaagagctattcctgcacaatgaccacaccgaagcctcacatagctcgcgagcttcttgcacgcgcccactcaccagacacagcagaacagctattcacagagcgggtcaaacaaaaacccctctacctcagaccgacctcccccacacctgcggacaaccgagaaagacgtcgcatgcaccgtgtccgcaaaaaggaatacttcttgcgcaaacagaaaccaaagcccctctccgcgcgcgaaaagcgcatctcgggcctctacgatcttcccaaagaggaatgcaaatattccatctttcaggagcttcacaaattatgggttggctatatgcaagagatcttggacctacgagttcgaaaggttcccatcacgccacagtcgcatgggagcaagctggttactgcagattttcatggtgctgaggtggaggttgttcggagtcggtgcccagggagggtaggtgtgaagggaatcgtggcgagggacacaaagttcacatttatgattgtcacaaagaaggatgaggtaaagagtgagtatcctttcacaaatccctttatacggccggagaaggagagctttggctaa

SEQ ID NO: 11777 - DNA, 1158 bp, A.fumigatus
  unsure (151): Identity of nucleotide sequences at the above locations are unknown.
ttaagcctttgtcgcctccggaagaggaaaccccggcgcccagataagggcaacgagaatggaaacgttcaagccaatgacgagaatgttcaagaagtgccgtccaaccggcgtcgtgccaatagcgttgagccacgacggtcttcggacnccgcagaaaagcgttggcaggagcaagatgcaacggaggcgctgcggcgggctattcagtccagcccagcccgaaaccttgagaaccaccctggtgcggcggtcgatgagaacagccttacacctaagccagtgagaagagcgctcttccatagtgctcagaacgaaggttgtcctctcaagtccttgggcggttccgccctgaacagtccccgccgtagccctcgcgttaactgtcgcgatccaggtcaaaagcctcaagacaaggaaaacgcggcgattgacaaagacctagaagggttattcgagagtccgcccttcgaatatgacctgcccgccagtcctacccccagaagacgaaaccagcgcagcaacctgctgggagagaagcgcaattcgttgccgtgtatctcgcctttgtccaaagcgcgcctagagggaagcacagacataacgcctaccaagctcagcgcgcagaaacttcaccgtatacagggcagtacgactgtgaccccccgtcaaaataaaacgccgaagtctctgcgatctttaggacctgatatgccttccatgcccgacggtgggtttaatgtggaggctttggacaatattgacagtatgcttgttaatatcttcgaggacgtgccgtcttccgcacagtgtgactccttgttttcttttgggcaatccaaggactcgacgagcggcaactggtctggatggattgaatccgattatatttcattgaacggatccgacgtccaggaggcaaatggcgagcagcggacgagtaggcggagcggcgcgagcgaggacgaagatctcatccacgccattctctccgacccggacatccaaaagaatgcgcattttgatccattccagtttactagtgcaagcgccttggactctggcatttttggctcagattcagtcaccgccgatgtcgtcactctcggctccagaagcaaaactgccgaggagcccgcgagcaaggagtcggcttga

SEQ ID NO: 11778 - DNA, 585 bp, A.fumigatus
agtcaccgacacattgtttacattgataccattccacgagcggtcgttgccatgcctcctccgcttccatcccagcatcgcggtatgaccgccaaccctctcaagccagtgaagcgttaccggccgggaaaaccgatcgcagaggaaccctcgtcgtctgaagaggatgacgatgcggaggaagaggtacaggagcaggagcggcgcagacaggaacaacaacggcagaggcaacaggctccaaaagcgacttcgttccctgctggcgctgctgctgctgggaggattacaaagggcgtgcaagatgtgaagattgaagaggatgacgacgaggaagggtttgtgacggaggaggaggaagaggcgccgccgaaagtaactgctcgtgttgctggcgaccgagcggagactgtgacggctcaagcaggcggagacgaagaggaggaggaagaagaggaagaggaggaggaggaggaaagtgaggaagaagagagcagttcagaagaggaggcgcctcgaagggttctgttacggcctacgttcatcaagaaagatcttcaccacaggctgaagacacgcgtcaca

SEQ ID NO: 11779 - DNA, 276 bp, A.fumigatus
  unsure (167): Identity of nucleotide sequences at the above locations are unknown.
tccaaacagaagaaagacgaaatgtccctccaaaccccccgcatcctccctgcccaccttcacgccttccacccctctagcggctcctcaacacacactgtccgcatccttggaacggtaacagccctccatggtgacaccgcatcaataacatgcgggaataacgncgatgtcactctcatcctaaagtcagactcacatctccagatgggaaaattagtcgaggtggtagggaaagtcacggaattagagggcgggcaggtacgtgcctcttga

SEQ ID NO: 11780 - DNA, 234 bp, A.fumigatus
gctccggctaggttgtctgtgtggttcggtttcgggtcatccctgctcccctcctgctgctggtgctgctcctcgtcatgtcccataatgcctgttgatctcatacctccgccccgtatatccctcccttttcgtccgtctcccccaaacctcttctctccagatgttcctcctgtgactcctttaaaccaacctccgatccctgagacaccgcctgtcgtgacggcctgttaa

SEQ ID NO: 11781 - DNA, 240 bp, A.fumigatus
agccttttgtggtcgattggttccatcttggaaaagaaccccgctacatcctgtggcctctgcaaccaacaggaaggaaacgtatcggaggtgattctccctgattccctacccctcgtccatcagccccctatcatgttaagcctcctgacaaccctcccctgttgtttgtatatctcttctctcccggctgtctggactgtcgtgcccttccggcccagtaacaacctcactgcgtag

SEQ ID NO: 11782 - DNA, 465 bp, A.fumigatus
atcgagtccgtgttcaagatcgtgaccacggtttacttttccagctttgaagggccacatacgccacgaggaggagaaaggtacaacaaaagcgttaaccttaacgactcttccttgatctatctttcgctcatctgctggaagaacagcgctaagcgtcacataccttcaaacatggctcctacaaccactaccaagaccaaggccgttgaggaatctgtacgttgctgcccattggccatcgtaactgctgttgagtggccactgacatctcgacagccccaacccaaggagactgctccaccaaagaagctctcagagatgagcgaagtcatcgacaaggccacctttgaccagatcttggagatggacgatgatgaagacatggatttcagcaagggcatcgtgtatggatttttcgatcaagccgaaaccacgtttgacaagatggacaaggctttgtaa

SEQ ID NO: 11783 - DNA, 303 bp, A.fumigatus
cattcacatcacagagagaagaaggacctcgatgagctttcttcgcttggacatttcctaaaaggatcgtcagcgaccctggggttgaagaaggtcaaagatcactgtgaaaagatccagcattacggtgccggtaaagatgaaaccggcactgtggacgaacccgatgaggagaaatcgctgcagaacatcaaggaaactctggctgaagtcaagaaggactataaagaagtagcgcagttcctccgcagctattacggcgagacaaagtctcccgaggtcacctcgccctcctctaaatag

SEQ ID NO: 11784 - DNA, 1203 bp, A.fumigatus
aaaacgcagaattacaaagatgacatgtatgaggtcaaaggccgaggagctacaggggaagccgacggggaaacgggcgaggacgaatcgtacggcctgaaaccgatgaactgccccggccactgcctcctcttcaagtcgcagaaccactcatatcgcgaactgcctatccgctacgccgatttcagccctctccaccgtaacgagatttcgggggccctaagcgggcttacccgcgtccgacgattccaccaagacgatgggcatatcttttgccgaccgcagcagatcaagggggagattgcgtccgcgctggggttcgtcgatatggtgatgacaacgtttggtctgggaccataccgtctcgtactctctactaggccggagaaggactttatcgggagcctggaactgtgggacagcgcggaggcgcagctgcgggaagccttggacaacagcgggagggaatgggcgatgaacgagggggacggggctttctacgggccgaagattgacattcaactgcaggaccaggcagggaaatatcaccaattatccacgatccagctggacatgaatctgccacaacggttcgggttggagtaccaagttgcggagggtgaagaggactacaacccggcgactccaggaagagcgacgcccgtgctggttcaccgggccaattttgggtcgctggaacgcttccttgccctgctcatcgagcaatatgccggtcgctggccattctggctctctccgcgccagggtatcattctgacggtcaaccaggacgaggcggtgttgcagcaggcacaagaagctgctgcgaaaatctctggctaccgtccgcttgttgctggccaggacaatgcaacctctccgaagcctctttcatccgtcgactccacgtacctgatcgatgtcgacaccagcagccagactctcgggaagaagatccaacgggccaaacagatgaagtacaatttgattttcatcctcgggcctaaggatgtcgcggactcgagtattactgtggatgtgacaggtcaaatgcagaccaaaacggatgtgaatggacagaaattgaaggaagtgctcgcgacaagattgggggagaatgctctccagaacccacgggcagtgaggctaaaggtcgacgaggtccatgatctgttggtccagctggagaagcaatttgtttga

SEQ ID NO: 11785 - DNA, 420 bp, A.fumigatus
cttgatgtcctggcccaccgaaccagtatgggtgtcatcaccggggatatgttcgttaatgggaaagctttggacacgagtttccagagaaagacgggatatgttcaacagcaagatctacatctcgaaaccgctactgtgcgggaatcattgcgtttcagtgccctcctgcgtcaaccacccacggtctcaatccaggagaaatatgactatgttgaagaagtgattcgcatgctgaggatggaggaatttgctgaagctattgttggagttcctggtgaaggattgaacgtcaaacagcgcaaattactgaccatcggtgtggaacttgctgcaaaacccaagctacttcttttcctcgacgagccgacaaggtatgcgattgacggcgtccataatttaatggatttggtcaaatga

SEQ ID NO: 11786 - DNA, 792 bp, A.fumigatus
atcagtggtctggattcgcagagttcatgggctatttgctcatttctgcgtaggttagccgatagcgggcaagcgattctctgtacaatccaccagccaagcgctattctctttcaggagttcgatcagctactgtttctcgcaaaaggtggaaagactgtctacttcggtcctgtgggggacaattctcgcaccctacttgactacttcgagtcgaacggcgcacggaaatgcggcgaattagagaaccctgcggagtacatgatcgaagtcgtcaacgccaagaccaatgacaaaggacaatattggtatgatgtctggaatcaaagtcctgagagccgcgcggtccaggaggagattgaccgcatacacgaagaaaggaaagccactcaccaagaggacgatgatcaggcgcacaccgaatttgcgatgcccttctggtttcagttgtatgtcgtttcgcgccgtgtcttccagcagtactggcgaatgccagcatacattgcctccaaatggggtctggccatcatggccggcttgttcatcggcttctccttcttcgatgccaaagcttcgctggcgggcatgcagacagtcctttactccttgttcatggtttgctctgtctttgcatctcttgttcagcaggtaggatcccgaataaccacatcccgctgtgttaccatgatattaactgccttttctagatcatgcccctatttgttacccaacgatcattgtacgaggtgcgcgaacgacccagcaaggcgtactcatggaaggccttcttga

SEQ ID NO: 11787 - DNA, 768 bp, A.fumigatus
atcatgcccctatttgttacccaacgatcattgtacgaggtgcgcgaacgacccagcaaggcgtactcatggaaggccttcttgattgccaatattgtggtggagctcccatatcagatcgtcatggggatcctcacctttgcctgttactatttccccattgtgggcgccagtcaatcaactgagcgacagggtctggttcttctctactgcatccaattctatgtttacgccagcactttcgcccacatggtgattgcagcaatcccagacacgcagactgccagccccattgtcatccttctgttctcaatgatgctgacattctgcggcgtgatgcaatccccatccgccctaccgggcttctggatattcatgtatcgactctcacccttcacatactgggttggaggcatgggcgccacgcaactccacgacaggaatgtcatctgctcagccacagaactctctatcttcgaccccccggcaaaccaaacatgctacgagtacatggcagaatacatgaaactcgccggtggccaactccagaatcccaatgctacctccgagtgcaagttctgctccttgactgttgcggaccagtaccttgcagggagcgagattgaatggtcccagcgctggcggaatttcgggataatctgggcctatgtcgtgtttaacatcttcatggcgacggtcctgtactaccttttccgagttaggaagtgggacatcgcgagcattaaggcgaggttcggaaggaagtga

SEQ ID NO: 11788 - DNA, 450 bp, A.fumigatus
ggcacctttgtaaatggtaaagtcatctttgataacccgcgtggccgtcttccgttgcaatggatgaaaacaatccccaacgaaggcctgattcattttcgagatgtgttcaaccgcagccacctcttgcctaccactcaccaggctcttttggatatcatgagcaccaacacttacgacttcgagaaaccatggcgcgcgcgcgagttcctcgctcggatcattggcttcggcttgattttgtctgagggcgccgcgcataagaaacagcgcaaggccttgactcctgccttcaacataaagaacattcgttcactgtactccttgatgtgggagaagactggcctctttcttgatgaattggaaaaggagatccggcagaatccaatggaaggaaccagtccggaggacggtgtgggtaaggtcgagatgagcatgtgggcgaggtaa

SEQ ID NO: 11789 - DNA, 384 bp, A.fumigatus
aattgcaacatgtcgctagaaagcgctctcagcatcgcacggcaatacgcccagtcgagcctcgcgcagctacctgaatccgcgcagaatgccctcctgaaccctctcgtccaaaaggcacttacggctgcgctggtctacggtgccctgcgacagaccaaccgtttgctgtcgcaatggtcgataaacaactggcagcgcgcacatccatggcagggtgatcgcgagctcgttctggtttccggagggtgcagcggcatcggcaagcagatcatggaagatctgtccaggaaagggatccgggtagttattttggatatcaatgagcccaactttcagctacgtaagaatcatcagtcccctttggtatgcgccatagactaa

SEQ ID NO: 11790 - DNA, 588 bp, A.fumigatus
cgaagcaaagcccgcaatgtacacttcttcaaggccaacatcaccaactcagagagcatcagagccgtagctgagaagattcgccagaaactaggcgaccccactgtgctggtcaacaacgccggcgtgggctacgacggcaccattctcgatgagcccgaggccaagatccggcagacgttcgaggtcaacaccatctcgcattttctaatggtgcgcgagttcttgcccagcatgatccgccagaaccacggacatgttatcacaattgccagtatggccagctttgttgcgttgggggagatggtggattactgctgcaccaaggccagtgcgctggccttccacgagggactgacgcaagagttgcgatactggtatcaggcgaggaaagttcgcaccaggtatgaggctacattcgatctgacaggctttgggactgaccaaatgaagtgttattcacccactttgggttcgtactccgatgatccaacagttgaccgacgcgggaaaccaattcaagcagcccgtgatgacaccccaggtggtatcggatgcagtggtcaagcagatcctcacgcagagtag

SEQ ID NO: 11791 - DNA, 642 bp, A.fumigatus
  unsure (128): Identity of nucleotide sequences at the above locations are unknown.
ttggcaaaattccggtccggtcgaatccggggaatctatccccagcaccaaccacctagccgagagaaacccttccccaagcttcccatggcttatgcgtctatggacttcgatcttgatcccaatgnaggacaggaggaccttccattatcttaccgctttacgttccttggtatctttgcggttcccgcgctgatcgatatcactctcctcaccaccatcggacgaggcctgtatctcacaacgttcatgagcaacgatgaaaaaaccttggcgaccactgcactgatggttgcgttgctactctgtggtggcttcggcggctggatcagctcgggaggcagctactacctatatgcgatggcctttcccgcgatgagcatgttcgtcttaacccggttcattgctggtgtagcagttgtctctgtcggcggtctctttgcatttattgggataggaattgccaaaggctttgtgtctggtgttgtcttttccgcatacctggtgatgctgacgatatatttgatgacgctgtctgcattgtcaatctatcagctcccgggattccagttccagtcggtaggtttttgcatgcacagaataacagtgatagatgctgatgtgatcagggccgcacggtga

SEQ ID NO: 11792 - DNA, 2358 bp, A.fumigatus
tgtgatcagggccgcacggtgattatgagctgcattccgatccttttcgtctcccccgtcctgacgatttggcttcaacatgacataatcatctatccctgcgtactcgccgtctttttgacagtactattgctcggtgcgagacgtgtaattgccaagtggaacaattggtatctccatattccctgcatcactgatggggaggtagtcgactggtaccagaggacgtatctcgccagtgcgtctactgatgatgccgataaggaactggcatccactgccctggcccgacagacattgttggcctgcgtgcagaaggaacgaaagcgttggttctggaccagatccacagccgacccgttcgtcaagcgtcttgctgagggatattccgcgactatgttcctgctcgtctggtactgcaaattctcaaggaccaagcttcctcttgcgtacagtccgacgtggaacctgcaacttaaagccgccgttgataccatgggagacatgcaaaagggactcaagttgcataatgctttccttcactggcggcacacagggaaagacgtctggggaggaattctttacttcatcatcgccctcatggacaagtggaccgccttgttcaccggcgaaggactagtcggactatcctccgcgtcaagtgagacctatcgcttagccgtcggcttcggtctctgttactatctgataggtgctgttatcctcgatggcgtctcacagccgctgtggacgctggcacaccagaggacccctcagccaattccttctctcgagtttctgcgagaggccacacgtaacgacgcacgcgctcgacgggcgctgtactggcggaatctgctcaagttctctttcctccatatctgggctgttgccgtcacttgcgctttggtctggtcatttgaaggctcccgcagtgccaccatcatgtacctcgcgtatgtcggtgcatatacaggtctgctatggtatcagtataaccgaatttacactggatcccgatcggatcgggcgctcacggctggtgcgattggtggtttcgtggcctgcatcctgctgcgagtcctcccgcgggagtttgcttacagcggcgtgatcggactggcagttggcacctggacgacggcgattgtgtctttcttcagggctgacgttgcatggacccgtggacagaaattgaccagtcttgataaggacacgcatgcggtaacgtacacctgcagcaccttggaaccagaccctgatttctcacaatccacactatcaaatacttttgaagcgatccgtgctcttccgtccgagctgcgatacaagttggatccttctcaacaccctggcgcggaggtgatgcagatcctcctccgttcgaagagcgaggccacgacaccccccagcttgcaacaagcctttccccaatccgagacaatattgcaccgtacagccgagctatggcagtcaggagaaacagtcgtcgagcttgtgtcagcacgtcatctcatgctgccgccacaggaccctaccatgcgcgcgatcacacaaagagcaggggatcggctccacattttcattctgatcagcctcgaccttgtgggggacgagtgggttgtgaacatccggcgcaattgccaagctatcgctgagactctcgtttacgtcacggctgaaagtcgactagggctttcgcgtgatcatgcaatgctagcacaacttctggcagcccagcatcacgacagcgggacgcttgccgttcccgagggcatcaagcgccagctcaaaagctctcctcctgaaagaaaacgggtgatcgcccacgctcagaagacaatgttgcgccatctgctccttggaatggaccctgacagggaatgggatcttatgcctcggcatgtccacgccttcttgatagagagagcatgcggccaaccaactcgtctttctgcccccgatgtggagtggatccgttgtcaccctggcacagccgacgcagttgagctgcattgtctccttgcaagatctagcttgagtacttccctggcggtacttgtaggccagtacgccggagcgatcgctgcccatgacgaggattttggacccaggtccgatttccgcgactcaagctacgatcaactaattaccacggtgtcatccgagatcgagctcaagaacaaggggtttgcggagtttatgcgagtcgcagtcatcaggttccttcagaagattcgaacctgtatcaagttcactgtgctctcgttggtcgcagatcccgagtatcagcgagaattgaactatatccttcgtgggcagtcgctggtgatctcttggcctatcacttggattctg

SEQ ID NO: 11793 - DNA, 825 bp, A.fumigatus
gtgctcgaggcccacgatgtcgacactttccacgtccccaaagctttctatgagaagcacccttcgaagactcatctgaaagatttggacgagtataagaaactatacgacgagtctatccgtagccctgacacgttctgggcccgcatggcccgtgagctgctcactttcgacaaagacttccaaaccacgcacatcgggtcgctcgagaatggagacaatgcctggttcgtcgaaggtcgcttgaatgcctcgttcaactgcgtggatcgtcatgccatcaagaaccctaataaggtcgcgatcatctacgaggccgatgagcctaatgagggccgcatcattacctacggcgagctcctccgcgaagtctcccgcgttgcctgggtcctgaagcagcggggtgtcaagaagggtgacactgtcgcgatctaccttcccatgattcctgaagccgttgtggcttttctcgcctgtgcccgtatcggtgccattcactccgttgtcttcgctggtttctcctcggactccctgcgtgaccgtgtccttgatgctggatccaaggtcgttatcaccacggacgagggtaagcgtggtggcaaggtgattggcaccaagcgcattgtcgatgaggccctcaagcagtgccccgatgtgaccagtgtgctggtctacaagcgcactggtgccgaagtcccttggaccaatgggcgtgacacttggtggcatgaggaggtcgagaagtacccctgctatctcgctcctgagtcgatgagctccgaaggaccccctcttcctcctctacacctctggttcgactggtaa

SEQ ID NO: 11794 - DNA, 519 bp, A.fumigatus
gctccgaaggaccccctcttcctcctctacacctctggttcgactggtaagcccaagggtgttatgcacactactgccggctacctccttggtgccgcgatgaccggcaagtacgtctttgacattcatgacgacgatcgcttcttctgcggtggtgacgttggctggatcaccggacacacctacgtcgtctatgcgcctcttcttcttggttgctctaccgtcgttttcgaaagcactcccgcctaccccaacttctcccgctactgggatgtcattgagaagcacaaggtcacccagttctatgtcgcccccacagctctgcgtctgctgaagcgtgccggtgatgagcacatccaccacaagatggagcacctgcgtatcctgggctccgtcggtgaaccaattgccgctgaggtctggaagtggtactttgagaaggtcggaaaggaggaagctcacatttgcgacgtaaggactggcagaccccctattcaaccccccgtgctccaacgctaa

SEQ ID NO: 11795 - DNA, 318 bp, A.fumigatus
tgcttgaaacagacctactggcaaactgagaccggctcgcacgtcatcactcccctcggtggaattacttccaccaagccaggcagtgcatccttgcccttcttcggcattgaacccgctatcatcgaccccgtctccggcgaggagatctctggcaacgatgtcgagggtgttcttgctttcaagcagccttggcctagcatggcccggaccgtgtggggtgcccacaagcgctatatggacacatacctgaacgtctacaagggctactacgtaagaagcttcattcgtaccattcctgcaagggcgttgggctga

SEQ ID NO: 11796 - DNA, 990 bp, A.fumigatus
actagagcggtacagtcagcccaacgcccttgcaggaatggtacgaatgaagcttcttacgtagtagcccttgtagacgttcaggtatgtgtccatatagcgcttgtgggcaccccacacggtccgggccatgctaggccaaggctgcttgaaagcaagaacaccctcgacatcgttgccagagatctcctcgccggagacggggtcgatgatagcgggttcaatgccgaagaagggcaaggatgcactgcctggcttggtggaagtaattccaccgaggggagtgatgacgtgcgagccggtctcagtttgccagtaggtctgtttcaagcattagcgttggagcacggggggttgaatagggggtctgccagtccttacgtcgcaaatgtgagcttcctcctttccgaccttctcaaagtaccacttccagacctcagcggcaattggttcaccgacggagcccaggatacgcaggtgctccatcttgtggtggatgtgctcatcaccggcacgcttcagcagacgcagagctgtgggggcgacatagaactgggtgaccttgtgcttctcaatgacatcccagtagcgggagaagttggggtaggcgggagtgctttcgaaaacgacggtagagcaaccaagaagaagaggcgcatagacgacgtaggtgtgtccggtgatccagccaacgtcaccaccgcagaagaagcgatcgtcgtcatgaatgtcaaagacgtacttgccggtcatcgcggcaccaaggaggtagccggcagtagtgtgcataacacccttgggcttaccagtcgaaccagaggtgtagaggaggaagagggggtccttcggagctcatcgactcaggagcgagatagcaggggtacttctcgacctcctcatgccaccaagtgtcacgcccattggtccaagggacttcggcaccagtgcgcttgtagaccagcacactggtcacatcggggcactgcttga

SEQ ID NO: 11797 - DNA, 699 bp, A.fumigatus
aggaggaagagggggtccttcggagctcatcgactcaggagcgagatagcaggggtacttctcgacctcctcatgccaccaagtgtcacgcccattggtccaagggacttcggcaccagtgcgcttgtagaccagcacactggtcacatcggggcactgcttgagggcctcatcgacaatgcgcttggtgccaatcaccttgccaccacgcttaccctcgtccgtggtgataacgaccttggatccagcatcaaggacacggtcacgcagggagtccgaggagaaaccagcgaagacaacggagtgaatggcaccgatacgggcacaggcgagaaaagccacaacggcttcaggaatcatgggaaggtagatcgcgacagtgtcacccttcttgacaccccgctgcttcaggacccaggcaacgcgggagacttcgcggaggagctcgccgtaggtaatgatgcggccctcattaggctcatcggcctcgtagatgatcgcgaccttattagggttcttgatggcatgacgatccacgcagttgaacgaggcattcaagcgaccttcgacgaaccaggcattgtctccattctcgagcgacccgatgtgcgtggtttggaagtctttgtcgaaagtgagcagctcacgggccatgcgggcccagaacgtgtcagggctacggatagactcgtcgtatag

SEQ ID NO: 11798 - DNA, 1083 bp, A.fumigatus
agaagatcagatacgatgccaataatatcaccctttgagtcctccattgccaaaccaggtcagggcaaagtcgttctatctctccttcctccttcgatcccgaccctgacgaccttgacttacaagtatccattgaagctgctcacgcgcgccccgggcttcgtgccacagtcctccgggcttacaggctcttctcgacctgttcatctctatcttctcacatacggtggaggtcttctaccaggcgaccacattgatgtctccattacgttggatccccgcacaagactcgttgtgactacaccgcagggaagcaccaaaatcttcaagacggagcctactgcaagcgtcaagggccaacggggaacaccagcacgtgcattaacagacaaaagccgccagctagtcaacgtgcaggtcgccagcgaagccgctctctgttaccttccagatccagccgtgcccttcaaggacagccggtacgagcaggtacaatcattcaccgtcgacggggcctcaaaagaccacaagagaagcagcctgtgtgtgctggactgggtgacgcagggccgcacctcacgaggcgagaattgggacttccatctctggaaggggaagaacgaagtctggacacacgacgccacaggcaagaagaagctactcctccgtgactcgatcattctagacgacgagatcgacgccgtatgtctggaaaatgactcggagaccttcagccgcaacaacttgatccgggaacgtacgcgaccccacgggatcataggcaccctgattctgtacggtcctgtgttcgaggatttagcgtcattctttatgaataggttcacgtcgcagccgcgcatcggggctcggaactggtcgtcctctgccccggcggcggcggagacaccgccaaatgcagactcggaagtgaccttcaccgcggcgcgagtaagaggaggcttcgtccttgtgaaatttggcgcgaatgactttgagacggccaagaattggctcggtggtattttacgtgacgaagggacaattctcagagagtttggagaagaatctttaatgtgtctatga

SEQ ID NO: 11799 - DNA, 1227 bp, A.fumigatus
acggttcaagaatcacagggtgtcctactgcttgcttttgaccgttgcgggggttttcatcatgctgtaagtactcgtcctaccctaccatcaccgccacattcggtgccgatgaccactgattgttgttcgaacccatacagaggactcgttcagttcgtctcgatagtctgtggcattgtggtctcatttttccccgacgaattggacaaagcggctggccattggcgccatgttccggacaacgacctttacacagacatcacacgttggcccacagatatctcgcgggacatcatccctgtcggatgccattcacacaatgattactggcgacggatacccctgtactcggccttgcaggcgggttgcattggtgtcgaggccgatgtgtggctgattgacaatgagctctacgtcggccatacctccacgtccctcacgacgaagcgcaccctcaagaacatgtacatcgacccattgatcaagattattgaacggcagaatcccatcacccacttccatgccgctgtcgatcaccctctacatggtgtcttcgacactgacccttctcaaaccctcattctcctcattgacttcaaaaccgatggagagaagacatggcagcgtgtgatggaggatttgtcgcctctgcgcgagcgcggttacctcacctacttcaatggcactggtttgaccaacggcccaatcaccgtggtcggaacgggaaatacccccttcaatatgatcacgtcgaattcaacctatcgcgacatttttttcgacgccccgctaaacctcctggcggagcacgaggccattgctcctcctgcagaggctgacgtcctgcatgactcggcggccaccgcccagccacctaccggaaacgacggccagggcctgtcaggtatctccgccggcgacattggccccgacaccttcaactggaccaacagcttttacgcctcggtctccttcaagaagtccatcggctatccctggagattccacttgacaaacgagcagatggatctcatccgggcgcagatccagggcgctcatcgccgaggactcaaggtgcgttattgggggttgcctagctggccgcggagcctgaggaatcacatctggagcgttctggcgcgtgagggcgtcgatattctgaacgtggatgacttgcagagtgccacaaagcaagaatggaaggtcaggattttcgattggtag

SEQ ID NO: 11800 - DNA, 219 bp, A.fumigatus
acctcctggcggagcacgaggccattgctcctcctgcagaggctgacgtcctgcatgactcggcggccaccgcccagccacctaccggaaacgacggccagggcctgtcaggtatctccgccggcgacattggccccgacaccttcaactggaccaacagcttttacgcctcggtctccttcaagaagtccatcggctatccctggagattccacttga

SEQ ID NO: 11801 - DNA, 306 bp, A.fumigatus
cgcggatctttccctgtctgtttcttcatagcaatgactccgataacttcaactttcattctgccccgccggactcacgcgctaggagcatgtcgtacctgcagacgtcggcatgtcaagtgtgaccaaaagcgtccctcatgtcgtacttgtcgatcgcttggtgtcacatgcgagcgtcctccaagcaaggtacgatggatgcacaattccaatatcgaggagagtgcagacgaccaacgcgaaacccgccggcatctttacacaggtgagcaccctagccattctagacgcatccgtgcatga

SEQ ID NO: 11802 - DNA, 1230 bp, A.fumigatus
agatcgtccgctaacgcagatacagagcaatctagattgtccatgacatcctcactacgctcgcgactggtctcaggctcaatcaatgcgtctttggctgaaattgacctccgaaccagggacattgacaaccctcccacaggcgatatcgtcgtcggtccgtttgcagttctagggctgcccactcccgagtccccaaggggtgataaggtggtacatctgcaggcccagcaagatggaccggattcagtttcagtcgagtctgaggggcagcctactcagccggtcagcccgccaaacatggaggacagctccgaacctatcggccaattgacgacattctctcaggcatcttttcttgcggacccagtgtgccattttgacgatttcctccactggtctgatctgcttggatgcagtccagatgctcttggctggaactctgcaccgataacagacgacatggatctggggacgaacataggctctttcggtgcggagttcgaaacagatcctatgtcgtttgacggtccagaaaatgttggatcattcccactcgccccagatagtgacgactccatgcagacgaccggaccgacagagatggcctccaccttgctatacgctgcttcattggcagaggccccctttctcttcaaacattttcatgataacgtgattccccaaaccatgcccatgcctctgggcaagaagtctccctggaagattctgaatgtaccagccgcaatgatgacttacagcgacctgacgattcttggatcccaaaatatcaaccatgcgcgccaggccaatctatacgggttgttggcttgttctgctatccatttatctatgtatccaagcgcaccctcgacagaagcagcccaacattggcaaggaacagccgaccatttgttcgaacaagccagggaacatatgcaactctcgataaagtatgaaacccaagagccaaagaaagccaagtacaaggaccaactcatggccatatgttgcttgactgaatacgccgtaagttcctggcatccaatgttgtgttcacttcctgagaacgaagctaatgtgcatagattttgtctgggcaacagcactatgctcgtgggttccttatcaacgctgagtatattctgcgcatgcgggggctgccgaaactacggatctcgccaaaggcgcgccttctacaccatgtttatacatggctgcgacttgtag

SEQ ID NO: 11803 - DNA, 1389 bp, A.fumigatus
tgtctctggagtagatcagtgattatggccctgtgcctctccaactgttctgcgtcctttcgccggaagctcacgattgcccctgatgggggcagagctgcagtgatggatatggtgtctttcagagcagctggtcgtcgccggaccggtcctagagaattttcgacaaaatcatggaagcagtacaatgatcagaacaagcatgagcgttcgtcgccaaggagctccttcggatctcggcttcgatttgccttgcgaaccacgaaagtagaatggtacccaattcctgtcggtctgggtatcggtttactgggtttactgcacttttacaagtcacagcgggcggaaagagaacgtgccgagagggaggcacttggagagtcgtttgatttcgagaaacctcctccacgtccccgagtcaggcccagcggaccatggcaagtccagatcctgtcgacattgcctctcaaggcaatgtctcgctggtggggagccttcaacgagctggaactcccttattatcttcgtgttcctggattcaagctttattcctggatcttcggtgtcaatctggatgaagtagccgaaccagaccttcacacgtatccgaacttggccgccttcttctatcgcaaactaaagccaggcgtacgaccaatagatcctgaccctcacgccattgtctccccgtcagatggccgcattctgcaattcggtctgattgaccgcggtgaggtggaacaagtcaagggtataacgtacagcttggatgcgctcttaggtgctgccacaccgtcttccgctgaccacagcaagaaatttatgaaccatatggcagagccatcccagaaagatgcggctaatatgctagctgatgaggaattcgccaaagtgaacggtatctcgtatacactgccgaccctccttgcaggagacaagggaggggcacggagacgggcggcttctttggacgcatccacaaagtcagaagctgctgcagaagaagcagtgaaggccgaaattgctcgcggggatggctctccttggtatgcgcctaagccgacatcgaacaatgcactctactacgtggtaatctatctggcgcccggtgactatcatcgcttccactctcccgtgtcatgggttgttgagagccgtcgccattttgcaggagaactgtactctgtttcgccttaccttcagcgtcacttgcccggtctttttactctgaatgagcgagttgttctactgggtcgctggcgatggggctttttcagttatatccccgtaggcgccacgaacgtggggtccatcaagatcaattttgactcagaattacgcacgaacagcctcacaacagacacggctgccgatcgggctgcagcactt

SEQ ID NO: 11804 - DNA, 393 bp, A.fumigatus
gcccgtgtcagctacacttccttcaaacacttcaaagcagaaacatcgggtttccagattatggcgtccaattcttccgatcaaccaagtgcaccttttgagaccgttccgcgcagcatcaccttgcacgtgctctgcccgtctctacccaatcgcttcaccttcgatgatcttcccctctctacgactgtggctggcctcaaggctcgcttgaccgaatcaataccaagtcgtccagcgccgagtaaccagagattgatctggcgcggaagggcacttttagatgatgctatgacactggaaagtgttttgggccccgcggatgtatgccccacccccaattccctttatttggctgaacctctcgcatttggaatagctactgacgattga

SEQ ID NO: 11805 - DNA, 1233 bp, A.fumigatus
gcggaccttcgactagatctcaccatggccgacacccgctacacttcgccagacccgacgacccacgacacggtcggcgcgtctacaatcgctacacctttgtttctgccgtcgtcacctcctcctgccgaggagagaatggttgattctcgtccacgtgccgatagccctgtttccgaccgtgtcgctgccgagagtgagggagcgcgttcgccagcgctctcgagatcttcatctcccgaccatcaagtcaatgaactcgatgcacgactagcggaatatactgtggatttccgtgccttatccggcacacagttagctcacgatggtgatacgctaccggatctgaaatttccgcatgaggaggacaagctctctgaggtcggtggcccggaggactttactgccaacatggagaggtatctgatgggcatggatgatgacttggaggataagggctgggaggagggccaatcagcgctcgtgaatgacaatccgcagccagcgattacaccgggcgacaagcacgaggggcaaggagaagaaaaggaggcggaccaccagccacaacaacaggggcatggcttacagcagcctggccccgatgacgaagcggaagttagcgagtacagtgaattcggaccccctgttgacatgtctactccatcccatttcctacgtaggaccggcgctttcgctaaggaaatgacccagctggaagacattgaggaggatcccgacgatgaagccccaccagtttccacaccgtctgtccagagacagaccgctacaccacagcatgatacgacggattcgaacgaggatttgcggcgtcaaatcgcggaattaaaagcagcgattcgagaccgcgatcagcagctggagagaaaccatagacgggtactggaagccgcttctgcgggggagcagatcaagcatttgcaggctgaacttcagaagaaatcaagccagttggacgatcttcaagcgaaaatcgacgacgaggcgaatttgcgacagcagatacagatgccccagagcgagaacgatgaaaaagagtcgtacatgcagagatcctcgttcagccagtcaggactcagtgcgcttcagaaacagctcggtgatatgcaaaaggagctgcagagcagggatacacgcccggacctggacgcagaacgactggagacgattgcatatctacgtcttaacgccgccgatggaagatccacgctg

SEQ ID NO: 11806 - DNA, 438 bp, A.fumigatus
catgctctagacaccaaacaaacccgagtcgttaaggtcacagtgcctaccgaatcctttttcaacttcttctctcctccacaaccaccgactgacgatgatgacaccatcgccactgacattgaagaacgcctcgaacttgactatcagcttggcgaggacatcaaagagaagcttatcccgcgtgcaatcgattggtttaccggcgaggctctccagttcgaggagttgggtgacgacatggatgccgacgagtttgatgatgaggacgatgaagacgaggaggaggatgaggacgacgatgatgaccgaagatccgatcgcgatgttgacgatgagtccgaggaagaggtacggtttttctctctttatgcctccaaatatatctttgcctctactccgttcttcacaacgatgacagcgttgcctcaatcctaa

SEQ ID NO: 11807 - DNA, 819 bp, A.fumigatus
agcgatagcattaatctaacatacatgtcagagtcactcgatcacgctacggctgcttctctttttgcaaggaatcccgggcttgtgtccatgattcaaggtaaacttgggtcgcttgtcgggcgctcatcaggctacatcgagtctctccctgccccggtccgtcgccgtgttgctggcttgaagggtattcagaaggagcatgccaagctcgaggctcagtttcaggaggaagtcctcgagcttgagaagaagtactttgccaaatttacacccctctatcagagacgtgccacgattgtcaatggggctgcagaaccgaccgacgacgaagtccaggccggcaaggaggaagaagaagaagaagaggtagatgttaaggccgaagatgagcgcaagcaggaggagaaagacatcacaacgcctggaatccctgaattctggctctccgccatgaagaaccaaatctcccttgcagaaatgatcactgatcgggatgaggaggctctcaaacatctcaccgatgttcggatggagtatcttgatcgccctggtttccgactcatatttgaattcgcggagaacgagtttttcaccaacaagactatctcaaaaacttactactacaaggaagagagtggttacggtggtgatttcatctatgatcatgcggagggttgcaagatcgactggaaggctgacaaggatcttactgttcgcgtggaaagcaaaaagcaacgcaacaagagtacgtccacctggatttgttcagtcggaaaactaacatgctctagacaccaaacaaacccgagtcgttaa

SEQ ID NO: 11808 - DNA, 291 bp, A.fumigatus
agtaagcagggcacttgtgttagccgcggctggctcatctcaatgcacgatgacgttaacattcctgtcattagggtgttttactggtttggccactactactcgctctcgctgctcgtacaagccgtgattatgattggggtccagatcgtcttgctcaaagttgccctggataaccggccgtctccaggagtcaagaatagcgtggagcatgttccgtttagcaatttggatgagaagggttttgccagaccatacgaattctggcagtggaagtccgcaaagccgtaa

SEQ ID NO: 11809 - DNA, 441 bp, A.fumigatus
cggactttgggtctacataggtactggatgttcctggcctattttgtcggggcgctatcattcgtccagatccttctgccgcccattgctcggtcggacttctatgtgagcctcctgggatatgctggtctggctgtagaagctatcctcccactccctcagatagttgccaatcaccggactcgttcgtgcaaaggatttcgggtttcggtgttggcagcttggattcttggtgatgtgatgaaaatgagttacttcttctgcagcaaagaggtgattccctgggcttttcgcctatgcggtatgttccagtgcgcctgtgatctctacctcggggtacaattctggatgtatgcgcggcatacactcagggctgcgggcggccctaggcataacactgccagctggccagccggggagaaagacatacggatgacctaa

SEQ ID NO: 11810 - DNA, 339 bp, A.fumigatus
  unsure (213),(281): Identity of nucleotide sequences at the above locations are unknown.
atgactgatgtgtctcacagtggctcccacatcatgtccttcgtgctggctcagaagcaaggttggaagcctgattcattgacaccggctgtccttggtccgttccaggctatgcggaatggggtcacgggatacaatgcctcgcaccctgatcaggccacgcccgcggctgagttcttcatgtgggagcattttaccacgaagccgtacttncacgcggacgcggacaagccgcacccgccactggaagagaatcgggagattttcaccccatggccatncctgcttattgtcgcgttccactcggtcttccctgaccccgacatgacgagaaactga

SEQ ID NO: 11811 - DNA, 753 bp, A.fumigatus
gtgcgtttccggccagcccgcgctggtgaagacaagggcaaagtgcttgtttctcagcgaacagagtcgtccttgatgccttctattccctcggacaagagttacttccccgaaatcgtggaatttctcccgtcaaagtctcatcgacgagcagtacgctttgcagatgggagggttgagatggacatcgatgccattgttttctgtaccggctacttgtactcatttcccttcctatcgtccctcgacccgcctgttatcggagacggccgcaggacgctgaatacctatcaacatcttttctacatctacaatcccaccctcgtattccctgtgcttccccagagagtgattccgttcccgttatcggaaaatcaagcggcagtctatgcgcgtgtttggtcagggcgccttactctgccatcaatagcagagatgaaacaatgggaggaatccactgtcgccactaaaggcgacagcacaaaattccatctgatgcactttcccttggatgctgattatatgaacttccttcatgattgggcagatatggccgaaacacgccaaggtctggccaataatggctatggcaagcaatgcaattactggggaatgaagcagaggtggatgagacagaagttccccgagattagaagggccttcgttgagaagggcgaggagcgttacaatatcaaatccatcgcagaacttggttttgattttgatgaggattggaagcaaaggcaagattag

SEQ ID NO: 11812 - DNA, 267 bp, A.fumigatus
acgcgcatgatgtggcgcaagcggaaagccgcttcacccgcaatttcagaccctgcagacaacttcagaaaaagaaggtggaaagtagtctatgtcatttcctcaagcgacgacgagaacgacgagaacgacgacagcacatctagcttggacgaagacgaatggtacattaactgcatccttgacgaaaccgaatcacaataccttattgactgggagggcccctggtcgccgacgtgggtgagttgggcgaagagtctgtcttga

SEQ ID NO: 11813 - DNA, 606 bp, A.fumigatus
agatcctcgaatcaagacgcctcaacatcgctgcccgctattcatgcagccgaacatgctgtgctctccctgctgcccaccttcgtcatctcgtcgcccggcgacgtcaaaacagagtgcaaagtcgcaaagaaggaactcggcagaaacctgaagatcgcgaacgagatgcgcgatcaacaaattaaagagaacattaggaaacttcagccccctgcccggcaacgaccagcgcgcctcaccttctacgatgccaagggcggctcatgcggctccgggattgcgagcaaagcgttcgagttcgtcgacgtcctacttcgccgcgcggtggcgcgcatcgaagcctgcgagtgcgtcacaccgcagggttgtatggagtgcgtttgcgatgagagatgcagagagttgaattccgtgatgagcaaggcgggggccggcgtcgtgctgcggtgtctgcttggttgggatgtcgacatcgacgccctgccttggggggaagatgtcgagggcgaagacggactaagggaattggcggggggactggagacggtcatcccggcgactgaagtgccgttgcgtcgtcagtgccgtagcgataacgtgtga

SEQ ID NO: 11814 - DNA, 2889 bp, A.fumigatus
aaatccagatcgaccaaaacatcaagaatccaaagggtgatcaagagcccatcacccaagcgcaaaccttccgcacactggccggaggccttcaaaagtttgtctcagatccaccgcgctttgaacctggtgtacacgttctgctgcacgcgcaaacacttcgccacgacgttcgagaatattcagaaagcggtacaggcgcaattaggcagcggtagtgcactgaccgttgaagatattgcaagggtgagggttctgtttcctcgcgcggtgaaattcgagtatgtggacgcggccaagttggaagttatgacggtgggggagaaggagacggcgaggaatcagtcttatggcctctcacatcctgaatgcgatgggtctgatgttggtgcggatgtgcagtcgaaagaggtgttgctgtttgagtttctggacggggatctgaagcgcgaggtgcgacatccgaaaaacggggagcccacgaaacccgtgcggaagttgaaggatgaggatctgaaaatgcctgtttacagtcaaaagcagatgcttgccttgattgagaaacggaataagaaattctctgatgccatcgatgcgttcctggtgcagtgcgaggacggcggcagcgatccagttgagagactggaaagggagaaggacgcatggatcccgaatcctcctgtttttgaagatgacagcttaaagacggcgaagctcctctcgatgccgcctcccgagattcccaaggagcgcaaatccacggcagagatcattgacgaaattcgcgcaatggattggtacttcgctcagatcgtccccgaaggccatagagtgtttgaggcccaatctgccgtctacggagacttgacttttcaactttcgcaagacctcgttaacgctctgtacaacacaaagggcataacacagttctacttgcatcaggctgaagcaatcaactccctttacgccggtgaagatgtcattgtatctacgtctacaagctccggcaagtcattgatctaccaggttccaatgcttcatgagcttggaagagaccctaacagccgtggcatgtatattttccccactaaagctcttgcacaagatcagaagcgtagcattaaggagcttctgcagtttatggatggtttacaggacgtcatggtcgaaacattcgatggcgatactccgatggggagccgcaacctcattcgtgacgaggctcgcattatattcaccaatccggacatgctacacattaccatattaccgcaggaaagttcttggcgcacctttttgaagaacttgaaattcgttgtcgtcgacgagttgcatgtctacaatggtctatttggatcacatgttgcattcatcatgcgacggttgcgtcggatctgtgctgcggtgggcaaccgacatgtccgatttatatcttgttctgccactgtagccaaccctgaagaacatatgaaggcagtatttggcattgacagtgtcagactcattgactttgacggttcgccgtcaggccgtaaggagttcttatgctggaataccccttacaaagaccccaatgaccccacctctggacgcggagacagtgttgctgaaactgcccgtctcttctgtcagttgatcctcagaggcgcgagggtcattgccttctgcaggatcaggaaaatgtgcgaggtactactccaagccgtaaggaacgagttccaggccatcggtaggccagaagttggaaagctcgtcatgggttaccggggcggctacagtccgcaagaccggcggaaaattgagagagagatgttcgagggccatctactggggatcgtcgctacgaacgccctcgaactaggggtcgatattggctctctcgatgctgtaatcactcttggcttcccttattctatctccaacttgcgccagcaaagcggtcgagctggacgtcgaaacaaggattctttgtctgtgttggttggcgataggtttccggccgatcaatactacatgcaaaatccagatgaactgttcacaaaaccccactgcgagctacaaattgatctttctaatgagctgattcttgaaggacatgttcaatgcgcagcgttcgagatgccgatccggccggacgaggatcatgtctatttcggaaagcagctgcatgagatagcggccatgagactcgtgagagacagctttgggttctaccattgtcacgagagattccgacctcatccctctcgatgtgtgcccattcgtgatacagaggaccagcattttgcagtcattgacgcaacaaacgcacgcaatgttgtcctggaggaagtggaggcttctcgtgccttcttcacaatctacgaaggcggcatctttctgcatcagggccagacatatctcgtcaaggaattgaacactgatcagcggttcgctcgcgttgtcaaggtccacgtggattggagcacgatgcagcgcgactacactgacattgaccccattgaaacagaagtgatgcggcagatcaatcaaagctctgcctctcgcgcattctatggctcggtgcagatccacgcagtcgtgtatggcttctttaaaattgacaagcgtggccgcgtgctggatgccgtggcggtggacaatccgccgatcaacatcttcaccaaaggcatgtggctcgatgtgcccaaacgcgctctagagatcctcgaatcaagacgcctcaacatcgctgcccgctattcatgcagccgaacatgctgtgctctccctgctgcccaccttcgtcatctcgtcgcccggcgacgtcaaaacagagtgcaaagtcgcaaagaaggaactcggcagaaacctgaagatcgcgaacgagatgcgcgatcaacaaattaa

SEQ ID NO: 11815 - DNA, 543 bp, A.fumigatus
tgctccgcacgcgggcgggcagggcccttggcgaaattgcggaagccatcggcgaagggctccatgtggttgaaggactgcacgtccgtttcctcctgggaggcgtccatgcgaccggggacgaacggcaccttgatcgggtggccggcgtcctgcgcggccttctcgacggccgcgcagccggccaggacgatgagatcagcgagcgagaccttcttgctgtcgccgcgggcgttgaagcgcgattggacagcctccaacgcggagagggcctcgcgcagccagggttggttgttgacctcccagtcgcgctgcggggccagacggatgcgtgcgccgttggcacccccgcgcttgtcgctgccacggaaggtggaggcggcggcccaggcggtggagatgaagcttcttggaggcacaccggaggcgaggatctcgtccttgagcgcggcaatgtcggacgcgtcgacgagtggatggttgacggcggggatggggtcctgccagatcagaacctcgctggggacctccgggccgaggtag

SEQ ID NO: 11816 - DNA, 1404 bp, A.fumigatus
gaacaaactcgccgttcccgacgtccttccagggggtgttcatgtccagcaggtgaacaaagaagtcgttcgtcagagctccagacgggaggtgaagacgccgtgcgtggagccgtcgtagttggtgttgagcacccgcagaccgccaaccaggacggtcatctcgggcgcagacaggttcagcagctgcgccttgtcgacgaggtagtgctccgcacgcgggcgggcagggcccttggcgaaattgcggaagccatcggcgaagggctccatgtggttgaaggactgcacgtccgtttcctcctgggaggcgtccatgcgaccggggacgaacggcaccttgatcgggtggccggcgtcctgcgcggccttctcgacggccgcgcagccggccaggacgatgagatcagcgagcgagaccttcttgctgtcgccgcgggcgttgaagcgcgattggacagcctccaacgcggagagggcctcgcgcagccagggttggttgttgacctcccagtcgcgctgcggggccagacggatgcgtgcgccgttggcacccccgcgcttgtcgctgccacggaaggtggaggcggcggcccaggcggtggagatgaagcttcttggaggcacaccggaggcgaggatctcgtccttgagcgcggcaatgtcggacgcgtcgacgagtggatggttgacggcggggatggggtcctgccagatcagaacctcgctggggacctccgggccgaggtagcgggcgcgggggcccatgtcccggtgggtgagcttgaaccaggcgcgggcgaaggcgtcggcgaactggtccggatgctcgaggaagcggcgggcgatcttctcgtaggcgggatcgaagcggagcgacaagtcggtggtgagcatggtgggcttgtgcttcttggaggcatcgtaggcgtcgggaatgatctcgtcagcgttcttggcaacccactggtgggcgccggcgggactcttggtgagctcccactcgaacttgaacaggtactccaggaaattgttgttccactgggtcggggtcttggtccaggtcacctccaggccgctcgtgatggtgtggggacccttgccggagccgtgcttgttcgcccagccgagaccctgggcttccaggccggcggcttcgggctctttgccgacgttgtccgcaggggcagcaccgtgggtcttgccaaaggtgtggccaccagcgatgagggcgaccgtctcctcgtcgttcatagccatgcggccaaaggtgtcccggatatcgtgagcggccgcgacgggatcggggttaccatcgggaccctccgggttgacatatatcagacccatgtgggcggcggccaaaagagtctccagctcacgcgagtgggtggtcttgtgtga

SEQ ID NO: 11817 - DNA, 261 bp, A.fumigatus
tccagaaaaccccttggcgtaccgcgcgtcgttgcccagccaggtattctctcgtccccagtaggtggcttcgtccgcttcccaggtgtttggacggcttccagcgaagccaaaggtcttgaaacccatggactccagggcgacgttaccggtgaggatcaggagatcggcccacgagatcttgttgccgtacttttgcttgatgggccagagcagacgacgagctttgtccagactgacattgtcgggccagctgtttaa

SEQ ID NO: 11818 - DNA, 201 bp, A.fumigatus
  unsure (1),(39),(40): Identity of nucleotide sequences at the above locations are unknown.
nttgattttctctttcctgtctctgctcttgtcgtaaannaagaactagaagactataatcgattcgcaagctatcctaacccaggtcatattgggcatttatacacagcatatgcccctatcaagaagagctgctggtatttaatcggacaacggcgcgaggcgagaagacgagcaaagcggggtagcctgatggaatga

SEQ ID NO: 11819 - DNA, 540 bp, A.fumigatus
cgagatcattcccgacgcctacgatgcctccaagaagcacaagcccaccatgctcaccaccgacttgtcgctccgcttcgatcccgcctacgagaagatcgcccgccgcttcctcgagcatccggaccagttcgccgacgccttcgcccgcgcctggttcaagctcacccaccgggacatgggcccccgcgcccgctacctcggcccggaggtccccagcgaggttctgatctggcaggaccccatccccgccgtcaaccatccactcgtcgacgcgtccgacattgccgcgctcaaggacgagatcctcgcctccggtgtgcctccaagaagcttcatctccaccgcctgggccgccgcctccaccttccgtggcagcgacaagcgcgggggtgccaacggcgcacgcatccgtctggccccgcagcgcgactgggaggtcaacaaccaaccctggctgcgcgaggccctctccgcgttggaggctgtccaatcgcgcttcaacgcccgcggcgacagcaagaaggtctcgctcgctga

SEQ ID NO: 11820 - DNA, 2001 bp, A.fumigatus
gacaagcacatcatgacacaggacaagtgccccttcaaggagcagtcgtcgcagcccaattttgctggtggcggcaccagcaacaaggactggtggccggaccggctgaagctcaacatcctacgccagcacacggccgtctccaacccgctggacgctgactttgactatgccgccgccttcaacagcctcgactatgagggcctgaagaaggatcttcgtgccttgatgaccgactcgcaggactggtggcccgccgactttggtcactatggaggtctcttcatccggatggcctggcacagcgccggaacctaccgtgtgtttgacggtcgtggcggtgccggtcagggccagcagcggtttgcccccttaaacagctggcccgacaatgtcagtctggacaaagctcgtcgtctgctctggcccatcaagcaaaagtacggcaacaagatctcgtgggccgatctcctgatcctcaccggtaacgtcgccctggagtccatgggtttcaagacctttggcttcgctggaagccgtccaaacacctgggaagcggacgaagccacctactggggacgagagaatacctggctgggcaacgacgcgcggtacgccaaggggttttctggatcagacaagcgcggctcccttattgcagacgaggagtcacacaagaccacccactcgcgtgagctggagactcttttggccgccgcccacatgggtctgatatatgtcaacccggagggtcccgatggtaaccccgatcccgtcgcggccgctcacgatatccgggacacctttggccgcatggctatgaacgacgaggagacggtcgccctcatcgctggtggccacacctttggcaagacccacggtgctgcccctgcggacaacgtcggcaaagagcccgaagccgccggcctggaagcccagggtctcggctgggcgaacaagcacggctccggcaagggtccccacaccatcacgagcggcctggaggtgacctggaccaagaccccgacccagtggaacaacaatttcctggagtacctgttcaagttcgagtgggagctcaccaagagtcccgccggcgcccaccagtgggttgccaagaacgctgacgagatcattcccgacgcctacgatgcctccaagaagcacaagcccaccatgctcaccaccgacttgtcgctccgcttcgatcccgcctacgagaagatcgcccgccgcttcctcgagcatccggaccagttcgccgacgccttcgcccgcgcctggttcaagctcacccaccgggacatgggcccccgcgcccgctacctcggcccggaggtccccagcgaggttctgatctggcaggaccccatccccgccgtcaaccatccactcgtcgacgcgtccgacattgccgcgctcaaggacgagatcctcgcctccggtgtgcctccaagaagcttcatctccaccgcctgggccgccgcctccaccttccgtggcagcgacaagcgcgggggtgccaacggcgcacgcatccgtctggccccgcagcgcgactgggaggtcaacaaccaaccctggctgcgcgaggccctctccgcgttggaggctgtccaatcgcgcttcaacgcccgcggcgacagcaagaaggtctcgctcgctgatctcatcgtcctggccggctgcgcggccgtcgagaaggccgcgcaggacgccggccacccgatcaaggtgccgttcgtccccggtcgcatggacgcctcccaggaggaaacggacgtgcagtccttcaaccacatggagcccttcgccgatggcttccgcaatttcgccaagggccctgcccgcccgcgtgcggagcactacctcgtcgacaaggcgcagctgctgaacctgtctgcgcccgagatgaccgtcctggttggcggtctgcgggtgctcaacaccaactacgacggctccacgcacggcgtcttcacctcccgtctggagctctga

SEQ ID NO: 11821 - DNA, 537 bp, A.fumigatus
tctggcaggaccccatccccgccgtcaaccatccactcgtcgacgcgtccgacattgccgcgctcaaggacgagatcctcgcctccggtgtgcctccaagaagcttcatctccaccgcctgggccgccgcctccaccttccgtggcagcgacaagcgcgggggtgccaacggcgcacgcatccgtctggccccgcagcgcgactgggaggtcaacaaccaaccctggctgcgcgaggccctctccgcgttggaggctgtccaatcgcgcttcaacgcccgcggcgacagcaagaaggtctcgctcgctgatctcatcgtcctggccggctgcgcggccgtcgagaaggccgcgcaggacgccggccacccgatcaaggtgccgttcgtccccggtcgcatggacgcctcccaggaggaaacggacgtgcagtccttcaaccacatggagcccttcgccgatggcttccgcaatttcgccaagggccctgcccgcccgcgtgcggagcactacctcgtcgacaaggcgcagctgctga

SEQ ID NO: 11822 - DNA, 477 bp, A.fumigatus
agcatagagcaatgtcggtcaccgccatatccgtgcaggtggcccgccagaccggcccagtcttcttccagcctcagcaacgcgcatagttctcttcctggacacctcccaccgcagcatccgttttcttcttttggtttctacgatagtcccaccccggcgttttgttctccgcactttgtctttccggataccaccctggatcttgcctcgtttgctcccgacccgtcagtctccgacaccgacccatctgcctttgtgcctctaccccccgatctcgccagcttcggtgatctggattatgcaagtctgcccacggggacttccagttcgccgtacgcgcccgattcgtttgatgtgacggcaatttcgactcccgctgttgatgtgaaggactctctgccgtgtttggacattgattcctcaggcaccgattcaggtctgtctgcttcagccttcacacaagcattgtactga

SEQ ID NO: 11823 - DNA, 429 bp, A.fumigatus
  unsure (324): Identity of nucleotide sequences at the above locations are unknown.
cggtcccacatgagtagagcatggagctcgccccctgcaccggctgcaccgggctcgaccggccagacgcacccatgggataccactcaaaacgatgaggaggacgtcgacgatgtcgcgacgaagttggtcatggaggacgccagccacgactgggatctgctgagggacctgctgaacgcaatgcgcttggtggacgacgcacacgtgcaggcgctgctggggatggtccgcgccgactgcgcgatcgaggaagtgaagctgttcgtccagaagacgttgaatgatgtgcaggatgccggtcgcggcggggagaccgtcaancggttgcacgacatgcggatgcgggtgcgcatcgagagcggcgacccgccgttccgcccccaggtcatggatattcactatctgtgccatgtggcgccgtacagg

SEQ ID NO: 11824 - DNA, 387 bp, A.fumigatus
ttcctcaggcaccgattcaggtctgtctgcttcagccttcacacaagcattgtactgatatcagcagacacacaaatcaacccaggccaaatccacacgttgactccacctctgctcatgcccgcctcgagacctcagcgcgtgtccatctctgcagcatcgactgcgaaggacaacccgcccaaggagacgccgaaccgggtcttgaagcgtcagctcaatacccttgctgcgcgccgatatcgccagcgacgggtggaccggatgaacgagctggaggcggaactggagaaggtgaagcgggagcgggacgagttgaagatgcgggtgtcgaagctagagggggagacggaggcattgagggggttgttgaagaaagacaagtaa

SEQ ID NO: 11825 - DNA, 312 bp, A.fumigatus
  unsure (75): Identity of nucleotide sequences at the above locations are unknown.
atatccatgacctgggggcggaacggcgggtcgccgctctcgatgcgcacccgcatccgcatgtcgtgcaaccgnttgacggtctccccgccgcgaccggcatcctgcacatcattcaacgtcttctggacgaacagcttcacttcctcgatcgcgcagtcggcgcggaccatccccagcagcgcctgcacgtgtgcgtcgtccaccaagcgcattgcgttcagcaggtccctcagcagatcccagtcgtggctggcgtcctccatgaccaacttcgtcgcgacatcgtcgacgtcctcctcatcgttttga

SEQ ID NO: 11826 - DNA, 201 bp, A.fumigatus
acaaaactgaccagtcatcaactaaattacttgtctttcttcaacaaccccctcaatgcctccgtctccccctctagcttcgacacccgcatcttcaactcgtcccgctcccgcttcaccttctccagttccgcctccagctcgttcatccggtccacccgtcgctggcgatatcggcgcgcagcaagggtattgagctga

SEQ ID NO: 11827 - DNA, 429 bp, A.fumigatus
gaggccttaaacttcatacttcccgtatacgacatcacgttggagaagctgcgctacgaacttgtcgaaactcatatcgacggtcaagcctgctttgtcccggttgcgaaggtcctcgtcggagaacctaatttacacggtgcatggggtgttgccgttgactcgagtcgccgctgcctagacttgtggggttggaggaattcgacattgagattgagaactggggtgcggaagcgcttattgctggcgacgcgcgagagggattttcagagcccgtggaatttacctctggatgacctgctcttcgatcggtgccagattgaagacgactatgctacttcgtgtgtggtggtggctgaccgcgcagactacgataccttttcgcttcattcaacgacgagtagatcaggagtggaagttgtgacgtaa

SEQ ID NO: 11828 - DNA, 345 bp, A.fumigatus
  unsure (243): Identity of nucleotide sequences at the above locations are unknown.
ggcggcttttccccgggcgcttcgaaagaagaaatagactcgggttcagagggttttgtggcaagcgtaccaggagatgcttcgctagatgcccctccattctggcggagttcttgctcatccaagttattgaccaaaggggaacactgctggcgatggcattcccccattgcatcaccccgtttgtcaatagcaaccaaatcttcaagaggggctgaagcttccaggggtgctggaccttcngaaggagcagcagcagccatgtctgtatcgaccacttcagctgggtcatctggctcttcatcaggagtttcagttacaggagaaacctcgcccgttgactga

SEQ ID NO: 11829 - DNA, 426 bp, A.fumigatus
agtatatgtgaggtacgtgtgccatcggaagactcactagtgtcggaagccacggattcacggtctgaaaccaaagaggactggggcaaatcagcatacttctgccggagctcctccgctgtcaaaccctcatcatcgtcaacttcgtcttcatcctcggtttccgaatccgtagaggacatgttgctttcgtcctcttccgcatcgctggttgttgcatccgttccactctcttcagcatctgttgaatcaaggaaatcgctgccagtctctccaagaatttccagacgtctcttctcgaacagcatggtagattgtttgattgcgcgatctagagcccgctggtcctccactttccgctcttcctcccagcgtgctagacgcatccgatcaacctccgcccgggccaagtcgaacattttctga

SEQ ID NO: 11830 - DNA, 2457 bp, A.fumigatus
  unsure (5),(1599): Identity of nucleotide sequences at the above locations are unknown.
cgccntcgagcccccggtgaagactctacttcagcccctaatgaccctacttcgcacaacgcacgatcgaagcggtcccactcgaatgtcacttcaacgccgacaatcggaatcgatgagctatggaatgatatcgggggtgagactgacttaggagacgaacagggtcagcgggtgccgaggttgcgaattaaagtcaagaagcctgttattggatttcagcatccttcccatgtgattcctccccggaaatataattctttcagggaatggcttgagagcggggaaggcagaatagaagatggtgcagtgcttacacccgaggcagcactcgtggaagctcggaagagatgtcgagtcttggaagccacagagcctggcggtcttctgagccctgaagtatgttccgcctacttaccagagcaacaggaagaaccaccgcaacaatattcgcaccaagaccacctcgtcgctcatgccttgtacttcaagaagcttcttgaccaggagcaccggcgccatcgcaatacagcgagacttcttgctcagtggtgtgctgatgcgtggaggaagcgcaataagcgcccagaggatattcttagagaacaacaggaagaggtgcgcgttaagcgcaagcaactggctagggatcttcagaaaatgttcgacttggcccgggcggaggttgatcggatgcgtctagcacgctgggaggaagagcggaaagtggaggaccagcgggctctagatcgcgcaatcaaacaatctaccatgctgttcgagaagagacgtctggaaattcttggagagactggcagcgatttccttgattcaacagatgctgaagagagtggaacggatgcaacaaccagcgatgcggaagaggacgaaagcaacatgtcctctacggattcggaaaccgaggatgaagacgaagttgacgatgatgagggtttgacagcggaggagctccggcagaagtatgctgatttgccccagtcctctttggtttcagaccgtgaatccgtggcttccgacactagtgagtcttccgatggcacacgtacctcacatatacttcagaatatagaggacatcaacgactctcagggcgaaacgccgctggagcagattgaactggacgaagtcgatccaatgctcctcgacgatagcgaagacgaatctacggatatggatgatgatatgggcgatagtgatgaggatggagatgccgacggcacagactcagatgacgaaagcgatgatgggccggggctattaggattcttctcatcaaaagatcgcgtgttgaatgatgctcatcgctttgacgatgaaggtgatgatcctttagctgtttcgaatcatgaaggtggctctggtttccacgatgacgggcaatctgtttcagtcgatgaggacggcgatgaggaactggaggatgcagatgaagtttccctggttccgaatggtccatcgaactcggtttctatctctcagtcaacgggcgaggtttctcctgtaactgaaactcctgatgaagagccagatgacccagctgaagtggtcgatacagacatggctgctgctgctccttcngaaggtccagcacccctggaagcttcagcccctcttgaagatttggttgctattgacaaacggggtgatgcaatgggggaatgccatcgccagcagtgttcccctttggtcaataacttggatgagcaagaactccgccagaatggaggggcatctagcgaagcatctcctggtacgcttgccacaaaaccctctgaacccgagtctatttcttctttcgaagcgcccggggaaaagccgcctcagccaagtgaatcccccgctcctgggttgaagacgccgataccgcatctactccggggaactctgcgagagtatcagcattatgggttggactggcttgctggactctacaacaaccacatcaatggtattcttgccgatgaaatgggtcttggcaagactattcagacaattgctttacttgcacacctggccgtggaacatgaggtttggggtccacatttggttgtcgttccaacgagtgtgattctcaattgggagatggaattcaagaaatggtgtcctggtttcaagataatgacttactatggcagcatagaggaacgcagacagaagcgcaagggttggaccgacgatacgagctggaatgtattgatcacttcttatcaactggtgctgcaggaccagcaggtcctgaaacgaaggaattggcattatatggttcttgatgaagctcataacatcaagaacttccgctctcgaaagtggcagaaactgctcacttttaagaaccgcgcacgggtacttccttacaagttacaccgcctccaaaaacaatctcaccgaaactatggtcccctcctcctccttcttggatgccctcctgattggtga

SEQ ID NO: 11831 - DNA, 885 bp, A.fumigatus
  unsure (830): Identity of nucleotide sequences at the above locations are unknown.
gtttccgctcccatgcggagttccactctagccgatgctaaaccgatggccgtcggaccatactcaccaaatgcctgtgcgctctgccgcagtcagaagagaagatgcgataagacgctaccgtcctgcagtcgatgcatcaagtctgagttctccgcatcttccctttgcctttctgttactgacacccaaaaaagatcaaagctatcgtgcgactatgcgtggaatgcgacacgaactgaggggcttccccgagtgtcgctgtctgatttcctcctcttccatgtgccggtcactcaggatcaattgtggctccccggcagctttcaggccttacagccccattgggacaatatcagtttccgacgcgtagatattgacaactactttgtcggtctggccatggcaacgctgacggagcagtgtgtttccgtggagagaatgctcgaggagtacttttgcaatatccatccgtggttctctgtaatcatagagccaggttttcgaaaacggctgtctaacctgcatcgcgagccttgcgcagagactgcaatgctccttttagctgtatccctggttactggctcacatgatcgatcgagcaacgattctcaccggaccaggatctaccagattggcaaatacctcttctcctttctgcagctccaaagggaaccttcattggagatggtgccgagtgggttgttgctggtattgtacgagctgcgagcttcccgtctcaacgaggcctctgtgagcgttgggaactgcgcgaggctgggatacactctccgcttgaatattgatcatcccaacaggggggaaacggnccgtggatggaatccgaggaacgacgcagagtatggtgcggactatacatgttag

SEQ ID NO: 11832 - DNA, 648 bp, A.fumigatus
gattctattcgtactcttagtaacatgtggatgacagccattgtcgtcgaaggcaaaaccttcgcccttaatggctacaatgtttcctaccggttccacgttgacgagagcaccggtgacttgcgctccgatcacttcggcggcagcgtcagtggacctattcccgatgattcagctcccataatgaatgggtggaccggtatgcctgaccgcgttcgccgcgagttcccggaccaaggccggggagattttcgaatccctgccattcgcatccgccagtcgcagggacatactgtttcagcttttcggtatgattcgcataccgtgttgaagggcaagcctgcgctggctggcttgccagcaacgtttggcacagaggaggatgtctcgacgctggtggtgcatttgtatgaccaacatagcgaggtggcggcggatctaatgtactccatattcccaaagcacgatgccattgtccggagtgtgcgcatcacgaacaagggggagggtacaatctcaattgaggcgctgtctagtatgagtgtggatttaccatgcgaggactttgatatgattggcctcagaggggactgggcaagagaagcgcatcggcagaggcgcaaggtggactatggaatacaggggtaa

SEQ ID NO: 11833 - DNA, 903 bp, A.fumigatus
  unsure (896),(897),(898): Identity of nucleotide sequences at the above locations are unknown.
gccatcaatacagtcgacaggacgagacttttcactgagctcgacagatttgggagtacaacaggcttctcgtcccacttgcacaaccccttcgtcgccctggcgcatcgctctactaccgagtcccacggtgaggcatggggattctcactggtctacaccggctcctttgctgccaatattgaaaaaggctcgcagggattgacacgtgtatccatgggtttccatccaaaccagctatcctggcccttggctccgggggaaaccttcacgtctcccgagtgcgtatcggtatattcaaaagacggtctaggaggcatgtcgcgctctctgcatcgcctgtaccgcaatcacctgatgaaaagcaagtttgctgcggacaaccgacccgtcttactgaacagctgggaggggttgtatttcgacatcaacgaggagaacatgcaccgcatggcacaggaatccgctgctttgggtgtaaagctcttcgtcatggacgacgggtggtttggcgacaaataccctcgcgtctccgactcagcgggtctaggcgactgggttcccaacccaacccgatttcctaatgggctcgcgccgctcgtgaaagccattacctccttgaaagtcgccaagtcgccagaaaatcttcgctttggtatctgggttgagccggagatggtaaacccacagtcaagcctataccacgaacacccggactgggtcctccacgcaggctcatacccacgcaccgaacaacgcaaccagctcgtcctgaatctcgcgctacccgaagtacaagagtttatcatcgacgccatcaccaacatcctcaacagcgcagacatcagctatgtaaaatggtcttcaccacggggctggaaggagccgctccaggnnntataa

SEQ ID NO: 11834 - DNA, 195 bp, A.fumigatus
ttgcggtacaggcgatgcagagagcgcgacatgcctcctagaccgtcttttgaatataccgatacgcactcgggagacgtgaaggtttcccccggagccaagggccaggatagctggtttggatggaaacccatggatacacgtgtcaatccctgcgagcctttttcaatattggcagcaaaggagccggtgtag

SEQ ID NO: 11835 - DNA, 615 bp, A.fumigatus
ttttgggaagaggtcatgccggaaaaccccaacactccggttccggagctgctcgaccagactttcacttctgtggaccagcagctggagaagctgccgttgaaaaacagcgggtgtaccgcagtcattgctcttctacgctgggaggacagagtccctagctctcattccgtgaccggctctgcagcattggctccagccgctgtcgccgccgccgccgaacccaattcggaagctgacaacaccccaacccaatcagcacctgtatctgtgctcccaacattgcaagagaaagcctcccgtcaacgagttctctatactgcgaatgttggcgacgctcgcatcatcttatgtcgcaacggtaaagcgctacgattatcttacgaccacaaaggcagtgacgaaaatgaggggaaacggattgccaacgccggaggattgatactccacaacagagtaaacggagtccttgcggtcacgcgagctctaggtgatgcctatctcaaagatcttgtgactggccacccgtatactacagagacagtcatactacccgaccacgatgagtttatcattctggcctgcgacggggtgagcattctatctctttactag

SEQ ID NO: 11836 - DNA, 918 bp, A.fumigatus
tcttctttccttcccaaagggctacctatcaagctggcaggtaataagagaagaagtttttctagccagggtgggttgctgaacagaatgttcagtggctcctcgagcccacccaaagataaactagaaacaattccacactcggaggccatcactaccccgtccctgaccgtcaagaccgacgaagctaccgtatctcagaagaaattttctcctcccagtggattctttggtcgcagagcgagcgacgaacccagtcctggcggcgagaagaagaggagaagcagtaccgtcaccaaagcagcgacattgttctccaacgccaaaaactcattaagttggagcaactctcgtgaaaccgctgcaacccttaccgtggctcactcgccacctacttcgttacacaaacttgggagaatggatccggcattgattgtccctcaagggtcgttgaacaattctgccggtgaatcattacccaccccgcgctcatcattcagagttggtgtcacagaggaccggaaccgaagatgtcgtcggactatggaagatactcatgcatacctctacaacttcttggggacgcccgcaccctctggccgggctgatgtcaatggcagaaggcagtccggtgatgtctcgccttctgctgcagaagagaccagcgtcgtcgaaactgataacgggtatttcgcgatcttcgacgggcatgctggcacattcgctgccgaatggtgcgggaagaaactacatctaattttgggaagaggtcatgccggaaaaccccaacactccggttccggagctgctcgaccagactttcacttctgtggaccagcagctggagaagctgccgttgaaaaacagcgggtgtaccgcagtcattgctcttctacgctgggaggacagagtccctag

SEQ ID NO: 11837 - DNA, 213 bp, A.fumigatus
  unsure (3): Identity of nucleotide sequences at the above locations are unknown.
aanaccgatcgggtcggaccgcggggtttgacgacctccttgaaggggattgtggtcaacccgaatcaccatgcaagagggttaatcagtggtgaagcgagcaaggccatgatcaaccagcattttggaggcttcgtgagcatccggtatattcggtatcagatctaccgtttcttggtcaccacatacgtcccacaactgtcaaaacattag

SEQ ID NO: 11838 - DNA, 195 bp, A.fumigatus
gcactgctcttgtgcatcttgcataagcaagctcataatagttatgtgattctctatggctactcttcttgcctcgtatcttatcagtctgcctggccgccaatggtctacacgaacggcctctcagagtttactttcctcgtagcagttgactcctttcctgagtttgtccacgtccacgttagcatggatgag

SEQ ID NO: 11839 - DNA, 636 bp, A.fumigatus
aagaaaattcatcagcttggactggaactccatcagcgagaattgcttgctatgagctatgaaatgctccaacaaatcagtcttcgctgtttcaacgacttgcggactgttttcctcgttcatgacaagcgcatgctaggcctcgtcctcgaagagctggattcccttgtctcgcgcaacgtgatttcattgcaccaagctaatatcctcaacaggggactcgtccacacgattatccccggatcgactaagctggagaactttattgtaacttgtcaatcagataccctgttcaaggacaagcatatgctcaagccagttcgtagcggcaagggcaagggcatcttgttcggtgatcaaatcagccaggatgagtggctctctattcttcagggtatgcgagacccgtttttggagaatgggaaaacgacatacgttgttcaaacacaaattcagcaacgacgatatgatgttctgcttgaagaagggaaagggattgggaactttcctctcattggaacattccatatcacacatggtgtattccttggtcttggcctttggcgcagtggccccggtcgtatctgtgccctaagtcgtggaggatcatggttgtgcaccgtgatccaacagtaa

SEQ ID NO: 11840 - DNA, 399 bp, A.fumigatus
gttagacattatcaacaccctggacaccgagaaaaagtttgccatcctgcgttgctactcatcatcatggaagtccaagttcccacaaaaagcctggcctctctgcccatcatcgacttcgaagctatcgccaacaaggatgtgacagaaattcaaaagctcgttcaggcaggccggacccagggcatgttttatctgaacctccaaggccctcggacaaacggagtctttgatgatattcccaccttatttaaagccgggaacgcctttttcagtctccctgctgattgcgaagagaagaccaaagcccttcgaacgggggtggagcgcgggtactaccgatcctgcccagcttttagttcatatttgctaatgaatcgtcagttaccaccccagtaa

SEQ ID NO: 11841 - DNA, 576 bp, A.fumigatus
  unsure (503),(537),(569): Identity of nucleotide sequences at the above locations are unknown.
attcctcgcgatgagtacgctgctggaagctgggagttacatgcaaccctacaaccggaacaagagcgcatcgcacgaacaatggaaaccttccatggcgccttgcaaatagttctggctgaactttgcgccagtgtcggcatcactattcccgaattgagcgacgactccacaactcccagtgacaccgccctcaaattcgtctacaagttccccattcatgaacccggaaaggtgattaatggcgctcacactgattttggtcttgatacgctgctctggtatgatgaggaaactacacaagtggcaatatatgatgaaaatggggagcggacagaggaatggctaacaattcctgtggtggggggctcagtccttgtgaatgttgccgatgagctggcagctaggtctaatgggtccttgcactctacagtgcatcgtgtggttgcaccaccaggtgctaagagagtaaggaatggggttctctattttttcccggcctncacagagcttgactggcagaagatgagtccattntggaggtcatgtatgcagcagagatgcaattncagatag

SEQ ID NO: 11842 - DNA, 201 bp, A.fumigatus
ggaacaggctgcagatacctagttgttgtcgtagtggtcgctcctgctgctgttgacaatgtgggtggggcctgccatattcaggcatcaccactctttcaactcggctccatcaacccccactcctcactaattttcattctcatcctcagcctcacctcagtctatctaatccacatcttcatcctaggtcggcattaa

SEQ ID NO: 11843 - DNA, 489 bp, A.fumigatus
  unsure (403),(417): Identity of nucleotide sequences at the above locations are unknown.
gtaaagccgcgagcccatactccctccgacgacaaggccctcgtatccgttgtactcgagcagaaagaatgggagattctcacggcctacccgaccaaatcctttaccctcagagggagtagaggctgcaatgcggacggctccaggctcacccatgtcgctatcttgggtttgctgggtaagatgactggtgcagctgccgtggcgaacagtgatatcatcatggcggagaacggccggctgcgtttcgacgtcagcctcaaaggtctggggactctgggtatctacttttctgatctgcagaattggagtattgctcgaaatttcatggtgactatccgtggccgggctgtgccaagaaagacggtctggaaggaaagatgtgcccatgctaaggttctancggttgatgttcangcggcgtggaaagcgatgggattggatagtggttggagcaatgaggtccttgtgcaggtctttgttgggtga

SEQ ID NO: 11844 - DNA, 537 bp, A.fumigatus
acaagcggatcccaattattacctgaagcagctgtacagagtctgcgcacaaagctactacccctgacgaccatcctcactcctaacatccctgaggcgatactcttactaaaagatgccggggtggatgtacaactaccgaaggacctttccgagctcacccaactcgcaaagcaagttcgtgctttgggtcccaagactgtgcttttgaaaggcggtcatttacctcttacagcagcccacgaggcggcgcagaacccggaagatgcgtcaagagtgatcgatattctgtacgacggagaaaacaccacgctcttcgagactgaattcctcatgtccaagaacactcatggcactggttgctctctggcgtcggccattgcggctaatctggcccttgggaaggatatgaaacgagcagttcacagtgctgtccgatttgtcgaagcggggatcaagacgagtgtcgacatgggcaagggaagtggtccaatcaatcactttcactccgtgtattccttgccatttgcaccgtag

SEQ ID NO: 11845 - DNA, 195 bp, A.fumigatus
ctccttgcccttgggctaacgcacgtcagcgatcgtttccttgagtatgctctcgcccgacctgatgtccgtccgatatggaagaagtttacagagcatgagtttgttcacggcctgggcagtggaaagctccctgtggagcgatttaagcaataccttgtgcaagactatctctacttggtgcgaacgtcctga

SEQ ID NO: 11846 - DNA, 456 bp, A.fumigatus
  unsure (4): Identity of nucleotide sequences at the above locations are unknown.
ttgntgagaacccccattttagcctgtacggcgtacagccggtacattctcgatgtgggacaatcggaggattggctcgcactgcagatggctcttgcaccctgtctcatcggttacggagccattgccaagcgactgtacactgagaaagagacacttcgagagggcaatcgctattggcggtggattgagaattatgttgctgaagactacacggaggctgtccgattgggatctggtaagaatacattttttttttcttctcaacgtactcaagtgtatgtggctgacagaagtgttctagaactactggagacacacatacgacaggtctcacccagtcggatggaggaactaatcaagatcttcatccgggcaacggagctggaaatcagcttctgggatatgggattgggtgaccacccacgagcgcacatgacttcgttgagcgcgtag

SEQ ID NO: 11847 - DNA, 384 bp, A.fumigatus
attacctcttctcccgccatgtttgacacggtctgcactctcccgctctcagcggacctgttctcccaggcccttcatcctaaggagccaattgtctccgttggtctgtctaccggccacgtccaaactttccggcttccatcggaggagagcgacaccgacaatgacggggcggagtcgacttcctcatcacgcaatggcaagggacacattgatacgatgtggaggacccgccgccacaaggggagctgtcggtgtttagggttcggcgtggatggggagatgctgtattctgcggggacggatgggttggtcaaagccgcaaatgcggagaccggcgtggtggaaaacaaaattgcgattcctcctgcgaatgatgggtga

SEQ ID NO: 11848 - DNA, 900 bp, A.fumigatus
  unsure (50),(72): Identity of nucleotide sequences at the above locations are unknown.
ttttgtggcagatcggtcgacgctccgacaatcgttcatgcgctctcccntcagactctcctcctcgctacngactctagcgcacttcatctctacgaccttcgaattcccttctctcctgtgtctgctcggccacagcagacccatcatccacatgacgactacatttcgtctcttacaccgctccctccctcggataccagcacgtccggcttcagcaaacaatgggtgaccaccggtggcactacgttagctgttactgacctccgccgcggggtcctagtgcgcagcgaagatcaggaagaggaattggtgagctccgtttacatcggcggtttacgcgcgggtggaacaagccggggtgaaaaagtgattgtgggaggctccagcggcgtcttgacactctgggagaaaggcgcctgggatgaccaagacgagcggatctacgttcagcgggaagccggtggcggagagtcgctggagaccctggcggttgttcctgacgagctcggaaagggcaagatgattgccgttggcctgggaagtggtggagtgaaatttgtccggatgggtgtgaacaaggtggtttcggaagtcatgcatgacgagactgaaggcgtcatcgggttgggattcgacgttgaaggacgcatggtcagtggcggtggtcagattgtcaaggtctggcacgaggccgttgactcggatgaaatggacggcgacacaattggcgggaaacgcatgtttggcagtggcagtgacagtgacgacagcgacgatggtgacgactcggatgatagcgatcgtgggagtcgcaaggcagctcagcctcagcgaaagaagaggaagaacaagggcaagggaggccaagatatcatgggatttgccgacattgattga

SEQ ID NO: 11849 - DNA, 996 bp, A.fumigatus
tttaatacttgggggtacctcacaccccgctatccggttcctgattgctgtattcatagtatcgggggtaggaactggatattggatgcttcctggaatgcatggattggtgccatgcacaacagcagccagttgatgggaatcttgcacgcattttacggactaggtgcggttgtggcacccataacggcaacatacttcatcacggactgcgattgggagtggtacgagttctactatgcaatggcgattgtagcaggaatggaattcctgacctcggtggcagccttctgttcttcgacaggatcgaaatctaaagattcagatgcctgtactgaagaaactctgtcatccgatagctcagataatctcatgtccagcacaccgacaaggaaacccaccctagagtcattgaggattccatcgacttgggtaataagtctctttctctttatctatgtcggagccgaggtgactgttggaggatgggtttttaccttcctagttgacctccgaaacgtgcctctgtctactgcaggttttgtgagcttcagctactggggtggacttacggttggtcgtgtgtgcctcggcttcctcactccatttttcaacaggcagcgcctggcagttattctttacttgggttgttgcattttcttacacattacattctgcatcgttcatgacctccgcttgctagtcctttcggtgaccttgcttggtttcttccttggccctctctaccccgaagcagttattgcccaagcaaagcttctgccaaagtctctccatgttgcagctgtcggctttgcttgcgctttggggagtgccgggggttcagtattccctttcattactggcgcgattgcaaagggttatggaattaacgtccttcagcccattgttcttgtaatgctagttctttgtttagttctatggcttgtactgccggaaaaacgtgaacacagcagaaggcaagcatctccagtctga

SEQ ID NO: 11850 - DNA, 1269 bp, A.fumigatus
tattttgaacatttatcgactcgctcctcgacttcgcgcccatgcgataggtggtgttcgcacattgagtttctaatattgtctatcacgccaggccatttctccatgactgctgttgcatcaccgcctagtgtgcaagaaggtcctcgcttgggatggtacgactctggtaaaggaggacaaggagccctgacttcaatgaacgacgaagtttcacggatgttcatgccacggaagtcgattcagagatccaactcctcgtcgtcgttaggatcaaactcctccacctccaccgtagtcgccggttcacaaaacgttcatgcagtacaaagtaacaccgctgaatcttgcacctggtcttcgaagaaaaagtcctccaggagcatttggccgagtaccaagtctgaaccggcaactggagtgagtaccacacgcacgcaggtgatgcctgcattctcctctggacccggtgctacttcggccatgtccgttctccatcagccttcgtctattgttccctcgcagcacatgctccagtcttcccagcaaaacggcgtccgcgctggcagcgcgccatctggggagccgccggccatattgacgcttctgccaatcaacggcacctttgagaagaagcagatcactgttcctttttacccagatgttttgcgaattggacggcaaacaaatgcgaaaactgttcctacccctgtgaacgggtttttcgattccaaggtgctttctcgacaacacgcggagatatgggcggacaagagtggcaaaatctggattcgagatgtcaaatcgtcgaacgggacctttgtcaatggccagcgcctgtctccggagaaccgcgagtcggaaccacacgaacttcgcgaaaacgacaccctggagctggggattgacatcgtcagtgaggatcaaaagacgatcgtccatcacaaggtctccgctaaagttgagcacgctgggatctatgggactatgccaaacatcttcgacctcaccctaggagatttggatcccgcttctggtaacggtcttctcccttccccgctcagtcagcccctgtcacatctccgagggcggtctgggagcgcgatgagcaatagaagctcacaaagcgctgcgagcagtcaactcagtgcattgcagcagcaacgtcagatgaactactggaattctccaatatccatcgaacagattgtcaagcggcttacagtacgtttgttgctcgcctttcctccaaaggttgcatcccactaa

SEQ ID NO: 11851 - DNA, 1296 bp, A.fumigatus
aagctcacaaagcgctgcgagcagtcaactcagtgcattgcagcagcaacgtcagatgaactactggaattctccaatatccatcgaacagattgtcaagcggcttacagtacgtttgttgctcgcctttcctccaaaggttgcatcccactaattcctttttcttgtgtccagagtgaaatgaaacaggcaaagcagcaagctcaagatgtccggcaaaccgatgaatttttgacttctttgacgaaacagggtcaccaagaaagagagaaagcaaagcactcgccaccagacagtggtgtctcgcgtcaagtcaacggcagacctaaaatgccgcgcgttgattctttctcaagattctcagatccccctgcaccaccaccacagcaaccacttcccgaaaagcctgatgcaccaccccgcacgggtgcagatgcattctctcctctcaaacggtcagatacagagaagccgaaattaggttcgaataactctcctgcttcgcgtgagtccagtcaaattctgtctttgattgaggcattgtcgtccgccaagcgggagctggatagtcagggtgcccgggtaaaggaattggagactctattgctgcaagaacgcaacgcacgggagtctgcggaggaaaaggccagaaatctggagctgcaagcaaagggcgtcaacggagaatcgctcgaacagggtatgaatggtcggtctgatgatgcggcgatcagcgagaagcacgcgcatgagcagcctgccaacgcggaattgcctcctaactcgggctcagacaaatcatctacctcagaaagtctagcagacactcaggcttatcatttgcaacttcgccttgaaacgatgatggaagaaatggaggaaatgaagaagcaagtcgcaatgtttagaagtagggcagaaaaggcggagagtgagacggcggaagcgcgcaagtctttggcggagatgatcgagactctgcggcgtgagcgtgcagagaagtgcgaactaagcaacgaatctgcagcgaaggacattactattactcgcgatgattcggcgactgccgatgccggctatgttgccggcggagaagtcgaggagcaagcgcatccaaatacaacaccgtcatcgccctataccaacgtcaataattctggcacggcgttcgcgaaacagcccttgaaacacgatgttctggaacagaccagcccgtatgcgtcgatgcttggagtggtgcttctaggggtaggccttatggcatacctgaacggatggcagaagatggacaagtaa

SEQ ID NO: 11852 - DNA, 984 bp, A.fumigatus
gctctcaatcacaagatgagggagaaagccatggctccctcagagactactccgctccttgtcgtgaatgtcgctccgcagcgatatcgatacccccatcatgccttgcgacgggcatgcagtttctccttgatcctgattcttttcatcggtttgattctgttcttaattccgtttcctatcctgccccgcgagcacggctctctctggtcgtatctccctggtgccagcccgttcccatacccgtcatggcccaacagccccggcctcacgtatgagcagctgcaggctgttcttcagagcacaccgtcagccgcgaaagctcgtgaatggagcagttattacacggcaggtccgcacctagcaggcaaaaacctcagtcaagccctctggacccgtgagaagtggcaagatttcggtgtaatggacacggaaatcgtcgcttatgatgtctacctcaactatcctgtagatcatcgtttggctctgctgaagaaggacggggataaaaccgatgtcacctttgaggcttcacttgaagaggacgtccttaaagaggatcacacgagcggccttcccgatcgcgtgcctactttccacggttactctgccagcggaaacgttaccgctcctttcgtctatgtcaattttgggacgtacgatgattatcaggacctagtcgatgccaatgtcagtttggcgggcaaaattgctattgcaaagtatggtcgcatctttcgtgggctgaaagtgaagcgggcacaggagttgggtatggtcggcgtgatattgtatgatgatccccaggaagatggagatatcacggaggacaatggttacaagccgtaccctgagggacctgctcggaaccccagcgccgtacagagaggaagtgcgcaatttctaagtatgtcttctttcaccttcggtcctcaagccttgacggatactgaccattctgcggtaaggcatcgctcccggtga

SEQ ID NO: 11853 - DNA, 843 bp, A.fumigatus
  unsure (4): Identity of nucleotide sequences at the above locations are unknown.
gggncggacgcgtttccttcgagccctgcggttaagacggcctcctccagtgcttcagaatcaaaaacgggtagtagctcacagaaaaccaaaactaggtccagaaaggaagctgttgacagggctccaagctttatggtccccccggatatcgacgaccttctgccttcatcgtctggaaatcgcacgaagcccgagtttattgcctctgcttccattcctaacgatacgatatctagctcctctggattcgcatcatccgcacaaatatctcacttctttgattccgacgacgactgttcaagtggcacgtctctcagttcagtgccagaaaacttgctggaagaattctcgcagatggaggatgtctttctctctgacatggacgactcggaaaatacggagttgaaacaatcgttgtgtccctggtgcaagaagactgtcgattcagatgctctgaggaagtttcgggcgcaaccaaaacagcggatttgcgagcaacagcaattctgcgagtcgcatcaaaaggagacggcggagaaagaatggaaagagagaggctatccagacattgattgggatactttcgatgagcgcatcaagtgtcatttcgacgatctggagagtatcttggtacctgaaggcaactcatactacaggaatgttcttgatactatgttgaaatcaggaaaggcaaagaacttccgcctaacactcgctggagacgccctagagacgatctgttgcggttattacgggactcgaggggccaacaagatgtacagtcacctactttccctcctcaccttcaaacgctgtccaattattaacccactctcttga

SEQ ID NO: 11854 - DNA, 2295 bp, A.fumigatus
agacccgagcaacggattgatgacgatgtccgagaagtatcaacatacagcgaggccagggaatttccgaagatgcttcatacaccaacctgccccgagtcctcgagtgcatggacaatgcccgaattcacgcttcacaagatctccttgaatagctcgcagcttcccacaagacgaatgtcagatggggacgtttctcgagatggagagttcgtcgcaaaatctgatcctctatcctccgcattcgacgagggaagagcagctcagacaaatttcttatgcgagttaccctcgggaattagaggcgcttgctcacctgagttcctattcctggtatcatcgttgatcgagcaactgcaaccgagtcacccgattgagataatcgattcgctgcagaaggatgttatatccgacatagttgctcatgataagtcaatgaaacaaccgaaacaatcgacgagcttcgcgattcgggctccattcatcgttgcgaaaatggtcaacacttctgactcccctacggatcatgagttgagttttcgagatgagtatagcatcgagatttccaacttgagaacagaattccggacgaggattgaaagacggaaaggtgatcttctagccggaatagatagaaaattcaccgttcatgccgcagcccagaacctcacgggtcttgttgagggcggccgggcggatgcatttcaggagaaagctgggtttaggtgtcttcttagtgacttggatttttggctggtgacagcgcccatcactaggtccaaccttcaggttcgtgccttcgataccatcagctccacgaaatcggtggagcaacttgctgtcctcgttcgtcgggcaacaactatgtttgattctgttgcctggtctttcgaacgtagctcctctgttggcagcaagcgacttcgctatataatatattccctcacccaatcggcaggaaacatccctgatcctgcgttcctcactcgcatttcacatgttcttagggttgcccccactcatctacggcagcacgattcatggaaaatcatttcccgaattcgcaatgtctacaataatctaccagtacatcaacagagagacctgattttgaaatgctccactgacaacacctcgattccggataatgcgaaggtaactgtattgtcaggttttgaccagtggcgtgcctgggacttggcacatgtacagaagagttatgtgatgcaaaaaatctgggacacatcagagcagaagccgtcagaaatacctacagcactagcggcgtcgcttacagtcaaaaactttcgcttctccattgatcctggaccgaaagagagtgactttgtccttgaggatctgtcatctgcattgtccatcagcacgcagcagacgttacttgacaagaagccgacgagagtgatagtttcacagacatattgctcatctgttggcctccacctgcggtgggaaattcttgaacttgttgatggtgtgctaaagacgttgtcttcggtcaaactagagtccgtatcttctgctcaggaatccgatgatcagcccacggaaaagaacgagctacatctcattttcgggattgactccggtttcataacactggacgggatcaacatcaaaatagcaatgcatagcaagggcttgaggagctcaatagtccgcaaattaaaagaagcggagaattccgaggccctaagtgtattacttagtgctcagatgtgctctgctgagctatccagtctttccaaggcgctgatggcttggaccgtcagcgatccgtatctatattcctcgcgcatcatggaagagaacaagaaggaactgacccacgactggaagattgctggatcttgcaggaagctgcgatatgatatgaaagaagatccggtgagcctcgcgcacacagccgatcgagtgatagcggatgaggttcggtaccttcatcggcttgctaagaatctcggtgactcctggccgagcacgagcacggtgatgaggaaaccagcttccaatgactttcatgtcgcaatgttcttggacgattatcggctgagtttttgtattctaccgtcgttgacctacacgattgccggcaaggtggcacgaatgtcaatcttgcccaaggcggaatccaagatcgaggtcgatttcgacctcaagaagaatttccacactttctactcgaacgaaggagacgagcgccgcgctttgtcacaattagggataccacccatcaatgggcgtgttgcagtcaacatgccgcccagtcttcaccac

SEQ ID NO: 11855 - DNA, 225 bp, A.fumigatus
gtacagtgttgttcgaacaatgcaagcgtatctttctacgatctattgggaaagtcatttctgagtgattgcaatatcagaacattctatgattttcggagatctaccttgggagatccggaggaacatgatcagtgcgcccccttgtgtctcaccgagttcacccggctaactgtcaatgccgctgtgagagtgaacgtcatcaatagtctgatggtgagttag

SEQ ID NO: 11856 - DNA, 282 bp, A.fumigatus
ctgactgctgtttcgtccctgttttctacagtcttcttaaagtgttattgcacatcaatcgcccccaaaatgcctgaaaactacggagactttcagacggagatctatggccgtggtgctttgatgggtctcaagcccaatgtcaccaccgaccctcgtctgcttgaagaacaggcgcgcaaagctttaggagcacgatcattcaactatgtcgctggcggagcgggcgaaaaagcaaccatggacgccaatcggctggctttccgtcaatggaagctgtaa

SEQ ID NO: 11857 - DNA, 780 bp, A.fumigatus
atggctaaccagagtttaactgtaaacctcttcggccaggagtatcccacccccatcctcatggccccagtgggagtccaaagtctcttccacgaggacaaggagacgggccttgctgaagtatgtgctgaggtcggagttccatacatccttagcacagccagtagcagcactattgaagaggtcgccgaggcgaacggagatgggaaaagatggtaccagctctactggccccaggacgacgacgtgactatgtcattgctgaagcgcgccaaagagaacggcttctctgttcttgtggtcacactagacacttggtcgcttgcatggcgacctgcagatctagacaacgcctatgtcccgttcattgatggagtcggcaatcagatcggcttcagtgatcctgtctttcgcgcaaagttcgaaaaggatcagggcttcaaggtcgaagaggacatcgtcggggcatcccgggcgtggatcggggacgttttttcgggcaaacctcacacctgggagcaaattgctttcctgcggaagaattggaacggtccaattgtcctcaaaggcatccaacatgcggaagacgcaaggcttgctctgaaagctggttgcgatggcatcattgtatccaaccatggaggtgagttagcccatcacagagaaaaagcgaaggccctaaaacaagctcacttcttcctgtctgacaatgcacaggactgcacgtctattgccctatcggctcactggacgtgctccctgataatgtggacgcagtaa

SEQ ID NO: 11858 - DNA, 240 bp, A.fumigatus
catagtcacgtcgtcgtcctggggccagtagagctggtaccatcttttcccatctccgttcgcctcggcgacctcttcaatagtgctgctactggctgtgctaaggatgtatggaactccgacctcagcacatacttcagcaaggcccgtctccttgtcctcgtggaagagactttggactcccactggggccatgaggatgggggtgggatactcctggccgaagaggtttacagttaa

SEQ ID NO: 11859 - DNA, 276 bp, A.fumigatus
cagcaaaggaaaaaaaagttttggttggttttgaacgttcagcccgccgtattgatagataaccatcgtgaacccaatcagcatggaatcttggcatttggccactgtgacacaaagtccatcaacttttttcttctcgcgttctcctctgaccttgaatctttcgctcacactttgaaatttgcttttggaaccttccatgtcaattatgtaaaccatagcctagcgatttctgtttgtctcccgtccaaggcctcattattggtgatcacctga

SEQ ID NO: 11860 - DNA, 717 bp, A.fumigatus
acttgttgcaaagagggaaagttgatctcaaagtacttagcaccgggatggaagggcccggctgtaatagtttcgaggagctcatattcgtcgaagacgtattctggactctgctcgacggtttcttctgcttccttttcttcttcttcgaccgtctcatcagtctccccaacgcctgaagactccgcctcagagggagcttcgacggcgcgatctttgtcattcaaaagcaaagcgcgggagacaatcatcatcttcaacgcgactctccagatatcgttgctgtgtactccctctttctttaaagcctcaatacacactctcttggcgagtctggcgtgctcgatgtccagctttttttgcagcttgcgctgtgccgcattctggccatcgtccccactaagctcgtcgtttgcagtgtcatcgttagacttgtactcgcgcaccaactcggctttgtcaaggagcttgcattcattcggaccaaggccgtcattcgggagccatatgatgcccttgcattgttctgcttcttctggcaggatgggacctttgccactaggtagaaaagccaagagctgctcaggattgcgatgcatgctcaacatgcttgacaggtgcacagcgcaactgctggtcaagttggtgttggaaatgataaggaacgggaccgagcgcaggcctcgagtgcaggcatatcgctcgagctctgcatag

SEQ ID NO: 11861 - DNA, 1137 bp, A.fumigatus
cgatatgctcttttaggttcttctcaccctacttgcgccacgaagaagctgacctatgcagagctcgagcgatatgcctgcactcgaggcctgcgctcggtcccgttccttatcatttccaacaccaacttgaccagcagttgcgctgtgcacctgtcaagcatgttgagcatgcatcgcaatcctgagcagctcttggcttttctacctagtggcaaaggtcccatcctgccagaagaagcagaacaatgcaagggcatcatatggctcccgaatgacggccttggtccgaatgaatgcaagctccttgacaaagccgagttggtgcgcgagtacaagtctaacgatgacactgcaaacgacgagcttagtggggacgatggccagaatgcggcacagcgcaagctgcaaaaaaagctggacatcgagcacgccagactcgccaagagagtgtgtattgaggctttaaagaaagagggagtacacagcaacgatatctggagagtcgcgttgaagatgatgattgtctcccgcgctttgcttttgaatgacaaagatcgcgccgtcgaagctccctctgaggcggagtcttcaggcgttggggagactgatgagacggtcgaagaagaagaaaaggaagcagaagaaaccgtcgagcagagtccagaatacgtcttcgacgaatatgagctcctcgaaactattacagccgggcccttccatcccggtgctaagtactttgagatcaactttccctctttgcaacaagttcaacaggctcaacaaaccaacggccatgacaaagacgtccagtctcgagagacaaaggaatttacgccgccgagccagcccactcgctcaggaaagggtaaaagccatcctagttcggtcgctcgcacctctcgtaagcgagaatggcgtttcggactgccctttgctttctggcgtcagattatcgcggatgcagtcggcgctgacggtattctcagttaccagcagcaagtccgcatcatggcttacgctgccgattggaatgctgtaagctatgagctgaccatcaaaggagcagaagatcatcagcagatttggaagttccttgagactgtcaaatgcatcacctacagctctttgacttga

SEQ ID NO: 11862 - DNA, 813 bp, A.fumigatus
  unsure (813): Identity of nucleotide sequences at the above locations are unknown.
cctccctggaccacggatcggacagcaattgagttactcggactagaagcgataggaaaggtgaattcaacaaattctttcctgtccgcattctgcgcatcgcataccaacaatatgatgaaaaacaagagaacaaacacccaaccgctagaagacgcatctaccgcgccggcgaccttcaatgacggtcttcctcttccaaaattaattgcatttgacttggactatacattatggccgttctgggttgatacgcatgtcagcgcacccatcaagcctcgcgataacaattctcgatgcgttgacaagtatgtacctgattcaagcgttggtgtccatctccatatcctcttactgactcaggaccttcgccacagatggaacgaatcattcgcattctacccagccgtctcatcaattgtgtactcctgcaagactcgctcgattccccttgcgatagcttctcgcacgcatgctccagatttagctcgcgatatgctgaaggcgctccatattatcccgacattctcggacaatcctgcggccaaaacgaagtcagtccgcgctctggattactttgactacgtccagatcttccctgccaccaaaacacaacactttgcgaaaatccagcaagccagcggaattgcttacgaggatatgttgttctttgatgacgaggcacgcaacaagaacgtcgagaccgaattaggggtcaccttctgtctggtcagagatgggatgaccaaggaagaagttgatcgcggggtctgggcctggagaaagcgaaatgggatcaaaccaggggcatan

SEQ ID NO: 11863 - DNA, 288 bp, A.fumigatus
  unsure (31): Identity of nucleotide sequences at the above locations are unknown.
gggccgggggcgggattttatatcgacgccnctcgaaccctgcgtgaagacatcctggcgcgtgtttacatgcaaagcgacctggactttctggaagccgatgctgatgcggtcgttgggataaacggcgagggagaccacgaaggcgacacaatcgcagacggactggaaaatctcaagatcaatggcaaggacaacgaagctaccaagaaggtgtcctcgaagcaatcgcccaagaagagcaaggttgcacagcagaatggtaagtcaagcattcagtcatcttaa

SEQ ID NO: 11864 - DNA, 201 bp, A.fumigatus
cccgagattggcggagcctccaggataattatgacttacggaatccatctcctcatcaaaacctcgaatctacctccagttgcactcaatcagcaaagtgacattattcgaaacccaatccgccccaaatcaagcattagtacctaccatcatatcattaattgctcttccaactttgcctggataatttacttccaataa

SEQ ID NO: 11865 - DNA, 933 bp, A.fumigatus
agacatgcattgattgagagtgattttgtttgccctggttgcgccacagaaggtgttttgcttgacaatctttcggtggatgatgaggccgtttcaaaaatcaaagcctttgaggatgaaaaagcggactcgagaaaagatacgcagaagaacctcacagtgcatgatagctcatccaacagtaaagggtctgattccgagagaacagtcgctggggagaaggggccatcatcgttgccgtcagtcaacgacgctctggactcggctacgaagaaaagaccggcggacgaaaatctcccgagcaccgaccatgaagggtcaaatttgagcccgtcaaacaagaagcaaaaagctgatctgattgctcaggcgggcaccgagtcgaccaacctacaaactcaggattcttcgaatgaggtctcgtccataacccacgaccagtcaatgccctttgggtttggctttatgaatccgcaaaacatgcctacaatgccattcactgaggctgggttcatgggcggaggaatggggtttataaatcctttgggctttcctacaagtggttttccgaataatttgaatcaagcatggaatccattgaataatccgggattcgactcccttcagaacggcatttatggtagtcaacagagtggtgcaatgaatggctacggtcaagcaaacatgtactccaacatgggaaatgcctcgatgcaaatgatgggcatgagccagcttgcagggcccattcctccaaatgcggggtttcagcagggaccaggcgttggccacttctcaaatcaacaacggacttcatttagttcgccattcgcgagagaagaagactccccgtatttccgacaacctgtcaatcctcaacgacaccaaggaagacaccgaagaataaggccaagtgattatcgtgagttataa

SEQ ID NO: 11866 - DNA, 1344 bp, A.fumigatus
atcactgttccttccggcggcgtgtgtgaagacgatgcagccatgacactgactgagaaccaaacccctcaaccctccaaggtacattctgattccccaattgtttctaacaagagggtaagcaatcaggatgaatctgtcccgcatcttactactggtttggggtttctgactggagtaggttctgtcgttgaagcatcggaactgccgaattccgacgctcaaacggatcagagcctcttcgcggaccattccttgccagtaactcatcaacccgactcagtcacagattcctcgaaaccgtctggactatcatcttctcttatggtggctgggtctccaatacgggcggccaacaatgaaaatgaaattgtcatcgactccaagacaacacacgtatctttgccacatcgatcttctccaaagcacaatgtcctcggagaacttacttcgaatgagccctcgcagcgggccaacaagcaaattcgacatgctgcgaacaaacttgaagatgaagtaacgacaccaattgacgaccattctcgtcatcgctggaagaaggtcgagatagcggatcggcggacgagtattagcccacgttccaaggatcccactaaggcgcaacagatgctcgacaaaggtattcaacgaattcgcacaaagactatggatattcttggatatcgcaagcttcaagggattatcaaataccatgattctatttttaccaatgaggagaaatacgatgaaatgttgttggcgctcttggacgaactggaaagttcgcctgacgacaagaggcaacccctcggccgacccctggacctgaagactcaggttctcctcacgatccgacttatgcttatccacaacaaaatctacttctcagcatactgttccagggctctgggtgccttagtgctcgctcgcaagtattatgatgccaattgtcatatcgtgagtggtttagaggaaacggccgatgatattattgccctttgcgagcctgctgctgttattgattctgttttggatgttatcattacggaggagaaagacgatcgcgagtatcggtcaatcctcatgggagttagtgtgttgactcggattctcagtcgtctgaatgccgacaagtgccgtgtaccggaactgcctttggaccgtctcggacagtttgctgccagcaagttagccgatcggcagcccgatgtgaggaggctcgcggttcaactatgtgtgcagttacacggaatggtcgccaacgaggaggaatactggcgagtattaggtcaccctcgggaaaattcccgaaacttgttgacttattatattctcaagaagtga

SEQ ID NO: 11867 - DNA, 246 bp, A.fumigatus
gactggaacctgtccgccgatgtcagcgatgttctcgctcaataccacgactttcaccccacgcttctgcgaatcatcaagtataactggtcaacatttagccaaaacaagacgcacactaaccaagcccagaaaagcaacgagcatcaaacgatggccgctcttttaccgcgatcctatcccaacctggtcccgcggccgcttcgtgctgataggcgatgccgcacacccaatgctcccccgtag

SEQ ID NO: 11868 - DNA, 186 bp, A.fumigatus
ggtatctactacagtttgtgggtaatctctcgtttgatgaagtacggtccaaataccaagaactataacctcttctgccaatattgtttaaaatacggagtatgggaggagcatatcaaatccggggtttccacagtgtcgttgctccattccagccactcttcaacagcagtggagatgggcgtc

SEQ ID NO: 11869 - DNA, 606 bp, A.fumigatus
gcatgccagattttcgaacgctcctcgtttctccgtgaagtcggtgcagcaatccatgtccagccaaacgcctcccggattctctcagactgggatttcgaccctaagagggctcgcttcgtgacgggtctgcgaacgatggtagtaccaggaacatcgctcacgtcaaacgtcggagtagactgctcccactttgttgagacgtatggcgcgccctggtatctggctcaccgggtcgacttgcacactgaactacggcggcttgcgacgacaccggacgggccaggattccccgtggagaccatcttgcgatccgaggtcgttggcttcgacgctgagaatgggtcagtcactctgacggatgggtcagttcatcaagcggaccttgttgttgctgcggatggagtgcatactaccgccattcaccaggtcatcggccatgctaccccagcggtcgccaccggctccgctgcgtttcggtttctgattccgacggaggatatccagggcgaccctgagacggcgcacctcctggaggatggtctgatgaggatatacgttgctgaaggtgtgcgacggctcatctggtattcgtgcgccgagtaa

SEQ ID NO: 11870 - DNA, 264 bp, A.fumigatus
ggtcgaaatcccagtctgagagaatccgggaggcgtttggctggacatggattgctgcaccgacttcacggagaaacgaggagcgttcgaaaatctggcatgcttagtttcgtcccaactcaacctgttctagcaaaggtttacctggaccctgtggtcagcacgacggagtccaatcgccgcggccagtccggcgattccgccaccaactataatgaccttcatctgagagtatcgggctctggcgtctatttgataagttaa

SEQ ID NO: 11871 - DNA, 225 bp, A.fumigatus
gatatagggagtctcatcatccgtaatcatgtctacaccttcaatagctcctgctcctgctccactggtgcccgcattggctgccaagccagccatctcaccttcgcctggtccgggcacacccgggtcgattacctccaaggaatgggttattccaccacgaccaaaaccaggcaggaaaccggccacagatacgccgcctacaaagcgcaaggctcagaatag

SEQ ID NO: 11872 - DNA, 855 bp, A.fumigatus
ggagtctcatcatccgtaatcatgtctacaccttcaatagctcctgctcctgctccactggtgcccgcattggctgccaagccagccatctcaccttcgcctggtccgggcacacccgggtcgattacctccaaggaatgggttattccaccacgaccaaaaccaggcaggaaaccggccacagatacgccgcctacaaagcgcaaggctcagaatagagccgcccagcgcgccttcagagaacggcgagccgctcgcgttaatgagctcgaggagcaaatcaagaaaatcgaagatgagcacgaaatccacattgcggcgttcaaggaacagatcaccaacctctctcgcgaggtggagcagtgtcggtccgagatgacctggtggcgcgatcgatgccatgcgttggagaaggaggtatcggtggaaagaagtgccaaggaagctattgtgaaggagttccgatcgtctctttcggacagggaggctgtaagatccgacaaaggacttgctcctcttaccacatccactccacaaacccgttcctccgaccggccagacaatggtgatgcgtccaacaatgacagtggggagggtcgagaggaggtaccgttaggctgcaatgattgctccacatcgcattgccagtgcattgaggatgccttcactatgccgggagttgtggctcaggaacagtccagacgtcttgataccaccaagcctggtctttccgagcctcagatcaagcccgacccggaagagatggaaattgatttcacttcccgatttgccgccactcaacagcaggatcagtcaccgacgtccgtttcgtctcctgccgtggatcccctgttt

SEQ ID NO: 11873 - DNA, 306 bp, A.fumigatus
aggaatttgttctttctagtcctcgccgcctgctcgtggcagcgtcctcacgtcatcgtcctcgacgagcccaccaactatctcgaccgtgactctctgggtgccctgtccaaggctctcaagactttcgagggtggtgtcgttatcattacccactcccgtgagttcaccgagaacatgataaattctgccttcaggtttctagacggaacacatacaagcctaggtacactaagtaataatgcaaaaaatgtatgtcttctgatgaaacagcttcatagtatgggagaaatgcccggggcataa

SEQ ID NO: 11874 - DNA, 1416 bp, A.fumigatus
  unsure (582): Identity of nucleotide sequences at the above locations are unknown.
agatgtcttccagaattcttctactccctcgatcgaaatctcgaggatgttgattacttctacaagaaaaaatttgcggacttttcccgtcggttgaagttgctggaagagcgatacggccattcgctgcataaagggcatgagcttgattcagaagatgtggaggatctcctggcggcattgctcgaactgcgtggtcaactgcgcaagttgcagtggttcggcgaagtgaaccgtcgtggatttgtcaaaattaccaagaagcttgataagaaggtcggcgtccaagcacaacagacgtacctggagaccaaagtggatccgttgcctttcgcctcgaacgcaggagtcactgagtcattgaagacaatcaacgattggctctccgtgcttggagaccagaaggccatcgacgatgcaagctccacgagatcctcgctttccttgaagaaaggaccttcgcgtcccaatctcaatctgcccccaagcgtgctggctgaagtggacgaagcattgcgcaaggatgacacacatgttctcctggaactaatggagacgctgaagaaagctgcggatgatatncgagaagccgtctatcccaagggcttaaaaagtcttcttcagccgtccatttactatcgttccaaagcatgcatttcagtccttcttggccgaattgactcgctcgacgaggaggacgacattaataagcgcaactgtattcatcgtctggtcatttctatcggacgggcgcagtcgtctactgactcagagtcgtccgcctcgatggtgcttgatttttctctggaaacctctcattacatcacccccgctgctcttccgaccatgcagccaccgcgaccagtggtaaaagaggcgaatcatccccagattctgggcagagacgatccttcagtttcacttttgcaatttattctggacgaactccagccccatcagcgcggcgcattgctagccaaagacctttctggacgcacccctctgcattatggtgcacagtatgggtttaaagtggtatgcgaggtcatcattgaacatctgcaagcttgggatatgtttgatgttcgtgaaggcattgatgcgccgcagtggcaggataacgatggctgggctcccttgcacttgagtgttgttggtggtcacccgctgacgacgcggacgctattggaggcagagaactggcagggtgcttccgaggagaaagcctccatacggaagcacgtgtcaaaatccagcgcagtcttggcattagccaccaaggcaaatttcgtcgatatagtgcaactccttgtggatgctggtgttgacatcaactaccaggatgagcaagggcgaaactgcgttgcatgtgggccctccgtttggtcacgatgcgtgcgcaaagatcctacttga

SEQ ID NO: 11875 - DNA, 210 bp, A.fumigatus
aggttacgattgcagcctttcatcatgaagtttgggcgtaacttacctcgaaatgtcgtgcccgaatggagcacttcgtacatcaggtacaaggccttgaagaaactgatcaagtccgcggcagaggaggtgaaagctggctgtgaagcggatcttgcgggtgggtttcagtctccttgccatacgccccatggcgaaacgacctgctaa

SEQ ID NO: 11876 - DNA, 711 bp, A.fumigatus
acaccaaccaatagtcttaggcacgattccgggcttcacatatttggaggttgcagaggaggtggtggtggtggtggtggtgctgggcaaaggagaagaggagacgtgggaggaagatggatggaaaagacgggagctggaaccggtagggctcaccgtgacataaacggtagacgccgcagcgctggggcaggtggacggcgtgggcaccggggcagggtcgacgcagggctcgacaggctcggagacggtgaacttgtcgccctgcgcgaagatgatgtagacgttggtgccgttgatgccgctgatctggtagccccattcggggttggtgtcgcaggggatctgaacggagtaggacagatcggccgtggggatgtccagggccagcggcacataagtcggaggccaggagacaaagttccaaaggtagaggctgaagttggtgggatcggtgtcgacgctggtccaccggacggccacagtggaccccgctgcgtaggtggtgttggctgcaggactggtgatgttgatggccgcagccagcgagccaagcgaaacaaccagggggatcacggagcgcatcatgttgatcctcgtgttcttattggtttgatcttggtgggtatgggtttcaggatctactgggggaagcaatggtcgatagaacaaaaaacacgtctaaaaacgaatggacttgaaaaggagtga

SEQ ID NO: 11877 - DNA, 312 bp, A.fumigatus
cagtccaacctcttgatctatgccaacagcaaggtccccgagtccctgaagtacccccatgacgccgtcggccacgactacgacagcgtcggcatcttccagcaacgtgctatctactaccccaacatcgccgctgacatggaccctgcccgctccgccgctcagttcttcgccaagatgaagaagatcagcggctggaagacgatggacgtcggcaagctttgccagaaggtgcaagtctcggcttatcccgatcgctatgctaagcgtgtgcccgaggcgaagaagatctgcgctgctggcggactgtaa

SEQ ID NO: 11878 - DNA, 237 bp, A.fumigatus
  unsure (37): Identity of nucleotide sequences at the above locations are unknown.
cgtgcggaggatctttcaccggttatgttgaccccgntaatgacaaacaggcaaccatgcaaccccaactttgtccaggcccgtgacgccatcctggatgctgatactgctctgactggtggcgagaaccagtgtgagatttggacgccatttgccaagcggggattgggtgctggggcgaagtatagctcaaggaaccgggtgggaagtactgaggtccccagtggtgtctgttga

SEQ ID NO: 11879 - DNA, 843 bp, A.fumigatus
acgtgttttttgttctatcgaccattgcttcccccagtagatcctgaaacccatacccaccaagatcaaaccaataagaacacgaggatcaacatgatgcgctccgtgatccccctggttgtttcgcttggctcgctggctgcggccatcaacatcaccagtcctgcagccaacaccacctacgcagcggggtccactgtggccgtccggtggaccagcgtcgacaccgatcccaccaacttcagcctctacctttggaactttgtctcctggcctccgacttatgtgccgctggccctggacatccccacggccgatctgtcctactccgttcagatcccctgcgacaccaaccccgaatggggctaccagatcagcggcatcaacggcaccaacgtctacatcatcttcgcgcagggcgacaagttcaccgtctccgagcctgtcgagccctgcgtcgaccctgccccggtgcccacgccgtccacctgccccagcgctgcggcgtctaccgtttatgtcacggtgagccctaccggttccagctcccgtcttttccatccatcttcctcccacgtctcctcttctcctttgcccagcaccaccaccaccaccaccacctcctctgcaacctccaaatatgtgaagcccggaatcgtgcctaagactattggttggtgttcagactacgcccaccctgtgaccttggacaaggttcccaccccgactccggccccgattatgacccccgcccctggtgagggcagcggtggtcgtggtcctcgtgtcaagaccatcactacgacagtgagtgtcgaggcttgtccgatcgatgcgatgtga

SEQ ID NO: 11880 - DNA, 420 bp, A.fumigatus
tccccctggttgtttcgcttggctcgctggctgcggccatcaacatcaccagtcctgcagccaacaccacctacgcagcggggtccactgtggccgtccggtggaccagcgtcgacaccgatcccaccaacttcagcctctacctttggaactttgtctcctggcctccgacttatgtgccgctggccctggacatccccacggccgatctgtcctactccgttcagatcccctgcgacaccaaccccgaatggggctaccagatcagcggcatcaacggcaccaacgtctacatcatcttcgcgcagggcgacaagttcaccgtctccgagcctgtcgagccctgcgtcgaccctgccccggtgcccacgccgtccacctgccccagcgctgcggcgtctaccgtttatgtcacggtga

SEQ ID NO: 11881 - DNA, 510 bp, A.fumigatus
tctcgcacaatctcatcaaggactctcttgacatcaaccgacatcatgttgtaccttcctctcgttgccctttcctttgccaccaccctggtgagcgcataccccatcactggcaatggagtcaactgccgctcgggccctggcaccaactaccccgtggtcaagtcttaccccaagggccatgaggtctccattgtctgccaagcgcccggcaccgacatcaagggcgacaagctctgggacaagacctccgacggctgctatgtcgccgattactacgtgaagaccggcaccaccggctatgtcaccaagcactgcgatggcggcagcgatggcggcagcgatggtggcagcggcaaccttcccggtctctctgcgaaacagtcctctcacgcccgcaagatcatcggggaggccaagaaggaaggccttggtcggcagggttgcctggctgctattgcgaccggcttggtcgaggtgagtttcaatcctctgactccgtgttgttga

SEQ ID NO: 11882 - DNA, 240 bp, A.fumigatus
gagcgtactttgcggaactcgaggctcttactaaatgcgcggacagtgggaaaacccgctctgccccaatcctggcttctctatggcacccaggcacaaaacaatgctgctggcgaaaatttcgtgaaccaaaacctctacaaaaggacaagcatcatccctggattggtctctgagccatcctattacactgcgacctcaagctacgatagtgttcattgtcgacaagagcgagcctga

SEQ ID NO: 11883 - DNA, 687 bp, A.fumigatus
agactactttctatctcgccgcaatccatctgctggccagctccgtttgcggtctcccgctgcaggacagccagatcccaggatacctcgacgctcctgctggcagagcatgggttgagaagcgccagagtagctcctggaatcccccagctaatctcgtcaagcctctcaacgaggtacatatcccatctcacctctagcctaaaatcccccaatctaacatctgcccacatccaggtctgggagcaccaaatggccacctacagcgacccgatgggattcaagaactacggcttcgaccaggtaattgccggccgtggtcaaataaattactgcgtgcgatgggactcaaaccagaaggtaaccgccgcacaacgcgagcagatcgccgctgcggtgacgcgctccttcaacaagtggatcgctgggctcgccgggttcgacggctttccgtataacactgtcgaggtgaacgtcgtcggctacgccgtgcgcgataggtcccttctggaaggcgacacctcgggactggacatctacaccaccacggacgaaggcgggattccccattgcgatccgcggtgtggacggttcttccaccatcacggggattacagtcagtgtccgggcggtgcgagccgtcactacggtattgtgctcttccctgcggtaaattactgtggctaa

SEQ ID NO: 11884 - DNA, 282 bp, A.fumigatus
ttggttcgtaatatactcctcgtatcttgtaacacccactgtctaacaatagcagactacctactttctcagtcatcaaccacaaaagaaatcaactacgaaaccctctggaccacactgcaaactgtcctcctgcccgtgtggccctcatcccgcacccacatcgacggccgccccctcggtgacgcctggccccggtgtggaatagttaggaaaacgagagtcaaaatgggcgcacttcagccttccataaactcacgcagtggttcgggtactccctga

SEQ ID NO: 11885 - DNA, 429 bp, A.fumigatus
actcacgcagtggttcgggtactccctgacagttcccttcgaacgcctgctgggcgtgaaatggacgaatatggatctcgggcattgtctccccagagtaccgcaatggaggcctgttttgtcgacctgggtgttctaacactgaagcttgctgcggaagaacatggtcgacacaattgtggatcgacacttccggcatttgaggcgacgtcggatgagattgtggagtggcgcgcgatgacggttgcactattggacaagttgcatgagcaaattatgaacagtgaggtgttttccggggttaggctgcgccttgcccaggttctagaagctgggagctggaaggctggacgggaattggcggctgagaagaggccggagactagatcaagcccgattttgatactgggtgatgggacactgttttaa

SEQ ID NO: 11886 - DNA, 696 bp, A.fumigatus
gacagttctgcagaggaagacaaaacgccgttcatctttgcgcacgaattcttcgatgcacttccaattcacgcttttgagtccatccccccagcgcccgagaattcgcccgagcagaaagagattataactcctaccggtcctgcgaagctgcaccaacccatgaagcccgccaatactccccagtggcgcgagatcatggttacattgaatcccaaagcagtcgaagataatattgaaggagagcccgaattcaagctgacactagccaaggcatcgactccgtcttctctcgtcatcccggagatctcagagcggtaccggaagctcaagtctacaccaggttctacgatcgaagtcagtccggaaagtcgcatatatgcgtccgactttgctcgtcgcattgggggttcgtcgcagccgcctcgaactgtgggctcgcgaaattcgcccgccgcgcagccgaagaagataccatccggagcggcactgatcatggattacggaacgatgtcgaccatccctatcaattcgctccgcgggattcagcaccatcggactgtgccggcactctcgtcgccgggccaagtcgatgtgagtgccgatgttgatttcatggctcttgcggaggcggcaattgaagctaggtcttcaccacggggctggaaggatccgacgcgtggcgctatgccaagc

SEQ ID NO: 11887 - DNA, 207 bp, A.fumigatus
tattccggtgttagtctagaccgtgcgttggaaagtatgatcgcgcgtatctcacaatacctttacaacaccaatccgactggcgagactccctggcttcgttttctgagccttgattccagctcccgcgcctgcggcgaccgtctttctgtttttaccaagaattttgcttgcgagttcttcattttttctctttttgcgatctaa

SEQ ID NO: 11888 - DNA, 549 bp, A.fumigatus
cacggacccatctgtatcccaactggggaataccctgtgggctctactaaatccgaagattgcctgttcatcgatgtgtatgccccaaggaatgcgtccaacctccctgtgttcttctggatacaaggtggtgggttcaactccaattcgaatgccaactacaatggaactgggttgatcgaagcgtctggctcgcaaatcgtcgtggttaccttcaactaccgagttggaccttatgggttcttggctgccacggaggtccagaatggcggaagtttgaataacggcctcaaagaccagatcaaggctctcaagtgggtccagaaacatatcagcaaggtgaggcgtctcctgctctatctatttctcagccggtggttaactcttcgtcaaagtttggcggcaaccccaatcatgttgtcctcggcggtgctagcgcaggggctgcttccatcaccctgttgctctcagcccatggagggagaaacgatggcctattccacgctgcagctgcagagtcgcaaagctttgccactatgctcacattga

SEQ ID NO: 11889 - DNA, 348 bp, A.fumigatus
tcacctactcttggagtatcctttcgagccattgtctgctgtcttattcatgctgatcgggcgcgccggcagaaaatgcacctgaacaatcttcacgccttggttctgctactacttcctgctgcatccgcccggaagtctgttgtagaccttggctatacacagtatcaaggccatgagctctccaacggcattgtacagtggctgggcatgcgttatgctgcccctcctgtcggacagttgcgatttgctgccccacaggatccgctgccaataaagggtgttcaagaagcaaataaggtagcaatacagtcacaacctagatgtgtcgtaagtttcccaagctga

SEQ ID NO: 11890 - DNA, 1350 bp, A.fumigatus
cggcctcaaagaccagatcaaggctctcaagtgggtccagaaacatatcagcaaggtgaggcgtctcctgctctatctatttctcagccggtggttaactcttcgtcaaagtttggcggcaaccccaatcatgttgtcctcggcggtgctagcgcaggggctgcttccatcaccctgttgctctcagcccatggagggagaaacgatggcctattccacgctgcagctgcagagtcgcaaagctttgccactatgctcacattgaatgagagtcagtttgcttacaacaacctggtcatccgcaccggctgtgcgagtgaaaacgacacactcgcgtgtttgcgcaatcttgatacagcaagccttcagcgccagaattttaacacgccgtttcctggagcgcaactggcgccgctgtacatgtacgggccgactatcgacggagaccttgtgcccgactatacgtatcgccttttccatcagggcaagttcattagggtgcccgtcatcttcggcgacgacacgaatgaaggtaccgtcttcgtcccgaaagatgtttccagcgtctcggaagtcgacaagttccttcaaaaccaattcccaaaaatcgaacttcatcacctagctaagattaatgagctgtatctacaggaaaatcagactcagtctttcccagatgctagtgtttggtggagacctgcaagcaacgcttacggagagatgcgctacatctgtcccggcatcaacatgtcagccgtctacgagaatgctggggtcaagagttggaactatcactacgccgtggaagatgaagccgcccaagcttcgggtactggtgtgtcccatacagtcgaggtcaacgccatctggggcccaaagtacacaaacgggggtgcacctccctcttatactaccacaaacgctccgatcgtcccggtcatgcagggttactggacgagcttcattaagacgttcaacccgaatactcatcgctatccgggcagccccgaatggaagacttggggtgacggaggaggatacaaccgtaatttcatcaagacgaacgaaacgaaaatggaaagtgtcccgatagatcaaaagcaaaggtgtggatacctgaccaacattgggacggcgctgggccagtatacccagatagggtacactacttcgggacctctgtttcgaggtataatgatgaggaaaagggaacaattttcttttgtgttgtctgacaagtgtatatacaataatgaagccttgaagcctggtacgcctttgacaataatgatgctggagaaaccaagaatcccgtatccacggacggcccgagtatcaaagatgtcatga

SEQ ID NO: 11891 - DNA, 501 bp, A.fumigatus
  unsure (225),(237),(243),(246),(250),(278): Identity of nucleotide sequences at the above locations are unknown.
tggtgcagtcattccgggtatccccatcatggcatcagcgccaatgccgctgtggttggagttttgaatgagttcttgtgtactaaattccccgagtcatcgttactgggcccgtcgacgttcaatatcggcaagattgagggaggagtgagctataacattgtcccggcttcgagcacagcactatgcgccgtccgtgtggcgactgatatggccgaatgttanaaaaatgtgtcngaggtngtngcgnaacatccacatgtcaaactggagttcangttccgattatcggagaacatgcttgatcatgatgtcaaaggttgtcaaccatacctttgtccgaatcctgctgacggattacagggtttgaaacagccccagtgtcatatggaactgatgtgcctcgtttcaagggagaccataaaaagtacctatacgggcctggttcaatcctcgtggcccatggagagaatgagcagatcaaagttgacgagctgctag

SEQ ID NO: 11892 - DNA, 222 bp, A.fumigatus
caaatgcttggtttttcttttcttttatttttattcttatttttatttatttttcttttttattcatctatttatttttttgacttagttaatcaagggatactgagtaccaaagtaatatggcatgataacaaactgcactgcatcctaccatttctaggcatgtatttcatttataagcatttggtcagcactgttagtaagttccggtgtggagcttaa

SEQ ID NO: 11893 - DNA, 375 bp, A.fumigatus
ttcagattcacctctatacatccagacaaaatgggctcgactcaacccgaattcaagaaccccgccaccaccactctgctggagctggtcaaggcccggcgcacaaactacagcctcaaggccgagagccctatttccgacgaggccattgagcgcatcgttcaggatgccgtcctgcacgtccccagctccttcaacactcagacctcccgtgtggtcctcctgctcaaggaggagcaccagaagctctgggacattgccattaacatcatggagggcctcgtggctgccggcaaggttcccaaggagatgtttgagaaccacaccaagcctaagctgaacggattccgcgcgggctatggaactgtaggctga

SEQ ID NO: 11894 - DNA, 645 bp, A.fumigatus
ctaaaaatgccagaagctcctgtggtgtccctccttcaatccctcatccaggtccccagcaccagcgaccatgaacaagacatcgcccgctggctcgacaaccacctctccaccctcggctacaccgtcgaacgcctctccatcgccccaggctcgacccgcgagaatgtctacgcatacttaggctcctcgcgcagggtacgagcctgtctcaccgcacacatggataccgtcccgccgcatatcccactgcgcgttgagggctcgactatttacggccgcggcgcatgcgacgacaagggtcccatggctgcgcagatctgtgcgcttgaggagctgcgtgcggagggggcggttagggaaggtgaagttggtttgttgtttgttgtgggcgaggagaagggcggtcctgggatgattgcggccaacgatcacgatttgaagtttgagggcgtggtgtttggagagccgaccgagggaaaactggttgtcgggcataagggacatttggtgtttgagttggttggcgaggggaaggcttggtatgtctgctctgatgctctatctgctgaggctaatggtgcagtcattccgggtatccccatcatggcatcagcgccaatgccgctgtggttggagttttga

SEQ ID NO: 11895 - DNA, 444 bp, A.fumigatus
cggtgcctgtgcgtgctggggaacataaataccctcttccctactccatacagacagaggagaaatcaatcaccatcgatcaagtcatcaacatctccagataattcagattcacctctatacatccagacaaaatgggctcgactcaacccgaattcaagaaccccgccaccaccactctgctggagctggtcaaggcccggcgcacaaactacagcctcaaggccgagagccctatttccgacgaggccattgagcgcatcgttcaggatgccgtcctgcacgtccccagctccttcaacactcagacctcccgtgtggtcctcctgctcaaggaggagcaccagaagctctgggacattgccattaacatcatggagggcctcgtggctgccggcaaggttcccaaggagatgtttgagaaccacaccaagcctaagctga

SEQ ID NO: 11896 - DNA, 465 bp, A.fumigatus
gtgaagacagatactagaccgtcagtacagaccatcatgaaagggagaaaatcagcctacagttccatagcccgcgcggaatccgttcagcttaggcttggtgtggttctcaaacatctccttgggaaccttgccggcagccacgaggccctccatgatgttaatggcaatgtcccagagcttctggtgctcctccttgagcaggaggaccacacgggaggtctgagtgttgaaggagctggggacgtgcaggacggcatcctgaacgatgcgctcaatggcctcgtcggaaatagggctctcggccttgaggctgtagtttgtgcgccgggccttgaccagctccagcagagtggtggtggcggggttcttgaattcgggttgagtcgagcccattttgtctggatgtatagaggtgaatctgaattatctggagatgttgatgacttgatcgatggtgattga

SEQ ID NO: 11897 - DNA, 366 bp, A.fumigatus
atcatggacctcgatcccaccctcatgaaatcgaccaactcaacaaccggcctccgcagcttcagcgtcaacaccaacgcaatgaatccagcgacaacgcgcctctcgcgccgcctcctcatcttccaggaagcccgcaacccaagcaacatgagcgaaatcgtttacctccccgtcaacaagctgggtctgcccatctgcggctccgggccggagttaccctccatcctggaactccccttgcggattctgagggcgtttacggagattttcaatcagcccaagtataaggggtggtatgtttcccgccccgcttctctcttactatatcatcatagatgtatatatatatatatatatggatga

SEQ ID NO: 11898 - DNA, 240 bp, A.fumigatus
catgactccatgctctacaactctgctagctacccagctctgcagatggaatacctcctcctcatcttccgcaaatggcccgaaacagaaacctactggctcatcaaccgaccaggcctccccgtgtcgcgccactcgcctctcgtatataacatccccagcgatccaatcctcatccctgaacttctggcatcgcttacagagacgctgacaagtgatttggccgtttacatggggtag

SEQ ID NO: 11899 - DNA, 237 bp, A.fumigatus
caaaaaagggaaggttggttcccccggagccgtatgaacctttgtttccgcgtccacggcggtgatgctgagaaggagaaggagttcctggctggagccgagaagcggctgctccaggggttgaagggacaccgcagtgttggcggtatccgggccagcaattacaatgcagttcccttggagaatgttgagaagctggcgaagtacctcgaagattacgctactggcaatgtttaa

SEQ ID NO: 11900 - DNA, 1125 bp, A.fumigatus
ccacaattgatacatgaatgcctttacaactactggctccgagaaatgtcccatatcaccttttcgcaaacggacaccagatcaaacaatctccatgcccctcgtgattctctagaacttgcatcactcgcttcttcctccccagaatctgtgggcaggtcgtcagcctcatcctcgccctcgggcatttcctcctcacgcaagctctccctcgaggacgaggatccactatctgacgcacattcgcacgcgaatcttgagtccgggcgagcgcggccgacccgatcatactccatctcttctgccttcgatttcggcaatgccctcttcccactatcgcaaaccgccgggggctatgcgcccttgggggctccctccgcacttgaccgacaggcggggaccgacggctcgttggaacgaaataaaacattgacgtatttgaacggtctgtcactggtggttgggatcatcatcggatctgggatcttttcgtcgccaagtcaggtcaatgccaacgcggggtctcccggtgcgtccctgatcgcatgggctgtcgcagggttgctggcatggaccggggcggccagctatgcggaattgggtggcgctatccctctcaatggcggggctcaggtctatctctccaagattttcggggaactagttggatttcttttcacatggtgcgctgttctggtgctgaagccagggagcgccgccatcatcgcgatcatcttcggcgagtatgtcgttcgagcagtgatacatgcagacgccgagacggtcagtccttggattagtaagggagtcgcattcgggggcgtgtttctggtgaccgtgctgaactgcatatcgacccgactggctgcgcgcataggggattttttcatgttcttcaagttcgttgcattaataggagttacggtcataggtattgtcgttgccgtgactgggttctcttcgactgggagcgccagcaaggagtggaaagaaggttggttcaagggaacgagtaaggacatctccggctgggccgttgcaatatacgcgggtctctgggcttttgatggctgggacgacgtaggcttctcccattctgcattctcaccccgtgccatttactga

SEQ ID NO: 11901 - DNA, 231 bp, A.fumigatus
tcgtacttgcagacaaactatgtgaccggcgagttcaaaaatcctagccgggatcttccccgagtgatccacacggcaatgccgctggtgatcttatcttatttgcttgccaacgtttcgtatttccttgtgctaccccattccaccatagaagcgagcaataccattgctgtccaatttggcgacaaggtgtttggctgtcttcaccggccgggcctggaaggaaacgca

SEQ ID NO: 11902 - DNA, 267 bp, A.fumigatus
gatgtaagaccaccaccacgagactcgacgatactcatttatcgtacgtgctctttcgttgagagtcaacctcatgaaatcccgactaccaagatcagggggacttttgttcaacccgccttctaccctcagcaagagagcagcttctcgtcgttatactgcgtcttcatcacctacaacctccgcaccttctccgccaaaaaggcgactatggcttcgactgacgattgtcactgcaactgcggcaggaatcggagcctatgttag

SEQ ID NO: 11903 - DNA, 1212 bp, A.fumigatus
gaccaccaccacgagactcgacgatactcatttatcgtacgtgctctttcgttgagagtcaacctcatgaaatcccgactaccaagatcagggggacttttgttcaacccgccttctaccctcagcaagagagcagcttctcgtcgttatactgcgtcttcatcacctacaacctccgcaccttctccgccaaaaaggcgactatggcttcgactgacgattgtcactgcaactgcggcaggaatcggagcctatgttagatcgcaacaaggctcagagccgacaactctgaatcccgtcacatttaccaaataccggcttgtcgcaagggagccggtatcgtcgaacggcagcatcttcactctgaaaccacccaagcccgacgacaatcgcgaagtctacgaagacgcatggaagaccggcgtatggagtgtcatgttcaagcaaccgcaattgcaaattggaagagactatacacccctaccgccgatatcgctaaacgaccaagatgagcaggaagggtgcctccggttcttcattcggaaagacccgttcggggaggtatcgcggtatctgcattctctagatgtgggatcagctattgaagtgcgcggacctcgaatcgaatgcgaaatcccttcggatactcggcagattctctttattgcgggcggtactggaattgctccggctttgcaggctggacatacgctcctacgccggacagacgccgaccacaagccgaggcttcacattctctgggcaaatcgaagacgggatgactgcctggggggttgcaacgatagttcggcaatagacgaagtacagcaaagatcctggtttactggtctcttcaggtcaagacccagcagtcctccgcccgcatgtccgacacaggatccggcggccacttcgctcatggtccgcgagcttgaggctctcaaagctcgttatccgggccaagtcacggttgactattttgtggacgaagagagttcgttcattgagaagaaatccatcacgagattcaccgataccgcctcctccaatgggccgcctggtggtaaaatgattatcgtgtcaggaccggaaggcttcatcagctatatggcaggaccaaagctgtgggcgcaggggatggaactccaaggtcctctcaacggagttatcaaggaactcgacctgaaagattgggctgtttggaagctttga

SEQ ID NO: 11904 - DNA, 291 bp, A.fumigatus
  unsure (195): Identity of nucleotide sequences at the above locations are unknown.
cggatcttcgcgacactttcgcgttatgatcgcctcaacctgcctcgcctcaaggcttactctgaacttcccaatcgccagcttctacccgcactcgctgctatgattcagcagcatcttgtctaccattacacgtcctacgatgatggcgttacgtattacgaagctaatatgcagtctgcatactacctcgtncgttctggaaaaaatctggagtttgtggaggacgacttggcaagtatgcggcgaccgtcctttcgaccatcatgtttctcggacacgcccaagtga

SEQ ID NO: 11905 - DNA, 255 bp, A.fumigatus
tctctgactgtttctgctttcaatggacagtctacactcaaacggtcggcgttgcggatcactcgggaggttgaactgctgggcggtgaagtttcctcgacacattctcgtgagaacgtcgttctcaagaccaagttcctctcgaaagaccttccttactttgccgagcttttggcggaggttgctttccagacaaagtttgcaggtaagtggacagcagtcgtcagccataacctccaatgtgatattggctga

SEQ ID NO: 11906 - DNA, 318 bp, A.fumigatus
tacgcacatgcgataatgctgtcgcggtcttccctcagccgaaatgcgccccgtgcgctctctgctgccagcgccagcagtcgtcgcagcatggcctctgctgccactcctggcctccaatacgatgtctctgagtctgccggtgtgaaggtcgccaacagagaggtcgcaggcccaaccggcaccctggcgttggttgcaaaggccggctcccgttaccagcccttccctggcttctccgacgccctcgaattcttcgccttcaaggttggtattatagctcgtttgcaatctttgcagcttaccaatgtgaattga

SEQ ID NO: 11907 - DNA, 888 bp, A.fumigatus
acgagttcgtcctcaacctcatcaagtacagacagcaagccttttgccgccgatgctgagaacatcgccgttgacgctgcccacgctcttgccttccaccgcggtctgggtgagaacattactccgtccgccagtggccctttcgaaaagtacatctctgccgatgccatcgccgagtttgccaaggacgcatacgctaaatctaacatcgccatcgttggaagcggctcttccaccgcagaggtgtccaggtgggttggtgagttcttcacagaggtccccagcgctggcggctctagccaattcaaagtgcggcccaacactgcctccaagtactatggtggcgaacagcgtatctcttccaagtctggcaacgccgttgtgattgccttccctggctctagcacctttggcacttctggctacaagcctgaagcttccgttcttgcggccctcctcggcggcgagtcttccatcaagtggactcctggtttctctctcctcgccaaggccacccagggcttctctcaagtccgtgtcgcaaccaaaaacaacgcctactccgacgccggtctcttcaccattacagtctctggaaaggccgaccaggttgctgctgccagcaagaacgtggttgacgttctcaagaagacggctgctggggagattgctggtgacgagatcaagaaggccattgcgttggccaagttccgtgctctcgagtccgctcagaccctcgagaccggccttgaggccaccggtgctgccctgatcaacggcagcaagccttaccagattggtgagattgcccagggcttcgacagcgtcactgaggcgcagatcaaggatgtaagtcttttctcttttcctactcactgcgtactttga

SEQ ID NO: 11908 - DNA, 231 bp, A.fumigatus
caaaaaaaacaaactacaagaagtaagaaagagtccgaatctgagataagaacctgcttgaaaggctcatgggtctctattgaatcatctgcgccgttctcctacttttctcttatcgatgccataaaaaatcacgtgtatttgtatcacctgatctcacctgacacagagggcgatggaaaagccggttccgcccgcactcgtcatttcgaccaatcagcaaacgagtaa

SEQ ID NO: 11909 - DNA, 867 bp, A.fumigatus
atggaggtaagatatggcctttctgcgtgtctgaaaaccagtccgctaacgaatacttgtttctttgcagagaaatacgaggcagctccaattgccctctctctgaacgaagcatttatagccatttccctcgcctttggtaaccttcatcctattctcggctccttccgcacatcacagcatctaattcaagctgttgctccgggctcgtcgccattgctgcaactgccatacttcaacaaccaagtcgtcaaggctattgaaggcgcagatgccaaggatcattacaccgtgcagaagttcatgagtttgcccgaagacaagcggcgcagtctgactgttggtgctggtctcctgtccgagaagcagtattcaacagccgtgtccgtcgccaagcaactacccgtccttgaagtctccagggccttctttaaggtgatgggggagaaggtcattaccccaagcagtctggtgcaactagttgtgaaagcccgattcattcccccaggttccaccaacatccctgaagtgaaccccgccgaactggaagaacgtgacccagatgaggacgacctcgatgctctcatgggccgaaagccccccaggacagacctaccaggactgtcaacggccaacaggtcgagaacaagattgagattattcaaccccctctcgctcacgcaccctacctggctcgcgaccactctcctcgctggcacattttcctggccgatgccaagcagggcaagatggccgttcctccattcaccttcaccaccttcgaccagcccctgttcgacgaggcaggaaagccaaccttcaacgttcagacactcaagatgcagttccaggctcctcctcaggtag

SEQ ID NO: 11910 - DNA, 225 bp, A.fumigatus
aggtatgttctattgcattcttttcctgtattggcaagtcaaatcactaatcaaatctcgatgatagattctattgctggccaaatgcaagctttgaaaaccggccaaccacccaggaagaaggcacggaagccctcagatgagtctagcgaggaggagagtgatacggatggcgatgcgggagataccagcgacacgaacacagaaactgacgttgaggattaa

SEQ ID NO: 11911 - DNA, 504 bp, A.fumigatus
ggacgacctcgatgctctcatgggccgaaagccccccaggacagacctaccaggactgtcaacggccaacaggtcgagaacaagattgagattattcaaccccctctcgctcacgcaccctacctggctcgcgaccactctcctcgctggcacattttcctggccgatgccaagcagggcaagatggccgttcctccattcaccttcaccaccttcgaccagcccctgttcgacgaggcaggaaagccaaccttcaacgttcagacactcaagatgcagttccaggctcctcctcaggtaggagacttttcttttgtcatgcacatgatgtgtgacagctatttgggtctcgacacaaagctggacatcacgctacatgtcgacgatccagccaaggcggctgctctcgaggaagaagacgacatcagcgagcctgatgaaggtatgttctattgcattcttttcctgtattggcaagtcaaatcactaatcaaatctcgatga

SEQ ID NO: 11912 - DNA, 381 bp, A.fumigatus
ggacccaatgactcgggtcaaacacatggcaaactgttctgttctctttctcccattctacaggcagtcatgatggcgcttcatccctttgaccccatcacgccggcggaaatccagttggctgtcaaaattctggaagcggctttccccggggtgtccttaagatacaagaaaattgacgtcaatgaacctctgaaaaaggaggtggtaccgtatattgaagccgagagatcacggaaggctttgccggcggcaccaactcggttgttgcaggtgctgttccatcgtcttgacaatggagcattctacaaagcgttgctcaatgcggggaccaggtctgtggtgtatgccaaacagctgcccaaagaggttcaggtatag

SEQ ID NO: 11913 - DNA, 573 bp, A.fumigatus
ttgcggacaagagaagtcgctaacaagatagatccccgcgccccgtaccaccgcaagcaggcgtttgacgttggggacgttggattcggcatcactgcgaaccagctctcccttggctgtgactgtctggggtacatcaagtacttcgacgggtaccgttccgactccaaggcccatccggtgcaactgaagaatgtcatctgcttgcacgagcaagataatggtctgcagcacaagcacaccaattaccgcacgggggctgccacggtggtccgtaaccgccagctactggtccacatgatctgcaatgtgtccaactacgagtacatctttgcctttatcttcgaccaagcggccaacatctatctggacgtgcgcgcgaccggtattctgtccactgtgccgtttgacaacgaaaagttcgggacgacagtaccctggggaacgaacgtcgggcctggcgtgatggcgcctttccaccagcacatgttctccttccgtattgaccctgccattgatgggttcaaaaacaccgtctactacaaagatagcgtgccgatgcccgatgactag

SEQ ID NO: 11914 - DNA, 408 bp, A.fumigatus
aacaacccatatctggtgggttacaccaccgaacaaaccgtcctgcacaccagcggcaacggcaacaccagcgtggagcgccacccggtgttcaagatccgcaacgacgcctgcatcaacccgatcacttataaaccggtggcctataagctgcagaccgcgccgagccagatgctgctggcggggaaccggtcgtttggctacaagcgggccgagttcgctaccaagccgatctgggtgaccaagtatcaggatgacgagctgtttgcggcgggcgaattcaccaaccagagcaagcagagcgagggggtggaaaagtgggtgcagcgcaatgacccggttgagaatgaggatcttgtcctgtggcatagtaagtctgaccgattgttcttgttgaggcgtcactga

SEQ ID NO: 11915 - DNA, 867 bp, A.fumigatus
aaaaggaggtggtaccgtatattgaagccgagagatcacggaaggctttgccggcggcaccaactcggttgttgcaggtgctgttccatcgtcttgacaatggagcattctacaaagcgttgctcaatgcggggaccaggtctgtggtgtatgccaaacagctgcccaaagaggttcaggtatagactctgtcgatcggtgaaccttggaggaaatgtctctgactcaacccagggcccagtcgatgcagacgaactgatcgaaattgagcagctctgtctgagccaccccgcggtgcaggcggagattgccaaaatgcaactgccgcagggggtgactgtttgcaacgatccgtggatctatgggacagatgaccctaaggaaacccggcgtctgttccagtgctacatgtatgtggtgaccacggatcacccgcaaaataaccactattcgactccctgtaaattctcgcccgtgttcgatgcgcttactcgggaacttgtccgtatggactatctcccgggtggtgtagacacccaggtctccgagactcagccatggaagacggtggagaccattcaatacgcgcatgatctgctcacagagccactgcggacggatctgaagccttatatcgtgcagcaacccgagggtccgtcattccatgtgcagggcaacctggtctcctggcaaaagtggaagtttcgcgtggggttcaacacccgcgaagggttggtcatctacaacaccacctatgacggacgcaatgtgttttaccggctgtctgtgtctgagatgaccgtaccatatggaggtatgcagtggcccatccatgattgcggacaagagaagtcgctaacaagatag

SEQ ID NO: 11916 - DNA, 348 bp, A.fumigatus
tggcgcctttccaccagcacatgttctccttccgtattgaccctgccattgatgggttcaaaaacaccgtctactacaaagatagcgtgccgatgcccgatgactagaacaacccatatctggtgggttacaccaccgaacaaaccgtcctgcacaccagcggcaacggcaacaccagcgtggagcgccacccggtgttcaagatccgcaacgacgcctgcatcaacccgatcacttataaaccggtggcctataagctgcagaccgcgccgagccagatgctgctggcggggaaccggtcgtttggctacaagcgggccgagttcgctaccaagccgatctgggtga

SEQ ID NO: 11917 - DNA, 723 bp, A.fumigatus
aggatggcacccctctctagcatctgggcgtacctgaacgaggacatcggcgaagacctcctcctcgaatgccaacttctccttctctccttcgccaccggcatccaagacgccgcgacatggcccgactacagctgcttcgcctcgaaccagaccggcaacaccctcttcctcgcgatcggggtcgccggcctcgccaacaatgcctacagcttccccaacatcggcatgagcctggggatgttcatcgcggggggactcctcgtcggccagctggggaacctgttcggagtgcgccgccgcctgtggctgttgctgagtagtgttattcagacggtgctggtcgtagccgggctggttgtgcagtatacgctaccggtaaagcaggagggaccggccgcgttgggggtcattgcgtgtttggcgttctcgtcgggggcgcaggtggcgatgagccggtcgctgaagatcacagagatcacaacggccatggcgacggcggcatatgtggatgtggtggtggatccgggactgttgagggtacataaccggccgcgcactcggcgggtgctgttcctggtgatgctgacggcggggtgttttgtcggggcgtttgcgcaacgggcagtgaattcgtcctttgcgctactgtggtgtgcggtggggaaggctgtcgtgacggtctcgttgctgtggaataaacggctggagaagacatgttga

SEQ ID NO: 11918 - DNA, 237 bp, A.fumigatus
ccgattgttcttgttgaggcgtcactgaccgtcccagcttttgggcttacgcacaacccccgggtggaggatttccctgtgatgccggtcgagcgtgtcagcgtcatgctcaagccggatggcttcttcaccaagaacccggcgctggacgttcccgcatcgactcagtcattcaatcggtcaacgctgcatccggagccggcggcttgctgcgctcctgccaaggtgaagttgtag

SEQ ID NO: 11919 - DNA, 405 bp, A.fumigatus
accgggattgatcaacatgtcttctccagccgtttattccacagcaacgagaccgtcacgacagccttccccaccgcacaccacagtagcgcaaaggacgaattcactgcccgttgcgcaaacgccccgacaaaacaccccgccgtcagcatcaccaggaacagcacccgccgagtgcgcggccggttatgtaccctcaacagtcccggatccaccaccacatccacatatgccgccgtcgccatggccgttgtgatctctgtgatcttcagcgaccggctcatcgccacctgcgcccccgacgagaacgccaaacacgcaatgacccccaacgcggccggtccctcctgctttaccggtagcgtatactgcacaaccagcccggctacgaccagcaccgtctga

SEQ ID NO: 11920 - DNA, 327 bp, A.fumigatus
caccacgctctctctagtcgaaccaagccgcaagccaagcaaaataataatatgcagccattggactatagaccgggattgatcaacatgtcttctccagccgtttattccacagcaacgagaccgtcacgacagccttccccaccgcacaccacagtagcgcaaaggacgaattcactgcccgttgcgcaaacgccccgacaaaacaccccgccgtcagcatcaccaggaacagcacccgccgagtgcgcggccggttatgtaccctcaacagtcccggatccaccaccacatccacatatgccgccgtcgccatggccgttgtga

SEQ ID NO: 11921 - DNA, 225 bp, A.fumigatus
aatgctccattgtcaagacgatggaacagcacctgcaacaaccgagttggtgccgccggcaaagccttccgtgatctctcggcttcaatatacggtaccacctcctttttcagaggttcattgacgtcaattttcttgtatcttaaggacaccccggggaaagccgcttccagaattttgacagccaactggatttccgccggcgtgatggggtcaaagggatga

SEQ ID NO: 11922 - DNA, 942 bp, A.fumigatus
agatattatggaggctcactcccataccccgtcagccaggatatgcccgtggagcacttgaagtatctcaccaccgaacaggctcttgctgatatcccatattttgcggcaaatttcagccggctgaatcatcctgatttcgatctgacacccagaggaaccccttggattatgatcggtggatcctatcctggtatccgtgctgcgatcactcgcaacaaataccccgataccatatttgcagcttatgcttcgtccgcccccgtccaggctcaactcaatatgagcgtgtactatgagcagatttaccgcgctattgtgggcaacgggtacagtaactgtaccaaggacatccaggctgctcttaagtacatcgatggccagttatccaacaaaaggacgttcgcattgatcaaacggctttttcttggacccgatgcggagaagaacagcaatgaagacttcaccacggctttggtcactctttacggaccttttcaagctcacggtctttggagtggtaatcaaagcttgcccgatttctgcaactaccttgagctggacccggcgacaaaccaatcggcaggaccggagggtctctccccaatccacggcagcaaatatgttgcagagcgatgggcgtcatttccttacttcatatcgctggtcaacaggatgtatgggactaactgcaacggtcttaatgcatcagagcctttatcatgcgatttcagtcaaacaaacaccatccctgagttgatcagctggacttggcaatattgcaccgaatggggctttttccaaaacaacaactttggctctcatgcgtttctttcctcctatcagaaccctggagtatccacaaggaactctgttatcgccagttcccaaatggcgtccaggctggcgttctaccgccacgaccacagacggaaggcttga

SEQ ID NO: 11923 - DNA, 225 bp, A.fumigatus
ctcgtgcagatgctcattgaccacgaggatccctcagttggcacctatcgaaacaggttttgggtcaatgaagacttctacatctctgggagtccgattatggtctatgatattggagaggctacagccgagtactcggtttctttgttgacaaattcctcatcctggctcagtctgctgttgcaggaatttaacgctatggggattgtgtgggagcacaggtag

SEQ ID NO: 11924 - DNA, 303 bp, A.fumigatus
ttgatagcacggccagtcgatggtctttgtttagccaaggttcaacgccaatacagctgccagagaagctgcaaagctagccccttgcagcaagtcacacgatttctcgctaacatgagccatgaaattcgaacgcccatgaatggtgtaatcggcatatctcaacttgctcgtagttgtcggcagacttctcggactaccgctaatgcaatttcctttacagtggacctaactagacccttctttcgacctataattaagaagcctcctttaaagaacagtgttcgaacgtattgcacctaa

SEQ ID NO: 11925 - DNA, 276 bp, A.fumigatus
accttggctaaacaaagaccatcgactggccgtgctatcaatcatttcagtattgactgttttcaccagaagtcgactgtgctgatttccgccttcgagccgtttgccaccatctttacgtttgcattgcctaagtgtttgatatttggaaacatgctcaccacacgggatgtgtccatgatgtatggcggctgtggacggtggtcagttgattccaaggatctcgatcattcgtacaagaatgttaccgttgtgattctgcgaacattatcatag

SEQ ID NO: 11926 - DNA, 192 bp, A.fumigatus
tactatacagtactgctagtttcacatgttctgttcaagtccccttacgttgtttcgactcgagaacaatcatccacctaccaagcatacgtcctttgccaggatgcctcaaatgaccccttcaatcggacccagttctccaaatcccaggatctcaataatctaccttgtgaaaatggccaaaatgtctaa

SEQ ID NO: 11927 - DNA, 702 bp, A.fumigatus
gaccgctaccaagactggtatgttaattattttcatcgtatcttgattgacgtctttgtgctaactcatgcatcaggtatgattatggtctttggtgaaatcactaccaatgccaagctggactaccagaagatcatccgtggtgccatcaaggacatcggttatgatgactccgataagggttttgactacaagacctgcaacgtccttgtcgccattgagcagcagtcccccgacattgctcagggtctccactacgatgaggctcttgagaagcttggtgctggtgaccagggtatcatgttcggttatgccaccgacgagacccctgagctccttcctctcacccttttgctctctcacaagctcaactctgctatgacacaggctcgtaaggacggttccatcccctggctccgtcccgacaccaagacccaggtcaccgttgagtacgctcacgacggcggtgccgtcaagcccctgcgcgtggacacggtcgtcgtctctgctcaacacagcgatgatgtttccaccgaggagctccgtactgtcatcaaggagaagatcatcaagaaggtcatccccgctgagcttctggacgaccgcaccatttaccacatccagccctctggccgcttcgtcatcggtggtcctcaaggtgatgccggtctcactggtcgtaagaatcatgtcgacacctaa

SEQ ID NO: 11928 - DNA, 675 bp, A.fumigatus
ttccttgccggagaaagcaccaccaccgtggcaaccccagccacgttaggtgtcgacatgattcttacgaccagtgagaccggcatcaccttgaggaccaccgatgacgaagcggccagagggctggatgtggtaaatggtgcggtcgtccagaagctcagcggggatgaccttcttgatgatcttctccttgatgacagtacggagctcctcggtggaaacatcatcgctgtgttgagcagagacgacgaccgtgtccacgcgcaggggcttgacggcaccgccgtcgtgagcgtactcaacggtgacctgggtcttggtgtcgggacggagccaggggatggaaccgtccttacgagcctgtgtcatagcagagttgagcttgtgagagagcaaaagggtgagaggaaggagctcaggggtctcgtcggtggcataaccgaacatgataccctggtcaccagcaccaagcttctcaagagcctcatcgtagtggagaccctgagcaatgtcgggggactgctgctcaatggcgacaaggacgttgcaggtcttgtagtcaaaacccttatcggagtcatcataaccgatgtccttgatggcaccacggatgatcttctggtagtccagcttggcattggtagtgatttcaccaaagaccataatcatacctga

SEQ ID NO: 11929 - DNA, 186 bp, A.fumigatus
ccctttcatatacgcaagcaacacaaacacaaaatgtccaaattcggagtcctggtcatgggcccggcaggcgccggcaagtcgaccttttgcagtgcccttatccagcatctccagaccacgcgccgaagttgcttctatgtgaatgctcgaccccgccgccgaaagtttcaattacgagcctga

SEQ ID NO: 11930 - DNA, 219 bp, A.fumigatus
ggcacaggagccgcgggagccaaacgacgagcaggacgtggactacgaggatgccgatatttgatcctcatctcgtccactcacgacgtacgccttacgacctccacactatacgacacgatccaccgacgtatcgacgtctgcacttcgtcagccgatgtgcgtatcaccgtcgaatcgcatcagggcatcttcaccaccgggctagaaggacacgcg

SEQ ID NO: 11931 - DNA, 771 bp, A.fumigatus
atgctcgaccccgccgccgaaagtttcaattacgagcctgatctggacatccgcgagttgatcacattggaagacgtgatggaggagatggagttgggtcccaatggcgggctgatttattgctttgaattcctgctgcagaacctggactttttgtcgcaggcgctggacccgctgagcgaagagtacctgatcatctttgacatgccggggcagatagagctttacactcatatcccgctgctgccgtcgctggtgcagtatctttcacgacaggggccgctgaacatcaacctgtgtgcggcgtatctactggaaagtacgtttgtcatagacaaggccaagtttttcgcgggcacactcagcgccatgtctgcgatgctgatgctggagatgccgcatgtgaacattttgagcaaaatggatcaggtgcgggatatggtgtcgcggaaggagcttaagcgattcgtcaatgtcgatgtgaatctattacaagacgagatcgggggtgcagaagagccagtcgagggagaccccagttccaaggatactctgctgagtgggcgatcgtttaaacggttgaaccgggccgtcgggcagttgattgacgatttcagcatggtgtcttttctgaagcttgatgttcaggatgaagacagtgtgcccgcggtgctgagccatatcgacgacgccatccagtttcatgaggcacaggagccgcgggagccaaacgacgagcaggacgtggactacgaggatgccgatatttga

SEQ ID NO: 11932 - DNA, 279 bp, A.fumigatus
  unsure (61): Identity of nucleotide sequences at the above locations are unknown.
aacctcctcgcgccgtccaccccctgcgaatataaacataccactaacctagagacgcttnacttgctctactcaaaaagccaccttgggtttaccctcctattaccatcccagtttcgctcggcgtcaacgcacgcggggtctgctggcggctcgcccacggagattgcccctcctcgactcagcacagtcgctaaactcacatctagctggcaggccggttcgaacccccgagttggacctttcttccccattgtcatctccctgatgattccgtag

SEQ ID NO: 11933 - DNA, 183 bp, A.fumigatus
caagaaactttgcagaaggttgtatctgtatcgtactgtgacggtttcgcgcaacaatacaacgtatcttacagggcattcgagtgcctgtgtttctacgctgcaaataaatctcactccacgtccatccatctctgtcgttgcggacagtcaggggtcaaaaggagcgcattgtctccctga

SEQ ID NO: 11934 - DNA, 333 bp, A.fumigatus
cggctattgaacccatcctctaccctgcaacacatgttggatctctggggccagcgtcggcctatgagattgaatacttggtacgataaggtcaaatggaacgacatctttatcttcttcggcttgatgctgcttgttggcactgcgaatcttgttcgggagagcattcttctccttttcaacccgcttttggatcctgcgaggccggtgagcggtcgctacccccctcttctgaccgcatttgtctgcgcccatggttttcttttcacaagaggcgaaatcaactcgtttctgctctccgcggatcagtttctgtctattttagatagataa

SEQ ID NO: 11935 - DNA, 216 bp, A.fumigatus
tatatactcccaaatgcaggaaatttaattaacattaatcatgtctcccactcaacaatctgttttatggtcttgtgttgttcttttagtgttattaagtaccatagattgcctagaggggtgctgtctaatatctctataattatatacttagcactaactagatttacttttattaagtaccaagcatacaccttaggggtgggaaatccatga

SEQ ID NO: 11936 - DNA, 342 bp, A.fumigatus
tttcggacatcttcctggtctgccttgtttagtatctatataagggtaaaaggcaagaacagagagagcagaagaagttttggacctgcattttatagagagattcttctgttcttagattttcgacccctttttaactggaatgacaggggattaatatattataaagatgatttctataagccaacaagcgcagtcagtcttcaggcttctggggtagatgttgtgagacctctggaatataatattcccgaaatcccaagtcccattgtctactactactgtactacatcgcgaaaggctagaagtttgagattccttctgaacaatgttctcatttaa

SEQ ID NO: 11937 - DNA, 1614 bp, A.fumigatus
attgatattgacttacccttcgaaacgtgccgaagaccaattatcaagaacttccttggcctacagcacaagaaggaatacaccgatacccgcgggctgcgctactgtcatttgatgatcatgaccgatcaggatcatgacggcagtcatatcaagggcttgctcatcaacttccttcaggctcaatttcccagtctgctgaagatcccggagttcctgatcgagttcatcactcctattgcaaaggtttggaagggcgatcccaagaatcctaccaagcaacactcgttcttcaccatgcccgagtatgaggcctggaaagaagagcacaagcatgaacgtggctgggaacacaaatactacaagggtctgggtacgagcacgactgaagatgctcaggtctacttccgtgacctcgaccgccatctgaaggagttccataccctgcaggatcacgaaacggagctcattgagcttgccttttcgaagaagaaggccgacgagcgaaaggaatggctgcgccagttcaaacctggaacctttctggatcattccgtcgataagatcacctataccgacttcatcaacaaagagctcatcttgttcagtatggcagacaatcagcggtcgatcccttctgttgtcgatggcttgaaacccggtcaacgtaaagtcctgtacacgtgtttccgtcgcaatctcaggaaggatatgaaagttgttgaactcgcggggcatgtgtccggtatgaccgcgtaccagcatggtgatgcctccctgcaacagactatcgtcggtctcgcgcagacgtttgtcggatcaaacaatattaattgcctcgagcccagtgggaattttggaagtcgtcttcaaggtggccaagattgtgctagtgctcgttatatctacacgcgactgtcgccctttgcgcgtcgtgtgttccacgccgcagatgatcctcttctcacttacaacgaggatgacggcaaaaagattgagccagaggtctatgttcccgttgtgcctatgattctgattaacggtgctgatggtatcggcactggttggagttcttcaattcctaactacaatccggaagacattgtggacaacctgaagcggctgatggatggccagcccgtcaagcccatgcagccgtggttccgcggattcaccggcgaagtcactgctcttggaggcgatcgcttcaagttcagcggtattatcaaggagactggtgacaaggaggtggagattactgaacttcccatccgcacctggacacaggacttcaaggataaacttgaggaaattatcaaggccgagaaaacgccatccttcatcaaggactacaaggattacaacacgcacaccaaggtgcactttgtcatccagatggacgagaagaacctccagtccgcccgggaggaaggattggaggaaaagttcaagctatccaagaccatcgcaaccaccaatctggttgcttttgaccctgaaggccggatcaccaaatacgcttctgtcgacgacatcttgaaggaattctacgcagttcgtctcaagttttacgaacgtcgcaaggtatgtggctctcacgcctcgcgtatttga

SEQ ID NO: 11938 - DNA, 801 bp, A.fumigatus
caatatcaactcaacgaacttcagaaggagctggacaaactcaccaaccaggctcgtttcgtgcagatgatcattgacggtgaccttgtcatctcaaagaagaagaaacctgctcttgttgccgagttgaaaaaacatggcttcaaggccttccccaaggtgattgatgctgtgaaggcgggcgaggatgcgccagtagtggaggaagaagaagacgagtctggcaacgacgagaccgaggttctatcgagcgcttacgattatctccttggcatgcctctgtggtctctgacccacgagcgcgtggaaaagctgcgacgacagatcggagagaaggaggttgagatagacgccttaattaagctttccaaggaagatatttggaagcgcgatcttgacgactttatcaacgaatggcgattccagcttgaggatgaagcccgccgccaacgcaaggtcgctaatatgggccgccgtacctcggcgaagctcatgactgccgccggtcggggaaaagcaaccaagaagcgcaaggcggcgctggacgatgattcggacgacgaagactttgcggctccaaagtctaagaaatcagcagcagcaaagaagacagaacctaatggcggtcttctcagctacttgggcaagccatcggcgaagcctgctccttctggcgatggaggcgattctgacgatgatttcgaggtagaagtgctaccgaagaaaaacaggggggcagcaaccaaggccactaccaaggtaaaggatgaggatgaagttatggacgacctgggcgaataa

SEQ ID NO: 11939 - DNA, 765 bp, A.fumigatus
  unsure (645): Identity of nucleotide sequences at the above locations are unknown.
atactcccaaaaaagagccgcggacctgccaaaccagcacctaagccaaaggaagaagccgatgacgattctgaagacatcgctcctaagaagggcagagctgccgccaaggcgaaacccaagcccaaggtcgaggatgacgacgaccttgatgacgatgaattcatggagattgccaaagcagaggcagccaagtcggtcaagtcccagccgaatcggacaagcaggaagatcacaaactatacggccctagacgactcggacagcgataacggcgacgatcttcttggcgatgtgagcaagatggtcaagggcattggaggcgctaccggcgactccacgaccgattcacgccagctcttctccgagcgatcccggccgagcagcagctcctctggcttaaaggtcagcagctccaagccctcgaagctatccaccgatttcgatgcggatgagacggactacagcaaattaatccctcagaactctccccgccgatcgctgcaagtcaagcccaaggagaccaaagtcaatgatgatttcgacatggacgatgacgatgacggtgatcccgtgaagccagctgcccaggctaagccagttgccaagaagggcaattcggccggcactgctgcgtcctcaaancccgcaactgcccctaaaccgcgtggccgcccaaagaaagaatgcggcgaaaccggtgctccggccccgagtctgaaccaaacaatctgttccctgccgcctaaggccttttcctcccaa

SEQ ID NO: 11940 - DNA, 405 bp, A.fumigatus
tttgtgatcttcctgcttgtccgattcggctgggacttgaccgacttggctgcctctgctttggcaatctccatgaattcatcgtcatcaaggtcgtcgtcatcctcgaccttgggcttgggtttcgccttggcggcagctctgcccttcttaggagcgatgtcttcagaatcgtcatcggcttcttcctttggcttaggtgctggtttggcaggtccgcggctcttttttgggagtatttattcgcccaggtcgtccataacttcatcctcatcctttaccttggtagtggccttggttgctgcccccctgtttttcttcggtagcacttctacctcgaaatcatcgtcagaatcgcctccatcgccagaaggagcaggcttcgccgatggcttgcccaagtag

SEQ ID NO: 11941 - DNA, 405 bp, A.fumigatus
acaagcttttccgactcggtatccagcgcgctggtcgcctcatcgagcaaaagcacgcggggattgcgcaccagtgcccgggcaatggcaatgcgctgccgctgcccccctgaaaggagctggctaccgctcgctgtcccgcattgcgtgtcgagtccctccggcagcgaggacacaaagtcccatgcgttggcggcccggcatgcctcctccagtgcgtcgtcggatgctgcttccgtggcagagagacctggcatcccctgtgagatgttttcgcggattgtgcctgggaagagggttggctcttgctgcactagggccacgtgcctgcggtataggagtggattgagaaaggataaaggtgcagatgagtcgatggtaatagtgccgttagttgggtcgtag

SEQ ID NO: 11942 - DNA, 429 bp, A.fumigatus
  unsure (2): Identity of nucleotide sequences at the above locations are unknown.
anacgagcatatgcacaagccatcttggaattaatggggttcaccgtcgccattattctcatgtcgggaatcaacattgttgtgtcgagcgtcctcgccgttgctgtctcgtggaaactgggagtgatcggcgtcttcgttggcctgccgcccattatgctatgcggctatgctcgtgtccgacttgagaccaaaatggacgatgaaattgggcagaggctgtcagtgagtgcatcgatagcgtcggagacggtcatggcgatccgcaccgttgcgtcgctcgcattagaaaacactgtgctgaagaaatataccgatgagctcgaccgagcgatcatccaagcgagcgggccgatgttccatatgatgatctggttctctctcacgcagtccgtggagtattttgtgctggctttggggttctggtag

SEQ ID NO: 11943 - DNA, 693 bp, A.fumigatus
attcagagaggtgactttgtaggctttgttggtgcctcaggctgcggaaaaagcaccatgatatcgctcctcgaacgcttctacgacccaactaacggcactattaccatcgactcatctgcacctttatcctttctcaatccactcctataccgcaggcacgtggccctagtgcagcaagagccaaccctcttcccaggcacaatccgcgaaaacatctcacaggggatgccaggtctctctgccacggaagcagcatccgacgacgcactggaggaggcatgccgggccgccaacgcatgggactttgtgtcctcgctgccggagggactcgacacgcaatgcgggacagcgagcggtagccagctcctttcaggggggcagcggcagcgcattgccattgcccgggcactggtgcgcaatccccgcgtgcttttgctcgatgaggcgaccagcgcgctggataccgagtcggaaaagcttgttcaagctgctctggcggaggcggcctcatctggagcaaggattactattgccgtggcgcatcgtctctcaacggtgcgtgatgctaactgcatattcgtatttgatgcagggagtatcgtggaggttgggtctcatgacgagctgcttgctaaagggggattgtatgctcggatgtgtgaggctcaggcgctggatggctctggatga

SEQ ID NO: 11944 - DNA, 663 bp, A.fumigatus
tgcagcaagagccaaccctcttcccaggcacaatccgcgaaaacatctcacaggggatgccaggtctctctgccacggaagcagcatccgacgacgcactggaggaggcatgccgggccgccaacgcatgggactttgtgtcctcgctgccggagggactcgacacgcaatgcgggacagcgagcggtagccagctcctttcaggggggcagcggcagcgcattgccattgcccgggcactggtgcgcaatccccgcgtgcttttgctcgatgaggcgaccagcgcgctggataccgagtcggaaaagcttgttcaagctgctctggcggaggcggcctcatctggagcaaggattactattgccgtggcgcatcgtctctcaacggtgcgtgatgctaactgcatattcgtatttgatgcagggagtatcgtggaggttgggtctcatgacgagctgcttgctaaagggggattgtatgctcggatgtgtgaggctcaggcgctggatggctctggatgatcttcccccctcccacggggcttcgacgcctttttgggaactggtaatgatgctccaacctgtcactaccaatgttgctctggatgtgaaggagatcaaccccactgttcaatcaagccgttatccctgtgctagacaatga

SEQ ID NO: 11945 - DNA, 210 bp, A.fumigatus
ggtatccttagctattttccttctactattctattctattctactattattcatcttattcctcctattcttcctcttcttcctttatatctaggcaagccgactattcccctttgcatttgtgaaatttcctttatcattgatatactatttagtatatactgtttcattttcatccacagctggcaagactcaacaagatatcactag

SEQ ID NO: 11946 - DNA, 1899 bp, A.fumigatus
agggagcaaaagctgactttgctcaattgcgctacagggaagattaccgttgacgatgtcgaatattcaatcaaccaagactttcaacaaggcgcactacagcttgcggatgctctcaacattgatgaactggaggccgctgttctattctttgcggcgcaggaggaagctcaagtactggatagacctccgctgatcgcggcaattatgcgctttcatgaacggcggcacttccttcttgaatgcttacgtctgattcttcaagaatcgtttgaggttgagcgggaagtgacgcaagctctcatgcaagatatggtggcattcgtcgtggagatcaaaactggacccttacggaatgcatcgctttttgcgcggaagtgcatgaagtctatggaagatatcgagggatggttgctgctccttggggagcagattcaaaaggcatccattgtcggccaggtggaggatcgcgatgttatggaagccattgaataccaacgcagcagcctgcagcaacaacacgagtcattaggcgcaattctgtgctatttcttcaaaggaccttataccagccctgaggaccttcgggtgctcctgaatcgcttaaggaagctcgaaagatttgatggactgctgcttcactacatccctgctatgatatcgtcgtttgtccagcacggctcaccagaacggtcgaattcatacaaagaggccaggagcctgcacttggcggtcacctctaccaaagatggccaaacttggacgatcccgacgtttcacgcagctgtcatcgcgctttggcttgcggtttacagtggctgggatatcgatgggccgacctctcctgtccaaggggtcgacttcgaaaaagaagcagaggagcgaactcaaatgttcatgacggcactcgacgacggagggctcgatttcttacttgctatctgctcaggtgtgaacaacgaagagtgggctgacccggctcgccgtgaattagtggcgctattgttgaaagaaagcgcattcgcgaatttggaatccgaaccctgtgctggatttctaaagactctactgatggagaacctagagatttttgtggagtcttgcattgccaacatgccagatgcagttcgaaagctgaaatccgaggaggatatgcaacgcttggatcagattactgccttgagggatggtttgtcgtccagcctccatcgcggcctggtcgaagctcgcactcatctcgagtctttcctcatgatcatagcattcgcattcgaaagccgaccagacgcagctcaggagttctgggcggacccagacggcaatttgtatggtttccttcaatgggcttccaaaagacagactgttccgagagtcagcgccttttgcgagttgctgtgttctatttctggcggagaggagaatgccgctgctgcacatcgatttctaaccgaggaggacaagttcttgtcgtccaagttcaagcgatccacttccatgaattggtcccagatgtttgctgaactccaattgtacgcgacgagggttactgagaagcctagcgcttcccaagcggtcctgagggctcgaaagtctgaacctgccgacatgagcgagccagaaagccctgtcatgctgacttgctatctgcgattaatgggtcatttatgcaagcagagtggctccataagggaatggatgcttcagcacccatctttcagcgttgttagcaccttgttgaccttgtgcagcgggcccatacccacccacctgagggccactgttttcactacccttgcagctttaatgacggacagaacgtcccacaatggcaacgagatgtggctctctcttgaccaatggatttccggggggcgccatgagtggccccggccttggtaa

SEQ ID NO: 11947 - DNA, 189 bp, A.fumigatus
atccaagaggaacatgcgaacgagatcggactggtcaaaaataactctcatgacaactgtatttatgctattgaacgcggcctgatgttcacttccagcgatcggcgaaagcttcaaaaaagtcccaagcccgcgaaggaccttctcagcggctacctgcacgggggcagtcggagtcgctgtaagtag

SEQ ID NO: 11948 - DNA, 1434 bp, A.fumigatus
aacacattctccagcagaataaacggagctcaaagttgtatgtatgatccacagtcagtttatggaatgtgtgttatacaaagattgacatatgcttatctcatcaggacctcgctcaatgataaagcttgccataagatcttcgagtcccttttccgattcatctccgtcgaaagatccttgtataacagagcgagttccaagggagcatgcgcctcgcggttgtccgcttgcgcatccgtcattcgaacagccatcaatgtttttctgcgtaacctgagaacaaagtcgattcgggctatagtcgaccacataacagagatcctacaagttcctggagagggtctgtgggagcatctcggtgcggattatctgaaatgcctcaccactctgttgcgctaccctcctcatctcgagcatttggccgccaatgaatgggacaaggttctgaacctctgtctaagaagtatcggtgctccagaagatggggatagccaatcgagcgaccacaatggccatccctctactttggatgactttctcgatgcaagctcacgctcaacaccatcaagaagaacctcgagtctggctttgcgggagaagcagagtggcgacaagagaattgtcgcagaagcaatagtatgtatccagctacttacagcgactccgactgcccccgtgcaggtagccgctgagaaggtccttcgcgggcttgggacttttttgaagctttcgccgatcgctggaagtgaacatcaggccgcgttcaatagcataaatacagttgtcatgagagttatttttgaccagtccgatctcgttcgcatgttcctcttggatctaattccagtaattcgacatttgtggtccactaagcttatgggcctgaaggatgaactccttgtcactattttgctttgcatgattatcttgaccgatgcaactcgcagggcaccaacagactccctagctctttcaatcgagaaccttttggacacaatttactcagaatatacgaaacgttctgagaaggacattctgcagattgacgagttaattttcgatcgaacgagctccacacaaatcattgacctcgcactgcagcctcgacttgaagtgcccaggtccgagcacaacttgaccgtcgtatgggtcatggcgaaattgatgcgattgtcagaagaatcgaccgcgcagttatcgcatccagcaggcgaaacaccaagcaagaagcaacgattgaactcagcgtcggaccaagtttttcgagactgtgttatgtcgtctggcaacaggagggtatgtgccttgcagttgatccccatactcctccagggccgcctcactatggagtcgaaagcgtcactacttcagcgattgatcccctacatactcgatgacaacggcgtcatagcttcgtggacaatggttgcc

SEQ ID NO: 11949 - DNA, 216 bp, A.fumigatus
tatcaacaccacgctctagatgctgattgtgtgcgaaatacggatagccgcgccatcgtgatggctcaaatcactcttgacaaggccattgcgcttttgtcctccgagaaactgaaagagcgatctgacagcctggcaggtttgtctacagctgagccgtttaatggtaactttgctgatcctaccagatttgaaacacattctccagcagaataa

SEQ ID NO: 11950 - DNA, 516 bp, A.fumigatus
tcaactgcagggattaatgcgttcatctacatgaccctgggccgcctcatccacttcttcatccccgagcgacgcctgggaggaatctccgccaaacggtacggattgatattcgtgtggctggacattctcgcctttatcgtccagctcgcaggtgccagcatcaccacccagcgcgaggtgcccaccagcaccatcatgctcgggatccacatctacatgggcgggatcggactccaagagctgttcgtgctgatctttggcgctctgacaatccatctccaccgtcgcatggtgcagatggagaactatgggggattagacaacgaaaagaccacccgcggctccgtttcctggcgctggctgtttgcggcgctatatgccgcgttgattctcatcaccgtatgtgccatcgctccgggggagaggggtatactgacaaaagtcgcagatccgaatcatcttccgtctttgccagtatgcgcggggcacggatccgacgaaccctgtttttga

SEQ ID NO: 11951 - DNA, 183 bp, A.fumigatus
agcctgatcttaataccatcccttaatataaaccttccccttaaagattatataagaaggaagcacctagccagtagtattaatgcatttaattattataacccattcccaattacctggctgaataagatgaggcttcctaggcatattagctcttattactaccttagtagttataattaa

SEQ ID NO: 11952 - DNA, 189 bp, A.fumigatus
gaagctaaatatccatatctcaacccctaccccccctctgagccgtgcatcaaccaactcatcttggcttgctacacctcatacacttcagcaattacacaagcaagcatcctcagtcaagaagctcctaaaacaacgatcttaaagccctttgacgccttcaaaattagctatccagcagcttattaa

SEQ ID NO: 11953 - DNA, 1290 bp, A.fumigatus
cgtctaggagattctcgacctgtccctcctccgccgaagactgagacttctgctgatctcggtgaagaatcggacgacgaactttctgtacgtgcgaaggatctctcattgaatgccaccgaagcagagcaggaacctcctgcagctgctcagtcggtttcagctcatccccttcccgaccatctcgattcgcgacgctcctcaacctacgaacctacttctccgaagtctcctgctctcccctcggagaagagaatgagtcgcccgcctccgccgatcccaacaaatccaccgatgtcaccacagttccagggcagggctcctccgccacctcctggcaacatccgccgtagatcaacagcggatagcagaacaagcgcggtctcgcaacctcgccaagctggtgaagatcttgagggagaagtcaccgagtatgatggggattacgatacggatatcgcgtctggagccagattcaaagatgccttgaaatctcatggccgcgattctagcgttgacgaaggtactattaccgatgaccattctcttcagtctccacgaagccctcaagagacgcgccttcctcctccaccacctccttctgcgcccagagccgttcccccgccgccacccattcagccgccaaggagcagcggaggcgcttctcttgagtctcctagagggccaccaccgccgcctcctcacagagagctgtcatttggaagggaagaagattatgatccgtatcgctattctgcccctcagcatggtgtgcccgcaccgagagtgccacccgtgcctcttggccgcccagagtcacccacggtggctccttcgcaggctgctgaacatgattccgaggacatgtacgacgcgtctcccgccgttcaaagcgcctcggggagatcagcagctccgcctctggaaaagagatcttcttttgcgcctccgcctcccactctgccgcctagtgcgccacctccgtcagcgccacgaagtaatcgtgcatctttagacattcctagaggccagcctaatctgcggagatatatggatgcatctcgtccatccatagatcaaggcttcattgctatggatgtggatctggcggaaggctctctctggtggacgcagcctaatatccccccacctgttttccaaaatcgcaaggatgttctttttgaagtggaggaatcgacgtccactaagcggagcggaaagaccacgatttccaaagatgtctatgtcctgttcatggactattcacaaaccgtgatcacagtggcatag

SEQ ID NO: 11954 - DNA, 654 bp, A.fumigatus
gtagcgcgtttccttccagccccggtgggtgaagacgactactccgctgccgctgatactgaagatgcggaagagacttcgacaagcaaggaagaccttgaagatcgttctggggccgatactcatcaggcaccgaagcctgagaaaaaggaggctaacgacaagcttgaacaggacgagggaaatgagagtgatgaagaagaggacgaggaagaggaagagatcgaccccgaaatcaagcgtaggatggagctcagggaaaggatggccaagatgagcggtggtatgggtatgatggggttctttggtcctcctggtgggatgcctgttccgggcgctgggcctcgcaaaccaaaggccgctgcggagacagagaaaaagacggaagactcagatcgggctgctagaacaactgctccaccagtccccgtgatggcgctgccgggaatgaacgccgttaggccaacagcagcttctccaagcgtagagaaggaagaggatgtgcctcaatctgcttcagttaccgaacagcatcctcctcaggatattcctgatgtagaagacgtcgtgaaggaggattcttctcatcgggttcctgatgagacgcctgccgcacctcagggtatgcatccttgtttctccaacggacattga

SEQ ID NO: 11955 - DNA, 390 bp, A.fumigatus
ggcacttcactcgcatttctcactaatctctggttattctactgtagatatctccgcgctttcgaagttggtcgcgaaccgactgtctccaaatacgaaatccatattcgtttgaaaacaaagcgtgacgggccagtcatccgtaacatgctccgattccctcactccgtccagaccgaatcacgaatctgtgtcgtgtgccctcctggaacaagacacgagaaggaagctcgcgccgctggagctgttctggtaggtgaacaggacgtattcgatgctgtcaaggcaggcaagattgagtttgatcgtctcatctgtcatcccgacagtttggacgccctgaacaaagccgggtgtcttaacgccgcggctggaaggaaacagatcccg

SEQ ID NO: 11956 - DNA, 1128 bp, A.fumigatus
gagaatgaatggctgtctcagttggaagcatttgctcctctagatttcaaggcccttgaccctgaattgcagcgcctcgatacccacctcctgctgagatctttcgtcgtcggttacgctctctcgacggccgacattgccctttggggtgccatccgaggcaaccgtgtcgcagttgccgcgatcaagaagggctcacttgtcaatgtgactcgttggttctatttcttggaggatctgtgcccgtgggccacatctacactggaggtcttgaaccaggctgtgcgagagaagaaggccgccaaggcgaaggagggagctagctacgacatcgctcttctcaacactgaaaaaggcgtggtgacaaggtttcctcccgagccttcaggttatcttcacatcggtcacgcaaaagctgcgctgctcaacgactactttgcccacgagaagtataatggcacccttcttgtccgctttgacgacacaaatccttcgaacgagaagctcgagttccaggacgcgatcattgaagatcttgctctcatgggcatcaagcccgacaagatgagctacaccagtgactactttgacgagctttaccagtacgcccttcaaatcatcaaggacggtaacgcctacgccgacgataccgagaaggaggtcatggctgagcagagaatgaatggaaaacccagcaagcgtcgtgatgcatccgtcgaggagaaccttgcccgcttcgaggagatgaagaagggtacccctgagggtctccgttggtgtatccgagccaagatgtctgtcgataaccccaacaaggccatgcgtgatcctgtcatttaccgctgcaaccctgcccctcaccaccgcactgggacgaagtggaagatctatcctacctatgacttcgcctgccctatcgtcgattcaattgagggtgtgactcatgccctcagaaccattgaataccgcgatcgcaaccctcagtaccagtggttcttggacacgctcaagcttcgccatgtccaaatctgggattttgctcgcatgaacttcattcgcaccttgctgtctaagagaaaacttaccaagctcgttaaccaaggtgtcgtctggggatgggatgagtaa

SEQ ID NO: 11957 - DNA, 333 bp, A.fumigatus
ggcatccgacgaaggggaatgactatccctgctctgagagaattcattcttaagcagggacccagcaagaacatcaccaaccttgactggaccctgatctgggcgaccaacaagaagtacattgatcctgtcgcacctcgtcacactgccattctcaagaaggatatggtcaaggcgatcgtcaagggaggcccggctacaccttacacggaagagaaacctaagcacggcaagaaccctgcagttggtatgaagaaaggggttttggtaacacggtcattttcgaccaggaagatgccaagagcttcaagcaagatgaaaagatcaccttga

SEQ ID NO: 11958 - DNA, 570 bp, A.fumigatus
tactttgtgtactcaagaacggtcttccaggacatcctctaccgatttcagaggcaggcatttctcaaatgcagcagctacagcctggattcagtctatcggccgatgccctcccgagatcggggccgcccggtgatccccagaataaataaatacatataccctcatcccatcctcttcacttctgcgcaagaacctcattcacaattcacagctcaaaatcaagatgactcggattggctgggtaagtcttctccagaccagacaaacctagactcacagcactctaatgacctgaaccagtatggcctcggctccatgggcctggccatggccaccaacctccagcgacatctagccacaaaaggggccctgaacctggtctattccaaccggacaatggcacgcggcgacacgctgaaaaggctaggcgccgtgcccgagccgagcttccccaatctcgtcgcccagtgcgggattatcttcaccatggtagcccccttctatcccgagggagactgcgaaacgcataataatagacgacgcagatctccaacgacaccgtgctaa

SEQ ID NO: 11959 - DNA, 189 bp, A.fumigatus
aggattgcgtttcttttagaagtcgctgcggatagaaggatgcgcactgcaacgaccagaaaggatagtgcaatggcagttattctatataatcatcaatacttcgtgctcaactcgcttgcttacatctatactacgtacaaggatcaaccgggcaggcagctggacgggtcctggaaacctatttaa

SEQ ID NO: 11960 - DNA, 345 bp, A.fumigatus
acgacgcagatctccaacgacaccgtgctaagcaatctcatcaccacagcggtggaatcaggccactcgctcaaagacaagatcttcgtcgactgctcgaccgtccacccgcagacggtgggcctgaccgtctccaagctaaaggagaagcaggcttcgttcctggctgcacctgtattcgggggcaacccgatcgccgtggacgggaagcttgtcttcgcgatcggtggaccgaggagtgcggcggaggttgtcaagccgctcatccaggatgtcatggggcggaagatcatcgactgcggggaggacgcaaccaagtcgtccctgctgaagattgctgggtga

SEQ ID NO: 11961 - DNA, 264 bp, A.fumigatus
atggagaatggtatcgtgaagaaatgggacgacatgcagcacctatggaactacactttctacgagaagatgaaaatcgaccccacggggcgcaagatcctcctcaccgaacccccaatgaaccccctaaagaaccgcgagaagatgtgcgaggtcatgctggaacaatacaactttggaggcgtatacgtcgctattcaagccgtgcttgctctatacgctcagggtgagtgcaacggccgagcagatagtaccgacagctga

SEQ ID NO: 11962 - DNA, 594 bp, A.fumigatus
tccttgttcgtgccaggtctcagcagcggtgtggtcgtcgactccggtgacggtgtcacacatattattcccgtctacgaatccaccgtcctcaagcatcatatccgccgactggacgtcgccggccgcgacgtcacccgcaacctgatcgctctcctcctgcgccgcggctacgccctcaaccgtacggccgatttcgaaacagtgcgccagatcaaggagaaactctgctacgtctcgtacgacctcgagcttgataagaagctctccgaggacaccactgttctcgtcgaatcatacacactgcccgacggccgggtcatccgggtaggcagcgaacgcttcgaggcccccgagtgtctcttccaaccgcacctggtggatgtcgaccagcccggcatggccgagctgctcttcaacactattcaaggcgccgacgtcgacgtccgctcaagcttgtacaaggccatcgtcctcagcggtggaagcagcatgtaccccggtctgccgtcgcggctggagaaggaactcaagcagctgtggcttacgcgggtactccagggagaccctgagcgccttggtgtacgtccctaa

SEQ ID NO: 11963 - DNA, 246 bp, A.fumigatus
ccaaagctaatatatctcttgcagaaattcaaagtgcgcatcgaggatcctccccgacggagacacatggtcttcctgggcggtgccgtgctcgccaacctggtaagaaatcaatgctctctaacctttacttttaacgacgtctctaacatatcccagattgccgacaaggaggacatgtgggtcagcaagcaagaatgggaggagcaaggtgtccgtgccttggccaagctcggtactagctaa

SEQ ID NO: 11964 - DNA, 450 bp, A.fumigatus
agtaaccacctgccacagcaccgaatgcctcaccgatcaattcctccatcggcccggtacctaggcccgtccgctccgcgaagacctgtgcctcgcccacggcttccatcaagttcaccgtcacgatgttcctgtaacaatcagcctaaacaatccgacaccctgccgccaaaaaaaaaaaaaaaaaaaaaaaaaaaaaaaaaaaaaaaaaaaaaaaaaaattctgaaggaagaaagaaagactcacccagcaatcttcagcagggacgacttggttgcgtcctccccgcagtcgatgatcttccgccccatgacatcctggatgagcggcttgacaacctccgccgcactcctcggtccaccgatcgcgaagacaagcttcccgtccacggcgatcgggttgcccccgaatacaggtgcagccaggaacgaagcctgcttctcctttag

SEQ ID NO: 11965 - DNA, 297 bp, A.fumigatus
gcagcgaacgcttcgaggcccccgagtgtctcttccaaccgcacctggtggatgtcgaccagcccggcatggccgagctgctcttcaacactattcaaggcgccgacgtcgacgtccgctcaagcttgtacaaggccatcgtcctcagcggtggaagcagcatgtaccccggtctgccgtcgcggctggagaaggaactcaagcagctgtggcttacgcgggtactccagggagaccctgagcgccttggtgtacgtccctaacctcagcttccttggcgaaaatgaccaaagctaa

SEQ ID NO: 11966 - DNA, 579 bp, A.fumigatus
gcccgtccgctccgcgaagacctgtgcctcgcccacggcttccatcaagttcaccgtcacgatgttcctgtaacaatcagcctaaacaatccgacaccctgccgccaaaaaaaaaaaaaaaaaaaaaaaaaaaaaaaaaaaaaaaaaaaaaaaaaaattctgaaggaagaaagaaagactcacccagcaatcttcagcagggacgacttggttgcgtcctccccgcagtcgatgatcttccgccccatgacatcctggatgagcggcttgacaacctccgccgcactcctcggtccaccgatcgcgaagacaagcttcccgtccacggcgatcgggttgcccccgaatacaggtgcagccaggaacgaagcctgcttctcctttagcttggagacggtcaggcccaccgtctgcgggtggacggtcgagcagtcgacgaagatcttgtctttgagcgagtggcctgattccaccgctgtggtgatgagattgcttagcacggtgtcgttggagatctgcgtcgtctattattatgcgtttcgcagtctccctcgggatagaagggggctaccatggtga

SEQ ID NO: 11967 - DNA, 369 bp, A.fumigatus
tcctcgatggaggaactggtttcctcaaggtcggatatgctgcgcaggtatgtcggttactacacacagaatgtctatcatgcgccatgctcatgcgtctttcgtctacagaacttcccagagcaccagttcccctcgatagtggggcggcccatactgcgaactgaggaacaggccggcgacattgtcgtgaaggatatcatgtgcggagatgaagctgcagctgccagatcaatgctccagattagctatcctgtacgttctgcctcctatgtctccgttcctgttgcgaacagttgctcgccttcctggcggagctcccgtcaccgtctttgcagcagggcgttaatttcagagaccattggttga

SEQ ID NO: 11968 - DNA, 387 bp, A.fumigatus
tttcttgtctgcactgttagtttccaaccacgtcctcaatctgccctaagacggcgaagactgctcatccagcggctatgtttcatcggtggcatctctctgctactacttgtcctcatctttccttcctggcgcgccgcgattcttcccacgttatcccttggactcatacattccagcgaagatctacagctacagaccgtccgatattatgacctgtccaaagtacaaggcacggcgaaaggatgggagaaaggggagcgtgtacttatgttgacacctctccgagacgcctcatcgcatctgccgatatcttctcacacctccgaaatctcgcccaccctcaccttgttttcaaaactgccaagaagacccgcatatgcggga

SEQ ID NO: 11969 - DNA, 270 bp, A.fumigatus
gagtgttctccaagagcgctatcaacaaggccagtgttccggccaaggtcattgcgaaagtcgcattccagaagagaaacagtggagctctggggcagggagcgctattatatcttggacagcgactacgaggccggatccgtcattttggcactgcgagacccgcccctaatggattcactactaaagaaaatgttgcggcacgtcgagattggtgtcaagggaatgggctcgccagactcgaggatctcgcgggtcgagggcaattga

SEQ ID NO: 11970 - DNA, 195 bp, A.fumigatus
  unsure (152): Identity of nucleotide sequences at the above locations are unknown.
aacggaagggaatacggcgatgcaaccacagggggctataacgaacacttgcgtcactgtttcaaattgattatttctaacgacctcaaattaaagaattcattcactttgctaaaaaagggccaactatggggcatttctattaaattcancctttttttgaccaaccacaaatttcctgtttattcccattaa

SEQ ID NO: 11971 - DNA, 1794 bp, A.fumigatus
ggacggcctggaagctcgcaacatatgccagccccgccgcagcaccaggacaatagtcttttcctggtggccgatgaccagttttgcgtcgacgcccagaaagctctggcatcgctgcgggatatattgcccccgtacatgatcccatccgatctgctgcggatctcccatctacccatggtaccgtcgggaaagactgaccgtcgattgatccggatgcgtgcggtggatctggcgcccgaggagaggagaaagtacagcagtgtgctcggtcaatcccgggaccaaccagtaacccagctggaagagtcgctgctggggctctgggctacctgcctcaagcttcctccttcgcagatcggtgtcctggataatttcttccacctgggcgggggctcactggaagccatccatctcgccgcggaagcccgaaacatggggttcgcggaattatcctcagcagctgtgttccagtgtcccaccattcgggagatggcaggcatgttggacggggtgacggcctctgtccaaggacaggacccccgcggctgcacctccttccagctggagtcgtcactggtggctgaattgctgcggaaaagtcaacgcacgctcgaggacctgcaagaagggttcctaccccttactcccttccaagagaaaaccgcgaagatgaagccgatgcacctgttgctcgacattcccggcatcgaccattcgcgcctcgaggccgcttgggcgctcgtgctagaaaaacacatcagtttccgatccatctacgtggagcaccaaggccgtgtctaccaagcttttctgcgccaacctgacacggtctctattcctatcagatggtgcgatgaaccagtgcatgaatgtgcggcaagattctgcgaacaagatgtggatctgatcctggatggccgcccctggtggagcatgaccagaatcaacaacaagatcgacggtgttctcgtgctccgactgacccatgcccaatgggatgctctaaccctggatgtgcttttcaaagactttatggcggcctacgagagtcgcgaactctctcggcgagacctggaatttcccgcctacatgcggttccgtctgagacacaatgcgtcgccggcaacagtcagattctggtcaacgttcttgcacggttcccggctcactcagcccctgcttctcgatggcgccgcggaggtagacccaggaaatgaggcgatggtctttgtgtctcagcagattccgatgttgacccctcctcacgggattaccctgggttccgtatttcgggccgcctgggctttcgtgctggcccgctacaccgggcaagaggacgtggtctttggcgagtttgttgagggtcgctccctgctggtgaaaagcgtggagaaggtcactggctgcgcagctgcggagacccccatgcgcatcgtcgttccgcccacggcatcggtccgcgacctcctcaagcattcccaggagcaatacgttgcgcgaattccgtacgagacctgcgagctggaagatatcgtgccatccagcacctcctggcccaccgacaccacgttcaaccatatcctggtcatacagcatgagccagtgcttcctcctgtggctctggatgggcgtccatgcccgcaccggtggccttccacggacggctcgaggacgtctacgtccaaatggtgttcggcccggatacgctgcacgttggaatgtctggtccggagatccggctgtccaggaccattgcgacccagttggttgagaagctggcgtcgacaataa

SEQ ID NO: 11972 - DNA, 351 bp, A.fumigatus
gataaattcaatgctcacgagagttgggcgggagggcgagcaagcattgacgatgcgctggcaacgctcagcccttggcctggccgtgttagaccctggtcggtcattcgccatactctgcccgagaagctggtagaccacgcgctcatctatcggccgccgctggacacctgggtgtccgccgggggacgcgtgatgctcattggcgatgccgctcacccatactttcccgtcgtcggccagggaggcagtcaggcaatcgaagacggagtggtggtcgctacagcgctcgaattggcggggaaggagaacgttccgctggccctacgcgtggcagagaagatccggtag

SEQ ID NO: 11973 - DNA, 318 bp, A.fumigatus
gactcgctaatgaaattgccggcggcagcgggcgacgccattgtcatcgggcccaatgcggtccgcttgatcaagagctggggcgagcagctttgcgaggagatcgagcctcatctgtccaacgcaacgcatgcggagatgctcgatcatcacgatcgattcattgtccgacatgaactggccgggcgagggaaagggtggttcaccaaccgagggcggttgcttagcatcctctacgaacatgcgcgaaagctggggatcgacatccgactgggatcccgtgtcgccaactactgggaagaggacggccgcgcatga

SEQ ID NO: 11974 - DNA, 588 bp, A.fumigatus
cttttgttctcagatatcctcatggatggcccaccagcacagtcattgggtgttgagcctgtcgacccgaccataatgaatcgcccaccgcgatcgagaacggcacgggttcttacgagaccgctgattcaacgagtacttacgtcggcctttatgattatgctcggtacgttggcgatctatgtctacgagatgggcgacgccgatgacctctccaccccggggaagcgctcccgtgtggtgactgcccacgacacgactatgacgttcacctgctttgtccttttcgacatgttcaacgctttgacttgtcgcagcgagagcaaatccgtgctccgcggcgagctgccactcttcgggaacaagatgtttaactatgcggttctgggctctttgttcggacaggcttgcgtgatttatgttccgttcttccagcgcattttccagactgaacccctcaacgccgcccacctattcaagcttctgtgcgtttcaagcactgtgttctgggtggacgagggtcggaaatacctgaacgccgtcaagcggcgaagagcagttggggggaggtacagtgtcaatgtttga

SEQ ID NO: 11975 - DNA, 1557 bp, A.fumigatus
  unsure (669),(1522): Identity of nucleotide sequences at the above locations are unknown.
tttgtcgagctagccgcgaaggctgcggccatttgcggcggccgagaatgctcaactgccgctacacaggtccaggttctgaatctggaaatccataacccgctcgggcacgccccaggagctcgcgttggcctcaggctcaaacgcatcggatcatgcaagtggggattctcagttatcagtgacaaagacgtccagagcatatgtcacgcgacaggagtaatttctctcaggcaggagcgacatggcaaactcgaaattgggccccagtggtcagtgatccagagggtaatcggatacagccatatccaggacgtgcttgatgactcttcggcgatttctctgaaagaaggcataatctataaagtgctggaaaaagtggccgagtacaagccttgccatagagccatcaaatccatgactataaaaggcactgcggcagtcgcacagctggagatgccggcaattagccgcgatagctcggagataacagtgtccgatccgcttgtgatggaccagttcgcattgatcgcagaagtactggcactttgcagagatgatggcaaaagggataatgtattcatctgctcgggcctgagtgagttagtcacattcaagagcctccaatccgggttgggaccatggactgtttatactcaccaaacaccntgcgggcccagggagctcctgagtgacacatttgtatttgactcgaccagtaagcagctgatcattggcctacttggcgcaaggttcgttcggattaccgccagttccctcaatggaatcgtcaagagagccaatctcaacagtcaaacttcggaactttcagtcgagacagatgcggtaaaccacccagccagtgtagcttacccaccgtcaaataacaacgatacctcagatattctctctatattgagtcatctgctccacgagataactggacttcccccaagcgagatttccgccagcacacccctcatggaagccagtgtcgattcccttgcggcaactgagctggagaatcgaattcaagaagagttccatctccacaggcctatctccctctatgaaagacagtttaacgttggaacgctttgccaagaaattcagacgcagcgagacgaccggcttgctcgagcttcgcgaacgacgactgccacacgaaatacttcattctccctcggccgacgtacatcatccactgaatcactacctgatgatgcggaggcacgattcataagtaagagcgctgccgtgcttgcccagttatccagaatgttgtcggaaagcttcaacatcacagagagcatcctccctggaactgagcttcgaagtctgggcttggactcattagttgccgttgagctcgagtacgacctacaacaagcatttggcttgaaagtggatttgatgcaactaagtcccgagcctacggtgggtggactcgctcggcttattttggcgtccgagtctcagacgtctggccacatagcgtcttccatgatggattgtagacagncgacagaaggaaagagccagatgtatctgggttga

SEQ ID NO: 11976 - DNA, 285 bp, A.fumigatus
  unsure (96),(175): Identity of nucleotide sequences at the above locations are unknown.
ctgaacgttggtgggtattgcattgtcaattggattaattacggcctctctttccgtggggcctccatcgcatggaggttacccattgccttgcanctgttcttcatctgcgctttgtttgccacagttccatggctccctgagtctcccagatggctcctcgcgcacgggcccnaaaaagatggagtccaagtgctctcctgcattgaacccaagcctatcgacgacgcctacattatcactcatcaccatgagatccagtaccgcatccaataccagcgttga

SEQ ID NO: 11977 - DNA, 273 bp, A.fumigatus
  unsure (268): Identity of nucleotide sequences at the above locations are unknown.
ccctttgtgctaggtggcgtggtcgtaacccccgacttcctcgaattgcacgacttggtgggtcccaccagaaccaaaattctctctacagtaacggccatctacgatgttggctgctttttgggtgccattcttgcctttactctgggtgagcgcctgggccgcaagaagagtattctcctgggaaccacaatcatggcagttgggaccgttctgcaagcttcctccttcaggctaccccagatgttcgttgggagggtcatcttanggtaa

SEQ ID NO: 11978 - DNA, 555 bp, A.fumigatus
  unsure (457): Identity of nucleotide sequences at the above locations are unknown.
tggatggaaggactgggagccgatgtactccgtccatacagattcgtgcaaggctcttggaggccagattttcttcttgaatcctctgagaatccagagcagattgagaattatcggatctgtgagattaacgctcgtttcttttcaaacggctttctctttactgccttcggccagcaggctctgatcaatatgggcattgagaaatatggtctcaagggagctactgaccctgaaaaggtaagtcatcctgtgccgctctacgagactaacaaggttaacagaacacaggttatcactggtctgaataagcttgttaacccttctctccccttgcatatagcaaagggtgaggaatacggattcgatactcatatgtgggttccatatctgcaacaaaatctggccatggatgtcaaagtcataccacctgaaaatcttcggctggtacccgcancaaccccaggggggctcaaactatactgtctatctagcccagattgcaagccaccacaagttaccaatgaaagttgggcgattgtctacaagactttc

SEQ ID NO: 11979 - DNA, 1041 bp, A.fumigatus
tgctcagtgcatattgcctggaatggagtattggttaacaaatggaatagagctttagatcttatggccgagacgtttgagggatccggcgcctctgtcctttgcgctggtagcttgatggaaccggaccagatgattgagattctgcttgagtaccgagtcaatgccattgctggggatacaagtcagatcatgcagctatcaagatatatttgcaccctgccagacgatacgagaaagcaactgctgatcaacaaagtgatatacacctcagagccaatgactccggtccagcgcaagtttctgagctctgttttccccaatgtggctgtctcgtcggtgatcggcagtgcagaggctgggccttgggccacttctccagctcagctgacggaggcttccaaagggcagaactatgccgacttcgtgtatgaccagcggctgatgcatctcgaggtattccccttcgacatcgaagagtccgacggtgcggggcttgctagtgctcgccctgttcctgatggcgagaagggtctacttgtccaaacatcactccagagaatgcgtcatcctctcatccgttacatctgcggtgatgtctgctcactccatcctttaccggcgtcaatgaaaaacatcatcccagcggaggacgcagctcactacaaggttgcgcgtctgtatggacgcgaccgaagaatcagtttcgattggtatggagagtacttcgaattcgccgtcatccaggatgcaatgcgaaccgagtcatggggcatcttacaatatcagatcatccggcggtataacggaggcgataagaataaccttgacattgttcttgagctgcgtgtgctgcgacataatgaaccgggcgcaattagcaccgatgaattgacacgggagctacgtaagctcttttgggtgtttgagaacaacgaggagttgttcgatttgagatatctacagagttatgcgggattcgtcaggagtagtacaggacgaaaagtcattaattttattgatgaaacacagatagagtag

SEQ ID NO: 11980 - DNA, 195 bp, A.fumigatus
caccgttttctacagaacattcccgcaatatgccttaatgtcggtcccatgctcaatggctatatgaagaacgagctcgccggctcaggtatggtggtatggaaaggcagagaaaagtatgccgctggcgagatcagtagagaggagttcatcgattacgtgtcccgagggtatgtcccgacttcagtcagatga

SEQ ID NO: 11981 - DNA, 1368 bp, A.fumigatus
agaacgagctcgccggctcaggtatggtggtatggaaaggcagagaaaagtatgccgctggcgagatcagtagagaggagttcatcgattacgtgtcccgagggtatgtcccgacttcagtcagatgactcacgtattctgactctttgtagagcaccatccgtaggacactgcaacacaatgggaaccgcctcgactatgaacgcacttgccgaggccctggggatggccttgcccgggtccgcggccattcccgccccataccgcgaacgaggacaatgcgcctatgacacaggcttacagatcgttgagatggtgcatgccgatcgtaaaccaagcgatatcatgactcgtgaggcctttgaaaatgccatcgtcgtgaacaccgccatcggtggcagcaccaacgctccaatccatattggcgctatcgcgaaacatatcggggtggatctttcgctagatgactgggatcgactgggattccacatccccctattggtgaacatgcagccagcaggagagctattgggcgaagaatactaccgcgccggcggcttgccagctgtcatggctgagctgctcgacgcggggaaactgcacgccgacatcttaacgtgcaacggccgcaccgtgaaggaaaacgtccaaggaaagcacacgtgggaccgccgcatgatcagagcctacgacgacccgctcatgaaagacgccggcttcttgcatctcaagggtaccttgttcaactccgccatcatgaaaacatgcgtgatatctacggagttcaggcagaaattccttgaaaacccggacgatccgaacgcgttcgaaggcgcggtaattgtgtttgacgggccggaggattaccaccatcgtctggaagatcccaatacacccatcgacgacaggactatcctcatcatgcgtggtgctggacccctggggtatccgggcgcggcagaagttgtcaatatgcatcctcctggacgccttctacgacagggtgtccattcgcttccgtgtatcggcgatggtcgacagtctggcacatctggctcgccgtcgatcctcaatgcctcccccgaagccgcggctggtggcaatctggcgcttcttcgagacggagacagactccgtgtcgatcttaacaaacggcacgtcgacatcctagtgcccgcggaggaactggagaaacgaaagaaggcgctggaggccaatggcggttacggtgttcctgagagtcagactccctggcaggatctattcagaagggaagtggcgcaactgagtgaggggatggtcctccgtgaggcagtcaagtatcaaagactagcccaacgattcgaggagcctagacacaatcactga

SEQ ID NO: 11982 - DNA, 699 bp, A.fumigatus
gatcaccaagaagacttgaccatgccgtgcaatccacaggcttctgcctcatgtgaaggctgctcttgcgatgccggtgcgaaccgcgcgccggtgaacattgaagactgcgagcccgaactgctcgctctgcgaaggcgcactcttgagctggagaagtcgctggcatccatgacggctggcgctgcgaaggtgtcgagggctggtcgcaagctgcggtcctccagatggttcaactgcgagaacgaccctggcatgatggcgctctatatcgagcggtatctgaactacggcatgaccaaggaggagctcatgtcggggaagccgatcatcggaattgcgcagtccggctcggatttggcgccgtgtaatcgccaccatctcgagctggtgaagcgggtgcgcgaaggcatcagggcagctggcggggttccctttgagtttccaacgcatccgatacaggagagctccaggcggcccactgcggctatcgatcgcaatctgtcgtacctaggcttggtcgagattctccatgggtattttctggatggggttgtgctactgactggctgcgataagacgaccccggcggctctaatggctgccgctacggttgtatgtgacctttgctcgcccttgcctggagccgaaccgtttctgacaccgttttctacagaacattcccgcaatatgccttaa

SEQ ID NO: 11983 - DNA, 717 bp, A.fumigatus
gttcgatctcagcgtggtggttcaaaaggatggaacttacgatgcccatgcagagacaaccctgtgaagaaggaggacgcgcaactccttttgaacaatctcggcctctcagtcaaacccgatgaagtggacgattttcgtactctactagcagccgtccatgactgtgcagaggacgtcgcgaagctaccagattaccagccggtaccggatctatcacgttatccacgacaaaacatacggcgcccctcgccggaagagcaagtctttggtcaggcgtgggcgcataagttcttgatcaagggtaatgctgacggaggtccactggctgggaagacggttagtttgaaagactgcattgcagtcgctggggtccctcagctcctgggcagcgatgtgattccatcttggacacccatcaccgatgccacggttgttacgcgaatcctggatgccggcgctgatattctaggtacctcgacatgcgaaaacttttgccattccaccggctcctatactagtgctcagggtgtggtcgagaatccttttgcagctggttattctgccggtggtagcacatctggcggggcggctctggtggccggtggcctggtggatattacaataggtggtgatcaaggtgggagtatccgagtgcctgcgtctctctgtggctgtatgattgccccacatcagacagttgcctggcctcactga

SEQ ID NO: 11984 - DNA, 453 bp, A.fumigatus
  unsure (21): Identity of nucleotide sequences at the above locations are unknown.
tacctggggacaggagattcntggaccaagatagactacagcaagaaagcagaagagtggatgaagcctctggttcctggtcgcgagacaggcctggtggaaatccctgcaaactggtacatggacgacctgcctccgatgatgttcatcaaagcagcctcgaacagtcatggattcgtcaacccgcgtgatgtggaagacatctggagggatcactttgactacttctaccgagaatatgatacattcattttccccatcacaatccatccggacgtttttgggcggccacctgtgcttctcatgcatgagagacttatcgagcattttaagaagcacgacggagtggaattcgtgactatggagcaggtctgtgatatcttcaagaaggaaaacccaccacctgcaggcgcgctcatgccagccgaaccgggggccattctcaagaaataa

SEQ ID NO: 11985 - DNA, 204 bp, A.fumigatus
ccaaaaccgtttggatctcgatacgagctcaaaattgcagaaatgggcaagaagcgcgttctcgtcacttacggcgtcgatgtcgatgcagttgccggctggctcggttcttacggaggagaagactcaacaaatgacatcagcagaggtgaatcatgcggtcaacgcggatttgcgggttcctcatggctaactcggccatga

SEQ ID NO: 11986 - DNA, 285 bp, A.fumigatus
acaggtgtttgggctggcactgtcggcacgagacgtcttttgaaattcttcgacaagtacggcatcaaagcgacatggttcatcccaggccactcgttagaatcgttccccgaagacatggctgctgtgcgcgacgccggccatgagatcggtctccacggatattcgcatgagaacccgaaggacatgacgatcgagcagcagcgggatgtcctggataaaacctaccggatgttgactgagttctgcgggaagccgcctcgtggaagcgttgccccgtggtag

SEQ ID NO: 11987 - DNA, 426 bp, A.fumigatus
ctaaacccaatagtgatctttgctaccggtattctctccattccctcggtcatgtatgacctaggtgcgttccctggggccgtcaaccttgtaggctggtgcgtcctcaacgcctatggcgctattgtcctgggcaacttccggaactcatatcccggctgtcattcgatcgtggacatggttcacctagccggaggtcgttggggtccgctcatgcgagagattgtaggcgtgatgttcatcatagcctatgtgatcgttgcctcctccggcataatcggcgtctcggccgcttttaatgccctatcccgacatgcaatgtgcaccgtgtactggtctctagtctcaacggccatcgtggccctatttgccagcgtccgcaagttcgcccatgtcgtattcgccacgaggtggaagatccgcgtg

SEQ ID NO: 11988 - DNA, 327 bp, A.fumigatus
aaggcaaaacacaagccgcaagaaggcacggcacacacaatcagcttcaaatctctctcgctcttctctccctcaccacctcctcccttttcacctcccgctccacatcctccagccgtccctcccattcagcccagcactcgccgctccccaccagcccaacctcataccagcgctgcaacacccgcgctgtccggacgcggagctcagatatctccctcgcctgttcctcctgggtacgagccaattgatccagacgcggctgcagctggacgagagacgccgacgcttgggcgtccgggacaggcaggtcatttaacgaagtga

SEQ ID NO: 11989 - DNA, 417 bp, A.fumigatus
cagaattcagatgatcgcttccccgacctcttccgtcctacaccttcgcaatccgtcccggagaacctgacaacgcagaacctcgcctcgattgtcctctcgtacgcttccgcattcccggagaccgcgtccagactcacttcgttaaatgacctgcctgtcccggacgcccaagcgtcggcgtctctcgtccagctgcagccgcgtctggatcaattggctcgtacccaggaggaacaggcgagggagatatctgagctccgcgtccggacagcgcgggtgttgcagcgctggtatgaggttgggctggtggggagcggcgagtgctgggctgaatgggagggacggctggaggatgtggagcgggaggtgaaaagggaggaggtggtgagggagagaagagcgagagagatttga

SEQ ID NO: 11990 - DNA, 240 bp, A.fumigatus
gcgactcccgtgcgagccggacggttctccaatgtcctcgcagaattcaaggagtaccaaaagagatcaggatggattatcgctttcatcggtgccagcaatgtgttctaccaaaacgctagggaatacacgaccacgcaattcggcaccgagcgcgtgcttaatcttataaccaatgatgtattgaacgagagagcggggaaacgaatcatcgtacaaagcaaaaactgctcaatctga

SEQ ID NO: 11991 - DNA, 471 bp, A.fumigatus
tacagtcacatcggtcagtatccgtgtcaccgtgaatactccagcttatgtttcactagtctggcctgttctaaggcgcgacgacagaaaatgctaggaacaaggggagaacaagtggtcgacttacgagacggtgtaggcaccaccggcaacagtcttcttgcagcccttgcactcccagataccaacagcctggcgcttgacggtgttctttccgcagaaggtgcagacgtagcgggcgtgctgggtgatttccatcttcttcacctgcttacgcagggaggcaccgtatctgtaatgaacaagccatgtcaaccaaccattctagctctcccgaattcgatattccacgctttgaattccggtttcaacggagtagagcgaattgcagacgacttcagatcgattgttcgaggtgcgagggcgaaaagcatacctggtaccatatttacccgtgataccgacctctaa

SEQ ID NO: 11992 - DNA, 279 bp, A.fumigatus
tgtcacatagtcaagctttttgagttttcagtccatagtatattaccgtcaagattcgacagccctcgtataacaacagacatggaatccgaaaaggagttcgacttggttctggtcggtcctacgggttacactgggagactttgcgcagagcatattgtcaagaacttgccgacgaatctgaaatgggctctagcaggtcgctcggtgcagaagattgaagtcatcgccaaggagctcaagactctgaaccctgaccgcgccgcgccaggtaaatga

SEQ ID NO: 11993 - DNA, 189 bp, A.fumigatus
ttaaacttcgccaagagtcgaaccctaagcgagcccacccacaaccagtctctcaagaaagccgcaggctcgatttcgtcttaccgcactgtatccatctttgacctcaacagccgcacacgagacaagatgaccaagcgcactaagagtgagtgcattcgatcgagattaaccacggagaaaagatga

SEQ ID NO: 11994 - DNA, 201 bp, A.fumigatus
aatggttggttgacatggcttgttcattacagatacggtgcctccctgcgtaagcaggtgaagaagatggaaatcacccagcacgcccgctacgtctgcaccttctgcggaaagaacaccgtcaagcgccaggctgttggtatctgggagtgcaagggctgcaagaagactgttgccggtggtgcctacaccgtctcgtaa

SEQ ID NO: 11995 - DNA, 339 bp, A.fumigatus
gctaataacagtcatagaactactgccgagaccaggaagttcatcgatgagttcatcaaagctgttcccagatcacgaaacgcacaattggcccgccttgacttgattgactggagcttcaagtctggcagcctaaagagccatgaattgatcaccgcgtgccaggaatactttgatcgaaataagaccaaactgtattgtttcgtagatcttcggaaatatctgtctgatttggataaggcatctctaacagagttcattcaatatgcgtctcggaccgcagggatccaaggcgatgtatgtccaaccatgattgcgctttacgtcctttattactaa

SEQ ID NO: 11996 - DNA, 393 bp, A.fumigatus
tcgaaccttggtattattgcgacgctaactccacaaagctacctcacgcccaacaatatcgcggaccccgggatgattgagcagtttggtgccgattggggattgaacgcccgaggtatttactaccgccatttttattctccagggtgggttacgtccgatcacgagctctggctaccgtcacttgatggcatcgattggaatcatttcagtgagtccagtcgcctctcgagagcagaagctttcctcaagcatgttctcaacaatgaacgatggaagaagagcgaatatgcatgggaagccgacgcctggtcagatgttttcggtcagatgaagaatgacccagttcttgccgtgtcagtttctccccattgctgcagcctcagcaactga

SEQ ID NO: 11997 - DNA, 1269 bp, A.fumigatus
tactcttcaataatcgtccctctctcaaccaaatcgaaaatgccccggtcgcaggcctttcacgcgggtcgacagcccctacaagaccaacgagtgccactgggatcagcccacatctcgggtccactggccttttgcaatccaacacgggcgcattttccattgtccacgcattcgcagctgcaccaagaacccgtcgagaaacctcgcattgaaagactctggcgctctagggataaccggaaaggccgccatgcgctcaccatccaccagcgaccgccgggactcgcaggcaagacgtacccccggaaaacaattcacccgattgccatcgccaacgggattcttcgcatgttcacgaccttcccctactgggacatttccttctgggtggctttggtctttacggtcggatcgggaatctgggtcatcaacgcctttttcgtctggttgccgctggaagacccgtccaccgaatttgcgaacgaagtccttaccggcggcggcgtcacggcctttatcggcgcgacggtcttcgagttcggcagtattctgctcgttctcgaagcagtcaacgagaaccagacgggctgcttcggctgggcagtcgagacggccgccaaggaagccaccgatgcggccgaagaggccgtcgtgcgaatcaagtccgacagggacttgtgtcggcatcatcatgcgaaccgtcgttcgttcctgtcgccgtccgaggcaagacaggactcgaacgaacagacagggattgctcgaaggcggtcgtttgcctggcttcctacactgaacgaactccgctcccattatcgccatgagatcggattctgggcttcggccgtgcagctcgtcggagctaccatcttctggatcgccggcttcaccggtcttcctggcatcatgaatcatacgagcccagcagtcaccaacggcgtcttctgggtgccgcagatcgttggcggtgcgtgctttatcctcagcggcctgctttttgcgatcgaaacgcagccgaaatggtatatccccgccatgcacatcctcggctggcatatcggattctggaacttcatcgggggtattgggttcaccctctgtggagcgctggggccagcaacggccaactcgggggtcgagtatcagagcacgctggcgacgttctgggggtcgtgggcgttcctgtgggggtcagtgatacaatggtatgagagtttggagaagcatcctgtggaggagaagcatcctgtggaggagaagcagtaa

SEQ ID NO: 11998 - DNA, 519 bp, A.fumigatus
acgctagctcggattttcgccgtcgtggtgaagactctactgcctcgcctgcatctccatgcggcggctcctcaaccgcgtccacaacctcctctatgcgcgcgacaccggcgtcgccttcgacaaccaccagttcccctccgtcgtcgccgaactcgcccaccagctcgaggagtggaaggacctcctcccccctccgtttcagttcactgtcgacccccgtcccctgccctgcaccgccgccgcattcctgcgccagcgctacctcacctgcaagagcgtcatctaccggccctacctcacctgggcgctgtcgatgaccgccaccgcgacggtggagcatttcccgccgcagctcttggaaggatgcaagatctgtctcgaggcgtgctggctgcatgcgcagaacttggggagttatccgcatacggtgctggtggatacgtggatctgctcgttgtcgtatggatctttatggcccgggacccttggctttggatcacgctaatgatggtgtag

SEQ ID NO: 11999 - DNA, 477 bp, A.fumigatus
agactctactgcctcgcctgcatctccatgcggcggctcctcaaccgcgtccacaacctcctctatgcgcgcgacaccggcgtcgccttcgacaaccaccagttcccctccgtcgtcgccgaactcgcccaccagctcgaggagtggaaggacctcctcccccctccgtttcagttcactgtcgacccccgtcccctgccctgcaccgccgccgcattcctgcgccagcgctacctcacctgcaagagcgtcatctaccggccctacctcacctgggcgctgtcgatgaccgccaccgcgacggtggagcatttcccgccgcagctcttggaaggatgcaagatctgtctcgaggcgtgctggctgcatgcgcagaacttggggagttatccgcatacggtgctggtggatacgtggatctgctcgttgtcgtatggatctttatggcccgggacccttggctttggatcacgctaa

SEQ ID NO: 12000 - DNA, 1083 bp, A.fumigatus
  unsure (120),(868),(1003),(1031),(1033),(1077): Identity of nucleotide sequences at the above locations are unknown.
ttagagacgatcaaaatatacgcggtccgaatgaaggagatctctcaggatatatataactgtcacccatgcagtcaatctcgatatcaacggcgacaagccttcaccatgcgtctctcntgccttcttttcatggccatcgttggaaccttctccagccatgccatccatcatcaacccagccaggataccctccggtttggcactccggagtccgtcggccttctgtccgcccccctccgtcaactggtagccaacatcaccggctatcaacaaccagccaactatggaggattctcgcacaatgagatgcatccaatcgagccatcctctgcagtgattgtgggccatgatcgtaccatcgtctcccttttcgccagcggaaacatgttgctgtatgccgacgccaacggcaccgaattgcctcgagggcagcaactctcggcacgaccagacaccatctatgatctggccagtctgaccaaactatttaccaccattgcagcccttcgcgagatcgatactggtcggcttgccctggaccaaactgtcgcgtcctacatgccgtcattcgccgccaatgggaaagagaacatcaccatcctgatgcttctgacgcatacttctggctttgctccagacccagagcctccgttgtatgatcccgtctatacaacagtcgaacagaggacggctgcaatactgaaccagtctctgctccatgctcccggctcgacttacctctattcagacctcaacttcatgtctctgggtctcctcctggagcacatcacccacaaagcactggatgagttgattcgagagtacaccgatcccctcggaatgcacgacaccttcttcaaccggngtaatattgaaggcccagcattccccttctacccccgtatggcagccgaggaataccagatcgaggtcctgggatcaatggaggccgcgcgcccgcagccagttcgcgggaccgttcacgacgaaaatgccttgngctctggatggggtggccggacacgcangnctcttcttgaacgtcgaagatacagccaatctttgccaaaaggntcttga

SEQ ID NO: 12001 - DNA, 471 bp, A.fumigatus
  unsure (50),(95): Identity of nucleotide sequences at the above locations are unknown.
aaagcaccaggggccttattggaaagccgcacggaaaacattgagggttngggttttcaaatcgcccaaccttggagtgggtatgccgtccattngaccacgctttcccggccagcgttttgggggaacttgctgctccttttcctttgccataaagccaccattttgtgggaaggaaactcgcatgctttagctatgcaagccctaggagtatggatgtttattagcaaattcatcaaactcttaggacattacatccggtatccggtggacgtcttacttctgcccgtctctatccttttcggttatttccacggaggaatcaagatgtacgcggtgctaactctgaatgtggtaagtatcccattttcccaaagtttgttggcttgcaccaagcatggagtggactcgagcctgttgtgtccagaaattcagatgctgcgcaatttttttttcttttacgtttcttaa

SEQ ID NO: 12002 - DNA, 921 bp, A.fumigatus
  unsure (129): Identity of nucleotide sequences at the above locations are unknown.
tgcaggcaaaccacaatcgcaggtgtcaaaaccatcgtcgactctcgagaagcgattttggaaaaatgtcgatgtcaggaaaaggccaggtacctcaccctttcttttgtgcggattgttaactcccgntccgccttacataaaactgacttttctttctgtgtagacggggagtaccaggttttattggacacgcgaccgattcggacgcccacaaaagatattttatccattccttcgacgaaaccgcatcttgcacatgctattgctctcgagtgggacgttatgacatctgcacggcaggctttgaagaatcatcttattccgttgacctcgttgactgcgcgagcgggagatattgcgcaagaagatgcaaggggtgagactaccacgagggaccagattgtaaaactcgccatgcgctatctggatactgatactctactgtgctgggtgcccgagagaagaccatacgctggcgaagaatccggagaaaatggagagcggcctgaaagtcttcgagaagctcaaatgagagtagccaaggatataatcgcctttctaggcacaaaggtatggcctggtgtcgacattgtacccattcttgacgcggacagcattttgccggtgtctcagccccaggctactaaggacataatcaaacaatgggtttcgtcgctgcaaccgcacgatctagctgctttagaaagaggaattgttgctagcaagagcctgttggttgctgttcgactggtcgtcgagtggagtgagaatttccgtcacttgcaaaggtcgggacaaaagaagttcggcattgaagaggcagcagaagcatccagtcttgaagtgagatggcagactgatatgtggggagaagtggaggatactcatgatgttgacaaggaggatctcagacgcacc

SEQ ID NO: 12003 - DNA, 495 bp, A.fumigatus
gtctctttttcaagcctcgcctcgcctcagcgtctgatggaccagcacgcacatcttgaatcctcaacagcccgtgtctggggcgcagcataccacatccccgcctcccatgccgaggaagtccacgactatctcgacgagcgcgaaatagatggctacaccgtccactacaccccctttcatcccatatctgccgtcgccacatccaccgtctcaagggccccggagacggagacggtaccggagacacagtcgctatcgccggcgcacgccgcgccaatcacctgcatggtgtatatcgggcagcctagcaatccgcaattcctgcgcgacccggctcgccgcgaaccgcaggatgtcgcggaggtgattagccacggccggggccagagcgggaagaacaccgagtatctgtacctgctcgagaaagcgttagagggcctagggcttgggagtgctgatatgcatgtcactgacctggtgcgacgggtctag

SEQ ID NO: 12004 - DNA, 765 bp, A.fumigatus
gtgctaactacctttagatctgcatctcagggtcacaaccagccaagacaaggctcttcgaataacttatattcttctactttctcgtggaactcgcccgatatctcacacacagatcagcggagaggcgttggcaggaaggctatggcgacctccggggctgacgatcctgggcccccacccacgtctagctcaagctcgaaacagttgcagctaaatcccaaccaaatcgactactttcatcagaaccccaatgcctcctggtcatcctcccctaagatagcccccatggatagctcgggaacgttctcccatgacttctccgaacaagaggcatcaccggcatctgccactttccgtcctagcaccggccggaccttcgccagtgaacccgtggattttgactacaacagagacgaccgtagaccatcggtagccagcgccacgacaatcagcagccagggctcgaagtccagtacaggcggccgattccggaagaagttgcagggtttctttggcgatgaatacctcccgccaggcgaatcgaaacaggagcaggaacaagatacccgatcgttgagcagcaggccagcctctattgatcacttcaaagcccgcgaaagagccaattctgatggcgctcgaaacttcccagaaagatcccaggatgatacttcctcactacatccttcaagaccgcgaaccccgctaccatccagtgagattactccatggttgtatcaaagcttcaatgtaagttcatga

SEQ ID NO: 12005 - DNA, 1422 bp, A.fumigatus
gacattccgcaatttggagaagctcctattcgagaagtccccatcgcccctgaaggaagtcgccttgctggtcagactgctacgaactcaggtgcgccaagagaagctcggaggcaccatggcagccaccgtcattcacgaagcaaggaagaaaagccgactgtcgcgggtgatcttgctggttatccagctcgtccagctacaggacgtgatgattcttatctcggattacgccccttccgagaccatagcctaaatgcctcgacagcgatgagctcaactaccactctcggcggtcgctctactagccccacgccgagtatacagagcgcctattctcgagaacaaagccagaactcccccggagcgccgtccaacaagcgatcgatactggataaaatccgtcgtaccaaagcacatggccccttgaagcattttcccggatcaaaatccgcgcaagaagcatcaaagtcttcatcgaagctcgcgcggagggaggcttctcctcgacggggccggcaaggcagtctggaaggtggcacatctctcagaaacctggatctaggcgattacgagcgtcgaaaggacgggaaaggcattgtgatgggctccacaaagttacgaaaccggcggggccttggcaatgaagcgcctcctgggaaggacgtcaaactttctgaggagcctggtgtttggaggcttgatacagacctttcacacatggagggaatcgttagccagcaaccccctccttctccaggcgacaaaagcaaagctcaggatggggtcccaccaaagcatgaggaagggaagaagtcggagggcttgcctccgggtcactgggatgctccggagagctggcaagtgaagaagcatggggaggatctcgctgcgcggcttccaaatgtggcaagtgatgcgacaggtattgcacgtgagccagatgggacttcatacttcatccgggtctttcgtattgattccacgtttgctacgctttcagctggcctgaatgccaccgttgcagatatcctccttatgcttggccgaaagtcttttcttcaggaccacttaaacaactatgaaatcgtcatgaagaggaatgatctctctagacagcttgatcactcggagagacccattcttatgcagaagcgattgctggagcaagtcggatacactgccaaggatagaattgaagagatcggtcgggaagatcacagttacatctgccgcttcatattccttccaaccaagctcagtggctacagcagtcttgacggcgatccaggattcagcagaatgcagaagttcagtcatgtggatcttcagggtcggagtctcgtcaccattccgatcacactctacaagaaggcgtccgagattatctcactgaacctgtctaggaatttggtcccttga

SEQ ID NO: 12006 - DNA, 354 bp, A.fumigatus
gttcatgacccaattgcccacattcgaagtcgccttcacatgtcgtccctgtctgtttttggaaattttggggtttcttattttgtgactatcattaggacattccgcaatttggagaagctcctattcgagaagtccccatcgcccctgaaggaagtcgccttgctggtcagactgctacgaactcaggtgcgccaagagaagctcggaggcaccatggcagccaccgtcattcacgaagcaaggaagaaaagccgactgtcgcgggtgatcttgctggttatccagctcgtccagctacaggacgtgatgattcttatctcggattacgccccttccgagaccatagcctaa

SEQ ID NO: 12007 - DNA, 927 bp, A.fumigatus
  unsure (142),(154): Identity of nucleotide sequences at the above locations are unknown.
gctgtcccctcgtccaccgatttgattatcctgctccttggcttcctggccgcggttgcatccggcgtcccgttcccgatcatgtcaattgtctttgggcaactggtcaacggactgaactcggctacttgcgatgttgacncctccaccgcgncatcctaccaggctgggatcaattccaagatactgctgattgtttacgttggcatcgcctattttgcactcatctatatccacaccctctgctggaacattttcagcgagaggttggctcagcgcatacgcgagaggtatttcagcgccattctgcgacaggatacaatgttcttcgacaaccggcctgctggggaggtgtcggcacgcatcacagacgaaatagcggtcttgcagcaggggacgaacgaaaaggtcggcattgtgatcagcagtgtgtctttcttcgttgccgcgtacgttgtcgccttcatcaaggatcccaaactggctggcatgctcgtatccctcacgcccgcatacctcaccatggcactaggtggtggatacttggtgcagaagtacgtgggccgctcgatagaggccatggccatggcatcgtccgccgcgttggaagcgatctccaacccactggttgtgcatgccttctctgctaatgcacgcttggagcagaggtttgtcgaagtcctggcgccggctctgtccgccggcgtatggaaatcggtggcggtggcattgcaggcggggcttttgtacttcattgccttctcggcaaacggccttgctttctggcaggggtcgcgacagatcgccagtgcggtagaatcgaatatcagtggcattacggttggagacacattcactgtcattctgattctcatagacggtacgttgatctccttggctcagatattgaatgggagtgtatactaa

SEQ ID NO: 12008 - DNA, 531 bp, A.fumigatus
atgggagtgtatactaagccgactgcggcagcgtccttggtgctcagccaggctgctccattcttgcgaagctttgatgccgcatccgtcgcttttgccaagttggaggcggatatgaaccggccggcggtgattgacggcaccgtcgaaggcacaggtgggttgctttcagacgttgccggagaggtggagctgcgcaatgttgactttgccttcccatcccgtcccgataagcccgtgttgcaaggcctgtctttcgtctgcccagctggtcggcagactgccatcgttggtctttccggtagtggtaaatccacagttgccggactgatcgcccgattctatgatccggtcgagggcactgtgcttttggatggccgtgacctccgagagctcaacgtcaggtcagtgcgaaaccacatcagtctcgtgcaacaggagccctatctgctcaaccgatcaatcctggaaaacattgcccttgggctgatcaactcacccaagcacgagcatctgcggccggcactgatg

SEQ ID NO: 12009 - DNA, 279 bp, A.fumigatus
tgcttttacctccgtagaggcttccgaagtggcagccatgatggtggacacctctttcctctagacacctggtttctctatctcggatctttctctaccctcggtgtctctgaggatcaaataagaggttgcaagaatgcgagcacagacgcccgtgtaagtactccgtacagcccaacgactcccgttgccaaggtgtataccccctttctacgtaagatcattgtgaccgcagagcacgtctccaccagtcctggcgtttctttccaaaatggctaa

SEQ ID NO: 12010 - DNA, 861 bp, A.fumigatus
tccaagtatcttggccactgcactgggaggagaaacagactggtcgcgggccccttccgatcatgtaagcgctcacagacgggcccagaatcctgcgaggatggcatcggcttactaacttcaaccagctacattgttgacgggaatgcattgttcctgactgcgaccgaggctgcgtggcgccgtgcggccgcctcacatttcgctggcgggggcatcattgtcgctattggataccccttaaagggaaagctctatgatgcccgacggcgcagcttcgatctgacgccccccacggcgtgcgcacccgtggggtatgggggagcagatgtgttcctggacttcattgagaattctgttcgacctgcggtgcaggctcgattcccacaggtgtcgctcgccagagaagcgctttatggccattcctatgggggcttgctcgccctccatgcattattcacccggccgcagtccttcgattgctacatcgcgagcagcccctccatctggtggaatagcttatgtatcttgcacgaggcaaaggcctttgtggaaaccaagaaggtttcacatgaccagtccccgtcgttgatggtctcctggggttcctgggagcaacatcccccgcggtgggcggacgagctgcttgatcactacgaggcgagaaaacgaaccgcagcggagttgagaatggccgacaatgctctggatctgtgtgcgatgctgcacgggtgcagccggctacacgccctgatcaaaaccgagtatgagggggaagaccacacaagcgtgatgtcgtgctcggtgagtcgcggcctgaccatgttctttgaggaatggccattccaccagtcggggtga

SEQ ID NO: 12011 - DNA, 1158 bp, A.fumigatus
gaccttactaacaataatgcgcccagtagttcccggatgcgacctcggctttcgccattcgatttcgatattcagtcggagacattcccctcgctctgccttcgcctactacccccgcctcccagtctcttctctaccaatccgttcccatcaccgtcatctttcccactgaagccccctggggtagaacaccttgatattgtgcgacaggcgattcgagcgaagatcgaccagtggcaatccgatcagctgtccacgcaatctgcgaacaactcccccggtcggcccccgctcggcctggacgctaacatgatcagccgcagcgcacagcaacatgaagatatgagcctgaggcatctcgagctggcattcaaacattgggcctcgctgccaccggagacgcgcctagaggcgtggcatcttgagatcacccgcgcgttcgcccgtgaggtggagaaacggaaaacattagacgagcagctcgctcgcgtccagcaggaagccaaccagctgcgcgcacaggtcgagaagctgggttcctgccaatggccccgcgagttcgccctcttcccgccggacaccctacccctcccgcccgctgttgcgcgggagctagacgccaaggaaagccagatcagccccggttcgcctcggtgggactacgatagcgttgtcgcgaagtggaagcgggtcgtcatgcacgacaaatccatgggtcgcgtcggcgtcgggtatggcaatcctcctctcgacgatcgcagcagcgcggacaccaaggcccgcgcgacagaggagccgcctgcctctgctgctcttgcatctacatctacatctgcacctccgtccgcacaccccccgccgcgagccctccagcccgctcctggccccgcgctcgccgcaagtccagaccagtcgtcctcgcatacggggggcgcctcggctccatctagccagaacacctcgccttatctccggagcccccaggcaggtccgcaagccaagcgtcctcgattaatgaacggtgcagatggcggccacacttcggcagcgaatccatcggccacggcgccgaatacgtggaatccgcacagccaccagtcccttccgggttcaaacttggctagtgcgtctggaccaccgcctagctctggggcgtag

SEQ ID NO: 12012 - DNA, 456 bp, A.fumigatus
gccgcctgcagcgtcttcgacgtacccgccagcttgtctcgcaaaggcgccggcgtaggtctggcaggtctgacccgatgggggagagaactgggtcacctccctgctgacgcagcggacggggatgttatgggtgaggacgccgaggaagccctcgaggaggtagtggaagggggtgagccagtacatccaggactgccagaagtgggggagtgcgacgtaggggacgacgacgccgcagaaggcgacgacgaaggtgaagaagcaggggacgaggagggaggcgaagagctcgttgggggagaaggcggcgatgaactggccgaagctgacgtagtaaagctcgaagaccatgagcagcatccaggtgtagccggagctgaaggagtcgcgggggaaccatacgccccagtacctagttgtgttagtggtgggagacagctagaccttggctga

SEQ ID NO: 12013 - DNA, 498 bp, A.fumigatus
ctgtctcccaccactaacacaactaggtactggggcgtatggttcccccgcgactccttcagctccggctacacctggatgctgctcatggtcttcgagctttactacgtcagcttcggccagttcatcgccgccttctcccccaacgagctcttcgcctccctcctcgtcccctgcttcttcaccttcgtcgtcgccttctgcggcgtcgtcgtcccctacgtcgcactcccccacttctggcagtcctggatgtactggctcacccccttccactacctcctcgagggcttcctcggcgtcctcacccataacatccccgtccgctgcgtcagcagggaggtgacccagttctctcccccatcgggtcagacctgccagacctacgccggcgcctttgcgagacaagctggcgggtacgtcgaagacgctgcaggcggcctatgctcgtattgtccgtattccatcggtgatgcatttgtacgtttctccctctaa

SEQ ID NO: 12014 - DNA, 564 bp, A.fumigatus
atgaatagtcagtctggtcccggttccagccgaaatctagggaggcagatgggaattgacgacgaaacacggaatccttctgctggagtgcctgaggcagcgggaaatggcactagtgactcgtcacgaagtaatcaccccaaagaaagagaaagaggagggaagaagcaaaagcgggcacgagtggacgaggatgcggatgaggacgtggacgtcatgcaggcagagatccagctgatgcaggcgcagcaggaccgggcgtccgcggagatttctcggtcgtcgaagcgcaagcggctggatctcgctattcccggcgctgagcaggaagtcgcagatgtgatgcctgtggcattagagacggaggatatttcagaggaagtccagcggcgattgaaaatcaaggaggagcggcgcaaaaagagagatgctaaggcagaaaagaggaaacgggatagtctagcgtcgaacgggagcgcttctgcctcgtcgcctggcggcgtcgcgcggcctaggaagaagaaggtcaaaactagtggcgcaggagagggggggaagcgctga

SEQ ID NO: 12015 - DNA, 183 bp, A.fumigatus
tgccatttcccgctgcctcaggcactccagcagaaggattccgtgtttcgtcgtcaattcccatctgcctccctagatttcggctggaaccgggaccagactgactattcatctaaacgacccattagaaccaaagagaagttgccaggacgtgctaagaatgactcacgagctttttcttga

SEQ ID NO: 12016 - DNA, 576 bp, A.fumigatus
tcctatgaagaagcagctgcagacgccacccccccgtactgggagaccaccatcttggcgcccggcatctcgtccgatgaggtttatgtggatggattgccggtcggctcgatcttctccttcgtttggaacgccatgatctcgatgtccttccagctagtcggcttcctcctgacctaccttcttcacaccacgcacgccgcgaaaaatggcagcagagcgggtctcggccttacgttagtgcagtatggtttctacatgaaaggggggagtgatggaggctctgacggcggtgcggactatgttcctccacccgatcccaacagccacaactttgatccaacttcggtttctgagaattccggtggcaacagcggaagcggcgcgatatccgacatcacaacgagcgagtggatttcctatgtcttgatgattgtcggttggttcattctcatccgcgccatcagcgactttttacgggcccggcggcatgagcaattagtactacagagccccgagcgcggtctcagcgttccggtcatcgcggaaggcgaacggtccgaaacggttgtatag

SEQ ID NO: 12017 - DNA, 1395 bp, A.fumigatus
  unsure (97),(952): Identity of nucleotide sequences at the above locations are unknown.
gaactggccccccgccagtcattcaagcctactgcgtcggaggatgacggaaccgttctgactcgtacagatgtattcctctcgccattgaagcctncgaccaaatcaagcatttccgcagaagccatcaacgccttcctttactaccttcatgttgcgaccccggaggacgaactgctgttgcaggaggctgaggaggagcgtgaacaacaggcgaaactacgcaaggaacaatggggcgatggagcaccgccagagtttgcgcgattgaacaatgtccggcggaagcctgtccctggcagccctcttccagagacaccgttgcagcaggagaattactcgccgtgctctactgcagtcgaccctctgcctccgccgaccccgcctcgtccgacgcttcgtcaagactttcccagttcggagtcagctaccgctgtttcggatatctcagaccacctgggcgactcgcgtggaaatacaggagagactagagcaccgccgttaccgcccaggcctctgccgtttgtgccaacagagggagctccttcagatccgatcaacaacagttcggcgaagaagagtaatcgatggagcgccctgtcggggtatctcaacagtaaaggactcgatagctggaaggaaaagtacgaagccttgtctgcaggacgtcttagcctggacagcagggggtccgaactacggccgcatacgtccgacggggcagggtcgaacgctcgccgagcatcgccgtcacggagcccagggcagtctcctcacagaaggccgcgcgaccacggccaggcctcagatcgacagggattccatatcactctcatccgccgcgatcccactcatggcattcaatggaatgtcgcgacgatctccacatccaaggcggacagcaccgccgtcgacatcgaggtgtcgacaccggggtataaccggttcctancccaggacgagccattttccctgcagagcctgggcatcaatctcccgtcagatgcacaggctctgccctcctccacactcaaatttcctacacagtcgcatcctgaaacacggaccccggattcgtcactgccacgcaaattccgccgccaactctgcgtatcgcggccatataatcactgggacgactcgcgaggctccctggatttacctaccagcagatcctcactggacacctttactggcagtccgacccggccacatacacaagcccactccaagctcaaaagcggctactacacattcccctccccctggaacggcatctgcactttctccactagcgtcaacggccgcaatctcaaatgcaagcacattgatcccacgccctcatacccagggcatgggaacgaacgcttccacccttgcaaggccagccgttga

SEQ ID NO: 12018 - DNA, 711 bp, A.fumigatus
cgggtcgttactttgcgtcagccgttcaaggatcctcgaaactgctccttcgccatgaagacattacgtatagtacggtcaacgatttcgatactggctgttctgagtcagttgcaactatcggatgcgacaccgctggaagtcgaagaggtcagtctcaaagaagccggtctcgagaagcgctgcgcgaacccttgtggctattacagtcagctatgctgcacctccagccagacctgcggtaccaacagtcagggacaagcagtatgtttggactcgtcgggcggcagcggcggcggcggaacttgggaatactataccactacctacgttcttaccgagacggatactaaaacgattacttctacatggagtagcctgatacctaccgcaacaggctcgaccagttgcaggaccgaccttggcgaaacagcttgcggcaacacatgctgtggtgctgcttttgtctgcgccaatgatcaatgtatcgtgggaagttcatcgatatgggtaacagccactgcgacgcctccagtccggggaacgacacagtcgactatgacccagattgcaactgcgacgacaacacaaggtttcattccacctgtgggaactgacggcgcaactttgatcggaatccatgcctgtggaggaggactgagcggtggcgcgaattgcggtatagttatcggtgtaatttgcggcgtcttt

SEQ ID NO: 12019 - DNA, 228 bp, A.fumigatus
agcagattccacgaggttttcgaaaacgaacggaatgttaaaaaattttgtgtaatgattgaattaaacaaagtctctatgagagaaaagaatggaagaatgagaagcgatccagcagctcgtggagatctgactgtcgagactcagcacaactcccagcctcctctcatccaaaacccaaccaccggattttctgattctaactaccaatcgctacaacacacctga

SEQ ID NO: 12020 - DNA, 1368 bp, A.fumigatus
ttgttgccgctggttgatttcgtgagagcacctgcagggcccaacatgcatgctgccgagctggcctatcttctgggaggtatttcgattgcgttgaacttagtcgctagcgtcctccacggcctttgccttgcttcatcaggagcgtcgtcaatcgaatcgatcacagtcacactcagcgctgctagctgtctggtgttgcttatgctagtagttctatggagaaagagcatttggcttcagcctagagactgttgggcaaagtggcggaccgtcgcgtatggcctcatcttggcatatcttgcaatatccagcggcttcacagctggcgccgtcgtgtggagcacctcaaaactcgaggtaagggggaaagaaatggggatacctccaagccagctaggactatacatttccaggtctgtggtatggacattggctgtgttaagccaggggctgtttgcaggtttccttttgattgacaacccccacaaccaatgtccgagctcgctctcgcaggagcttgtgctgcaagcagaccagtcgagcctaaagcataagagcgctaccaaggaaccagcgttgaccattgaatcgggacgacaatctgttgatcgaaaaacgagctgcgatagcggtccttttgcgaaccagcccgctacctcaatcgcgtcctctcaccgctattctggaaggactctatatcagccagattctaagaacaattcagtcgatcttcaaccaccagggctgagtatgccgtcccctgattccaacgcttcccgcaacctattagaaacgagcccggatgagcgggacagctgcagcataaccaccgaggagcggcaagggatgcgcttattccacgggactcaacccgagatcaagaggtgtttggacagtttgatgcttcagccatcgtcaggcacgtcatctccggccgcatcgacgcctaagctagaggcttcccgagcgcctgcacccccaaagctgcacttccctgacgagagcaatatccacccattgtttcgttccgatagcccatcgccaccgccgacacctttacccggaacaaatcttcatggactagccgtggccggacagacgatctcggtcaagacgttgaatcggatgagatcgaccaattcccttcgacctcacggagcacgaagcaggtccccactgttcgagcggataaatcagcaaggcgagacgacaggggaccaaaagttgaatccatgctgtgagaaccgaggcagattagctgaaaagacggcgatacctggattcctcatggctgcggatgtgcgccaaagcatcgcccggtatgagaagaagtatgaattgaatgaatctccggacgaaagctag

SEQ ID NO: 12021 - DNA, 186 bp, A.fumigatus
taccgcgagagaacttgggtcactcttcttttctcttctacgattctgctgcctctcaagacccctctacactattcggaccctctaagtcgactgcgtcaaaacaactgtgcattcaactccacactggtactcctcgcatctcgaacgtgcatccatctcttgttaattgttgccgctggttga

SEQ ID NO: 12022 - DNA, 237 bp, A.fumigatus
aaaaaattttccgggcccccgttggtttcccctattgactatccccaggttcccaagggcaaatcgcgcgtccgggtcatgatccatgctgggaatacggaagaacaggtggattatctggtggccacgctttgcgactttgcgaacgagatgattgatatcgaggagggtggcgagaagggcaagatccccaaagccgcgcaggagatttacgcgttgatggcggcgcatgcatga

SEQ ID NO: 12023 - DNA, 414 bp, A.fumigatus
tcgcacggggaacggaggactgagctacacctggtcgtcgatcgcgttgaccgaccccttccggcgtggagagatgccgctccccatcctggtggccgacggccgcaacccgggcgagctgctgatcggcagcaactcaaccgtctacgagttcaatccgtgggagtttggctcgttcgacccgtccatcttcggcttcgcgccgctggagtacctcggctcgcgcttcgacaacggccagctcccccgcggcgaaccctgcgtgcgcgggttcgacaacgccggcttcgtcatgggcacctcctcctcgctcttcaaccagttcattctgcggctgaacaagaccgatctccccgacctggccaaggacgtcttttccaagatcctcacggccatcggccgggacggggatga

SEQ ID NO: 12024 - DNA, 480 bp, A.fumigatus
catcgccgtctacggcccgaacccgttctacgggtaccgcaactccaccgcggcctactcgcgcagccgcgagctggatgtcgtcgacggcggcgaggacggccagaacatcccgctgcacccgctcatccagcccgtccgccacgtcgacgtgatcttcgccgtcgactcgtcggccgacgggccctacagctggccgaatggctccgccctcgtcgccacctacgagcgaagcctgaacagctcgggaatcggcaacggcaccgtcttccccgccgtgccagacgtgaacacctttgtcaacctcggcctgaacacccggcccaccttcttcggctgcgatccggcgaacctgtccgcgccggcgcccttggtggtatacctgccaaacgcgccgtacagcacgcacagcaatacctccaccttccagctggcgtactcggattccgagcgcgacgagattatcacaaatgggtataa

SEQ ID NO: 12025 - DNA, 2112 bp, A.fumigatus
gccctgaatgattggcagttattctggaagatccacggattgtcgactgcatgcctccgattcgtggagaaagggtccattctgcgatgggtcgatgagggttcacggctgttccggaagtatgtcctgagcccaagaaccagcgtatatctactacgtccgtctgagctatcggcacatttggcaagccacttctggaagacatccaacggcaccgatatgaaggcccttctctcccttctaacggctgtcgccgtagctacggccactcctctcgacctgtctctccgagccctccccaacgctcccgatggctatactcccgccaaagtgtcttgtcccgcgacacgacccagcattcgaggtgccgggtctctttccccgaatgaaacgtcctggctggagattcgtcgcaaaaacaccgtcgagcccatgacagacctgctcgggcgactcaacctcggcttcgacgcagcgggctacatcgaccgcgtgtccagtaacgcatccaacctgcctaatatcgcgatcgccgtttcggggggtggatatcgtgctctgaccaatggagctggggctatcaaagcctttgacagccggacccaaggctcgacgcagtcgggacatctcggtggtctactgcagtccgcgacatatgtatccggactgagcggcggcggatggctcgtggggtccgtgtatctgaacaacttcacgaccattgcggacctccaatccggggatcatgggaacgtctggcagttttccacgtctatcctggaagggcccaaggccaaacacctgcagttcctatccaccgccgactactggaaggatttgctcaaagcggtcgacgggaagagcgacgcgggcttcaacacctcgctgacggactactggggccgcgcgctgtcctaccagttcatcaatgatcgcacggggaacggaggactgagctacacctggtcgtcgatcgcgttgaccgaccccttccggcgtggagagatgccgctccccatcctggtggccgacggccgcaacccgggcgagctgctgatcggcagcaactcaaccgtctacgagttcaatccgtgggagtttggctcgttcgacccgtccatcttcggcttcgcgccgctggagtacctcggctcgcgcttcgacaacggccagctcccccgcggcgaaccctgcgtgcgcgggttcgacaacgccggcttcgtcatgggcacctcctcctcgctcttcaaccagttcattctgcggctgaacaagaccgatctccccgacctggccaaggacgtcttttccaagatcctcacggccatcggccgggacggggatgacatcgccgtctacggcccgaacccgttctacgggtaccgcaactccaccgcggcctactcgcgcagccgcgagctggatgtcgtcgacggcggcgaggacggccagaacatcccgctgcacccgctcatccagcccgtccgccacgtcgacgtgatcttcgccgtcgactcgtcggccgacgggccctacagctggccgaatggctccgccctcgtcgccacctacgagcgaagcctgaacagctcgggaatcggcaacggcaccgtcttccccgccgtgccagacgtgaacacctttgtcaacctcggcctgaacacccggcccaccttcttcggctgcgatccggcgaacctgtccgcgccggcgcccttggtggtatacctgccaaacgcgccgtacagcacgcacagcaatacctccaccttccagctggcgtactcggattccgagcgcgacgagattatcacaaatgggtataacgtggtgacgcgggggaatgcaacggtcgacaagtcctggccgagctgtgtggggtgcgccattctgcagcggtcgatgtaccggaccaacacgtccatgccggcggtgtgtaacagttgcttcaaggagtattgctggaatgggacggtggacagcaagacgcctcggacgtacgagccgaccctgctgctggggagtacgtcgaccaatgcggcgtacacgcagggggtgacctggctggtgggcatccttgctgttggggtggcaatgggaatgacagcatag

SEQ ID NO: 12026 - DNA, 720 bp, A.fumigatus
  unsure (55): Identity of nucleotide sequences at the above locations are unknown.
cccctcgaattggctggtttttacgccgcacagctccccggcgaacggcgtttgncggccttaatagggcgcgggtttctgggggattctgaacggggccacacggatccccggctctggcgatggctgttcatcatcgaggcaagcatcaccgtcggcatctcgctcttctcggccatctcgctgcccaactacccggcgaccacgtcctggctggaagagacgaaccaggcctatgctcagtggcgtctcatcaccgatgccggcgaggccgatgatacaaacgccgtccgcatcaaagacgcgctggtgatggtgtcccgggaccgacgaatctatctctttatcctgctccagcattgttctctcctgtcgcagacgttcaaatacttcttcccgacgatcgtcaagacactgggctacgggagcatcgagaccctgctgatcacggcgcctgtgtgggtcgccacgttccttgtttcgctgctggtgacctggacttcgggccggacgaacgaccgcagctggcacatcgtcgggttgatgagcgtgagtgccgtgggctgtatcatctgcacggccacgaccaacatcggtgccaggtttttcgccatgtttctgtatgcggcttctccgtctgatccactgagagagatactgacgccagtaggatgcccatgggcgctgtgtcagcctaccaaatcatcatcgcctgggtag

SEQ ID NO: 12027 - DNA, 183 bp, A.fumigatus
acaacttcacgaccattgcggacctccaatccggggatcatgggaacgtctggcagttttccacgtctatcctggaagggcccaaggccaaacacctgcagttcctatccaccgccgactactggaaggatttgctcaaagcggtcgacgggaagagcgacgcgggcttcaacacctcgctga

SEQ ID NO: 12028 - DNA, 246 bp, A.fumigatus
  unsure (240): Identity of nucleotide sequences at the above locations are unknown.
gtttcagggatgtatagatgtattagtgaaaatatatatgtattaatgattagaacaaactgcttagtctcccctaagctgtttagaactcctatttctactgagtgcattcagaattgggtatataattacctaagcaagagggggcttgccgctggcggctcgctgggcttacgttgttccgagcatgtgacattaaggtcttcaccacggggctggaaggggcagtccagcaagagnaaccgc

SEQ ID NO: 12029 - DNA, 828 bp, A.fumigatus
gccggtaatctcccagccagggttttcccaaagggcgcattcaaggtggggattccacaaacaccgggaccaaggccttggggaaacgaacccggcctgcgctctcagggggctgagcccacgcctgaacctgaagttgaccaggtagagcctccatctgttgagaaacagaaggcggtggcgcctccaccaggattgacaacttcgtacaaagtagataaggaggatacgacttcttctgcggactccgcatctacgattcgaccgcagacgggcagggcagcctcatcatctggtataatcaccgcagaagaacatgtggccaaggggattgaatgccacgagaaaggatctctaaaagaatctacttatcatctgcggattgctgccaagcaaaatcaccccactgggatgcttctctatgctctggcatgccgccatggctggggtatgcgaccaaaccaacgagaaggcgtgcaatggctccgtaaagccgtcgattgtgtgggactcgagctgatggacgattcgaatggcactatacctcagcgagcaaaggagatgcaaaaggcctatcgtgcgcagtttgccctcagtatctacgagcttggcgtgagccatctgaacggatggggtatcgaacaggacaaatctctggctttgcgctgcttcgagattgcaggtcagtggggtgatgcggacgctctagcagaggctggattttgctacgctgaaggtatcggctgcaagaaggacatgaagaaagcggccaagttctatcgccaggcggaagcgaaggggatcagcatggttgggaacagctggtaa

SEQ ID NO: 12030 - DNA, 210 bp, A.fumigatus
tgcttatcactttgttcacttttatctttctgcctttcccttctttttcttgttccttttctttctttcttttttccccccacttcatcaaccatctcttccattctcctgttcattattgaggttcgagcagtatttttgtccgctgcctcagtcgactctggcgcgggtgctgcgagatctgccaatgaccatttggctgctttgtga

SEQ ID NO: 12031 - DNA, 192 bp, A.fumigatus
tataccttggtttctcgaacagcaatctcactccattggagaagtgaaggacaaatagcaaaactgcctccatcatcaggtaaccctagggctcccaaaaaccttattgccaatgacgttctattgcatcttccccttaactcctctcttcataagttgttgactcattactgtcatatcaacatcgagtag

SEQ ID NO: 12032 - DNA, 237 bp, A.fumigatus
ctcatgagtgcattaatcacaagagatatagaaatggatatggcttctttcttcaatccctttagctttggatatcatttcaagtactatcaaaagattaattttttcgttgctggactattaagggctatgcaactgggcgacaacccggggagaagtgtgaaggaacccgaaaaaactcagcctttcttggttggttcaacggggggaccctcgaacaagggatcagggggatag

SEQ ID NO: 12033 - DNA, 192 bp, A.fumigatus
gatattgtcgaagtcgccatgcatatttccacccaacaatatgccgttctgaaccaagttaaggggcgcggtctgagatcctgcagtaatcaggtggctgaaatctcaattgaagagtgcttcctcctttacgagaatgatatgtgcttcttggaacgttccccatctgcctttgctgacaccacggcatag

SEQ ID NO: 12034 - DNA, 333 bp, A.fumigatus
agaagtgagtcgaacttatcttggttctcggagatattgcaactgctgacccctacccttttcagccccgaagttgaattttgcggatacacgattccgcatccctcggaagctaagatgaacttgcgtatccagacctacggtatgtatttctgccacacattggcacggtttgatggagctgacaggaatatcgcagattccacaactgcagttgaagccctggagaagggcttggaggctttgatggacctctgtgatgtcgtcacagacaaattcacatcggcgcgggatgcgttcaatgccgcccaggctgataagatgacctcgtga

SEQ ID NO: 12035 - DNA, 186 bp, A.fumigatus
tactatcatagatcgggcccgctccgattaagaatccgccgcaatcttgcgggagttacaggaggagagaaggccgtcaagcagttgctggggcccaccatccgggcattggagactgctttggccaagtataatatggcatacactgaagaaatccagcgactgcagtcgctggaaaatagataa

SEQ ID NO: 12036 - DNA, 537 bp, A.fumigatus
aataaaataggcgaaacaatgctaacctccggcctaaccaacgccccaatcaccaaactcctcctcatctacaccatcgcctcctccatcgccctctccatcctcgacatcaaacacctcgccagcatccacgtctccccacacctctggccctacgcacaattctggcgcctcgcaacatggcaactcgccggcttcaccaattcaaccgagggcctcttcgccgctatgctcgcctaccatctccgcgttgttgagcgcgcatgggggaagcgcaagttcgcagtacgtccctccccttccaccttctccctattgagctcaatgtcacgctttgctcgcaatactgacgagaagggaaaagacatttatcatctccacgctaccatatacctccctcctcccgccgctcctcctcgtcctcctccgtccattgaccctttacaaactgaactatctcccttgcggaccgaccgccacgctgtttgcattgctggcgcagtatcatgcggggatcccgcatacgtttcggtatag

SEQ ID NO: 12037 - DNA, 639 bp, A.fumigatus
  unsure (19): Identity of nucleotide sequences at the above locations are unknown.
ccctccgccgcgtttaccnatttatctgtcggtgtgacacagaccgccaatgacgagctagaccggcagcttctgcgcatcgatggcatatttcctttcattgcaggggagatcagtgaggaggcgcgactgggcagtcttacacactgggcctattcaaaccggaacgccacgaaaactgctacaaatgagcgcccccgccgcgaagtcgcatccaacaaacaagacctgaaccatgctctggaaaacgaagctggatcccgtactgatgcgagacgggacgccgctcgcaaacagcggcgcacgcatgccgattcggactttgacgatgctcgtgcatctggttcgcgaaaggggcaggctagcaaaccccgcagtggtgcaggtgcggctactggggatctatctgcagttgggcatggtgcacaaacttcgggggcatcgggggcatcgggtgcgacgaaacgccgcaaggtcgaaagacctccagcggccgatgcgggcgcagcgatggaaagatccgccagcggcgctggaaatgcttcgggacgtggtgcatcgaaggacacgacagcttcagatgccaccaagaagagatctcgcgctcctaacacgaatgcagccgctcgcaagaggtga

SEQ ID NO: 12038 - DNA, 1014 bp, A.fumigatus
ccaactggcagaaataatacgggaacctccgcggcgaattcgccagtgctggcacctactcctctggctggggcgtcgggtgccgtgcgtagcgcagccagtcccggacctggagcagccgctcggccccagtcttctcgtgctcaacagagctctggacagccgaccaatggtcgccagcggccatcctcctcggcgtccaatcgcctgacaagcaacagtatgtcacctctccattttctttttgtctttcttttgctaaccttaatcttgattcaggcaaagtcgttgataccaagactctacctaaagaaactccgaaagcggatatggttgcagctgcacttaactcagaactgcaacgccaagccgagggaagagaactccggcacagccacagccaaggctgtcggacccgtcagcatgaaacgcgaagatacagaaacccgccctgcggagtcggtcgagtctcgcgaaacaccagtacctcaagcttcgaacgcagccccgaagggccggtcgtcgaagacgtccacgcctgtgctctccaccttgtcagaacccaactcgcagcgcacccgacctacccgcaacacagactccgcgcctgcgaaacgatcacataagaagagtggcagtgtagcggtatcccagcagcgagcagtgtctgaggaggaggactctctgcatgaaggggacgacgaggacgaagatggcgagccgcggtattgttactgcaacgagattagcttcggcgagatggttgcttgtgacaacgatgcatgcccgcgggaatggttccatctgtcttgtgttgggttgaccaaaccgccagggaagaatggtaagtttcattggtcgaatgagtcggaccatgctgatagggcacagtcaaatggtactgcaatgaatgcaaggagaatatgcgaagaaatcggaacgcgcggtaaccagtcagagctcggggtttcgtatgctcaggcacagttttgttggttgggatggtctctttga

SEQ ID NO: 12039 - DNA, 1038 bp, A.fumigatus
  unsure (891): Identity of nucleotide sequences at the above locations are unknown.
agatcactgaccaacactaccatcatgacgatcaagaacctacgacttggactagccattggccatggtacaggccgcgagcttattgcggttttcaagaaggtcatccacgcgctagcaagcaagcactctctgcatgtcgacttcattgaatcatcccgcatataccattcgtatcataccctcactgtttcgggggaagagaaggacctcatcaagcacatcgcggatgagaccacgcaagatgctgacgagtaccgcactttctgcgagacagctgcagccaacgggattgcagcaatattccgcacggcaatccacgcccagtctctctatctcgttcgggatcaactgaaggccgtcaagattgaacatttcagcctgggcgactccaatgctttgctcttcattcgggacgaagcccaaggcttctacgcaggggtcaatgagtatgacaatggcaaccatagcatcacgcgaagcagccccttcagtcgctccacctttgatcaaatcctggcatatgcgttggaacgagccgcagaggagtggggtgtggaaaatgtccccgaatccgtcacccttgtctacaagttccatctcttcgacggggtcttccaagcctgggcaccacattggaggtcccgctttggcatcgatgtcgacttcatccagccggacaccatgaatcggaatctcatggcctggggcattcagggccgccgcatcatcattgcgggcaatgagtacgccgacatcatccagcctgtattcttgaaatggttcggcaactccaccattgaaacgatgtgcgcggagaacgtgtacctgagtccgaacctgcatcgcctcagcgagtaccagacgtgcatgggtcgcggacgccatcgncggccaagggctcgtcaatccgtttgcgaccatccgtgccgcggctgccatcctcgaacggcatggaggatgctccggcgctggattccggcaccaaacggaaaaggcgattcaaagtctcctccggaggagactgaccacacctga

SEQ ID NO: 12040 - DNA, 903 bp, A.fumigatus
  unsure (59): Identity of nucleotide sequences at the above locations are unknown.
gtccgaacctgcatcgcctcagcgagtaccagacgtgcatgggtcgcggacgccatcgncggccaagggctcgtcaatccgtttgcgaccatccgtgccgcggctgccatcctcgaacggcatggaggatgctccggcgctggattccggcaccaaacggaaaaggcgattcaaagtctcctccggaggagactgaccacacctgaccagggcggctcctgcagcacagatgcggtcgtcgaacattttctgcgcgcgattaccgatctgacggatgctacaacacctgatgtccacagtgatacggctgaggccggactaataagcaatgcctggatcggtaagaagtccgccgtggtaatagtggactaccagaacgacttcatcgcaagcacgcccacccctgccgtgtctgagctgtctcgcaccattccgcggctcatacgatgcgcccgcaaggagggacgcgaagtcatctttgtgcgcttcctggggaacaccagcttccaaggacccagctggcagcaccgggatgcattgctaggaaaatcggagaaatgcgtcgagggcacctggggagcagagcttggcccgggcatcacccctgcgcctggtgagcggatctttgacaagaaggccctattcgatccttttctggtcccggagtttgcggagtacatcgcccaacagggcttggagcatctggtgctggcgggcttgtacagtgatgtttgtatcgatgccacggcccggacggccttccagaagggactgtgggtcactgtcgttgaggactgtaccgctgctttgcatgcaaaccaggtcgatcatttgaggtttatggagaaggtgtatggggcacgggttgggacggtggccattttatttggggtgaaggcttag

SEQ ID NO: 12041 - DNA, 666 bp, A.fumigatus
gtcctatcaccacaattgaacaaggataagtaccaacatcactgtcctaaaatgatagactcgtcaacggccggaatcgaggagctgcatgctcttcgaccgaagaccattcatcaacctcttcacaatgctatccctccagaactagtccctcgtttcgacccggtctacgtggagtactacaacaaatataatgctggacggctacacactcacgaggtacccatcgaagactttcgtagaaatcccgccaagtacaccatcgcctatggccgcgcagccggaccagatgtgttccgcatcactgagcagaaatgccccgtgaaggatggagagatcactgtgcggatctttgaacctgctccagtgtccgatgaccagggcaacccaaagaaaagagcagcatatgtcaacttccatggaggcggttgggtgtttggtgatctctccgtcgatcatgatttttgcaaacgcctcgtacacggcctcgatggccacttggtggcttttgacgtcaattaccgactggcacctgagtacaagtacccaattcctgtcgaggattgctgggcagcattcaactgggtcagtgacttggtcatcaattccttcactgtacaattgtcgaagtctgagaccaaaggtctgacagtcggttcagattag

SEQ ID NO: 12042 - DNA, 345 bp, A.fumigatus
cagtcggttcagattagattgaagaaagcagacgaattcaatatcgatccggatcggatggcaatcggtggtgtctctgcaggaggacaactgtcggctgttcttgcacatctctgccgtgatggcaacattccactgcgcctgcaactcttgactgtgccagcctgtgacttgcacagtgtcttcacgtcagatggacagtttgaccgcgagaactgcccatacgagtcataccgggaaatggaatttacgccggcgcttccagcagcacgaatggcatacttccataggcattttcttgggaatcctcgacctcccagatccgaggaggtaggtatccgctag

SEQ ID NO: 12043 - DNA, 258 bp, A.fumigatus
gactggaaaatctctcctatgctggctcctaattttgaaaatttagcacctgctttggtgcatacagcagagatggaccctctccgggatgagggcgaggtttatgctgccaaattgaaggatgccggagttcgtgtggaactgatccgtgctgtcggagcacctcatattttcccgctattggatggaattttggagtcgggaagggtgtataacgagaaggtgatagccacgctgcggaaagagcttttggtgtag

SEQ ID NO: 12044 - DNA, 390 bp, A.fumigatus
tctgaggacactgtgtatctccaagacagtaagatatgctacggtactagtgagtgttcattcattcatgacgccagtgttattccctttcccggacaactgaagaagaaggatcatagtttatccgactccaatgtttaccatacattacccactaagatccccgaatctaacggattttgcacggattgtccagctgtattgtgtttatggaataccggaccgggtgttttcggcagagaagcccggaaaactggttgggatagctctgtaggagaaacaaaagggcaaaaaagcggctggacggaaactggcagaagctctgttttatttgtctcgttctactcgtcttcttcttccgctcgcgctctttgcttcctttttttttaa

SEQ ID NO: 12045 - DNA, 666 bp, A.fumigatus
catacgcattgcgcggttccttccggccccgtggtgaagatgttcctgaggtcgtttgtaccgttttccagggcctgtgcatcattggtatgttcccgtcccggctggcaaagttcgccgctgaccgatcagaaccgatctcttgaccgtatgacgcgaattgcagccggcaccgagaacgtagattacgacagctgggttccgtcgaagatccatctgaacatccccttgatgtggaatatcctccagttcacctgcagcgacgattcctatccggctgtcccgtctggaagcctcttgcattcctcgctcagcgcgtctgccacccgaaacgacgccgaggaaagctctacactcgaaatcatcgtgacgacttcacctgaagtaaccgtcaacaccgcagacggcggccagggcgtcccaatgcctctgtatcgcgccccgaattcgtccaaggacagcaataccagcccagctaccgctccacggtctatgcctccgccagatgcagtggtagctccgatcgacagccttatgctcaacacgccgtggctgtgggctgatccggcgccatttggagacgtggatgatctggattatagcacgtccgctccggcgataggtgacattgaaggttcggcgtggtggaatctgggaaatttatag

SEQ ID NO: 12046 - DNA, 714 bp, A.fumigatus
ggagctgaagcggaagcatgggtatgcgtctgcgtggggcatcgaggcgcggctcgtgagtccagccgaatgcgtgaagatgtatccgcttctgaacgaggaaatcgtgctcggggggttgcatatccccagcgacgggctggcgctcgcagcccgagccacgcagctgctcatcgaacgcacacgacacgcaggcgtgcgctacttagagatgacgccggtcaccgggatccaaaagaccggaaatcgcgtcaccggcgtcgtcacctccgccggcgtcatcggcacggatatcgtagtctcctgcgccgggttctggggcgtggaggtaggcgccatggccggcgtgtccatccccctcctgcccctcgcgcaccagtacgccaaaaccacccccgtcccagcgctggcgggccgcgagatcaaccaccgccccaatggcctcaacgccacgttccccatcctccgccaccaggaccacgacctctactaccgcgagcacggcgacgcctacggcattggctactatggccaccgcccgatgcccgtcgaggcggcctccctcggccgcaccccgagccacgtcgacgagaagaccatgccgtccaggctgaagggtccaccgcccgaataatttccccccccccccttggggcctatcactatatcaaactcccccccccgcttggcccaaacacgctctctccgccctag

SEQ ID NO: 12047 - DNA, 972 bp, A.fumigatus
ccgcgcgagtcaagagctagtctagtcctcagtgcaaacatggcaccctcaccacacatcgtaatcatcggcgctggtattgtcggcgccaacctcgccgatgagctggtctcccgaggatggagcaatattaccgtcgtcgaacagggcccgctgcagatgcccgggggctcgacatcgcatgctccaggcttagtctttcaaaccaacccgtccaagacaatgacgcgtttcgcacagtacaccgtggagaaattgcgttctctcgagaaagacgggcagaactgcttcaaccaggtcggtggcttggagatcgccaccacgccggagcgacttgaggagctgaagcggaagcatgggtatgcgtctgcgtggggcatcgaggcgcggctcgtgagtccagccgaatgcgtgaagatgtatccgcttctgaacgaggaaatcgtgctcggggggttgcatatccccagcgacgggctggcgctcgcagcccgagccacgcagctgctcatcgaacgcacacgacacgcaggcgtgcgctacttagagatgacgccggtcaccgggatccaaaagaccggaaatcgcgtcaccggcgtcgtcacctccgccggcgtcatcggcacggatatcgtagtctcctgcgccgggttctggggcgtggaggtaggcgccatggccggcgtgtccatccccctcctgcccctcgcgcaccagtacgccaaaaccacccccgtcccagcgctggcgggccgcgagatcaaccaccgccccaatggcctcaacgccacgttccccatcctccgccaccaggaccacgacctctactaccgcgagcacggcgacgcctacggcattggctactatggccaccgcccgatgcccgtcgaggcggcctccctcggccgcaccccgagccacgtcgacgagaagaccatgccgtccaggctgaagggtccaccgcccgaataa

SEQ ID NO: 12048 - DNA, 1368 bp, A.fumigatus
agcatcatgcagcacagcaaagggcccgaattccccgagctggcaaggacactgtcgcgctcgcgcagcaccagcatgtccagcgactcccagctctcacgcatccaccttctctctccaccaccagtgaaccctccgccctcattcatcgcatcatctgcagcggctcaaataatcaccacagaccaggagtttaacactgcagactttgtgactagcgaagaagacaacggtgcgaatgccagcgctcttgtcaccccagaggctctttcggctttgaacgggtttctcgaccaccttctctacaacatcttggcaaccgccaagtcgacccagttggcatgcattcgaccggcaatagctgacgtcctcaaacctcgactcgcgaaagaagtcgtctctgctgcggatgatgaactgcatgagtacatgggcggggaggaagatgaacagtctgaatttcgcggcgggcagacttcggccaatgattttgacctggtccggtcctggaagttgactcggcttcgatgcatggtatacacgaggttgggcgacatggaggaagacgatgaagatgagtacatcgcgcaagaccggctgatcgattccgacgatggaattccgccgagattcgacagccacgtgggcaacatcactccggccgccgcgatctttctaacgtctatcatcgagcacattggggaacaggcccttatcattgcaggtgaaactgcacggtcccggttatctttgaaacttagcgacaatcatgacgaggtgaccgaatctggcgcagagcggggcaggatggataggctggtcgtggaggaactcgacatggagaaactagctttgaatccgaccctaggaaggctgtggcggacctggcgaagacgtgttcgaacaggtagtttatctcggacggtttcaagggagtcattccagcgtcgcaggttgactgcaccctctgcaggcagcagaaaaagcagcatcgttactgtcgatgaatgtccaccctgtctgcgagtgtcaccggatgtggagcacagcaaggagcttgatccagcatctgtcgctctgccaatgagcgagcacgatgtcgaagagattgagatcccgggatatgtggctgaggatggcagcgaagtgcatgaaatacatgagattcggaccatgcaagctgtcgtagctcacaaagtgcgacctcatagcctcatggtgctcaccctggcatctccaaaatctccttccacagggaactcccccgttactcctctcagcgcccagggtcccagagttgtccgtcacgctcggtcgcggtcactacccagcagcccgtaccccgaagatgatactccaaatgagcgt

SEQ ID NO: 12049 - DNA, 186 bp, A.fumigatus
  unsure (13): Identity of nucleotide sequences at the above locations are unknown.
tatcatactttcncgtccctgctggagaaaaaacttctgttcgcggtcctatttgcgtacccatcatgtgttcgcaaccacaagaatacgaagccccctaacaagcaggcagtgcacaaagcaacattttctgtctacaaggctggcgagatactaatactatctggctcttccagaatgatctag

SEQ ID NO: 12050 - DNA, 747 bp, A.fumigatus
agactcgctcaagctattgatgagatctgcgaggccacagcatcccagaactcccgtctttggatcgatgcagaacagcaagtctttcagccggcgatagacgcatggacgattgacctaatgcgaagattcaaccgaaacggacaaatagtcgtctacaacactatccaggcgtatttgaagtccacgagcgagaacgtccatcggcacctttgcctagcgcaaaagcaaggatggacattgggaatcaagcttgtccgcggggcttacatcgcacatgatatcagatcccggatacacgatactaaggcagatacggataacagctacgaccatatcgttgaaagccttttatcacggaagttcccgctgaaagtagcggctgataatgcggcagcgttcccggatgtacggttgttcgtggcctctcataacgcggaaagcgtgcgcaaggcgtcggcgctgtatagacagaggatcaataacggtcaacccacgattccacttgagattggccagttgcaagggatggcagacgaagtgagctgtgagttgttggctgggaacagcacgggtcagtcggagatgccgacgcctggagtattcaagtgcctggcttggggaacaacggaagaatgtctgcatttcctgttgcgaagagcgattgagaataaatcggccctggagaggaccaaagacacagcagtagcgatgcgacgggaagcctggaggagactttggtggtga

SEQ ID NO: 12051 - DNA, 441 bp, A.fumigatus
cggggcaggagaagtatccgtgctagcaacggttatggcatccaggaacggcttccaactgacaccacgaacgcgctcgatcttttgtcctcgatatgtggttcccggatgttgcagcccagcgtattccagaatagttgggacaatgtccatgactgtacaaaaggcgtcgatgacacgaccaccctcatgcagggcttccggattgcccgccggcttcacaaccaacggcacacggcaaccaccctctgtagagaacatcttgtagagtcgcgatggggccgtcgctgcttgggcccagcgactgccgtaccacacgtaggagttgggccgcccgatgttctccaacgaattatcatagtacttctccagatgtgctgtgataccactgccgccgagaggcgaagcctcgtaactggcgccctcggcaccattatctga

SEQ ID NO: 12052 - DNA, 195 bp, A.fumigatus
acttccatcgcgcgagcggatttcgcccgctcttcgttggacatcatctcccaatcaatgtctcccggtcccgttacaacgtcgtggggcacaatgtctggcgcaaccaagcccagttcctttagtctctcgagtcgcttaagtctcaatgcggctggaccttcattgtacatcccgcggtacttgtctacgtag

SEQ ID NO: 12053 - DNA, 393 bp, A.fumigatus
cgcctaagcctttttcggggtggactgagttcaatttccttccaggttgttggggctggcgttcccacaagttccatgctcatgactggaacggaccaccacttgaccggtttaggccaattgccggagtacatagccctgtctggcgcccaccaaggcgccccaggccatgaggggtatttgaacgagagggttgtggcattgccggagctgctcagggacggcggctactatactctgatgtcgggaaaatggcaccttggcttgaagcgggagtactcgccgcatgcccgggggtttgcgaagtcgtacgctatgctttccggtgcggcgaatcattatggtaagtctgtgcaagttgtttatcttcattctggatctgaaggttgctaa

SEQ ID NO: 12054 - DNA, 1494 bp, A.fumigatus
agcgggagtactcgccgcatgcccgggggtttgcgaagtcgtacgctatgctttccggtgcggcgaatcattatggtaagtctgtgcaagttgtttatcttcattctggatctgaaggttgctaacgagacccaaggttatgagcctctgtatgatgacgctgtcacggacgtccaccctttcttccaaacaacggtgacggctctccacatggaagacgctgagtattcgacaaaactgccagaggacttttattcttcccagacatacgcctcgaaggtcatcgaatttctttccgagcgtcctaagtcggaaaatgggaagccgttcttcgcttacctccctttcactgctccgcactggcctctgcaagcgcccaagtcctacgtagacaagtaccgcgggatgtacaatgaaggtccagccgcattgagacttaagcgactcgagagactaaaggaactgggcttggttgcgccagacattgtgccccacgacgttgtaacgggaccgggagacattgattgggagatgatgtccaacgaagagcgggcgaaatccgctcgcgcgatggaagtctatgccgccatggtggaggtgatggatgagaatatcggccgcgttctggactacttacgacagtccggtgaatacgacgacacaatcatctgcttcatgtcagataatggtgccgagggcgccagttacgaggcttcgcctctcggcggcagtggtatcacagcacatctggagaagtactatgataattcgttggagaacatcgggcggcccaactcctacgtgtggtacggcagtcgctgggcccaagcagcgacggccccatcgcgactctacaagatgttctctacagagggtggttgccgtgtgccgttggttgtgaagccggcgggcaatccggaagccctgcatgagggtggtcgtgtcatcgacgccttttgtacagtcatggacattgtcccaactattctggaatacgctgggctgcaacatccgggaaccacatatcgaggacaaaagatcgagcgcgttcgtggtgtcagttggaagccgttcctggatgccataaccgttgctagcacggatacttctcctgccccgtcatcgatccatggcgaggagcatgtcacaggctgggaaatcgctggaagtggtgccctgcggaagggacggtacaagattacttatgttccccttcctcggggcccacaacggtgggagctctttgacattgtagaggatcccggagagacgcgcgatttgagcaaggagaagcctgaaatcttcaatgaattgttgagactctgggcgatctacgctgaggaggttggtgttgtcggactggctggccaaatatcggcgaacaaccaggtagttgaaggagtcaaggatgaatttgaggatactgggcgttggatccgttttattggcaaggacaatgtgccacctgagatacaagctcggcttcccaaatga

SEQ ID NO: 12055 - DNA, 192 bp, A.fumigatus
  unsure (72),(103),(122): Identity of nucleotide sequences at the above locations are unknown.
aatagaagtcaaaacgcgtttggtgatccgctcggttgcgtgatccgctcgcttaccgattacgtttacgtnatcggtaaagttatcaaaccattgaccgcgnataccaccgaacatgaatnttcaatacttcccccaaatatttggaacatacaagtatcaacgcgcggtatccctatcaattttgtataa

SEQ ID NO: 12056 - DNA, 261 bp, A.fumigatus
tccaaagaggcccgcatgcaaatggccatttctgcatataaaaatcaaaaaattaaatcaaaatcaaaggctgctgagatatttggggtgcctaaatctaccctttgtaagcggcttagtggggttaaactatgtatagaaacacgcgcaaatagccatagaatgatagttatggaagagaaatctcttattaagcatctcctagatgcagataagcgggggttcttaattcagcctgagtttttacgtggaatagcatag

SEQ ID NO: 12057 - DNA, 255 bp, A.fumigatus
gcgagcggatcacgcaaccgagcggatcaccaaacgcgttttgacttctatttcaaaagctgcagtgctcagccagccactatgccaccaaaagcgtgtataaactcaaaaaattcagttgagcaggagggaagggtcctacttgcagtatcagctttgaaaaataaggaaattcttaatattcgtgaagctgcgcgtgtctataatgtgccttatactaccctccagcggcgcctaaaggggcatactttttga

SEQ ID NO: 12058 - DNA, 1032 bp, A.fumigatus
caacgcgaaagggtccaacccaaaatgggaagactggatatagattatcagaaactttatgaggcctttttccgcttccagacgaaaccggaattgactcgttacggtgaggtttactatgagggcaaagaatatgagaccaaccttagacacttacgccctggtgagctcagcgctgagctaaaagaagctctcaatatgccgcccggtgcacctccgccctggttgataaaccaacaacgatatggaccaccgccgtcgtatccggctctgaaaattccaggtctcaatgctcctcctcctccaggtgccatgtggggctatcatcctggcgggtatggcaaaccgcctgtggatgaacataaccggccactttacggtggcgacatatttggtgtgctacaaccacagcaaactgttcaacaaggagagcctgttgaaagagatctatggggcgagttgcaagaatctgaaccgtcggatgatgaaagcgaggagaacgaggatgaacctgaggacgatgtggatactgagacaggcgtgcagactcccagcggattagagacacctggcggtatagtctcaagcgttccatctgagtttattggtgcggagaacgttacaggcgagtttgacgtgcgcaagagttatcgaggtacccagacagaggaacatgtggggcgtcgaagtgcttttcagatcatcccagagaaacaggcccatgtacagggtttctttggggccgacagagtgtacgatctcaaggcacctcctgagggcttgccagtgctcggtgctgaggacccaaatcgaaaacggaagaagcctggtgatgttgacgtgtccgttgatccagacgcattacaagcgagcgatgggatgagtaaagaaaacctacgaagtctttacgagtcgcataagcatcaagagaccaatcccaactgggatttccaagaagacttgagtgatatgatcgcttatgagagtcggaagagattgaagaaggaagaggatcgacgaacgaagcagtga

SEQ ID NO: 12059 - DNA, 276 bp, A.fumigatus
ggtagtacagagtcctattgcaaagccagtctcatcaaagttccagatatcatcttcatgtataccatactcttggatagctttgcatacagttttaaaccactgtttaataatatttggatcctcctgctttgcacactgataagatatgtattatttatatcttatacacagctctggatgacgtttaacaaacttatatacctagttaatactaagggtagtagtaggatcatgagtacgcgctcgcagcagaatctatgctattccacgtaa

SEQ ID NO: 12060 - DNA, 399 bp, A.fumigatus
  unsure (279),(396): Identity of nucleotide sequences at the above locations are unknown.
agacgcttgcacaattggccactcatttctcaaactgcccaagaagccgtcgccatgcttaacacaccggaaattgtgcttgaccagttctgcgtttctcttcgaaatgggtttctccctgatacccttcctctgcagaaactgaacgatccatactactccccatgggaggaagttgtcgctgatttaccagctctgctcactgcgggaaatttacggcaagcggttgacagtctacctatcctctcgacttccaaactgcagaaagaatcagaaagncggcgagcatatgttgtgcttgcttttatcatcaatgcttatatttggggaagtgaacagccaaaagacgtatgtgtctttttgtcgttgtatgattgcagctttctcatggctctntag

SEQ ID NO: 12061 - DNA, 639 bp, A.fumigatus
gttcttccaccagcagtgtcgtgtcccatcctggaggtctcaaagcatttagagctgccaccatgtgctacctatgctgctttgaacctttggaacttcaaagtctcttctcctgatattgatctcactaacccggacaacctgtctatcatcacaactttcaccggtaccaaggacgaagaatggttcttcatggtgtctgttgctatcgaagccaaaggagcggatttgattaccctgatgctccacgccatatatgcagccaacctggctgacgatcaaagggtcacaagtctactttatcaactgagtgatggcctgaaagagcttggcgaaattctggagaggatgtatgaaaagtgcaacccacacgtcttcttctatcagcttcgcccttacttggctggtagtaagaatatggcatcggctggactgccccagggtgtcttttatgatcagggaggctacggagagtggcatcagtacagtgggggaagcaatgcgcagagctcactaatccaagcattcgatatatttttgggtgtggagcattctgccaccggggaagcaaagctgagcaacacaagtcagtacaagcctaagattggctatattcaggtacgtatttactctcattga

SEQ ID NO: 12062 - DNA, 381 bp, A.fumigatus
gatatgcgaaactacatgcctggccctcaccgacgcttcctggagatgatgattcgaatttcgaatgtgcgccaatttgccatgaactacaacgcagatacagaggtcaggaatgcatacaacacggcagtcatggctgttggggcattccgggataagcatattcagatggtttcacgatatattatcacgccttcgaggacaaaaccaacccgtatgtcgtctgcacaagtcaatctagcaactgtgacagcagcgcatcaggtcacacgttcgaaggacactccagcagaatacagtggtacaggcggaactgacctaatcccattcttgaaacagactcgggatacgacaaaagctgccgccaaatatactgactga

SEQ ID NO: 12063 - DNA, 243 bp, A.fumigatus
gtgtcagacagtttgtcacaatcaaactcattctgctgtgatctcaaaagcaccggtgccacatcctcctccatcatgtccaccaacggcacactatccaagcctgagttccctgccaatgcggcaagcaaggagtatgcggcctctctggacgctgcagacccattcgcaggctttcgcgagaagttcatcatcccatcaaaggcaaacattgcgtctacaaaactggcgaaaccaggttag

SEQ ID NO: 12064 - DNA, 471 bp, A.fumigatus
gttctagtcttccgagcagccgacttgaccctattcagttctaatgtcagaacagagttcaaaccaatccctggagcgggtggttaccagatttcgaacccttcggctatcgaccttgcgtgcttgtgtgctgctctatcggtctttgatgagacctctatagctgagctgcgcaagaaatccgtcttgatgacggcatatctagagtacctgctgttaaaggacaccacggaggagtcgcggcaattccaaattatcacaccttccgatccagccgctcgaggtgctcagctcagtcttctgcttaagcctgggctattgcacaaggtagctcatcgacttcaggaagcaggaattatttgcgacaagagagaaccaggcgttgttcgcgtcgctcctgttccattgtacaacactttcactgagatctggatgttcgttcagcaactcaaggcggctctggaaggatga

SEQ ID NO: 12065 - DNA, 528 bp, A.fumigatus
attcgcaatacccgcatgggttatgctaacttgcaccagtatgccatcgaatcacatcttgcctggcatcatctagatcctaaggagaccatggtgctcatcggcccagatgagggaacatacgagatcccaactgagaagatcttgtcttacatcgatcagcatgcagacgaggcagctctcatcctgcttccgggaatccagtactacactgggcaattattcgacatcccaaagatcaccgaatatgcgcactcacgaggacttattgtcggatgggatctcgctcatgcctacgcgaacgtcccactaaagctacacgactgggacgtcgattttgcagcttggtgcacttacaaatacggcaatgccggccccggggcaatggcaggcctctttgtccacgagaaacatggtcaagtcgactacagcgaaggagaggatgcgccaaagttccgacaccgtctgactggatggtatggaggcgataaatcagtgcgattcaagatggacaatagtgagttctag

SEQ ID NO: 12066 - DNA, 459 bp, A.fumigatus
  unsure (84): Identity of nucleotide sequences at the above locations are unknown.
ccgttcatcgtcgctgatgaagctttctcaggcctttcatcagaaccatgtatttacttctgtggcaattcccttggtattcancccaaggccacccaaaaatacttggaggcgcaactggacacatggtcatcaattggcgtctgtggtcacttcacaaaaatcgaaaaatccccattaaaggaatggcaaaatctgggtgagcaagcttgccaatctatgtcgaaaatcgttgggggcggcgcccaaaaaaatcccaacaatgggtacattaacgatgaatctgcacttgttgctcgcaagctttttttaaaccccactgcaaccaagcgtaaaatcctgatggactggaaggcgtttcccagtgatcatgtgagtgataaattcgcaatacccgcatgggttatgctaacttgcaccagtatgccatcgaatcacatcttgcctggcatcatctag

SEQ ID NO: 12067 - DNA, 633 bp, A.fumigatus
ctgactgattctggacagctccaccttgcaacttgcaatggccttactccccacatctctctcatgtcctacacttatctgccgtcaaccccctttgatccatatccgacaatcattatgacgacgaatccttcgtcacgcaaaacgaaccatctcatgaccaacccacgagtctctcttttagttcatgactgggtgtctcaccgtcctcccacccgcgccccaaaccccagtgggcaacgcgatggttccccgccgcccgttgcaacccggtcctctttggctagtctgctcctcaatctgaacaccagcgcactatccagcatttcgacaactatcactggtaccgcccgatttttggaacctggttcggaagaagaagcctggtgcaaagagagacatctggagaataacactttcgaagaagagctgggtatgttcggtcaacagcagcaggctgctggtcaacggaggcccagtctatcaattgacaatgatgtacgggttgtcacggtccgggtaagagaaggtcgcattgcagattggaagggtggcgtacgggattggaaactggtgtctgaaagcgagtcacaagccgacgaaccacttgtcaacgggaccatgactccatag

SEQ ID NO: 12068 - DNA, 1149 bp, A.fumigatus
tcatcacatgatctcacgtcacaagagatctctcttatcaagaccgaagcttcacaccgacaacgggattcacttaatctccataacacactggccgatcccattagtctcgcaactgactcaatctccgtccctaccattacacatgatgttttcatccagactcaattgcatctaagctccacctcaagtcaaggacaagaacaaaccaccacaatacgtccaaccatgaagcttgcacaccttcattttcccgacatcacctccttcacccgggtcgcccatctccagcaaatcctcaccaaccgtcttctcgcatacaagcgactgagctctccggcaaccgcaaacacaggagcgatacagcctagcggggtaaattccccacccccagatcccaccatcataaccttcaccccgaacccggtctacacaaccggccgccgagacctcccaccctccaacaccgcccctttctcaccatccgcgcctctctccctcccgccgtccttggaacccatccgctccatcctcaccgcaccgcccaatggctcgccccgagcagagtaccatcccaccctgcgcggggggcaaacaacctaccacgggcccgggcagatggttgcatacacgattctagatctacgacggctgggcctgaccccgcggtgccatatccgcttgctcgagaatagtgtcatcgatgttctgcgcgggtatggcatccagggattcgtgaccgaggatccgggcgtgtgggtgcggccgcgaccggctacgaacacggttgcggcgatggctgtgtctgcgggaggggatggggatgcagatggtgttctgcctaagaaaatcactgctgtgggggttcatctccgtcggaatatcagtagctacgggattgggtttaatgtgacggaggagccgatgtggtattttcggcagatcgtgccgtgtgggcttgaggggcgggaggccacgagtctggagggcgaaggtgtgccgggtgtgtctactggggaggttgcagacaagtttgtggatgcgttcgttcagagagtgaatgcggattttgcatgtggggggcgtgcaactggggagaagatcgagggtgtgtataatgttcgggaagaagacctccttcaacaatag

SEQ ID NO: 12069 - DNA, 183 bp, A.fumigatus
cgtccatcgacaaacttctcttctctatatatgctttttgacacctattaccctattcctaatgatttctgggtacgtgcttaccagaggtatacccgagtacggattgtggagcacttgattttctcgccttgtctacttgatttcttttccttctatgattggtatcttatcttggagtga

SEQ ID NO: 12070 - DNA, 195 bp, A.fumigatus
atagcaatatcttcagcaagctttctgcaggagcattcggtcttgtcggctcaccgtaacaatgaatcgactaggcaggctacctctgcctctgcctccttcagtatgtctattttgtcggtttcgcgcaacggcgtcgcttccgtcgtcgttgcaggccacccgttcaatggccactgctcgactccgccgtag

SEQ ID NO: 12071 - DNA, 1953 bp, A.fumigatus
caatatcttcagcaagctttctgcaggagcattcggtcttgtcggctcaccgtaacaatgaatcgactaggcaggctacctctgcctctgcctccttcagtatgtctattttgtcggtttcgcgcaacggcgtcgcttccgtcgtcgttgcaggccacccgttcaatggccactgctcgactccgccgtagagtcgctcggatgactctatcgccagatgtcgccaaaccatctgtggtgaagaaaactcggggtgacaaggaacggtttggaccatttgcggggatgaatcagacagaagcacgaattcgcgaaacaccgagagcaaggtctcgagcagctcagaagcgctctggagagcccgaggaggattcccagaaggaaagcccgttgtataaggcgttgaagatgcaaacagcactgacgcctatcccatacggtcgtcgcgcagccatcaaggccaagattgccgatatcacgagcttcgatcaatttcagctactgcctgtcgtacgcaattcgatttcttcccaagctttgcccggtttggtcgacgtcacgccgacaccgattcagcgtcttgccatcccgagactcttagaggagccaaagacggagaagaaaccaacaaaagcagacgatgacgagcctcggtacgaccaataccttctagcagcagagacagggtcgggcaagacattggcgtatctacttccggttgtggacgccgtcaagcgggaagaagcccgggataaagaattagagaagaaggagcaggaagagaaagctagggagagagaagagaggctgaagaatagagcttttgatatcgagccagagatcccgccgctctcaaatgcgggcaggccaagggcgatcatactagttcccacatcggagttggtggctcaggtgggcgtaaaggtgaaagcactgtctcacacagtcaaatatcgatctggaatgatatcctccaatttcacaccacgccgcatcaaaaacacgttattccaccctgacggaatcgacattctcgttgccaccccccacctgctcgcgtccattgccaaaacagagccctacgtgctcagccgtgtcagtcacctggtcctcgacgaggcggattcgctcttggatcggtcctttgccccgaccaccacagagatcattagcaaggccgccccttcactccgcaagctgatcctttgctccgccactatccctcggagccttgataacctcttgcgaaagcgttatccagacattaagcggctcacaacacctaatctccacgcaattcctcgtcgcgtccagctgggtgtggtggatatcgaaaaggacccataccgcggaaaccgcagcctggcatgtgccgatgtcatctggtcgatcggcaaggctggcgacgccgaatcagagggtccttacgcctcgtacgttgcgccaaagaccaagaagatccttgtttttgtgaacgaacgcgaagaggcagacgaggtggctcaattccttcgctccaagggcatcgacgcgcagtctctctcgcgggactctgatgctcgaaaacaagaggaaattctcgccgaattcaccgaagcaccaccccctccaagccctgatgaaatcctgctggcccaaaagaagcgccgttacgaagacgcgatcccattcgagatgcccgagaaggcgaaccagggttcgtcccgccgcctggccaacaccaaggtgctcgtcacgaccgacttggcctcccgcggcattgacactcttgcagtcaagaccgtcattctctaccacgttccgcacactaccattgactttatccatcgcctcggccgtctcggccgaatgggcaagcgcggccgcggggtggtgctggtcggcaagaaagacagaaaggacgtcgtcaaagaagtccgcgagggtatgttccgtggtcaggcattgatctga

SEQ ID NO: 12072 - DNA, 195 bp, A.fumigatus
acgacaactcctaggcttactgtatatctctactgtcagacaggaacccgctcccccaccgactcccaaaaatcacacctctcctttaaaaacgacacctgcgcggttgccaacccatccggagcaatcacccaatcctccccggttcttctcgaagaaccgggacaccctttcttcgaacgcattcctcagctt

SEQ ID NO: 12073 - DNA, 948 bp, A.fumigatus
agtgtcccacaatacgatccagctagtgtatatgttccacaacgaccattggcgacaaatagatcgccacagaaacagcctcaaagcaactcgtctcctcagcagccgcaaaatcgcaatgaccgccaaccagggccccgaccaccatcaccaagcaaagaccaggtatctccagccaaatcttccttgtctcgtgccagccgatttggcgtcaaagggaccggcttcgatcctgagagcgagatctggtcggatttggacagcgttggtaatcggtaccctaagagtgtgaccttcgatgctgctcctcctcaggtgaatgagtacgagatgactactccagatccttcgtcaatcgcctcggagtctcgcgacggaagctacgactctgaagaggatgaaggtgacgttagtttcgatcgcgagtcctcgctggaccgcgacgacagcttcgatgcctctttggaggaccttgaaaagactcccgttgtacttcccgatgattggcgctatatgagtccttcctgcgcaaacgacgagctcgtgaaggaggatgatccattcacagaggatgacgaatcccacagtcccggcccaacgactccctcacagcaaaaactgcctctccagcattctcgtgtggagtcattggattcgaacggagagcggcgtcctcttcctcccctgcctggcgcgagtcgtcaacctgtcaatcctcactcttcctctcctggaagattggcagcagcgttcgagttgggaagtggcggtaaaagagttattcattctccccccgctcctgcatcatgtacaaagtcggacatcagtgaattgagccgtgcatccatgtctttggaggacagactgcgtttgatgatgatccgcaaggatgaacgggccaagcaggagcacgagaatggtcttcaccacagggcgagcaccgcgtaa

SEQ ID NO: 12074 - DNA, 822 bp, A.fumigatus
agagcttcaggcaatcattcagccttgctccctgctttacccatagcagtcacagtgtcgtcctacgactcatcgcgtcgtctgttccacccaccgtctctcttgtcgtccctacgcgaacggatcctcatcagaagaatctcaactcgcagagttgtccgccctcgtcgatcatacaccatgcccgccttgatcaatagcgccgagcccgtcgcgcccgtgctgcgcgtccgcgagcttgaagacgacgaggaatatgtcatgaccgcattcgagcgccatgcgagccactgctcgcaatgcgcggacccctttcgtgtccaccaggaaggccgttcactctgtgaccgtggtcaccagtacgccctcgacgtggccgagtacttctacagtgagaatggcaaggccaagtccgtcatcgaccgtgaattgagccagcccacactggtcaagattccccgggactgcgtcgctgtccggggcctcctccttgcgatcgaggatggcatgcgtctgcagcgcaaggagcaggagaagcctcagagccagaaccaagctcgggttcaggttgtgacccctgtcatcagctacgatcgcacgttccccattgcgcctcgccaagcagccacacagcaaccggcagcttgcaatgaaatcatcgaacgcgagccacgcactctcaagcgtcgtcgtgtgatcatctaccaatctccacgtagatcgtctcgcggctccctgtacgactctgatgcggcagaccgcgctgagcgctccaaggaatctccttcgcgcatctaccgaccaactgggtaccatcgttga

SEQ ID NO: 12075 - DNA, 234 bp, A.fumigatus
ccgccagttacgacatttaggccaatcacaagaccagaaatcaaccaacaagcagaaattgtggccgactctgttgcagcagacgcccttttcctatctagaattaacaatcagaggctaaaagcactgcctgcatgcaccagccacagcagactagccagtcacagtgttttgtggaagcctgaggagtcatccccaggcaaacatcagacactaagagtggaatgggaatag

SEQ ID NO: 12076 - DNA, 210 bp, A.fumigatus
ggcatctccgctgggatatggctgcctgcgcctcaaaccagtttctggctcgtggccgatgggcttatcaccggatataataagattatggtgctctacatgtgcatgtgtagcgtgaggcacagctgcagtcaacccagcggggtaaagaaattagtatacatgcacctaggtggcagctactgtcacgcactccaggctaatgcatga

SEQ ID NO: 12077 - DNA, 597 bp, A.fumigatus
actccgtctcccactccgttgtggcacccatcggcgccgtcgagtctcctggtctcacatgtgggagacacgcggattctgctatgttatactgcaacaggagcggcaatcccactgacgtccaaccatcatccttcgtccccgatcgaagccaatcggttgaggcgatatgccgccacatttgtaaccgattcctttggcgaggagcgcatgagtggtttggcgaatacgcgtgcctttggcgacgtccaatcgaaacgcatcggcgtatctgcagaaccagaaatccggcgtatcgagatgggtccagcagagtactcgttcttagtcctcatgactgacggaattagtggaacgctcaccgaccaagaagttgtcgacataatcaaggaggcaaagacgccggatgaaggggctcggaacgtggtcaacttcgcaacggaagtgacaaaggaaggggataatgcaacatgcctcgtcgttcgtttgggcggttgggagcgccgactggaaggaggacttgggagtctggggaccaaagaatcccgagaatggcgtcgacaagaagcaactgatccgcgcagttccaggcgatga

SEQ ID NO: 12078 - DNA, 348 bp, A.fumigatus
cagagcctgcagactgtccttttcatttgctgtgccctcaatgaacttttcttcattggtttatacctgctttccttttcctctcctattctctccccctctcttcttcaagctcaagatcccagtgcgcctccagctctcgctagtccctggagcgccggagctctggagcttgcccgggcaaacaagattgacagcttctggccttgggttatcaccggaatctccgccccagtcatggctttgaagcaattcatcaacgtcgttcagctggtgaaagctagcaaatggcttgctgaaggggatcgggccagacgcaaggctgaacgggaggggaagacactgtag

SEQ ID NO: 12079 - DNA, 864 bp, A.fumigatus
  unsure (170): Identity of nucleotide sequences at the above locations are unknown.
aaattcaaaggtcctgatcaaaagtttcctcgctccgggtttgtacctcataccggtgcgatatcacatccaccgacttctttccaggcggtggttgaccgcgagaccacggtcgtcggcataccgttgcgcagtgcgaaacaccacttcggtgctgccacatcccgtgngactcgtgtctcgaatgaggatacacaccaggctggcgtccttgatattcctgcctttgcaaagcgaccccctgcgtctgtgactatcaagcgcaccactgcgcctctggagaaccggggtgcagatagcgccagcggtgacccgcaagtcttttactttggtgtgtttgacgggcatggagggagcgaatgcagcacatttttgaaagacacgttgcatgaatatatacaggacacggcagccgaatcggaattccagtcgagcctgagcaaagaccgagagggccacttttccaagaatgagtcggagatctgtcggggcgatctgcctatcatacaacggggcaatcataagagaatggcggaaatggagaaaaccctagttcagaattggagaaggctggtcggaggttacttcaagcgatttgtgccggcccatttttcctatcgtgggaacagtgctcaaggaaacgggagcgcaacaggcaacggggacgatcataccggaggcgtcacgattgaagagattctagagtatgcgtttctgcgtgcggaccttgacttcgtttcagcgcaagccgccaaggaagacgatgaactagccacggctcataagccgcagtaccaagatgacattctgtacgggccaaagcatacacagcagaccgaagcttggcggttaccgacgatttaa

SEQ ID NO: 12080 - DNA, 441 bp, A.fumigatus
gacgctgaccgctggtgcaacggtgcaggatattcccgagttttcttgaccattgcctctctctactacatgcccctccacccacgaacatgctctttactatatagcatatcatgcttgttggatgccttggatggatatgcagcgcgctactacaatcagtccaccacttttggtgcggtgctcgacatggtgacggaccgatgcacaaccgcctgtctactggtattcctcagctccgcgtggccgcggtgggccatccttttccagagcctgatttctttggacctcgccagtcactatatgcacatgtacgccacgcttagcatgggaggagcgagccaaagccacaagaacgtcgaggccaccagaagctggattctgtaccaatactatcacagcaaggtgagtgcgatgcaatgtctacaaaaggagagctga

SEQ ID NO: 12081 - DNA, 621 bp, A.fumigatus
acagtaagacaaccgagactatacagtatgaccaggaaaaccactaattatacctctgtaggaaaccgaggccctaataaggccaccaacgccgctggttctgcgagcgctgtcaaggctgcaatcgccgcaatcacagctaatccttccagtaatactacgacgacgaccagctccagcaacaaccggtggacctcagacgtgcaggaaattcttagcatgaatctcgaactgtggcgaaatagtcttccagagatcatgaaatggaaagacgccgatccgccttcgaacgacataaacgttgctcgcatgcgggccaaatattacggcgcgcgatacatcatccatcgtccacttctgtatcaggctctgcattttgctggactcccctatcctaatccgacctccgcgttagtcgggtcacccgctgggtctgttctccctagcacgaaatctgagcaggtttcgtccctattaccccacagtcaacaggcttcaagcatggcgcatctgtcaagcaatataggcgtaccagtccatacagcctccacttatgtccaaggaagctcgacgggcagtcttcaccacggggctggaaggaccagagctgatcaaatggga

SEQ ID NO: 12082 - DNA, 372 bp, A.fumigatus
tttgcctggtcccagtcacatcctgacagagtcgcatccgccgatttttcttcatataaacagagctccgcattattccatacccccttcggcaccccctcatccggctcttcatctgcttcctcaactgacggcccccgagtttcgtcctcagactatatatccctctcaagaccacagcagcaatggcaatcctccttctcctccagctcagtcttcgacaacgatctcgcatatttcccgcacgcctgctcaccagcatctaacctttggtatacatcagagcaaggcacatcgcgctcagcaggtaatgactctccttttccacggcgcatgaaaaaagctgctctgaacacaaaggaactggactaa

SEQ ID NO: 12083 - DNA, 276 bp, A.fumigatus
ctttacattcttccacaatataaaaaggcgtgcgaccggtgtagagcaagaaaagcaaagtgcgatgaagggcggccctcctgcggccactgcaaggagaacaatttgatatgtgtctacaaagaagtcctcccccataagtgcgtgacatgcctgacttctgtccttcagttggttagttgtcggatactgaccctcaagctagacaggaaaaggccacccagcagatcttggacaagatacaatgtctggaagataagctcgacgagcgtctga

SEQ ID NO: 12084 - DNA, 417 bp, A.fumigatus
aacaaagacccatatgtggcagtcctggttgatggtgacggcgccatcttcaataaggagttgttgctggaccctcgtcagggggcctctgaagctgccctgcgactcacccaggccgtgagaaactaccttaaagatacacctcttgggtccgaggatgttcctattgtcgtccggatctttgccaatctgaccgggctggccaaatcgcttgtcacttacaatgacatcgaccatgaggataagatgcgagaattcgccgagaattttactaatagtcgtgccgagttcgattttgtcaatgtcggtcgcggcaaggagaacgcggactctaaaatgagaagtaagtttccgacgggtggacagtttcaactcgctgacttgatttctcgcagagatgttcaatcatttctataa

SEQ ID NO: 12085 - DNA, 273 bp, A.fumigatus
catcaatcactgggatatgactataacacggcgcacaagcaacttttcgcagtccccgtgatcatcctccgtccatccaacggcggcaagaaatggaagttcttcaggtgcgcggcagatgacatgcagagtgtctggtcgctggttcacggtggtgcaatgatcgacaccgctctgttctccaaggactgtatcaaaggacctgtgcatcaatcacatcgaatattctatgtgactacgagggagcaagaatcaccgggttcccgatgttga

SEQ ID NO: 12086 - DNA, 195 bp, A.fumigatus
tttctcgcagagatgttcaatcatttctataaaaacttccagtgcaagaaaatcttctttgctggttgccatgataacggctatcttcatgatcttcgcgattacgctggcgagtcgggcccgaccagcgcatccgttctttttagaagaactactcccgctcaagtcagggctttacctccagatgggcttttc

SEQ ID NO: 12087 - DNA, 786 bp, A.fumigatus
gtcttatggtacctaacgcaacccgcagttaaccgacttgtacaactcgccgaattctatcagctgggaggttttgagtactggggccgcatgcaccaatcagacttatatggcagcgacagcgattctagtgaatccagtgaatacccatcaaatctgacgcgtgcggaggctgttcgtcagtatccggaatccgcacaccaagctctcgccgcaactttgggtctggtctactacaagattcggaatgaagtgggtgaagggccgaacactcatatcccccgtcccccgaagcgggagcgccaacaggaggatctggcttccgtctcctctggttccaagcagaagccggtaaagatgccacgccgacccaacaacgtctcccccaccactctgcacaggctcatcactgggccctcactggagtcgaagtcgctgatctcggaagaatccgacaagcttggctggaatgtccactccgacgtgtctgacgacgccatgagcaagcttcgaggtatcgtgtctgaggaagtcggtacccttcttcgtgcactagaacaaggtcgtctcaaactcaaacccagccgatccgaacgattaaatatgtcacctacggaatctaagggaggttcattccaagacaaggtcccagaatcagcccaggaagatgaggttcgaacagtggcgaacaccgtcgcgaccgaacttgtgtcaccatcatccacaaggaatgaggaacatgatctcccagacacagcatccgatgctacaactccattgacttga

SEQ ID NO: 12088 - DNA, 372 bp, A.fumigatus
  unsure (4),(5),(6): Identity of nucleotide sequences at the above locations are unknown.
cgtnnnattgaaactcacttccttccgccccgcgtgaagaccgacttggaacagcttcagactgatgtctgtggatgccgtattgaaatcagcaagctgcatgctgctatcagtcaactacgtactgatctgattactcttcaacatgagacatcgcgtcacctgaacgcggtgttcaatcggttcactctaattgaggctcgcatgaagcactcggaacgagttcgattcaactcccttgctcacaccacgcatgcccctatcacacctgttccggttattgaagaggatggatcccttcagtggcccgaatacttccctcgtacagtctggagattctggtgcttgaagaagcgcagtaggagtgagtga

SEQ ID NO: 12089 - DNA, 846 bp, A.fumigatus
tgtcctccatcaacgcaccatgagatactggacgtcttgatgtcgttgttgtcctctgtgtccatccgaatggcgtcgcgaatgacgtgcgcttcccgcttgatgcggccaaaccccatcgtgtctcgtggccatcgacgcttacctgcgaccttactacagccctcttgtcgtttcgttcatccaggagagttcaaaccatttgtccccccttctccgagttcattaggcaaacccatccccgcaaagacctacacccggactcgtatatggctccgccgtctcgcctacctctctatagccaccggagtggtctacgccatcgacacccaggtctacgcatcctcactgacgcggacggctcggacgttctctctcggtctcctcgtcgcattagactacaaaatcaacttccgtccgaacccgccgttcgctgaatccatcacagccctgcacgcccgcaatgcggaacgactgtttgatctgctccggcataatggcggcctgtatctgaaaatcgggcaggcaattgccatgcagtctgccattctacctccggagtttcagaagatgttcgcccggatgtttgacgatgcacggcagaatgactggaaggacgtggagaaggtgatccgggaggactttgggaagtcggctgaggaggttttcggagtggctttcacaggagatccgactaagggcgtgttggagcgcaaggctcgggcgagcgcgagtgtcgcgcaggtccactgggcgcggttagccgatgggcgagaggttgccattaaggttcaaaaaagggagattgctcagcagatcaaatgggatctgtgggctttcaagtaa

SEQ ID NO: 12090 - DNA, 498 bp, A.fumigatus
atggacgctaacgagaccagagtggtcacttgggtctattcccgcgcgttcgatatccccttctacagtttggtaccgtacataagcgagcgactgttcctggagacggactttgagaatgaagcgaccaattcggaaaccatggctaagctggtggccggcgagtcgcgtctgcgaggccgcgtctacattcccaaaatctaccgcgagctcagctcgaagcgggtcatgaccgctgagtggatcgaaggagtccggctatgggacagagagtccatcacgcgtccgtggctcggcggttggtgggaaggcagccccggatgccagggcacgccgttagatgctcccaaggctgaagatccggtgaccagggtcgcgaggaaccccaatctggccaaaatcaagccggagcgcaaccactggcgcggctggaacggcaaaggtggtctaggtctgtcgctcaaggacgtgatgacgacgatggttgacctcttctcc

SEQ ID NO: 12091 - DNA, 321 bp, A.fumigatus
  unsure (201): Identity of nucleotide sequences at the above locations are unknown.
aactgcggggaaatccgcagcaacgatcaatctccaatctttggctcgaggctcaagcaagattcaaccaatatgaccacggtcactggtaagtcgataactccgtcactcatcttcctttctgatattctccagtccatccaacctgattcgtccaccacagtggatgaacctacctacaatgcgcttcctcctccttcncgtacttctcctcctgctcagcgcatccgccgcaaccgcgaaactcgccccgacatgcttcaaagtcgtcgccgcgctcgtcagccgaccaggcgatctgtacgagaaatttcagcgtga

SEQ ID NO: 12092 - DNA, 195 bp, A.fumigatus
acgaaacgacaagagggctgtagtaaggtcgcaggtaagcgtcgatggccacgagacacgatggggtttggccgcatcaagcgggaagcgcacgtcattcgcgacgccattcggatggacacagaggacaacaacgacatcaagacgtccagtatctcatggtgcgttgatggaggacatcaacgggggttctga

SEQ ID NO: 12093 - DNA, 450 bp, A.fumigatus
agagtcttcgatttattgtctaccagccggctctgcttcacggttccaatcccttggatgaagttcaactttcaatccggctttttgcgctctgcacgacaagcaattgttgatcctattgtcgtcgtacctgtccgtcggacccttcccagcgcagcagccgtcagcccaacaaccctcactctctcttccagcgaccccaccatcccccactaccgccactcttcttccctcaccctcagatattcgcgcccggtagacacgatgccaaaggataacaagaattccttcaacctcaagacgcccaagggcacaaaggactggtccgggtccgacgttctcctccgcgaccggatcttctcgaccattgccgatgtcttcaagcgtcacggcggcacggcgctcgacacacccgttttcgagctgcgtgagatcctggccggaaaatat

SEQ ID NO: 12094 - DNA, 189 bp, A.fumigatus
agctcgatttacggaaactatggggtagtctcaaaccttcggaaacatgtgcctaggttgtgtaattcgactctgtgtgatgcttctgtctggatcttcctgttccatgatagccaggatttgccccgttctccgggtggagagggcttcaaagctcactatgccttcaagaaggtacaccatgagtga

SEQ ID NO: 12095 - DNA, 186 bp, A.fumigatus
ggcaagtcacgtgttaatctttccctccaaaccctctctgtacggagtagactaactagtggtgtttacgacaccacgctccgccatggttctatgaaagagcttattcagtacaagattgagggagaagctttagacactcagcaggccggaaagagactgggtttcatgaagccgagccaatga

SEQ ID NO: 12096 - DNA, 1209 bp, A.fumigatus
tatcaagtgccaaccaaaggtacaactcatccggtgaaggaattgctttacacaatagaagactccgacccatctttggtcattctacaccctgcattcgacaaggtcagggagccgctacgtgagtcagttgccaaggatgtaccattcatgaatttccagtctttccatgcgaaaaaggatctctcatcgaagtctctgcctacgttcagccctgtctccttcctggatcgaagggcactgatgatctacacatctggtacaacctcaaaacccaaaggttgcgtcaccacgcacaagaacatcaccttccaagcgagatgcctcatcgaagcgtggaagtacagcccgtccgaccacctcatccatgtcctaccgcttcatcacgtccatgggatcatcaacggcctaacatctagtttcctcagcggagctacggttgagatgcacccgaaattcgacccgcaagtcatatggaaccggtggcaggatcaggactcctccacgatgttcatggccgttccgacgatctactctcgattgatcgattacttcgaggccaacatacgcggtacagacaaggaagccgccgcccgaagtggcgccaagtccttgaggctcgtcgtaagcggttccgcggcgctccctacccctatcaagaccaagttcgccgcaatcacaggccagatccttttggagcgctacggcatgaccgagatcggcatggcgctcagttgtgggctggacgtcgacaagcgcatagacggcagcgtcggctggcctctgcctggcgtacaggttcggctcgtcgacaaggaaacgggcgcaatcatcgaaacagcgaacgaggacggcatgatcgagatcaaaggggagaatgtcttcctcgaatactggcgacagcccgacgcgacagccagggagttcactgcagacggatggttcaagacgggggacgttgcacggcgcgatggttccggcgcatactttatccaaggccgggcgtcggtcgacctgatcaagtccggtgggtacaagatctcggccctagaggtggaacggaagatgctgggcttggataccattgaggaagttgcggttgtgggcctggccgacgaggaatggggccagcgagtcgctgctgttgtcaagcaacggcctggggtgagacaatatgcctgtctcgagcacatctctcgcaaaacgtga

SEQ ID NO: 12097 - DNA, 645 bp, A.fumigatus
gatgcacccgaaattcgacccgcaagtcatatggaaccggtggcaggatcaggactcctccacgatgttcatggccgttccgacgatctactctcgattgatcgattacttcgaggccaacatacgcggtacagacaaggaagccgccgcccgaagtggcgccaagtccttgaggctcgtcgtaagcggttccgcggcgctccctacccctatcaagaccaagttcgccgcaatcacaggccagatccttttggagcgctacggcatgaccgagatcggcatggcgctcagttgtgggctggacgtcgacaagcgcatagacggcagcgtcggctggcctctgcctggcgtacaggttcggctcgtcgacaaggaaacgggcgcaatcatcgaaacagcgaacgaggacggcatgatcgagatcaaaggggagaatgtcttcctcgaatactggcgacagcccgacgcgacagccagggagttcactgcagacggatggttcaagacgggggacgttgcacggcgcgatggttccggcgcatactttatccaaggccgggcgtcggtcgacctgatcaagtccggtgggtacaagatctcggccctagaggtggaacggaagatgctgggcttggataccattga

SEQ ID NO: 12098 - DNA, 981 bp, A.fumigatus
ttcattctgggcggggggcacattgctgaaactttgggccggtcgttaaacaccggaacctcgactctgaccaagggttccaacttgcgagagctggagctcatgcacaaatactccaccgaaacttacatgagtctctctaacagaccatcagactaccatgtctggcaggtggtcattccccgcaaagctcttgaacatgactttctcctgaatggagttcttgcggttgctgctttgcatgtagcttcaacgctgaagccgccagatgcattgacgtatattgacacggccctggaataccacaatcgtgcttttgctccataccgacaagctatagataacctaacccctatgaactgcgatgctgtattcgcccactctgtgctcactacggtcattggcatagcattaccacggctgaccgcggagcgcaacgaaagttcaggcatcactgaaaacatcgttgtggtcttcgagttattgcaaggagtaagcaaaattttcaagatcagccgcccatggctcacaatgcagctattcacctcacaaaatgactgggacaaagtgacgaggtcgaaactagacagcgaaacggagcgtgcgttgaaccgactagccgtattgaacgatgatattgtggctactgtggaccctgagcagtaccttatagtgaaggacgctatctgtcgcctccatgaatgctttacaggatatgctaccaacggggaggcggcatccgtactcaggtggctcgcagtagcgagtaaggaatttgcacacgccctgagatgtcgaaaaccattcccattaatggtgcttatgtactggggcgtactacttggcgaactcgatgggaaatggtggtgggcgaaaaactcgggtacggctctggtttctgaactcctggccgttctgcaacccggagatatccgttgggaggaggctcggctatggcccaagcataaaatgggtctatga

SEQ ID NO: 12099 - DNA, 1311 bp, A.fumigatus
tggcctcacaatacgacgacccaggattcggcggatgacaattgcttcagacgtcatctgtgcaagctttccaaagagagcatgtcagacacaatcgcagacgagattctgaggaatggatatgcgaagacattcacgagacactctgtcttcctcacgggcagcactggctcactgggaggatgtcttctttacaaattggcactgcagcttcctacccagaagattttcgttttgatccgcggatcggctgagtccgccattgagaaatggcggaggctgatgccaaaacagacgcaagcgatcctcaacaccggaaaggtgcattttgtcgttggtgacatcaagaagacggacttcggtatcgaagaggcggagctgagccgactgcgcgaagaggtcactcttgttattcatacggcagccacgatcacgcttgacgcaggcattgtcgaatcgatcgagaacaattgtctcccttctctcgagcttgcaaagatagtttcacgctttagacgattgaagctattccttcagatctcgacggcatatgtaagcagcttcttacccgacggttatgtcggggagcgagtgtactccatctccgacgcagatccggaggatgagctcgcggccatactgtcaacaggcaactctcttgacaccgctcggttttcgtcgtcatatacccatgcaaaatacctcatggaacggttgttgttgaagagataccctcttctgcctctgctgcttgttcgtcccaccattttcggggctgcaatgcgggacccgtatcctctatatgggcccatcaattccacaccgatgaataaattcgccagtctgttctttgcggaccgcgggggaacacatatctggcacgccaccgagggttacgagacaggtgcaaacatcgtagacgagatccctgttgattttgtcgcgaacggctgtctcctgcatgcggcctcgaggactcagggtattgttcaccttggagctcaactctatgtgccgttcactttcgacgacttcttgcgtctcgcagaggccagtgcccctccgtcgattcagaaagagttgcccagtctcatattcacccaagaccgaaacgccccacaatcgctcctggctgatttggttaaagtcagcacacgtaactgggtgtttgactgtggcagatcgtattggctaaagcagatggctggaccattgagcttggctgcctgtaagcatgacgttgacgcgctcaattcagcgaggattaaggaaatatacgagaacacagtaaagaagttggcgaagctttag

SEQ ID NO: 12100 - DNA, 387 bp, A.fumigatus
ttactgattgcccgccaaaggcccgcttcaaaactccccgggacatcttatgattttacttggttggctttcaacttcaagacagtcggctctctgagtcttgatcaacagagctcccttcacatttatctctgtcgactaaacctgtcgatcaactccagtgcagtcccggaacaagcctcgtccgcccttgttaagaacacctactgcaatggcatctgccccgccttcctccgaagccgcaaattcctcgtcgcggagaaccttcactatagggacacgcaaatcgaagcttgctcttttgcaaacagacctggttgttgcagcgctgaagaagtcatggccggaatatacatttcaaatacactctcaggagacagcgggtga

SEQ ID NO: 12101 - DNA, 357 bp, A.fumigatus
atgatcctggctgatagtcaatctttagatgtaccaactcaactccctccctcgtgtacattggggcccatgatggagagagaagatacaagggatgttctggtgatgaagaaaggattgcccaatatgtccttttccgaaatgcctgcagggtctgtcgtgggtacttcatccatccgccgcactgctcaactcgcccgccgataccctcatctgaaggtccaggacgtgcgcggcaatatcggtactcggttagcgaaattagatgcagaggatagcccatttacttgcattgtcttggctgctgctggtctgttgaggctaggtatggaggaccgcatatccccagtatcttga

SEQ ID NO: 12102 - DNA, 396 bp, A.fumigatus
acctgtcgatcaactccagtgcagtcccggaacaagcctcgtccgcccttgttaagaacacctactgcaatggcatctgccccgccttcctccgaagccgcaaattcctcgtcgcggagaaccttcactatagggacacgcaaatcgaagcttgctcttttgcaaacagacctggttgttgcagcgctgaagaagtcatggccggaatatacatttcaaatacactctcaggagacagcgggtgataagaatacagttattgctctccgcgaattcactaccaagaacctctggacgcaggagttggaagagcttttgatggctggtgatgtcgatctcattgtgcattcattgaagggcaagtttatcactcctgcctcatatcgttataaatga

SEQ ID NO: 12103 - DNA, 192 bp, A.fumigatus
gtatggaggaccgcatatccccagtatcttgactctaagaatggcgggatgctctacgcgttggccaagggagcacttggcgttgagatccgcaaggatgataaggtttctgcgggatatgctcaactctatcgggcatcagaaaacgactttggcctgcttcgcagagcgaagcttcctgcgaactcttga

SEQ ID NO: 12104 - DNA, 489 bp, A.fumigatus
cccatttacttgcattgtcttggctgctgctggtctgttgaggctaggtatggaggaccgcatatccccagtatcttgactctaagaatggcgggatgctctacgcgttggccaagggagcacttggcgttgagatccgcaaggatgataaggtttctgcgggatatgctcaactctatcgggcatcagaaaacgactttggcctgcttcgcagagcgaagcttcctgcgaactcttgagggtggttgcagtgcccttctgggtgttgagacggagtgggtccaggactccgacaggtcgtccaagctgagaatgagggccatagtcgtcagtgttgacggtcgtgagagtgccgaggttgaagtagacgggtcagtcgatacggcagaatccgctgaagagttcggcgtgactgttgcgaaggcactggtagaaaagggcgcaggggagatccttgcggagatccaacgcaaaaaactcactccgtga

SEQ ID NO: 12105 - DNA, 195 bp, A.fumigatus
atcacgcgaacctcggcttcgggaagcgcttatcgcttcatcgcctccccagtcacggactacgtctatggagttctggaacatctccgcgactttaaaactgatcgtctggccccatacagcccatttgtgttaattgactggcttcaggcaaacgctctatcctcttgctcttataccattagctctgtttga

SEQ ID NO: 12106 - DNA, 348 bp, A.fumigatus
tcaatagctcgaggtgacgaacaaggacgaatgtgtaacggtcaaggtatgactggacataaatcctcaagtatatttggtgctaacgcaagacttaagagtcccgcaaagaacatcctcgtggagaacatctactgtaacctgagcggtggttgcgccatgggctcccttggggcagacacggatatcagcgacatcacctacaagaacatctacacctggaactcaaaccagatgatgatgatcaagagcaatggtggcagcggcactgtttcgaatgtcgtttttgagaatttcatcggtaagcagcaagcacttcccttgtcattcagcatacaggcaggctga

SEQ ID NO: 12107 - DNA, 645 bp, A.fumigatus
  unsure (5),(8),(90): Identity of nucleotide sequences at the above locations are unknown.
gcttnggntgctgcatcactttccggttctgtcggacccctgacctcggcgtctgcaaaggcggccaagaagacatgcaatgtgcttgantatggagcaaaagcagacaagaagaccgatctgggaccacttctcgcggcagcatttgcggcctgtaagtcgggtggactggtgtatatccccgccggggactatgccatgtccacctgggtcaagctggcaaatggtaaagcatgggcgctgcaaatcgacggagtcatctaccggaccggcacggatggtggcaacatgatcatgatcgagcataccagcgactttgagctctacagcagtacgtcgtcgggtgccatgcagggcctgggatatgagtttcacgcctccaacaactggagtgggcctcgtctacttcgactgtgggatgtctcggacttctcggttcatgacttgattctcgtcgattccccctcctttcacttctctatcgacacttgctccaatggggaggtctataatatggcgatccgtggtggaaaccatggtggactggacggtgtcgatgtgtggagcaccaacatctggatccatgatgtgaggattggcttccgttccgggatacgatcaggatactttggatcacaaagctga

SEQ ID NO: 12108 - DNA, 756 bp, A.fumigatus
gcagcaagcacttcccttgtcattcagcatacaggcaggctgaccgagggcgtcaaaacggccataggtcacggcaacgcttattctttggacatcgacagcttctggagcagcatgagcgcagtgtcaggagatggtgtcacactgaacaacattacgatcaagaattggaagggaaccgaggcgaacggcgcacaacgcgggcccatcaagatcatctgtcctgataaagtgccctgttacaacatccttattgaagactttgccatgtggaccgagaccggcagcaagcagtggtactcgtgccaaagtgcctatggttcgggattctgcctaaagtcaggatctcatcacacctcttacgcagtgaccacgaccaccgtcagcagtgctccgtcaggctattcagcggcgaagatggcttcggatttgtcgactgatttcggcagcaccaagtcaattccgatcccgaccattcccacgtctttctatccgggtgcaactccttacagcgctttgatgtctaagcagtctactaaagccgccaaggcacgcgcagttgacatgagcgtggagacgcctgcagccgcatcccgttcagagcaagtggtgcagggcgctccacaggaaaccggtcagtcagctcctgagagtgctggtcctgttccttcgggtaatcctggtccagtgcccacaggcggcagtcgaccatcgagacaccgtcatggtcaccaccacttcgggagcgcaatataa

SEQ ID NO: 12109 - DNA, 1653 bp, A.fumigatus
cacttccgctgggaagatcgatcgcaccgattcaacccccgctctttaacgcgagacaatcttccggaaccattacagccattagcggacatgtttccacacatctggcccgtcaaagctcctggggactcaaagtataacaaggtccattctcctcttcaagccatcttactttcttctttaccgaagaataaagaaagtgggggcaagggccctaaaccgcctaaggtagacaaaagctatgtccctaagcgtacgcctatcacggcatttattagcagtgttgacaatctgcgcgaaaacgactatgttcttcatccggccctcttgtcaactgaaaaggaaaagttggcgttggcggaaaatcgcaaaagagctggccagtcgacggaggatggttgggtcgatacacatgtctcgagctgggaagcggggcaagttcctgagcatgagatccagcaaggcagtgtaactgccggtcgcgatatactggctctggattgtgagatgtgcattacagaaggtggtaaatcagaacttacacgtatcagcttggtacggtgggatggcgaagtggtgttggatgagcttgtgaagccacagttgcccatcattgactacctgacccgcttttccggaatcacaaaagagaaattggattctgtcacgaccaccctcgccgacattcaacaaaagttactcaatattctcactccgcgcacggttctggtgggccactcgctcaattccgacctgaacgcgctcaagcttacccatcccttcatcgttgacaccgcaatcatctatccccaccctcgcggaccaccactcaaatgcagcttgaagtggctcactcagaaatatctcggaaaggaaatccaaaagggccaaactggccatgactccgtggaagacgcccgtgccgtgctggaactggtaaagcaaaaatgcgaaaagggtgagcgatggggcacaagcgacgcctcaaacgagagcatcttccggcgtcttggccgttccccgcgcccagggaaagcaaccacctctggcgagggccgtacaggagccgtcgtggactggggcaaccccgagcgcggattcgggtcgcaggcgaccgtcgctattgggtgtcagaacgacgaagaagtagtccaaggcgtgtccgccgtcgtgaaaggcgatcccagcaatccatccattccaggcggcggagtggatttcacctgggcccgaatgcgagaactcgaggttctccgtgggtggtgcaatcgacttcccgacccgaacaacgccaacgagtcgacgactttggtccccccacccgaagaaaccaccccaacgggttcgggcacagtcgagcctgctgctgctgctcggaattctctggcagatacagtagctcgcacagtcgccaacatccaacgcatctacgaatcccttccaccttgtaccttgttcatcgtatacacgggcaccggtgacccacgagaagtcagccgcctgcagtccatgcacaaaactttccgggaggagttcaattcgcgcaaaccgtgggatgagttgacagttaaatggacggatgcggaggaacaggcgttgaagaaggcctgcgaaagggccagggagggttgtgggtttatgtgtgtcaaatag

SEQ ID NO: 12110 - DNA, 1344 bp, A.fumigatus
ggtcatgtgcaagtgcggccttctaactgggcttacagtcctaatatcttctggaagctacccaaggtatcatttagggagatcgtcaccatgcgcaccgttgaaccacttttcaaagatggatccctcgaacgtttcctctgcccgactccgaaagagtccaccagtcgggctttagtatctaccggtcctcacaaggtcgacgggagtaccatgtcgatggaacagcagatccagcatcaaggtgtcagcattgattacatttccaactccgttaacaacctacatgataccatgtcggaattgaaacattccttcacatctcttcggatagagttaaatggtcccgggcgacttccccctgacaactctggtactcatggaagcgattttgatatgatcaggacggtgttgaaagaactcaaatccaaagccgaagaaattgagacattgaagttggagatccaggctctccagttaaagaaccgatacatggaggagcaggcaacaaggcaccctgctgcaactttcggcacggaaacgactgtaatgccagaagttcggagccctgggctccttcaggctggtaggaagcggccctggcccgactcattcccaagtggtcgcaccgagcccattgcggactcgttcgatgaggaagatggcacattcggcgacttttctctcgcggatatgcatgctcaatcggtcaaaatacccttgaaagatcccgagcctggccatgccatagccgattcaacgcaccatcagataccgcctgaatcacctagacttcgcattgaggtcactcgatcacgtcaacatacgcctcactttgacaacatggttgaagacactgaaggcacaaacttggatacccaacagcccgctgtggtcaaacggcctcgcatattcgattcggctgaccggacttccggtggaaacaccgagaagagaaggccaggacgaccgcgtaaatcattgagccagtgtgccaagccggacttttctcaaacaccaaaaccgacaccgttgagcgagcaaaacggcaacgtgggcacatgtattccaaatgagcaaataccatcaaacacgagccctagcgaaccagtggatgtcttgcaacggagctctacacgttcgcgcaccttgcgcagtcaatcgcggcccccctcccgacgtcagtcgggcaatgcagtatcccaatcgacggatggagatcaaaacgcctttagaaagaagtctgccaatgactacggaggaattatcccaacactcaaacaaagaaggcaggcattcaaccacgggaatctgagattgaccccgcgaaggagacctccctga

SEQ ID NO: 12111 - DNA, 186 bp, A.fumigatus
ccgcctttcccctcctccacccatgtagatatcaccacgagaatagtgagctggaaagtaactatcatgtatgctcaacgccctctttcctatgcacctacaccttacagctacacgcctaacccggcgctgtcggcgactatcaatctcgatgaggtactcccgttcggatcgcctgtgaactga

SEQ ID NO: 12112 - DNA, 273 bp, A.fumigatus
ctgcggtcgtaccaggaagtgaaactagcctccagctccgcggaacgcgacctacatgaatcgctggccgagatttacagtattatcgtcacacttgatggactcgagaaggcatatatcaaggatgtggtcacagaggcggaatacaccgagacatgtacccggctactaaagcagtacaagtccagtttaggcgatgagaccgtcgcagcggagtttgttgatctggaaaccttcaagcggacatggggggtgagcacactctctgtatag

SEQ ID NO: 12113 - DNA, 420 bp, A.fumigatus
ctattctggcagctggaatgtccccgcgcgactgagcgtctccgcatcggccttcccgcaacagtcgagcaagcctctcacggaacaccttcaggcaacgcaggcccaacgaccggaggtcctgttggcggcgcttcaggtagcctcattctgacggctaccgagaacttcattacgttcctggacgcactgaagctgaacatggtgtccaaagatgcacttcacccgctactgtctgaagtcattcaatccgtaaacaaagtgacggatagggactttgagaaccgcggcaaaatcattcagtggctgatcacattgaaccagatgcgcgcaacagacgaactaaccgaggaacacgcgccggagttggcctttgacattgagcaggcttatcagggattcaagtcgacgctgggctga

SEQ ID NO: 12114 - DNA, 693 bp, A.fumigatus
cgatctttgaggattctaacgccgggtcttctgaacgtagccatgccagccatgtcccgatccttcacaatccctacctcatcggacgaggagctcacgctgacactgcatgagccctcattgaccgctgacaacctaggcatgaaaacctgggtctcatcgtacctcctctcccgacgccttcacacacttctcgatgtcgctccagcgcttgtaccctcgtcatcaacgactcccaagtcagacaggacgctccgagcgctggagctgggcgccgggaccgggctggtgggcctttcctttgcagctctccgcggcagctcggcgacaatccatctcacagacctacctgacatcgtaccaaatctagcccataacgtctccctaaacgtcgaactgctcacaagaacggatgcagccgtcacaacaggggtactggactggtctgtggcgccatcaccaccaccaagggaagaacagtacgacctcattctggctgcggatccgttgtactcgcccaagcatcctaagtggctggttgacacgatcggtcactggctaagacgcggactggacgctcgcgttgtggtcgaaatgcctctgcgcgatgcatacctacctcaggtgcaagaattccggcaacgtatgcaacagttgtcttcacgcccgggagctggcaggatccgcgcttaa

SEQ ID NO: 12115 - DNA, 225 bp, A.fumigatus
gaatcatgccacactcttttgcagtctttatactttgacgtaacgacaatgccgatctgggtggctttctgggtggattggactactcgattcgagcaacagatggcctctcattctgtagcatcaacttccggtctatcctcttctagccttgtctcctggattctctacgtgtcactgcgacagaacaatgaggcaatgatgacgccgtcgataaatctctga

SEQ ID NO: 12116 - DNA, 783 bp, A.fumigatus
acgcatattggctggaaggatatccgatgtaactttgaatatcgcagtgctggctggatctccgaccgtctcaaccactggctgggccgcaaggctgtcattgcgattgcggccgtgttcagtttagttgctcccattgcatgcggagtgactcagaactggcaccaactcttgggctgtcgtatactgttgggaatcggtatgggcttgaaggaggttacggttcctgtgttttccgccgagaccgtacccacgagcatccgtggaggcttggtcatgtcctggcaagtctgtaggtgctccctttttccctggttgatccttgaattcgggtcctcatctggtctaacaactgacaacggttatccagggactgcatttggcatcttcctcggaacgtgtgctaaccttgctgtggttaacaccggcaagattgcctggaggctccagcttggttcagctttcatcccagctgttcctctgctgttgggcatctggttctgtcctgaatcgccccgttggctattgtccaaggagaacccgcgcaaggcgtacgaatctttgctccggctgcgaaacagcccattgcaagcagctcgggatctctactacatccatgcgcagatcaagatggaaaagcggctgctccgggaatccgagttcacccggggcggcaatacccttgcacgattcctggaattattcacagtccctcgagttcgccgggccacacaggcttctggcattgtcatgattgcgcagcaaatgtgtggaagtacgtga

SEQ ID NO: 12117 - DNA, 813 bp, A.fumigatus
ttgcgcagcaaatgtgtggaagtacgtgaatcctcccccaatctagtgacaaactatggccatcgctcatactgcaaaacagtcaacatcatcgcgttctactcgtccaccatctttgagcaagccggcgccacgaacatccaggccctgcttgcgtccttcggctttggcttggtgaacttcctcttcgcctggcccgccgtctggaccatcgacacgtttggccgtcgttggctcttgctcgccaccttccccaatatgtgctggaccctgctggcggccggattctgtttctggattcccgcgagtagtagcgcccatctcggcctgatcgccctgttcatttacctgttcaatatcttctactcccccggcgaaggccccgtcccgttcacctactccgccgaggtcttccctctgacgcaccgcgaggttggcatggcgtgggcggtggcgaccaacaacttctgggccgccgtgctgtctctgacgtttccgtacatgctgcgggacttcaagccccagggagcgtttgggttctacgccgggttgaacattattgcgctgcttctcatcttcttcttcttgccagagactaagcagcgctctctggaggaactcgaccgtgttttcagcatctcgacccgtgcgcatgccaaataccaggtgaccgaagtgttgccgtggtggatccggcgatatctgctggggcggaaggatgacgtcgttcgtgacatctaccgccacctctctccggaccctgttctgatcgcggagaagcccaaaaaggaggagcaccttgaatcggtatga

SEQ ID NO: 12118 - DNA, 252 bp, A.fumigatus
acagggcgatcaggccgagatgggcgctactactcgcgggaatccagaaacagaatccggccgccagcagggtccagcacatattggggaaggtggcgagcaagagccaacgacggccaaacgtgtcgatggtccagacggcgggccaggcgaagaggaagttcaccaagccaaagccgaaggacgcaagcagggcctggatgttcgtggcgccggcttgctcaaagatggtggacgagtagaacgcgatga

SEQ ID NO: 12119 - DNA, 651 bp, A.fumigatus
ccctgtgaaagaagggaaacacgggcgggggaaccgggcatgatgtgccacggcttcaaaggcggcactgggagtgccagtcgtgtgattgatggggtggcgttcggcgctgagacaaattatattgtggctgggttggtccaggcgaactacggcgcgaagagagatatgcgcttcgggggtgctcccgttgggctcttgatggagcaagaagacggggccgttgccacagcagcagccaacgaggacgatgcaaggaaggccaaggatggaagcatcattgtggtgatcgcaacggatgcgccacttcatccgacccagctccagcgcttggccaaacgcgcgactgttgggctgtcacgcgtgggaggatggggctccaatagctccggggatattttcatcgccttcagcacggccgaacggattccacgagctccggatttcagctggaagccaaccgttgagcagcaggtgtcggtggtgcaggatgtgacgattaacgccttattcgaaggggcagctgacgccacggaggaagcgatctacaatgcattagtaggcgctgaagatatggaaggcccccggggaaagattgtcaaagcgttggatcatgcgagattgaaatccatcatggaaagatatttgtag

SEQ ID NO: 12120 - DNA, 516 bp, A.fumigatus
ttagccattgcgtcgttcagcaacctcgtagagctcctgtcacgcttatatgagtccgtcatttccccagccccgttccgcaccaaggagcacgcaggagcccagctcgtcttttgtgtctcctacaacgccttcagttccgccatggcccacactctggaatttgcttccgcttgcaggtctggtgaattcccaatcgactgtattgaaatatggaagacctccacaatggaacctattcgcaccgaaccagaggaaggctttgcaagcaactggaggttcataacgtgcgagaatcactggactattgtctttaagtacggcggacgacaagccattgcgacaaaatacagaggatacgacttgaaatggcgccacgacgatttggccgaaccctctgtggttctaaagttcgagcctcggccttcatgcccatccatgagcgacgtcgcatggaaaatatgcgccgtagaaaacccgaatacaaaggcatttgactgttctcagtttgtgtga

SEQ ID NO: 12121 - DNA, 261 bp, A.fumigatus
aatatgtacgctccacattggggagaaggtatcagagctaactacatgtccatgcctcaaaccaaacatgaggccgatcctcaccctccaacatactgtgagcccaacgctcggcggcttgacacggtatccaatggaacagagcaactagtatccgatatgcaaggtgataagagtaacgtcattgctctggactgttcagcagaggcagctcaacgcgacgcacgcagatgctctatcaactcatctactggcccatga

SEQ ID NO: 12122 - DNA, 1290 bp, A.fumigatus
gattttatggaccttttctcgacccttatggtcagtttgaaactggattcgcatcgtgtgagatttacgaaatatgatcacactttcacaagcgaggaagccatcaacaacctcggttcgctcaagttctcccaatcgaaccgcatgcctgatcccaaggatccctctcgcattgtgaccactactacaaccaccaccttttctatggccaaggagatggctcgctcggtatgccagcgtttcgttgacgcccgctttatcgaacccgtcgatggcaaagcactcccgatattcccactgaaaggcgcgttgtttcagctcactccgaagggcataaatatcttgcagagattctgccagagaaatggcattaccgcccgacatgtgatagatgtgctggaatcccctcgcaacacgatgcaactggtcaatctggagcgcgacacggagactgataaactgtcgcatgaccgagctaccatcgaagtcatttttcgccgctttgccggtcaggatggacccaatgtgaagagtagtatttctacctcggattctgattcgttgagtgactactcaaacggtcttgttggggtaaagatggccaaggaacggaaaatcaacgacaagatctacatgaacaccttcaccgggaaggctgccgtggactggctgatggattgttcgacaaccattgaacgccgggaaaccgtccttattgcggagcttttcgtcaaatacggcctgatcacaatgcttcaagaggacaagggatatcctcagccagatgcgtccattgtcgtcttccagccatccaagtacgctatttacggtatcacggagcggggtcagcgggtttgcggttggattgcgcgcgacaagtcccgtgagacgttctatgacaaccgcggtatgccaaaggattccaacaacgctcgtttgaaccacattcttcaagatcctgctctgcgactgctattccgtgaattcctgcgtttctctctttgcgaagaaaacctgtcattttacctcgatgtctcggaatttaccgctgcttaccacaagtcggagaagatgggtgcattcaagaaggccgacgctgtccgtgaaacgctggctgcggcatatggtaagccactcttcataggggattctgattggttatacagtttttgctcactttcttccaggtctttacaatgctttccttgcccccggttctccgtgcgagctcaatatcgatcacgccctgcgaaacagcttagcgagccgtatgacaaaggctgtaggtga

SEQ ID NO: 12123 - DNA, 375 bp, A.fumigatus
accgcaatcgcggattttccaggtcgtggtgaagacctcgagacctcggaggtagaatcccagcagagcttgagcggaaggcggcgccatactcttcaacgcaattcacctatctcagagcaacagctggaagccggatttgctgcactcccatccaagatgcaccaaacgtcttcgagattgttgcgcatgacggaagatgatcgcccatttacaaaggtatggaaagaaaagaaaaccggagcctcttcaataatcaatctcagcatgatacatagaatgctcaaaagtttggagacaatatttgttgacgatttgggtttttttttctgtaggattttatggaccttttctcgacccttatggtcagtttga

SEQ ID NO: 12124 - DNA, 360 bp, A.fumigatus
gggattctgattggttatacagtttttgctcactttcttccaggtctttacaatgctttccttgcccccggttctccgtgcgagctcaatatcgatcacgccctgcgaaacagcttagcgagccgtatgacaaaggctgtaggtgatgacgagtccatgttcaaaagccttcaggaggttgtgcagttgtttgagatggctcaaacatctgttttcaagttaatgtctagtgtaagtcctttttcttccgataacagcttggttaatcacagttcactgatgaggatcaggactctgttccaaagttcctacgtgatccgaaatatgcggttgtcctgcaggagcatgacgtcgacttga

SEQ ID NO: 12125 - DNA, 636 bp, A.fumigatus
acgttgatctctaccgcctggttaagacgcggcagctccaagaaccaagacccgatcatccttctctccccctccgcctcgtctctgatccgcatgtccaacgtccgctccttcctgcaggacggcgtcttcgtgcccccggaccacccgaccctcgccatgcccagctcctccaacaacctgctctacatttaccgccccctccgctcagaggccggctcgacgtccgcctctcgcccacttggcgcttctccgcccggagcaacttccaagaaacccacccgcttcatcctcgttgacagcaccgccaacttccgtccggactactggaaccgtctcgttgccgttttcacaacgggccagacctggcagttcaagtcgtacaagtggacctccccgcccgaacttttcaagcacgccacaggcatctacgtcggctggcgcggtgaaaacgtcccccgtgaagtccgcggctggggccgcggcgtgcagagcttcgccgtcgagcgatgggacgagaaaggcggtgtccatggcgccggccgctggcgcgatcgtgaagtcgtcgagaatatctggacagccatcgaagaaagcatgaaagcaagagggtggggagccgggtcgacgaaataa

SEQ ID NO: 12126 - DNA, 513 bp, A.fumigatus
tccgcatgtccaacgtccgctccttcctgcaggacggcgtcttcgtgcccccggaccacccgaccctcgccatgcccagctcctccaacaacctgctctacatttaccgccccctccgctcagaggccggctcgacgtccgcctctcgcccacttggcgcttctccgcccggagcaacttccaagaaacccacccgcttcatcctcgttgacagcaccgccaacttccgtccggactactggaaccgtctcgttgccgttttcacaacgggccagacctggcagttcaagtcgtacaagtggacctccccgcccgaacttttcaagcacgccacaggcatctacgtcggctggcgcggtgaaaacgtcccccgtgaagtccgcggctggggccgcggcgtgcagagcttcgccgtcgagcgatgggacgagaaaggcggtgtccatggcgccggccgctggcgcgatcgtgaagtcgtcgagaatatctggacagccatcgaagaaagcatga

SEQ ID NO: 12127 - DNA, 285 bp, A.fumigatus
ccgactatcgactcccaattcaccaggcaccttctcggaagcccgtccctggactgcatcgtggctacccttttcaatcctacgagcctcaccagcaacaaccgccgcaccattatcgtccgcagcaacagcaacagcaccaccaccaccacctacaacaagaggtttctccccatccctccgtctcgtcggccagccgcaatcgagcttcttcgtcccacgtctcgccgtacggggcgcatcagcaacaatatgccggcgccccttcgccgcaatacacaatga

SEQ ID NO: 12128 - DNA, 213 bp, A.fumigatus
aggcttaagctgaccctttctcattttacatggggttattctaccttcactacattcttcgacaaatctgcctacggcgcattcgtcttcatctgctcactgtgtgtatttgcatattttgcacctttggggcgctcttataccaatcttctgcgccgtatcgctaattctaataatatgacttgtacataccagacattggtttccaattga

SEQ ID NO: 12129 - DNA, 1188 bp, A.fumigatus
cctttggaatcttcttttctgccgcaacctctcaactgctttcggtcctgcatggctggcgtgcaagctcagcccaccatgaccgactatcgactcccaattcaccaggcaccttctcggaagcccgtccctggactgcatcgtggctacccttttcaatcctacgagcctcaccagcaacaaccgccgcaccattatcgtccgcagcaacagcaacagcaccaccaccaccacctacaacaagaggtttctccccatccctccgtctcgtcggccagccgcaatcgagcttcttcgtcccacgtctcgccgtacggggcgcatcagcaacaatatgccggcgccccttcgccgcaatacacaatgaccagccacgttagtcaccaatcaaggcgcctgtctagtgccaccacctcgaccagctcaaccggaaacaactttagctctgatatccgccggagtacatcatcccgctcgaccaacactcaagtcggctacgtggctctcatgcgcaggcagaaggcaactgtctggtgtgatcgagctcagcctgaagatccccgacttcgggcccaaaagctagcggataagaaaagggcctacctggaagtccacggcgctggcgccggacgcaccggtaccctggcaagcggcaagaacaagcatggaaacaagggagtgacagaattttcggcgtcagctctcgttggagcgaccgttccggtccggctcagtgcaaacgaggtgggcgacggagacgaggatggacatagtgataatggatttcctcatcgccgcacgggcagcggccgcagttctctcgggagcaattaccgctaccctagtagctaccagcggccttcccagggcacctcggggagtaataataccccgcccaacgaaagggctgatcttccagaagttacggaaaatcctccagcggagcgccacgagcaggaaagagcctcatctgccaaggacgattctgccactagtcatagcaagaccagtgagcaagaggatagcttcggatctgtaggtgacatggcagcgcccagtgccgccaccaccgctgctgagaaggcccggaaggcggacgaattgcggcgcagaggaagtgtggatgaacggacgaccacaatgacgaacgtgcgacttttcgtcgcaaatcccgatctcagtgactga

SEQ ID NO: 12130 - DNA, 2223 bp, A.fumigatus
cctttccacatttcccccggtaaaacaaatggcctccaaagggaaatcatggatcaaattttccctgaacgtgtgtcgctttcccgctggtgtctcaataagcggtcaaactccaaggtgaccctttttttttttttggcagacatcaggcgatttatccatcaaaccggacagaattccttggattcggcatctggacaaaatctccggtctttgttgaaagcactttcgacgcaacttccttgtgttacaccaaaagttgtccgtacaaagtctggctccagaactaccggggtgcccatcaaatcagccgatgccttttcggtcatttcccccgctgctgcaggagtttttgatgacgatatagcgcccatgctagtaggcccggcctgtaagctagccgtagaaagtccatcactggatgaagtgagaaacaagcccctccctcgggagcccccgattgcattagctcccttgtcagttcgtcacaacggcccccgtccgttccaggcttgccagcgcccctccagcgactggctttgtacgacaaccccggccagtcctgccacacggctttcgcattctcagcgtactctatcccaggcagctcaggaattggaaaatttccttgcagggatcaccgagcagcgccacaatgagccccaattgttttcttcacagatctccaacgggcctttgcaaataagtcgcggaaacatggacatgattgcgactcgaccagctccaaggcctcctactaatattgcttctgtcaagtcaaaagataactcgagtcaaaaaattagtcccgaaaaaccagaacgcgatttgcaaaaaccaatgaagaaaaccaagtataaagggcccttctcgttttccgtccctggattcagtcgcaagtacaccaatactcatctccgatcgttcagcagctccagcttgaagtcagaagtggaatccccgtcctttcgccctcagcgcccgccgcgcccggaaactattcacgatgaggcagaagatactgctgaagtggcccagtctcccttcttaccagtaccctctcagagacagagatcatcgtccttttgcagcgaaagagaattacgattgagactccctcggcttcagacaaagcaagtgcgcagccacgaagacctcgtctcctcctcatccagctttgtggaagccgaacgggtcgccgagcgatcgatgcctagcattcgagcgaacaatgtggaggagaagatctttgtcgcgtccagcaaatcaggacgatcaaacacctcagactcgcttttcgaattggacggtggcatgccccaaagaatgatctatgagcttgatgcaggtttgccatcaccacatcccaaaattaacatctcagttcacaaaccctccaagacaactgccgtccaattgccagatgacatcgccctcaaaatactggagcaagttgcttcccttgatgatctcttccatctagctgtcgtctccaagcagtactatcgcgttttcaaacagcatgaattacatcttatgaagactactgtctaccgcatgtcccctccagcctgggaattgcgtgaaatgagccctccgtgggatagcgaatggcagattctcgttgatccggacgctcctgtccccgaatacactcccacactttatctccaacgttacgctcaagacatctatacactcgctcagctcaagtcactcatcctggcccgctgcaataccttccttcgccaggaaacgataaatggtctgacaggcaaagatgatacccgagcggcagaaatcgatgacgccttttggcgaatctggactttctgccggatctttggctgtggcaagaatcgggagaatgatatagtaggacagatggactggctgaatggcggcgttatggcccacgaccgtaacagcatcatgaccacgtcgctcactgagccattcggtatgaacaatgtcctattcgaaccgccggaggggttcgggcgcgggaacggggaaggtctttcccaaagtcagctctacgacatgacagaaatatggacttgtcttgccgtgttgctccaacccattcacggcaggcgcactgaggcccgaaaggctggcgtttttgccgggctcgacatcgcagaaaatgacacggcgaaggaagaagctatgataggtaagtgttcctttctgtcatcttcttcgtatctgggatcgtag

SEQ ID NO: 12131 - DNA, 195 bp, A.fumigatus
actgacaagggaatagaggaatggacatactatgtcctcacgcttggaccttcggcagtccttagtattggctcaatctgtgctttcgatgactctgaagcgacattccagacagcgcaatccattggactgacaaagtgggagcctgccgactcctctatcagccggtccacttttctcaaagaagccgtcttc

SEQ ID NO: 12132 - DNA, 222 bp, A.fumigatus
cagaaaggaacacttacctatcatagcttcttccttcgccgtgtcattttctgcgatgtcgagcccggcaaaaacgccagcctttcgggcctcagtgcgcctgccgtgaatgggttggagcaacacggcaagacaagtccatatttctgtcatgtcgtagagctgactttgggaaagaccttccccgttcccgcgcccgaacccctccggcggttcgaatag

SEQ ID NO: 12133 - DNA, 261 bp, A.fumigatus
gacattgttcataccgaatggctcagtgagcgacgtggtcatgatgctgttacggtcgtgggccataacgccgccattcagccagtccatctgtcctactatatcattctcccgattcttgccacagccaaagatccggcagaaagtccagattcgccaaaaggcgtcatcgatttctgccgctcgggtatcatctttgcctgtcagaccatttatcgtttcctggcgaaggaaggtattgcagcgggccaggatgagtga

SEQ ID NO: 12134 - DNA, 918 bp, A.fumigatus
  unsure (188): Identity of nucleotide sequences at the above locations are unknown.
tggggccaacaagccggcacatccaatcggaagaacctgccatgcggaccacccaagatgcccgatttgcccggtatcccggtgaccccgggggtcctccccgaacagcaaaaagaggcgctcgccgcggctttggaacgtattgccggcaagatgatcgacacagtgcgcatcgataccactcactntgtatgtagagaaggcagaggcccgctgtgggagaaagcggtggagatgaacattcccgtcgtggttccggagtgggtggatgcctgtgaagccgagggcaccatcgtcggagtccggggctactacctgaatgcagaccccaaggccagacagctcggccccatccatgcctcgacacatcaacataccagatcctccgtgtcgatggcaaccaatgcgccatctcagtctcagtctcagtctcagtctcagtctcagtctcagtctcagtctcagtctcagtctcaatcccaaccccaatcacagtctcagagtagactgagcctccagcctcaacctacgcaccagagggaattgagcgtcggggacccccccgtgactcccttccccggtgcagatatgagtggccagcctcgagcggatgagagagaggtctcatcggatgaagaggacttgccgccgccccctcctccgaaggatgatgctgcaggtgctgaacccgctgtgaacggcaaacctgagtcgacaagcccggagggagttgtctcttctggagacaaggaggaacggagtgaaagtgacgagaaacatgacgaaaaggatgaagatgaaaccgcacacgaagaggccgaagaaaagcaggaacaggaagaaccgacatcaaacgacagtgatgccaagggtaaggggaaggaaggtgagggggactttatcgagatttctctgtga

SEQ ID NO: 12135 - DNA, 528 bp, A.fumigatus
  unsure (339): Identity of nucleotide sequences at the above locations are unknown.
gttgaggctggaggctcagtctactctgagactgtgattggggttgggattgagactgagactgagactgagactgagactgagactgagactgagactgagactgagactgagatggcgcattggttgccatcgacacggaggatctggtatgttgatgtgtcgaggcatggatggggccgagctgtctggccttggggtctgcattcaggtagtagccccggactccgacgatggtgccctcggcttcacaggcatccacccactccggaaccacgacgggaatgttcatctccaccgctttctcccacagcgggcctctgccttctctacatacanagtgagtggtatcgatgcgcactgtgtcgatcatcttgccggcaatacgttccaaagccgcggcgagcgcctctttttgctgttcggggaggacccccggggtcaccgggataccgggcaaatcgggcatcttgggtggtccgcatggcaggttcttccgattggatgtgccggcttgttggccccaga

SEQ ID NO: 12136 - DNA, 1170 bp, A.fumigatus
tttagagataccataaatcacctcaaattccttctagcgcattcacaatttagttcgttttccgccaccatgtctgtgctcagtacactggcacccgtcccaccagatgagatcttcgccttgaatcgcgcgtatgccacggatcctttcccgcaaaaggtcagcctgggagttggcgtctaccgcaccgacgacggcaagccatggcctcttccatgcgtgcgcgaagccgagaagcaactgcttgccgaagacagtcttaccagacacgagtacaccgccatcgaaggcgacattcccttcctcgagctggctcgggacataatgttcgggtttgatggcaagaacgcagcagagaagcacaagagccgcattggttccgtccagaccgtcgcaggcaccggcgcaaaccacctcggagccctgttcctggcaacccacatgaagcccggaaaggtctggctctccaacccatcctgggccaaccacatgaccatctgggaactcgcaggcgtcccccgcaagacctacccttactacaaccccacgacccgctcctttgacttcgacggtatgatggcgaccctggaggccgaggcgcaacaaggcgatgtcatcctcctccacgcctgcgcacataaccccaccggccttgatcccaacaaggagcaatggaaggccattgccgacctctgcgagcgcaaaaagatcttccccttcttcgactcggcctaccagggtttcgcatcggggtctctcgaggaggacgcctgggcggtgcgctacttcctcaacgagaagcccggcatggagatgtgcgttgcgcagagcttctccaagaacttcgggctctacggacagcgcgtaggtgccttccactacgtcctgccccaaggcagcgagagtctccgcgacaccgtcgtcgttaatctgtgccatttgatccggggcgagtactccatgggtcccacagcgggttgcaacctcgtcaagaaggtcctgacgaacgaagaactcactgcgcagtggcacaaggatctcaaagtaatgagctcgcggatccgctcaatgagaaaggctctctatgacgagcttctgaggctgcagaccccggggtcctggagacacattgtggaacaagtatttcccctccgctccctcctcccttga

SEQ ID NO: 12137 - DNA, 198 bp, A.fumigatus
ggctgcagaccccggggtcctggagacacattgtggaacaagtatttcccctccgctccctcctcccttgaacaagtctgcaaccagtaccttacacagaaggctaacacttatctagaatggaatgttctcctacaccggcctcacccctgcgcaggttcattccctcaaagacaagtatcacatctacctgcttaa

SEQ ID NO: 12138 - DNA, 465 bp, A.fumigatus
tgcacgggacaagtatgcagacacagacactgttcagcacgaagcatcagggatgcagatcgcggtcatcacagagaaatctcgataaagtccccctcaccttccttccccttacccttggcatcactgtcgtttgatgtcggttcttcctgttcctgcttttcttcggcctcttcgtgtgcggtttcatcttcatccttttcgtcatgtttctcgtcactttcactccgttcctccttgtctccagaagagacaactccctccgggcttgtcgactcaggtttgccgttcacagcgggttcagcacctgcagcatcatccttcggaggagggggcggcggcaagtcctcttcatccgatgagacctctctctcatccgctcgaggctggccactcatatctgcaccggggaagggagtcacgggggggtccccgacgctcaattccctctggtgcgtaggttga

SEQ ID NO: 12139 - DNA, 243 bp, A.fumigatus
tacgcttttcagctcttacatgttgcaatccaggatctagtcttcggtgctgatatgcatgaagcttgggttgagtatccactccatcagcttacagtcatctcttctgtctccattaggcaactggggcagaacatcccatttctcttagcttacaatgttacattgactccaaagctcgcactccacttgtcagtttgcggcatgatctaccctgtaaggggcgtcttctggccccaataa

SEQ ID NO: 12140 - DNA, 447 bp, A.fumigatus
acctggacatgcatcaaccaacagctgaatcccaagacaaacaaatgggaagacaagcggcttctatacaatcaagccaaagccgaaagcaactcccaccacgcacctctttccgacggcaagaccggtagcagctacccgcactggttcactaacggctacgacgggaatggcaagctcatcaagggtcgcacgcccatcaaattcggaaaagccgactgtgaccgtcccccgaagcacagccagaacggcatgggcaaggatgaccactacctgctggagttcccaacttttccagatggccacgactataagtttgactcgaagaaacccaaggaagacccgggcccagcgagggtcatctatacttatcccaacaaggtgttttgcggcattgtggcccatcagcgggggaatcagggagacttgagactgtgttctcattag

SEQ ID NO: 12141 - DNA, 186 bp, A.fumigatus
gctctgccaatgttcacgctcctccttatcattcagagataccatgcctatcaatctgtcaataagatcacgatgccagcggctcgcacggatctatacttacaatcatacatctccctgaatgtcggacctagcaacggtaaatctccccacaagtcaaaggtatggtcccatgacgctaggtag

SEQ ID NO: 12142 - DNA, 807 bp, A.fumigatus
  unsure (770),(775): Identity of nucleotide sequences at the above locations are unknown.
gtttctctcatattgatttttcctaagtaccctccacaactgcttttctttccgtcccttctgacagtcaccagggcagccctgataatccccaccccccggcaaacgtttctcatcatgtcgaacacattctcttttggtgcgccggcctccagcggcgcctcaagcggaagtctatttggaactgctggcaacgcttttggctccaatcagaacagctccaacaccaccaccggaggtggtctctttggcaatgtaggagcttcctctagcggcacttctacaccctcattattcggatcggcacctgcgacggggaaatctggcaataccctgtttggtggtggtaccagtgctacgagcagcagcacacctaccggaagtacgcctgcatttagttttggaactcaaaccaagtctggtagcacacctcagtcaccgtccttgtttggcggcggatcgcagacacccaaaccaggagagtcttctgcttctgggcaaaccggcggcaatgctctcttcgggaatgccgcaaagcctgctgggaatatattcggaagcgccgcagcgactcctgcgccatccggaggctcactcttcggcaacacctctaccacacctgctggccctccgccacagggaaccgcggccgggcagggacagtcgcttttcggacaggcagctcagaaaccaggcggtctcttcggtggactaaacgcaacaactacttcctcatcgacagcctctcccacagccacgacggcgcgcgncagtnttcacgaggatgatatgatgtcattgggatcg

SEQ ID NO: 12143 - DNA, 246 bp, A.fumigatus
tcatgcaaggcgtgtgaggaagtgaagaaagcacaggtaatatcatataatatgggtttctttctttcttgtctctttggatattatctctcggtcaactcatgggagaagagcgctagataccaatcttattctgttcaaggcgaggttggaacctcgccatatcctatccgccatggaacactgactttcctcttgaattttgggtatatcttcgcccgatttcgggtgccgatggctttttag

SEQ ID NO: 12144 - DNA, 258 bp, A.fumigatus
tattattggcggctggcccttgggcaacctttcactgttgatacctcaggccattacgaacgcagttttatgtgtggcctaaggcacatggccgagactcccgtagaacctggtcatcgacaacaactacatattgatgacaacgtcatccaatgcaaggcatcccttcctcacctatatatccattatacctttcctccagacatccttcttgtctctactgaccggttctatatgaaattctcccggaaaaattga

SEQ ID NO: 12145 - DNA, 762 bp, A.fumigatus
gcactttttgcacgcatatatactaatatcatttcaaattcgcagcctcccataatagatttcgacaccttccagtcttttcccgatctccacgccgccttggatcaatacctcgacaaactctatcccacttccaagaatgttgaatcgctccctcctctagagccaatccaagatgcctcctccatcttcagtactgagcgatccctgtcactttggtctcagctcgtcgcgccgccgccattgcagccgcaaaactgggtcaagtcgcgaattcgccgtcttttcttggtttctttgggcgttcccgttgacctggatgagatactgccggcttcaaagcaaaagaagctcgtgcttccatctatcaatctgagcggctcagacactactggatctgccgttcattcacgctctcatagtcaggccaggaaaagcggctcacaagacggcattgacagtcccacaacgtctgctccgacaggtcggcatcgaacatctcgtcgccgtgaccggtctccgccaccgcagctggatctgtcggccgtgcggcgactatgtgccaccaccgatgcagcattggacgggttgaccgacgcggagttgaggacgcacgtcaaggaacttgagcaagtcacgcttcgggctagttctgtccttgaatactggctgaagcgtcgagatggactagtcagtgagagggaggcatttgaaggcgtgatagagaatcttgttaatcatgcaaggcgtgtgaggaagtga

SEQ ID NO: 12146 - DNA, 306 bp, A.fumigatus
ccaaggggactgggagatttgggacacgcactcatgcagattgctgcgattcagggtctggccgcaaccttggatgcatcgagcgacggacgatccaaattctcggcatccgaggactcctcggatatggttctgataataatacatataagtactgcacatgaatcgagctttgaaacggttgctaacgatgtcaggagagggaacttggtatcgtcactacagagtatgtgtcacgctcaatattatcttacacagtggctctgtctactccatacagccctggggatcattgcggattgctag

SEQ ID NO: 12147 - DNA, 804 bp, A.fumigatus
tccgcagacgaggaacaggtgcgcgaccactatgaccgtggcgacgacttctacgcttggttcttgggccctcggatgatctacacctctggcatcattagtgatatcaacaaggaagagactttggaagaacttcaggacaacaagctagctgttgtctgtgagaagatcaatgttaagcccggtgacactattctcgacctgggttgtggctggggtactctcgccaaatttgcctcagtccactatggcgcacacgtcaccggtatcacgctcggccgtaaccaaactgcctggggtaacaagggtctccgcagcgccggtatccccgaatctcagagccgtattctttgcttggactaccgtgatgctccccgcgtcgagggcggttacaagaagatcacttgtcttgagatggcagagcacgtcggtgtacgccacttcggttccttcctgtctcaggtctatgaaatgctagacgatgatggtgtgttcttcctccagatcgcgggtctccgtaagtcctggcagtatgaggatctcatctggggtctgttcatgaacaagtacatcttccccggagctgatgccagcactcctcttggattcgtcgttgataaattggagggcgctggttttgaaatcaagggcgttgacactattggtgtccactactctgctactctttggcgctggtaccgcaactggatgggtaaccgcgagaaggtcgaagccaagtacggcaagagatggtttaaagtaagtccctctgacaaattccttttacacgtggtgcaccactga

SEQ ID NO: 12148 - DNA, 528 bp, A.fumigatus
tacccggctatcaaaaatgctcccgtccccgcagacgctgcaggcagtgatagtttctccaacatcctgcttttctctctactgctgtttgttccgtggtacttggcccgccaggtcggtggtggtttctacaccactatcttctttgcaatctttaccaccgtccccatcctgatggtcttctggtccgtggcttcttccatttctccccgcaagaatgagaaggccaagtatgctggtcgccccgtcgagcactaccttcacttccacaacgagcatgatcgtgccacctaccgcggcaagagcaagattccgatggaggtcttctacgaaaagtacttcaatggagaggttgatttcaaaggcgacgctcttgaagctctggagttcagacacgactgggccaacttccgcttcaccatgggcctctacaagcacttcctcttcggcttcattcctgaattgctggtccactcccgttctcaaggtaaagtggcattctcttggttattctgcacagatgaatga

SEQ ID NO: 12149 - DNA, 294 bp, A.fumigatus
ccacatcggcccgtgaacctccgtttcgagatccgtgtggctaagcttataatgatccacccttcgtctgtgagatctctagtaactcttcgactgtccggcagttcacctgggttgatgatacgtgaccaggtgctctcagagtactcgattcatcatgcctctgtaagtttattgaatttgttcttatgcgattctatcgcgcatactaatgccttgagcagtcacctactcggcaagaagtcatggaacgtctacaatcccgagaacatcgctcgtgtacggcgtgatgag

SEQ ID NO: 12150 - DNA, 561 bp, A.fumigatus
tggatgatgccgtattggataccgctcgagagctgttcctctgacacacccaaaaacaggttggacttattccagcgcatggtaaaaatcggctctgttaaccttcatgtttacgacatcctcactgatgccggccatggtaccgaccttgacatgccgggtaaaagcaaacgaagacgcggacttgacgaggccagcaatttcggcgccagagaagttcttagtaagaagcgcgagctcagccaggtcaacgtctggatccaatatattgttttccctcatcttctgggtgtgaatcttcagaatctgagcccgtcccgcctcgtccggaagagagatctccatgtgcaattcgagacgacccggccgcaacaaagcttcgtcaatcatgtccttcctgttggtcataccaatcaggaggatattgttcagttgatcaacaccatccagtttcgacagcagctggttgaccacactgtccccaacgcctgtgccaccacctgcgccgctgccacgttgcttgcacacagcatccaactcgtcaaaaataatgatatgtag

SEQ ID NO: 12151 - DNA, 351 bp, A.fumigatus
ctaataacaagcagtgttgccgtctcaacacaggacttcccgccttcacgcgacggacttgatcttttactccttgtgaacgatctctatgtcttttctgctcgtcctctggatggtttccctcctggacatatcagcatgtcggatccccaacggacatgggcaggcgttgctttcacagattcagtcaaggctcagatatacgatccgttcagccagggcggacaagcctatctcggatcgacagatattgaagtcggctttgctgggaaaaagaggatcgagactccgtacgaccaggacgagttagcgaacgccgtcgtcaaggtaaatactcgtttggatcggtga

SEQ ID NO: 12152 - DNA, 1092 bp, A.fumigatus
aactttgaaaaccagatcttctctccgggtcagaagatcttgatggatcataagagcataccactgctcctgactgtcaagaccgttcagcgcgtcgatctcacatcggagaaagctggggctactgctggaagcactgagacggaccctaccgcgaggggaatctcgacgaggcacacccagattacttttttcaaggatgcccgcaccggcatcagcttgaagccatcgaatcgtcgccccgcagctagctccattatcacacccgacttcaagtttgaagatatgggaatcgcaggccttgatgcggagttcagtacaatcttccgtcgtgcgtttgcatcgcgtatcttccctcccgggttggtcgaaaagctcggtatccagcacgtgaagggtattttgctttgcggccctccgggaactggtaagacattgatcgcacggcagattggaaagatgttgaacgcgagggagcccaaggtcatcaacggtccagaagtgcttaacaagtttgtcggtcagtcggaagagaacatccgaaagctgtttgccgacgcagaaaaagaatataaggaaaagggagaggagagtggactacatatcattatttttgacgagttggatgctgtgtgcaagcaacgtggcagcggcgcaggtggtggcacaggcgttggggacagtgtggtcaaccagctgctgtcgaaactggatggtgttgatcaactgaacaatatcctcctgattggtatgaccaacaggaaggacatgattgacgaagctttgttgcggccgggtcgtctcgaattgcacatggagatctctcttccggacgaggcgggacgggctcagattctgaagattcacacccagaagatgagggaaaacaatatattggatccagacgttgacctggctgagctcgcgcttcttactaagaacttctctggcgccgaaattgctggcctcgtcaagtccgcgtcttcgtttgcttttacccggcatgtcaaggtcggtaccatggccggcatcagtgaggatgtcgtaaacatgaaggttaacagagccgatttttaccatgcgctggaataa

SEQ ID NO: 12153 - DNA, 186 bp, A.fumigatus
aggttaacagagccgatttttaccatgcgctggaataagtccaacctgtttttgggtgtgtcagaggaacagctctcgagcggtatccaatacggcatcatccattattcccccacaatcaacgaaatcctgaagggagttcaactttttgtaaagcaagtcagcaatgctgaatcctcgccctaa

SEQ ID NO: 12154 - DNA, 618 bp, A.fumigatus
catggtcccaccgccagtggcaagactgctttggccgctcgaattgcgattgattccggtttccctttcatcaagctgattagccatgaagatatggtagtctttagtgaaatggccagggttcagtacatcagcaagattttcgatgatgcatacaagagtcgcacgagtgtcgtcgtcgttgacaatattgagagaattatcgactgggtccctatcggtccccgtttcagcaacactatccttcagaccttgatggtcttcctgagaaaacagcctaccaaaggccgacggctgctgatccttgccaccacgacggagcgcgctgtgctcaaacagctggacatctataactcgttcaactcggatattatggtacctaacgtgatgacctacgatgagttgcgtcatctcatggagcagtccgaagcatttgacgcctcggaaatcgaccaggctttagcaggagtcggtggcatcaccgaagatagaaccatcggcgttggcgttaagaaggtgcttttgggaattgaaacagcgaagcaggatcccgacaaggtgggccgatttgtccgcgtcatcaacagagcaattgaggaagagcgaacattccaatag

SEQ ID NO: 12155 - DNA, 324 bp, A.fumigatus
ctaagattactagccggctcttatgcgcttgttggcgccaaggtggctgcggattcaactgttgcaaagaagctcagacaagcaggcgtcatcatcctcggcaagacgagcctgtcagagtgggcgaatttcaggtcactgaatgggtcctccggctggaacgctcagggaggccagacatatgcagcttactacccaaagcaggatcccagcggtagttcaagcggcagcggcgtcgcagctgacttgggccttgcctttgcagccctaggtactgaggtaaatgattttcatctacatggtctctatgctatcgtgtgctaa

SEQ ID NO: 12156 - DNA, 204 bp, A.fumigatus
gcggaaaggaaatgtgtgcctgatcgcagcagtattgtctaccgcagcattcggggttgtgctagcctatatttccacagccatgttacacttaagcaaatggtttctggcgccctttgtgtatgcgacgaccactgcatcaagtcctcagagttcgccgaatggtacagcagctcgtcaatgtgtatttccctccctgattga

SEQ ID NO: 12157 - DNA, 198 bp, A.fumigatus
agctttaccaaggtaatgaataagcatactaagaagggagagaaacagatacttctatttaatggccatggctcctaccttattattaaattcttgcaactttgcaaagataatagcattattccctttagattccttccttatataatatatctttaccagccattagatggtaagctattcttaagctataagtaa

SEQ ID NO: 12158 - DNA, 588 bp, A.fumigatus
gttgtgatccgtgcacatgtatgggcacatactgatgtgaaccagactatcaggttcagaccttccaatgactcaccacgcgagatcaccgaccaagacactactattgcctctatcaaatcactcctgtcgactatgacaaaacaaatcgaccgactggagaacaagattgaggagttgaacttgaccgcaaaagtcgctatccagaagaaaaatcgtgtctcagcattggcagcggtacgctccaagaagctggctgaacataatcttaagcaaagactggacactgtgacgcagctcgaagaagtctattcaaagatcgaaaatgccgcagaccaggttgaatacgtccgagtgatggaagcgagcacgggtgttcttcgcggactgcatactcagattggtggcgtcgagagggttgaggacgttgttgaggagctgcgtgaagagatgtccagggtggacgaaatcggcaacatcatgaatgaggttgcaccggagatcgacgagacagagctggatgatgagcttgaagaactggagagtagggagcgacaagcggtggaagaaaaggaggcagaaaagact

SEQ ID NO: 12159 - DNA, 423 bp, A.fumigatus
aacatactagtaatacctaagctactagaagagtatataaatcaggcacttgaacgcgctgagcctagcatatctagatacattagtaagacctgggtatattgctttgagaaacaacttccagaataccttagtctaggctcagtgaggcaaaagatgaaggaatcaaagtatatccaggctgaagatgcaggcttattaggaagctggtataatcagcttacaaatataattaaagatactccagcgtggttagtatataactttgataaatgtagattccaacctggtgaaggcaaatctaggaaggtaattagtttaaaagggaaagggaaagtccctaatcttactgaatctaaaagaggagagaatattacagctattgaatgtgtatctgtagatggatggcatatggatccttag

SEQ ID NO: 12160 - DNA, 474 bp, A.fumigatus
agagatagcttaagcaacatgagtgacctcctgaactacatcctcacacaagaagactccttcaaaaagtctgttaccacctgcatctccaaacagaaatttgccccaaagcgtaaagctgactatcttggtccagaaaccgcttgcccctcgctttactccgacttcaccttacagaagaagacgaaccccgacggatatgcggtgaacgtcgctgcgtgggagcgagccctgactagggccgcaaggcggggctatgtatcgacttctccttctcgcgaaccgagctcgacgaccggtacagcggtccaaagcgaccatctgatactgaggacggacgattctctgttacgagatctagaaatacctgagtatggtcggccggtggcgcttggtgcgatgctcgtatgtctcagcttccaatctcctgaagatttgcacttgctaagtatgctggttccgtgcacaggatga

SEQ ID NO: 12161 - DNA, 276 bp, A.fumigatus
agtcttttctgcctccttttcttccaccgcttgtcgctccctactctccagttcttcaagctcatcatccagctctgtctcgtcgatctccggtgcaacctcattcatgatgttgccgatttcgtccaccctggacatctcttcacgcagctcctcaacaacgtcctcaaccctctcgacgccaccaatctgagtatgcagtccgcgaagaacacccgtgctcgcttccatcactcggacgtattcaacctggtctgcggcattttcgatctttga

SEQ ID NO: 12162 - DNA, 510 bp, A.fumigatus
gagctgtactcaggtctcagtggcagctcctgccacggtgatgcactcgcagtgacatcgtacttccaaggttcagccttaagcaccgtcgacatgaagagctcgatatctgcgaggctatgtcccagaggccctgcggatggtttgagtcctggaatcccttccatggctagaccggctacctggccgccccagggaatgcggtcggttgtaggcttgaagccatatacaccgcagcagagagaaggaatctggatcgaccctgcgatgtcggttcctacggccagaatcgaaccgcggaaggcgaccagtgctccctctccgccacttgatcctccggctgttaggttagtgtcatgcgggtttaaggtccggccgaagatgttgttttcggaatcacctgtctttgttgtgtcagtcattgaacccggttatgccagggtatggatgagtacgacaactaaccatcatcgtctgcgggatattaagaactgccccgaggtcaaataa

SEQ ID NO: 12163 - DNA, 945 bp, A.fumigatus
ccgggttcaatgactgacacaacaaagacaggtgattccgaaaacaacatcttcggccggaccttaaacccgcatgacactaacctaacagccggaggatcaagtggcggagagggagcactggtcgccttccgcggttcgattctggccgtaggaaccgacatcgcagggtcgatccagattccttctctctgctgcggtgtatatggcttcaagcctacaaccgaccgcattccctggggcggccaggtagccggtctagccatggaagggattccaggactcaaaccatccgcagggcctctgggacatagcctcgcagatatcgagctcttcatgtcgacggtgcttaaggctgaaccttggaagtacgatgtcactgcgagtgcatcaccgtggcaggagctgccactgagacctgagtacagctctcaagtcaagttaaccataggcatcctccctgagagcaaggacttcccactgcatcctcctgtgcggagagctctagagtccgccatcaaatctttatgccagcgcggtcaccacatagtccgactcccagatgacccctcgcgagacctcgcctacgcaagccgcctagcattccaatacttcatctacggcccgcacatcgaccacatcacgtctagcggggagccgctcgtgacatcagtggctaaaatgtcatcgccgatgttcacgggcccgtttcctcttgatatggagctcccgccgtgtgaaaagatcagtgcgctacataccgcgagacaggagtatgcggatgcatggcgcacgtgctgggttgggaacggactggatgttgtccttgcgcctggggcgcagaatactgcggttccacacgatacatttgggtggcctccttacacagttatttggaacttactggatgtaagaagcctgtggacagatgcctggatgctatga

SEQ ID NO: 12164 - DNA, 501 bp, A.fumigatus
ccgccgcaactatgtaaggcagtcgagccatgccattatcgtgatatctaccgaaggaaaatggccatatccccatcccccaagactgactggcagggccttgtcgcagcgaaacgcaaacgcccagatgcccaaattccatcggaatggcgcctcagcgacgacttccgggcgtcagtccccgctgatggccatctaatcgaggctgacattgctcgccgaagcggcattctctctgataaagagctggacatcacggagaacttctccgctgtggaattattaaagaaccttgctgaaagaaagttgagtgcagtagatgtcacgactgccttctgcaaaagggcggcgattgcgcagcagctggtaagtggtttcgacatccctagagaggtgccttccattatagcagtgagataccggcgactgattacggtagacttcatgtttaacggaacatttctttgccaaagccatcgagcgtgcgcagttcttggatga

SEQ ID NO: 12165 - DNA, 315 bp, A.fumigatus
acttcatgtttaacggaacatttctttgccaaagccatcgagcgtgcgcagttcttggatgaatacctgcaaagagagaagaaggtaataggtcctcttcacggcctccccaatagcatcaaagacagtttctgtctcgaggggatccagagcactgtcggatatgtctcgcttcttcagaacgaacccgtgtcgcataattcagccctagtcgagatcttatttgacctcggggcagttcttaatatcccgcagacgatgatggttagttgtcgtactcatccataccctggcataaccgggttcaatgactga

SEQ ID NO: 12166 - DNA, 1548 bp, A.fumigatus
ctctttcatcattgtggggtcgggtgtttttggccgtatgatgactccccgtttgccttgttttgtctgtcaacccagagagtcttccctaaccctcgaatagtctccctggcctatgccctaagcctggacgatcggtttgccgacaagaagatcatcctcgtggatcgatggaacttcgagccacccaacgccacaggctcggtccacaacccggcggccgcaaatgcagataccagtcgcgtcatccggcgtgactatccgcacggtccatacgcgtccctagccctcgaggccatgaagcattggagggggaaattcggcgagaacaaccgatacgtgaaccagagactgcttttctccggggaaggctcgtccctgacgacgccgccgaaagcgctggagacggtgaattatatcaagaaagcgtatgccattagctgtgagttgacgcctgggggccgagacgcggtccaagtgctcgactcgctggacgaagtccgagcgtttctggggaacactcccagtcacccgccccatctgcccctgaacaaggatccggcggcccgagatctgagaggatacatctcgaatgactgcgggtgggccgacgcaggggctagtattgagtggttgcgccaggaggttctccgcctgggccgcgtggagtgtgtggtgggggaggtcgagagcctggtttacagcgacgaccaacgagcagtgaagggagtgaaactcgtcgatgggaaagttttgaccgccgagctgacggtcatcgctgcgggtgcacggtcatcgcacattctcggcatccccaagctctgcgacgtctacagcgagttcgtggcctacatccagctcaccaaagaggaggccgacgagctccgccgcagacaatggcccatcctcgtgaactgccatcgcggcgtgttcgccgtcggcccggatcacgacaattgtctgaagtttgggcacttttcttacagcgggattgtcgacgtgctgcgcgaagcgagcatccaggtcccgacgcgacccgacggatgggaggctcagcagaaatactggagcgatcccagatttgcgtttggtggagaagtcaaggtttccgcgctgggcgacgtagacgactacgagaatcccgccgcgcagcgggcgttggcagattatcgcctgttcctactggaactgcttggccctacggggctccagggagttgacacgctgggcttggaccagtccgacaacctgctgaacaacattgcgaatcggcccttcacccgggttcgcaagtgctggtacaatgacaccccggcgctcgactttgtcgtcgactaccatccttcgtatggcaagaccttgttcgttgcgactggcggttgcgatcatgcctttaaattccttcccatcatcggagaaaagactctcgctctcattctgcgcaaccgcggagacagcgcggtatcactgccagcaggggtggagccctcgctggaggagctctcggaactctggaggttccccgtggaactactacaggacaactag

SEQ ID NO: 12167 - DNA, 363 bp, A.fumigatus
aggaacatgaagaagaccgctctgatcctacataccctgcagtctcagaggaagtacattcactacatcgcctgcgatgtggaccgcgtagccctccaaagaggcctccgcaatctccaagcgatcttccccgcgtcgacgtcgagcatcaaaatccagggtctcgtcgccacgtatgaagactgcgctgcctggctgcagcgcaatccaggaagtggacacacatcgctaatgtggctggggaacagcttggccaacttccccccgccagaggcctcggaatatatccggagctttctcagcaccggtgcctccctgattcgtcttcagccaccggggctggaaggatccgcgctagcgtaa

SEQ ID NO: 12168 - DNA, 1428 bp, A.fumigatus
agaaagtccttcttaagactcgtaacgatgtcacccgatgaaaaatggtggaagaatgccatcatctaccagatctatccggccagtttcaaagactcgaacggtgacgggattggtgatattcccggtatcatctctcaactcgactatatcgctagcttaggggtagacgtcgtgtggctctgtcccatgtacgacagtccgcaacacgatatgggctacgatgtctccgactacgagaaggtgtatcctccttatggaacggttgaggacatggagaccttgatcgatgcttgtcaccgccgtggactacgcatcatcctcgacttggtggtcaaccatacgtcgcacgagcacaagtggttcaaagaatctcggtcctcgaagaacagccccaagcgagactggtatatctggagaccggccaagtacgacgccaatggagatcggaaaccacccaacaattggcgcagtgtgttcggaggcagtgcttgggaatgggacgagaaaacacaggagtactatctgcatttattccttgcccaacagcctgatctcaactgggagaatcctgaagtacgacaggctgtctacgcctcagccatggaattctggctccaaaaaggcgtcgatgggttcagagtcgatacggtgaacatgtacagcaaggatccgtcatatcccgatgctcccatcgtcaatcccaagtcagatacccaggtagccttctccttattctgcaacggcccgcgcattcacgagtatctgagggagatgaacaaagtgctggccaagtatgacgccatgactgtcggcgagctgccagagacacataccctcgagggagtgctgcgctatgtatcggccgccgagaagcagctcaacatggtcttctcgtttgacgtcgtagacctcggtttgggcaaagagtacaagttcctaaccacaccgcgcgggtggaccttgccggacctcaaggcagcgatcaagcggacgcaggacatcctcaagggcaccgatggctggaccacagttttcatcgagaatcacgaccagggccgctctgtctctcgctttggctcagacagaacgcccgagctccgcgacacatctgcaatgatgcttgccatgttccagtgcactctgtccggcacgcagttcatctatcaaggccaggaaatcggcacggtcaacgctccggaagaatggcccatcgaggagtacaaggacatcgatagtaccaagtactatcacatggtgcgcgagatgacgaataatgaccctgtccacatgaagacggccatgaaggctctgcaacacctggcacgagaccacgctcgactcccgatgcagtggagcccagcagccaatgcggggttttctcatccgtccgcgtcttcaccacggggctggcaggatccgcgataa

SEQ ID NO: 12169 - DNA, 528 bp, A.fumigatus
aagcccgccaatctctgcggtgaggtgccattcccttgctttctgtcgacaggcctggccttgcctggcaattccaacacaaatttttgttattgtctcgtcataatcatggagattgagaagtcgaccggaatcgaacatgtggaggaggaagctgcctcacgcaggccccatccccagcctgcgagccaccaggacctcattgccagcagtgaggcccaggcggcgctcgagaaggagcacagcatgacactgtggcaggcactgaagatctaccccaaggccgtggggtggtcaattctcctgtcgtgtgccatcatcatggagggctatgatgtcgtcctgatcggctctttcttcgcttacccccaattcaaccagaagtacggccatatcatgtcggacggaaactacggtctcgctgccaagtggcaagcggccttgaccaactcgatgagctgcggccagattatcggcctgttcatcaacggcgtagtctcggaatgtttcgggtgcccgcggaccctc

SEQ ID NO: 12170 - DNA, 1032 bp, A.fumigatus
catacagccatagctccgacaatggatgctttaggagccttcacatacatgtgcgacaacctgccggcttggatcgatcaagtttcagaactggctgcctataccgctgcgaaacatgccgagtacaccgaggcttacaagaaatacgccccggtgaggtctcggcgacgcaagaacagctccgtctgctccatacacaccgatgacaacttccctttgtcccagaaacgtggtacctcggtcgaaccaacccagggaacacccagcactgcagcggaagcctcgataacccagattagatttgttgggaatcctcgaaaacgcaatgcggacggcactccgtccattaactcggccgaggagactgcggactttgtcagcattcgacacaacgtggtcatccactatgacgcccacacgcaaaagtcgctggaggcgatggtacggaatatcgggaccgcacggaacaatatgcgacgaggcaagatgtcacagatctccctgggtgggctccgaccgcgcatgggcaagccagacgcgaggaggaatcttctgggccaggctgacagttctgatgccgacatactgatcaatattcgcagcatgcgaaccagaggtcctcctcccgcggaggcttcctctagccgcattcctccgaaggaatcggtttttgatgtggtggatagacagctcgagctggcacacagccattgcgagacagcggcttaccagttcctgcgctatggagattgctcggcggagttgaaaagcgttgtggagacttttcggtcattactcgaattagcaaccgaagaagcgcgaaatctgaaggcagagcaacctgaggagtctttacaagaagacatgaagaaggaaagtgtcacggtttcacctacgaagacggctgccgaacctgagggcggtaaaccacaggcttcatgcacccacgaaatcgaagttgacgacgcttcggccgtttcagtggaatctatcgatatcaaggccttccgcgccagtcggctcagagtctag

SEQ ID NO: 12171 - DNA, 804 bp, A.fumigatus
cgcggatccttcgagccctgtggtgaagacattgcgggattcgagcaccccaaccgtgataaagaggctcaggacttctggctcctgagccatacacatttcagtcggttttttgctattgtcaatggctccgtgcctttatcagagcaagttcagaggtcaatagagaaacatttgctcaagttgtcgaaacttcatgtcgagatggcaaaggaacggcctgctgcattcgccttgctgccggacagcattccccttgttcaatcttactggacccttgttgtcaaactcggagaaaattacagccagctgggagaggatggtgactcggacaacaagacacttatggaaaaggtgggcctcagagcccttctcttgatcagggcctgttccaagatggcattcaatcccgctcagacgttcaagtatcagactccacaagacaaagaggagaaacaacggtcaattgaacaaataaagtctgatattttcacccatgaattcgttgttagtgtgatggagcttttggttactcagtttttccgcttccggaaagctgacttccaagaatgggaggctgagccggaggagtgggaaagaaaggaggaggatattgctgaagcctgggaattctccatccgatcgtgctctgagaagctattcctcgacctggtcatccacttcaaagacttactgattccccggctgttaaacgtcttcttctcatttgcaagtaagttcaagttaccaaggacatctaccaacactattgaccatttcccctccaggtcccgagaagcgtga

SEQ ID NO: 12172 - DNA, 738 bp, A.fumigatus
acgtcttcttctcatttgcaagtaagttcaagttaccaaggacatctaccaacactattgaccatttcccctccaggtcccgagaagcgtgacgtactgctcaaagactcgttatattccgccatcgggctggcttccgcaagcttagagcagcagttggacttcaacagctttctggagacggcccttgtccaagaagttcaaatccaggagcacggttacaatgtacttaggagaaggattgccatcgtccttggacaatgggtaccagtgaagccagatgaactcaacaggaatgctatctaccagatcttccagcatcttttagggaaacaggatcccttgaatgacctggttgtccgcatcacggctggtagacagcttaagaacgtcttggatccatttgaattctctcctgccgtgttcatgccctatgctcagtccattcttcaggatttgatgtctctcatccaggaggtcgagcttcctgaaactaagatgggacttttagaaagcgtccgtgtcttggtagtaaaaatggagcatcatgtatgcacccccttgccgacccagctcaacaagtctgctaaccctcgtttagattgcgccattctcggaccagatattagctttactgcctcctttgtgggagcaatccggcgaggagcatctcatgaaacaggccattctaactttaatctcgtcactcatacattctttgaagcaggactcgattaa

SEQ ID NO: 12173 - DNA, 204 bp, A.fumigatus
cgccataacaagccaattccgggcgccaccggccactattcctttggtgggcgcgacagccagaagggagcttgttggagctggaagagcatcttcaggccagggggttggaaggaaccggacattgctatcgccggaaacgcctttgaaaccgacctcctatttcttctatcagaaatcgacgacgacaagaagcatccataa

SEQ ID NO: 12174 - DNA, 306 bp, A.fumigatus
ttcatttaccagttcagcaacgaccacctgatcttgaagaccactttatcctcacacagtcttgcgtcgctcgtcccctatattgcctacccttacttatcccgctccgcgcccgtcagtatggcaggcttcgacttctccaattacaatcgcaacgcggctctgcacgccaaaggtgtgcctctcccgaaagcgacaagtacgggtacaacaattgtgggttgtatcttcgataatggtgttgtggtaggtgatgatggagcccaccgaataatcgcttgtgatgatggactgtccgcaagctga

SEQ ID NO: 12175 - DNA, 225 bp, A.fumigatus
gagggtaagatagagtcagcttgcggacagtccatcatcacaagcgattattcggtgggctccatcatcacctaccacaacaccattatcgaagatacaacccacaattgttgtacccgtacttgtcgctttcgggagaggcacacctttggcgtgcagagccgcgttgcgattgtaattggagaagtcgaagcctgccatactgacgggcgcggagcgggataa

SEQ ID NO: 12176 - DNA, 723 bp, A.fumigatus
gaggtcggtttcaaaggcgtttccggcgatagcaatgtccggttccttccaaccccctggcctgaagatgctcttccagctccaacaagctcccttctggctgtcgcgcccaccaaaggaatagtggccggtggcgcccggaattggcttgttatggcgtcatcggacgcagtgcgaaaggccatcggcgcaacgaccggggaaagcaaagtcaagactaaacccttcgaaccgcaagcgaccataccctttcctgcgcgacctacacatgtggctttcgcctcgggcgacaatgctttagtcttggccaccgagaatggcgcggaacttgtggtctatcagactgcgactctgctgacgggaaacccgcagcctgccttgggcatcccgatgaacggcacgacccttcgcgccatggcacccaatccttcaccgtcagaagatatcctttcatctcttgtcgcactagtcacggcaaatggcgagcttttgattgctgatttgaaaggagcgaatctaatccgggggcctagcgggcaggtactcaggaccggagtaagctccgtatgctggagtaacaaagggaaacagcttgtggctggtcttgcagatgggacagcagttcagctaactcctgacggtacccaaaaggacgtaataccccgcccttctgacctggaaggcgattgtcatggtacgttgggccattattactcattgtaa

SEQ ID NO: 12177 - DNA, 666 bp, A.fumigatus
tctcgaatagtgtcgtccattgcctggcttgaaaatgacatattcttgatggtatatacgccaaatgcaactgaagatgatatgggccagacgcctgcatcttcgtactatatcatcaccagacggaaaggcgcacctttcctggtccagaagatgccggaactgtgcatgccatttggtgtcaaccgcagcccagcctaccagtttattgcgcgtctgagagactacaagccgcacttgaaagacattctaattgtatcttcaacagcatctacagatataggtcttatcacgcggtccgatcaaccactagctagcgatgactctgccaaaggcaccgtgggtctctttacaacaacagaggtcaatgatgacacaaagagagcctcgctccctttgaatgaggcctctagtgatacttcagtaattggattgggcgttgacctctctagcaccgaacccgtggtttccccgatccaaggcgaagacattgcggaaagctccacgcctctgcccaatctcttcctcttgaacaacgaaggcatactgtgctcttggtggatcatatattcggactctattcgccagaaactgccctaccatggtatggtctcggtaagcccgcaaccaccgacagtcttcacccggggctggaaggaacgcagt

SEQ ID NO: 12178 - DNA, 411 bp, A.fumigatus
tccggccggaacgattcgcactcctccttatcgccctgcccaaatcgacaccaacatcccctcgccccgatattgcgcgcatacttcagatccgtaatcgtgtccccaaccatcagcaccctgctcgggtctaccgcaaacccctccccgtatacccctttcaaccgcggtaccagcacgtccgtgaaactcgttgcgtcaggcttccttttcgcccccggcgtcccatccccgatgatcagcgcctccggaacgaactccgctagctccattctctccaacgccgtcttaatcggtggaaccgccttattactcacgattgcaatggggattcgccgtgagtggagcccctccagtagctcacggagaccggggaacgggttcgtgaatttctcctcgtgcgccgcgtag

SEQ ID NO: 12179 - DNA, 666 bp, A.fumigatus
agatccccgcacaatgtggacgagcttctgtcaacctgcatgttcatgggcattacctccctctgccccgatcggttccagcctactgactcgtgggttctaacgaacgcacccggggcaatgaactggctctgcttgcagagcggcatccgcaccatcatcaagctcgctgggccgtacatacagtctagcatctgggcatcggcattccagcagactcaccaggaagaagttcagttgtacgaggagggcgtcccccagggccgcgaggggcttgacccagacctggccgatttatgtgggattgatgattcgaccaccgccgcatcgatgaatccgtactatgagcctctcagattactggcggccatatccggcttggaaaagaacatgaagaatgctgctcaatgcgcgtctttcatgggcaggctggacaatgattttcttgcactcctgagggagagagacccgcccgcgctgttgatcctggcgcagtggatgggtctcttgtgtacgctgtccgaatggcagccctgggtcgaggggcggatccgcggcgaatgcactgctatctgcatgtatctagagcatagcaccgacccccgggttcggcggctgcttctgttcccggcgagcgcgtgcggatatcacttgacatacgcttaa

SEQ ID NO: 12180 - DNA, 726 bp, A.fumigatus
ctaacaagatccataaaactacgcagcacaatggccgacctcgtgatcctcgacttcgacggcacaatcttcgacacccgcgaagcaatccaacacgccgcaagactcacgttcaccaccctcctccccacccacgagatcccctatgccaaagcccgacggctgatggccaccggcgcggggctgtcagagaccttccgcgctctccaccccgatccatcaaccttcaacgaggaaaaatgggtcgcgacctaccgatccctctacgcggcgcacgaggagaaattcacgaacccgttccccggtctccgtgagctactggaggggctccactcacggcgaatccccattgcaatcgtgagtaataaggcggttccaccgattaagacggcgttggagagaatggagctagcggagttcgttccggaggcgctgatcatcggggatgggacgccgggggcgaaaaggaagcctgacgcaacgagtttcacggacgtgctggtaccgcggttgaaaggggtatacggggaggggtttgcggtagacccgagcagggtgctgatggttggggacacgattacggatctgaagtatgcgcgcaatatcggggcgaggggatgttggtgtcgatttgggcagggcgataaggaggagtgcgaatcgttccggccggattatgcggtggattcgttggcggaggttctggagattgcggtcaaggagtag

SEQ ID NO: 12181 - DNA, 237 bp, A.fumigatus
  unsure (99): Identity of nucleotide sequences at the above locations are unknown.
atcgggcgcgacgtctcgggcgtggtgaacgcagcgtgggacgtcggcggcgcccagggtgcctcaggacgataccgacaccgtgaggcgttcgcccgntgcctgcagatggcgctgatgatgggcatggacgacgacgaatgggaggatgtcacccgcggcggcgaaacggcagacgtgctcgataagatcagccgggaggagcgcgcgcgcatccgtgcaatggtgcggcggtga

SEQ ID NO: 12182 - DNA, 693 bp, A.fumigatus
agaagagtggttagcaaggcaaactggacctataaactctgtcaacttacccttggtggcatagttgcaaacaacgccagtcacgataccaaggataacactggcccaaggggtcaaaaacccagaggcgggagtcgcagcaaccaggccggaaatagtgccggaacaccagccgaccatcgaccactttctagccagacgccaatcgagaagaacccaggtaatagctccaaaggcagcagtcaagtttgtgttccagcaagccacggtagcccgaatgttggccccgaaggacgaaccaccgttgaatccaagccaaccaaaccagaggaagaccgttccgaggagaatgagcgagacgttgtgaggacggaagttcaacatcatacgttcctgacgacgaccgaggaccatcgaataggcgagggctgccataccggatccgatttcgacaggaccaccaccggcgtaatccaaaacaccatatttgaatgcccaaccattcacattccatacccagcaaaccataggacaatagacaatagtagcccagatgaaggtgaaaaccatagccggaagcagacgtccacgttctgcaacagcgcccattataatagccgcagtgacgccacagaattgcatctatgccatccaggctgggttagcctacaatgtccgctaaatcctaactaa

SEQ ID NO: 12183 - DNA, 195 bp, A.fumigatus
atcccgccatccgatcgtgtcatcgtcctcgcagccttttccgctctctgcctctcccccggcatcggaaaccctaactatatcccatctctgtgcccaccttacaacgcggcggtgacacatcccggggagagagtctggttttcgcgtgtactgagattctctgcattcttcatcaactcaacaggcacgtaa

SEQ ID NO: 12184 - DNA, 666 bp, A.fumigatus
ccactcttctttatagttaaatactggattcgcatcgatgactctatggatgtgtttgccgaacacggtgtcgcgggaatcattggccttattttcaacgcccttttcgcagacgatgcgatcgtcggtctggacggtgtgaatacgggaacaggagtcggtggatgggtcatccataactataagcagctctacgttcaaattgctttcatcgtggcttcctgcgcttattccttcgtcgtctccgccatcattgcctatgccatcaacgctattccgggtttgaaactgcgtgcctcagaagaggccgagttgctcggcatggatgacgaccagctcggcgagttcgcatacgactatgtcgaagttcgccgcgattacctggcctggacgcctcagaagcacgaccagctcgaagacggccatgagatcccccacgctgcccgttatggcattggagagcacagcgagatgctcgaaggccagacccctgtgggaatcgacagccgaggatgcagtgaaggcgactctggcatccaggagatcaagattgcaccggctccccggccggtcgctgagcacaatcctccggcgcaagttcaagagacgcaggtgccacctgcagctcctcaaatcgacgagaagcgcgacggctcatcacaataa

SEQ ID NO: 12185 - DNA, 408 bp, A.fumigatus
ttccagtatgttttactactagtttctgctcgctttgtatgggaccatgattctaacggcatcatttcaggaacggaaaatgtgaacaaatggtttcaatcgggtgaccaggcgtacatcatcgtggcctccgccatggtcatggtcatgattcctggtcttggattcctgtactctggtctcgctcgtcgtaagtcggctctgagtatgatctgggcctgtatggcatcattctcggtcgtcaccttccagtggtacttttggggctattccctcgccttctcccctactgccaccaatggctacattggcaaccttcgcaactttggtctcatgaaaactctggccgacccgagtcctggatcacctctcattcctaatctcctctatgctttctaccaggtatga

SEQ ID NO: 12186 - DNA, 648 bp, A.fumigatus
atgcaattctgtggcgtcactgcggctattataatgggcgctgttgcagaacgtggacgtctgcttccggctatggttttcaccttcatctgggctactattgtctattgtcctatggtttgctgggtatggaatgtgaatggttgggcattcaaatatggtgttttggattacgccggtggtggtcctgtcgaaatcggatccggtatggcagccctcgcctattcgatggtcctcggtcgtcgtcaggaacgtatgatgttgaacttccgtcctcacaacgtctcgctcattctcctcggaacggtcttcctctggtttggttggcttggattcaacggtggttcgtccttcggggccaacattcgggctaccgtggcttgctggaacacaaacttgactgctgcctttggagctattacctgggttcttctcgattggcgtctggctagaaagtggtcgatggtcggctggtgttccggcactatttccggcctggttgctgcgactcccgcctctgggtttttgaccccttgggccagtgttatccttggtatcgtgactggcgttgtttgcaactatgccaccaagggtaagttgacagagtttataggtccagtttgccttgctaaccactcttctttatag

SEQ ID NO: 12187 - DNA, 192 bp, A.fumigatus
atcttagacgcgagactagggggtgagtacgtctgtctgattgggcaaaggtgttgctgcgctacaataaatgttctatctcccggttatgctatttacagttcgcggcgaagtctatacactatgtccaagaggcaaggtgagatcaccgccgcaccattgcacggatgcgcgcgcgctcctcccggctga

SEQ ID NO: 12188 - DNA, 501 bp, A.fumigatus
ctgacagtttcaacaacaggcaaataccgaaataagtttaccgatgcggtggagttcagagtccgcagcaccgccaacaccaatgtggtcttcttcaatgggcagctgctggctctaaaggaggattctcccccttatgcgatggaccccatcacgttggagactaaagggctctatgactttgagggccagctgcccgctctcaccttcaccgcgcatccaaagtttgatccggtcacgggtgagatggtctgtttcggatatgaagcgcggggagatgggacacccgacgtgtgctactacagagtctcacccaccggccaattcaaggaggtggtctggctggttgcgccagtggtagcgatgatccatgactttgctgtgacggataactgggtaagtgaacctgtttggcaagaaagcagtggggatgtcaggctgatgccagaacccaggttgtttttccaatcataccccaagtgtgtgacattgaacgcatga

SEQ ID NO: 12189 - DNA, 675 bp, A.fumigatus
tggttccaatacaagaattcctttccaggccatactgccaacgcctacgaggacaaggaaggacatctggtgattgacctgggtctaagtgagaaaaacgtgttcttctggtggcccgatgcccaaggaaatgcacctgagcccaactcgattctttcccagctggttcggttcacgctcaatccccacgccgaggatctcgcccttcccgaacccaaaatcctgcaccagggcaactcggagttctatcggatcgatgaccggttcgccacccattcctatcgccactgctacttcgatctgatggacccgcagctgggtaccgattttgagcggattcgaccgaatctcggcggtggttaccccttgtacaactccttggcccatttcgacaacgccacagggcaaacggaggtctacttccccggaaacactcacctggtccaagagccagtctttatcccgcggaaggattcaaccacggagggagacgggtgggtgctggcactggtcaacaactatgcgaccatggccagcgagctccatctgctggacacacgagacttcactcacgcgcaggccaagatcctgcttccgatccgtttgcgccacggcctacatggaagctgggtggacgggagagacatcgggtcacagacagagcaattgcaatag

SEQ ID NO: 12190 - DNA, 1245 bp, A.fumigatus
  unsure (40),(43): Identity of nucleotide sequences at the above locations are unknown.
cttccctcgacatgcgcggctcgtcctggccacgtgtgtnaanaactgcctcccaggcgttctcccctcttgaacgtgagacacggaaaagaatatggtttggctgtgtggttctggatcggtacggggctccctcagtgcttgcgttgggtgtggatcttgactcaacagctccctacaaccttaagcatgacctttggacgaccgcctgcgatccctgacagttatgttcagctggacctccccgtcgtcgatagtgtcggtgagggcgaaccgtttgtcgacgacaagaccatccgtcatagcatccaattttttaatagcaccatgtcagttgccgcgcccctcccggccccgcaacaaactcttccccagtttgactgcaaggattggactgatgctgaccagaaccctctacaaacaaatgggcagcatcatcgaccaagtctacggccaattctgggctgtggctctggcccgtctgttggtgagactgtgggccgggtgctgttgattgaaaatcagttgttctcatgggtcatggcgcttccggagaaccttcgcctgttaacactgcaggggctgcatgaggaaatcagcaagtcggagaaccagccaggaccttttttctccctgaagtttcgggtcatcctcaccctgcgctaccttcacacccagatcctggtgcatcggcccatcctggtcaagtttctcgacgcgagcctcccgtctggcctggagcatggccaagagcggattatgaatgagatcggccatagtagcatgaacaagtgcgtcgaatcggccatgggaattatcgacataatccacgaatggttctttgcaacagggcggcagcgcgatctcgtaggggcgtggtggtactctctgtattatagtaagttacccctttcctctttagcttccattccagtttgtcggtggctcatactttcgtgttttggggggacagccttcaacgcggcactggttattattggggccacctgggttcagcgcgcaaggcagtcggcccatgattccccggtgcaccagtccaccaatatccaaccctatcctagtcgcgctgtcgcaactctgtatcgactggatacgggtaatcgcatggtggaccgctgcagatattatcttgagcagttgatctccgtcctccatttacagcgtaagggatccaatgcactcccggtggactcgatgacgctaatcggattgcacagcagatga

SEQ ID NO: 12191 - DNA, 228 bp, A.fumigatus
tcacaattcttgctgtttcaaaaacagaaggccacagtcttcacatttggcaagataaaacctatcaatatgaatagttctattcccttcaacttaaaggcaataaggacggctgactctattgcaattgctctgtctgtgacccgatgtctctcccgtccacccagcttccatgtaggccgtggcgcaaacggatcggaagcaggatcttggcctgcgcgtgagtga

SEQ ID NO: 12192 - DNA, 1284 bp, A.fumigatus
  unsure (1113): Identity of nucleotide sequences at the above locations are unknown.
cgactacaggctgcgcgaaaacgcagcataggttcatcagggtcagacccaacaatacagtcacagatggcacatggttccgaggactgtgcttccgtgttggagcagttcgttcatgatgtggcgaatcttccagcagaaatcaaccacctgatggaagagatccaggccaaggacaagatcatccaggattgtcgcgcaaccatcaactctcgtgacagcagcttacagaagttcatcaaactcaatggcagtctgacgccaaaccccaaagaagagcagtactcgaaggtgattctacagaatctggacagggcgcaacagttacaggacgagaagatacagctgagcgagaaagcatgcatcctgctcgatcgccaaatcaagaaactggacatcaagatacgcgacctacaaaacgatggcgtgctttcaaatgatccgcccctgccctcccttttcaacaacaaagaccagtaccgcgatccgcccaagattttcttccccgatgcaaccgccgcggatactacttcttcccctcttcaacccacgtcaggcaacaccaactcgttactgggcatctcacaacggctcaaccagtcgcttgcgcggtctacaagttcagcggcattggcgacgcaaggcgccgcgcgcagctcagctccagcaaccccgtctggcacaacccacttccaacaccggcaacgcgaatcatcggcaggagcggtagagaacaagcggcgacggctcaacgcatcattaggcactctacccgctgcgtcgtctaatctccgccagtcatcccttggccctggcacacccaagggtggcacaccggcttccagtcgcgcaggcagcgccgggccgcgcgcaacaggcgcaactaagaaggcggctaccaagaaggtcgcgcctcatcaacaactcaagaagatcaaagcccatggtaaagcgacaaaacgctcgtccagtgcgagcggtcgtgtcaagctcaccggtgcgaccaagaagtccccatctgcggcgggcggcgatgaagatgaggacgattcgctcctcagcagtgccgaggcttcggattccaatgccagcgatactagacgcatggatgangacattgacgaggaaaatgaggaagaggagggtaaacgagataccaaggtctactgtacctgccggtatgtcagtcatggagacatgggggcgtgtgataacgaacactgtccctacaagtgtttccttggaagggggtggtctgacaggggagccggggggaactggtaa

SEQ ID NO: 12193 - DNA, 537 bp, A.fumigatus
cgcggggtgcttataaatggctcctggaacaaatggacagtatgtgaatttgttctactcaacctgcgggatcttggtattgactcgtcgctctggatagggctcgctaacgtccgcgtgaccgacgaggagattgctttcttgaagaagcaatgcccatacttcaaccatgcctacctccgatacctttctacgttccaactcaagccttcggagcagattgatatcaagttcagacctgtacaagacagcggcagcgatgacgacttgggcgatattgaatatatggtcaaggggctttgggttgagactatcctttacgagatcccactccttgccctcacaagtcaggcgtacttcatgttcaccgacaaggattgggatcatagcaaccaagaagaaaaggccttccgcaagggctgcactttgctcgaaaacggatgcatcttctccgaatttggctcccgacgtcgacgcgattaccatactcaggacttggtcatgcacggcctatgccgggctgctgaaaaaggatag

SEQ ID NO: 12194 - DNA, 1065 bp, A.fumigatus
cagcacctcagctatggtattactgcagaagatatcaaagccgacttgactgctggtaaagggctgccagaatggatattctctgcttatggacccggccgaaacgctccaaggcaactgttcggtggccctcagcgagagcagagctttgaagaactacgattgcggcattacgaagctgcggcagcaggaaacatcgaggtcgctgtccaagaagctcaagctttgtatgcagagtcgataaagcagatggaggctgctttgaatgatgttaatggcgctgtcaagttcatcctcgacggaatcaatgagcatccgaatcggatcgacatcacggaggggaaggcaggccctgcttctggtcaaggcccgtccccgtttggtcaaccggctgccgtggcacagacgtctgcctttggccagccttcggcattaggcggcgcgggtgccccagcctttggcaagccggctggatttgggcaaccatcggccttcggtcaaccctctactctgggacagacacctggctttggacaacctagtgccttgggtcaaagtaccccgtttggaaagccctcagcgcttgggcaacctgcattcggaaaaccggcattcgggcaacccagctttggacagactgcttttggccagccgtcagcgccaggaacagggacaggaccattcggtcagccaagtaccacatctccgtttggtcagatatcgagtcaaaatcaggggcaaggcggcgggtttgctcaggctgctggagcaacgactacttccccgtttgcacaagctgctggtggccaacagcctgcggcacctgctggatttggtcaaacttcgacaacaacacaaacgtcagcaacgccctttggacgacctgtccaggcgccatcgcccttcgggacagcctcaggcaccgacagctccttttggccaacccggtgcagccccgagcccattcggagctgcggctcaacaggcaactccgtcacctttcaatcaacctactggaggttttggtcaagcagctcaagcggctccaacaacctcagcatctaa

SEQ ID NO: 12195 - DNA, 228 bp, A.fumigatus
aaggtccacaagatccgtatcaccctcacctctcgcaaggtcgcctctctcgagaaggtgtgctctgagctgatcgaccgtgcccgctccaagtccctccaggtcaagggccctgtccgtctccctactaagactctccacatctccacccgtaagaccccttgcggtgagggttccaagacctgggacaagtacgagatgcgcatccacaagcgtctcattgagtaa

SEQ ID NO: 12196 - DNA, 477 bp, A.fumigatus
  unsure (328): Identity of nucleotide sequences at the above locations are unknown.
agggatgccagttacgtgcccaagctctttgcggataatgagcaccgcccagagtactatatcccacaactcgagaacttcgatgagaccgtctacacccacgaagactacagtgaaggcactctccttctgctgaatccggttggagcagaaatggtttcagtaggttacagctcttcgtggggctccctcgacatctcttccttgacacgttcgttgaccatggatccatccagattctgtgcctgcattcggagagacccccaagaggaatatctgcgcttatccatcgggatcctgtacaccttcctcgactgggtcttgaatntgcgtcggggtaaagatggaagacgactccccggcattaaacggaagagctcgttggagaccttctggaaagtctttcgactggtatacgaaagggctaccagcagcaagatcgagaagccgatgaaccgtcaaatgcaccgggtatga

SEQ ID NO: 12197 - DNA, 978 bp, A.fumigatus
tatgtcccctacgatctcaacgtcactgaccgtttggccacaggatccgtcagcgatgctctccgcaacctgatcatgcaccatgccgatacccgcaccttcttgaagtactaccttcaccggaggatcgacaaggacctcgcagccatcatccgaggtctcgatccccaggaggatatgatgcgtgcggcctgtcgtatgagccggacaattgatcctaagcggccgcaggagttgacgaccgcgcaatcatcctctgtcaacaaacagcctgaaattcaggatctgatccgacggcgcggtgagctccgccgacagctgggacgtccattggcgcggcaccatggaacagtgaagtacgaggtgtatcagaagcttaaccaggaattagccggcgccaggcaacgggcgcgggatgcgctgcttgcccagcttcaagagaaatatgaccgagagcaaccaatgctggaaatccagcggcagctgtctgggaccaagctggccgagaccgtgaaccagacactggattattgcgaagaactgcccgctccgcagaaacgtctgattgaaactatttttactcttccacgatcgacactggaggacgagatgcgccgacggaccgatgctattgacgccattgccgcttactgtctattcgaggaaggggtcacatgccgtctcgcacgggacaaacgtcccactggccagatggtcgaggcaacaaagccagaaggatacgacgttaaagaccaggagactaatgctgccgaaagctgctcccagtcggatcagctgctggaggcagctattcgatcggtcatgacagaaaaaaggccccgtgtctgtttcatctgtgtgggacagccgaatttggacatcaaaaggcgcgtgaagcaattcaaagagcacggtgacctaaccaagcacatcagacggaagcatgtcaaaccgagcccagaggggagatccctttag

SEQ ID NO: 12198 - DNA, 327 bp, A.fumigatus
gtgatccggaaattggctaagaaacacaaactgtccagtaaaggtcgtgaaaagtcagctatgtatgtcgaggatctggcgaaggttgtggagactgtcatcagcaccacaaaaaagaagtttggacacggtcgacatcgcatcgagctctgtctgtttctacagctggcaggtcttacaacaaatcgtccgcaggccatcttggatctcaagtatcgccatattaaagtctgcctgctccgagatcctaaaggtggtcctcatcggatcgtgatcgagttcacttttgagttcacgaaggagtttctgggcgccaaagacgagtaa

SEQ ID NO: 12199 - DNA, 417 bp, A.fumigatus
ccttggactaggaatacctttattctcccggaaatcatcttcgacccatcactcatccttagtccgcacgttttcctgttaggtcttctcttcgccgatcgcgcctttgcacgtgttgatggagaggaagtgctgatgtctgcggagcaactcctccgcctgcggatccccgatgaatgcaacgagctgcaattgacgcttgaccccgcgttggataacatcccggtcttccgtcagtcagagcgcacgctggagggaatcactatctctcttgataaggctctgccctactccacccttttaccatgggtcaagaaggtaggcgcaattgccggcttccggcaggtctcccgcccgtacagtctgcggtatggagccggcaaggcactggataatagcggttcgttgctcttttga

SEQ ID NO: 12200 - DNA, 2580 bp, A.fumigatus
tctggctctaggttcggcaattacattggagagcctgtggactctgaggaggaaaaccaagatgaagagctcaaaccgcagacatttgcttttgacgaagcatttggagaggaagaagatgaaaaccaaaatgcagatcaattgatggaggttgacggtatttcatatttatccaagcattactacctcacacccgttctgacctcgtatgcagaaggcccttcaaatgccgtcgtcctacatgaagacaaacaatattatcctagtgcaaagcaagtctacggtgacgaggttgagaccctggttcaagaggaggactcgcagccactttcgcaacccattatcgctcccgtccagcagaagaagttttcgatcgaggaggccgatctgccacccgttcatttctcgcgagagtttatgacagacttgctcagttttcctagtcaaataaggaacatcgcgcttgttggccatcttcatcatgggaaaacagcgtttatggacatgcttgtgacggagacgcatgatttgacagagcgtctggagaagcgagtaggcaagcggaaggaggaacagctccgctataccgatattcacttcttagaacgagagcggggtctctctataaagtcggcgcctatgactttggtactccaaaacaccaaaggaaaatctcatcttttcaatattattgatactcccggccatgtgaatttcgtggacgaggtggccacatcgtctcggctcgtcgacggaatagtgcttgtcgtggatgtcgtcgaaggtgtgcaagcgaacacagaacagatcatcaagcacgccgtgctggaaggtctccccataacgatggtcgtgaacaagatggaccggctgattttggagttgaagattccgccaaatgatgcttacttcaagttaaaacacgtggtcgaagaggtaaacactattatcgagaggactctgccagggcaaggggaaaggtatcggctgagccctgaaaagggtaacgttgcctttgcatgtgcctctatggaatggtgttttaccctacaatctttcgcaaaaatgtatgccgagacttatcctcaagtcgaaacgtctgacttcgccttacgtctttggggggatattttcttcaacccagggagccgaaagttcactcgaaaaggagtggaagagaattccaaacggacattcgttcaattcgtcctggagcctatttataaactctactctcacactataagtgaaagtccagatgacctgaaagaaacgcttgcgggtgtcggtatcaacttgaagccgtcgcaactcaagtcagatgcgagggtgctactcaacatggtctgccatgaattctttggtcctgccactggctttgtggacatgatcgtacagcatattccctccccagtagaaggatcccagagaacactcgacaggtactatactggcccccttgatacgaaagttgcagccgccatggcagcctgtgacccggacgggccgcttgttgtccatgtcacaaagctctttaccagcacggatgctaccaagttccatgcgtttggaagagtcatgagcgggacggcgcgccctggtcaaccggtcagagtgttgggcgagggctatacacctgaggatgaagaagacatggccacagcgactatatcggatacatggattgcagaaacctgctatagcatcccaaccagtggtgttcctgcgggaaacttcgttctgttaggtggtgtggacaattccatcgtcaagactgctacgattgtcccactgaggctggaggatgacgaggaagcatacatcttcaaacctattcgacacatgacagagtctgttttcaaggttgctgttgagccagtaaacccatcagaacttcccaaaatgcttgacgggctgcggaagattaataaaagctaccctctcatctcaacgaaagtagaagaatccggtgagcatgtggtgttgggaaccggagagctttacatggattgtgtgctccacgatcttcgaagactttattcggagatggagatcaaggtgtccgaccctgtcacccgtttctgcgaaactgtcgttgagacttcggctatcatgtgctattctatcacgccaaataagaagaataagattaccatgattgcggagcccttggatgatgggattgctgaagacattgaaagcggcagagtcagtatcaaagatccaatccgcaaagtcgcgaggttctttgaagacaaatacgattgggacaagctcgcagctagaagtatctgggctttcggccctgacgagatgggccccaatatcctacaagacgacacgctaccgtcgcaagtggacaagaagctacttggaaatgtcagggattccatcacacaaggtttcagctggggcacacgggaaggcccactttgcgaagaacgtaagtcttctggttgtttttcgattgcccagtccgtttcctttctttccaacgatctcctccatcatttctcctcccctctcgaaccctataacgttttttcctgtcgaggcacttcctatatcttcaaactatga

SEQ ID NO: 12201 - DNA, 288 bp, A.fumigatus
tcaaccatcatcgccatgtccgaagtccagaagcctgttgaggagacccccgtggccgtcccaaccgccgagcctgttgaagctcctgctgccacggaggccgctgcaactgaggctcccgctgctgaggctcccaaggaaactcccgttgagaacggtgaggccactcctgctgcggctgagacgaccgaagcaactgccgagcagcccaaggaggaggccaaggaggaaatcactcctgcgactgaaggtgtgcttggacacaagggtcccggtctggtgaagtaa

SEQ ID NO: 12202 - DNA, 198 bp, A.fumigatus
agtaagcgttacttgcgaaccttgacacggcatagagcaatgctgactagttcttttttttttttggtgattaggggtctgcgtttctccaagcgatttttctacttcagcaacgatcccgtcgaggccaagcagctgtccgtcttccagcagaacgagaagcctgctgtcgccaaccccattgtcgcttgggctacc

SEQ ID NO: 12203 - DNA, 243 bp, A.fumigatus
tccttcagactaattactgaggtcgctttccgactacgtatgtggatagatagcttcgtgatcaactcaaggaaaactcaaggagctcccctacctgtcgtgcagatagataggtcgaaattaaacggctctagactgtctacggagtcactaggccttgcttgggcggacccattccgaactaacccactaattgtccctaaatttttgggccgattccaacttaattttggtcggttttag

SEQ ID NO: 12204 - DNA, 543 bp, A.fumigatus
aggaatcacacccgtctcgatcacgtactgatcccacagtttcagcaactgcctcaatcgctcgggatgagcatccgccaggtcgtgcacctcgcccggatcatcggccagattatacagctgccatcgctcgggacctttgggtttcggaatatatacgatcttccagtcaccgaagcgaagcgccgcacggccgcaggtctcccatccttggatgaagtccttctcgtgaatccgttccgactcgccacgcgcccacggatagaagctcttgccgcgcatggggaccacttcacggccttggtacgtgggagccggatgcttgactcccgccatatcgaggatagtcggtgcgagatccatgaccgtggcaaactggtctgtaattccactccgcgccgcggccacgctgctggggaacctggccaggaaggggacgcggacgccgccttcagttgtgtaggctttgtacagacgggacggggcggtggcggcctgcgcccagcgcggaccgtaacagatgaaaggagttggcttggctaa

SEQ ID NO: 12205 - DNA, 585 bp, A.fumigatus
gccttcgtagcggcaaccttcggcgcggttgtcggacatgaagcagacaaaggtgttgtccagttcgccgatggaggccaggtagtggacgaccttgccgacattggcatcgatgcactccaccatgccggcgtagacatccatggcggtgcaggacttttttttctcttccggtgtgtagtcggtccattctttaacctcgtctgcgacgacggggtgcggttctacgtccggacggatcatccccagctccttgagccgctgcagtcgcttcagacgcaacgcatcgggtccgtcatcgtagacgccgcggtagtggtcgatgtactcgcggggcgcctggagcggccaatgcggggccgtgaagggcaggtacgcgaagaaggggcgctcatcctttctctcgtgccagtcggagagatactgaagcatcttatcgccgtatccatcagacgaataccacccctccggcaactgcttcacgtaatggtcatcttccatgtggagggcgatgtagctcgcttcaaggaaagtaggcgtgtcatcggacccctggagctgcggctcataggcatagtggtttga

SEQ ID NO: 12206 - DNA, 543 bp, A.fumigatus
gcacgcaggcagatgggcaaacgagcgctcgaagcctcgcttgtatggcgatcgctcgggcgtaagccccaggtgccatttcccagacatgacggtgtggtagcccgcatcccgcagcagctcgggcagcgcgacgacgcgctcgttcaagtatccctcgtaaccgggcatgccgcgctgcggtgcggtgctgatctgggagcccttgggtccgttctgcccggagatgttggtccattcgatcaggttcccaagacctgcgatgtggtggtctgtcccggtcatgatcatggcgcgggtgggactatcgcggttagtccaggtcaagagcaagagggtgctgaaatgctagagaaaagacacttacgaacaagcagccgcagcatgaaagtctgtgaaacgtatgcctccattgagagcaagacgatcgatatttggtgtgcggatttctcctccgaagcagcctacatcggagaagcccaagtcatcggcgacgatgacgaggaagttgggacgtttatccatgatagcgcaacaggatga

SEQ ID NO: 12207 - DNA, 342 bp, A.fumigatus
  unsure (159),(174),(178),(179),(181),(189),(192),(199),(202),(203),(204),(205),(207),(208): Identity of nucleotide sequences at the above locations are unknown.
caaacaaatccaacctataatccaaaatccccaatccaccaaccacttacacaaccaatctttattactaactcaaactccaacaccattaatttcaccattcttatcttaattaaccaatccaaatccattccccttcccaacaattccaaaatcaancaacacttcccttcncaanncnctgtcctnacncaaaaanccnnnncnnctctcccctcatctcccccctcctcccttcagatctccctgtctcattcccagcatcatcctgttgcgctatcatggataaacgtcccaacttcctcgtcatcgtcgccgatgacttgggcttctccgatgtag

SEQ ID NO: 12208 - DNA, 990 bp, A.fumigatus
aaccgcaccccgtcgtcgcagacgaggttaaagaatggaccgactacacaccggaagagaaaaaaaagtcctgcaccgccatggatgtctacgccggcatggtggagtgcatcgatgccaatgtcggcaaggtcgtccactacctggcctccatcggcgaactggacaacacctttgtctgcttcatgtccgacaaccgcgccgaaggttgccgctacgaaggcctaccccatgtccagagtgggtcatgccccatctccagaatatacgacaaacagcctggagattttagccaagccaactcctttcatctgttacggtccgcgctgggcgcaggccgccaccgccccgtcccgtctgtacaaagcctacacaactgaaggcggcgtccgcgtccccttcctggccaggttccccagcagcgtggccgcggcgcggagtggaattacagaccagtttgccacggtcatggatctcgcaccgactatcctcgatatggcgggagtcaagcatccggctcccacgtaccaaggccgtgaagtggtccccatgcgcggcaagagcttctatccgtgggcgcgtggcgagtcggaacggattcacgagaaggacttcatccaaggatgggagacctgcggccgtgcggcgcttcgcttcggtgactggaagatcgtatatattccgaaacccaaaggtcccgagcgatggcagctgtataatctggccgatgatccgggcgaggtgcacgacctggcggatgctcatcccgagcgattgaggcagttgctgaaactgtgggatcagtacgtgatcgagacgggtgtgattcctctaaatccggatctgggtgactttctcgaggccactgaggcgcagatgccggagaatgcctggatggagtatgattactggaagaagggcgcccgcgatgagcccgaaaagttcatgcgaaagccacaacggttccagagagtggtcaagcagttttag

SEQ ID NO: 12209 - DNA, 261 bp, A.fumigatus
agaatggaccgactacacaccggaagagaaaaaaaagtcctgcaccgccatggatgtctacgccggcatggtggagtgcatcgatgccaatgtcggcaaggtcgtccactacctggcctccatcggcgaactggacaacacctttgtctgcttcatgtccgacaaccgcgccgaaggttgccgctacgaaggcctaccccatgtccagagtgggtcatgccccatctccagaatatacgacaaacagcctggagattttag

SEQ ID NO: 12210 - DNA, 327 bp, A.fumigatus
  unsure (43),(58),(62),(63),(65),(73),(76),(83),(86),(87),(88),(89),(91),(92): Identity of nucleotide sequences at the above locations are unknown.
ccaatccaaatccattccccttcccaacaattccaaaatcaancaacacttcccttcncaanncnctgtcctnacncaaaaanccnnnncnnctctcccctcatctcccccctcctcccttcagatctccctgtctcattcccagcatcatcctgttgcgctatcatggataaacgtcccaacttcctcgtcatcgtcgccgatgacttgggcttctccgatgtaggctgcttcggaggagaaatccgcacaccaaatatcgatcgtcttgctctcaatggaggcatacgtttcacagactttcatgctgcggctgcttgttcgtaa

SEQ ID NO: 12211 - DNA, 1089 bp, A.fumigatus
catttcagcaccctcttgctcttgacctggactaaccgcgatagtcccacccgcgccatgatcatgaccgggacagaccaccacatcgcaggtcttgggaacctgatcgaatggaccaacatctccgggcagaacggacccaagggctcccagatcagcaccgcaccgcagcgcggcatgcccggttacgagggatacttgaacgagcgcgtcgtcgcgctgcccgagctgctgcgggatgcgggctaccacaccgtcatgtctgggaaatggcacctggggcttacgcccgagcgatcgccatacaagcgaggcttcgagcgctcgtttgcccatctgcctgcgtgctcaaaccactatgcctatgagccgcagctccaggggtccgatgacacgcctactttccttgaagcgagctacatcgccctccacatggaagatgaccattacgtgaagcagttgccggaggggtggtattcgtctgatggatacggcgataagatgcttcagtatctctccgactggcacgagagaaaggatgagcgccccttcttcgcgtacctgcccttcacggccccgcattggccgctccaggcgccccgcgagtacatcgaccactaccgcggcgtctacgatgacggacccgatgcgttgcgtctgaagcgactgcagcggctcaaggagctggggatgatccgtccggacgtagaaccgcaccccgtcgtcgcagacgaggttaaagaatggaccgactacacaccggaagagaaaaaaaagtcctgcaccgccatggatgtctacgccggcatggtggagtgcatcgatgccaatgtcggcaaggtcgtccactacctggcctccatcggcgaactggacaacacctttgtctgcttcatgtccgacaaccgcgccgaaggttgccgctacgaaggcctaccccatgtccagagtgggtcatgccccatctccagaatatacgacaaacagcctggagattttagccaagccaactcctttcatctgttacggtccgcgctgggcgcaggccgccaccgccccgtcccgtctgtacaaagcctacacaactga

SEQ ID NO: 12212 - DNA, 567 bp, A.fumigatus
agaccatctggacctggtggagccggttcgcaaaccacagcgcccaccgttcccgaaggctggaccaccactgtgaccgtctgcactcagtgcgctgccaagccaaccaccgtgacgtggacactgcctgtgactgaaactgggtcgacgtcgaccgacgcggtgcccgcaccccctgccgcgactggtgagggatcgaaccctacccagccatcaggtgcttcccctaccggtggcaacggcagcttttctgaagaaccggttcctcccccagcagtgactcaggtcagcacgagcaccgagattgtgaccctggttcgtcccacttcgagccgccccctgattctcggtaccggcacagtccacccttcgtcgacgctggccgtgaagccatcggccaagccatcgggtcaaaactccggcagtagctctcacgtgcccattcctcccagctacactcaagaagctgtgtcgcccttgtccaccggtgctgcctcgcgcgtgactggactgggccacggcttggtcctcacggttctcaccctgtcggcgttcttcgtgttgtag

SEQ ID NO: 12213 - DNA, 384 bp, A.fumigatus
ttgatgcggacagtggaactccttcttgacgaagtctcctttgaccacgagcgcgaccacctcatcttcgctggcgacatgatcaacaagggtcctgacagcctcggggtcgtcgacctggtccgcaagtacaacgcctcctgtgtccggggaaaccacgaagaccgggtgctgctgctccgccacgacatggatgcatcgaatactctctcgccggactcggacgacggcatcagcccagaccttttcttcgggctgaaaaaggaggatcgcgcgctcgcgcggcagttgtccaacgagcaggtgcagtggcttgacgcttgccccgtcattctgaacgtgggccagatcccggaaatgggacaggtggtcgttgtgcatggg

SEQ ID NO: 12214 - DNA, 1074 bp, A.fumigatus
tcctctttgaatagacatgctctcgctactctcgccgatgtgggcacacccaaggtacattgcatcaggaagagactgggacagattgtcccttgggtcaagtttgactgtaggaacgaactctttggtggatccgctgctgcagatctacttgctccgtggtcctgggatgacagtgataagggacggaagccagactacgtgcttgactgcatcgacaatattacatcaaaagttgaactgctgcactattgtcattccaactctatccccgtgatatcgtcaatgggagcaggatgcaaatccgatcccacacgcattatggtcggcgatatctcactgagtaccgatgaccctctgtcgcgcagcactcgacgacgccttaagctcctgggggtcaactcgggcattcctgtcgtgttttcgacagagaagcccggtcctggaaaggctagtcttttaccacttgctgaagaagaattcgccaaagggcaggttggtgagctcggcgtgctgcccgactttcgagttcgcattctccccgtgttggggaccatgcctgctgttttcggatacacggttgccaatcatgtcatctgtgatatctcaggctatcctaatgattacaatgtcggcggaaaaggccgggaaaagctctatgatagcataatcgcgtctctacagggattgcatgaaagattggctcgggctgaagcagggcaggatcttattgggcttcgtattcctatcagcaaagatgatgttggatacctcgtggaggagatctggaggggtaggagtgctattagcaacctgactaaccggttgatactggtgccctggcaacgaccggctcggggcttcttgcccgacccagagtgggaaaaggagggccaaaagttcattccgattgatttgaagaatctcgtttgcatgaccaaggaggagggagctcgccatgagcgggaggtcctccgaggaggaaaggatgtgacagaggtatatgacccgaaggtcttggaaaaggttaagtggcatatggcagaagtagaagttcaggagaaattccgttaa

SEQ ID NO: 12215 - DNA, 2091 bp, A.fumigatus
gtcgggggggatcccgatcatgttattggcttagaattctggccggtttaccggagaaagccattccaagattaccggcgccgggactacgaaaagggtggctatcggcggatggttcgcctggaagccgaaatatcttctttccaaaaagacggacacgatcttgagagacatggggagcgaatacgcgatatagaagagttccggtctgcagcagagcgaatggagggctctcgagatctcggggctcagctgttcaccgcgctggtccgcgctctaggtatggaagcccgtgtggtcgccaatcttcagccccttggatttggctggaccaaagcggaggcctacacgccgagacccaaagtggatgaagggcccgtggaggaaaatggggggtctgagcctatagttggtctagagtccgacagcactgactcagagagcgatcccccccataagtacaatcccagaaaatacgacaaggaccttccctttcccatctattggactgaggtagcctcacccgtcactcacgagataatccctgtcgatcctttgatactgtcaaaccctgtggcaacaactccagagctgcaggctgcgtttgagcctcgtggggccaaagctgagaaggccaagcaggtcatatgttacgttgttgcgtactcttccgacaagactgctaaggatgttacgacacgctatctccgccgtcgaacctggccaggcaagaccaagggctatcgcataccagtagagaaaattcctgttcctggccggaagagaaagtttttcgagtatgactggtttcgaaccattttgcgggtgtatgagcgctctgaggaaaatcgcacgaaagtcgatgagatcgaagacactacagacctacgccctaaccaacccgagaagaaacaggtcaaggaaggggacacgctgcagagccttcgttcgtcgacggaattcgtcctggagcgatttttgcgccgcgaggaagcccttcgacctggcgcccagcctgtccgcacgtttgtgagcggcaagggcgacaaggccaaagaggagaaggtctaccggcgagcagatgtcctcaaatgcctgtccgctgagagctggcacaaggaagggcgccggatcaagatgggggaagccccgctgaaactggtgccaatccgggccgtcacccttctccggaagcgcgaagtcgacgagatggagcgcgaaacgggcgaaaagcccaaacaaggcctatatgccaagtaccagaccgaatacataataccaccaccaatccgggacggcatcatccccaaaaacgaatacggcaatatcgattgcttcgtacccagcatggtaccccgcggtgccgtccacattccgtggccaggcaccgtacgcatctgcaagaagcttggcatcgactacgcggaagccgtcaccggcttcgagttcgggtccaagatggccgtccccgtcatccagggcgtggttgtagcctccgagaacgaagatcttgtcaaggacgcctggcgcgccgaagacgccgagaaacggaaaaaggagcaactcaaggctgagaaacgcatcctccagacatggcgcaaattcctctttgggctgcgcatcgcggagcgcgttcgcgaggagtacggagccgaagacggagacatggagcgcgaatctcataacccgttcgcaagccgacaggcacgaagtcaagcccgtccacccgctgttccggaggccttgcatgactggcatggggaacctgccgaccgtggcggtggcttccttcttcctggtgatgacgatggcgacgacggcgacctggtcgttgaggatcaccacccacgccaggctcatccgcccgtgcagcaaactgaagctctgagccaggacgagggtgaggagggcaccggctacgatgccgttagcatcagctccgacggacccggcgatctctcgtctccacagcagatatcggattctgaagagaccgagccgtcagtatctgcttccgattatgagccaccctcgaggcgcaggcgcactcggaattcgggtcaaaggacaaggggcaaattatcacaatga

SEQ ID NO: 12216 - DNA, 336 bp, A.fumigatus
acggactttctggacaattcacctaacagtcaacaggacattgcattcgaacatcaacacggctgtgagcttcctccagagctgacgaagaactggcccctggggctcgatcggatcaaggaactgtggacggcaaatacagagggccacctcctcgcattcttgtgctctgtagcagagaagtatgagcccggcaacagcatcactcagtactttttattcggtccgagagcctttcacattttgcagccagagaacgtggaggcgattctttctaccaatttcaaaggttcgcatggctacctgcatcagttctacctttctcacgccatctag

SEQ ID NO: 12217 - DNA, 420 bp, A.fumigatus
  unsure (214),(275),(398): Identity of nucleotide sequences at the above locations are unknown.
ggaagtgaggtcttcgtctttaccccccccggtccactgaataaccgtgaagccattcggacaacgattttacctactggtggtggccctgacgcaaatcgtctcatactagtcaggaaaggggaagctcatgtcttttctcaatatgttaattcacgcaaaaagaatatctatggtcctgacgcatactgctttcgttccggaaatatggtanaccggcaaactggatcatattggggtgggattttttcctttccacggaaggccttcggcantgccttggggagaatttcgcccttgattggaatttcctaccccatttgtgaggcttatgcaaaactttttcatccatcatcctgccaaagggggcaccgaattaaccctttttggagacgaanaaaacccccccctctcggtcct

SEQ ID NO: 12218 - DNA, 246 bp, A.fumigatus
ctacatccaaagtcactcgaatggaaagacggagatagggattcatggggcactcccctacctttcgcgggtgtcagaagcgaaatttgtgcactgctgacttttccccgagcctgctatgccatgtacgataaggcgcctccggctctgtctgatgaacttggtgtctggcagaagaagtgcctgtcgaatctgctccctgatctctttcctcccgatgtagtttacagaagcaagggcgtataa

SEQ ID NO: 12219 - DNA, 222 bp, A.fumigatus
gtgaacagtcggttacttgttcaccatgagcaagcaatgattcgcctgcgagaggagatagcctcggtgatgggggattctgcgcatccaacgaaagagcaaatcaaaaagatgccctatctctcctgcgtcattaaagaaagtaagtattccttcccttcaattccgtctcctgtggctaaggaagtgaggtcttcgtctttaccccccccggtccactga

SEQ ID NO: 12220 - DNA, 789 bp, A.fumigatus
gcccggcaacagcatcactcagtactttttattcggtccgagagcctttcacattttgcagccagagaacgtggaggcgattctttctaccaatttcaaaggttcgcatggctacctgcatcagttctacctttctcacgccatctagactatggctttggtgcacgagcagctatatttgctccacttctgggcaacggcattttcactcaagaaggtcccgcctggagacattctcgagatcttttacgcaaacagttttctcgagtccagaatcgcattcttgaacatttccacgagcatgttgacaacatggtagctcgcctaccattggatggagtcgtcgatcttcaaccactattcttcaacctgaccctcgacatagcgacagcgcttctattcggaagatcagtgtacagcttaaaggccggtactgatcaagacgccgacaataggctctttgccgagagctttaatatcgcccaggacggcctagcaaagcgatttcgtatcgcaccctggcacttcctctacaaccctcctggatttcgaaaagcttgtggcgatgttcaccgatttctcgaacagtacatcgatcagttggacttggaaaatagcgaggacctggatgataaaacatatggctttatcaagcgggtagcacacgagtctgccagccgacagcatcttcgcgatcaactactcaatgtgcttctggcaggaaaggataccacagcctgttgcctttcgtggacattgtatgtggcgctagtcgaggaatttcactga

SEQ ID NO: 12221 - DNA, 264 bp, A.fumigatus
gaacgctcaggggctgtttcccccagacgcctgtattttcgtcggaaagtgagtagtaagatgttctctactgttaaactagagattctaactttcattagtttgaaaattaccctcgaggacaaagacctagtacgggatgttcagcaaacgttctctgctttcggcccatgtcatgtcaagatcaagcgcgacaagcgaaaaattcccacggcctttgtgcagtttgaggtgagcacttcctggctcttgtcatcgtcctaa

SEQ ID NO: 12222 - DNA, 1134 bp, A.fumigatus
  unsure (7),(10),(45),(71),(73),(79),(161): Identity of nucleotide sequences at the above locations are unknown.
catcgcngtngaaagccgcccgcaaagcgttcaaaaggtgtttgnagggacatcatcccgcgggagcgcgncngtctcntcactcgccttgcggacctcctcgagcgcgacttggataccatcgccgccatcgaggcgctcgacaacggcaaggctttcangatcgccaagggcgacgttaccctctctgcaaactgcatccggtactacggtggctgggcggacaagatcgtcggccaaacgatcgataccgacccgggctgtctgacgtacacccgtcatgagccggtgggcgtctgtggccagatcatcccatggaacttcccgctgctcatgtgggcgtggaagatcggaccggccatttccaccggcaacaccgttgtcctcaaaacggcggagcaaacgccgctttccgctttgtacgtggccaaactggtcaaggaggccggcttcccccccggtgtcatcaacatcctctcgggattcgggcgcgtggcgggcgctgcgatcgcggcccacatggatatcgacaaggtggcctttaccggctcgacgctggtgggccgccagatcctccaggtcgcagcgaggagcaacctcaagaaagtcaccctcgagctgggcggcaagtctcccaacatcgtctttcccgacgccgatctggacgacgccatcaagtacgtcaacctgggtatctacttcaaccacggccaatgctgtgccgccggctcgcgtgtcctggtgcacgaatccatctatgacaagttcctggcgctcttcaagcagcgcgcggaggaaaacaaggtcggcgacccgttccacccggagacgttccagggtccccaggtctctcaggtgcaatttgaccggatcatgggatacatcaatgagggtaagaaggccggcgccaaggtggtcactggtggagcgcgccatggtgaaaagggttactacatccagcctaccattttcgccgatgtgcatgaagacatgaagattgtcaaagaggagatcttcgggcctgtctgtacggtgcaaaagtttagcaccgaggaggaggccattgagattgccaataacacgaactacggtgagtctctactctactctgtcctctgggtcattcgatgctga

SEQ ID NO: 12223 - DNA, 726 bp, A.fumigatus
cgtacacccgtcatgagccggtgggcgtctgtggccagatcatcccatggaacttcccgctgctcatgtgggcgtggaagatcggaccggccatttccaccggcaacaccgttgtcctcaaaacggcggagcaaacgccgctttccgctttgtacgtggccaaactggtcaaggaggccggcttcccccccggtgtcatcaacatcctctcgggattcgggcgcgtggcgggcgctgcgatcgcggcccacatggatatcgacaaggtggcctttaccggctcgacgctggtgggccgccagatcctccaggtcgcagcgaggagcaacctcaagaaagtcaccctcgagctgggcggcaagtctcccaacatcgtctttcccgacgccgatctggacgacgccatcaagtacgtcaacctgggtatctacttcaaccacggccaatgctgtgccgccggctcgcgtgtcctggtgcacgaatccatctatgacaagttcctggcgctcttcaagcagcgcgcggaggaaaacaaggtcggcgacccgttccacccggagacgttccagggtccccaggtctctcaggtgcaatttgaccggatcatgggatacatcaatgagggtaagaaggccggcgccaaggtggtcactggtggagcgcgccatggtgaaaagggttactacatccagcctaccattttcgccgatgtgcatgaagacatga

SEQ ID NO: 12224 - DNA, 477 bp, A.fumigatus
gccggtgggcgtctgtggccagatcatcccatggaacttcccgctgctcatgtgggcgtggaagatcggaccggccatttccaccggcaacaccgttgtcctcaaaacggcggagcaaacgccgctttccgctttgtacgtggccaaactggtcaaggaggccggcttcccccccggtgtcatcaacatcctctcgggattcgggcgcgtggcgggcgctgcgatcgcggcccacatggatatcgacaaggtggcctttaccggctcgacgctggtgggccgccagatcctccaggtcgcagcgaggagcaacctcaagaaagtcaccctcgagctgggcggcaagtctcccaacatcgtctttcccgacgccgatctggacgacgccatcaagtacgtcaacctgggtatctacttcaaccacggccaatgctgtgccgccggctcgcgtgtcctggtgcacgaatccatctatga

SEQ ID NO: 12225 - DNA, 267 bp, A.fumigatus
ttcaaccccaggttccccagcttctatctcaccttgcggcatactctccctcatagacgacggccagacacaatggacactgaacagggccttaagaaccacacggcgaagacctctccccacgacgagacagccatggcgtctcttacgacaatccccacatccgtcaccctgtccgcggagcagttcgagaagctgtacctgagccccctgacccagcggcagggcatgctctcgaagcagatgggcaatcctacccctttgtaa

SEQ ID NO: 12226 - DNA, 1068 bp, A.fumigatus
  unsure (938),(1020),(1026),(1028),(1054): Identity of nucleotide sequences at the above locations are unknown.
agactcaccgtagttcgtgttattggcaatctcaatggcctcctcctcggtgctaaacttttgcaccgtacagacaggcccgaagatctcctctttgacaatcttcatgtcttcatgcacatcggcgaaaatggtaggctggatgtagtaacccttttcaccatggcgcgctccaccagtgaccaccttggcgccggccttcttaccctcattgatgtatcccatgatccggtcaaattgcacctgagagacctggggaccctggaacgtctccgggtggaacgggtcgccgaccttgttttcctccgcgcgctgcttgaagagcgccaggaacttgtcatagatggattcgtgcaccaggacacgcgagccggcggcacagcattggccgtggttgaagtagatacccaggttgacgtacttgatggcgtcgtccagatcggcgtcgggaaagacgatgttgggagacttgccgcccagctcgagggtgactttcttgaggttgctcctcgctgcgacctggaggatctggcggcccaccagcgtcgagccggtaaaggccaccttgtcgatatccatgtgggccgcgatcgcagcgcccgccacgcgcccgaatcccgagaggatgttgatgacaccgggggggaagccggcctccttgaccagtttggccacgtacaaagcggaaagcggcgtttgctccgccgttttgaggacaacggtgttgccggtggaaatggccggtccgatcttccacgcccacatgagcagcgggaagttccatgggatgatctggccacagacgcccaccggctcatgacgggtgtacgtcagacagcccgggtcggtatcgatcgtttggccgacgatcttgtccgcccagccaccgtagtaccggatgcagtttgcagagagggtaacgtcgcccttggcgatcntgaaagccttgccgttgtcgagcgcctcgatggcggcgatggtatccaagtcgcgctcgaggaggtccgcaaggcgagtgangagacngncgcgctcccgcgggatgatgtccctncaaacaccttttga

SEQ ID NO: 12227 - DNA, 417 bp, A.fumigatus
atacccaggttgacgtacttgatggcgtcgtccagatcggcgtcgggaaagacgatgttgggagacttgccgcccagctcgagggtgactttcttgaggttgctcctcgctgcgacctggaggatctggcggcccaccagcgtcgagccggtaaaggccaccttgtcgatatccatgtgggccgcgatcgcagcgcccgccacgcgcccgaatcccgagaggatgttgatgacaccgggggggaagccggcctccttgaccagtttggccacgtacaaagcggaaagcggcgtttgctccgccgttttgaggacaacggtgttgccggtggaaatggccggtccgatcttccacgcccacatgagcagcgggaagttccatgggatgatctggccacagacgcccaccggctcatga

SEQ ID NO: 12228 - DNA, 240 bp, A.fumigatus
ctctacgtacatatagcacactggcaggaaattgtctgtggcgttctgactattattttgcccattctcattgatactcataaatcacgcaacctgcgtgaccctaattactcatatagagacttttctaatgctattcatacttgtcaaacctcaatgctattatccccggtctgcttaacatctaggggtcagtcacatcagtgctggtttcatgtttgtgctattgaatgtaagtga

SEQ ID NO: 12229 - DNA, 192 bp, A.fumigatus
tatgggtgtctgattctcaaggtcgtctacgccttgcaaagagtgagcttcacctatccccagaagttttccgttcctaacctttgctattacagatggggcaaacgatgtacgggttctaagtgtcgggtgactgtctgggctgaaactctgaggaatccaaccttggaagacataatgacaaaggaatga

SEQ ID NO: 12230 - DNA, 462 bp, A.fumigatus
caacttcttaatcagtacgaatgctcggctcatatcatcgatgtctgggtggagacagttgcccagggtcgatccaatgttgcgcctcagaaactcccttgggaaatgatgcgtaccctgataacagagacatacggcggcaagatcgacaacgctgaagacttccaggtgttggacaaccttgtgaacagtttcctaactccggctgccttcgaagtggactacaagctcgtttcgggcgttgagaaggacgagtgtctggcactgcctggagagaccagcatccgtgactttgtggaatgggtcaagcgcctccctgagcgagagccacccacgtatctgggtctgccagccaatgccgagaaacttctgttggtcgggcatggcaacaagatgatctcggacttgtccaaaatcactactttactggatgaaggagagcagttgatgattgacggttga

SEQ ID NO: 12231 - DNA, 804 bp, A.fumigatus
acctgtgggatctcgccgctttgtaaagacatcgtaccggctgccgagcgtttcatcgaagcggtctttggccgagaattctttgaaggaagttccgatttgaaggatgttgttgagcaggttgcagcaaccacaccaatctctcttagctcgagtcctggattcgatgctagttacaaggtggatgctctcgtcgaacgtatgcacgcaacctgcgccaatattgcaatgggatccaacgaaggtctggagagtgccgacaaagcaatcagcaatgctgctactgctggaacgtgggtactggttaagaacgtacacctggcaccttcgtggcttcaaagtctggagaagaggctcgaatcgctcaaaccccacaaggatttccgacttttcttgtcaatggagtccagtcctaagattccagtcaatcttatccgcgcttctcgcgttctgatgtacgagcaaccagccggtattcgtgcaaacatgagggactcactgtctacactgatggaacgcgccggcaaaccaccggtcgagaaagcgcgtgtctatctcttgctttgcttcttgcatgctgttgttcaagaaagacttcgttatgcgcctagcctgggttggaagggcttctgggagttcaatgacagtgacgtaagtgaacaccacaagggaattcatcattgcgatcccactaacaacttcttaatcagtacgaatgctcggctcatatcatcgatgtctgggtggagacagttgcccagggtcgatccaatgttgcgcctcagaaactcccttgggaaatga

SEQ ID NO: 12232 - DNA, 654 bp, A.fumigatus
  unsure (631): Identity of nucleotide sequences at the above locations are unknown.
ggacaaccaagcaccagtgctcccgccaaaggaaagtgttcaaagccccatgacccgaaaaagcctttgattcagtatgctcttatgattgatgctggaagccaagggtctcgaattcacgtctatcgattcaacaactgcggcccatcccccgaacttgaagacgaagtctttttccagactgagccgaagaagggcggctccgggctgagttcctacaaagaggatgctgaaggagctgccaaaagccttgatcctctcatggaggttgcgatgaagaatgttcctgatgaatacaagtcttgctcgccaattgctgtaaaggcaacggccggattgcgcatgcttggcccggaattgagccagaagatcttggacgcagtacggaatcgactcgagactgtttacccgttccctgtggtttccaaagagaagggaggagtggagatcatggatggctctgacgagggtgtctatgcctggatcacaacgaattaccttctcggaaaaattggcggtcctgacgaaacacctactgccgcagtctttgaccttggtggaggttctacccagattgtcttccagcctacatttccgaacagcaagtcaggcggtatgtcttcacacacgngggctggaaggatccgcacttag

SEQ ID NO: 12233 - DNA, 1038 bp, A.fumigatus
aataagatcgatgtcagaaatatggcggaaagtcaggggaggaaagtccaagacggagacaagacccttgaaacgatggtattagacccacatgctgtggcggttgttccccatctgctgtggcttggctttctgcatgcgtccagtgtgtgggatagaccagtcgtaggattaactacctctttatggagtaaagcactccttatctacaccaatcgctttcagctttcacctctcaatcaagagaagtcgtttatattgtttatttgctttgttcatacgaattctgggtatctctgttattctttcgcttcctgccaccgaactcgctttgccagacgaccaatactcgacatgaagcatatacgcggcctaatatcgataacacaagcacttcgccttaccttcctgccccctttccagaccacccatgtccagtctctacgctacaataatgcattacgaggaacacaattgaggttccttcagtcttctcgccgtcttccctcacagcaaccaagacagacacagatcagagatgaagatattcgatccgagtatatacaaatagtcaacgaaaatggcgaccttgagcctgcaatgaagctaagagatgtgctacgctctttcgatcgatctgagaactttctcgtacaagtgtctcctgcccttcctggccgcccaccaatctgcaagatcatgaacaaaatggccatgcgtgagcacgagcgagccaaagccaaagctgcacatgccactaaaacagcagtaaaacagattgagttgaattgggccatcgacagtcatgatctggctcaccgcttgaagcaattgacgaacttcctagagaaaggccgtcgtgtggaaattatcctgacacggaaaaagggcaaacgagcacccactgtggaagagattaaaaacgtcatggacagtgtcttgcaagctacgaaggaagccaatgcgatgcagatcaagcccatggaaggggaaccgggcaaacatgtaaccctatatgtgaaaaagaaggatgcttaa

SEQ ID NO: 12234 - DNA, 522 bp, A.fumigatus
aatcccaccaatgacgtgaatgtaactgataacgagatcggacttgagtacggaaaatgctaccgcatacaaaatgtatgcggggaaagactaggctatcaacaaggcgcctcctatcaatatggaaacccagatcatcaggtctttcaagtctgccttactgcaaccgggaactgcctccgcgaaggtaaggccgaccagaaagtagagtcgaggaacttgttttatctatatgacactcgcggctcctcgtggtccaagggacccacgaacattggattctacgggttgtatttatacccaaacatatacccgaatcggcccgacctgatggctcgttttcaagcctggaaggattgtgatgaggtggatgagggagaaccgtgtcctcttgcagtcaacttgaaaggagcctacaataattggaacggtctagcaaatactccggcatatggctatgttatgcaagtcgccaatgcgtacgaaactgttcactgggttttcaaggaggtcaaaaattga

SEQ ID NO: 12235 - DNA, 216 bp, A.fumigatus
tggtccattatctccatcgtccaacgaccccacaagcccaggcttatcacggccgtccagccagcgcagagtaccaaacaagctcgtgaagcgacccccctcgcagcattccagtggtctacctttatcttcacatgcgccatcatcgccctgggcaccttcgcaattgcggagacctgcgacgagctatcaacggtccgaagtattacggcatag

SEQ ID NO: 12236 - DNA, 2220 bp, A.fumigatus
  unsure (2219): Identity of nucleotide sequences at the above locations are unknown.
gcaaaaaagcttcttgttttgtctccactggtgtttgcgatcgagcactacttgactggcccgacactaactcgtctcgctttctgtcagctctgtgcggtcagcactgtcggtattgcagcgaccggtttcgctctcggtcgcatagatcgaccttcctccaaacaagggagatttcgaagaaagaccctcctgcgcgacaatcatgcgcctacagcaaacaatactgtatcgccggctttcagtactacatctccagattccccgtcttttccctccacagtctgcgatgtaaatacacatcatatcacagacccttcccagcctcacagcaatgtcgcttcacccgagcttaattccggggactcacagtctcggagaaagtcttcatttgcgggtgtaatacgtcggcgccgaggtcatacaatgaccagtccaccttcgcatcttaaagaggagaacgatacaccctcacattcccgacgaccgtcctcttcttggttgcgacgtctgtcaatccagccgcaggaaagccgcctctcaaataatggtccattatctccatcgtccaacgaccccacaagcccaggcttatcacggccgtccagccagcgcagagtaccaaacaagctcgtgaagcgacccccctcgcagcattccagtggtctacctttatcttcacatgcgccatcatcgccctgggcaccttcgcaattgcggagacctgcgacgagctatcaacggtccgaagtattacggcatagagcaactcacagcttaaattttgaacctagttctatcacaggtcccgcgtcgcattctgttgaggcaggcgcatcgattgacattgaggagggcgcatggcaaccatatctaagacccagtttggagggggtgactgagagactcgcccgaaggctgtccactgtgacaagaccgaaggaacaaacactacggcggatcctaccgagcccggatgccctcccagcgcttcttctggcgacctccatcacggtgaaagaacctgcaataaacatcacttcgaatgagtttgctcctgcctctccagtccagtttcgagaccccttcaaacttgatgatccaccgcatgcgcgagacgcaccttccgtagtggaaagcaacagcgggccttcttctattgtactcgaagcggacccgaggtcacctgaaaaaggctcaagcgcagcagcttccaaacagtccaatagtggacctccggtctggtcaagaaggagagcagcatcgacatccttctcagagttaccaaattcgaaagccgccacctcggtgtcgagacgattacacgggaagcgtaacatcaccgacccaaacatcttccgtcggcctcctgacacattcaaggcaggatatcctaacttcctgacagcaaagatcatgagatcgcggcgttctgttacaccttcttatcttcgagagtacagagcggaactgggtcgctgtcgggattacgggaaccgccccttgacatcggacgcgatagcgctatcagcatcccagaatgcattctttcgcgcttctgatttgactttcctgtggtccgtccgccaacgtcccaggcgccattcaatcgcagcctcagatccagcttcatccgcgattggatccgaagatacccgtatttttacgtctggagatgaagacgagtcagatttcttgaccgataccgcatttgactcaatccgcactcacttcacaattggtagcatctccggttctcggggcttgcggattgaaaccatgtttgacaagaattcggtagagagtcttgcgaaccacgagattacaatcgaagcgctcgagcctcgcggtccaagaatgccggatggactgacttcggctaaatgcgacatgggaatcgacagcgatgcagtttctggttcaacccctagaacccgtgagatagcagagctagacgacagcgaagacaacaggatatcctttccttcggacctatccgaagatgaagatgctcgcagcacggttgccgccttgcctggtgagacaaattcaccgttcattttcccccgtagtcctctggttgcttccaatttctaccccgaaggcaatgatatccgtgctcacgtccactcaaattcatcccatgcttcagatgagtcttcaccacggggctggaaggatccgagcgggtgctatcaaaaaaccccccccccaccggnc

SEQ ID NO: 12237 - DNA, 1194 bp, A.fumigatus
ccggttcaaagtggctctttggaaggaaagcagaagcagattccactttcagtcctatacaagcgaccggacctgcgacatatcggctccatccagaacccaacctctgatctatttgtgacggttcaactatggtcagattccaagcaactgggtgtacccatgcagacttcgtacaagtctttcaagtccgttcgagcctggaatgaatggctgcagatgcccatatccatcaaggatgctcctctgaggtgccaactggctatcactatctgggatctctcaccatttggcggccaaggtgcagacggccactatataccattcggcggaacaaccgtacccttgttcgatgaagacggtaagctgaagacggggcggcaaaagtgcaaagtgtatcgacacaaaacagcagatggcttctcgtcgacgactaccccatccactccaccgccccaagcgacgccaagaacaatgcctcggacgctcttggccccttcggtggatgaaatggaactggaaagagtggaggtgttgatcaagaaacatgagatgggggagttaccccgaatcgactggatggatcagatggtcttccgccaactggagaagttgaagctgaacgctgaagaagctgcgaggaagagggcgatccgtctcaaagcggccaagaacaaagcgccagagacaccaggcgctgacggagtaaattctgatgaggaggagatagatgacgagaattttgtcctgtatatcgagttcccgcgcttcgatcatccgatcgtctggactgaccatcagtacccgccccctccggtgtcgtcgtattctcaaaatgcgtcggcgaaccctaatgccaccctaaaaccagttcctgaagtccgctttggaccaggaattgaaggcgccgatggtgacggtgtgattcgaatctacgacccggaagtcggccagacgggtaacccctgtgaggacaaacacagaaggttgattcgaagccatcggaccggcatcatggaccgtgacctgaaacccaaccctaagattcgcgacgagcttaacgtcattgtgtcatatgagcccactcaggacctcacagcagaagaaaaagacctagtctggcgtttccgatattatcttactcgtgagaaaagggcactcaccatatttgtcagatcggtcaactggcgttga

SEQ ID NO: 12238 - DNA, 423 bp, A.fumigatus
gtcacaaccttcgacaatggaacgtacgcgaccaagaacacagcacccgagttctccgttacatggcaattcaaccccggtccggcgacccaaccggtccacgccttctcgaacgtgatgattgatgacgggttgcccatctctctggagaaaattcagcatctgaatgtcgatttccactggacgtacggagttggcaacacacccgctgaggcgaccaacgaggcggaactgacggccgcatctgtcaatacgaacgtcgctatcgatatgttcatgagtcaggaagagaaggtaaaggacagtgccgattatacgcacgaagtgatggtttggtttgcgaagttcggccccgccgcgtacgtgattggacaagatgatggcatcgttgcgaccaaagaggtgaatggaactatcttgtga

SEQ ID NO: 12239 - DNA, 186 bp, A.fumigatus
accaatttcataaccaatcagctccacttgttatcagggaccatccccgtcaagcatatgactagtctgctttggtccctgatttccctctcaaaaaattcaaactatgaaaacaactcgattcttttcccttgtacgttacaccttccttacgtctacagataccccaaggtaaatgtttgctga

SEQ ID NO: 12240 - DNA, 441 bp, A.fumigatus
agggtagttccgttcccagtattggcatattatgtctgtactatttcccaaactgtctacgatatgtccactcttcagatatccgaggacaatccattcctgactttgattaccgagacgaataacgatgcggtaagtaatattcaaaggtttgtgattagagattatgttaagcctctctatcaggatcagttgcagtcccgctacgagaaccaccgcgtaaatcgaaatgcacagcaagccgcgaagatcctagcaccagacttcgctggctgggatctggacgagattttgatgcgccttgacggtcctacaaaggaagaaggatttgttgatccgcgcaactgcctggtcatttgggcccggccaccatctccgattcgcgatcttgtagagtttgtgcaaagcgaacttagacgcgttgctccgagtaagttctga

SEQ ID NO: 12241 - DNA, 237 bp, A.fumigatus
cgacgttggaatacggagggagagagcttacaaaagcaaacagatggtgaaaatggctatgcggttcaatcaggaggacctgcgggaattaacatgtgtatccaggccgtgatggagtataagtacccgatgtgtttctggaatgactcgtgcgagttcctgagcagtggccttacacaacttgtcagtatgaaatacattctacgtcggggtgaagggcgtactcttcccacgtag

SEQ ID NO: 12242 - DNA, 693 bp, A.fumigatus
cctggtacaagaacatgctcactggtgagaccctatgctcatgtactggttggacaatcactgatgaaaagtagtgagcgtgatggacgtgatcatgttcgaggcccagaggcaagggcgtctcagtttctatatggtacgagcactcagccgcaaagccaacaattcgccaacaattctaacgaggtgcaggtttctgcaggagaagagggcatcagcgtcggctccgcagctgccctgacccccgatgacgtggtcttcgcccaataccgcgaagcaggcgtctttcaacaacgcggcttcaccctcagggacttcatgagccaactcttcgccaaccgcaacgactacgggagaggccgtaacatgccggttcactacggctccaactacccccgcacagtaagtacccgcccgcccctcgaactggtggtcaacccgggatcatatctgacacaacatgcaagcacaccatctcctccccactcgcaacccagattccccaagcctccggcgcccgctacgccccgaagctccaagccctccaaaaccccgataccccgccccgcatccgtacctggtacttccgcgaaggcgccgccaccgaaagcgacttcctcgcccggcctgaaacttcgccgcccacgcgggtccggccccgtccttcttcatctggccgaaacaaccgggtta

SEQ ID NO: 12243 - DNA, 225 bp, A.fumigatus
accgttagcatactcgaaagtactccgaagcctctgagactaatctttaagtgcaatgacaactctggtcgaagaggatggactgagtcgagggattgctgtcaccgattgtcttgcgcctatgtatggaaggattatagtgcaggatggcttagtggacgcgtcaacgactctatatacataaacggatctggcagcatccaggatgctcataagtccctgtaa

SEQ ID NO: 12244 - DNA, 267 bp, A.fumigatus
catgacgttgggcccgacgccaaccgagtcctccgcatttcccccagaatcataagaaatcaacacctgtcggcccctgcacctaaaaagggtactgtgattcttccctcgatctcaatcaatgagattctgctagattgcaaaaatttcagtcatgtcgttaaaatttatggcccgcttaccgcggccggcgcgcagccagcggactctcctcccttccgtcaagcgatggggcagctccatctctcagcggccaggatcggatag

SEQ ID NO: 12245 - DNA, 255 bp, A.fumigatus
cggaaatatggcaatagggtccgcttccctggtgccgtcaacagcaaattcaccacggagatgtcctttattaaccctgccgagacgtcgagtatccctacctaccgagtgatgaactctgacggagtgatgttggagaaagaccggaaatcgcttgatgtgtcaaacgaggagatattgacctggtacaagaacatgctcactggtgagaccctatgctcatgtactggttggacaatcactgatgaaaagtag

SEQ ID NO: 12246 - DNA, 330 bp, A.fumigatus
catgccggttcactacggctccaactacccccgcacagtaagtacccgcccgcccctcgaactggtggtcaacccgggatcatatctgacacaacatgcaagcacaccatctcctccccactcgcaacccagattccccaagcctccggcgcccgctacgccccgaagctccaagccctccaaaaccccgataccccgccccgcatccgtacctggtacttccgcgaaggcgccgccaccgaaagcgacttcctcgcccggcctgaaacttcgccgcccacgcgggtccggccccgtccttcttcatctggccgaaacaaccgggttacc

SEQ ID NO: 12247 - DNA, 285 bp, A.fumigatus
tgctttgacagccttgaagatttcgagtccacatggcttgtctttgatggactggacactttcgcaacaatcaccttctgtgaccagcatgttggttctactgataaccaattccgtcaacaccatttcgacgtatctcagatcctgaaagaatgtaaacaagatccggtgctgaggatcaatttcgggagcgccccaaatattgcaaatacgattgcaaagagccccgatgcggaaggtcaggggacccggcaccactcctgtcatcccgaacttgtgcattga

SEQ ID NO: 12248 - DNA, 1224 bp, A.fumigatus
cgattcggcaattcagccgcacggagtctcaatggatgctggacctgtcgagtccgcaagaagaaatgtgacgaaactcggcctgtgtgtcgttcatgctcttattttgggctggagtgccacggatatggtccaaaacccgagtggatggacaacggtagacaacagaaagaacaggctgcaaaattcaagcggattgttagtcaacggaaagcgtcaaatcgaaaggacaggcaatctcgggaagtgcgttcgtcgctggattgtaaccagagtctgggaccggtctcgactggagacgtgccaacacacatagcatcgtcagccacttccgcaccgctcccctttcacgattgcaatgatgtcgggggccatggccctttttttgatacaatcttgagttcctttatggacccgacatggggccctctgcccaactatgactatgtagctactgcagcccagtcccttatgaaagaagaacatcaccaacacccatctgcatttttcaggaacatggactcaacgcaaagctcattatcgcccgggtcgtctggggatgtatcatggcttgcccccgacatgatgggcttgcatgaggtaaaggctgtgcggagtgcaattgtacaacacgacgagaagggacattccacgaatgaacggcccttctcaatgggaaatgaatgggcatgggactcctcttcaaatggtaacggcttctccagtcacgccagcgtgagtgactatgctgccggaaagccaactgctccaggacagtttgtggcttctggagatgaccaaaaacatagggccccgccagaggctctgattgagccactccgacaacgaggagcagaggacacgttatttatgcactacctggatcgggtattctacatccagttcccattctacctctcccgaaacccacgaggaagagcctgcctgttctcgattatacggatggtcaagcccgcttacctggcaactctggccctcggtgaacgagaccttctctccttccatccgcaacagggcgatgtcgctatcagcctgactcaactgcgcgccaatggcgggtaccacgacctggcagcccaagcaacacagcgcttgctgcaagaatcacatacatggaatagaagtgcgtatatggttcacaatatcgagtctctcgcatccatccttcagctcttgttctgggaggtatgtcacctccactag

SEQ ID NO: 12249 - DNA, 429 bp, A.fumigatus
acgcagaataaaaggggccaaggaagaagcggtagcaacagcagcaacaacgccagcggcatgtcgttcatggaggcgatcttcctcgatgatgggctctccgaggaagacaagaaggtgaaaagcgaggctgctgagatactgacagggctggtgggaaattcagccgtcgtgtatgatctgacgagtgccagtacgcccactgcgtcgtctgcttcaattacctccatgaagatggaggatgccgcggagagtttctcgtcggcgtttggcgatgctgtcatacaggaaggtcgggggatcggtcatgttactaacggggatatcgacgtgcctgctattgaacatgatgggttcgatatggcgggtttgtactttcacggtcatggggggtacggcatggatgatatctacggcggggctgcgtga

SEQ ID NO: 12250 - DNA, 765 bp, A.fumigatus
agcagctccgtactaggaggtttcctgcacgcgttgatgctgtccgccgcgaaaaagtttatcgaaacggagctcggcgatggacggtttcccgaccctgtgcatgcatttgtgcagtttctcagcatggttcctcctggtccggtctcgatcacctgcaaattcttgcgtgtttccaaacggcagtgtgtggtcaatgtggaactggtacgctcttctgctgcgctgtggaagaagccggaacttccggctacggtcggaatcttcacatacggtgatttatccaaggaaagaggtctgtcacaggcaagcgaccctgctttgaggatccctgtacctccgcgtgagactgagtgcgtcacaatcgatgacccagtagttgattcgactcccgtcacacggaaactgcactggttagcgccgaggtcggcaaacgggctctggggtcatcgactgggaggacataaccgcgaggtctggatatccttccgggacgggtcgaagatctccgactgtctacatctagccttgctatctgatatggtaagcccacacggaatctaccaccccgttctgaaagctgaccaattgactcaaacagccgcttcagcctgccgcaacccaccaaccaggcttctacaaccactacgcactatccacgctctgcatttccgtggagttcaagcaacggcccgacccgtccacacagtgggtgatgatccggtcgaattcgcacatggtgtccaatggccgctacgatgttaa

SEQ ID NO: 12251 - DNA, 1353 bp, A.fumigatus
gcgggtccttccagccccgtggtgaagacacttggccagagtgtcagcgttgactccatacgtcagagggcttacatggccgtgggaaatgcgttaaatgaagtcgaccttgagactcttcaggttatttcacagcagcgttatccctggtccatcttcgccttgtctcaggaaacagattactcagttccacttacggtggccacaaccttgagtattcatatacacgattctcggttgtcagcctcggaggaagaggcggccatcaatctgcgttgtgaggagccagtcactgcgttagtgccggattcgcaagtatatgcacgtccggactccccgctgctacaactccaacctgatggtcggcctccctaccgtatacgtagccctgatccctcgcagaagggagcggactatgcacctctgttccagcctggccctttatcgcttttacaccctcccgcaccgcatgtgaacacgattcttcttgcaggccgctttcctagcatactacaatacgaccggcgattcttccctcggctacagaacacggtacactcaggtggccgactctgcggtcttacttccatgcctgctccccattttcctgtatcatcaggctcgacatatccacattcacataaagtggtagcctgtggtgaatacaatggaaaaggctcactcgagctttacgaactgactccctcatccctgaacagcggagacagcccgtcggaagtaacttccaatatgaattctgtatgtcaaaaccgtcaaagtgccgcgaaatcgaaggtcctctctgtagagtctcacgggactcgcatcgcctactcggacgctgagggtaatatcaaatgggtcgaacgagacggccgtatcgatgttcgttgcttcaatatcaactcctatctacagcaggcccgaagccagaacaatcgacaatcaagtctccaaacttcagacgctttcgccggggacggcgatgaagaacaggaggaagagggcgcctccggactctggcgaagcgttttccgctctcagactgacggtgaagttgctcgcaagatcttacctactggtgggaatttaacaggggatgagctccttgtctggacaggagagcaagttggccgtgttgtgctctccacctcttccggtgacaatcagggtgaagaagatgacgatgacgagatgtcaattgacggggacctggacgactctactcgcgaagaactgcgaagtagaagacgagaacatcaacgacaggaacgagagtacgcccgaaggatgcgcagagcgctggaaaggcaggcggacgaagtccggcgtatgagaggattcggactatga

SEQ ID NO: 12252 - DNA, 627 bp, A.fumigatus
aagatagacgacgaccaagagtcgtcatatcatatggagcagtcaaggtcatcgcccaaacccgtagcacgtcggcgcagaccaccgctatcgtgcaccgtgtgcagacggcgaaagctcaaatgtgatcgagaattgccatgcggccaatgcaccaagtccaaaactccagaccagtgcatctatgtaggacctcaggctggctctctatcaagcgtccgacgcgctgaaagtcgagacacaactgccaatgaccgtacgcgggcgtccacagattgcggcagtcccgtttataacggtgtctatgttttcgattccaaacaccaacgatttccgacaagggtgacaaagcccaaaagtcactctgatgaggtgcaggagctccgtacccgagtactgacattagaaaatgcactggcaaaggccagctcgattcaaactccagacaccctggggaccgtaccctcgatcgtctcagaattgggaccccgtacagcgggagacgaacactatatcagcgaagacattcggtctctcccatgtgcattctttcggggtaaaaagtctaacactaggttctgtggtcgctcgcattctttcttggccctttcattcgtaagttgctag

SEQ ID NO: 12253 - DNA, 1734 bp, A.fumigatus
ttccgggatgtgggtgattttttgaggcagcgcaagtccaaacataagaaagattccgtctatggatctttgaaaaaaattcagaaagaaatgtggctcaagcaaagacaagaacaacagcaacgcgtgcgccaggagttggtttcttctttcgtggacctgcttcctcctcgccgagttgctgataagctagtccagttgtacttgtccaattttgaaaccacacatcgcatcctgcatataccaacctttctcaagcagtacgaagagtactggattgcaccccaacaccccgatatggttttcctggcgaagcttttgcttctaatggccgctagcagttgtttttacggtccaacaaaaaagatcaacgacaaagatacactggcaagtactgcaatacattggatcgaggctgttcagacatggagcgcaacgacaattgggactcgaaacaccaactttgacatgttgcaaatccattgtctgttgttgattgcgcgccaggcgatcgcttctgatggggataccatttggatatcatctggctcgttgatacgactagccatggccatgggcttacaccgcaacccgttgcgctttcagaagctgtctagattctgggcagaaatgcgccgccgtttgtgggctaccatactggagttagacctacaatcgtcgatggatggagggatgccgccagcaattgacctggaggagtacgattgcgatccaccgtccaattatgatgacgcagatttggtcgaaagcatgacagaagatcccccgcctaaagatcccgacatcgtcactcggagcagctttcaggttctactttcgcgttcattgcccgtgcgagtacacatagcaaagcttgtgaatcgcctgagattcacgatctcctatgatgaggctctgctcttgagcgaacaactcatgcggtctctgaatgatgctttggaagtgttcccgagcgacggatatccgtcgcatatacctggcgttgagaatcccgcattcacgaagtcgtatttcatttttctaatacgaaggcatttgctagccctccatcgccctttttgcctcagtattatgcgaactcctaaattctcctattcacgaaaaatttgcctcgactcagcgctggatatactctccttgctggagccctctcttgacattgccgagacagagccccagcctcatcttggacatttgaccggcggaatgttccgtgaagagctattaaatgcggcggtcatggtgtgcgtggagctagtcctgcaagctgacgagtattcgcggtcaaaatccatgctcccaggccaaagtagcgtcttaagctctctcaacgacatggaggaatcccagcaagcggtcttggtacgtgcaattgaaaacaccctgaatgtcttcggcagtcgcattgcaccaggcggaaggggttgtaagccttacttcttcctaagtctcacacttgcatctgtcaaggcgcgcttgaatggggaggatcccttcgtcgctatggatcaagttgttacaaacgtcatcagagactaccatttactgatgagcgggatgccttgggccgatgtacgcaagcaagatgaaaacagcacaaaggacgtgagtgattgcaggttcataacacagcggctatttactgatacacaactagaccagtattcctacacctgggctcactgccggtacgccgttagatctgccctttga

SEQ ID NO: 12254 - DNA, 762 bp, A.fumigatus
agactgcagcgtgacggcgagcttgatgcggaaaaaccagaagcaggaaaggacatgctgtccaggtggatggccatccacttgtcggaccccgagaagctgaccacccgggacgtcatcgtccatctgtcgacgaacgtgtttgccggttcagacaccactgccattgcgctgcgagctgtcttctacttcctccttcgtaacccgtccgtcctggccaaactgaacgccgagattgataatgccgaccgtgaggggaaactaagcaccccgatctcctaccgagagaccatgaaccacctgccctatcttcaggctgtcctcaaggagtcaatgcgactccatccatccgtgggtttgatcctcgagcgcgaagtgcccaagggcggcgtcaccatctgtgacagacatttccctggcggaaccattgtggggattaacgcatgggtcctacaccgcgatgcgcgtgtcttcccagatcctgacaagttcatccccgagcgatggatcgatagcgacccgcagcacttgaaaaagatggatcagagcttcttcgcgttcggagcgggttctcggacctgcattggtaagaatatttcacttatcgaaatgcataagattatcccgcagcttttgcgcgagtttgagatccgcctgcatagtccagagaaagaatggaagacgaagaatgtatggtttgtgcagcaggagggattagtatgtgatcttgtatgcagacgggatgccaagtgttatcattag

SEQ ID NO: 12255 - DNA, 252 bp, A.fumigatus
ttgctctatttgactcgacgtgagattattttcctcaagactatcttcgctttttgccttcatcctctccttcccccattttccggttttcaacccaacaacacctcaacgcacatttcgtctaacaatattatcggaaacacccgtgttccgctcgctggggtccgaaaaatctgtgtctccggccccggttcccagttcccctccgaaaaacccggaatccccctcacctccggttccaattggcggtaa

SEQ ID NO: 12256 - DNA, 444 bp, A.fumigatus
ttcctcgaaggaatatttgctgtatggttgctggaaagagatactttgatagtggttggtcacattggaactgctatccttctccgtgaaggggctgaatggagtgctaccggttccctcacaggggggcactgcctgttgaaatgcagttcctgtgccaccgccaaagccagtaccgcctccgaaaccgcctcctgttccgaagccaccagtagtaccggtggtggtggtggaggtgccaaagcccccagcaggtttgttgccgaacagtccaccaccagttgttccagtgcttccaaagcctccagtggttcctgtagtgcctgtcgaaccgaagccaccaaatccagtaccgcccgtggtggaagttccgccgccgaagagactaccaccggttgttgtgccagtgccaaaaccgccagtacgattttggcccccgaatag

SEQ ID NO: 12257 - DNA, 210 bp, A.fumigatus
aggcccgtctctttgataagaccactgttgcctttggactacctaattctgttgaagtttttctgttttagcgctgcactggtttccatcggctgtgatgacgtgactcgacatattcgtcatgcttcccaccccatttatattgctcgcgccggttattcccgctcgatttttccacagggaaacaagaaacaatcgcataacctctag

SEQ ID NO: 12258 - DNA, 252 bp, A.fumigatus
atccttaatcctcaaagaacgtcgtcaatcatcatgtctttcggtggcttcggaggatttggacaaaacacccagcagagctctggcttcggcgccggctctggctttggtagtacaacttctggaggaggtaggtcttgtgatccttcgttgtgctgcggcattacccatatcccgcccgtcatccgtgacttgctcgtcttgcctcgtttgcttgggatctcaatccaggactatgctggtgcctcttga

SEQ ID NO: 12259 - DNA, 222 bp, A.fumigatus
accgcaacaggcagtccactgaacttcttgggctgtctcccatctcacttcgctctgggggcagctttcttcctctttttcttgacctctgcgcgtcacattttcccttccattcccttccccccccaactccttgccatctttcctacccccattgccactatccctttagatactacgctctctggctttgacggtcttttacaatccgtcttaagctag

SEQ ID NO: 12260 - DNA, 1686 bp, A.fumigatus
  unsure (990),(1016),(1034): Identity of nucleotide sequences at the above locations are unknown.
tatggttcgcgtgtgttgagttgtccaggatcattgcttccaagggcttcatgggatccctgtctgaggacggactgtttcaatcctttatgctttgccaattttttttttttttttttttttttttttcaaaaagcaattcatcttcaggtactgacatgggattcatttctaggctttggaaccaatacacaaacccaacagaactcgctattcgggggccaaaatcgtactggcggttttggcactggcacaacaaccggtggtagtctcttcggcggcggaacttccaccacgggcggtactggatttggtggcttcggttcgacaggcactacaggaaccactggaggctttggaagcactggaacaactggtggtggactgttcggcaacaaacctgctgggggctttggcacctccaccaccaccaccggtactactggtggcttcggaacaggaggcggtttcggaggcggtactggctttggcggtggcacaggaactgcatttcaacaggcagtgcccccctgtgagggaaccggtagcactccattcagccccttcacggagaaggatagcagttccaatgtgaccaaccactatcaaagtatctctttccagcaaccatacagcaaatattccttcgaggaattacgattgggtgactataatcagggtcgcaggttcggaaacggaagcggacaggccggggcttttggaacgtcagctttcggtggatccggttttggggcgcaaccgtcttctggatttggtagtacgtcttcgccatttggcgccagcaccagcgcgccatccgggtttggcacgacccagactactggcggatttggctctacctccactaaccctctgtttggagcagccaaaccagcgacctccctcttcggaggaggaacctccacaacgtctcagcccagcctgttcggcggtaccactgccacgactggcggctttggttcaacgcanactggaacaactgggttcggaacggngacaggaacgggaggctncttatttggtggcagcactcaacagcaagctaagcctttgttcggcggaggtactggcaccgctacaactggtacgggcaccgggtttcgcggattcggcacgcagaataccagcacggccagtccgttcggtggtactgccgcgacctcctctccatttggcggtcagcagcagactggcggtacgggagcgtttggtgggtttgggcagcagaatcaggctcagaaccagacgcagaacaagggattgtttggcggtttcggcacgaccacccaacagcagccatcttctggcaccggtctttttggtggcggtacaactggtaccacaggcacttccctgttcggtcagaacactcaacagcctcagcagcagaccacaggtggtgggctttttgggggtaatacccagcaaaccggaacaagttctcttttcggcggcaatcaacagcagggccaaaagagcctgtttggcgggggaacgactggcactggtacaggcactagcgcattcggaggttttggagggacccagaatcaacagacaggtacaggcggtctgtttggtggtggccaagctcagcagcagcagaagcccagcctcttcggtggcagcactgtcttcaccacggggctggaaggtgcggtctga

SEQ ID NO: 12261 - DNA, 582 bp, A.fumigatus
ctcatcttcaataaaggggtaaacgaatcattcgagtcatcatcttcgggcgtagctaaggagacaggccgtcgccttgcttctcgctcagacagttctctggtactcgctaaatgtcgcacatggggcacactccctgatcacctcgagataccggacgtttcaattccagtggatggaaaaggcaagtctgcgcttgcagatgcagttcttcccgagactttcacagttgatagctgcaaacttggtgacgaatttgtcgacaccagcatcattcctggcttgcggagcaaggtcattggtaaaggtgtcacggctactgtcaaattaatgcacaggaaagggaccggaaagcagcaatattatgcggtgaaggaatttcgcagaagtcgcaaggagaacctgcaagcttatgacagaaaggtgaaacttgagttcagcatcgccaagaacttacatcatcctaatgtcgtggagactattcgtctttgctcccacgcaggccgttggtctcatgtgatggaatactgcagtcaaggggacttgtttacaatcgtgcaacaacgatatctttacttttga

SEQ ID NO: 12262 - DNA, 270 bp, A.fumigatus
tggaatactgcagtcaaggggacttgtttacaatcgtgcaacaacgatatctttacttttgaaagtcagctgtgcctgttcaaacaactcttccaaggcgttgcatatttacatagcattggaattgcgcaccgcgatatcaaactggaaaatttgctcttgacgcaagacagtcacttaaaaatcaccgacttcggatgcgccaaattcttcagtgagctccgccgagatctgcggtcttcacaacggcctggaaggatccgcatgggt

SEQ ID NO: 12263 - DNA, 195 bp, A.fumigatus
ggcaggacatcacgacatcacgacattatgctcgcatttcctcatcagaggtacatgactaactattcggcatatattgacccaatgtgtgaacatagcgcaatatcggtcgctgtcaaggaagcgctcaagtcggatattttactacctgactcgatgaagcatggagtagataggttgagtcagcgagggtaa

SEQ ID NO: 12264 - DNA, 330 bp, A.fumigatus
cagctactcagtgctttcaacgccattgtctccgcttctgtggtactgcttgatattgcgtatggcatgccgattgtcgtcaactgcctgcgcggacgcaacatgctccccgagcgcccatttgtccttcctaatattgttggctggattgccaacgcggtaagttgtttctacggttcctttcgagacgagaactcatccgttgcgttaggtctcccttgtttacatttctgtcaccactgtgctcttcttgttccctccagacctccccgtatcgggcagcagcatgagtatgttttaatgcactgcaatgccggattgagcagctaa

SEQ ID NO: 12265 - DNA, 198 bp, A.fumigatus
ctgacaccattgcatctagattactgcgtcgctgcctttggcattatcatcgttatctcggctattcagtgggtcattgacggacggaagaacttcactggaccacggaccgatatggacatcttgacaggacaactccctgttggccattaccctgtcgacagcaatgctgcgcatgtcgtacctcaaggaaagtag

SEQ ID NO: 12266 - DNA, 276 bp, A.fumigatus
gttccccctggtctgcatgctttttgcaaccatttccatcatgacaacaagcagccgtatgatcttcgcttttgcaaggtgattaccgaccagactataggactgtggatttgcgctgacaagcctgccagagatggaggtcttccggcttctcgcttcttcagcaaagtgcaccccaagctgaaggttcctctgaactctttgtatctgaatctggcactggtggtcatctttggatgcattttccttggctctaccaggttggttgcgtcttga

SEQ ID NO: 12267 - DNA, 2775 bp, A.fumigatus
gacaaactgctcctcgcgcctctatttgtggctcacatctacaagcacaaggatcgtgaggattatgcggaagatgtggtcacggcaacagggctgaaggttcgtctggacagtttgaagctagatgtccatcagcggcgggagcaaatcaagacggtagcaaagggtcgcctgaagcaaacaaagacaagcgccatgcggatcaaccaaggccaactggatctgcaggcggccgatttcagagccgtatctgttagtattgaaggaacgaatctcgatgacatacagaagaaccgggacgatatcatatcttccttccagcagccagtcccctcggttgatttatcacgattcactatcccagaccagaatcttgattgggttgatatggatgactttgttgagcttgattggatattgcctcaagagtccaaccccaaaacacatattcttcctcttgcgttcaccccacgttttacctactttcgccagactgaccatggagatataacgccggatcaaacagggtacagcccattcgggcatgagcccactcacgactgcgttatgtccgagagtaacgaacctcgtcgggtacaaatggaactgattagggatcgcctcgccactgttgaagcacaaatacggaacttcgatcgtcagattggggagcaggaacttcgtatggcaaaggatgtcgaccatcattccgaccttaaaaaggagcacgatgactttatcagacaggctgaatcgcttgctcggagacgtgccttccttgtgactgggcttcgtcgccttgaagcgcaactttcacgtgaagagaaaaccccaatggacaagaagcctgaaaatttcgcgagtgatagctcgttccgtcttggtgctgactccgattcaacgaacgatggcaaggaagcggatctcgacggcttgtactcgtcgcacaacgatgaatacgctagcgacttcaacaaccgcttcttgattcacaacatgcagttgaagtggaataactcactccgcaacattatactgcgctacattcatcaagtgagccaaagacgaggtttcgtgtactacatgtcccgcagagccgtcaaattcattcttgatattgtcgaagaacagaacaaaaacaaccaaagacgtgccaaaatgttcaaggactcgtcgagacggccatcgaatgccgacacagacgaagatagtgtggaggatcgtatcgaacaacttctgaacgataccaaacgctttgtcagtgctgaggaacaggaaagcgttgattcggttacccagacccagccagattctgacagctctagtgagaatatctcgcctgagttcactccacagaatagttactacttacggttgattgcgccgcagatccagcttcagagcgcgaaaaaccagaagtcagtcttgttggtggccgcgagtggaatgcaactaaaggtgatttcaatcatggacaaagaacgtgtttcagacgatgtcagcggtttggtacagcgccgcttctctcttgacatggatggtgctcagttcttcgttgcaactcagaagaatctgatgaatcacttgcaattctatgccggtaataagtatggcaacgctccgggatcggcatggccaccttgggtaacgctcgaagccatgtttgattttgagttgaatcctttcggcttctcgcgaattattcagaagacttccgccagcttgagatatgacaaatacaacaacctgcgtctgaagtacaatgaggaagtggcaaaagggcaatccaagcacgtcggtccagatggtcaagagactaggatggatcatattagtgttgactttcctcactttcgcgccatttgtgactcggctgaatattactcaatgtacatcatcgtgctggatctccttctctatagcgaaccgttggagaaggtcagaaacgaacgtctggaacgcatacttctcacttcggatttcagcgacctgagaggtgctccggagatggtgttcaagctgcagtcccgcatccgtcagctagaggagatcaaagagcatttccagatcaacgctaagtacctggacaagcatggctgggaagaccggctggtgctggaaaaggatctggctcaatgcgaagacgagttattcttcttgatgaaagccatcacgacatctcaaagacggatcgaaccaacgacgtctggagcaaatggaattctgagatggaagatctctgcatccgaggtagtctggcatcttatgatggaccagtgtcagcctttggtcgaattccagctacggaatgccgagtatgatcgcacggacaatagtgatgggtcgaatcacaatctcgtggcagttgaacggatatacggcttgaaccttctaccggacgccatctaccctcaaatcatcgtgccgtatcttgaccaagccaagaacctggacgaacccgatgagaatatgattagggtcaaatggcacatgttggaagctgttggcggtattcccgtcctcgatgacttcgaggtgtcgcttttcccgctcaagatacaactggagcgcgagcttggtcaaagggtgtttgagtatatctttccgaatgttcgctccaatgggttcgatggcggtttctcacctttcatgatcaagaacatgaaacctttggatgtctcggaatcggaagaagacaatgatagcccatctccacctccaagcgcgcaaggcgccagcgacatcccaaccgaggtctttaatggtgcccgccgc

SEQ ID NO: 12268 - DNA, 1398 bp, A.fumigatus
agatcttggcgagggcgaataggtggcagtacgttgaataatggggacagcagcaggcctgcgaccatgagctccgtgacgaacccaaagcctaagcaaagcgagctacttcgtgagttggagaaattttccagatataaagttgaacagttggtgttgatcaaggaggccaagctgctcatctcgctgtccggcggatacgtatcaattcacgacttacaaacttacgaattccaagagcagcttacgatgaccagaggtgcgactacctttgctgtgacttcaaacatagttcacgaccccgagactggcgtcccgtcgatcgtatcgcgccttgccgttgctgttaagagaaagatcctgctgtggacatggcgtgatatggagttagagaatgatacggcggaaatgagtctggctagtggcataaagacactcacgtgggtctctggaacaagaatcgtcgctgggttgagctcgaatttcgtcatggtggatgttgagaccacaaatgtcatggatctcgtcggaccgggcagcatcggtggactacccggacaagaaacagggcgactggctggtgttggcgttgctagtatgagctatattgggattggcggaactgcccctaaaccgctggctacacgcctaagcgaagggcaagttttactggcgaaggatatcaacactcaatttatcgacatcgacggcaattccttgggaagaaggcagattccttggagtcatgccccctccgacattgggtactcgtatccttttctgctggcgctgcatgactcttcgaagggagtgctggaagttcgaaatcctgagactctgagcttactccaatcaataccattaccatcggcgagtctcctgcatattcctcagccctcaatcagcttggctcacgctggcaagggattcttggttgctagtgaccgaaccatctggagaatggaggctttgagttacgacactcaaattgatgctcttgtggaaaagggatatttggatgaagcgatcagcctcgctaatatgcttgaggatgcccttctcacggacaaatatggtcgtctacgctccatcaaacttgacaaggcgcagacgttgttctctctccaaaaatacctcgagtctatggagctcttcacggagatctcagctcctcccgagacagtcattcggctttacccgcgggttatagcgggcgatctttcgtccattccagaagagcaagaaggatcggaggccggtacgacggatagtcagccaagacccgaacaggagcaaaagcaagacacagtccctgcaacgtcggatgacgctgctcttgccagaacgcccccgccatacaccctcggtgaggtccctccttcgaacgaagacagatga

SEQ ID NO: 12269 - DNA, 1188 bp, A.fumigatus
cgggcgatctttcgtccattccagaagagcaagaaggatcggaggccggtacgacggatagtcagccaagacccgaacaggagcaaaagcaagacacagtccctgcaacgtcggatgacgctgctcttgccagaacgcccccgccatacaccctcggtgaggtccctccttcgaacgaagacagatgataccagcgatgcaggtagcgtccgcagcaagctcatggaagatgctcggatcgacaaacgccttgaaggaaaagacctcaagcttgctgttcgtgaacttcaagcgtacctggcagatgttcgccggcgatttcagcggttcctgaatccggatggctcgctcaagatggagcctacagctgatgcggtgaaagacgaatttacggagtccgtcatgaagttgcttgagatggacaaagatcaaggcgaggatggctttggtgagaggcttagagccaaagctaaactcgtagacacaacgctcttccgcgtttatatgtatgcaacgccgtccctggctggctccctcttccggatcgccaatttctgtgacccggacgtggttattgagaagttagaggagagtggacggcaaaacgaccttattgactttctctacgggaagaagatgcatcgtcaagccgtggagctcttgaaaaagtttggccaggctgaagtggacgaagagactgcaacccaacttcagggtccgaaaagaactgttggctatctgcagaacctgtctcctgaacatattgatttgataatagaatttgctgagtggccggtacgagagaagcctgacttaggcatggaaattttccttgcggatacagagaacgcggaaacattacctcgtgatcaagtactaaattttctgaaagggattgatgtccgtctggctgttaggtatcttgagcatgtcattggagaattgaatgacatgactccggatctccatcagaaccttctcagcctttatttggatcgcttggaggaacaaaagaacaaagaatgggagttcgccagtgaagaagacagggccgattggcggaacaagctgctggacatgctaaggacaagctctcagtattcgccggcgaaaattcttgaccgtcttagccgagatggtaagtccagggctggtaagcccttggccaaggcacatatattgatctaa

SEQ ID NO: 12270 - DNA, 504 bp, A.fumigatus
aatctggttcgcaggtattgcaatcaccttcacaagatcgaagacgccacgagcacagagacgacggctatacagaatatagcccttccggattttgagggagaaaagccttccatatacctaacgcttttatctctttacttgtcaccgccgcatgggtacaaaccacgatatgggcccgcgctggaggtgctcgcaaaacatggatcccgccttcctccaaactcggctcttgaactgatcccggaaacactgcctgtcaaggaactgcaattctatttcaagggtcgcatgcgggcggcaacttctattctcaatgagtccaaaattgtggccaacctgcaaaagtcgcagagtatcaagacacaagcgcagctcttggttggcgagggtggtgacatgaaggcatcgaggtcgaggcatgtcacgatcacagaagaaaggatctgtgggatttgccataagcgacttggtggaagtgtgattgatgttttccccgagtaa

SEQ ID NO: 12271 - DNA, 204 bp, A.fumigatus
catgtccagcagcttgttccgccaatcggccctgtcttcttcactggcgaactcccattctttgttcttttgttcctccaagcgatccaaataaaggctgagaaggttctgatggagatccggagtcatgtcattcaattctccaatgacatgctcaagatacctaacagccagacggacatcaatccctttcagaaaatttag

SEQ ID NO: 12272 - DNA, 330 bp, A.fumigatus
catttctatcggcggtcaccgcatcttaaccgacgcctcccttaccctagcttacggacgccgctatggtcttgtgggtcagaacggtatcggaaagtctactctcttgcgtgccctgagtcgccgagaggtagccattcccagccacatctcaattctacacgtcgagcaagaggtgcgcttatgaagcaaactctccctctggcggttgttgctgacatcagctttcagattacgggcgatgataccccggcaattcaggctgttctcgacgcagacgtttggcggaaacgtcttcttgcagagcaagaggtgggcctcgctctatga

SEQ ID NO: 12273 - DNA, 483 bp, A.fumigatus
gcttcatggccaaaacctatcccggaaagacagatgaagagtatagacggcatctgggagcgtgagtttgacccgaacaatcttctgatttctccgaaatctgtaacacgtcgactgatgttcgtctttagcttcggtatcaccggaactaccggtcttcagcgcatggagttattgtctggaggtcaaaagtcccgtgtcgcattcgcctgtctctccctgactaacccccacatccttgtgcttgacgaaccttctaatcacttggatattgagggtatggatgcgctttctgaagcgctgcagaggtttgaaggaggtgtggtgatggtgtcacacgatgtgacgatgctgcggaatgtctgtaccagcttttggctctgtgacaagggtacggtacacaagtttgatggcactgtcgatgcctacaagaagatgatcagctctcaggccaatgaggctggtgtggtggcgcaacattag

SEQ ID NO: 12274 - DNA, 786 bp, A.fumigatus
attgcctgtaatcgggccctttgtcattcatgctctaacacgaaccagggttatctgactcacgcctcaaatgcttatgtcgaggatgcaaatgctccgtcaccattatcggaagccgccgacatggtgacagagcttcttgtttccgcttctggagacttctccgaacacaatgaaaaggccattcggaacctagtcgaaaaattcatttcctccctgagttcgtctgatggcgtcgatgcagagcgcaggcagatgccgttcaccgcaaagaagctggaccaggccatccatgtcggctcccagaggaacatgtcctccacgctcggccttgctgggggtaatgtcgatctcgagtccgccaactccagaaaggtagagtcccgagtggaccgcaagaagctcgaaaaagcagaacgaaagattcgtgccaagcaggaaaagaagcagatgaaaacagtgcaatacgaagcatcccgtctcctcaaccagccagagagtactctgtcctatgaagagttcttcatggctgtcaacccacttcagctgggatcggattcgcaatctaagagcaaagatatcaaggtcgacagcattgacatttctatcggcggtcaccgcatcttaaccgacgcctcccttaccctagcttacggacgccgctatggtcttgtgggtcagaacggtatcggaaagtctactctcttgcgtgccctgagtcgccgagaggtagccattcccagccacatctcaattctacacgtcgagcaagaggtgcgcttatga

SEQ ID NO: 12275 - DNA, 210 bp, A.fumigatus
agcgatacagaaccttcaaacatgttggacgtgccatccattaccttcctatccaactacctccagtcatatcccagcactatccttgtagtgtctcacgatcgagcgttcctcaacgaggtggccacagatattgtgcaccagcattctgaaagactagactactacaagggagccaactttggtaaggatcattctcttgtcctctaa

SEQ ID NO: 12276 - DNA, 471 bp, A.fumigatus
taccccggcaattcaggctgttctcgacgcagacgtttggcggaaacgtcttcttgcagagcaagaggtgggcctcgctctatgacctcttccgttgagagtgagttagctgacgatttgcagaaaatcagtaaacaacttgcagcaattgaagcggaaaggtcgtctatggcagacacatcgaaagatgctgccaggcttgaccatgagagagagggtcttgatataactctgaatgatattcattccaagctggccgagatggaatccgacaaggcagaatctcgcgctgccagtatcctagccggtctcggcttctcaccggagagacagcaatatcctacgaagacgttctctggtggttggcgaatgagactggccctcgcacgggctttgttctgcgagccggacttacttctgcttgacggtaagcttcgtgcctctcaattccgaatcaagcatcaatattaa

SEQ ID NO: 12277 - DNA, 486 bp, A.fumigatus
cgacagacgccagccttcattgacaaattccgctataatgccgccaagtcatccgaagcgcagtcgagaatcaagaaactggagagaatgccagtcctggaacctccagagagtgactatgtcgtccattttaagtgtccagatgtcgagaagctttcccctccgattgtacagatgtcggatgtctcttttggctatagtaaagaccaactgctcctcagaaatgtggaactcgatgtccagcttgattcccgtattggtaatggtgggcccaacggcgctggtaagactacggtgctgaagctgttgactggtcaactccagccaacatccggcttaatctcgacccatgcaaggttgcggatcggctacttcgcgcaacaccatgttgacgcgctggatcttactaccagtgcggtgagcttcatggccaaaacctatcccggaaagacagatgaagagtatagacggcatctgggagcgtga

SEQ ID NO: 12278 - DNA, 195 bp, A.fumigatus
atggctgttgaactaagaaatagagatttccagcaaaaaagttttttccccttgtataataacaatgttctattcaaagcatatagccaacttctcacccaagacggaaattcgcaatgcagattgccaactgtaacggacacccagcccaaccagaacactccttggtctgtgttcccggccaggctaacgtag

SEQ ID NO: 12279 - DNA, 3168 bp, A.fumigatus
  unsure (2711): Identity of nucleotide sequences at the above locations are unknown.
gatttgccctttgcattgcgacacaatgggtggaaagaagaattctcgtttctcttccagaagcgccgctttctatactacccggagcgtcaatgtttcgcgcccttgtcgtacgtccttgacgcggagcccaagccccccgtcaaggtctttcagcaagcccagggcttaacctccaaggaagaaatcgatcgcatccagcatcactatggagacaacacgtttgatattcccgttccgacattcatggagctattcaaggagcatgctgtggcgcccttctttgttttccaggtcttctgcgttggcttgtggatgctggacgaatactggtactattctttgttcaccctgttcatgctggtcgtgttcgaaagcaccgttgtgtggcaacgtcagagaaccctcaacgagttccgtggcatgaacatcaagccttacgatgtttgggtgtatcgccaaaagaagtggcaagagttgacaagtgacaagcttctgcctggagatctgatgtccgttaatcgcaccaaggaggatagtggcgttgcttgtgacattctcttgattgaaggtagtgctattgtcaatgaggccatgctgtcgggcgagagcacacccctcctgaaggagtcgatccagcttagacccggcgacgacttgattgacccggacggtttggacaagaacgcctttgttcacggaggtaccaaggtattgcaaatcacccatcacaattcgaacggagaagatgggtcggagaaggcgcggaaactttcatccggggttcctcttcctccggacaatggcgctgttggtgtggttgtgaagactggtttcgagaccagccagggaagccttgttcgtaccatgatttattccaccgagcgcgtctccgccaacaacgttgaagccctgctgttcattcttttcctcctcatattcgccattgctgctgcatggtatgtgtggcaggagggtgtagcgaaggatcgcaaaagatcgaagctgcttcttgattgcgtccttatcgtcactagcgtcgttcctcccgaactgcctatggaactcagtcttgccgtcaacacgagtctggctgcactgagcaagtttgcaattttctgcaccgagcctttccgtatcccctttgccggacgtgtggatgtcgcttgttttgacaagactggcacattgactggcgaggacctggttgtcgacggtattgctggtctcaccctgggccacgagggtgccgatgttggaaaggacggcgctcacacggaacttgccaagtctgctaatgtcccactcgacacgaccctagttcttgcgagcgctcacgctctggtaaaattggacgaacgcgaagtcgttggtgatcccatggataaggcgacattgcagtggctcggctggactctgggccggaacgacactctcatgagcaaggctgctgcgctcgcaggcccccgcacagttgaatctgtgcagatcaagagacggttccagttctcatctgccctcaagcgtcaaagcacaattgctacagtggtaacggccgaccgtaagacgtccaagaagaacaaggctaccttcgtcggtgtcaagggtgctcctgaaactatcagaaccatgttggtcaacacgccaccgcactatgaagagaccttcaagtactttactcagaatggtgctcgagttcttgccctcgcatacaagtatctctccgaggaatccgagttgtcccagggacgtattaacggttatattcgtgaagaaatcgaagctgacgtgatttttgccggtttcctgtcccttcaatgtcctttgaaggaagacgctatcaaggcggtgcgcatgcttaatgaaagcagccaccgtgtggtcatgattaccggcgacaatcccttgacagccgttcatgtcgcgcgcaaagttgagattgtggaccgtgacgtccttatcttggacgctcctgaggacgacatgtccggcacaagactggtgtggagatccatcgatgacaagttcaaccgcgacgtggatccaactcaggacttggaccctgagattatcgaaacaaaggacatctgtatcaccggttacgctttggctaaattcaagggtcagaaggctttttcaacccttctgcgtcacacctgggtttatgctcgcgtgtcccccaagcagaaggaagatattcttgtcggactcaaggatgctggttacaccactctgatgtgcggtgacggaaccaacgacgtcggggctttgaagcaggcccacgttggtgttgcactgctgaacggatcgcccgaggatcttgcgaaaatcgcagaacactaccgcacgacaaagatgaaggaaatctatgagaagcaggtgtccatgatgcaacgtttcaatcagccacccccgcctgttcctgtccagattgcgcacctttaccccccgggaccacgcaacccgcactatcagaaggctatggaaagggaggctcaacgcaagggtgccgccacgctggccacggcaggaaaccagacagagcatatccccactatcacctcgcctggcgcgcaggctctgcagcaatccaatgccaacctgactcctcagcaacagcgacagcagcaagcttctattgcagctgccggcttcgctgacaagcttacatcttccatgttggagcaggaattagatgacagcgagccccntacaatcaagctgggagacgcttcggttgctgcgccgttcaccagcaagctagctaatgttatcgcgatccccaacatcctgcgtcaaggtcgttgtaccctggtggcgacaattcagatgtacaagatccttgcgctgaactgcctgatcagcgcctacagtttgagtgtcatctaccttgacggtatcaagtttggtgatggtcaggtcaccatcagcggcatgctcatgagtgtctgcttcctttcaatttcccgagccaaggtaagttacgtcatgcgtcatttgttacttggtgaccttgtgctaactctcgtgccagtccgtggagggtttgtccaaggagcggccccagccgaacattttcaatgtgtacatcattggctccgttctcggccagttcgccatccatatcgctactctgatctacctgtcgaactatgtctattccattga

SEQ ID NO: 12280 - DNA, 483 bp, A.fumigatus
ttcatgttactcacattgaccaggagaaaatccgacatcgatttggagggcgaattcgagccatcgcttctcaacagcgccatctacctcctgcagctcatccagcagatctccactttctccatcaactatcaaggccgaaccttccgagagtcgatccgcgagaacaaggcgatgtactggggcttggttgccgcatctggcgttgccttctcatgtgccactgagtttcatccggaattgaatgagaagatgcgccttgttccattcagcactgagtttaaagtcacactaactgtgttgatgatcattgactacgccggttgctggatcatcgaaaacgttttgaagaatctgttcagtgacttccggcccaaggacatcgcggttcgccggcccgatcaactgcagcgcgagatggagcgcaagaaacaagaggagttggagactcaggcagagaaggaacgacagaggaaggtctaa

SEQ ID NO: 12281 - DNA, 615 bp, A.fumigatus
atcctatgggacatgctattgacacccatgacagttcggaattccatgctttggactttcccaagggttgcagcccggcatggagggatcccagacctttttctaaaggacttcatgaagcgccacaaattccccaccgccgcgtatcagaacttctacgaatatgagcccgcacgtcaatatctggactctgtgaaccacaacgttgtcatcaaggcagatgggttggcagctggcaaaggtgtcattatccctcaaaccaaggaggaggcccacaaagcactccgcgaaatgatgctggatcatcactttggagatgctggtaatgaggttgttatcgaggagtatcttgagggtgatgaactcagtattctcaccttcagcgacggctatacgattcgctccctccctccagcacaggatcacaagcggatcttcgatggtgaccagggccctaacaccggcggaatgggctgctatgccccaactcccatctcatcaaaggaggttctggaggaaatcgaccgcaccattgtgcagccgacaattgacggcatgagaaaggatggttcgtctgaatccaacaaatttcgagctttatcggacggatgctaa

SEQ ID NO: 12282 - DNA, 534 bp, A.fumigatus
tgtgactcatacctctcaggtttgctcgagaaaactgcatccaaaatggctcaagaacaattgcgcgtccttgtggtcggcaacgggggacgcgagcatgcgtatgcctggaagctgagccaatcgcccctcgtcgatgtcgtctacgtcgctccaggcaatgggggtactgctcaaggcgcctctagcaagattaccaacgccaacgttaagggagacgattaccctgcccttgtcgagtttgcgcagaaaaatggtgtcaacctggtcgttcctgggcctgaggcgcctcttgtggacggtattcagggctatttacacgcaagtgggtggtttgttccctgctggaatctcttgaatatactgaatcctatgggacatgctattgacacccatgacagttcggaattccatgctttggactttcccaagggttgcagcccggcatggagggatcccagacctttttctaaaggacttcatgaagcgccacaaattccccaccgccgcgtatcagaacttctacgaatatga

SEQ ID NO: 12283 - DNA, 1701 bp, A.fumigatus
  unsure (1286): Identity of nucleotide sequences at the above locations are unknown.
atccaacaaatttcgagctttatcggacggatgctaataagttcggttaaatcaggtttcccctttgtgggtatcctattcaccggtctcatgatgaccaaggacggccctaaggtccttgaatacaatgtccgtggcggagacccggaaacccagaccttgctcccgttgctcagcgccgataccgacctggcccagatcatggttgcttgcactgaacactggcttgacggtgtggacatcaagatcgagcccaagttctctaccaccgtcattgcggtagcgggtggttaccccggctcctacgccaagggcaaggcaatcactctggatccggcacctgaagacacattgatcttccatgcgggcacgaaactcttcggcaacgaattgcagaccaacggtggccgtgttattgcttccaccgctactgcgtccaccctcgaggaagcactccgcaagagttacgctggcatctcagcaattcactttgaagacatgttctaccgcaaggatattgcgcatcgtgccttcagacagagagacgcagctgcttcccagcagcagcagtctctcacctatgcctctgctggtgtgtccatcgacgcgggtaatgatctcgtcaacaagattaagagctgtgtcgctcgtacgaagcgccctggcacggatgcagtgattggtggcttcggaggactcttctcccttgccgccgccaactctgcctaccaccctgagtctcccactctgatcggagcgattgatggcgtcggaaccaagttgaagattgcccacactgtgggtgtgcacaacaccgtaggaatcgatctggtggccatgaacgtcaacgacttggttgtccagggtgccgagcccctcttcttccttgactgctactcttgcggcaagctggatgtcgagaccgctgccgctttcgtggccggcgtcgcggacggctgcgtccaggcgggctgtgccttgatcggcggtgaaaccgcggagatgccaggtctcttcgtcgacgagacctacgacgccgtgggtgccgccgtgggtgccatcaacaccaccggtaagaacgccaagtccatcctgccggccaactctgccatgcaagccggtgatgttctgctcgcattggcgtcctctggccctcactccaacggatactcgttggtccgcaagatcgtcgagagatccggaataagctacgacgaccctgcccccttcaccatgccttcctcttcctccgaatctctgaccctgggtcgcgccctcctcacccntacccgcatttacgtcaagcccatcctgaaggctctgtcaatcccgccctccaacagctccagcggttcctccgccatcaagggtctcgctcacatcaccggtggcggtctggtcgagaacgtgccccgcatgcttccttcgaccctctcggcacacatcgacgtctccgcctggcaactgccccccgtcttctcctggcttaagaagaccggcaacgtcaccgcccccgagatggcgcgagccttcaactgtggtgtcggcatggtcattgtggttgagaagggatccgaggccgccgtcaaagaactcttcgagaaagagggtgaagttgtctaccaagtcggtgaactcaagcctcggcaggacggcgaggaaggctgtgtgcttgggggcttacagacctgggatgcatga

SEQ ID NO: 12284 - DNA, 282 bp, A.fumigatus
  unsure (85): Identity of nucleotide sequences at the above locations are unknown.
ttttttttcaaaaagggggctcaatttttttttcttcttccctcaagtcgggtgggacccacaatgtaccccgggattcttcggnccgtatgcagaaggaaatcactgcccttgctcccttcgtctatgaaggtcaagattattgctcctcctgagcgtaaatactctgtgtggattggtggttccattctggcctctctgtccaccttccagcagatgtggatctccaagcaggagtacgacgagagcggtccttcgatcgttcaccgcaagtgcttctaa

SEQ ID NO: 12285 - DNA, 846 bp, A.fumigatus
  unsure (38): Identity of nucleotide sequences at the above locations are unknown.
cagagccttcaggatgggcttgacgtaaatgcgggtangggtgaggagggcgcgacccagggtcagagattcggaggaagaggaaggcatggtgaagggggcagggtcgtcgtagcttattccggatctctcgacgatcttgcggaccaacgagtatccgttggagtgagggccagaggacgccaatgcgagcagaacatcaccggcttgcatggcagagttggccggcaggatggacttggcgttcttaccggtggtgttgatggcacccacggcggcacccacggcgtcgtaggtctcgtcgacgaagagacctggcatctccgcggtttcaccgccgatcaaggcacagcccgcctggacgcagccgtccgcgacgccggccacgaaagcggcagcggtctcgacatccagcttgccgcaagagtagcagtcaaggaagaagaggggctcggcaccctggacaaccaagtcgttgacgttcatggccaccagatcgattcctacggtgttgtgcacacccacagtgtgggcaatcttcaacttggttccgacgccatcaatcgctccgatcagagtgggagactcagggtggtaggcagagttggcggcggcaagggagaagagtcctccgaagccaccaatcactgcatccgtgccagggcgcttcgtacgagcgacacagctcttaatcttgttgacgagatcattacccgcgtcgatggacacaccagcagaggcataggtgagagactgctgctgctgggaagcagctgcgtctctctgtctgaaggcacgatgcgcaatatccttgcggtagaacatgtcttcaaagtgaattgctga

SEQ ID NO: 12286 - DNA, 1650 bp, A.fumigatus
  unsure (1243),(1264): Identity of nucleotide sequences at the above locations are unknown.
tacttgctggacaacgacgtcgagtattataacgaagcggaaccagtgacattactttgcccgttgcttcctggtcagccactcaatgtgctccaggttcccattatccttccagacacacggcctacacatacctttcaagacggctccagctccaggcagcctgatgtacggaccatgaacccagaggacaagtatatgaacccacggcggccgccaaagccaaagcttccccgactccgtacatccccgccactacttcaggcgccaaccccagcttggtccttcagtacgtctcctctgggagcattgaccaatagagcgacttcccagccaagcagctcagtaaacaaaacaccccgaagttctagctccaaggctgctcgctcggtgtcacccccgagatcaagaggccttcgggctgcagtccgctatctgaatgcttcatctcccgacctcagcaacacgcaccactccgacagggagcttgattcaaagggcgaagatgccgctggggtatgccgcaccggtagtagtggcaaaggccgctttgactttcccgagcagtcttgccatgccttcgctccggcctcgaccgccaagcattacgagcactcccttcatccagaagaccttctcttccgccgacctgtgtctgcggaccatgaaaaccctctgacaatgtccattcaggatcgtcgtgcattgaacataaaatccatagagcacttgtcgtgtaagagtcctctaactgttgagacgcagcctgacgatacgagcgcgagcgaagagtactcgtcaaaaactttttcatatatggctgcagagctactagcggccttagagtcgccgtcctttttgagaacggccactattcccgatgctacgacgcctacgccattcacatacaaggaaaagcggcttcctacgttacccaactcgccctcgtcagtgatggatgaagccctgcgtgatattgacgcccgcgagagagaactcgataccgagaacctaggaagtcgcttttctgacttcactgaaacggaaggctccgttgtcggcagctcctactgcgagagaagtcacttttcggaatggagtacagatacagagattatctctcccgagtccatgacctcctcttccactttcaacaacgaaacccagctgtcccacaatcccggcgacgcggaatctgcagaccggattgtacccttcttaggttcggacacgagcgatccanacactcctcacctgacagtgnattcgaaattgtcacccgcgacttccgttgcaagcgattcaccacgcttcaactttcctctcccccgcttgacggtgtcattttctccgtctgaccttgacatggcaggtctcggtattgaagacatgtgcaatgtggagagagaccccaaaagacatgcagcttttttcggcgccatgaatgctttcgagacgctgggtctggtgaaaagtcccgacgcgtccaccaccgagtttccggatggtgtccaaaacgacacggcttcgcttattgacaaccgggacgtatccaatcgccttagttgtgcttctacgtctatgctggatatgatggatgaattggcctatctacggaacgtgatccagtctggtactgccgaggaatag

SEQ ID NO: 12287 - DNA, 360 bp, A.fumigatus
tcagcatgcatattatgggctaccaagcccggtcctccttgccacacaacggcgattactgagatcctccatgcctctggggaggctgagaagctctatgagcttttacatgatttgggtgcaattggctgtctggcgtcggatgacagtacggatcttcaaaacctcctgtcactagtacgtgtccattggggacttactatacggtcgcgcaacgctaatgatggccagtctgttggagcgttgcaaatcttgggtatcgtgactatacgacacgaggtcgggatcggctacatcgaaattcaatccaagtgctatgatattgttgagacaagcgcggtgacaaggatgacgacctaa

SEQ ID NO: 12288 - DNA, 294 bp, A.fumigatus
cttgacactggcgcgactgacatcctctggatttcaacaggcacaatcctccacggcaccatcaccgctgtctctcctcagatgaacacctctctgcgcaccgtcaaaatgacacccaagggccgcgatcccatctctctagacacgatcaacatccgcggctccacgatccggtactacatcctccctgacagcttgcctctcgatactctgctcgtggacgaccagccaaaacccaagaacaaggcgcgcaaggagacggatcggggccgcggtcgcggtggtgcacggggc

SEQ ID NO: 12289 - DNA, 738 bp, A.fumigatus
gctctcttgtgttctgcaggagctggcccattgctgattatccagttcgtcaccgtggcatcagcgctcgcgctggcgcctaccgccgttgttgctcgccagggcgccgctgccttcgtcacagtgaactcgatagacgtttgtcccaaaaaggtggcccaggaaatcatcaatccgggaccgaaggtagttaccacgccctacacttgcgatcaagtgaagctcggtcatggcctggacgtgtcctactacaacttcgacatcgagcccctcaccaaggacacctttccttactgcaaggctctcaaggtctttgacaacgaaggttgcctgggcttccctactttatggatccccctcgagagcccacttgaggacaagtgcatccctgaacactacttcagcgacgaagtgaagtctatctcgttccagcttgattgccgcgaggacgcccctgtcaagaaggagccatatggccctaaggagggggctgaacaatctgcaccgcaggcagagcatagtactaagcaggacgctcaacagggttctcaccagggacaggaggtgcagaacagccctaagcaggaggctcgccaaggttccaggccggcagaggctgctcctaagcaggagcaggaagctgagcaagcttctgaggcagcgcccgagaaaaaggcctcaaaccctgctgacagtctcggcctgggcgaactcacaaaggtgctcggtttccggtga

SEQ ID NO: 12290 - DNA, 768 bp, A.fumigatus
  unsure (691),(694),(705),(733): Identity of nucleotide sequences at the above locations are unknown.
gggatcacgcctcagtgcaaaaaatcgtctctcttcctgcgaactatcaccgccatgcatttcaagaacgtaagacaaacctgcacctacattatgcacgatacaaactctgacagcatcgcattgcagcatctctccttcctcctgatcctgacacccgccctcgcctcaactacagcccgcatctgggccgaattcctgccctcctgtcctatcaaccgcatccacccagcctcagcagccccagaccaccttccgcacgaggagttcatctcagcgctcaacatctccccagggacctgcacaaacatcttcgtgccgctctcgtacggccacgaggtaacgcacatgtcctttgacgcggaagtcgaagtcgtaggcaccagacccgagaaatgcagaatttccatctacgaagtccccgggtgtgttggccagcctctcctcgacgaggaggtgaagcacggcttcgcgtctagtgattgcgtcgctaggaacttcgcctcgtataaccaggtctgggccatgttggactgcaaagagcaagacgcggatgaaaaagtgcagtcgactggacaaccggcgcatagccataagcccctgcttcatgaccatccttacctccatgtgaacaattcgacagacttggcgaatcagaatgcgcctttatgtgaaatgggaccgggtccanaancctgtgccaangccggtctcccctccggaagggcccttncctatacggctggtaggggtatccttcctcttggg

SEQ ID NO: 12291 - DNA, 537 bp, A.fumigatus
accttgctgtcatcactcggaatccgtacgcaacaggaagcgcacgcgaaggccgatcctatttgttcgaggagagcagtagccagagcggttattcgtgtaacctcgggcattttccttgcgatggcatcttctcgcaagctatctacacctagcgactatgcggaacttctgtgtcggtatgacacttggctcttcgactgcgacggggtgatatggtctggggatcatgctactgagggagctagcaaggcaatcgacttcttgagagaccatggaaaacgagtggtatttgtcacgaacaatgcggcacgaagtcggaagatgctgaagaccaagtttgacagactgcgaatcgcagccagtgaggtacgggccaagtgtctggaggatgggccaccaactgacatatcccaaccaggacgagattgtatccagttccttcgcagcagctgtgtatctcaaggaagtgctcaagtttcctgccgatcggaaggtgtttgtcatgggaatggaaggggtcgaagcggaacttga

SEQ ID NO: 12292 - DNA, 357 bp, A.fumigatus
ccgcagcttgtaggcgccggttctctcgttacgccattgatcgcctcgacgaagcgcaacccgatcgtgattggcaaaccgcatgcgcccatgcttgacacggtcaagtcgctatacaacatcgacccaacccggacgatcttcgtgggggacaacctgtacacggatatcctgtttgcccgaaaaggccgtgtggattcccttctggtccttacaggggtcacaaaagaagaggactgtcaaaccgaaggcatatggcccaccttcattgcgccgagtatcagcaacatcgtcgcggcggaatcgggcccgtcgatcattgcagatggaaccagcaccatccatgcatcactatag

SEQ ID NO: 12293 - DNA, 549 bp, A.fumigatus
agaccaagtttgacagactgcgaatcgcagccagtgaggtacgggccaagtgtctggaggatgggccaccaactgacatatcccaaccaggacgagattgtatccagttccttcgcagcagctgtgtatctcaaggaagtgctcaagtttcctgccgatcggaaggtgtttgtcatgggaatggaaggggtcgaagcggaacttgatgccgtccacatcaagcgatgcggaggaaccggcccggaggacaacaagttcctcgccgcaaacgactattcttcgctagccggggaggaggcgatcgatcccagtgtaggtgcagtggtgtgtgggttcgacatgcacatgaactacggcaaactctgcaaagcattcaaatacttgacgcgcgacggagctcaagggcccgttcttgcaggcgagacgggaggcggttgtcatttcattctaaccaacgacgataaggtggttccggctttaggagagctatggcctggtagtgatcctgttcctacgaagacgcgagcagtcgctgaccgcagcttgtag

SEQ ID NO: 12294 - DNA, 285 bp, A.fumigatus
cagcttgcttcagaactcgtgcacctcaaggtggagaatgaagagctctctgacatcaatgatgctctgaaacttcaggttagcgagctgaagattgttgtggacaagcagcccgcagaggttgaggagaagcttcgcacagaaatggaccggataatgaagcgcaacatggaagttcaaaacgaaaatcggtctttgtcagagcagatggcagaaatggagagggagcttgtggaggcgaagatgcaatgggctgaggtaagcattcagcgattgctaagatga

SEQ ID NO: 12295 - DNA, 231 bp, A.fumigatus
caggacgcatttgaacaggatgggaaaccgtatattctcagcgccgcggctggcgagtcgttccccgatcctcgcaacaagggcttcaatatctctgtgaagacgacctttgcctcattggaggacatggagtactatgataaagagtgtgaggcgcataaggcgctgagagctgtggcggggccggtgaaggaagatgttctcacaacttatttcgagagtgttctgtga

SEQ ID NO: 12296 - DNA, 297 bp, A.fumigatus
cgaggcgtatcattcctcgaagtccccggtgctcactactcggacctgcgtcagcgactgtcacacaccggactgacactcgaagaggatattgccgttctggaaaagcttcatattctggttgactttgacgagaagggatatttgctccaaattttttccaaacatgtgctcgaccggcccacggtgttcatcgaagtcatccagcgcaacaactttgacggctttggagctggaaatttcaagagtctgttcgaggcttttgaacgtgagcaagcacgaagaggtaatctttag

SEQ ID NO: 12297 - DNA, 2244 bp, A.fumigatus
tcgatgccaaagagctatccggaattggcaaatacaccgcaatacactagccgtgcgcgcatcatctccgtcttcttcaagtccctttattcacgatcccacgatgtcatcgaggcggccaacgcaggtctcagggatgtcctcacacagacgaacaagctgcccaaggacctacttcagaatggccttcgccccatcctcatgaacctacaggaccccaaacgccttagcgtggcaggtctggacggccttgcacgcctccttaccctgctgacgaactacttcaaggttgagattggtgcccggctgttggatcacatgaaggttatagcggatgatgcggtgttgcaaaaggtgtcgtttagccttgtcgagcagaaccagacaattaagattgtcaccgcgatcttcaacatattccatcttcttcctccagccgccacatcattcatggagcaccttgtgaataaagtgttggaacttgaagagaagcttcgccggacgtctaacagcccgttccggaaaccgcttgtcaagtatctcaatcgctatcccaaggagagtctggcattctttcaagctcgctttaaagaggagcgcttcggacgattctttggccagattctcgccgacccggaaagtgaggcgttgcgtgctgcagtcgtagcagacaccgagggcttcaagtcagctgtttttggacaagactcatccgatggcaggaatactgctgccattaacggtatctatgtcgtgcattctgtgtgctcgtacgaagccaccaagcgctggctggtttcgcacggggatcttaaaaccatgctactcaacgctggacgtgatcttgagaaaaagctgcgcagtgatcgacttccagcaaacgaacgtctgagggtggagcaagcggaggaccagttgatggatattttcaccatttacctgtccgagtcggtgcaggacctggatttcctctttgacctgatagatggtctctcgtcagaagaactgaaacgtacgctagcattccccaagttcatctaccgccacatcatcaccaacgaatccatcgactaccggcggtcagtgataatgcgttgcctcgacctttacggccaacgcacttgctcgcagaagatgaaaacgtacgcctttcacaatctggtcaacccaatattcgccatggacgtccaaacaacatggaacagcccttccaacagcccgaagctgatggacaagagcatgaccgaatcaattcaaagccgtctctggaggcctcagttagctgatttgagtgaggagtctactcaagctggtgtggaccattcacgtatggaattgctccagctgtcagctttgttgatcaaataccatcatcagaccgtccaagattctcggagggatatcattaagtttgcttggaattacatccggcttgaggatataatcaacaagtatggagcctatgtgctcatcagttacttcattgcccactatgagacgccttttaaaattgtggttcaggtctacgtcgctttgttgcgagcgcatcaaaacgagggcaaagcccttgtcactcaggctcttgacgttctggctcccgttttgccctcgaggataatgtctgcaacgagcaatgctcaggcgcccgacacacggtatccgttgtgggcgaagtggcctcgacgcatcttagcggaagagactgcgaatctgcaacaagtcatgagcatctttcaattccttgtgcggcatcccaacctcttttatgaatctagagagcacttcgttccacttatcgttccctctttgatcaaaattgcggcacctcccaattcgaataatgaaagcaagaagcttgctctgaatctaattggtctgatttggcaatgggaacagaggagggttaccagcagccgtactgctatgaccaatggcatcttggagtcgccaaatgccaggaagcgcaaacttgacgatacgcaaggcacatattcaccttctgcagcgcttggtcctcctagctctcacgaacgcactgagtacatcatcccttcagacctgcgagctgcaatgacgaagtacctgattacattcattacaaccgtgcctgagcggttccccgttccagctgctcggttccgagagctaccctcgtcaaaaccgcagccacagcagccgcccatcctgactggcgacatgatcaagaaagccgtattcttgctcaggaatcttctctcaacctga

SEQ ID NO: 12298 - DNA, 1986 bp, A.fumigatus
tcaagaaagccgtattcttgctcaggaatcttctctcaacctgagtactggggcgatcttgatattgagttgtatcagaagatcaccgagccaattcttgccggcgaaaaggcagacaagccggacgaaaagcacatcaccagcatgattaatgctttgcaggtcgttcgtgtgcttctcgcggttaagcccgatgaatggataactgctcgccttccgctcgttcaaaaattattcgagaagcccttgcgctcagacaatccggaaattcaggattctcttcatggtgtagaggatagcatggatatttcgcccaaactgcccccccccgtacgacgcgttcttgatgctttgccggaagatcaaccggaggaggaggacgccatggatgttgagaactcgccctctgaatttgtcacttacctttcggccatcgcgacagagactctttcggcgaacaattacatttcgagcctcaacaccctctggacgctttcaaagaacaaaccagctgagatggacacccatattctcccagttatgaaggccttctctcagaaactggcgaaagagcatgttgcagcatcgacgaacaatcagcaagcccagtatccacccggagccgccaaacctgcagagaatctgcctgatcaacaggaatatgaaattggggttgacctgattcttaagacaatcgagttgatctccgtgcgcatgtctcacctcggcgagcaaagacgtcctttcctgagtgtacttgcgcagttggtggaacggtcgcagaatgaggccctttgcaccaagatactgaatatggttgaaacctggatcttccattccaccgagtcttggccgaccctgaaggagaagactgccgtcttacacaagatgttacttttcgagactcgagcggaccagaaaatgctgaagaagttcttggatctggtgatcaggatctacgaagattctaagatcacacgcaccgagctcacagttaggctggagcatgcattcctaatcggcactagagcgcaggatgttgaaatgcgtaatcggttcatgaacattttcgatcggagtttgaccagactagccagctccaggctaagctatgttcttacctgccagaattgggacactctcgcggactctttctggctcgctcaagcctcccatctcatactgggatgtgtcgacatgacagcaccggctaggcttcaccctgacgatttcaccgtctatcctctgtctttccttctgagcaatgctgaaaaagacgcaaggaaggctgatatcatggtcgatattcagttggaggcttttatctccgatcgcaagcgattcatagccgacataggcgacgtgagaattcgagatttgatggaaccgctctgccagctccagcatacggacccaagagtcgcctacagtctgtggaccacattgttcccgatcttctggtctactttgtccagggaggaccgtatcgacttagagaagggcatggtgacgctcatcacacgcgaataccatcaaagacagttggacaagaggccaaatgttgtgcaagctctgcttgaaggtgccgtcaggtccaagccccgatttaaagtccctcctcatgtgatgaagtacctcagtcggacttatgacgcgtggtacacagctgctagctatttggaggaatccgcaatcagcccaatcattgataccccgactgtacgtgagagtaacctggatgcgttggtagaagtatatgcgggtctacaagaagatgacttcttctatggtacctggcggcgtcgatgcaagttcgttgaaaccaacgctgccctctcatatgaacagcagggaatgtggaataaggcccagcagctttacgaaaatgctcagattaaggcacggtccggtgcaatgccattttcgcaaggcgaatatcatctggtcttcacctcgagctcgccggaaccgcacatagcctatagg

SEQ ID NO: 12299 - DNA, 243 bp, A.fumigatus
tggctgcctacaagcacgagggaatggatcccaccccgtactactggtacaccgatcagagaaagtaagtttgcctgccatgctaccttcgaatttacgtctaatcattgctctaggtacggcacatcccctcatggtggatacggcctcggtctcgaacggttcctcgcttggttgtgtgcccgctacacagtccgagactgttgtctgtatccccgtttcaccggtcgttgcacaccttga

SEQ ID NO: 12300 - DNA, 1254 bp, A.fumigatus
acggaagatccttctttgcccaagcctgttcgaattcgcttggatgtcaccgacccagccatcgtcaagcttggatcccccgaaacacaaactgcgggtactcgtgtccgtgtgttgggacgagtccatcgcctgcgcgtccagaaggatgtgatttttctgactcttagtgacggctacggctacttgcagtgtgttctgaccggaaacctgaccaagacctacgacgccatgactctcactctcgaaacctccatggccatccatggagagatgcgcgcggtgcctcccaagcagcatgcgcccaacgaccgggaactgcatgcggatttcttcaccgtcattggtcgcgctgccggtgacaaggaggccatcaccacccgtgtggccaaggacgccgacccccagaccctttacgacaaccgtcacctcgtcctccgtggagagatctcctcggccgtgatgaaggtgcgtgccgcctgcctcaaggctttccgtcaggtatttgaggagaagcgcatgctggaagtgaccccgcctgccatggtgcagacgcaagtcgagggtggtagcaccctgttcaaattcgactactacggcgaagacgcatacctcacccaatcctcccagctatacgtggaaacctgcctgccctctgtgggtgacgttttctgtgtctgcccttccttccgcgccgaaaagtccctcacccgtcgtcatttgtccgagtacacccacatcgaggcagagctcgacttcatcaccttcaccgacctgctcgaccacctcgaagaggtcatctgccgggtcattgagctgaccctcgccaaccccgccaccgctgccctcatcaagcagctcaaccccgacttcaaaccccccagtcgccccttccgtcgcatgaagtacgccgacgctattcagtggttggtggaacatgacatccccaatgaggagggcaagccccaccagttcggtgacgatatcgccgaagctgccgagcgcaagatgaccgacatcatcaaccagcccatcttcctgacccatttccccgccgagatcaaggccttctacatgaagaaggatcctgaagatcgccgcgtcaccgagagtgtcgacgtcctcatgcctggtgtcggcgagattgtcggcggcagtatgagaatggacgactgggacgaactgatggctgcctacaagcacgagggaatggatcccaccccgtactactggtacaccgatcagagaaagtaa

SEQ ID NO: 12301 - DNA, 291 bp, A.fumigatus
atgttaaccgatgttaggcaagatcccaacgctcaacctagccagcagctcgagctcgaagccgcctttccacaatctcagccccagaacggacgcatcgaggacacggaatattatacaaactttcttgagcagcttctggggttggttcctcatggcgaccaggaaagcgtttctcgcatgatatccgtcatccgttctggggcctcccaggaagaaatcctcaaaacattatccgaaatttcgaccaacatccgtaacggtcaagagggaaacaggggtaacagatga

SEQ ID NO: 12302 - DNA, 660 bp, A.fumigatus
ttagacgtaaattcgaaggtagcatggcaggcaaacttactttctctgatcggtgtaccagtagtacggggtgggatccattccctcgtgcttgtaggcagccatcagttcgtcccagtcgtccattctcatactgccgccgacaatctcgccgacaccaggcatgaggacgtcgacactctcggtgacgcggcgatcttcaggatccttcttcatgtagaaggccttgatctcggcggggaaatgggtcaggaagatgggctggttgatgatgtcggtcatcttgcgctcggcagcttcggcgatatcgtcaccgaactggtggggcttgccctcctcattggggatgtcatgttccaccaaccactgaatagcgtcggcgtacttcatgcgacggaaggggcgactggggggtttgaagtcggggttgagctgcttgatgagggcagcggtggcggggttggcgagggtcagctcaatgacccggcagatgacctcttcgaggtggtcgagcaggtcggtgaaggtgatgaagtcgagctctgcctcgatgtgggtgtactcggacaaatgacgacgggtgagggacttttcggcgcggaaggaagggcagacacagaaaacgtcacccacagagggcaggcaggtttccacgtatag

SEQ ID NO: 12303 - DNA, 417 bp, A.fumigatus
caacgtgactggtctgatgtgagccgcgaccgcttcaaacatggaatcaaagtgctaaaggttctcagttatgccgctttcgaaacatccgagtcctccacccgagcaatcctatgcgctctcatgcgagatcctgtacgctaccgcaatctacagcaggagatccggtcaaatttctccgctagcaagcccatcaccgacagccaactcgtagggcttccataccttactgcctgcataaacgagggactgagactctggcccggactgaacgggcaattcacgagccgtgtttcgacaggcgcggtggtagacggggtctacgttccccctggagtacgtcgcatgattcctctcccttcatatttcttctccctcttgtcgtgcctttttgttattcttgaatcccgcaactga

SEQ ID NO: 12304 - DNA, 222 bp, A.fumigatus
acccgaaaaacccagacgaaatgcgcgcattccggccgttttccgcaggggccccgctcgtgtccaggccggcagatcgcgctgcagaagcttcggctcacgctcgccaaattcatgttctttgttgatatgcaagttgtcaatccccagttcgagtgggaccggaatgtgcccgtcggccctttggtggagctcggtcgaggtcatggtgcggatgaaccc

SEQ ID NO: 12305 - DNA, 195 bp, A.fumigatus
acacacgaagccctccgagccacccccctggtcgagctttccagcttgcagcaggatgaagcccttatctccaacaaatatcccgtgcattccatgctcatcacaatcacccaaacgcataagcttccctatcccttgctccaacgtggtatgccaatgcgcactcgctctcgttttagaaatctttcagcgtag

SEQ ID NO: 12306 - DNA, 198 bp, A.fumigatus
ccagatgcgtcgtggatagacaactggaacagccagaaaactcaccaaaacctgatcggggttgccttcgcgctgggttcgttccttctgagcaggcgcggactcaagatgctcgtcgatagctttggtcctttctggataccaaaatacctcgacccagcgcacctaattgatgttgcattgaagcagtacgtctga

SEQ ID NO: 12307 - DNA, 246 bp, A.fumigatus
atcccgcaactgacaggattcgacgtacagtgcttagtctcggcggacctgtacacccttcagcgccacccgaggtattggcacgacccggacaccttcaagcccgaacgctggttagacccgaaaaacccagacgaaatgcgcgcattccggccgttttccgcaggggccccgctcgtgtccaggccggcagatcgcgctgcagaagcttcggctcacgctcgccaaattcatgttctttgttga

SEQ ID NO: 12308 - DNA, 213 bp, A.fumigatus
aatctgattacgtacagaacagcatacagtccggaaacgcgtcgaatacaagcatcgctccgcgtggagaatgcccagactgactgtcagtttttcccttttaaacccactctgctaccgcccctcgtttcgtttagtgatcgtcagggcgtcgagttgaatggtcgaaatatcccatgggttgtgtttgggacccatcgaggtatcatctaa

SEQ ID NO: 12309 - DNA, 453 bp, A.fumigatus
gtgcagagtcgcattccttggtacctgttcaggtcatcaagacccggaaggacaccactgagaatggagtcggttgatactgtggctcctgtgcttccaacaactcagcgtactgtgatcatagaagctggagatcgggtgcgcgtccgagacgatatgcctttgcctacgcttgagaaacaccagttcttgatccgaacggaggccgtggtaatcaatcctagcgacaccaaaacgcgtggcccctgcgtgactcctggtggtgttctaggtactgattataccgcaaccgtcgtcgcttgtaggccagaggtcacagaggtcaaggttggtgacagggtgtgtggagctcaacatgccatgaacgccaacacacctcatcgtggatcattcggagaacacgacatttctagtatgattatcaaggaagatgctgctagttcaagtccgtga

SEQ ID NO: 12310 - DNA, 333 bp, A.fumigatus
caactcggtctccttcaaaggcaccgaagcatcccgatagatgccgcagttgatgtggacctctccttgagtggtaaacttcaccgcgttgccaacgagattgatgaggacctgacgaatgcggaacctatcgccaattaccataggtggcacattcacatccatcaagtaattgagctcgagtcccttgtcgagagctctagaagaaatggtatctattacatcctcaaccacagaccggacatggaaccaggagttgaccaaggacatctttccagcctcaacccgagagacatcgaggatattgtccaccagctcgcgcaagttggttga

SEQ ID NO: 12311 - DNA, 2340 bp, A.fumigatus
gggaaatgctggtattggattgattttttccttgacatacacgagcagcatgttgcagaattgaaagctgcacaagagcgccaaaggttcgcgatcgatgctaagtatcgagcgttctcgaactccatcccgcaagtcgtgttcgaggcaattgaacatcggggccttatttttgtgaatgagcaatggcatctgtatacggggcagaaacttgaagaggctcttgacttcggtttcgcaaaacatgtgcatcccgacgatttggagaaatgcggctcgctctccgtttacattgcagatttacagaataaaacgaccgccgactctacggggaaggacggttgtactgggacagagaaagcaggaactccggggcgacagttcagccaaggcgttacgcctgcattagctgaactcgtcaggcttgggatcgcttccgtccagaaggacgagaatgggcgagtgttctattcgacagagattcgcattcgttccaaaggtggcgactacaggtggcatcttgtacgcttagttcgagttgagaccagcagttttggcagcggggaagcctcgtggtatggcacttgcaccgatatcaacgaccgcaaaaatctggagagggaactcaataaagcgatgcaacaactgaacaaccagatggagtcgaaaacgaaatttttcagcaatatgtcacatgaaatccgaactccgcttaatggaattcttggcaccattccattcattcttgatacgcagctcgatactgaccagaggcgcatgctcgataccattcaaaacagttcaaccaacttgcgcgagctggtggacaatatcctcgatgtctctcgggttgaggctggaaagatgtccttggtcaactcctggttccatgtccggtctgtggttgaggatgtaatagataccatttcttctagagctctcgacaagggactcgagctcaattacttgatggatgtgaatgtgccacctatggtaattggcgataggttccgcattcgtcaggtcctcatcaatctcgttggcaacgcggtgaagtttaccactcaaggagaggtccacatcaactgcggcatctatcgggatgcttcggtgcctttgaaggagaccgagttgttattgaattttgatgttgttgacaccgggaagggattcagcgccagggacgccgagcgcttgatgcaacggttcagtcaacttggagaaaatgcctcgcagcaaaacgcaggcagcggactggggctgtttttatccaagcagctggtcgaaatgcacgggggccggttaactcccagcagcaaggagggacagggtgctacgttctcgttctttgttaaggtcgatgctccgcctcctccttcaccggatgaccctcgtctagttcgacagtcctcgagcacgtccgatctcggaacgcagtcaaaacccgagccactgcagagaatgctcttcgcgagagaatctgctgattctagatcagatctagctgatctgtctcccgccctcgaatcacccctctctcagccttccagtagcgtcgacccctccgcgcgtgctacgttcaacaacttttccgaacactcgtcaatgtcgtcggctatgccgaccccagacatccatggtacagagccacttccaaaaattgaatgttccaggcatcccgttcagtcagatagcaccgaaaaccgagggatagcaccgacttcctccagccaggatgcttcgcgctccctgtatcggccctctgaatccgggctggaaccccttgctaggagatcccaggccttcgagacccctcagagcctctactccatcgtcatcttgtgcccattcgactacgcccacaaagctattaaacagcacatcgagcaagtcgtccctcatgatattccattctcgatcgcatccatgcctgatgtggaagactggagggactcaatgagtgacggcgccacacctcagccgactcacttggtccttaacctaccaagcgttgaagaagtgttggatatgatctcgtatgtcgcggagtgtgatcaggtcactgctcccgcgcttgtcatcatttgcgacctcgttcagaaacgtcagatcaattcgagtttgaaagatttgtcttcaagcggaaagcgcgtcttcaccgttcctaaaccggtcaagccatcagcgttctcggctatttttgaccccgacaaccagcgcgatctgagcaaagataggaatcaagacatggcccgagagataaacaataatttcaagaccatgtcgaagatggtgaaggaggtcatcggaaataaaggctatcgaatattggctggttga

SEQ ID NO: 12312 - DNA, 315 bp, A.fumigatus
cacgttacttgccagtgtgatatccaaatgccggtcaaaaatggttacgaaacgtgtcgtgagattcgcagatgggaaatgaagaatcactatccccagattcctattatggctctctccgccaatgcgatgaccgatcaaattgagaatgctgcacgtgctggtttcaatgattatgtgacgaaacctatcaaacacaacgaacttggaaaaatgatgatgggacttctcgctcctgatcgccctttgcttcttcgtgatcgtctgaaacctgatcacgacggtcatctgtctgatgcatcgcactctcagtga

SEQ ID NO: 12313 - DNA, 1998 bp, A.fumigatus
cttgacaatctctatcagaaattcgcccacgcaaaccttctttcggagggacatatcgatgatccattgacgtcattaccctggcttcctgtcgtccttcagagtgctggaaactcgcgacatttggccagttggactcccgagtcggcctcgtatgactgtttcaagctagagatagctacactggcgcagcgagagactgtgtacaaagagtcttcaactagtcctcaattactagagtttggaaagcacctcgagtctgctcatcgccttgtttgcgccgatcgatatcacaaaaaggctccgatcgcatgttatcaatgtactctccattgttcaacagataggaagtcatttcggcttgagacgtttattctatggagagattctctggatatcatcgatgaaaagttgctaagtgccggggcgcttgatacgtttgcgaaatatgtgctacagcgtgatgccgaggtggacaacaaggcgcgcgataggggtttcgcgccagcagtcatttggtcgccccgagatttctacgataatgtccatgttcccaaagacgcacctgagtcatctgcagaaatcaagtccgacctgatacattgtcggctttatccattccaacggagggcagtacgatggttactcgaaagggaaggtgtgaagcttcaggagaatggacacgttttgcccctggaggacaaatcgacgagtgaactgcctacgtcattcgagaaacgtacagacgctgaggggaaaacgtactatgttagccccttgttcgtgaccgtcacatccgatctttccaattggtacgcaccggcggactatctcaagggcggtattcttgctgaagagatggggctgggcaagactgtggaaatgatcagtctgatgtgcctccatcgtcggcccttgcaacctgatatggatttggaaattggtgggatgagacaatccggtgcaacattgatcatcacacctcctgctattctccagcaatggatgcaggaaattcagctgcatgcaccggctctccacgttcttcattatacaggtataaatcgccatcagaagctttcagaccgcgaacttgttgaactacttgccgaccaggatgtcgttctcaccacatatgatgtacttgcacgagaaatccattattccggtgctgctccaaaacgtaatttgcgacatgagaaaagatttcagccacgaaaatcgcctcttgttgaaatatcatggtggcgagtctgtcttgacgaagctcaaatgattgagagtggcgtgagcaatgcagcaaaggtcgcacgtctgatacctcgccagaatgcgtgggctgttaccggtacacctcttcgaaaagatatctctgaccttctcggacttttactttaccttcactatgaaccgttctgtgggttcgtgtggaataggctctgtcgatcgtttcactctgtgctatccggcattgtcagtcgagtcgcccttcggcacagcaaggactatgttcgcagtgagcttgatttgccgtcccaaaagagatttgtgatcactattcctttcacggcggtcgaagaacagcattatgcacaattatttgagcaaatggccgaagattgcggcctagacatgtccggtgcgccacttaaagacgattggaatccagaggaccaagccgttgtagagaagatgcggagttggctaatgagactccgtcaagcatgtctctatccggctggaagtggtcgtcgtgtcttaggtttcggtggcggcccgctacgttctgttgccgaggttcttgagataatgatcgatcaaaatgatgcccttgtccatgcagaagagcgcgctctcatccagtctcagcttcgacgggggcagctcctggaaaatgccttgcgtcgtccacaagcacttgaactttggaccaagtcatatgagcggtccagtgcactagtcaaggaatgtcgcatccggctacagtcagaaccttga

SEQ ID NO: 12314 - DNA, 729 bp, A.fumigatus
cattgtactatacattacaatatggtgtattctgctgctgcgattctacctatatccatataccttcaaattatcactcacgcatccaacagagtcattgtttgtgcctgcgtctatcgtctcattcggaacaatgttgatcaatatttctcagtacggtccagaggctacaggaccttggctaagtcatgccgtcggtgtgttattttggatcgatgcggctcttgcagtgatcctctctgccggtatctacctgctactgtatgtgacattcttcttgctcactatatgatggaatgctcaccttgccttaggtggtcgactcagacgttcacgatagcccaaatgacacctatatggatcttcccggcgtaccctatgttgataatagggccccatgcaggaatcctaagtgcaaaacttgaaccttctcgggccttacccatcatcattgggggaacaactatacagggaatagggctgctagtaacccttaccgtttactcggcctatgtctacagactttttagtcagaaattgcctagggaaaatgtgcgtcccggaatgtttgtctctgttggtcccagtgccttcactgtctcaggacttgtgaccatggctgcccatgcaaagcgatgctttccggatgactttatgggcaacggcgccctggctgcgaatatcctcgaagtggttgtcaatttcgcttgtctgtggctctgggggtga

SEQ ID NO: 12315 - DNA, 354 bp, A.fumigatus
gaattagttccttataaatttcgcgggcttgaaatgattggcaccatagtcttcctgtttaacattgtactatacattacaatatggtgtattctgctgctgcgattctacctatatccatataccttcaaattatcactcacgcatccaacagagtcattgtttgtgcctgcgtctatcgtctcattcggaacaatgttgatcaatatttctcagtacggtccagaggctacaggaccttggctaagtcatgccgtcggtgtgttattttggatcgatgcggctcttgcagtgatcctctctgccggtatctacctgctactgtatgtgacattcttcttgctcactatatga

SEQ ID NO: 12316 - DNA, 360 bp, A.fumigatus
catctacatagcctggcgatatttttcttttttattgccacttttgcccactggtcaaccatcggccctggcagaatgaatttttcaatggcatggttctcatttgtcttccccaacactgccctgatcaccgccacgttcgccattgggaacgctttctcatgcaagccgattctgatcataggctgcgccatgatttttcctctcatactaatgtatatctttgtcttttacatgatgattcgagccatcgtgttacggcaaattatgtggccacagaagggcgaggacaaggatgagggtggatttgagattaatcgaaccaagcccgagacccctggtgaacagactcctgtataa

SEQ ID NO: 12317 - DNA, 354 bp, A.fumigatus
  unsure (207): Identity of nucleotide sequences at the above locations are unknown.
ggcgggcagtcgttcccttcccttcccccaccaattagcaaaatctttaattggccaaagaatgcttccaccaagccttttacggcaagtttgcctcaatcccatgtggcatggtgtcagaattcttggttccatccctcagtttcggcatcgatcagatgcggcaacaccaccagtgacacaggcctttttttttttttttttttnaaatgtcttggcttctcctcctctactttttactggatacctaagggacattctgattttatctcgcacaaaaatcccctcgaagctgttgcccgctcattgatcttcttctatcgagaatttacccttccacgattccttctttga

SEQ ID NO: 12318 - DNA, 684 bp, A.fumigatus
gtgtcgcccgtcccgtttcgaagattagcgctccgaatgacacaacaaagaaaaaccattgccgtcgtgaatgcgacgggccgccaggctgcctcccttatccgcgtcgcttctgccgtcggccataatgtacgagctcagatccattccctcaaggggatcatagcggaggagctgcagggactacccaatgtcacactcttccaaggatcgctgctcaataacaccgcattgatggacactctgttccaaggcgcgaacctggcgttcatcaacacaacatcacaaatgggtgacgaggtcgcgattggaaaagcactggcggacgctgcgaagcgagcagggtccatccaacactacgtctacagcagtatgccagatcattcggttcatggcccatggccccccgtacccctatgggctcccaagttcaccgtcgaaaactacatccgacagcttggattgcctgcgacctttgtgtatgcagggatttacaacaacaacttcacaagtctcccttaccctctctttcagatggagctcatgccggacggcagctttgaatggcatgcgccgttcgacccggacactccattgccttggttagacgctgaacacgacgtggggcctgcgctgcttcagattttcaaggacgggcccaagaagtggcacggtcatcggtag

SEQ ID NO: 12319 - DNA, 276 bp, A.fumigatus
acacgacgtggggcctgcgctgcttcagattttcaaggacgggcccaagaagtggcacggtcatcggtaggttccccgagaggaataccccggtcatggaagacagttgctgatggttctctgtcgcacaggatcgcccttacattcgagaccttatcgcccaaccaggtgtgcgcagctttctcgcgcgccttgaatcgtccatgtcgttacgtgcatgtccccaaaattgaaatcaaagtcaacatccccgccggataccgggaacagctctaa

SEQ ID NO: 12320 - DNA, 510 bp, A.fumigatus
tcaacatcgtccacggctctgccaagaccgttgacttcatcctcgacgagccagccattaaagctatcagttttgttggtagcaaccgtgcaggtaaatacatctacacccggggctctgcccaatggtaagcgtgtccaggccaacctgggtgcgaagaaccatgctgcggtgctgccgaactgcaacaagaaccagaccctgaacgccatcgtcggtgctgccttcggcgccgctggacaactgtgcatggccctgagcacagttgtcatggttggagaaaccaaagaatggcttcccgagatggcggagcgagccaaggctctcaacgtcaacggcggtttcgaaaagggtgccgatctcggccctgtcatcagccccgagagcaagaagcgcatcgaagacttgatcgccagtgctgaacaggagggtgccaccatccttctggatggcaggggctataagcctgagaagtatcccaacggcaactttgtaagcttaccctcctaa

SEQ ID NO: 12321 - DNA, 435 bp, A.fumigatus
tcctttcagccgcgtggtgagcatggctggcgggcaaccagcattatcgccaggcagcagatcatgttcaagtttgtcaacctcatccgtgccaactgggaccgtctcgcagcgtccatcaccctcgagcagggcaagacctttgctgatgccaagggtgacgtccttcgcggtttgcaagttgcagagaccgcttgtggcatcaccacccaattgaccggtgaggtcctcgaagtggccaaggatatggagactagaagctacagggagcccctgggagtcgttgcggctatttgccctttcagtaagtccttgccttccatcgcttgtccggtggatccctcccgttctttctccgtgactaaccgctccacccgtagacttccccgcaatgatccctctttggtgcattcctatcgctacgattaccggtaa

SEQ ID NO: 12322 - DNA, 366 bp, A.fumigatus
gtcggcccaactatcatcaccaacgtgacgcctgacatgaaatgctacaaggaggaaatcttcggccctgtcctcatctgcctcaacgtccccacgctggacgacgccattgaactcatcaacaagaacgagtatggtaacggagccgccgtcttcacttgctccggctcgaccgcctcgcgcttccagaaggacattgaggccggccaggtcggcatcaatgtccccatccccgtccccctacccatgttctccttcaccggcaacaagaagagtattgccggtggcggtgcccaacaccttttacggcaagcccggcctgcaattctacacccagcagaagaccgtgaccagcctgtggcgtag

SEQ ID NO: 12323 - DNA, 297 bp, A.fumigatus
  unsure (127): Identity of nucleotide sequences at the above locations are unknown.
ctaaccgctccacccgtagacttccccgcaatgatccctctttggtgcattcctatcgctacgattaccggtaactgcatcatcctgaagccttcggagcgggaccccggagctgccatgatactancggagctggcccgggaggccggctttcctccgggtgtgatcaacatcgtccacggctctgccaagaccgttgacttcatcctcgacgagccagccattaaagctatcagttttgttggtagcaaccgtgcaggtaaatacatctacacccggggctctgcccaatggtaa

SEQ ID NO: 12324 - DNA, 378 bp, A.fumigatus
aatgctacaaggaggaaatcttcggccctgtcctcatctgcctcaacgtccccacgctggacgacgccattgaactcatcaacaagaacgagtatggtaacggagccgccgtcttcacttgctccggctcgaccgcctcgcgcttccagaaggacattgaggccggccaggtcggcatcaatgtccccatccccgtccccctacccatgttctccttcaccggcaacaagaagagtattgccggtggcggtgcccaacaccttttacggcaagcccggcctgcaattctacacccagcagaagaccgtgaccagcctgtggcgtagtgaagatgccataagcaccaaggcccacgttgtgatgcccacgcattcttga

SEQ ID NO: 12325 - DNA, 270 bp, A.fumigatus
ttgcccagacagacacatgaaagtcatggtgaccactgtccccccggacagccttattttaatacgcattcctctccctcttccaagtgtcaaaaagataatcaatcattcttcccttccctcgataactgcaagcgcttcgaatccatccctatcctatcatctaccatctactacccctcaaagtccatcatggccgcccccgcagacgtcactatcaagaacctcagtggagagtggacaatggtatgggttgtactcaagttctaa

SEQ ID NO: 12326 - DNA, 432 bp, A.fumigatus
gcttacaaagttgccgttgggatacttctcaggcttatagcccctgccatccagaaggatggtggcaccctcctgttcagcactggcgatcaagtcttcgatgcgcttcttgctctcggggctgatgacagggccgagatcggcacccttttcgaaaccgccgttgacgttgagagccttggctcgctccgccatctcgggaagccattctttggtttctccaaccatgacaactgtgctcagggccatgcacagttgtccagcggcgccgaaggcagcaccgacgatggcgttcagggtctggttcttgttgcagttcggcagcaccgcagcatggttcttcgcacccaggttggcctggacacgcttaccattgggcagagccccgggtgtagatgtatttacctgcacggttgctaccaacaaaactga

SEQ ID NO: 12327 - DNA, 618 bp, A.fumigatus
agccatatcccctggtctctcgagcttcattgcataacctatctcggatcatttcattgccattccatgtttactgataacctcgttcagcaaggtattagctgggtcactcgcaaagctatctcatacgccactgtcaccctaattatcaaggagtacgccgactcggaagatgcgaaggtcatgcacatcgatatcgatcaggtcttgacaggaggcatcaagggcactagcgagaagcgccacaccgattgggcggagcgcgaccacaaggaccacatttttggcaacctcaagggacggtcgcggctgatccgtggctccaagggcgatgatggcaaagttcggcctgccgtcgagatcaacaccaagatcgatgaccccaaggtgaagcagttcctgcggggcgaaattcttatagatggtagcccgtgcgagggtttcctcgtggacagtgagggtgaggagtatggtgagggcgaagggctcttcctgcagagcttcgtcgttaaccaggacgatggagctggctggaccgcagaacaggttcgtatattcgacagtttgccgggggggtcggcgacagatgctaacctttgtatagatctggggctttga

SEQ ID NO: 12328 - DNA, 501 bp, A.fumigatus
  unsure (498): Identity of nucleotide sequences at the above locations are unknown.
cccctgccatccagaaggatggtggcaccctcctgttcagcactggcgatcaagtcttcgatgcgcttcttgctctcggggctgatgacagggccgagatcggcacccttttcgaaaccgccgttgacgttgagagccttggctcgctccgccatctcgggaagccattctttggtttctccaaccatgacaactgtgctcagggccatgcacagttgtccagcggcgccgaaggcagcaccgacgatggcgttcagggtctggttcttgttgcagttcggcagcaccgcagcatggttcttcgcacccaggttggcctggacacgcttaccattgggcagagccccgggtgtagatgtatttacctgcacggttgctaccaacaaaactgatagctttaatggctggctcgtcgaggatgaagtcaacggtcttggcagagccgtggacgatgttgatcacacccggaggaaagccggcctcccgggccagctccgntag

SEQ ID NO: 12329 - DNA, 417 bp, A.fumigatus
ggggacggggatggggacattgatgccgacctggccggcctcaatgtccttctggaagcgcgaggcggtcgagccggagcaagtgaagacggcggctccgttaccatactcgttcttgttgatgagttcaatggcgtcgtccagcgtggggacgttgaggcagatgaggacagggccgaagatttcctccttgtagcatttcatgtcaggcgtcacgttggtgatgatagttgggccgacctacgcgggcgatgggttagtgaaggcgaggcggaaagggttaggagggtaagcttacaaagttgccgttgggatacttctcaggcttatagcccctgccatccagaaggatggtggcaccctcctgttcagcactggcgatcaagtcttcgatgcgcttcttgctctcggggctga

SEQ ID NO: 12330 - DNA, 630 bp, A.fumigatus
  unsure (143): Identity of nucleotide sequences at the above locations are unknown.
atgtatttacctgcacggttgctaccaacaaaactgatagctttaatggctggctcgtcgaggatgaagtcaacggtcttggcagagccgtggacgatgttgatcacacccggaggaaagccggcctcccgggccagctccgntagtatcatggcagctccggggtcccgctccgaaggcttcaggatgatgcagttaccggtaatcgtagcgataggaatgcaccaaagagggatcattgcggggaagtctacgggtggagcggttagtcacggagaaagaacgggagggatccaccggacaagcgatggaaggcaaggacttactgaaagggcaaatagccgcaacgactcccaggggctccctgtagcttctagtctccatatccttggccacttcgaggacctcaccggtcaattgggtggtgatgccacaagcggtctctgcaacttgcaaaccgcgaaggacgtcacccttggcatcagcaaaggtcttgccctgctcgagggtgatggacgctgcgagacggtcccagttggcacggatgaggttgacaaacttgaacatgatctgctgcctggcgataatgctggttgcccgccagccatgctcaccacgcggctgaaagga

SEQ ID NO: 12331 - DNA, 225 bp, A.fumigatus
cattctttgtcctcatggagtacagttttatctactgtgacttatttcttcggtctccgcactgtattaggagctcagccgagggcacagttatatccggttacttataactataacacgtccatacctgccttgctgtctcataatgtgcctctctcctggattactgcatgtacaccgaaccctgctaagatactacaattcctgagtagtctactcgattaa

SEQ ID NO: 12332 - DNA, 1176 bp, A.fumigatus
acaagcacgtatctactccctgcagtattcaatccatcgggactaacgcattgtagcttcccgtacttcgaggaggaacccgcccgcttcaccgcaacgctccaggcctaccacgcattcaaagtccaaggcgtcgatgcaactctcggctacatcccaaacaccctggtacagagcatcccctggcccaaagaacattggatgatcgactccagggcaatcgtcctactcagccccccgggcaatgcagcgtccacacgcacccaagtcatccacagcgcgatccacaggatgattgaagccgggtataccgacgtcctcaaaggctggcgcaacgagagattccccgtctaccggcccgacggcggcgtgatcctggagatcgaacggtccgcgagcgcactattcggcattgtaacgagcggcgtgcagatgctttgttacgtcaaggatgcgaagaatggcatccgcctgtggattgcgaaacgctcgatgcggaagcagacctaccctggtatgttggactgcactgccgccggggccctgagcgcaggagagtcgccgcaaagcgccatgatcctcgaggcgacggacgaggcgtcgctcgcgcgggagatcatcgagagtggcatgaaatacgtcgggactatctcctatttccacatgaaagactcgtctcttgcgtcgagcgaggggtcctcgacggcggttctgctccccgaggtcgaatacctgtatgagctgccgctggacgaagggactgttccgcggccgagggattccgaggtcgaagattttcggctttggaatgtggaccaggtggttgacgccttgggcaggggaagcttcaaaccgaatagtgcggttgtggtcattgactttttcattcgccacggtgtcattacaccagagacggagccaatgtatgatgagattataaggagactgcatcgagaactgccgtttcctacagcacactggtgcactggtgcctgtggaagacaggcaaaacccgattcatgcatgcctagcagaatcttatgccctctaaggtggggacacaagtcaatccatctagggaatagtttaccaggattatgcactaaaacaaccccaaatccgagcaaaaggactatgtttgaccgccttaccaagaaacaacaggcccaccacata

SEQ ID NO: 12333 - DNA, 225 bp, A.fumigatus
  unsure (13): Identity of nucleotide sequences at the above locations are unknown.
atcttgggacgtnctgatctagctcgaataagtacggaatggaagactcgtggatgggatggaattgtcgaggcgtattctttctctttggaccctattatgggtttgcttctagcattctttgtcctcatggagtacagttttatctactgtgacttatttcttcggtctccgcactgtattaggagctcagccgagggcacagttatatccggttacttataa

SEQ ID NO: 12334 - DNA, 297 bp, A.fumigatus
tccatcaacaggcgttccttccgaagtgctagatgccctatcatggtggccactggcgtctcggctcgtggacttgacatcaagaacgttatgcacgtcgtcaatttcgatttgccgagtgccgcccatggtggcatcactgagtatattcatcgtattggtgagcatatcggctacgtacactatcttggtctgccagctaacggtccacaggacgtactgcacgcattggcaacgaaggccttgcaacctccttttacaatgacaaaaactccgatatcgcccccgacctcgtga

SEQ ID NO: 12335 - DNA, 237 bp, A.fumigatus
agagcgtcctcacccagtcaagaacgtaagttgttgccgtccctagttatgatatatccgtactcagtattcgacgactccaagtttgacgacgctggtctccatcctattatgcgcgagaacattcgtctatgcaactatgaggtcccaacgcctatccaggcctacgccattcctgctgttcttaccggtcatgatctgattgccattgcccagacgggtgagtatgagagctga

SEQ ID NO: 12336 - DNA, 405 bp, A.fumigatus
tacccctcgtctaacacgactaacaaaaccaacgagttaggttctggtaaaacggcagcttttctgattcctgtgctttcccagcttatgggcaaggccaaaaagctagcagccccccgtcctaacttggccaacggctttgatccttcagtcgatgctgttcgtgccgagccactggtgcttatcgttgcaccaaccagagaattatccactcagattttcgacgaggctcgtcgtctatgctatcgctctatgttgcgcccctgcgtcgtttacggtggcgctcccgtgcgtgagcagcgtgaggagctccagaagggctgtgacattctcatcggtactccaggcagactgctggactttatggacaagcctcatgtcctttctcttcgccgggtcaagtaa

SEQ ID NO: 12337 - DNA, 198 bp, A.fumigatus
atcatctatgccgaggatcaccttaaaaagcaatgcctttacgaccttcttctggcaatgccgccatcgcggaccttgatctttgtcaacacgaaaattcaggccgattttctcgatgattttctatacaacatgggtcttccgagcacctctatccattccgatcggactcagcgtgaacgtgaggatgctctgtga

SEQ ID NO: 12338 - DNA, 294 bp, A.fumigatus
ctgccagaagacgtgaacgaggatgcagatcatcgttacatgatgttctctgcaaccttcaaccgcgaatgtcgtcgtttggcccgcaaattccttgcggaagaccatgttcgtatccgcattggacgccctggcagcacccacataaacgtcgatcagaccgtaagcaaattgaaggcccaaagcgagccggaagcgatactaaaaatgtatagatcatctatgccgaggatcaccttaaaaagcaatgcctttacgaccttcttctggcaatgccgccatcgcggaccttga

SEQ ID NO: 12339 - DNA, 309 bp, A.fumigatus
cggtccacaggacgtactgcacgcattggcaacgaaggccttgcaacctccttttacaatgacaaaaactccgatatcgcccccgacctcgtgaagatcttgattgaaaccggccagaaggtccccgatttccttgagtcctataaacctgccgatgacgtggtgaagttcgacgacgatacagatgacgaggctgccgatggcgacgacaacgtaatcaccaataatgatgatgctggaactgtctggagtggcatccccatggaatcatccagcgacgatgcccctgtctctaccgactgggagtga

SEQ ID NO: 12340 - DNA, 645 bp, A.fumigatus
ttcagctattactcccacacctcgcaagactcatatactacgttcatgttgactcagaaagagatgcgcaacgatggagcctctcgtgcatctattctgatgaagactggcgcttgcgtgggcggtacaatcattggatacctgtcgcaatttgttggacggcgccgagctatcattatttctgccctgtgctctggcatccttattcctgcctggattctcccacaaggcgaacgagctctgagcgcaaccggcttcttcatgcagttcttcgttcaaggtgcctggggtgtcattcctattcatttgaatgagctttctccacccgcgttccgttcttccttcccaggtttgtacctcgtaccataccgatcgtggagaatcctcactaacgtgcaaaggtatcacataccaagtaggaaacatgatctcctcgccctccgcccagattgtcaacgccattgccgagaaaaccatgatcaccgctccatctggtcagcgggttcctgcgtatggccctgtcatgggagttgccacggccatcattgcgatgggtatcgtggttactacggcatttggaccggagaagcgtggtcgtcggttcgagactgccgttgcgggcctccagtcagccaggtcagataa

SEQ ID NO: 12341 - DNA, 408 bp, A.fumigatus
atgagctttctccacccgcgttccgttcttccttcccaggtttgtacctcgtaccataccgatcgtggagaatcctcactaacgtgcaaaggtatcacataccaagtaggaaacatgatctcctcgccctccgcccagattgtcaacgccattgccgagaaaaccatgatcaccgctccatctggtcagcgggttcctgcgtatggccctgtcatgggagttgccacggccatcattgcgatgggtatcgtggttactacggcatttggaccggagaagcgtggtcgtcggttcgagactgccgttgcgggcctccagtcagccaggtcagataaggaaatcgatcttgaagagggtctggatgacaaggcagccgagaggagagtggaggaagttgggaaactttga

SEQ ID NO: 12342 - DNA, 315 bp, A.fumigatus
gtcgagataagtgagatcacatctcacctcagtagtttctatcaaaactcaaaaatcctccctggacaaacaaccaacatggacgcaaagacgacaatcatcatcagggcagtcgttataccactcgccttcctcatcttcatcctcactattatcgcaatctttatcctcaaatgtcgtatggatcgcaagaaagatgaacgagagaatctcaactactccttcgcgtcctatgagcaatggcagactcccaaccagcctcacaaccaaaaaatggatgctgctcagcactctcacaattcaatggcccgatga

SEQ ID NO: 12343 - DNA, 291 bp, A.fumigatus
tacggatccacatgccaatttacagcgccaaagaccatgattccaccaatcagactatctgtcagaagatgtgatagtctcaaaggttcgtcaattagttcccaagtcatgcatccgctgcaggtcctcacaccgaacggctctgctccgcccaactgcaacgagacggtcgagacctgcatgcagtgggtgggaatctttgggtataagtatgacgctctaaagagtgtcgtagagaatacacccgacgacaagtatgaaaaccatttgagggtgacaagttgcaagtga

SEQ ID NO: 12344 - DNA, 222 bp, A.fumigatus
ggtttaattcattatctaaaggaaattggcttgcgtacaaactcttcgtttctagctactatccttgccgtggtgcatggatctaatggtagacgcaagggaggcagaatattgcatatgatagatggatatggcttcgacaacaacaaggcccaacctatgcaagtatctgccggatctgccactaccaaactgaatatgctgctgaggactcgcttttga

SEQ ID NO: 12345 - DNA, 765 bp, A.fumigatus
  unsure (652),(732): Identity of nucleotide sequences at the above locations are unknown.
gtagcgaacgcgatcaacttcacgcaagaaacatgggccaacgacatcgccgccgcgcaggccgcgcacatcgacgccttcgccctgaacctcggctacggcctgcacaactacgacctcatcctcaatgacgccttcaccgtcgcccaccggcacaacttcaagatgttcctctccttcgacatgggccagggcccccaatggcccgtcgacgagatcgtccacctcatcgacaactacgccaccggcggcgcatacttcaagcatcacgacgacaagccgctcgtctcgaccttcgagggcggccagaacgccgacgtctggaaggacgtcaggcataatgcgcagtcggacttcttcttcatccccgactggtcctcgctcgggatcgaagccgcatccagcagccccgtcgtcgacggcctgatgagctggcatgcttggcccgccggcgcacacgacatgaacaccacgctggacgaagagtacatcgctgcgctggacgggcggccgtacatcatgcccgtctcgccgtggttctacacgaacctgccggtgttccacaagaactgggcctggcgcggggacaacctctggttcgaccgctggcagcaggtgctcgaactggcgcccgagtatgtggagatcatcnactggaacgactacggcgagtcgcactacatcggccccatgcaccaagaagacctggggatttttgccgtgggggaatcncccttcaactatgccgaaggggatgccgcttga

SEQ ID NO: 12346 - DNA, 417 bp, A.fumigatus
taccagctcatccggctcggccgacacgggtaccgctccatcatgcagaacctcacccgcaccgcagaccatctcgccacggagctgcagaaactcaacttcaccatcatgagcgatggggcaggcagcggcctcccactcgtcgcctaccggctcccacccgacgagaatagactctgggatgaatatgcgctggcgcatgtcctccgccagcgcgggtgggtgatacccgcgtacacgatggcaccgcatagcaaccggctcaagatgatgcggatcgtgctccgggaggactttagtatggatcggtgtgatgtgttaattgaggatatgaagatggcaatgaagtcgctggaggagatggatcgggcgatgatcgagcagtatattcggtatggcctgctgctcactgactga

SEQ ID NO: 12347 - DNA, 735 bp, A.fumigatus
  unsure (7): Identity of nucleotide sequences at the above locations are unknown.
agtgaanacagccgcggcatcaacatgatcgcggacctctttcacgctccgactgctgacggggcgggcgtccaagacgccattggaacatccaccgtcggatcctcggaggggattatgttagccatgctggcgatgaagaagaggtggcagaaccgccgcagggccgagggcaaggacagcacgcacccgaacatcgtgatgaatagcgcggtgcaggtgtgctgggagaaagcagcgcggtatttcgatgtcgaggagaaatatgtctactgcacggagacgcggtatgtgattgatccggaagaagcggtcgacctggtggacgagaataccattggcatttgtgcgatcttggggaccacgtacacgggccagtacgaggacgtcaaagccatcaacgacctgttgatccacaagaagatcgattgtccgatccatgtagacgccgcgagcggcgggttcgtcgcgccgttcgtgaaccctgacctaaaatgggattttcagctgcccaaagtggtgtcgatcaatgtatccggccacaagtacggcctggtaggtacaactcccgagtcgccagacgtccctaacagacctaggtctaccccggcgtcggctgggtattctggcgctcagccgagtacctccctaaagaactcatcttcaacgtcaactacctcggcaccgagcaagcaacgtttacgctcaacttctccaagggcgcctccaacataa

SEQ ID NO: 12348 - DNA, 873 bp, A.fumigatus
  unsure (545),(668),(792): Identity of nucleotide sequences at the above locations are unknown.
gccattgacatatcagacgccgcgtgcgatatctggactgcaactgacttcaggccaggtatgccttggaatgatcagctcctcacggtagcagcaggccgatcactgcaaagccgcccccgagaccgactgcgactccatggcagcgaccatctgcctcgggtcgacgtcctggttccctgctgcggagagccgacggatgtagttctggacacggtccgggcagcctgcactatggactatcccgtcactcatttccgggtccttctgctggacgatggggcctctcctgcgctgcgtgacgccgttgcagggctacgctcccaatggccgcacctgtcttaccacacgcgcgggcagcactccggccgtgtctttgccaaagccggaaatctcaactacgcgctcttctccttgcagaacgaggttcagcccgagttttgtgccgttttggatgctgactgcatgcccgcccccgactttctgcgagccacgctgcctcatctgctgaaggatccgcaggctgctctgctcacgacgaggcnatactactataatctgcccgatggtgaccctctgcaacagtctcgtgtgcacttctacacctggcacaattccgagctcgaccgcatgggcgcttgcatcgacgcaggatctggggccgtctntccggcggaaggcaatcgtcgatgtggggcgctatccccacctttcccttcttcggagaatgggaactcctcgtggatgtttcgggcctttgggtttcccacgattactggttctgaaaccgtngcaattgggggtcggtccccccttccctggaaggaactttcgccccaaccaaaccgaagggcaattgggccctcccaaaca

SEQ ID NO: 12349 - DNA, 1065 bp, A.fumigatus
  unsure (744),(805): Identity of nucleotide sequences at the above locations are unknown.
aattttattcactttctgtcgctccttgtgtcccgggtcctcgcgcattccatttgcaccatgtattttaccacattgctcagtgccctcagcctgatggctgctgccgcatctgctctgccccatcagctatcttctcgcgcgtccggtgcccagaacgttgtgtactggggccagaacggcggtggcaccgtcgagaacaatgacctggcgtcctactgcacgtcgacctctggcatcgatatcatagtcctgtccttcctgtatcagtacggaaatggcaacaccattgcctccggcaccatcggccagtcctgctatatttctccctctggacagccccagaactgcgatgctctggcctctgccatcaagacctgccaatccaggggcgtgaaggtcattctgtctctcggaggcgccgtcggcgcctattctctttcctcccaggccgaggccgagacgatcggccaaaacctttgggaggcctacggcaatacccaaggcaatggaaatgtgccccgaccctttggaagcacttttgtcaacggctgggactttgacattgagagctactccggaaacgaatactaccagtacctgatcaacaagctgcgctccaactttgcttcggatccttccaaccagtactacatcaccggtgcgccacagtgtccgatccccgagcccaacatgcaggtcattgtcaccaaggcgcagtttgactatctctgggtgcaattntacaacaaccccggctgctccgtcaacggtcccatcaactacgaccaatgggtctccaacntggccaacaccccctccgccaacgcgaagatctttatcggcgtccctgcttcgccgctgggcgcgacgggaacgtctagtggtgcgcagtactatctccagcccagcgctctggcctccctcgtggccgagtacaaggacaacccggccttcggaggcgtcatgatgtggtccgccggtttttcggacgccaacgtcaacaacggatgcacttatgcccaggaagcgaagcgcatcctgactaccgggtctccttgttag

SEQ ID NO: 12350 - DNA, 261 bp, A.fumigatus
aacctgacaagacaatccaaactggcctttatcaacacggagtacatcctaacccttgatacagccaattgcagcaagcgtagacttcgtgataaacaatgctgtcgtacgtatgctgatagcaagctcaattggtggactggttctcgctacgagcccgtgccgtcgaggatcaccaacactacagcacatactaagcagggatcacaagaactaagctacctacatatcaaggccaagggacggaaaccggactcttag

SEQ ID NO: 12351 - DNA, 375 bp, A.fumigatus
  unsure (165),(269),(344): Identity of nucleotide sequences at the above locations are unknown.
cgagaattttttccagctcaaatcactctcccacaaatcgatcgagtttgcagcgtcaataacatgtccatgaaggtcttctttcgtcgaggagcgctttcaacgctcgcgcgacgcgcccctgtaaccctacggtccctcccgcggaaggggctcactacacancaagaagagatcgtcaagtcaacaattcccgcactacaagagcatggggtcactatcaccaccctcttctacaaacggctgcttgatgcgcatcccgagcttanaaacattttcaacaccggccatcatgcaactggcgagccacccggcaaccctggcgcatgctgtgtgggcgtacncatcccaaatcgaacaacccgatgcccttga

SEQ ID NO: 12352 - DNA, 549 bp, A.fumigatus
cgctcttcctgcccggtttcattggcatttttcaacggcgtcgcgtcagtcacccgactcaaatgggcttttgcccgcgacgagggccttcccttctccagtttcttcgcgtacatctccccccgctataagatcccgctgcgcgcgctgttcctcgtcgctatgatcaccgtcctcctggcgctgatcaacatcggctccaccaccgcgtttaacgcgctcctgtccctcaccactctggggcagtacatctcatacctgattccagtgatcttcctgctcatcaagcgtctgcgtgccccgcaggagatccggtggggttcgttccgtctgggtcattggggagtccccattaatgtctttgcgattgtgtatggagtgtatattgctatatttcttccctttccgccgaattaccctgttacggcccagaatatgaattacgcggccccggtgtttttggctgcgttggtctttgcaactggggactggattgtccgaggacggacacgctggcaggggccaatggttaaggtgcgagcggagtag

SEQ ID NO: 12353 - DNA, 612 bp, A.fumigatus
ggattacaggagagcggctcccgcaatcagaccagcgacagcacccacgccggcgttcagacgggacgcggcgccggtgaacagaggggaggaagggctggcggtggaggagcccgagggcgatggggtgccgcttggagaggtgaccgtgggctgggtggggatgacgggcttggaagtagtggccggggtcgaagccgaagtggaagtggaagtggaggtggaagtagaggtggtctcctcggtggtggtggtagtaataggcgccgcggtctcggtgtgagtgtttgtcagagtgttggtaacagtgttggtccacgtgttggtgatggtatcggtcagcgttcccgtcagggtaccgccaggtccagtacagatctccccgatggggcagcagccatcgtcggtgcagtacgtgcctggctcgcagccgccctcaccgatagcgcagcagctgtaggtgacgggaatgcaggacgacttgcaggtcttgtaaccagggtgcgattcgcagctggagacctggcgagcaataaggccattgtggcctgccgcaagggcgacagtggccaggagagaagcagtcagaagcttgtacattgtaaagattga

SEQ ID NO: 12354 - DNA, 453 bp, A.fumigatus
gggcggctgcgagccaggcacgtactgcaccgacgatggctgctgccccatcggggagatctgtactggacctggcggtaccctgacgggaacgctgaccgataccatcaccaacacgtggaccaacactgttaccaacactctgacaaacactcacaccgagaccgcggcgcctattactaccaccaccaccgaggagaccacctctacttccacctccacttccacttccacttcggcttcgaccccggccactacttccaagcccgtcatccccacccagcccacggtcacctctccaagcggcaccccatcgccctcgggctcctccaccgccagcccttcctcccctctgttcaccggcgccgcgtcccgtctgaacgccggcgtgggtgctgtcgctggtctgattgcgggagccgctctcctgtaatcctcacgcgtgcgcggtga

SEQ ID NO: 12355 - DNA, 621 bp, A.fumigatus
tcctttattatttcaatctttacaatgtacaagcttctgactgcttctctcctggccactgtcgcccttgcggcaggccacaatggccttattgctcgccaggtctccagctgcgaatcgcaccctggttacaagacctgcaagtcgtcctgcattcccgtcacctacagctgctgcgctatcggtgagggcggctgcgagccaggcacgtactgcaccgacgatggctgctgccccatcggggagatctgtactggacctggcggtaccctgacgggaacgctgaccgataccatcaccaacacgtggaccaacactgttaccaacactctgacaaacactcacaccgagaccgcggcgcctattactaccaccaccaccgaggagaccacctctacttccacctccacttccacttccacttcggcttcgaccccggccactacttccaagcccgtcatccccacccagcccacggtcacctctccaagcggcaccccatcgccctcgggctcctccaccgccagcccttcctcccctctgttcaccggcgccgcgtcccgtctgaacgccggcgtgggtgctgtcgctggtctgattgcgggagccgctctcctgtaa

SEQ ID NO: 12356 - DNA, 564 bp, A.fumigatus
tccttgcagcctgttctcgccgaacaagacgtatgttctcgccggtctgagcgggcagatgggccagtccatcaccagatggatagtacagagtggtgggcgccacattgtgatcacaagccggtgcgaacagacacgtctgtgatgtggataagtactgacagtaatagcaatcccgacaaggacgatctctggacaaaagagctagaacagcgcggtgctcacattgagatcatggccgctgatgtgaccaagaagcaagaaatgatcaacgtccgcaaccagatcctaagtgctatgccccccatcggaggcgtggcaaacggtgcaatgcttcagtcgaattgtttcttctctgatctgacgtacgaggccctacaggatgtcctgaagcccaaggtggatgggtcgctggttctcgatgaggtcttctctagtgatgacctcgacttttttctgttgttctcgtccatctcggcggtggttgggcagccattccaagcaaactacgatgcggcgaataacgttaagtttggccaatctgccgcagtgcggacctactga

SEQ ID NO: 12357 - DNA, 1788 bp, A.fumigatus
ttccgaggtgagcatgagggctgcttccagacgcttcttcttgccttcgccgcccctcgagatggttcgttatggacgattttcgtgcctacccagatcggtcgactcacgatatttccgaattcatccgttggcatcaatacgccagcctcggtaactatcgatacgcacctacatgaatttactgcagggcataaagcagatttacccatgatcaaaggagacgtcagcgtctacagctcagaggctgggcagttgcggatacgcctcgaaggcctcacgatgagccccatagcgccctctaccgagaagcaggacaaacggctgtacttgaaaaggacatggctgccagatattctctcgggcccagtactcgagcgagggaagccagttttctgttacgaactcttcggcctgtcgctcgctcctaagtcgatactggccgccacccgactgctctcgcatcgctacgcaaagttaaaaattctccaggttggaacttcttccgtacatctggtacattctttatgtcgcgagctaggaagttccatggactcttacacgattgcctgtgaatcggacagttccatggaagatatgaggcggaggttgctatcggacgccctgcctatcaagtacgtagtcctcgacatcggaaagagtcttacagaaggggacgaacctgccgccggtgagccaaccgacctcggctctttcgacttgataattcttctaaaagcctctgccgatgattctcccattttgaaacgtacccgaggtctcataaagccaggggggtttctactgatgactgtggcggcaacagaggccattccgtgggaagcaagagacatgacccgaaaggcaatacatgatacgctgcagagcgttgggttttcgggagtcgatttattgcagagggacccagaaggcgattcgtctttcgtgatcctgtcacaggccgtcgatcatcaaatcagatttcttagggctccgtttgactcgactccaccatttccgactcgagggacgcttcttgttataggcggcgcctcgcacagggccaaacggcccattgagacgatccagaatagtttgaggcgtgtctgggctggggagatcgtcttaattaggtccctgaccgacttgcagacccggggccttgaccacgtggaagctgtgctgagcctgaccgagcttgatcagtcggtcctggaaaatctcagtcgcgatacctttgacggcctacatcgactgctccaccagtccaagatagtcctgtgggtcacatacagcgcaggaaatctgaacccccaccaaagcggtgcaattgggctggttcgagccgtccaggctgaaacccccgacaaggttctgcagctccttgatgtggatcagattgatggcaacgacggtcttgtggcggagagcttccttcggcttatcgggggcgtcaagatgaaggatggcagctcgaatagcttgtggacggtcgaaccagagctctccgtccaaggagggagacttcttatcccgagggtgcttttcgacaagaagcgcaacgatcgtctcaactgtttacgccggcagctgaaagcaaccgattcctttgagaagcagtcggctctggctcgtcccattgatccttgcagcctgttctcgccgaacaagacgtatgttctcgccggtctgagcgggcagatgggccagtccatcaccagatggatagtacagagtggtgggcgccacattgtgatcacaagccggtgcgaacagacacgtctgtga

SEQ ID NO: 12358 - DNA, 471 bp, A.fumigatus
atgctggcgcggatggccggcccctgtggtagaaaacaagaggccggctcgtcacatccccaggttgcagaagcttgtgtagtcgctatcccagaccagctgaagggtcaactgcccttcgcgttcatctccctgtccgtggcagatcacccggactccgccataccagccccgactatcgcggcagaggttcagtcactggtacggagtcgtgttggagcattcgcttctctgggaggtatagtacagggcaaaggcatgatcccgaagacgagatctggcaagacattacggcgtgtgcttcgagagttgctggagaatggggtttacggggatttggatcggagtgttgaggtccccagtacgatcgaggatgcgacggctgtgcaagtcgcgagagcccaggttcgggagtactttaacaggaacaagggtaagcacaaggcgattgaagcaagggagacggcatga

SEQ ID NO: 12359 - DNA, 246 bp, A.fumigatus
acgcttagcgcggatccttcggcccccgtggtgaagaagggagaagcatcctacttgcctgttgaagtttgtctggtagaacccggacagccagcaaaatccaagcttaccccgatgcaaacgcgcaatatgctgagcttcgccgtccgaggtcctgcttcaaacgcatattcgattgtctccaagggcactgctgtcctcggcctcaagaatccccttaaccctactcttgtatgtgttctttaa

SEQ ID NO: 12360 - DNA, 1482 bp, A.fumigatus
gcgagttttggcatccaaccagatctccagctcgtaactgttccaggtcgcgttctccctgcgccgcgagtatactacaaagacgccaagtcgaaccaaagacatatcgataccatgggaggcagctggaacatgaagtcaatcaagttctccacatccacaaagctgccttcttggacttggctctatattaacagcgaaaggggcatacctcgctttgagaacccaggtcaactgaacacttctcttcaggccttcacggccaagctgaacgagattggtgtcgctgctgccgccccgaagcccggaatgatgatcaggttgactggaaatgaccacgagggagagattgacagagcagtgggcgagctaatgggtcgtcatactcccaccctcatcctcaccattctctacagcagtgacgtagaggcctacaactgcatcaagaagatctgtgacgtacgtcgcggcgtgcgcaatgtcaatgtcctcgctgagaaactgagaggcgccaatgaccagtactacgccaacgtcggcctcaagttcaacctgaagcttggcggagccaatcagatcctcaaagcgagcgaacttggcatcgtcgccgagggcaaaacaatgctcgttggcatcgacgtcacgcacccgtcccccggctcctccgccgaagcccccagcgtcgccggcatggtcgcttcaatcgactcatcgctgagccaatggcccgccgacatccgcatccagacctcccggcaggaaatggtgtcaaacctggacgagatgctcaaggcccggctgcagcgctgggcgcgcgccaacaagaacgccctcccagagaacatcatcgtctaccgcgacggtgtctccgaaggccaatacgacgtcgtcatcgagcaggaactgcccctgctcaagaaggcctgcgtagagacctaccccgccgcaagcaccaagaagaacttcccgcgcatctccatcgtcatcgtcggcaaacgccatcacacccgcttctaccccacccgcgacgaggacgccgaccgctccgccaaccccaagaacggcaccgtcgtcgaccgcggcgtcacagaggcccgcaactgggacttctacctccaggctcacaccgccatcaagggcaccgcccgtcctgcccactactttaccgtctgggacgagatcttcgcccaccagaaacccgtcgcccccttccagaacgcggcggatatcctcgaggatctcacccacagactgtgctatctgttcggccgtgccaccaggcctgtgagtatctgtccgcctgcctattacgcggacctggtctgcactcgagcccgctgctacctgagcagtgtctttgatccaacaccggcggctaccccgtctgtgagtgagattggggggatcggacgtggtgggcttgtgaagggtagcgatgttcaaatccatgagaacgtgcgcgatacgatgttctacatctga

SEQ ID NO: 12361 - DNA, 843 bp, A.fumigatus
ccagtactacgccaacgtcggcctcaagttcaacctgaagcttggcggagccaatcagatcctcaaagcgagcgaacttggcatcgtcgccgagggcaaaacaatgctcgttggcatcgacgtcacgcacccgtcccccggctcctccgccgaagcccccagcgtcgccggcatggtcgcttcaatcgactcatcgctgagccaatggcccgccgacatccgcatccagacctcccggcaggaaatggtgtcaaacctggacgagatgctcaaggcccggctgcagcgctgggcgcgcgccaacaagaacgccctcccagagaacatcatcgtctaccgcgacggtgtctccgaaggccaatacgacgtcgtcatcgagcaggaactgcccctgctcaagaaggcctgcgtagagacctaccccgccgcaagcaccaagaagaacttcccgcgcatctccatcgtcatcgtcggcaaacgccatcacacccgcttctaccccacccgcgacgaggacgccgaccgctccgccaaccccaagaacggcaccgtcgtcgaccgcggcgtcacagaggcccgcaactgggacttctacctccaggctcacaccgccatcaagggcaccgcccgtcctgcccactactttaccgtctgggacgagatcttcgcccaccagaaacccgtcgcccccttccagaacgcggcggatatcctcgaggatctcacccacagactgtgctatctgttcggccgtgccaccaggcctgtgagtatctgtccgcctgcctattacgcggacctggtctgcactcgagcccgctgctacctgagcagtgtctttga

SEQ ID NO: 12362 - DNA, 513 bp, A.fumigatus
ccctcttgccctccaaatctaaacttgggatattccacacgtccccagacctccagccgatcagcgccaggacccttggcctcctcgcctgtgaaccagcgaaccaactcctcctcggtccaattgcaactcgtcacaaccaggaacccgcccttgcgcactaacctgcgcgcaatactgggataccgctcgcatacacggcgctggatcaccttcccctcgctcttcccctcaaccaccacctcctctgacaacgaaaccgcatcaaacgtccccttatcaagcacaatatcaaacccgccctgcgcatacgggaaccaatccagccgaccctccccctccaactgcccctccgaattcaaaatatcccactcctcaaacctgatcatcatgtccttatcctcctcagggaccggactcgcctccgcagtctccgccccgttcgaaaccaccacatcctcctcctccccttcttcttgttcctccccttcagattcactcccactcaaataa

SEQ ID NO: 12363 - DNA, 531 bp, A.fumigatus
ttgtgcatctctttctacagcttggctcaggcaaagaccggtactggaaaaacccttgcgtttctaacgccggtattccaaaatatcatgaaggacccgtccttgaaggggctgaactggaggaggtcacaggcgagctcctccgacatccgcgctattatcatctcccctactcgtgagctggcagagcagattgctgtggaggctcggcggttagcggctcactcaggtgtcattgtccagactgcagttggcggaactcagaagcgcgagggccttcgtcgcatccaaagagagggatgccatgtgttgatcggcacgccaggtcgactcaaggatgtcctctccgactcctacaatggtgttacggcccccaatctgtccactctagtactggacgaagcagatcgtttactggacgatgggttttcggatgctatcatcgatatccagcgtcttcttccggaccccatgaaggttgaccgtcaaacgctcatgttctccgcgacggtcccaatggaagtcatgcac

SEQ ID NO: 12364 - DNA, 522 bp, A.fumigatus
cggcggaacgggattattcccaattggggccttcaacggggaacaaaacccttggatgcctccgttcaacaagggaatacaacatgggcgagttcctggaggggtaatacccacggcaagggcaaggaacttttcggacttgggtgccaacaaacgtcggcgactttttgttcggcaagccccattgccattgttgccattgggtaccccaccggggtacctacggatggagactggtacgaggaccagtgccacggccagggaaccttcgtcgagaagaagacaggcaacaaatatgtcggcggttacaaggacggcaagcgacatggcaagggcatcagctactgggaagtcgcggacgaagagatggatctgtgccagatctgctacagtgaggagcaggacgccctgttctatgactgtggccatgtctgcgcctgtgtgacttgtgcccgccaggtcgatatctgtcctatctgtcggaagaacatcatcagtgtagtcaagatttataggacgtaa

SEQ ID NO: 12365 - DNA, 186 bp, A.fumigatus
gcttttcctctgcgtcggacagatcctcgtcgtccgagaacatggccctcccaagatgcctcctcccctgattccccaccgagtcttccccttctcctcttcctctccggaatctacttctcccggaataccattaattcgtccctgaacccctctcaattctccaattctccccccccactctaa

SEQ ID NO: 12366 - DNA, 447 bp, A.fumigatus
acgatgtacccgcctgttttcgaggcgtggtcgaccgagtcgatggcggcgaggaggaggttgcgttgcatgtgggggatggcgaggaagtcacgttcgttcttggacgtcttgacgctggggtcctttgagataacgcctgtgccggtgcagggggcgtcgaggaggacgcggtcgaagccgccgagcgccttggggaaggcggtccgagcgtccaggttcgtcacgatggtgttcttgcaccccagacggtggatgttaccgataagacccttggcacggggcttgctggcatcgttggcgatgacacagccagtgttgcgcatcagggcagagatgtacgttgtcttaccaccgggggcggcggccatatcgaggacccgctcgttgggttgtggagccaacgccatcacagggaggaaagatgaggctgcctgcaggatgtag

SEQ ID NO: 12367 - DNA, 1866 bp, A.fumigatus
tggtattccgggagaagtagattccggagaggaagaggagaaggggaagactcggtggggaatcaggggaggaggcatcttgggagggccatgttctcggacgacgaggatctgtccgacgcagaggaaaagctcacagctgccaacattgagggactgtcccggaaattggatgaggctagacaggcggaggaggaggaggcccagcgcgagttacaggagtttgcaatgcagaccaacattgcaggtgaccgtccggatgtctttgctgatgcggagggcaagcctggtttggcccctgacctccaattgcttcgcacgagaattacagacaccattcgaattttgggcgacctgaaaacgctcggacaaccgggcaaatcccgcgccgattacctgcaactcctcctggacgacatctgcacgtattacggctacaccccgttcctcgcggagaagctgttcaaccttttcacccctatggaggcgttcgcctttttcgaagccaacgaaacccctcgtccagtcgtcatccgtacaaacaccctgcgtaccaatcgacgatctttggcgcaagctctgatcaacagaggcgtggtccttgaacccgtgggtaagtggtccaaggtcggcctgcaagttttcgagtccgcggtgcctcttggtgccacacccgaatacttggcgggccactacatcctgcaggcagcctcatctttcctccctgtgatggcgttggctccacaacccaacgagcgggtcctcgatatggccgccgcccccggtggtaagacaacgtacatctctgccctgatgcgcaacactggctgtgtcatcgccaacgatgccagcaagccccgtgccaagggtcttatcggtaacatccaccgtctggggtgcaagaacaccatcgtgacgaacctggacgctcggaccgccttccccaaggcgctcggcggcttcgaccgcgtcctcctcgacgccccctgcaccggcacaggcgttatctcaaaggaccccagcgtcaagacgtccaagaacgaacgtgacttcctcgccatcccccacatgcaacgcaacctcctcctcgccgccatcgactcggtcgaccacgcctcgaaaacaggcgggtacatcgtctactccacctgctccgtcaccgtcgaggaaaacgaagccgtcgtgcagtacgccctccgcaaacgccccaacgtcaagctagtcgacactggcctcggtgacttcggctcccccggtttcaccagctacatgggcaagaagttcgaccccaagatgactctcacccgccgatacttcccgcaccgcgagaacgtcgacggtttcttcgtctgcaaactcaagaagattggccccaccccgacccccaagccttccgcgggcggttttaccgcccccgccgccgcagccgacaaacccggtaagaaggccgacgatgacgaagtcgtcgacaagacacccatcttgaatgaggacggcacaacccttgacatcgagggcggcgcattcggccccttcgacgaagaggaggaccaggagcgcattgctcgcgcggagcgcaaccgcctgcgccggaagggtctggaccctcgggctgtcctgaacaagcctaagaaatctgcgtctaagaagacagacgcctcgaaaaaacaggaggagagcaagaaggaggagtctgcggttgagaatggggacgaaaaggccgcaaagacatctgacaaggtcgacgaaaaggctgacaagaaggacaagaaggctgacaagagcaagacggactctgactctaaaggcagcaagaagaacaagaaggcagcgagcagtagtcctggcaagaaagcaggcaaatag

SEQ ID NO: 12368 - DNA, 939 bp, A.fumigatus
gtgcggatcctgccagctcccgtggtgaagacccagcttgaggaagggtatctcaaacttaagccatggcgcctggaaaatgaccaatgcagtctcccgcagacccatgcaaacccaaccctccagcaagcagatagatcagatgtgaacaagtcggggttgcaatgcacgcccgaaccagagttatgcgcatcgcagccacatactggtcaggctggacatgcaacttctgtccgagtaaacgagcctcggcactatcgtctttttggtgcttacatgaactgcatagtgacatatcaggattgttctacagctttgttggcgaatgacgatttcatgtcacgaatgagcagtaccgtataccaaaaattgggcggtataccaggtacaagagtggtgcgtggttttgtcgaaaccaaaagacagaaggaaacaccagctgtgaagagtcgtgatcatagtgttggtacaaaatcttcgtccgatacccctaatacagcttcgacagatcatgaggtcaagtctgttgcggaaatttcttcagacacatgccataatgaggatgtgagggagaaagagactaatcaggatgatccaaggtcaactctggaacggcagatgtcgtcccttgctggtgaacctcaaaatacagctgagcttgaggagcaagcgcggaagcaggaagagaaggaaatggaagactccagggaagcagatgaagaggacagagagcgggagattgaccatttggtccttgtcacacatggaataggccagcgacttggattgcggctagaaagcatcaactttattcatgatgtgaatgttcttcgaaagaccatgaagagcgtctataaggcttctcctgatttgcaggctttgaactctagtttctcagacagtcacaaaaactgccgcgttcaggtacttccagtgtga

SEQ ID NO: 12369 - DNA, 795 bp, A.fumigatus
ctgttggagaccctccttgattttccttacagaggagtgaggcagaatcgtaaagaacttgatttagcagatgcagactttgatgacgacaattcttatcccggtttgaatgatattacccttgacagcgttcccgcagtccggaatctcatttctgatttggcaatggacgtactcctctatcaaagtgcttactgtgaacacatttctaccatagttaagcaggagtgcaatcggattttgaaactcttcaagcagcgaaatccgacattcaatggctctgtgagcctctgtggtcattcacttggtagcgcgatcctgtttgatatcctatgccagcaaccgtcgactcctcccacgcccggagagaggaggatggaccgagaggggtctcaggacattttgctcgactttgactgcgaagaattattctgcctggggtccccagttgcccttttccaaatgatcaaaggaaacaccattgctgggcgatctatgatcgacgaggcgaatatgaagcggtccaagaaggcgtgtgatcatcggaacccaaagtctttctcctccgcgagccgtggcgcatcagttcaggcgagcacggcgtcgagtgaggggctgactatcgtatcgtcaccgaagtgtcggcagctttacaacatatttcacccttctgatcccgttagttaccgaattgagccgttaatctcgccggcaatgtcgtcgctcaagccgcagcccttgccctcggtaaagaagagcctctgggcaactcctggggcaaagccctatccatga

SEQ ID NO: 12370 - DNA, 546 bp, A.fumigatus
gccgttaatctcgccggcaatgtcgtcgctcaagccgcagcccttgccctcggtaaagaagagcctctgggcaactcctggggcaaagccctatccatgattggcagtcgtgtcggccagagtgtgggaaccttatggagcaatttcgcaaccggggtcgcaagcagtctacttatccgaagcctcggacttggttcagaggacgcttcacaatccacaatgactgctaccgagactcaaatgtctcgaaaatcactagctaactcttctcttggagaggatggttcttctcggtttggttcgggcgttgattgtcaagaagcgtctgccaacagataccgaacactgattgactcgaacttagaaacactctacgaaggaaccaacagagccaagactagttgtcacaatgatattttacattcggcggccactgagtctgtcgttggccgagagagcgaggatttaaggaggttgaaaatggaagatgctaaagtgagggcactcaatactaatggacgagttgactacagcatccaggagtaa

SEQ ID NO: 12371 - DNA, 189 bp, A.fumigatus
gagaatcgaatgcaaatggctgtctcagctattaaaaacaaaaaaattaaattaaaacaagaagctgctagcatatttagtgtatctgaagctacgcttcacagtcagctgaggggaatcaaaccacaatcagagacacgtgccaataggtcttcaccacggggctggaaggatgcgaggcgatgcaaa

SEQ ID NO: 12372 - DNA, 660 bp, A.fumigatus
  unsure (431): Identity of nucleotide sequences at the above locations are unknown.
ataaccagtcaagaacatggcaagtgtaccccggacagcatggcacggtcatggctcatgttttcttatatcagtcctcgctctcaattcatttcctcaaacaatcctcacgctcttcagtcttcgttatccccagatttctgctcactcattatgttgcgccccgttgcatttctcgcgttcagtgctgtcgctcaagcacacaccgtcgcttgggccaaaggcatgtactgcttgggaggtcccgacccttcgacagacaacgccaacacaaacacagcggtgaatcccctgtacaatctcaagaaggaagactggtggttccaacacgaccgcggctgtgacgcagcacctccagcagagggcgacatcctggaactccccgcgggtggaaagttcacggtggaactcgcacacaaccgcgcgcagantacgctctcatacggtggaaagtatgcctcggaatggccggacggaaaagagcaccccgaggactgggctggtcctggtaacccgcccgactgtatccaggacgatggagcattgcataccaatacgcgatccatggctgcgggcgctgcgtttgctatcagctatcagtctgacctctccgcggtaacgatggagaatttggctgtgtttacagttttggagcagtaa

SEQ ID NO: 12373 - DNA, 195 bp, A.fumigatus
ctcacgagagccaggtacatggctggttataaatgcaatgtcaccgggtccacctcctcgaagaaggtcgcccccgctcaagtccctgtctattgtgcggatgatagcagcaagtgtgtcaagggtgctaagcaaatgatcgccttcaaccgtgagtcagcctttcttctggaggtatggtcagaagtaacctga

SEQ ID NO: 12374 - DNA, 855 bp, A.fumigatus
gaagacaatgcgggagaagattttgctcccgaattccttcaagagatctacgactcaatcaaacaaaacgagattattttacccgatgagcatgagaataaacacgcttttgattatgcatggcgcgagcttcttctaaaatcttcgtctgccggagacctggttgttggggagaccaacatttacgattcggaaatgtttgaagcaacttggaaaccagtcgtggcaacgctttcctacgtcttcatgtctgcctcagacgatgcagtctactctcgagtcgtgatgggtttcgatcaatgtgcacagatcgctgcgcgttacggtatcaccgaggcatttgaccgcatcatttttagtctcgcttccattagcactcttgccacggacaagccgccaagcacagcccttaacactgaggtccaagctgggaagaagaccgtgatggtcagcgagcttgctgtcaagttcgggcgagacttcagagcccagctagccacagttgttctcttccgggttctggcaggaaacgagtctgttgttcagcaaagctggaaatacgttttccaaattctcagcaacctcttcgtcaactcgctcattcctccattcgaaagtgatatgattgccgaactcgggatcccttcgatcccattgcaacccccatcacaggttgtagaccgtgatgcgcgtggtagtgagtcaggactcttgtcggccttcacatcttacctctccagctatgcagccgatgatcccccagaaccttcagatgaggagctagacaatacgctttgcacggttgactgcgtggctgcatgcgcgatcaatgatgttttgttcaacattaagtaa

SEQ ID NO: 12375 - DNA, 957 bp, A.fumigatus
ctaaacaaagcttgcagtgagaacgaagtcgttgctcgcggtgtcaaagccgttggtctcatctatcacctgacgaatcgggttccgaccctcattaagcagtctcatcttgaggagcgtgaaggtacgtataaagcgtgtttagtcggagcagaactggccattaactttgataatgccgtagcttggtcagcctactggtcacccattttccagtctctgagtgcacagtgcattaacccctgccgggatatccggcatcatgcggtttccactctgcaaagatgccttctctctgttcacattgattcgaccgatgataaggaatggaccggtatctttgaccaagtcctcttcccacttattctcttgttattaaaacccgaggtctatcattccgatccacttggtatgggtgaaactcgcgttcaagcagcaacactggtttgcaaaatcttcctacgctatctcgaccagcttccgaaccgggaaggcatgctagagctctggctgaagattctggatatcctcgaccgtatgatgaacagcggtcagggagatagcttggtacgtgaagttgcattccttgaactatcgagaaatggatacactaactatcttctacaggcggaggcaattccagaaagtctcaaaaacattcttctagtcatggcggatggtggacatttggtaccgccgtcccaagatcctagcaaggaaccaatctggacggaaaccaagaaacgcctggagcgattcctcccagacttgttcaaggagattttccccgaggatttgatcgaaaagcccgctgcagtccctgcagtctcgtctcctatttcatcttcgcacgacaacaccaacgccaccgatgcaaacgttggagagtctcagccaacgcctggtcagtcagaaattgaaggcgaagccataaagcctgaaactaagacggactaa

SEQ ID NO: 12376 - DNA, 609 bp, A.fumigatus
acggctggccaccgtgttgcaggcctttatcagggatgcaacgaatctgcactcgctggccctttcccggatcgtctcctatttgttcaatttattgcgactgagccatgtgcgcatgccctaccctatctgttcttgatagtttatgtccagtcgattaacatttttcaggatcaatccttcatgcgtgtgccggtgattctccacggcatatccagcttcgaacaggacgttttagaaagtgttgctgttcccacaatcaagggcctatcccagtgcatctcagaacaaggtctcttgagaaacgagctcaccgtctcccccgacttctggtccatgctgcagagactgcaccaacacacggaggcggctccgttagttttcgagctccttcgcaggatcattgaatctgtgcctcctatagtgaccgcagataactatgagtctgctgtcggtcttgcgaatgatttcataagcgccggtagcgtgggttacattgaagaacgacagagggatgtggcatatcggcgctctaagggcgtcaagccatcaaagccaaggtttgtatctttttccaagagtgaaattgatatctcaagtagtagctaa

SEQ ID NO: 12377 - DNA, 2277 bp, A.fumigatus
cggtgccagacaggtcaggggaggaaagtgatgatcgtgagacggatgagcagcctggtgggctccagtccatacagtatccttttaacagaggccgaaactcccccgggggaaatacccgtcatagattcgtctcaggaacagggcgagtcgcagctcaacgttgaatcaaataagaagaataaaggagcaccaacagcattttatacagttagagaaaacaacccagaccgcaccactgaagcagaaagcagttgggcgttgagtatccctagccaagatgattccagtcaatcagctcctgtggcacccgttagcgaagctagctctacagcggcattgctgaggcctagtttgcgttctaaagggaagaggaaactcaaatccttgtcttctggtagcattgggcgccaagagccccagaatgaaagagaagacgatgtgatcgatcctcggtcgtataaatattctacaactttgctcggcggaaaagtgaaaagctaccaattggatgacaagctcatggacaggcaacagcgcctaatgtcccgtatagcctacacctatgatgtgctctcaggcaatcgtcgacaacggcgcaagctgcgtgagggcgagattatccgagcggagaggatgcttgttcgcgtcgaggtggctgtgcagaaggagctcccgaacgactacactgaaaatgatagcctcaggttagaaacaaaggttgtagagagttggagggagtttcttgtcgtctgccgggtgatatccgacgccgagtcatctgttgcgctccagatgtataagacgcgtgtcgttccggagatacaaaagtcaaattccaaggtcaaaccctaccacgaaatcgctttgaatcgcaagaataccaaggtgaacctctactcttgcttggataagaccatcgtgatttggagaccctgcaagcgtggcaccaagatatacataattcggcccaaatccgcagtgcatgccacggagtggtttacgtttatttatcaagtgttggggcggcaccgtccaagttcattatccatcaatgtccctgatttgaacgtttctcttgtctttcgaaatccatttaagcagttcgagtccaatggtgaggctcagaagggggacaaaatcgatggcacatccgttcaatcgacagatcgcgtagccgatgttgctgcggctatcattcggggttgtatggacctgctcgaaaaccgtaccgagtgggcggaagtgctacgcgaatggtcaaaaaccgagaagatgggcctggcctggaagcgctacgacagactggaatgggtggttggcctgggcgaagagaagatgtacggatctcttgcaatgcaaaccacccaccagcttcagctacgaccaaggcaacattatcaaacattcgtcaagattggtgatgagaaagtcgaagagccaccacctgtggagggcttcttggtccgtttgacatctcaaagaggagtgcatcaacggatgaacaggatgtttttcaaacgtctctatttcttcacacaagatcattaccttttgttctgcagaccagcgaaagccctgcctcctactcctccgaagctttgctcggatgaggctggcataccctcagcgcggcagatattgaacgagatgcctctctcatatgacgttgatccctttccaatccacgacggcgagatcacatggatgtcgagcgggaatgaggcccacctgaaggaacatgatcagaacgcttatgcacacagcaagagatcgatacacaatgtcacccatgcggatgggttcatcgatatttgtaaagttcgtgaggtacgtcaagtgtggcgtggcagctcccctgccgatccaaacattcgcgaaggtctcgatgtggaattccattctgaggcgcaagacacccatcgggatgatggtgcgacaaagcaatttgacgatgatcgaactttcgagatggtacttgagaatgatcttgttgttcgactgcaggcatatgacaagaccaccagggacgaatggataaagcgaatggatgcgctggccaaatattggaaagcccgcgttgcggccgactcggttgagcttaaggccattcggcggcgcaatctgaatatcttggacatcgatgaaggaactgagtccgtggtaggacagtgctccgaggaatgggaaacaaagaagtcagaagcatcacccttgttgcacaacatatgtactctatcgggttgccggacaataaaggtacgctgtgcgagctaa

SEQ ID NO: 12378 - DNA, 204 bp, A.fumigatus
cacttccgcccactcggtacggttttcgagcaggtccatacaaccccgaatgatagccgcagcaacatcggctacgcgatctgtcgattgaacggatgtgccatcgattttgtcccccttctgagcctcaccattggactcgaactgcttaaatggatttcgaaagacaagagaaacgttcaaatcagggacattgatggataa

SEQ ID NO: 12379 - DNA, 840 bp, A.fumigatus
cccctgctgaagacagatggtcaatctacgccgtctggcgaccagtctgcggctcctttgacttcggatgggagattctccgcgctcaaggcgttctacaaagaccagatagctgcgacgtccacatcgcccacagaccctctgggcactgactttggacctggctttgcctcacctggtgctctaaaccgtataatgtctctctatgcggcctcatcgcggctcagcagtctctacggtagcgccaataagaaacctaaatcaaagccgccggtcatgagagaagctctaaccgccagcgagggtctgaaggtcgcgactcccggcgccgaagacgccatcatccagcggatttcctcggaagtatgtggctgggacggcctcgcgtccatcgagcagcgcatgtttcagtcccctgatgttcggttcgtggaagaccttctccccttaccagtattactccgaaccaagcgctcgaaacgctgcaagtcgtgcaagcacatcctcgtcaagcctgagctcaaacctcagtccacccggtttcgcatccgtctcattgccctcagctacatacccttaccaactctacgacctctagccctgggaccacccacgggcctccccgcaataacaccttcagcatccagttcagctcctaacctggacgcccttcccccgctgaaacccttccagctgcttctgacactcaagaaccacatgttcgaccctgtccgggtaaccctcgccacaccctcagtaacaccaggccgcgtagcccacaaaagtcacaatcctctgcccgcagttcgacatcggagccaacagcgacgtctggaatga

SEQ ID NO: 12380 - DNA, 486 bp, A.fumigatus
agccctgcagggcacacaaactggaggagacaatcgctcctcccgttccggcgggatgaaacctcgggtaacgaaaaagtcgcagaagcgggcaaagtctgggacaaggggcggaactggacaactgttgtcctagaagttgtccctgggacattaccaggcggcagtctagggacccgcagacggcaatctctcggtgatgatgagggcggagacggggctagcagccccagtaccgacgataatgacgaaaccaacaacaagaatgccagcctcgactggagcggacaggcccaggatcccaagaaccagctccagcccgacgaagacgtcctggagatcccggtctttgtccgtatggaatgggactcggagaatcagatggagcaggctgctgggaaggggcagaactccgatacggtcaagcgagaattggcgtattggatggtgttgggggttggccggatcacggctgaacttgcatag

SEQ ID NO: 12381 - DNA, 285 bp, A.fumigatus
ggtaggaactccgtcctgaacctcgattattttccccttcgacgaccaactcccctcgcgacaaggaaagcagcaccagcagcacagccagctacccgtcgctcgtctgcaatcatggctgctatcaacaagatcgcccacaactcgccatcgaggcagaacccctccgagctggagactgcgatcgccggcgctctctacgacttggagagcaatacacaggacctgaaggccacccttcggcccctgcagtttgtctctgcccgtgaggtaagactcgcctga

SEQ ID NO: 12382 - DNA, 192 bp, A.fumigatus
tggacactggactctacaggttttgtgcatacatatatttttttcaggtcatctaacacggtactacaggttgaggtcggccacggcaagaaggccgttatcatcttcgtccccgtccctctcctccagggcttccacaagatccagcagcggtacgaaatgccaagcagaaaccagtatcacagcaggtga

SEQ ID NO: 12383 - DNA, 384 bp, A.fumigatus
caagactgtttgtgtagcctgacccgtgagctcgagaagaagttctccgaccgccacgtcctctttgttgctcagcgccgcatcctgccccgccctaagcgctctgtcaactcccgcaccaaccagaagcagaagcgtcctcgctctcgcaccctgaccgctgtccacgacgccatcctcaacgacctcgtttaccccgtcgagatcgtcggcaagcgtatccgcaccaaggaggacggcagcaagactctcaaggtcatcctggacgagaaggagcgtggtggtgttgaccacagactcgatgcctacggcgaggtttaccgccgactaaccggccgctctgttatcttcgagttcccccagagcggtgccgccgagtactag

SEQ ID NO: 12384 - DNA, 195 bp, A.fumigatus
tctgtcgatgacttggtaaatacaatctgccttagatgttactgcctcaggtgtaaagggcgaagaaagtcacgggatgagcgttcccctaagagggcagaggctaaccccacaacggcaaagcgcaataccgctaagcgaggcgccgagactccgatcccacaccagcacgaccgagcgcaaattgtagggtag

SEQ ID NO: 12385 - DNA, 183 bp, A.fumigatus
cacaagaaaagggggaaggatccaagaggccagttcatctttacaggatgtcgactgaatgaccaagtcactttcccctttccgctgggtgaggtgacgactcctgcggtgtaccttatgaccctgatgacccctatgaacgcaccgacccattttgaattacaaccacgcataattaattga

SEQ ID NO: 12386 - DNA, 243 bp, A.fumigatus
ctcctcaactgtctgctcttctccggaaccttcctctcgaacctccttaaccttcttatcttgccctcgacctcgccatcaaccaccttcaccctcaacctcgtcgtccccgctgatacggttcttctcgattctttcttggctgcattcctcaaactgagccgatatatatttcctcgaccaccttcttccttccgatcaccttgtttaggtcttgtgtacagaacagggctggaaggatag

SEQ ID NO: 12387 - DNA, 489 bp, A.fumigatus
agtgctgaaatccgggctttgttcagcttgtctcttccgcccatgcctaagcattacaggaaggttgtgcatgacatggcaggcgcactgtcactcaaatcacagtcccgcggcaaaggctcgtccagatttcccatgctgtacaagaactcccgcacccccaagcatacacagaaaacgatcgcacaggtgggagaaaatattatcgaaaacctcagttctctcaacgcgggccccaaggcacggacttcagaacaacaagaaactggcgaaaggcttctccgtggtccccctacatcatctgtcagctacatggaaggcgacgttgttggagcatcagcaccagaaatcggagcggaaaataagggaagagctatgcttgaaaggatgggatggagttcggggactccgctcggtgccataaacaacaaaggcattctgttacctgttgcgcacgtcgtgaagaattccaaggctggtctagggtag

SEQ ID NO: 12388 - DNA, 1278 bp, A.fumigatus
tgtttacgggacggcaccttaaagcaaagtacgctcgaggaccatcagacagaaaccgatctccgatatcatgtccatccaagaagaacaacgctgggagcctcgctcatcgaaaagagcatgaaaaccccgactatcgtagaggacacgaacctagcccgcagagtcacggctcaacgcatccttgggctaccgcatcacagccacaaaacaccgacgcaatcatgcgccacaacagaagacgcgttgggacacctactgcatgccaccgaatctacattgccggagagaaccgaccagatacaaccacgtgccattgatgaaactgttgatttcatacccttcaagtccacacatgcatcaattagggagcaatattcaagactttctgaagaagaagaaaatgacatattgaccgattacatagcgaacattgacgatgactacggagattactgtcagtggactgaattatgtcgtagtacaagcacggagtccgaaaacggtcgaatggacagatcggcgaatacactcgtctctgccgaactggtcaatgtcaactgctgcggcccaccaaacaatggggagagaataatttcatgcgaacgcggccaaatgttgactgaatgtgaagatgagagtgaccctgatctgacttggagaggtatgcccagccaactacatccaaatagttatcttatgctgaagtcaccaggttttactgctaaatcgaatggatttgcggtgctttgcacaagtttgcctgacaaacatagcaccactggctcctccgaatgcagtgatttcaaaacgaagggaattggcaatcactcagagatcgagacagagagcaattgtctgtctcgaccgcacagtaaccacaacaaagcaaagagaaatcatttcgcttcggcaacggcttttgctgaagcgttggaatcggacccattttatggattcgatattatggatttcaacaggcccagcctgcggaataaaacaaaagggaaccagcgtgcttttgatctgtcattatccgatagcgagttggaactgcaattggaacgggcgtggcgaaatgacagagagaagaagaaaacaaggaaacagaagagagaagagcttcgtgctggaggcctgctcggtcggactgcaaatgcacctgatctcagagcgaagtattcgagtggcttcgatgtcgatgatctgagatcggaattgcgtagcttcttgctatcatcaaaagaaaggtacgaatcttcctgcagccggtattga

SEQ ID NO: 12389 - DNA, 192 bp, A.fumigatus
ccaaggaccgttattgggccttcccccgaacataacttgaccccctgggccgggacacaaatcacggtggtggaaaaacacgaccccggaatccccgtgaaaacaaccctctgggctggattcaaacccataaatggtggcgagacaacaccttcccggttttacccgctttatgagagtgcccaattttaa

SEQ ID NO: 12390 - DNA, 186 bp, A.fumigatus
tggtcctcgagcgtactttgctttaaggtgccgtcccgtaaacactatctcatcctcgctggtgttatcccctctggtggcgatatggtttatatgctcagtatctgtggcattctctccatccggtgcaatagtagtagggggtggatatcgcatcgaatctccgttggattgttctgggggtag

SEQ ID NO: 12391 - DNA, 780 bp, A.fumigatus
gcgaggcggaccttggtcttgagagtcatgccctccaacaacaaacgaaagaagaaacctgcctctaatcccgctaggggtttcgcgactgtttctgtgccctcgaaaccaaaatcggtggactcaacgacccctgcatcgaccgttgattcccgatcagtcactgagagtgaccggccaacaccggcagaaccgagccagccaccttccgagaagcaagagccttcctccctacagaactactcgccggaggaacttgagaaacatttggagaacgcagagttgcagctgctggttgaaaagtttgctgccaaatgcaagaacgatgctgcccgccaagtcgcaaagctcgaaactgagcggagggtcttgcggcaacaggctgtatctctgaatctttcggaatggcttcctaaagaagtgcaggaactaattctcagccttgccgaagcggaagaacgcgaaatcagccctccgtctagcttgaagaagtcgagctctgaggaagagctgtacatgagactctggacattgcgggaaacgctcatgaaacttgggttccccgaagtgaaagttgaggaggcattgaaacatgtgctgttttacttgcccggtacagcgacaagttctaatagagacgtggtcccgaacctggatgagtctttggactggcttgccatgcactgcctttccgcggaactaccatcttatacacagtcgagcgctcaaacacgcaatgagtcggaacgactcgtttcttatatctctggtaaattctga

SEQ ID NO: 12392 - DNA, 1212 bp, A.fumigatus
  unsure (1140),(1211),(1212): Identity of nucleotide sequences at the above locations are unknown.
aatcaggagatctggagagcctgcgagtcgctctcttctcgagctcgactactcgcagaactcatgctctccaggagctccgcgatagaattggtaagttggttgttgctcacccctccggagtcagcctttcagcatggacattgctcacgcgctctgttctctttcgactttttaggcactgagttaccacaagaaatccggcagtcccttataggactcctttttacaacctatccgctctacgttgatcgcccctctcgacaagccgtccagcaatgtctgcgcacgatcctcaaggcgcccgttccgaccgaagatctgaaatacctcacccagaatctgctcgctgaggcttctaaacccggattagccccatcttccgcgtttgtcctgctggaatggtgctcccttctgctgcagatattgaaaaatgacccggacacacacctctcaatcgtccttgacattgtcgctgtggatgcaaaggctctcgaaacctgtcttgctgctcgtcctagaccaacgttgaaacagtctgcccttactgttacgagacgtgctctacgcgccattttctcgtcagacaattggggcgaggatgctgtccgccagtcagtcgctcggctgactggtgactcggcggcggggcagaagaatgcgcccttcctcggtgtcatttctggtgtatgcgcccgcttaccgaacagcaaggccgtcctggagaatgaaaagaaattgatcctcgcatactacatcaaagaattggtcggctcaaaagctgcagtaccaaaccacatcgcaagcggcttatccgacttcttcgcctcttttattacctacgaggatttcacatcagagctagtacctcctcttgagaaatcactcttgcgtgctccagaggtggtgttgggtggattggtgccttcactatgctcttctctgccagaggactttgacctttctgagattctgttctctcggcttctgaagcaccttctctccagcatgaaatcaaacaatgcaactattaggcaaggtgctgtgcaatctctggagtccatcctttcaaagtctaaaaaggaggaatggcttgtcaagatcgctggtgagatcatcgggcccatcaagacccagaanatcactagcccggagcatcgtgctgtgtatgctcaagcggtctgtggtatcctgcctagtgagagtgtctnn

SEQ ID NO: 12393 - DNA, 516 bp, A.fumigatus
ggccaccatcagctttttgatgtagccacaaaaggagcgcctacaggttcatacctggacttgcacgtctcttctaggacccgtcgagggctaagcccggtccatttaccgaagtcacgcatcgtgacggatgctttcttgagctcttctgtaataataccagtctccaaaattggctcctcagtctcgaacatatctccaagaagatctgctgtatctccgttgtcgtccatgaacccggcgccattctcagcctcagtcgacgcctcatccggcttcctgacctcgggttccacaggcccaccatttccttcgtcgcgagcaacacgtctggaaaatgctgcttccctcctcaggtcatcaagcttctccctccaccggtactcggcctcatcgcggtcaaacaacacgtcattctcaatgcttgcaagtttacgctggagtctcgcaacttggggatcctccgtggtaacattggcctgctcacgcccagattttttgcccttctttggctga

SEQ ID NO: 12394 - DNA, 750 bp, A.fumigatus
ccatggacaagatcgtttgtgctgacgggctgcctacagattccacatcatggcatcttttcggtgaccaatgaacctttccctcggccggctccaattgacgagcactggcaggccctgcaaggcattgtccgcagttgtcgagatgtagcgtgcacaatctttcggaccatgtccacggcgctccatctgcccgccgacaagacctttgaatcattccaccatccatgccacgcctcgctggacatcatccgactcctcaaataccagtcagcgcccccgggcgagaccacccctcgggtgccccagaccgcgcacacagacttgggatcccttacgatgttgtttgcctctacgccgggcctgcagatttgtccccgaggctccgacgattggttgtacgtgatgcctcgcgcgaacagcatgatcgtcaatctgggcgatgccatgagcatctggacggatggcgttttccagaatgtgctacaccgcgtcagctcgatgcccggtcaggccatggaggaacggtacagcttcgccgtcttgatgcgtccggccgatggggcgccaatggtttctttgatgcgcccttccccgagcggattggaggccgaacccatgcggtgtgacatttggcttcgggcgaagttcctggcgctccgcggccagaagaatggtgagcggaaggattctgatatcgcggtcctcacggggtgtcctgatgggcgaccccgttttctggaggtgtag

SEQ ID NO: 12395 - DNA, 318 bp, A.fumigatus
ctgcgccatgccgtcggggctgatcgcctgaaggtcctttacctgactggacgcaatgctgctctggcctctgactatgccctgcaccgcaaacgcgaattgatggagcatcatgtgtgcgagtgcaggggccacaatatgtggatcgaacctcccttgaacatggtagggtccttggttgccactcggggtgatgattatctcgggcgacagcttttcgtcgccatgcactgcaggatgaagactatcgcccacctccttcctctggatagcgatatcagtctcactgcctgctccctgggccacccacgatcttag

SEQ ID NO: 12396 - DNA, 246 bp, A.fumigatus
ataactactccgtaccagacatccaaacgcacatacaactactgccaggcggttttgcctaggaacagctatggcggtgaagactttgaccatctaggctcttctcctgctctagcttgtgtcgatactgttcgactagcgcaacctgaggacatattttgtgataataagaggatgtactattatggaggtatggaagaaatggttttgcttttcatcttgctccgtagtcggtaccatacataa

SEQ ID NO: 12397 - DNA, 597 bp, A.fumigatus
tattacttcgcatcgcttccctttcatttccgaactgtattttgtttggttgttcattacctactataccatacccatatctcaactgcttcattgttcttcccttccccgtatattactttctccatccgcaagtctattctacacattatgccttacaatacgcgccgcaagtcgttgtctcttccttctctgggtattcatcttcccaattcatctcgtcggtccccttctgcgtcgaaacagccgcacgcgaccgacgatccactgccgccatctaaaaaagtaaagaggtcgcacgactcggtatcatcatcaccggaaccttcgccatcctcgacttcttctacagatgcaaaggaccagcaaacaatacggcccaacggaagacgcggaatttatgagcatacgccccctccgtcccctacggacggaaccgctgcgcccaagatcgacatagaaggtatcaacgacgacatcgtcgtgggggtgattgagcaactagagaagacgggaaatcgccctcacctagttaaggagctcgcagccattctcgttaccctcaacgagaatgtcgcaaagtatgctatcccctag

SEQ ID NO: 12398 - DNA, 1047 bp, A.fumigatus
  unsure (846): Identity of nucleotide sequences at the above locations are unknown.
ggagctcgcagccattctcgttaccctcaacgagaatgtcgcaaagtatgctatcccctagccttgaaaccgtcttatgcttggaagctaacagtctcgcttttgcctagctccgccaatcccgctgctctcttgtcttcgcgactaggcacatacatgaagcgcccttggactgctctggcgccgtgccctattgcaaaggagttaattcctatacatccgcgcaaagtgtattactacctcacgacattaccgcgtcggcctatcccggagaactcagatgatgtgatcattccaggtgttgatgggaaagacttcacgcctagcgtttccaacgctgacctggatgatgaggagatgatggcgcgggaacgatcgcttagtcccgaggttgacctgtcctcgcctgacttcgaggaagaaaatatcgatcgtagtgcaggacgccctggccacagttttagtgaacatcacagccatgcgcgcctcatgcattcgaatcgcgccgcatctccgccgctggagggcgatgagaaggagttcacgcagactgccagtgctgttcgcgagcgggcctcggagcagaaagcagccacagagaagtcctctgctctttcggatgctctcagcgagttggaaaacggtgtcatgagcatttcagagaccgcaatcgaaaacagtcctctttcctctatcaacgaggagcgcctgccggatcacgaggacagcgattacttctcacacggaaactaccaggctcaacagcggttacaacagcagctggagttggagcaagttgataccgattctgtggctgcgtcggccctattcgggacctcgccttcnccatcactcgcatcggtcgcgtcgtcgctctcgtcaaggacgagtgccgcgtccgatgacggtcttgaagttgaagaccgtgcgactgtcctcgccagtgctctccagatcagccttcttgaagatcctagtgctccctcggtctccaccctgaaacgatctattgacatgttgaatattgagcttccagacttggaatga

SEQ ID NO: 12399 - DNA, 339 bp, A.fumigatus
cagatgctgattctacaaggctactggcttcagatctcgggcgcaagtgtcctttcgattactgatattgtccatggcacctacggcgaaggaagcgacgggatctttggcgatgtcgacgatgtcgatgtggtccgcgagattattcgcgacaatgcgactcgccgtgcagtcgataactttattctcaatctgagcgggcccaggacagctcttgtgtttgcaccgatcatttacggacgcggtcgaggcatcatcaaccagcggagtattcagatccctgagcttgcgagagtcgccattgaaaccggacgagcgatccaagtgggcaaagggtaa

SEQ ID NO: 12400 - DNA, 390 bp, A.fumigatus
atattcttcagattgcgtgagaatgaggccgccttcgaccgctacaagatccttcctcgcgttctgagaaatgtcgacaacgtcgatacaaccacggagatactaggaaccaaggtttctcttccgtttggattcagccctgctgcatcgcaaaagctagctcacccagatggagaactggcggcatcgcgggctgccgcaaagtatggcatctgcatgggactctcgtcgtattcgaattactctctggaggatgtggcggcccaggggaccggcaacccgtacgtgatgcagatgtgtgttttgcgggatcgctcaataacaatacagttgctggagcgggctcaaagtgcgtctctcgggtttctgtctggcgtcgatacgtactaa

SEQ ID NO: 12401 - DNA, 204 bp, A.fumigatus
tatggagcagaggcgggatacaaggcattgttcctctctgtcgatgtccctgtgctcggaaagagactcaacgaatatcggaatagttatacgcttcccgaagacatgaactggccaaatatcctcagttgcggcgctgatacctcaaaccgtacggactatggtaggagttcccaattccctatggctgccgcagaaagataa

SEQ ID NO: 12402 - DNA, 333 bp, A.fumigatus
tcttcaacccacggcggtcgccagctggacggatttccagctacgctagatgcgatgagagtctgcgccctaatggcacggggacgaatcccgcttgcgatcgacggtggcatccggcgaggatcggatatctttaaggctcttgcacttggcgccagttattgtatcgtggggagaattcccatttggggccttgcggtaagctttgttctctggcatgttgccatgatcggcctggctaattacattcagtacaacggccaagagggcgttgagttggcaatcaggattttacaacaagaattgaagataaccatggccctcgcagggtga

SEQ ID NO: 12403 - DNA, 315 bp, A.fumigatus
gcatgccgatccgcatcacccctctcgcctgtccgaaggcttatattagaatctcagaggccattgactgtgaatctcatcatccatcatacaatttcacacagatcaacaatcagaaccatgggagatctcttcgtcgatattcggacgccaaataatcacgcttaccggcagccaactggcctgttcatcggcggtgaagtcgtggccgcgtcgagcgggcaaactatcacttcgattgaccctgcgtatgtgtggaggatcctctctgagtcttcaccacgagcctgccaggatccgagcttatcgtgtaac

SEQ ID NO: 12404 - DNA, 192 bp, A.fumigatus
gtatcattgctcgccgaagaggacagcggtggaggccccgccgggctgacgggcttccccacagtgggcgcttcaatttcaggtgccacagggggctctgacgaaacgagtgtcttttctgagtctgtcatggtggtgtctaactgtctgactatacttgaaaaaaagttgtggagaaagtcgcgtcgttga

SEQ ID NO: 12405 - DNA, 1392 bp, A.fumigatus
ctcactgcaatcaacatcaccatggcatcgtcgccgagaacaccccattcacatttttccttaaagcgacagagcacacagcacattttcagctgttatgcctgctcctattacccaacttctttcttcatagcctacatgtcacgcatatgcaaagccatggcggacaatggagagggaagctcgagacctcctatatggcacagcaaaagtccccgaacgcaacctcctcgaattccatttccttacatcaacccgccttcagagccctcgcctgaagacgtcctgcctgatatttttgagcaacggccggacatatacccaggaagtgcatggcgaggatggcgtcttcgagcaccttttggcctgaaacacaaccttccgcagtatgagatgaacaaacagtgtacccatggcattatggttcgccggtttgtggacgatcgtatactttgtcccaactgcgctcgccagccccttcttggatggttgctcctctgcgtcgaagatctcgatcaaccaaacggtccggggctgtcacgaggaatttccagagccatgataaacggtcactacactttcagagagagaacgatcgtcaggcaacagagggcaatcgtgttgcagcatatggagcaagagtatgggttggcagcagctccattctcacacatcgaagtcatccagggaatcgaaccgggcgacgaggtcgatgataacggcaacgatggactgcccacagagagaatggagggtatccgccaggagaatcaggtagaatcaatgccttgtctggaacaaccttccaggcagccgcgtccaccttgccgattctggtgctgctaccattgtatggatcatatcccggagcgtgcctccatccatcttgacggcttcttcaaaaatccatgtactgcgatcacccttccatgggagctcagcaacaaaagggtttcggacgctagagttgtccgcaacttggacaatcattacaagcagagggagcatttctttgggttgccaactcctccttatacattatccgaaagcatgagtctcgcaataatgcagccccggcttatgcgcctttgcgcaattgcatcacggactgatctgcgtagtctttgcgatccgttgaaagtaaaagaatattcaagcgcaggtcttattcccggggtcagtgacagtgacagtggatcagcacattcctttttgagcggcggctcgagaggcatcttgatagcttatgctaaagagaacgctgttgagcctgctgaagtacggagcactcatgagcgtgaaagtgaccttgatgtcgaagtgggcgatgacgattatggtttggaatcgctatttcgcagtacgactttggacatttgcgacctcaactga

SEQ ID NO: 12406 - DNA, 627 bp, A.fumigatus
aaaaccgtacgaagtctacacgcaataccaccgccccgtcctcatcgccgcaatcccggcttctcgccctttcctctctcatgtctgagaaccggtataccatccggctctggggttctggttcccctccggacttggggatctgctactctgaagtcaccaccttcagatcccattattcgcaacttgacactcgcccaggtggctgtgaacatggtataccaatttctcgagaacgtgggctacctggcatccaaaggtgtcatctcgaagaagtggatcgatcgatggggaggcatcaacaagtggtatctgtggagtatccgggcctggttcggccatattatcttccagttcttcgtgctgtggaggcaggttgtcttgcggaggaggaagattgcaagtaacccggccgaggcgcagacaaaggagggccaggaggaactgagggcagagattcgtgcctggaagaaggctctggtgaacaacgtttgctgggctccgttgtgtcttcactggtgttttgaaaacggtgttggcatcccagatagcttgtctggtgtgatcagtttcatggctggcgcttggggattctacgatctttgggctgcgactgccaagtcatga

SEQ ID NO: 12407 - DNA, 312 bp, A.fumigatus
tttaatacggaggaaatcacctacgatgaactgactcactgcaatcaacatcaccatggcatcgtcgccgagaacaccccattcacatttttccttaaagcgacagagcacacagcacattttcagctgttatgcctgctcctattacccaacttctttcttcatagcctacatgtcacgcatatgcaaagccatggcggacaatggagagggaagctcgagacctcctatatggcacagcaaaagtccccgaacgcaacctcctcgaattccatttccttacatcaacccgccttcagagccctcgcctga

SEQ ID NO: 12408 - DNA, 2493 bp, A.fumigatus
gacccccgtcctccgcgcgctccgcccccgccgccgcctgtgaaagttgaccttccccattcgcgtcctggcgaagatatgagtgtagtggaggatggcccattgttccgagccactatgaaagcgttggagcagaagacagggaacatgcgtgcgaaaatcaagaaggtgctgaagaaggcggaggctgcccaacaagcccaaggggcctgcaatgatgctgtggaagccttcctatccgcgctcagcgaggcctcaacgactaattccaacgcaatccaaccagctctcgatcactattttgagaaaattgctcggcagatcctaaattatgagagactcaataccatccaactgcaaaagctcgtcattgaacctctggtgaagctttataataatgacatcaagcaagccgaggccaagaaaaaggagtttgaagaagagagcagagactattatgcctacgtgagtcgctacctcggtcagaggcaggattccttgaaagagaaaaagcgagcggagagcgattcccagtaccaagctaagaggcggaactttgaattgaagcggttcgattattcctcgttcatgccagatctccatggtggccgtaaggaacacgaagtcctttcgcccctgaccaggtacgcggatgaacaggctaagagctttcttgcggcggccaagaaggtggatgatatgattcctcaactggacgctctgattcacgaggtcaatcaggcagacaaggaattccaatttcagaggacagaaagagaagagaaacgaagggctctggaaaaaagcagtaacctatttcttgagccggattccctcgccaacccaagtgttccgtcatccctgacgggcaatggtagtagttgtcacatgtctgaatcggacttgggccgtgcagacagcacagggtctcagctgcgaagtgtggtcagcaacagttcctccatggcctcgcagacaaatgcagctatgaacagcacggccggaatcccgccgatatcctcaaatgccaattcgagcggccagcaacggaaggagggacttctctgggcattatcgcgtccgggctctcacatcgatcccaagggcatcaacaagcaagcttggcataagttctggattgtgttagatcaaggcaaactctcagagtacagtaactggaaacagaagcttgatctgcatatggacccgattgacctacggatggcctctgtgcgagaggcacggaacgccgaacgacgattttgtttcgaagtcattacccctcagttcaagcggatttatcaggcgacttccgaagaggacatgggcaactggatcagggccatcaacaacgccctgcaaagtgctgtcgagggtcgtggcatgtccccccccgttccgtcaaagaacgacagttcgtccctgggtcgcgatattggttcagtcttgaccgggaaaagctcgtcgtattccggccaacactctcagtctgcaagttctgtcagcagtgtcagccgtcgcaccacggttggtgcacgaccaagctacgtgcgcaacgatagcaccggctatgaagagaaccccgccaaattactgcagaccgtccgcgatgcggaccaaggcaataattggtgcgctgattgcggctcgacctcgaaggttgagtgggtgtcgattaaccttggaatagttttgtgcattgagtgtagtggcattcatcgttctctgggaactcatatctccaaaatacgttccctcacattggacgtgaattctttctcaaatgacattgtcgagatcctcttgcagattgggaaccgcgtcagtaatatggtctgggaggcgacgctagaccagagtcagaaaccgatggcaacctcgactcgggaacaacgactgaaattcatcactgccaagtatagcgatcgagcgttcgtacagccactgccctcgcctttgtcacggttttcgactcctgatgaaaccttacttgcggcaatcaaaaagaatgatatccaaggcgtgctatatggcattgcactccgagccgatgttaacatcactgaccggtctcgaaacacccatgcggtcttcctcgctctagcggctgcagaccccgcgtcgcccgggtcgacgccgtctaacctgccgcctagacccagtactgcaaacgcagccaaggcgattccgttcccgatagcagaattgcttgtgcagaacggcgcggaaattccttcacagccacctcccattcctctatcaccagctgctcagctctatctgagccaacgcacgacgagatacgtgacgcccatggcaggcagctctactgcggacacagtcggatcactgcccagcattcgaggaacagcaggtgatcaggcggtgccatcgggatccctggacagcaaggagcgtgatagactgcacaagagaggaagtgctggagctcgatttgctggaaaagtcgcgtctctcggcatcgaacgatga

SEQ ID NO: 12409 - DNA, 186 bp, A.fumigatus
aggccgttacgtctcaactctacagctacggacctgacgatccagatcaattggcttacaggatgtattagacggcatgttaagctcgcggctcttcgtctcctacgtggtgcgacccataaaaacgggttcaaggcggctgtggaagataacacggacatttacatagtcactagaggaatatga

SEQ ID NO: 12410 - DNA, 273 bp, A.fumigatus
tataaagtcatggcgtttgaccaggagggaactgctcagctcacagagacaacgacgtcgtacgaacctccacccatctacgacaccattgcggaccccatcatcctcaggacgctcctggtggaagatatctatcttcctgggggccagtttgccattcatttgtcaattgcccattctgccctgcccaagggcgctacaaccaatccaacttggccactcgcattcccaccgtctgcagaatacaacccgtttcttaatggcggccgcttt

SEQ ID NO: 12411 - DNA, 1245 bp, A.fumigatus
  unsure (1245): Identity of nucleotide sequences at the above locations are unknown.
catagaccatctacattcattacgctattcgcagaaaacaaagaaaagaaaagaaaaggattaacagcacaagaaatggagccaactccgtttcagagctcggaccatggctttcaatcaacaggcccaaacgtcgacagaaaaggttccgtaaaacgggcgagacaaatgttagaggctggcagacgtcccgatatcgcgatggcgccgtcgcaaagtattcatcctggtcctaaccccaaggtcaaggcagatcagtcccatatgacccaatggcctttaccgactgatggtgtcctgcaaacaagcgtgtccagtactcaagcaaggcagttcatcccaaatgggctccctccagagcgaccaccacggcctgatgccccgtctccgtcggtttattctgaaagaagcatgtcggacatagcacccagtccccttcatctggcccggcctatcccctcgttctcacaccctttgccaaatccaccacctccccgccctccctttaaggggcatcttccaccttacgggccggatcgtgctgcatatgcagcccctcgagttcctatgacgactgatgaatcgttcaggcagtctacagcttcttctttcatgtccattccttctattcccgactttgctcttcccgcccaacctgcaactgcagaaacaaacccggcccaaaaagagcaccagaggcgacttgccccatccaatgctgcgagattctccacgaagcgcaggtcgtcggtctctccgatcccagaagaactctccgacagcccaactatcttgcaggggtcatatgcatccagccgagtcattccgtctagctggggctctgcaccggccgggtctgaatttcttggagcctatcaagacgtcgagtcgggcgacgatcaggattccccgcctaccgttcatgagggagattcgaatcttgtcagacaagccagccttggcaaaaggggcaaaccgtcactacgaacgatccagaagcccagtagcccatccccggtatcaatggtagaagagcgttcggtcagccatattgtgcatgccgcaactgcttcagagaggattgcagcagggtcaaagaacgaaagacattccgtctctacaatctcgaccgattcgtctgtactcgatccggagaaacgccgatcgtggtggacatcaacggccaacatcctgcactccagcacacggatgatgatatggaatcttcgcagaaggagtgggtan

SEQ ID NO: 12412 - DNA, 258 bp, A.fumigatus
aaccaggcaagaatgtggatgtccaaggttgatccatatcttgaagctagtgctcagcctctgatgggagtgctgatcagtcgaacagtgttacttcaggcgatgaaagaagagcctgcgcctgatgccaaatgcaaagacaagttcctggttcagaccgttgccgtgactggtgacatggagttctctaatgtttcttcgattgtgcgtctgtcccttgctgcaagttgtctgccatactttctaacagccatttag

SEQ ID NO: 12413 - DNA, 441 bp, A.fumigatus
agtgcacctgaagaagaacccccttcctatacgtcacctggcgcgaactatcaaactcctgcagttggggcttccaccaaattttccaatgacacgtcacctatcccaccgccagatttcagcgagaagcccaagcgggatgctttcgcccaacagtcgaatgagacttcagccacatctgtcaaatcgaacacatcgggtatcccagcttcagctgatgagctgaaggctcaactttccgaggccaatgctcagattcaaaaactcaaggagaggcttgcggaccagggattgagacagagaaagattgggggcgataacgagaaatcaacgcctacgatgcaacaacagcaggtccagcccgacgccgcaggtgtgccattgcagatcgtggccgggctttgcttgctaagtttcttgatcgcgtacttctttttctaa

SEQ ID NO: 12414 - DNA, 201 bp, A.fumigatus
aagtatgatttcctagttacccttatgatacgaatccagcagatgcagcaattctgtctgtacctcgcggaagagcacggggacttttctatcaaataccatgcgcaactttcaattgtatcgtacgaatttccttcaaagctcttccggctttgccgcatgactatctttcagtcttcgtctcagtcttcctgttactga

SEQ ID NO: 12415 - DNA, 381 bp, A.fumigatus
cgagactggacgtcaaggtcaagatcagtcagtttaccaacggcgagcgttgccaagtggggcagcgttggaagcggtgtaagtaccaccacgaccacggccaccgccgcgaccaccgcggccaccccagcggccataaccgccgtgaccaccaccgccgccgctgtagcgagccatctcagcgagacgggggtcaatctgctgcttggcctcagtgaggatagtaaccaagtcacgagcctgcttggagtctgcattgaagagtcattagtcatgacaattactgacaggggtagtcgcaagagaaacttactttcagtggtgaagaaggtaatggcagttcccttcgcaccagcacgaccagttcgaccaatacggtga

SEQ ID NO: 12416 - DNA, 1299 bp, A.fumigatus
gtccaaggtcctcatggtatgagcaccattttcaggagacccgacaaagcctggacgagtcatgttataccaacatggtttcttttagaagagagtcaagcaccgtgccattgtcacacgacgtcaatatgggtgagggagcttaggaaggagaatagggaggggagaggggaaagttgcgattcaatcataccaataccacgggaagccacatcagtggccaccatgattgggctcttgcctgtcttgaactcgttcaagacccaatctctttcctgttgttgcttgtcgccgtggatagctgggattgttgttagcaagaggcattgggggaatgataaaatgatccgaagacttacaaagtgcgggccatccgtcctggcggaggaatcgagtaatctcatcagcaatgcgcttagtgccggtgaaaatcagacacttgttgctacggttttccatgattttctcgaggtgcttaatcatcttgtcgcgcttttcgaagtcggaaacgacctcgacaatttgagtaattctgtggttagcagacaagtccatggaaccgatgttcacctggatgtagtcgttcaggaagtccgtagcgagctgacggacttccttgggccaagtggcggaccacatgcaggtctgtctgtcaggacgaatctgagaaacaatcttgcgaatctgaggttcgaaacccatgtccagcatgcggtcagcttcgtcaagaacgaggtacgtgacacggcggaggttggtccggccagcttccagcatgtcaatcagacgaccaggggttgcgatgcagacttcgacaccgcggctcagatcacgaatctgagggcccttgggaacaccaccatagacgcaagtgttgcgaatccgggaagactttccgaacttgctgatttcggcttgaatctgaacagcaagctcacgggtaggagcaaggatgaggacaataggaccatcgccgggagcaaggagaggctgagcgttgatgtgtacaatggcagggagacagtaggtaagtgtctttccggaaccagtttcagcaataccgacgacatcccgaccagaaagagccattggccaaccctgagactgaatggcagtaggacgctcgaagccttgagccttgacctcactcaggacgtactgggggaacccagcctcgtcgaaattctcgacgggacgaggaacattgcgtccctgcacagtcatctcgtgcttcttgcggaactcctcaacctcgcgctcagagcgagcggcaacatcgggatgctctttgtagaatga

SEQ ID NO: 12417 - DNA, 318 bp, A.fumigatus
ttttcaccggcactaagcgcattgctgatgagattactcgattcctccgccaggacggatggcccgcactttgtaagtcttcggatcattttatcattcccccaatgcctcttgctaacaacaatcccagctatccacggcgacaagcaacaacaggaaagagattgggtcttgaacgagttcaagacaggcaagagcccaatcatggtggccactgatgtggcttcccgtggtattggtatgattgaatcgcaactttcccctctcccctccctattctccttcctaagctccctcacccatattgacgtcgtgtga

SEQ ID NO: 12418 - DNA, 231 bp, A.fumigatus
ctcttcaatgcagactccaagcaggctcgtgacttggttactatcctcactgaggccaagcagcagattgacccccgtctcgctgagatggctcgctacagcggcggcggtggtggtcacggcggttatggccgctggggtggccgcggtggtcgcggcggtggccgtggtcgtggtggtacttacaccgcttccaacgctgccccacttggcaacgctcgccgttggtaa

SEQ ID NO: 12419 - DNA, 234 bp, A.fumigatus
ctgacaaatacatacagctctagaggtggtcacgacaccggttatcaaaatggcaacggctactctggcggctattctggcggtggtggctacggtggtggctatggcggtggttatggtcgcggtggaggtgccgctggtggtgatcgcatgtcgaacctgggcgctggcctgaagaagcaagattggggtaagttgactaccttggattcccgttctgacttcgggtgctga

SEQ ID NO: 12420 - DNA, 777 bp, A.fumigatus
aaatggtgctcataccatgaggaccttggacttacagtgcagtgtagcagattgattcgtactttctgttctgagttttccatctctgttcttgaacctcgttggtcgagagatgggctttctctcacttcgactttgttgaggctgcattccaaggttactctaggaccgcgatcctgccccaggcgatggaccttaccacaaacggatttcgactatagagtccgcgagagagtgatgcatcaagtctcacatgactcaaaagggcgcctaggcctcgttgctattttcactaatgctctttttgctaacctaaatctgtttaaagatgttcgcgacatcactcatgtgctgaactatgactatcccaacaactcggaggactacattcaccgtattggtcgaactggtcgtgctggtgcgaagggaactgccattaccttcttcaccactgaaagtaagtttctcttgcgactacccctgtcagtaattgtcatgactaatgactcttcaatgcagactccaagcaggctcgtgacttggttactatcctcactgaggccaagcagcagattgacccccgtctcgctgagatggctcgctacagcggcggcggtggtggtcacggcggttatggccgctggggtggccgcggtggtcgcggcggtggccgtggtcgtggtggtacttacaccgcttccaacgctgccccacttggcaacgctcgccgttggtaaactgactgatcttgaccttgacgtccagtctcgtcactga

SEQ ID NO: 12421 - DNA, 1164 bp, A.fumigatus
ctaccttggattcccgttctgacttcgggtgctgacttgctatccctagatttggactccctccccaagttcgaaaagtcattctacaaagagcatcccgatgttgccgctcgctctgagcgcgaggttgaggagttccgcaagaagcacgagatgactgtgcagggacgcaatgttcctcgtcccgtcgagaatttcgacgaggctgggttcccccagtacgtcctgagtgaggtcaaggctcaaggcttcgagcgtcctactgccattcagtctcagggttggccaatggctctttctggtcgggatgtcgtcggtattgctgaaactggttccggaaagacacttacctactgtctccctgccattgtacacatcaacgctcagcctctccttgctcccggcgatggtcctattgtcctcatccttgctcctacccgtgagcttgctgttcagattcaagccgaaatcagcaagttcggaaagtcttcccggattcgcaacacttgcgtctatggtggtgttcccaagggccctcagattcgtgatctgagccgcggtgtcgaagtctgcatcgcaacccctggtcgtctgattgacatgctggaagctggccggaccaacctccgccgtgtcacgtacctcgttcttgacgaagctgaccgcatgctggacatgggtttcgaacctcagattcgcaagattgtttctcagattcgtcctgacagacagacctgcatgtggtccgccacttggcccaaggaagtccgtcagctcgctacggacttcctgaacgactacatccaggtgaacatcggttccatggacttgtctgctaaccacagaattactcaaattgtcgaggtcgtttccgacttcgaaaagcgcgacaagatgattaagcacctcgagaaaatcatggaaaaccgtagcaacaagtgtctgattttcaccggcactaagcgcattgctgatgagattactcgattcctccgccaggacggatggcccgcactttgtaagtcttcggatcattttatcattcccccaatgcctcttgctaacaacaatcccagctatccacggcgacaagcaacaacaggaaagagattgggtcttgaacgagttcaagacaggcaagagcccaatcatggtggccactga

SEQ ID NO: 12422 - DNA, 186 bp, A.fumigatus
tactatggcatgtcaggtctgttccagaattatgtgaacaaccttctggacggtagcaagggtcgcggtgccttcggtatgggtcaccagggtgccaccggtctgacgactttcttccagttctggtgctacggtgagatctgtccacccagaacttcacaaacaacgacgaatgtactgacataa

SEQ ID NO: 12423 - DNA, 381 bp, A.fumigatus
  unsure (360),(372): Identity of nucleotide sequences at the above locations are unknown.
ctggatgtagtcactcctatccttggtgccatcattgccgatcaatacctcggaaaatacaagaccattgtgctcttctgcggcgtgtacctggtcggtctcctgatcctggtctgcacttcgatccctactgctctcgagcacggtgctggtcttggcggtttcattgtcgccattctggtcatcggtctgggaacaggtggtatcaagagtaacgttgcgcccctgattgccgatcagtacaggcgcaagaagatggctgtcagcactaccaagaagggcgagcgagtcatcattgaccctgctctgaccatccagcgtatctacagatcttctacggcgcatcaacctgggctcttngtctctgctcgntactcttaa

SEQ ID NO: 12424 - DNA, 1017 bp, A.fumigatus
  unsure (11): Identity of nucleotide sequences at the above locations are unknown.
tctctgctcgntactcttaacatggagcgggacattggattctggtcggggtacctgctctgtctgtgtatgttcgcctgtggtactctggtgctcattgttggacgcaagttttacgttgtccgcccccctcagggctctatcattaccgacgctttcaaggctctcggaattatgatcatcaaccgtaacatggatgcgcccaagcccagttggcaggctgccaatggtggcagcaggcgcaacctgccttgggacgaccacttcattgatgagctcaagcgtgctctagttgcttgccgtgtcttctgcttcttccccatctactgggttgtctatggccagttctccggcaacttcgtcacccaggccgcgcagatgcagggccacggtatccccaacgatctgatgcagaactttgatcccatctcgattattgtcttcatccccatcctggagaccctggtgtatccgctgctgcgccgtttccatatccgtttccgtcccatcacgcgtatctccctgggttttgtcgtcgcgtctcttgccatgatgtacgccgcgattgtgcagcacctcatctattctgccggtccttgctacgaacatcctctctgtgatgcttctaaaatcgacggcaccgctcaaggcaaccgggtccacattgccatccagacccctgcctacatgttcatcggtatctcagagattttcgcctccgtgtctggtctggagtacgcctacacaaaggctcctccttcgatgaagtcgttcgtgcagtccatgtatctgctcaccaacgccttcggctccgctatcgccgaggccttgacccccgccgccttcgaccccgccatcatgtggatgttcgtcggtctggcctgcgcttcgttcttggtcggtgtcatcttctggctcgtgttccaccacctcaatgcccaggaggacgacatgaacaagctggatgccgacgatccggatactcctcctccccgcgcgcgcgaggagaagaactag

SEQ ID NO: 12425 - DNA, 1032 bp, A.fumigatus
tccttccagccccgtggtgaagacagagggctggaggctgagagattacagcaacaaaagctggtagagagtttgaagcagaagattgaagagcacgaggctaccgctgctgctcatcttcaaaaaattgctgctctcgagcaatcgcacaagaccgcgcaggagcagctgtcggatcttcttgcgaccaaggacagggccagcggtgaggctgaagggttccagtctcgtgtgtctgaactggagaaagagattgagatccacaaatcggccgctgaatctcacaagaaggacctcgagtctttgcaggaattacataagactgaattggctgaactcgaggagcgcgctaaggcagtggcgcaggccgagtatgactcgcggattgcggagaagaatgccgagcatgaggaggcgatgaagagtctgacatctgaaattgagacatcgcggaatgagctggtgaagcttctgaagatggtttcagaacttctcaattccgatgttaccgcggacaacctcgcagaccaaatccaagatatcctcacgcaaaagcaacacttttccgacaagtatgccgagctgatagatgcaaacgaagatcttcgcaagcagctcgaagccaagaagggcgatgccaacaagttggaagaccttacccagcgcgaggcggccaaggacgcaaaggtgaacgaacttgccatcctcgtcgccacgctggaggatacccttcagcgtaaagaagagcaagtcaagaagaaggacgcgctcatcgaggagatcaccgccgagaaagataagagcctgcgtctggtggaagagctagaggaacagatcaccaacagcttcgaccagcaccacaaccgtctctccgtcatccagcatgagcgcgatcaggctttggaagaagccaaggccaagattgcgacgtatgagaaagaaattgagacatatcgcatgcggattgaacagcttgaggtaagcactgctgtgttacatactgcaatacggatcccgactaatggactttag

SEQ ID NO: 12426 - DNA, 549 bp, A.fumigatus
cttcaactcaagaatggtgccggccaggatagttcgcatgaccgcaccagctcgttgacctcgaatctgcggaagagtacttcggcaacctctctcccttcgccgccacctgccattcctcttccgcctctgccgactatacagtctgccaccaacggtagtgtctctcctccaaactctcgccacaccagcaaggaactggtcagcgtccaaattgtggaagaccaggaggctcgtatccgcacgatagaaaaacatctcaatgcggagaagcaactcactgccactttggaagaagctctgggcgatcttgaagcgcagagtaacaaagtcaaggccgactgcgaggcctggaagaagaaggcatggcaactggaagaggagttgacggcccttcgcaaggagcgcaactcgcagcgcctctcacttcaggccgtcgaggaagaacgcaatgcccgccgcgaagccgaggctgcccgagcccagctcgaagagcggatgaatgcgctgaacaagaagaagaagaagagcacgctcaattgcttttaa

SEQ ID NO: 12427 - DNA, 690 bp, A.fumigatus
  unsure (292): Identity of nucleotide sequences at the above locations are unknown.
tcacaattcggaccagcaccattcgacatgccagctggagaaatcatgagagctacctataggccagatcctacagctacacgagaaacactcgacttctttagcaccatccccaaatgcgcagagatcctctctcagcctgatttgagggtcaaccacccgcgcaacccagacgcctttttccactcgaccctcagatccaacaacggaatcctcaagtccatcttcatttaccagccggctcattctcataccccagcgtcggatgttagtccaagtgaggccaacgcanacgcaatcccacgagaacgagggcaggagggaggacgagaacgaggctacctcctcctccacctcggcgccggcgtatcagggcagcccgatatcgcgcacggtgggttcctggctacagtcttggaccaggttacggggactgcgatccgggcgagtgggttagatcgtgggcggggagcagtcacagtttatctgaatgtgatttataagaaaccggtgagggttccgggggtggtggttgcgaaggcagaggttaagaaagtacaggggaggaagatttatgtggtgggggagatttctgttgctgaggcagatgggggcggggaagagcagggtgtttgtgtggtttgtgaagggatgtttctggttaagagggatgctgctggcaggatttaa

SEQ ID NO: 12428 - DNA, 186 bp, A.fumigatus
ttttccgcggctggagattcatcctccaacatcaaagctcagccccagctcctgaagtacaaatggggtgcaaaaagcattcgaaccacccctaccttaccacctaaggacctagtctgctggcagaaagccacgaaacgcgtacatcttcatcacttccctaggttatcaacgaccaaaaagtga

SEQ ID NO: 12429 - DNA, 183 bp, A.fumigatus
aaggtgatatttcctagttatataactagaagtagcaggaataaagagatttttaagctagtaaaggcctatcttattagtagtccatctattaggactaactttaatcctactattgtgtgggagcatgatatcttaatactaaccctctatatagacttttcctttgaagataatatatag

SEQ ID NO: 12430 - DNA, 3198 bp, A.fumigatus
ccccgtggtcacaacccttttccgaagtccaccgtgcgggcgttaacctccaccgatgcggtaccaaagaatgagaaagctgctcatgatattctctggaagagtatttcacaagtctccccggcggaacgcgccctggggatccgcgcggctatagcagcccagaggctgggcgagtggtatcgggaggtgcaggcatgggactggccgaagcgagccgatgctgaattagggaaaggtttcatgccgccatcttcgagtaatgtcaactctgaggagcaaggctactatggcagcctaccttcggttgttgttaagcagcacgaagatcgcattgaagagatccgagatggaatggaaacattggacgtggacgaactcaaagaacatgtactcaacgcccacattccagcgcggtctcggccctcgtcatcaaatagcaccgtttctgtcccccctcctctgacctatgttcaactgagcgatttcactgccgtcatcaccgccaccattcttcgagcccttcctcttttgtcccggttgaacaacctccttacgacatgggacgttcgactattggtccttcgccagattccgggcctactacgagctttgcattttgctcagtccgaggtggattctgcgatggacctgttgaaagctaccgctcctccttccgagaatgatcctctttactcgagagaaaactatcacgccaagcgaactagtcttgaggcgatagtactctcggcgggcagacgaatggatattgtccttgacgcgctcgagggccgagaggattcactcccggaaagctggattgacaagctggaggctgttgagtctgattttagcacctgggttatggaagctgaaaagcgtacggttgagaatgaatggctacgcatgaggtcgacgaccagcgaatcgaaagaggcccaacgtgtgcagaataaacagaaccggctgtcgaacattcccgaagaagaagattctaagtttccagttgcggattcatccgacccatccccgcaatccagttgctcgcttcctatggaaaccatcaacgaaggtgacggtgatcaattgttggtggaagctatttctgatgctgttacgcataatcaaaactctgcacaggggctcaatgctttagatccctctcaatcccatcttgactcgagtgagtttgtgagtttgtctggacccgacacgaagatatcgaatgagccttcagaacaaagtacaatcgaaatcgcgatagatgctgtattacctgtcgatgtggacatgcctcgaccggagtcttcggaaatcgtgaaaagcttctcggaagactcctccgatgattctattggaggatcttcagacaagccgtcgaatgaccgcccttctcagtcgactccgtccgtttgtcaaattcgacctgcggtgtctgaggccgcttcagaagaggtatcattggaagagcttgtagcggctgcaactcaacgtcatggaaatactacggtgctacaaattcccgaacagggacgttcaacttccatagaacaatcctccggagaaatgacggacgacacaagctcaagcaaaaagcatcaggcccctcgtgaccttcaatgttccctgccaattgaccacttcgtcgcaaaccggccaggagttgaatgcttatctgtttcatcagaacttgtaccagagaatacatatcttgtctcacatgttgaggagaagttatgcagttcgcaattatctgcatctgctcaggaagtatcatctatagctacaaggttggcggattcctcttacaaagaacacaaagtaccgctaaaagaacccagctttgccactacaaagaacgattccttccggattgcggagtctgaaacaccctcactacgtacgactggcacatcgatggaacagactgatgctgtttgtggcatcaatgagaatcagacaagcagcacaacagccggagacaacagtcaggaagaaaggaaacaattttcagacggattatccgccgtcgcgacgccttctgactctggtcgtcagctttcagtcgaaccattggaggacaaagttgctcccacggtctcgagcaacttggcagaagttgcattcaccgaggaaacatctgcggctgaactgctcgaccgtcagggcctgaatgtagatataggacgagcaattgacccgtttgattctgagaaatcctcgccaattgaaaatgaagcagcaactctggcaagcgtcatagccgaagcagctacaactagagcgccttctacttctacgtcactcaagagagaagagtcgttttctagatccgcaacttcgtcgccagaacctgcaaagcctgtgtctaattctcgcaatgacaaggcgtctgctgtcgacccaggcgaaccacaacaatcttcggagacagttcctccacccaagattcgcttggaaagtcccatcaaactatcgaaaaccaggccgcagagcttaaatattagtaaaggaaactcgaaatcgcaggctcgacgaacttctaccgcatctgcgggctccctttcggattatccctcccttacatctagtccaggcatccgtgaacctcgcaccgcgtcttcgaatgggacaccgctgcttctcgaaacaccaccacccttccaagatctttcactagcatctgattatgtgtcagttggtaccgaccatactctgcgtgaggagcgcttgcgccgtttggacaaccagaaggtccctaatgcaaccgtgtcgcataaccgggccctaagccttcccctgcaaagattcatcaatgaaagacttgacatgcagtacgagagcggggctgggggtgatttgaacggtgccctcggctatcgacgagcctcagttgcttccattgacctgcgtccccaaagcgagcaacatgcaacggacttacaatcatcaaaggatggctcaaccgtgccgactaacaatctgaaactccttgcaagtcagcacatggaactttctcagaggagacaatccacttcgaaactcgatgacgctacccctaagccgtctaaagcctgggcaaataatgcgaacgcttttgccagagactccgtcattccaagtccttcgttggaatctactgttcgtaacgacaccgtgtcttcaccacggggctggaagggtccgcgcaataaaagc

SEQ ID NO: 12431 - DNA, 297 bp, A.fumigatus
caaaagaagatgcacttttccaagtttttcctcgtcgcggctgccactcttgccgccgctcaccccggtgaagtccacgatgctcacgccctgaagcgggagattcgtgctcgcgatgcatatgccgttgcagccaagcgtgccctggatgcttgtgcgagcaccactgaggcacagcagttgaaccagcgcaatgtcgctcgtcgtgcccgcactgcccgccagctccgccagaacaagggcatcacaactagtaagcgacctctacgcttcgtcgtgctcccagctgacggttaa

SEQ ID NO: 12432 - DNA, 366 bp, A.fumigatus
gatgctcacaagtggcggcgtgacttggctgccctcgagaagtgggaagccatcaaccacaacaagaccgatgtccttgactactccgccaacacgccggaatcacggatttttggcggcaacactagtgccatcctagcccctaccattaccgacggcccatactacgtctggggagagattctgcgccagaacgtcaaagaagagaagtactgtgacggtgtcgacctcacccttgaggtgcagtacatcgacgtcaacacctgccggccggtaaagggcgcagtggtggatatctggaacgccaatgccaccggtgtctacaggtatgacctcgtcgcttatcccgagaacggaccctgctga

SEQ ID NO: 12433 - DNA, 639 bp, A.fumigatus
cctgacagtggcatctctacatccggcaactacgccgctgacggctgggattccacctacctgcgcggtatccagcagaccgacgacgacggggtggttaccttcgacaccatcttccccggccactacgagggacgcgccacccacactcacctcctcacgcatctcaacgccacgatgaacgccaatggcaccctggaagtcggcaccggcagcattgcccacatcggccaactcttctggaacgaggtccttcgctctgcggtcgaggatacctccccttacaacaccaacacgcaggccatcaccaccaacgccgacgacatgtggagtgttctgcaggcgtcggatgagtatgatcccttcccggagtatctctacctgggcgagggattagaggatggcctcttcgcgtggatccaaatcggcattaatgcctcggccgactacactgacaactcgtactacagcattgctgcgtactatcaggaagacggtggacaccagaacagcgccagctcggcctttggtggctctgggggagatatgaatggcaccatgccttcgggggttgctccttctggtgcgatgccctctggtgcaataccctctggcgccagcccttcttccagcgcataa

SEQ ID NO: 12434 - DNA, 270 bp, A.fumigatus
agggcgcagtggtggatatctggaacgccaatgccaccggtgtctacaggtatgacctcgtcgcttatcccgagaacggaccctgctgacctgacagtggcatctctacatccggcaactacgccgctgacggctgggattccacctacctgcgcggtatccagcagaccgacgacgacggggtggttaccttcgacaccatcttccccggccactacgagggacgcgccacccacactcacctcctcacgcatctcaacgccacgatga

SEQ ID NO: 12435 - DNA, 993 bp, A.fumigatus
tctatccggaagttctggaaaacaggtcgactcatgccttcaacgcccccccttacctcccgccccgtggtagccatcgcaggcgccacaggacacctatgcaagcacgtcgccgccgccttcctgtctcccccgttaaacgcctacttctcggaaataatcttcttatccagacatgacaacccacctgtcccttcagtgccggagagttctggcggcggcgccgtggtgacagtccgcaagtacgacgaggacaacctccccgcggccctggaaggcgtcgacgtgctcgtcaatccaatgggggcatccgcccacgagttcaagagaaagctcctccgtgcgttcccctcaacgggggtccaggtctactttccctccgagttcggagtggaccactacgttcatgatttcccgcatggggaatgggatcagaagaagaggcattttgaacttgcgggccagctcatcccgcaggtgaaggtgtgcagggtattctgtgggttgtttctggaggatagtatcgggccgtggtttgggtttgataccgtgcgaggaaggtatgggagtgtggggagtgcgaaatcgctggtgtcatttactggattggaggatgtagggaagacggtagcgtccttggcggcgatgccattgatgagtattccggaggtggtgcacattgcaggcgatacgcggtcgatcgaggagattgcgaaagtcatggagggtgcaggggccgggccgattgagatcacggaagttgatctgatgaagtacaaggaggaaacgaccgggaaggtctcgaatgacccggccagctatctgcgtttcctgatgggggagaataaaatcaatcataccgcgtccgggctggggagtgataatgacttgatcaatctccagcagaagacctggaagtggaagactatgaaggatctagcgaagtcgaccaacggaaggccgtggaaggactttccctggcctcctaagtag

SEQ ID NO: 12436 - DNA, 261 bp, A.fumigatus
aagcaccatgttcaattcctatctctagcctacaacgaattatacacataccgatttgtccatgcggtctgcccccgggactcgtacccaagcccatctaatgtgatttatgcgctggaagaagggctggcgccagagggtattgcaccagagggcatcgcaccagaaggagcaacccccgaaggcatggtgccattcatatctcccccagagccaccaaaggccgagctggcgctgttctggtgtccaccgtcttcctga

SEQ ID NO: 12437 - DNA, 561 bp, A.fumigatus
ggccaattggggggcaatttggtttatttccttcggccccggggaatcggttttgttccggccggtgcgcaacccagggttcctccagatgttggtgaaggatttgacccaccggttcggaaaccgtgcggcggggcgtggccaattgccgagaaaccgtcggggccggaccaccgggagtcgatgaccctgtcgccgcatcgggattcatgtacacgttacaggcaacgggcggagcttcatcacgttcgcggtgccggggagcgacaacaaccagctggagatggcgggcccgtggctgacgcggtacctgtcgtgggcggaggtgcgcaagggcaaggacagcggcgacgtgcagtccatgctggacatgctggcgcagctgcacatggcgcggcggcagtatacggaggcgggcaagtactacgagcggctggtggagtcgtaccaggcggcggggatagccataccgacgctagtgcagaccaatctgcagacgtgtcgcatgcacactgcgatgtttgcgcagtactcgccccgtggaaccgggtcggctattga

SEQ ID NO: 12438 - DNA, 378 bp, A.fumigatus
cgtaaacgcgcagaggccaaggaggagatcactcctgactccaccaagtccacccagcagaagatcaaggagggcgttactgacaccggcgaccgtgtcgctcgtggtctgcagaccgacggaagcaagtccggcactcaggaggctttcgacaagactcagcgctcccatgacaaccacgcccactgccgtggcaagcggatctatttgaatctacttcccacaccactgattcttgcaccccacctccaacttggtcttccttcactggctgataaggtccccaaaccttttcggcctcggaacccattaaatctcgctccttgggaatcccaactaatcattttcttgcgcagcctccatttctgtcaatccccc

SEQ ID NO: 12439 - DNA, 195 bp, A.fumigatus
ctcaggatgcctgccaagttgccttcaaactacacctctgatgcagaggccgctgtcgactccagagatcttcagactgaatccggctatgtcagtggggattcgagtgatgtctacactccagagattgtcttcaccaaaccacacctgcaatttcttaacaggcaactccagttccttgagcctcaaggttag

SEQ ID NO: 12440 - DNA, 744 bp, A.fumigatus
gaaatcttgagatggtgtatcacatcccttcctcacctcttccagaccactgcgtttggtttgactggacttgtcaccctggacatgctttccaagcttcaagtgccccgcccacagatggttgatttgatcttccttgacactctccatcacttcccagaaaccctggctctggttgaccgtgtccgcaagaggtaccctctgaacaacatccacatctacaagccagctggtattgaaactgcggaagagttttccaagaagtacggtgccaagctctgggagacagacgatcagttctacgactgggttgccaaggtcgaaccggcccagcgtgcctatcgtgaactcaacgtccatgctgtcctcactggacgccgccgcagtcagggtggcaagcgtggcgatctcgatgtgatcgaggtcgacgaggccggcctcatcaaggtcaaccctctggccaactggactttcgaacaagtgaaacaatacatcaaggagaacgatgtgccctacaacgaactgctggaccgcggctacaagagcatcggtgactggcactccacacagcctgtcaaggagaatgaggacgagcgatctggtcgctggaagggccaggagaagaccgagtgtggcatccacaacccccgttccaagtacgcccagtacctgatggagctggagcgtaagagacaggaggaagctctatcacaggcacttcaaaaccagctcaccactgcgtag

SEQ ID NO: 12441 - DNA, 225 bp, A.fumigatus
cctgaaacgccacatgctgctaccgataagcctatcaacggcaactcgagccatcacgacattctccgcacggcttgcgtgattgtcaatttctttttgagttttggttgttcttggcattttgatatcacgtgctcagatcagccctatcttctcgtccctgtcgttgctagtacaatgtgtttactgaccgtcagcagttggagaatcgaaactgtgctttaa

SEQ ID NO: 12442 - DNA, 225 bp, A.fumigatus
tcacgccatcgcgcaacctgcaccagaatgtcaatctccctcaatcttaaactctttagtctggtgaatgccaacattactcttatcattctgatttcaggtcaggtgttgatgtgtctttggattgaccgtcccttcacgtatggcctaggtatcaccttgacgatgagaaatcaatccgtagtgattgcacaatacagattgttagttttacgccacatgtag

SEQ ID NO: 12443 - DNA, 240 bp, A.fumigatus
gagaaagaggtccggtcgtacatagtcaaaacggaccgtggtatcggggatgtcgatcttccgcgccagaacctcatcattcgtcttcatgaagatgatcgtaagggcaacggtagcaccagcggtggctcgatcgagcacatgagccaagtgtacagtcttcgtgcctaccgcaatggccaagagtctttctacgatatgcatgtctcgcatgcctctcaggtctttgcctttgcctag

SEQ ID NO: 12444 - DNA, 522 bp, A.fumigatus
gcctcggtatcctctcccgctcggacatggtcaagccagctgtacaacagccgtagctgccagaggcggtcgcggacctcgtcggcggcggcgccccgcccggcagccgcgcggatcacttgctgcacgctgctctcgatcaccaatttgctgtccacggccgagacgcgcagccacggcgcatcccccggcccaccagtcgcccccatgtaccgaacgcgtgcggggaacgaggccggcagcacgagtgacctctcgtggatgtcgagtccctgcagcgagtcgaggttgaagatccagtcccacatgctctgtgccggcgccgtgcgagggacgagcttggagccgcccgaggtgagcagcgcggcggccttgggtggtgcggcggggaggagtcgccggcctgggtttggtgcggtcgcggatgacgggagcacgtcctgcgcctcgttgaggccggatagggtcgccacgaacacggaggatccggtggggttgtacgtggccttgcgtcgcagatag

SEQ ID NO: 12445 - DNA, 2622 bp, A.fumigatus
gggacgcgtgtcttccagcccgtggtgaagaccacttcgatacctccccaaccctccctgtcgcacgatgcaatgcgcgacttccaccaaatcggtggttccgcactcgaaattgacacgattaactcgtttgaggcttctgcagaggcagatcggttctctataacacggctcatcttcaaggacgacaagcgcttcattgaagcggccaaattgctgaaccaatccaaagctcccgtggcagagtgtattccagagcccgactggaccgattcagatttacttgaggcgcaaaaggaggtggtgcaactcgtcaccctgcggaccttgtcgatccctgctggccgagccatgcttgctttcagcggacgcttgcctctattgacagagaagcttccaattccttcattttcgttgcagtgcgttatgaagccgtcaaatgtgacagtcagtgccgaaagagcatttttcagcgaggaaaaggtgtgctgggcgtttttccacaacggcgtgtccacagggctcgctatctccaagaaatcaaaagggatcgacacatcatggatccttttcaataagccacaggagctgaccaatcgacatgcgggcttcttactggctttgggtctgaatgggcacctcaaatcgctggccaaatgggtagctttcaagtatttgacgccgaagcacacgatgacatcgattggtctcttactcgggctctcggcgtcttatttgggcacaatggacaccctcatcacccggttgctgtccgtacatgttacgcgaatgctgcctcctggagccgccgaactcaacctatcaccgctgacgcagacggctggcatcatgggaatcggtcttctctactgtaactctcagcatcgacggatgagcgaggtgatgttgtctgaaatcgaaaatgcggaacaagaggagagctcgccgtcgcatgaggacctgcgtgacgaaggctaccggctggcggccgggttcgcccttggcttcatcaacctaggcaaaggcaaagacctgagaggcatgcgagacatgcatatcgtagaaagactcttggccattgcggtaggcacgaagactgtacacttggctcatgtgctcgatcgagccaccgctggtgctaccgttgcccttacgatcatcttcatgaagacgaatgatgaggttctggcgcggaagatcgacatccccgataccacggtccgttttgactatgtacgaccggacctctttctcctacggacgctggctcgacatgtcatcatgtgggatagcatacgaccgagctatgattggattattgagagtttgcctaaaatctatcgacgtcgatatcggctaacaggcgtcagccgactgaagagtgacgacatgcctttcttcaacattattgctgggctctgcttcgctcttggtctgcgcttcgcgggctcagctcagctagctgttcgcgacctgcttgtcgcgtacctggaccaattcatccgcatttgcagactcccagccgtgaattacgatgggcgactgaccaggaattcggtacgaaactgtcaggacatcgttgcactctccgcggcgactgtaatggccggaacgggagacctagcgctctttcgacgattgcgatcactgcacggccgcgtggacgcagacacgccgtatggaagccacatggccgcgcacatggctatcggcctgctcttccttggcggaggcagttacacggttggcacctccgacctggcgatcgcctcgctgatctgctcactgtaccccattttcccaacgacggtgctagacaataaatgccacctccaggccttccggcacttgtgggttctggctgccgagccacgctgtcttgtgccccgggaccttgattctcgccgcccgatccatctcccgatcacggtgacgaacacgagcggacagaaacagaccgtgacggcgccctgtctcctgcccgatctggacagcatcgcgaaagtggaaatccgcagcgccgactactggccccttgttctggactttacacagaacaagcggctgtacgacaagttccggcacggggaccagtccgtctatctgcgacgcaaggccacgtacaaccccaccggatcctccgtgttcgtggcgaccctatccggcctcaacgaggcgcaggacgtgctcccgtcatccgcgaccgcaccaaacccaggccggcgactcctccccgccgcaccacccaaggccgccgcgctgctcacctcgggcggctccaagctcgtccctcgcacggcgccggcacagagcatgtgggactggatcttcaacctcgactcgctgcagggactcgacatccacgagaggtcactcgtgctgccggcctcgttccccgcacgcgttcggtacatgggggcgactggtgggccgggggatgcgccgtggctgcgcgtctcggccgtggacagcaaattggtgatcgagagcagcgtgcagcaagtgatccgcgcggctgccgggcggggcgccgccgccgacgaggtccgcgaccgcctctggcagctacggctgttgtacagctggcttgaccatgtccgagcgggagaggataccgaggcg

SEQ ID NO: 12446 - DNA, 519 bp, A.fumigatus
cggcgccctgtctcctgcccgatctggacagcatcgcgaaagtggaaatccgcagcgccgactactggccccttgttctggactttacacagaacaagcggctgtacgacaagttccggcacggggaccagtccgtctatctgcgacgcaaggccacgtacaaccccaccggatcctccgtgttcgtggcgaccctatccggcctcaacgaggcgcaggacgtgctcccgtcatccgcgaccgcaccaaacccaggccggcgactcctccccgccgcaccacccaaggccgccgcgctgctcacctcgggcggctccaagctcgtccctcgcacggcgccggcacagagcatgtgggactggatcttcaacctcgactcgctgcagggactcgacatccacgagaggtcactcgtgctgccggcctcgttccccgcacgcgttcggtacatgggggcgactggtgggccgggggatgcgccgtggctgcgcgtctcggccgtggacagcaaattggtga

SEQ ID NO: 12447 - DNA, 816 bp, A.fumigatus
ttttttctagccactatggatcgagtaactcatatcattgatccagatggcgaagtggtgataatactgcgcaatgcaaatactcctttcgcggaactcgacgaagatatggttgccagcattgcctctcaaccggcagaagtgtccactccagagcctgccgaagagaatggcctcgcacctgcagagcaacctcctgaacagcaggctgaacagcagcccgaagaggaacctgaagaacaacttcaacaacctgaacagcctgctgaagatccaattgaaatcggaggtgaaacggaggacgagacttgcttccgcatccaagtctctgcgaagcacttgatgcttgcctctccatatttcaagaaattactcaccggccgctggagagaaagtgtggcctatcagcacatgggctcaatcgagctccctgaagagggctgggatatcaacgccttcttgatcctactccgcgcgattcacagccaacactatcgtataccgcggacgttaactgttgagatgcttgcgaagggcacggtcctagccgactactataaatgtgaggaagccatctctgtttggacgactatctggatcaacgctctggaggaagagatcccctcgacatattctcgggatctattcctgtggttatggatctcctggtatttcaaactcccaaagcagttcaaacaggcaacatcgactgccatgtcacgaagtgataattggattaagaacggtccgggtcttccaataccgacgaaagtcataagtaaggctagacgaactctcagcgtgctcagtcactaa

SEQ ID NO: 12448 - DNA, 219 bp, A.fumigatus
gctgcactcaaagccacacccccgagtgccgctgagaagagcctcgcgtgtgtcatgaaggacctggatcaagttattgatagcttcctctctgcggtcgttcatcgcgtctacgttccattagtgactgagcacgctgagagttcgtctagccttacttatgactttcgtcggtattggaagacccggaccgttcttaatccaattatcacttcgtga

SEQ ID NO: 12449 - DNA, 507 bp, A.fumigatus
  unsure (24): Identity of nucleotide sequences at the above locations are unknown.
agtatctttgttttcacctgcggntgcatccccgtaacagccatgtgggacatgacgcaattgcccaccgccaagtgcgtcgaccagctggcggttgtttacgccaacgcggcgtttaacttgctctcggatctgatgacgctcatcctgccggtcaagctgtgctgggcgctgcagacgacgctgaagcagaaggttctgctatgcgtggtgctcgcgatgggctcctttgcgtgcgtgattgccattgtgcggatcgtgacgatgatgccgtttgtgcattcgatggatttcacatggtataaggttacgttggctaagtgggcgtacgtcttctttccttttccccttttttgccgtttccgtcttgtgggtcctatgctgatgaacttgaaggatggtcgaaatcaatgtcggcatcatctgcgcctgtctccccgtcctccggcctctgctgctacgcgtcgttccccagttagcaggcagcaagaactcgggcgcggataa

SEQ ID NO: 12450 - DNA, 318 bp, A.fumigatus
aggatggtcgaaatcaatgtcggcatcatctgcgcctgtctccccgtcctccggcctctgctgctacgcgtcgttccccagttagcaggcagcaagaactcgggcgcggataagcagtctgacgagagctataccctgcgcgatgccgtgcccaggaaaaagaagggcatccggaactgggattacctcacgacggtgggggggacgcagaatccgcgcgaggacgacgtcgagagtgtccatgtgcggccgaatgggaagagtgagagccaggaggggattatcttgtcgacggagacgaagatcacatatcattga

SEQ ID NO: 12451 - DNA, 1719 bp, A.fumigatus
gttcaaacagcgatcagtcgtcgcaaccttccgtttcttcaacccccggcgggtatcaaagcgacagtggcagcagctcctccagtcgccatcccgatgagcgtcatgacccgttcgcgcttcctaaggccgtcaaagcgaggaagtcggagtacacccgcgaacaaacgctccgcgtcaaggtcggcacttggaatgtggcagctatccgaggtacggaggatgatattggaaaatggttcgtggaaacggaagggtatatgcgaacagctcttctgtcttgagctgcaggatccccgagatatgtccgacgggaccgactgggggtcgggggacgatgcttcgcgagatactcagggcggccagtcgaaacgcaagggatttcccaaactccctccgtacgaaccggagaaggtaggcctctacgtgctaggattacaagaagttgtggatgtttcgtcggctgcggaggcattgaggccatacgttgatccaggaccgtcgaacaaatggaaggcggcgcttgagaaagccctgccagagggttttcagctcgtttcggaggctcagctagtggggctcctgcttttaatctacgcggctccttctgttgttgagagcatatcttcggttagctctgccaacgtgggtacgggacttttgggttacatgggcaataaaggtgcagtagcaacgcgactgatgctcggtgaaacgacttgtcttgtgtttgtcaactcgcatctttccgctggctcggataaaagtagcttggaacggcgcaattgggatgcatctcagattgtcggacgtgctaaatttgaccccattgacccagacaagggcctgagagaggaccctggggacagtattgggagagaagattttgccttctggtttggtgacctgaactatagacttgaagatattcccggaggtgacgtgcgacaagtgctcgctcggcatacggagaacgaatacgacaagaggcataagccgtcacaccatgtcgaaggggaagtgccatcatcaccaatggtaggtgtcgaacacgaccataaatcggaagaatcatttccaactctatcggacgatgaaatcgaccctcatacggacccatcttcgctgcaaactactattgcgtctctactgccccatgatcagcttcgtatgcaacagaagaagaacagggctttccatgacggttggagagaaggcgacatcacattcttaccaacatacaagtatgatgtggggagtgtggccaggttcgattctagcgagaagcatcgtgggccgagttggtgcgatcgaatactataccgggcacgccacgatagactgaggtatgaaaaacgagttcaagaagccgagaagtcgagacaacgggacgaagaaatgaaagcaagaggcttggataaggcagctgctgacgatagcgtattatttgactacgacccggacgtcgatggtgccgacagtggggacgagtacgattcgaataaggacaagtcgagcgacagtgattcggtgtcttccgaatctgacaaggatgagtgctgtcggctcgaatattacgtgtcacatcagggtattctatcatcggaccacaagcctttgactgccggttttacgatcaagtatgaggctgtcgacccttatctgaaagccaaggtacaccaggaagttgtacgggagctagacaaagctgaaaaatga

SEQ ID NO: 12452 - DNA, 990 bp, A.fumigatus
gtattcccctccactacacatattctcacaatgacgacccgcaaaccccgacgaacgaacaatggcagtggcaaccatcatcgtcccaatcacaatggcacgcaaccctctgactatgagtccgattatccaaactacttttccgacacgcaacagcagcaagaacagcacatgcctcccccgccgttacgctcgaacgaggagctgaacctctccgtactccgccgccataatccgtctgtgaacacgattctgtctctcgctccatacgcagtggtttacttattcaacccgacgtcccgacagtgggaaaaaagcggtgtggaggggtcactgtttgtctgtcaactatctcaaggaagtctaggcgaggaacgatacagcgtcttcgtgttgaaccgacgcggcctcaacaacttcgatattctgttgacggacggggacaatgtggagcttacggaagaatatgtcatcatcaaatctgactacgacctggatacagaccaaggcatttccaataatggtgactacagtggtgccaagaagaatgtaaaccccgccgacgtccgtatctacggcctctggatctactccgagccaccgccaaactcgacggcagaaacacgcacaatcaacgctcacatgatccgggaatgcgccgtacatgcagggcagagtctgaagattgcccgtgagcgactagaagcgacgcgccagaacggccttcatgttgctaccgccgctgctgaggctggctccatggatggaatgcactcgagtgttcctatgggtcgtcagatctccttaaaggacctttttggccaacagagggcacaggatgatgaatggagtgtcaaggcacacaattttggtcaaccgcaatggcagcaaacaccaatggagatgccggcggcggaacctctacctcgacaggatgttctacgggatttgttcagaagagcaggacttgcctgccaggaatactcatag

SEQ ID NO: 12453 - DNA, 189 bp, A.fumigatus
cttgaagtgatatattatatattctcggtcctctacacctcttttacgaaggagtcaacaggggttaactctatgagtattcccctccactacacatattctcacaatgacgacccgcaaaccccgacgaacgaacaatggcagtggcaaccatcatcgtcccaatcacaatggcacgcaaccctctga

SEQ ID NO: 12454 - DNA, 441 bp, A.fumigatus
tctccaacttcatcatcggccttcccttcctctgtgcgtctcctcctcttccccccacttcccgtcccctcatatctaatttgccattgtataatcctaatctcactcctcttctccctcgtcacctactggctctccaacttctgctccgacgcattcgtcttcttcacatgggtcatgtggctcttcctcgacctcctagccgccgaatccctcgtcgtcttcgtgacatccatcttccccaacttcgtcatagagtttgccctcgtcgccttcgctaacggcctctggatgagcgtcggtggctttctagtctccccgactattcttaacccgttctggaaatatgtttttcattacattgattatcagtacaccccccaccccatttttttttcccaagctgtagattgtggaaggcatgtttctgactaccactag

SEQ ID NO: 12455 - DNA, 906 bp, A.fumigatus
gcaggaggatgctctgatcggttcgttgactgtgcaggagacgttgaagtttgctgcggatctctcgttaccaaggtatgcttccaatcatcgttctctgtgctacaaggcttacggacaggggcctgcagctctgtttcaaaagcacagcgacgtgaccgtattcagactctattggagtcctttggtattctaaatcaagctgcgacgctggttggaactccaatccgaaagggtatcagcgggggccagaaacggcgagtaagcgtcgcaagccaactgatcacctgtccgaagatttgttttctggatgagccgactagcggtctggattcgactgcgagttatgaggtgatttcatacgtcaaggaattggcggtcgccaacaatgtaagacgaatcccgctactggttggagactggactgacgcaagtttcgcagctcatcgtcatcgcaagtatccatcagccgtcgacaaccacattccagctcttcgacaaattgcttcttttgtcaaaaggcaagtcctgctactttgggcccgttcctcagatatcgacctatttcggcagtatcgggcaccccatcccgttgaacacgaatcccgcagagttcattctcgacattgtcagctccgacttctccgatgcaaaggaaggcaatgccgcggaacgagtgcggcatatccaggaatcttggttgcagtccgccgagcggagggccgtagacaaccaaatctcgcagctgatcgagcaccccgagcaggacaggaagaagatcacaatgggagaactctcccggccaaacactgccagtatcacctggtcactgttgcaccgctctttcatcaagagctaccgcgatgttgtggcgtatggcatccgcatcgtcatgtatctgggtaa

SEQ ID NO: 12456 - DNA, 450 bp, A.fumigatus
ttgagggcatcagcgggagtatccagcagggtatgttattgctgtatcctcgctactcttgaatctcatagtgttgacattgccaaaggtgaactagttgcattgatgggcccctcgggatgcggcaagacgactttgctgaatgtgctcgcacgccgggcagctacgtcgggcgcgaaaaccacaggggaatgctacgtcaatggaggggcgctcgacaatgccacctttggccgaataacttcctacgttgagcaggaggatgctctgatcggttcgttgactgtgcaggagacgttgaagtttgctgcggatctctcgttaccaaggtatgcttccaatcatcgttctctgtgctacaaggcttacggacaggggcctgcagctctgtttcaaaagcacagcgacgtgaccgtattcagactctattggagtcctttggtattctaa

SEQ ID NO: 12457 - DNA, 549 bp, A.fumigatus
gacgaatcccgctactggttggagactggactgacgcaagtttcgcagctcatcgtcatcgcaagtatccatcagccgtcgacaaccacattccagctcttcgacaaattgcttcttttgtcaaaaggcaagtcctgctactttgggcccgttcctcagatatcgacctatttcggcagtatcgggcaccccatcccgttgaacacgaatcccgcagagttcattctcgacattgtcagctccgacttctccgatgcaaaggaaggcaatgccgcggaacgagtgcggcatatccaggaatcttggttgcagtccgccgagcggagggccgtagacaaccaaatctcgcagctgatcgagcaccccgagcaggacaggaagaagatcacaatgggagaactctcccggccaaacactgccagtatcacctggtcactgttgcaccgctctttcatcaagagctaccgcgatgttgtggcgtatggcatccgcatcgtcatgtatctgggtaagtacctgtcccgggaaccaggttcaggagcatgctaa

SEQ ID NO: 12458 - DNA, 543 bp, A.fumigatus
ctcacgcgagggctggccatcatgatgggtactgtctggctacgcctccatgaatcccaggagtacatccaacccttcatcaacgcaatcgtaagtaatccttgctcttcttccgaacgacgctcacgctctgatgtccagttcttcggatccgcgttcatgagcttcatggccgtagcgtacgtgcccgccttcctcgaagaccgtgcaaccttcatcaaagagcgggcaaacggcctctacggcgccctcccattcataatctccaacttcatcatcggccttcccttcctctgtgcgtctcctcctcttccccccacttcccgtcccctcatatctaatttgccattgtataatcctaatctcactcctcttctccctcgtcacctactggctctccaacttctgctccgacgcattcgtcttcttcacatgggtcatgtggctcttcctcgacctcctagccgccgaatccctcgtcgtcttcgtgacatccatcttccccaacttcgtcatagagtttgccctcgtcgccttcgctaa

SEQ ID NO: 12459 - DNA, 576 bp, A.fumigatus
ccgcaaggtcctgacagagatgtaagtgcagtcgctttttcaattcttgtccttccggttgtcggatctgacagcaacagcgtcaatctaggaggccttcacacgctggcgagactcgacaccacggtgactgttgtcgatgcattcaatcttctttccaactttgacaccgccgagttcttgtcagatcgatatggatccaaggacattatcccagaggatgagcgtaccatctccgacctcatggtggaccagatcgagttcgcagatgttctcatcatcaacaagatcgagaccgtggatgaaaatacccgagcaagaatcagaagattgttgaagacactcaaccccgaggccaaagttctggaaacgagttactctcgtgttgatgtgaaagagattttggacacgggaaggttcgatttcctcaaggctgcttcgggggccggttggttgcgcagcctgcatgaaatgacaattcagaatactggaaatgggcagagaatggctccgaagccggagaccttggagtttgtctcccctgccctccatccaacatcagggaaggtacactga

SEQ ID NO: 12460 - DNA, 354 bp, A.fumigatus
gcaagtacgggtacctcgctatcaatatcaggaaacattgatgcttactggcaatacaggctgaacattgatgctgctttgatcactcatcacagggtgtcccagacaaaggaaaagctcatccagctccaaaatggatgtatctgctgcacactacgtggggacctgctctcggagctggctcatctcgcgcgccaaaaggaagtgcagtatgttgtcattgagagcacgggaattagtgagccgatgcaagtagcggaaacgttcacggccgagttcagcagtgcaatgctgcaggcggatcaggagatgctggtggatgaggatagccgcaaggtcctgacagagatgtaa

SEQ ID NO: 12461 - DNA, 927 bp, A.fumigatus
caattcagaatactggaaatgggcagagaatggctccgaagccggagaccttggagtttgtctcccctgccctccatccaacatcagggaaggtacactgacttgaacaggtatgggatcaacaactttgtgtataccgctcgtcggcccttccatcctcgtcgactcttcacccttcttcatgataaatttatcctgctgcaaaacaacgaagccgatgaaggtgacgaggacgaggatgagaaagaagctgcagacgaaggagaagaagaaggtgaagaagaagacgatcatatggaaatggacgaagacgaagacgaaaacgacggcgatgacgatgacgatgacgaaagcatctccgactttgagcagccagatccgtccgagatcctgaagaacaagcgcaaccatcccgcgttcagctccgttttgcgctccaaaggtttcttctggctcgctacacggccattccagtttggagaatggagtcaagcgggtggcatgctaacgatgggatgcggcggcccatggttcgcagaagtgccagacgaggcgtggcctgaggatcctgacgtccggaaatccattgagaatgattttcgagagccaccattgggagaccgaagacaagaaattgtattcattggtgagggaattaacacagaattgataacaaagttgctggatgagtgtctcgtggatgacgatgacatgagccggtggacaaagatcatgaacaacaagaggctatcttaccggcaaaaagaggagaagctgggaaagctgtgggaagatggctgggaggcatggcctgagtttggtattgtagatgaagacgaggaagacaacaacgagggagggaagaagaagcacaaacaatacaccagcgagtatcagggacgtgtccaatcccattcctacaaataa

SEQ ID NO: 12462 - DNA, 324 bp, A.fumigatus
acttttaggcaacaggagatattcaccaagaatctcactctggggtgctggttctgggataaccagttcagatatatccagcgctatggggttggcacccagtcgctgaaagagcctattgatatcgtctggtcgaaacagagattttatgcgttcagcggcagtatgctaacaaggtcatctagtcagtcatacaagatcgcagaaatgaacggatggttctacataccttcaaaagcctacaatacgcatgcctcaggctttcccgaggctcgcaagatacttgaacgtagtgagcaatgcggacgactccaccacaaatag

SEQ ID NO: 12463 - DNA, 186 bp, A.fumigatus
aacatagaacccgaatcgagagagcgagccttccactctggcgctcttgaattcgctctatccagagcatatttttccgatgagctcatgtcttggatctttcattctggtcagtatctatttgtggtggagtcgtccgcattgctcactacgttcaagtatcttgcgagcctcgggaaagcctga

SEQ ID NO: 12464 - DNA, 561 bp, A.fumigatus
ccgaatttcaagttgcaccgtgtcttcataactgcctacgacaccatcagagactccgtattgcagagtcgccttttgaagcatatcttacctacctcaagtcgaatcgcagcgctgaggtgccgtctcgcactggccttcttgacgagcgacccagagcgactgactgaggctcctgacgtgatgagcgatctgaagatgatcatcaaccttctgaaggatcgacgattcaacattaacctatataaagggagaggcaatcctgagtatgactacggagaactcagtgcagtgacagaccttctcaacgttgctattgattcgggatggtctggactggcatttccgacaaaagaggccgagaaagactttaatgccgatgttgacaggctttctgatcgggtcaagaagatctttgtgtcgattcaagactcaggcgcgtctcacctcaagcggactttggcgaaggaggccctcgaaactttgcactaccgcatcattaattctgtaaggtccaaaccccttccaaagaaaacaattgcttggtcattacggagctga

SEQ ID NO: 12465 - DNA, 378 bp, A.fumigatus
caccccgtgatgtcacagaatcgacctggggtgttctcgaatctgcgcatgggtggtaaggaacatccaaatgctgagtccaattgttcagaaaacattacccaggagcctgtggaactaactgctttgctttccgaccatacagaagtcgtccgcgagaaggtccaggatggactgacaggggaaactaaggagatttcgtactcacaatgtaaaatcgtcggcaatggatcgtttggtgtcgtctttcagacgaaaatgatgccaagcggcgaggatgctgccattaagagggtccttcaagacaagcgcttcaaagtatgtgtacattataagggcaattgccctcgctgcccaacccaaagatactgtcgctga

SEQ ID NO: 12466 - DNA, 324 bp, A.fumigatus
ttcctccttcaagtttggtactgtcatgctgacgatcgtcaagacgtgtggtccacgggttgtgtgatggctgaactcatgcttggtcagccattgttccctggagagtcgggaattgaccaactggtggaaatcatcaaggttcttggaacccctactcgggagcagatccgcaccatgaacccaaactatatggagcacaaattccctcaaatcaagccacacccattcaacaaggtgaccacgctcttaaagaacttcttgcgaatatgcactgacttgatgaccccaggttttccggagagctcctcacgaggccattga

SEQ ID NO: 12467 - DNA, 207 bp, A.fumigatus
ctaccctaccatcgtctttcacagaaggatgaagtgtacctaaacctcgttctcgaatacgtaccagactccgtgtatcgggcgtcgccgtactttaataaactcaaaacgactatgccaatgtcggaagtcaagctgtatatctatcaattgttccgttccctggcatacatccattcacaaggcatctgccaccgtgacatctag

SEQ ID NO: 12468 - DNA, 264 bp, A.fumigatus
ccccaggttttccggagagctcctcacgaggccattgatctgatctcagctttgctagaatacacgccgacacaacgtctctccgctatcgaggcgatgtgccacccgttcttcgacgaactcagagatcccaatacgcgactgcccgactctcggcaccctggtggcgctgctagagacctccccaatctctttgatttctccagacatggtttgttgtcacttgaggcccaaattcattcttccagatggcttattcgctga

SEQ ID NO: 12469 - DNA, 216 bp, A.fumigatus
ggagcagactgtagtttcgagtctcaattctctcattctttgacggagggcaacccgatcatgtacaagtgccagcaaatcgggagcttctggggtaacaggtttacacagcacaactttcaggtagatccggtgtacttgatcaaaaaaaatagagaggaaaggcagcacgaagaaatgatacacgtatctgtgtttatacatactagcgaatga

SEQ ID NO: 12470 - DNA, 1632 bp, A.fumigatus
  unsure (857): Identity of nucleotide sequences at the above locations are unknown.
gtgggaagggaacattgggaacatccgggttgggtggaggaaaataaggttatgcaaatttcttccttggcgggccaggggcttaggggagggtttcggaatttcataggacacaattttcggaaggggaatcagtccggagagggagagtggattttcaacaaggactttgttgcgaacgtctatgttggcttgacctctttgttgaaaggaggcaagcccaacttatcgttgcttctggatcaattgtttggcttaaaagcgagcgctggggtgggcactccaacggcaaagagagagcctacaatactttcagatctaatctgcagctcagatctattagcccgtctggagaggtacttgaatatgcatccgcaaaaacggggtgaagatctactatccagcttgcggtcgtatcgggatgagtcgaaagcattccaccaccggtatcagaagcaaaggaagaagacggacaaaggcaaaggtcgtgtcttagatcttcctactgccgagaatatgcatgtccacaagatgtcactcgtgacacaggtgcaagatctcttccctgatttgggctccgggtacatcgttcgattgctcgatcactacggcgacaacccagaggcggtcgtcgcacaccttctggatgactctctaccacctgaacttcaagaactcgatcaatccgagcaacttcctgtctcagaaacgtcaccccgtcacgaccctgtacccccacacgcaactccaccagaaataccatcgcccgccgcaccggcccctcgcaagaacatgttcgacaacgatgtagacctcgccgaaatagcccgctcagccgaccaggccaggcaaggcanattgcatttcggccgcagagattcagatctcaccgcggacaccatcctagctgaccgcagccagcacgcagtcaacaaggcagccatcatgtccgcactggcagccttcgactctgatgatgacgagcacgacgacacgtacgacgtcgccgacgttggtggcacagtcgacggcctcaccgcagtcacagatgctgaagcagacgccgacatccgcaatcgtagagccgaggaccttgacatgaccctcttccaagcctacaaggccaacccggccctcttcgcccgtgattctgccacgcgccgctcacaaccccgggcatcgctcaagcgcgagaccggcatgactgacgaggccattgagggctggagcgtaatgttggcccgagatccaaagcgtttggccaagttggaagaccgatttacgatgttggctggtgctccgggcggcgccttggcgcagcctgaactgccgtcgacggcgtacaggaagcctgggcctagagaggatggtgaatcagatagtgacaccgatcaacccagttccgcttctggtggcagaggaggtccccgacggggcggtggtcgcggtggtcgacgaggtggcggtggtggcagggcgcgcagaggagggactaatgctggagcttctggagaccagaaccccactgtggctcgacaaaggaaggaagaaaataaggctagcagggcgaatcacaacagacgccaacagagagccaggaagattgcccggggtggtggcatgccaggttga

SEQ ID NO: 12471 - DNA, 387 bp, A.fumigatus
ttagcatggatgactgagttgatattttgtcccttaggtatggtatacatccgtaactaccgtctatcaagggacacacatcataaaatgtacaaaatgtgtagtgtctctttcgtacttcgtaacagatcaacctggcatgccaccaccccgggcaatcttcctggctctctgttggcgtctgttgtgattcgccctgctagccttattttcttccttcctttgtcgagccacagtggggttctggtctccagaagctccagcattagtccctcctctgcgcgccctgccaccaccgccacctcgtcgaccaccgcgaccaccgccccgtcggggacctcctctgccaccagaagcggaactgggttgatcggtgtcactatctga

SEQ ID NO: 12472 - DNA, 225 bp, A.fumigatus
gttgggcttgcctcctttcaacaaagaggtcaagccaacatagacgttcgcaacaaagtccttgttgaaaatccactctccctctccggactgattccccttccgaaaattgtgtcctatgaaattccgaaaccctcccctaagcccctggcccgccaaggaagaaatttgcataaccttattttcctccacccaacccggatgttcccaatgttcccttcccac

SEQ ID NO: 12473 - DNA, 696 bp, A.fumigatus
agggtttttcgagcaccttactatgaccgtatcatgcattttgacgctatggcgaatttcatgttgcggtatcagaattacctctactatcccatcctcttgtttggtcggttcaatctctaccgactaagctgggaatacctgttttgcggccaagccccaaagaaaggtcctgcctggtggcatcgctggttcgagatcggaggacaggtattcttctggtattggttcggctacggtgtgctataccgctctatcccaaactggagcagccgcatagcctacatcctggtttctcacatggtcactgctcctctgcatgtgcagatcacgctgtcccatttcgccatgtcaactgccgacttgggtgcgcaagaatcatttcctcaaaagatgctgcgcaccaccatggatgtcgactgccctacatggctcgacttcttccatggtggactgcagttccaagctatccaccacctctaccctcgcattcctcgtcacaacctgcgtcgtacccagaaactcgtgatcgacttctgtcgcgatactggcataccctacgccgttttcaccttttatgacggcaacaagaaagtaattggcaaacttggggatgtcgcgaagcaagtccgtatcctggaagaatgtcggaagtcgtgcgccgagcagggcgttttttcagatcatcatcactga

SEQ ID NO: 12474 - DNA, 1287 bp, A.fumigatus
gcagttgaaacaaattgtagaccttctccctcagaacatcatgaccctcatctttcacgtctattgcagtcaagagctctaccaggcgaccgaagacacatatcaggctctgtcagagctagaggcgatttttcctaccagtgcattcctaaagacacaaaaagcgcttctctattaccattcgaaaggttctggttttctatacccgtcgctgaacccaggctaactatcctagtagactttgaagaggcatcacatatatttacagacatattgataacatctcctcatcgtctggacagccttgatcactactccaatatactttacgtcatgggtgcgcgtccacagctagcctttgttgcgcaggtcgcaaccgccaccgacaagttccgccctgaaacatgctgtgttgtcggcaattattactcactaaaatccgaacatgaaaaagctgtgatgtacttcaggcgcgccctcacactcgaccgtaactttctctcggcctggaccctcatgggccacgaatacatcgaaatgaagaatacccacgctgcaattgagtcctaccgccgggccgttgacgtgaaccgcaaagattaccgtgcttggtacgggctgggccaagcgtacgaagtactcgacatgtcattctatgccttattctactaccagcgcgcagcagcgttgcggccatacgatcccaaaatgtggcaggcggttggatcctgttatgccaagatgggccgtgttgagcaaagcatcaaagcgctcaaacgcgctctcgtcgccggttcatattacgcagatgacgcctcgcagggcggtggaatgggtggaccggggcgtaaaattctcgacccagagacgctgcaccagattgccaccctctacgaacggctcggggatgaagaagaagccgccgcgtacatggagctcacgctacagcaagaaactggtcaagggcccgaggatgagtcctttgcctccgataacgacaacgacgatgaccagtcgggtggtgagggccagcaaggctcacggcgtgctcgacagtcgtcttcgttcggcaaccagaacgatagtgaggatggtacatatcatggtaccggtgtgacggctacgacatccaaggcccgtctgtggctcgcgcggtgggccttgcgccatggcgacctggaacgagcagatcaattggcgggcgaactatgtcaagacggggtcgaagtcgaggaggcaaaggcgttgatgagagatgtccgggccagacgagaagggggtgggtaa

SEQ ID NO: 12475 - DNA, 450 bp, A.fumigatus
ttcgccggaaaggcaaagccaggtaacttgtattcgaggtcaaagaggattgcccggccaagattccaattcccaagttcagtcaaaagtccttggttcctgcccttgtacgcaaaatatttagcgggggagaagcgaaaggatgaagagaccgagatggtgctggccccggcagatggagggatgacgttcaaccgggaactccctggcttggcttgggggcttgaagggtggtttgcggaaagacgagaaagaggcctggaagagcgcaaccagggctggctggagtatctttacggtgttgtccttctgaaaggtcgcaatgaagaggaagccaagaaatggctcatcaggagtgttcacttgaacccatttcactggggtgcttggcaggagctgaacgacctgctttcaagcacagaagacgtacggtgccatgctgccgattga

SEQ ID NO: 12476 - DNA, 1290 bp, A.fumigatus
cgacggatcttcggccccttggtgaagatccaactatcggctgaagaagctcggatggtaccagccgaagacttgcatcatgaggaagagtggagaagacagctccagcaaggacaggtgtcatcgtactatatcgtgaccaagtcacagacgacatcctccgggacaagctcgtgtccgatgacagcatctagcccgagcaagggaccgtcgttcgaagctatcgccacgactgttatacgaacccaaccgcaacatttatcgggggactcgattcagcaatggaatcgcgtcgacgacgagcgtgtcccagcagatgctatttccattttcgtggatgattctatggcaacagtatcgtcaccggaatcatccgagccgcctcgaaagcttctgagaagcaatgacaatctgtcatcaattcaaggaagtagtaaaaaaagaaaccaggagtcttcctccaacccgtccaaaggtaacagtgctagttatggcgaggagaatggaacaacgtttccatcgaatgactcaaatgcatcaattgagttggaagcctgcataactttacctttgcaaccaagaaagcgtcgaagactcaccgagaatcatgcttctaatgttgctcctgtcgttcctagctcctgtagcaaccaacctcgatgtgtcaaggcaccactgacaatgattcctttatacttccgtcaggacctggatcgtggtgactctaccaacaccttaatccctcccaactcatcgaatctcgctggggatttacagaccttcgtacagaaagtatgcttaaacaaaccatatcctactaagagctctaattcaaatacggggcacctcaaccctgccctgggcttgcttatagcaacaatatcccaagactctctcgggagacttcttctcgaagtcagccaacaggtctcaacagccctcaaatccaacagacataaagctccacgaagcggcaagattttcatccttgatgccaaattcctcgttctcaaggcaagactagacgatcccagattcctttttcgcatgacatgggagagtatcgggagagaatacttctacgcttgcgtatcgtggagcctggagttgggcgtcgagtacgccgatggcggtgcctctgagatacgagggaccccagcaaatagcgatggaggtcagcggtcatgtctacgcgagttgatcaaatcccagagtgctgcgagggcaccgcgtgtttctataacgtttgacagccgcgaattgggggatttgggagatttgggtgcttag

SEQ ID NO: 12477 - DNA, 309 bp, A.fumigatus
tttgagatagatggcgatgattttgtcagccgcggggggtcgtgcattgtcagctgcctgggtgaggtcctcgctggccccatctgggaggtctctgcggatgatgcgcccgactcaacggtgacggctcgcgcggctggagctgatacggatgggaatgcggtcggggatgggctgctggtcgccgagatcgatctctatgactgtgagcgcggacgcctggatatggacgtcgcggggagctattcgcgcaacgatgcgttcaggttgacggttgagggcttggacctgagtcctcctccgttctga

SEQ ID NO: 12478 - DNA, 1581 bp, A.fumigatus
ctattcctccatcgattcgtatccaagaatcttgtcatcgtcttcatcagaactactatttactggacgtgggtggaggtgggaattggggtggggtggggtggtggtgaaggctcattaacccttttctttttttttcttttttttttttttcttcccggcttcttttttcgtcctcctgggacaatcatcgggtccatcccactctccatgccttggtttcgcaaaaagcacaaatccccatcgcctgctgcatctcctgcctttcgttcggtcgagcaactgaccatcccgcctccgtccaccggttcgtcgcctcgtgttcctcctgaagatcttgcgttttaccagcgcttctccgacgtgcgcctccccacttctcctgcagacccgccagacaactcgtatcgtcaacaaccccaacacgaacaacaacaacaccatccccatcagctatatcgtcatcgtcatcgtcaagatcatcccgatcatcagaatcattcggaacatcctcctccgcatcaaccaacaatcactcggacgcaaagccatcactctcctactctgctcaactcggtacttgcgacccccgctttaccagctgctactcacttcatcgatgctgaccctgccgaccagtccagcgtggacagggcgtctgagcaaccggctttggcccccaacgctcacaatagcaataaacaggatccgctgcaaaagtcccgcaggaagctattcggcctgcattcctcctcgtcctcgtcctcatcgacaggcttcttggaacgtagcctatcggtcaaagggacttcctcgtcgcagtcgtcccgccagcgacggcatcagcaacaactgtcattagacacccagcgaacgcatcgcgatcgagatcaccagaagagaacccgaaatatcaattaccattcctcgtccgagacagtgcctgaggaccatgtggtagacccaaaccggagtagctcacagtctctcctcatgcagcaggacccggcatcagctcatcagcgacctccccgttccccgcagcgcccgccttctattcagcgatccaacaccgatcccagccttctcgagaaattatacagttcctctcctgtggactcggcttctaggcaacctgccgacccttcccgcgtcatctctaatcagtcccagacacatttacagcagcagcagcagcagccgcagcaacaatcgcctgtttcccaacttcaagtggagccgccgttgagtgcacgacctccatcgcgacagtccatggggccgccctctccgttgcccccattctcccatcaaccggatccgcacccatcctccacccaccagagcggcatggcttcatcgtccgaccgtccggccggtcccccacagacgcaaccccaaggtcacccggccttccaaggtggcggccagcagaatgccacagagtcggggcgcagcacgccccccgtcaattcgagcagaagagatgatctgggcgatatcgatgtgcgagctttgctgcaaaagcatgatgaactccgtaagagatgcacaggcgccccagtcgggcagacatactga

SEQ ID NO: 12479 - DNA, 186 bp, A.fumigatus
tccgcagatgatggcgaacaattgaccgttattagtacggaggtgtcgggtgatgtcactactttggaccctttttccctcattggttttgattgtggaggactaagccttcctggcccacaagtaggtcaatgtcccctggtttcatggtcgtttccatactgtgacatagcagagaagaggtaa

SEQ ID NO: 12480 - DNA, 447 bp, A.fumigatus
gaaatcgtcaatatgggagctggcggcgtggttatccgctttttcaacttagcaattcgagtgctccaattcctcgatgccgcagtcatcctggggatcttttcatacttcctggctgtccagagccaacacaaccagcccattccaacatggatgaaggccgttgagggactttccggcgcagcaactttgtacggactactcgggtcactcttcacctgctgcgtgggagggcttgcctttttcgccttcctggctatcgtgcttgatgtgtgcttcattggagcgatgattgccatcgccgtgatgacccgtgacggaacgcagtcctgctccgggatcgtctatactcccctgggctctggagctgataatatcgacagagcatctggcgtccggctacgctactcatgcatgctctataaatccactggtgcagtctcattt

SEQ ID NO: 12481 - DNA, 957 bp, A.fumigatus
atcttccccagcccaacttccgttctgaatggcttcttgttctcaccgccctgtttctcctctccctgcctgtccgtctcctccaagacagcatcgagcatcttaagtacccagcagcctgtcatgtcgtcgtcgcagaccatgacagcgccggcggtgggccatcgacctcctgatgcaggtccagatatgtcgtccctgttcgaatatggccgccctcaccatcaccatcaccaagaaggccaagagccgcaacagcagcagcaggaacaacagaaccaccagcaacagcgagacaacggctctttctccccgcgcagcgactccgcaaaccgcgctctgcacgattctacatctaacaattctgtctctccccgcggtttaccctcttcttccggtatgaatggcatcaagtccgaatccagtgatgcagggaacgatttcgccggcgctcagccagattatcagaatgatctccgccgccagtccgccgccagcgcccttctggctcaactcctcggcaaccaatcttctgcgcctcccgccagcaccgaaacacagcctgcagaatcctcatcttccacaaataatccactaaatccgaccgaaaactctgaaaataatccctcagatcaaatcgcgggtggccaaggatcgacaagcgtttctacggagatcactgcgcccgcagagtcggccgccagccaagaccaattttccacatcaactgacttaccacgcttgccgggagatggagagaaaaatcgcgaagagagacccgctgatatgtcgttttcgaaatccgaggaatctgggaatcatggagttaatacagtgatgaacacgccggatcctgcagaaggtttgacggatcctatgatgttctcccaagacggtcttgaacgactcagatcttgtattcacacccggagcctggaaggaaccgcgatctgcggt

SEQ ID NO: 12482 - DNA, 615 bp, A.fumigatus
gctgattgtcacgatttacccaaaaccagtgttaaaaccatctcaaacctaggcgcaaataaccagacgaagagagaaacgaaaatgcctcccaaatccaagaagcagcacccaaagcccaaatcccaacctccagatcatccaaaacccaactggcctcccctccggcccctcatcccttcatcaaacctttccctagaatccctcctccacgatcaaatctacttaatccgcaacttcctgccctcctccctctgcaaaacctacgccttcttcctagcgtcgctcccactcaccaccactcccagcaaacccaaaaagggcgaggccgtccgtgtcaatgaccggttccagatacaggatgccgacttcgccgagaggctgtggagcgggacggcgctgagggagctggtgagcggtgctgttgacgaggaccaggatggcgacgggcagccacgctcaaacagggagatctggggcggggagccgcttggtctaaatgcaaatatcagggtatatcggtattcaagaggccagttcttcgcccagcactgtatgtccccccccccccccctctctttgtccttcctcttttttggggatgagatgggctga

SEQ ID NO: 12483 - DNA, 186 bp, A.fumigatus
ttcccagattcctcggatttcgaaaacgacatatcagcgggtctctcttcgcgatttttctctccatctcccggcaagcgtggtaagtcagttgatgtggaaaattggtcttggctggcggccgactctgcgggcgcagtgatctccgtagaaacgcttgtcgatccttggccacccgcgatttga

SEQ ID NO: 12484 - DNA, 471 bp, A.fumigatus
  unsure (12): Identity of nucleotide sequences at the above locations are unknown.
cggcatggaacnggattaatggggccatcatattttttttggccattggttccagcttgtgcaagtcaggaggttcaagttgaacgtggaaaagacacgctcaaaccccttcaaggcttgatccctctggtcacaatgtggacgcttgtccccgtttacctatacttgcagcctaccattttggaacactatacgattccattcatgctgctagtgggcttgatcaacgcctacgctgtgggcaacatgatcgtggcacacctgatcaaagcggattttcctttctcccgtatcttcatcggcattgtccctctcgctttgggtgtgctggacggtgctgcgcccttgctcggtctttggcagagtgttcttgggagcgaatccggccaagtcgcctatctcttcggatgtctgggtctggccatcggtgtgtacggaagtttcgtggtacgttctgctgcccgacaataa

SEQ ID NO: 12485 - DNA, 219 bp, A.fumigatus
cgatctgttaagcttttattctcatggaggggagttccggatatctggcacatgagcacggtccaacactatatcaatccgtttctgcatatcttctactcgttgcttcttaactctgttcttttacttgttctcaccgcacttgttgatattgtacgacgattcttctcattaacggattgtatctcggttaccctggaaaaacgacacggacgatga

SEQ ID NO: 12486 - DNA, 183 bp, A.fumigatus
acccttgtgcctgctccccgttccttcttcatggacgtcaagtgccccggctgcttcaccatcaccaccgtcttctcccatgcccagactgtcgtcgtctgcgccggctgctcgaccgtcctttgccagcccaccggtggcaaggccagactcactgagggctgctccttccggaggaagtaa

SEQ ID NO: 12487 - DNA, 468 bp, A.fumigatus
actacgagcttgctgcccgtcgtgtgcttgtcgtcgccggaccagttttcatcacagaaagttgtcaaggtatcatcagctaacacgatttcttcctttcacaacaggttctcgcggtcgacctcctcaaccctactcctcaggctgaggctcgcaagcacaagcttaaggtatgataccgcaatacgcacctctccaccaaggtcccggatccgatggctgatgttgggaatcgcttcgacaaatagacccttgtgcctgctccccgttccttcttcatggacgtcaagtgccccggctgcttcaccatcaccaccgtcttctcccatgcccagactgtcgtcgtctgcgccggctgctcgaccgtcctttgccagcccaccggtggcaaggccagactcactgagggctgctccttccggaggaagtaaatgtcacattacgatgcaaccaaagccggagcgatga

SEQ ID NO: 12488 - DNA, 342 bp, A.fumigatus
tggacttgtaaatggcgagcagcatttgcaggatggatccgaagaagcgccaagacacataacctaagggatgcaacgtcgtccgagcgagaagcaggcacccctaatcacactcccaatggtactcgtagttcgggtgcggctgtagttaaggtaaatgccgatgtctctctttccggcggcccgattacacccaagggaaggggagttgagaacagagggaaactatcacggtcagcaagccggaaatcggtcgtggagattatcccagatgatgacgcgcctcaggaaaacaacattgctgatgcagacaccgatggcgacgcagtcatgcagacatga

SEQ ID NO: 12489 - DNA, 2259 bp, A.fumigatus
cattgtacagatgtcggtccatggagatgccctacttgcgtcggggagaaattgcagcccagtactgagcagaatggtacaaacccgcgacaacctcgtcaaaagaagatgcgcagagaacttttaccggcacacactggagagaaaggtcctggtttccactcaatcttcagcaccgtggatgtcagtgatgacctcttgaccagctccagatcattgcgaaaaaggaaggcctcgtcgaccgacgtgggagaacccacacctggacatcgaaaattgcgacggcagtcatcaatgcgatccgctcgagctgagtcccgagaccagggctttggcaatacagacggccagtccccagtgcgtacccgttcacggcgaacgcgcggcgaggaaaagggtacctgccgcgtggttctgaggcaatttgggagactggttcttgcttttcgactcaacgagaccaaagtgtccaagattctcagttctcgaagccggtcacaactcagaggcagaagaacgcctaagccgcccccagcggtacaagaacctctgtcccattttgctcccattacacctgcaccctacctctcccccttttactcattcaacgaccgcgaaacggacgaatcaaaatcaaagccatacggcggtattctgtcggaagcagatgcggacacctcaagaaccctgccaacacacacagatcgtgaaaggtttgagatcgcgcgacaaaaggccgaagaggaatggcaaaggaagcttttggaaattgaaaacagcggagaagccgcaccacacgcttcacagaagctttctggtcctccgtcccggatcaaatacattaactttggaggatacgagattgagacttggtatgcagctccttaccccgaagaatacagtcgaaaccgggtgctctacatctgcgagttttgtttgaaatacatgaattccgactatgtcgcctggcggcacaagctgaaatgccctgcaaaacatccgccgggagatgaaatctaccgtgatggttccatctcgatattcgaggtcgacgggcgaaagaatccggtctactgccagaatctttgcttgctcgctaaattgttcttgggatccaaaacgctctactacgatgtagagccgtttctgttctatgtaatgactgaattcgacgatctgggctgccactttgtcggctatttcagcaaggagaaacggcccagttcggcaaacaacgtttcgtgcatcctcacactgcccatccatcaaagaaaaggctacgggaatttgcttatcgacttctcatacctgctgactcgtattgaaggtaagactggctcgccagagaaacctctctccgacatgggcctggtatcctaccgcaactactggcgattgatactgtcgtatcagttacggaaccagaaaactcctatcagcatcgcggaactctcagagcgaacaggcatgacggccgatgatgtggtctctggattggaagggttacgcgcccttgtcagggatccaattaccaagacctacgctttgcgactcgactgcaaatattttgaggagtgtattcggaactgggaggagaaaggctacgttcagctgaacccggatgctttggtctggacaccatacatcatgggtcgcagcaatcagtcacaattcgaccgggctccattgcacaccgttgcacagagagaagaccctgaagaggaggaaggcgaagaagtcaagaaggctgatggtgcagtcattccaacggccagctggacgggacacgctgattctgggggtcgttcgactgtggcggctgggccaccttcaacccaagcgctctctaacaccagcggtttccatcaccccacgactgctacagcgagttcgagtacctctgctccctccgaccctgctgcgggcattcctccttctcggtttgagatatatcctcctgttcaagctcctgtgttcaaacggaaaccgggacgaccctttggtagtaagagcgtgttcaaggcgggtgggaccccaacaagtgcccggacgagcggtcgcggtacccctcgcagaacctcaacgttggcctcggcggcgactcctacttcgaatccaggtagtgttcggcggggtcggagtgccaagctgatggactcccctgctccagagccgtccggcgcgaagactaatggacttgtaaatggcgagcagcatttgcaggatggatccgaagaagcgccaagacacataacctaa

SEQ ID NO: 12490 - DNA, 522 bp, A.fumigatus
  unsure (448): Identity of nucleotide sequences at the above locations are unknown.
ctgcatgattcatctggtaggacgcgcaaaacgaaagcgattgatttcggattctcatttggacttgcttcggcacccccagagtccacgtcggaacccgcgccgcaaaccgccacgactgttaccgccaccgaaccggctggttcttcacaaacaacatcagtcctaggcgaaacagctaagtcattggtatcagcagcacagacaccttcatctcgaaatctaggttctggccagcggacaccaggaagtgcgcgcaatggcctccccgagcgaccgtcgatgttcgatataccctcggatgaggagttagaacttgggcgcagcagcaaaaggagaaaaattggtatgttattgagggctcctgatgatttgattacagtatctaacaatgcgaaattcaagaatctcccaaagttaaccagacatcgggcgaattcagacgtcncagcccaggaaacgagtttagcacagtcccgggcgggacagcacgaagagaagcgcacaagggagccttcctga

SEQ ID NO: 12491 - DNA, 1680 bp, A.fumigatus
gcgaccagaatcccaattgtatgcgccattatcgtcctattttatctgcatcggcggaatgtgaagaagctccggcaggaagatgccaatgacaagcataaatctctcgattttggcttagatttggaacccagagctggatctaaaccaatgacgcaggcagagaaagggagcaacatgcattccaagggaatgtccctcgacataggccaaagcccctatcttcttcctcctggtttacatggttcccgggagtctttacactccctttcaaggtctatcataggtgatgacgataaataccgccatgcaagttcattcctcggggataacgcatctgtcagatcgcaaccgaggggattccacgatgagacgtcggcattctccagatcacagagtaaagccagtctgcgaggagatgacatgaaccaaggtttactacagaacgcccagagaatgtcgcgttcttcacccccactgtataatgctccttcggacggtggtagctcgcacagtcctcggggccaagggaatgggcaggatatggggttgcagctgaatctgccacgtagtttgagccctgttcatataccaggagttaacggtagccgtggaacaagcccagcgccaggtggccatgccgacggcagcgaggacatatcatcttcagagacccgcaatgccaacttgcctcaacaacctctcaagaacgccatggacccttcattggagctgcatctcgacactcgtgaacaacagggtcgtcccattcaggaagatctgtcgaccaaacttggctcgacctctccttcaaagcaatcaccgtccgtgccaacacctcgaatttcacttcctgtgagcgatgcagcgagcgactacggtgataatagaaattctcatgctgagatcccggcagtgaatgtcgacggggctgaggatgcccagaagcgtgacggggctccaaatcatgcagcagctccacctatcccccaggagccactgcagtctcagaatcagagccttgatgttcgtcgtgacactcgtagattcaccctgggacttcgccctctgcctccagaggatccatcagacaatcctgagcagcgcgccaaccgtattcggtcgttctacaaggagtacttcgacgagtctaagacgggcagggaaactatctacgaggactacggtccagagtactttcaagatgatggttacgtctacgatcctgccactggtgaatactacgatgcagttccagcaccgttcgctgagcccgtcaatcgtcgtgccatgacgccgccccctcgcgcaccaccccgcttccaaggagctgccaggcatatggctacaggctctgtgggtggtggtgccagcgatcggtccaactatccgggacctcgtgctttctcttcggcttctcatcggttgcctgggcctcgagctcctcgcaagccaatgcctcctccgtcaccacttcaagttctaccttctcctcacttgctgaaagaggattccctaatgaatgctgccgagtatgcccctggcatgaattacaaagacaaaagagaaggacgagcagagacccctcttggtggattgcgtccttacactccggtaacacctgctcgtacacctcttgtctccgctttcgatgagctcgcgccgataccaagcccgtaa

SEQ ID NO: 12492 - DNA, 216 bp, A.fumigatus
cggtctattgaccttggagacttttgtatcgggcgtccgacacaaaagtcattgagaccagacgagttaggacgaccatgcatcatcatcaccaacatctacattttccccgtcatggaatccacctggccgtgcgttccccgccgcgtcgaccagacattgtacctcgagaccgtgtgcctctcttggttggcaccgaagatccaacccttgtga

SEQ ID NO: 12493 - DNA, 222 bp, A.fumigatus
atggccgagtccaaatccggatctccgtacgccgtaggcgccagtcctggtaccaggatgcgcgggtcggtcaaacggtttgctcctgcttccaggacaagcacctgggtattcggatctgccaccaatctgttggcgacgactaacccggacatgtcaccaccccttaatgatcagatcaaaggctgcgacgtctaccagcagccgagttggtatctatga

SEQ ID NO: 12494 - DNA, 213 bp, A.fumigatus
gttcagtctctggtaagatcctcggtttccagccaattgctgtatcagtctcagtgtctgatcctctggaaagcgactactagttcagagctacatatgtctaaaggactgccggccctactagatgctataaatatcagtcaccaacaaactctgaatcccgctaacaccccactcagggttgacttgcaagacaaaatggaaaccgcgtga

SEQ ID NO: 12495 - DNA, 717 bp, A.fumigatus
ggttatttgtgctctttcgaccgacgtgacgctcgcagatgtgatcctggttctgtcagtttttgttcaagtaggccaggagtttgtgttgtccggttgagggcgttttcgccgaggttgaggcgactgaagagatgcgaaaaaaagtatggagaaatgacaaagacttacataaagtgcctctgcagaaggacatttctcagagcaaccctgccacaagcaggaaagttgttcatcactcggaggagttccgttggcttggggagcactaacagctgcggtcgcagcagccgcggtcgcagtcacggaggctggaggggtcgaagtagacacaggagccggggttgtagctgcaggctgcgacgaaggctgctcctgcgagataggtgcaggcataggagccgccgttgccgaaggcgaagcagttgtgttgttgttggttgcggtatcttggtgttcagacattgtgccaagactgatttcttgtcccttttcttgggagcagcggagaatgaagggaggatatcaaggcaagtgaactgtgatgaatcgtgtttcccaacacaaggagagaaagggagaaagggagaagggataaaaagagtcagagaatcagtttgttggaggagcaacggacgtcgtctgccagaaaataatcagcaagactcggtgaatcgctgcgcaaacgacaacgcaaaacaagctgtaaagtcgtga

SEQ ID NO: 12496 - DNA, 189 bp, A.fumigatus
acaccaagataccgcaaccaacaacaacacaactgcttcgccttcggcaacggcggctcctatgcctgcacctatctcgcaggagcagccttcgtcgcagcctgcagctacaaccccggctcctgtgtctacttcgacccctccagcctccgtgactgcgaccgcggctgctgcgaccgcagctgttag

SEQ ID NO: 12497 - DNA, 399 bp, A.fumigatus
  unsure (173),(181),(247): Identity of nucleotide sequences at the above locations are unknown.
cagaaccaggatcacatctgcgagcgtcacgtcggtcgaaagagcacaaataaccttaacctgacatgccagtggggaagctgccgcaccacgactgttaaaagggatcacatcacgtctcacatccgtgtccacgttcctctgaagcctcataaatgtgaattctgtggganagcattcnagcgtccccaggatctaaagaaacacgtgaagacccatgccgatgactcggtgcttgtgcggtccnccgagccgggagctagaaatccggatatgatgtttcatggagctggaaaaggtaatgacgaatgccgatgttctctttgcactctcggggctgacatgatcctccttgaccaggctatgctgctgccgcccattacttcgagccatccttga

SEQ ID NO: 12498 - DNA, 459 bp, A.fumigatus
tatcctcccttcattctccgctgctcccaagaaaagggacaagaaatcagtcttggcacaatgtctgaacaccaagataccgcaaccaacaacaacacaactgcttcgccttcggcaacggcggctcctatgcctgcacctatctcgcaggagcagccttcgtcgcagcctgcagctacaaccccggctcctgtgtctacttcgacccctccagcctccgtgactgcgaccgcggctgctgcgaccgcagctgttagtgctccccaagccaacggaactcctccgagtgatgaacaactttcctgcttgtggcagggttgctctgagaaatgtccttctgcagaggcactttatgtaagtctttgtcatttctccatactttttttcgcatctcttcagtcgcctcaacctcggcgaaaacgccctcaaccggacaacacaaactcctggcctacttga

SEQ ID NO: 12499 - DNA, 741 bp, A.fumigatus
ccaggctatgctgctgccgcccattacttcgagccatccttgaatgcagtgcctagccaaggatacgcccacggtgctccccaatactactcgtctcatcccccacaccagccgtccaatccttcctacggaaatgtatactacgctcttaaccacggtcacgacggccatgcttcgtatgaatccaagaagaggggctacgacgctctgaacgaattctttggcgatctgaaacgccgtcagtttgatcttcactcttacgcagcggtcggccagcgcctcctcggtcttcagaatctgtctcttcctatcctgaccggtggccctttgcctgaataccagcccatgcccgcgccggtggccgtgggtggtggctacggccctggtggacacggtgctcctgtctaccatctccccccaatgagcaacatccgcacgaagaacgaccttatcaacatcgatcaattcttgcagcagatgcaggataccatctacgagaatgacgatcatgttgctgctgccggtgttgcacagcctggtgcccattacgttcatggcggcatgagctaccgcaccacacactcccccccaacgcagcttcctccaagccacgctgtggccaccacctctgctagcacttccatgagcaaccctgccacgcactcgcctcccactggcactccggctttaacacctccatccagcgcccagtcgtacacctctgctcgttctccaatctcc

SEQ ID NO: 12500 - DNA, 1635 bp, A.fumigatus
ttttctttttactctgactcggtcgttgcgcacgggattatcactcaagtcggtagtggtactggtcataactcatctcgaccgctgctaacctggcaatgccttcttatagtgtcgtcccctccatcctcgggtctggtcgctctgactctctactcgtttttgtacacgctcctcgtcttctgccccgtagtcacctcttatgaccttcatctatccccatttccctctgaggagtcttgcttgaccatcccgatctcacttgcgcctggccgtgcaatcccaatcgggacgtccttaagccctactacccttactactactacttccatagcggccaagtcgaccagcactgcccacaattaccaggctgatcccttagtgcctgatccttcttctagagcaaatacatccaacgtcagggttgtctccctggctgtggagcagatgattggcaaagcgaaaggcaccattatcattttgtcttcgctgattgcatatttctccatcaatagcttagtacgtgctttgaatccggatgcattcatctggtacgatgaggacagggaagagcagcgctggatcgcttcgtccccgtcgtggttggaccgtaaagcctgtcgctggctgagtctctgcggtaccgctcatttccacacggttggtccgcgcttcggccagcggagagtcctgacagagcccaatgcctctgtcacggcgcaagacgaagtcgctccgtggcggtccttctggttccgagaacaggagcatctggcgaatcagtgggatgatgccgaacgttcgctcagagagatacccgactatgtctttgaatatgctcctctcgtgcatctattctccaaagagcagttctggccatgtgatatcgcagagcatctgttccacaccacgccaatgttaaactacacgccggtgcaatcagagcatagtcatccaacgttggaggacctggaccgactgaaccaatggcaggatggtcgttacgtcttcctgaccagtaatgataatgtggaggagcggcccccgtggatggaaggagaaaagaatatccctgttgcgccagatgagcacgaagaagaatcatggtcggactgggacagtcgagtggatggggccattccaggagatacaccggagggccgcttaaagtggtatgacacgaatcacaactcgatgtcgaaagatgaagccgccaatctaccatgggagaatcttggttattccaagtcagaggatcttctgcaggatgaaagggtcagggacgagctgcggaaacgatacggtggcgaaccggtaaagatgcaagagactggaggccgaagtgaggcgcctgcagtgctgctcgtcgtggacaagggcaacggcatagtcgatgccttttggttcttcttttacagtttcaatctcggaaatgtggttctgaatgtacggtttggcaaccacatcggtgactgggagcattgccttgtccgtttctataacggccagcctaaagctcttttctttagcgcccattccgcgggcgaggcatatagttatgaagcggtggagaaaatcggacaacgagtaagttgccactcccacactggtgattttggttgggttagaggctga

SEQ ID NO: 12501 - DNA, 516 bp, A.fumigatus
gttgccactcccacactggtgattttggttgggttagaggctgatcaattgtttccaatgtgtatacagccagtcatctattctgcagtgggtacgcatgccatgtatgccactcctggtgtccattcgtatgttctcccctggggacttcttcatgaccaaacggaccgaggacctctctgggatcctctcttgaattcgcacatgtatacgtacgatcatgtgaatgacacgttgcgcgcctccacagccagcccgttggcacctacggagtggttctactttaacggtcactggggagataagttctatccgctgggagaccgtcgacagtatcgcttcgcaggtcaatatcactacgttaacggtcccctgggcccgcggttcaagcatctgcaccgccgcaaggtgtgtcaagggcccgacgaggatccctgtgtgattaaagattgggtgggcgaaaagatgcggcccaagcgcctgccaaatccccggccccacgagaatccagtgtga

SEQ ID NO: 12502 - DNA, 294 bp, A.fumigatus
cctctcctaccgcaaagtatcccgctgatatcaaggctcgcaggcgtcctctctcaccaagcatcagacaacgtcaagaagctcggaaagaacaacgatttgatcgaacgcgtccgccgcaccgccttcttcgcccccatccttgacgaactcgatactctcctcgaccccagcaccttcatcggccgcgctccccagcaggtggagaagttcacatcgacagaggtcaagaaagcacttgagccctacgaagagcacctcctcaatgccgagaccgccgctctttacgtctaa

SEQ ID NO: 12503 - DNA, 417 bp, A.fumigatus
accgttggaaagagagcctgtctatggattcaggacttgctcatggatctgcggaaccttgagcgggcccgcaatgacctccgtttccgtggtgtaaagggtaccactggtactcaggcctccttcctccagatcttcaacggtgaccacgacaaggttgagcagcttgatgagcttgtcaccaagaaggccggttttgattcggctttcatcatctccagccagacatattcgcgcaagatcgatgttgacgtggccaacgctcttggctcgtttggatctacttgcgagcgtatcggtattgacatccgccatctggctatgctcaaggaggttgaggaaccttttgagaaggaccagattggaagcagtgctatggtaagtcgaactcttgcccacaaggtgaggagcatgtga

SEQ ID NO: 12504 - DNA, 258 bp, A.fumigatus
acttaccatgccatgcaggcttacaagcgtaaccctatgcgttctgagcgcctttgctcgcttggaaggcacctccagaacctgcccaaggatgctctggatacctactccgcacaatggttcgagcggtcgttggtaagctatactccccaacgtcgtcgtatgcacgcaacgttctcattgaccttttccaggatgacagcgctatccgccgtatcagcattcccgagctttacctttcggccgatgcctgcttga

SEQ ID NO: 12505 - DNA, 612 bp, A.fumigatus
agcgaatcagttccagcgaggatatgtttctcccaggcgacaaatctgggccacggagcacttatgcctgctcaacccgtaagttgtcaacttcaagaagatatacatattggcgctgactttttgtgtcactcagatgtgcctcatgttttcgtgaaagtacttggatcgcctgcctcaagagactctcgtgaaaaagtccagaagttgcttgctcgctccgacagtcaaaagaagcttgttcctgtgattcacagtgtttcgctctcgacatcattttcgctgtccgcagccgagagtagcatggacgaatggctcgctctgccggaagtcaacaaacaatacacgcctctgctttgggtggggcccacggctcccggtcatgagaagctgtccaccgataccaatattcccgccaacagtgccgtgtggcagtatgctctagacacgacaaaagcagctcggagtagagggatggaagttctaggcatgtacaacgcaaccttgcaagctgctagctgggacggcaaacattatggtgaaaaggtagctatgatgcaagccatgatggtaagttctcgtctctgctctgaagcagactatctgatctga

SEQ ID NO: 12506 - DNA, 420 bp, A.fumigatus
aaggtaggtcgagctgagtttgaagacatgcttcctcggaaactgatctgtccagacaccgacctgcttgcagcccagtcgaatggataccgtcgcatgtccgccaacctttacagaaccaagaacgagggcgaattctttcatatccatggctccctcgaggctacgacgacactcaacatgattggattggagggtcaccgtcctgatctcacagactatgaagagatcattgaggttattgagagccacgtgcaaaagtacagcgctgccgagctagaagagatgaacaaggagaggagacaagctggggtcacggcattcaaatacgaggatttcatcaatactcctcatgttcgtttagtcaatcgttccgtcgctactggaccacaagctgattgttttgcagggacggcttaa

SEQ ID NO: 12507 - DNA, 381 bp, A.fumigatus
tcaatcgttccgtcgctactggaccacaagctgattgttttgcagggacggcttaatgtgcaggaacctccatggaaggtcaagcgacttactggtgacttgcctccgacacccttccccgccagtcgcagtgcaagcaggaagatcctggagggtatcaaggtgctggagctttgccgcatcattgcgggacccaccgttacgcgaattctctccgagtacggcgcggatgtcttgaagattactagccctaatcttccagatgtccccttcttccaggttgatggtaacatgggcaagcatgccgcggatctggacttgaaaactaccgaaggacgtcgccagtttgtcttcaccgcggggctgcaaagagcgctctaa

SEQ ID NO: 12508 - DNA, 408 bp, A.fumigatus
acgcggaaactgagagtcaacatgacggacacagaaacagacaacccgtattcgcctgttgacgaagcacgcctaatcttctcatacctctgcgatcaagctgaacgacttagtctgccgccccagatcgtggaaaataaggatgccgtgtcattctcatcttcccacaacgagatctactacccgatcccattcaaagaaaccgagactttggccgcattgaagggtgtcgaaggtgctgtcgctagcgcaattgccgacttgcgatttggtgaacagaagcgcaatgtcaaaatcaacctggagaaggcgacagctttcggatgccaggcatacatggccaaacttgatggactttctaaactggacccagctgtcaagtcgaaattgaaaggtaggtcgagctga

SEQ ID NO: 12509 - DNA, 192 bp, A.fumigatus
ggagtatttgaaatcaggagtatccttctcctttccttcggttatcaattcctggtatggatctggcagagttcctctgatgcgttgagcaaagctcaatcgaatttctttgtcaatggcgcccgtaatgaacgccattcttgggtggacaagcgggagctcgaggtcctcaatcctgaaaccaaccgttag

SEQ ID NO: 12510 - DNA, 834 bp, A.fumigatus
tttggagctcatgcaccgattcttggattggttcgctcatcacctgagcaactttggattcacgtggaaatggagcgaatggttggtgagcttggtccgaacatcattgtctgtatgctaacggttggtttcaggattgaggacctcgagctcccgcttgtccacccaagaatggcgttcattacgggcgccattgacaaagaaattcgattgagctttgctcaacgcatcagaggaactctgccagatccataccaggaattgataaccgaaggaaaggagaaggatactcctgatttcaaatactcctcagatagtgagtcttacctcatatgttgtcctcgttctgcctactcgaaagggctaactaaaatccttattcctacagctactccttacgccaaagaaggcagagaaatcatgcaactcattcgtagaaaagcgggcgatgaggagattcagccactgatcaccgccatcgaggagcaagcgaaggccctaggagtcgacgaccctatgctgccctctaccgatgcctttgtcacgtctatctgcttcgttggctctaagtctctttctcacgtcctgtcatgcattgagcggaacaaggaaagactgttggcaattgggcccaaatcagctcgtgcccgttgtcagatcatcacctcagtgatggagtactgggtggatcaaccaggcgtcgcgatcaatatcatcgacaagctgttgaactacacgattctgacacccttatctgtcatcgaatgggccctggtggagaggttgcaagcaggaacaattcttcagcagaacacatcctcacaacggcgatga

SEQ ID NO: 12511 - DNA, 927 bp, A.fumigatus
ttgctaggactcgagctcgtcaaaattattctcttcacgatcccatacactatggcatctccagctactgggtttgaagcacaagcaagtgccctcttggagaaaacggacatcatcgcctcaacaccgcatgctctagttgacttggtgaatccatttgccttaaaggatggtgaaccaactgctgtgcagagcgtcatcagtttgcttcagaaccaactccaagccgaggcaaaccgtggctgggaacttgcttgccttcctcggccctggaagaggtcggaaagcgaagaagatggccccatagaagccggacctaaacatgctttccctcagatcaccgtcccgaatcctgtacgaaaaggagccagggcaattttccccgagatctacctctctgtatacgcgaatcaagacttggagacggtccctccgacgtcggacattgcgtcgtctctgttgagagaagcactcgtggatacaatcaacatcctcgacttcaaccgcatcgctactgccaagtttttgatagatgtggattgttatttcacaccatacacttttgtgaagcgtgctacgccatttgacaggctgcgcgatctccctggggatcgccctacatggaagcctgaggatgtggctgtcgacgccgtcttctcccagctattccagcttccttccccagaacataagcttgtttattatcactcagtcctcacagaatgttgcaagattgcgcccgctgcaattgcccccagtttaggtagggctattcgtttcctgtatcgaagccttgacacaattgatttggagctcatgcaccgattcttggattggttcgctcatcacctgagcaactttggattcacgtggaaatggagcgaatggttggtgagcttggtccgaacatcattgtctgtatgctaa

SEQ ID NO: 12512 - DNA, 297 bp, A.fumigatus
atgtccggagctgacatgttaaacgcttgtagatcgctcattgccctttcactgatcatggcacttctgcaattcaagcctgcgccaatgtatattctggacgaagttgacgccgcgctagatctgtctcacacgcagaacattggtcggttgatcaagacccgttttaagggctcgcagttcattgttgtctctttgaaggacggcatgttccagaatgccaaccgtatcttccggacgaggttcagcgagggaaccagtgtggtccaggctctgacaccggctgatatgaagtaa

SEQ ID NO: 12513 - DNA, 459 bp, A.fumigatus
atgatgccaggtatacttccattctccatagagctacgacgtccccaatcttgtgttgctcatggggccaatcaagccgtctgttccgctggccggaacaacaactgtcagatgtctccgagttccgtcattctgcccaccgccaccctgtccctgtgggtgagcatcactatctccggaattgagcgattgcctggcactctcattcaatcgttttccaacgtcaaccctgacaattcttccggtgtgccaaattattaccaccttcaccttaatactatctcttgggtttacctagtcacgtctcgcttgcaaatctatcaaccttggtcctatccgcgggtcgaccaaatcagtcattcagccgataacaatgcccgaggaagaaccatcgctcaacatcccgtcgctgctcactttagcagtcgtttctttcttcgttatcagatggttccttaa

SEQ ID NO: 12514 - DNA, 210 bp, A.fumigatus
atactgaaattcgaatattcatcgcatagacccaagtaccaggaaaagacgggacaaactgctgggtcctatccattagtactgaatggacctgaatgttccgtacccaggtacgagaatacaagctcaggtaccatgcatggggggtcaggagtcaggaacaatcatcatcatcatcatcatcatcatcacactcacacacctccatga

SEQ ID NO: 12515 - DNA, 540 bp, A.fumigatus
ctctgctcattcagaaccggatggcgctcgaagaggtatgttattctatttcccggtaaacggatgccattggggggtcgctcatgcctctcgcagcaaaacgaagttgcaaaccatcttgatgacgaagatccccaagagggtttcttccccaatgatgagaaaacgcagaaatatggaaacctcctatttcttctgcaatccgaaccccggcacatcgctcatctgtgccgacttgtctccatgtcggaaattgattcccttctccagaccgtcatgttcaccatctacggaaaccagtacgagagtcgtgaagagcatcttcttctgactatgttccagtccgttctcacttaccaattcgataacacccccgagtactcgtcactgttgcgccaaaatacacctgtctctcgcatgatgactacctatacccgtcgcggtcccggccaaagttacttgaagcaagtgctggcagaacagattaattctctgattgagctgcgcgatgttgatctggagatcaaccctctgaagtag

SEQ ID NO: 12516 - DNA, 225 bp, A.fumigatus
tcggcctgccgccccttctccgcttcgtttcaatctatctctttgggctcgccaatttcttcccatccaccttgcgctccctactttactgtgcataatcatttcctcccaaccatctcctacaccaacggtctcgacgttctttttaaacttctccgcttgagacaattcagctccgactgtctcaattgctttcccgcgccccgcgaccgtttcctgccttga

SEQ ID NO: 12517 - DNA, 219 bp, A.fumigatus
gttacgttaattggcccggttgaaacatacaggctcagatgtctgatcggttctggaacagctcaaaaatatctacgggaactcaaagcgaaaatctcctcgcaatcgaagaagaatttcgttctcgaaaaggatgtccgatatctggactctcggatagctctgctcattcagaaccggatggcgctcgaagaggtatgttattctatttcccggtaa

SEQ ID NO: 12518 - DNA, 342 bp, A.fumigatus
aatccagagaacctgatggagcttctgaaccagctggatggtttcgactacctcggaaagacgaagatcatcatggcgaccaaccgaccagatacccttgacccggctttgctccgtgccggtcgtctggaccggaagattgagattccccttcccaacgaggttggccgtctggaaatcctgaagatccactccagcaccgttcagctggagggcgagattgattttgaaagcgttgtaaagatgagcgacggactcaacggtgccgatctgcgtaacgtggttacggaagcgtatggctcacatcttcgaactcctttatttacaggaataaattgctga

SEQ ID NO: 12519 - DNA, 669 bp, A.fumigatus
ctggttgaatcgctaggatatgacgagtacaagccgatcacgaaagaaggaaaacagatggtcccaggagggttgggctggatcattgttgacgccctcgatacgctcatgatcatgaatctgacctcgcgggttcagcacgcgcgcaactggatccacaattcgctacagtacaaccaggaccacgacgtcaacacattcgagacgaccatccggatgttgggtggccttctgtcggcgcattatctttcgaccgcccatcccggactggccccaatcgcggacgacgatgcgggctcaccaggagaggatttgtatattgagaaggcgaccgacttggcggacagactgcttggggcttttgagtccaagtctggagtgccatatgccagcatcaatctgaatacgtcgactggtattccatctcatgcagacaatggggcttcatctacggcggaggctaccactgttcaacttgagttcaagtacttggccaagttgacgggagaagcggagtactggcgggtggtggagaaggtgatgcaagtggtcgatgaccagaagatggaagacggcctgctcccgatctatatctatccagactctggacatttcagaggagacaacatccgtctgggaagtcggggggattcttactacggtgagtga

SEQ ID NO: 12520 - DNA, 969 bp, A.fumigatus
cacagtggctttctagagtatctcatcaagcagtatttgcaaacatctaaacaggagcccatctataaagagctctgggatgaatcgttgatgggcgtccgcaagcatctgattgcgtacaccaaaaatgctcagctaatgattttgggggagaggccgtctgggctccatgggaaactgtcgccgaagatggatcacctggtgtgcttcatgccgggaaccattgctcttggagccaccggcggcgtgccgttgagcgaagcccggaagtctcctgactggaatcaacggcgggacgaagaaattctgattgctcgggaattgatgaaaacatgctgggcgacatacctcgcgacgaagacgggtctggctccggaaatcacctacttcaccttggacgaccctccaaagatgttccacgacatgtacccggactcgacggcgagcgccggcaaccgcaagtcccagggggctgatttgccaatgaagtcacagcctctttacccgctggacgacgaaaccctcaagtggcgggaggacatccagatccaaagccaggaccgccacaatctccaacggccggagacggtcgagtcattgttttatatgtaccgcatcaccggggacgagatatatcgccagtggggatgggagatgttcaagtcctttatccgccacacggcagtggttgaacatgaccactcgcacgagaccgattcccctgccgatgccgctgccggaagccaatccgagaaagtcgcgcgtccctcgcggattacgggattcacgtcgctgagcaacgccaacaccgtgccccctgtaccccgagacaacatggagagtttctggatggcagagacgctcaagtatttctacttgttgttttcccgaccgggactttatctccctggaggaccatgtgttcaacacggaagcgcatccgctgccacggtttcagcctacgggtga

SEQ ID NO: 12521 - DNA, 195 bp, A.fumigatus
cgtggttacggaagcgtatggctcacatcttcgaactcctttatttacaggaataaattgctgacattgcatagtggacttttcgccatcaaggactatcgggacgcgatcagccaggacgacttcaacaaggcggttcgcaaggtcgctgaggccaagaagctggaaggcaagcttgaataccagaaactgtag

SEQ ID NO: 12522 - DNA, 207 bp, A.fumigatus
gcaacgccaacaccgtgccccctgtaccccgagacaacatggagagtttctggatggcagagacgctcaagtatttctacttgttgttttcccgaccgggactttatctccctggaggaccatgtgttcaacacggaagcgcatccgctgccacggtttcagcctacgggtgatttgaagacggggtggacgcggaagcctcggtag

SEQ ID NO: 12523 - DNA, 654 bp, A.fumigatus
  unsure (15): Identity of nucleotide sequences at the above locations are unknown.
tttttggcggaacgnaccgagttggccttggtccccggcccaaagggcatgctgggctttgaggtcgccgcgcatggccaccccgcccactccggatacccgtggtgggcgaagagggccatttccgccatcctgccggcgttggggcgcgtggatcaactgggtgatatccccgtcgaggagggtggcctgccccccagcgataagtacggtcgcacgacggtcaacatcgggcggatggagggcggcgtcgcgacgaacgtggtgccgagcaaggcacgggcaggggtcgccgtgcggctggcggcgggcacgcacgacgaggcgcgcgaggtggtgctcaaggctgtccgggatgtgacgggcggcgatgaccgcgtggttgtcaacttcagtctggaggggtatggcccgcaggatttggataccgatgtgccagggttcaacatcaccaccgtcaactacgggaccgacgtgccgaatctgcagcttcatccccgcccggacggcaaggtcaggcggtacctgtatgggccggggactatccacgttgcgcatggcgataacgaagcgttgaccgtcgcgcagctcgaggaggccgtgcgcgggtataagaaactgatccaggcggcgctggaccggtcggcctcgtag

SEQ ID NO: 12524 - DNA, 438 bp, A.fumigatus
  unsure (92): Identity of nucleotide sequences at the above locations are unknown.
gaaaccgccggtgacgcaatgaggccttttacaagtccaccacctcaacccctccccaggcggtttccacaccgtaatttttggcggaacgnaccgagttggccttggtccccggcccaaagggcatgctgggctttgaggtcgccgcgcatggccaccccgcccactccggatacccgtggtgggcgaagagggccatttccgccatcctgccggcgttggggcgcgtggatcaactgggtgatatccccgtcgaggagggtggcctgccccccagcgataagtacggtcgcacgacggtcaacatcgggcggatggagggcggcgtcgcgacgaacgtggtgccgagcaaggcacgggcaggggtcgccgtgcggctggcggcgggcacgcacgacgaggcgcgcgaggtggtgctcaaggctgtccgggatgtga

SEQ ID NO: 12525 - DNA, 606 bp, A.fumigatus
accacccaagtcccacaacatgtcacagctctcctttcacatcttacatcacgccccggcgtacaatccaccttcatcctttcccgcaaagacggatccataatccaaagcaccgggctcctcgcctcaccaccaccgaggaatagcacgacaagcgaaacacaaacaccgccagcaccgaacgatgcgaacagtactaccaccattcctacggagtcattggatccttcttcgcccgccggcgcaagcacagcccgagcccctaccgcacagaaaccataccagccgtctcaggcggaagctctcgcagcgcggatctttgctttcgtggagagtgcgtcggagctggggatgacgctgtcgtgtccgcgcgcggaggacatggatagctatcagactgggttgaatggagatggtgcggggagagacgatgcgaggtcggagggtgtggacagggaggaggaggatgaggtcaagctgctccggctgaggactaagaaacatgagatcgtggtcgtgccggataggaagtatcttctgtgtgtggtgcatgatgctgcgcatgcatctgggggttcgggggttgcgggggtgcgctctaggtga

SEQ ID NO: 12526 - DNA, 279 bp, A.fumigatus
agccggtctgatgtccagggaaggattacatcctacctctctaccaccaatgttcaattgggagcgacgtatggcatatctcgggcagccaccactgcattttctaagggttacgaggcggcggcgaagtttgtcaatgcgagtcctgatgaggtgtgttctctgaccctggtagctccggcttgctctgaccccattacctcagatctgcttgggtatatcaacaactcagctcttgcacaacctttcgaccgcgctcaagttcgaacccggcgatga

SEQ ID NO: 12527 - DNA, 387 bp, A.fumigatus
ctccggcttgctctgaccccattacctcagatctgcttgggtatatcaacaactcagctcttgcacaacctttcgaccgcgctcaagttcgaacccggcgatgagctggtgctctcaaagctgaaccacgaagccaatacggccccctgggttcggatcgctgaacgactgggcttgcaggtgaagtggtggtcggcatcggataccagaaaccctgtttgtgacctggatgagctgggccaattgctctcggagaagacgaggctcgttgcttgcccacatgcttcgaatatcacagggacaatcacgaaggtcaaggagattgcgaagctcgttcatcagtatccacgtgtgagttctctggtggcttcttcttgccattgctga

SEQ ID NO: 12528 - DNA, 717 bp, A.fumigatus
aataaattatgcgcgggtctgtcactacccgaggtgaagagctcgtgtcaagacctggcgaagtctcatcgaaatgaagacgagtcctatacacggtcttctacaccagggagggcactgtttgaattttggacctcgactttttcaaaaaatcaatcactatacaacgctgtactagaagactgctatgaccagtcaacatccatctgtctcctatgcgctcgaggagaatctcgagtctcagcattcttcaagctcttgaccaaccatgtacatgcttcagaaactgacatatcgatagttggctcactacccaaggatgctcctgatgtcggtctcggacttgttggtgcacctgcttgcggtgacgttatgaagctccagatccgagtcgataaggacaccagcaagatcaccgatgtcaagttcaagacttttggctgtggtagcgcgattgccagctccagctacctgaccgagttggtgcgaggaatgacgcttgacgaggccgctaagatccggaataccgacattgccaaggaactttgcttgccccctgtgaagttacattgctccatgcttgccgaggacgctattaagtctgccatcaacgactactacaccaagaaccccaaggctgctaagactgatctttctggcactgcggcttccatttccaacgtggaaaagaccgacggtagcaccgcaagcctgtga

SEQ ID NO: 12529 - DNA, 561 bp, A.fumigatus
ctagtgcggatcttccagcccgtggtgaagaccgtgtttctcgagaagaatgggtctatctttataaagttgggccagcatctcagtagcatgggttatcttcttccgttggaatggacgacgactttcgtccctctgcaagacaagtgtcccgtctcgtctattgagtccgtcgaggaaatgttcgtcaccgacacgggccatcgcatcgatgaattattctcgagtttcgagccattgcccattggagccgcatctcttgcccaggttcacattggtacactgaaggagactggtcagaaggttgctgttaaagtgcagcatcctgcattggccgaatgggtgcccttagacctggcattgacacggtttactttctcgatgttgaaaagatttttccccgaatatgatctagagtggctctcgaatgaaatggatttctcgctaccccaggaattggatttccgcatggaggcagagaatgccaggagggctagtgagtatttcaaaaatcactcagatgctccgttagtgattccggaaggttcgttccatttataa

SEQ ID NO: 12530 - DNA, 1017 bp, A.fumigatus
gtatttcaaaaatcactcagatgctccgttagtgattccggaaggttcgttccatttataacgataaaaaaagaaagttcagccgctctgctaacgcctcaagcagtcatgtgggctcagaaaaggattttggttatggaattcctctcaggccatcgtccggatgatctcgaatatttggactccaaccatattgaccgtgacgaggtctccgccgcgttcgcacatatcttcaacgaaatgatcttcggagacaatgccccgttacactgtgacccccacggcggtaatatcgccattcgcaagaaccccaaccgacgccgccacaacttcgatatcatcctctacgaccacggcctgtaccgcgacattccacgcgatttacgtcgtaactatgctaagctctggctggcagtcatcgaagcagatgaaggccgcatgcgtgagtatgcgcgtaaggtcgcaggtatcacagacgaacaatttcccctgttcgcgagcgcaatcaccggacgagattacaccgtgctagccaataaggatgtcgcttctccacgcacggctgccgaaaaagagaacatctccggtgcgctcggggagggcatgctgcaacagctcgttgagttgcttggccaggtaccccggatcattcttttgatactgaagacaaacgatctgagtaagttatactcgcttacaatgcactcgtttccatctttctgttttcttcttgaatttccagctaacattgcctgctctccaccttcagcccgcagtctggacgaaaatctacatacccgacagggacccatacgcacatttcttatcctagcccgctacgccacgcgcaccgtcttcgaagagaagatggagaacatcaacgagaccggcggcatgctccgcccactcaacttcttgcggtttctctgggcctggacaggctatctccgggttgaactgaaactctccatctacgagactctgctgtctatgaaaagtcggttcgggttgatctga

SEQ ID NO: 12531 - DNA, 969 bp, A.fumigatus
  unsure (916): Identity of nucleotide sequences at the above locations are unknown.
ttgggtattggttttccccctctggctcttggactgcatggccctaacaaactgtctaggcactacgaggctgaggatattgaatgggacctcgatccatcccggaccattctcgcaagcttgagcatcggtatcctcgccggcgctgccgtggctctatccagcagcctggcagatgtatccaaggtcggcgccgaaagtgttcgcgtctcctttcgcctaggggtgtacgtcgccgacatctcgacaaagctcgaagctccccagtcagatggaacgctgcagagttgggcgcatgtcgtcacgggaatgtcgcatgaagcagttcaggaagagctctctcaatacaatgcagtcacgcaaaacccagaaatcacaaaggtctttgtcagtgctgcggacaagacgtctgtaagtgtgactgggcctccatcacggatcaaagctgcctttcaacactcgcccagcttgcgatactccaagtcgttaccgctgcccgtgtacgacggactctgccacgcggcgcatctatacagccaggatgatatcgagatcgtcatcaacagcgccaagtctgtgatcccgacttcccggccggtgcgactccccttgatctcctcccagactggcaagccgtttgcggccaagacagccggtgagctcttcctggagattggcaccgagctgctgaccggcacaatcttcctggacaacgttacggccggtatcctggagcacgtcaagcttcaggagccgacaggaaactacgaaattgtctcctttcgcatgtcacaggtcctgaatggtattctgacagccatcgagactgacttcccggagctggggcgggcccggcgcgatatggtgtcctgggttcacggagactatggtgcccgccgccctctttctacgcggnctcaaagctcgccattcttgtatggcttgcaggctaacgggaagcgccaatga

SEQ ID NO: 12532 - DNA, 840 bp, A.fumigatus
cccagcatgtctcttcagttgaatggcaaaagccgtggcacatcccccggcaacgcccagccactgcccattttcgatgctctttgccgttcgctccctgtggggactgctgacgagcagttctggtggaaactgacgggccggcaccttgcccgtatgatgctcgaggcgggctatcccgaacatcgccaggtcgaatgcctagtcttccatcgcttcaaggtagttccaaccttcggtccccagccccggtcggccgagccgtggtacaggagccgggtggctgcaagtgcgggcgacggtgctcccatcagctacagctggcgttttggcacggcggacagaaagccctatatccgcaactacatcgagccgctgggccctctgactgggactgcggccgacccgaataatgacgtggcgaccagggcgtttctgcaagacctcaccaccacgctaccgaatcttgatctgtcgctcttctggacgtttgagccacatctcgtctcacggttttccgacaaggcggaccgagagaagtatgccggtccgtcggtgctgacgggcgtggagctttcgcccgactcggacgccattgatatcaagatgtacctgtatccccgaaatcccgaacagatcagccagctcctcagtaccatcattcccaaagcaatgcgagatgcttacggcgaagacgtgtgtcttgacagtctgaatatcgtgaaacacttcctgaccgggcaccccgatgggcgccagctcaagcctcgtggaacaaccggcatagactgctgccaagtacaacactcgaaggtgaaattctacgtcgcgacggataac

SEQ ID NO: 12533 - DNA, 303 bp, A.fumigatus
gattcagacggcgacacattacaagaaggtaagagcctctcttttcccttttacgacctgaatctcactgatgagcggcaggttatggtcgatggcgcagagaaattgactccgtgttcgcctggcgatagcggtgcgatcgagatgtcatgggtggacattgaagccgatcagctcctcgagccacctcttatgttgaaggacttcatcaaggctgttcgcaattcaagaccaacagtcagccaggaagacctccaaaggaacgcggaatggaccaaagaatttggcagtgagggagcttga

SEQ ID NO: 12534 - DNA, 513 bp, A.fumigatus
attgaactccgtcgctccttccagccccgtggtgaagaccagctctttaacatggcgcgcgaaaacaaaccagcgatcatctttattgacgaggtagatgctctttgtggacctcgtggcgaaggagaatcagaggcatctcgccgtatcaagaccgaacttcttgtacaaatggacggtgtcggcaaggactcgcgaggagtgctgatcttaggcgcaacaaatatcccttggcaattagatgcagcgattcgacggagattccagcggagagtacatatcagtcttcccgatctcaacgcccggatgaagatgttcatgctcgccgtgggtcaaacaccgtgccaaatgacgcaggccgactaccggaccttggcagagatgagcgagggctattctggtagtgatatcagcatcgccgtccaggatgcgctgatgcagcccattcgtaagattcagacggcgacacattacaagaaggtaagagcctctcttttcccttttacgacctga

SEQ ID NO: 12535 - DNA, 279 bp, A.fumigatus
aagatccgcattagcactagactgttcgttgtctccgagaggctgctgttcaagaagcaactcaagctcatggatgcgcttctccagacgctgtactttacctttagccagcgtcagttctctgtctcgcccaccggaggccacatgcagcttatcctgaagctgatcaatttcggccgacaatcggttctcttcctgcgtggcacgctcaatttcggagctcagttgcttttcaagagattctttcgcttccagaagggaagccttatcgtcctttag

SEQ ID NO: 12536 - DNA, 1875 bp, A.fumigatus
actgatgagtctggtagtctacagcgcgagctcagtcaggaacggtctcaagttagggaacttcagcgagctttggacgaggaaaagcagcgctcgtcggaaaacggacgcatcatacgtgcacagtacaaagaagaggtcgagcggttgcaagaagaaatcgagtctcttcagcacgagattgaagacaaagaaggccagtttgcgctcgagcaggacaggtgggaaagcgcaaagcggactttacaacttcagaaagaccgggccgaggaccaagcggctggatacaagcgcactatcgagaagctggagcaagttgagcactctgtatcagcaagggaagtgaaactgcaggaggtcatcgatagtgagaaggcccgacatttcaatgcagaagcggttcttagtcgtcaagtgaaggaattaaatgacgacatcgcatcgaaacgggaagttatcgatgagctaagaaacgagcttctgtctgtcaaggaagaattgagagtcaccaaacgggaggaagtcgccttgagagagagagttcaggctctagacgacgaggtagttgttcttcaagcaagtttagaagaagagcaagaatacacgaaagctcggctgcagaaagggtcttctgaagacggccacttgcaaaaattggtggcagagaagcagaagcttcgtgatcagctggcaaatgctcacgtcgaactacatgacctgcgcacttcagtagctgagctagaggccgaacgcgatgaactccagagtcaactcgataacgtcaaagagcaggttggcgatacggcacgatttgaccgagagaaaattgatctacgcaaatccaccctacgccttgaaggtgaggtaaagagactaaaggacgataaggcttcccttctggaagcgaaagaatctcttgaaaagcaactgagctccgaaattgagcgtgccacgcaggaagagaaccgattgtcggccgaaattgatcagcttcaggataagctgcatgtggcctccggtgggcgagacagagaactgacgctggctaaaggtaaagtacagcgtctggagaagcgcatccatgagcttgagttgcttcttgaacagcagcctctcggagacaacgaacagtctagtgctaatgcggatctttcaatgctccgtcataatctggatgaggcgcgaaagagagaacgagtactgctacaacgggaagccgatcagaaatcatccgttcgcaaatgcaagcagcgaatctctgagctggaaagggagctccacgatgcgttgatgaataaatacgaaacaagttcgcctcatgggtcgccctccgacaaattacatgaacaaacacgaagcctccggaagcagttgtctgagactcatcgggccttgaaggagttgcgtgctaagaaccgtgacctcgagcgagcagccatgcgagaggaggatcagcgagacctccacgaactcctcaaatcttccactcttgaagccgaatcactggcgttgcaagtgtctgagagggatgctcgcctcagtgacctgaagtcgcagcttcgcagagtccgtgaggaacgcgccttctgtagcagaaaagctgaggcggccaccaaagagctagaaagtcttcgagaacgctatgacagaatcgtaaagagcatggagtcccacgccgacaataagaacagacacgacaaagagatctcaggtctcggtagggagatcatttggcttcgagctcgtttgaggcgagaggagaagttccggcgtgacctagcttggagcaagggcctgatggagcttggagaacgcgtccgcgttgcttggtatgttgtacccgtattgtgtttcctcctctcgtacagccactga

SEQ ID NO: 12537 - DNA, 252 bp, A.fumigatus
ctgtcaactagtaacgaggccgacctcaggatgatcaacgagatgggcgtcaagcctctggaccgaacttatttccgcactccgcggcaaaaactgaaggctgccatctccatgattctggccacagttcgcatgcaaagaaagtctcgtgaatggtcgaagacgaagaagttaggcgaaggcctcaagcgggccaaaaatgaagtgttgaagaagaggagggagagctccggcaaagccgcaatgacttga

SEQ ID NO: 12538 - DNA, 771 bp, A.fumigatus
ccgtcgaacatcagtctggctaatgcattcctcgacggagtcaattcatcagccccattgccatgggtacataaatcaatagctccaggtctatctactgatttcttcgttacaaatcttcccactcgatcggccgccatcatgctttctgcgaaacagccccctcccaaagtcctcgtgccggaaaagctgtcgccagatgggttggctcttctgcgtgcgtcgctcgaggtagacgagcgaaggggtcttgatgcagatgaactcctccaaatcatccctgaatatgaagctctggtcgtccgctccgaaaccaaagtcacggccaatctgcttcgagccgccaaacaactcaaggtcgttgccagagcgggagtaggagtggacaatgtgggtgagttagcccaaccccccctccccccttcccccagccttggttcatggccactgacaagtcaccgcacagatgtcgaggaagccaccaagctcggcatcgtcgttgtcaactcgccgtcgggcaacattggggctgccgcggaacataccattgccctgctgatggccatggcgcgcaacatccccgaggcctgcagcagtctgaaaagcggcaaatgggaacgaagcaagtttgtcggcgtcgaggtgaagacaagaccctgtcgatcatcggtttgggaaaaggtgagcttcttgcaatctggggacgaggcattcatttccgctacgatggggggtcgagtggatgggctgaccgacaaacagtcggcttga

SEQ ID NO: 12539 - DNA, 846 bp, A.fumigatus
gttagcccaaccccccctccccccttcccccagccttggttcatggccactgacaagtcaccgcacagatgtcgaggaagccaccaagctcggcatcgtcgttgtcaactcgccgtcgggcaacattggggctgccgcggaacataccattgccctgctgatggccatggcgcgcaacatccccgaggcctgcagcagtctgaaaagcggcaaatgggaacgaagcaagtttgtcggcgtcgaggtgaagacaagaccctgtcgatcatcggtttgggaaaaggtgagcttcttgcaatctggggacgaggcattcatttccgctacgatggggggtcgagtggatgggctgaccgacaaacagtcggcttgacggttgcccggctggccaaagggctaggaatgcacgtcaatgcactcgatccgtacgcgtcccctgctgtcgcagcgtcggcatctgtcacgctggtctcgtcgctgtcggagctgctgcccacggcggactttctcaccatccacacgccgttgatcgcgtcgaccaaggggatgatctcgacagccgagctcgcgcagatgaagcccggtgcccgtatcctcaacgtcgctcgcggcggcaccatcgatgaagccgccctgctcgagtctctggagtcgggccacctggccgcagcggccatcgacgtcttcactaccgaacctccccagcccgaatcgactgccgctcggctggtcgcccatccccgcgcggtcgtcactccgcacctcggcgcctccacggtcgaagcccaggaaaacgtctccatcgacgtctgcgagcaggtcctccagatcctcaacggctccctc

SEQ ID NO: 12540 - DNA, 384 bp, A.fumigatus
atcgttgtcgaacgtagtccacgctggtcgtggctgtatgatacgatggtcggagtcccccatagcacagggtgctcgatgtgccgcgaaagacgcatcaaggtcggtgattcgtctcatacgtctcgtttcaatccaactgagagaaacaagtgcgacgaggccgtcccccaatgttcacaatgccggaaatacggccgcccgtgtccaggctatcgccgcacctttcgcttccaggatgaaggaccagccctccaacgccggcaccagtcgaggtcccagtctcgccgacgtcccgagacagccacagatgcagcgacggcagcagcagcagcagtcgtgcggtcttctaccacagggggccgaagcatccgcgcaatgcga

SEQ ID NO: 12541 - DNA, 450 bp, A.fumigatus
gagggagccgttgaggatctggaggacctgctcgcagacgtcgatggagacgttttcctgggcttcgaccgtggaggcgccgaggtgcggagtgacgaccgcgcggggatgggcgaccagccgagcggcagtcgattcgggctggggaggttcggtagtgaagacgtcgatggccgctgcggccaggtggcccgactccagagactcgagcagggcggcttcatcgatggtgccgccgcgagcgacgttgaggatacgggcaccgggcttcatctgcgcgagctcggctgtcgagatcatccccttggtcgacgcgatcaacggcgtgtggatggtgagaaagtccgccgtgggcagcagctccgacagcgacgagaccagcgtgacagatgccgacgctgcgacagcaggggacgcgtacggatcgagtgcattgacgtgcattcctag

SEQ ID NO: 12542 - DNA, 522 bp, A.fumigatus
agggagccgttgaggatctggaggacctgctcgcagacgtcgatggagacgttttcctgggcttcgaccgtggaggcgccgaggtgcggagtgacgaccgcgcggggatgggcgaccagccgagcggcagtcgattcgggctggggaggttcggtagtgaagacgtcgatggccgctgcggccaggtggcccgactccagagactcgagcagggcggcttcatcgatggtgccgccgcgagcgacgttgaggatacgggcaccgggcttcatctgcgcgagctcggctgtcgagatcatccccttggtcgacgcgatcaacggcgtgtggatggtgagaaagtccgccgtgggcagcagctccgacagcgacgagaccagcgtgacagatgccgacgctgcgacagcaggggacgcgtacggatcgagtgcattgacgtgcattcctagccctttggccagccgggcaaccgtcaagccgactgtttgtcggtcagcccatccactcgaccccccatcgtag

SEQ ID NO: 12543 - DNA, 615 bp, A.fumigatus
ctcgttccgaatgctctctgtaccagaatgcgtttcaatgacggagccgtcgacagtcatgggcggttctgggccggatcgatgaatgatcccaaagtccagaaaccaaccaacgagggcgtcttgttcaggctggaccccgacctgcagttgcatcgtatggtcgaaggggtgtccattcccaacgggatcggctggaacctccgagacgacaccatgtactttaccgactcgcccacggcgaagatcttcgcctttgactttgacgccagcacgggaactatcagtaaccgcagagtgcactatgatgttggcgagcctatggaacccgatggtttcgccatcgacgaggaaggatgcatctggagcgcgatttacgggggcgggaagatcatccgcatctccccggagggcaagcttattggcgagatctcattcccaaccaggaacatcacctgtccaacctttgtaggtaccgaactatttgtcaccacggccaaagacgatgtcaacgatgagcaattcccagagtctgtccgttatggtgggcgggtctatcgaattgacgtgggggttaggggcaagccgaaaaacgagttccggttccagaagtag

SEQ ID NO: 12544 - DNA, 363 bp, A.fumigatus
cgcgccagcgaaatattccgaggcatgtcagatgaaaatcaagattttgcagccagacccgtgagtgattacaacgcctctgtgtatgttcaattccatttcatttcagcccgagcacatcgcgcaccgctgcagagttcagagttcagagattgcgaatcaacagacgagagcgatcaaggcaaccaaaatggtgtggcaaagtcgtggtatggtgctccgtcgtgcaccgtcggacttatcactgtgtttagagctaccgtcgtcatcatcgtcactgtcgctgtcgctgtcgctgtcgctgtcactgtcgatcggggcagccgaggtatgatgaggatcggagccaccggtcgctgttga

SEQ ID NO: 12545 - DNA, 966 bp, A.fumigatus
cctccagggcgactcggtcctcgtgcgcatcacccactccggcgtgtgctttacggacgtgcactacatgaaggccgacatggcgctcggccacgaaggcgcaggggtggtcgaggccaccggcccgggcgcccagcacctgaagaaaggcgaccgggtcggctggggctacgagcacgacagctgcgggagctgcaagcagtgcctgacgggttgggagacgttctgtcccgagcgcaagttctacggatacgccgatctggaccagggctcgttcgcgacgcacgccgtctggcgcgaggccttcctcttcaagatccccgatgcgctcagcaaccaggacgcggcgccgctgatgtgcggcggctcgacggtgtggaatgccatcgtggtcggcgaagtgaagcccgtgtcgcgcgtggggatcgtggggatcgggggcctgggccatctggccatccagtttgcggccaagatgggctgcgaggtggttgtgttctccggcagcgacaacaagaaggcggaggcgatgaagctgggcgcgtccgagttctatgcgaccaagggcgccacggagctcaaggtcggcaagccgttggacaacctcatcatcacgaccagcgctcagcccgattggaagctataccttccgattctagcgccgggcgcggtcatctcccctctgacggtggacgaaaaggatctgcaaatcccatacatgcctctgctcgtcagcgggatccgtatccagggcggtatcgttgcagcgcgccagtcgcatcgggacatgctcgactttgcggcacaccacggcaccaagccgatcatcatgacgtatccgatgagcgtggaaggaatccaggagtgtctcaagacgctgcaggatggcaaaatgagatatcgtggggttttggtggcagacaagcagtaattagcagtatcgcaatagtaggttttactgtataa

SEQ ID NO: 12546 - DNA, 1044 bp, A.fumigatus
aaaacgaaaatatccgtatataaacggaaacggacaacaatgggcttcgattttaccgtgtacaaaggctcctccgatggctccatcaaaaaagccaccacccaccgcgatgacctccagggcgactcggtcctcgtgcgcatcacccactccggcgtgtgctttacggacgtgcactacatgaaggccgacatggcgctcggccacgaaggcgcaggggtggtcgaggccaccggcccgggcgcccagcacctgaagaaaggcgaccgggtcggctggggctacgagcacgacagctgcgggagctgcaagcagtgcctgacgggttgggagacgttctgtcccgagcgcaagttctacggatacgccgatctggaccagggctcgttcgcgacgcacgccgtctggcgcgaggccttcctcttcaagatccccgatgcgctcagcaaccaggacgcggcgccgctgatgtgcggcggctcgacggtgtggaatgccatcgtggtcggcgaagtgaagcccgtgtcgcgcgtggggatcgtggggatcgggggcctgggccatctggccatccagtttgcggccaagatgggctgcgaggtggttgtgttctccggcagcgacaacaagaaggcggaggcgatgaagctgggcgcgtccgagttctatgcgaccaagggcgccacggagctcaaggtcggcaagccgttggacaacctcatcatcacgaccagcgctcagcccgattggaagctataccttccgattctagcgccgggcgcggtcatctcccctctgacggtggacgaaaaggatctgcaaatcccatacatgcctctgctcgtcagcgggatccgtatccagggcggtatcgttgcagcgcgccagtcgcatcgggacatgctcgactttgcggcacaccacggcaccaagccgatcatcatgacgtatccgatgagcgtggaaggaatccaggagtgtctcaagacgctgcaggatggcaaaatgagatatcgtggggttttggtggcagacaagcagtaa

SEQ ID NO: 12547 - DNA, 384 bp, A.fumigatus
tacggcccgagtatcagcggtaacagcggtcatgatgaggccgatgtgctgtacattgcttttgcgggcaaggaggctgtccctgcaagggccaagtgggatgcagacagctacgaggcgttcgaggagagcatcactgcgcaggggggccagttggtctcgcaattgtttggcgacaggtcaacagcgaccggtggctccgatcctcatcatacctcggctgccccgatcgacagtgacagcgacagcgacagcgacagcgacagtgacgatgatgacgacggtagctctaaacacagtgataagtccgacggtgcacgacggagcaccataccacgactttgccacaccattttggttgccttgatcgctctcgtctgttga

SEQ ID NO: 12548 - DNA, 234 bp, A.fumigatus
ctcgacaccactactaaactatctgctaactacaaactcaccgcaacattcagtgtctccgtatccttcctctctccgagtctatcttctcccagtctcacacgtcttccgctcctccttgcttattttatcgttattgctttgcaccccttccgaccatccatcatggaagagatcgcccccgagtatgatgttgtggtgctcggcactggtatgtattaccccgccgtttga

SEQ ID NO: 12549 - DNA, 1122 bp, A.fumigatus
acatctgttgattgcttgcttgtcctgcagctattcaagaaatacggcaacgtccgccccggcgaagaaccctggaagaagtatggacgagtcaacgattggaatattgatctggtcccaaagctgctgatggcaaacggtgaactcaccaatattttggtttctacggatgtgacgagataccttgaattcaaacagattgctggcagctatgtccagcaagggaagggccccaaagctactgtggccaaggtgccatcggatgctggtgaagctctacggtcgtccctcatgggcatgttcgagaagagaagagctaagaagtttctggagtgggttggtgaattcaaagaggatgaccccgctactcaccagggtttgtctctacattgtagcatttattcaattgctaatgtgaagggctcaggtctgaatgtcgctcagtgcacaatgaaggaggtctatgacaagttcgggctcgaggacaacacccgcgactttgtcggtcactccatggcgctttatccgtctgatgactacatcacaacaccgggcatggccgtcgagactatccatcgtattcgactgtatgtcaactccatggcccggtacggaaagtccccatacatctaccctctctatggtctgggtgagctcccccagggctttgctcgtctgtctgccatctacggtggcacctacatgctcaacaccagcgtcgacgaggttctatacgacgagagcggcaaggtctctggaatcaaggcaaccatgaaggatcgcgacgacaatagtgaggccatgaagttcaccaccaagacaaagaagatcatcgcggacccatcttacttccccggcaaggttcgggtcactggctacctcctgaaagccatttgcattctgaaccaccccattgaaaagaccgacggcagcgactcgctacagctgatcattcctcagtctcaagttggaaggaagcacggtgagtcaaccttggagtctgttggattcaagactttactgatcagaatcagacgtttacattgccatggtatcatccgcccacaatgtctgccccaagggctactacatcgccattgtctctactattgccgagactga

SEQ ID NO: 12550 - DNA, 339 bp, A.fumigatus
tcagaatcagacgtttacattgccatggtatcatccgcccacaatgtctgccccaagggctactacatcgccattgtctctactattgccgagactgatgcaaaccaccacctggaactggaacccggattcgagcgtctgggccaaattgaaaaaaagttctttggccctcccattcctctctacgaacctttggacagcggcgagaaggacaacatcttcatttccaagagctacgatgctacctcccacttcgagacaacaacaggtatgtcacagtttttccgccacatcatggttgctaatggtcaaaacagacgacgtgcgggacctttataa

SEQ ID NO: 12551 - DNA, 291 bp, A.fumigatus
catcagcaccagcgtcgaatctaccccgtttctttgaataacaactcaaagacaaacaaacaaacaaacataccggcgtgtaattccacctccattccctccggcaacgcccttcgaagcgaattcaccacatgcgccgttggcgtcgacccaaacgacaccaccactttcctcccctccttcctatctagataccccgccgcgcgaaccacaccctccaattcactcttcagcaccgccgccgctgcctcttccgtccgacacgcatatgaatgccccgcatggcagtag

SEQ ID NO: 12552 - DNA, 810 bp, A.fumigatus
ttgctaacgtcaacagcgcggttcttctctatgaaccttaacaatgtaatggagcagtatgtcgaccatctcaccccaaacgtcacctacgcgccgaccataagcggaggcattggagcacgcgatctgcgtcggttctatgaacaccacttcctccgcaacctgccgccatcgatgcggttacgtcttctctcacggaccatcggcgttgaccgcgtcgtagacgagctctacgcttcatttgaacacacccaagagatcccctggatgctccctggtgttccaccaaccaacaaaaaagtcgaagcgatcctcatcagcatcgtgagcctgcgctccggaaagctgtactcggaacacgtctactgggaccaagccagcgtcctcgtccagatcggactgctggaccctaagctcgtgccgcagggagtggagggcgtctaccggctgccggttgtcggaaaggaggccgcgcggaggattctgacggaagacccggagtcagagcagcgacgctaccataatcggcttattcgtgcgacgcatgcaaagcacaagggccagcatggaaagcacgagcttgtggaagggtccggcgcagaattgaggagcgaggcgggagactctgtaaaaacggggaatgttaaagggaaaagtgtacaggggcagtcgtggcccgagaaagaggatggggctgatggtgaggaggaggagacggggacggggcggaatgggaacggggttgcaaatgggagcaatgggaaaagggcagcctccgtggaggatgacaatggagagaatgacgactaa

SEQ ID NO: 12553 - DNA, 294 bp, A.fumigatus
gcttgcaagagaagaagcgccggaaccacgaggcggatcaaccagggcatgggcacaggggagcgtctgaacatcggacaccaagcttacacttatgataacgtgcagccagggtttgcagagcacgacctggaagagtacgatcgactggcggccgagttggccttttcacgctcgttgcaggtgatacggtcgacggttacagacaagattgaccttgagaagcggtgggaggatcatctggagggtatgtcgccttgtgttccatgcaaccttcaagggcctgattgctaa

SEQ ID NO: 12554 - DNA, 546 bp, A.fumigatus
attcgcttcgaagggcgttgccggagggaatggaggtggaattacacgccggtatgtttgtttgtttgtttgtctttgagttgttattcaaagaaacggggtagattcgacgctggtgctgatgctaggtgcgtaggaaacttccccgccaacgacctgcagcaagtttgtactggcctcgtggctgaagagcagcaggcggttcgtgtcctggtggaggtgtgcagcgtatatcctgagcgtaacgaggcgcttatcaacgcggggacagttgcgttaaccaaggagacaagtgacgtggtgggttttgggcgggtgactgaccggccagggtgggcggtagtgaggatggcgcaggagcatgggattttggggctggcgaatgcgtccggggttcagagggtcgaggagacgtttcgtgtgggccagaaggtgatgctgtatattcagcatgcttgtattactgctgcgcagcatcatgtatatcatgttgttgatgaggaggatatagttagggagacctgggtgccgtggaaaggatggtaa

SEQ ID NO: 12555 - DNA, 342 bp, A.fumigatus
  unsure (339): Identity of nucleotide sequences at the above locations are unknown.
cgacttcccacactccacctcctcacctcaatcccccgtttgcaagataggcatcaatggcttcggccgcataggtacccgtcagccttctcaccacaaccggaagtgatactaacggctggccccctcccaggccgcaacgtcctccgcgccgccctcaacagacccgacctccaaatcgtcgccatcaaccacacctgcacgaccattgacgacctcatccatctcatccgctacgactcgtccatgggcaacctcccaccctcgatccccatccacgccctctccgacaccctcctcagcgtcttcaccacggggctggaaggagccgcgccatgnggg

SEQ ID NO: 12556 - DNA, 810 bp, A.fumigatus
ccgatattgagctggatcctcccgaacactgtctaccgcaaactacagcgcctccgatggatcttcacttcccggctgttctttctgttctgtcagaccttcccctggatggcgcgacttcttctcaagctcagcgtcgtgcggcagctccctaagaatatcccccatgacccgcacttcaagccgcggtacaaaccctgggatcagcgcctgtgtatctgtcccgatggcgacttcttcaagagtctccacaccggccgtgcggacgtcaagacagacaccatccggcaggtcacaaccagcggcatcgagctgaattcgggagacttcctcgacgccgacatcatcgtgacggcgacggggctcaagctgcagatcgcggggggcacctcgatcacagtggacggcgagaaacagcgagtgcccgacaaatacctctggaatggagtgatgctgcaagacctgccgaacgcatcatttgtgatcggctacacgaacgcatcatggacgctgggggccgacgcgacggcactctttgtctgccgcttgctcaagtggatggaacaacatcacaagatcgcggcggtcccgcggttgaatccgatgctggccaagcagatgcagccccgacgtttgcttaacctgaactcgacgtacgtgacggcggcggagaaagatctcccgaaagcggccgatcggggtccctggcagccgcgcgacaattacctgtcggatctgatgtttgccaagtatgggcgtctcgacgagggactggaatgggttgatgggggctggaagaagcagcaatag

SEQ ID NO: 12557 - DNA, 201 bp, A.fumigatus
gctactatcaccactgtccacttgtcctatcatacaccgtacatcatactatatagtatagtatataccactgcaatggctccctccattaacgacttcccacactccacctcctcacctcaatcccccgtttgcaagataggcatcaatggcttcggccgcataggtacccgtcagccttctcaccacaaccggaagtga

SEQ ID NO: 12558 - DNA, 222 bp, A.fumigatus
gtccaaagtctgctccttctgcttgctccagcgcttttcgccgcctccgtgtacatgattctgggtcggattattcgactgctgaacgcgggttccctctccttggtccgtcggaattggctgaccaaggtctttgtggctggtgatgttatttcttttttcatgcagtgcggaggtatgcggttcctgcaaatgtatacaaggcatgagacaccaagctaa

SEQ ID NO: 12559 - DNA, 456 bp, A.fumigatus
tctcagtattctcctgtaggtggtggtttactggcgggcgccaaaacacaggacaaggtcaacatgggagaacatatgatcatcgctggcctttttgttcaaatcctgttcttcggcttcttcatgcttgtctctgtgattttccatcgccggatgcttgcaacgcccatccatcacatgatgtccacccagctgccatggaactactacatgaagattctgtacacggtcagcgtcctaatcatgatccggtcggtctatcgtgtggccgagtatgtgcaaggaagcgacgggtatcttcagagcaaggaggctttcatctatgtttttgatgctgccctaatgtttgcatgctgtgttattcttaatgtatcccaccccagcaagctcttgtcgcacagtcaggcggaccagaaagtggattctgatctggagatgctgaacccggaacggtaa

SEQ ID NO: 12560 - DNA, 282 bp, A.fumigatus
tttgaaaggtcgaaaatcagtctctctgcctcattcttccatggactcatcttcgtcgtcgttatcctgcgcttgtccctcttcgtcatcttccaggtcatcgctgagccaatcatcctcgtcatccatatctacgtcttcttcgtccccgtcatcttcgccacctcttccttcagctcgagctttggccttctcctgtttcttcttctcaatgttttctctttgctgcttctttctctcttccttctccttcttcttcttggcccaattcttatccagtga

SEQ ID NO: 12561 - DNA, 555 bp, A.fumigatus
actaatgtatcaaaaggaacctgcctgacagtaaccgcattcgacaagacctggttcaaggtcggcgttgcccccgagacgcttcggcggacaaacctgggatcattggaaaagggctcccgggtaaatcttgagcgggccgttctggcagagacgcggatgggcggtcacttcgtacagggtcatgtcgacaccgtcgcaaaaattctctccgtcactccggatcagaactccttggtattccgtctacagcctcgtgatcagagtgtaatgaggtatatcgtggagaagggctatgtcacactggatggagccagcttgacggtgactaaagttgtggatgggccagacgggtactttgaaatcatgcttattgcctacacacaagagaagattgtgacggcagctaagaagcctggggattacgtcaacgtagagattgacattgtgggcaaatacgtcgaaaagagtgtccagggttactttgctggaaccgctggaggagacatgagcattttggagaagatggtgtctcgcattgtagacgagaagtaa

SEQ ID NO: 12562 - DNA, 570 bp, A.fumigatus
cttcctccgctgtctggacaagagtgtgacctctctctcaggtccagaaaaaaagtagatttgtcggagcaaagccgcggaggagctcggatcaacaattttgcggcgccaaaaaatatttcctttgctgatacaaagacgagcacatcagaaatccaacgaaacctatcgatcaagtgctgtgagaattatccgagcataatgcgggacgtcaagaagcgcaagatcgcccacgaggccccagaacatgggagcgacactgaatcaacaagttctcacaagtccgttgctcagcaagatgatcctcttgagacgcaagatgaagcgacggccacagagtcaaggccagcgcccaagagcttcaaagatctaggcatcattgatcaactatgcgaagcatgtgaaacgatgggttacaaggctcctacgccaattcaagccgaatcgattcctttagcactccaaggtcgtgacttgatcggtttagcggaaaccggaagtggaaagacagcggcttttgctcttcctatattgcaaggtatgattccatcagacctcactatcctttga

SEQ ID NO: 12563 - DNA, 519 bp, A.fumigatus
gcgtcttggtcttcaatcgatgtctactttccagtcgtttcggtatctgacaagccacccacagctctaatggaaaatccacaatccttcttcggcctcatcctcgcacctacccgagaattggcgtttcaaatctcaaaatcttttgaaagtcttggttctacgatcaatgtccgatgtgctgtgatcgtcggaggtatggacatggtgtcgcagtcgatcgcgcttggaaagaaacctcatatcatcgttgctacccctggtcggctgctagaccacctggaaaacaccaagggcttctcgctacgaactctcaaatacctcgtcatggatgaggccgatagacttcttgacatggacttcggcccccttctcgacaagatcctcaaagtactccccagagagcggcgcacatttcttttctctgcaaccatgagttccaaggtcgagtcgctgcagagagcgtcgctctcaaacccacgtcttcaccacggggctggacggacccgcgctaagagc

SEQ ID NO: 12564 - DNA, 1428 bp, A.fumigatus
tattcatatctggacttatattacaatggccaaggcacgtacgaagaagcgcacacatgtgcgggctcaaaatgcttctgccgccgccaaaaacagcatgagcaaaactccgaagtcgatggtcatcagagtcggcgcttcgcaggtcggctccagtgtcagccaactggtcaaggatgtccgtttgatgatggagccagatacagctgtacgattgaaggtaagcgtttcgtggagcacactggcgggtttctggagtcggcaactgatgatgggtcatttaaggaacggaaatccaatcgactcagagactacacgacaatggcgggccctttgggtgtcactcatcttatgcttttctcaaaatcagctacaggaaatactaatatgcgattggcgcttacacctcgcggtccaacccttcatttcaaagtcgaaagctattccctttgcagagacgttgagaaggcattgaagcgcccaagaggtggtggccaagatcacaaaacacctcctttgctagtgatgaacaattttaactctccaaatgcaacggaggattcgaaagtaccgaaacgtctagagagccttacaacaactatctttcagtcacttttcccacccatcaatcctcaggctacgccgctctcctccattcgccgtgtgatgcttttgaatcgtgaacttaccgccggatcagagaaagaggaagattcctatgttttgaatctaagacattatgccatcagcaccaaaaagactggcatctcgaagcgtatccgacgcttggaccctaaggaaatccgcagtcgggagaagagaaagtctgccgtcccaaaccttgggaagttggaagatgccgccgactatcttcttgacccatcagccgctggctatacctcggcaagcgagacagaactggacaccgatgctgaggtcgagattgcagggagcaccacaaaaaaggtcttgacaaagagagaactgcagcgcatgaagtctggcgagaaagcaaaggctcagaaagccgataccccagaggtggagaaacgcgcggtcaagctcgtcgaactgggtccacgcctgaaacttcggctaatcaaggttgaagaaggcctctgtgagggcagagtaatgtggcacgactacatcaaaaaatccgaagaagaggtcaaatcactggataagaattgggccaagaagaagaaggagaaggaagagagaaagaagcagcaaagagaaaacattgagaagaagaaacaggagaaggccaaagctcgagctgaaggaagaggtggcgaagatgacggggacgaagaagacgtagatatggatgacgaggatgattggctcagcgatgacctggaagatgacgaagagggacaagcgcaggataacgacgacgaagatgagtccatggaagaatga

SEQ ID NO: 12565 - DNA, 651 bp, A.fumigatus
tgtgctcgtctttgtatcagcaaaggaaatattttttggcgccgcaaaattgttgatccgagctcctccgcggctttgctccgacaaatctactttttttctggacctgagagagaggtcacactcttgtccagacagcggaggaagctattgggacttggttttattcccaataatattcatatctggacttatattacaatggccaaggcacgtacgaagaagcgcacacatgtgcgggctcaaaatgcttctgccgccgccaaaaacagcatgagcaaaactccgaagtcgatggtcatcagagtcggcgcttcgcaggtcggctccagtgtcagccaactggtcaaggatgtccgtttgatgatggagccagatacagctgtacgattgaaggtaagcgtttcgtggagcacactggcgggtttctggagtcggcaactgatgatgggtcatttaaggaacggaaatccaatcgactcagagactacacgacaatggcgggccctttgggtgtcactcatcttatgcttttctcaaaatcagctacaggaaatactaatatgcgattggcgcttacacctcgcggtccaacccttcatttcaaagtcgaaagctattccctttgcagagacgttgagaaggcattga

SEQ ID NO: 12566 - DNA, 291 bp, A.fumigatus
aaaattcaagagaccgtcgatacaatgcgctcgaatattttcaaggtatcagagcgtggtgaacgcttggactctctgcaggacaagacagacaacctggccgtatctgcccagggcttccgtcggggtgctaaccgcgtgaggaagcaaatgtggtggaaggacatgaagatgcgcgtgtgcctggtcatctgcattatctgcttactcattgtcatcattgttcctgccggtatgtctccttccctgctcgctctccgcacaaccagggctcccgaacgtgctggctaa

SEQ ID NO: 12567 - DNA, 231 bp, A.fumigatus
tcctactcagcctcaatagtcagtatgaagcgtctatccattgatccccgtcaggacatccccccaattcgggattcgcctgctactgcactcccagcaagtctccccaaggcgaaaaacatcaagaccagccctgctcgagccggagaagaaaatgcatcagtttactttgttggaaatgctacgacgatcttgtcagtagcttcttgtcttgtatcaatgagatgctaa

SEQ ID NO: 12568 - DNA, 756 bp, A.fumigatus
tcaagaagtcgaagcatctcttcggcgggacctgcccatcatcactaccagccatgccaagtccatattgacgtccaagggagcagactctttccagcaagtgttcgagctcgagccattcgagcagatgatggtcaatatcaaaggcgacagctcgagaaccaaacaaccgcacatccgagtcacaggaatgccaggcaaacacatcccgaccaacaaggtcgtggagaaattgaacgagttcgcggcggcagtaagcagtttcctgacactgcgatgacacatggcaatgaattgacgatcaagattccccccaccaacggatggatggttgaattaggctatggcagcacccagactatgcaaaccgatttcgaggtcggctatcgcatctacatctccggcgatacgctgatggtggatgaactcaaagagattccgcggcggttcgacggccagaagatcgacctgatgcttatccatcttggaagcacgacggtaccttatccgaagatgtggccactgaccatgatggtgacgatggatgcgaaacagggcgtggagctggtgcgcctgatcaagcctgacctgaccattccgatccactttgatgattacgatgtgtttgcgagctcgctggaggacttcaagatagagatgcagaaggcgggattggggggacaagtggtgtatttggatcgcaaagacgcttatcgcttccaagtgagaagcgacctgacctgtacctcacgatga

SEQ ID NO: 12569 - DNA, 285 bp, A.fumigatus
cccagcggggtgcccgcggattgccccttgtcgcgtccggcctgctttcagaccggcgacgagcagtttgacgagttcgccctggcgcacaaaatgcgcgagcggggttggatcttgcccgcgtacacgatggcgccgcacagcaacgagttgaagctgatgcgggtggttgtgcgcgaggactttagtaagaaccggtgtgatgctctgctgacggatatcaagctggcgctgaagacgttgagcgacatggacaaggccatgctggagaagtatactctgtaa

SEQ ID NO: 12570 - DNA, 462 bp, A.fumigatus
cgacgagtcattagctctagaccaaatggagacggacatgtcttatatcccccattcccatccaccagccatcagccaagtaaaccagaactgttcctgaagatgacctcccagtccccatccgaccccctcatcgccgccctctgcggcctcctaaccctaaacatctacaccctcctcgcgctcctcctctccatccccccattcctcgatcttcgcctgtcgacactatacgtcctcgcgctacaaggcctgatctcgctagtcgtcgtccgcctcttctatatcgctacgtgccgcccgttccagctgcgatgcaggacgacccttgccctgatgcttctgtatgcggtgtttcctgtcccaagggtcgctctctgggtgtttgataccgttgttccggggctttgtgtgcggaaggggtttttccaggtgtgtcgtggtgatgcatgctcggtgtga

SEQ ID NO: 12571 - DNA, 306 bp, A.fumigatus
ggtttttgtaaatacttgattgatacgcctacactgttggcagtgtggccgctatttagcagaccgggagattgtcagatgttagagcgagagctaatcgagccatcatccaaaattgagacgggtctgtcccttctctggcttcccgcgagcactgcgatcacctcttccacgagcttgaagcgtatccgaattattcggacgcggcatctgctgattctttctagctatctgtctttcttcaagttcgaggtctttggcgaaatgccaatcttcatgctcgttctgttcatcgattgggactga

SEQ ID NO: 12572 - DNA, 585 bp, A.fumigatus
ctctcggcaacccagctaaccaccgttcacccgcagcccgaaatgatcgaggacattggcgtcccaaaaaatgaagttgcgaaatgggtcggaatcagctcggccgcgtcatccagctgccaggctgtcatggctgtaacctggggaacaatctcggacaccgtcggtcgcaagcccatcatcctgtgcggcttgaccttcaccatgattttctcgctcatgttcggcctgtcaaagtctctggcgatgctaatcgcttctcgtgcgctgctgggtcttatgaacgggaacgtcgggatcatccgcaccatggtggcggagatggttccagagaaggagttgcagccgcgtgcattcagcattatgccactggtttggactatagggagtatctttgggccggcctttggcggttccctggcgcgcccggcagtgaagcatccggagactttcgggaattggaagcttttcaaggcctatccgtttctgttgcctaatctggcgtcggcttttctgttcgttattggaattacgacggggtggctctttttgcatgtaagtgtgattcaagctacaggaagttag

SEQ ID NO: 12573 - DNA, 864 bp, A.fumigatus
  unsure (18),(56): Identity of nucleotide sequences at the above locations are unknown.
tgtggaagtccccgcggntgggacccactttggccccccgggatagtcggttttanaacaagtcatctacgaagtgactggattgtccagtctcccaaccagacactggaaggccagacagtgcgggatacctgggatggccaaattgataccatgggaagtggtagcgactttaatgcgttccaagattttgcaggcatccccagttacgatctggggttcagccatggtcccaaggaccctgtatatcactatcactcgaactatgatagtttcgactggatggatcgattcggtgaccctggttggctgtaccacgaagcatgcactaagatttgggctctggctgcggctaaattggtggagactcctgtgcttgcctttaacgctacggactatgctgtgggccttagcacatacttggatcaaattcggccggcggcggagcagctacctggtcattcatccttcaaccttgagccacttgacaaagcaatcgcacggcttcagaaagtcgctgcgaaattcgacgccgaagccgcagagctgacctcacagctggacgagaatcttccatggtggctctggtggaagaaggtgagactgtacttcttgatccggggggtcaatgacaagtacaaggcctttgagcgcaagttcctgtaccagcctggcttggacgggagaaattggtacaagcacgtagtgtttgcgcctggtatctggactggatacgctggcgcgacatatcctggattggtggaaagtctggatgcaggagatctgaaaaatgcaaaggttagtcattttcacttttcgtactttttgcaccatcttgcttgttcgtctttgctaacgctatga

SEQ ID NO: 12574 - DNA, 297 bp, A.fumigatus
gtatctctcacacactctctctttttctcaagcctctgtcttgacaatttctgcacagactcccaaacaattggtatatactacaccttgatcggtatcattggcatgttcgttcagttcttcatcttcccagtagcggccaagcgatttggtgtcctcaactgcaccaaagccactgccatcgcctcccctgtcctctacctcatgacacccttcactgcactcgtaccggcatcgatccggagttttgttgtgttcatgctcatgctcagcaagctgatatgcagtatcttcagc

SEQ ID NO: 12575 - DNA, 2217 bp, A.fumigatus
catcttcgctcttacctttccatggatgacgggcctttacggatatctcgaatgggcaagactgccgtcatgagtttgatgcccattgtcttgcttgtgtcgctgcttatctgtactgtccacgcagcgattccatactcgccgtcccatatcttctatacctcccagtacaacgattcttttgcctacttactgcggtccagtgattcgcagccgcatgccacccaatttctttcgttggatgtctcaggaaaggtagacgcagccaacccagagtacacggttcttctagatgagctgccgttccacacaaacaaccagtcttctgccttcgttccggctattgatcaacatggtcatatcaaagtctatgtaggggactgcggtcaatcaaacgagcacgataggctctgggtttttacgccgaatgtcaacagctcgagcggcaatggaacgtgggaagtgcgtgatttggacttagggcaagggagcttaggagtcaacagctacggacccaactatctgtctgccgcattcgcctggtcgtcttctaacatgacggagagctcgctgtacaccttcggtggcatgtgtccgttcaacattaccccgaaagcaacttggatctatgccgccaactattctcagtccatgatcgtcttgagtcctccgagctctgaccgtgtctctccgtatcaaatatcagccgctgggctgcgcgcaccacctatcccggaggcaggtttcgcagtcactccattgaatcccacctacgcgctgtctcctttaggtcgaacactccagcaacagagctttctcttcattgggggccacacccaaaaagccttcatcaacatgtctgaacttgccatctattctctccctcaggacagctggagcttcgtcacagtcgagtcggggtcggatatcggcaaaactgagcttgctgtccgagattcagcattcgtggagccaagatcgggccacacggccgttctctcgccggacggaagcaaggtcatcctcttcggcggatgggtaggcagtaccagtcgacctgctcagccccaactggctatattggagatgggagaagagtttggagggactggctcatggcgttgggtaatcccatctaccccaaaaagcgttttcgcagatggaaccgggatctatggccatggtgcagcaatgcttcctggcggtgtgatgatgattgccggcggatatagcacttccacaacaacaaagcggtcggcagtaggacctcagcctaactcccaaatctttctatacaatgttacgtctggaagctggatgacctcatatagaaatccaagcctgccggaacccgaaccggaacctgtaggatcccctagtggctccgattcttcattgtcgaaaaaagcagggctgggtgcaggactcggactggggattccatcagctgcaggcttggctgtgtttgcttggttctactggcggagacgccgtgcgcggcggtctcgggatcgggaattgcgcaagctcgcgctcagtgcacaaagggcacacttctggggcagggacgagccggaaatggcgagcagcatccgcatgtccaagaccagggaccagaataagacgatctcctggactaccgctccaagtcggaacggacaggacaacggcgaaggtgctgcggagagcaccagcctgcttcgtgacatcccggcccctgacagaaatagccagcaaagtttgggaacgcgcccttaccgatattcagcaccatatagcgagtacagaagaagcgagactgcaggtgaaatacatccaatcgacgaacgggatgaggaagaagcaagttcaccagcgttcggcggccccgatactgccgcggcctctgagcctttcttaggcgctgaatttgtgactccgcgcagtacaatatccaatccagttggaattccattccgaacagttagagctgtccccgcggaagatccagcccgtgacggagttttgtccccagatcaggacgagcgcacctcgtcgaatctttcagactcttcggctagatctgggaacagtgcccctcgccgcccagcgtctcttcgtacccctacgactttgccagataatggatgcaattcaccgggacttgccacccctcgaagttccaccgtggccacaggaactgtccacagaagaagcgctactcctccggactcctaa

SEQ ID NO: 12576 - DNA, 531 bp, A.fumigatus
gatcccctagtggctccgattcttcattgtcgaaaaaagcagggctgggtgcaggactcggactggggattccatcagctgcaggcttggctgtgtttgcttggttctactggcggagacgccgtgcgcggcggtctcgggatcgggaattgcgcaagctcgcgctcagtgcacaaagggcacacttctggggcagggacgagccggaaatggcgagcagcatccgcatgtccaagaccagggaccagaataagacgatctcctggactaccgctccaagtcggaacggacaggacaacggcgaaggtgctgcggagagcaccagcctgcttcgtgacatcccggcccctgacagaaatagccagcaaagtttgggaacgcgcccttaccgatattcagcaccatatagcgagtacagaagaagcgagactgcaggtgaaatacatccaatcgacgaacgggatgaggaagaagcaagttcaccagcgttcggcggccccgatactgccgcggcctctgagcctttcttag

SEQ ID NO: 12577 - DNA, 765 bp, A.fumigatus
gacctgaacattcgacggcctcccgacattcctcctatagagctaacaactcgcttagatattgaaatgggcagactaatcactggctccaccaaccctgtcgttctatacgtctcaggaggtaacacacaggtgattgcctacagttcgcaaaggtaccggatcttcggcgaaaccctcgatatcgctgtgggcaactgcctggacagattcgcccggacattgcacatctccaatgatcccgcaccagggtacaacattgagcaactagcgaagaagggcaagcagctggtcgatttgccgtacacagtgaagggcatggactgctccttttcggggattctcgccgccattgacggattggctgcatcctacggcttgaacggcgaagagaaagaggaagaaggtgcaggagatgactccaaaccgacacgcgcggatctgtgcttctcgctccaggagactgtgttttccatgctcgtggagattaccgagcgcgccatggcgcatgtgggctcaaaggaagtcctcatagtcggcggcgtcgggtgcaatgaacgattacaagagatgatgggaatcatggctcgcgatcgcggtggtagtgtccatgcgacggatgagagattctgtattgacaatggaattatgatcgcacaggcaggtttgctcgcgtacaagactggtttccgcaccccgttgaaggagtcgacttgtacacagcggttccgaacggacgacgtgtttgtaaaatggagagattaa

SEQ ID NO: 12578 - DNA, 501 bp, A.fumigatus
atcttaggctcgttcaataataagttcttcccagtcatgattgccatcggactcgaaggctccgccaacaaacttggggtgggcattatgctccatcccgaggatggcagcaccccgcgggtccttgctaatatccgtcacacctatgtctcccctccaggtgagggatttcttcccaaggatactgcgcggcaccaccgctcttgggtagtgaagcttgtaaagagagcgctcagagaagctcgtatctcagtgcgtgatgtggactgcatctgctttaccaagggccctggcatgggtgctccgcttcagagcgtcgctgtggctgcccggatgctgagtttattatggggcaaagagttagttggtgtgaaccattgcgttggacgtatgtgtgaccataggcgctgtccgctgtccgctgcctcatgcttgagacctgaacattcgacggcctcccgacattcctcctatagagctaacaactcgcttagatattga

SEQ ID NO: 12579 - DNA, 264 bp, A.fumigatus
atacctctgatagatgcatatatgcaagagccgtatcagttcacatgcctcacgacgcatggctgcagtcaagtcactcaccatatgatgaatgatttcatttatgaccgcgctgctcacatttcatttcttggttattacaacatgaatgtcgatatgcaacatcatcaaatgccgccgcttcttccaacatttttgtaccttatctgttcctcatgggctggtgcacgcttgcgttgcggtcatcgtcaggttatcgggtga

SEQ ID NO: 12580 - DNA, 678 bp, A.fumigatus
ccgcttatcttcacattatcagtggctcggtctgatatcttcgacggcgaagagcttttctccatcccccgcggactcgttctgtcggctcagaattcgaagttgaaggatctgctctcacaggatttggaggaattaggcccatggctgtctctgattctggtgatgatgtacgaatatctcttaggagagcaatctgcttgggcaccgtacttcaaaattcttcctaagagctttgataccctgatgttctggtccccttctgaacttcgggagctgcaaggcagtgcaatcgttagcaagatagggaaagagggtgctgaagactcgatcatgcagatgattgcaccggttgtgagagccaatccttctctctttccgtcagttgacggcctagcctcctgggacggtgaagcaggctcccacgcccttctgcgcttagctcatatcatggggtcccttattatggcttatgcatttgatattgaaaaggttgaagatgaagatgacgagaataatgacgaagaagacggttatgtgaccgatgatgagcaggaccagtcgtctaaaggcatggtaccactggcagacatcctcaacgcggatgcggatcgaaatcatgtgcgttccctttctccgcacactcgtattcgaccgccggcctggaaagtaaacagt

SEQ ID NO: 12581 - DNA, 528 bp, A.fumigatus
acgtcaaggtctgatatcggtgtaggcggtccagactgcaagaatggcaagtctttgaccgagatgctgtctgctggcggaactaagtctgaagcgagctttggtgatgtctcgggagtttctaactcagcgtcttgcttgactgcgacaggtgcaggttcctctgcctcatctgccgccttgggaccttcgatcgcgggaacagggggaagagcagcttcgcctgcaggctgctcattggcaaggattcctagaagctggatctgcattaagagggaaacgatatgtggatcttcaaggggtggaggaggcatttcggcgcggagcgctttcatgtccttttcgaagatctgtttccgttcctcaaggtactcttgcgtgaatacatcgttctcatcttcatcttcatcgcttgaccggccaaagtctggtatcagcgtgtcttcctgcaaggcgggtttgtcttccggggcgaccttcttctcgggtccgacaactggttctggcgctcgtggaggagtgacgtga

SEQ ID NO: 12582 - DNA, 2193 bp, A.fumigatus
  unsure (1): Identity of nucleotide sequences at the above locations are unknown.
nacatggaccccacccctgtcgcgtccatgggccctgtccctgcagcctcggatcgattaccagaccatgcgatcgttgaactgccccgtaaacctgccatggccgaagctcgtcgagactcaatacggcctgatttggctgcatcgcgcccagacccggttaaagacctaccatcaccactaccgatcaagcggtctccccctccggccgcccctcaggtgccggcctttgggtcagtcaccgcgcccatccccgatctgtctgcggataaagggcccatcgatacaattccggcagaggttgctccgtcagttgcagagaaggaacgcaatgaaacatcgtcgcgtgcgcccgtgcaacctcctacgggtccgaaggcagagcgtgcgtccgcccagccaccaccagaaccaagatatcgacgagaggaggtacgccgcgatgatggcccggaaacgagcgaaaaggaccattctatatcacgagcacccagagctcacgttagcccttctctccacgcgcggaagcagactccagaactctccccgccgactgcacctgcggccatgattggcaaggaatcaagcataccgcatgcagaagcgtcattgaccggcaggacaggtagtatagtcggctctcccgaactgagcaaggctcgcaccccttcgattggtgcgacgtcacccggtttgcacattcctacaggacctcgcgccctgcagcaacgctcgacgccgactcgaggaccttcgaaggttaaagcgcagtgggctcgacctggttataatcgtcacccagccggagccggcaccgtaccagtaccgaaacgggattccatcgacgggaaagaaggaactatgtccatcagcgaggactccagacgggaaccaccagctccagcagatgaccatggcaacgaactggaggcgggtgagattttgcccgacaaggggatggaagtcgacgcgcatatgtcccctgaatcctccaaggctgacgcagtttgtcacgtcactcctccacgagcgccagaaccagttgtcggacccgagaagaaggtcgccccggaagacaaacccgccttgcaggaagacacgctgataccagactttggccggtcaagcgatgaagatgaagatgagaacgatgtattcacgcaagagtaccttgaggaacggaaacagatcttcgaaaaggacatgaaagcgctccgcgccgaaatgcctcctccaccccttgaagatccacatatcgtttccctcttaatgcagatccagcttctaggaatccttgccaatgagcagcctgcaggcgaagctgctcttccccctgttcccgcgatcgaaggtcccaaggcggcagatgaggcagaggaacctgcacctgtcgcagtcaagcaagacgctgagttagaaactcccgagacatcaccaaagctcgcttcagacttagttccgccagcagacagcatctcggtcaaagacttgccattcttgcagtctggaccgcctacaccgatatcagaccttgacgtttaccaggaaaatgcggcgatacacgctcgtatgaaggatgtgttcagtcaagaattgatgaaacggaggaaggagattgcgcggaagaacgcggagctccgcgaggagtacttgtcatactacaagcgttggaggatgcaagtgtgggaactggatcgcgcaaaggccagagcttccgccacgccaggtgctggaacatctccggctccttctgcaccaacgcctccggtcgccgagggaagacgatacaaaggtaacagcgagctcgactttcagaacgcgctccgtgcgtccgaaatatctgcgcaggaagaactggagcgccgtcggggaaataaggctacagctcagccagacctcgcccgggaagccgtcatccccgacatgctcgagccaggggaggcaaaagcgcagatctacaaggataccaacaactctgtcgaccctgcgaacgccatggatgtcttcggcttcctacctcctcccaacgacttcacgcccgaggaacacgagatattcactgatgccttcatggctcacccaaagaagtggggcaagattgccgagtcgctccctgggcgggacttccagcagtgtatcagtccttattacctcagttttcacacgcgccaggtggccaggaaccagggtgaa

SEQ ID NO: 12583 - DNA, 1215 bp, A.fumigatus
gaagacgaagtcctgcatgcccaggtcgccctcgagaagaaggggagcgtccagccgcttgtgctcaaggcacacctgaacctgtccactagctccatgtcacttgcctggttcaacgcgagcgctgagacgggcgagtgcgccgctgaatcctttgctacatgcgtggttcgattcgaggatccagccgcgtggaccagggaatgggaccggctgtcgcacctggtcctcggccgcattgaggcgctagaacaacgggccgtcgaaggcaaggcgagcaagctctccaagccgctggcgtatacgctcttcaagaacgtcgtcgactacgcggatcggtatcggggaatggatcaggtggtgttgtacgagcacgaagccgttgcggaggtgaccctcgtcgcggaacggcatggcacctggcacacaccaccacactggattgacagcgtctcgcacctggccggcctcgttatgaacggcagcaatgcatccaataccagggattacttctacgtcacgccgggctgctccagcttccgtctgctgaacccgctgaaggctggcggcaaatatcgcagctacgtgcgcatgttcccactgccggaggaagcgaacatgtacgcaggtgacgtgtacattctggagggggagcaaattgtgggcatggttggccatattcgattccgtcgtgtgccgcgacttctcatggacagattcttctcgcccgctgcggcttcccatacggaaaagcagctgcaggagactgctccgagtgctaccaacgtaaagaagagcacccctccgcctgctgaggcccctatctcagttccagtggccccgggcaacccagtcgcaatcccactccccactgccagcaagagccaagtcgccacgcccccgctcacccctccctcccaggaagagtcccccggcgaatccgccgtcataacgccggccacatcggaccggggcgattcgacagacgcaggcgtggtgggccagtgcctgaaggtgatggctcgtgagacggggctagaagttgacgcgttgacgccagacgcaagcttcgtgcagctaggtatcgactcgctcatgtcgctcgtgttgtccgagaagttccgtgccgaactagggattgagattaaaagctcgctgttcctggagtgtccgactatcggggaaatgacggcttggttggaagagtattgttaa

SEQ ID NO: 12584 - DNA, 231 bp, A.fumigatus
actactatggcttcccgtctcccaatccttattatcggagccggcatctcaggcctcacaaccgcccgcctgctaacaaacagcggcatcccgaacatcgtcttcgaagcatccagcccagatcgtagacaaggcttcgccatcagcctgcgcgaatggggctacacgatactgctgtctgctctcggggacccgccggtcttcaccacggaggtgccgcatccgcgctag

SEQ ID NO: 12585 - DNA, 486 bp, A.fumigatus
tcgccagctgcgatgaacttcaacggcggccagatgcctcctgatatggctggtggccagttcttcatgaaaggcatgccggatgccatgggcggtccgaacggtatgcgtccgccgagctctaatccggctttcagcggaccccaaatgggccaacccattccggctggagcagtcaaccgggttccgagtggcaattggcagcagcaacagggccagcccatgggaccacaacaatctccggcccagcaacctcaatctactgggacgcctcagactcagaactcaatgcctcctccgcaggctccgccagctggtgccaatgctgcacggacatctcctcaatcccagaatgctgctcctccgacgcctcagcaggcgaataaaccggctccgaagaaaaaagagcccaaggacactgcgcggaaggtatgtttttacatcccaatctttcgcaaacctactgtgtttgttttaccttattga

SEQ ID NO: 12586 - DNA, 195 bp, A.fumigatus
tcggccccgtacaatcctgacagcctatcttttgttcaattcaacagcggtatgaattatgcttgcgaagatatgatggaggtagatgcttcatttctacccttcaatctctaccgttggcctaagaatctcaacttcgtcctcgatgcacgctcctctactcatacatttgagaacactccaagatggagatag

SEQ ID NO: 12587 - DNA, 1392 bp, A.fumigatus
ggcggacggttcgatcttggggcccagtccatcttttccactctttctctcccactcgtctgctacctcactctcaccttcaacatggggtcctcagccgacatttccgactactctgataccggcaaagccgtgggagctggcaatgacaagggcgagaaattctttgctcctccccagtacgatggagacatgattggggagatgagcgaggccgagagacacatctatgagcacggtataaagaaattcagccgtctcggatggaagcgtctgaccgttgtgctcatcgtggaggccattgcgcttggtagtctgtcgatcccctcctccttcgcgaccctgggtatggtggctggtgtcatctgctgtgttggtctgggatttgtcgccatctataccagttacgtcgtcggtcaggtcaagctcaagttccctcaagtctcccactatcccgatgcaggacggctcatgttcggccgcttcggctatgaactgatcaatgtcatgctcattctccaactcaccttcctgaccggctcgcactgtctgaccggcacgattgcgttcaccaacatcaccgagagttccatctgctccgtcgtgtttggcgttgtgtctgccatcatcctgctgctggtcgccgtccctccgagtttcgccgaaatggcgattctgggctacgtcgacttcgcgtcgattattgccgccatcggtatcaccatcattggcactggcatcaaaagcggcaatgcaccggggggtctgtccggagtggagtggtccgcctggcccaaggaaggcatcaccttcaccgatgctttcatcgccatcaccaacatcgtcttcgcctacagtttcgccatgtgccagttctcgttcatggacgagatgcacacccccaaggactttgtcaagtcgatctgggcgctgggtctggtggaaatcttcatctacacgctcactggtgcgctgatctatgcttttgttggcatggacgtgcagagcccggcgctgctgtctgccgggcacactctcagccgggtggctttcggtatcgccctgcctgtcatcttcatcagcggctccatcaacaccgtcgtctgcggccgtctgatccacggacgcatcttccggaactcccacatccgcttcatcaacacccccgctggctgggccacctggctcggtctgatcaccaccatcaccgtcgtcgcattcatcatcgctgaggtgattccggttcttctccgacctgctctccatctcctcgggccctctttcatcttcaggcttcccccttccaactttcccttgcgcccgaaggtggtttccttccttcatcccgccaaaggggttagttgggaattgaagcccaaaaaaacttgggcc

SEQ ID NO: 12588 - DNA, 1299 bp, A.fumigatus
ggcccaagtttttttgggcttcaattcccaactaacccctttggcgggatgaaggaaggaaaccaccttcgggcgcaagggaaagttggaagggggaagcctgaagatgaaagagggcccgaggagatggagagcaggtcggagaagaaccggaatcacctcagcgatgatgaatgcgacgacggtgatggtggtgatcagaccgagccaggtggcccagccagcgggggtgttgatgaagcggatgtgggagttccggaagatgcgtccgtggatcagacggccgcagacgacggtgttgatggagccgctgatgaagatgacaggcagggcgataccgaaagccacccggctgagagtgtgcccggcagacagcagcgccgggctctgcacgtccatgccaacaaaagcatagatcagcgcaccagtgagcgtgtagatgaagatttccaccagacccagcgcccagatcgacttgacaaagtccttgggggtgtgcatctcgtccatgaacgagaactggcacatggcgaaactgtaggcgaagacgatgttggtgatggcgatgaaagcatcggtgaaggtgatgccttccttgggccaggcggaccactccactccggacagaccccccggtgcattgccgcttttgatgccagtgccaatgatggtgataccgatggcggcaataatcgacgcgaagtcgacgtagcccagaatcgccatttcggcgaaactcggagggacggcgaccagcagcaggatgatggcagacacaacgccaaacacgacggagcagatggaactctcggtgatgttggtgaacgcaatcgtgccggtcagacagtgcgagccggtcaggaaggtgagttggagaatgagcatgacattgatcagttcatagccgaagcggccgaacatgagccgtcctgcatcgggatagtgggagacttgagggaacttgagcttgacctgaccgacgacgtaactggtatagatggcgacaaatcccagaccaacacagcagatgacaccagccaccatacccagggtcgcgaaggaggaggggatcgacagactaccaagcgcaatggcctccacgatgagcacaacggtcagacgcttccatccgagacggctgaatttctttataccgtgctcatagatgtgtctctcggcctcgctcatctccccaatcatgtctccatcgtactggggaggagcaaagaatttctcgcccttgtcattgccagctcccacggctttgccggtatcagagtagtcggaaatgtcggctga

SEQ ID NO: 12589 - DNA, 1800 bp, A.fumigatus
gacatcccgaggccggcctggacctctgctacgtcacagacaaccgtgagagctctgtccattcctagtagtgatgtctcgaattattcttcttattatctaatgggctcctctgacacttattccttgcgcatagtcattgcaacctcagggccgtcctctaactatccgcaacgtgcatatcggaaccctctcgatgcgttggtgaacttcctcgacaccaagcatggcaagaactggtggatttgggaatttcgagcggagggcactggatatcctgactcggaggtctatggacgaatccaccactatccatggccggatcatcatccaccgccgtttgcgctcatcccagcgatcatgggaagcatgaggaattggctgcatagactcgatggtccagatggggagggggcgtcgcatcctgtcgaagagaataaggtggccgttgttcactgcaaagccggtaagggacgcagtgggaccatatcgtgcagctatctgattagccacgatggatggaatatggaagatgcccttgagcggtttaccgcgaggcggatgagagttggcttcgggcctggtgtgagtattcccagccaactgcgctgggtcggatacgtcgaccggtgggcgaagcagatgggcaagaagtacattgagcggccggttgaggtcctcgagctgcatgtttggggtttgagagatggcgtcaaagttgccattcagggatatgtcgacgagggcaagaagatcaagtgcttccacttgttccatcgcggagaacggacggtcgttgacgatggcaagaccatatttccagcgaagaatacccaagatggcgaggagagtagtggtagcagcaaaacggatacaaccaccgacgcagctctacccgctttccagtcttcttcaaggccaagcaacattgcctccacttcctcccccaagcccactgtcaccgcgcctctagcatcaggagctgatggcctcagtgctgctccccaaagacgcatctcggccgtcatactccgccccagcacaccagtcatcgtcccgtcctccgacgtgaacatcgacttcgaacggcgcagcaaagccgcctacaccggctgggccatggtgacctccatcgcacacgtctggttcaacgcctacttcgaaggcggcgacaggcacgactcgggcgtctttgaggcagactgggagtccatggacgggatcaaggggacctccaaacggggcgtcaaagctctcgaccgcctcaaggtcgtctggcggtacgcgccaccttcccacttcggcatccgcgagcccgggaaggaggacaccgccgtcgtggcgcatgccatcacggagcccaaaccaggcgagccgatccgcgaaagccacccagccgactggcgcggccaggaaacaggagccgccaatgagcacgagcgcgagcaggagagcatttcctcgcgcattgcggaggtcgacacaggcaccaagggtcttacgagcgcgacggagcatccgttactcacgagcgtcagtacgacggctgctaaggctgtatcggcgactgcgcactcgatccacgggcttagcaaggagctggggctgcggaagcagacagatgagagtaaggacgtcagtctcgcggagagcgaggcggagtcagtacaaacgaagacgggtacggacaaggaacatgagaacggggatttcgaaggcgtccggccatattttggggacagtggtaacgattccgagcatcattcgggcgatgctgaatctacgaggagtctaccgtag

SEQ ID NO: 12590 - DNA, 678 bp, A.fumigatus
cctccatcgcacacgtctggttcaacgcctacttcgaaggcggcgacaggcacgactcgggcgtctttgaggcagactgggagtccatggacgggatcaaggggacctccaaacggggcgtcaaagctctcgaccgcctcaaggtcgtctggcggtacgcgccaccttcccacttcggcatccgcgagcccgggaaggaggacaccgccgtcgtggcgcatgccatcacggagcccaaaccaggcgagccgatccgcgaaagccacccagccgactggcgcggccaggaaacaggagccgccaatgagcacgagcgcgagcaggagagcatttcctcgcgcattgcggaggtcgacacaggcaccaagggtcttacgagcgcgacggagcatccgttactcacgagcgtcagtacgacggctgctaaggctgtatcggcgactgcgcactcgatccacgggcttagcaaggagctggggctgcggaagcagacagatgagagtaaggacgtcagtctcgcggagagcgaggcggagtcagtacaaacgaagacgggtacggacaaggaacatgagaacggggatttcgaaggcgtccggccatattttggggacagtggtaacgattccgagcatcattcgggcgatgctgaatctacgaggagtctaccgtagataa

SEQ ID NO: 12591 - DNA, 321 bp, A.fumigatus
atcaaagcgacaagcgtcggagctctcgtcgtaatggacgcaacaaaagcaagagcgtcgtcttatgtcttgcgaggccgcgagaacaatgaggaggcaccggtgtactatgctttttccgagaaagagaagatcagatctgtcgcagttgcgtcgatggttacattcctgagccccgtctccggcagcatatactatccagcattacagtccttgtcccaagaccttggtgtgtccataaacactatctatctgaccataacagtgtatatggtacgctttccctatgattatcgtgagaacgcaacggagaaggtctaa

SEQ ID NO: 12592 - DNA, 1167 bp, A.fumigatus
ccactactatttgtattcgatggaagacagatatttcaggggtttactcctctcctaacgggtactttatcggatcagaatggccgccgtccggtgtttgtcgcctgccttattgtgtacattggtgtgaatattggactgtgtgtacaagacagcgtgctgatactctttgtccttcgatgtctgcaaagtgttggtagtaatggtgtctcagtcgtggccactgccaccatcgcagacctaatcacgcgtgcagagcgaagaaaatacatggcttacggatcgcttgggtttaccttcggccccgccgtgggccctgtgctaggcagtgtcctcacgcagttcctgggatggcgtagtatcttcgccttcctcgcaattgtggcagccacgctcctcaccctaatacttgcctttctgcccgagacctgccgcgccatggtgggcaatggcagtgttcctgcgccctggtggaacagatcttgtcttcagtggctgcgactttcgtttcagtctggcacaatcgcagaggatcgaggaacgctagtctccccttgtcaccggccgtccctctgggatagcatccggatcacacgacagagatcgacggggctgttgatcctggccagtacaactctctccagtggctcaactgctatcttggctaacattcctgcgctgttcgaagatcactaccgcttcaatgcacttcaggttgggctctgctatctccctgatgcaattggtgctctgtcagcgccgtggaccgtgggcaccctggcggatcgcaactttcggcgatgctgtcgcttggcaggcatcacagtcgcccgaaaccagcagactccccagcagctgctatcaatgccactggagaaggcgcgcttgcagctgatgctgccgctggtctacgtatctgcgggtgtcctgaccatttatagttgggtgatgcaaatgagagtacacgttgcgggccccttgattccgctgttctttttaggaaatgtcatctccggtgctcgtaatagcctggctatgttgatcatcgatatacacgcccagcggccggcgactgctagtgcatcccttgctttcttccggttcgctggcgggtgctggcgtggcggcggcgatggtgccctccatcaaggccatcgccaccacgga

SEQ ID NO: 12593 - DNA, 306 bp, A.fumigatus
attggacattcatttcgtggttttcaattattctgtttgagacctgctgttgttgttctataccagcgcctgagtactgtaatttttaacatgtctggttgcaacctgccctcgtccagccgtgcaatctcctcaacaaagacagccaagctgacagagtctcaaattaaaagacttagtgcctggatcgagaacgatatttggatcctgtttctccaacgcgtcgtcgagaactggatcggttccatgatcgtgcatactcggaccgcttccgtcgcgacacgcgcggtgctgtccctcggctag

SEQ ID NO: 12594 - DNA, 288 bp, A.fumigatus
aaggactgcatgtccttaccatcggacatccgcaacggcttggaaccttcgaagcccaacaaattgcactgcgctgatactgattaccgatcacttcaattcagcgtcttctatttctctggcacttatcaaattattgaaactgtgactatgaagctgatctgttcaagtatactatacgaccaaagccatgcggcttccagtgacctggtcattagaagagtgagacgcgaccagaaggcactatctcgtcagcagggctcaactcgcatcgcactttctcattga

SEQ ID NO: 12595 - DNA, 207 bp, A.fumigatus
aatggcaagtattcgtgctatttctcaaatcaatattttctcttcgagggcaaatacgcaattgccaaagatgtgattttcttcgacattgctagtgttacaagtccccccatcagcgtccgttctgagaatggaccgaagctaatgccaaagacaatgtacttgtggacaagaatacaaagtaaccctatactctgtagatattga

SEQ ID NO: 12596 - DNA, 2256 bp, A.fumigatus
tacaagtctacagatgccatttccagcgatgcagaaacagttgagttgttccagcagctgaggcaactgtcccgcgaactcgtaaccctccttcgactgtcgtctctactaccttcgactggcacacgcctgtcgccgcttgtcgctcgtaaattcgaagtctacattgctaagacagatttatcgcaggctggcaatctggccgacttcatggcagatgtaactgaccctacgttcgaggagaaacttcgtgtgttggcttctcttgctctgaggactatgttggaaagagtcgtcaagctattggcccgacaggtccgaggaatcaagaataacgtcaaagttactacgatctccacctcgtcattcccatccaattctccgtttgatatcagtcagattgatcctcgagatcgtgagttgttggcgaagagagccatggccggcttgacgggcttgaccccccctggagccgcaggcggacggaacaatgaggacgaaaaggagacaatcgaagtcgatgagctgcaaaagagactccaggaggcagagctcagccccgaggctcggaaggttgctgacaaggaattgagacgtcttcggaagatgaacccggcgaacgccgaatatggtgtctgccgaacatatctcgaaaacatcgcggatattccctggaccaaagtcacggaggacaaactagggcccgagacgctgaagagagcaaggaaccagttggatgaggaccattacggccttgagacgattaagaagagactgcttgaatacttggctgtcttgcgactaaagcagtcaaccaaccaagatgttgagcggcaaattgctgcactcaccaaggaacttgatgctgccaatgaagtgcttgccgagaaggacgtgcctgctttgtccgaatcagacagagtctcccttgaagcaaaattgaatctgcttcagtcaagacgtctggctgataagtctccgatcctgctgctcgttggcccacctggtactggcaagacgagtttggcaagatccgtggccacgtctctcggacgcaagttcaacaggatttctcttggtggcgtcagggacgaggctgaaattcgaggccaccggagaacctacgtcgctgctatgccaggcctaattgtgaacggtctcaaaaaggttggggttgccaatcctgtgtttcttcttgatgagatcgataaagtgggcggggccaatttccaaggagatccatccgctgcaatgttggaagtcctggatcctgaacagaactccacattcgtcgatcattacattaacatcccaatcgacctgagcaaggttctcttcatagccactgccaattcccttgataccatacccgcgccgttactcgatcgcatggagacaattactctatccggttacacgactgttgagaagcgacatatcgccaagagacacttgattccaaagcagatcagagccaatggtttgtctgagggccaagtcgttctttctgacgaggtcgttgacaaagtcattacgtcttacacgagagagtcgggtgtgcgaaaccttgagcgcgagttgggctcaatttgtcgacacaaggctgttcaatatgcagatgcggttgataatggcaggttagatacgtacaaccctgtagttgcccttggcgacttggaagacattctcggaattgagcgttttgacgaagagattgccgagaagcatggtcggccaggcgtcgtaaccggtcttgtcgcgtactcgactgggggccagggtagtatcttgttcattgaggttgcggacatgccaggcaacggccgcgttcagcttacaggcaagcttggcgatgttctgaaggaaagcgtggaagtcgccttgacctgggtcaaagctcattctttcgagctcggtcttacacatgaccccaacgaggacatcatgaagaaccgaagtttgcatgtccactgcccagcaggagctatccccaaggacggtccctctgctggacttgctcacacaatcgggttgatctcccttttcacaggcaaagctgttcctccccagattgcaatgaccggtgaagtctccctgcggggacgggttatgcctgttggaggtatcaaagagaaattgattggagcacaccgcgccggtgtcaagactgtcctccttcctgagcagaaccggaaggatgtcaaggatgtaccgcaagaggtccacgatggcttgcagattgtctatgtcaggtaa

SEQ ID NO: 12597 - DNA, 384 bp, A.fumigatus
ctcctcgctttgggacttctgtttcactgtgctgataatataccgcaatgtagacctgacttcacaatcgcccttatacgcacacccttccttcccccccgatatgccacattctacgtgcccttgaatttcaacaagctcgatatgcgcgactacctgcagcgcttatatggcgtcggtgtcctccgcatccgcagttacgtcgagcaacagaaagtgacccgcctgcgacccctgggcaagttcggatacggccgtctgaggagaccgatgtcgaagaagaagatgacagtggaaatgaaagagccctttgtttggcccgaggcgccgacggatatgtcaccgtatgtctactgtttttggcattttccccctaagagttag

SEQ ID NO: 12598 - DNA, 306 bp, A.fumigatus
ccggtccttactcaaagaaacaaagggttcggcttcgacaagttcataagtggccttctttttcctttctgcttcattcgttctggggatggaaaagcgggatcttgctcttttctatgtggcatttttctttccctcatccctttctctttttacatgttcattaactttgtaccatatgtcgaaatttcatctggctataaacacaatattcaggagcctagttttaccggaaagactccaatttgggatatgaagttaaagatgggcggaataagaagtaaaaccaaggcggccattaactag

SEQ ID NO: 12599 - DNA, 240 bp, A.fumigatus
aacagatgggagaaggatcagtacttcaacgcggagaagtaccaggaagaaattcagcgctcgcaacgacccgacgctgccatggagcccaataaggccgagcgcgaagaatacgcaaaggaggcgaagcagctgctggaaggcacgaagacttggagaccgacttggcaggcattgggactcaattatgaccggtccttactcaaagaaacaaagggttcggcttcgacaagttcataa

SEQ ID NO: 12600 - DNA, 693 bp, A.fumigatus
cttcccaaatatgtctatggtgtaatatgcgtcaataatcaattatcctgtttcaatgtgaggatcaatcatgtcttacctgacatagacaatctgcaagccatcgtggacctcttgcggtacatccttgacatccttccggttctgctcaggaaggaggacagtcttgacaccggcgcggtgtgctccaatcaatttctctttgatacctccaacaggcataacccgtccccgcagggagacttcaccggtcattgcaatctggggaggaacagctttgcctgtgaaaagggagatcaacccgattgtgtgagcaagtccagcagagggaccgtccttggggatagctcctgctgggcagtggacatgcaaacttcggttcttcatgatgtcctcgttggggtcatgtgtaagaccgagctcgaaagaatgagctttgacccaggtcaaggcgacttccacgctttccttcagaacatcgccaagcttgcctgtaagctgaacgcggccgttgcctggcatgtccgcaacctcaatgaacaagatactaccctggcccccagtcgagtacgcgacaagaccggttacgacgcctggccgaccatgcttctcggcaatctcttcgtcaaaacgctcaattccgagaatgtcttccaagtcgccaagggcaactacagggttgtacgtatctaa

SEQ ID NO: 12601 - DNA, 234 bp, A.fumigatus
cggcgcgggtatggtatcaagggaattggcagtggctatgaagagaaccttgctcaggtcgattgggatgttaatgtaatgatcgacgaatgtggagttctgttcaggatccaggacttccaacattgcagcggatggatctccttggaaattggccccgcccactttatcgatctcatcaagaagaaacacaggattggcaaccccaacctttttgagaccgttcacaattag

SEQ ID NO: 12602 - DNA, 960 bp, A.fumigatus
  unsure (960): Identity of nucleotide sequences at the above locations are unknown.
gataattctagggccggatccgcagacgagaagaagcacttgactattctacacatcccattgtttgagtactggctatacatactccgtatggcgcatccattggtcttcatcaccggtgcaaccggtttccttggtagtgccaccgcggtggccgcactcaaagcgggatatcgattgcgaatctgtgttcgaaagccctcagacgaattacagaatctgctgtcaggatatagcgagcaagtggaatttgttactgttgccgattggacagccgaaggggcattcagaggactgttggatggagcagactatgtcatccatctcgcccatcctattcccagtggccctgagaaggagtactacttcactccagctgtgaaagcaacgacggccttgctcagggaggctgctcgagtaccgagtatcaagaaggtggtggtcacctcgtcgatcgcggccttgatgcccctggacggcataccgtctgggggcgtcatcaaaggtgcgttttcagggctcctgggccgagcatatcgtacctggactgacatcatcccagaggacaacgactgggacttcgacgttgacgagactgaagactttgcagcctctaacgacccgcgaggggtacctatgcggttgtaccatgcatccaaactgctcgccaatcaaacggcatgggaattccggaaggccgccaagccgccgtatgccctggtaacgctccatcctgcatttgtgtacggacgcaacccggtgcagaccactgctgaggcgatccaggaatcgtcaaatggtctcctgtggcatgctatcatgaccggcgtccctcatcactcctactcccgggttcctggtgtgcatatcgatgatgtggttgaagcacacctcagggccctggatccagccatccccgacgggtcgaagtatctgcttgcagcgaagggcgggacctgn

SEQ ID NO: 12603 - DNA, 1143 bp, A.fumigatus
  unsure (192): Identity of nucleotide sequences at the above locations are unknown.
agccagcgtttgggttaccgccaatttcaaggatctaaattcggtcattcgggtccaaggggcacggagatgaccaagtggatccgaaacgatttgcagagcaggatagccccggacgattacaccatccaagggggaacctgggcccagttgttcctcgctggacatcattggcttggcaggcaagggccngggatttcggctccctgcaggacccggaaaacagtttcagccgatcctaacgaaatgatcatcgccaccccgggtctgggaaccaagattcttttcatccttggaatgctccttgggaatacgacgtggctggcaaagctccccaccaagcagaatcggctcattgacacgggctgccgcaatatccgcgatgccacgcggcgcatgattcgcgagcagaaggcaaagatggaggatccgaacgcagcggccgaagtcgacatcatctccgtcgcaatgcggagcggcaactttgacgatgacaacctcgtcgaccagttgatgaccttcctcggcgccggccacgagacgaccgcgggggcgctccaatgggcgatatatgcgctttgcaagcaccccgatgtccagagccgtctgcgtgaggaagtccgcgccaacctgccaccgatccatggcgagaatcccggcccgatcgacgctgcaaccatcgacagcctcccgtatctcaatgccgtctgcaatgaagtcatccgcttccatccgtctgtgcccaatacagtccgggtggccttgaacgacaccaccctgatggggcatccgatccccaagggcacgcaggtcgtcatttcgccggaacttgtgaaccacatgccggcgctttggggccccgacgcagaacggttcaaccccgatcgatggatgggccccgggaaggccaacaccggcggcgcagccagcaactacgctttcctgagcttccttcacggtccccgcagttgcattgggcaggtcttcgccaaggccgaactagcgtgtctcctcgctgcggtggtcggtagctttgcgttcgaattgaaatcccccgacgctccactggaggtgcgagagggagcgactattgcaccgaaggacggcgtcctggccaaattcactccagtggaagggtggtga

SEQ ID NO: 12604 - DNA, 237 bp, A.fumigatus
agacgccggagaaagaaagttccgagattcacgatggggtatgacaacatgttcattactatcaccatgctaacactattccatccaatccactgcatccccaatgggtcatttttttatcactcagcagatacaattaccatgactagcgcgctctccgcaccacacggtgaccagatcctgaagttctttggtttggaatcagcagcttgggtgaattcgtgcaatgggaagtag

SEQ ID NO: 12605 - DNA, 333 bp, A.fumigatus
tcaagacgtcaacttgtagatgcctttgttaccctccccgattatgaaaaggccgtgctagaggataaggctgccaaagatttcaaacccccgggcaagttggtgcacggctatgtttctcggaatagaaactttgagatctgggccggctcgctggctgaccctgaagttcgacggttgctcgatcgcgctcaaatcttcgtgtcgctcttcatcgaggcaggcacccctcttgccacgaatgatcccgagtggacgctgcagagatggactgtctactttgtgtatgtggatctgctgttccatgacgtgatgacccatcacagccgctaa

SEQ ID NO: 12606 - DNA, 978 bp, A.fumigatus
gtcccctacagatatgagatagtgaaacctccaactcccactgcttccaaatactccatcgtcggatatgcgacaacatatcgctggtggcattattgcagggacaggacacaggtccccgttgtcaagaacgatccatttccctctggaccggaaattcatccttcacagctcccatcgcgattgcgtatcgcccaattccttatcctccctcctcatcagaactcaggacatggcagacacttgtataccgccatccattcggcgtgtgtacaagaccccagtgttgttgaattgaccgtcgaagatccgaacgaagcttttgatgttctccgggactctgcggactaccatatactgcgccctgaattcatcaagcatgaggtgaacatcaaccccgacccgtacgaagcgcactcaagaaaccaacgaccacggcgtgttcctacggctgccctcattccagtcaaactcctccatgacattcgtacctcatacaagattgattctacacagtttgctcacattctcgaaatgttcctgttgagtcaaatccctctcaagaatagacatgctggcggagcaaacatgtcgcggctcctgattaagaagcacagggcggaggatcccaacgagcggcgctactattggtggcgcatgctcaccaagcaacgcctgtacaaacgatccaaggacatcctgatccagctggatctcgatgagcgcatccagaaactcgaagagaccgtgtcaaatgtcgaagaaggctacgaagttcttctgaaagaattcagtgagcgtgaagagaaactcaaggccagaggagtggttgagtcgccagctgccacagtctcagatgatgcgagtgctgggcccagcggtactagcagagatcaacgggtcaagcgaaagttcacagtagaggacgatgaggacaaggtcgaagaggaagatactgccaagcgaacaaaagtgtag

SEQ ID NO: 12607 - DNA, 240 bp, A.fumigatus
  unsure (218): Identity of nucleotide sequences at the above locations are unknown.
ttaccattaggtcttctgacggccgcgcaaggccaccccatgcttgtggagctcaagaatggcgagacactgaatggacatcttgccaattgcgataactggatgaacctaatactcaaggaagttgttcagactagccctgaaagcgaccgcttcttcagattaaccgaggtctacgtgcgaagaaacaatgtgcgttacctacatcctacacccgnccgtgctctcgttccaagccta

SEQ ID NO: 12608 - DNA, 240 bp, A.fumigatus
aatgcatttatcccagggacgtgcgatgcgaacgacgccgtcaatattaccttagtccaaccagacgaacagaagctgaagaccgtctctagctttcatcctcaatttacataccccatcttcggcgatgatgagcgcatcttcggttacaagggcttgattatccgtctgcggttcgcggcgcatgaccttccgccttcagcttcacatctcgtacgacgagaaattcaagcctgttga

SEQ ID NO: 12609 - DNA, 1617 bp, A.fumigatus
  unsure (107): Identity of nucleotide sequences at the above locations are unknown.
ggagaaataaggatgaggaggatattgagaaaatccgccggcatgctcgacgattgggacgtcaagaggaatacgaagaatttggcgacggcgacagcgaagttganagaagtcccacctcaagagatcgggcttcatgtgttggatcgagcatcgctcttgtcaatctttgagagtctgagttgcgaggccatgcttcgcaatgacactcttctgcaggagcacttcgacgagccattccggcttattcaaacaaaacgtagtcttaaagtctcggattacgtccctgctgtcacccgatttttatttgactccaaccagagccgaagcttctgggctattcactcctggatgcgctactcacggccgccgaccgcgcttgagttcgactgggcgatcaaagaggggcttctcgacatgttgaaaacagcctcacagcaaccgcctcagatagctgttatccagcgactttggcgtggcatgcaacttgtagtgaagagattggataaggaccaaattacgcatcacctacgggcgcttgaaatagacccgtgccgcctttctgtggaacatcttggaattcaatctccaggtctgcgtttccttctcaacacgattcagatcttcctcgaaaaagccccgggggacttctgggatgctatgcaaacgatttcccctcaagcaatcatcgagctcgttttctataaccctcagctagaggccttcttgatgcaaatcagcgagggggagccttacgagaagtccgctttgaaggatatgctctcttgggttgaacctttcatgtcgtccttgaagggcgcgcaccaaccttcagcctgcagatctcttgtctatcagctccttgatcgactccaaaacccgcgcttcccggacttggctcggtatcattgtttttatgttggactggctagtttacttcaaacacttcgcagcttcactgacaatgaatcttcacgaggctcggtggcgcgcatcgtgttgtctgagaccatgggagttgtgagcgcaaatatcgagacaattttgaaccctcccaagttcgcagtggagcagagacgccaagaggagatatcctctttatgcatggacgttatccgtaatacattggcccttgagtgccaatccttgaagagcgattacgaagttattttacggcagaatcttcttcagcatggcgtaagcacctactcagcttctatctgggaagctgttgtcaggaatcttcacgaggataatcgtgcgctttcgacctcggcgctgcttggtatattgcccctggttggcttggaaacatttccgacgaaaggcgagtcaagtccggagaagacacatttcaacctgatttatggtcatctgactcgactctcatgccaaattattgagcgccttgctgatttcaagcccgagcatctcaacgaactgttcaagagccaagataccagtagtgcattgatctctgctctgttcgcagcggatcttgacacctatcaagctgctgtcgacctcatcaagaacatgagcggtcagtcagctaggaagggatgcgatctctcatcttctacagtcctttttcataacgacgatgtacggacttag

SEQ ID NO: 12610 - DNA, 210 bp, A.fumigatus
agggcgcgcaccaaccttcagcctgcagatctcttgtctatcagctccttgatcgactccaaaacccgcgcttcccggacttggctcggtatcattgtttttatgttggactggctagtttacttcaaacacttcgcagcttcactgacaatgaatcttcacgaggctcggtggcgcgcatcgtgttgtctgagaccatgggagttgtga

SEQ ID NO: 12611 - DNA, 813 bp, A.fumigatus
aatcaacgtatgcctggttggcagttagcatcgaacacgtcccatccgatccggtggaaacaaaaagggcagcaaaaccccggctccaagctgctcgcacatcgcccgcttctcatccccaccatcaatcgcaataacccgcaaacccatggcccgcgcgtactgctgcgccagggatcccagcccaccacccgcaccgacaatcgccaccgtctgcccaggccgagcgccggactccttcagccccttgtacacggtaatcccggcgcacagcaccggcgccaccgcatccaggggcacgtgcttgggaatcttcgacgcatgcgtcgccttgccaatcgtgtactgctggaaggtgccatcgacggtatacccggacagcaaggcattctggcaaagcggttcatcggcctgcttgcagaactcgcaggcgagacaggacccgttcagccacttgatgcctgcgtggtcgccgatctcgaattccgtgacgaggtcgcccttggctacgacgacgccggcgccctcgtggccaccgacgaggggcatcttgacagggagaggccagtcgcctttcatggcgtggaggtcggtgtggcagacgcccgagtaacggatcttgaccaggatctcatcgggtccgggctttgggacagggatttgcttgaggaccagagggccgccgacctgttcggccacctgggcccattgcatggaggggatgtcgaacttagtcatggttgttatcggtggggcgaactggtgaaagagatttgtctgatggtgtataagccaagcgatgtgattgactga

SEQ ID NO: 12612 - DNA, 192 bp, A.fumigatus
ttaccccgtattctgatcgccacgaggcccggaatagcctggaccctgattggttggtggtgcatcgtactattattggattcccccccccccccccccccgcatattcacactgaggatcagcctgtggataagctctacattttcctactcgattctctagcttgtatgttctcggacacaaggaagtag

SEQ ID NO: 12613 - DNA, 510 bp, A.fumigatus
  unsure (125): Identity of nucleotide sequences at the above locations are unknown.
gaagcgggcgatgtgcgagcagcttggagccggggttttgctgccctttttgtttccaccggatcggatgggacgtgttcgatgctaactgccaaccaggcatacgttgatttcaccaagtccanagatctggtcgcggatgtcaaggccgccacgccggatgggctgggtgcgcatgcggtgattctcctggcgttctcggagaagcccttccagcaggcgaccgagtatgttcgctcgcgcgggactgtcgtcgccattggcttgcctgcgaacgctttcctgagggcaccggtcctcaacacggtggtgcgcatgatcaacatccggggcagctatgttggcaaccgacaggatggcgtcgaggcgattgatttcttcgctcgcggactgatcaaggctccgtacaaggttgctccgcttgcggatctgcctaagatctatgagctcatgggtatgtttcttccgtcaccttcagtcctgtggtgggtctcgctaacaggtcaatag

SEQ ID NO: 12614 - DNA, 813 bp, A.fumigatus
atccatctcatcaatcatcaatcatcagtcaatcacatcgcttggcttatacaccatcagacaaatctctttcaccagttcgccccaccgataacaaccatgactaagttcgacatcccctccatgcaatgggcccaggtggccgaacaggtcggcggccctctggtcctcaagcaaatccctgtcccaaagcccggacccgatgagatcctggtcaagatccgttactcgggcgtctgccacaccgacctccacgccatgaaaggcgactggcctctccctgtcaagatgcccctcgtcggtggccacgagggcgccggcgtcgtcgtagccaagggcgacctcgtcacggaattcgagatcggcgaccacgcaggcatcaagtggctgaacgggtcctgtctcgcctgcgagttctgcaagcaggccgatgaaccgctttgccagaatgccttgctgtccgggtataccgtcgatggcaccttccagcagtacacgattggcaaggcgacgcatgcgtcgaagattcccaagcacgtgcccctggatgcggtggcgccggtgctgtgcgccgggattaccgtgtacaaggggctgaaggagtccggcgctcggcctgggcagacggtggcgattgtcggtgcgggtggtgggctgggatccctggcgcagcagtacgcgcgggccatgggtttgcgggttattgcgattgatggtggggatgagaagcgggcgatgtgcgagcagcttggagccggggttttgctgccctttttgtttccaccggatcggatgggacgtgttcgatgctaa

SEQ ID NO: 12615 - DNA, 210 bp, A.fumigatus
acaaatcatcgacagataacaggtagacccctcaattgtttccttatcgttccctttccctctatttccttttcttcgcactttgagctggccattctgcgacaaatctggaccgctttcccaactacatacttcgccgacttggactccctggactcccggactttagctgccttactggatcttactgtcataagacagtgtccttga

SEQ ID NO: 12616 - DNA, 498 bp, A.fumigatus
aaaggaaggttctcttccacgttgtgtctaagaccttcatcgaaactgttcaagccaacgtctcccagtccgaatccgccgctcagtctctcctctctcagtcccagtcccttcaagccgccatcgccaacttacaaggcgagatttcctctctcaattctttcaattcaactctgcagtccaacacctccattctccagcaatccctccaccgtgccgacggcgtcatcgcagccgcgcaggcacgaatctcctcgtccactgctcaagcccatgcctcaaactctggctcagacgcggcaccatcggctctgccacccatcgatgaggtcctcgtcgcccctaccgtcgttggtaagcagctttatgacctcgtgtccgaagagcgaggaatccagcaggctatttacgccctgcaagctgccttggtcaaaggagtcattggcgttgacacatggtcgcgacatacgcgcagtttggcgcgtgaagcgttcttga

SEQ ID NO: 12617 - DNA, 894 bp, A.fumigatus
gtttcatggcagaacaacagctccatccggatgacgagggactggacaggccatttcgtttcattagtcactggcaaatacctcgctgttcgctataacgacaacagtttcactctacaccgtgattaccatggcaatggaagcctgttttatctttcggatgacgagattcacataataagagaccgcacatatgttggccagcttcacagtcatcccatctacaaggacaacgtgtttcacatctgtcgtgggtcacagtacatctcgagagaggggcggtggacggacaatatcaatgaagctcttgatgtccaaatcgacccagaagacccacacagcaccgacagcgctgaccgcgctcctatcctatcactttgcgagcctatcctcaaccccgctcatcctgtttccgcagatggaatcgacctctaccatcccggtaagcaattcgctctgtatcccgttactagcgaccgcctttggaacggtgacgctagtaacttcaatggcaagcttgtcttcggcggcaatccatacagcgccggactcccgtttcagctctcggtacatgaaggtcggacgcgaatccgcgcaaatgacggcatgtacctcactgtcgtcatggaagatgatcttgtcccgtacctgaaaggagaatgccagcggcattccagggtcagtccgtgcgcacattgttcaacatggtacagcctcggctttcgtcctgagcctgctgattgccttgctctgattccccacggtctgcctagcatgtttgtcttgcatgacggggctttctactacagcatgaatgtccttaaggcaagctatgccgagacaaagcgcgtcaagcacattgaggaggcatcgctttttcaatttgttggttag

SEQ ID NO: 12618 - DNA, 606 bp, A.fumigatus
atcccttcattaacgccccacaggtcccggccccccggatccggccaaaccctgaaaaggaaggttctcttccacgttgtgtctaagaccttcatcgaaactgttcaagccaacgtctcccagtccgaatccgccgctcagtctctcctctctcagtcccagtcccttcaagccgccatcgccaacttacaaggcgagatttcctctctcaattctttcaattcaactctgcagtccaacacctccattctccagcaatccctccaccgtgccgacggcgtcatcgcagccgcgcaggcacgaatctcctcgtccactgctcaagcccatgcctcaaactctggctcagacgcggcaccatcggctctgccacccatcgatgaggtcctcgtcgcccctaccgtcgttggtaagcagctttatgacctcgtgtccgaagagcgaggaatccagcaggctatttacgccctgcaagctgccttggtcaaaggagtcattggcgttgacacatggtcgcgacatacgcgcagtttggcgcgtgaagcgttcttgaagcgggcactgattcgaaagatcggcaagggaatggggcttgaagaggcctga

SEQ ID NO: 12619 - DNA, 1113 bp, A.fumigatus
ccaatccaacagaatcgacatctctgctccgagattttgcttggttgcttcagaagaacttcagagttctctggcttccgagactggaaccctattaccacatatgtttcactgggcgaagaaaccggctccatctgcactgtgtgcacccctccaaaacccagaatactgtggggtcgggatatgaaaggtttgatcaaagcatatgaggatccaagggatgcagctctatatgagcgtcaggtaaaagcgcagccatcaccgttcttgatttttcgccgtgtcgatgatgataacattggccacttccttgtcaccctgaacgtgcaaacactgttgcataaagcctatgcaaggctgggcagctccggatcaagcaatccctcgttttactggcgtcttgtcccaaacgcgtatgatgaacgaagagtccggttccctaaattcaatttcctgagcaacagaaacgattcgcctcacagccaaccgccaaattttcggaaagctctgagactggagcaattgcggtcattgacatggatgttagaacaagaaaaggacgatattgctcccttcgtcgaggaggaggttgaagaggcaattcttccgtccatgatgtggcgtgcagagggcaaggtcatggtccagcgaaccgtccgcggaggtgtcttagcggacgacgtaggatacggcaagacggcgatcacactggggctcattgacgtgcaacatagcaggggccatgacactgtaccaaagcccatggcgggcttcattccctctaaagcaactctcgttctcgtgccccaaatcgtgcttcagcaatggcagttggaaatcacgaaattcgtgggcgaaaagtacgaggtcctggtgttatcatctggaaaagatttttcagaaacgatgatcagcaatattcttcgtgccgatattattttggtgccctggtctgttctcaaccgccagtcatactacgagagaatgcaaaaatttacgggcatgccacgagttcccgaaagcgcaggccgaaacttcgatgcttggtttgccgaggcacagaattccctcagaaaaacaagtccaaattctgatggatcaaggaacctgtga

SEQ ID NO: 12620 - DNA, 756 bp, A.fumigatus
tcgccctttagtcaaacggcatatggttctctcgagaaaattcccaagaaccccgatctggtgatcgcgggattttcatgcgtcgacttctctggtttgaacaataatagaaagaccctcgatgagctgggtgagtctggaggcaccttatggggtatcattcgatatgccatagcctaccgtccgcggattgtcatcctggagaatgtcaaaactgcgccatgggaaaagattgcagaacattggaacgaaataaactatctcgctgtccacaaaagcgtcgatactaaggcatattatctgccacagacccgagaacggggatacatgttctgtatcgaccgcaacctcttgggcaagtgcggtctttctgaacagagtgtgatggattgggcaaagatttttgacgacttcaaacgtcctgcaagctctccagcaggtatgttcctattggatgctgacgatcccagactcgaacaaatcgagaaagacatgtcaattcgggtcaagtccacaacagtaagacccattatcgactggacaaagtaccaagctcgccatcagaactaccgttcagcccaggaactcggatttgaaaggccgataagcaagtctcaagataccggcggatgccagatgctggactttgcgtggcagacgtggttcagatacttgcccgaacgaatctgggatacaattgatgtcaacttcttgcggaagctggttgagggatacgacatgaacttcaaagagtaa

SEQ ID NO: 12621 - DNA, 1863 bp, A.fumigatus
acttcaaagagtaaggcggtccctccctttgagaaaacaagcaacccagctaatggatgccacaggagatgcattgagctctcccaaggcgttgaacgagaggtcgatagtcgtgcgtttggcattgtcggctgcatcacacccgcaggtatcccatatatcacaacaagaggcgggcctctgtgcgggcttgaggctctggcgctgcaaggtctgcccgtgaacagacttctgctcaccagagaatcaccgcgggatctgcaggatctcgctgggaatgccatgagctcaactgttgtcggtgccgcagtgctctccgcccttatcgtgggacataaagtgctgccgcccggagaacactcacctactcccagtaattgtattccgaagaacaagagaatcagcctccatcagaatctccttccgatgccgcgggtctcgcagcttagccaactccacacagccaacattttggatcttcaaaggcaagccacaagcagcgcaaggtactgcttatgtgaaaggcagtctggagtaaagcaagatatcttgaagtgcaccttgtgcgcgcatactgcctgcactgactgcgccggtaatccatctcatgcatacgaacggtggcccggtttgattcgcagtcagccctctgctttcattagacggttcaaaagcatactgcccgctagattgatcatgtctgggttgaatcgtgaaagctatcgttctttcgatagaagcctacctggaaacaccgatcatgtttgggaaaaatacttggatgccgtcaccagaactgttggagatgagctccgttttttggatgtacgacgcagtaaagattggactgctgtctatgagggaaagtgctccattttgaaactcgtcatcagtggttccacattcgagtggttgctttttgcgaagccactcgattcggagcctgccctatcccttcaccgtgagatcctatcgaagcccatcgcgcgcatgatccaggatcgaggaatctgggaggtgtgcgccccactgagttcaaagtttacattgactatctcaggcactggcagtcaggtcccgacttatgaggcacgttgtggtctgcaaaagagagaatttgttaatgccagccgttggaatcgtctggaggttcaaggctccagctacgattgcgagcatcttgaagtcgacatccgtggaacctatcagcttctgcctgactgtggtaccgcaaacgggtacctgcataagaaagaggccaccgatcgagatcctgaagtgtatttgttccttgatcccacgaagcttggagagccgaagaacgactcttttgtattcgctttggagcatcagcgtagtcccggctatgagtcccgaatcacaattgccgaattgtcacacaaatggcgctcttccaaagcaaacgatgctcgcagaaatgtcaacgcatattatcgcaaatgggtccaggttcaaaccatggggctggatgtacacccctcagattccactatcacttgttggggcctgcggccagggacaactgtcttcatggcaaatactggctgccacgatgcaaacttccccctgctgtccctctccgcgccagctgatgccattgactctctatggcgtaaagggccatggcaaataaccaatccaacagaatcgacatctctgctccgagattttgcttggttgcttcagaagaacttcagagttctctggcttccgagactggaaccctattaccacatatgtttcactgggcgaagaaaccggctccatctgcactgtgtgcacccctccaaaacccagaatactgtggggtcgggatatgaaaggtttgatcaaagcatatga

SEQ ID NO: 12622 - DNA, 249 bp, A.fumigatus
tctggaattcaaaaatgccatctactgtggcaatgtacctgcttaagtcagttttccgcctcgaacttgaaacagaccagcgaggcctcatcttacagtgtccttccgtcagcgccgaaacccagtccagccgtgctacctgactcctggtctctagctccgggccctagactcctgtctggtagttcgttcaagacactcctgatccatctaggagagcgtgtctgctcaaaacccaagagctgttga

SEQ ID NO: 12623 - DNA, 183 bp, A.fumigatus
tgtatcgccacgtgcggtccgatcagcgatccgtacaaaggcgcactctccattatcggagcccccgacacctatccaaccataccccgcggtgagacattttggttcaaacggtatgacggctatagtctctcgcttttgcgacgaaatgtgaatcgaatatatcactctgtcagcgactaa

SEQ ID NO: 12624 - DNA, 1632 bp, A.fumigatus
atgtgcggcagtaataatgacaagactgttacgatctattctctgactcggtcgaaggttctcaaggtccttcctcaccaagcatgcatgaattatgctataatgtccccggactctactctactcgctgcggttggagatgagactcgtgcatatttctacgatgttacatgtgattatgagacaacgattcagacagacaacggtgagaagcttcctgcatgggattgggatcttatccgttgcatagagatggatattggcacgcgcttcgatgatggctgctgcttcactgttgcattctcgccattcagtagactgtgcgctatcggttcacagtcgggagttattacagtgttcgacgtggccacagttcgagacacagaaggcgaggcagacggtaagaacgcgataatatgcaatttcaactcatccaggccgtgctgtaacggtggtgctgtgcgttgcatggcttttgcacctgagccttgggacctcctggtgtggcttgaagacaaaggacgagctggggttgcggacgttcgccaggctttcatacgcagacagattctaaatctggatatgaacgacccaaatctggaagaagtatacacagagccgatactaaatgaccctgaagagctcgaatctgaccttgatggtcgtgttctcgctgaatctcggcatggaacagatgcaacccaccgagctattctcgattcgatcgagcgtacttccaatgagcggggaaatggggcggatcattctcctttgcgtgagagcttgatacaggacctcacacagagagagaggctgatagtggaatttttaaatacagcacgttggacatcgaggttagaagagggtctgactgaacggcgagctagagtcaacgcctcatcgcatcctacacctcgctcacaattccaagcatccaccgaaggaactcgtcgaccatcccgtcctacctcgccaccacaccgaagcgacgctcttattgatacatttcgggaaaactaccttggccacgcaggaatctccagccggaacttgaatgcagggcgcgacaaccatgtaactcctccacggggatatccagagggtagtaggtcggttattggggccaatgttagaccgcagccaagtctcactctgagctggacagcttcgccatcggaacttcaatctgccacatttcttgatcacttgcatcctgtagaccgcgatgccgatggaccgagcagctctagtagtgaagaaggttcggacactcgaacacatgatcctataacgcgcccgtcggccactgttgatcattctagttcgcgactcacagcatccgatagtcggcatgacttggggcgtctttcaacttcagaattgaggactaatgtcgcggcagagaggcttcgaagacaacgacaaatcatcaacgaggcccaaaacagaaacagtcaacgcgaacaacgataccgtcaacagctcttgggttttgagcagacacgctctcctagatggatcaggagtgtcttgaacgaactaccagacaggagtctagggcccggagctagagaccaggagtcaggtagcacggctggactgggtttcggcgctgacggaaggacactgtaa

SEQ ID NO: 12625 - DNA, 1968 bp, A.fumigatus
accactgtggtttctaataaaaagatacaggcatttcaattacaccatgtcgcaaccccccgtgatccgacaatagacgccattcctggaggcgccatgcaggacactgccggggagaaaaccattgagccaggcacccgttcaccttgcggtacagagacaagaagacgaacactacgtcccatgtcctcgtcaccaactttgacggatctcagatcactgttgccgctttatgaagcttctgagctactcgtcgatacctattttgaccgagttcactggtttatgctcatctttcagcaggatgactttcgtcagaactggccacacctgtatgaaacacaatcagatggccccaatgaagtttgcaatgatctgggctttctcagcacttttttgatggtcatagctattggagcacactatacaggaccctatcggcaacgtctcctagctcgatataaggtcgaacctgaggcgctcaagcaacgcattctaaaagccatcaaatccagtttgctggatatcatctcggttgggtcgttggaagttgttcaaacgtgcgtcctattaggaacatactatctcttccacggtgctcctcggctagcatggccggtctgcggctgtggccttcgggttgcccagtcgctcaacctgcatcgcaaaaaagaacatgccactttaccattaactcccgctgagcgtaaccagaacgaaacgaggaaacgttgctggtgggcgatctacgagatagagacgttctgctcgatgtcatacggccatcctcacagcatcggagatgcagactgtgatgttgagccattgaatccgtcggcaaagctgcggaatgctccatcacctgtatcctttgatgaaccactgagatgcgagaccacgcttttggcctacaaatattacatgtccaaactatcggtgcttacaaagtcggtcctgagcgagctctatgggtttggaccaggtttagtgaacaacaacaaggctcctggtgagtctggctcgaggttacgcgcagtcgttataagggtagcgaaactagatgcaaggcttcgggactggcgagctgaaatccctcccaaactacggtgggagacggttgcttctaccagcgtgagctattcatcattggaagaatttgatcgagacatcggtgcatcgggggttcgattcgacaatcatatctatcaccttcaggccttagcacttgaacttgcctatgaaaacaccatgattctagttcacaggccgcttctgtcgttcaagctcgtgaccaaatctaccgacaagcgggatgatatgtcttattttgacattcaagaaaatccatttttaaaatcaatgaaagcgtgccatgatgcaggtatgagcctatcggaactcgcgaacagcccgattctcgagcttgtctctgaaacctatgccgctgcctttgttagcatccatacgttcaccgctggagttgctcttgggattctaggcagtattgagccgcttaccccgcaggctcaagaagccaaagttgggctgcatcgactcatgtccattcaagcgaaattacaaactcgatccgtactagccacgcagggtctggatattctccagcggctgacgaaactcgtactggacaaagagctgagcatgatgctcgatgtttcgaaacccatacgatggccagaacaacacagtggcgtacaaggcgatgtcggtgccctccaaacaagtaccctttctcctaagccatcgtcaagcgaccaacgtacgaggacgttgcctcatgatgctgctggggcgatcatgccaacggacgcaccattaaacatgtcagatactacagacacccgagaaacagagagccagaaagccgcgccagatcgaaacagtctcggcaactacacgcatcttcagtatattgaggacacctctgtatccgaagcgctccatgacttc

SEQ ID NO: 12626 - DNA, 288 bp, A.fumigatus
gaattaacaacgttgcgcggttgtatgacgcctcgcgggacggatagctcgattcccttccactcggtgggagtggcttgtaacagcgccaagtaccttgcggctgaggcagcattcacagcgtgtgaaagagctgttctgacgcatggaggaatgggttatgcgatggagtatgatgttgagcggtatctgagggaatgtctagtccctcggattgccccggtgagtcgggagatgatattgaattatgtgagtgaaaaggtattgcaattgccgaggagttattag

SEQ ID NO: 12627 - DNA, 546 bp, A.fumigatus
gcagcgcgtttccttccagccccgtggggaagacccctcgctcctctcctgcctgtcctcatggggattccccacagtggacttgggaatcgcgcgcgacacaccacccacggaactagaaaacgctctccgcgacgccctccgcggcgtagggcgcgcaaataccagcgtcgacgtgatcgtcaccacaggcggcgtctcaatgggcgagctggacctgctcaagcccaccatcgagcgttcgctcggcggcactatccacttcggccgcgtctcaatgaagccggggaagccgacgacgttcgccacgatcccgttcaagccctcgtcgacaccgactggctccacgcaacaggagcgcgagtcgaagctcatcttctcgctgccggggaaccccgcttcagcgctggtgacgctaaatctgttcgtgcttccgtccctgcacaagatgatgggaatggggcagagacagactgcgccgggagtaactcctgctctggggctgcctcttgtgtccgtcacgctagcgcatccgtttccgcttga

SEQ ID NO: 12628 - DNA, 771 bp, A.fumigatus
cagcgcgtttccttccagccccgtggggaagacccctcgctcctctcctgcctgtcctcatggggattccccacagtggacttgggaatcgcgcgcgacacaccacccacggaactagaaaacgctctccgcgacgccctccgcggcgtagggcgcgcaaataccagcgtcgacgtgatcgtcaccacaggcggcgtctcaatgggcgagctggacctgctcaagcccaccatcgagcgttcgctcggcggcactatccacttcggccgcgtctcaatgaagccggggaagccgacgacgttcgccacgatcccgttcaagccctcgtcgacaccgactggctccacgcaacaggagcgcgagtcgaagctcatcttctcgctgccggggaaccccgcttcagcgctggtgacgctaaatctgttcgtgcttccgtccctgcacaagatgatgggaatggggcagagacagactgcgccgggagtaactcctgctctggggctgcctcttgtgtccgtcacgctagcgcatccgtttccgcttgatcctaagcgcacagagtaccatcgtgccattgtcactgcctcacgctctgatggccggctgtatgccacgagtaccggacttgaaggtgttggccagcggagctcaagagtagggagtcttgcgagtgcgaatgcgctgttggtgcttcagcccggaagtggaaaggtggacaagggtactctagtggaggctttgctgcttggaaatgtggtgtcggaggcgtag

SEQ ID NO: 12629 - DNA, 240 bp, A.fumigatus
aggtatgttggatctatacattacccaggttgttctaccgaacacctgctgataaactctacagcgaaccttttgccacggcgaggcagggataagcccggctacgaaggcgaagatcgactccgtggtgtggcgggcgaggcagacacctatggttgtttggccgttgataatctctacaacatcatgcatactacagaccgtaggtccctcctcatttgccatttgaatcgaatataa

SEQ ID NO: 12630 - DNA, 471 bp, A.fumigatus
ttgactccatcagcaatcgcatatcgtctcaatgccgcagtggacgttgaccttgccaattctttaaaggtcgcttctatcccgggcacttcatcctccttctgggaatccttcggcagtgtctttcgctggagcacgtctactgttcccgcgcctattcgtcctgccactcttaccaagctcccttctaacgtggaaatggagacacatgatttcacacgcgaggagattgcagaaaaacgcatgttactccttaacgataacggccaaatagactatttcatctccggtggtggtgggccactgaacattcaatatctgaacatgctgagtgcgcatagcagttactggatcctatcagattttgttcgctttatcgtcatagaaatagcccgcaagcagggaagggaatcgacattgcctgcattcagggctgagaagaaaaagggatggaagatacacaaaggttga

SEQ ID NO: 12631 - DNA, 219 bp, A.fumigatus
gacgcggattttccacccgtgggcaagattatcatcagtcatcagccgagcaagctacccgacattgatttcgcaacgacgagcgtccgcagtgatattttcgagtttgacacgaagaatcttttcctctgtggtagtcctgtcggctttttcttactattgaataaaggtatgttggatctatacattacccaggttgttctaccgaacacctgctga

SEQ ID NO: 12632 - DNA, 249 bp, A.fumigatus
  unsure (184): Identity of nucleotide sequences at the above locations are unknown.
ttcctttccttactctgtttgtttgctccaccccccttaaacatctttctctgcactgtaagtatgatctcgtatcactgccccaaatccttttccgtccccctctccggggtcaaccacccctcccccctgtctctctgctctggtgggcatttggcggacacaagccagggatccaaggcanatgttgctgcatgggagaacccctggctgagtctggggtttgtgtggctaaaaattgctttacaa

SEQ ID NO: 12633 - DNA, 1431 bp, A.fumigatus
ctcatgctggcgactgctgtcaacctgataggaggtttagtgatctcgttctcaattgcttggaagatcacaattgtattgtgtcccacaattccagtcctgctggtgtcaggcatgatgaaactccgagtgcaaaaacaactcgccgaacgtcatcagaaggcgtttgcgaaggctacagctgtcaccatagaggccgtcgacgacatccgcgcagtttctgcattctctctggagaagcaatcgtaccaggtttatggtcgtgcacttcgaggtccataccgggctaccatcaaagccacgttccacgggaatgcatggttagcattggcatttagcatcagcaacctggtctatgccctagcgtactggtggggttcgaaacagatcgccgagggtcgctattcccaaacgcaatttttcattgtcatgccagctctgttgtttagcacgcagtcttgtgggcagatgtttgcccttgcgccggatatctcgaaagccggggtggcttcgtccaatatcgtcgaactgctgactacccgttcggcagaggatgaagtgacacctggatcatcgcacagcttccagcgttccagcagtcttctcgaggagaagaccgcagtgcaggacatcgaggcgcaggaatatgctcgctccacacggcaacgtgccgctgaaaggggaggcatgggcgcccaactgcgcgatgtccattttacttatccacatcgcccagagcgcccggtcctgaagggtctcaacattgacatcaaaccaggtcagttttgcgctctggtggggcccagcgggtcaggcaaatcgaccacgtttgccatgctggagagattttaccggcctaatgccggtgcagttgtcatcgacggtgtggacgtcactcgtcaggtcgggacagagttccgcgatgatattgcgctggttcctcagcagaacattctcttcgagggaactgttgccttcaacgttgcacttggcgcatgcccaggccacgagcccacacaagaggagattgaggaggcatgtcgcatggccaacatccacgatgtcatcatgactctgccccaggggtatcagacgatgtgcagccatgacggcaagcagttttcgggtggacagcgccagcgactgtcgattgcccgcgcattggtgcgcaagcctcgcttgctgctgctggacgagtcgacaagtgcgctagacgtggaatcggagaagcgaattcaggaagcgctggcgaccctggcaggccggaccacagtagtggccatcgcgcatcgactgaataccattcatcgggccgatcagatcttcttgatcgaggacggcagatgcattgagcaaggtacacaccagcagctgatccagcggagcgagacataccggacgagtgtgattcaccaatcgctggaaacttga

SEQ ID NO: 12634 - DNA, 276 bp, A.fumigatus
  unsure (212): Identity of nucleotide sequences at the above locations are unknown.
ttcttctcgtcaggcgtgtttgtcttgattcctttccttactctgtttgtttgctccaccccccttaaacatctttctctgcactgtaagtatgatctcgtatcactgccccaaatccttttccgtccccctctccggggtcaaccacccctcccccctgtctctctgctctggtgggcatttggcggacacaagccagggatccaaggcanatgttgctgcatgggagaacccctggctgagtctggggtttgtgtggctaaaaattgctttaca

SEQ ID NO: 12635 - DNA, 729 bp, A.fumigatus
attgacaataggtgtatagtccgatcgcaggtcctcgcgcatgtccaacccgagactgtccctgcggtactgtatcatggcgagtttcagctgcccagggctgatttcgaccggctattccggccgcacacaggagagtccaacatccttgcgggtgttggcgatggcttcaacacgccgttcgccgtctgcaacatgactaagacgcatgtacacatggactggtcgtactcgcggccggtcagaggcagcggagaggacgacccgctgtaccggcccaatctcgcctccgaggaagcaaagcggatccccacagcgctggtggaagagcttgcgtcgcgcgatctggccgagccgtggagtctgtttctcaatggtgaggctattcaacatcaccgggtgtttcactgggccgtccggtgcgtctctgtgacgcgagaagacatgcagcgtgctgtagggcggggggtcgcctttgtcggcgactcgtggcatgcgatgcccatatttggcggagagggagggaatcatgcactggcagatggtattgagctggccggtgctattgcggctggcgcgaccggcgatttaggcacggcgattgggaattactatgaccaagcatggaaaagatcacaggacgcggtacgacggtccaaacagcggttctatacgctgcatcggccgatggctgagtggcgggagctttcgaagaagaagcccctgtga

SEQ ID NO: 12636 - DNA, 270 bp, A.fumigatus
gatgattggcgaggcagagaggaaccccaccctctccagcgagccttgacagttagggctggaaaatgtggagccgacactgagaatgagagcactggctaccttgatgttgattatgcatggatggcaattgagagtaatgaagatcaaaagaccttgtatctatcccgacgagaaatagacaagaaaattgcagctaaggttgaccaagacgggacgagacacagaagcgggtggctgggtagagcaactgaagaaaatcgtccttga

SEQ ID NO: 12637 - DNA, 498 bp, A.fumigatus
  unsure (416): Identity of nucleotide sequences at the above locations are unknown.
cttgttccgaaaataagaaatccaggaagctttttttcgcttgtctggtcagttaaagcatatatagacattaactcacgcccagccaccaaacaaccatctattatcaagatggagaaaagtaatcggcggaaacgcccctcaactccccatctcagctgcgagctctgccgcgagcgtaagatcaagtgcgacaaggtcgatccctgcaacaactgcgtctcggcaggcgtggtctgtatccctgtccatcggccacgcctgccacgaagcgtccatgcgcgacgagctcgcccaatgtccccaacattcgtgcccccacgcgcgcctacccctgtagcgggtccggtaccttccaagaaaaagcagacagatcattcctccggcgccgtaacgggagttgacgacgaactcanggagacgcgttcacccggcttgaagggggagtcaacagcatgcgtggcggctatgcaggactcatcctccgcaaatggttaa

SEQ ID NO: 12638 - DNA, 2325 bp, A.fumigatus
tctgattctcatctccgacagataaattcagtccccgcgctatctcctgctcttgcacccttggacgtgagcgatttggccttcagcagtccctcgcctgagccagagcttcagatgctacccagtcctgcctcgaccgagatcttggaaacttcgaagccacaaaaccaccagtccaaagatcccgatgcaagtcacggcccttatgtcctcgaacgcgtacagcggacttctaagggaggtgccggtggcatgatgcagatagatcggcctctatcagcagctgaaagactgcaaatctgggaccatgcagcaacagtcggcgtaactgagccttgcgaatccacggcgtttgcagccgaagagggaagaagtcaacggaattcacaagatatacagctccaggcgaacctaataatacagaaactggacaaccacgacgaacaaccagcgtcacattccgccccgttagcagaacgaaaggtgtcggagaaagaacatgaatggctggtgactgaaactccagtcaaagagaatacagcagtagttctacagtctcgacccgcatcaatctccccgtccactacctgctattcttcgcatacaaatgacgcagcattcgaagcgtcaattcaatgttctaataatgattcaggagagtcagacactcatcactcagccccagatccccatgcctccagcactcaagaacaggccaacaggaaatcggtcagcaacataactgtcgaaggaggaattgtatcaacgaatcagaatgtcccaacactacctgtccttgattcccagattgtctcaaagcagggacaaccaaccagtaggatccagcagagcaatataagcgcgtttatggtcggcgatagtgatctgactgcagcgactcagactcggcttcagaccaacacccctgccaccgtcttcaatcaacatttacagcagaggaagaggaagcgacagcttaccaacaaaagtttcgtcggatcctcgcagtctgagcaacaggagcagcaaaggcaggttaggaaaccgtcatttacaactgtgggttctttggccgccttcatggagacaagagggcgaaacgagatgcggaatatggtgacacaaagcccatacttcccagcgggaaagtcaactgacgacgtttccaagcgacaaagtgatgaagtgagcatagagaagcccgaaagctgcttaaatgagccaaacaaaagcgaaaacgtctcggatatagtacagacagccacacaacttcctcgctttcagcagcagacgggagaacagccgatcctgttcttatcaaccacacttctgaagagtcaccttcggcttgtacgctgtcttgaaggaatggcaggcctgccagtaatcgtatatagagactataatcaggaaacctctggtagtgagcctcgagggaagcatacaacctctagcatgaacaacaaccccactcatcaaattgaagcagatattataatctcgccgagtactggtctcgtactgacaacatcgcaggcggcaacacagctatacctaccaggccacaagtccactcaccctgagacgaacactgagtgcatcaactcaccacttcgagaacgcatcttccttctcgctcctcgatacgaaagaatctacctgttcatttgccatagtgcaccttctcctaaagagtcgcaaggcaaacaatcgggtccaacagctgacaagcgactgttagcgtccatcgcctcgttgactgcgttttgcaactcgatgtccgcctatgcaacaatcaacccattgctagcaccttcctccccagaaaccgcggcgggctggatcctttcgcttgcaaacaagcacattgcgcgacttcccgagaatccgacgcggattccgcccagcacaagcttcacaccgattaactcgccacagaaaaaccgattgaggccggaaataatgatgagaacagccgtctgggagttgttcctccgccaggccggtttgaacccgtatgctgcgcaactgattttggcgttcatcaagcgagaagacgaagaagagcggacttatatacgttacgcatcccctaaagctgccagttctagctctgtggaggacggaggtacacatggccttgctaggtttatcgagatggagccagatcgaagaaaggaggtcttcggtcagctaataggtgacaggatgatggggcggatcaaccatattctcgacaaagattggcagtgcgactgggtccttaactttgacgttgatacggaacttcttcaccacaggggccgcaggatccacgctaagagt

SEQ ID NO: 12639 - DNA, 249 bp, A.fumigatus
cttcccatctcaattgtctaccctgttgattttctgccaattccaaacacggaacagatgcaactgattgattcattcattgctgacatggaggccacgttcggtatcaaaacggaaaaggtttctatagctgacacctggaaagcttttccaccaaacgaggctggaaaccacacaattcaggagtatctgaaggatgtgagaatatcaggcagtctatccagcagatttgaagagacactgtgctga

SEQ ID NO: 12640 - DNA, 474 bp, A.fumigatus
ccttgcctgagggtgagagatcagattcagattcagctgatcggaagctgtgctgtttgctgttcaccatcgttgctgctgaattcagatttgatagcagataaacaagcaattattattccgatggacgaccccggctcgacagttcaggccagcatgttcttcctgacgccggacgaattgcacaagcaacagcggccttatacgtttaaattcccaccctacaatggctgtcctcagagcaacatgacacatgaaaaaatcaacggtattaccgttgagaatatgcggggacgggaagatcagtttcagctggagcgcaatggcttcaccattctcaaggtcaacactggcctcgagtatgacgattctttcaagcagaaaggggttacacagtaccttcgcttgatggaaggagtgctgaaagctcgtcttggtgctagtcgggtcgatgtatttcgttacggtgtatag

SEQ ID NO: 12641 - DNA, 210 bp, A.fumigatus
cggtcaaagcatcggacctatttcgactctggtgactatgctcttgctgcagctcataaagtgacggacgagggggatatccaaactggaacggcgcatccgttgcgcgagagcatcccacatccctatgctcccgtccctagctctggtaacgttgctggagatgccaacaaggactcgcattgtaggaggagttcaagtcccgaatag

SEQ ID NO: 12642 - DNA, 777 bp, A.fumigatus
tttccaacactgcatgatattactgctaacacactgataagctctaaaataccttcagcatgcccatccaagattacggtgtctggaaggcatatcctgtgcactacaatagttgaacaccatgaagatgacccacggtcaccgcatctatcattatatcatgacggcagtggacaacgtcgcaaggagggctctcaacgcaaccttggccggacagggatggaaatttcttggctcttccgagctgcaatcaatatcaaatctggagacacgaatgactctcgcctcgtgtattggatagatcgcgatttcagccagcactccatcatcgacaggctcagtgtcctaaagccgggattccatctactcgaagatacgaaatcaagccctgatggtccaagggttggttttatccggagtaacttgttcaacgtcaacagcggccgggttctgccgcagaacattgagggccctgataacaatattattgatctgctagaacctgaagttcgtcaggccattgagcgccaagctgaagtatatgtttttggtgcgcgttttgacacgaaggatggaatccacgatgtccatatgaaccagggcaacaaaggacgctggaaggggataacaccgtctttcaagacggagcactctttattcatttcacaaatcctgaccgatggcttggcattttcctcggctttgcatcccaggcagcccattccgatgatcggactgggcatgccatatcatcggagacttggagtgactacctaa

SEQ ID NO: 12643 - DNA, 2286 bp, A.fumigatus
  unsure (147),(996): Identity of nucleotide sequences at the above locations are unknown.
ccccctatcaggtccaagaccgatgcggatcgggcgaagtccaagcagcagctgaatttgcttcgacagcaccagcatggcgccttcaaacttgacgcggcccaagaggctcctgcgatacccctggacttacccaccatcctgcanggacgtcgtaagaagttcaatccgtctaaactgtcctcggaacagttcaggaaatgtgtcgaaccttgggcgctcagtgctgttctggcttggattcgcgatctgtgcgaagaggaaacagccctgaggaaatcggccattgtcgacgcgatcgtcgctttgttcactcccaaggtgccgacgatgaatatcgcggacgcagagacgctggctgcgcgagtcgttgacaacatgctggagcaggaggctctggtgaaggaagaagaatgggtcaaattcggcagagggactctgtcgggtgttttgttccagattacaggcactgggtgctattcgcccctgctacatgaacaggagaccgagatcctcggacgctgctattcgcaccactgcatgcggacgctgaagaaggtcaacctgaaagcgcacaagatggcaccgcaaaagaaagtcgaggactgggtcacattctacaaggttccgaaggaagtgtgggaggcttatccgaagaaagaggtggaccgccagaacaatctgcatgagattgtcacgaccgaggatgcattcatcggacagctggacgtcctacgcgaactctaccgggatcagttggcaaatatgcagcctgccatcattccgccaaagagattaccgaagttcctgaacgatgtttttggaaaggtagatgcggtcaagaaggtaaacgaggagtacctcctcgcgcagctcaaataccggcagaaggaacagggcccgttcattgtgggtttcagcgacattttccgagagtggattcgaaaggctaagatggtgtacattgactacgcggcaacgttcccgtacgccaantaccttgtccgtaaggagatggagagaaatgcccactttcggcagttcttgaatcaagctcgtgagcacaaaatgtcgaatcgtctcagctgggatacctatctcaaagctcccatcactcggattcagagatacaccctactgttgtcgactgttcacaagaacatggtcaaggagtgcgaggaaaagacgaacctggcacaagctattgatgagatcaaggtcgtggccttggaatgtgacaacaaagtcggtgagacaagcaagaaggttgatttgatggaattgtctgccaaactgcaacttagaccggagatgaagaaggaagtagagctgaatctgcagcatcttggtcgcgaaatcatctaccgaggagacttgcagcgccctggcacacgcactcgattcctcgtggacacgcatgccattcttttcgaccattaccttgtccttgccaaactgtccaccacccgtgatccgacgaggggcatcaaatatgaaagctatgatgtatccaagctgcccattccaatggatcttttggtactcgagagcacgaatgatgatcccgtcgttaagtcttccgttcgaggagtttcgactgtcactccaccgcaagccaccacgcgtggtgcaggtgctgcacccctcattcattccaatagtggcaattcgggtaactctacttcttccggcaagacattggtagcagccacggtacttgagagttccaaagatgacaagatcctatatccgttcaaggtcaaacaccttgggaagaacgggacctttacgctatacgcattttccgcgcagaatcggcaggagtggtgtgacaaaatcatggaagctaagacgagacatgctgctgctctcttcgcgcagaacgccgagcccttccgacttcgcgtgctggctgacacggcctttgcctcttccgatcattcaggtatctccaagcggacagtcaccgtcaaaggcacccctctggaccgcgctattcgggaagtcgaggagcggtatgggggctcaaagtctcggcctgtgccggtttgcagaaccagcgtgcattgcgcaactgtattccagcagcctccaggccggatgatgtgtgcagtcggtactgattacggcgtgtacatttccgagtacaatgaccctcgaggttgggttcgagtaagtactttccattgtggtctgttggcatctgctaaaattggtcctaggccattccgatcatccgagtgtcgcagattgcggtctttgaagagttcaatctcttcctgctga

SEQ ID NO: 12644 - DNA, 1554 bp, A.fumigatus
  unsure (1074): Identity of nucleotide sequences at the above locations are unknown.
acgcgactgcgcgtgatccttcgacgccctgtggtagaagtacacccccacagctcgcagtttcccctctataccgcacaatcgccccaccactcggatgcagctattgcgccgccttatccggacgagctccctccagaaccacctgcgcactcgacacctgcggaagatttatacggtaaacgacagagcttcggccgtcgcgggtcgggacggtcgctgcctacgcctcccattcaacaagcacaatcgcagatatctccgcgccggacagatgccttgactcggcatccccagtcgcggcccttgcccggcccaccagtcgacgcggacagcgattcgtcgccgcttgatgatcttaatggggtcggtggccgagatccgcggtcggaccgaccggtgggttatggcgatctgatgagggaagtggaagcggctgtgatagataatcgtatgagtcgggagacacgctataacaccaggccaccgcgtgttgacgctcagagctcccatcacgaagaatatgaccctagcccttccgtcactgccacctcgagtatgcgcttgtctcctgacgagaggcatacgcacacaaacggcacattagcgacgggcacaggccagtatgttaactatgatgcgtacagcgatgacagtgatgcagaagccgcggccgggcttgcgatgctgcaaatggcagacgaggaggacaggatacaggccgagcgggagcaagcgcgcacacggcgggagactaatgcatcaatcatcagtgcctatggaagccattcgtcagcgcgagcgccatcacctcgtcgagattctcgtcaagatgaactccatttcgcgaccaatacgacctacggcagcaatcattatgagcgctatcactacgatgctgacatggatgaacatgctgacgagactcacaatgaaggcgtagatcaagccacaaggctcgccccttcgggctcgctcagcagatccaacctttctgcggacgaccgcggcgagtactcggacgactatgactactatcctgtacccgatgatcaagtacaccaatattatgantacatttccgcggcgcgggtcgatgctgcaggcactggtggcctgtcagaacctggcgcatacgagcgtcggatgagcttcgactacggtgacgaggctgacgcctatcccgatgatgtgcatcactcaggaagtgaaggatccgatacaggaggaataccaggggagctctttttccatcccgggatgcggccactgccaccggcccccgttgaaccagcgaataacgcagatcttctgccccacctgatgccggctgggacatataggcctcaagaatcgggtgaatacccggaagaaacccagtatacaagccctcaataccctgtttctgcggattcgtttgcgtccaccgtgtccacaccaacatcccaagtgccacggtcgacatctctgtcaagtcatcctattggacccggacttgaccccctatcaggtccaagaccgatgcggatcgggcgaagtccaagcagcagctga

SEQ ID NO: 12645 - DNA, 1002 bp, A.fumigatus
gccattccgatcatccgagtgtcgcagattgcggtctttgaagagttcaatctcttcctgctgattgctgacaagtccctaatcgcgtatcatttggacgtcgtatgtcctgccagtggtgtgtcctcgcaaacaacaaaggactctgctcgccgggcgccacagaagctgtctggaaaccgggaagttggattctttgcagcaggccatatgaaagatcgtaccctggttatgtacaagaagcgtgatggactgtcgtccaccttcaaggtgctggagcccgtgctacagaagtccaccaccagtaagagtcgactgttccatacccgtcgttcccagaccgagttcttccgcgaatacgacgaattctacatccctgccgagagctatgggatcaacatgttccactcatccctggcgatctccacccagcggggcatcgagatcctcaccctcgacaagaagcaaacctggtccgtccccgatttccggtcggaagctccagaggcacaagcccagctgagcagcatcgccaaccgcatcagtaacctgcgtcccctgggcatgttccgcctaagcgacagcgaattcctcgtcgcctacaccgactgcgctgtatacgttaacaaacacggcgacgtctcccgcagcgtcatcatggagttcgtcggccgcgcccattccgcctgtttgtacggcaagttcctgatcctcttcaatgacgacttcgtcgaggtccgcaacgccatgaacggccgcctacggcaggttatcccaggccacaatgtcgtctgcctcgacgacgggagcgctctccccgggtccagcgcaaacaccgtcccgactaactcagggacctccatcaatctagccagcgggctctcgaacggcgtcgcgatggccagtagtggccgcaccgtcaagatctgcatgcagcatccggaatacgaacggagtcagctcgtgctcgagctcatcgagaacgagggacagaaggagtaa

SEQ ID NO: 12646 - DNA, 183 bp, A.fumigatus
tttgggctttgggggattcccgtcatgacatactccgtccagccccagtatctcgcatacgtctccccatggggtttgcctcctttaataacatccccatatctgcccgatacggctatgatcttctctatccagtttctggggttccttcccacgtcttggtttctccatgttatatattga

SEQ ID NO: 12647 - DNA, 282 bp, A.fumigatus
tcgggttcattgctgacttgtctttcgcagacgttctacgtctttggtgccgccatgttcgcctacatccccatcatctactgtttcttccccgagacggccggccgcacactcgagcagatcgacttcctgttcgccagcaagagcccctttgtgtgggaggaggagaaggagtttgccaagcgcatgactcggttccatgccgaaatccaaaagatggagatcgagaacggtggatatgcgggcgagaagacaggtgaggagtttgtcgagaaggtctga

SEQ ID NO: 12648 - DNA, 264 bp, A.fumigatus
tcttctctatccagtttctggggttccttcccacgtcttggtttctccatgttatatattgattcgaaaagtaccctattcccccccccccctttttcctctgcaactcggttcaccatgatgcatcgacatttctggaagacggtccctggacctaggctgctcaggttgatcactgtcgtctcggctgtggccatttcctatgagggcatgagtcagggggtcatgggcgctgttaatgtcgcccccgaatatggagtatga

SEQ ID NO: 12649 - DNA, 972 bp, A.fumigatus
tcgaacatcacactgcagcatcggatgggcttcgccgatgagcagggaaaagtcatcaagccctctctgcaaggtggcatcgctgccatgtattacttgggcgcgctcttcggcgccttctgggccgggagcttctcggacgcctacgggcgtatcaaggggatctggctggcgtgcgcctggtgccttgtcggggccatcctgcaggctagcgccgtgaatcttgctcacatgctctgtgctcgggtggtcgcgggggtcggagtcgccttcatcatcgtgattgctccctcgtggaccgcagagctggctccagccgcacatcggggccaaatgatcgccgtgactttcctcgccaactttggaggcattgcgctgtcgtcctggattggcttcgcgacctcctttaccgactatgcgggcggcgcctttcgatggcgcttctgctttgcctgccaagtgattccgattttcttcctcgtcatcggcaccctgctcattccggaatcgcctcggtggctcgtcaaggtcggacgcaacgacgaggcgttcgagatcatcaccaagctccggggagatggcgaccgcgcccacccgaatgtgcagaaagaaatccgcgagatcgtcgccgtcgtgcaaatggaacacgagtcgcagagctccagctatctccaaatgtttttgggcatcggatccggggacattcacattggccgtcggatccagctggccttctggctgcaggttctgatgcagtacggcacggggatcgcggcggttgtcatctactcggggaacatctatcgcacggccggcttcgacgatttcaagtccaactggctgtcggccgtgtgcatgacctgtgggattctgggaacgggcattgccgccttgaccttggaccgagtgggtcgccgatggaccctctactggggagcggttgttctgagtgttatcctctttaccctgtaa

SEQ ID NO: 12650 - DNA, 345 bp, A.fumigatus
gtattcgaatcgtcgtcatcctggccgtggctcctcctgacgttttccaggggtggtctcaaccggggagccgtcaacaaccccgacaaggccgaacagtacggaaccggagccgccgccatggtgttcctctacgtcgtcgtcttcagctcctcctggttgatgatccctttcatttatcccacggagatcttcccgacctggctgcgtgccaagggtaacgcctttggtgttgcgggctgggccgtcgggtacggcgccgggtcactgctggtcccggtcatgtttgccgggatccaggagaaagttagtgcagtcctccaccttgatcgggttcattgctga

SEQ ID NO: 12651 - DNA, 207 bp, A.fumigatus
tcgggcgctgctataatcatctactcggggattggcatctcgtatgccttgtactggtacggatacctgctgttacggcatatttcagcgactcacgccatttcgctaggtactgccaccaccgactgcggacaatggtccgctccatacttgtcactgagacctttaaagccgccacgagagtccggctgggagcagggatcctga

SEQ ID NO: 12652 - DNA, 246 bp, A.fumigatus
gatgcaaccaaacacagtcctaaggagacaagcggaatattttcgctaggtgtcttcttctggctgaataagctcttcttggctggatataggcatgtattcacaattaaaagcctctacccccttgacagcaccttcgacgcacaagccctacatgaggaattcgcgaagaaaatggactacaccaagctgaagggagataaatttggccttctgaaagtgctagtacgtacattgtgggtgtaa

SEQ ID NO: 12653 - DNA, 813 bp, A.fumigatus
ttatttccatcgattgacttgataaatgcagggcttacatactggagtgacgccactgagtctatccatcctgcacaccccaactcctactatgcagggatctatgccctcctgcagatttgcgccatcatcgccctcctcctcctcctaggcataacactcttcatagtctctgtgaagaaagctggtgctaatctccatcagcaagccttaagcaccctgatctgtgcaccactccccttctttactaataccgacactggggtggtcacgaacctcttctcccaggatctcaacctcattgacactgaacttcctgaggctattctcaacaccctcttttgtttatttcagtccattggccaagcagctgtaatgctcacctcgtctgtctacctggccatcagctacccgatcctgggcggcttgctctacttcgtgcagaaatactacctccgcacgtcgcggcagctgcgattgctcgacctggaggccaagagtccactctacacgcatttcctccacacgctcaaggggatagtcacgctacgcgccttcggattcatcccgaatgacatacacaagaacatccgtctggtggactccagccagcgcgcggcgtatctcctcctcatgatccaggagtggctgaacctagtcctcaacctcgttgtgatggtcatcgcggcagtcctgacgacgctggctgtccggctgcattcgaactgggccttccccggtgcatcactgtactcgctgatgaagtttggtgatagcctctctgggattgtgatttcctacaccagactggag

SEQ ID NO: 12654 - DNA, 1770 bp, A.fumigatus
tacgtacattgtgggtgtaactattcctgcctattccccccgagggcggctttgatggcattttacagctgccaccttcttttcatcgagagtcttatcacgtatctgtctcattcggatccagatccaaatgtgggatattggctaatcgggcgctgctataatcatctactcggggattggcatctcgtatgccttgtactggtacggatacctgctgttacggcatatttcagcgactcacgccatttcgctaggtactgccaccaccgactgcggacaatggtccgctccatacttgtcactgagacctttaaagccgccacgagagtccggctgggagcagggatcctgattaacttcaccggtgactcgcaccgatcctggatgtccggggtccagaaacgggtcgggctcacagccactgtcatcgccagcatgaaatggcacaagatatctggtctcgctggtcccgttgccgagtacgtgcagcagctgcgtgttgacgaactcgctgctggcgcccgataccgcaggatcatgatcttcgcagccgtctttgcattcatgcgtcagttgatcagccctccgctgaccttcgctttcgcccagaacccgctaaatgcttcgaccatgtttaccagtctttcgtttttgactctgctgactcagccgctgtcgcagcttttccagtcgatcccagagctcgtttcgggcctggcctgcttgggtcggattcaggtatttttggaattagagcctcgtcgggactatcggcagcctcaggttgaagcccagagttgcggcatggagaagagttcaaaacagctaaacctaaaatctacggattgcatcgtcatccgagatgccaacttcggatggaaagcagacaagttcgtcctgaacaatatcaacactcaaatccccgccgcgtccctgacaatggtcatcggtcccgtcagctcaggcaagtcaacattctgcaaggcgcttctaggcgaaattcccttcagccaaggcagcttcgtgatgagcactcccccccgtcacgttggtttctgcgaacaaactgcctttctttggaacggtacgatcagagagaacatcgtcggattcacgccctttgactgcgagcggtatgaccaagtcattgaggccaattccctacgcttcgacctcgccaccctactgcagggagaccagacgaatatcgggtcagacggtgtagcgttgtcgggtggccagaagcagcgtctgtctcttgcgcgagcgctatatctaccttcagactttttgatcccgggcgatgtgttcagcgggttagatgctgatacagaggagcaagtctttcggcaggtctttggacccgatggtctcctgccacgacggggttcaacggtggttctgtgcacacatagtgttaggcatctcccgactgcggactacatcatcgcactcgaaaacggcagcattgcagagcagggcacctttgtccatttgtcaacccgtgcgggttatgtccagcgtctggaggtgggactaaagccggaaggcgaggataccaatgctgacgatgagcctggtccttgtcccaaacttttcgagggccagactaggactggcaagaaactcgaccctgcgatcactgtaaacagcacgcaatcatccaccttaaatgcctcagcagaggccggagcccggcaggttggtgacgccaccgtctacaaggtgtatatcaaaagcatgggatggtttgtggcccgcttgtag

SEQ ID NO: 12655 - DNA, 2478 bp, A.fumigatus
tcagatcgctttttctctggatcaacgagtcgatctcgggtgataatagctcgcttggctttgtcgcaaaacccaggcactggctcgctggcccttcgccccactcaattgccttcccttgtcagggctgcatgtcagcttctaagccgttgctccctcgggttagtgtcagacagtccaaagtatataaagtcagaggaatcgtggccattgggccccgcgattctttccttctcgttagtttcaatgtccggtcgacctggactcacggagaagcgtttgtcggcccatcgctttcaaccgcttccggattactcaaatgataccatgatggccagtccacacgacgtgacgattgatattcccctgaccaatgtccccagtcgcactccgacgggggcgcggagggggagtgcacacacggccacttctccagcggcctaccaccctccccttgacgatgttcacaccaacaccagcgagaaggctggtttggtcgccggtactggtcctggccgtcgcaagagaaccgttgacgactcgaccggccgttcgctcgaggatcccgaagatggcactcttacgcggatggggaagatttaccaggccatcctcaacttctccatcgttaccaggtacattatctatgtcaccccgatcgcgctcttgattgcgatcccaatcattgtgggcgccacggttgcggaagatgcgagaattggcggcgtgacactgccttggttctttgcctggattgaggtggtctggttgagtttgtggatctgcaaaatcatcgctcatttcctgccatacctgtttcagttcctctgtggaattgtcagcccgggcactcgcaagtatgctctcatcctgcgcgcactggaactgcccatcgcgacggtcttctggaccattgtctcgttggtcactttccttccggtcatgacctataaccccgagaagaagcggaccggcgatacttccaccaagccatgggaaaagtccgtcaagaatatcctgttcgctttgtttgtctgtagcttgattctgttggcggagaaattcctggtccagctcatctccatcagctaccaccgaaagcaattcgacttgaagatcaaggagtcgaagcggaacattgaactgatcggtcagctgtacgacgcctcccgcaacatgttccccatgtactgcaaggagttccgggaggaggatctgatcatttccgattcgctcttgactgcagccaccgcgaagggacccatccactcccgctccagctcctcgatgcccctcaggctgattcgcaatgtcggccataacgtgggtcgatttggtgaccgagttaccgccgcttttggtggggtcgcccacgagatcaccggcaaggaagtgtttaaccccacctccgtgcgcggtattgtcacccaggccctggagcgccgaaagcccgccgaagctttggcgcgccgaatctggatgtctcttgtcattgagggcagggatgccctatacccggacgacatccccgaggtcttgggagccggcaaagagatgatcgcggaggaatgtttccatatgctcgatcgcgacggcaacggtgatatcagcctggacgagatggtgatggttgttggggagattggtcgcaaccgaaaggccctcaacaacagcatgtacgatgtcgaccaggccatccatgtcttggacaacctgctgctgaccgttgccggtattatcgcggtgctggttttcatttcgtttgtgaccagcggtttcggcaccgtcatcgctgctggcgctacttcccttctctctctcagtttcgtattcgcgacgaccgcccaggaagtcctgggctcgtgcatcttcctgttcgtcaagcatccctttgatatcggtgaccgcgtcgagattagcgacaaggattacatggtcgagcgcatttcgctgctgtacaccgtcttcaagtcggtgacggatcagcgcgtgactcaggtgcccaacgttgtcctcaacactctctgggttgacaacttcacgcgttccaacgccatgcatgaaacactcaagattcccgtcagcttcgacactacatttgccgacatccagctcctccgcgatgagatggaaagattcgtccgtgacaaggagaattaccgtgacttccagccggatgtcgacctggacgtggtcggggtcggcgacatggacaagctggagctgaccgtcagcatccgccataaatccaactgggctaacgagtcgatccgtgccatgcgtcggtccaaattcatgtgtgccttggtcagcgccgtgcgcaagattcccatccgcgctcctggtgctgctgcggaagacgccgccggcgacagcgagaacaaggacgacaaggacgacaccaatgacaagcctcacaagcctgacgccgataacgcagagcagaactacttcacgcggatcgtctccggccggtag

SEQ ID NO: 12656 - DNA, 252 bp, A.fumigatus
ccgtcagcatccgccataaatccaactgggctaacgagtcgatccgtgccatgcgtcggtccaaattcatgtgtgccttggtcagcgccgtgcgcaagattcccatccgcgctcctggtgctgctgcggaagacgccgccggcgacagcgagaacaaggacgacaaggacgacaccaatgacaagcctcacaagcctgacgccgataacgcagagcagaactacttcacgcggatcgtctccggccggtagc

SEQ ID NO: 12657 - DNA, 1461 bp, A.fumigatus
gattttagctgcctcccaatcacactatatgtacatctgaagtggatcaagatcaatgagacatcacggcccagaacgccgacgaacagtggggtgtcaccgagagagtgtataaaaaggttgtctttctctgagaggaagtctagtgagcaagcaactgatcctcagtcatcatgctctggactctactacttgctgccctgcagggacacgttggtatgtatcctaatccaccaagatgatataggtctgacaaggtcagccttgggtctggctgtcacggccagttccatcacaatcagcccatcacccaccagcgagccatcaacgaccagtggccagtggctgataatctccggcacgtccatcttttggcccacatataccgactacttctatgggccaacaaccggccccgaagcgccggttgtaacctgcaacgcgaaatgggttgaatattatggccggtccgacggattacgctcgctgggccccacgggcacgagtatcacctttgacccatatccaaccagcgggggggcctgcagaacctcctcgtcgctagagggctactcggatactcatacaggacctgtgacaaccctttgcgacggtattccacgcgcgctaggccctcgtgagatggtgacatcctactatcccggcacaggaccctgcagcacttacaccattacctttacggacacggttgagctctaccgggagccgccaacgcccgactgtgagctcaacacgcaagaatgcattccgatctggtcgacgtatagtgaactgtccagttcgttcgacgccaccgccaccaccgtcactccaggcgacaccaagagccccatcccacccgatggctgtccctctacgacgcgaacctaccccgaagacccctgcacagcctgccatttcctccccggcacggcaactgtcttctactggcctgtgaccaccgccggtggcgacctgtgtctgcagaacggcaccaccatccctgcgacaccaaccggaaacggccccaataccgccgtagtcaacgggcagaccttcgtctccccaagcatctacgtctcatttacctccatctatgcctggagtaaccggcgcgcccatccgggaagccaatgcggcgacacgcacaacgacgccatcatcgccgtggatcccgccagcgtctcgtcggtccgcaaccaccgtaacgcgaagtaccccaccatcgggactgcgtatccgttcaactttgccgagttcatgccccaggatgtaggcaactataccatgccactgataccctggccgcagtaccgaggaggatcgcaatgtccgctgtacgatccttcctgcacgatgatccgggacgattacatgcctttgcctggatgttcccaagccttccgccaaattgatccgctttgggaccatggtgatgccccttggtattccccactgtga

SEQ ID NO: 12658 - DNA, 1566 bp, A.fumigatus
ttggagacacagtggtcgacatcccagagttctcgttacagtccccgccactcagttctttatcttgacctctgttattctcctaaaacggctgcagccatggcgtccgatctgacaaactccattctggacgccctgtccgcgtccgacggcccaattctctctgacaaagccttcccctctaccccctcactagatcttaagagtgcgctcgaccgtctagcctcgcgaagtatgatcgaatatgaaagaatggaaagagaagccattgctttgacccaggagggtgaggaaatcgccgccaatggcagtcacgaagccaaggtcttccaggcggtattggcggccatggacggattgaagatcggtgatttgcctggcattgtcggaaaagagaacgccaaggtcggccagggtaatgcattcaagaaaggctggatcaagaaggacaaggatgtgttaaggccgaacaccgagtccatcgtcgacgagacccaggagcagctgttgaccgtcaagaacacgcagaccttgagcgatcagaaggccgtcgcggatctcaagcgtcggaaattgattgctctgcagaaggtctttaccttccggatttcaaaggggcccaagttcgccaaggagtttgtaaaggaggagaccgatctgacgcccgaaatgctcgcaaacgggtcatggaagacggttacactgaagccgtacaatttcaaggccaagggtgctcctacgccggccggtgccttccaccccctcaacaaggtgcgacaggagttccggaatattttctttgagatgggttttgaggagatgcccaccaaccgcttcgtggagacgggattctggaacttcgacgccctttacgttcctcagcaacaccccgcccgtgatcttcaggatacattctacatttcagaccctgccaccgccgaccctccacgtgaagatcccttgaacgatccccaccgtctgaaatccgttcatcccgcctccgtagtgagctcggagaaacccctcgactacaaagagtactgggagaatgtgcgccaggtccacgagaacggaaagtacggctcgattggataccgttacccctggaacgcggacgaagcccttcggttggttctccgtacccacaccacctcggtgtcgacctacgtcttgcacaaactggccgcgaacccgcggccggcaaggtacttcagtatcgatagagtcttccgtaacgaggccgtcgacgctacgcacttggccgagttccaccaaattgagggtgtcattgctgacttcggtctcaccctgggtggtctgattggattcatggaggtcttcttcgcgaagatgggtatccaccaactgcgcttcaagcccgcctacaacccttacaccgagcccagtatggagattttcggttaccacaaaggactgggcaagtgggtcgagattggaaacagtggtatgttcagaccagagatgctggagcccatgggcattcccagggacatgagagtctacggatgggggttgagtctcgagagaccaaccatgattaagtga

SEQ ID NO: 12659 - DNA, 237 bp, A.fumigatus
ccctacgtcccccgcaagtgcagcgccaccaaccgcatcatcaaggccaacgaccacgcctccgtccagatctccatcggcaaggttgacgagaacggtcgctacaccggcgagaaccagagctacgccctctgcggtttcatccgtgcccgtggtgagagcgatgactcgctgaaccgcctctgccagcgtgacggctacatccgcaacgtctggtccgccagccgtcagcggtaa

SEQ ID NO: 12660 - DNA, 234 bp, A.fumigatus
tgctattctcttccctgtaatatctctctacacattctccatttagtccttctccagtcgcacgacagggttggtctcgatgaagttaaggtcgactttgtgaccgagaagctctcgaatattgctcactccgtatctgcgaaaaaagaaacgtcagttcatggactcaagggaaagtacggcagaactcacttaatcatggttggtctctcgagactcaacccccatccgtag

SEQ ID NO: 12661 - DNA, 900 bp, A.fumigatus
actacattgtcaggcttcaaatccctaactcaagctcagctcttgtccgatgctctgtactatactccaagtaccgactctcagccatggcttatctattacatctcccggccgttgatcggcttattcgaccctggcaaggtcatttctgctgtggtgcccgggtcgctacctcaaagggtagtcacaaatactggtgccaagtctggcgattctaccacttcattaccgaaaaaggaaatcaagtcgttcggagaactgctggccaattttcctatgatcgcaagacagatgcagccaggcttggacagactatttcgagaatttgggaaagaactggggaagccgttaccgccacctccgtcgcgctcgccttccatccctgatggctacgaacgtaaagaggatcgcgatgaatcttcggcggatgaagtcgcttctattcggagcgcatcgtcccgcaacagagatggccttccctttaattccgaggagtacttcgaagatgatgaggacttgatgcgccgcagtttggagacagcagttaccgccgccatagatctgttccggctcgtggacaaacagcagttgtccttcctcggcgcgacaacagacctgactggacctctggtacaacggttgattgagcgctatgttgccgagcaagtgcacgaatcgctgctgtttcctcgactgtgcagtttccgtcaaccagaggacgcggaactggattccagaatccgtcatatggagaatcttgatgtttcgcaggtaggtatcgctgtcgaaggaggccgagagggtaaaagagagctgctacatcggctcgggagagcggtcgaggagttccgaaagatgacggacgcaaagtgcccgcacgacatgctcaatactttgctg

SEQ ID NO: 12662 - DNA, 420 bp, A.fumigatus
gggggggacgcttgtccttccagccccgcggtgaagacagcctcaggagtacctgaagaacgggtactcacctttgcgcgtcgcgcagctgctcttattgggttggatgccgaaaaggacatttctatggatgatgttcggcttgatgatcggttcgctggcaccgcatatggcgttctagacgcccagacaagcacggcgctggacttaatggcgaaaaaggaggcagtaatgctagatcccgtatatacttcaaaggtcgtacggggactcttgcactgggtacagcaagaggagctggcaaaggactggtcacttcgtctgggagatcgagaacgtcccgactgcatgaatgtgcttttcatccacactggaggacaggctgcgttaggcgcctacgcagacatggtcgaattatag

SEQ ID NO: 12663 - DNA, 1128 bp, A.fumigatus
ttccgtaggtatcacggtaaatgcttaaagatcgcaagggggaaagtcaaggagtttgacaagtatacttgtcccatctgtgactggcgccagaagattccccgagatgctgctcgccccaagctcgaggatctccaggattggcaggccgaaatcccaagtctcccttttcagcctgacgaggaacaagtcttggagaatatcatcaaccaagcaactaccttccgtgattttatacagagttttaccaatgcggcttgcacgacgacggaagaggtgcctacgttaattttctacctgcgcaagatcgagggcgcagaagtgttgttggcatatgagacgaattttttccgccaagagatccataaatgggcacctgttgctccggaaccgccaccaatactggagcagtccctgtcgacacgcaaaccacgcccgacaaagcagcagaaaataatggcgcagttgggcgttgagcgtccggaagatcttcctcctcatttgcgtaccaagcaaccaaaccatgcgaagagaaagtctctcgaatcgcaaacccctcgaccggcaacactgcagcgtacatctcatactccatgtgaagactccaatcgcaccggcccagcgttgactccgatgacggaagcacaaaatcccccgtatcctttctctgccaattactctcttcctgctagcgactctactccggcatttgcacccggagcgtctgcattcctgccgcatgtttcagcccactcgccttcattccctccgcgatctccatcgccgcatcatgggctcgacagcgctctgttcagctctcctcggtttaaccgagatcctaccgagggtcctccagtagttgacgttgacaatcaggacccctttaacagtagtcctcgacaaaatctggatgatgttttcgcagatttgacgaaccaagatgcggagcccgagccagaaccggagcctatggagaacacgcatgctaacgaagcattggaggcactcgatgcaagtaacggcggggaccactctgacgctatgcaagacgacaactctcctgatactggagtaaatggtgacatgaacggtcaagccgacgcagagaacacgacagagagttcttga

SEQ ID NO: 12664 - DNA, 1191 bp, A.fumigatus
tttggtcccctgatcctcgcacccttgagcgagatttatggccgaagaatagtgctcagcttcgccaactggtttttcgtcgtttggctagtcggatgcgccctggctcccaacattgagtctctcattgtgtttcgatttttatgcggaataggaggctgcggctgcattaccctcggggcaggtctcatcgctgatctgttccccgtcgagcaacgcgggatggcaacatctatctggagcttgggtccgctggtcggccctgtcgccgggcctatctgtgctggttttataggtgaatcaatcggctggcgctggatcttctggattctactgattgcaagtggagccatctcattcggaatcgagtgtctgaaccgtgagacgtgtgctcccgtgcttatacggtggaagacagccaaactggccaaagagctgggtcgtacagatttgcacagtgcatacgaacctgacggccaaggcgtatcagtggcgtcaaccctgaagctgggccttatgcgacctttgcagctattcttcaagtcgcccatcgtgtttctgctttcgatctacatgtctctcacctacggcctcttatatctcttcttcaccaccataccctcggttttccaaaagcaatacgggttcagtacgggactctctggactcgcctacctaggcattggcattggtttcttcgtcggcctcgcgctcatcgctttcacgaacgacaggatcttgatgaaattgacagcgaagaacggaggcaagtccgagcctgagatgcgcttacccaccatgatcttcttttcctgcttcttgcctgtgagcttcttctggtacggatggtcggcagccaagaaggcgcattggatcgtgcctataatcggcatgtgccctttcggcatctcgttgatgggcttgttcatgccaattcagacgtatgtcatcgattgctatcctgcttatgcggcttccgcgaatgccatcttgactgctacacgatcattggtgggtgcgttggtgccccttgccgggcctagtatgtttaacagtctgggcctgggctggggaaattcgttgctgggattccttgctctggcttttgtgccgatccccatcctcttcaccagatatggcaaggctattcgagagaagtttccggtcaatttcgatgggaaaaaagcttaa

SEQ ID NO: 12665 - DNA, 309 bp, A.fumigatus
agacgcttcccagaaacaaacctctctcgtgggattgtcggatgggacgggcaaaatgaccctgcgaacccccagaatttctctgcaggccaaaaatggggtctactcgccctcatgagctctatcacctttctttcaccacttgcgtcgagcatgttcgcccccgccgctagctatgtggctgttgacctcggagtcacgaatgagacgctactttccttcagtgttacaatctttctattaggttacacggtgagaatccgtcccatttacatctggttgaggagcacacagaataaggaggcctaa

SEQ ID NO: 12666 - DNA, 264 bp, A.fumigatus
attggcatgaacaagcccatcaacgagatgccgaaagggcacatgccgattataggcacgatccaatgcgccttcttggctgccgaccatccgtaccagaagaagctcacaggcaagaagcaggaaaagaagatcatggtgggtaagcgcatctcaggctcggacttgcctccgttcttcgctgtcaatttcatcaagatcctgtcgttcgtgaaagcgatgagcgcgaggccgacgaagaaaccaatgccaatgcctaggtag

SEQ ID NO: 12667 - DNA, 534 bp, A.fumigatus
atcgaaagcagaaacacgatgggcgacttgaagaatagctgcaaaggtcgcataaggcccagcttcagggttgacgccactgatacgccttggccgtcaggttcgtatgcactgtgcaaatctgtacgacccagctctttggccagtttggctgtcttccaccgtataagcacgggagcacacgtctcacggttcagacactcgattccgaatgagatggctccacttgcaatcagtagaatccagaagatccagcgccagccgattgattcacctataaaaccagcacagataggcccggcgacagggccgaccagcggacccaagctccagatagatgttgccatcccgcgttgctcgacggggaacagatcagcgatgagacctgccccgagggtaatgcagccgcagcctcctattccgcataaaaatcgaaacacaatgagagactcaatgttgggagccagggcgcatccgactagccaaacgacgaaaaaccagttggcgaagctgagcactattcttcggccataa

SEQ ID NO: 12668 - DNA, 198 bp, A.fumigatus
atgctagtatcatccccccttattaccctgtttttggggaacaaatcagattcaggccccgaggtcacggatggaggaaccatggttctgtatcccgtagtcggtgagttatgcattattattgctgcatcccataaagtgaagaaccaggctaacctaactgtcttcggttcttggtccgaagcttccggtacttga

SEQ ID NO: 12669 - DNA, 1449 bp, A.fumigatus
cagcaattgcaccgtgttattgcggctgcccaagtctggaatccggtcaatagtctcttggacgaatttcaaaacttcatggccaaaaaggggtcgctcgcggaggcgaccggaattcgttctgtcgctcggaggtatctcgaccggctggaagctgtgtttgcgcgggacatctcgtccgagtctggtcactgcatgatgtgtgatcacgatgagatggaagaacgtccatcaggagtgagctggggtgaggtgcttgagctagtatctggtcgcagagaactgcttagctggcccccattcatgatggttccgtcagtagaagccgacatctcgggcgacgagcacatccccatgcaaaagatggacattgatgtacccgaagagtaccgtgatcattatctccggcagtcacgcaagaccaaggctgcagtggataagtggttgaatgaacaagtcgcacagcctaccagtgctcccgaggaggtggatgatgagacgttgacctttgcaatgctgacacatctgggccccgagctccgtccattgttctgctcgctgttgggtattacatccacgtctacacccaccccacggacggacgaccagctgcctcgagctaaaccgcaggcgcttgtgtcatcatcaatcgccattcaacgcctctaccggctctccactttgccgcgtgaccctgaaacagcaatttatatgttgaacaaccccggtatccaccatgtactggcgacacttgctgcgatcagtgatgacgaatgggatatcctcatctcgggccgctttgatggcttcctgcgcagcggcgctgaggatccgatcccaggcatcccaggcgcgacccccacgcgctggagtagcagccgatcgaacacgcctttcacaacaggaggaatgtcccgcggtccgacacccagccacatggaaggtggcgtccgaccggccagtcagccgtatggcgttaattcgccatcgcctgcatcgttcggtgggcccattgcgctggacgaggagacggagattgcggcccttgctgagattgagcgtgagattttccttggaatggaagccctcgaggacgcttttgaagctcttcactgcaaggcggaggccgtccggcgcacgctacgcgaacgcggcgcaggcctgtccatcgccaaccagaaccgccgtggatcgtacgtcgaggcacgactcggcactccatcgtccgccctggggacctgggaaagcggaacggaggatgatggaattgacgatgaccgatcgctggcacctgatgactcggccagcaacatcagttccaaccgtcgacgacgacccaagcgacgcaccgaacgacgcacgcctgcgcccgtcgaggaggaagatgaggaagaggaagagtcccatcccagccgccgcgaccgcgatcgaggctcgcgaaggagatga

SEQ ID NO: 12670 - DNA, 402 bp, A.fumigatus
tgtaagtgtgactggggtgagagttcagcttgggggtatttcctatctacacagtatcagggtagccagcctcaaaattgggcatctgctcgtatataccacatgaacaacaacaacaacaaaagagttgctctaccccaagacccaaatacgccgatcgaggatgagcctccattcggctcgactgatccttggttgatgccaggtgcccctggttccttggttgcggttatggttcagtcagttatcctgtggaacgcaagtttgactgacgggactgacacgccgacaacgagcggccttccatggttgagagcgtgtagtcagtccatggaacgttcaagtctggtctcgagtctagcctctaaggagaacggtatacgccaatggaggactccgtaa

SEQ ID NO: 12671 - DNA, 882 bp, A.fumigatus
cactttctcagctcttttgccgcaaacggaaagacagagcagcccaggatgttcgctcaaccattcgatcatgccttcaatgatttgttcagccagtacgtcgacatggactcatcgatggttgatggcaacaaagacgtttcaattccaagcgactttgaccaaatcttctctcttgactcgctgtcaagtgattgtggcgatcattcacccccagtccccaccaaacccacccatcagtcaccgcaaccgtgggccacagacttatggtctctgccgcaagatgcagcctcatctgccagccaatgcagttttacatttcaggacactgtgcatccctcagctgtctcggacctaagcttccaccttgaagctcctcctacttcacatcctgtccctgcagttacctgcaaagcatcctcccgatcaccgtccactcctcccgcaactccccaccacaaatccaccaaaagtgctctggtcactccgaaatctatccgtcgtcaccgagattcccatgagcgtaaactgctgcgcaaacagagcttctccccgagcttgatgcgcccttcccagctgcaggcaggcagaatgatgtatcccgaagcatgggctcagcggtttcagaacttcagtcttcatagctcgggcgagcacttgccgctgtcaccccctccatctgatatccttgtgcaacatgagaacacccctgcggacaatgttgtcacccatatgaaccattcgactgaaggcttgtccagaaatcctgcagagatggcttcgcattacgagactggcatctttaaccattcaccagcaatcttctatgccatcaccgtccgccaagttgctaacgcaacagcagcagcacaacctatttga

SEQ ID NO: 12672 - DNA, 801 bp, A.fumigatus
cgtctgatcccgtatgtagcagcatcgcatccaacgagtaaagctgggctcatccagccaacgacaatgcccctcatccctgacgattcaagtctcgcgtcgcaccataatatttcctccccaccagaacgcctggttacaaggagtactcctgcgtccgccattcatagtcgagaagcctccgctgtgaggggaagagcagccgatccatccgctctagccccctcgacgctacagcctcagaataatcgtcgtggccaatctcattcgaaaagtcctgatccgactgctgcacgccccggtataggatacgatgtaagcctcgaaagaaggccttcgaactcatacggtcaccaccgacagacttcgattgtccatggcgtccaacattctcgaaatccgagttttgctgcctcctccaactctacgagtcctctgagtccagagttgatcgcgtccctcggccgcggcgctggaaatgaacaggagataagtagtgcagggcggttggatcagaacgagatgccaacgattcatcatagccctggaggcaatgggacgagccatatcttgcaagggaccttgagtaccatcgaggatcaggatactggcgaggttggcaacgcaaactcggcgagctcggtgcatagaaggatgaactcggctggaaaatcctggaaagagcgctctcatagccgctcacactcgagacaacaacactcggaatccaagactgtcggcgaatatgccttgcaccatctttttaattcagtaagcacgacattttgtacacaacgctag

SEQ ID NO: 12673 - DNA, 291 bp, A.fumigatus
ctgcttcttcagttcgtcggtcaggcagacaacaaggtcaatcaagccattatgaagcttggacattcggatgctccggtagaagaggtttgcggtcctggcgtggatccgaacttcgatcaattgatctcagctttgggccacatctctcgacagaaaccaaagccgttgatcgacaccataatgctatggcgaaaagccaaaggagacgcagccataatggctaagcaagctagtcaagtatgtcacgagatcatgaagccgctggtctatatagcattgaaaggttga

SEQ ID NO: 12674 - DNA, 651 bp, A.fumigatus
ctcgtgcttaaacagaagccgtctacctctgataatgtgcccatcgcgcgccgtaatacagagccgtcccagaacgttgttgattcggcagcaccaacagattctacgacgtccagcaccatcctaacacggcaagaagatgtcgtcttagctgagcgccgtgcgactgtgtccgtgtatcttgtttgcagagtcttgattgagatattcaaccagagcaatatagcatccataacgattgacatggctgagcgtttggaggacatcgtctttggtcaactcaagacggttgacccggatcagatatcagcgtcaccgcttcgcatggctaattggcggatctattcccagttgcttggtatcatgagcgagacgaacttcacgagtgtcactggtcgcttcttagcagaactcgaacgatatcagaaggaagaaatgctccgtgggccgtcaagggagggtgactctcgagcagaacttctgatcttgggaatgagacacattcgtatcaggacctattcggataactggagtaaatcatgcgacttcatgcgatcattggcccccttgtttggcaatgctcacgggcaacgcttcaaacaggttacggttaccttttccaaaaaatcctcctggccattaccaccaatt

SEQ ID NO: 12675 - DNA, 1161 bp, A.fumigatus
  unsure (118),(169): Identity of nucleotide sequences at the above locations are unknown.
ttaagcatgtcacctcccgagattgacgacgaaaagaagccccggtctactgatgacagccgtggttccgcacgcatcgtatcatcaagggagtcaaaacaaccattcccgcctctcnccgcggatgaacatgctacaaccatgcacgatgcgccgaacaacagctacncagggctggacgactcagacatgctttcgcctacaaccgatgatcttgtagaggaggaggaggatccagacttccactccagctattctctagacaatcagtcattctccgacgagtcaatggaatccgatgaagaagctgctgaagatggcatcgccatgcaccacccgtttcgccagtcttcgagttccctgcacgggcccaatgctttcgctcctccgttctataacagacctccgaccccgctaccgccgtccccgtcgttgacatcgcttctccgtccccctttctcgactactacttcccgaccgactacccctgatagctccgatgtggaaacaccgaatgatactgaagcggctgtcgcgaaatctgctcgtcgtgcaaccacggttcctcgtgccagcccgaaagtaccgacgtatgagtattacggctttgtcttatacctggcttcatcactggccttctgtgagtcgaacccgatgcgctgcaggaagagatcgcccattctgatacttccaacagtaatctatatactctggtcctacctaccatccccattcctgcatcagctcggcatctactactatcccaatcggtggtggtcgctcgctattcccgcatggctggtcatgctgatcatctacatatatgtcgctctggcgtcttataacacgggttatctgacccttccgatgaatagtattgagaatatcgttgacgaagtcgccaatgtcgctgtcattgacggcaaaggccgacgacgaccgggcggcgctgccaagatgaaacctggtgcaacatcgtatcagatcatgggaccacagaatcgcaaggtcaactggaaagacatctggtccgagggcacggatgccgtaatggacgtacctgtgggaggagtctgcgaggttttgtatggacaggaaagagacgatggtgaattgagtgacggtcacactgggttcgcacctggcacagcagagacatag

SEQ ID NO: 12676 - DNA, 636 bp, A.fumigatus
tcgcatcaggagatcaatcgcatgaaagccaaggcgatccgcgaacaacgagaggccgaggaagctaagaagagagttgcaacacccagcagtttaagtagcgtcagcggggtgaaacgaacatattcttccatgacagcgtcagagacaccagcaacattacgagatgcgtcggcgaatcgtccacttgatgcgatcaagccggcccgcaatttcgccaagtatgtcgagtatgactttagcaaaatgaccgacacgaaaggaggttttctaacacaagaggatgatccatacaacaaggctttgaatgtccgagatgggaaggaggagcagaaacctgcgcatatgacgcagaaagaatgggaaaggcagcagctggtcgactcccttcgccgcgagcgagcagggccgtttgaacccggactgagtgtactagaggataaaagcaagcagaaaaagtgcagggaatgtggaagtctggagattgactggaagtgggaggagctactccgatgttgtgtatgccacgcttgcaaagagaagtacccggagaagtacagtcttctgacgaagacggaagcaaaggaagattatctgttaaccgatcgtgagtatatcccaaacgcgtttctataa

SEQ ID NO: 12677 - DNA, 234 bp, A.fumigatus
agagcagactgcttagaatctctctgtttactgtctatggaatatagccaactctcgatcaactgtagaattgtgagttgtacacaaatcattttgtcttggacatacgccagccctatattcctcctggtcacatatgcatatacagatctcacagaaaccctaggattttaccagtttatgatactacaatactttgtggcaacaccattctggtgttatgaatggatttag

SEQ ID NO: 12678 - DNA, 423 bp, A.fumigatus
gctgtgtggcacctcgtagtgaagatctcgggtcctgagtacgccagctactacgccgtgcagattacactgaaaggcgcgatatatagcctcaagctgaagtgggagttcgccgtccttggcaggcttgttgacgtgatacacggacatagacggcccatgataggcagggacgccgttcacctttgttcgctggaattcaataccggcccgaacaacggcactgttccgccaggtatgaacggggatgtcaacgtatgtgagatttcggcgatgaacaacgcggaagccgggaagatcaagaggacaaccaccgggagtttcaatgggcgaatctcagatggcaagatcctggcaatgactgagttttcaacatgggttgagcaccggtgccatggaaatggtgaccgaaggatggcctga

SEQ ID NO: 12679 - DNA, 582 bp, A.fumigatus
cgcacgtgtaaggcttcctcagccatggagtgcgacataactaatcatacagccagagagccggacggttgcctagctttaagtgacgaagggtctgagtccttcagctcctccgttggcgcatcccttgccgtagcctcgacgatggccgcctcgtcttccggatcttccggaaggacgaggttgaggaccaatccgatgaccgcagtaatagcaaatccattttccatgacgagctccacagcgttcaacagaccctccagggcatggttatcaccactatacgtgaagaagtacgagaaccagtcgggcaccagcgtagccgccatacccaccgcgaaagaggccgtcagaataaaccggttacgccgggtaaatgggatcgtggagatgatacggatgccggagatggctacggacgagaacaaaaacgtggtcatgccgcccaggacaggcttggggatggccacgatggcagcagcaaacttggcgaagacacccatgacgacgaggaagaagcagcagcagtacccggccttgcgattggcgcactttgtcagagcaatgacaccgttgttctga

SEQ ID NO: 12680 - DNA, 1386 bp, A.fumigatus
gaaacgtctgagtactttatgactgttgcgctgctgagtttgaatttgctagtgactccaggtctttacgtctcgtcaatgctgagtcaacttacatacagcttcaccaacgtccaacaagatgctgtgaaggctttactgtcaactgcaggcatttcactgctttcaattttacccgtaattatcatcattgtccgtcaatatagctctgcccatccaaggcagccgagaggatgccgcaggctaggtctaccaccgggccacaccaacctccacgacgaattcgaccccaagtatagcaagggaacttcaagcgatgtcgatggcaaaggtcagccttcatggagcatcaaagcgctcttcacccatccgatcaaaagctgcgctgcgatagagttggacgtcacccacgtcgtatcgaccggattcgcgtttcgacggcagttctgcttcgcggaacaattcacgcctgaccaagcaagcgccagcgatgggaagacgcacccgtactgggatgcgcggaatctccgtaaacgggccattacagccggcttgacgctcatccggcctgagatctgggtccctgatcccgctgcgcccgactacgcgcctgatctggacgaggtcaggtcccagggtgtgatggtcgtgtactacccacgaccagctgagcgagggcgttcgtcgttcttgattaagttgggggtagccctgcgtctggtcccccgggagctgtcattcagggttccgctcgtgccgccatcggaccgcgccagcgcttatccttctgtaccggtgaggatctggaaagataccccggtggcatacgactacggccggcatcttccgcattctctgcgggagtttctagctccaacagccgccgacgccggtgtctctcgtcctctcaccctcttccgcgtcgaccccacgcaccaccggcaggtcttccgcaacgcgcctcgcaaagaggagctgggatttcaacctgtgacaggcttcgcggacgcgtatcccctacatatcctcaacatcgcgagtgtccatgacgttgccgcgcgatgtgcacgggatatcccccggctctcggtgcggcggttcagggcaaacatcatcgtcgaggggcccgaggcgtttgcggaagatcactggaagcgcatcctgattcgaccagcaggggggaagagcgacgctgactccggggtcgagatacatgtcgcctgtcggacgatgcgctgtcggctgccgaatgttgaccctgccacgggtatccggcatgcgtctgaaccggataggacgctgaagagctataggcggattgaccctggggatccgacgaatgcgtgtttggggatgcagtgtgttcctgctgcacagggttcgtga

SEQ ID NO: 12681 - DNA, 1125 bp, A.fumigatus
acgcattttcccggcttatggttacgggttcttacggttctcttgatcgaagcaagcctcattaaaagtggcatgagggactggcctggtggctctggctgtggatctgacccatccgctcgtgctttgtgtcccagtgctggtgcgccacatgctctcccctggggaagtgccgagttcattggcctcggattcctggttttcgtgacgatcattctttgcgagcggttcggatcccccattatgaaatcgtgcgccgtcgtggtcggccttctggttggctgtatcgtggcagctgcctgcggctatttcgaccggtcgggcatcgactctgcgcccgttgtctcgttcatctgggtgaaaaccttcccattgactatctacgcgcctctgatccttccgttcctcgcgctctacatcgttatcatgatggaatcaatcggtgatatcactgccacatgcgacgtctcccagctcgaagtcgaaggcgcggactttgattcgcgcgtccagggtggtgtgctaggcaatggattgacgtgcctgctggctggactctttaccatcacgcccatgtcggtctttgctcagaacaacggtgtcattgctctgacaaagtgcgccaatcgcaaggccgggtactgctgctgcttcttcctcgtcgtcatgggtgtcttcgccaagtttgctgctgccatcgtggccatccccaagcctgtcctgggcggcatgaccacgtttttgttctcgtccgtagccatctccggcatccgtatcatctccacgatcccatttacccggcgtaaccggtttattctgacggcctctttcgcggtgggtatggcggctacgctggtgcccgactggttctcgtacttcttcacgtatagtggtgataaccatgccctggagggtctgttgaacgctgtggagctcgtcatggaaaatggatttgctattactgcggtcatcggattggtcctcaacctcgtccttccggaagatccggaagacgaggcggccatcgtcgaggctacggcaagggatgcgccaacggaggagctgaaggactcagacccttcgtcacttaaagctaggcaaccgtccggctctctggctgtatga

SEQ ID NO: 12682 - DNA, 1005 bp, A.fumigatus
  unsure (97): Identity of nucleotide sequences at the above locations are unknown.
gggcacgcctggatgttgttccagatgaaaagttcacggctgaggatatcgaccgcccggttgacaaacctgttcgccaagataagcgcccaatccngacggtcccatcattcattttttttgggagccggtgaaaatagcagtttcaacccccagagcctttcgtttgatgccaggaaatgggcccgagccttttacaacgctcgttaccggcaggatgatggccacccccttcgcgtggtaggtgtcgcgttcaaaaatctgaatgtatttgggtatggcagccccgtggactatcagatgagcgttggcaatgcgctcctgaaggtgccgacgatggtccgacaggccctgggaggcggaaaacagcgggtcgatattctgcacgacgtcgagggcctggtgctgcccggagaacagctgtgtgtccttggccctcctggctccggttgctcaacgtttctcagaacgattgcgggcgagacccacggtctgaatgtggatgcagcgtcatatatcaactaccacggcatcagccccaaacagatgtcgacggcttttcgcggcgaggcaatctacacggccgaggtggacgctcacttccccatgctctcagtaggagacacattgtattttgccgcccttgctcgtgccccgcaggtgatcccggggggtctatcccgacaggagtacgccaaacatctgcgcgatgtgatcatggccatgtttggcattggccataccatcaacacgcgtgtggggaatgactttgttcgaggcgtcagcggcggtgagaggaagcgagtcaccattgccgaggctgctctgggatactcccccctgcaatgctgggataatagtacccgaggtctggacagtgcgaatgctgtggaattctgtcggacattgcggacgcagagcgatgtctttgggattacctcctgtgtggccatctaccaagcccctcaagcggcatacgatgtgagtgaaataccactggaatga

SEQ ID NO: 12683 - DNA, 204 bp, A.fumigatus
ggcgtctccggggctgggaagactaccttgcttgatgtcctggccagccgaacgacggtcggagtcgtcacgggcgaaacgctggtggacggacgacagcgggacagttcattccagcgaaagacgggatatgtccaacagcaggacatatcccctctttcggtgttcaccacgagcgcctggatcagcgacaggttacgccca

SEQ ID NO: 12684 - DNA, 1629 bp, A.fumigatus
gtgaaataccactggaatgaacccgctaggcaccagctgatggatggacagttgtttgacaaagtccttgttctgtatgaaggatggcagatatactttggcgcggcgcacgaggcccaagcctacttcgagcagcttggattccagtgccctgaatctcagaccaccgccgatttcctcacctcgatgtgcagccccgctgaacgcattgtcaaacccgggtttgagcacatggctcctcgcaccccagaagagtttgcgcagcgctggaaagagagtccgcaacggcagtccctattgcacgcaatcgagaagtacagcaccgagcatccgcttgacggacccgatctccaccagtttgccctctcacggagggcagagaagtcacaccggcagcgagagaaatcgccatacaccctgtcctactggggccaggttaaactgtgtttgtggagggaatggcagcgtctcaagaacgaccccagtgtcacattggccatgctcatcggaaactttttcgaggctctgatcattgccagcatcttctacaacctcaccggagacacatcctcgttctactaccgcggcgccctgctctttatgatggtcttgctcaacgcctttgccagtgtcctcgagattctgacattgtacgagaaacgcaccattgtggagaaacagagccgctacgcatactaccaccccagcgcggaggctctgtcgtcctttatcatgagtcttccatacaagttcgtgaattcctccttggtcaatctcacgctatacttcatgtcgaacctgcgacgcgagccgggcccgtttttcttcttcctgttgatttccacgtcaatgatgctggccatgtcgatgttcttccgctggtttgcatccttgaccaagaccatcgaccaggcccttgctccttcgtctatcattctgctggcccttgtcttatatactggcttcaccattcctgtgtcgtacatgcgcggctgggcctcgtggattcgatggctcaaccccgtgtcgtatggcttcgaagccgtcatgatcaacgagttccacggacgtgagttcccgtgttcctcttttgtcccatccgggccaggctacgaggatgtatcccgcacgcagcgcgtatgctcgactgtcggagcgacttcgggctcagatgtcgtttcgggcgacgtgtttgtccgctcctcgtacggctacgtcaacagccaccgctggcgcaactttgggatcatcatcgccatgaccgtcttcctggccgtgtgccattttgtgacgacggagcttgttgcttcgaagcggtcaaaaggcgaggtacttgtattccgacgcgggagcgctcatatcgcgcgagcaaagcaggggcagcgcgacgaggaacagccctctgcctctgccgtgccgagtgaaaagtacagtgaggccccgactcctgttgagggtgttgagacgcagacgtctatatttcactgggaagatgtgtgttacgatgtgaagatcaagaacgaaacgaggcggattctcgaccacgtcgatggatggatcaaacctggtacactgactgctctgatggtaagtcttttctgcctgtctgtgacattcgagagacgctaa

SEQ ID NO: 12685 - DNA, 561 bp, A.fumigatus
gttacgcttagcgtcggtctttcgagccccgtggtgaagacccgtgctttcggcatccctgtcaacaccttctctaacgaagtggtgacactgtggtatcgtgctccggacgtgctgttgggcagcagaacgtataacacgagcattgatatctggtctgccggatgtatcatggcagaattgtataccggccgtcctctgttccccgggacgaccaacgaggatcaattgcagaagatcttccgcctgatgggcaccccttcggagcgttcgtggcccgggatctctcagctaccggagtacaaacccaatttccacgtatatgcaacacaagatctgggacttattctgcctcagatcgaccccctcggactcgacctgctaaatcgaatgctccaattacggccagagatgcgcattagtgcagcggatgcactgcagcatccttggttccatgacctacctcaattacaggctcagttgcagcaacaacaacagcagcaacaacaacaaatggctggaggttacggagggatggttccaccacagcagacatactag

SEQ ID NO: 12686 - DNA, 279 bp, A.fumigatus
tggttgctgttcgcatgtcgcaggttcatgcccgctgatgcgttgtggactcttgccatggcatgcaatgtctacttgacattcttccacaaatataactcggaacagctgcgacaactcgagtggaaatacgtgcttttctgctatggcctcccctttattccggcattcgtttatttcttcatagaaaccgaggctcggggaaaggtttacggctcagccatagtaagtgcaacgtttgtcgtaggggaatcagtcatatgcagagttaccctctaa

SEQ ID NO: 12687 - DNA, 252 bp, A.fumigatus
aagaagcatgtgaggctcgacatgcataagatttggacgcatttctttttcctttcctttcgttttcttttctttttttgtctttgtctttctgcttcccctttctactccctaggggaaacagtctttattccgaactggttactcctaatggttgaggatcaaccccttgtgttgcttctaatggacgagttttttattggccagaatctgaatatgaggaatcatctagttcgtagtcctgtgcattag

SEQ ID NO: 12688 - DNA, 840 bp, A.fumigatus
ggcatcttccagccccgtgtgaagacaatgagcaaagcctccgttcagatgatcttatcgactaccgggtttggatcccaggtagatctatctcgaatccaaactgcatctcagcagcatcatactgctaatacgggccccgcgagggactcgggaagatccagttttgaccaacgacagcgctttactcatgtccctcggcggcagacgcaggtacgccaatctcgtcccttgccaaagttcgacatggaccttgccgatctcttcaatgaccccgggcccgttccggatcgcgctggcagcagtacaaggaagccggtacaggcgtatccaaggcgctcagaataccctgaaccctccacaccgaactttggctctgaccttccaccccggcctcatcctcaacgaacaccttctatggagtattatggaggttacgaaaaccctgtctctccgcgaacacagcagcaacaatatttctatagcaattctccacagcacagcgtgtcctcaagcggcgcggcccccaatgtaggccaacaccaattttccccggtggatcaggagagtgccgcagggatcagccttgatttcttggactttgactcgacaggagcggaaaacacagtttctgtaggctcagacggtaatcccgagtataacatgtcagccgtaccctcgctgggccatggggctggccacagtgtgggaatcgacctcggattcggcatggcggtcgacttccagcatgactggagcgagaacgccaattacgatatgctcgaaggttacttcttcgggggatcggtgggaaatcccccaggcgatggttcgatctga

SEQ ID NO: 12689 - DNA, 570 bp, A.fumigatus
gtaaggcgaagggattgcttgcagggttttctttgcgagtctttcgtggttaatctattcccagccctcaagtaccatcccgatcgcaatccaggccgcgagcttgagttcaacgccaagttccaggctatccaggcggcccacgaaattctcagtgacccccagcagcgccttaaatacgatacagaccgactacgtgctggatacggcaagctctacggtccaaacaaagccaatacggctcggaaagcgcctacaaacccttacgcctccgcatccaccgcgaagcctcagactcctaagccgccgttttccagtcgcccgcaatcttttcacaatgggccctcaaccggcgcccagcgatatgctagctacgcgagagcggctcccaagcagccgtgggagaagacgcaggatgaaggacagaccagggcagatgcttatcgtgggtttcaggagatgaaggggatatccccccctggatggtcccatttagatccgcgttctgggcgaacacgatatttgggggctgcccccccggattccacacctaaaggggcaccccactag

SEQ ID NO: 12690 - DNA, 201 bp, A.fumigatus
ggccacgagtcaatctcgcagtcattcaccatcgacacatggctgggagccgggtatgccgctcccaccacctcctccggggcctcctcctaccgccaggtcgcaaagtgtaagtggcctgtcagagacatcgggaatgaggaactcgcagatctcgatgcgaagacggccgccccccgttatgggacccggtttggatag

SEQ ID NO: 12691 - DNA, 2475 bp, A.fumigatus
tctgtacgtctaatagaagaatctttatcaccgccgcccccgccttattttcttccgagccaacaacagcagcatccacagtcaagagagcatgtaaatcatgagagctcgaatagaggctccgtgtctccatccgccgcgccgtcatatcacgttgaaccacatgttgaatataggcagcgagccattccccgaactcgcccgctgtcaatggccagtccaggcgatgcagcgcacggaaggcaaatgtcgcttcccccgcctcctccactaccgcaaggtgctacaggatcgaggtcatcatcgcagagccgcgttgatgcgtatggtgatcgggcttcctttagtacggggcagagaccgtgtaccgccgtctctcaggctcaggagagtctgcagtcttcatcctcggccagtgaacagtaccagctgaatcctactcctcagtttgataatttcactcgtgcaccaggcgccaaaagagctgtttccgcaggtcccatgatcggcagtgcgagctcttctagggccacgagtcaatctcgcagtcattcaccatcgacacatggctgggagccgggtatgccgctcccaccacctcctccggggcctcctcctaccgccaggtcgcaaagtgtaagtggcctgtcagagacatcgggaatgaggaactcgcagatctcgatgcgaagacggccgccccccgttatgggacccggtttggatagcatcccaccaactcccgccggctgggctgatgagggctcgggccagaacggacacaggcaggatagggaactcccgaacattgatacatctagcgcggccctagctaatcgcgggattactgggtcagaatccagggatcccgcccacgcctctcaaacttcagccaacagtggtctcttccgtagcccagctattcgagacgcaagcgccaaaggtattcgcgagaggcgcatcgaacgccgaaatagacagagtcaagttttcgaagacttcagcgccgtctcaagcagcagcaatccttgggctgatgctctagatcaagtgaagccttccgatctcatccttgacaactcaaacgcgagtcatggaaacgggcggcaccccaactcaacgaagtttacgcctcgaagcaccgctagcgccggctctgacgggcagcaacttggcacacggtcgagggcatcctctacaggtctgttctcaggccgctcctccttttccactcccagagcggaacccagtcctgcagggccacctcgcacctttgctcaaactccacccttctcacccgacaacgagaatgtatccccaacgttcgctaaagccgcagcgtcgcaggctttaccaccaaaagctctcccgacacccccattgcaatcgggtcaggacgtgagatcatcgtctcggttgacccccagcgaggaacgtccggtttcccacatattacaccttcctaacgatgcgttgcccgctgtggctccgctgtctccccgccgcctggcagcacagcaaggatcgtccctggactctgttctcagtcaggatttgggatttattcgtgatgccatgcagagacacaaagaattcatcgagaaggaggcaagcgctgtcaacgagacggaggccttgagaattttcgcggatttcatcattgcggagtctcagatcagacgcgagcgatacggcaaagtctgggactcgggcactttcgatgttgaggcagcccgccgcaagctgtttgaattgccgccaaagcccattgtcgaaccccagaacaacatttcagcgactgtatccctttctcgacagccttcacgtgggccacgagcggtaccggcgttagacatacctacaagccgccctgaatctgcctggtggagcaattacaagccttgcttgtcacccatcgcgagcatgagtatgagtaacgatgagatgagctccaggggccggccacccagtcgttggtgggagtcaaaaactggctcagagagtgagggcggcgaacgaaaggttcaacgatcgaagcgagagtcaaagtacatgggagtgcctcgggaggctatgcaatgggcggaagggcaggggtctttcggcgcgagtcaacgaagctacgaatcaaatgcaacgagtcaatacgccgcttatggaccagacgaatacccgcctgaaaaggtcggatggcatgaagagcaagagcctgctccctcggacttccccagctctgcgccacgtcacggatttggacggacgagagaagtccagaaactcgatgtctcgaggttgattactttaccaccaccttatccacggcatcaccctgctgttaacaacagccacccggacctcgttgcataccgaacgctggtgcgtccaattagcaatctctctgaaatcaaagcaaccagacacgggcatcaatccggaagggggacgtttattgaagaaccatcgggagacagttga

SEQ ID NO: 12692 - DNA, 273 bp, A.fumigatus
gctgtgtggttttcggagggggtcatactaatgctttcgcgaaggtttggtatcgaattcgctcccgaggttgtcaaagctgacggcaatgtccacaacctcgcccggaggatatgcaatgcaaaaagggtcctggtatgtagtcgtctgcctccatacctcaccacctatttttttctggccgctgaagctgactatgaatattacatcgcgcaggctccctatagcctgactaggaatggtgcaacgacaccaactgaagggaaagagtaa

SEQ ID NO: 12693 - DNA, 225 bp, A.fumigatus
tcaggagtttttggtaaggtattttgttttcttcaaggtttttgcagaagcagaactgaaaaaaatgtctctcatcacgaagaggatatgggtggtgtgaccgtcaaggacgtgagcaaaacatacctaacagagcctacagagagtgcgagttatcagagactagacgagaagttcctgtctgatgaattggttagcaagactgcttggagcaaagcgagctga

SEQ ID NO: 12694 - DNA, 420 bp, A.fumigatus
gcggagagcaagcccatctggaggcgtcccgttccggatataaaacaggctgtcttctgtgaaggagttgagactgcccactgtgctcaaggcgacaacgctgccgtcgctcagctcctgggtatcacatcccccagcgtgcgactcgactcgcaggccaagtactgctcaattgctagaggcgcaggcgatatctacctacggctacctgtcagaaaggactaccaggagaagatctgggatcatgcggctggcgatctcattgtccgcgaggctggtggacaagtgaccgatatctatggccagcgcttggatttcagcaagggacgcactttggctgccaacaagggagtcgtcgccgctccagaggccatccaggaccaggttattagtgccgtcaagacggtcctgaagctatga

SEQ ID NO: 12695 - DNA, 909 bp, A.fumigatus
gtcctgcctttgcagggaagctgccgaccggtatgttccagacaaggaattatcgatgcatcattgataatgaagttagggacgttggtaccttctcatgatgcacctgcagaaattgatctagtatccttcctacagtcgaagacacagcagcatgatgctatctttaccgaagcagtgcagctacttgaatctatgaagtcgtcgccttcctgcaaccgggttgcagcttcacggctcgtcgcatcttgtcaatcaatagggggaacgactgatcatacagaacaaagtacatatcttacattggaacatgttcgctctctgtacgcggcacgacttgcagtatgtgaactcgacggagcgggagcgtcaattcctcctccatgtcttccagttactcttgaggctccacgaaagaaaggattctttgggttttcctccaatcataaatccacgaccatcactgccgattctatgcctactgagatcctagaatcatgcttacggtcactggaatctcgtccgcagtggtggacatcgtatagtaatagtagacagaatgccatggtgatatgccaagcaacgcggcttgagaccgagaaggaggagcttctcgagcttcatcgctcaatagtcgaaagttccatcaagcttagccatgggctcgaggaggcgcttgaaatggcctatgctgaatcttcccagcatcaagccttcatagaggcgaccgcagctttgcaggcgaagctgagacaggacctggaagcaaccgaaactggttttaaggctctactgggtaacttaatggagggtatcaaatccgccgtcgattcgggagttacaactgtcacttcaacccttgcaagggtacataacgatgcagcaagcctcgagacagtacgtgtctag

SEQ ID NO: 12696 - DNA, 390 bp, A.fumigatus
cttgtgcgccttctaggaactatgcgggcccatctgcagaactacgtacttggagtatcggaagggcatatttgcattttgagtctggtcggtgtcggttacagagcgagcatcgagtctacagcaactacagtggaacctgaatatccaggccaacaattcgtctctctcaaggttggatattcccatcctattgagctcggtgttccgaagggagtcaaggccagcacaccgcagcctactcgtattctgcttgagggagtcgacaaaaacgttgtgacacaattcgcggcggaaatcagagaatggcggaagccagagccttacaagggcaagggtatttttgtgaacggagagacaatcagactgaaggccaagaagattcggtga

SEQ ID NO: 12697 - DNA, 861 bp, A.fumigatus
cttacccaatccccaggaatcgaattctctagacaagacgtatccctcaccgatctccacgaaatcacctcagccacaactcccgtcgccatcaccatcgacggccatgctgtccgggacgccccctcccccaaggggctccccttcttcggcaacttcttccagatattcccagaccacctgggcaaccaccagcgtctctttgagcagtacggtcccctaatcaagaccaacactctcggccgcacagtctaccagaccaacgaccccatcctctcggccatcgtcttcaacgaatccgactttttcaccaagaaaatcaacgaggcgcacccgctgtactcgctcaagacacccgccgctggcgtgttcctcggcgacactgacacccccgaatggcgggttgcgcacaagttcctcccgccggcattagggcccaaggccgtccggcactacgcgcccaccatgcagaagaccgttgaggatgcctgcaccatcttcgaccagctcgatgcgcagggcgaggcctggaacgtgtaccagtacatgctgaagctggggtcgcaggcggtgggtaagttgacattaggcctggactttgagcacttttcttcggcggatgcgccgatccacgagatggtgcacttgatcgccgaggtcctgtcgctgaataagaaggtcacgtccaagggggactggtacgctagcctgccgtttggggatcccaagcgtctgagggacacgaaggcgcgcatcgagcagctggtcgaggagtcggtgcagaaggcgcagcggggaggcgtcgaggatctgcccttgcaggatgctgcactgcgagcggcgaacatggttggtgagtag

SEQ ID NO: 12698 - DNA, 750 bp, A.fumigatus
acgaaccaaaaccccagccctgcgcctcaaaaggggagtacccccgttaaacagcaaacagactatgctctccgcgccaccgacaacaaaggcgagaaactgcccaagtccagcctcgtctgggccctcgtcgtagccaccggcgccggcttcacgaccaccagctcgctcctctcctggcttatctacggcctggtcacctaccccggcatgcaggaccgtctgctgcaggaactggtcgaccacggcttcgacgataccacggaaatcaccgccgactttgccgatcaactcaccttcctggacaaatacatcaaggaaacgcagcgccggcacaacccctccttccagcccggccgcaccgcaaagctcgacctgatcctgccaggcggatacaaaatcccccaagacgcagtcgtcatccccgccctgcatcacatccacaacaacccggccatctgggataaccccgcgcgcttcaaccccgaccgatgggacacggacgaggtgaagcagcggcacaaggcggcgtatatcccgtttgggacggggccgcgcatgtgcatcgggttcaatttcgcgctgcaggagatcaaggtcttcctgcccaagctgatctatcggtataagtttacgcgggagggggatggccccattgagtatgatccgatgttccagttgatccggccgaataatctgtatgtgcgggcggagaggagggttaagtggccgtacaagtcggatgcgtag

SEQ ID NO: 12699 - DNA, 402 bp, A.fumigatus
gctatcgaaatggcatcacaacagttctatcttctcggggaaccgatctcgtcggcgagaacaatctcgcttgacggcatcaatgatctcgagggcctgcgaaacctgattgcgtctcatttcgccattgtcgaaccgagtggtgagtctcatctcagagtcccaactgacagcactaacttacccaatccccaggaatcgaattctctagacaagacgtatccctcaccgatctccacgaaatcacctcagccacaactcccgtcgccatcaccatcgacggccatgctgtccgggacgccccctcccccaaggggctccccttcttcggcaacttcttccagatattcccagaccacctgggcaaccaccagcgtctctttgagcagtacggtcccctaa

SEQ ID NO: 12700 - DNA, 399 bp, A.fumigatus
cgtgagttccctcgctaccgtgcaatgctgtttctaatcggatgcagtccacctctcctcgtccccgccatgcacatccacctactcaactgcaaatcggacgatcctctcacgcggcagctcagtctcaacaagcttgacttttgcatgttgatcctcaaggtcatgcaagatgtacacacggccgcgtcgtactaccggggcatattctccgaggcgatccggcatctgtcgtccacgacgagcaagccaaccgggcaggggccggttgtggtcgagacgccggcgtctctccccggcgaaccgacaatggagacgctgctgagcggcgatttcctcgacggactgatggacgaggcctcgtttttcaacttctgggaaccgctcagtaatatgtga

SEQ ID NO: 12701 - DNA, 213 bp, A.fumigatus
tctgtcgattcaagtacaaagtctatagtctatatacagttctcagacagcccgcatatgcgttcaaatggccgggatagctacgcatccgacttgtacggccacttaaccctcctctccgcccgcacatacagattattcggccggatcaactggaacatcggatcatactcaatggggccatccccctcccgcgtaaacttataccgatag

SEQ ID NO: 12702 - DNA, 192 bp, A.fumigatus
ttacgttgtatctcacaatccgttaacactgcaagcttcaaacagtttatcaagagaggtagcaaggaagattaccatcttttaaactactcaaagtctacctcatccatgctgccttccttcgttgaaatcctttgccataatccatgctggtcaaaagaaccattcagatgggtactgttcccgatttaa

SEQ ID NO: 12703 - DNA, 348 bp, A.fumigatus
ccctgggtgcttgcagctattgttcaaagttaccggcgatcatcctttggcggaggacgcaagttcgtgatcatcctcccatccaatgtggaaggaggggtcatggagtggaagggagcacgcgaatgggccatcgagcgcaatagtatctctaacaaggaggaatacgcgaagcggtggggttacgaactggagattgtcaacatgctggccaaaaagcggtactcgcatgaatggcgggagagctgggagaaagttgatatcatccgagacgctatgaggaagtatccaaatgcggagtggtcagtcaaaccttgcatgtggagtttaccacgtctaactgattga

SEQ ID NO: 12704 - DNA, 486 bp, A.fumigatus
tgtaggttttggtggttggacctaaacacctggatcatggagtactcttattccctgcaagatcaaatcttcgatcggttgggcgacttgacgtatcgcgatatcaacttgtacaacccgctgaacatcagccaccccccgacagccccgtatctggacgaactatcccgctcggcggaaggagacgggaatccatcctctatcgatcttttgctgtcacaagactgcggaggtttcaacttgggttcattcttcattaaacgctcgctgtggtctgaccgactattggatctctggtgggaccctgttatgtacgagcagaagcacatggactgggagcacaaggagcaggatgcgctggagtatctgtaccaaagtcaaccgtggattcgcagcaatgtcgcctttacgcctcagcgctacatcaactcgttccctccaggagcttgtggtgaaggcgacgatccggacgtgcattactcggag

SEQ ID NO: 12705 - DNA, 2058 bp, A.fumigatus
tggatatgttcggctttgacaaaccagaaaaagttcttgttgagtatgcctgctcacttcttcagagcatgcttttacaggggtacatgtacgtcaccgagggacacatctgcttctacgcctatctcccccaagaaatctacagtagctatcaagtctggatatcttcacaagcgtggccgaaagaaccccaagtatagccgctactggttttctttgaagggtgacgttctttcctactatgccgacccgtcaaatctctactttccgagtggtcatgtcgatcttcgatacgggatttctgcctcattgggcgacccgaaagagaaagggagggagcctagagattttcaagtcactacagaccagagaacgtactatttcagagctgacagcgccatgagtgcgaaggaatgggtaaaagccctgcaaaaagtgatttttcggactcacaacgagggggaaagcgtcaagatatcttttccgatcgaaagcattatagacatagaggaaagtcctatggtagactttgccgagacgttcaaaatccgcgtgattgaggatgatgattcgtacgcgattgacgaggtatgtctctttactacgatccgtctgtacaaggctcatggttcgcagtatttcttcacattcttcaactccggccgagaagcattcgagtttcttaaaatccttattaatgaccaatctttgaaaatttcttctcagcacctttcgccgcaaccggaccggtcacctcggtctgatcgtacccgcaaatctcgaaacaggtggtcattgaccagcgggacgagtcgagctgagacgcagcggaaaaggagtgcaagcacaagccatatgagcctcgcccacgatattgtaaaatcatcgccggcaactcgacaccaggactcgtcagactcaatattgaattctttcgagcaagcgactgagtcttcggctgcctggcaatcgataacggatgcggcagaatcagcgagccagatcttgaatcgcagtgatgtctttcagtctcctactatttatggtctggacagaagaccttctggcagggaaagaagagggcgacgcaattctgatgaaacggctcgatcaccatctacgcgtgccaatgttggtaccggtcaacagatcgatgagcttgacagacgaacggatggtaatacgagtggacgtgaggctcgggataccaccagtgaatcagaccaatacacgcaagatccgactaaatccttctcaggtgcaccttctctgaacgagcttgtcaaagccggggtatatcctctccagcgtgcagcaggtcttgccgagtacttgaggacacggtcaaagcaaatgagtaatctcctggccagtgaatctatgggctatatagagaaagtctcgggaatgtggactggtggtcgaaaacattatggcgaggcagaagatgttttgcctgatgatcaagatgtcgacccagaagacaaggaggacggctgcaactatggcgaccgttttcgtgcgcactttgcattaccgccgacggagaagctgcaagctacatactttgcatacttgcaccgggtgcttcctctctatggcaagatatacgtcagtcagaagaagctatgtttccgcagtcttattcctgggactcgtacaaagatgattcttcctctgagagacattgagaacgttgagaaggagaaaggcttcagatttggctatcacggtcttgttattattatccgcggacatgaggagttattcttcgagttccgtacgtctgatgctcgggatgactgcgcagttacgctccatcaacatctggaggctgtgaagtttatggcagagtcaggcttgctagccgagcaggagcagaatgagtccgaggcagcgatgacagaacaccgtatgcttcaagaggccagatactatgattatggcgaaaatgacttgcggcccttaaatgagtcttctgagctacatccaatttttgacgatcctcgcgcttccatcgtcaacttcaaacccgccgagtctcttcggatcacctgc

SEQ ID NO: 12706 - DNA, 921 bp, A.fumigatus
tccacgtcgagaatgcgcccatttctggacgatgcaaagcgacgggtggaccgcaagctcagcgcgaggagacagtccctgtccgcaagccgttttcttcccagtgctttgccggacagactgaaggacaaccacgatgcccaggtcgactttactgctcctcctggaggatctggctctcgcgagggccatcttcaatacatgcaacaatccatattcgggataatcgccgctgttggctccaggtctgattttcatgcgcggtttgatgagtcaagtgacagtgatggagaaacagggcagcggccaaggaaggagtcgtctgtcaggaaaggaacgtctgtgtcggtgaatacgtcttccctcgatccaagccaaagatccagttcgcagaccgatgggaattcagagaaggacttgggcacaagaggccgtcgccatcgaaggacaatatcggaccataaattattacggccattcatgtcgaactccaagcatgagccagatccttcaacgggcgatgaaatgcccaccgtttcacctccttcgcggccgcgtagtgccactcctcgagcagctcctatcctgagccgcatggttgaagctcaagcccaatttgatttgaaagcgtcgtctaccgaacgctcccaatcttctctcaatgaaactggcgcgaagggccctcgcgacgcatctgtgtcccccctttctacaaggctgatggatatgttcggctttgacaaaccagaaaaagttcttgttgagtatgcctgctcacttcttcagagcatgcttttacaggggtacatgtacgtcaccgagggacacatctgcttctacgcctatctcccccaagaaatctacagtagctatcaagtctggatatcttcacaagcgtggccgaaagaaccccaagtatag

SEQ ID NO: 12707 - DNA, 1206 bp, A.fumigatus
  unsure (332): Identity of nucleotide sequences at the above locations are unknown.
cagcagggaatcgtggtgatgcccactgaggccgaggatgttcgggccgctctcctctgggccccagagcaccagatcgacctcgccgtcaaaggtggcggccactcggtcgcgggcaccagctcgtccgacggcggcctggtgattgacctgtccctcatgaactccgtctccgtggacccagcggccaaaaccgtgacggtcggcggcggcgccacctggaaggaggtcgacgaagccgctgccgcgcacgggctggccgccgtgggaggcaccgtcaaccataccggggtgggcgggctgaccctgggcggggggtatggctggctcancggccagtacggcctcaccatcgacaacctgctctcggcaacggtcgtcctggccaccggacaggtggtgacagcgtccgcgacggaaaacgccgacctcttctggggcctccgcggcgccgggtacaactttggcgtcgtgacgagcttcaccttccgggcccacgagcagcccaaccccgtctacgcggggctgctggccttccccccggaccaagtcgaagcggtcatcgagcagctcaaccgcaccctcgagcaccccgacccccgcagcggcgccatctgcatcttcgcccagccccccggcgctcccgtccccatggtcaacgtgatcgtgttctacaacggcacccaggcgcagggcgagaagcgcttcgcgggtctgctggccctcaaccccgtcgtcaacaccaccgccacgatcccctactcccaggtcaacgccctccagaacccgatggccacctacggcggccgcaaatctttcaagggcgtcttcttccacccgccgctggccccgtcgtttgcgcgcagcatgctggacgacctgaccgcccggctgcaggccgagcccgatctcgccgcgtcggccctcctgctcgagttctacgatatgcgcgccatctgtgccgtgccgcgcgaggccacggcgtttgccagccgcagttggacgcagaacggactgatcaacctgcggtggaccgatgcgcgcaaggacggggagcaccgggcctgggcgcgcgaacggcaggcgcgctggaaagccgagttggacgcccgggtgcaggagggggtcccgcagtacatcaactatgccgagcgtacgtctcttcatctcctctcttcatcccttgccatagctgacaagtgctaa

SEQ ID NO: 12708 - DNA, 579 bp, A.fumigatus
gttgcttaccgccaccggcccaaaaatctcctccttcatgatggccgcatcctcggccacgtccgcaaacgccgtattctccacgaaatacccggtctcgccgaccttctccccgccaaacagcagccgcgcgcccgtctccttgccctgcgcgatgtaccccaggatcctccggtgctgggccccattgacgatcggccccttggtggtggccgggtccagcggatcgcccaccaccccggggttctccttggcggcacgcacatacgccgcgaggaacttgtcgtagatcgtgtcctggacgtagatgcgcgatcccgccgcgcagatctgcccgttgttggcggtgatgccgatccgcgtccagaggagcgcgttgtccagatcgcagtcgtcgaacacgatggaggggcccttgccgccgagctccagcgagacctttttcaggttcgtcttggccgcggcggcgaagatcttccgcccggtggcgctggagccggtgaaggacactttgcggatggccgggtgctcggcgaagctctggccggcggggaaggcccacgcccgcgaggatgttga

SEQ ID NO: 12709 - DNA, 657 bp, A.fumigatus
accggcgattctgtagataggacgaaatgcaactacataatcatatacttgaccgtcttgaccgacgtccacccctccagcgcctcctcgcccatgtcccgaccgaacccgctctccttgacccctccaaacggcgcattcgcgctgagcatcgcccacgcgttgaccgtcacctggcccgactccagcgcgcggctcacccggtgcgcgcgattcacgttggtggtgaagatcgccgcgctgaggccgtgcagggtgtcgttcgccttgcggatgacttcctcttcggtcgagaacttggcgatactctgcatcagcagcattagtatagtacctcacttgtttctcgtacgtgccgatccgggtaggttgcttaccgccaccggcccaaaaatctcctccttcatgatggccgcatcctcggccacgtccgcaaacgccgtattctccacgaaatacccggtctcgccgaccttctccccgccaaacagcagccgcgcgcccgtctccttgccctgcgcgatgtaccccaggatcctccggtgctgggccccattgacgatcggccccttggtggtggccgggtccagcggatcgcccaccaccccggggttctccttggcggcacgcacatacgccgcgaggaacttgtcgtag

SEQ ID NO: 12710 - DNA, 1047 bp, A.fumigatus
  unsure (183): Identity of nucleotide sequences at the above locations are unknown.
cctgtccctcatgaactccgtctccgtggacccagcggccaaaaccgtgacggtcggcggcggcgccacctggaaggaggtcgacgaagccgctgccgcgcacgggctggccgccgtgggaggcaccgtcaaccataccggggtgggcgggctgaccctgggcggggggtatggctggctcancggccagtacggcctcaccatcgacaacctgctctcggcaacggtcgtcctggccaccggacaggtggtgacagcgtccgcgacggaaaacgccgacctcttctggggcctccgcggcgccgggtacaactttggcgtcgtgacgagcttcaccttccgggcccacgagcagcccaaccccgtctacgcggggctgctggccttccccccggaccaagtcgaagcggtcatcgagcagctcaaccgcaccctcgagcaccccgacccccgcagcggcgccatctgcatcttcgcccagccccccggcgctcccgtccccatggtcaacgtgatcgtgttctacaacggcacccaggcgcagggcgagaagcgcttcgcgggtctgctggccctcaaccccgtcgtcaacaccaccgccacgatcccctactcccaggtcaacgccctccagaacccgatggccacctacggcggccgcaaatctttcaagggcgtcttcttccacccgccgctggccccgtcgtttgcgcgcagcatgctggacgacctgaccgcccggctgcaggccgagcccgatctcgccgcgtcggccctcctgctcgagttctacgatatgcgcgccatctgtgccgtgccgcgcgaggccacggcgtttgccagccgcagttggacgcagaacggactgatcaacctgcggtggaccgatgcgcgcaaggacggggagcaccgggcctgggcgcgcgaacggcaggcgcgctggaaagccgagttggacgcccgggtgcaggagggggtcccgcagtacatcaactatgccgagcgtacgtctcttcatctcctctcttcatcccttgccatagctga

SEQ ID NO: 12711 - DNA, 696 bp, A.fumigatus
tcaaaaccttccggaaattccccgctgtcacggacagaagctcgcccaattcatcgtcgaacccgggttccccccccggggtcgtcaacatcctcgcgggcgtgggccttccccgccggccagagcttcgccgagcacccggccatccgcaaagtgtccttcaccggctccagcgccaccgggcggaagatcttcgccgccgcggccaagacgaacctgaaaaaggtctcgctggagctcggcggcaagggcccctccatcgtgttcgacgactgcgatctggacaacgcgctcctctggacgcggatcggcatcaccgccaacaacgggcagatctgcgcggcgggatcgcgcatctacgtccaggacacgatctacgacaagttcctcgcggcgtatgtgcgtgccgccaaggagaaccccggggtggtgggcgatccgctggacccggccaccaccaaggggccgatcgtcaatggggcccagcaccggaggatcctggggtacatcgcgcagggcaaggagacgggcgcgcggctgctgtttggcggggagaaggtcggcgagaccgggtatttcgtggagaatacggcgtttgcggacgtggccgaggatgcggccatcatgaaggaggagatttttgggccggtggcggtaagcaacctacccggatcggcacgtacgagaaacaagtga

SEQ ID NO: 12712 - DNA, 303 bp, A.fumigatus
ggtactatactaatgctgctgatgcagagtatcgccaagttctcgaccgaagaggaagtcatccgcaaggcgaacgacaccctgcacggcctcagcgcggcgatcttcaccaccaacgtgaatcgcgcgcaccgggtgagccgcgcgctggagtcgggccaggtgacggtcaacgcgtgggcgatgctcagcgcgaatgcgccgtttggaggggtcaaggagagcgggttcggtcgggacatgggcgaggaggcgctggaggggtggacgtcggtcaagacggtcaagtatatgattatgtag

SEQ ID NO: 12713 - DNA, 1230 bp, A.fumigatus
  unsure (845): Identity of nucleotide sequences at the above locations are unknown.
agagaggagatgaagagacgtacgctcggcatagttgatgtactgcgggaccccctcctgcacccgggcgtccaactcggctttccagcgcgcctgccgttcgcgcgcccaggcccggtgctccccgtccttgcgcgcatcggtccaccgcaggttgatcagtccgttctgcgtccaactgcggctggcaaacgccgtggcctcgcgcggcacggcacagatggcgcgcatatcgtagaactcgagcaggagggccgacgcggcgagatcgggctcggcctgcagccgggcggtcaggtcgtccagcatgctgcgcgcaaacgacggggccagcggcgggtggaagaagacgcccttgaaagatttgcggccgccgtaggtggccatcgggttctggagggcgttgacctgggagtaggggatcgtggcggtggtgttgacgacggggttgagggccagcagacccgcgaagcgcttctcgccctgcgcctgggtgccgttgtagaacacgatcacgttgaccatggggacgggagcgccggggggctgggcgaagatgcagatggcgccgctgcgggggtcggggtgctcgagggtgcggttgagctgctcgatgaccgcttcgacttggtccggggggaaggccagcagccccgcgtagacggggttgggctgctcgtgggcccggaaggtgaagctcgtcacgacgccaaagttgtacccggcgccgcggaggccccagaagaggtcggcgttttccgtcgcggacgctgtcaccacctgtccggtggccaggacgaccgttgccgagagcaggttgtcgatggtgaggccgtactggccgntgagccagccataccccccgcccagggtcagcccgcccaccccggtatggttgacggtgcctcccacggcggccagcccgtgcgcggcagcggcttcgtcgacctccttccaggtggcgccgccgccgaccgtcacggttttggccgctgggtccacggagacggagttcatgagggacaggtcaatcaccaggccgccgtcggacgagctggtgcccgcgaccgagtggccgccacctttgacggcgaggtcgatctggtgctctggggcccagaggagagcggcccgaacatcctcggcctcagtgggcatcaccacgattccctgctgtcaacctcagtcatgatccgtgtctggagtattgcccagccgtggaagacatag

SEQ ID NO: 12714 - DNA, 408 bp, A.fumigatus
aaaaggtctcgctggagctcggcggcaagggcccctccatcgtgttcgacgactgcgatctggacaacgcgctcctctggacgcggatcggcatcaccgccaacaacgggcagatctgcgcggcgggatcgcgcatctacgtccaggacacgatctacgacaagttcctcgcggcgtatgtgcgtgccgccaaggagaaccccggggtggtgggcgatccgctggacccggccaccaccaaggggccgatcgtcaatggggcccagcaccggaggatcctggggtacatcgcgcagggcaaggagacgggcgcgcggctgctgtttggcggggagaaggtcggcgagaccgggtatttcgtggagaatacggcgtttgcggacgtggccgaggatgcggccatcatga

SEQ ID NO: 12715 - DNA, 531 bp, A.fumigatus
  unsure (184): Identity of nucleotide sequences at the above locations are unknown.
acggggttgggctgctcgtgggcccggaaggtgaagctcgtcacgacgccaaagttgtacccggcgccgcggaggccccagaagaggtcggcgttttccgtcgcggacgctgtcaccacctgtccggtggccaggacgaccgttgccgagagcaggttgtcgatggtgaggccgtactggccgntgagccagccataccccccgcccagggtcagcccgcccaccccggtatggttgacggtgcctcccacggcggccagcccgtgcgcggcagcggcttcgtcgacctccttccaggtggcgccgccgccgaccgtcacggttttggccgctgggtccacggagacggagttcatgagggacaggtcaatcaccaggccgccgtcggacgagctggtgcccgcgaccgagtggccgccacctttgacggcgaggtcgatctggtgctctggggcccagaggagagcggcccgaacatcctcggcctcagtgggcatcaccacgattccctgctgtcaacctcagtcatga

SEQ ID NO: 12716 - DNA, 1173 bp, A.fumigatus
ccaccggcaatttttttattaatcaaaaccttccggaaattccccgctgtcacggacagaagctcgcccaattcatcgtcgaacccgggttccccccccggggtcgtcaacatcctcgcgggcgtgggccttccccgccggccagagcttcgccgagcacccggccatccgcaaagtgtccttcaccggctccagcgccaccgggcggaagatcttcgccgccgcggccaagacgaacctgaaaaaggtctcgctggagctcggcggcaagggcccctccatcgtgttcgacgactgcgatctggacaacgcgctcctctggacgcggatcggcatcaccgccaacaacgggcagatctgcgcggcgggatcgcgcatctacgtccaggacacgatctacgacaagttcctcgcggcgtatgtgcgtgccgccaaggagaaccccggggtggtgggcgatccgctggacccggccaccaccaaggggccgatcgtcaatggggcccagcaccggaggatcctggggtacatcgcgcagggcaaggagacgggcgcgcggctgctgtttggcggggagaaggtcggcgagaccgggtatttcgtggagaatacggcgtttgcggacgtggccgaggatgcggccatcatgaaggaggagatttttgggccggtggcggtaagcaacctacccggatcggcacgtacgagaaacaagtgaggtactatactaatgctgctgatgcagagtatcgccaagttctcgaccgaagaggaagtcatccgcaaggcgaacgacaccctgcacggcctcagcgcggcgatcttcaccaccaacgtgaatcgcgcgcaccgggtgagccgcgcgctggagtcgggccaggtgacggtcaacgcgtgggcgatgctcagcgcgaatgcgccgtttggaggggtcaaggagagcgggttcggtcgggacatgggcgaggaggcgctggaggggtggacgtcggtcaagacggtcaagtatatgattatgtagttgcatttcgtcctatctacagaatcgccggtctacacacggatcgggtgcatcttatgaaacacattgtgaggatcatacttggccttgagctcctgcagtcgccccagattctcgccgtagatgttgtcgaccaccgagtcacccgctaa

SEQ ID NO: 12717 - DNA, 513 bp, A.fumigatus
cgattgcttaggacgcttgcttctgcagtcgcagtgcctgagcacgacatcctccctccgtctccagatgccaccctcaagcgaagaaattcatctactacggatccggacccagatagcaagcgtcgccgattaagtacccaggaggagaaggatcatccagcatcggatcgcaagccttcgattttagatacagcagagcagaggccgggccgaagagccagtcggcaagcaaatggtcgcgaagaggagcgcaagcgcggacaacgactattcggagcactactcgggacgctttcgcagagatccagtacagcagctgagaagcggcgagcagacattgaacggaagcaacaagtcaaattgaaacttcaagacgaagagtacgatgagctgaaaaagaagaagagggaggagcgagtcgcactcaggaagaagcaacagagatactacgaagaggaatcggtaagtgcccgctgctctcaatttacgagtttacgagcttacggttga

SEQ ID NO: 12718 - DNA, 225 bp, A.fumigatus
aattgtctggtcggcgttgcaatcatgtttgttgataagatcaacgtcaccggcgaccctcgggtccagttccgtcaagcaagggtcaatggcaagcaatacggtatgcatcttgtcacttcagcacgttgtgcacgtttttctggcaggcgaccggaactcctgcgttgtcggacggattatgctggaggcaccatcgcaaatcatatcttgaccatttactaa

SEQ ID NO: 12719 - DNA, 255 bp, A.fumigatus
gatgctccagaggatatttcgctatactctcacaagcagtgtgccgatgacatcaaggagttagcattacaacttggcgccgacaagatcatcgtaggaggacatgactggtacgtccctcctggcttcaatttttacattctgagagtgcctgtgactgactatattttacaggggcgctgcatttgcgtaccgagttgccctctggtatccagacctcgttactcatctgttcacggtctgcgtaccgtatag

SEQ ID NO: 12720 - DNA, 420 bp, A.fumigatus
cccttcttttcattgcagtattacaagccctggcaattgcggcccgaggatgaggacttaatatgccgccagattgaggaagcagaagctaccatctcccgagagcgcgctgaattcgaagcacgtcatcctcctcaggaggaaagtgagtcaaaggaagaaacagagttccaaactggtaatcaacaagaagctccgcagcccgacgccgatgtccaacagcccaaagatacgaccgaggaaagctcagaccaggcgaacgctgggacgaaagaaagccaaaataatgaagcttctgtgcccgacactgtcgacgacatcccggcgtcagtcaatcacaccggttcagatgaccatcgggcagctgatgacgatgggggagaggtggtcgaggacaatgaggatacggtaatttattaa

SEQ ID NO: 12721 - DNA, 363 bp, A.fumigatus
atcgctaatgggactacagttaactggtaccggacgagagaagtgaaccacaaagaagaactagccatccttgacaggcgcatcaccgccccagtcctcttcatccaagcactcagagatgccgctcttccggcacacctgggcaagggtatgacaaagaccatccctcatttgacctacaaacaggtcaatacttctcactgggctttgtgggagaaacctaaggaggtgaatgagatgatcgcttggtggctggaagaagtgggttcactgatcctcgtttgttcaagttgtgaaggttgcataaaaattgctttttacacgattgtatgtgatagtatatgtgtgatacttcgaaactaa

SEQ ID NO: 12722 - DNA, 186 bp, A.fumigatus
cccgcagccccatatcgatcagcatggggatttgataccgccatcccatcgacaggtctgggaagccatggagctaagaaagagtcagttactcgcccggagcatgtgggtgagctagagctgactgacaaggaagatggtggctctgtacgtgcctgttttcggttcgctataaaggtaacctga

SEQ ID NO: 12723 - DNA, 195 bp, A.fumigatus
tttgagctgcacgttgagagcatactaactatctgcagtacgctgaagactggtttggtagccaaagccatcaaggcgggcaaaacggttgatgagaagacgcttcaacacttttacgagactgaaaaagtttctgcaattgagactgtcggtctttctgatgccaaaaccccacatagcagccgcaccccctag

SEQ ID NO: 12724 - DNA, 969 bp, A.fumigatus
tcagtgagaaatccaagtggtggcggcaaccaaaccaacacacaacgacagcaacaagcacagaagcccacgctatctctctttgggaatcaaaatgccgcgccccaactgtcgacacaacaaacagccacaagcggaacagtggtgcccggggtcaaggtagatctcagtaatctcttgccgacgacaaagtacgagagttgcgccgacgaaatcagatcagagttggagaaattcgacaactacgtcctgcttcaaattaagctatgtaacgaggtctccaacatgcttcctacaatcgctagccaggccgagaccattccaaatgatgtggatttcgtccaaggcaaactggaaaccattgagcatgcgctggagaacgacgcccgcgatattgatcaactacgcagcctcgtgtctcgcgatgcagctgaggcacaggtggcgttccgtgctatcgatacattaaaattacccctgcaatatcaatctgcagggggcgcggggtggtggtcagcccaggatcaaaagggatccgatcgccaggcgttgcgatccacacgcaagaatactctcgctcttccagatgatgtcgagactgacgcctcgtctgccacttccatcaatggtgtgccagtaaaccttgtcgactatttctctcagcgctctgacgagatgggtacggttctcgaacgatatactcgcaatctgaaggagattgaagaccaccttcatggtatcgagctttcactgaaccgccagattcaagaatttgttgcttcacgaagtcgagatggagcgaccgctggaacccagaaatcgaagctcaatgatcttgcagcggtccttggagatgtggaaaacggtatacttggcgttgctagtaggctcggtgcggtcacggaacaggtgctggaagtggtattgggtccgccgtcgggagatggtatgcttaattataaaccttga

SEQ ID NO: 12725 - DNA, 525 bp, A.fumigatus
actgaagagtacactatggcaccgttgctggaggaaccagcggctacgccttaccttggacactttactgttcccaagaaggagcctgcagagcacaacaaattctggtacgagccagggcgcacgacagtcaagagacatgacgactacccttacgaggaccttctaccctcgtttcctgatgttcggtgggaacctataggggaggttccatacgaagacaaagggcttcgtggagacccaaaattccgtcacttgctccaagatgcaactgacgtcttcgactacactccgcgaattggaacggaaatacatggagtcaatttggccaggcttaatgatgcccagagggatgaccttgcacgcctgatcgccgtccgtggcgtggtatttttccgcaatcagaaggattttgatattgacgctcaacgggaattggggaaatatttcgggactttgcataaggtgagtcttaactcccccagatcgtcgtcaggtcgtgattggtctctaacagtggtgtag

SEQ ID NO: 12726 - DNA, 678 bp, A.fumigatus
catgccactactgctgtaccaaaaaagaaggggttggaagacgtgcatgttgtttatactggggacaactcttccgaccagcgagcgctgttttcccctagcttcctatggcattctgacgtaacatacgagattcagccaccatcctatacatcattgaaagtcttgacgggtcctcctcgaggcggcggtggtgacactctctggtcgtcccaatacgcggcgtacgacgctctctcatcgcacatgcagaactacctgaagggcttgactgctcttcatacagccaacatgcaggcatcagactcacgagctcttggtcgaaccgttcgtcgtgagccgatcaccacagagcaccctttgattcgcacgaatccagttactggctggaacagtctgttcttcaatcctggcttcgtaaccaagattgtgggaatcccgaaaacagagagcgacgccatcataaggtaccttaccgaggttgttgccaccacgcaagaggcgcacgttcgtttccaatggggtgagaatgatgtggccctgtgggacaatagaacaacagtgagtgacgcacagatattccccatgattcctcctgactttctagtagaatcactccgcttcttatggcttttctcctcaccgtcgtcatgccgttcgagtcgcttgccacgctga

SEQ ID NO: 12727 - DNA, 198 bp, A.fumigatus
gcatgccgttcaaggtttataattaagcataccatctcccgacggcggacccaataccacttccagcacctgttccgtgaccgcaccgagcctactagcaacgccaagtataccgttttccacatctccaaggaccgctgcaagatcattgagcttcgatttctgggttccagcggtcgctccatctcgacttcgtga

SEQ ID NO: 12728 - DNA, 441 bp, A.fumigatus
ccactccttcagtccggcgctacacaccttgttgccggtggcgagccctacaagaacgtcaaggacggcaaaggctttttcatcgcaccgaccatcttcaccaacgtcaaggacgacatgcggatctaccgcgaagaggttttcggcccatttgtcgtgatctcaagcttcaagaccgaggaggaggccatcactcgggccaacgacacgacctacgggctgggtgcagctgtcttcaccaaggatattgagcgggcgcaccgcgtggcttcggagatcgaagccggcatggtctggatcaatagcagcaatgacagcgacttccgtgtcccctttggtggcgtgaagcagagcggtattggtcgggaactgggcgaggcgggtctcgaggcatacacgcagatcaaggccgttcacgtcaatttgggaaccaagctgtag

SEQ ID NO: 12729 - DNA, 234 bp, A.fumigatus
  unsure (105): Identity of nucleotide sequences at the above locations are unknown.
ttgcaattgcaagtggctaatgggcaggtagtcattgagctaccgggttccccctccgatccgaacggtttcaaagtacgggtgcccggatgcttagctctcatntacggtaagattcagaaatataatagggagaacaaatatcagggagcaggatttacaaaacatgcatttattctcatgtgtggtgcttcgaagctggtgggcttgaactttacggggcttttgctgtga

SEQ ID NO: 12730 - DNA, 1233 bp, A.fumigatus
gcaaggatgtctaagggtgatatggtaaactcctggtatgctaggaaatacgcgccagcgtgggaggcagcctcgtccttaggccgtactagtgatgcgagtatgctgcgccgcagaatcaatcctttcgatggggctgataaaatgcgactatattcccaggacccaggcgatctcaattttcttttcttgtctacaacacttttccaccctttccaggcaattcatatgtctcatgcgatggaggatgacgctctgcatcagctacaacaagaacagtccaagctcttggataagatcgatgaactgcgcaccattggcgtcggcggcctcgtggaactgcctcagctgattgtttgcggcaaccagtcaagcgggaaaagctctgtcctcgaagccatttctcgcgtccggtttccggcgaaaagtaatgtctgtacacggttcgccactgaggtgatcctgcgacggaatgcggccttctcgaaaatcaaggtgtctattgaacctggtccttctcgcacagacgaggacgagcgacggcgactgcggagttttacttatgaggacttctcgaatggcgatgacctgccccccttgatcgagaaggcaaaggtgcacatgggaatcacagagtcggtgaacacgggcttcagtgatgacgtgctcaaggtcgagatttcaggaccggacaaaccggagctgactcttgttgatttgcccggcctgtattactctactagccaggagcaggacttacaggggattctgataatccgcaagctgacggagagatacatgagcaatccaaggagcatcattctcgctgtgatcagcgccaaaaccgattaccatcttcaggaggtcttgaacattgcggaacaatttgatccaaagcgcgagcgcacgcttggaatcattactcaacccgatactctggaggcgaattctgaagaggaagatacttatctgcactttgtcaagaatgaaaagattcccctggagctgggatggcatgtcttgcgcaatcggtcgtttgagaccagggatatctcagacgacgcccgcgacgagatggagaaggcgttcttcaaccagggacgatgggcatcgctctcccgggaatgcgtcggcatcgaaagcctacgccgccgccttagcggtgtactgctcaagctcatccgtcggaatcttcccagggctaatcacagagatccaagacaaggtgtctga

SEQ ID NO: 12731 - DNA, 360 bp, A.fumigatus
ggagggttacttcatccccggcgttatgacaccttcttcgattcgtgcaccaatgggcaggggaaggtcaatcccaacttgtacgaagacggccgaatctgtcttagcatattgggtacctggccaacaaagagcccggaggaaagctggtcgcccgtcaagtccactgccttgcagatcctggtctccatcatgggccttgtgctggtcaaaaatccattctacagtaagtatatcctcgaactactagacgttctaaatcacttagttatctcacagacgaggccggctatgacgcccttgctgtgggcgacaatcgtcgcgtcgagtcctcacaatatacagaaaaggcattcttga

SEQ ID NO: 12732 - DNA, 294 bp, A.fumigatus
cgggctttcgcaagcgtgccccgaagaagaagaaggctgacgaggaagaggtatccactccgtaaagcccattttacgctcatcgctaagctatcacaggcggaatctgcatccgagaaggaggaaatgacccctaaatcgaagaaaaggggccgtgctcagacgaaggacgagcccgaggagaaagctaccacacccaagaccaaaagagtcaagaagggcagccgcatcaaacaaaagagcgacaccgaggacgacgtgtcttcaccacggggctggaaggagccgcgccac

SEQ ID NO: 12733 - DNA, 258 bp, A.fumigatus
cacgcaaccaggggatgtgttacgcccaagatcatcgcaaacctcaacgaagcagttgaggaagcgagcggtgactcaaaggatctggacgccattgacggctttgaggagcttccttctgagtatcaggaaaaggtccgtaaggctctggagcagggacatgttgacgatgaggattggaagggggtaggttttgctccttttgctcccaatctatataggtttcaagatgagactaacaccggtttaggatcctga

SEQ ID NO: 12734 - DNA, 447 bp, A.fumigatus
gtatatcctcgaactactagacgttctaaatcacttagttatctcacagacgaggccggctatgacgcccttgctgtgggcgacaatcgtcgcgtcgagtcctcacaatatacagaaaaggcattcttgatgacacggaacttcatcaagcacgcacttcatcatccagtcgctggcttagaagacgttttgacttggaactatatcaaatcggagcagaaagacgatgcttctagtcggcccaatctactacgccgcgctattgactcggccgtcggaatgattgaccatcacaataacacctctgctaccgacaagcttgacgaggagagcgcagcagctccatttgtttcccgtcttagccttggagccgtagtaatgctgaggaagcatgtcaccgacctagggaatattgaatcgacgatcattgccaacaattcttcttaa

SEQ ID NO: 12735 - DNA, 597 bp, A.fumigatus
gggcattcgataagcatgtcgacatgcaaagccgttgcccaaagatggccccgatatctccaccgccacatcccattcgtcgcacctagtccttcaatccggccagcgcttcgacgctgtcgcatgagcaagcagccgtccctcctccgttcgtacgcctcgatctccgctgcggatcttaaattcgggcaacctcttcacgagacgcatcctcatttattgaatcctggagaatgtgtgtatatgctccccattgcatgtgaatgtgacacaacaaagaatgagaggattaacctgaaactagtgactcctggtatcacggctctcgaatacgctcaacgtcgctcccggcttgcgaacaagcttcctaagaatgcaattgcagtgttagctgcctcggaggttacttaccgcgctactggcatcttcaacaactatcgccaggattccaacttcttttaccttaccggtatgctttcattacaagtcgaaaataaagcaagcagctcactcgatattttgtcaataggcttcaatgaacccaatgcgctagctatcatcggtaagaccggtctaccagttaagcgactaagatag

SEQ ID NO: 12736 - DNA, 276 bp, A.fumigatus
atgttcatgattgttccggatatagtcgaagtcagaatctcaaagcaggccagtgcatcaccatcgaaccgtaagtattcttccagtctcactttcggcacatttctaattcgccttcccagtggaatatatgttccggacagtgaaagatggccagagcagttccgaggcatcgggatccgtatcgaagacagtgtttgcgttggggatgataacccgattgtcttaaccacagaggcagtgaaagaggtgagttctaattcaattcacttttga

SEQ ID NO: 12737 - DNA, 420 bp, A.fumigatus
ctattcgagcagacgggtgacattggtcgcatcggggatattctcccaacgatcctttcgggggccacagagatctacacagatatccctgcctttaaccccgggagatcctccttgcatcatttcctatacggccccaccaatgcatccgagaagctgaagaagatggtcgactatcacaaagtcaagcccttgcgtaacatcttaaacgagatgcgagtgttcaaaagtgaggatgaggtcgtccaattacgcagagttgggcaggcgtcggggcgagcctttacagaaaccatgaggcagacctttacaaaagagaagaacctgaattccttcctggagtacaatttcaaagtgaacgggtgtgatggaagtgcttttgtcccggtagttgcaggcggctccgtgagtacctcgtaa

SEQ ID NO: 12738 - DNA, 429 bp, A.fumigatus
aggaatggtgacatggttcttgttgacgggggcggggtccgtactttctctatcctgggaactgactgtgacactaacaggctgcaggaatggggcacgtacatatccgatatcactcgaacttggccagttaatggcaagttctccgaccctcagcgcgacctatacaatgcagtgttgaatgtgcaccgcagttgcgtctcactctgcagagagagcgccggactttcattggacaaattgcacagtattgctgagaatggtctaaaggaccagttgcagcaactcggatttgatgtttcaggcagcgtaagtcgacttgatgtcaaggtgcccattcgtcaagctgatccatgtttgcctcgaacaggcaatgggcatccttttccctcatcatctgggacactacattgggttagatgttcatga

SEQ ID NO: 12739 - DNA, 198 bp, A.fumigatus
ctgttcattgtttgtttgttttcacggttgaccctactacagtattcacatcaacgtctttcgtccgtggatgcagcatctcaagtcaatctgtactgtacaatcacgtatgaatgggtatctatgtgctacagcaggttcttttatctagtcccgaagcgcctcgatatcatcaacctattcaacatcctatattag

SEQ ID NO: 12740 - DNA, 246 bp, A.fumigatus
ctataccgaattggtcatcaccaactgcatctagatggcttgacttatttctgtctcggattcactaattacctgaagacctacttgatgtttctcatagatttgatgtattacacagtaaggtacagatgctgcagaagattaactcttgggtttccgggttggatagggattgtctggacattgcatgattcaaaggtctgcttcaagttcggcactattattgtattgttgatattgtggtaa

SEQ ID NO: 12741 - DNA, 288 bp, A.fumigatus
  unsure (67),(72): Identity of nucleotide sequences at the above locations are unknown.
cgacccacgaccatagaccacatacctttcgtgaaagcccttaatctagaagccctggggagcaacntggtntgcattgcccagtacaccggcattcaccgcatcggcgacgtgctcgacgtccacgccgtccttgagcacatcgttggcaacgccgttggcaacgttgttgcccttgatggggacgtcgacgttgacggggattttgttattctcaacgttgacgccggcaagaccgttgtgattagattggcgacctggttcgttagttgggtggttactctgtag

SEQ ID NO: 12742 - DNA, 465 bp, A.fumigatus
tcatcaaatgtctctttcttcaaggtcaagcagttggcccaaccatatgagtcgtctggaggtcaccgggattgttgcactgtgactattaacgagtggtcctgttcaaagggagaagatcgagtaaacatcgcctcgaccacgctcctctcgacatcaaaaatgaactgcagaagccaagtcaactggggccaactgaagaaaatgctggagtacccacttggccacgcgtacattaggtcgattaatgatggatcgctgcgaggcagacatagtggcggtatttgcgccaccatcatacagcctgctcctcctaccccaatcttccaatcttctaaagcgttcaagtctaccatctcgttctacctactaaatagggaacttgttattgaggtaagatgcctactccttgtgatttgtttctggtatttgttatttcctacttactatcttgtgcttctatca

SEQ ID NO: 12743 - DNA, 786 bp, A.fumigatus
tggtcaattctccttttggtcggctgcgctgccgccattgacgtccctcgtcaaccatatgcccctactggaagcggcaagaaacgactgaccttcaacgagacggtcgtcaagcgagccatttccccctcggccatctcggtcgagtggatttctacctccgaggatggggattatgtctaccaagaccaggacggcagtctgaaaatccagagcatcgtcaccaaccacacgcagaccctcgtccctgcggacaaagtgccagaggatgcctacagctactggatccatcccaatctctcctccgtgctctgggctaccaactacaccaagcaataccggcactcgtactttgccgactactttatccaggacgtgcagtcgatgaaattgcgaccgctcgccccagaccagtccggcgacatccagtacgctcagtggagtcccaccggcgacgccatcgcctttgtccgcggcaacaacgtcttcgtctggaccaatgcctcgactagccagattaccaatgacggcgggccggatctcttcaatggcgtcccggactggatctacgaggaggagatcctcggcgaccggtttgcgctctggttctcgccggacggggcgtacctcgccttcctgcggttcaatgagaccggtgtcccaaccttcaccgtgccgtactacatggacaacgaggagattgcgccgccgtacccacgcgagctggagctgcggtatcccaaggctcgtcttcaccacggggagcgcagcaccgcgcataggata

SEQ ID NO: 12744 - DNA, 390 bp, A.fumigatus
acaatcgagcctggtcccatcatcatcatcatcatcatcaacgcagtttctcacctcaacacggccttctcatctctcaagctcaactgtcagactccaaccaactccaaaatgcagttctctactatcctctccctcctcgccgttgctggcatgaccatggctgccccttctgtcgcgcgtacgtctcccaacccctacagagtaaccacccaactaacgaaccaggtcgccaatctaatcacaacggtcttgccggcgtcaacgttgagaataacaaaatccccgtcaacgtcgacgtccccatcaagggcaacaacgttgccaacggcgttgccaacgatgtgctcaaggacggcgtggacgtcgagcacgtcgccgatgcggtga

SEQ ID NO: 12745 - DNA, 768 bp, A.fumigatus
agtgcggttacggactacggtagcagagtacatcaccaattgctacgacagagtacaggcaatggtccgcccccagccatggctgccgacgcccatgattctctcgaccgcgaggacgctccgtttctcgcttcttctgcagaaagcagcgcctcgagcagtcggatcggggaccaggacgatgaagcggaacttaagcatgtctacaacgacaatgaggccgaagacgacggcctcgacaaccgcaagggaaccaaagcaattgagaaaatccgcttccgcttcatggttaccctctttgccatgatcctcgcgttcgaggtcggcatcgtgatggccaatgggcccatgacgcgcatctacgagtctattgcctgccggcagtactacgccgagtatgacccgcgtcagatcgcggccgacgggcaggtcgctgaatcgatgtgcaagattaaagaggtgcagacggagctggcggccgtgaaggggtacatggagttcttcgacggggtgttgagtgcgtttctagcgattccgtacggtctgctggcggaccggatcgggaggaagccgattatctgtttgagtattccggcgtttgcgctgaattcggggatcatgcttgcggttatgtggtattcggatatctttccgctcagggcggtttgggcgtcttgtctcgcttggttgttgggtggtggcccggttgttgccttcgcgattatctggacgatgatgtcggatgtcacggcggaggacgaaaggtag

SEQ ID NO: 12746 - DNA, 270 bp, A.fumigatus
ggaacgttacgcgcttttcagagtggacggatcagctacgtctttaaatggagtgggccatctctcaccctggatacggcttgttcctcgtcgatggtggccattcatcaagcagcacgagcgctccaggctggggactgccggtcagcattggttgggggggtaaacgtcatcaccagtcctgatgtgagcgaatctttccacaagcatgatgctgtccaagcaatggagccacatttttacaagcattacgagctgacagcgccttag

SEQ ID NO: 12747 - DNA, 303 bp, A.fumigatus
atgtatcttggtctcgatcgagcacattttctaagccctacaggccaatgcaagccatttgatgatacagcagatggctactgccggtctgaaggctgcgcggctttcgtgatcaagaaacttggtgatgcgatatcggaaggtgaccgaatactcggcgttattcgaggcatcgagatcaatcaaagcggaaatgcgcattccatcacgcatcctcattcaccaacacaggaagacttatttcgaacgttgctaaagaaaacacggatccatccccatgaggtgcgtcatccaagcgggtaa

SEQ ID NO: 12748 - DNA, 789 bp, A.fumigatus
cagattactgtggtggaaacacatggcaccggcacacaagccggtgacccaaatgagcttgtcagtatccgcggggcattttgcaagggtcgagatccagcgaatcttctccattttacctctatcaaagcgaacatcggccactgcgaagccgcttccggcggtgcagcgttggcgaaattacttctgatgatgagacatggccaaatccccccgcagatatctctccagacactcaaccacaagatcaaagacctcggcacggacggatccgtcatagatcgggacggtgctacttggcctcgaccttcgagacacccgcggcttgctctacttaacaactttggtgcggcgggctccaacggtgccttgatcctgcaagaatattcccgtctcaacgctccccctcaagacgaggagcagcgtgaggctcccagctatatacttgggctctcggccagaagcagctcaagactccttgcctataaagatgcgttgatctcttatctggaggccccttcgatacggagttctcttcgtgatgtcgcttataccagcacggctcgccgccagatcttcgattatcgcatctctgttaccggttccaccatacaggaaatagtcgacaacttgaggaacgcagaaatttacaacattcgcgagtcggcaaacccacagccacgtgcggtattcgcattctctggtcaaggatcacaggtgaagctccatcgctgtacatcaggattcacaaatctatcagaaattgtagtacctacgaatgggccgtga

SEQ ID NO: 12749 - DNA, 429 bp, A.fumigatus
attccgtcgtcaaggttccatgtcgaagacttttatcagaagaaagatggtcgtactctacgaacaaagtacgggaacttcctggaaaacccattcatgttcgacaacgaactgtttggtatttcccgtcgggaagcccattcaatggatccacaacagcgagtgatgctccaaactgcctatcgagcgctcgaagatgccggatatgtgcctgattcaaccccgtcgttctcccgggagacgtttggctgttttatcggaaacgctacgttggactacaccgacaaccttagagacaacattgatgtctactacagcccaggtaaatcatgtcatgcttggctccgatcgagactatggcatgctaatcatctctcggtaaggaacgttacgcgcttttcagagtggacggatcagctacgtctttaa

SEQ ID NO: 12750 - DNA, 189 bp, A.fumigatus
atgaggatgcgtgatggaatgcgcatttccgctttgattgatctcgatgcctcgaataacgccgagtattcggtcaccttccgatatcgcatcaccaagtttcttgatcacgaaagccgcgcagccttcagaccggcagtagccatctgctgtatcatcaaatggcttgcattggcctgtagggcttag

SEQ ID NO: 12751 - DNA, 432 bp, A.fumigatus
ctggtggctaatttaccggctgcagttatgaaattcttccctcgccagctgtggaagacgattcagccgaacttcaaaccctcggtcgcaatggatggatacgtgccacatggccctcgcatcggagtgaaaaggggatttgaggatgaggaagaagaacatgacatcgaggagaccaagcgtagaaggggcatcgatgaagatgaggatgctgagcgggatgagcgagaagagcgggaagaagacgtggatgtcttggacccggatgaggatcaggaggaagagatcgttgacgacgactttgaggacgatgaagatgaaatgggcggggactacaatgcggaacagtactttgatgctggcgacgacgaatacggagatgacggattcgcagacggcggaggcggaggtggagatgaagacacctactga

SEQ ID NO: 12752 - DNA, 204 bp, A.fumigatus
accttacttacaattctgccgcagaagatgctcaggtcgtttacctttacgatatttgttgtgtcgactacgggccagggtgagatccctgcgaatgcgaggtcgttttggaggtcgttgcttttgaagaagctgccgcctactttcctgagcggggtcaattatgtttcgtttggattgggcgatagttcatatcccaagtga

SEQ ID NO: 12753 - DNA, 321 bp, A.fumigatus
ggcctactgttgctcacatcatgcgcgcagagatataacgttccccgcgcgagacctctgaaccctcgcgaacagaaacaggtcgatctctaccgtgctctgcgggatcgcttccacgacggtccctactactccgtcctccaatcgacctcggtcacggcaagaaaagatgaggctgctcgcgcacactttgacccttttcacggaatgcctacgtattcgggcaagtaccagaagccagaaagcgggatcggcccggagtttgaaaggacgtccgtacgggtaagtgtggtgctagcggggtatatgggttggggataa

SEQ ID NO: 12754 - DNA, 1263 bp, A.fumigatus
tcctctaccggcggtgaggacactcgggagatgataaccaaggttattgcacaagtcactgagatctggttccagtgggctagtttgccagctgcggcagcagagcataaagtcctctctttcttaccctatctccagcatgaacctcctacacatctgcagactggaaagaccaccactcaacgcgatggtgtggctcaaagtctgcagtccgccgatctcagccagcaaagcgaagtatcagcccattccaccgacgatccgtacggaccaagacgatggcgctccagcatggttgagttgagcggtaaggacagggctctaaatgagttctccgtggagagagttggtgaggaagtggaccaacatttagtcatgcttcacggatatggtgcggggctgggcttcttctacaagaatttcgaacctctgagccggctaaaagggtggcagctgcacgcgttagacatgttgggcatgggccgcagcacccgaccactgttccgcatcaaggctaagaaccgagaggatgctatcaaggaggcggaagattggttcgttgatgcattggaggaatggcgcgtgaagcgcaagatcgaacgcttcacgctgcttggccacagcatgggagggtatatgggagtcgcttacgccttgaaatacccaggccgtttgaacaagctgatccttgcctctccggtggggatccccgaagatccttatgctgtctctgcggatatgcccgaaccatccgagtccaccttagcccaggagttcacccaggatcagcaaactatcgcacagtcatcgttgtctgtccccccggaagttgcccagaaaggcgacaacaacgtcctgctgaaaggctacggtaacgcagcggcaccaccggaaagccgaccggcccgccgcagcattcccaaatggtttgcctacctgtgggaagccaacatctctcccttcagtctggtccggtgggcgggccctctcgggccccgcatcgtatctggctggacctctcggcgattctcccatttacccgccaacgaagcgaaagctctacacgactactcctattccatttttagtcaacgcggtagtggagagtatgctcttgcatatatcctagctccgggagctttcgcgcgtagccctctgattcggcgcatacagaacgtcggacggcagatcattccgccttccaacccccagtggggagcctgcgaacgtcacggacccctctccctcgcaaccgccttctga

SEQ ID NO: 12755 - DNA, 420 bp, A.fumigatus
ttcggcgcatacagaacgtcggacggcagatcattccgccttccaacccccagtggggagcctgcgaacgtcacggacccctctccctcgcaaccgccttctgactcggcaactcaggcttcttcagccccaggtaagcgcgagaccggtatacccattgttttcatgtatggagaccacgactggatggatgcggcgggaggcttcgcagccaaggccaagatcgaagaggagaaacggcgggtgctccagaatgcttcaccagaagagcgtgaggcggataatggctcagctaaggtggtaattatcaaggggtcgggtcatcatatataccttgatggatgggaggaattcaacaaggtggtattggaggaaatggaagaggtgagccaaagggaaagggctcggagtcggacgtga

SEQ ID NO: 12756 - DNA, 783 bp, A.fumigatus
  unsure (365): Identity of nucleotide sequences at the above locations are unknown.
agggttttttggttcttcctcaaggaaaacaaagccccgggacttttaaagttgtgggcggttgggcgttgccccaccaatccgcaaggtccaaggcccattgtttccagattcgcattgttccttgttcaaaggccaggtttaagcgacgaggcagttgagcggggcctggctttcccatcaatgatcggcaaagagctcccctcaccagcctttccctgttacggagccaccccgaaacagcagacattttacccttggagacacagccaggccgcttcttgtagccccgatggccgcaggcagcgccatcaccaccgatcagcaaccacgtccctgatcccaagtcatactcgccgagctcntacatctccgtcagcatctcggtcaaacaggtcagccggctctggggcccgctcccgaggcctctctccgcggccacggtctcaggacgcatcgtctctttcaacatattctgatttcttccatgcaatggccagtgcgccgcaggctcattctcaattgcacctatccaattcatccgaggtcccgggtggttactttgcttttcgcccgggcaatggagcgaatagcagcgggagtgcagtctcaacaggcaccaccacgccggtcgaggatcgatccagcacaacgtcccgtaatatgggaagattcatggcccattatcctgcgggcgtgagatatcgtagacgaagtgtatcgggggccaatcttggatcgcaattacccaatgcttctttgagtatcgaccgacccttttga

SEQ ID NO: 12757 - DNA, 288 bp, A.fumigatus
gggaccatttcggctgcttgtggatcccaactccacagcaacgcatcatgcgatatagaaagaaagatctgcccagatcagatgccgatcggtctgctcgtggcccctgaacctgtgaataatatgatgaatcataacggcgacgtctgctgtatctgcaaaacaaagaaaaccactttcactccccatttccatcacccacatcgtcatgcattatccatggcttctctcatcgcaaatactggcactaacatgtcttgcaactcaagcagctcagatacaaaataa

SEQ ID NO: 12758 - DNA, 483 bp, A.fumigatus
tcgtccaagatgggcaagaaaaataagaagtccgccgagcacaaggagcgggtagcagcaaagcaatccaagaaggctgcgcaaaaggaaaagaggcacaaggcaaagggtcgcgacgcagatagtgacgcagaagatgtcgatctggatgcgatcctggctcaatatgctgaagagcaagctaaatttctgaaggtcactgaggtagtctcaggaccgccgtctccacgtagctctgctacaataattgcgtctccctcaaaccggaatgagctcctgatatttggtggcgagcactttgatggcactcttgctactttcttcaataatctcttcgtctacaacattgatcgagatgagtggaaggaagttacgagtcccaacagccctctacctcgaagcgggcatgcatggtgccgtggaggaaatgccggaggtgtctatttgttcggaggtgagccctgtgcaagtttccccggatga

SEQ ID NO: 12759 - DNA, 1383 bp, A.fumigatus
aagtggccacagaatgacatatttcaaggtatgtatcaaaatctattcacatctagtgaatatcacgctgaggccatccagaactatattatcctcttcggaggctttcaggatacttcacagcaaacaaagtacctccaggacctgtggatttacgactgctcaaaattcacctggttcaaccctacactgcccccagcagctcaaaagcctgatcctcggtcatcgttctcattcttgccacacgaatctggagctgtactgtacggtggttactctcgcgtgaaggcgtccactggcgtgggtggaaagccacagaagggtggtcctcagcgcatgaccatgaagcccatggtccatcaagacacttggtttctacgaattacaccgcctgacgctgatgcccctgcgtccgcggctcctacagtacgctgggaacgccgcaagaagcccgcaaactcgcctaacccgccacgtgccggcgccactatggcttaccacaaaggacggggtatcatgttcggcggcgtccatgacgttgaactcagtgaggagggtatcgacagcgaattctttgacacgttgctggcatggaacactgacaggaatcgtttcttccctctgactctccgccgtccaagagcaactggtaagaagcagcaggccaaccaaatgagatctcgaaaccgggcaaaggccgacgaagaggagcttctccaaaatttgagagctttagaagcaaaaggagggctccgcgatctggacgatgatgacgagtttcagcgaatctctcacagaatggaggacgcacctgctaagtcagagaagccctctattgtacgttttgagatgcctcacaagcgtttcaatgcacagctggccgtgcaagacgataccctgttcatattcggcggaacctttgagaaaggtgaccgggagttcactttcaatgatatgtactctgttgatctggtgaaactcgacggtgtcaaggaaattttttacaaggagcccgagaactggcatcttctcaacgaagcggagagtgatgatgagatggatgaggacgatgaagatgaagatgaggaggaagaagacgatgacgaaaatgcaatgtccctggactctgcttctccagcacctactgaggtcacagtaccgtcagtcacccagggaatggagcagcttgaaatggaagaacaggaagcagagccctctgtgcaggatagccgacctctaccccgaccgtttgagagcttgcgcgatttctttagccgtacgtctgaggagtggcagaagattctgctagataccttgaaagagaagggcattacggtggagaagaatgtgaaggaattacgtcttaacgccgggtcgagataa

SEQ ID NO: 12760 - DNA, 639 bp, A.fumigatus
tatttggtggcgagcactttgatggcactcttgctactttcttcaataatctcttcgtctacaacattgatcgagatgagtggaaggaagttacgagtcccaacagccctctacctcgaagcgggcatgcatggtgccgtggaggaaatgccggaggtgtctatttgttcggaggtgagccctgtgcaagtttccccggatgaatccggtattaactgttacttccaatgctcaggtgaattctcttcgccaaagcaggggacgttctatcattacaatgacttttggcatctcgaccctgccaccagagaatggactcgtctcgaaaccaaaggcaaaggccctccagctagaagtggccacagaatgacatatttcaaggtatgtatcaaaatctattcacatctagtgaatatcacgctgaggccatccagaactatattatcctcttcggaggctttcaggatacttcacagcaaacaaagtacctccaggacctgtggatttacgactgctcaaaattcacctggttcaaccctacactgcccccagcagctcaaaagcctgatcctcggtcatcgttctcattcttgccacacgaatctggagctgtactgtacggtggttactctcgcgtga

SEQ ID NO: 12761 - DNA, 186 bp, A.fumigatus
cgttcattgttctttctttacagcggtcgcaacaagaacggccgcggccacgtcaagcccgtgcgctgctccaactgcgctcgttgcactcctaaggacaaggcgatcaagagattcaccatccgcaacatggttgagtccgctgccatccgtacgttcgagcccttgtcaatcctataccattga

SEQ ID NO: 12762 - DNA, 1221 bp, A.fumigatus
tcgctattgactgacactcgattgcactcccgcggtgacgactccggtctgtatttggcggcacctgggccggtttcacgatgtgcctctccggtttcacctgagggtttacgggcacagatgatccaaacacttcttgccaaaagacctaagaatcaaagcctacctcgccgcgatggcaggggagggagctttccgtacttgcatccttctcacgtccctcacctcgagactttagtgttaaccgatgttccgtctcatgttcctgaaggctcccacatcctgcctgccttgattcgatttataacagcctgttcgaatgaggccctgttagccactctcctggcgggatcggactactctctgccccctggaagagcccgagctcacgctgagcaggaacgatcacggtctctttttgctctgcgtcgcttggtacttgaaatcactcccacgactcatctggccggcgcagctcgaatcagcccgtggaaatccatcagtcagcaaagtgggatgtcaaggtccagtaccggcgaccgtgattccgagaatctgtggtccgcagccacaggcgactttagtttcttcggggaagatgaatgtggtatacccgaaaatgatccggggaaatactttcctatggcgatactcaatgagaaggtgacactcataccagaggacgaagattccgggcgttcgggatctccagaggtagatgcgtctttcgcatccaattcatttcagcctgctggagcttttttccgacggggccgatcgcagactgactcgtcgatctcggtatccggctctgtagccgatgctcgaccgagttcgactgcagtcaataaaggtgatggaggccacatgccagttgctgataccaaacaggtcgaccttgtcgcagaattggctgccttccgccgagcgaaaaagcttgagtatgaagaagtggtccgagccgatcgagagaggcgaagtatgagcagtgctgcattctcccatctttctcctccagcggaacctactcgaccagtgtctcccagtcccagtgtaagaaccatggctgcggtctctgcacctcatctgtccatagcccagttcgtcgaaggacattggaaaggcgaagtaaagattgtccgcaatgcagtgccaaaggggcggactggagtcgtcgatatgtatgggaattacttcgagaagggatatctgtacccttga

SEQ ID NO: 12763 - DNA, 240 bp, A.fumigatus
  unsure (98),(133): Identity of nucleotide sequences at the above locations are unknown.
aggtcactgtggttggggtcaaagtccccagtcaatatcgctaaccctcaggcacgaagcagaagcaccgcataccgaaacgagggaaaatcaacgtnccttaaagtacaactccctaaagatattacccatnccctcagatttgataggacttctattgacattaagcaacccgcccaagccatttacctaatttgggccttgcttccgaggaagttcatcggcggaacgattcgataa

SEQ ID NO: 12764 - DNA, 999 bp, A.fumigatus
aggtcgctcccttttcaatatgctaattttcctgacccagtggagcttgtggggaatagggatctgatcacgtcgggtatcacctacttcgaccgcgggcagacaacacaatcaggcaatgtctatggagcagatatatgtcacatactggaccgatctggcatagatacagataaaggccaacacagaagaaccgcagagaaagcgtcttcgagagaccgatcccttcctaagtatgatactggcgccttacagcaggctggactctcgggaggagtcaccaagagtgctctatttcccgctgctgattatctgtataactttgaattcctcctgcacaactccctcccggagaccatcgatacggaactaatatccacccggtactacctggaagctcagattgaaccgtctggactatttgcctcgaaggtgctttgtcaggttgatgtcccggtcattcgactgccagcagaaaactcactggagctgactgagccgattatgtttgcccggaaatggcatgagcagctcgcctacgatgtttgcatcttcggaaaatgttttcctcttggctcacagataccaataagggtgaaattgacccccttggtcaagctacaatgtcaccggctcagggtatacgtgtccgagcacgtacagcatcatgcaaagggccaaatagctcggttcctacagctgcccacgaagaaagtgcttctgtttgaaaagcagcctggccttgcaagttacacctcctacccaggtagcaccatgcgaatcatgacagacgagggcacaggaacacctcccggcatccaaagcatgagtctgctaggggaagaattcgagacctcagagatcaacttagaggtccagttacctcgatgccgggaaatgaaaaccaaaggaaaacaccaatggattcacttcagcaccaaaggcggtagctctgaggagagtcattggatccaggtaaggaagatcaaaatcccgtaa

SEQ ID NO: 12765 - DNA, 492 bp, A.fumigatus
gttctcccgccccagtctccgatgacaatatctaacaatcccggacagcaacctgtcgacatcctcgtcaacgctgcaggcatctccatctcgaacatcctcgccaaacttgaaccagatgatatctcgcaagtccttcggacaaatctcgagggcgcaatgctagcctcgcgagctctcgtgcgcgcctccatccgcagtcagatgaagattcgcaatacctccagcacatctgaagtacctctcccatcaaaatgtattatcaacatttcttccctgcttgctgttaagggaggcaccggcgcggtaccttatgcagcatccaaggctggtatccttgggctgacgcgctcgttggcaggggaagctgcccaatccctccgaggcgttgtgattcgttccaacgcgatagtcccggggtacatagacacgccaatgattgctggtgagtcgagctctagtggagacgtgactggttgtgacgactcttga

SEQ ID NO: 12766 - DNA, 183 bp, A.fumigatus
tctaatactgatgatataactacagatttcagtgcgggggaaacctccagactaaaggagagtattcctgttcggaggtttggtactccgcatgaagttgccgacgccgctgtgttcctggcgcagaatgagtacgcgaataactgcgtcctcaatctggacggtggtttgagtgcgatgtaa

SEQ ID NO: 12767 - DNA, 249 bp, A.fumigatus
gttccatgcacacttcctcatgatggctcctttattgtcaaggcctctcagcggatggtcgtggtctaccacacggactggtggtcctcccctcaaatcttcggacagattagctggccgaacatgtatgattacaggcggcacatctggcattggattcgccattgcagaacgattcctccaagaaggtgccaagcgcgtcatcctcgttggcagatctcacgaacggcttgtcaaagccgcttctag

SEQ ID NO: 12768 - DNA, 639 bp, A.fumigatus
cggaaagacaatagcgactcagtcatgtaccatacacatattatgcgttctcgctcccgtggcgcggcagtatcggcatcatgggccacactaggccatcaagcacgtcaagctaagactaagttccatgcacacttcctcatgatggctcctttattgtcaaggcctctcagcggatggtcgtggtctaccacacggactggtggtcctcccctcaaatcttcggacagattagctggccgaacatgtatgattacaggcggcacatctggcattggattcgccattgcagaacgattcctccaagaaggtgccaagcgcgtcatcctcgttggcagatctcacgaacggcttgtcaaagccgcttctagattagaggctcctacatctgggagttcgttcgctgccgtccaatcaagcaatgatagcatcgcttgggaagtagcaattaaagccccagaaacagaccaacaatcgcaaaacaaggatacggaggcaaagtcacatggtagactaatcgactcctcgagtagaatcagtctcctcatcggtgatatatcagaagccgggacctggctgcgcgaattggagaaggcaatggtgagttctcccgccccagtctccgatgacaatatctaa

SEQ ID NO: 12769 - DNA, 582 bp, A.fumigatus
aaaatgcacactaagcagatctcgcccgccttatgtctcaccgcctacaatacagccaatcacatcacttcaattccccaatcccattccgccgacgacatgcatgaaaaggcacaagaatcaccccgacaagcccgtaaccagctcaaccagctcctcccagcacagcaaacctcacatcccttccggacaacccatcctcttcctctcaacctcaaccagcaaaaagaggggaataaaaaaagaattaaaatgcccacccccgaatccgccgcattcctggctaagaagcccaccgtgccgccgacatacgaaggcgtcgacttcgaggacaacgtcgccctgcacaatgcccgcgacgccatcatccgtgaacaatgggtgcgcagcatgatgtcccgacttgtcggcgaggaattgggcaagtgttatgctcgtgagggtgtaaatcatctggagaagtgtgggaagttgagaggtgagttttcctccgggggttcctttgtctccgagcgctgtgtggtggtggcatggctaatgggtgacgattgcaatctgcagagaaatattttgagctgctga

SEQ ID NO: 12770 - DNA, 951 bp, A.fumigatus
  unsure (75),(87),(192): Identity of nucleotide sequences at the above locations are unknown.
ttatacatcgtcatcatgtctgacgcccctcgcccttcgctcaagctcaccctgggggaaaagaaggcgcccganggagcttcgcanccaccaaaccagcctccccctctctcgtcagaaacacctcagcggaagatcacattgaaaatagcgcgcaaaccacaaccgactgaaaaagaagagaacgcccanaaaaaaaaccctcccaaaaagcgaccggcggaggggctcgcaggtccctctgcaccagaggcatccgcgcagcccgcgggaccgaaacgtatcaagctcaatgcttccaaaaagccaggggtacagtcgatccgaatcaagaacaaggggctggtccccaacagacctgtcggcgttggctacgactctgaagcctctgatacggaaatcgatccctacatcgaggagcaattcattttgcgcatgcttcctggcgaagactgcgaatatttacgtcaagcgatcaacgaacgacgattcgatcggtcagaattctccttcaagcccctcacgcgcgagggccgacgcgccgtcctgcggatccgtgataaacagtacgcagcggcgctggtggacttgccctgtatcattgaaggcatgaaaagttgggatcggcgtggatggtataagtctgcagatatctgtcagatgcttttagtcttagggcctgtttcgagcgatgcagaggccctcaattaccctcttccctccgacgtcgagatcctggatgaaaagactttgcagtatccacatggtctgacaccccctttgcgttacgtgagaaagcggcggttccgcgaacggctcagcacgcgaacgatagaacaagtggagaaggctgtggaggatctgattgcgcaagacgaagccgctattgcatctcgctatgagttgttggacaagacatcattgaaccgggcggaaggacttgtccagagt

SEQ ID NO: 12771 - DNA, 429 bp, A.fumigatus
cgaagatggtcgaaagcctgcctttaccgccctagaaaatgcacactaagcagatctcgcccgccttatgtctcaccgcctacaatacagccaatcacatcacttcaattccccaatcccattccgccgacgacatgcatgaaaaggcacaagaatcaccccgacaagcccgtaaccagctcaaccagctcctcccagcacagcaaacctcacatcccttccggacaacccatcctcttcctctcaacctcaaccagcaaaaagaggggaataaaaaaagaattaaaatgcccacccccgaatccgccgcattcctggctaagaagcccaccgtgccgccgacatacgaaggcgtcgacttcgaggacaacgtcgccctgcacaatgcccgcgacgccatcatccgtgaacaatgggtgcgcagcatga

SEQ ID NO: 12772 - DNA, 510 bp, A.fumigatus
aaaggccccctttgctctttcctgaagcttctttctctccctgagatgcacttctcagccccaacgcgcctttcgctgcccgcagccaggcaatcccctcccctatcttccccgcaagctccgcatcaacaccgaaaaaccgacaggcccgagcccgcgcgacacggcccaaaactcgcgcatagccgaccacttcttcgtcaatcccggtcttcccatgcgcgccaaccgttcccatgccagcagccgcctgctccgcatactcggccgcacgaacgcacagtcgcgcaaagagcagcgcccgcaccttggggatctccggcgcccgcaccatccagtccttatcgtttgggtttcgagcctgtatgcaagccgcaacataggagtcgtctttcaacacagccaggagtgtcgcttcagctaacgcaagtgacgacagtgccgcctgagccgccgggtccaggtctggtacggcggcggctgtgctcgtctggcgtgctgcgcctataa

SEQ ID NO: 12773 - DNA, 1455 bp, A.fumigatus
  unsure (78),(221),(224): Identity of nucleotide sequences at the above locations are unknown.
actgcatctgtaaataggctgtgctatgaagacgactcttggcctcgcggtgacatcaacagcggatcctttcgcttnctcatccccgccatcttcaacctccgcattgcagtaaagaagtccagcaccatggtgtatgcctttgctctccctaccaccactcatctttcctttcaaacttttctctcatctagcacacatccatctctacccccagccgngtntaccgctcgacatgcactgcgactcgccctcaaggcccacaaaagactaccccacagtccacaacgagattcccacctcatcacaatcctcgacgcgctgaacggctacctaccatatctcgctgctatctctcatggattgagcggcagacctgttgaaagtggaagcagcacaggtggtgaagaaatcgaggtcactctccacagcgagctcgaaacagaatggcgcgctacattaagctcaactccgttatcgctgaaaagccgacccataaacggccgagtccgcggacaaggaatcgactttgagatcgccttcgtcctcacgacactaggctacgtgctgagcggcttggctcgctcaggcatcttacgcgctctctacgcccccaccactccaaccccagaacaacgcaccgcggccgtccaaaccgccacgaaatacctcctgcaagcgagctcagtacactccctactcgcgtcttcgccctcgtttataggcgcagcacgccagacgagcacagccgccgccgtaccagacctggacccggcggctcaggcggcactgtcgtcacttgcgttagctgaagcgacactcctggctgtgttgaaagacgactcctatgttgcggcttgcatacaggctcgaaacccaaacgataaggactggatggtgcgggcgccggagatccccaaggtgcgggcgctgctctttgcgcgactgtgcgttcgtgcggccgagtatgcggagcaggcggctgctggcatgggaacggttggcgcgcatgggaagaccgggattgacgaagaagtggtcggctatgcgcgagttttgggccgtgtcgcgcgggctcgggcctgtcggtttttcggtgttgatgcggagcttgcggggaagataggggaggggattgcctggctgcgggcagcgaaaggcgcgttggggctgagaagtgcatctcagggagagaaagaagcttcaggaaagagcaaagggggcctttctagattgaagaaggaatgggctgagagacgggaggagcgaaggttggaaaaggagtcgggcggcaaagaccgcgtggcgaagggtgagctcgatcccggcgatgacgcaggcagggaagaagagtgccgtgtgatcgaaatgctagagacaaagtgggagaggatgaatgacacggtaagcctcttttcagcagccctggggcatgaaaggtctttgacagtttga

SEQ ID NO: 12774 - DNA, 405 bp, A.fumigatus
  unsure (377): Identity of nucleotide sequences at the above locations are unknown.
ccgacaggtagcagcatcatgtccgggcctaatctacacaatgctcttctccgcccacccatcattcagatcttgcgcgcagccggcttccatgccacgcgtccgtcggtcttagatacactagccgatcttacagctcggtatatgatgatccttgcatcatctgttgcatcccatgctgccaatgctcacccgaacgatcctgcccctgcgccggtgctagaagacgtctaccaggcacttcaggacgttggcgcactacgaccgcaattgcgcgaatgggaggaggattggcaaggcgaggaagatacgcggggactggagaatttcttgggttggttcacaggaccggcgaaccgtgaaatccgacgagtggntggttctaacctagcgagggtgacatga

SEQ ID NO: 12775 - DNA, 225 bp, A.fumigatus
gtacgcatagacccgacccggatcgttgctgagtctatcaaggagggacagccgtttctcttcgtctctttcaactaccgtctcaatatctttagttttggcgacggaaaggagaagaacctcgcgataaaagaccaaaggttggccattgactgggttcgggagaacatcgtagaatttgggggtgatccagtgagtgatccaacattgcttgagaacacctga

SEQ ID NO: 12776 - DNA, 843 bp, A.fumigatus
aatccaacgcaaaagcacctacgggatgggcgtgtatctctttctggcacgacggatgagcgtgacagtaacggtcgtaaggagcatgttgcaacatcgagctcgacaccgcgaggcgacacaattggggatgcaaaccaacagatgccccgcaagagacgtttcggcgctgttgccaccctgttggcctcagaccggatgcttgtcacgttatgggcttattttatcgtggctgttgcgttgacatctctcgatagtgtccttcctcttttcgttcaggatacgttcggttggaaacagacagcccaaggactcatcttcattccagtgtcggtgcctcatgttctagatccgttcttcgggtacatcaacgacaagtttccccaagctcggcgctttgtagttggaggagcgttgctcataacaatcccattgttcgtgcttctccgacttgtcacaatgaattctatgagccaaaaagtggtgctttgtgtgctgttagctctgatcgggctctgcctggccttcctgatccctccgctctttgttgaggcctcgtacgttgttcaggagaaagaagcagagtcacccggagtcttcggcaaaggaggcgcaatggcacttgcgtacggcatcctcaattctgcttttgcagctgggtctatggtcggtccattcctggctgggttcatccgagaaagcgctggctggagcacgatgtcctgggtcataggtctgctgatgggcgtgtctgctattcctatactgctttttttgggaggccctatatggaaacctatggaacggcatgctgagagtcagtctgccgaagcagctggataa

SEQ ID NO: 12777 - DNA, 933 bp, A.fumigatus
  unsure (56): Identity of nucleotide sequences at the above locations are unknown.
agcaatcttgttggattgggtaaaacccccaacggcgaacccaatggatcgggganggacggacccggccatgaaagaccgtcagtggaggaccccgctggtgaacggtggcagccggacggggctacagagggtgtcttgaagctcttactggattccggggccagcccgaacgagagccgtcaatttcctcgggtgcccctttctctggccatccaatatggacacgacgcagctgtgcgagtattactagcccgggaagacacaacggttaccctgccatccgccccgttcagccaacaaccgctgcatttcgcgttaggacgcgggtcgctggaatgtgtgctcctcctgatcgagcgaggcgccgatctccagcagtatgagtctaccggctcccgggccctctatcccgccattagcagcgggagtcacgctctggtcgagttcctcgtgaaccgcgggtgtaatccactcggctgttgcgggtatacggcgctctcgcttgctgcagtcatgggacaccagtcactggtgcggtacttcctggctcagggagtggatccggagatgcgggaccgtaccggattcactgctctcgggcacgcggccaaggcgggccacgcggatgtcgtcgagacgttgctggagtggggcgtccggcgagacaatgtcggcgaggacggagagacggccctgtgctgggcggcccgcgaaaaccacgcagtggttgtggaggtgctcctgcggcatggagcagatccaaactcgcccaaccctcgcgggatacgccccatccactgggccgtcaccaacgggtccgtccccatattcaaagcgctcgtggcccggggtgccccggatagacattcacctcgagggagaaacactcctccatatcgccgcacggcggaacgatcggccgctggttga

SEQ ID NO: 12778 - DNA, 666 bp, A.fumigatus
accgcgggtgtaatccactcggctgttgcgggtatacggcgctctcgcttgctgcagtcatgggacaccagtcactggtgcggtacttcctggctcagggagtggatccggagatgcgggaccgtaccggattcactgctctcgggcacgcggccaaggcgggccacgcggatgtcgtcgagacgttgctggagtggggcgtccggcgagacaatgtcggcgaggacggagagacggccctgtgctgggcggcccgcgaaaaccacgcagtggttgtggaggtgctcctgcggcatggagcagatccaaactcgcccaaccctcgcgggatacgccccatccactgggccgtcaccaacgggtccgtccccatattcaaagcgctcgtggcccggggtgccccggatagacattcacctcgagggagaaacactcctccatatcgccgcacggcggaacgatcggccgctggttgaaatgctcctccagctgggcaccgaagtggatccacgagacaacgaggggccggactcctttcgctgtggcggcggcaggcggccatgtcgccatgatggagctcttgctcgccaacggcgcagacatgactacccgcggtcgaggcacatgcgcgccgctgcacagggccctctggagctgtcaagatga

SEQ ID NO: 12779 - DNA, 591 bp, A.fumigatus
ggccgccgcgttcttgctccgacgaggcgcggatccggactttgcagcggccgacggttcccgtcaacccatcctcgccgtccgcagtcgaatggtccgggtcacgcggtatctcctggaacacggcgtcgatcccgatccgctgtcgaattgcggtcgtaccccgcgctgcttgttgcctgtgagaggttcgatgcggataactacgcgatcgctgggatgctgctgcggaccggtcgagtgaacgtccatgcccgaaacgcggaccgacgcacggcgatcatgttcgcgaccggggaagacggggatccgcagctcgtcaggcttttgctcgcccacggggccaaccccgacgatcaggaggaggacgggtggagctgtctggagagggccatcggggcgggaaacgaggagaccgccaggatcctcgtcgaggctggggccaacgtcaacgcccgggacagctatgggcagactgctttacatctggtgcactcacgggatcctttctacgcatatctgctggaaaagggcgcagagctctgctgtcgccatcattatcatagtgatagttaccaactcagcaaatga

SEQ ID NO: 12780 - DNA, 501 bp, A.fumigatus
acattcacctcgagggagaaacactcctccatatcgccgcacggcggaacgatcggccgctggttgaaatgctcctccagctgggcaccgaagtggatccacgagacaacgaggggccggactcctttcgctgtggcggcggcaggcggccatgtcgccatgatggagctcttgctcgccaacggcgcagacatgactacccgcggtcgaggcacatgcgcgccgctgcacagggccctctggagctgtcaagatgaggccgccgcgttcttgctccgacgaggcgcggatccggactttgcagcggccgacggttcccgtcaacccatcctcgccgtccgcagtcgaatggtccgggtcacgcggtatctcctggaacacggcgtcgatcccgatccgctgtcgaattgcggtcgtaccccgcgctgcttgttgcctgtgagaggttcgatgcggataactacgcgatcgctgggatgctgctgcggaccggtcgagtga

SEQ ID NO: 12781 - DNA, 825 bp, A.fumigatus
  unsure (801): Identity of nucleotide sequences at the above locations are unknown.
gcagtaagaatgttcaccaatgaccgtggggatcaggattccggtatgtcggtagagatggatcccaaataccgtccagatactgaccctctcccagtgagctccgaggtcaccatcgtcgattgggatggtcccgacgatccggaaaacccactgaactggtccaaggcgagaaaatggctcatcacctgcgtcgcgctgctcatgacgtttgtggccctcatgaacggcaccatcatcaccgtcgcccatgaagccatcaacgagcggtttgggatcagcgatgccgtcttcccgcactcgtattggccggtgacctcctgggccctcggcggtgtcgtcttctcgctgctcatcctccccatcatggaggactttggcatccggcggacgttcctcctgacgcatctcctgttcatcctgttcgtcattccccaaggcgtggcgcagaactttgagacgctggtgattacgcgtttctttgccgggggctgcgtgacggtgatcggcaacagtgccgccagcgtgatcggcaatgtgtgggaaacggagaagcagcgcagtaagcccgtcagtctctggatctgggcctatctggcgggaagcagcgttggcccggtgattggcgcgtccgtcttccagtttcgatcctggagatggatctcctacctgcagatgatctggctcggggtgttgttccccatcaactttctggtgttcagggaatcgcgcgcggcgatcatcctccaccagcgggcgaagcgactccgcgccaaagggcagaatgcgccttttcgaccncaggtattgaagatccgcctcccc

SEQ ID NO: 12782 - DNA, 441 bp, A.fumigatus
ctgcctgagctttcaagcaacccgctcgtggagcatgtttatcgctcccgtccaccctccgcatcagctatccttcccctctatctcgcccactcaccccctcgtccgtcactcctctacattccaaatatcacgcccccggtgacggtcttttctatcgtacagtcaaacctgctgtttttggccctttccgaagttgataccgagccacttcttgcactggagttcttgcaccgagtagttgatgtgcttgaggactttgttggggctccattactctcttccaagcttcaggcgaactacgatgtggtcgcacaattgctccacgaaatgtgtgacgccggcatcgtatgcaatacggaaccaaatgcgctgcaggaagttgtggagatgccgggatggatggggaagttgttgggaggcgttggactaccggggtga

SEQ ID NO: 12783 - DNA, 258 bp, A.fumigatus
gacacacgacagaccggcatgatgagcgaggtcgatgcgctctacatctatgatgagcataagtatgcgctgcctttaatgacttccccgaggttgaatttcatgagtgctgactgcctgagctttcaagcaacccgctcgtggagcatgtttatcgctcccgtccaccctccgcatcagctatccttcccctctatctcgcccactcaccccctcgtccgtcactcctctacattccaaatatcacgcccccggtga

SEQ ID NO: 12784 - DNA, 1443 bp, A.fumigatus
ccggcttatactgcgtacaggtcgtctacacctatactagggccttccaaccctctgaaaaccccattatcatcctcaaatatcccacagggccctgcgatcccgtggagaaaggccggtgtgcggcacacgtcgaatgagttatacgtcgacattattgaatcactctcagtcacgattgctccatctggacgactactgtcagcgctggtatcagggaccattgcgttcacagctaaattatcgggggtacccgacttgctcctcacattaaccactcccagcggtccccaggctgtggggaaaaagatagacctgccggtattccatccctgtgttcgactagctcgatggagagagcgacctggcgaactcagctttgtgcctcctgatggccgatttattcttgcaggttatgaggtggatctgcttcctattgatcctaatattgaccaacctcctacgcatatggagaaggtgttcttacctgccgttgtcgaagtacgcaaatcactaggaccgacgggatcggaatttgaggtccgattgatattaaatacaagctttccaggatactcgtctttcaaccgccccggagcagggcggggcggatcgggtacttccactccatcgttcctcggaggaggcgggaactcctcagcacctgtccttgaagaggtcgtggtcacagtgccaataccgaagacggttcggaacatcaccgatatgcaggcgagtcgcggagaagcgatattcgcgcccggcaacgacactttggagtggcggatacctaccaaagactccggaactgtttcgggcacagcgactcttcgctgcacggtcgtcggacaccagaatgtagaagatgagattgaagaagacaatgacggggcagacgcagacgcaaattttttgcaaggatactacgacgcctcaacagcagcgtcttaccaggtcgccgaggaagctgcaacaggtaccacgaaacggaaaacaaagaaaaagaagaagacaacaaagacaacaaagacaacaaagacaacaaagaccaagaagtcatccaaatccgccgctgccagcgcgctcgtcgcctccgatcaagacagtgtaccgcaaacctcccccaatccttctaaacctcaaagccctgcacctgaatcgtcgtcatcgccagccgcacccgcccctgcacaatcctcctctcaatcgtcgtccttattctatacaccacctcgtaaaaccaaggcacaaataaacgccagccttatgccgaactccgcctctgtctcattttctgttaaaggttggctaccgtcggggctccgagtcgacagtctgaacatcgacccacggcgcagtcgaggcctcggagaaggcgtgaagccatacaagggggtgaagtatctgtgcgtcagcaggaagggcgtggaagctaggtgctaa

SEQ ID NO: 12785 - DNA, 192 bp, A.fumigatus
aaacacataggttcggccgcgttcattggccttggagtatacagttactacacgggaatgaataatctacggaagcaggaacaaacaatcatgtggagcgcgacaaaatacaagatgggatctcggagattgggcattgcaactatatctgcaacattagtaggcatgggaatatggagggctttgaattaa

SEQ ID NO: 12786 - DNA, 2034 bp, A.fumigatus
gctcctaaggaagagcttgcgacatccattaagcgcggatacccattgtcttccgttgaactcatttcgccgggaatgagttccaacaatggcattattgacactttcagccctggggccgccagcaccaacaccggcagcagatctacgtccaccgtccgaccacgcacccgccgtttgatatctgtcgatgatgttacagacgaggactatgaaggaccattgcagtccaccaggctttctaccacaacgctctcacgagactcctccgctgtccgctcacgaggtgccaccccatcaccccacacgtcccgcgggacgtcacctcttccaatgcggcatccttctcgcgccactgagtcactcaacctagatgatcttaacaggttcggtggttccctaggcgggcacagtcagacagggaaggcacaggtcaagttcgccgattcttcgcgggcagcggtggattttctagattcatcatggacctctttacaaagcctggcatcttctttcctggggagcgatattgcccgatccgcaccgaatgggacggcacgtacccatgcgaggaagccttcgcgaccagacccgtacatgagggctaatccaaagacaccctcagcatggggtccgtcgaccccgtccacatcggaaattgcagctggaacaaaggaagagagactggctatggtgcaggcgaagaagcgggaggctctactactaacagacacaggttcagaggctagtcgcgacattcggcacaaaaggcgagattccagtgatcggacggaccacgcggcggtcgatgcaaggcaggacgaggaggctttagtatatgtacaccacgttcaaccgaatgacagcataactggggttgcaatcaagtatggctgtcaaccagcgatattccgaaaggccaatggattttggcccacggatagtattcagagcagaaagaccgtgcttttgccggttacctcctgttctgtgaaaggacggccgatccgtgccccgaccgaaattgatcttttaggaggcgacacttcgaaccgggattctttagaggatctgacaggaagctcgatagcacctgcaccaagttcagatgctagggcttcctctaccgagggagaagcacctacagaagcgccgcttgaaggagaggcagataagatctggaagcatcagtcgtgggtgcagatagataggttttctgcgccagtagagattggccgcgttcctcgcaaagcgttgggattcttcccgcgtacacgacgaaaatctctatcttacacagactccgaacctcgttcatcaatttccggccgcgagcgaacggcagctctcacttcagctctgccttcaccgacagagtcgccatcatcgcaagcgtccactgcacagaatcgaagctccacagacccttcaggggcgcgagccatatctagtgccaagccgagaccgcaccaccaacgccaacgtagcaatatacagctcgtaggaacaggagttggaacgctcgatcgcagtgcaatggctcccggaccagctctcgacggattgagtaaatttgtcgcacaacatctgccacagttagctcctgcacctgcgcctcctggcctgggaaggacaccgtccgagtatgccgcggctacggcttccaacgcttcaactagccttgacaatatagggggtgcagttgaaggttgggtgagaaaattaacgactcgagcgaaagtaggtctcagcgagctgcaacagagcgctcaagcgtatcagagcaatactggtgcgaggactagccgacgtggtatgggagatttgattgaactggacgctggcttagagtcaagggattcatctggccttctgccggagagttcgcggaaaccgaacctgaaccgatcaggatcaaacctgcacgacgcatccttgagagagcgtttccccagtccttcgtcatccggaacgagcaggactcgcacgggtggatcaaacctaggctatggcaaccgagtgaaggatgattga

SEQ ID NO: 12787 - DNA, 495 bp, A.fumigatus
caggctgatttccacggagatggctggtttctcagcgacagagagaaatccaacatggcgcgtcgaatctcctctctcgcctggctgtctctcttactaggtgcactgagccgtgccctgcccagctcgcagacccaaggcgccattgcagactatcccacagccaccctgcgtacaagctatcaatccggctcaaaaaccgtcttcgtaggccgctccctaccagagttcgaccaggaactgttcctgggcatcaagtatgcagaccagccaattcgatttacgccgtcgagcctgaagacatcctatgctgccaacgacagtaactctggcccttatgatgcctctgggactggcctggctttgtccaagggcacggtgctgtacaatgccacgcaatacgggcacgaatgtcccggctacggatcggacgagacgaagctggtcgacatgggggtcttacacgccgaggcggcaaggtactgcgctcaatag

SEQ ID NO: 12788 - DNA, 1887 bp, A.fumigatus
gaaatgcagatatgtgcgtgcctgcgttccgcacttagcatcgaagagctcagtgatcatgccttttcggcctggagcgtgttggtcagctctctgcacgaagaagagctcgagccactcattgatcaaacattctcaattgttatcagatactgggatgcttttaactatcaaagcaagaagactgccgaggaactgatcggttatattctcagaagccacagtggactagtacacactaatttcagcaccatcccctcattggcttcaattccagcattatctgcgcttgaaagtgagatcagtaagatgaaagagaagatggatgttcgaagtcaactttcggcttttggacgtcgctgccaaagtgagaatgccgctgttgttgaacaggcattgagagagctgttgccctgtctttcaaggcatgaagaattcttgcatgagtccgtactaagtgaacagcctgacccagttgttgcacaattaacaaggtccttgctggattgctgcgtcaagttcaacgcgggttccgacagcataacacttctttcggctcaatgtctgggccttgtaggctgtctggatccaaatcgagttgatccggtcaaggataaaaaggatattctcgttttatcaaacttcgacagaatggaagagacctttgattttgtactttttttccttcaacatgtgctggttcaagccttcttgtcggcctccaatacgagggcccaaggttttcttgcctacgctatgcagaacctgctcagactctgcaacctcgattcggccgtcacccagcgctcccgagatgttcaagcggatgaaaagtaccgtcgttggtcggaattacctgagactgtgcgcaatactttgaccccttttctcacgtctaagtacacggtcacagtcggtgccataagatcgcgttgcaagttcccgatattttccacagagctgacgcatggcgattggttgcgaagttttgtgcaggatctgctgcaaagaggaagcggtgacaacgcacagcttatttttagcgtttgcagtcgtattgtcaagggtcaagatatttcaatcgccagctttctcctaccattcgccgtactaaatcgtatagttggtggaacccaggaggagaggctagacctgcaaagtgagctcacaaccatactctcccatccgcttcctgaagcaagtaatcgggttcacgaagccatcatactatgcagtcaggtgagcgttccttttgtatccataaggtctgtacatactgctttcccgcttctgacaataggacagagcgtctttgaaattttggactacctttcaaggtggctacaggggaaaaagaagctcctccacggcctcaagaatcatgcatctcatactggccgttctcataaggattctcatcaagattcattatccgaaacgtattcgtctcaggtcaaagctgtggaaaccttcttgggctcaatacccccagaagtcatttcgaaaagagctgtcgaatgcaaatcattttccagggccttattccattgggaacagtatatccgccggttcaagagtcaatccgataagaatgaccacacaagcactgagcttctctaccaacatctccaagtgatttacagtcaaattgacgagcccgatggtattgagggcatttcatctcatttgcatgtgctgaatattgaccaacaggtcctccaacaccgcaaggcgggcagatgggttactgcgcaaagttggtacgaactgcaagtcgaaaaagaacccgacaacattgatgcgcagtggaatcttcttacgtgtcttcgagagtcagggcaacaaggtaatctccaaatgaagagctgccatcaatgttggcgttaa

SEQ ID NO: 12789 - DNA, 528 bp, A.fumigatus
ctttctaaacttgctcagcgtctctctgtgactcctgctggtttgttccggcctttctggaggacattgtcgataacggtggtgaagaattttcagtcccgtccacacatggctgagcaactctgtgatctgctgggaatgaatgtagatgattttttaagattaactgaggttcacatcctgccatatcttgttctcactcgaaaacgagacgtcatcacgagggttggtgcagcctacaagcatatcaaaacacctttcgacatttgctccgagaagaacaaccttgcagcgattcttgcttttttgatgagtcaaccgtggtcggacccggaaggtatgatcatgtccgttctatccgatattgactccgctttcggcggacgcactttggcggagctggtaagaacggagccaatcttgattgcttgtgatctgttaaaaggccttggtgattcgggaagtgagaaaggcgcacgggcatgtgagaaccagttcctttttacattgagctgtgtgctaatctga

SEQ ID NO: 12790 - DNA, 330 bp, A.fumigatus
tttcatcgagctctccatttgttggcagccttagttccccgcaaatctactgctacatcaaagaaagctaatttgctttgccatttcattgaggagcatgttctgggtataatcacgcagttcgcgcacgcaatcaacgactttcaaataagacagcctttgattgaaaagaggcgaaatatcttggccattggtgagatgatcaaagttgcccgtggccatatcagcagcgcattaccacaggtaagtcgctgtagcattccgttcattttaagtcggtactttgatctaagaaatgcagatatgtgcgtgcctgcgttccgcacttag

SEQ ID NO: 12791 - DNA, 876 bp, A.fumigatus
gcggaggatgcgtttgagcggcggaatgaggattggagggcgattgtggagaggttagtttttagtaccaccactacaaccacaagccaggaggaggacgaggaggaggaggaggaggaggagcgcgcggcgctgcttggttcgtcgagggcgaccggggagagtgacggcgagggggtatttacggggggttatctctttctcgcgggtgatctcaactaccgcacgtccaatacgctgccacagccggcggatatcgcgcgtttccctggcctggaggccgacgagagcgacccgctgcattactcgcggctgctgcgcgaggaccagctcacccgcgaacgagagaagcgccggtgtttccacggcctgtctgaagcgccgatcggtttcccgccgtcgtacaagtatgaactgggggcgcgggatccgcgcgactggaagtttgtccacagccgttggcccagctggtgcgaccggatcctgtatctggagtcttcgacggcgacggtaacgccctaccgatatgatgcactgcctctatttccgacgtctgaccatcgagccgttgcgctggcggcggcggtggtgctgcggtcgatccaggccggtccatcggattcagaatctgcccctgcgacagacatgcagcagcagcagccgcagccgcagccgcagccggcgccggcgccggcagccccattcccgatcgaccgggactggaaacgcaaacgagatgaggcccgacgcaaggagttggtggtgggaggattggcgtatctggggttgacctgggagggccgtcggtacctggtgggcatggtcattggcggattgggagcgtggttcattctgcgatcgatgctcaacgtctga

SEQ ID NO: 12792 - DNA, 492 bp, A.fumigatus
ccatgcccaccaggtaccgacggccctcccaggtcaaccccagatacgccaatcctcccaccaccaactccttgcgtcgggcctcatctcgtttgcgtttccagtcccggtcgatcgggaatggggctgccggcgccggcgccggctgcggctgcggctgcggctgctgctgctgcatgtctgtcgcaggggcagattctgaatccgatggaccggcctggatcgaccgcagcaccaccgccgccgccagcgcaacggctcgatggtcagacgtcggaaatagaggcagtgcatcatatcggtagggcgttaccgtcgccgtcgaagactccagatacaggatccggtcgcaccagctgggccaacggctgtggacaaacttccagtcgcgcggatcccgcgcccccagttcatacttgtacgacggcgggaaaccgatcggcgcttcagacaggccgtggaaacaccggcgcttctctcgttcgcgggtga

SEQ ID NO: 12793 - DNA, 261 bp, A.fumigatus
tgtgattggtcacactataagttgtactacctagtcatggagatccggaggccctcccgacacggaaaccatcccgaccgaacttatcaacggacctacaaggcctgtatatcctgccggcaacggaaggccaagtgtgatctggggacgggcccggatggacttccccttggccccccttgtgcgaaatgtcgccgggaacagaagccgtgtctgtttgacgagaagagggcctgggaacgggtgaagaagcgaggttag

SEQ ID NO: 12794 - DNA, 795 bp, A.fumigatus
agacgtgcctcttcagtcgtgacttcaggcactcctatccgccgtcccaatggccaaatcctagccaaccccgccgctaaccccaaggtgccgaccttttccccctgcaagagattggatatcgaattggaacttgccgcctttgtcagcaagagtaatgagctgggcaagcctgtttctattgatgaggctgaggactatatcttcggcgtcgtattgatgaatgactggtcggcccgtgatatccaggcttgggagtacgttcctctgggaccgttcaacgcgaaaaactttgccaccaccatcacaccctgggtggtcttactcgatgctttggagcccttccgcacggccggtctagagcccggcaaccgcgaatcgctactgccctacctgcgcgagaagcgcgaactcaatgcctacgacatccctctcgaggttgagatcactaacgctggtggaaagccgactttgatctctcgcaccaacgcaaagaacctgctgtactcgttccctcagatgctggcacaccacaccatcacaggttgcaacatgaacaccggcgacctgcttggcagcggtaccatttctggcaaggagaatcagactcagggcagtctcctcgagcagactaacggcaagaaccctctgaagctggctgatggctcgcagcgattgttcttggaggacggagacaccgtcgttctgcgaggcatggctggtacggaaggaaactacgttggctttggcgactgcgttggcacaattcttccagccctaaagttggagttctaa

SEQ ID NO: 12795 - DNA, 210 bp, A.fumigatus
agaagatgcactgccggatatttcattggtctgggggcggagattgacggctatttcaaaattcccgcattctgttcctcctcccatctcgattcaatgtcccatttacagcttacccaatccgaaggcccagttttgaaagctccctaccgcgcgctcctagaagtattgtctatcacattacagattgatttaattaccatgatgtga

SEQ ID NO: 12796 - DNA, 732 bp, A.fumigatus
tcaaatttaacatcgtctttgcatccaacgatcaccatggaagactcaacaagccccaaagtcaccctatacacctatttccgctcctcctgctcagccagactccgcatcgccctcaacctcaaatccatcccttacaccccaatagccgtcaacctcctcaaaggcgagcaatcctccccagaaaatatcgcgctcaatccttctggtacagtccccaccctgatagtggaacacgactccaaagaacccgtgaccatcacgcagtccctcgcagcactcgagtacctcgaagaaatcaccttagcctcatcccacgctctccttccaccagcttccaaccccgaggcccgcgcagtcgtccgcaccttggtagacatcatgtcctgcgatgtccagcctgtgactaatctccggattctgaagcgggtggcgccattcggcgtggaccgggcggcgtggtcgaaggatttgattgaggatggcttccgcgcgtacgaggccatcgcggcgaagagtgcggggcttttcagcgtgggtgatagcattaccatggcggatgtgtgcctgcttcctgcggtgtggggtgctgagagggcgggggtgaaggtggagaagtttcctacgatctaccgggttgcacagcgattagaggaggaagatgcggtgaagagggcgcattggaggacgcagcctgatacgccggaggagtttcgagtgagttcttcttga

SEQ ID NO: 12797 - DNA, 375 bp, A.fumigatus
agacacccaccttaccaactccgcaatggtccgactcaccctatccgtccggggaatctcatgcccgcccccatgatcaaacaccctcctctttcccggctcacaaatccccgaaagctgcaccccagccgcatacctcggatccttagacccataaacatgcaccgtcggaacccccaccgtaaacgggccccggatcgccccccgaagctcctcctcatccaccgccccacccctcgacgcatcacccatccaacgcgccgaccccctcgccaatatcgacgcagaatgagcctgcgtcgccaacgcctccctcccggcccgatcgcgctcctttactgcgtcagaaacctcaaaccctatgctctcaagtag

SEQ ID NO: 12798 - DNA, 438 bp, A.fumigatus
atattgtcgaaaagccgtcttccctcctccactgccttcacgatagatgaaaagttatcatccgcgagtaccatgtcggccgcttcttttgcgacatcgctgccattcttgcccattgcaatgccaacatctgcgcgtttcagggcgggcgagtcgttgactccgtcgcctgtcatcacacagaaagcgccgcgtcgatgcatcgcctcaaccattcgaacctttgttgcagggctgcatctagcgatcacaagaggtagctgctcaatggcgtctatgtcagcatcagacagctcgtcaaactcggcagcagccatgactacgcgacatgatctgctatccaacattggaccaagaattccgacttccgacgcaattgctgtcgccgtcttgatgtggtcaccggtgagcatatgtacggtgattccggccatctga

SEQ ID NO: 12799 - DNA, 846 bp, A.fumigatus
cacctgcagttcctgatgcacctgcttatatcaaatatcgctcaagtgatcctgctgttgatagctctcgcgtttaaggatgaacagggagactcgatattccctctttcgccgcttgaaattctctgggccaacctagtcacttcatcgtttctagctttagggttagggttggaagaagggcagcctgatctgatgtaccgtccaccgcatgacctgaaggttggcgtcttcaccaaagagcttatcacggacaagatgatctacggtaccttcatgggatctttgtgcctggtggcctttgtatgcgtcatctatggggccggtgctggtatttcggacctgggagaggactgcaacaatggctggaacgaaacatgcaacgtcgtcttccgagcgcgtgctactacctacgcctcgctgacatttcttctactgatcacagcatgggaggtcaagcacttctcccggtctctattcaatctagatcctgataaatatcccggcaagctctctgtagtgcagtccatatggagaaatcggttcctattttgggcagtgattgccggcttcgtggtggcctttccggtgatctacttgcctgccgtcaacagactggtcttcaaacaccaaggtatcggatgggagtggggaatcgtctttggatgtgtcgctgtgtacctggcgctcgtggaaagttggaaggcgatcaagcgggcttacgggattggaagcgggaagaacgcaacgctcacaatgggggatgctgagatgagagctggtttgacgctgacgccatgtactcttttgtcgatgagtgccaatgccagcgtggagatgaagtag

SEQ ID NO: 12800 - DNA, 516 bp, A.fumigatus
  unsure (13): Identity of nucleotide sequences at the above locations are unknown.
cgttctcccttcntgaagcgcatatattttctagccccggccgtctatgaccgaacggcgtggatacgaggtgctggtgttctgaccgttcaggataccaccgacccatacgaccctaccagcggtttagttcaattgaacgggtctggctgggctcctgaaaagcattgtgataacccggctctctctacttttctcaccactatctctttatgtaatatgtcagtcgtccaaaatgaggagccatctggcccctcaagtggtcgctggactgctgtgggggaacccaccgaggtcgccctgaacgttttggcgctgcgggtgggttacgagaaatcgactatactgcagagagccggtatgcagctccacacagagtatccgtttgactcttctattaagcggatgacaatcgtctacaaaaactcgggcgagagcatgaacgatgtgtatactaatggagcccccgaagctgttctgccaggtctcgccatttctgagaaagaaaatgaataa

SEQ ID NO: 12801 - DNA, 669 bp, A.fumigatus
atccagtatgaatctgatatgatggctggggaaggacttcgtgtcctgtgcattgcacacaaaagagcacccctcgaagacgaatcccaagtgtcctctcgcgccatggctgaagtcaatcttgagttctgtggcctcgtagggctttacgaccctccgcgcgccgaaaccgctgctgctgtgcgcaagtgtcagatggccggaatcaccgtacatatgctcaccggtgaccacatcaagacggcgacagcaattgcgtcggaagtcggaattcttggtccaatgttggatagcagatcatgtcgcgtagtcatggctgctgccgagtttgacgagctgtctgatgctgacatagacgccattgagcagctacctcttgtgatcgctagatgcagccctgcaacaaaggttcgaatggttgaggcgatgcatcgacgcggcgctttctgtgtgatgacaggcgacggagtcaacgactcgcccgccctgaaacgcgcagatgttggcattgcaatgggcaagaatggcagcgatgtcgcaaaagaagcggccgacatggtactcgcggatgataacttttcatctatcgtgaaggcagtggaggagggaagacggcttttcgacaatattcagaaggtaatctcgacttgcggttttgtatgggcatga

SEQ ID NO: 12802 - DNA, 213 bp, A.fumigatus
cggagacttcctgcaatggcttcagtacaacgcagaaaatggtatcagatcaagtggtttgcggacgatgacacgaaagaggaacggcatctcatcatgaagctggatcttctaattgttccatatgcctttcttgcgtactggaccaaatatatggaccaatccaatataagtaggtcatccaatgaaatgagccatactgaactagactaa

SEQ ID NO: 12803 - DNA, 279 bp, A.fumigatus
actagactaatcgtactcgcagacaacgcatatgtttcgggactttcagatgatttgaacctgcgcggtaatgagctcgtccatctgcagacaatatacaccgttggcgcagttctagggcaaatccctttcgcctatctcttcaccaaatttccaatgtcctgggtcattccggctttggatatttcatggggagtgtttacattactgcagtatcgagtgacctcgtacggggagttgatggcttaccgatttctcgtcgggtggtttgaagtatga

SEQ ID NO: 12804 - DNA, 1173 bp, A.fumigatus
acaacggaaccaactcacatttgccacacaggatcttggtatcgcggtgatgaaatcggccggagaggcggctgcttttatgttggcctcaccctcggaacattgacttcaagcttaatccaagctgggacatcggcaaggcttgacggcgtccatggtctggcagggtggcgatggatgtacattatctgtgcaatcatcaccattcccattggcttactgggatatgtaatcttacccgggactcctgacaagccgaacagattagtcctcaaacaggcggacatcgagctggccaaaaggcggcttcaacgagcaggacatggtgtacaagaacatttccgatggaaggcgctcgtgagcattgctggcaattggaaattttgggctttactcctgctagatattttcttctggaacggaagcattaacaccactacaggaggctatctgctctggctgaaaagtctcaagagattctccaccagtcgcatcaacgagctcaacgcgatagctccagcattggggatcttctacacactcttcatctgtttttcatcggatcttttgttcggtccagcctgggctatcaccatcgcacacacttggaacatcattgggctggtgatactcgtcgtgtgggatgttccccagtccgcgctctggtttgcatttgccacgacctattcggcagtcgctatgtccagtgtgctctacggctgggttaacagtcagctgcgatactcccctgttgaacgagcggtggcactgatcattttgaatgctgtctcgcaatcaacgaccgcgtggacgcccttgctcgtcttcaagaccgttgaggctccccgattcactaaagggtactcgttcgtactcggcaacgccatatgcttggttatactggcgcatgtcattcagttcttcgcgaaacgagaggagtatgcactctgtcacattttcattgatacgtctaacagacctacaggagaatttcaaaaagagcaggaggcaactccgacgtcagcgactcagatgaaacgagggatattgaacctggtgatagagcaatcctgcaggtgtatccagagaagtagtcacccacgtcgcaggatgatagacttggcagatatgcagcctgaaagtatgtatgcagggccgtgtgtagacgaatga

SEQ ID NO: 12805 - DNA, 660 bp, A.fumigatus
agacccagcgaggaaatgctagacttgcgcaaggaatacaagagccatgtgaagctacagggcaaaggcatcaatatggccaaacatatccggctgaagctgggcaacagtgcgtttgggaaagtatgctacgcaaccgccctgggccgctgggagtccgaagcgtactgggccaattgctactaccagtctagcacctcgcggcgggaactcctcatcgagtctctaatgggtcgcagcaacagcgacatccgcgagatcaagcaatgtttccgtgactcacggtacttggacagcctggaaaagtgcatgaaggcagaactcaaggcggacaagtttcgagtcgcggtgctgcttgccctcgaggaaacacggcagagcgagcgtgagcccatcgatccgaatctggtccagcgcgacgttcgggacttgtatggggccctgatgtcacggcacgggggcgagaccgcaatgatctacattattgtacgacggagcgacgcacatttgcgcgaggtgctccgcgcttatgaaaagatctacaaccaaaactttgctcgtgcaatgattgccaagtcgcagaatcttgtggtacgtatctctacttttagttcgccaagtatccctcaagatcttctaacttggttgatgacagggtga

SEQ ID NO: 12806 - DNA, 318 bp, A.fumigatus
aaaaaatacaggggccagatcaatggctgggctgggctaatccgtgtcgatggtgctgtctacacgtggatgggtatgcctggatcgacaactgccaaccagactgcatacgaatacacctcaacaaagagcatcttcacatttcacgtgggagatgcagtggagatgaaagtcacttttttgtctcccataacaccaaatgatctacgaaggcagtcactgacattctcctatgttcacgtcgcggtttcgtcaattgacggcaattctcacgacgtacagctctactctgacatttctgccggtgagtctgaataa

SEQ ID NO: 12807 - DNA, 2499 bp, A.fumigatus
acaggatctttttcgggctcctggcagcatcaaaccatggcttgcctacatcgaatacaaacagcagaatgggacactctacgagcaggcctttgtaggattcccctccattttctccgagattgcatgctgatagatcggtttaggttatggagcgtgcctgtaaacagcttcccagatcatacaagctttggaaaatggtatgtcaacacggtcttttctctggctcgctttccttacatgagttccgaaaacatagcaatgaatgatttcactgacggttcggagtatctggagtttcgaataaaccaccttcggggtcgtaatgcgacaaaataccgcgctgaatatcagaaagtgaatgcactcttcgaacgagcactcatactgctgaataaaatgccgaaaatctgggagatgtatctgtcgtttctgctacaacaaccattggtgactcagactcgaaggacatttgaccgcgcgcttcgtgctctaccgatcactcagcacaaccggatctggaaattgtacaaagcctttgcgcgctcagcatctggacaaacagctgtgaagatatgggctcgttatatgcaaattcatccggaaaatgctgaagattatatcgagttgctcgttgaactgggtcagtataccgaagcggtcaagcggtacatggaaatcctggacgatccgcgatttcagtcgaagaaaggaaagagcaactttcagctttggactgagatggtcgatctgctcgtctctaaagcgaagcaaattcggaccggtccgcaagtcggcatcgacgttgatgccatccttcggagtggaattgatcggtttgcggatcagagagggaagctctgggctgggttggcgacttattggatcacgaagggtaattttgagaaagcgcgcgatgtgttcgaaggaggtattaccaccgtcctgaccgtccgcgacttcaccctgatattcgacgcctatgttgaatttgaagagtcgatcattggaagcttgatggaggccgcagcggtccgggctgataaagggaatgttgacgaagacgctgattttgatcttgatctacgaatgctgagatttgaacaacttatggatcgccggccattccttgtcaacgatgtcctgttacggcaaaatcccaacaatgtcattgaatgggagaagagggtggctctgtggggtgacaacaaagaagaaattgtcaacacgtacaccgccgccatagctgctatcaacccaaagaaagctcatggaaagttttctgaactctgggtcaactacgccaagttctacgagagtggtggagatttggacacggcccgagttatatttgacaaggctgtcaaagttcccttcaaatctgtcgctgaattggcagacacatggtgcgaatgggccgagatggaacttcgaagtgagaatttcgataaggcagtcgatatcatggccaaggctacgcaagcaccgaagaagtctacagtggactatttcgatgaaactctctcgcctcagcagcgcgttcataagagttggaagctttggagtttctacgtggatctggttgagagtgttgcaaccttggaagagacgaggaaggtatatgagaggatttttgaactgcgcatcgcaacacctcagactgtggtcaactatgccaacctattggaagagcataaatactttgaggattccttcaaagtatacgaaagaggactggatctcttcagctatccggtcgctttcgagctctggaacctttacctcaccaaggcggtggatcggaagattggcattgagagattgagagacctcttcgaacaggctcttgacggatgtcccccgaagttcgcaaagccactctatctgatgtatggcaaccttgaagaagaacggggtctggcccgacacgcaatgagaatctatgagcgtgcaactcgagcagtttccgacgaggacagatttgaaatgtttgaattttacatcaccaagtctgcctccaactttggtttgacatccacacggcctatctatgaacgcgccattgcggccttgccagaccaggaagccaaggagatgtgcctcaagttcgcagacatggaaaggagacttggcgaaatcgatcgcgcacgtgcgatctacggacacgcttctcagttttgcgacccccgtaccaacgccggcttctggcaaaagtgggaggcattcgaggtccaacatggaaacgaagataccttcaaggagatgcttcgtatcaagcgaagtgttcaggcacagtacaagtatgtgaaccctgaccaacacatgaaatctaaaaacatgctaatatcaattgaaacagcaccgatgtcaacttcattgcttcccaagcaatcgcccgcagccagcaacgcgcccaggaaggcgcccgggagagggaaggcgaggaagcaggcacggatgcctctaaggagcgcgcagacgccatggcagcgctggaac

SEQ ID NO: 12808 - DNA, 258 bp, A.fumigatus
ctgttgggaaacgaatggaccactcagctcgttccaagcgaacttcccacgcgtacgccgacctggctcccagtcgagtttctgactgactgccacaggtgtgagcgatgtcgagctcgaaaggtcaaatgttctggcacgcagccatgtgacaagtgtcgcaatcgacagcaggactgcgtatttgaggaagatcggaagattgtagtctctgaggagtatgtcgaagaagacctgcataagaagttgttgttctaa

SEQ ID NO: 12809 - DNA, 306 bp, A.fumigatus
cgagcgcagattggtcatgccatgcgtatggccctggtggaaggtttgcatcgcgctcttccggtcgagcaactcggtgagaagcgcgtcgaacggtgtactaagatctggtggacggtatacattctcgaccgcaagttctcttcgttgatcgggtcgccgacttcggtgaatgatgaggacgtgaccaccatcctgtgggacctgaagacctgctcccaagaggcagcagccttgagccttcatgtcaagatcacgcaggtcatcacgcgggtgttgcatagtaagtggcctgccgactggtaa

SEQ ID NO: 12810 - DNA, 393 bp, A.fumigatus
gatacggcatacctcgtctgtcataatgtctttctctggtcgcgcttgtatctctgtctcttgctccccgaccgtctctatcccgatctgtcctatcgcgatcgcggtcccggtcccggtcacgccgatcgcgagacctgctcctttctctacgcctttcagctcgatctcttgaccgggaacgatatcttctatcatcacggggcccctcacgccgccgatcgtccttctgaggtgcgtcacgccgagggcttcggccaatatctgagtccggctcaggagaacgcgtttttcgttcgtctaagtcccacattgtcgagctatcgacccgttttgctcttttcgcggggggctctgccattttttgattctacgctgatgcggagatcgtga

SEQ ID NO: 12811 - DNA, 774 bp, A.fumigatus
aatcaaaaaatggcagagccccccgcgaaaagagcaaaacgggtcgatagctcgacaatgtgggacttagacgaacgaaaaacgcgttctcctgagccggactcagatattggccgaagccctcggcgtgacgcacctcagaaggacgatcggcggcgtgaggggccccgtgatgatagaagatatcgttcccggtcaagagatcgagctgaaaggcgtagagaaaggagcaggtctcgcgatcggcgtgaccgggaccgggaccgcgatcgcgataggacagatcgggatagagacggtcggggagcaagagacagagatacaagcgcgaccagagaaagacattatgacagacgaggtatgccgtatcctactgatgaaattgatttactcatacctaatgctcttcaaggatatcgagacagataccgctcccgctcccgctcacctattcggaatgggaataggaacaggactagaactccaccacctcgagggccgaagggagatcgcagagacgatcgcaaagacaaccgtccgtatgcaaatggcgtcccacattcatcgttacgacgagacaaggacgagatggagttggaccccgcagtaccgattgaagaagatgaaatggaggcgctgatgcgcaagaccgtgggctttacaaggtttcaggagcacaaagaataccaaagtgcctggaaacaacatctacggtgtgcggaaagagaagaagactgtgtacagacagtacatgaaccgtgtaggcggatttaa

SEQ ID NO: 12812 - DNA, 540 bp, A.fumigatus
agacatcaccgtcagatttacctcctcggcaaccccttcatctggtggtcgtcgactgccgccattgtcgtctatattgtctttaagggcatcgccggtatccgttggcaacgcagttggggtgattatcgcaacgtcaacttcaagcgatttgattatgaagtcggtacgagcgtgcttggctgggctttccactacttccccttttatcttatggctcggcagctctttttacatcactacttcccggccctctacttcgccctcatggcgctgtgccaggagttcgattttatcgccaatcgcttcaagtctttcggtctgtcatcgaggcctatcattggcaaaggattggtcgcagtctttctggctctcagcatcttcaccttcactctttactccccattagtctatggcaatccttggacccaagatgcttgcaagaaggtcaaacttgttagcacttgggattttgattgcaacacattttacactgacgtaagtgttccagaatggcaacctccgcgacgaggacactag

SEQ ID NO: 12813 - DNA, 543 bp, A.fumigatus
cttggtcaatatgttactcaatttctcaatgcgaacccaattgcatcatcaacgccttccgcacaggtaaatccagttccagaattgcctgtccaaaattcacccgttaaggaaccgccggtggcaccgccccagcagcatcatcaggaggttcacaaggaggctcaggaggcaagcgtgacttcacaggcccaacagcctcgcggaacaatggcgagagtggagtaccgtgatcaacatggcaatgttcttgatgaggcgctcgtcgcatctcttgcgagggaaggcaaagtttcttttgaaacccggcatgaaactcggactcgccttgaacatgcccatgaagtagagatgatagatggtcgaatcgcaccgccacacccagatgtggaagggcaaaatcctgaaactgtgaaggaccaggagcaccaggctgcgggagacagcccagcttcggctgctgtgggcgagagatcagtcaaggaaccaagttcccctgagccaaagccggctagcgaagcaaaggaggcaactcagaattaa

SEQ ID NO: 12814 - DNA, 192 bp, A.fumigatus
aacctacaaatcttcaacatgtcttcaattgctgccatggcttcccgccgggctttcgcccgtcagtctcttttccgggctgccccgcgccgaaactacagctccaagctggaggaggccaccctcgacaaggcccccaagcgcgaccccgagctctatgtatggatctcgtaccaagctccgctcgactga

SEQ ID NO: 12815 - DNA, 420 bp, A.fumigatus
ttggattcctcgctaaaggatgttgcaggttctactcggtgttatgtccggagcttttctgattgctggatggtgaataatcctcctccctatcgcccacattcgacacgaaaaagcgactgcagaacccgattgtcgctaattgcacgctggattgatgcggacgccgcttaccaattatttgtcaacaggtacttcggcagaaagcccacctcggtaacctctgagagcaacgttcgtatcggcgagagcgccatgccttgggagcgcgatgacgacggcaagatctacaagtaccagtaccaccctcacggtgacaagagccagcccctcagaaacgctcccagcgctctgaacaccgtcattgttcccaatgtcactctgcccgtggtaatgatccctcgcctttcatctccatga

SEQ ID NO: 12816 - DNA, 738 bp, A.fumigatus
aggagtcccttcttccttgtgtcactgaccgacggtccactcttctgtcagacatctcaatccggcatcatcgacgcgtctacttcccccgcggattccaaggcacctttcgtgcgtggacatcgccgtcgctccacccacgtcagtcgtcgtgaccttgagaaatttagaacggaagtcctaggtattgtttcagacccttctctctggtgcgaggaggctggcggatctccagcaagcatcaatccgtctacactcgacgaattgaacaccgccttcgctttcgcgagtatgtccctgaacaatagcagtggtattcctagcaacaaccctggttcgggcatgttccctaattacgtcgacaacaccgctaattccgcaaatttgcccaacgcttctcgtcagtcgatgtctcccgccatgccaagcccctcgactcaggtcaacggtgctggaatgcccggtatgaacgctggcatacctatgaatgcaggccatcaaatggatcttcatcacctgtacgagatggtgttggagctgagtgaggtcttgaagaacaaccgcgagacgaccaagagcattgtatccactgcggaggaaatcatggtacgtttgtcggatcgcgaaggctacactgtagctccgcggatctgctgtttggctgtttcgctgacagagattacagaagcgtgcctcttccgaggggactactcccagcttgcagcaggtcaatggtga

SEQ ID NO: 12817 - DNA, 483 bp, A.fumigatus
aagccgctgacagtctctacgttagctgcccgtatcgcagaactcgaacgtgccctcgcgaaggagaagcgccttgtggaaattttgaagcaggagcaagttgagaacaccaaactgatcggggaatatgaagcagccgttgggaccatggtcgaacaaatccgcaactactgccagaacaacaacatgaactacctggctcagaaacgccactacaacaatctactccaggccgaacgcgacgctcatctggaaagtcgtctcgaccgcgaccattggcatgctcagaccatgaagtgcgctgagatgatccgcactgcctaccgccttcgctgtgaagaggaagagttgcccattcgtatcgtctctggtctacagaacgaggtacgcgcgtatcgcaatgcccttggtatggagccagaaaaaccagaggaagagtacggttgggaaatcctcaaggatgtgcccccaagcgttgactaa

SEQ ID NO: 12818 - DNA, 1662 bp, A.fumigatus
actttggccaaaatctcgattgacttccccgcttctatcgtacgagagggcggcctgacagcatgcttaacttatctagatttctttcccacaagtacgcaacgtacggcggtgacaactgcagccaattgttgccgaaacctccctcatgatgcgtttccggttgtccgagatgttatgcccacgctgctaaatgttctctcgagcagcgaccagaaagtcgtggagcagggatgtctttgtgtgtcacgaatagttgaaagtttcaagtacaagccagagaagttggaggaactgattgaacccgaaatgctgagggctgtgctccgtctgttgttgccgggaacgacaaatcttattggacctcatattcatacccagttccttcgcgtcctggcgatcacatctaaagcgagtcctcggctgtccgtggagctcctcaaaatgcacgtggttgacaccatctatcaaatcttaaccggtgtttcgccgtatgagaacattgaagccacgggggttaggatggatagcgttttggtcatgcaaggtcttattcaccgtccaagagaacaggtcttcgaaactctcaatgtcatttgcgaattacttcctgaggttccttcgggacgacatggctattcagcagatcgcgtgctgacttcctccatcgaagatagtgcaaccttcgacgacaagcacattcaaggacaggaatccgcagagaaaagacgttccctgttgatggaatgcaaggctgagcttaaacgttttgccatgatcttactgcccactctcacagacgcttattctagtacagtcaatcttggagttcggcaaaaggtcctcatcgcccagctgaaaatgttgcacaacctggatgctgcattgatagaggaagccctacactcggttccatatgcgtcatacctggctgctattctttcacaaaaagaccatccgtcattggtctcattggctctgcgatgcgcagaactcctcttcaagcgcctcgagcacgtgtatcggtaccagttccatcgggaaggcgtcatctctgagatcttcaagctggctgaagctcctctttccactgataaacactcgagggactcccttgatacgcccgccactgttcctatggatctctcaagcgattcaccccgtgagccgaaatcggttgcatcagaagatgatggttatgatgacagcggtcgccatcaagccgacgacgaagacaatgaccaagatgatgatcgggatgaggagaacgatgacatttctgactcggaaagctcgtcctccttctccggtcactacaatacgacaaggatggaagatgctacccaagatcttgtcattcgcgatgcgcgcgcatttgtcgagctctatgaagccagtgaaggaaaagccatgcgagagcgtgctcaacagattctagatgaattgcaaggcctcgcagcagatataagaaattgctatcttggcgacggggacggcgagggactcccgctttttaagaagttagcctcatactttgacggagatgcgcttgaaagtatcaccagtgctgagttgctcaattccggaatcaccaaggtgctcttggatgtgtttggtgatctacaatgtaagcttcttcttaacatttcctgcggctattga

SEQ ID NO: 12819 - DNA, 654 bp, A.fumigatus
catgatacccgttgctcccactcatctctgctccgtcttctaagtcaggacttggcgacaaagcctcggacgcccgatggacgagctctgctttccaccccgttgaacccacttttatcacccatatcctctcttccatctctgcccgaacacccacttccagaaaaagctcagtttctcatgtcccccagaatcactcgctcagctgcgagacttgctgcagactccccctcgtccgctggctccggcccctcctcgattccagccgctggttcggccccaactcgaaaacgcaaggcccacgcacgccgtgatccccccctggacgttcccgaagagacgaatccccaatctccaacccggaggaccaaaagacagaggctcgcatctcctcctcatccagctagcactgtctccaccagccgacgtggtactcgaaatcggccagcaatgtcgcaacaagggtacgtcatgggtgttccgcgagttgttatcggtagcgacatcaagctaatattttgtctggccttagtccgtcagcaagctccccggaggaaaccacgaagaagcagtcctcacctccgccatcgaggcgaaagtccagcagacatcgaggaaaagtatcacaaggtaaggcatttcatagataattag

SEQ ID NO: 12820 - DNA, 747 bp, A.fumigatus
aagcttatgcatctcggagcagatcgtccctcagccacgcaatcccctcttccacgccgacagaagaagcgctcgtcgagaacgaattcggatgtgatgatgaaagaggcagaggaagagctggacagtcatgagcgcactgcaaaccgggaatcttcgccgtcgaatgatagtaatgatgggacgactccctccggtatagacgatgatgatgatgcagatctgtttcataacagcctcttcggttcgcgaagtccgctagggctccagagcacccttcgcgcactcagtggcatgatgtcgggcatgtcctctcgactgcgagagatcctatgcaatctcagaatgaaagaagacccttcgattcagttgatcgcattgcaagagctgtctgaccttctactcgtatcaaatgaggacaacctttctggccaattttctccagatccctacgtcaaggagttggtcactttgatgcaacctgaccaggtcggcgaagagaaccccgaaatcatgctgttagcctgccgctgtttggccaacctgatggaagctttacgaggctcagtcgccaatgtagtttacgggggagcagtccccatcttatgccagaaattgctggacatccagtttattgatttggctgagcaagcccttagcgtgagtatttccccccccatacttgtggaccgttatcattgggtatatgttgatttttatatagactttggccaaaatctcgattga

SEQ ID NO: 12821 - DNA, 504 bp, A.fumigatus
  unsure (378),(393),(495): Identity of nucleotide sequences at the above locations are unknown.
aagtggtgctacgtcggctaccgccgtctctcccgggccatcacagcccacaaagccatatacccatccgacacctttaccctcacctggcacgccttctacctgaacccggcctccccggggtaccccggcgttgacaagcgcgagtactacgcctccaagttcggcgagggccgagccgcggcgattttctcgcgcctggcagccgcggaagagcccgacggcatcgccttcaagttcggcggcaggacggggaatacccgcgactcgcaccgggtactttggtatgcgggcttgaaggagaaggaggcgggtgcccgggggggtgcggcagcgactaacggggacgcaagcgaggagaaggtgggtgggctgcanacgaaggtcgctgancagttcttccgtgcctactttgaggaggagaagaatatcacggatcggaagatgttggttgattccgccgcggcggcgggattggatcgtggggaggttganaatttttag

SEQ ID NO: 12822 - DNA, 501 bp, A.fumigatus
  unsure (44): Identity of nucleotide sequences at the above locations are unknown.
aacacagttcagctatacaagcaaggcctcggagggaggggggnagagggagggggggggaggaggaggaagaaggagaggaaggagggggaagaggaaggaggaagggaaaggaagggggaggaggaggagaagaagaggggggggaagagaggggaaggggagaggagagaggaggggggagggaggagggaaggagggagagaaggaggggaggggggagagagggagaaaagaaggaaggggagagagaggaaggagagagagaggaggaggagaaagaaaagaggagagagagagggagagagaggaggagggaagaggaaggagaaaaaggaggaggaggggaggaggaagagaaggggaggagggggggaagaaagagagaggaaagggagagaagagagagagaagaagagagaagagagagagggagaaagagaagggaggagaagagagaagaaagggagaggaagaagggaagaaaggagagaagaaaat

SEQ ID NO: 12823 - DNA, 510 bp, A.fumigatus
  unsure (52): Identity of nucleotide sequences at the above locations are unknown.
gcaaatgaaacacagttcagctatacaagcaaggcctcggagggaggggggnagagggagggggggggaggaggaggaagaaggagaggaaggagggggaagaggaaggaggaagggaaaggaagggggaggaggaggagaagaagaggggggggaagagaggggaaggggagaggagagaggaggggggagggaggagggaaggagggagagaaggaggggaggggggagagagggagaaaagaaggaaggggagagagaggaaggagagagagaggaggaggagaaagaaaagaggagagagagagggagagagaggaggagggaagaggaaggagaaaaaggaggaggaggggaggaggaagagaaggggaggagggggggaagaaagagagaggaaagggagagaagagagagagaagaagagagaagagagagagggagaaagagaagggaggagaagagagaagaaagggagaggaagaagggaagaaaggagagaagaaaatc

SEQ ID NO: 12824 - DNA, 513 bp, A.fumigatus
  unsure (57): Identity of nucleotide sequences at the above locations are unknown.
catgagcaaatgaaacacagttcagctatacaagcaaggcctcggagggaggggggnagagggagggggggggaggaggaggaagaaggagaggaaggagggggaagaggaaggaggaagggaaaggaagggggaggaggaggagaagaagaggggggggaagagaggggaaggggagaggagagaggaggggggagggaggagggaaggagggagagaaggaggggaggggggagagagggagaaaagaaggaaggggagagagaggaaggagagagagaggaggaggagaaagaaaagaggagagagagagggagagagaggaggagggaagaggaaggagaaaaaggaggaggaggggaggaggaagagaaggggaggagggggggaagaaagagagaggaaagggagagaagagagagagaagaagagagaagagagagagggagaaagagaagggaggagaagagagaagaaagggagaggaagaagggaagaaaggagagaagaaaa

SEQ ID NO: 12825 - DNA, 489 bp, A.fumigatus
  unsure (458): Identity of nucleotide sequences at the above locations are unknown.
attttcttctctcctttcttcccttcttcctctccctttcttctctcttctcctcccttctctttctccctctctctcttctctcttcttctctctctcttctctccctttcctctctctttcttccccccctcctccccttctcttcctcctcccctcctcctcctttttctccttcctcttccctcctcctctctctccctctctctctcctcttttctttctcctcctcctctctctctccttcctctctctccccttccttcttttctccctctctcccccctcccctccttctctccctccttccctcctccctcccccctcctctctcctctccccttcccctctcttcccccccctcttcttctcctcctcctcccccttcctttcccttcctccttcctcttccccctccttcctctccttcttcctcctcctccccccccctccctctncccccctccctccgaggccttgcttgtatag

SEQ ID NO: 12826 - DNA, 492 bp, A.fumigatus
  unsure (457): Identity of nucleotide sequences at the above locations are unknown.
ttttcttctctcctttcttcccttcttcctctccctttcttctctcttctcctcccttctctttctccctctctctcttctctcttcttctctctctcttctctccctttcctctctctttcttccccccctcctccccttctcttcctcctcccctcctcctcctttttctccttcctcttccctcctcctctctctccctctctctctcctcttttctttctcctcctcctctctctctccttcctctctctccccttccttcttttctccctctctcccccctcccctccttctctccctccttccctcctccctcccccctcctctctcctctccccttcccctctcttcccccccctcttcttctcctcctcctcccccttcctttcccttcctccttcctcttccccctccttcctctccttcttcctcctcctccccccccctccctctncccccctccctccgaggccttgcttgtatagctga

SEQ ID NO: 12827 - DNA, 534 bp, A.fumigatus
  unsure (459): Identity of nucleotide sequences at the above locations are unknown.
gattttcttctctcctttcttcccttcttcctctccctttcttctctcttctcctcccttctctttctccctctctctcttctctcttcttctctctctcttctctccctttcctctctctttcttccccccctcctccccttctcttcctcctcccctcctcctcctttttctccttcctcttccctcctcctctctctccctctctctctcctcttttctttctcctcctcctctctctctccttcctctctctccccttccttcttttctccctctctcccccctcccctccttctctccctccttccctcctccctcccccctcctctctcctctccccttcccctctcttcccccccctcttcttctcctcctcctcccccttcctttcccttcctccttcctcttccccctccttcctctccttcttcctcctcctccccccccctccctctncccccctccctccgaggccttgcttgtatagctgaactgtgtttcatttgctcatgtcattctaaggcattctga

SEQ ID NO: 12828 - DNA, 1956 bp, A.fumigatus
  unsure (1212),(1244): Identity of nucleotide sequences at the above locations are unknown.
gttattatctgcttttcatttgtctcaaaaaatatcttcactgtgtcaacctggtttctccgcccagatcgattcggtgagaacgtgcttcctactaacaataatgctgcatatagcaatggcattagccaggtgtcgaccccaagtcgagtccgtgccaccactctcgatatcccaggtctgaccaagtccaaagtgtctcccgatggacgtatcgctcagagagatctcggctccaagctggtgattgtcatggtcggccttcccgcccgaggcaagagctatgttacgaagaagctggctcgctacctaaactggctgcagcatgatacagagattttcaatgtcggagaacgtcgtcgtgtcgcggcaggcaagtctccttctccggctaaagccatgggccctcgtgacaagcgtgcgtcggtgcataaggatctcgtggactctgtgcgacgtctcagtgtgagcgtgggcacgatgaacacacagccctctcagactgagatctcacctcctgagtctgctacctcgcctccggaaattaacagcctcccgccaccggtcgtcaccgctaagatcctagtcaatgggcaggaagaagatccctctatgcaacaggagggcagcacgatcataacctctatcgatgcaggaccggacaaccagcagacggtcacggaagcatcaccggagccaatggatcaatcggcatcgttcttcgacccacagaatgagcgtgctgtcaagctgcgtgaacaggttgccctggataccctggatgagctcttagactatatccttgtgcagggcggcagtgtgggtattctcgatgccaccaacagcaccctcgagcgccgcaaattgatcgtcgaccacattcgccaagttgctggccctgagctgggtgtcttgttcttagagagcagctgtgtggatcccgagctcttggaagccaacatgcgtctgaagctatcaggcccggactacaaaggtcaggacccagtgaagtcgctggaggatttcaagaagcgtgtagccctctacgaaaagtcctacgtccctcttggagagtatgaagaaaagcacggcatggcttatatccgaatgatcgatgtcggacgcaaaatcgtctctcatcaaacccatggctttctttcctcgcaggttgtctattatctcttgaatttcaacctctctccgcgtcagatntggatcacccgtcacggcgagagtaggacaanccagctgggccggatcgaaggcgatttcgaaattagcgaaaacgggcgccgttatgcaaaggctttgacccgtttcatcgattatcaacggcatcaatgggagcagttacagcaacaaaagaatatgctgcgacacttccccccacgtcccggtgacagtacgcctcccaacccttcctacattccaagagatcggccgcgtaacttctgtgtgtggtcgtcaatgatgcggcgctcggtccagacggttgaaggattcaacgaagatgagtatgatgtcaaacagatgaaaatgttggatgagctgtatgctggagagatggaaggcatgacgtacagcgagattcgcgaaaagtatcccgaagagtacgcgatccgcaagaagaacaaactgttctatcgttatcccggccctggaggcgaagggtatctagacgtcatcaaccgccttcgcgctgtgatcatcgaggtagagcggatgacggaccacgtcttgattgtcacccatcggtcggtggcgcgtgttctgctcgcttacttccgtggactgaagcgggatgaagttgccgacttggacgtgcctctaggaatgctgtacatgctcgagcccaagccttacggcgtggacttcaaggcctatcgctacaatcctgataccgattggtttgaccatattcctgactttgaactgagccaagcccccacttattga

SEQ ID NO: 12829 - DNA, 750 bp, A.fumigatus
ttcacagcgctgcttgctgattggcttcgctatagcttagtcctccttcttaccggtgcaatcatcccaatcgcctcttctctactccgtttcgtaccgttccccgctgcttggcgagtatggttcagggcagtcttcatcgatcctccttttgtcggtcgtcgccatagttcccctatactcgacaccttctttatgcccactcgaggacaagccctattcatcgcgtatctgttaataatcaacatagtattgtgctcgatcgggttccactctgctaatccaagcatttggttcgcgtccaagcacgacgagattctcgcttacgtggcaaatcgcatcggcgtgctcagttttgcgaatattcccttgctggtgctatacactggtcggaacaactttctcctctggctgactgactggtcacattcaaccttcctcttgctccatcgctggctggcgttcatctgcactctccaagcttgtctgcactcggccatatatctgcagattgccgttgccaataatgagcacagtaccgaaagtaaggagtcattctggatctggggcgtggtcgccactttggcgctagccatcactatcccatcatcagcatggccaatccggaagcggtgctacgagctattcctcgcttggcacgtcgtcctgtcctttctagctcttcttgcgtgctactggcatatttggtacaggtatggacatcagtggggctatgaaacttggatctat

SEQ ID NO: 12830 - DNA, 393 bp, A.fumigatus
  unsure (352): Identity of nucleotide sequences at the above locations are unknown.
cctgagcgcagtcgactccatcgggaacaggttattggtggtggaatcatgactgcctacccgttcagcgcggtgtgcgagcatctcgattggttcatcgtcggtgtgagcgtgagcatgatcccccctgttgatccgcacgaatcgtggaagaggactgaagcgggccttgaagcgagttgtgcgctggtggaagggaagacgtccgagggcttcaagagcgcgcgcttcaatgatcttgttctcaagtatatctcggacggcgaccaagtgtctgttccaccaagcaaggaagaaaaacacgacgagtgtaaggacgtacaccgcgatggagtcagtgctctggtcgtanaaaggcaaattgaggcgagttccaccgtgaaaggaagttga

SEQ ID NO: 12831 - DNA, 705 bp, A.fumigatus
atggaagccaaatacactcgccttgcagagacaatatgccagaaagccaatgcccacagcaagaggcgcttcctagtggccattgctggcatcccgggatccggcaagacaaccaccgcagtcgcggtcgccaggcttctgaacacccaaccgtcgccaaaacgcactactctactctccatggacgggttccatctgtcgcgggcgacattggacctcttacccaatcgagaagaagcatatatccgccgcggagcaccttggacctttgacgcggcccgcttcgtccagttcatccgtcggctacggaattgggctgattcgacgccctgtgcctctgcggagacgatctacgcaccctcttttgaccacgaggctaaagaccccgtcgaaaatggcattgctatcaccgatgacacggagatcgtcattatcgaggggaattatctgctgcttgacgagcctgaatggcgcgaagtggctgccctggttgactaccgcgtgttcgtcgagagtgacctacaggaagcgcgagaacgcgtcgcccgacggcatgtccttgcaggtattgaaaagacgttggaggatgggtttcggagagtggaccgcaatgattatttgaatgcgattaccattcaggagaagctcatcactcctgatttggttattcacagtgtgacggagccaactgctggatactcataa

SEQ ID NO: 12832 - DNA, 312 bp, A.fumigatus
cgcgattcccatctttacgactgtcggagtttagtcaacatgtctttccaaaactttgactctttccaaaaccagcacccgtcagccgacgctgctgctgctgctgccccaggcgctccggcaactgcggataccaccatgaccgggcagactgaccctaccactggctctttccagggtcctgcccccggcgagccctcagctgctcctgttgctcagcagggcaatgagggaaagaccactctctggtacgcttggcctcgatcatcgcgctcatgtacatattcggaaatacgcgttcttttttgctga

SEQ ID NO: 12833 - DNA, 210 bp, A.fumigatus
  unsure (86): Identity of nucleotide sequences at the above locations are unknown.
tgtcaagatgatccgcgacaagttttctgggtgagtttatgggaatcttcttgctcttttgaaggcgatcctaatgttggtagtangagcaatgccggatattgcttcgtcgacttctcttcccctgccgctgctgccaaggccctttctctcaacgggacccccatgcccaacaccaaccgcgtgttcaagctgaattgggccactggt

SEQ ID NO: 12834 - DNA, 195 bp, A.fumigatus
aatgctaattcatcacctagaggtactcgatttacactctcgagggatgagctgttaaccctgcctgaatttgtccttctatcactgtttcccaatggtcttctgcctgatgggcatatgggctcatttcaagagggtgatatctatcccgttgacgtacgtcaagtctttccgccattccctttgtctaaatga

SEQ ID NO: 12835 - DNA, 354 bp, A.fumigatus
tatgatccaacatctctccagtacatgttagatttcttccgttcagtggctcagtcgatcccgtcatcttcaccttcagcgtcgactactccggaattagagatgtctgaaacggtgctggggtcaccaagagacatactacaagatcgggccggaattatcgtcctacgtgaggacctcgatttctatgcgataccaccacgtcctgacatcgaccatacggagatgatggaggtcaaacgtgccgtgggcaaggcacttcttaaacaagacgggatattttccggcctgaagaagagcgatgaacccggatcgacggagcaacatcttattgagatgctcactgcagggtaa

SEQ ID NO: 12836 - DNA, 324 bp, A.fumigatus
ttacgtacatcaaactctatcaaatctgcaagaatactcacgaagtgcagtggttttgaaagagacgaccggtggggtcaccgtgctcccgaacccaacaaggcggtcatttgcagccttgcattagctaaacttcgcaccgacgtcagaggtgatctgtccaataacaatgcggtcggcatggcacagaaactcttattgttctggagaaaaccagccagaagatgctggtgggagggtgtcgaactggaaagtgtcgagggcgtcgaaggcaaagtaaaagtgtggattcggagagtctggacgcttgaaatggtaagttag

SEQ ID NO: 12837 - DNA, 258 bp, A.fumigatus
acagttctacaggatccttctgtggcttcgtcgcccattgagaagagagtcgcattcctccaatcaaaaaaccttacacaggaggagattgatctcgctttatcccgcgccggtgaagatacgtctgctgctgcttctgctgtcgcctcaacgcaaggctatcaacgtcctactcaaaactctgtctaccgtcctccccctccaccaccggggtatggctacccgccttatggccaatggcaggcccctccagagtaa

SEQ ID NO: 12838 - DNA, 675 bp, A.fumigatus
tcggaggtgtgggttatgggttatacaccgtcacaaaggttagtaatctgtgccgcagttcgcttggcttctcttgcgatggtagtaacaaatgctttcaagcggtacattgcgccgttaatcgcccctcctacaccaccccaattggaacaagacaagcagagcattgatgagcagttctctcgcgcttttgctttaattgagcaactatccacagatactgcggcattgaagtcagctgaagaagcgcgcacagagcgattggacacagctcttcgggaagttgaaaccctggtggccgatctgaagaccgcttctcgccgtcgggatgatgagacacgccgcattagcgacgaggtgaaatcattgaaggatgccatccccaaggctcttgaaggtgctcgggaaggcaacgaaacccgcttgaaggaactcggcactgaattgaagagcttgaagactttgcttggcaacagactcagtggcagcggcgcgtccagcactcctgttgccggtagaactatgagcgcatcaactctgcctagcgtcgctcggtccgcggaggaggcgtcaccggctgccacatccgctactaccaacggcgttacagcgactcctactacacaagaatcgcagctctccccggcacagccaggcgccggctcgaccaccggt

SEQ ID NO: 12839 - DNA, 657 bp, A.fumigatus
gcaccggtggtcgagccggcgcctggctgtgccggggagagctgcgattcttgtgtagtaggagtcgctgtaacgccgttggtagtagcggatgtggcagccggtgacgcctcctccgcggaccgagcgacgctaggcagagttgatgcgctcatagttctaccggcaacaggagtgctggacgcgccgctgccactgagtctgttgccaagcaaagtcttcaagctcttcaattcagtgccgagttccttcaagcgggtttcgttgccttcccgagcaccttcaagagccttggggatggcatccttcaatgatttcacctcgtcgctaatgcggcgtgtctcatcatcccgacggcgagaagcggtcttcagatcggccaccagggtttcaacttcccgaagagctgtgtccaatcgctctgtgcgcgcttcttcagctgacttcaatgccgcagtatctgtggatagttgctcaattaaagcaaaagcgcgagagaactgctcatcaatgctctgcttgtcttgttccaattggggtggtgtaggaggggcgattaacggcgcaatgtaccgcttgaaagcatttgttactaccatcgcaagagaagccaagcgaactgcggcacagattactaacctttgtgacggtgtataa

SEQ ID NO: 12840 - DNA, 969 bp, A.fumigatus
atgagtgtgccttttacatgtcctcccatgtacctcaataatgcagcccgcgtcctgactgcggcttttcgcggggcaacctcgtttgtggatcgcatcgctgagcactggaaatcatggcccaagaagagacaaaagcatacttctgtggtcatcctgacagtgtttatcttttgcctcggtctaaagctaggatcgggcctgttctatgcccattactggggccgggcgacgatatccagcttcccggttacgccctacgttgattactgggagtgggagacaacgtcacgcttctcgaatgcgcacagcgccaacgagacccaagagaacagtgatggcgatgacttttgtgactccttcccttcataccacctctcgcatgttcaagtcgttctgaaaatcggcagtacagagcctcgtagtcgtgttgatactcatctggccactgttacccgctgcataactaatcccatcattgtttctgaccatgagtcagaaatcaacggtcaccatgttcacaacattctggcaaccctgccagggagcttctggggggatagccgcgactttcaggcgtatagtgcgctccagcgcggcgaacttgaaactgtcgctggttcccagggctggacgcttgacaaatacaagttcctgcccatggtcgaacgcgcgtatgagatgaatccgactgctcagtggtttgttttcatcgagtctgatacatacatggtgtgggacaatatgtttcgtcttctcgaccagttcgatccctccgttcctttatactttggctccccgactccgggaaagaggccctcgttctttgcctatgggggtgctgggtttgtgttgtctactcccgcggtccagaggctggtcactcataaggctggggccaacggcgtgtacagccagctttcattgagtcatcgttacaaggagctggtccatcaggattgttgcggg

SEQ ID NO: 12841 - DNA, 450 bp, A.fumigatus
gaccgactcaaccctggcaagaaaatgtactgcaatgattctcatggcatctccgtcggttctctaggccatcacatcggccaggttgacatcgtggagaatatattagtctgtaacacttccctgaagcttcggtacgtgatctgtcaccacgttccccgagcgggcggaagaagctggcttgtcaggcttgaatcaaaatctggcctggagcaattagcaactcccaccagcacgggcggcagcagtggttgggacaggaacgtaacctatgaaggcatgcacaactatcacaacgactgggcgattaagatgacccagttctacgttgcgcctaatcagacggcttgcaatgagcatccggtatggttcgctagctggacatacagactcggctggtcggttctaggcttcgcctattgtcgagtatattatgttcatgaattttga

SEQ ID NO: 12842 - DNA, 1434 bp, A.fumigatus
actgtccgcttctatgtagaccatccattgtcaaggcgccaagaccagcgagccatcatggtgttatccagcctattgatgactatcatactcatattcctgaccctcgcggtgggtggaaatggctcgaggataaaccggcggcaggtcgtccgtcgcttcaatcccgtgcgtaccaacttgtcctcgacgactcccattcaagtgggaaatggcaacttcgcctttggagctgatattaccgggctgcagaccattctgccgtacaacattctgtcctcctggtgttgggccaatgactccctgcctaccgagccaggccaggatgatccctccgacttcaccggactggactggtggactcatggcagattggtaaactacgatatgcccaacacggccgaagcagccatctcaacttggctcagggcgaacccgcatcgtgtcaacctaggaaggattggtcttctgtataatggcaagaatatctcgctggcggacttgtccaacatgtcgcagaccctggatctctataccggacttttgacgtcagaattcgttctcggagggaagcaggtggttgtgcagactgctggaagcccgagctcggacgaggttgcggtgcgcatagattcgcaactgatacagaatggctcgctgagtgtctttttcgactatcccctgacgaccggcgcggcatcattccaagcgccatttgtcggtgattggaatgctgtgtcgaaccatacgacggagctgttcgtcaacggccaccagaaagctgtaattcagcatactctgggaggaacaacttactacaacagcatttcgtggctacccaaagggaacatcagcggcccgatcaacagaacccatcgatatgacctcaacccatctggaaagaccacgttttccttcacttccgcctataccccggagaacaacgccaaggtcagagctttttacaaagtaaaagcagaatcagcgacctggtgggccaagtactgggaatcaggatcgttcgtcgacctcacggccacccgaagctcggacgccgaagaactgcagcggcgcatcattctctcgcagtatctccttgcggtcaattgcgcggggagagaccctccccaagaagcaggcctgcaaaacaacggatggtacggaaagttccatctggagatggtcttttggcatctgggtcactgggcccgatgggggaagtgggagctcctcgaccgcagtctcggagtgtacactcgctttcttccctcgtccctcgagcgcgcccagaaacaaggctacagaggcgctcgactgggtaagatgagcgatccatccggtcgatcggccccgggcgagatcaacgccctgttgatctggcagcaaccgcacgcaatgtatttcgccgagctggagtatcgcgcgtttcccacg

SEQ ID NO: 12843 - DNA, 1215 bp, A.fumigatus
gtcacggattgtgggccgcgtttattttatcatcatcaccttaccccccccttgtctagaaagaatgtcgacgaccatcgcaaaatgacttccaattactccatctctctcgtcgccggggcgatcgccgtcttcgtttacacgcttagcgtcctccgccgcaaatggacgcagtatcgctttgcccgtgcgcacaattgccaagcacccccccggctcgcctccaaggaccccttattcgggttggacaccatctatgccacgatccagaacgtcaaggaacacaagttccttgagcgcgcgcaggcccgtttcgatgcagtcggccacaccatccaaacgcgccgcctcctgcagacaatcatcttcacccgcgacccccagaacatcaagaccattctgtcactccggttcaaggactacgcgctgggccaccggtacaagaccttcggccccctcctcggccatggcatcttcaccaccgacggcgagcactgggcgcaatcgcgcgccatgatccgccccaacttcgtccgcgagcaggtggccgacctcgccatcttcgaggcgcagatggccgatctgctggagttgatccccaacgacggccgcaccgtcgacctccaggacctcttcttcagctacaccatcgactcggccaccgagttcctcttcggccagagcgtgcagagcctgaagaagcgccgctccggcggccgcgacgcgcacgccgaggacgacttcgccagcgcattcaactacgcgcagcatgcgatcgccacgcgcatccggctgggccctctggctgctttctaccgcgaccgcaaggtggagcggtgcaatcgcgtctgccacgcgctggtggagcagttcgtcgacaaggcgctcgaggtgcgggcgcagggcgggcgcgtcgacgagaagaccctcgaagatggggacggcgagaagaaaccgcgatacgtgttcctgcatggcctggcgcagcagacgggcgaccgccgccggatccgcgatgaggtcatgaatgtccttctggcgggtcgcgacaccaccgcctcgctgctgagtaacctcttcttcatgctggccaagcacccgcgcatctgggccaggctgcgcgacgaggtggccccgttgaacggccggccgcccacgtacgagcagctgcggaatctgacctatgtcaagtattgtttgaacgaatgtacgtaa

SEQ ID NO: 12844 - DNA, 429 bp, A.fumigatus
cttccaattactccatctctctcgtcgccggggcgatcgccgtcttcgtttacacgcttagcgtcctccgccgcaaatggacgcagtatcgctttgcccgtgcgcacaattgccaagcacccccccggctcgcctccaaggaccccttattcgggttggacaccatctatgccacgatccagaacgtcaaggaacacaagttccttgagcgcgcgcaggcccgtttcgatgcagtcggccacaccatccaaacgcgccgcctcctgcagacaatcatcttcacccgcgacccccagaacatcaagaccattctgtcactccggttcaaggactacgcgctgggccaccggtacaagaccttcggccccctcctcggccatggcatcttcaccaccgacggcgagcactgggcgcaatcgcgcgccatga

SEQ ID NO: 12845 - DNA, 687 bp, A.fumigatus
agaggaagcgaagggcctccgagcgaatcaccagagaacaccaccgaagacgctaagctgcctcctgtgacgacgatccagcgcggtgacctccccaagggcaaggctaatggcacgaagaaatcccccgcctctgcgccagtcgacgtgtcctccaccacctcctcatcctctgacgaatcctcggagtactccgagtccgaaaacgaggatgacgacgagaccgacgccgaggccgaaacccagaccggcaccgatcaacccgcccagagcaaggctgacctcctccgccgcagcagtgtaaccccttcatcacagagtaacgcgcggtcccccgccccctcgcagtcggcatcgcaatcctggggccaacccataaacggaagtcgcagccgtgccacactcaagacactcctcgtcgacaagaagaaagagtccgcggagaaggcacagctagccaagaaaaagatcagcgccgcgccgaaacggccgcggaatatcttctcgcctccatcggacgacgattccgacgagagcgagtccagctccagctccagctccagttcgagtgagagcgagagcgacaaggacagtgatagcgagaacgagagccatagcagtgcggatcatggggatatcatgtccagtggaacggtgggcaaactgcgagccgcgcgcaagaagtaa

SEQ ID NO: 12846 - DNA, 723 bp, A.fumigatus
gcgcgcgcaggcccgtttcgatgcagtcggccacaccatccaaacgcgccgcctcctgcagacaatcatcttcacccgcgacccccagaacatcaagaccattctgtcactccggttcaaggactacgcgctgggccaccggtacaagaccttcggccccctcctcggccatggcatcttcaccaccgacggcgagcactgggcgcaatcgcgcgccatgatccgccccaacttcgtccgcgagcaggtggccgacctcgccatcttcgaggcgcagatggccgatctgctggagttgatccccaacgacggccgcaccgtcgacctccaggacctcttcttcagctacaccatcgactcggccaccgagttcctcttcggccagagcgtgcagagcctgaagaagcgccgctccggcggccgcgacgcgcacgccgaggacgacttcgccagcgcattcaactacgcgcagcatgcgatcgccacgcgcatccggctgggccctctggctgctttctaccgcgaccgcaaggtggagcggtgcaatcgcgtctgccacgcgctggtggagcagttcgtcgacaaggcgctcgaggtgcgggcgcagggcgggcgcgtcgacgagaagaccctcgaagatggggacggcgagaagaaaccgcgatacgtgttcctgcatggcctggcgcagcagacgggcgaccgccgccggatccgcgatga

SEQ ID NO: 12847 - DNA, 540 bp, A.fumigatus
gtatacagccggtggctttcctctcattctctggacatttcagctcatctcattgcagacatccggcgttatatccgtccgtttttcttgactcctgatggcgctaagccgctacctaccaaacgctattatgatatcctcagctggcttgttacgcaactaaccatgtcctttgtcgtgatgccgttcatcttcctgtcgttcagttcgtccatccaggtttggcggagcgtgtatttctacggcattattggaaacatcatgtccatcatcttcttcgccagcccggcaaagggatatcttgttcgatccttgagtaagcgcaacaagccacacatcccacgcactgccagcatggaaagtctccaacaaccgacccttggtctcccgaatgaccccgctcgggaattcgatgatgcagtccaggaaatcaaggctgagtttgaggcgcgaagaagacgtggcagtgtggtcggagtaccaacaggcgaggaactgaaggccgccgtggaggccaagcttggtcggaagatctcgtga

SEQ ID NO: 12848 - DNA, 1284 bp, A.fumigatus
gttggggggagcgcactacctttcatcccggcggttaagaacctcgacaactccggcttaaattttgtccgcatcggtccttcctcaaacccggattcggccacgcgttctaactcgctgacatccttgaactctatggggactgttatcagacatattggtgccgctccgtggactcacggatcttccgaagagcagagttctcgttcacaatctttccgatctactcctccgtaccatccatcagtgcgatcaaactctaactccacccgacctcgcggccgcagtcattctcggtcccttacttcttcatctcgcagcgggccaccctcggttatccaggctattgtggatagtggcgtgtttatccaatatcccacaatcctggctccctcatcatcaggttcatgggtggatacttcacaatccgccaacgcatccgatcgcactgtccaagaattcacccccgaccaatcatctgaccgcttcaagtcccatttgtcaaccgtcacatctaggtggtccgccgagctggactctagctttgcttccggggccgatgagcccagcgaattgtcggctgcagagccgtccaggccctcggctgcactcgtgcgccagagaccgggatcgtcctcgttgtggctggtaagcgactcagacagagatgagcatctggaccatctctcaagtctaccagctcgtcccaccaatccagctgtcccaagcagtctttcgtcggagtcgaggaagagtagcttgcgcagcaacagtattaagcgaccgggaactagctcaagctttgtctacaacatacttccggcttgggcaaagatgtactatggtcttgatggacagaccgtgaactctgcgctgtcggtgattgatgggacccgcccgcctactgcccgccctgcgacgtccaactcgcaagctctacggcatatcccaacagcatcaggccgatcgagagctccaaccaatgaaacaattgggagtgtgcgttggatggccccaccggacccccgcgaccctcgaaaccattgggtcaagggctcagagaccgaccagctatcggacgcaaacaaccggctacgacacagttggtcgccgcacttgtatcctgacaagcgggctgttgggcaagaaggcaaaccatggaccgcgccttctatggattctcggacagagcccttgctgggacgaaggaacatgcaagtatggtcatttagcatggggttcgtttttccacttggtaagttcacttgttgccgtgagcattga

SEQ ID NO: 12849 - DNA, 1164 bp, A.fumigatus
ctaatctcggtagacgatgtgtataagaaagatctcaaccccagtaatcctctcgcccataatggtgatatagccaaggcgtacgcaaaccttcttcgcatgctctacgacgaagcgggtcagtcgtcgttcgctccccgccaatttaaacacaccattggtcgttatggtccagcattctcgggatacggtcaacaggattcgcaggaatttctgttgttcctgcttgatgggctgcaagaagatttgaacagaatccagaagaagccatatatcgagaagccagactccacagacgatatggtccatgataaggtggccctcaaagagtttgccagtaaatgctgggacatttacaaagcccgcaatgactcggtcatcacggatctctttgctggcatgtacaagtcaactcttgtctgtcctgtctgcgagaaggttagcatcatcttcgatccattcaacaacttgacactccagcttcccatcgaaaatctttggagcaaggagatcttcttttttcctctccaccgcaagcctgtcatcgttgacgtggaaattgataaaaacgccagcatcaaggcgctcaaggagttagtagccaagaagatgggctcggatccccagcgtctcgtcatggccgaaatctacaagtgcaagttctataagatgtttgacaactctgcgtccattgctgattgccagatcggccaaggcgatgacatcgcaatcttcgaggtcgagtctgttcccacgaactataatcccgacaagcgccagaagagttacttttcttatggccgttcagactatgaagaaattccaagctttgattcacccaaggcagaccgaatgctagtgcccatcttcaatcggcattaccggccaaagtcgaataacagcgggaatatgcagcggtcactcttcggcgctcctttgtatgtaatcatcagcagagaagaggctctaagttacgatgccatcctccgcaaagttcttgaagctgttgccacgttaacaacacgagacattctcaatgaggcgaacatcaagaatgctgacgagcaagggggaactcaagaggattcggataccgttgtgatgaatgaagacgatgcgcattctgcggattctaaaatcaagacctcatccgtggaaccgtga

SEQ ID NO: 12850 - DNA, 807 bp, A.fumigatus
cctttcagccccgtcgtaagactagcaaacccggccgccgggaccactccacagagtctaagagagaagaatatgccgcctgcaaaggttttgtccagccgacacaccaacttccaaaagtggctgaagcaagtgaaggggctggccaatgttgacatgtctaccaaagttcgtgtatggagaatcctaggaggactgggaagcgccacggcatcggctgcaatcacccccgctgcgtcacggagcgcttctccggcccctacggcctccctggttgccaatgctggtaacaatcttgtgcttgacctcaatacgttcctctcattatcggacggcgctcaacgagaactggtcgataatgtcaaggatcaaactaataatcccaatttcaacggtcgatctaccttggatcgagttggtttgtctaccagtgatgttgtggtgcttgaggagcgcgttggtggagagtgggcttcagaagtatccaagaagacgctcgatcgactaggtgttccgagtggcagtgtgaagaatggcgctcctgccaagctcaagaacaagagtcctaacaacagtggtagatcatctcccgcgccagaacctattaggggccggcgtaaagatggaaagcccaggggctgcacgggattgagcaacctcggaaatacctgctacatgaactctgctctacagtgtgtgcgcagtgtggaggaactcacatactacttcctgagtacggactctcacctttcccctctggcccttggctattatccactaactaatctcggtagacgatgtgtataa

SEQ ID NO: 12851 - DNA, 321 bp, A.fumigatus
cgcaattacgcggacctttcaggcccgtgtgtgagcacgtatcccagccgtatctacggttggtttgccttctgcaccgccaacatcgtgtgcgagatccccatggccatcgtctcgagcctcatctactggttactatggtactaccccgtcggcttccccacggactccagcaccgcaggctacgtcttcctcatgtcgatgctattcttcctcttcatgtctaactggggccaatggatctgcgcctttgcgccgtcgttcaccgtcatctccaacgtatgtccacccgtctcctttcaccactcgcttcaacgctaa

SEQ ID NO: 12852 - DNA, 549 bp, A.fumigatus
caccctcaacaggtcctccctttcttcttcgtcatgtgcaacctcttcaacggtatcgtccgtccctaccgcgactacccggtcttctggaaatactggatgtactatgtcaacccggtcacctggtggctccgcggggtcatctcctccatcttccccaccgggcagatagacggctcccctccgaaaacaacccatttcaacccgcccccgggccagacgtgcgccaattacgcaggcaattcaatcacaaacatcgccaagaacgggtatgtgctcaacccggacgcaagcgcagactgccagtactgcccatacagcaacggcgcggagtacatggccacgctgtacgtgcacgacggcgacaagtggcgctgtttcgggatctttctggcttttgtgattatcaactggctgttggtttatttctttatatatactgtgcgtgtgagaggctggtcgtttggtatggggtatttgtttggggggatggggttggttattgataaagtcaagggtgtttttaagaggaagtcggagaaggcgtga

SEQ ID NO: 12853 - DNA, 459 bp, A.fumigatus
gcacgtatcccagccgtatctacggttggtttgccttctgcaccgccaacatcgtgtgcgagatccccatggccatcgtctcgagcctcatctactggttactatggtactaccccgtcggcttccccacggactccagcaccgcaggctacgtcttcctcatgtcgatgctattcttcctcttcatgtctaactggggccaatggatctgcgcctttgcgccgtcgttcaccgtcatctccaacgtatgtccacccgtctcctttcaccactcgcttcaacgctaacaccctcaacaggtcctccctttcttcttcgtcatgtgcaacctcttcaacggtatcgtccgtccctaccgcgactacccggtcttctggaaatactggatgtactatgtcaacccggtcacctggtggctccgcggggtcatctcctccatcttccccaccgggcagatag

SEQ ID NO: 12854 - DNA, 393 bp, A.fumigatus
gatcaatatacctcgcttctaaaggtaagcactcgcaccgttccatccagccacaagtctaaaatcctcccaggagacggcggtacaaccgacttcaccctccgaacctctaagaccttctccgctcgtaaccccaacgacaaagaccagctcattcacaaaaacaccgccgaagaatggaaagatcgctttcgggtttacttcccctcacagacgaccattgagcaatcacgcggcggtccagactgtgccggtacaatctgcttccagtctaaatggtacgaaggtccgaaattcccgcgtcatgtgctgcgcgactgtaagagtcggcggccgggacttttgatgcataacaaggtagctctccctccatctgctgaggtaatatcctag

SEQ ID NO: 12855 - DNA, 183 bp, A.fumigatus
agtgcttttctcattgatctcccccgaaaggtagccacgacttctgtgggctccaagaccgtcttcgaggaagaattggtctactttctaagagcgagtactttgcaagaaaatattatttcgagactcgacgagtttgatttcagcccaacgtctcatattatgctagttcacactatgtaa

SEQ ID NO: 12856 - DNA, 192 bp, A.fumigatus
gagggcagcaggcaaggctgggagactcacttcacagctctgtggaatatcgcctcatctaagcctaagaaagataatacatgctcttatcgacaggacattcagggcatatcggggccagacccggaactggattgtctagattgtgagcatggagcggctgagagaactgaacctgctgaagctctttga

SEQ ID NO: 12857 - DNA, 1740 bp, A.fumigatus
acttcgcattcattcgccatgggtgttcccaagttcttccgctggctcagcgagcgctatcccacgatctccatgttgatcgcggagaatcggatacctgaattcgatgcgctttatctcgacatgaacggtattattcataattgtacacataaagacagcgattctcccacgtttcgcatgacggaggataagatgtttatagcgatcttcaactatatcgagcatctgtacggcaagatcaagccaaggaaattgttcttcatggcggttgacggtgtcgctccacgcgcgaagatgaatcaacagcgtgcgagacggtttagaacagccctggacgctgaggtggcaaaggagaaggccatagcccagggaatcgagatgccgaaagaggatccattcgacagcaactgcatcactcccggtacggagttcatggcaaagctgacgcaacaactgaagtattttatcaacaagaaaatctcagaggataaagattggcaaggggtagatattgtgctgtcgggtcatgaggtaccgggagaaggtgaacataagatcatggagtatatccggcatgcgaaagcacagccagggtatgaccccaacattcgtcactgtctctatggtcttgatgcggacttgatcatgttgggccttcttagtcatgatcctcatttctgtctccttcgtgaggaggtaacatttggtcgccaagtccagaagaagcctaaggaacttgagcaccaaaacttctacctcttgcatctttgtatggttcgagaatacctggaattggagtttcaggaattagaacaggagggagttctggatttccccttcgatatggaaagggtcatcgatgacttcatcctgatggctttcttcgttgggaacgatttcttgcctaatcttcctaatctgcacatcaacgagggagccctctcgctaatgttcaagatttacaaggacgtcttgccaaaaatgggtggttacgtcaacgagggaggtgtcatcaacctgaagcgcctcggcatgcttattgaagctctgagtgatgttgagtttcgcttctttgaagccgaatactctgacgcgaggtggattaatgccaaacggaatggcgtcgcgaacggttctgagtttcaagagaagccaaagggcttgactctcacgccagcccagaaggagcttttcaaagaaatcaagaagtacgttttgaacaggcctgagaaggcatcagattcaaaacctctagacctttctcccacactaccggctcgtgatcgcaaatttgtggagcaacttgcagacgacctgcgattaccatggaccacagttgcggacgagcacggagaccgattcatcagacttcagctccctgtcaacgaggatgacgacagcgaagaggaggaagatgaagaggcatctatggccgtacagcgtgtcattcggagatatgacaatgcgaaggtccaggagatttcccccgaggaagctcagaaagcagcagagaagaagtatgaggaaaaattccaggactggaaagacaagtattacatgagcaaatttggatggggtctcgacaatcacgaggaattgcggaaactgacggaaaattatgtgcaaggtcttcaatgggttctgtattattattacaggggtattgcgtcttggccatggttcttcaagtatcattatgcgcccatgatttctggtacgtgctggctactcatctga

SEQ ID NO: 12858 - DNA, 1398 bp, A.fumigatus
ctagatgtgatcaagggtctgaacgcggacatgaattttaaactaggccaaccgttcaagccgtacgagcagctcatgggtgtcctacctgaccgaagcaagcaaattgtgcctgccgcgttccgggacttaatgacgtccccagaatctcccatcatcgacttctatccgcgtgaattcgaattggatatgaacggcaagaagatggaatgggaagctgttgtcaagattccgtttattgatgaacgtcgcctcttggaagctcttgccaccagagagcacctcttgactccggaagaaaaagcgcgaaatgggtttggggttagtctcaagtttacttactcaccggaagtgaacttcacctacccttcatctttccctggtgtcttccctgatattcccagttgccattgcattgagaatatttttgacctgcctaccatggatggcttggaaccttatattggattggtcgagggtgtccaacttggagcggctgcattggctggtttcccaagtttgaagactctgccgcacgtaggccagcttggttttcacggcgtgtgcgttttccaacaggagagtcgcaacgagagtatggttatcacggtacttgacccgggcagcaggtcgaatattgagctggctaagcagaagcttgggaagcgtgtctttgtcggatacccctttctgcaggaagctcttgtcatccgtgtatctgatgagctgttcgattatctccttccggaaggagagaatcatgtggtctcgattcctcacactgaggctcaaattgatcagtggaagaaaaaggcagataagatcgaagggatatacagtcgcagacttggcactattattggccccgttgagtcaatggtgcacgttcaacttctcaagggtttgatcaaaacagacgagggtgctacaattaaggaattcgccgatattccggggcaggaaaccgactatgcgctacagctcgtcgtggacgaagttatcaaccccgatgagcgcttcatcgaacgtgatgccctacccatcgagaaagaattccccgaaggctcgcgtgcctttttcttgggcgatttcaattatggtagaccggtgcatatcacaggacacgaagacggcaaggtcaatgggttgattgctgcaatcaagggccgcgagccagagtttgggagagatcgcgctagagaagcggagaggctatgtccctatatgccctcatttgccattgctcgcagcctgcgtttgaatccgttggtgttggcaaagatcacctcctcattctctgttgacatagaggggcagcgcgtcaatttgggtctgaatctcaagttcgaagccgtcttcaccacggggctggaaggatccgacggtggtcgatcatcc

SEQ ID NO: 12859 - DNA, 1560 bp, A.fumigatus
  unsure (1548): Identity of nucleotide sequences at the above locations are unknown.
tacgatcttttgcgacagtctaatcactcttcccattccattcctttgtcaactttacctggaccagtactcctttgttattttttcggatacggagtgctctgtacatctgagcttcttcggtaccaaagacaatcaccttctatacaggaacgccctcgctgtgatacttccgttccaccacatttctcagctatcgttcatcatggttctcccgaagagatcttccaggccgaaaaagggtcatcagcaaatactgctgattcagatgaaacccggagcccaccaactgaagctgtcaatccactgcagaggtctctgagcttaaatccttcacggcggctggacgccgacgaacagttcaagagcattgacaaacagttcgaagaactgcacgatcaaatgcagacacgacctttatcttctcgctcccatgctcccacgtctcgtgcctcaagtcgtttcacgcagcgcaatccgcgacatgtcgatctgctggaagccttgttctcgtcgcatagatatcaggtgcagatagcaaatgcactgtcgccgactactccttttaatgaagatatcgccgagcgcaatatggttcgattccttcagggtcagccgaggacgaagaatgtttattcccgtatcatctcagccctttatcaggaagatgtggcggacaggaacattgcaaagaatcgaatgaacaaacgcacaatatcccgaagcgctagctctcgatcgcagcctgcagcagcagcacctggtgaggttactcaacgtgaaatcggcagccagtcccttacactggccaatgagggcaaaatcacgccggcctgctcacggccaggttcgagctcctcgtctcaacctcgttctttacgggctcacaagtcagcaccgactataatggctgaatgtacaaatgcgtcaggagaacaatctgtacctaatgctggaggctacttggacgtccctccagctcacaagcaaggcgaccaatggagcaacacaccgctaccggacagtccaaccttacctgtgccaatgactcaagcccgaaagatgggtccgtcgggagggaggggcactcctgaagtgacgagaagctcgccgtcaacctgcagtaatgcctcatctacatcacccagactcaactccaagaaaaatgtccgggacctttccatcaacacggagttagcagctcgaggaaaacctaagtcacggatctcgcactgtgcgatccagcctccaactcctagcaatcatgatgtcaagcagaatcctagcattgccgaagtcatcaacagccccctaccactccgaacccccacgttgatgtttcccctgcccccctcaaaccaaaaagcggaggtagtgggcatgtttaagcaggctttgaattcgtccgcagtgactatctcgccccatcccacctttgagactctacaggacgcgatagttcgagagattaactctcatgaagcttttcgacgtgttcctgttcctgccgttcaagcaggttctctctttacccccgtcccatctcanggagtcttttga

SEQ ID NO: 12860 - DNA, 558 bp, A.fumigatus
tcaaccaccgaaccgccgataccaccgaaccgccgcttcgccgcgaatatcatcgaattcttggagccatctaatcaacacattatttctttaccactattattaaaaatgccactatccaaagagaatcgaatgcagatggccatatcagcatataaaaaggggcaattcaaatcaaaagcagccgctgctaaggtctttggggtgtctagagagacccttcgtgatcggcttcgcggaatcaaaccacgcgcagagacacgcgctaatagccataagttaacagctcttgaagaggaggcccttgctaagcgtctattagatgctgataggcgtggcttttcaattcgaccgcagttcctgcgtggaatggcacatattctactatgtgcacggacaaatgatccaacttcagtcattggagtcaactgggcatataagtttattaaacgccatccagcactgcgtacaaggtataatcggaggatctcataccagcgggcaacgcaggcagatcgttttcacacacgacagctggccaggatccaacgctgcagg

SEQ ID NO: 12861 - DNA, 192 bp, A.fumigatus
ctgctccaatgtatgtacctaagctcttgtggtctcatgaatgatcccactctgattcaccgctctgtggcgctggttgaggttccgtttcaggtcgatgccaccttgttgcggtcgggcatgacaattgcttacccctaccgaatggagaattttggtgaaatgacactatcttgcgatctactcgagtaa

SEQ ID NO: 12862 - DNA, 276 bp, A.fumigatus
cccaagtcttccgtcggtgtcatcatctacaaggttgtcggcaaccgctacattgagaagcgcatcaacgtccgcatcgagcacgtcaagcactcccgctcccgtgaggacttcatcaagcgtgtcaaggagaacgccgccaagaagcgccaggccaaggagcagggcatccacctccacctgaagagacagcctgccatgccccgtgagggccacgttgtcgagggtgttgccgctgagaccatcacccccatcccttacgacacccacatctaa

SEQ ID NO: 12863 - DNA, 639 bp, A.fumigatus
  unsure (607): Identity of nucleotide sequences at the above locations are unknown.
caggaatcgcccacgggaacggccaccaacccaatctggctggtgaagacacgcttacaactagacaagtctaacgccgagaacggcaagggccgtcagtataagaacagctgggactgtatcaaacagacgatgcgccacgagggcattcgaggcttgtacaagggactttctgcatcatacctcggtgtgactgagtcaactctgcaatgggtgatgtacgaacaaatgaagatgtacttagcccgaagggaagcagccaagcgtgctgatcccaatcacatatacaatgtctgggacgatgttgagttgtggggtggtcgaatctgctcccgcgggcatggcgaaactgattgctgcggccgccacgtacccccacgaagttgtccgaacgaggctgaggcaagcccccactgtatctgtgggggatggcaaagttcaaatgaaatacaccggtcttgtgcagtgcttcaagactgtgtggaaggaggagggcatggtcggattgtatggcggtctcacaccgcatttgctacgtgtggttccatcagccgccatcatgttcggaatgtgagtatctttgttcctgcttgtacagatgaccagnctcctgatatcatcggtctaggtacgaggtga

SEQ ID NO: 12864 - DNA, 330 bp, A.fumigatus
cccgaagggaagcagccaagcgtgctgatcccaatcacatatacaatgtctgggacgatgttgagttgtggggtggtcgaatctgctcccgcgggcatggcgaaactgattgctgcggccgccacgtacccccacgaagttgtccgaacgaggctgaggcaagcccccactgtatctgtgggggatggcaaagttcaaatgaaatacaccggtcttgtgcagtgcttcaagactgtgtggaaggaggagggcatggtcggattgtatggcggtctcacaccgcatttgctacgtgtggttccatcagccgccatcatgttcggaatgtga

SEQ ID NO: 12865 - DNA, 462 bp, A.fumigatus
attcacagaattggtggaatgaccgccgcgactcttacctctcctcttgatgtcctgaaaacccggttacagtcggacttctatcaagcccagctcaaatctcttcgggccgctcacccattgccaccatctaactcacttgcttcacttccacggaccgctatgatgcactttagcgaaacgttccagatcttgcgctcgatacatgtccatgagggctggcgcgcactgtttaagggccttgggcccaatctcattggcgttgttccggcgcgtgccattaacttctacgtttatggaaacggaaagcggatactcagcgactactttcaatatcacgattctaaggagacgcccgtcgggatccatctgacggcggccgccatagcaggaatcgcccacgggaacggccaccaacccaatctggctggtgaagacacgcttacaactagacaagtctaa

SEQ ID NO: 12866 - DNA, 726 bp, A.fumigatus
ctttcacttcccaatagactgtccagcactggctacatcgtcgtgaccatcgaccatccgtatgacgcaggcattgtaacatttcctgacaataccacaatcctcgccgcaaacattacaaccgatgaccaaattgtggatgacctggacgtccgtgtgagagacgtatccttcgtcctcgacgagctccaccggccgtccgtcatctcaaagctcatcccaggtcaaacatgtgggctcgatacctctaaagtgggaatctacggtcactcccttggaggcgccactgcagcggaggctatgctttctgattctcgcctcaaagggggtatcaacctggacggttcatttttcggctctgttatccaccggggattggatcggccgttcatgataatggcacatgaagggaagaacctaacaaccgatgccacttggggcgctctgtggccaaagttgaagggtaccaggagacgattcatgattaaaggaagtacacatggcacatttacggatttggcgcaggcggctgatatccttggtctgagagaggagtttccgacccaggcggccgtattcctgggaagtattgaggggggaagagcccttcaggtcattgctacttacactagcagattctttgactttgttctgaaggggaagaaagttgagctattggagatgtccagtaaggagttccctgaggtgattgctggagaagattaa

SEQ ID NO: 12867 - DNA, 243 bp, A.fumigatus
ctcatacattgggttaccacctggtcgaaccaatacgcactgtgttcgttggaatgcgcggtgctactggctaaatggcttgataaagtgactgtgccgaatcccgatctcgccttgacagagcaagaaaccaagcttctacaattcgttatggaaaggttaatggaaacaccccatggaaccaatcgagaatggttcctgggacaacaataccgggctcaattggcttgttcccccgtcttt

SEQ ID NO: 12868 - DNA, 210 bp, A.fumigatus
cgtcttgtgagacgtctgcaggttggagagaggcacaaggcgcttcagccacataacgacatactctcaccgcgatggaaaatggtcaaggctgcccggactttccaatgccagcgatgttctcggacgtttgctcggttggagcatctccagcgccacgatcggtcccgtgagtcgcatccccgatcccctcttctccaaatcctctga

SEQ ID NO: 12869 - DNA, 1698 bp, A.fumigatus
gtgtttagggatctcttgacccgccatgagcgattgtcccacagctcgccgtccggtaaccacgacaccgagaatggcgaccatccaacacccgccccatcagcccctgaccatgtgttggatgggctgaatatccttgcatccgccgtggcggatcgtaccgtgaccactcctactcggggacctcctcgcggcccgtttcagcatccactctcggccagccaaggtacattctcttccggccggccggcaaccgcggatcagacgcctctcgccggccatcctatacaatcagcgcattcccccggcactgccgaagcgactgttttcggtgaaactttgtccggatacactacgtccaacgcatacgacggtgacgacttcacgtctttccttgacagcattccgcttcccagccacccttactcgcctacatatcagcccttgccagtatttcctgcctggaacttcgattcgacttccgattacgataattcagttgtccgaacaggcacagcggacgcagcagtaacgccctcgagctcggtgcttcctcgtcatgggacgcagttgccctctcttcagcccgaaagcccccaaacctcccatagagcgcgacagccgaagggggccatttttgtcacaacacagtgtcgcgacaaaataattgcgcagctcgctgattacgccaacgtccttccagatccttacatcccgtctcgacacgctctgtcccgatgccttacagggtatctgtctggatatcacgaccattacccattcatgcacatccccactttggacattgaacatgtgagcttgcaactgtttctttccatggcagcattaggcgctcggtactgtcgggaaccagatacaagtttgagcctgtaccgaatcgcaaggaccgttaccatggaacatatccgaaggacgtatcagtttcctgggaccggtcaattttccgaaaagtttaaactttcaactactgaaagtcctgaaagccaagatcttctcgaaactgtccaggcattattgctgctccattcagtctcatcatggttcaaacgcaatccgtcccatcacgaatctctcttcatgcgcagttttatggagacgatgcttcgagaaggaggactgaacgaactgcctgagcaggatggctcatggaaaagctggatacgccgcgagtgtgtgaaaaggacctcactcattgccttctgctatcttaatatcctcaccattgtcttcgatatcacaccgctcatcctcaccgagggaaatcagtatggatcttccatgcagcgaaaaggaatggcatgctcccaatgccgttgcttggatgcaagaacgcagtcagacatcgccggaaccaaagctacaagacgcgctctcgtcgcttttcactcatcctaccacaccaaagacaaacatggagaccttctcctctttgggtggatacgtgctgatccatgccattctacaggatatctggcttcttcaaaaggctcgtcgcctgcctctgtcgagaaacagctccttctcgacggcggaagccttatccctcgaacaagcgttagaacaatggtgccaatgctgggagcgcaaccaggaatcctcgatcgatccattcaaccctcatgggccgctctctttcacctccaccgccctccttcgtctcgcatacatccgtcttaa

SEQ ID NO: 12870 - DNA, 741 bp, A.fumigatus
aaaggacctcactcattgccttctgctatcttaatatcctcaccattgtcttcgatatcacaccgctcatcctcaccgagggaaatcagtatggatcttccatgcagcgaaaaggaatggcatgctcccaatgccgttgcttggatgcaagaacgcagtcagacatcgccggaaccaaagctacaagacgcgctctcgtcgcttttcactcatcctaccacaccaaagacaaacatggagaccttctcctctttgggtggatacgtgctgatccatgccattctacaggatatctggcttcttcaaaaggctcgtcgcctgcctctgtcgagaaacagctccttctcgacggcggaagccttatccctcgaacaagcgttagaacaatggtgccaatgctgggagcgcaaccaggaatcctcgatcgatccattcaaccctcatgggccgctctctttcacctccaccgccctccttcgtctcgcatacatccgtcttaatgcggacttcacatccgcacggcgtctgcagacctgggacccaagccagattgcacaatcactgcgccagaacctttccgtgcagcggggcgaccggctgacacgggccgccttgcattgcgctcatgccctgagcacacctatcaagctggggatcaactacgtagctcatacattgggttaccacctggtcgaaccaatacgcactgtgttcgttggaatgcgcggtgctactggctaa

SEQ ID NO: 12871 - DNA, 246 bp, A.fumigatus
acacttagtatactcccttcttccgaccctctcgtggctcaatgcagtacttacttgcgagtgaacgattttggacacttcttgcagacatacggcttttctttggtgtctacagaagcggtcagaggatttggagaagaggggatcggggatgcgactcacgggaccgatcgtggcgctggagatgctccaaccgagcaaacgtccgagaacatcgctggcattggaaagtccgggcagccttga

SEQ ID NO: 12872 - DNA, 243 bp, A.fumigatus
ttgccaaagcgccacctcggatccttccagccccgtgggaagacgaaggcagcttatggtcaaggcaccatggtcgctttatcaaggcgggagatggaaattgaggaatattacaagcttgttgcgacaggtcttggttgcctggaggcagtattaaaggtttggattgcctcttcccccggttacaacaattgcttcgccagtctgtggagcattcaagttaatttcggtgctaccctttag

SEQ ID NO: 12873 - DNA, 189 bp, A.fumigatus
gagttgcggtatatgacggagctcatcgttgagttgatggcttcttgctactgcaaccgcacgctgagcctgttcgattgcatcggagctcgttccttgttgcagatgagcaagtgcttctatcacggccgagatggccgcaacagctttgtcgccttgtcggttagccatgttggagatcttatgtag

SEQ ID NO: 12874 - DNA, 201 bp, A.fumigatus
tccgccgtggagctcaggggatacggtcgccgcgtccgcaaacgcattgtgacagttgtgcgtcagcgtcacatagcgaacgcccagtcgatgcagcatgcgcagcgcgctgacgctgtcggcgatctgatggaggccttcgatgccgatcagactcgcgacgcggcccgcacggaagctgctccagatactggccgctga

SEQ ID NO: 12875 - DNA, 333 bp, A.fumigatus
cggcggagaactggtccatccgagacgagctcgtcctaccagtacaaggccctcttcgcccaacatctctctccgcgccatctgtcctatgcagatggcatgggtggtgacgcaaaactgctgcaggccgcggcggacttcttcaaccgggtgtttgccgcgcatagccgtgtgcagccggcccacctcgtcgtcggggctggatgcagctcgttgctggagaatctgctgtatgacatctgcgagccgggggagggcgtgttgatcgagacgccgttctggggtgcgtaccatcgggggtttcgttggcaccgcatgcatggtcttagctga

SEQ ID NO: 12876 - DNA, 891 bp, A.fumigatus
tgtatacgaatagggggcttcgagacgagcttcgtcctgcgctccaacgtcaccgctgttcatgtgaggcctccgtgtcatggcaatggatccgcagatctggatcgtctcgtgtcggcgtatattgaagcgtacgaacgggctctgcgtcaggccccctgccgcatcaaggccatcctcgtgtgtaacccgcacaatccatgcgggcacatctacccaccgagagtaatccaggccttgcttcaattcgcccaacggcatgatctattctacatctccgatgagatctacgccctctccacgctggatgagcaaaccgccttcacctcggtcctgagcatcgatgtagccgccctgggtgtagacctggcgcgcgtattcaccctgtacagtatcagcaaagacctcggcagtagcggattgcgactggtatactgtcttatctcctccgactctcaaggcctccgcagaactgacactgtgcagggcttcggcatcacccaagcacatcccgacctgcgtctctccctcgccatctcgaaccattcccgcgtctcgacattcacctcgctggtcatcaccgctctcctgcacgacccggaagccgccacggcaatcctgcaccagaatcgagccgctctgcagcgcagcgccaagctcatcagcgactttctcgccttccaccagattccctttgtgccgccggccgccggagtatacgtctgggcgcggctcggatggagatcgtcgtcccggccgggtgatgagcccagctgggacgaggaggcccgtctgaacgatcgattcgaggcggcgggtgtgtcggtcggtgcgggacaggggtattgtgctagcgagtcttcgaccacggggcagaagatccgcgtccgg

SEQ ID NO: 12877 - DNA, 432 bp, A.fumigatus
acctggcgcgcgtattcaccctgtacagtatcagcaaagacctcggcagtagcggattgcgactggtatactgtcttatctcctccgactctcaaggcctccgcagaactgacactgtgcagggcttcggcatcacccaagcacatcccgacctgcgtctctccctcgccatctcgaaccattcccgcgtctcgacattcacctcgctggtcatcaccgctctcctgcacgacccggaagccgccacggcaatcctgcaccagaatcgagccgctctgcagcgcagcgccaagctcatcagcgactttctcgccttccaccagattccctttgtgccgccggccgccggagtatacgtctgggcgcggctcggatggagatcgtcgtcccggccgggtgatgagcccagctgggacgaggaggcccgtctga

SEQ ID NO: 12878 - DNA, 234 bp, A.fumigatus
catgcaagaatgtctccgagccccatcgaagagcaggcaacgaggcttctgaaagaggtacctctgatcgacggccataatgactttccatacatgatacgcggatggttccgcaatgacatcaatggccaggatgcccatctgtatgatatgcccatcgggcagacggatctccagcgtctacagaagggactgttgggtggccagttctggagcgcatttgtgccttggtag

SEQ ID NO: 12879 - DNA, 621 bp, A.fumigatus
ttgacctctcgcacacgtcacacgaggcccaaacacaggcactgcggctttctcgggcaccggtcatctactctcattcttccatgtaggtggcacaccatgatcctaaccgacaggagctcacaaccggacagatacagtctccgtgcacacgcccgcaacgtcacggacgaaaacctgcacctgctgcatcgcaacagaggcgtagtcatgatctgtttcctgcgcgagctgctcgcatcggaggctgaccaggccacgctggcccatgtcatcgatcatatcatctacgctggcacgcgaatcgggtacgagcacgtcggcatcgggtccgactttgacgggatgctccgcggtccggatgggctgcatgacgtctcgtgctaccctgccctggtggctgggttgcttgagcgcggagtatccgaggaggacgtcaaacgggtgatgggattgaacgtcattcgcgtgctggaggaagtggagcgtgttgcggcagatcttcaaggggccggggaaaaatgtctctgtgacgaactcgacgaagtgtggaacgaggatatcaaggagcagttgacgcgggagcgaaaacgggtgaagaagttggggcctcaaaagtaa

SEQ ID NO: 12880 - DNA, 537 bp, A.fumigatus
tatgcccatcgggcagacggatctccagcgtctacagaagggactgttgggtggccagttctggagcgcatttgtgccttggtaggtgtctaccccaatattggcacatcgatcattgtgctaagtgaattcagccccaagaaccccgacaaggaggttggcagtctcgaggccctccgccagacactccaacagctcgacgtgatccacagactgatcgaaagacacccgacgatcctgcaattcgccgactcagcggccagtatctggagcagcttccgtgcgggccgcgtcgcgagtctgatcggcatcgaaggcctccatcagatcgccgacagcgtcagcgcgctgcgcatgctgcatcgactgggcgttcgctatgtgacgctgacgcacaactgtcacaatgcgtttgcggacgcggcgaccgtatcccctgagctccacggcggactatcccgcaaaggagagcggctgattcgcgagctcaaccgcatggggatgtatgtatctgcccgtagactgggatacggatag

SEQ ID NO: 12881 - DNA, 255 bp, A.fumigatus
aagtacatactcgcgagcgctgtgatcaccagacgagtgattgatgcatcaatcctggcattactggctctactggggttggctgtgcaccacctaggaccatcctacgatatacttgctctggctgagactcagtatatatatgcaattaattactatgtcgccgacatgaacagtccacatcataccactcatggtactaagcacatccggatcagtcattccattccaattatgtacgggaaacataagtaa

SEQ ID NO: 12882 - DNA, 204 bp, A.fumigatus
tcacagcgctcgcgagtatgtacttttattattattgcccatgtagcatataccaatgtcccctctttatcccattccaacccccaaaatgagaagcccccgtccagtccgtgtcctttccccgcagtcctaattcttccttctcatgccatcatggtctcgtgcgacttccccttcttcggtcgctccaagctcgttcagtaa

SEQ ID NO: 12883 - DNA, 330 bp, A.fumigatus
  unsure (156),(171),(192),(310): Identity of nucleotide sequences at the above locations are unknown.
ggaagggcaggtatttcgcgtggatttgacgaggaggtgctgacagtgtgcaggatgataggaatcgggttctcgagcaacaaagcgtccgttgagaggctttcccggtgggagcaagaatcttgggcataccacggtgatgatggcaaatcattntttggggagaatcanggacaaggacgaccgtccggnccgacgtttggtgccaatgatactggtgggtgtggcggtaaatttggtaaccggatgcgccttttttcaccaagaatggcggctttcctggtatatgcgggccgccctaatatcaggnctatggtgacagaaaactga

SEQ ID NO: 12884 - DNA, 930 bp, A.fumigatus
  unsure (756),(860),(880): Identity of nucleotide sequences at the above locations are unknown.
gggccgtcggatgcccccttcgtcactaaaagtacccgcctggccgttggcttttgctccatccagcgaaacgacgacagcatgactgatgcgcctttgcccccttccggtggagctcgacgagctcctcctctgtcaacttcatattccggtccaagcatctcatctgttccacgccgttcttcctacgcctcggtcctgtctgggactgctctctcgccaccaagcaacagtagtcctccttcccatcctcttatctctaactccaccacttcataccccccaccctactaccccgacggccgactactgaggccttcctcctccgccttggatgcagatatgcagttaaactccccctggaggacgacgcctggcgattcacttcctccttattctcggaagtttgccaaccttcctcgatacgatacattatttcagaaccccggcagcttctccgatccctcattatttactccatcctatctccgcaactcccgatacatcgctcgcctcgaggccgctcgccgaacaaagctcgcttctcaacgagatgttccaccttccgcttctacttcaaaccctctctcggcttcctctagccatgcaagcttgcctcgtatagctccttcccatcgtgggatgacgtatgatatcatcgaaagggaaccgccgagcgacgacgatcatctcccaccactcccctcacgatggagcgacaatgataaatactccggtatagagctcacaaacggngggcttgagatccggtatcccggcccggcaaacaagcacgatcatgaggctgccgcagtccgtgctgatcaccccatgcccccgcagtgtggcatttattactntgagatcacgattctatcanaacctaaggaagggcaggtatttcgcgtggatttgacgaggaggtgctga

SEQ ID NO: 12885 - DNA, 183 bp, A.fumigatus
tatggacctgggctgaccttctcccttagcaactatagccaagccaaggcaatctccttggtaattggcacagcagcactgttcggtggtcttgaggcgttgctgattctcacattgcgagtatgtctgcttgatgcacctgttaaggctgcttcactggaacagatccttaccattgtgtag

SEQ ID NO: 12886 - DNA, 216 bp, A.fumigatus
tggcgcggctccttccagccccgtggtgaagactccactgcttcaaacaacaagagcaagcaggaaacgatgttggccaaaatgtttctcaggatgaggtcgtgggacgtctctatctattcttctcttgtaaagacaggtaccgtttgggcgcatctagatcgaggccccaccatctggcaaccagagaagtccttccactcaggaacgagctga

SEQ ID NO: 12887 - DNA, 282 bp, A.fumigatus
  unsure (160): Identity of nucleotide sequences at the above locations are unknown.
aaaaccctctcagtacctggtggacaagttgttggagtggccggatttatagtcactgaaacccgactctatacaagtatggctgacacggagcatgtcactgtggcgtccaacattctaggaactatcggaacggttctctggtgcattcagctgatcncgcaaatatggtataattggcgacagaagaagacagacggcctgccaccgtctatgatgtttctatgggcttcttgtacgctgcacttgaaattctgcgttcttccggagctcgatggctga

SEQ ID NO: 12888 - DNA, 246 bp, A.fumigatus
ggcgatagggtcgtcctggaagtcggcatctacgcgagccatatcgtctggcgctttcgctaccggaaactgcgaaaagaagccaaagctgctggcgtcagcattgatgagatgctgaatatgcgcgggaatgagactgactgggtgaatgatgctgagaagaggcctggcgataatgagagtcagattgctgtggaccaacggcaagtttcagccgaggttgtagagcagcctgaattgaattag

SEQ ID NO: 12889 - DNA, 222 bp, A.fumigatus
acaataaggatgcttcaacgactaaaaacaagtattgttagcatcctaaacggagcacgaaatcgtaatagcagtgatattgtttttgtttttgccggccctgagaccgacgggaaggaggtgctttgcccccagccgggcactgctaacaaggagtcgaaccctgctcgccactcctacccaagccccccaggaccctcagaaccgacaatccacaagtga

SEQ ID NO: 12890 - DNA, 879 bp, A.fumigatus
atcaaccgcggatccttccagccccgtggtgaagacagctggtggctgggaacatattttgccttcgtttacatctggtcattgggagtcatcgccggtatccaacgttcagttacagctgcaacagtgagtcagtggtactttcaccgtcttgcgagcccgaaacccacgtctcggcagatagtacaggcggcttttgtccattctgtcaccacgttgttcggcacagtctgtttctctaagctgatagcattatctactcggctgccacttctgttactaccaactcgcctatctcggcttctgaatcttttcgtgtactcacttgttccttctcctctcgcggcgctcacagaccctcttactctcacttacgccgctattcattcccaaccgctcatactatctgctcgtggcctccttgaaatgcagagtgtctcacttgcgacggcggtgtcgtcactccacatgaggtcgacttcttggtcccatgcgggttctgcaccgctcctctcctaccggctttcgaagctctttcttcacgctgctcgcttcatgatgtctttgacactcggttttggaggatgggtaagcgctgcccggaacctcgaggttcccggcccgggtaatggagttcatggcagtatgtatgcctacgtggtcggtctcattgcaggaatcattggctggagtatcctaggagcggctgaaggcgtcatcgcagatattgtcgatgcctcgttcatctgctggagtagtgaagttgggactcgtggtggagaagcccggtattgccgagaagctggctggcttttcggtgaacatttggcaaatgaccttcgccatacatcccatacacatcatcagcctgagccgtaa

SEQ ID NO: 12891 - DNA, 207 bp, A.fumigatus
tcatcagcaacaaatgcgagaataaaacaaaggacagcctctatcgccgtcacaactgcaagtttttcatcagcagcagtcaccgcatctttgttggtatgcctctctgcagcatgctttaactccctacccaagttacaagtctctggtattcgtccttccaagctcgacgctcagagttccgggaccgagacacaggattattag

SEQ ID NO: 12892 - DNA, 222 bp, A.fumigatus
aagaaggcgtggattggagctgccgactggatttatgacaagacgacagattatcatgctatggctgcctttcttcaaaccgtgactatcgtttccttcctatttctgttggctttttctgatttgtcagtcagtcaattcaagccagcgggcgttagacgagtccactttcagtttgcgttgtgtcgtgataccacagttttgaactctttccagaattag

SEQ ID NO: 12893 - DNA, 804 bp, A.fumigatus
aggccgaagagatcggaccgtttgccagagtctctgggaactcctacaattagtcgttcaccgtcagtatccgacatctatgggtcctaccctgtggcggcggctcagccattacccgccactggttcctcccgctaccaaccagtgagccagtatgctccaagcgcttcaccagagcaacttcgtggtagatcgtctatggactcccagaggtcagcatcgttcgggtacccactaggacagcgacgaggatctcaggagccttctacaccggttgacacgaacatgtttcacggaatgccaatgtatggctctccaccggttgctggctaccagtccacgcctccacaatcatcctacatgcctttggcacctgttgctgaggattcggcatctggagctcaacaagaatctttctccgcacactctcaggtctccgacaatgccccgtcccaccggtcttctacgtatgcaccggaaccatttggtcatcctttcgatacccaagctgtgtctacgacgtctcaaccagatcagggcggatatatgcctcctaccagcagcggggcctacgaacctccatcctttgagtctaatacagagtctgcggacggtgctcaggatgagtctactgaggaggacaagccgaagaagaaatcaattatggacgaggacgacgacgaggatcttgcagcgcgtgcagctgccattcagaaggcagagagggcacgccgggaccgcgaagctgacgaggcgttccgcaaagcggccgaagcagatggtaagttccaatgtagctgttaa

SEQ ID NO: 12894 - DNA, 588 bp, A.fumigatus
ctgatttgtgtagccaagaaacccccgcccgcaacagggaagaagggatggttcagtggatggttcggaggcaagaaagacgacaatagcggcggtgggccaatccgtgccaaacttggggaggagaattcattctactatgacactgaactcaagaagtgggttaacaaaaaggatcccgggagtgctgctccaacacgtggaacgccacccccaccgaagggttcggcacctcccagtagatcaatgagcggcagtggtgggccaccacctgcaatggcgacacctccgccgacaggggcctcgggaagccggccatcctcttctgcaggcgcacctacgtctgtgtctgctagcccagctcccccctcgctcggagctccgccccctgctatcccacgatctgtgtcaacaggcgcagtcttgccgactcccccgagcagttcagccggggcaccacccaggcccgcaacgtcattgagcaatgccagctcaatagacgacttactcggagcaccgcaggcgcgtaaaggccctgcagccagggggaagaagaaaggccgctatgtcgacgttatggcgaagtaa

SEQ ID NO: 12895 - DNA, 1968 bp, A.fumigatus
  unsure (158): Identity of nucleotide sequences at the above locations are unknown.
aaaataaagggccttagcggggtggacgtatttggagaatgtgcctccggtaatttacccgaacggcaatcgccacccaaaaatccatatgctccttccgcatataccaatgaatttgccaatcgcggggctcccgtgtctaccggtccacctatcgntggaatgactggagtcctgaattcttccactgaggaatccccgtttgtccctcctcgtcgatcccaaacacagtctcccagtcagaccctcagtcccagattgtccgttccatcgcttgaccctttccaacggcctgcttctgtgcatggttcgacgtctccgacgcgaacggttaatccttacgccccagcaccagttcccacccacaaccgtgcaccctctcaagtgcttgagtttatccctccaactgatggacaacaactcgactctctggaacggtggaagggtgcacccattttcaagttcgggtttggtggcgctgtgatatcttgcttccccaagcatatcccgcgttactcggctggacaggcagccccgatgatcaaatcttgtcctggtgaggtccgaatcagccagctgaatgactggcttcccgctgctgagggtattgtgcaacatccaggtcctctgaaaggcaagtcgaagaagaaagacctggttgcttggctttctagcaaaatcgcagctttcgaaaacgccgatatccccgacttcgatcgtctttcgccagatgcttctaaactccgtgaggagaagaccctcttatggaaggtcatccgagtcttggtcgagaatgacggagttctggaaggctccgttgaggctcagaagtctttgcgtaacctactatttcccaacttacaggattctggtccgaatcaatcgcttggagatgtttttacaccatctgcaactcttcaacccttgaacgcgccctctcaaccggatgctgtcgattctcggtcggtagatttactccgtgatactcttgtacttggagaaagagagaaagcagtctgggctgcagtagacaaacgtctctggggccatgctatgataatagcctcgagaatggatagatcagtctggcaacaggttgtccaggagttcgtgaggcgagaagtgagatcagcgacaagccgcaccgagtctctagcggcgttctacgagattctagccggaaatatcgaggaaagcattgatgagctagttcccccttcagccagggccggcttgcaaatgatcagcaaggttgacggacatggcccggccaagaattctcttgatggccttgacagctggcgcgaaactgtgggactagtactgagcaaccgtagtcctgacgatcaacgagcgctggttgctctcggccgactgcttctctcatataaccgtaccgaggccgctcatatttgtttcattctttctcgcgtcgctgtgttcggcgggctcgatgacccacaagcaaatatcgtgcttctcggagtggatcatcaacgcttgtcgtcctgcgctgctctgtacaatgacgattctattctgctcactgaggcctatgaatttgcgacatctgtgcttgcgggctcgtccgtgtccacacttccgcatctgctggcgttcaagctaattcacgcttggtcgcttgcggagcgtggtcgcaagtctgaagctcaacagtactgcgacgccatcgcagccgctctaaaggcaaccacaaagccgtccggctatcacaatcagcacctgttcttcggtgtggatgagctatcggcgcgccttagggaaacgaccagcgatggcggatcatcctggatttcaaggcccagtatggagaaggtatcgggctcgatgtgggcaaagtttaatagctttgttgctggagatgacagcgatgcagcttccactggttcagtgaaggccgaagagatcggaccgtttgccagagtctctgggaactcctacaattag

SEQ ID NO: 12896 - DNA, 246 bp, A.fumigatus
ccttcccaattctcttctcttcccagcagccgagctaccaacgatgtctacacccaagcatctactgggaagccccacccttggtctagacagacagatatcaccgactccgagcctatccagatttcagagttcagagcgtggcaccgattttcattcacaatcttccgcaaccgcgggggagaatgtatctacgtcatgtctgtagtaacagcattaaaagcgaccgaggtgaatcgcatttga

SEQ ID NO: 12897 - DNA, 291 bp, A.fumigatus
caatgtctgaaagtaagcatctccgcacggctcatagtatgccccgctgatgttgaagacacacatacctctcaccacaccggattcatggaccggatgttccatgacagacaagatgacaacaaacaagagcaaaatgagcaacatgaccagccgcccgaggttcagcctcagcagggcacccaacctattccaccggtccaggaacgcgaagggaaaagcgtcgaggactacgtggacgaagagcgaaagctactgcaggggggagacacatacagtggactcatgtag

SEQ ID NO: 12898 - DNA, 243 bp, A.fumigatus
caatgtcatcatccgattgagtggatcattatcagattgcgccagacaagattgagcaaacaattccaaatcatttacattagtctgaagacggatattgcagtcacgagtacttcccgccggccttttgtcatcgcgacggtctacacatcagagattggtttttgcagaggctgggccaaggctatttacaaccaatgcttatcaatatctggacagttcactcgttttcactcgttatag

SEQ ID NO: 12899 - DNA, 657 bp, A.fumigatus
cccaccatgattccttcgcccccggaaagactacgacaacttagcctgctcggtagcctctccctcacccttcctcgtcgaagcggccgtcccctccttcttcgctttctcaatctccttcaggattgttgcttccaacgactcaggcttggtaatactagcccagcgcccaacgaccttcccatcggcggaaatcaagaacttctcgaaattccacttgacgcgcttcagccccataagtccaggcatcatctccttcatccatgtccacacgggcgccgcattgtcgccgttgacatccaacttgcccaacacgggaaaggtgacgccgtagttgacctggcagaaggactggatctcgtcgttagagccggggtcttggctgccaaattggttgcaggggaagccaagaatggtgaagtcttcgggatgcttggccttgatggactggtagaggttctcgaggcctttaaattgaggagtgaagccgcatttggaggcggtgttgacgacgaggacgactttgcctttgagggaggcgaggtcgaagggttcgcccttctctgtagggggataggtcagcaagaccttgtcattgtttttcacggggttgggagagggagtcgcaaagacaaaacatactgtcggcaggcttaa

SEQ ID NO: 12900 - DNA, 255 bp, A.fumigatus
gcattcttcttcaataatggccttacggggctagggatactgactccggatcagtcccgtctagcagtcaactcagtcactcttggtgattataaccgccctgttcagatcggtaaatttatcaaggatctgttcgctggtttccagctgctcaacttgaaaaatgatattctgcgaaaaaggagtgatgggattaagtacagcgtaagtcttttatactgtgtggttcttgatcgtgtatgctctgctaattag

SEQ ID NO: 12901 - DNA, 363 bp, A.fumigatus
  unsure (1),(70): Identity of nucleotide sequences at the above locations are unknown.
nactcctccttcagtgtccctgtccatgtacacaccactaacaaaattcaaatcaaaagaacaatatccntgcccctccccaacaaccggctcgcctcctttgcgctccaagccatcgaagtcgacgccgaactatccccctttgtccgccgcagtttcgccctgaaatctccagttcagagctccaccgccgacgaggatgaggcggtgaagacagttcttgagacgacctaccgcgatacaacgaatcgcatgctgcgtgtggctgttaacgggttcatggagagcttgggggtagtgctcggagttatggaggagttggatgtggatgttctgaacgaggagattgaggaggagaaatga

SEQ ID NO: 12902 - DNA, 699 bp, A.fumigatus
acagactttccagcactcgagcgccttcccttctcatcaggacaatggcctccgcgacgacattctacgattttaagcctgccgacagtatgttttgtctttgcgactccctctcccaaccccgtgaaaaacaatgacaaggtcttgctgacctatccccctacagagaagggcgaacccttcgacctcgcctccctcaaaggcaaagtcgtcctcgtcgtcaacaccgcctccaaatgcggcttcactcctcaatttaaaggcctcgagaacctctaccagtccatcaaggccaagcatcccgaagacttcaccattcttggcttcccctgcaaccaatttggcagccaagaccccggctctaacgacgagatccagtccttctgccaggtcaactacggcgtcacctttcccgtgttgggcaagttggatgtcaacggcgacaatgcggcgcccgtgtggacatggatgaaggagatgatgcctggacttatggggctgaagcgcgtcaagtggaatttcgagaagttcttgatttccgccgatgggaaggtcgttgggcgctgggctagtattaccaagcctgagtcgttggaagcaacaatcctgaaggagattgagaaagcgaagaaggaggggacggccgcttcgacgaggaagggtgagggagaggctaccgagcaggctaagttgtcgtag

SEQ ID NO: 12903 - DNA, 609 bp, A.fumigatus
  unsure (532): Identity of nucleotide sequences at the above locations are unknown.
cttcttctgcactccacttgccaactccacttcttaatcatgggtgatgacctcgaggctagcaaatcctccctggatcggaaagagttcccatctgcggaacatgtcgaaggaactaccgtcggtatcgttcgtgcggtagaccctcaccagctcgaatccctgccttatggtcctagcggattcaagggcattttcagctccaagtatgtctttggcgcagctttcctggcctccatgggtgggttctccatgggatacgacatgggcgttatctccattatcaactcgatggacaagtttcacgcggcgtatccgcgggccgaaagcgcctttggcaagggattcatgacggggatgttgctgttgggtgcatttgttggctgtatcttcatgccatatctggcggatcggatttctcgcaaatgggcgctcacggctatggtcatcgtcttcaactttggagccattcttcagacgggcgctaccaactacgacatgcttgttgcgggccgctttatccgaaggatcngggttggtacattggcaatggtatactttctactcaatcggcagtgtttccaccacaaattaatgggtcaattttag

SEQ ID NO: 12904 - DNA, 972 bp, A.fumigatus
ggcgcacctctctatatctccgaagtctcgccaccgcacatgcgaggcacgctcctcgtcctggaatccatctccatcaccctgggagtcgtcgttgcgttttacatcacttacggcacccgacacatggccacggaagcctgtttccgactcccctttggtctgcagatggtgaccgcaacgatacttggtgcgggcattcacttcttcccgtactctccccggtggcttgctttggtcaaccgccaggatgactgcatgtctagcctgtgtaaactgagaggtctcacgagcagcgatgaacgagttcaattggagtatcagcaaatcatcgccgagatcaacttccaaagagccgtcctggccaagaagcaccctggtgcgtccggcaccaagctcgaagttctctcctggatggacctcttcacccggaaattgtggaaacgcaccgctgtcggcgtgggtgtcgcgttcttccagcagttctcgggcattaacgcgtttatctactacgcgccaacgctgttcgaatcgctcggccaaacagcggagacgtcactcattctctccggtgtcttcaacgttctccaacttatcgcagccattgtctgtttcctcgtcatcgagaaagtaggccgacgccccctcgctatcttcggcggctttggtactgcagtggcgtatatcatcatcgcggtcctttcgggtctttactcaacctcctgggcttcgcactcggccgctggctggggctgcgtcgccatggctttcatctttatccttatctacggagtcacctattccccgctgggttgggccctttccctcggagggttttctcgactacgtcgcggtctaaaggtgtcgctctcgccacgtgcaccatctggctgtcagatttcattgttggcgttgtcacaccgtccatgctggccgatatcggttaccgaacgtacatcttctttgccgtga

SEQ ID NO: 12905 - DNA, 213 bp, A.fumigatus
gatgttagccatagtataaagaaagtatataacattatctatggatctatctgtccacaaagaagtaagcgtgcactaagcatgcataactttctcttctctctatctcgcttcccatttcttgcactctgttccgactctgtctcaggaatcacattcactattgcctttgtcattccgactttgaccaagtccttctgtttctggatctaa

SEQ ID NO: 12906 - DNA, 627 bp, A.fumigatus
cgcgtttatctactacgcgccaacgctgttcgaatcgctcggccaaacagcggagacgtcactcattctctccggtgtcttcaacgttctccaacttatcgcagccattgtctgtttcctcgtcatcgagaaagtaggccgacgccccctcgctatcttcggcggctttggtactgcagtggcgtatatcatcatcgcggtcctttcgggtctttactcaacctcctgggcttcgcactcggccgctggctggggctgcgtcgccatggctttcatctttatccttatctacggagtcacctattccccgctgggttgggccctttccctcggagggttttctcgactacgtcgcggtctaaaggtgtcgctctcgccacgtgcaccatctggctgtcagatttcattgttggcgttgtcacaccgtccatgctggccgatatcggttaccgaacgtacatcttctttgccgtgatgtgctcgctggcgggtatctgggcgtttttcctagttcctgaaacgggtggaaagtcactcgaagagatcgacgagctatttggcgattccagcgcgagggaagagtgggaacttgctcaagaagcaatcatgactggaagtaccaaatag

SEQ ID NO: 12907 - DNA, 237 bp, A.fumigatus
cttacttctgtaggtattctatacggcaaaccttctgttattcgctggtcatggtttagtgaagagatcagtttgcagtcttttacgactcagccgaaaaaaggtgtatctgcttgcttgcagaatcagccttcatatcacgactctctggtgcatcgcttccattatggcattagccttgagctgccccgcgagatatctgtggtccccggaaaattcactaacgtaatcttgtaa

SEQ ID NO: 12908 - DNA, 228 bp, A.fumigatus
gttatacccctgcctcccgctgaattttcacgcttccattggagatactggagccacggggaaaccaagaacaccgaagacaccatgcatcgcacaatgtccaccttggaaatcaagctcgtcgagccgggtgacatttcggcaaatactgagctctggtatatcacccatctcgcagaatctgaagatgtttccagatacaccaggagtccagcagtggtggaataa

SEQ ID NO: 12909 - DNA, 2112 bp, A.fumigatus
cccccagcactgccaattgcgacgccgagttcaccacgcagccgctcaagccgtatgctcggagcttgtcccatgagttacgaacgccaatgcagggagttgtgggaatgctggatgtcatgcatgccaccgtacgagaggccttgcaggcaaaatcttctgcaaaaaatcaatctgtctttcaatctctcaaggaaagcattgagatggttcaaggttagttgccatgaaacatccttcccgaccaagccgctaatgcaaaccgaatcacagacagtgcaatacgggcggttgaggccgcatataacgtcgtccatgcctacgatctcaatatgcaagttcccaaaacaccccaacggggagcgggagagcgatccgtttagtggccttgtccagtccccgattgaaagtctgccaaacatcttccaccgaaggcaccaaccccatacaagcggcggcggagcaatcccgctgactgaagcgaagcatcgacctcaaaaggctaaagcgcaacgacgctcggccaggaaagagctgtcccccgcgggagtgaggacggtcaagaatcccgtccacgagagtgagcaaatcgttcacgcaaattcttcgcatcacttcgataaggtcatggcagacatggtggaggttcgtcccccgttagctgtgaggagatcagcatcccatctgctgctagaaggcatcaatctgaatatgagaagcccctctctgagggtcaccaagattcgtgacctgcttcgactggtgataaacgaatcgctccatgtcggcggccgacctgattttagtctgagcgaggctacggagctaggagagagaatcgaggttcggacccgatcgtccaacggggaaattttctgcaagactatcgtgtggagcgtcgatgaagcgctaccggaaactttgctggtggatgacaaagacctggcaaagttgatctcgtgcgtctttctaaacgcagtgaagttcacaaatagtggtatgattacagtcagcgcaaaggttggttccaatatcggtgaagtctttatcactgtgcgagatactggaccaggtataccggaggcatttttgcccaagctctttcaaccttttgccagaggagatgcgtcaatcactcggagcaaggacggccttggtcttggacttctggtcgctaagggtcttgctaggaagatgggtggtgacttgatctgcgttcgctcgtctacctctgggcccgatcatggctcggaattcgaaattagtatccctgtcactcaatccaagtcaagcaacaagccggtagcttgcatgacaagtagtttgactcctgacggcagcggttcttcacgattgggtacgacgagtacctcgagcaattcccgcctcgaacagtccatgctatcacccttgatccgccggccgagcccgccgattcaacagccatccccaagcttgaccgaagaaatttcgtctcagacatccactcccgttcgctccgtctccaccgcaaaatttatccgcccttcaatcaacggggatgcgtatgatgagaagctcggacagaagcacccgctcaccttcctggtagctgaagacaacatgataaatcgacgggttctggtgaacatgctcaaacggcttgggtaccaggatatttatgaagcctgtaacggaaaggaagccgtgcgtatcatgcaggatgttttggcagcgcagaaacccaaagcttcgagtcggctctccgactgtgatcagttgggagattgcggatgtaagcgcatgaaaccagtcgacgtcgttctgatggacctctggatgccggaaatggacggttatgaggcaacgtcgaagatcctcagactggtagatgattaccagcgccgcacccttcatgcacaaccgagatctcaatccaataatttactgctgccgctccccacagtgcttgccgtcagtgcagatgtaactgatgaggctctcggacgtgcctccaaagtcggcatcaaagggtacatgaccaagccttataagctgtcagatctggaacgattgatcgttgagttctgcggcgaggcgacgagtccaactcttgaccggatgaacatataa

SEQ ID NO: 12910 - DNA, 222 bp, A.fumigatus
ttagcactacttacgcagacacttggtacggagacactatgtctacgagggggatggaggatgaccagaagagacttctcatacttccagtcctacttccatgatcccccgatgaccatctgtaaaaagacaactcctaggactaaccagtctgctctctctcggactggacagatccatctctcctctcaatcggcgggtctagacacacgggaaggctga

SEQ ID NO: 12911 - DNA, 1233 bp, A.fumigatus
cctacattgcagatgtccaaagacgtaactttctcccccgtgtccactatcatcccacgatctcctccgaacgatcccacaaacccttatattcgacgccggcgccgacagacagattccgcggtggttctgaaacgtaccactcatgggccccagagagaccagcaccccattctggctcgacgatctattgcgaatcctgattgggcggcagactcgattccttcttctttctctcccactatctcttcagtctcgtccaggttgagcctgacagggtcatcggcgggtccaacaaagactgaggactctcagaaacgccggcagacagcacgccatgacctagatgatcgtcaacataaccaagactccggctacaagtctcatcgcgacgaccagagtatcgctagaactaaagttttcagccgtcagaccattatgtttgcggcagcttcccgtgacacgggcagggcagccacgctaatatccgctggtcccagtgcctccccatcagtaccaggaacaacaacaacgacaccagcaaactcgacctcatcatcagcatcgcatccttatccatcttctgcttcaccacctcgtttaccacaaagtcgatttagcttcgagtatcagcctccccggcacaagcaggccctgccgacctccgctagctttcccagtgaaatcccctcagacactgatccgactccgaacccccagcgcgctttcttgtacgacagatctcggcggtcagtgtcaaccttcagtacctcccgtgttcgcaaatcaaccgcgcttgcttctccgtcccaattgccgtccccgttatcaatctcagagaagtctagcgacttgcccctaccgttcgatgccaactcgatcgacaacgccctgagtttcaatgcatcgaagcgtcgtcgtaaacaatccttgtcacagtctcagcaggaaagccaggcagatgtgaagaggaggatgccagtgtcaacagcgacttacgtccaggggagcccacaggcaagcgaccgcgatcgcgcaatccacgacttagaccagaccgatcaagaagatggcgctagaacgccagtcgcagaagattccaaatccaagaacgaggacatcttcttgaatattgcccgatcagactcaaagcggcgcgactctttggggcgctcagaacatagacgggtgagtgacaacctgtgttcgacgacgatcatgacactcttgtaa

SEQ ID NO: 12912 - DNA, 300 bp, A.fumigatus
  unsure (293),(294),(295): Identity of nucleotide sequences at the above locations are unknown.
tcgcggcttgggttgtctaatggtcaccttcgttcacccaattctcgattaaatgaacagacgtcttcccctggtcaattacggttgagcacttacgacacccccttgcactccctcaacaattccccatcaaacccttacagcgcccttccttactcctactcggcctccgctcatccccttgatgaccatccccgctcccgacattccgtagtaggttcgagttcgaggtccactcttggcatatcggtcttcaccacggggatggaagaatcgacgctcaacgctcaaannngacgc

SEQ ID NO: 12913 - DNA, 627 bp, A.fumigatus
agacccgcctccacgcctcccatcccagcacgcaaccactcccccgctatattgatcttgaccttcttcccttccctcgacgaagccttcttcttcttctttttcggtgcatccacatccacccccaaccgatcctcccaatacgctcccacccgcctaggctcaacacccagcaccaccggccgcatccccgcctcggctccctccccagcctgtcccagcgcatgcaaaacagcatacaacatcccctcaaacacacccacccgcagcgtccactcctgcactgcactgcccccgccagagcgaaaccgctgcctctcgatgagtacatggctgggccggtacgcgtgcagcaagcgcgtgacgagcgcgtacgccgtgcgcgcatactcggatggggagaatgtatgtttctctttctctttccttttcacgttcgctttccctgtgagcttcgatgcattcgacgcacgtcccccctggatcttccccagggaatcaggggctaggtcaagtaatgcatccgagacggctagccggcgccatgcgtttagcttcactacggtcccggcggtcgctgtatggctatcgcgcgggaccagaagatgcgcgtatgcgaggttctga

SEQ ID NO: 12914 - DNA, 429 bp, A.fumigatus
tgcccacacactgtaaggaaaccgattgaaggactggaatcgaagatggaagcattgtcgccgcgatcgacgaatcacttgatcaggcctaaaatcagcatggagcgaaaagtcctggataagaatgccgccgccgccgccgcagcgcaaaaagccgcttcgtcgaaaatccatgcgcctcctccaccatcactggttatagagcctgcggaagggggtgagcgctattctactggcgctttccttggaaaaggaggtttcgcaatctgctacgaaggaacgctattgcggaatggacgagtctttgcaatgaaagtggtgaggtctgagatggggcagaaaaaaatgcaagagaaggtatgtctcgagtcgcatctgcccacattggcgtgcttttatcagcccggttctaaccaaaacactctgtag

SEQ ID NO: 12915 - DNA, 447 bp, A.fumigatus
tttcgaaccgaacttcaaatacattcgaaaatgcgtcatccccacatcgttgaattccatcgcgcctttgcatttgacaaatgtatctatgtggtcctggagctgtgtccaaacggttcagtaatggacatggtgaggaaaaggaaatgcctgagcttgccggaagtgcgacgattcatgatacagctttgcggtgccgtcaagtatctccacaagaggagcgttgcgcatcgtgacctgaaaatgggaaacttgttcttggatcgtaatatggacatcaaagtgggagattttggactggcagcgatgattatttctgaaaaggacgagaagcggaggaaaacactctgtggaacaccgaactatattgctccagaggtccttgataagagtaagggtggtcatacccagaaggtagatatctggtcattgggtataatatggtaa

SEQ ID NO: 12916 - DNA, 1617 bp, A.fumigatus
agccatgacacgcaaagggctcccactaacaaatactttcgaagctttgcgatgcttaccggctatccgccttttcaatctaaaacacaggaggaaatatacaagaaagtcaggaatttgagttatgtgtggcccagcggcactcagtgcgcgaatcacattcccgacgaggccaaatcgctggtcagctcttgtctcaatctctcagagaacgagcggcctgacccagacgacattgtcgaacatccattcttcaatatgtatgatggatgtatccctcgtcgactggacccgacttgcactgtttcgacgccgatctggctcaggtcggatgagcctcgtggtgatcgcatgatgctcggtcatagcctggagtacgacgagaagctggcaggttacatagagcaagttgatgatccgacacagcgatacctcatctgccggacggctttctacagtctctgcggagtcggacgtaaaccagatgggacagttcgcaagtgtgttggcaagaactgttcgaaatctgcatttgcggagtgtgtatctgaggaggaaaaggggatgcagccagtcatgccgctgcccgaagacatggtctacagataccctagtgacccagatggggactggagcacgcccagtcctggtcttgcacttagcaaggatgattcgtcactggacggtataaggtcttctggtaagcgcactgtatccatgcgcagtaattctacgtctctttccagaacccaagctgctcttgccgcagcccagcaacgacggaaagaaccgcagagccatgctgcaacgcttcgccaacaggcaatgggtgctcgaagctcggtcaggaagattgcagctatctgcgatccaccagcagtagtagaaccagattctgctgctcctgtcatgccaaccgggggactcgcggaaagacccatacgtgcacgacgcggagtggcagtctcgtactcaggttcaacgcgtgacttagacagaaggattgtgccatctaccagtgaccctgggatgctgacagtgggtaaaacacggtcgcagtctcgacgacttggagcggaaagcaacgaggcacgttccgctcctgccgtcatcaaagagcggtctgtttcctcagcgttggacaatctacctaccaagttacgccaaagctctgcacgttcagtcgcgagggaagaagctctccaatcttccaagcggcacgagctagaagcagaagaagaagtcaaggcgagggaagtgccaagcggagatggccgtctgcgaacagaagccgctgtaagccgttccagtaacaaaacagcttccacgtcaagcagtaagcgctcgacattaggtctgtatccactccttcatccagacgatcactgtgagatgatgccaaggacgtctctcgaggacgtcaacacggatctccgactgatgctttctaacctggtccctccggtatctggccgccggcgcgtaagctcgagaaggacgccccatgcatacgtcatcaaatgggtagactacactatccgttatggcattgggtatgttctagatgacggtagtgtgggatcttcacgccgggctggaagcaaacgcgctgcgggg

SEQ ID NO: 12917 - DNA, 186 bp, A.fumigatus
aagtgcctttggctatcagtcatcatcaactgcagcagtagcctggacgtttactcaattcaaccgctgaagtgtattgagagctgtcaagatgtctctgaccttgaagctctcttctctcgtgattcgcactctatcaaagccgatcgcagtatgcttcaacccctcaacccctccatttcttaa

SEQ ID NO: 12918 - DNA, 579 bp, A.fumigatus
gcagctggcactgatgataatgataagcctaccccccgtgccatcagagaacgtctcgtcaaaatgcgccaaattgtaaaggcgtctggcagcggtggtttcaccattggcggcagcgacacctccacccctaagaaggccaaaaagaccgctactcccgttgagacccccggttccaagcggaagcgcagtggaaaagccggtacttctgctgatgataacgaaaacatcacccctcttaaaaacgaggagaatgcaaccagtctagtcaagatggaagccgctgaggacgagattgacacgcctactaagaagaagccgctccatcccactctttcaggaaaccaggtccaggtccaaagtggcttcgtaaagaccgaggaatctgatgaagccgtctttggtattctaaccactcctactaagcgttcccgcaaggcgagcgttcttcctgctggtatggttaactacgaggacgacgagcagggagaagatgatcccgagagctctgcttctgagttcctgcccgatgaggcgggtgtgaaaatggaagacatggacacgatgaattatgcttga

SEQ ID NO: 12919 - DNA, 228 bp, A.fumigatus
ccccggttccgcttcaggtccttgctagccacagcccacagctacagcaacacagataaacagcccagctctttcagactcgtctctcctcttcttctcactacgccatcattctcttactctacgtatcccacttcatcgaccagccctccaacgaagccttacgttgatttagccacaaccacactttacaatcaacatattctcttgaatctccaaaaaatctga

SEQ ID NO: 12920 - DNA, 195 bp, A.fumigatus
cgtctcagaacggatcctagggctggcagcgctaccaacggggattcctctactcttcctactccggagaaacgcaaacgcggctgcgcaaagaaggacgccaacggtgatggcgcagagaaggacaaggccagccctaagaaagctaagaaggctaagaaagaggagaacggatctgctgtcgacagcgcttga

SEQ ID NO: 12921 - DNA, 1221 bp, A.fumigatus
  unsure (91),(121),(145): Identity of nucleotide sequences at the above locations are unknown.
tcccaaggaacgatccagggttctccactgacaagcggaacaagttcttcccccattcaatcgttaatagctttggcttttactatcatcntactcgcgcaaccaaggccggatcatgagncgatgggagacgaggatagcatgnattcatgctcagaaagacaggcctatcaggatgtgccaatttcaaatggagtcagtctttcaggtgtactgcctgtgcgccggtctcctggtggtcatgcgggggatatgataggatcgtcgaggcacccatctgctaggtcggttcagcaagcacagatcccgcagtccaaaaacttcgagattgtcctcgttacagataacgagtcacggcgtcaggtccgccgccatgcaatgcggcaatatatgcgtcagcggcgcttggacagcattgctcgtctggagacgcctcgcttgccaattggtggttgggtcaaccgccaggtactatcggaagcttcatcatccagcattccaccctctccagttgaaatccctgtcaaagacacttctccagaggaggagaagtcatctctagtaaaagatggggagccatgcaccccagtaagttggacagggccactgatgcccttggcgtcgaaatcatccaaagtcaaaactgaagaaccgtcctctccttccttccccaacgttagctatacactatcagatcctcgttccagccctggtcacggggccgtggaggatccatttagctgttatccaatccctgttagtcactctgaccatgagttaattcaacactgtaagttcttccttggaagcccgtattcccatacagatcacgccgatcttgataccagtgcaagaggggcgtctgccagaacaatcttgatctcgttgtctggtggcttacactgcaaagttattgtgacatatccatccatgatgaataaatttgccgattccgtcgcgaacaacccaatgatggagatttttcgacagcttgcgctgcacgacaatctttcattccaagcgatgcttgctattgcctcaaagcaccgagctggagtggaaggcaaggcggactctgttcaaagcctcactcataagatgcgggcacttcgattaataaacgagcgaatacacaccgactcccaaggcctgcaagatggtacaatatacgccgtagccacaatggcagttattgaggtgataactttccctatgcattga

SEQ ID NO: 12922 - DNA, 672 bp, A.fumigatus
atagtcccccgtgatccttccagccccgtggtgaagaccaacagggcgctcgagtacggcgatgtgatcaagcttgtaggcgtggctaggaacctcgatgacaacacggctctgaggaagttcaagaactgggccgaagaggctcacgacgtgccactgatcgcgatcaacatgggaggcaacgggcaactgagtcgcatcttgaatggattcatgacaccagtatcgcatcctgctctcccgttcagggctgctccaggccagctgtctgcgaccgatattcgcaagggcctgtcactgatgggcgagatcaagaagaagcgctttgccctctttggaagccctatttccgagtcccgctcgccggcactgcacaacactcttttcgccgagatgggacttccccatgagtacacccggttggagactgccaatgtggaagatgtcaaggacttcatccgcgctcccgacttcggaggagcctcggtgacgattcctctgaaactggatatcatgcccctacttgatgagattactgcggaggccgagatcattggtgccgtgaacaccgtcgtgccagtttccgatggtgagggcaagccgcagcggctggtcggtcacaacacggaatggcagggcatgttccaatccattcgaaagcgggccccttag

SEQ ID NO: 12923 - DNA, 675 bp, A.fumigatus
  unsure (134),(138),(142): Identity of nucleotide sequences at the above locations are unknown.
gggcaagccgcagcggctggtcggtcacaacacggaatggcagggcatgttccaatccattcgaaagcgggccccttaggaacggacgtcagcgccagtgcatttgtgtttgttggcggaggcacatcccgggntgcnattnacgctctccaccagatgggtttctctcccattaacattgtgggacggaaccctgccaagctggagagtatggtctccaccttccccaccagctacaacatccaaatcgtcgagggcaacgagaaactggagcatgttccccatgtggcaatcggcaccatccccgccgaccggcccatcgatcccgggatgcgggagattctctgccacatgttcgaacgtgcccaggaggcagacgccgacgcctcccggacaatcgagggatcccctcgcgtactgctggagatggcttacaagccgcgggtgacggcgctgatgcagcttgccgtcgatgcagggtggactactattcctgggttggaggccctgatcgggcaaggggtacaccaggtagggttgatcgacctgttacagatggacattactgatggagtacagttccaacattggacgggtattcgccctctctacgaacgtgcacgggtatgttgtgacatcttgttatccggtcgaactatgctaacatgctcgtag

SEQ ID NO: 12924 - DNA, 474 bp, A.fumigatus
ccgaccagccgctgcggcttgccctcaccatcggaaactggcacgacggtgttcacggcaccaatgatctcggcctccgcagtaatctcatcaagtaggggcatgatatccagtttcagaggaatcgtcaccgaggctcctccgaagtcgggagcgcggatgaagtccttgacatcttccacattggcagtctccaaccgggtgtactcatggggaagtcccatctcggcgaaaagagtgttgtgcagtgccggcgagcgggactcggaaatagggcttccaaagagggcaaagcgcttcttcttgatctcgcccatcagtgacaggcccttgcgaatatcggtcgcagacagctggcctggagcagccctgaacgggagagcaggatgcgatactggtgtcatgaatccattcaagatgcgactcagttgcccgttgcctcccatgttgatcgcgatcagtggcacgtcgtga

SEQ ID NO: 12925 - DNA, 702 bp, A.fumigatus
cccagcagcccgttcacccgcaaacggaagagaatcaccaacagcctgtccccctcccgggaggacccgcgcaccgcatccaggcccgccgctgccctctccgctgagaagagctacagcggccgcagcgagtatctcagcggcagtgtcccctttgacgagaccctggtccagtccggccacgatgccctcgacaccgacaatcacgaggacatgcagctgttccagcaccagcgagtatttgatctcccgccgaagcccgtccagcggcacctcatcgactgcttcatgcggtactgtgcgccatggacgccgatcatcgacccacagtggttaaccgcggagactccctcgccgctgctgttgcaggccgtcttgctcgcggggagtcgagtgtcggcgccgtccgcggacgtctcgagcaaagacttctaccgcaaggcgaagctgctctacttcttcggcagcggcaacaattcgctgatttccattgtgtcagcgtgcctgctgcactggtacaaccccgtcggaccggagaaggtctcgacggacacgagcggcttctggatccgcacggccggcgccatggcctttcagatcggactgcacaaggagccggccgcgcatgcaaaggaccgggggctgcgcaggaggctctggtgggcattggtcgtatggacagatcccatccgccgacactga

SEQ ID NO: 12926 - DNA, 402 bp, A.fumigatus
caactgcgtcaaagcaaaggccgagtgcctgtaagcctctccattgtcagatcgtcctctactgacccagcagcccgttcacccgcaaacggaagagaatcaccaacagcctgtccccctcccgggaggacccgcgcaccgcatccaggcccgccgctgccctctccgctgagaagagctacagcggccgcagcgagtatctcagcggcagtgtcccctttgacgagaccctggtccagtccggccacgatgccctcgacaccgacaatcacgaggacatgcagctgttccagcaccagcgagtatttgatctcccgccgaagcccgtccagcggcacctcatcgactgcttcatgcggtactgtgcgccatggacgccgatcatcgacccacagtggttaa

SEQ ID NO: 12927 - DNA, 912 bp, A.fumigatus
  unsure (746): Identity of nucleotide sequences at the above locations are unknown.
ctttacacgcttagttcggatccttcggccgccgtggctgaagacatgcatcctgggactttctcgatcctttttcgcaacgatcatttctcaactgtctataaacatcctcaacggcatcagctgtttactctggtcaccgatgctggttattccaatcacgcagaaattgtctgggagtgtctcgttgatgtgaatggattcaacgcagagttcttctcgggcgattttcgccccattggtcatgctcctcccgggacggtcccatccgggccacgaaactccaacaaccaaacaaacgttcctcccagcacaagtgaagatagaacaagtgaattgtctccccaagagcaagccgatgctgactatgcctacgcactttctcttcaataccaggaagaagaacgccgggaaagagaaagcaataaccggtcacgcaatcaacgagcttcggccccaaaccatcccccgggagctttttggggttcaggctcggctcatcaacgttcagcgagtgtagcaaacggtagcggtagtggacccacgtcggacggccgctcgtcaaggcacggtcatgaccctggcgccagtaataacgcggaagatctcccgccgccatcctacgaacaggcggctaccagtccagcacacccaccacgagacagtcactacaatactttacctcagcaaactcgatatcaaagacactcgttgggacggcgaattaggcccaggtactgtcgcancaggctcaggagatcgggccaaggatcgaaacaaagactgtgtggtcatgtagtgcccacagtatattatcttacaagtaatccgagggcacatagcagggcaagccacgtatggtgcataccacgaaccctatcaattttcggcaacgcttcatgctgcttttga

SEQ ID NO: 12928 - DNA, 183 bp, A.fumigatus
catctagttacatgggcataccacttcactggcgactcgccggactggacagtggatccagcttggctgcagagagtctctgacgttttggatatgattacatcccgcggcctgtacgcaatcgtcaacgttcaccatggtaaaatatgtttcagcgagatagtaccagttatcaaggactga

SEQ ID NO: 12929 - DNA, 339 bp, A.fumigatus
gagttttgtcagtttatgcagaaccaagccatgaaggggttgcgcgttgctgcccttgtggcacttttcagaagtgcatgggcccaagcaggcaattgtccgggaacctttacgtccatatctgctgctgacttcgtttctcgtgtccatcccgggtggaatttgggcaatactcttgacgctgttcctaatgagggctcctggaacaatgctccagttcaagcatccacgtttgataccgtcaagtcggctgggttcaacagtgtacgacttccaggtgagttccattcggtgctccacgcatctactactgccaaacctgttgctgataacatctag

SEQ ID NO: 12930 - DNA, 405 bp, A.fumigatus
  unsure (404): Identity of nucleotide sequences at the above locations are unknown.
gaaatagactcgtggatctgggccgatgtcactcagtcgggagccaaccttacgatgattgaggagaaattctatcgactctggtatcagattggcaccaagttgggttgcaagtcgaacatggttgcctttgagtcgattaatgagccacccgtcaacaatgcccaggatgctgctgagctcaacaaactgaatgagatcttccttcaggctattaataaagctggaggattcaactccaagcgagttgtcaatctggttggtggtggccaggatagcatcaagacttcgcagtggttcaaggctcctaccggcttctctaacccttatgccattcagtttcactactatagtccttgtaatcttcaccacgaggcgccaggaccgcgctcaggttacgcccnc

SEQ ID NO: 12931 - DNA, 204 bp, A.fumigatus
accagggaattaaaaaactccgaatccgttatctatcattcagtgaatgttcagacatgccagtcccgtggtatctatataaagtacatagcatcatatcgtatcgtcgtcaaaagcagcatgaagcgttgccgaaaattgatagggttcgtggtatgcaccatacgtggcttgccctgctatgtgccctcggattacttgtaa

SEQ ID NO: 12932 - DNA, 2202 bp, A.fumigatus
cctggtttaagccctacggcatcgagagtagcacgcgctgttgacgaaaaggtcttgaagacgagcattgatcttacagctcctgaaggggtaacagctcctttgatcgtgaaactggcccagtcaggggggttggctgacattgagatgcttatagaaagtggacatggagttgatgcacgccatctgagtactcgcaggactgcactattggtggcagcgcactgtggtaacgaggcggtggtcaacttgctaatccagaagaacgcgagacttgatgcggtcgatgcctggggttctacagctctccatctagcggcttcacgcggtcattgtgatgtaattcagctgcttctcctggagccactggatcgcgaggcacgagatgcccagggcaggacggcgctttggctagcagctggtcgaggccagcttgaagccacccgcttgttggttgcccaccatgccaaggtgaacgtgcgagcggaaaatcatacgacgccgcttcatgctgcagcaaagcgaggtgacgaagaaatggtagagcttttaatatcatgtggtgcagatttagaagcaagagatggtgcgatgatgacagctttgcactacgcgtgtgaagagggccacctaggcgtgatgaagctgctcctggataacagagcaaatatcaatgtgcccggcagtgaccgaaggacaccgctcatctgcagcgcagcaatggggagatgtccggtggcgcaggagctgctcaagcgtaaagcgtcggctcattgtgtggatgatgcttccatgactgcggtacactgggctgcgttcaatggacacatcgagattgtggatctcttgagtcagaagaagggcgtgctgacagcaaccaacaagttagggcgaacagccctacaccttgcggccatgaactcccgtttcgcggtgatcgagctgcttgtgcgcaagggtgtaccagtcgacgcacgatgccacgacggcctcactcctctccattacgcctgtttggccaacagccttgagattgccagactacttctcatcagtagcgcgaacatcgaggcacagacagagatcaataagcagagacccatccacatcgcagccgctcgtggatcgatgaatatcctcaatctgctttgtgacaagggagcctcgctggaggctagagacgccaagggtgaccgggctctcggggtcgcttctcgccacggccatgcagcagcagttcagaatctccttgagcgaggttgccctttgtacttggcatacgaaaccagaccacaggaagattccccactgtgtctggcagcaatggggggacatctccccgtagtatcccttctcctccagcacggcgcatccgtcgtgcggagagatgagtccggatggcagccacaccactacgccgcatattatgggcatcctgacgttctggcactgttgcttcaccatggacctgcatcggcaaacgatgggactaggttcggccttgacgctgctggaatcggctttgcccctcatgcgatcatctctgaggagcggaaggcgcaagtccggcagttgttgaaccaagatagcgggcaattcgtcgcgcagacccagatccctgctttccagcctcctcaagctataggagaaacactccataacaggacgatagcccctcagctacccttgacgactcgatcactagagccatgcgccgagccctcggccatggcgccgcaggagctgcctgttaccctcgagcaaggactgcccccgagccggtccgtgacgccagagcatatgcggggaggaagacgcaccagcattggcttgagaagtagttcatcacaatccaggcaattcgaggcagctgtacagtcttcttcgtcaggtacagctccccgtcaacctgagccaagcctttctcacactggctctacttctgagccttggttcgattactctctgccgtactggaggggctccccggtttccactgttcacgaaaccgggactgaggtcgaagtactcgcaccacaaccgggtcggggaacggtatcaaagttaccattgctatccacattcaatcccgttgaccctgtatgtgagccaactggtataatgaactcggattcggagtcttcatcttctgtatatactgcgcgcgaaaagtcagttgtgatgaacagggtttgcatgtga

SEQ ID NO: 12933 - DNA, 804 bp, A.fumigatus
  unsure (731),(750),(765): Identity of nucleotide sequences at the above locations are unknown.
caggccatcttctcgattcttgaccattccctccgtcgcaatgccgatcaggagcgtgtcatcggtaccctgcttggaaccagatcagaggatggaaccgaggtggaaatccgtagcacctttgctgttggacacacagagacgaccgaccaggtcgaggtggatatggaataccagaagcaaatgcttgcgctgcacctcaaagccaaccccaaggaagtactggttggttggtacgccacatcgtccgagttgaacaccttctccgccttgatccagaacttctacagtggccagggtgacggcacatggcctcatcctgccgtccatctgacagtgtctactgagcctgggaaggatattgaaacccgcgcctacatctccgcccccgtcggtgtgaccgctgagagggccgcagacagcgctgctttcattcctgtcccttatgaaatccgctatggcgaggctgaaaagagtggtctcgaggctattgcttctgccaaagatgccgaaagccgtgctacaaacatcttcactgacatcgaagctctggagcgtgccatcgaggaggtcctcggaatgatcgacagagtctccagatacgttgagtccgttattgatgaagaagctcccgcttcgacggcactgggccagttcctcctcaatgccctggccttggccccaaaggttgaacctgccgacattgaacgtgacttgtatgttttctcttncggcctcctccttttttanttggtttgttttcanccacgggggcggaaggatccacgctatgcgtatagggag

SEQ ID NO: 12934 - DNA, 198 bp, A.fumigatus
gcgggcggaagaattagaaaggaaaaagattacagagccatccccaccaccggcgaggaagcattcaagactgtgagagaaccaggcttcggcatatttttcacatcttcaacatggctgaaaccgattctttccttcaccttgctcgccctctgggcccagtggcagtggggtctgcaccaaccaccgcccctctga

SEQ ID NO: 12935 - DNA, 582 bp, A.fumigatus
ctcaagaagaaactttgtggccctgccacagagcggatcccagaaatcagcggtgacgctcagcatatcgcgccttacatcttcaactatcaagatgttttatacggagcccgaacgacgtcaaactcgagcgcgatgcgggatattctagccgttcatgcggtcaaccacatcctgaagacacgggaccgggtgctgaaaaacaactctcgcattgctaaagaacaggacgcagacctggaccttcgggaccaaggctttaccagaccgaaggtgctctaccttttgccgacgagacaagcctgcgttcgggcggtcgagtccataacacgcttcttccagccggagcagcaagagaacaaaaagcggttcttggactcattttccgctgcagatgacaaatcctgggaaaacaaacctgaagattttcgggagcttttcggcggcaacgacgatgatatgttccggctgggcctcaaattcactcgcaagaccatgaagtacttttcgcaattctacaattcggatataatcttggcgagtcccctgggtctacgcacaatcatggaccaggctgagtaa

SEQ ID NO: 12936 - DNA, 489 bp, A.fumigatus
ataacaaggaattcatctattagaccggaggatcattccgataacgaatcgcatctcaaccacgagcctgccggagatgagatggaccacgaaacccaaatggacgatgtgttgtccgatagcgacgacgacgaagaccagcagacagctcgcccgtacaacgaattgattcaattgctgcaagtaaatacggagcctaaaggccccactaggaagaggagaaaggttgaatacaacggtggagagaagagagatttcgtgcccgccgcgaacggagaagaggttgatgcggccctacaaggagacgatgatttgcaagagcaggaaccgtctgacgaagaagaggaagatcacccagaggaagcggatggcaaccatgggagcgacgacgaagaagatggtactgttcgcactgatccgccactgtttatctttatttctaacgctgtgcagcaaacgacccttttgaggctcatttctcggccatag

SEQ ID NO: 12937 - DNA, 690 bp, A.fumigatus
ctgccatccagcgtgaaaaagcgtgaccacgacttcttgtcctcagtcgaactagtgatagttgaccacgccgatgctctgctcatgcagaactgggaccacgtgggctacattcttgatcgtctcaatctacagcccaaagaggctcacgggtgtgatttcagtcgtgtgcgaacgtggtacttggacaaccatgcccgatttgtccgccagatgatcgtctctgcttcatttatcacacccgagatcaactccttgttctctacacatatgcagaacttcgcaggaaaggtcaaggtgacgccggtgtacgtgggagctatctccgaggtacccctcccagtatccgtcaagcagaccttttcgcggttcgacagtcttacgccgaccaaagacccggacgcacggttcaagcatttcaccacgacggtgctctcatccttggtgcgaaacatcacctcaagccgggataagagcagcgcgggaggtaccctgatcttcatcccgtcgtatttggactttgtgcgggtgcgcaactactttgcaacatcgtcgcaaaccaccaacgtctcgttcggggcgatctcagaatatagcgaggtccgggagatgacacgcgcacgcacacacttcatgaacgggcggcatgcagtgcgtcttacacgaccgggcctggaaagaaacgcactc

SEQ ID NO: 12938 - DNA, 576 bp, A.fumigatus
aagcgattgatctatataaagcgctgttcaaggcaaattaaattggagaatctacgtcctttagtgcagctaactttcatcatcacctgccgaaatcggagaaacagcatggcagctatcaatccaatcccaccttcagcacgaccgcgtatccgggagcttttgccaaacctctacctcggtcgtcaccggcctggaaccaaaaactccctcacggatgttccgggggtcttggttcatacggagtcaatcaagcgcccgtttacggcaaccagccatgcggttaacacaggggtaaccacgattctcccgcgccgggattggtttgactctggctgttacgctgggtattttcgtttcaatggatctggcgaaatgaccggctcacactggctggatgagactggtctgctgaactccccgatcattcttaccaattcgttctcggtcggcgcatgctacacgggagtctacgagtatgcggttcgggagtataaggacccggcaaccggactggtggactggttcctgctcccggtcgtggccgaaacgtgcgatctgttcgtcttcaccgac

SEQ ID NO: 12939 - DNA, 1707 bp, A.fumigatus
caacaggcccttcctcggtgcgtcaatccggaaggcatcttctggactgctctctggtatgtccctaccagtgcgccctcattcctggtatgtgcccattgctatgaaaagcacatccaacccaccccccacgcaggccttttcgaggccgtctgggtagatgagggggacacggctcttctctgtcaatggaatactccgcgggtaatggcgcatctggctgccggggactgggatgcgatcaaggccttcatgatcgagcgggtgaacctcccgaactgcaaaggcccggcaggtcacaccgggcttgatggctcccggtggtatcggatgatcggcgcatgggagattcagggtttcgtgatctgcgagacatgctatcaggagctggtggcgtggaatcagctaaaaagttacttcgccacaacgccgacaatcaagtcggatgagcatttatggacatgcgatgcggcggtggtgccgctaatcaaggaaggactccgtcgggcgatcgcgtcaccccaccgctgggatgagctgcaccgcctttttcgacgccggatggagtatccctcgtgtctggagacgaaaaacctcctggccggctcgacctattggtacgcttgtaaggcggtgcccgacctggtcgtatgcacggcatgctacctggaccacttcgtgttggactacgccagttcgtgggagctccaccccctcacgccagagcagcaacagcagcgattcgagtgtgggatgcagacacttcaaatttatgctgccttgggtgtctgcaaacaaattggtatcgcagcaaacaccgacgagtacgacggcttcgagacattggcccggatgatcctcgagtcccctccctgcaatgcagaggacatgcgcaacgcgacctggtacgcccccaaggattgcaccgtcgatgtctacgccatctgcagacggtgcctcctcggcttcatggcccctcccgggttcgctcgcgagttcaaagaagtcgagtcccggcgcgggggcaactggctctgcgacctgcaccctacaacaccacgattccgaaagtatctggcaaaatacgcggccgcagtgaagctagaagacttctccatcttctccaaatatgtggtggagtggacaccatacccggaatgtccccggaacgaagcctgcacgaaccgcaaatggtatggggagggccgctttactgcatgcgaactctgctacaaggaagccatggagggggcgagcctggccagtcgtctcgactgtgccctggtcccgaacgaagcccgatgccagatgtactctcggcgaatgcggaatctctggcggcaagcttgcgagaacaacgacctagactccttcctggcgcttgcaaacgagcgcatggacgcgtttctgttgatgaacatggagaaggagcgccagttggccgagatgagcattcgcatgtcacagaggaacaccttgctactggcgtcctcgatgaatacgggaatagacggaattgtttcggcggcgcgaggtgataacggtacccggtgggggaattcgagcatcgggtacatctggcagacgagcgcaggggctgagggccgtctgcagtttgaccaggcaatggggatgaatgtcgtgccggcctcttcggaccttgcgcggatggcgcctgtgatgcagaggtgggcggaattggagtag

SEQ ID NO: 12940 - DNA, 255 bp, A.fumigatus
actataacgaaatactcgatcaggtatatctcaaccacggaatcaattaagcccccttctaaccctggccagatccacacaaacctcacgaatgctctcaacacattcggcccctcctctcagcagtatcagaatatattgaagatactaaaggagtgcctgcagaatatcgacaacgataagaaagagaggcccgctgctatcgacccagataccctgagcttggcgatgaagttcttggagcttgggagatga

SEQ ID NO: 12941 - DNA, 741 bp, A.fumigatus
atccactatagccttgcagacccatcacagtctagtctccctaaacgaggagagaaagactttgagcccaacccgacagaattccaagccgatgtccttgccgcctcacgcagggctatgcataatgccctctcgtacccgcgactccaccacccaaaacacaggatcgttggcgtatacgcgccagacggacctgcagcaccttcgatagcgcccgtcacggaaggcgaaacgcagaacaccgagttgaagtcggggaaagccagggggacgaagctgggtgttcatcaggacgcgtgtgtgtacgtggccaatcccaagggccagttcttcaagacgatgggccaaggggaccggtggaatagggtgtggttgcttcctgaggaggcgctgtacatgcttgaaagagggagcctggagattcggtggccagtttccgcgacggggtgcggagatgctgggaatgcgggcgactcggggattcctatgagcttgcaggcggcgtatgcgtgttttattgggcgcggtgggttgaccatcgataggtttacggtttatacggggttgaaacgtctgggttatacgcttactcgggcgcctgcgtggtatgatgatacggaggaatcgagtgttggttcagagacacaggagcccgttcgggttggtgctggtttagtaggggtgtatgagcagttcatgaaatggtctcaccacggggctggaaggatccgcggtggcgct

SEQ ID NO: 12942 - DNA, 243 bp, A.fumigatus
attccatttccattgaccggcgccgctggcgggaactcggcgtcaaagaagaactggctgtccctgccgaccagctggtggagacctacctggccatgggcgcgcggcccgtctttacttgtgctccgtacctgcttgagtctgcccccgcggccgggcaggatatcggctggtccgagtccaacgcagtggtgtttgcgaacagtgtgcttggcgcgcggacgcaaaagtatcccgatctga

SEQ ID NO: 12943 - DNA, 1689 bp, A.fumigatus
accaagatgcagtatcatgggcattgcctcgttgattcggcggccaccggaaaactcctctacgccaacgttggcctgagtttctgggccggagtcgactcccagactggggagatcattgaccgccatcatcctctccacggacaatcggtcaacggtcgcatattggccattccgtgcagcagaggatcatgtaccggcagcattgtgctgatcgagctgctgttgaatcaatgtgccccggcggggctcatcttccaacagccggagcagatcatcaccctaggggtcgtcgtggccaagacactgctcggcctctcgattccagtactggtcctaaaaccagcagaattccactcgctaaaagactaccgatacgcggcaattacaggaccaaccctccaaaccggagaggaccccctcccaccacccacctacgaagcaccttcgtgcgccccctcagggaccatagacctgtcagaaaccgacgaggcaatcctccatggcgcccgtggagcagccgcccaaaaagccatggagatcctcctgagcttcgcccagatccaaggagcaacaagattcatcgacatctcccgcgcccacatcgacgcctgcatctacacggggcccgccagtctacggatcccgcagacctttctgtctctcggcgcccgcgtcgccatcccaaccacgttgaattccatttccattgaccggcgccgctggcgggaactcggcgtcaaagaagaactggctgtccctgccgaccagctggtggagacctacctggccatgggcgcgcggcccgtctttacttgtgctccgtacctgcttgagtctgcccccgcggccgggcaggatatcggctggtccgagtccaacgcagtggtgtttgcgaacagtgtgcttggcgcgcggacgcaaaagtatcccgatctgatcgacgtgtgtattgcgctgacggggcgggctcccctggcgggtgggcatgcggatgaaggacggacgccatcggtggtggtcgaagtcgcggatttcccgaagatggacgacgcagtgtggccgctgttgggataccacattggtcagctggcggggggggatataccgttggtggttgggctggagcagacgaagcctcgtatggctgacctcaaagcgttcggggcggcttttgcgacaacggcgtccgcgtcgatgttccatgtgcgaggggtgactccggaagcgaccaagttcgagggagtccggcacacagcgaagcggatggccgtgcacaaatccgaccttgtgcggacgtgggaagacttgaacacggctcaagactcgtcagttgggttggtgtcgttggggaatccgcacttctcgctggaagaattcgaatcgctctctcgtttgtgcgccgatcgcaaaaaagatccctcggtgcagatgatgataacaacggggcgggagacgtacgagctggcggctagcaagggctatattcaaactctagaagcctttggcgcaaccatcatcactgatacctgctggtgcatgatccgccagcccgtaatacctccccagacgatccatcttattaaccattccccccagtatgccccctatgccccccggaatggtgccccgaggaattgcctttggggaccctgggccccatgttttggtggccccctgccccggggt

SEQ ID NO: 12944 - DNA, 285 bp, A.fumigatus
agaagtcttagatgggttatcaagatgaactgtccctcccgaaccgacgacactcttctacactgcgactggaatcagaatcccccttttctggcgccggatttgaccacccgccaagacttcaacggcatcaccaatgcccgcgtgtaccgatcgggccccgggttggatgccgtgtcgtcgacgagctgggaagactcccaagctatgcctgaacaacgagatacgccaattgggagtaagtcggacttgcgtggggcgtcactgtcttcaccacggggctag

SEQ ID NO: 12945 - DNA, 693 bp, A.fumigatus
cgagtcttgagccgtgttcaagtcttcccacgtccgcacaaggtcggatttgtgcacggccatccgcttcgctgtgtgccggactccctcgaacttggtcgcttccggagtcacccctcgcacatggaacatcgacgcggacgccgttgtcgcaaaagccgccccgaacgctttgaggtcagccatacgaggcttcgtctgctccagcccaaccaccaacggtatatccccccccgccagctgaccaatgtggtatcccaacagcggccacactgcgtcgtccatcttcgggaaatccgcgacttcgaccaccaccgatggcgtccgtccttcatccgcatgcccacccgccaggggagcccgccccgtcagcgcaatacacacgtcgatcagatcgggatacttttgcgtccgcgcgccaagcacactgttcgcaaacaccactgcgttggactcggaccagccgatatcctgcccggccgcgggggcagactcaagcaggtacggagcacaagtaaagacgggccgcgcgcccatggccaggtaggtctccaccagctggtcggcagggacagccagttcttctttgacgccgagttcccgccagcggcgccggtcaatggaaatggaattcaacgtggttgggatggcgacgcgggcgccgagagacagaaaggtctgcgggatccgtag

SEQ ID NO: 12946 - DNA, 453 bp, A.fumigatus
  unsure (422),(444),(448): Identity of nucleotide sequences at the above locations are unknown.
cagtatgatccgtcgctatgcaacgcagtgcatgtcagtcccagtccagtcccgttggtggaacatcagctacctactcatctttcgcgcaggaccgcatcaggacatattgcaggatatggcccagcgtcaccactggcacaagcaccgggtccccaagattctccgggccattggtcttgcatgctgcgtcgcgggccttgttgcaggtctgttcgacgttcgcgacgtaagccgacaacgacgactggcaggtggccgtgcaggtgcggtcaaaaaccgccgagtcgaagtcctgcagccaccatcggtcttccttggacacggccagggcgagcagaaagtcgtcgcagtcgatgtgggcgctgtaggcggctttgcattctggcgacgtggtgctggacaggctggccgtggtgtanttccagtacttggtgggggtantcangctga

SEQ ID NO: 12947 - DNA, 408 bp, A.fumigatus
ggagcgcagccgagctcttggccgcctggaatcggatcgaccatgttcccaacgccgcctgtccgaagcaccagtccgcagtcgtgctctggccaacggtgtaggtcagattcgccgggcattgggcgaccagcgcgtgctcgtacggagcgccgccgtaccggaagcccagcgacttgcggtcaaagtcgccgacctggaagattcgcgtgcgcgaagggacctcccatcgcagcgtgcccagcttggctgtgtgcgacttgcgcaccgtcacgtcgttctgcaagaaagaggtggccacgtcggcgagctgcccgccgttcgaccatgcctgcagcccgtaaggcccggtgccccacttcctccaatttgaaacaacccctggttcgtcggtcgggccccgtgtag

SEQ ID NO: 12948 - DNA, 540 bp, A.fumigatus
tgttccaccaacgggactggactgggactgacatgcactgcgttgcatagcgacggatcatactgctatatcggccagagcaacttgtactatgacaacggcgagtgcgactggacgtgcgcgctggcctatttctgggtctgtcacgaatatccatatgacaactaccagtttggcattcatctgccgggcatggagggtcagcgcaccgagttgattcccagcagcgtgctcctggacgattcgcagaactcgacgtatggctgggcgacggtcgagcagtgcggatggaccacgaatgattccttgccattgtacaatcccggcatgtcgaagagagtagttgaagaacagtcgaccacgaacactctcgcagcctcgacagccacctcgacagccacctcgacggcgacatcgactgcgacgacccctgctgcttcgagtgcggtcaccgctgattcgggaacggggtcaatccggatgcatctcgacacggggatggcagtgtggattcttgcttttgggatagtggtcctgtaa

SEQ ID NO: 12949 - DNA, 750 bp, A.fumigatus
cgttctttcctggggggaccacccacccggaaccaagaccggcgctggaacatgggcacccacttaattactacacggggcccgaccgacgaaccaggggttgtttcaaattggaggaagtggggcaccgggccttacgggctgcaggcatggtcgaacggcgggcagctcgccgacgtggccacctctttcttgcagaacgacgtgacggtgcgcaagtcgcacacagccaagctgggcacgctgcgatgggaggtcccttcgcgcacgcgaatcttccaggtcggcgactttgaccgcaagtcgctgggcttccggtacggcggcgctccgtacgagcacgcgctggtcgcccaatgcccggcgaatctgacctacaccgttggccagagcacgactgcggactggtgcttcggacaggcggcgttgggaacatggtcgatccgattccaggcggccaagagctcggctgcgctcctcacggtctcgctggccggctactcgtcgggaaccacctcgacgattctcctgaatggcgatgcagccagtccgatcggaaatctgaccactctcccgaacgacccctgtctgtaccggtcggcgacgaccgctggcgagtggcggctgttccagtttgaaattccccaggggaagctgcagcctggatggaactcgattgactttgccgtgggcaaggccagcaggtggcatggcttcatgtgggatagtatcatcctggagtatttgtag

SEQ ID NO: 12950 - DNA, 570 bp, A.fumigatus
  unsure (134),(135),(151),(196),(200),(222): Identity of nucleotide sequences at the above locations are unknown.
gctcgccataagtacgcgcagtgcccctggtttcgtccccggcctggcgtcgtcggtacgggcgctggtttttgcggtcactgtccttcagttcaaccaagtcactctttcagtttcccgttgttcttcttgannatgccttctttctttntattccttctggcgattggcgttgtgcccgtgtggagtttcagcntgantacccccaccaagtactggaantacaccacggccagcctgtccagcaccacgtcgccagaatgcaaagccgcctacagcgcccacatcgactgcgacgactttctgctcgccctggccgtgtccaaggaagaccgatggtggctgcaggacttcgactcggcggtttttgaccgcacctgcacggccacctgccagtcgtcgttgtcggcttacgtcgcgaacgtcgaacagacctgcaacaaggcccgcgacgcagcatgcaagaccaatggcccggagaatcttggggacccggtgcttgtgccagtggtgacgctgggccatatcctgcaatatgtcctgatgcggtcctgcgcgaaagatgagtag

SEQ ID NO: 12951 - DNA, 426 bp, A.fumigatus
ctagatggcgcgcaatccgacctgaactggacctcggcggaaatctatcgcagaggaaaaacaaacggacaagacttcctcgatatccaattcaccgccaaagagggcgacttccactgggtcatcttcgaggacctcgtcggcgcgtaccagtactttgtgaatcatgccctccccacgctgggcgagttccggacactgtggcgcttggacaatacgagctttcccaacggacggaccaacatcaaggacggcgcgcttcccacactggcggagattgccagcggcaccaaggtgcaggacgagacgtggcagctggcggacggatcctacattaccaagtacgactggaccgcgtggatccgcgaccaggattactacggcgtgtatggcgagttttcacaacgcggcgagatccatctagga

SEQ ID NO: 12952 - DNA, 558 bp, A.fumigatus
  unsure (461),(542): Identity of nucleotide sequences at the above locations are unknown.
ccttcctacatcaccatggagtcccccacgtacgaggctccgagtaattcgaatggccccccggataagaaaggaggcatccattcgactatcgatgtcgaccacgattatggagccgacaccgacctccaccgctccttgagcacgcgccatctcaccatgattgcgctgggctcgtcgattgggatgggattatggctgggaagcggtacctcgctggtcaacggtgggcctgccgccatcttcatcggatacctcctcagtgggacgatgatctgggccgtctcgcactccatcggggagatggctgttgtctatccgcttccttcggcctttgtgcagtggtcgtccatctttatcagcgagccggctgggttcacactggggtggagctactggtttcagttcttcatcaccttggccaatgaactgcaggttcgtcgtcccctattctgtgatanggttcgatctgactggtataaggtgtggtcaccgtgctcaatttttggaccgaacaattgcccgaccgccgcgtggatcantatcttctgggtcctc

SEQ ID NO: 12953 - DNA, 228 bp, A.fumigatus
gaatccagctggaggatcagccaacgttacattcccagcagccacagagccctatttcaggatgagcgtctgatcgaagactcacttgataagcgatacgacggcatcccgtgttctccggttacgtgcatgcatgctgagtggcagacgggcgagggttatctatccagcctcgatgataaccagcacgctagcaacggtcagaccaaagggcttatcgcaagctaa

SEQ ID NO: 12954 - DNA, 471 bp, A.fumigatus
ctgatcgagatcatgttacagccaatgaacgtaacttggatcatgggctatccaacgggcaaggagcaaggaaagttcctgatcctcgacatgggaggcaccaacctgcgcgtaagccaggcacagcttctggggagcgatcgcgatatggagtccatccaggaaaagtacagtataccgcagtcgatcaagcaaggtacagccgatgatttgtgggatttcgtggcggactgtgtgcagaagtttctccagtcccgactcagtgaaagcgaaagatcgaaagtgttgccgcttgcctttacgttctcttatcccgtcattcagtcgtctataaaagtcggagtccttcaatgctggacgaaagatttctgcgtatctggagttgaaggtcatgatgtcgtgtttcagctagaggctgcttttgaacggaaggtgtgtactctcgtcattccagccggctgcaaagcctag

SEQ ID NO: 12955 - DNA, 789 bp, A.fumigatus
aaaattcccgtccaagtcgtggctttggtcaatgatactgtcgggacgctcttcgcagctgcgcatagagaccaagaggtcaagatcggtagtatagcaagcaccggttgcaatgctgcatacatggaagaggttgccgcaatcccaaagatccaaagctgcgggctaccaagcggtgctctcgtcgcgattaacaccgagtacggtgcctttgataattcacgtcgcatacttccgcggacccgattcgacgatgaaatcgaccggacatccgcgcatccaggccagcagctttacgagaagatggtctccgggccgtacttgggagagctgctccgactggtgatgttggaactgcacgaagccaaacttctctttgtaggtcaagacgtttcgtgcttgcgccagccaaatgccctagaggtttccctcttcccaaccctagaggaggatatcagcgagtgcatggaaaacgctcgtaagtgtctctgggagaagacgggccttgatccagctccgcacgaacttaaggcctgccgatacctggccgagttggttgggacgcgtgctgcccgtctctattcatgcgggatcgcagcgatctgcaagaaacgcaatatcgaacgctgccatataggcgttgatggctcaatttttggtcattatcagaattaccgcaagcgagcggcgcaggccctccgtgatatttttgcatggcccgatgaccttgaggatccgattgtgtttggggtctacaaaaaatgggtctggaattggcgcccgctttga

SEQ ID NO: 12956 - DNA, 564 bp, A.fumigatus
ctactcggagaagaaccccgtcgtatcagttgcacagaacttcgatgtcctggggtttgcgccggaccacccgggccgcagccggacggatacatactacatcaacgacaagaccgtgctccggacacacaccagcgcccaccagcaagcctacttccagcagatcaaccgcaacgaggccacccgcccggaggaggtagggtacaccgtggtcgcggacgtgtaccggcgcgatgcgatcgaccgcagccactacccggtcttccaccagatggagggcgccatgctgtggaagcgcccgtcgacagacccgctcaagcacgccgcgcataccgccgcagccatcatggaagacgtgaaccgcatccccgcgcacggcgtccccgtcgaggacccgaacccgaccatccacgtcgagcgcaacccgctccaagccgagcaccacgccgccgaggaagtcgaagccgtcgcggcgcacctcaagcgctcgctcgagcgcatggtcgtcaagatcttcagcgaggcccgcgatgccaccgccgccgcagacccaaccgcgcaagc

SEQ ID NO: 12957 - DNA, 954 bp, A.fumigatus
ataaaagacatgcgtttgttggcgaccggcagagcgctacgggccagcagtggcagatggtccgtcgtgacccctcggaggagccctcggatatcgacctctcatctcctcgagcctctcactgtcacagttacgaggagaaatctaagttcgacagcgaaccggaagatagacgaaaagccagagacaaagcagaaagctacggctcgtccatcacctccgcagtcattgaccatcgagggccagacctaccgtacggaccaatggaccaacactccagacacaatactgtcccacgttggacgtcggctctacctcgacgagaaccaccctctcgcaatcactcgcaaactgatcgaaagccaattcccaggcccggtatacggtaactactcggagaagaaccccgtcgtatcagttgcacagaacttcgatgtcctggggtttgcgccggaccacccgggccgcagccggacggatacatactacatcaacgacaagaccgtgctccggacacacaccagcgcccaccagcaagcctacttccagcagatcaaccgcaacgaggccacccgcccggaggaggtagggtacaccgtggtcgcggacgtgtaccggcgcgatgcgatcgaccgcagccactacccggtcttccaccagatggagggcgccatgctgtggaagcgcccgtcgacagacccgctcaagcacgccgcgcataccgccgcagccatcatggaagacgtgaaccgcatccccgcgcacggcgtccccgtcgaggacccgaacccgaccatccacgtcgagcgcaacccgctccaagccgagcaccacgccgccgaggaagtcgaagccgtcgcggcgcacctcaagcgctcgctcgagcgcatggtcgtcaagatcttcagcgaggcccgcgatgccaccgccgccgcagacccaaccgcgcaagcc

SEQ ID NO: 12958 - DNA, 924 bp, A.fumigatus
catgtttctctcctcaaggtgattgagtcctacacaacgcctcttggtacctccttggctcgtcacttgactacccacctctcccaccagatcacctatctctccacttgccgccctctctcgatcagccaaggaaatgctattcgtgcgctcaagttggctatttcctcgattgacccgtccgttccggaggccagtgccaaggcgtcgctaagcgactttattgacagtttcatacgcgaaaagatcactgttgcagaccaggtcattgcggacagtgcggctcagaaaatccaagatggcgatgtaattgtgacatacgccggcagctcgattgtcaagcaaactcttctgaccgcacacaagcaaggcaagaagttccgggtatccatcattgactctcgtccgttgttcgagggcaagaacttggctcgcacattagcgaaggcgggtctcgaagttcagtactcgcttgtcaacggcatcagccatgccattaaggacgctacgaaagtgttcctcggggctcacgcgatgaccagcaatggtcggctgtactcacgcgtcggcacggcgctggtcgccatgtctgccaaggagcgggccggtggtgtggaagtccccgtcattgtatgttgtgagaccgtcaagttcaccgaccgggttgctctcgacagcattgtcgtcaacgaaattgccgacgccgacgagctggtaatgaacgagcccttgcagcaagtgacgggtctgcctgacgcggctgctgttgctcaaccagagcccaagaagggcaacaaatctgctgcgaacgccactccctccgagtctactgtggtcacaccaggcacttcacctctgaaagactggaaagacactcccaacctgcagcttttgaacatcatgtacgatgtgacaaccggctga

SEQ ID NO: 12959 - DNA, 537 bp, A.fumigatus
aacgcccccgctggaagtggaaggaagaaggcccaaaagcaggaaaaaggcaagcccgccagggggaaaggaggagggcccgagaagagcaacaagcttggtggttgcggcgccggcgcaagggcgccccaatccccccatttgggaagaaaagggcagacccggtgcgggggggtgccggttgtgcggggtgggaaggatgctgctgctgcgcagtcgcagaagggacgggggtatctgccgcgccggggctctgcgcaggctgctgctgggggtgcggagcagaagaagaagcaggaggataagaatgtggctgtttttggacacctgtatgggcagcagcggagaactacagttgctggggcgggcaaggaggtgcaccctgctgtgttggctttggggttgcagatgagggattatgtgatatgtgggagcagcgcgcggtgtgtagcgacgctgttggcgttcaagagggtatgttttgtcctctctctcgttttcgttgattatgctgacatgtttctctcctcaaggtga

SEQ ID NO: 12960 - DNA, 573 bp, A.fumigatus
aggattctatttcgacattcactgcaatccaaaccgcaattcagaatggttagcccatcaccaacacatcaaaacaaaccacacagggtgacagttactaaccgtgaactacagagcaaagactcctcccccacaaacatccacatgcatcatccccggctagcggattacttcgaggaatttacccgcccacacacatcacaaacagccaacatgaccgcctccgcgtctgcctcttacctctaccagcacggatacaaccacggcgtcacatacggctcctcctcgccgacgctggtcccgtcgtacctgcccatcgaggagatctatgtgctgccgcagtaccagccgcccaatcccgaggatgaggatgatgtggtgccggaccagcatgcggcgtttgggattacaagggcgatggagcggaggagggagcctgcttggagggatttggggctggaggggttggttgatggtggtgggaatggagctgccaaagggaacggagtgaaggtcagggttaaagaggcgggacggttgatgggtgggaagaggacggtttgtttgcggtga

SEQ ID NO: 12961 - DNA, 288 bp, A.fumigatus
cagaaatttgcatataaacctctcgcagctcaatgcaatgattcactgttctctcagcacagcctgatatcacatccttgccaaacagccaaaatgtcacccaacaacagcttcgtcctctatcactacgagccctccctaccagcagcaattgccttttcggtgttgttcaacatcacaacactggcccatgtataccagcgcgtcaagtccggatccaattacatgaacccattcatcgtgggcggattctgtaagtctgcaggccttccatccagacaccactga

SEQ ID NO: 12962 - DNA, 258 bp, A.fumigatus
ccagacgcagtccaagtcaccggctatggatgccgcgcagcatcccacttccttggaacgtccaccacgctctacgccatccagacccttctggtcctgttggcaccaacgctctacgcagcatcgatctacatgatcctgggccgggtgatccgatacctccatgcagaacgactaagtcccgtgccggtgaaatggatgaccgagacttttgtggcgggcgatatcctctcgtttatcctccagggagccggttag

SEQ ID NO: 12963 - DNA, 315 bp, A.fumigatus
  unsure (70),(167): Identity of nucleotide sequences at the above locations are unknown.
cgatttctcacgggcgccaccccagctgctccatcgggcactggatccaagtgcgatgctcctgatccancaacccatggatccgaaaaaattaatgcacactccacccctcccaaccaccatatccactcccaccgggggcagcaaaggaacagaagtacccctgnaatctccagcgcccccatatttcttgctcctcgaaaggagatttctgaaactccctctgataactccccaccagccaataacaaagacattttcccgctctccccacatccccgattttcaggaccaccagcgcgcttaccaaaaacc

SEQ ID NO: 12964 - DNA, 774 bp, A.fumigatus
gtctgcaggccttccatccagacaccactgaccagacgcagtccaagtcaccggctatggatgccgcgcagcatcccacttccttggaacgtccaccacgctctacgccatccagacccttctggtcctgttggcaccaacgctctacgcagcatcgatctacatgatcctgggccgggtgatccgatacctccatgcagaacgactaagtcccgtgccggtgaaatggatgaccgagacttttgtggcgggcgatatcctctcgtttatcctccagggagccggttagtaccctctacccgtggcgagacattcgttgctgacagcacaggcggcggagtcatgtccgccggctcggcaaattcccatgatatcggcacgtatatcatcctcgctggtctggctgttcagcttctgttctttggtgtttttgtctttgtggcctttgtcttccgctttcggttctccagttcccagggtgcaggtacttcggggaatgtgccctgggtgaagagctggaacggtcttctctgggtgctgtacctggttagcgcgctcattctcatccgaagtgcgtttcggatggtggagtttgcgcaggggttcgatgggtatctcatccgtcatgaaatcttcatgtatgttttcgacacggcgttaatgtttgttttgatggttgtgatgaatacggttcatccttctggtgtttcgagtgcgggaaagggtgagctggtggaatgtgagactctgagggctcggggtagcgacgcataa

SEQ ID NO: 12965 - DNA, 366 bp, A.fumigatus
  unsure (366): Identity of nucleotide sequences at the above locations are unknown.
tgggatcggaaatgtgtggggcctggacgaacagcccatgatctgtacgtccctgattctttgctatggaaaccactaatatttgctttagggtggcaattcagtacaggctgggaccttgcgtctgacgatatccgcgtgcagacctggtcgcgtcgactcacagagtctctgcacgccatcaacagggagaaagggatcagctctgagttcgtgtatatgggcgatgcgggcgaatggcaggatccgtttgtggggttccctgcagccaatgtgcgacggatgaaggcagttagatctgcctacgatcctctggggaccttctcaaggctgaactggggtgggttcaagcttgggtttgactan

SEQ ID NO: 12966 - DNA, 747 bp, A.fumigatus
atgtacgatgccgtctccaccaaatactcatttactgacaatggccagtttcctggagccaacaacatcgacaacggcgtgctcatcgcattgtccggattgaacaagttcaccgtccacaacgggaccatagacgttggaccaggcatgacctggtacgacgtctactctgccctcgacccctacggacggatcgccatcggcggccgtctgaagaccatcggcgtacctggcctcactcttatcggtggcgtgcattattttatcaacaagtacgggtttgccatggacaacgtcgtccggtacgaggtggtgttggggaacgggacgcaggtcgtcgcatcggcgaactcgcacccggatttattctgggcattgaaaggaggtgcgaataatttcgggatcgtaaccaagtttactctgaagacgtttgcaattccgaagatcagtaccacactccagagcttcaatgaatccgggatctatgactatatcacagcgctatgtgatctggtcaagcttgatgagccaaatcccattgcagcagggggtgtcttcacgatcgattataatgtgaccacgaaggtgtcttcggcttcgctgattggggtgcaggaaggcattagccggcctccgtcgcagttcgccaatttcactgctctccctggcgtgtcaaaggtgcacaatgtgacgactgggaaacagtttgcttcgggactggttaccccgaatcagatgttccggtag

SEQ ID NO: 12967 - DNA, 273 bp, A.fumigatus
accttgatgttcaacgctgatggcgatagtgtcatgttctctcaccatacagtacagcccgaccccgagaccctctactccatctatcaagcgtggaagacagcggttgatgagatatccgacgtgaaaggcctctacccaacctttgtcatgaatctctctccagcaggcgcggcacgagtaggcaggactaatgggatcggaaatgtgtggggcctggacgaacagcccatgatctgtacgtccctgattctttgctatggaaaccactaa

SEQ ID NO: 12968 - DNA, 429 bp, A.fumigatus
aatcaggccggcgaaataacacagaatactgacttgccgcagatacttacaaacttgtgtcttctcgtcgtggggtttttcttgttctggctccaacgtctcctgtacggacccttgcggccgattgaaaccgaacagctttacgaaaaggcatggtttgcggtcacagaaacatgcctggcgatgacaatattccggggggaacttggcgggtggttcttggtcatgtttgtctgtctactggttggaaaggtctggggctggattggtgaaggccgcgtcgagttcctggagcaacaacccccggccaatccgcgcttgtttcacacccggctggcaatttccctcgtattggcggttctgtatgattcattcatgctgaaatactgcataacgtgttcaccacgggggcgaaaggaaccgcgctat

SEQ ID NO: 12969 - DNA, 1791 bp, A.fumigatus
catagtcccatacaaaaagaagtcgaaaggtctccgcggactcaccaagcacatcggccagactatgattttcctggtatgatggcgtcacaacaacttctatttacagctacccgcactcagacgttcacatatctgcttgccgtgtgtcccttctccattgcgtttttggtcttcgtcaattcatctgtctcatttgtggtcactgatttgattggactacacgatggtgaaggagacgctgttggcaccttggggtttgctgatgaactgctcgcgctggccgcgtgcccattatggggagtgctctctgatcgtataggcgtccgcaatgtacgttccgttggttttatctaccaatatggtttcaaatcactaatcactgacatgccctcaactaaggtttgcgtcatcggctacggcatcatagctgtttcgctggtcgtattcgtgcaggcaagaaatgtctaccctcagctgctactgggaaggctattcttcagccttggaggctctgcagtctcaaccatggtgacagctgtcttacctgccgtggctggagagactccaagcgagcaactgcggcccgggcgagaatccagggctgaggcgaagtctccttcctctcggctggctggatttgtgggcatgtgcgctggcagcggtgccctcatatctttggccattttccttcctcttctagctcgttttcagagctggggttactcaccctcggaagccatccagaacagttactacttggttgcttctgtggcaattttggtcagtttctgctgcttcatgggtcttaggggtcttgcaagcgaacaaggaaagggatggcacttattgtgggcctctccaaaggcatctgcgtccgagaccgacccgctagacttgaacaaaggagcgatacaattaccatacctcggtcaacttggtacagcactttacttagggctacaaaaccgggatatattcctcggttacctgggaggctttgttgcacgcgcctcatcagtcggcatttcattgttcattccccttttcgtcaaccactactatcgacgatctggcctgtgcggtcatgagcagggcgaggtgccagaatcgataccgagagatatcaaacaaacatgccgcaaagcctacatcttggcttctatcctgaccggcgtctctcagctagttgctctgatcgcggcaccggcgtttggatatctatcggagagatcgcgccggtaccatgcaccacttctgttcgcatctctggctggtattcttggctatactgtatttgcgctgttgcctagtcctcaaattagtgggccagacggcagtgcaggtgtcttggttctaatgggcttgatcggtattagccagatcggggccattgtctgcagcctggcggtgctgagcaatggtatcctcagaatcagccttgattccgacggttcggagattttccacacgccagaggaccccgggagtacttcaacgaaccaggtaaaccaagacgtcgacgagcatcagcccttgctacaaggatctccgcgtcacagagggcaccagctgtcccacctgaagggatcaattgctggtgtttattccctgtatggaggggcagggatattgtttctgaccaagcttggaggtctactgttcgatgatttgtctccaaagagtccattctatataatgggcggcttcaatgctgtactgcttctcgcaaggatcggaactggcgcaatgaactgggcgaaagattcttgtaaccgggctgaagcttag

SEQ ID NO: 12970 - DNA, 906 bp, A.fumigatus
ctaccgtacttgaatcatttccacccgtcggtgtcagtcaatgcctcccaccttctgaaccaccacccgatgagcggcaagccagacatgacgattcacacactgacacacttccttgaccgcttcatctaccgaacccccaaggcgtccgcaaccacccgcggtggctcgatcatgcaacctctcgctggtagcgacacgaaggaccggctggtggttaccgccaaaggtagtcaggatctgccacccaactctgaggagttctggaagaagaagaccgaggatgtggcagcggaagatgttttcttccatgaatacttcagccgagttggaaagagcaaggacaaggcccagaagaagagggccaaggacgccggtgggcgcggtgaagaaaacgcagaaggacttagcgacgccgaatcggagatctgggaagcccttgtcaagtcacggcctgacttggaggatgctggtgatagcgacgacgatctcgatctggatgatctcgagtccgcgtatgatcagggtgagaacgatgaggctgctgagagcgatggtggagttatcttcaacgacgagtccgacgaagagatggaagaccttgatgctgccgcagagtccgacgccgaggagccgcctaccaggggtaagaccaagggcaagaagatggaggaagaagaagccctggacgaggaagacgatttcgacatggatgcgtcggacgaggaggcattcgtcggcagtgacgaggagctaccgtccgatatcgaccttggaggcgtggagctgcccaaggaggacgaggcatctgggcggaagaagagacgcaagctcaagcacctgccaacatttgcatcggcggacgactatgcagccttgcttgccggggaggacgagggaatgtga

SEQ ID NO: 12971 - DNA, 183 bp, A.fumigatus
gatgtacagctggtcagggaccttgttatagttcacccgttacaaggaaccttttccgccacatctaacccctgccgtccacttcccaatgaggatggatatgatgactacctcctcgaccccaacgctcatacgtcaagtactacgcctattgcggctgtctttgctcactctccctcgtaa

SEQ ID NO: 12972 - DNA, 636 bp, A.fumigatus
cctgtccacagactttctgaacatatcgatactctattccgtatcacacactcttccaacttcaacactagcatccaagctctgatgctcatccaacaactcacagcatctcaccaagtgggtgctgatcgcttctaccggacgctttatgaatcacttctcgacccacgagttgccacttcctcgaagcagtcgctatatctcaacctgttgttcaaggctttgaagaacgatttgaacctccgtcgggtcaaggcctttgtcaagcggatcgttcaagtacttggtctacatcagccggctttcatctgcggtgtcttttaccttatccgcgagctggagaagactttccccggtattcaggctttgtttgatcaaccagaggataacgaaagcgacgatgaagaggtgttcagagacgtgcccgatgaggatgatgaacagcaagcacaacctgcagttcccgaagataagcaacagaagccttcaacccgatatgaccctcgcaagcgagatccggaacatagcaatgctgacaagacttgtctgtgggaattggtaagatggacctcaacttgctggcacctcaacatcagggagagcaaagctaacaggatctatagctaccgtacttga

SEQ ID NO: 12973 - DNA, 207 bp, A.fumigatus
tgtcgatatcggagctgtcaacagaagtatggaaacgccgcaggatcccatacgaacttcgatcaacaagaaacagggggctctgccaagtcaatcctgactgactcgtggagattagaaaactctggcgatgacgtggatgatcctgaagcgaattgtacatttgttgcaatgctctgtagtcgtatgatcaaaagaaaaatctag

SEQ ID NO: 12974 - DNA, 246 bp, A.fumigatus
atgcccccgcgcgatgaatcagccgcatatgcgctcgacgacgcgatcgtgttcgctcggatactagctcgataccgcggcgaaccgctcacggacgcattcagagcctacgaagacatccgacgcgagatagtcaacgaagcattcaagtccgctcggcgaatgtgggaaaagcacaaggacatgggtctgttggagagccggctgcgcgagtggacgctgcctttctatatccgcaattcgtag

SEQ ID NO: 12975 - DNA, 312 bp, A.fumigatus
gcagtacaggggctcccggggtatataaagctcactgatgccgcctgcgacgaggttttcgtttcagtaggctcaacaggcttggtcttgattcttatccgctctcttcacttactttctttcgctttatttgcttcgctcgtcaagtctggtacttgcttttctttcaactcaacaaccatgaaattcgttgctactctcattgcctgcggcctgtctggactggccctggctgctcctaccgctactgtcgactcgttggggaagcgcgccgccgatgatgtacgtcttctgcttgaatgcgtttcctag

SEQ ID NO: 12976 - DNA, 408 bp, A.fumigatus
acggaggcaccaccggtggtgctggaggtaccacgaccaccgtctcctcctacgcagccttcactgctgccgtctccagtgatgcgaagaaggtggtctacgtcagcggccccatcaagcagagcgccaagcaggtcaaggttggcagcaacaccagcatcatcggcaaggactccaccgctgtgctcgagggattcggcctgtacgtacaaccttgcctgtggacaaaaggacacgcctaatgagaacagtctggtcaaggagaagtccaacgtgatcatccggaacctgggagtcaagaaggttctggcggagaatggagatgccattggcattcgtaagtatcccttctttggacaatggactcaactaatgaatggcagaatactccaacaatgtgtgggttga

SEQ ID NO: 12977 - DNA, 474 bp, A.fumigatus
caactgcaggtcacccacgccgccgactacgtgaccatctccaacagctacatccacgaccactggaaggcgtccctggtgggccactccgacaacaacggcgatgaggacaagggccacctgcgcgtgacgtacgccaacaactactggagcaacatcaactcgcgtgctccctccctccgcttcggcaccggccacatctacaacagctacttcgagaacgtcagcgacggcatcaacacccgcgacggcgcccaggtcctcgtcgagtccaaccagttcgtcggctccagcaaggccctctactccaccgacgacggctacgccgttgagagggacaacgactttggcggcgccaagaacactgccctgcagggtaccttgaccacggttccctactcttactctctgcttggatccagcaaggtcaagtcggctgttgttggagtggccggtcagactctgaagttctag

SEQ ID NO: 12978 - DNA, 312 bp, A.fumigatus
atgcgtttcctagtatttctccagggcgaaacgctgacaggacaggctgcctttggttacgccagcttgaacggaggcaccaccggtggtgctggaggtaccacgaccaccgtctcctcctacgcagccttcactgctgccgtctccagtgatgcgaagaaggtggtctacgtcagcggccccatcaagcagagcgccaagcaggtcaaggttggcagcaacaccagcatcatcggcaaggactccaccgctgtgctcgagggattcggcctgtacgtacaaccttgcctgtggacaaaaggacacgcctaa

SEQ ID NO: 12979 - DNA, 450 bp, A.fumigatus
cttgacgactccgacagtgattatctcaagagagacgatcagtacctagcattccgattacaaaatgaggaggcgaggaacaaaatggctaaaacagccaaagaccgggatcgcgctttagccatggcgaaagccaacgacttaggcctacccgaagcagaggctgacggtgatggggatacaaatatggaggaaggtgcggaagggacaacagaaaccttgggttccaaggttattgtagtccatgtcggaagccagaatctgcgaatcggcctggccagcgacgcactgccgaagaccgttcctatggtgattgcacgaaaatcaaccacaagcgagtccgaagaccatgcggagccccatccgaagcggttgaaattagacgatggctctttgatggaacctgaagaaaatgcttggtccggaggtttgtcctacccaagcgcctga

SEQ ID NO: 12980 - DNA, 1635 bp, A.fumigatus
ttctcctcgctgtacaccacgatggccgcagaactcaaagcgcatatgcggcaaaataagcgcaggactctacccaactcgaaagaaatggtcattaactacaatcggagaacggtaccagagaccatcccggaacacaatgacccgctgcgtgtcgaatggacagatattaccgacgatgcacctgaatatattgtggggcaagcagcgcttagaatacctgatgattccaaacccaggtacaagctctactggccgatacgatacggatggtgcaacgagagagactatgagaacaagagactcttgtttttggacatctcactcattctcgaggacacaatcaaaagccaattgggcttaaccagcaagaaggattggcctcagtactcttgcgtttttgttatccctgacctgtatgagaagacttatgtcacgcaagttctcgagatgttgatgagggagttctcattcgcccgtgtctgcttcatccaggagagtttagcggccaccttcggtgcgggattcacatcagcatgcgttgttgacattggcgcgcaaaagacgtccatctgttgcgtggaagagggaatgtgtattgaaaactctcgcgtcaacctgaaatttggtggagccgatgtgaccgaggcgttcatcaagatgatgctcttcgaccacttcccatatgcggagatcaacctatggcgccgctacgactttttactagctgaggagctgaaaaagaatgtctgcaccttgaacgaagcaagtgtctcagtgcaagtgttcgattttcaccttcgcattgccggtcaggacacccggaagtattccttcaaagcgtacgacgaagtacatctcgccccgatggggtacttccagccctcgatattcgaccactcacggaaacttgaaggaagaagaaaattcatcacgcggtcggtagatatctacgacggtcagccgaatgatccaacatcgggggcccagtctgaaatcttgactgccattgcccctccccctgccaatggccaagtgaacggtgaatcccaatcattcacgttggatgtgcagtcgacgccgactcgctcgcaccaagtgaatgcactcagccgtgtccaggagctggatgccacccctcgatcttctgttgccgggtcgcctgctccggaagcgattggtacgccccaagctggtggtgctggtaccccactcccgggtggccagggacagaacgcctcacaagcccgtgcacctactgtcgaagagcgagatgatgttcttccagtcttcccgttggataatgcgatcctcacatctatttcgcatgcagctcgatctgatgaacgtaagatgcgagacttcctcggaggaatcatggtcgtcggaggcggcagtcttgtcagcggcttccactccttcctggaagagcgtctccagacgctgagaccagggtttgctagcgaaatcatggtcggtacacctccaagagacctcgacccccaagtggtagtctggaagggcgcaagtgtgtttggtaagctgagcggaaccaatgacagctggatcgggcaattggaatatgatagactgggtcaccgactgatggcgtacaagtgcatgtgggcatactag

SEQ ID NO: 12981 - DNA, 444 bp, A.fumigatus
gatacaagaagaatcaagagaaaagcagcagtatctagaaaggaagagctagtatgcccacatgcacttgtacgccatcagtcggtgacccagtctatcatattccaattgcccgatccagctgtcattggttccgctcagcttaccaaacacacttgcgcccttccagactaccacttgggggtcgaggtctcttggaggtgtaccgaccatgatttcgctagcaaaccctggtctcagcgtctggagacgctcttccaggaaggagtggaagccgctgacaagactgccgcctccgacgaccatgattcctccgaggaagtctcgcatcttacgttcatcagatcgagctgcatgcgaaatagatgtgaggatcgcattatccaacgggaagactggaagaacatcatctcgctcttcgacagtaggtgcacgggcttgtga

SEQ ID NO: 12982 - DNA, 273 bp, A.fumigatus
gcatgcattattttctgctggctctttgtacagcgttttagaatgagtacacgtgatcctcttttcatcgcccaggaagccgtctgtttctatcccattagcaccatttatgattcttgcccgcgttatctcttctacgctcttcttctcgccagctgtgtgacacggtggacaggatggctggctgacgtctttctgggtgctgcagcaacatacgcaggagtcgccgccatccaggcgttcattcttgtttccagtccctcgtcgcctgcg

SEQ ID NO: 12983 - DNA, 531 bp, A.fumigatus
atcactatctggttgaatggaggccctggatgtagttcgctcgacggattgctgcaggaaaatggcccttttctctggcagtcgggtacctacaagcccatccgcaatccatactcgtggactaacctgaccaacatggtctatgtggatcaaccggccggaactggcttctccccggggccgtccaccgtcaacaatgaggaggatgttgcaaggcagtttaagagctggttcaagcacttcgtggatacttttaatctgcatggtcgcaaggtgtatatcactggagaaagctatgctgggcagtatattccctacatcgcctcggccatgctggacgagaaggataaaaagtacttcaatgtgaagggcatccaaatcaacgatccgtccatcaacgacgattctgtgatgatttatggtatgagcatcttccatgatatctgttcattattcttcagggctaacatgtcgagtagcacccgctgtcagccatctgaaccagtacctgaacgtcttctctctcaatga

SEQ ID NO: 12984 - DNA, 816 bp, A.fumigatus
gcatcttccatgatatctgttcattattcttcagggctaacatgtcgagtagcacccgctgtcagccatctgaaccagtacctgaacgtcttctctctcaatgacactttcgttaagcatatcaataaacgcgctgaggaatgcggatacaacaagtttttagacgaggctattacctacccacccccaaaggaatttcctgtagcccccgacccatccaagaacaactgcgccctttgggatgatatcgttgaggcggcctactacgtcaacccttgcttcaacttctaccatctcaccgacttctgtccgtacctatgggatgagatgggcttcccctcgttggctggaggtcctaataattatttcaatcgctcggatgtccaaaaagcccttcacgtccctccaacggactactccgtctgtggggagaccacgatcttcgccaaaggcgatcaatcggtccccagcgcccttggccctctccctagtgtgattgagcgtaccaacaacgttcttatcggacatggatggctcgactatctgctattcgtgaacggatctctcgcgacgattcaaaatatgacgtggaacggtgcgcagggctttcagcacccgccggtagaacccctttacgttccatatcattatggccttgcagagcttgtgacatctactgcgccgaatccctacaccttaaacgcgggggctgggtatttgggtaccgcgcacactgagcgcggcctgaccttctcaacagtctacatggctggccacggtaaggagaatcatttgtaccttcatgtttcgttctga

SEQ ID NO: 12985 - DNA, 312 bp, A.fumigatus
gactttgttgttgccatgtttcacacctttgagggttttgaaaaccctggtgcctcagctccggctaagggacgggagcgccagcagtccgttgggcggagagtcaccacccttcgggcgtgcacctcatgccggcatcggaaaatcaaatgcgatggtgagaaaccatgcgaggcgtgtagatggtacaagaaggccgatcagtgccattattcagatccgcgtccttcccgaaggtacgttctcttcgtattatctatgagttctgtcccgagccttttatctttcccatggagcagtcggaacagatga

SEQ ID NO: 12986 - DNA, 1083 bp, A.fumigatus
gctgaacgcagtaggcatgtggaaaaactgtcgaccactctagacgagtatcggagcgttctggagaggttatttcccagcacctcccccgaggcccttgtcagtctaccccgtgagaagctcctggagctgtcgggtaagggcccgccgcagccacatgcacaacatccggcttctcctgccacctctgcgtcagttgaagcgcacgtttcccccatatccaacgaagatggcaacttggaatcattgcagacgatgccagaagatcccagcgacagccgaaaccagagcaccagtgatattgcgaatgaaatttcagacgatgtaaatgctctatccctctcagctaaacagccatcctcatacctaggcgtgtcatctatacacgctgtcttgaaagtcatcgtctggcttgatccaggatctctctcttatttctctcggacgccagcgagtgctgctccccgagagtcaatgcatgattactcaacatcagccgagcatcagaactggcacatccaatcgtctcagcagcgaccggtcacaccacccaaggctcatatgcaagcgaccgatacgcagctgctcgacgcatacttcacctggttccagccgtttgtgcccatgctggacgaacaagcttttcgcgagacgtacctgtccggacaccgcagagacgaccgctggctcggacttttaaacattgtctttgccttgggaagcatagcagcatgcccgtccgatgacatatctcacaaggtttattaccagcgctctaaaagctatctaagtttggattcattaggatcctcgcacctagaaaccatccagactttggggttgatgggcggttattatctacactatgtcagtgagccaaatctggcttactcactcatgggagctgcgctccgcatggcggccgccttgggtttgcataaggagttctcctacaatcaggatgcgtccaacaaacagaaactttcagccatggatctgaaacgccgaacatggtggtcgttattctgtatggatacatggggtggaatgactctgggtcgacccagcatggtcgtcttgtag

SEQ ID NO: 12987 - DNA, 1056 bp, A.fumigatus
agacatcacccaatcgctcaggcagtttctgctttttgtaaggggcgttcggaaatccccgtagcagcctccgatattgtagaaaaatcggggcgaggcatgatgggcaccttcaccatctcgatcaatgatcccgcatcaaactcctcgacgacagtagtctatgaagccgcgattggcaacgaggctcttctacagagccttacttctgcggtagacacttaccgtctttctggtctgttggaggaataccagtccgcagggaaatccactgccatcctctccctccgcaaaatcgacccaacgtctccagacaaaccttcgttcacgcctgcgattgtctttgccgcaactgatgccatccgcccccaggcctcagagattatctctcagctccgcaagcgagacgtcgatgtcttcatgtgcacaggggataaccaaaccaccgcctacgccgtcgcagacgtggtcggcatcccccggtccaatgtaatggccaacgtcatgccagccggcaaagcagactttgtccgcaaggtccaggccggcctgtaccccgtccgaaacgaagacgacgctgaaagtcaaacgaaccgatccggctcacggccgatagtcgccttcgtcggcgacggcgttaacgactcgcccgctctcgcagccgccgacgttagtatcgccatggcgtccggctctgacgtcgccatgaactcggctagcttcatcctcctcaactccaagctggataccattctccaacttgtcctcctcagccggcgcgtcttcaaccgcgtcaagatgaactttggctgggctgttgtgtataatctctgccttgtgcccgttgctgcgggcgtgttctatcccatcgtcactgggcagaagcatatgatgatggacggcgagatggtcaccgttaatgaccactggaggcttagtccggtgtgggctgcgttggctatggcgttgagcagcgtttcggttatctgcagtagtcttgctctcgcaatcgacgggcggacgatcaagaaactgttgggtcggtctatgtcttga

SEQ ID NO: 12988 - DNA, 1128 bp, A.fumigatus
cagggcatattgtcgatcgaacaaggtgactcgagtactcatgtccggagcaatacaagtaccagtgctgccccggggcctagggataacgacaacaatatcgttgcccaagaatccctgaatggcaacaacgacgaacccattcaaatacaagacaacgatcgaggaagagatcctattgatgagatcggaatcgaacctattatacttcctgccaatagtttcacaatccagctggtactggacacgcgtgaggtccgatcatccaaagaccgcgactacattgccaatgagctaagcaaaaaaggcatcaccccagaggtgcgtgccctggaactgggagatgcaatgtgggttgccagatgcaatgatcctacttttctttcacaatacggcgaggaatgcaacgaggtgatgctggattggatcgtggagcggaagcggatggacgacctcctcggttctatcaaagacgggcggttccacgaacagaaattccgtctccgtcgctccggtatcaagaacgtcatctacctaatcgaagagttcgccattacccacgacgtcggcagtgccagcgccatgaaatatcaggaaatgatggcatccgccatcgcctcgacgcaggtcgtcaacggctactttgtcaaacagacgcggaatctcgatgatacgatccgctatctggctcggatgacatatctcctgcagaagatgtactgcttttcgccaccaacacataccctcagcctgatcccaagccgtcaactgtcttcagctcagtcctatcttacaacacttgagcgacttcgagctcgtgatccatcggtaacatactccgtcaccttctctactttctccgcgcttacttccaaatccgatattctatccctccgagatgtcttcctcaagatgctcatgtgcacgaggggcgtgacgggggagaaggccctggagatccaaaaacgctggtccactccgcgagagttcgtcgaagcgttcgagagattggacgaaaagggtcgagaagatatggtatttgagcggacaaagacattagttgggcgtaagaagatgggcaaagttctcagtaagaagattgccgacatttggggtacgggcggatga

SEQ ID NO: 12989 - DNA, 480 bp, A.fumigatus
catgatggaaactctcaaccaactccttcaagacatagaccgacccaacagtttcttgatcgtccgcccgtcgattgcgagagcaagactactgcagataaccgaaacgctgctcaacgccatagccaacgcagcccacaccggactaagcctccagtggtcattaacggtgaccatctcgccgtccatcatcatatgcttctgcccagtgacgatgggatagaacacgcccgcagcaacgggcacaaggcagagattatacacaacagcccagccaaagttcatcttgacgcggttgaagacgcgccggctgaggaggacaagttggagaatggtatccagcttggagttgaggaggatgaagctagccgagttcatggcgacgtcagagccggacgccatggcgatactaacgtcggcggctgcgagagcgggcgagtcgttaacgccgtcgccgacgaaggcgactatcggccgtga

SEQ ID NO: 12990 - DNA, 219 bp, A.fumigatus
atcaagacacgaggtagttacaggaagctatttggcgcaagacgtgcggctcaatcaatctgtctccatcagattctcctgatccgattccttaacatggtcccgaacgcccctaagaaaagcttcaacagcatccccgccaccgagaggaacacctcctctatgcatgaaaccaccattttcaacagggatcttgagggcctcgcttatgcttggtag

SEQ ID NO: 12991 - DNA, 1335 bp, A.fumigatus
cataggtacggtttccacagctgcagtctgcaatgtctacattcggctagcgcattatacctgcctacgatggcttcgaatagccacaaccgcggccacaacgaagacaatgctcccacggatcaatcaattcctttacaagacctttccgggccgctggagcgcaatccgtctaggacaagtcgggtgggaaacagatttctgtcaaggcgttctttgagacgaggaggctctttgagtaactatgagaaggtgtcggaggagtcccctgttgaacccccgccagtcgcacggcgtgcacgtccgcaacaggctggccatggtaatgaagatgagttccatatcgaggatccggggacatttgctcaggcaatgtcggcggtgggcctcagtttcgacccgacacatagtaccacaacttcagcgcggcgccgcgaatctagctcagacttgataaatgtccctctcgatgactttgggccgcaggaagctgaacactacctttccccaaccgatacctacgaggatacggccccgttgaccgaccatcgttttcttcagcccatcagcggagcttcccaaaacttttcaggcggacaggatgaccgaggcagcacacacggcaaccgtttcccttctgattcgcgtccagagtcgcgtctgggtgacgatctgccacaccttgagagcggtttgggtcggagacgtcgcgggagcagcagcgctggagatagtcgggctcgttccttgtctccttcagccactgggtctgctttgcagcgggcgggttcgatgatgaagtcgatgtcgcagcgtgttgttaacctgagtaacgagcccgaggtggttgaacgagcaattatgagggaggaacagcacaagaatgcacgactcgaagagcctccgtcacttccctccttgagcggatatgcacacgatgcgccgtctgtcggaatgtctgatgatcaactaccgcggactggaacatccgcgagtaaagcgtggaggatgtacaacaatcccctgagaggcaaagcactcggaatcctgggtccgaacaaccttatacgggtgtggctatgcgacatcctaattcatcctttcatggagccatttattctggttgtgattattattcagacgatattgctggctctcgaatcggcaaagtcggtctgggatcatccgcgatctgtgcgttggggctctaatcctatggactacgcttattttgtcatctttgtgatttacaccttggagctagtagccaagatcctggtatcgggttttatcctccatccggccgaatacagtaccctagatccatcgatgggg

SEQ ID NO: 12992 - DNA, 234 bp, A.fumigatus
gtcttgaggctaccgaacgcgaaagcgaaacgctcctttggtaggagatttcgtcgtggaggaggagccatcgcttgctcctgctgtgagggagctgcgggcagaactgtgtgcgacaccctagagcaagtggacacccacatgcatgccccgaagggctgtggttcgagctactgggagttgaccctcgcgagtggcaagagaaagcccaaaatatatacaagaccagactaa

SEQ ID NO: 12993 - DNA, 348 bp, A.fumigatus
ccgcggttgtcgcttctctgccacagtatccgcacgatagcgtggaaccctaccggacagctcattgctacaggctcggccgatcgaacccttcgcatctggaaccccgagcgtccagcagtcaaatactcgacggaactgcgcggccattccgcgggcatcgagaaagtgttattcaacccagttaaagactcggagctggcgagttgctcgacggatggtaccgtcaggttttgggatgtgcgatcgaagacttgtgtaagccgtctcgatgtcggcggagaggcattcacgatgtcctggtcggcggatggcaggatcctcatggcgggaagaaaggtgtgttga

SEQ ID NO: 12994 - DNA, 897 bp, A.fumigatus
gccgtctcgatgtcggcggagaggcattcacgatgtcctggtcggcggatggcaggatcctcatggcgggaagaaaggtgtgttgaaagaacccatgctttacacttgggtcttcggaattcatcaacacgaactcggagcatgagccatgggaaagcgacgtgtcgaaagcggactgactttttcggatcccaggatgacaccttggtccccatttcgatagaatcgccctcttcatcacatattctgacagacggcatcaccaatttcccccttacatcatctccgacttcaaaagaaggaacaacaacctacaccgcactagaatcccatccacagcccgtccagaccaacgcaacgaccttctctcaccatatccccactcccacctctcccgacctgcatctcttcgccacaacaggcgaaggcacagtcaaaatcatgtcgtacccgtccttcgatgtcctgcacacccttcacgcacacacatccgcatgtctctctatagccctcgcgccgacaggccggtacctcgccgtcggcggcagcgacgctctgatttcgctctgggatacaacggattggatctgccggcgcacagtctcgagtagcaacgggggggcagttcgtggcgtaagctggagcttcgatgggcgttttgtctgcggcgcctgcgacgaggtaggctgcggcgggaacggcctggagatcttccatgctgaaacaggagagagcgtctacacggttcctacgggtggcagcagtgcatctggtattcccactgttgcatggcatccctcgcgttactggcttgcatattcgaccacggctgacgggcctggaagtgcgggtgccggaggactgaagattgtcggtgccgctggtggaagcttatga

SEQ ID NO: 12995 - DNA, 531 bp, A.fumigatus
gctgacatatgcacccaccccaagacttttgcagaaaaggctgcttgggactttgtcgagaaagagaaacccaactttgacattgcaaccatcaacccaccgttggtgctgggtccaatcgtgcattacttgaactcgctcgacgccatcaacacttccaataagcggattgccgagatggtccgcggccattgcaaagacggccttccgcctacgagcacattcctatgggtagatgttcgtgatgttgctctggcacacgtcagagctatcgaagtcccagaagcaggcggccaaagatttttcctcacggccggttatttctcaaataaggctgtcgctaatatcattcgcgaagcatatcctgagattgctgatagactaccccccaaggactcgccagatgatactccggctgatgtttacgggtttaacaacaagaaatcaatcgaggtcttgggaatccagtaccggtcattggagcaatcggttacagaaacagtcaagtcgttgttggctgttggggcatga

SEQ ID NO: 12996 - DNA, 1491 bp, A.fumigatus
  unsure (1310),(1350),(1476): Identity of nucleotide sequences at the above locations are unknown.
gcgctgccactcaccgtactcggcttggcatgcatggtgcaatcaacttttctcaagctcactccgcatcgaagagacaacatcgagaaattacaattgtctccaatactgcccatggcgacggctaggttatcgccgacggcgaatcttcttcggaagtcccgtctttttgcgcttccctcagccttaccgttgccccaacaagatgcaacctcgaagaccgttttcgaatccaacaccgcaaccttgcctcatccgatccgagcatccattgtcaccccggcttcatcgctagcgagaggagattggggtttgaagcgaccgcttcctgcaaaatcgacatcggaaaagtcgtcccggcctgtcatccgcctcaacgtactcgacacgtttgaacatgtcacagacttcgaatccgccgccgaccacacggtgaccttggagaaattccaggagcttcacatgcccatgtcccttccttccaaggtcaactacgcgactagcatggtgcctagacatcaaagccccttcgaatccgtggttgacaatacagatacgagcaaaagccttcaggagcctggtgctaaacagttcagacattctgggccttggctcgcgggacagacagaggcggaattcaacgcttatctaaataaagtgcgcgcgaggaagcctgagctacttcagaagcttcgtgaacacttcattaccaagcgaactgctgagcgcagaaagcaagcgcaggataacggcgaggatctagaagcacttggtccgctcaatgtcaccgaggaagagtttcaaaggtacatcaaatcgctgcgagccgatcccttctctcttggccccgtggtatttgaactgttggatcttccctcgccccctgccgtccctagcgaccgtatcgggcacaagtactaccagtctcctggtaccaaactctcctctgcggagtatgctgtatctggtcctccgaagacacacccttctgctggtctctcatatacgcggtctcacgctctgatctacaaccacccgaagttcggtccgcaggcataccaacgccctgtgcaggcccgtatcctgcggccgaaaggtcggttcaagggcaaaacatctaaggctattgccggtgttggtggtattgcggtggaagatcttaatgctatgactttcattgaacaaggctcgccagcaggtcttgggtacttcgacgcatctatacctggtggtgcaaagtactgggttactcccatccgtgcttcggtggactcggatggtaaaatcgccctcgcgtcataccgggctancgccactgctaaagcgccttatggtattgaagaataccanaaaccaagctcgaacagtatctccccggggcgctcctaccggaccaacgttttggtgtcccagttgggaccttttggcaaatttgtcctaatgttcggaaggggaaaggattcttcgggagattancccgaaaaaagttga

SEQ ID NO: 12997 - DNA, 507 bp, A.fumigatus
tgtcactggcgtggtccgtccggcagctctaggctaatcgcttttaaggctgtcaaatctaatccaccattcgactatgtccttcacactgcgtctcctttccactttaatgttatcgatcccgtgaaggactttctggaccctgcaattaagggaacaacaggtattctcaaggcgatcaaggcctacgcaccaacagtcaagagagtcgttatcacctcatcttttgcggcgattatcaatcccaagcagcatgcaaaggagtacagcgaggagaactggaaccccgttacctgggaggaagcgctggatccttctgcaacctacagaggtagtaaggtatgtatacagcctcgtatttcgcattgtgctaggctgacatatgcacccaccccaagacttttgcagaaaaggctgcttgggactttgtcgagaaagagaaacccaactttgacattgcaaccatcaacccaccgttggtgctgggtccaatcgtgcattacttga

SEQ ID NO: 12998 - DNA, 183 bp, A.fumigatus
ttacatcgctgtatcttggaatgcggcagaaaggtatattattatactgatctcatcatggacttgaaagatggttcaaacatttctttccaaggctcaaaatatatatgcattgagctctatttttacattatgctcgaccttttcttgctgttcatgccccaacagccaacaacgacttga

SEQ ID NO: 12999 - DNA, 1668 bp, A.fumigatus
agagggtcacaaaagcaaggacaagattctgtagacgcctcgacgactactgacataggccacgctttgatcaatcagctgcgtgtccgagaaaaggagcgcatcatcgagacgcgcatgacacagttagcgttcattgagctccaggagggcccggaggctgctgttaaccacagcggtcagctactcagcctttttgcaacgctattcaacaaactggagcttcaggctgatgaccagaaggaccgtcaaacagagcatctcgtgccaccgaaaagcgccgctggtacagtcaagagtctgcgaggcagtatatttgggagacataaagcctcacgcgcttccgaacgtaaagccgaatctaccggtgaaacgcagcctatcagcaccagctcttcgattcacaacgagcaaatgctcaacaccgatcttgccccagcaatccaagttactcaagagcagaatgggaatgctgaggatccgcaaccaccggctagatcagattcgacacggcaaaaattgcggaagcgcagcggtactctcaagaagggtgaaggtcaaagctccactcaaataaacggcactgaagatccgaccaacgcagtcagcacggctaccaacgggagtgcgacgctgcagcaaccaggaagcagggaaggccttgctcaagatgctgtcggtcttgcggtatcaagcaccgcaaaccaaccacagagcgcaaagcaacctctgcgacccgtcgctcataacatgaattgcaaacaagcgcctcctccgacgggtcaccccaaacaaccacccgagcaagacattcgattaccttatagatttgactctccgacaaaagcaattaccagattccccgctgtccaatcgcaaaaacacgctctttcaatcctgatcaaaatttggctcctgatcgcaggcctctatcgacgcgcttcgctatttgaggatgcgcaagaggcatgcgaagaggccgccaaacatgtcgaccgagtggaagctcttgttgctgcccaggaatcctctgccagagcgtttagaagtcgtggttgggcttcaccgaaaagctctgacgaactctgggccgacctgcacaccgaacaggggctcttggcacaagctcaatcacgccctcatgacgcaatggagctcttcgaagaagccttggtgcgtgatcccgaccatctcaaagcgacggtctgcctggcgaatctactcctcgacatatgggaaaggaaaatgcctttgaaccgaccacatacagatgatcttcatgcggagatgtcgacactatacctacccgccacaacccagaagtccagtgctaccttgaacaagatacaatatcaggagtttgacaatttggataatcggccaatgccgtcaaaacgacagtctccaccaactgacgttgaggaggatgaacctaaactgctcaaccgtatcgccgcccgggaccgagcctacgtcctcctgtcggcgttgacaaagcgtggcaccgcctgggataactctgaagcttggtttgccctctcccgtgctcatgaggcaagcggagatgtcgaaaagttgaaggaggttttgtggtggtgcgttgagcttgaagatcgacgaccaatccgacattggtcaaacataggctccggcctctatgtcctttaa

SEQ ID NO: 13000 - DNA, 216 bp, A.fumigatus
atcaatgtgttgtttaggcatgcctggctctcttacatggtggatgcgcctcccacccaagacaagatcctgcagactggtctccgcgcttgggaattgcccgagcacaggcctaacccgactctcagccgcggcgcttacaagccctactcgacgttagtatccccccttacaggagtatactatgaggctcttcttcgaatgcgcaaccactaa

SEQ ID NO: 13001 - DNA, 2199 bp, A.fumigatus
aagccttgtaaggatcaaaggaatgagctcgttgaagtagcttacgcgcagtgcgatgaagtaattgccaaatataaggctggaacacttgagaaataccctggttgtgatgagttgcagactatggagaatcaactgtctggtattctcagcaaggtccgtcaacaggcaggtgacgagtgtatcgctcaacttagcaagtacaactctcctttgatcatggctacttcaggatcgaagggttccagtatcaacgtctcgcagatggttgctctcgtcggtcaacaaattatcggtggtcaacgtgtgcaagacgggttccaggacagaacgctgccccatttcccgaagaacgctcgacagcctccgtcaaaaggtttcgtgcgcaacagtttcttttctgggctgttgcctactgagttcattttccacgcaatgtctggtcgtgaaggtctggtcgatactgctgtcaagacagcagaaactggttacatgtcccgtcgtctcatgaagtctctcgaggacctttccagtagatacgatgacaccgtccgaaactcttcagatgccattgttcagttccaatatggtgacgacaagctggatcctgtcgatatggaaggtaaagctaagcctgtccactttgaccggactttcatccacgctgagtccatcacgtacgataacgacgagcggagtctgcttccacacgaaattatggaagtatgtgaagagatgctttccaaggaacgtgcaaaattagttcgcgaagatctgctgggcaataagcttgcctacatggatagaagcgaccacggggtcgatcaattcgagagcgcgcgtgacttccttgagtcgattcagcaatacatatccagcaaagctgacaaactgatctctcgtggcggtgatattgatccatcggacgagaggagccagaagggcttgaaccacaccggaaagctgacagagaagactctcagaaccttcattacgtcatgtttgatgaagtacaagaaggctcaggtcgagcccggccacgccgttggtgctgttggtgcacagtcaattggcgaaccgggaactcagatgaccttgaagaccttccactttgctggtgttgctggtatgagtattactcaaggtgttcctcgtattaaggaaatcatcaacgcatcgaaggagatcagtacccctgttatatcctgtgacctcgtcaccaaagacaatgtcatcgcggcacgtattgtcaagggacgtattgagaagacatacctaagggatattattcattatgtccgagaagcctggactggcaaggaggcctaccttactgtcaagattaactgggagaccattcaaaatctggcccttgagcttaaaatcaggaacatcgtcgacgccatcaagaaccacaagcgtttcaaggccgatgatttgaaattccgaagcaccaattctcatatccatatctacatggacattgaccctgccagcaaagcttctctatccaagaccgaaattgcagcgaccagtgcggatcctttcctccgcctcaagcatctcaagcgcatccttccagatatacaggtgcttggtcatccgcaagcaaaccgcgccatcatccgtaccgacgatacatccagcaccaatacactccttgttgaaggctacgggctgaaggaatgcatgaccacgcttggtgtcaatggtctccgcacttctaccaataacgtcatggaaatgcgtgatgttcttggtatcgaagcggccagagtcacgattgtccaagaaatcagcgaggtcatgaaggacatgggcattgaccctcgtcatatgcaacttcttgctgatgtcatgacgtacaagggcgaagtccttggtatcactcgtttcggccttgcgaagatgcgtgactctgttctgcaactcgcgtcctttgagaagactgcggaccatctgtttgatgctggtggtgctggtcgtaccgatctaatcgagggtgtctccgaatgcattattatgggtaagaccgttagtctgggtaccggcgccatggaggtcgtgcgtaaattgaacttctttgagggccagattggtcggaagaagaccacttttgaagacgtgtgggctgagatatatgaggagcctgtcgacgctcagaaggggagaagggtcagaaggaaaatccgagcttga

SEQ ID NO: 13002 - DNA, 1092 bp, A.fumigatus
accgcgtgtatgaggctgagtcgaagacgctggagccgtggattgattctccgggggagatcagcacctatgactggcgggatttccttggacggcgggagtatgtctctctgggtattgcgtgggatgagttgcggaatgtggctgatgtggcataggtaccagcgggcgtttgtggatttctttgaggacgagcttgtgcggcacgggtatgactggaagaaggtcgtagcggactatctgttctccggcaaggaaccactgtttagttcgcttgttgctgatcgtgagtggttgcgatatttgcttcaggagggatatgctgatgttgtgcgtttagttgggcatccgttgattcatctgggttatgcctttgagatgtccagtcgggaggtcgctatggaggcgttgggtcttgtggcgacttgctacagcgacatacacaagtacattgatgattcatcttattctagggcggactcgtcgtaccattcgtcatcgctttttgagatcctagccaaggtccgcgctgacaagcgctttaaaggggtgtttgcaacaccaggggaccataacttggagactctcttccgacaccacgaggcggccctactggaccattggaacgcttggaagattgaggatccagtgcctcagttccgcgaaagccagcaactcgccgccgctgtgctcactgctacacaagcagatcccactgagaaatacgatttcttcctcgtgcatatcctgaccaccagccatgctgtccggatcctcctgtcgttgattcctgcgcggtttcaagttccactcgtcaggcagtggtggctgatgacgctggctgtgtacatcgcccagctcaggccggagatcgatcttggccgaattcgaaattacgacccgcaaggaagagactggaaatggaccgccaagcaagcagtcaagagcaagcattctacggacgcacattatgtcaaggctctgcgtgctatgcgggaggctgcagcaacatggggagactcggatgggctttatctaaaggcagctgtgaaatttgccgaggagttcgacggttggggagggtttgtgtaa

SEQ ID NO: 13003 - DNA, 204 bp, A.fumigatus
attctgagttcagcgtttctccaaggtgcagatgcggatgatctgaaccgcgtgtatgaggctgagtcgaagacgctggagccgtggattgattctccgggggagatcagcacctatgactggcgggatttccttggacggcgggagtatgtctctctgggtattgcgtgggatgagttgcggaatgtggctgatgtggcatag

SEQ ID NO: 13004 - DNA, 732 bp, A.fumigatus
ggattacaatctgtcatgcctagttccccagagaagtccgagacagatgtcgacgcgtccttgtatcttcacgccgaactcctcccgaacatccgtcacatcacattttatatctcaataccggccaatctaggtagccagaacatccagcccctgataaccctctcagaatcccgtcgatctgtctcggtatctttaccggcccccttcgaccatgtggcagatactatcaagctacccgcgcgggttaatgaagcctcgcggcgcgttctagccaccagtagacagggcgatgcagctacagcggataatgactcgggagtcaggcgacgtgaattctccttccgaatgcagattgatgagccggacgattcacttccgtccaaggatccgctcatcgatgacttcgttccctggaccgcggcagatatgtctccgtcgacgagactgcgttgtagcgggtgcgagaatgtcattctgaataatcctcgatgcgccgatgggtctggggataccagtccagcaggttggacgtggaaggacctgccgagcgggaactgggccgagatgatggatttctggcattgtcataaaccgggaccctcccgagggccaccgccatgtggaagaccccaatgctcagacgaagggatacggcgcggcgaatcaggaggtggcgacggccgggacggtcatcgtggatgtggcgacgtttcttgtgtcggaggctga

SEQ ID NO: 13005 - DNA, 324 bp, A.fumigatus
tcaattgaattgctggccatggggatcttcagtcgcttcctcaagctaaccaccatcggcggcgccgccacggtcggcgggttcttctggtacacgcgcaacgacgtcttcgtgccgctgcctttaaccgatcgcatcttccactccgcccgtttcaatgcccttaacccccttcgcaaccctaccacccatgatctctgcatccgcagagtccccttatcagacattgaccccaccctcctcgagaagaagggaaaattagtcgaggccttttgcgccggagtctggagcggctggggtaggcaggcaccttgcaacttttag

SEQ ID NO: 13006 - DNA, 492 bp, A.fumigatus
gcaggcaccttgcaacttttagctcacatcctctcatacaagccaacaacactaacaactgcaacgtcaggctacgcattccaacgcgcctacctcgcccgcaaataccaaggccccgaaaccgccaaccagctctggtcccgctccgagctgcgctcctccacctacgaacccggcaccctgatcacggaccacttcgaggtcgtcgagaagacccccgaccggatcgtcgtgcgatgcggggcgtcgccgcgtgtgcaggaggtccggccctccgatggtctgtttgagatgtctgtggaggtgaagcccaacgagggggtggcggagtttgggctcaagagctgtttcttccagggtctggggaagggcggaggcccagccgatgcccccgcatattgtttggttgcatcagcagtatacgaagttgtggatggaggcggcgattcggaatgtgttgcggtgatctcctgtcttgttttgtatatatga

SEQ ID NO: 13007 - DNA, 432 bp, A.fumigatus
gatcctacaggcacttccggaaaccggtctcccagggcggtcagcacgggatccttggatgactctgacactgcgcaaggcgactccgaagagcagggctctattgcctccgcatctgttgcgcattccacaatcccagtacccgcctcatccagcgctgctgcacttggtggctcttctatcgccagttctttcgcttcgtctcgccttattcccagacccactggaagttctacagccgcatccgccactgccattgccacctggtcgccgacagctggtgaaagcgcttcgggcacggcaaaagaatcggcgacactgacaacgccgtctgaagtgtttttcactcctggcctcagcaatggcgcaaacagaatgtcggttggcctttctggtctgatcggtgttatgttcattgctgctctggcatag

SEQ ID NO: 13008 - DNA, 663 bp, A.fumigatus
aatctccccaagaattattatacatggttgacgatgatgaaccagaggggaagagggaagaactacggtaaagatccactgcccgaccccgcattggggtatcaccatctactccccggtggttctccagatcaaccagacccaaacaaacaaacaatcatcagacatccgaccaactcgtttctagagataacaatgatcctaccagcagaatcaaacatccgcttcaacgccgaagccgccaaatgggacgataaccccttcgtacatgaagccacccgcctagcctacgaaaccctccaccccctcatcacgactctatcaaatggccgcgaccaaaccctcgatgtcctcgaagtcggctgcggaaccggcctgctcaccctccgtgttgcgccgcacgtcaagcacatcgtcgccattgaccccgcagaaagcatgatcgacgtcctgaacgcgaagctctcagaccctaccgaacccaaaaacctcacgcccgctctgccactttactctccaacccaagaagaccccccgctgcccccggcgaccggaccctggtattccgggccaccggaccgggggcccaaccggaaatatgacctcatggcttttcccacctcgctattgctaatggcccccgacctgcgccttattccttga

SEQ ID NO: 13009 - DNA, 288 bp, A.fumigatus
atctcacttcaaagtccggtaggaacgcggccagtgtcgtcccactatccaagaaccgctcctggtcaatcgggtccgcaccatccggcagggccatgtcgaacgcccaaaacaaacgagcagtggccaggaacaacgaatcctggcccatgtggcgccccggacacgcgcgctggcccattccatacatcaactgcggcaagtctgggttctcgatccatctctctggctggaacgcgaaggggtcgagaaatattgcctcgtcgtggtttatggcccacacgttga

SEQ ID NO: 13010 - DNA, 198 bp, A.fumigatus
gtttcagttcctccccgggatttactgcttcgagggggagtctcattaatgcaatactctgatagccccgatgaggactttgagaaggccgcgcacctttgcgcctatgtctcctttgcctacaagaacggcggtgcctacgtgacgctctacaaccacagtttcaaccctgtcggggatgtgtcgttccccaattga

SEQ ID NO: 13011 - DNA, 660 bp, A.fumigatus
  unsure (201): Identity of nucleotide sequences at the above locations are unknown.
aatatgtcccgaagttcgccaccacttgcccggacgttcggcaacaccattctcatcaccccgttcatccacgccatctgcgaggcctatttccagcgcacgggtgattactggttcagcgcggccttcttccgcgaaattgaatcgggaatgcccgcccagccgttccaccgcgacgatgccacccacccgctgatgcantaccagcccttggaagcaccgccgatttccctcagcgtcatctttcccctgacagagttcacggaggagaatggtgccacagaggtcatcctcggcagtcatcggtggacagaggtcgggacgccggagcgtgaccaggcagttctcgcgactatggacccgggcgatgtgctcattgtacgacagcgtgtggtgcatgcgggcggtgggaatcgcacgacggccggcaaacctcgacgggttgttctcgcgtacttcaatagcgtccagctgaccccattcgagacctaccggacgatgccgcgcgagatggtcgagtcgatgactgttctcggccagaggatgctcggctggagaaccatgaaaccgtccgatcccaacattgtgggcatcaacctgatagatgataagcggctggagaatgtgctgcagttgaaggctgctgattcgccggcttag

SEQ ID NO: 13012 - DNA, 636 bp, A.fumigatus
ccatctgcagggcaaatctggcaactgactatggagcgactcccgctgtcccccgctgtgctcttcctcatcatcgccctccccattctatacctttggattcgatacacagcacccgccaggccccatgggaagcacctttccctccccccggggcctccacgactccctaagattggcaacctccaccaggtaccccgccagatcccatggaagaagtacaaagagtggtccgacacttacggccccatcatgtccgtccaactcgccgacaccatcgccgtcgtcttctcctcatgggacctcatcaaaaaccatattgaacgccggaacacaatctacagcagccgaccctccgtgcccttcttcctccacgcgacaggtggcctgaatgcgtcgattctccccctacggtccggaatggaaactccagcgggccatccgcagctccgtcctcaaaccctccatgacggtcaagtaccgcgacgtccagcatgtggaaacgacgcagctcctgcacgagcttctgtccacaaacgacttccccgtttgtctgcgtcgatgtattgccagtgtctttctgactgtggcgtatggggagcgatgtgtcgatcatgccgggttggaggcgattga

SEQ ID NO: 13013 - DNA, 363 bp, A.fumigatus
ctatggagcgactcccgctgtcccccgctgtgctcttcctcatcatcgccctccccattctatacctttggattcgatacacagcacccgccaggccccatgggaagcacctttccctccccccggggcctccacgactccctaagattggcaacctccaccaggtaccccgccagatcccatggaagaagtacaaagagtggtccgacacttacggccccatcatgtccgtccaactcgccgacaccatcgccgtcgtcttctcctcatgggacctcatcaaaaaccatattgaacgccggaacacaatctacagcagccgaccctccgtgcccttcttcctccacgcgacaggtggcctga

SEQ ID NO: 13014 - DNA, 1221 bp, A.fumigatus
atgcgtcgattctccccctacggtccggaatggaaactccagcgggccatccgcagctccgtcctcaaaccctccatgacggtcaagtaccgcgacgtccagcatgtggaaacgacgcagctcctgcacgagcttctgtccacaaacgacttccccgtttgtctgcgtcgatgtattgccagtgtctttctgactgtggcgtatggggagcgatgtgtcgatcatgccgggttggaggcgattgaccggctcgaggagctcaatcgcgctatcgcactgcatgcggaggcgctattctctggtgctgctggtattctcacccagttggttcttcccaaagcactggtcgatcggctgccggtccggtggaagaaggacgctgatatgctgcacaatcggctgacggctgacctggtggcacggacgagggctgcgctggtccgaccgggctggaattgggtcaaggaattctccatgaaggacggaattgggagtggggatggcgacggggagcagggaagtaaagtcgggttgaagcgtctcgcctatatggtcgggtcgctgtatgaggcctccatggctgcgtcacaggcactccgagttatcatcctcgctggtctcttacacccggatgccacgcggcgcatgcacgacgagctagacgcggtggtcgggacgggccgccttccggacttccacgatgcggcccaattgccctatacgcaagccttcatcaaagaagccatgcgttggcgctccctaacacccatggggtcaccccgtgccacatccgacgaagacgactgcagaggctaccatatcccatgtggcgctactgtcctcgtcaacgtgtgggccataaaccacgacgaggcaatatttctcgaccccttcgcgttccagccagagagatggatcgagaacccagacttgccgcagttgatgtatggaatgggccagcgcgcgtgtccggggcgccacatgggccaggattcgttgttcctggccactgctcgtttgttttgggcgttcgacatggccctgccggatggtgcggacccgattgaccaggagcggttcttggatagtgggacgacactggccgcgttcctaccggactttgaagtgagattcacgccgaggtcggagaagtatcaggaggtcattgagaatagcatggctgtgttaccggatgtcttgtcgatttctgcgactccgtag

SEQ ID NO: 13015 - DNA, 300 bp, A.fumigatus
  unsure (49),(95): Identity of nucleotide sequences at the above locations are unknown.
aacacaattggcttgttcttgttctgctcatcccgggagaccgtcctancttgcggaaagggttcactcaaagctaaactccagggtttccacanttatttcgattcccaacttactttcatcgtcccttgttcccccggttccacaccctggttgcgctgccgaacggggggagtcacaaataaaatcccccggttctttggttccaccgaaattaacttcttacattgggacgggaattccccggcctttgatttttcgccgaaaatgaatccccccaaattgaatgtttatttggcc

SEQ ID NO: 13016 - DNA, 363 bp, A.fumigatus
atcatcttttcggtcattcccctcttggccgcaacaatatacgtcccaccgactatctcaagctcatcgactttatctgaaaggcttcgctccatgctaagtgtcatttccctgttgttgacggcgtatattatgaagtatcatgcaatcgagcgtccagaccccaaagggaaaaggccaatcacaaaggcagacctcataacgtctgccgaaaaatatgctatccctactaacgctgcattgtgtgcattattggcgcttacctctattatggcctcgccgactgcagtcgttacatatttcattccggccggtgagtctcgggcccgccactacctttctgaccaacatgttctggcctga

SEQ ID NO: 13017 - DNA, 1266 bp, A.fumigatus
  unsure (1),(47): Identity of nucleotide sequences at the above locations are unknown.
ntgtggaaaccctggagtttagctttgagtgaaccctttccgcaagntaggacggtctcccgggatgagcagaacaagaacaagccaattgtgttctattcggttgagcattactcaaagctcgtgggggacatcgatgggaaaagtatggatagcaagcaacagctgttgctcaaagactttgagcatcttttcgcactgtatactcagattttgctatctgagagcttttcacaggatgaagcggaagagaaggacatcgaatacattcctttggacagtaacatcacctgttcatactgcaggtgcaatatttttaatcgattcctgacttgcccgtggtgtgcgggtggacagactgccgacggcgaggacccctacgatatctgcatggaatgttatgtcatgggcagaagctgcgcttgcctctcgagattgaagtgggctgaacaatttccttggagtgagctgacagggaactatgaaaattggcgagaccaaatatgtcggctcaaccagggcaatccgaacggtcagatcttccggcctctcgccgaggagcgagctcgctacggcaagaaaaccctagctgagatgtgccagggggaattgaaaagacgaccgtgggttgatatcaccaaaccagtgacgcgcaagatcgaggacaatttgagtgatccagaaagccccgctcgaaaacgaaggaagactcgcctcagccacgaatctgaaaagggtggtcgctgccatatctgcaaatatattgagccgaaatggaagctcgcttcttgtgactattgcaaccaaaactactgttacggtagtctgtttagagccttcaatattcaaccacatgaaaccatggaagtgtatcgttggatgtgccctaaatgccaaaaggtttgcagttgcgcagcgtgccgtcgagatccctcgatgaaaccattcgaaccaacctgtacactactcggccatgatacaaggaaaatagcggatcctcgcagtgtggaaagcttggtcgacttccggcagtcgaatctcaggtggttgaaaaaagcaggcgacaatgagatagaaagactgaagaagcatcaaaaagaggcagacgaaaagcgtcaacaggctatgatcgaatatagtattcagttggaggattctcctcgagtatccgcccatgcgacggaatatggcgacataccagtcgatcctgtattggaggaattaagtggctcaattcttaccccgccagattcgttcactccttga

SEQ ID NO: 13018 - DNA, 534 bp, A.fumigatus
ggcaaaacatttcaccatctgggctaccgctcactgcatgacggttgtctactcgttactcgtcttttctcggcgccttttagtcctttcacaactaatctgacaatggcactttatactgcgcaaaggcgcattggcgttccacgagccttcctgtttcgtcgccacaatatgcctcctcaccgctgtctcattcctgctcccaaggctaactcgggccctttgatggagcgacgggcggatcgagagctcccttctatcaatactgagaaacgccgatggatcaagacgctgccaatatttgtggtagttgtgggagctgcaatgcttggcatatttaattaccagaagtcgtcatcgagcgtcgtgagcagcacgctatatgcccttcgaacatcacctcgtgcacgagaaatcctgggagatgaaatttactttgctcaaaagataccgtggattagcggggaaatgaatcagcttcatggtcgtattgatatctccttttgggtgaagggaacaaagggtcagggcaaa

SEQ ID NO: 13019 - DNA, 1089 bp, A.fumigatus
gtatcttgcgcgatgccaggcgtcgtcgatacgcccggcgggcctctgtggcctggattgggattcactgtcgcacaccagaaagttgaactggagatagattttgcgaccaaaagcctcaagggaaagacagaaataacgatccatccgcattacaaggaacttcgaatcattcgattgaacttccgacagggcgagctgaaacgcttaaatgtcaatggaaaggcgcctacaatcaaatatgcggatccatatgaatccctccagctgtacggccctcattatcatcagcgtctatcgaccaagatcgatagtttgctcacgactacccccgagccggacctgcttgtgacgatcccgaaaagtgttcggattgaggagctcgatcctttctcgcaggaggcccaggatcaaatgactttgcgtgctagtggtgcaggagaagacacggatgggcctttgggttctaaactggcagaaacttcattacctcggttttcagcgctcacggtctacatcgagtttacgattgagaatattcgggatgggctacaatttgtcggggtggatagcggcgacaggcgctatccgcatgcttacacaaccaactcgcttggttacggtgccgcaagccccctgttcccttgtgttgacgaccctctgtctcgttgtacttgggaaatctccgtcaaatgtccgtgctctttaggcgatgtcttcgaccgcaaaactcgggatccgtctggcgctcatcgttcaaagcagacgcctgggggtagtcgattcatctctccagacgacgagactcttgacttgtcggttgtttgctctggggatatgacagatgagatcgtcgacccccgggatcctagcaagaaaacggtttccttcgcatgtatgtcgccgctttctgccaagcagattggcttcgccgtcggtccctttgaatatataaacctctccgacttccgtgagagcgatcaggatgagcagcttggccagaacgctattcctttgcacgcgttctgtctcccaggaaggggagatgaagtcagaaacacatggtttccccatggcgaaagctattga

SEQ ID NO: 13020 - DNA, 198 bp, A.fumigatus
cttgagactgaaaggcaaaacttctacgagtctatttcgattgcgtcttcctattttgccaacttcgctcctgctcacctcgacttttccccgccgttgacgaacctttattcattgacaattttcccaaccttattttttggacgtatcatagggaagtattacgagaggaatggttgctcattgagctggacatga

SEQ ID NO: 13021 - DNA, 339 bp, A.fumigatus
  unsure (257): Identity of nucleotide sequences at the above locations are unknown.
acctctccgacttccgtgagagcgatcaggatgagcagcttggccagaacgctattcctttgcacgcgttctgtctcccaggaaggggagatgaagtcagaaacacatggtttccccatggcgaaagctattgactttctttcgctgacttatggctcgtatccattcgcaagttacaaaatatgctttgtggacgacgctcccgaaaacacgctgccaacggcgtgcttgtcaatctgcagcaaacacctcctctntcctgaggatattatcgatccaatgtatgactcaacgcgagctcttgttcatgccctatcatgccagttggatcggtggtca

SEQ ID NO: 13022 - DNA, 300 bp, A.fumigatus
tcatcacataggctattctataaactaatcgatccattttctcatcatacagcgactcaagacacgcttaccgatgagattttgatgcccctgaagagttacaagtaccagagcgtggataagtcttacatctcgaatcacatccttaagcattacgtattatgtccattgttcctcccacataccatacgctctcgctctgacggaaagattgtcacgctagtggaatgcatttgtcgaagtcctcccgctatggattgtcttacacgacgggcggactggaaggtaaatgaaccctcc

SEQ ID NO: 13023 - DNA, 483 bp, A.fumigatus
tacatcgcctacgaagacctcaagacagctgtcaagaccgggtacgtcagcgaacctacctccgaataccccaaacccgatcgcaagccatggacagaagaccacgagaagcgcttcgtgtcgctactggagagcgagctggacaaggtctttaatttccagaagctcaagagcgaggagatcgtgcggcgcatccaggccagcgagaaggatgtggccgatgttgtctcgcggctggataatgcgaataattcgaggaggcagagtctgcggacatcgcagccgccgccctcagatgaggattttctgctgctagagcaggtgctgagtgacatcatcgccgatgtgcatgatctcgccaagtttacgcaattgaattacacagggtttcaaaagattattaagaagcatgatgtatgttctgcatctagagctcttcttgaatgtttttggtacaacgttcgagaggctaatgtttgttag

SEQ ID NO: 13024 - DNA, 294 bp, A.fumigatus
aaacaaacggggtggcacctcaagccggtttttgccgcccgactcaaagccaagcccttcttcaaggacaactacgatgcattcgtggtcaagctctccaagctctacgatctggtccgcaccaagggtaaccccgtcaagggagattcggcggctggaggttcgcagcagaactttgtccgccagaccactaaatactgggtccaccccgacaatatcaccgaattgaagctgatcattctcaaggtatgcaaagctttgtctttatttgtatctcgtcaaacgttaaactaa

SEQ ID NO: 13025 - DNA, 453 bp, A.fumigatus
gtatccttgtgcccttttctgtcagtccaaattctcacgcatacaggcatccacgtccccgtccgcgtcgaacccaaggtctatttcgccgccgagcgaaccttcctctcctggctcgaattttccatcctcctcggcaccattgctgcgactctactcaacttcggcaacgactacatcaccttcgtctcctcgtgggcgtttaccatccttgctgcagtggccctcatctacagtctcatgctgtatatctggcgtgtcgacaagatccgcaagcgccgcgacgtcaaacgagtctactatgagaaatggggccctaccgtcgtcggactcggtcttgtggttattatgctggtgaactttggtctgagagtacgtcagactggctttgccgctcgcgacggagaccagggctttggtcatggtcggggatcggccggcggagaattgtag

SEQ ID NO: 13026 - DNA, 1680 bp, A.fumigatus
cagcaccttcctgtccttgtcttcaatcccaacaaggagtttgaggaaaaagatgccgccatttcatccatttactttgacaacaccaacacatgggagctatacgagggtcgtttgaaaaagactgaaggggcagaggccattcggcttcgttggtatggcggcatggaaagcgaccagatcttcgtcgagcgaaagactcatcgtgaagattggacgggtgagaagtcggtcaaggcgcgtttttcgctcaaggaaaaacatgtcaacgcctatctgtcgggtcgcatgacggtcgagagcatttttgagaagatgcgcaaagaaggaaagaagagcgaacaggaaattgccgacttggaacagttggcgcgcgaaatccagtaccgggtcatcacacgtcggctggaacctgttactcggaccttctatcatcgcacagccttccagcttccgggtgatgcccgagttcgaatttctctggatacagagctgactatgatacgagaggataacctggacggccggcagcgctcaggcaacaactggcgccgaatggacatcggggtggactggcctttctcgcaattgccgccccaggatgttgagcggttcccttacgcggtgctggaagtcaagctgcaaacgcaagctggccaggagccgcccaagtggattcgagagttgaccgccagtcacctggtcgaagcggtcccgaaattcagcaagttcatccacggaactgccacgttgttccccgatcgcatccaccttcttcccttctggatgccacagatggacgtagacatcaggaagcccgcgacgcgtcgattcggtatcacccggccactggccagcacgtctctttccgccaatgaaacgccagaagacgacgaatcggacgaggacgagtcggacgaggcccaggcgcgtacgagggctgccacccgcgatgcacagcactcagtggtcgaccagagtgacctgttcgaagacaacgacggcaatgctctggacatcgaagagcgcatcgccgcccagccactccccggcgacgaagattatccattgtatgattcggacgaggagtccaattactcggacgaactagaagaagcgcgaaggatcggtggcggctactactaccagaagctggtcgagtactacattcatcgtatgggccacgcactgatcaatgggctcaaggccattgcgcccgggccgcggcccacggacatgcctgaacccgaacagaacggcatcaccgtcatgggaaacaaacggacgatcaagcgattcgtcgctccaaagggtaaacgtaggtatccttgtgcccttttctgtcagtccaaattctcacgcatacaggcatccacgtccccgtccgcgtcgaacccaaggtctatttcgccgccgagcgaaccttcctctcctggctcgaattttccatcctcctcggcaccattgctgcgactctactcaacttcggcaacgactacatcaccttcgtctcctcgtgggcgtttaccatccttgctgcagtggccctcatctacagtctcatgctgtatatctggcgtgtcgacaagatccgcaagcgccgcgacgtcaaacgagtctactatgagaaatggggccctaccgtcgtcggactcggtcttgtggttattatgctggtga

SEQ ID NO: 13027 - DNA, 1311 bp, A.fumigatus
ggagaacccattcacattgtcatgtccaaacctctgtctccgttgccgacctcgcgccaaaattcgcgggccttttcgtcgggcttgaatggattggaaattgaatccttggtgaacgagagcggatccgagaatgtctttgcgagtccgaacaaaacgattgacggcggcgccgatacaactaccccccaaagtgggcactatccagctacgtatcacacgcaggaatccatcctggatgtcggagatctcgagtctgtcgatgaacagcccagctcgccatttcagtacgacgctcgagaccctacagttgactttcgggtcctcggtaaccaacaaatctcgagtgggctgagagagtgctctatgactcccagaaagcgctcctacagtcattgtccagaagatggggatgcgacggacaggtcaagcgagagaagcaagaagggaatgagccgacgtgacatgccagacattcaagtctacgccgatgacgagccccaaatgcatgaaagagagatgacaggacgcactgggcacgaaattgccactagcatggttgagcaaaaacgcaacgagggaatgagcactgtccttgacgtacataataactacgatgattcgttctccgaaaaagagaacctggatatgaaggctgcagacgatgttatgaatgacgactctcatgatcccatggatgacacatgtttcagtactttctctgccgttcctaacgtggacatgacgtcgttcgcgaacctgcgagggaattcaccattcaagacaggccgacaattacccagcagcccgggaagaatggatgaaaatcaatccagaagccccgcaccagctacccctgatacttcgaggaggtcacaaaggcaatccgcactcatcgatatcggcacgcccatcgcttctactcccagggggcgagaacgcagggatatggaaaatgcaagcgaaacgccaaacttgcttgacctgacagatcagcccaacttctttccacgacaacgctatagtatccagaaggagagatattcaccctcgcgacgttcgccgctgaggactctgcgggaatcaattcggtcccctgcaaaggtctcgctgctcgactttgacattcctccgattccgacgcctaggtctataccgaccgtcacaccacgggagctggaatctttgaaatccgggttccactctgaaatatcgtcactcaaagcaacgctgagcgggaaagaagcggaagtctccagcctgaagaatgctgttgcagatgctgaacggcgcgttgggcgaagctcttga

SEQ ID NO: 13028 - DNA, 1155 bp, A.fumigatus
gcgaagcgggcagacagctatccatatctgttctccgccaacggtctcttcggcaaatttccctacctgttaccgaatctggtctgctccttcttactccttctcagcatagctggaagctggttgttcttgcaagagaaccatcctggtctgcagcatcagaatgctgccggaaaccttgatcatacatctgctgaaagtccactcctggccaccgcaggagcgacagccaatgcaggtgtagatctacgtgcggaatcatatggtaccttcaaccaagttcgcttgcaggcagatgaagactggtttgtgaatgccgacggttcgaaatacaagacgcaaaaacaacctgttttcacctaccgagttgtctcgctcatcattgcgttatccatctttacctatcactccatgacgtacgatcatctcttgcctattttcttgcaggataagaatggcaggaatacttcgggcttcagtaacgcgccatttagcttctctggcggactcggcctttctacacggacagtcggccttattatgtcttcggatggcatcattgcgctcgttattcagagttgcattttccccattctggcccagttactgggggtctggagactattcgtggtggtgactgtgttgcatcctctcgcctacttcatcgttccattcctcattttcctaccccaaagcttcgtcatcttcggcatttacatatgcctcatcgttcgcaagatactttcgataatcgattaccctgtgctgctgattctcatcaagcaagcatgcccttcggaatcggtcatgggcaagatcaatggactagctgcttctgccggtgccgtcgctaggactattgctcctcctattgctggtttcctgtacagtaccggtgccgatatgaatttcactgctattgcatggtggggaagctctttgattgctgttattggtgctgtgcagctgtgcttcatgaagcacaagaaacatacctccgctacaattcggccggctatgccttgccattatcaatacgttccagacgagtcccgacctcagaaggagaccatccatatcatagtgacggacaccgatgctaatgcagacggtgctggtacgtcgcaatcccgccgttattcgtttttgacatag

SEQ ID NO: 13029 - DNA, 696 bp, A.fumigatus
  unsure (486),(493),(495),(496),(534),(556),(603): Identity of nucleotide sequences at the above locations are unknown.
aaccgggaacatctggaaaggcgcatggtggagttggagagccagctctcggctgcgcgtaagtcagctcccaatgagactggcgacgacggaagtgcgcagcgcacgaccgctgccgaggagaccgcaagggaagtacaagatgccgtcgaaaaggttgcacgtgagctccacactttgtacaagagcaaacatgaaaccaaggttgctgctttgaagaagagctacgaagctcggtgggaaaagcgcgtgcgagaagccgagagcaaattcaaagccgtcagtgaggagaatgaacggttgagaaacgagcgcgatgctgcattgtcggaggcttcccgtcctgatgctagcatcatggcacaccagaatgatgagcacgaagcagagaaacacgttctggcggcccaaatcaagggtctgcagcaagaaatggagacactcaagcaggacaacgaacgcttgcatgccgagttgaaagtttanagagcanannagggagagctcgtcgccgccgtggatgaatggctggcnatgcagcaaaacgtgccccagnccgtccgcccgccccggagtctcccgttgttgattgttgagtatganacaccgaagccggaacctgcccccggcccatccaccgaaagagtccaggaaaaattattggccccagttgactcccgtggtatcccggctgct

SEQ ID NO: 13030 - DNA, 324 bp, A.fumigatus
cttacgcgcagccgagagctggctctccaactccaccatgcgcctttccagatgttcccggttctactccgcctcctcaagctttctaataagccgctccttctcccgttcaccttcaacaatatctgccctaacagttcgcaagacgtcttccatctcttgaccccgccgctgccattcggcttgctcaatttcgagagcttctttccgcgcagcttcattacggatttcctcaagagcttcgcccaacgcgccgttcagcatctgcaacagcattcttcaggctggagacttccgcttctttcccgctcagcgttgctttga

SEQ ID NO: 13031 - DNA, 873 bp, A.fumigatus
ctcgtagagggcctcgaccccctgatggttcagtacaaccaatccctcccctacgatcgtatcttttggaagcaggatattgccggctccattgccttcgcccgggccaacaccaagagcggcatcctgacccagcacgagttctccgagatcgagcgcggattcaagcagatcgccgaggaatggagcaccaacaccttcgtcgtcaaggagagcgacgaggatatccacacagccaacgagcgccgactctcggagatcatcggcaaggagatcggaggcaagctgcacaccggccggtcccgcaacgagcagattgcaaccgacatgcgcctgtggctgcgggatgagctgcgcaagctggacgccgtcctgtgcgatctcatcaaggtgtcgatcgcgcgcgccgagaaagagctcgacttcatcatgcccggttacacccacttgcagaaggcccaacccgtccggtggagccactggctactgtcgcatgccaccgctttcgccagtgagctgcagcgtctgcgggaggtcacccggcgtgtcaaccgcagccccttgggcaccggcgctctggccggaaaccccttccagatcgatcgggaggcaatggccgcggagctgggcttcgacggtctgctgtacaactcgatgaacgcggtggccgaccgggactttgccatggagacgatgcagtggggaagctcattcatgctcaagatctctcgctgggccgaggatctgatcatctacagcagtttggagtttggtttcgtccggttgtctgacgcgtactcgaccggctcgtcgttgatgcctcagaagaagaacgcaggtgagtttttctcttgtgtttactttcatccttga

SEQ ID NO: 13032 - DNA, 246 bp, A.fumigatus
cgccgatgtcgctcctgtgtgaatcaccgaaataatcatttggattccgatctgtccatcgcctccttctcgcatttctctctcctcttcaattcatccattccttcgtctacagcttccacaatgagtgctcccaaagctgtcgcagagaacatgctctggggtggtcgattcacccgtgtgtaccccctcccccagcttcaattcctccgaatactactaacctatttatcttttgactcgtag

SEQ ID NO: 13033 - DNA, 528 bp, A.fumigatus
cccagcacgagttctccgagatcgagcgcggattcaagcagatcgccgaggaatggagcaccaacaccttcgtcgtcaaggagagcgacgaggatatccacacagccaacgagcgccgactctcggagatcatcggcaaggagatcggaggcaagctgcacaccggccggtcccgcaacgagcagattgcaaccgacatgcgcctgtggctgcgggatgagctgcgcaagctggacgccgtcctgtgcgatctcatcaaggtgtcgatcgcgcgcgccgagaaagagctcgacttcatcatgcccggttacacccacttgcagaaggcccaacccgtccggtggagccactggctactgtcgcatgccaccgctttcgccagtgagctgcagcgtctgcgggaggtcacccggcgtgtcaaccgcagccccttgggcaccggcgctctggccggaaaccccttccagatcgatcgggaggcaatggccgcggagctgggcttcgacggtctgctgtacaactcgatga

SEQ ID NO: 13034 - DNA, 405 bp, A.fumigatus
acgagaccagacagcctggagcttctgcgtggcaaggccggtcgtgccttcggccacatggccggcctgatgatgaccatcaagggtctccccaccacctacaacaaggacctgcaggagagcgtcgagccgctgctggaccacatcaagacggtcagcgatagcatccagatcgccaccggcgtcctgtcgaccctcaccgtcctccccgagaagatgaccgccgcactggcgcccgaaatgctggccaccgaaatcgccgactaccttgtccgcaagggcgtccccttccgcgagggccaccacatctccggccgggtcgtcgccctggccgagaagaacaacgtccccatggacactctgtcactcgaacagcgtcttcaccaggcggcggaaggacaggat

SEQ ID NO: 13035 - DNA, 1026 bp, A.fumigatus
ttggtctgggacgcgatgcctatgacccccgagacagacgagagcatgacgaagaagtcgagcccaccgcgcgtcgagaacgccgtgtgcaggttccagctgccgttgagcttgggcgccaggccgctcttccagtcggccagcgtcatctgctcgaagatcgcgtcgcgcaggagcatggcgccctggatgacgccccgcacgggtgggagaccctcgtcctcgcaggcgcggcgggccttggcgagggagctggctagggcgatgtcgcagctgaccggcttcacgcggcagccggcggcgcgtagctcgcggacgaacagagcgccctcggcgttttggttctgggcgagatcgagatcgccggcgctgcgggagaggaggatccggttctgggcgccgtggtcgaccagccagtgcgcgatagaccggccaatgccgccgacgccgcccacgaccaggtatgatgcatcggagcgcagtcggggtcgaggggtgatccccttgggccgtgggactactggaacgacctcctctgggcccgccggcagcacaacctttcccatgtgtgcccccgtctgcaggaatcgaaaggcgtcctggacatgctgcgtgggtgcacagcgacggggttggacgggcttcagggcgcgctggtccaccagacgggtgacctcgcccaggatgcggtggatgtcgggtccgcgacggcgcaagagcgtgggcacatccaacgaggccagcgagatgccgcgcgagaagcactccagcgcgaccaggctgttcgtctcgatctctttcttgccgaattcgatcagatggccgaggggcgcgatgacgctgaggctggcctgcaggagtggaccgggcagcgagttgagcatgacgtcgaccccgcgcccctcggtggcggccaggaccgctggggcaaacgaagcgtcgcggctgctgaagatgcgctcggcagggatgccgtactcgcgcgtgaggaggtctcgcttctcctgcgacccggctgtcgcgtag

SEQ ID NO: 13036 - DNA, 1659 bp, A.fumigatus
  unsure (1309): Identity of nucleotide sequences at the above locations are unknown.
tcccgggtctcaaggtcggcgacgcatacgagacccacgggccgaccatcacgattcaattctagcgggattgtcaaccgtgaggaaggggtggtcaagaattggagctggggcggcccatcatgctggccagacacttgggcgggacggagatctctacgcgacagccgggtcgcaggagaagcgagacctcctcacgcgcgagtacggcatccctgccgagcgcatcttcagcagccgcgacgcttcgtttgccccagcggtcctggccgccaccgaggggcgcggggtcgacgtcatgctcaactcgctgcccggtccactcctgcaggccagcctcagcgtcatcgcgcccctcggccatctgatcgaattcggcaagaaagagatcgagacgaacagcctggtcgcgctggagtgcttctcgcgcggcatctcgctggcctcgttggatgtgcccacgctcttgcgccgtcgcggacccgacatccaccgcatcctgggcgaggtcacccgtctggtggaccagcgcgccctgaagcccgtccaaccccgtcgctgtgcacccacgcagcatgtccaggacgcctttcgattcctgcagacgggggcacacatgggaaaggttgtgctgccggcgggcccagaggaggtcgttccagtagtcccacggcccaaggggatcacccctcgaccccgactgcgctccgatgcatcatacctggtcgtgggcggcgtcggcggcattggccggtctatcgcgcactggctggtcgaccacggcgcccagaaccggatcctcctctcccgcagcgccggcgatctcgatctcgcccagaaccaaaacgccgagggcgctctgttcgtccgcgagctacgcgccgccggctgccgcgtgaagccggtcagctgcgacatcgccctagccagctccctcgccaaggcccgccgcgcctgcgaggacgagggtctcccacccgtgcggggcgtcatccagggcgccatgctcctgcgcgacgcgatcttcgagcagatgacgctggccgactggaagagcggcctggcgcccaagctcaacggcagctggaacctgcacacggcgttctcgacgcgcggtgggctcgacttcttcgtcatgctctcgtctgtctcgggggtcataggcatcgcgtcccagaccaactacgccgcgggtggctcctacgaggatgcgctggcccgctggcgccaggcccggggtctccccggcgtatcgatcgaccttggacccatctcggacattggctacgtttcgcaaaaagcaatgtcnccaaacgctgcgcaaggacggaaactccccatgctcgacaagtaaatcttgctccgggcccccaatgccgcttgctgttaccgcttcggacgagcagccgcccccagctcgtcgtcggcctcaactccgagcctggcccgcagtgggatcccgccggcggctcccagctcggacgtgatgcgcgattcttgcacctgcggccgcgccggaaggcgtcgccgcatggcaaagcggccgatggcggcgccgacagcagcagtgtctcgctggcgacacagcttgcgggggcggcctccccggcaagaggctgcctcgctcatcggggctgccattgcctcgaagctggctga

SEQ ID NO: 13037 - DNA, 213 bp, A.fumigatus
ataatctatcgtctaaactgcatatactcgcagaaccctgtgcactgcttcctcacggtaggtgacaatatggcatggaacgcgcccattaatcaaatactcgtcatttgcaactgtagcgagatctgcttctctgtccaggacgccacagaggatatctatttcattgctgtaaagtgtgccgacgtgccgatgatccctgcctggttttag

SEQ ID NO: 13038 - DNA, 1668 bp, A.fumigatus
  unsure (1623): Identity of nucleotide sequences at the above locations are unknown.
ccactggtcgtttcctcggacctccaggcgcagggatttgctgcaggtcctttgggagtctctcccagccgaagcgcaatcgaagacgcacgcccagaaaaaggtttcggacatcaagacgaccgagaccggtgtcgtggtgagctgcacggatgggacgtcccacgagggctcgatggtcattggcgcggacggcgcgtacagcgtggtgcgcaaacacatacaactgatggctctcagggagcagccagcggcgaaggaggagcgacccttcctcaccacctaccgcgccttttggatgctgatgcccctgatcccgggtctcaaggtcggcgacgcatacgagacccacgggccgaccatcacgattcaattctagcgggattgtcaaccgtgaggaaggggtggtcaagaattggagctggggcggcccatcatgctggccagacacttgggcgggacggagatctctacgcgacagccgggtcgcaggagaagcgagacctcctcacgcgcgagtacggcatccctgccgagcgcatcttcagcagccgcgacgcttcgtttgccccagcggtcctggccgccaccgaggggcgcggggtcgacgtcatgctcaactcgctgcccggtccactcctgcaggccagcctcagcgtcatcgcgcccctcggccatctgatcgaattcggcaagaaagagatcgagacgaacagcctggtcgcgctggagtgcttctcgcgcggcatctcgctggcctcgttggatgtgcccacgctcttgcgccgtcgcggacccgacatccaccgcatcctgggcgaggtcacccgtctggtggaccagcgcgccctgaagcccgtccaaccccgtcgctgtgcacccacgcagcatgtccaggacgcctttcgattcctgcagacgggggcacacatgggaaaggttgtgctgccggcgggcccagaggaggtcgttccagtagtcccacggcccaaggggatcacccctcgaccccgactgcgctccgatgcatcatacctggtcgtgggcggcgtcggcggcattggccggtctatcgcgcactggctggtcgaccacggcgcccagaaccggatcctcctctcccgcagcgccggcgatctcgatctcgcccagaaccaaaacgccgagggcgctctgttcgtccgcgagctacgcgccgccggctgccgcgtgaagccggtcagctgcgacatcgccctagccagctccctcgccaaggcccgccgcgcctgcgaggacgagggtctcccacccgtgcggggcgtcatccagggcgccatgctcctgcgcgacgcgatcttcgagcagatgacgctggccgactggaagagcggcctggcgcccaagctcaacggcagctggaacctgcacacggcgttctcgacgcgcggtgggctcgacttcttcgtcatgctctcgtctgtctcgggggtcataggcatcgcgtcccagaccaactacgccgcgggtggctcctacgaggatgcgctggcccgctggcgccaggcccggggtctccccggcgtatcgatcgaccttggacccatctcggacattggctacgtttcgcaaaaagcaatgtcnccaaacgctgcgcaaggacggaaactccccatgctcgacaagtaa

SEQ ID NO: 13039 - DNA, 798 bp, A.fumigatus
atcttgctccgggcccccaatgccgcttgctgttaccgcttcggacgagcagccgcccccagctcgtcgtcggcctcaactccgagcctggcccgcagtgggatcccgccggcggctcccagctcggacgtgatgcgcgattcttgcacctgcggccgcgccggaaggcgtcgccgcatggcaaagcggccgatggcggcgccgacagcagcagtgtctcgctggcgacacagcttgcgggggcggcctccccggcaagaggctgcctcgctcatcggggctgccattgcctcgaagctggctgatatcttcatggcgcccgtgacggagatcgacctgagcaagccgcctgcgcacttcggggtcgactcgctgatcgctgtcgagctgcgcaacatgctggtcctgcaggctgccgcggacatttcgatattcaatctcttgcaaactccgtccttggctgccctggctgcgagcgtggcggaaaagagtcgccacgttcacgcggctgcttacactcacgttctgggtcctgggtgcatactaacaaggttcctctccagctatgaacccatgctgggcagagatgaagaggctgagtatccagggatggcccaggccagaaggaaggaacagttcaattgcggtgctggacattctacatatttctgtgcactttgctttattttgttccttattggctatattctacgcgttgaaggtagtagtactctgggtagatctgaatttacccgaccgcattgctcgtccatggataatagtattaaatatagataa

SEQ ID NO: 13040 - DNA, 420 bp, A.fumigatus
atccgccctcgccgtcctccagtactaaacgttgctcctagccactggtcgtttcctcggacctccaggcgcagggatttgctgcaggtcctttgggagtctctcccagccgaagcgcaatcgaagacgcacgcccagaaaaaggtttcggacatcaagacgaccgagaccggtgtcgtggtgagctgcacggatgggacgtcccacgagggctcgatggtcattggcgcggacggcgcgtacagcgtggtgcgcaaacacatacaactgatggctctcagggagcagccagcggcgaaggaggagcgacccttcctcaccacctaccgcgccttttggatgctgatgcccctgatcccgggtctcaaggtcggcgacgcatacgagacccacgggccgaccatcacgattcaattctag

SEQ ID NO: 13041 - DNA, 573 bp, A.fumigatus
ccatttcctccacgaggcgcgtcgaactatgttgctaaaacgatcaaccccaggtctcgacatacgcccttggataaagtgaaagtggtcatcatcggccaagatccgtatcacaaccataaccaggctcacggtctagcattctcggttcggccccccactcctgctcctccctctctggtgaacatctataccgggatcaaaaatgactaccctactttccagcccccgccaaacaagggtggccttttgataccttgggctgagcgaggagtactcatgctcaacacctgcttaacagtccgcgcccatcaggcggcaagccattcaaacaaaggatgggaacgtttcactcaaaaggccatcgacactgtcgctcgagtacgaactaatggtgtggtttttctggcttggggctcgccagcagggaagcgcgtagcaggtatcaaccggcaaaagcattgcgttttgcagtcggttcatcctagcccgctcagcgctcacagaggctttgtaagtcctgcttcactccttcgccatcatagcacacactaccgagccctggtgtactga

SEQ ID NO: 13042 - DNA, 300 bp, A.fumigatus
ttcaacaatggccatttcaaaaaatgcaacgagtggctcgccaaacgctatggtccggatggcatcattgactggagtctgaccccgaaaacgacaggcggctcgcttgccgccgtctcggaccaagctcctatgattgaccaagtgaagacatccacctcgaaagtgcttgattcgaattcttccgaggagagcaaagttgctagcgataaacgtctggacgctgacggattgcttgatgaatttgacgatgatgtcgatgcacttgaggttctagctgcagctgaggctgcaacatga

SEQ ID NO: 13043 - DNA, 582 bp, A.fumigatus
catttcttttttttctggaatttattatactactcccgtagtactaccccttcgtccttctcaagttgccgatatcaacagtcaagctctgttcacaacacacaaagggagcgcgtcatggccagtccgacagggctcaaacgtactgctaaccatctatcaacaccagcgtgtgatgcgaagaagcccagagccaatggcagtatcacgtccttctttggtgcccctaagcccaagcatggcgataccaaaacattgaccatttcgtcctcttcctcgaacttcaacaaagacaaatgggtggcatcattgactcctgagcaacaagaactcctgcgactggaaatcgatacgttacatgaaagctggctatctagactcaaggaggagctggtcacgccggaattcttggggttgaagcgatttttgaaaaaggagaaggagtcgggtgcaaagatctttcctccagagaatgagatttactcttggtacaatcctagccatttcctccacgaggcgcgtcgaactatgttgctaaaacgatcaaccccaggtctcgacatacgcccttggataaagtga

SEQ ID NO: 13044 - DNA, 183 bp, A.fumigatus
ccgtggggaacaataggacagcgaatcgagattgaaaggctgcggcgagagattcgctacacccgcaaatccagacagctcatcaaggatgatcagctcctctatattctcacagggttagccgatttccgacaattgcgaactagcagacctaagacaaatgctccaacaaccaaacaatga

SEQ ID NO: 13045 - DNA, 249 bp, A.fumigatus
gctgtctggatttgcgggtgtagcgaatctctcgccgcagcctttcaatctcgattcgctgtcctattgttccccacggtcagtgacatggcctcaaaacaagggggaaaattccgccctactcttggattccagcaagatttggaggacttaatttcttgttataacctgatcatccccttgcatgttctgtctattgttctcccttgcagcgatattctgtatatctgccctaatttgatggagtaa

SEQ ID NO: 13046 - DNA, 246 bp, A.fumigatus
ccttgttattccttctcaggtacacttgccgctctaactacgatcggggtgacagcgacgacggagatgacatcctctgcctcaatgatatcctcgacaacgacggggggtccatcaccagcggcaagtacagtagcggctgaaacgaacacctctgctccactcgagccgaaccagctcggaagcagaccggagtcatcgcaggcgctgcagttggcggtttcctcggtttggctgccatcataa

SEQ ID NO: 13047 - DNA, 288 bp, A.fumigatus
gaatcctgcacggatcatacatggcgtagctctgcctgtccattgttctgcattaacctggaccctctgaacctgaacaatcttgctggtgggcaagggattaaaaagtgtccaaacacagatttggatatgtactactgcatcgactataatatggggaatgccaactacagtgctcaacaacaggtgttgattttcaagggtatgtcgcagccatatattgggattctcgcaggggacccaattgctgaccttgttattccttctcaggtacacttgccgctctaa

SEQ ID NO: 13048 - DNA, 1128 bp, A.fumigatus
tccttccacccccgtggtgaagactccaaacctccgactaacaggatcagaccaatgacaagcacgctctacaagccccatcccaccgagcagatgaaagccgcgcagtggatgggcacgcgcttgatccagctcgacaccgtcgccaaacccaccatcacggaccccgcggacgccatcatccacatcacccactgcaccatcggcggcgcagacctccacctctacgacggggaactgagcgacatgctcgcccagggcgacatcctcggccacgaggcgatcggcaccgtcgaggacgccggcgaagcggtccgcagcatctccccgggcgaccgcgtcatgatcctccccgtgatcgcctgcggacactgcgagttctgcaagaggcaggagttctcgctgtgcgacacgacgaatccctcgcgcgagatggagagcgcgtacggacaccgggtggcgggcatgctggggttcacacggctgtacggcgggtatcccggagcgcaggcggagtacgtgcgggtccagcacgcggacttctgctgcgtccgggtgccggcggacatggacgcgaaggagctgctggggctggcgcatgtcaccaccgctgcgtggcatgggtgcgagctggcggacgtccagccgggggataccgtgggtgtttgggggtgtgggcccgtcgggctatcggtgcagcggctggcggtcctgcgcggggcgacgaaggtgtacgccgttgacaaggacgcgggtcgcttgcagattgccgaagggtttgggatgattccggtggatgtcggcgtgcattccgaggtcggggactatatcctgtcgatggagccccgagggttggactgcgcggtcgaggcgagtgggtttcggagtacgcagaaaccgcagcatgcggcgatgcgggcgattgggctggagcatgacagcagcgatacggtgtcggcgatgatcaaggcgaccagaaagggaggccatctcgcgctgctgggggatttcttctatcgcacgaatgattttcccatcgggccgttgatggaaaagggattgacgatccggggcgggcaggtcaattctcaaaaggcattcaccgtcgcagatatgcgtgtgaactga

SEQ ID NO: 13049 - DNA, 408 bp, A.fumigatus
acggccatgtggaatgccacttctcccacagcacgggggccacatggtctccccccaaatttgtctcctcccccttcctccccctccacggcatggcccccggcctcaactacggccaacaagcctacgaaggcctcaaagccttccgccacccatcgggccacatctccatcttccgccccgaccgcaacgccgcgcgcctccgccgctccgcagagttcgtctccatgccccccgtcccggaggatctcttcctgcaatgcgtcaagctcgccgtcgccgccaacgccgagttcgtcccgccccatgaaaccggcgccgcgatgtacatccgccccctgctcttcgggtcgtccgcgcagctgggcctctccccgccagacgcatatacctttgtggtgtttgtga

SEQ ID NO: 13050 - DNA, 429 bp, A.fumigatus
tcgcctgcggacactgcgagttctgcaagaggcaggagttctcgctgtgcgacacgacgaatccctcgcgcgagatggagagcgcgtacggacaccgggtggcgggcatgctggggttcacacggctgtacggcgggtatcccggagcgcaggcggagtacgtgcgggtccagcacgcggacttctgctgcgtccgggtgccggcggacatggacgcgaaggagctgctggggctggcgcatgtcaccaccgctgcgtggcatgggtgcgagctggcggacgtccagccgggggataccgtgggtgtttgggggtgtgggcccgtcgggctatcggtgcagcggctggcggtcctgcgcggggcgacgaaggtgtacgccgttgacaaggacgcgggtcgcttgcagattgccgaagggtttgggatga

SEQ ID NO: 13051 - DNA, 507 bp, A.fumigatus
catcatctcatcatctctcatcttcacttatacacatcagctactcaattcatatacacaatgtcattccctcctccccccgtcgacaccatcgactggtccaacgtcggcttcaaagtccgtgacggtaagctccctttccccccttcccccacctcagctcccaccagctcccgccagctaacatcacctagtaaacggccatgtggaatgccacttctcccacagcacgggggccacatggtctccccccaaatttgtctcctcccccttcctccccctccacggcatggcccccggcctcaactacggccaacaagcctacgaaggcctcaaagccttccgccacccatcgggccacatctccatcttccgccccgaccgcaacgccgcgcgcctccgccgctccgcagagttcgtctccatgccccccgtcccggaggatctcttcctgcaatgcgtcaagctcgccgtcgccgccaacgccgagttcgtcccgccccatga

SEQ ID NO: 13052 - DNA, 702 bp, A.fumigatus
caggatcagaccaatgacaagcacgctctacaagccccatcccaccgagcagatgaaagccgcgcagtggatgggcacgcgcttgatccagctcgacaccgtcgccaaacccaccatcacggaccccgcggacgccatcatccacatcacccactgcaccatcggcggcgcagacctccacctctacgacggggaactgagcgacatgctcgcccagggcgacatcctcggccacgaggcgatcggcaccgtcgaggacgccggcgaagcggtccgcagcatctccccgggcgaccgcgtcatgatcctccccgtgatcgcctgcggacactgcgagttctgcaagaggcaggagttctcgctgtgcgacacgacgaatccctcgcgcgagatggagagcgcgtacggacaccgggtggcgggcatgctggggttcacacggctgtacggcgggtatcccggagcgcaggcggagtacgtgcgggtccagcacgcggacttctgctgcgtccgggtgccggcggacatggacgcgaaggagctgctggggctggcgcatgtcaccaccgctgcgtggcatgggtgcgagctggcggacgtccagccgggggataccgtgggtgtttgggggtgtgggcccgtcgggctatcggtgcagcggctggcggtcctgcgcggggcgacgaaggtgtacgccgttga

SEQ ID NO: 13053 - DNA, 1083 bp, A.fumigatus
  unsure (456): Identity of nucleotide sequences at the above locations are unknown.
catcacctagtaaacggccatgtggaatgccacttctcccacagcacgggggccacatggtctccccccaaatttgtctcctcccccttcctccccctccacggcatggcccccggcctcaactacggccaacaagcctacgaaggcctcaaagccttccgccacccatcgggccacatctccatcttccgccccgaccgcaacgccgcgcgcctccgccgctccgcagagttcgtctccatgccccccgtcccggaggatctcttcctgcaatgcgtcaagctcgccgtcgccgccaacgccgagttcgtcccgccccatgaaaccggcgccgcgatgtacatccgccccctgctcttcgggtcgtccgcgcagctgggcctctccccgccagacgcatatacctttgtggtgtttgtgatgccgaccggcgtttaccacggcgtgcatgccgtngatgccctgatcctggaagactttgaccgcgccgcgccccagggcaccgggtcggcgaaggtcgggggcaactatgcgccggtgctgcggcatagcgcgcgcgccgcggcggaggggttcggcatcaccctgcacctggatagtcggacgcggtcggagatcgatgagttctcgacgtcggcgtttatcggggtgcggagggatggagacaaggtcacgctggtgcagccggacagtacgaacgtgattgattcggtgacggcgcggtcggtgtgtgagattggggagcgactctttggcttcgcggtcgagaagcgacgcattggctacgatgagatcaaggagtttcacgaggtgattgcggcgggcacggcggcggcgctggtcccgatccggagtatcacgatgcggtcgcgcggggagaagtttacgttcgactgcggcgcggatgggcaaagtgggggcgagatctgtatcaaactgttgcagaccctcaaggggatccaggccgggaagatcgaggatccgtttgggtggaattgtctcgtggatcaggccccgccggcggcatggcttgaaggcgcaacggggcaggagggtgacaccgaggggatcggtgtgccatag

SEQ ID NO: 13054 - DNA, 309 bp, A.fumigatus
cagggcggaatcgtcacgtacagcgtgtggtcgatgcaccgccgcgaggacatttacggcccggatgcgaacgagttccggccggagcgctgggcggaccttcgcccgggatgggagtatcttcctttcaacgggggcccgcgtatctgcgtgggacagcagtacgcgctgaccgaggcagggtatgtgacggtccggctggcgcagcagtttgcggtgctggagagtcgggatccgggcccgtgggaggagaatttgaccctgacgttgtgttcgaggaatgggaccaaggtgagcctgcggaattag

SEQ ID NO: 13055 - DNA, 1209 bp, A.fumigatus
  unsure (760): Identity of nucleotide sequences at the above locations are unknown.
ttttctcgatcgcagtcttttctgcgtcatgtatctacatttgacttctctacttttgatgacgctcttcttgtatgtatgaataatcatgaaagatttcaacgtcgggattcattggctacagctacaatactatggcacaccgatcccctcggtgtcaccctcctgccccgttgcgccttcaagccatgccgccggcggggcctgatccacgagacaattccacccaaacggatcctcgatcttcccggcctggatccccttgagggtctgcaacagtttgatacagatctcgcccccactttgcccatccgcgccgcagtcgaacgtaaacttctccccgcgcgaccgcatcgtgatactccggatcgggaccagcgccgccgccgtgcccgccgcaatcacctcgtgaaactccttgatctcatcgtagccaatgcgtcgcttctcgaccgcgaagccaaagagtcgctccccaatctcacacaccgaccgcgccgtcaccgaatcaatcacgttcgtactgtccggctgcaccagcgtgaccttgtctccatccctccgcaccccgataaacgccgacgtcgagaactcatcgatctccgaccgcgtccgactatccaggtgcagggtgatgccgaacccctccgccgcggcgcgcgcgctatgccgcagcaccggcgcatagttgcccccgaccttcgccgacccggtgccctggggcgcggcgcggtcaaagtcttccaggatcagggcatcnacggcatgcacgccgtggtaaacgccggtcggcatcacaaacaccacaaaggtatatgcgtctggcggggagaggcccagctgcgcggacgacccgaagagcagggggcggatgtacatcgcggcgccggtttcatggggcgggacgaactcggcgttggcggcgacggcgagcttgacgcattgcaggaagagatcctccgggacggggggcatggagacgaactctgcggagcggcggaggcgcgcggcgttgcggtcggggcggaagatggagatgtggcccgatgggtggcggaaggctttgaggccttcgtaggcttgttggccgtagttgaggccgggggccatgccgtggagggggaggaagggggaggagacaaatttggggggagaccatgtggcccccgtgctgtgggagaagtggcattccacatggccgtttactag

SEQ ID NO: 13056 - DNA, 600 bp, A.fumigatus
tccccgacctcggaatgcacgccgacatccaccggaatcatcccaaacccttcggcaatctgcaagcgacccgcgtccttgtcaacggcgtacaccttcgtcgccccgcgcaggaccgccagccgctgcaccgatagcccgacgggcccacacccccaaacacccacggtatcccccggctggacgtccgccagctcgcacccatgccacgcagcggtggtgacatgcgccagccccagcagctccttcgcgtccatgtccgccggcacccggacgcagcagaagtccgcgtgctggacccgcacgtactccgcctgcgctccgggatacccgccgtacagccgtgtgaaccccagcatgcccgccacccggtgtccgtacgcgctctccatctcgcgcgagggattcgtcgtgtcgcacagcgagaactcctgcctcttgcagaactcgcagtgtccgcaggcgatcacggggaggatcatgacgcggtcgcccggggagatgctgcggaccgcttcgccggcgtcctcgacggtgccgatcgcctcgtggccgaggatgtcgccctgggcgagcatgtcgctcagttccccgtcgtag

SEQ ID NO: 13057 - DNA, 246 bp, A.fumigatus
gtgaagatgagagatgatgagatgatgtcaaggcagaaggatgacgataggatgaggggtgatttatttattccgccgactgttgatgaattgggccaggcggggaacaacactacgcatccacgttggcatgcaagagtaccttatccttcccaccttatggatatgttcatgtcaactccaaatagttatacagttagctatttagttagctcgttcactaatgcagctgaggtcagaccatga

SEQ ID NO: 13058 - DNA, 363 bp, A.fumigatus
tcatcgccgacaccgtatcgctgctgtcatgctccagcccaatcgcccgcatcgccgcatgctgcggtttctgcgtactccgaaacccactcgcctcgaccgcgcagtccaaccctcggggctccatcgacaggatatagtccccgacctcggaatgcacgccgacatccaccggaatcatcccaaacccttcggcaatctgcaagcgacccgcgtccttgtcaacggcgtacaccttcgtcgccccgcgcaggaccgccagccgctgcaccgatagcccgacgggcccacacccccaaacacccacggtatcccccggctggacgtccgccagctcgcacccatgccacgcagcggtggtga

SEQ ID NO: 13059 - DNA, 486 bp, A.fumigatus
cttttggttaggatcactgcccaccccgatctagacttcctggtggtcgtcaatcccaacagcgggccgggcgacctcccttccccgaacaaggattacgcccgcgaggtccctaagctcaatgcgttccccaatgtctacaccgtcggctacattcgtatccactactgcgataagcctttggagaaggtctaccaggagatcgaccggtatgcgagttggtccgcctgcgatgggttagggttaggggggattctgctggatgaaacgccaaaccattattcggaggcgagggaggagtacctgcgtgcttgtacagggtttatcaaggggaatcaaggaattttacgcgatcggatggtaagtagtcttctgttttttttttatttttctagttttctaattttctcctttttacaattatcattctttctttctttttatttgggtttttctttccatgggatggctgcgaaccgcggctga

SEQ ID NO: 13060 - DNA, 978 bp, A.fumigatus
tctagtctctatcccagcatgacttccagttcacgttctgcaagaagcccatctgcttcgcctcgcatcttttctgaggtcccgacgcccgacagcgaggcggatggcttggatacattgacgcccgtccgggacggcgaggagtatgtcctggtcactggcggcctcggattcatcggcagccacacctgtctggagctgctgaaagcgggatacaatgtgctcatcgtcgacgacctgagcaacagctaccgtcatgtcttctcccggatcctgctggccgcaaaactgcactgtgaccggacggacggccactgtcccaaggcgacgctgtacgacgtcgactaccgcgacacgtccgccatgcggaagctcctcgacgcctatcagcgggacccatcgacacggcaatcgaggatcatcggagtcatccacttcgccgccttcaagcaggtcgaagagagcatccacacccctctgaagtactaccgcaacaacatcaacgggctcgtcgacctcctcgtcctgctcgaccagtaccgcatcaccaccttcatcttctcctcgtccgccaacgtctacggcacactcgccgagcaccggcccctcctccacgaagacgcatgcacccaccagccagaccccgggcagcgattcggtgcgtttcgccccgcggagatccacaactcccagatcaccaacccctacggccgcaccaaactcttcggcgaagccatcctcgcggacctggcgcgcgcgaaccccgcctggaccatggtcgccctacgctacttcaaccccaatcggctgggacgcgtcgggcctcctcgggcaaaaccccaagggtccacccctggaacctcgtccccgcccttggggagaaacctcacttggtcgacgaaccgaagctcctcatctacgggagtgactgggaagaccccggacgggaccccccggccggggattttatccccgtaa

SEQ ID NO: 13061 - DNA, 333 bp, A.fumigatus
gtcgtccataacccaggcaccccccccgacgcagggttggccaacacctgtccggatctgattctgacctgcgaagagccgtacgagaggtacagatccgacgaggtgcagcatcgcctggccgaactgccctatgatcgggtccgatgcgggtacatgatcaatgcggtgcctgtgggcgagctgacgggcctggtgcgcgaattgcgcgatcgcgcgacgtatgtctttgccacggaggtggagggggatttctacgagcgatttggaccaaccagctggaagcagttgatgcatgcgctgaaacgggattcagattcggagaccgtgtag

SEQ ID NO: 13062 - DNA, 447 bp, A.fumigatus
agtactaccgcaacaacatcaacgggctcgtcgacctcctcgtcctgctcgaccagtaccgcatcaccaccttcatcttctcctcgtccgccaacgtctacggcacactcgccgagcaccggcccctcctccacgaagacgcatgcacccaccagccagaccccgggcagcgattcggtgcgtttcgccccgcggagatccacaactcccagatcaccaacccctacggccgcaccaaactcttcggcgaagccatcctcgcggacctggcgcgcgcgaaccccgcctggaccatggtcgccctacgctacttcaaccccaatcggctgggacgcgtcgggcctcctcgggcaaaaccccaagggtccacccctggaacctcgtccccgcccttggggagaaacctcacttggtcgacgaaccgaagctcctcatctacgggagtga

SEQ ID NO: 13063 - DNA, 702 bp, A.fumigatus
ccggacggacggccactgtcccaaggcgacgctgtacgacgtcgactaccgcgacacgtccgccatgcggaagctcctcgacgcctatcagcgggacccatcgacacggcaatcgaggatcatcggagtcatccacttcgccgccttcaagcaggtcgaagagagcatccacacccctctgaagtactaccgcaacaacatcaacgggctcgtcgacctcctcgtcctgctcgaccagtaccgcatcaccaccttcatcttctcctcgtccgccaacgtctacggcacactcgccgagcaccggcccctcctccacgaagacgcatgcacccaccagccagaccccgggcagcgattcggtgcgtttcgccccgcggagatccacaactcccagatcaccaacccctacggccgcaccaaactcttcggcgaagccatcctcgcggacctggcgcgcgcgaaccccgcctggaccatggtcgccctacgctacttcaaccccaatcggctgggacgcgtcgggcctcctcgggcaaaaccccaagggtccacccctggaacctcgtccccgcccttggggagaaacctcacttggtcgacgaaccgaagctcctcatctacgggagtgactgggaagaccccggacgggaccccccggccggggattttatccccgtaacggatggccgggcggggccctaa

SEQ ID NO: 13064 - DNA, 561 bp, A.fumigatus
gcctgcctcaccagcaccgaaccgtccactagaacaccccccacaagcatatatttaggagctgacggtcatcatttctccttgcgtatagcattaacgaaaatggaaacggactggtggattgagctcgaatccacatacaaaactcgaatcgcgcaacgcaaggaattatacgccaaacacggctcatcagtcctcggctatcttccaggctctgaattagcttgcaaggaattgatggagatggtcttgcagtttctgtgcgcccggtatcctcagtacttctcgctagagagcaagaggatatttaagaacaaaatcctcgacaccgagcaagacatcaaagccaaacatcctttggaggtcctcctcgacaatgtgcccgaagactttgcaatcatgctgcgcgatgaggagacaggcttctatttcctccgcgcggcagtgatctgctctgctctgggttggaatgttggactgaaaataggacttcagctccatcaaatccatgggccgatcccggactataaggaaaagatgcagttctctatggatcggtag

SEQ ID NO: 13065 - DNA, 222 bp, A.fumigatus
aggacctctgggggggtcggtattcgtcgcagcataatgaatcatggttctgccatcagggttgatttgactaaaatctgcacctttgtcaatggcggcttggacgctgtccagactgcaacgacttgcaaggctagcgagggcggtgatgtcgccggcgatgtcaacaccggctatgatgaggattttgacgagttccggcctgcctttatagatggctga

SEQ ID NO: 13066 - DNA, 612 bp, A.fumigatus
gacttcagctccatcaaatccatgggccgatcccggactataaggaaaagatgcagttctctatggatcggtaggtccagaaaattaagagagtggcaggcccaggaggtcactgacaagtcctcctctaggttcttcgccaaaatgccaacagacaaaccaatccagcgagggtcctggggtctagaagtcggacagcctttgtacatgcccccgggggatcctcacgagaaacttcgtctgtctcaagaccctagcctgcagttggccgattgcaatctgcgagtggattggcaaacactgagacgtctgcctctgtcggcagcagtcgtcttcaattttaaggcactattcacgcctgtgtccgaatttcgtgatgaaccatgcataccagccttggtagccaagatcctcaaagaaggaaaagaaaatctcatgaaatataagaatacatggcatgtggagcatgtcgtgcttccgaagcttgaggaatgggctaaggagcaggaggataaaggcctcgtagacaaaaattggcaagtggctacattggacgagagcccttggttcaggaactgggaagacaagtggcatcgccagcaaggtttttga

SEQ ID NO: 13067 - DNA, 1281 bp, A.fumigatus
catgcatcaaggaacaatgtctctaagaacctttgtcaagtatctcagaaccctctattgtttgcacaaagctattgtctcaatagtcgtgcagaaagcagagaatacattaggatgtcttactgggagactataaagcaagtgcgaaagtccacagatgtgccgtatcttttccaaccaacctatccctcgacccttcaaccctcctacagtcatccaaagatagtctgtacaatcagcgcggttgactacctctattgtcgtatttcaagcgaacaacaacgcccaggcaaaatgtcgcagcttgagcagttacctatggaactcctcctgggcatctctgactacctggatcctctatcagtggctagtctcggtcaaacatcccggaggctcaacggtacattgcaacgtcccctggccagagctgccaggcagcatgccctcgctgatgaagctgagtacaaaaagcgaatcagatttcgagaggatgggaagggtattcttactcgcaaacggacgcacggggtgccttcccagccgctcgtccaagccatcaaacgtggtcaactcaacaaggtaagaaactatctagaagcaggtgtcgacccgaacgcatatgacttggatggatgtcgcatgctctcactagcagttcgcgccaatgacgagccaatcgtggaccttctgctcgagcacggtgctaaccctgctttgaacgacgtgtgcgcgccatatgcctcgcctgtttgtgacgcaacaaaaatgagcaatgagatggtcaagaagctgatcagcattggagctgactatactcaggtaagcgtcatacacgacctcgctggtcgttgcagtctggacgtcatcaaactcgccgttgacaaaggcgcagactttggacaaactaggacttatgggatgacggcgatccaccaagctgcgaaaaatactgaccacccagatgtccttcaattcctcgttggaaggtaccctgagctgatttcctcccagtccgccggcacatttttctggtcagccatctataaaggcaggccggaactcgtcaaaatcctcatcatagccggtgttgacatcgccggcgacatcaccgccctcgctagccttgcaagtcgttgcagtctggacagcgtccaagccgccattgacaaaggtgcagattttagtcaaatcaaccctgatggcagaaccatgattcattatgctgcgacgaataccgacccccccagaggtccttcaattccttattggaaagtaccctga

SEQ ID NO: 13068 - DNA, 1767 bp, A.fumigatus
aactggccatgtaaagagttccccatcaatcacgccggaattcggatgccacgtaaaaaggctgcagaccgtgtgggtccggtcaagacccgaacccgcagcggttgcaaggagtgccgcgcgagtcgcgtccgctgcgacacgcagaaacccatttgctcccggtgtcgggacaggggtctcgtatgttccacggagctggtgcttaaatgggagtcggagtttctgagtcggggcctagcgtttggtcgcgcgggtgtttggagtaagtcccgccctgctggaacggggtctcgagcgtcggcgtctttgtcagttaaggagaatgagtggtgcgagtatcctcctgttgaaagctggggatttgtgaatagtggtgtttcgacctttgaaaatccgcatcaggtgaacgttgcctgcgatgagttgaatggtcttgtggttcgtgcaagggacagggagttggtgtatgggggtgttgcgtcgccgtcgtcagtggttgttgctgacgatggctggattgcgcgagaggtgtccagcccgccggcttcgctttcgctgtttccgaatatcccagagtcgaaatcgcacttgttcgattattatcttcagcaggtgtgtccgcggacgactgccagttcgaaacttgcctcaccctttgcctctgtcattctcccattttgcttgtctgcgtcaccgactctgtttaaagctattcaagcgcttggagcatgccattggtcacgatttgatccctcgtacagcgttgtcggccttcgtttgaagtcggaagctttgcgaggtcttcgccacagacttgctaccgagggctcgtcgacatgctctggtgaccctgaagtgttggttattatgatgatgctttgtctatacgagattgtggataattgtgatcagcggtggacgatacacttgaaaggcgcaaaggagttaattcgcgccaggagacaagaacaaggcgcacttgcaaggtctcggaaagctcaagatcctgtctctgcttttgctgagcttttcttcgctttccaagatgttatgggccggactgcttgcggtgaggaggtccttttcgggacagactactgggaagatagcgagcagaaaatcgacttgtggatgggatgcagcccggaactcgtgtcgatcttgtcttccatcactgaacttagccgcacgagacggcagcttacgtctgattctgctcgggctgcgtttgcccttcgcgcagcgtctcttgggcgcaggctggagactctcgtccaagaaattgatgacgaggaagacgaaatgctcaagtcagctgcggagctcaaacgattggctgccgtgctctatcttcattgtgcactgtatggctcctcaccatccacccctttggtcatcggttacgtgaaacgcattctgcggctggtctcggaactactcgattctcgatctctggtgagcatgacgtggccagtatttgtggccgcggtggaattggacccagctcgtgacgaactatggtctgatcctacaactaagactgtggtgtatggtcggtcgcttgttctacgagcactggcggcgatggccgaatcaagtgtttcgaatgtcgctcgcacacgagctgtcattatcaaggtctggcaagctcgagatagtgacatgctgaaaggctcgcctgtagatgcagcagataaccacgcgagctgcaatgattgggagtggtatgttgccccagtcagtacagccatgagtctggcgtga

SEQ ID NO: 13069 - DNA, 882 bp, A.fumigatus
tacactgattttggagatagcaggacctatcttcatctcgctgcgcagtggtcgggcaacgacaccccacaggcgaacaaacacaagactgattccgtgaccttctactatcggcgcttcaagcttcatgatgtttcgtcgaatctgatcatcgagcgtgacctcgaatctcgacgcgcattcaaatctacctcaatgtctaatttgacgtcgtctacccctccttcgaccctgtcgcacagcctacccgctccgccatatgcgagcagactgagcgagcagttgtcccagagcaaggagcagagtgaacccagcaccgacacggactctacaggcgacaaggcgagttgcctggggacgccactgcgtccttcacaaaaatcccgttcgctgtccgatgccccaaaacccgtctccgcctcgccgtctatttcgggagacacacgcccctccagcaaagatgacaactccattacctccactcctgaaaccccacggaggtcgtccatgcactgcccgaacctttcattgaacttaccttcgaaattagccggatcaacatccgtaccaaatcgcgccccactctcccccaagctcgactcgtcgcacatctatggctccccgggctcggtactacctcgacggtcgcgaggacttgatttctcccgagcatgcacgaatctacaccactctatcattgcggagtcgtctcttgattcgtcaccaacggtcggcggccgaggtgtcaccatcccgcaacggcgtggctcgccggggtcaacctctatgggtcctttcctcaacatccggccctgccgaccgaaccgcgatttcgagctccgtgtccagcgtgaacatgatggagtcggatacaagcagtag

SEQ ID NO: 13070 - DNA, 477 bp, A.fumigatus
ttgtcttcacctgcttcttcatcgtcggcttcgccacaacctggggtcctatcgtctgggccatctgcggtgagctgtaccccgcccgctaccgtgccatctgcattggtatcgcaaccgcctctaattggacctggaacttcctcatctccttcttcactcccttcatctccagctccatcgactttgcttatggttatgtattcgccgcctgctgcttcgccgccgtccttgttgtcttcttctttgtcaacgagactcagggccgcactctcgaggaggtcgacacgatgtacgtcctgcacgtcaagccgtggcagagcagcagctgggtgccgcccgagggtatcatccgagatctgcaccccgctcccgaggagaatcagaagcaggacggtcagggtcaggtcgagcacaacgagcccactgagatccgggagtaaacatctcgtctcaactcatgtacagtatttctag

SEQ ID NO: 13071 - DNA, 771 bp, A.fumigatus
tccgctccccgccaggtccgtggtgccatggtcagtgccttccagctgttcgtggccttcggcatcttcatctcgtacttgatcaactacggtaccgagaccattgagtcgaccgcctcctggcgtatcaccatgggcattggctttacctggcccctgatccttggcttgggaaccctcttcctgcccgagtcgccccgctttgcctaccgccatggccgcattgatgaggctcgcaagaccatgagcaagctttatggtgttggacccaaccaccgcgtggttgtgcaggagatgaaggagatgaaggacaagctggacgaggagaaagctgccggtgtcgctgcctggcacgaaatcttcaccggtccccgcatgttctaccgtaccgttctgggtattgccctgcagtccctgcagcagctcacaggtgccaactttatcttctactatggtaacagtatcttcacctccaccggtctgaacaacagctacgtcacccagatcatcctgggcgctgtcaacttcggtatgacccttgccgggtctgtacgttgtcgagcactttggccgccggaacattctgatggtcggtgctggctggatgttcatctgtttcatgatctgggcctcagtcggccactttgctctcgacctggcggatccctcccacactccccaggccggtgctgctatgattgtcttcacctgcttcttcatcgtcggcttcgccacaacctggggtcctatcgtctgggccatctgcggtga

SEQ ID NO: 13072 - DNA, 606 bp, A.fumigatus
cccttgccgggtctgtacgttgtcgagcactttggccgccggaacattctgatggtcggtgctggctggatgttcatctgtttcatgatctgggcctcagtcggccactttgctctcgacctggcggatccctcccacactccccaggccggtgctgctatgattgtcttcacctgcttcttcatcgtcggcttcgccacaacctggggtcctatcgtctgggccatctgcggtgagctgtaccccgcccgctaccgtgccatctgcattggtatcgcaaccgcctctaattggacctggaacttcctcatctccttcttcactcccttcatctccagctccatcgactttgcttatggttatgtattcgccgcctgctgcttcgccgccgtccttgttgtcttcttctttgtcaacgagactcagggccgcactctcgaggaggtcgacacgatgtacgtcctgcacgtcaagccgtggcagagcagcagctgggtgccgcccgagggtatcatccgagatctgcaccccgctcccgaggagaatcagaagcaggacggtcagggtcaggtcgagcacaacgagcccactgagatccgggagtaa

SEQ ID NO: 13073 - DNA, 897 bp, A.fumigatus
agactggcgcgtatccacgtggcacagcctgttggaggcgtgcgtgaggcattcattcccgaggcggtcaagaacttgaagaagtacgacaagaacgacccgaaccggaagaagctcgagcgggacatcgaggaggagaacggcggtgccggtgtgtacaacatcgacctcaagaagaactacacgctggccgacgacgagtggaagcacgacaagatccctgaggtctggaacggcaagaacatctacgactttgtggacccagacatcgagcagaagctggccgcgctagaggaagaggaggagaagctggaggcggagggcttctacgactcggatgagagcgtcgaggatgccgaggacgcggacacccgcatgaaggcggacctgatccgcgagaagcgcgcgctgatgcgcaatgaagccaagctgcgcaagtcgctcaagaaccgggcggccatcccgcgcagcgccaaggccaagaagctgtcacagatggagcaggctctggacgcagccggctacgacgtcgatgcggctgccgcccgcgcccgctcccagagccaggcacgcggccgtaccaccacccgcagcgagatcgataccggcgacgccatggagatcgatggcttggatcctcgccaggcgattgcccgcgccaagagccgcgcccgcagccaggcggccaccaaccgtctggtggacggtgtgacggacacgacggcgcgcagcaaggccgagcgccttctgaagctaggccagaagaagatgaaccggatggccagagccggagaagcagaccgacataccaccgcctccttgcccaagcatctggtacgtctcaccccaccctttctttcttcttttcttctctctgtgattccccgtatttactga

SEQ ID NO: 13074 - DNA, 201 bp, A.fumigatus
caacgtaggaagacaatgcaacaaatgatctatggctacaaaggagatacattgattattgcacagtacgagatacacaaggtttttcggaagtcgaattgtcaagattggaagacaagggcgaagtcaaaattgtccagtggatctaagcacgcagccaaggtcaacagaaaggacgaggggacaggcactcaactctag

SEQ ID NO: 13075 - DNA, 402 bp, A.fumigatus
cacgtttttcatcgtctttgcgccctcacagaaataatgttcctccggtccgtttctcgggctgctgctcgcagctctgtcatgcccgccacgaccactcgctcctaccgcactgttcctagcccaattgcttgtctgaacgctcgtcctcagcctcagcagaagtcgattgcttcccagcagacccgcgcctcttccgagcatgccatctcgaatcccacactcgccggtatcgagaagcgctgggaggccatgcctccccaggagcaggccgaactgtggatgcagctgagggatcgtatgaaggttgactggcaccagatgactttgcaggagaagaaggctggtatgtacctctctttggcccggatgccagacattccccagtggccagaattttag

SEQ ID NO: 13076 - DNA, 441 bp, A.fumigatus
tcagagactctagcctactggattgctttcggtcctcacggcccccgcgcggttcctcccaagggcgagagcatgcgtattttctttaaggtcgctcagctgaacctggtctccctcgctctcttctacgtgatccatctgttcgccaagcccaagcctaagaccatgaccaaggagtggcaggaagccaccaacgagtacgctaaggtacgtatctatagctgttatgggaagcctcttcgtggaagctttttgaactcttgtgtggttaaatatttattgacatggttttacaacagcgtgagaaaatcaaccctctctacggtgtcagcagtgagggctacgagggcaagggcttcattcagagccctcctgccgagaagtaaattgggggataagtatctgggaggaacaggtgcggcattcagacacgctgggtag

SEQ ID NO: 13077 - DNA, 420 bp, A.fumigatus
ccaaaccgattgcgtattcatactgacggccgccttttctgctatagtgtctctatcgcagatgagtgcattactgcattcaacgatttccgcatgagcggcaacaaggccaacaagaccaagttcattatcttcaagatcgccgataacaagaaggaggttgtcatcgacgaggtctcgcaagaagaggactacgaggtcttccgtagcaggctcgaggctgccaaggatagcaagggtaatcccgctcctcgttatgcagtctacgatgtcgagtacgatctcggtggcggtgagggaaagaggtacgattgcttgcttcgctctgaaataaggtgggcttctgtggctgaccgaatctgtagaagcaagattgttttcatctcctgggttccctcagacacacctactctggtatga

SEQ ID NO: 13078 - DNA, 195 bp, A.fumigatus
gaaactcgcagtgtattgcatttcctacgtaagactgactctgatatttctgtcgctgactaccaacatagacaggaagaactgtcctgcacctctatcggagggaacctaatgcatggtacatgtaagtcgccttgttgtcgcccacagattaattccaagatggaatctctggttctgtgttcctttgactag

SEQ ID NO: 13079 - DNA, 612 bp, A.fumigatus
acgtctacgccggacaaggagcagcactacagcggcggtgctgaccctgccaaccgcgaggctgtctggctgtctggatactcgaccagcgctacgctgtacagctggattgcctctaccaacaagattcgcaagctagcgatttccaaagactcagcctacataacatccaaggtatttccggtcacgtcttcgcattccaccgctaacatcgatagaacaacccgttctactatgattccaatactctcgctatgcgcaagggctcagtcgctggctctcaagtcattaccgtcctcagtaacaagggatcctcgggcagttcctacaccctctctctcagcggcacgggctactccgccggcgccacccttgtcgagatgtatacttgcactactctcaccgtggactcgagcggaaatctcgccgtgccaatggtatccggcttgcccagagttttcgtgccctcgtcatgggtcagtgggagtggcctctgcggcgactctatctccaccacggcgaccgcccccagtgccaccacgagcgcaacagcgacaagaacagcatgcgcagctgccacagccattccgattctcttcgaggagctcgtga

SEQ ID NO: 13080 - DNA, 675 bp, A.fumigatus
aacaacccgttctactatgattccaatactctcgctatgcgcaagggctcagtcgctggctctcaagtcattaccgtcctcagtaacaagggatcctcgggcagttcctacaccctctctctcagcggcacgggctactccgccggcgccacccttgtcgagatgtatacttgcactactctcaccgtggactcgagcggaaatctcgccgtgccaatggtatccggcttgcccagagttttcgtgccctcgtcatgggtcagtgggagtggcctctgcggcgactctatctccaccacggcgaccgcccccagtgccaccacgagcgcaacagcgacaagaacagcatgcgcagctgccacagccattccgattctcttcgaggagctcgtgacaactacctacggcgagtccatctacctgaccggctcgatcagccaactcgggaactgggacacgagttctgcgattgctctgtcggcgagtaaatacacctcgtcgaaccctgagtggtatgtcaccgtgaccctgcctgttggcacctcatttgagtacaaattcgtcaagaaggggtcggatgggagcatcgcgtgggaaagtgatccgaaccggtcgtatacggtgccgactgggtgtgcgggaacgaccgtgacggtgtctgatacgtggagatga

SEQ ID NO: 13081 - DNA, 330 bp, A.fumigatus
tcgggtcattcttcaggtattcgggcaggattcacagttaaggtggtcctggtatggctggagatactaatgagagcagagtatgagatacagaagttgtcgttgtgtgacatccagattgatatcatgtactgcctgatggccgttacggcctgcctgagctcgtccaatttgaggagctcgtcaatgccgttcatctgcatgttaccgggagggagatcaactcacgttttaaacaagactctgaccattcatatttctttcattgacatccttattggacattatctactaggatacggtgaacaagcatgtccacgtataagataa

SEQ ID NO: 13082 - DNA, 183 bp, A.fumigatus
gcacaaccttcgtggtcttttcgtgagatcatattggcatcgtcactacaaaagcatctgcttttggcagaagatcaagctatcaccgcgctagatttctccgccattcataaggcggtaacaagcgctcttctcgggtgcgaggttaggtatggtgaaccttacgctggtgacatggtttga

SEQ ID NO: 13083 - DNA, 291 bp, A.fumigatus
gctgtggctatagataggaatactgggtttcagggatgtatagatgtattagtgaaaaatatatatgtgttaatgatcagaatgaactacttagtctcccccaagctattcagaactcctatttctactaagtgcattcagaatcaggtatataattacctaagcaagagggggcttgctgctagcagcttactaggcttatattattctaagcatataacaactaccccccccccttcagagaggttcatcccaaactatactaatcctaaagtagctattaaagattaa

SEQ ID NO: 13084 - DNA, 231 bp, A.fumigatus
ccgggattcggcgccccgctctgctttccacaccgtgtgagagaggacgactggtatcgagggatgctgattccaaaggattcaatcatcatcatcccaacctgggcccttcaccgcgatgaaaacgtgtaccccgatccagaaacatataacccagaccgcttcctgcaacatcctggcctggccgctgactatgcgggcaagggagatccgatgaagagagatgagtga

SEQ ID NO: 13085 - DNA, 216 bp, A.fumigatus
ccatctgtcgactggatcttcctggaacagcttctgtatatgtttagtatatctaatctcctctgtatattgagtcttctagaccatgtacttctctttctcttcctctcttcattcatcgcctttgatctcaatgctcccatagtctccagcctggtcgagtggaaatactatacacttcaaccttatacttgctatatcgtcactatttcgtga

SEQ ID NO: 13086 - DNA, 1524 bp, A.fumigatus
ccgttgattgcccttgcagaggttgcagatttctccccatggatgggcaaccatccggaagacgtacttaatgagcaaacggccaagcaaggatactacgatcgcacacaggtgtctcaaaatgagtccaatacagctcgcccctccctgtatgcgcaactgaaacatcgctctggcttgcaaatactgtcgtcagtttttgcagctgcactggagaaaagacagggccataacatggtcactgcgccgtcaacattcaagccccctccgcgagtcacgctgacggacaacaaacgtgaggcctggctccgcgatctcgcgaatccgaatgtcccgctgcgcaaactcagtcgaaccattcctcatggtatcagaggcagagttcttttggatcaatgtttgaccaaatgggttcctgtcggtcgtgctgtgtggcttgcgaagtgcgtcggtgccaacgaaatccgtgctttcaaaagaaaaggtaccagtggcgcattgaccattggcctggaagctaaatgggtgcgcgactggactgccaatgtccaacagtttctcgaaggtgtaatcactagttgtggagtagcagactggaagatgaagatgacttacgcggtcaacttgacctctcgtttgttctttgagcaactgcttgaccatgaccagtatctcgagtggttcctcacatcgctggaggcagcgccatttaacaccttgccagtctggcttctaatgttgggcatctactggagcaacatactgcgatataggaagcgaggacggcgactcgctgaactcttgcttgacaagctgcaactagttatcaagtcggattcggccccatcccttcgccccttgacagaccgattgtcactgcatatcagaaaactaactcttgagcatacttcatctatggtgcttccacagtcctgggaaaagtacaaagatctcctatcgtcctgtttgaaccttaacgacaatgtgcacagaacggtctttcaaaacttggctgagcgaaatgcgcgggtgcagaagcctccgaaatgtgaagggacaacacaacaaccgccacagcaacgcgtcatccaactgttcgactcgatatgctcttcgcacgacatcacatctgtttccgctgcatctttgcgtgctatagatgacaaggctgctctggttctcaaactgctcgagtgggcagcgactccgtttcgctatggtgtatctcgtgtttataccggcgcccgtctcctgcggaaatggaagatcgctggagtcgatgtggatacctgcatcatttccttccttggcgagagtcagatgagcgaccaattgaacatggacaatgtctatcatatcgtctctgagctcgtcagatcccagacattttcggttggaaagtaccttcagtggttaatggcaaagggggttgcagatttttcccgaagctccgaccatcagcccctttcgggggaccttgcacttctcgtgcagctccctgtgagccgtctgcctgagcatgta

SEQ ID NO: 13087 - DNA, 225 bp, A.fumigatus
tcaatagttatcacgcaattttacctgtcttcagggacttggatctctgtgattgtgtttccgctccatctctacggagaatccgcctgtcaactgttgattgtggtctcggcttattcggcgaatcattccacaacccagcactttttgaagaattcagggtatcaggcgatcgccttagccccaagatttcaagtgcctacgaggcaatggcccaacctatga

SEQ ID NO: 13088 - DNA, 285 bp, A.fumigatus
agcataatccgagtagcctctggagttggggaggagagagtaggttggtggttggtgcccggagacgattttgcgggaagttgttgcagcttctttgggggacttctgagggtcacgtcatgttgccggcgcatgttgatcctaacggtctcctacatcaacaattctagaaaaattatcggtgtggctttctcagatatcaacaatgtagatgacttttactttcgaatagcttcagatattttcaagctttcttgcttgagatcgggacatattggctactga

SEQ ID NO: 13089 - DNA, 1689 bp, A.fumigatus
aaatacaccatgtcagcgcattataccaccgagcccccgcccaccgcatccgcgaacctgcacaccaccttcggccccatccacatcgccctctttgccaaccaaacccctctcacatgcaagaacttcctccaacactgcctggacaactactacgccgggacaatcttccaccgcatcgtcccggacttcatcgtgcagggcggcgatcccaccggcacaggctcaggcggcacctccatctacgagtaccccgaattcgaatacgacccggaagcgcgcgacccgaacgagaaggtcgtgctgcgggatgagctgcatagccgattgcgcttcaaccgccgcgggctggtggggatggcgaagagcgaggacgggacatacgggagccagttcttcatcacgctggcgaacgcggagcgggagctgaacggacagtgtacgctgtttgggcgcgtcgagggggacagtatctacaatgtgttgaagatcgcggaggcggagcgcgtggaggggacggagcgccctgtttaccctgtgaaggttgtctcgtgtgaggtcggggagctggggccgtttgccgggaagctgaagaggcgggagacgattgctactgcaccggcggcggaggaaaagcctgcggcaaagaagaagaagaaagcgaaaggaggaaagacacttctgagctttggcggcgacgaaggagacgaagatgtccttttgcggccgtcgaagcccaaattcaacccgactctagtcgtcgacgccggcatcccgccggccaacgacgcaccgaagaagacatcaccagaggcggagcagcagactcggaagcgtcttcgctcgccctcccccagacgatccctctccgcggagcgcaaacaccgtcccaagacgccagaccccttgacacagcttcccctccccgaccctgaaagccccgctcgctccccgccccaatcccctccagcacgacagtcaatcctgtcccggacaagggccgagatcgagaacctcaaagcctcgatgcggcgcaccgtcgccacaggcccggcagacaccggccgcaagaagtccgccctcgaagccatgatccctgagaccgccatccgtggccgcaaacgcccaccccccgggaccgtcaacggcgccggccgcggcagcagcaccaacggtgtaacgggcttcagcagcgccgctgaagacgaaaccctgcgaatgttcaatgccttcaaagcgaagctcgagagtgcagacgccaagtccggccctcacggaaagacttcaatctcagcctcagacaccacgaaatacacctcgcaagccaagtccaataccgaaccggaagatgaagaggcccagctctgcgacctccactttatagccaactgccagtcatgcaaatcatgggacgacaccggcaccgcagaggaggcccccgacgacgacgaccgggactggttgacgcacgaactccgcttcggcaaggatatgctcggcaaagatctgcagtggaagcgcgagcacccggacgatgtcgactcccttgttgtgattgatcctcgggaacgcgagaaggagttcgtgggtgggaaacgtcgcggccttgagcgggatcgtgagcgggatcgcaagcgggagcgtgtcggcgatcaagagtgggatcgaaggaggagggagaagccgtga

SEQ ID NO: 13090 - DNA, 588 bp, A.fumigatus
cttgcaggttctgactccatatacttcaattgggcccgaagatttatattatctgaggctgttgcagctgtagagctcaagccgctcatctgcgtgcgagagctgagatcccagaaaccaacgtcaatatccctacagacctcctctatctatcctagaaatacaccatgtcagcgcattataccaccgagcccccgcccaccgcatccgcgaacctgcacaccaccttcggccccatccacatcgccctctttgccaaccaaacccctctcacatgcaagaacttcctccaacactgcctggacaactactacgccgggacaatcttccaccgcatcgtcccggacttcatcgtgcagggcggcgatcccaccggcacaggctcaggcggcacctccatctacgagtaccccgaattcgaatacgacccggaagcgcgcgacccgaacgagaaggtcgtgctgcgggatgagctgcatagccgattgcgcttcaaccgccgcgggctggtggggatggcgaagagcgaggacgggacatacgggagccagttcttcatcacgctggcgaacgcggagcgggagctga

SEQ ID NO: 13091 - DNA, 861 bp, A.fumigatus
ccccaagccaacatgcagctgaagtcttcggctgttcgactgctcttctgctcgctggtatctgcggcgccttcacagcccagtaatgcatgcaaagccccaggaggtccccctcagatcaattctctgagtactttgctggtcttgaagtacaataatttgggctccgaaaacaacggtacggccgcggttctgatttatgatcgagtggactacggtcaggcgcaggcgcagtgtgctgccatcggggcaagcctttactccctgcaacatgcgaccgacacaaaccggaccgagcttcaacatcagttcaattatcttattcagaatggcgatctccagaggagcgatcatgtatgggttgcaaagttgtcctcaagggactgctccgcctattctctcagccgcaaggagactgtgagcataccctgccatctgcagctgcccgcgctttgtacgtccaaggttcctcccactaccgacacgaaccgggctgttgtcgagtcttccaagatctcggtaatgtatcagggttacactctcactggatatcgcgacgcacgttcattccggttcctgggtgttccttttgccaacccccctgtcaaagacctgagattcgcaccgcctcagccgtacagtggtcccaaaacgctcgatgcgaccaaattctccgcctcttgcgtccagtcagtctccagctttggtaccctgggcaacagcggtggcatctccgaggactgtttgtatctcaacatctacacccctgtgcttcctgcgcacggcgcccacaactctctgcgcaaaccggtggccgtctacttctacggaagtgcgtttaccaaaggtgtgcgtccatga

SEQ ID NO: 13092 - DNA, 1842 bp, A.fumigatus
caatcagccgcccaaaaaatgcagtgctatacagaattgttatccccttccggggtcactcatgccctggcaatcccatttctctcagcatcggcggaaaatctggtcgtcgtgaagacctctgttctccagatcttctctttgcttaaggttcaacatcactcgagaggtgaaaccattgagactaagtctgcgcggccagaccaggtagagacaacgaagctcgtcctggagcgagaatatccgctttctggaacagtagtcgacatctgtcgggtcaaaatcctgaattctaagagcggtggtgaagctcttttacttgctttccgcaatgccaaacttagcttggtggaatgggacccagagcgtcatgggatctcaaccatttcaatccattactatgagcgggacgatctaacccgtagtccatgggtacccgatctgagcagttgtggcagtatcctgagtgtggatccgagcagtagatgcgcagtcttcaacttcgggattcggaatcttgcaattttaccctttcatcaaccaggagatgacctagccatggacgattacgaatttcatcttcatcaagacgatctcaaccaagtatcggatcacgttggcaatgggttgaagagcaaagactccaccgtgtatcagaccccatatgcctcgtccttcgtgcttcccttaactgcgttggatccctctatacttcaccctgtcagtcttgcattcctttatgaatatagggagccgacattcggcatcctgtactcgcagattgcaacctcacatgctttgctctctgaaagaaaagattctattttttatactgtgtttacactagatttggaacagcgagcttccacgactttactttcggtaccaaaattgcctagcgacttgttcaaagtggttgcccttccacctccagttggaggcgcgttacttatcgggtccaacgaattagtgcacgtcgatcaggcaggcaaaaccaatgcggttggagtcaatgagttcgccagacaagtctcggcattctccatggttgatcagtcagacctcgcactccggctagaaggatgcgttgtggagcatatttctgatagcaccggggatctccttcttgttctttcgtcgggcaatatggtgcttgtccatttccaattggacggaaggtcagtgtcaggcatctcactccgccctctacctacacaggctgggggtactatcatgaaatctgctgcatcatcctcagcttttcttggaagcggcagagttttttttggtagcgaggatgcagattctgtgcttctcagctggtcctcaatgccaaatccaaaaaaatctcgaccaagaatgagtaatgtggcagaagatcgtgaagaagcctcagacgatagtcagagtgaagaagacgcttatgaagacgatctttatactgcggagcctgaaacaccagcccttggtcgccgtccatctgctgaaacgaccggagtcggggcgtatatatttcagacactcgacagactgccaaatattggccccctgagagatataaccctaggaaagcctgcttcgactgttgaaaacacaggtcgtctgattaagaatgcctgctccgagcttgagttagtggctgctcaaggctctggcagaaatggtgggttggtactgatgaagcgcgaaatcgaaccggatgttacggcttcttttgacgctcaatctgtacaagaggtttggacagcagttgtagctcttggcagcggtgcaccattggttcttgatgagcagcaaatcaatcaagaataccgccaatatgttatactgtcgaagccagaa

SEQ ID NO: 13093 - DNA, 225 bp, A.fumigatus
acaacattggcgcatgcatgggtatggctggtatacagaacgatgggtataatactgcgaaactatagcaatgctttccgtgattcgacgctcactagcaatgctgcaggctacttgcagtcgacgatcagttctcgggatttccgcagtgtttacctaaatagtctgccagacacaaggcccaaccaagtaacctggcctacggagtatatcagattgagataa

SEQ ID NO: 13094 - DNA, 300 bp, A.fumigatus
tttcttttccaggttttttcagttcgggccgaatttggtttttctgcccagcatgggattggagggtgccccaagccggcttggatgggggggccaagatcgattaaaacgggtgtcatgattcataaagggatttcggaggtgaacatgggcaagcagattctcgtcggcgagattccttttttcaagggtgtcgacggggatttacacgctttggagcagaaggtccatgagattgagtggggggtggtaattgaaggagtgcaactcgctatcaacgaaattcgagcccggcaatga

SEQ ID NO: 13095 - DNA, 723 bp, A.fumigatus
cgcgtttgcgatccttcttgtcgatattgttctgcgtttcctaatgctggagaatccccggagaaagagaggtgggtgatcgacccgggggtgcttttctgtttcaaggtctcatctggcgcgtttgcagagaagcaatcggatccttcccctgcggatgacggcccacacgaggaagaaaactcgccgctgctccgcccggacaatgacacatcgaccgcctcgcgccccgtggctgcaccggagacagtcgacgagaagacaggtctcgaatactacgtgtacatgtttcgacaccgtcgattcgtaaccggggtcctgggttattttgtctttgcgatattgatctccagtttcgacacgacgcttcccctgcacgtccgcgatgcgttcgactgggatagtatgcccgcgggactgatgttcttggccttgcaaggccccggcattgcgctcagtccccttgttggctggttgaaggaccgcgttgggacacagatccccaccacgattggttttctgggtttggcgcctctgatgtggctgctaggggtgccgggggatgagcgattcccgtgggcaaatcaaggccagaggggcccgatcatctatgccatggacgtgacggccgtgggaatcgtgtcggtcttactcaatggggttggcgtactcgaagctaccggtaagtctgtcactcatcgatcagcagtgtgcaattcctga

SEQ ID NO: 13096 - DNA, 642 bp, A.fumigatus
  unsure (631): Identity of nucleotide sequences at the above locations are unknown.
tcataccttcataccatgcctccgagaaggattttgatcgttggggctggaattgcgggcatcgctagtgctctggccatctcgaaggagctgaccccatatgttccagacctgaagatcaccgtctttgagcgtcatgacgtcctctccacctcggggggcgctatcaacctcactcccgtcgctcagcgtcatctcgaccagctcggagtgctcgcagaactggaccgtttgggagacgagggtggagcggacgtcgatgccatccaattcttttcctgccggtcgggcaaatccctggggtcgattgattttacccgggatcaaggccagggattcagcggatacaaggcccgacgggtgatgcggattatcctctcggtcgcgatgctagcggtcgtcgagcgcacccggaatatcgagatcgtcttcggcaagaaactcgcccgggggcgaagagaccgccgacgaagccatcctgtactttcaggacggcaccaccgccgttgggagatctcgtcctgggctgcgatggcgtgcactccgccacacgcacgcggtgggatcgccacccgactatccgttccgagtacacggggcttctcattccttgcaggggcgttcctcaaanccaaagacgct

SEQ ID NO: 13097 - DNA, 297 bp, A.fumigatus
ctaagattttcgcttgccattgtttataagtggtggcagaatctacagctgatcgcctgttttctctgtagggcggattttcttcctggtcaatatttcgatatccgactggaggttcactctcccatcaacggctctgaagctcgtgcgggtgtacccgaccccgacttcaagttcaccatcgccaggaagggtagaaagccagtccctgtaacgaagtactttgacatcgaagagcccgagctcgaaagatggaacttcacctggtacgaaggtatggtcctcactagctgttga

SEQ ID NO: 13098 - DNA, 1092 bp, A.fumigatus
ctagacctttttgcggaagacgcgaacgcgccttcgcttgtcaatgtgacctccaaggcctacaggagagttgcactctatgagcctggagagtacgaagctaccttgacctactatggaaaccagacaaccacggccaattggcttgtccgggaccttcctaagaagcggcgcgccaagaacgtgatccttttcgttggcgacggaatgaccaccaacatgatcactgctgctcgtctcatcgctcatcgcagtatcaacggcaagtacatgaccaagatgcagctggacaaattccccgttctgggccaccagatgacacactcgatggattcgttcatcaccgattctgccaactctgcgactgctctgtacgctggccacaagaccaccgtcaatgcactgaatgtttatgtcgactcctctgaggatccctttgacgatccgaagtttgagaatattgctgagatcatccgtcgccggtacccgggcgctgggatcggtattgtctcaaccgccttcctagctgacgcgactcccgccgccctggccgctcacaccagtgatcggggtgaatatgagcacgtcatcgacgcttactatgaaggtctgaccaagtacgagtggactagcctggagggccctgatgtcatctttggcgctggtgcggagaacttcctcaagagcaaggacgcttcgcgggactactacggcttattcgcggagaagggctacagtattagctggaacaataccgccctccatgccgctcccaatgacaccaaggctctgggtgtgttccagatctccaacttggccacctggctcgaccgcaacgtctaccagtccaatctccagaacaagaccaactacccggacggctccggtcgcgatgccgaggatctgcctggcctgaaggatatgaccctcaaggccattgacgtgctgaatgcccgtcacaggaaggacggctggttcctcatgtctgaagccgccagcattgacaagcagatgcacactcttgattatgatcggtctctgggcgagctcctggagctggatgataccgtccgcgcgaccattgataagctc

SEQ ID NO: 13099 - DNA, 318 bp, A.fumigatus
aataatcttggattttttagaatcatcgacctttgtttctccagcggtgattcaattccctttttgacgatggaccagcagcctccggttcaaccccagcaacgtcccccgccgtcgctcacgaatccccgatttacgcttgaactagagttcgtttcctcgcttgcaaacccctactacctttcccacctggcggtgacttatcccaacctcctgggaatctccaaatccagcgacgacagtaacaccagcaccgagggcccagaccccgaagcgcaggctttcgccggtcttcaccacggggctggaagtatccga

SEQ ID NO: 13100 - DNA, 1002 bp, A.fumigatus
  unsure (764): Identity of nucleotide sequences at the above locations are unknown.
tacgcttatcgcggatccttcgacccccgtggtgaagacgaaagcatgtggaatgtccagcttcaaacactatggaagactgtggaaggatcacaaaagttcttgcctgtagctccaggccggcatatcgtgatggagacggggcagtgggtcgagctggactcggccacgtggaagcctaggcgccctgttcacatcgtgcttctgaacgaccatctattggtggctgcgaaaaagcgaaagcgggttgatgcaagcaaccatcgaggcccggttccgacaaaacttgttgccgaggagtgttggccgctacaagatgttgacatgattgacctcggggccaatatgggcactggggcagcccgcgaagaagccgaagagcggggcatcgcaaacgcaatcaatgttcgagtaggctcaaagactttcacatatcgtcacgacaagcgggatagttccgacaagggcgagcttcttgcgacttttcgaaaagcggtggaggaccttcggcgaacactgcggtccgagtcagacacagccattaagcccactgacggatttggctatgcaggcgtcaaacattctgtttcccaaaagttggatctcaatgcttcagacgcttcccgtgacaagcccgaagttcgcattgatgttgatggaaagcagcagaatcttcgatgggtggatggacaagtggatgaactcgacatcgatatcgcccttcaacgtttcgaagaagcagtttctggcattgagaggcttangaaattagccaggggcttgaaggggaactcatatgcgcagcagatcatcaacagcaaggtcgatgaacgcgcggcaaggctggctagtgtcttatcacgagcattggctgacactcactcgttcttgaatgccaccaagactaacgttacctggctcactcgtctaggatttgaggatcaggctcgggaggcctacttgaaagctcgatccgacgtgatctccaaacgggtccggtaa

SEQ ID NO: 13101 - DNA, 192 bp, A.fumigatus
gacgctgtcttccatccccggcgtgaagacttacggtttgtgggaaatgcaattcaatacattggcttcatcggggagggttcagaggcaattggtggcactcggggcgcgtacctgaatgctcggtatgagagtcccgggaagaaaccgactggacggttcgccagtatcttcggggccaaacctctctga

SEQ ID NO: 13102 - DNA, 714 bp, A.fumigatus
acatatgggaagggcgttgacatctccttagtgggcctagatccagctacagttcggagtatttccggccttctcgaacgcctagcagtgaaggcctcgccaaggttgatcctcgctctgaggccgcaggacaatcttccggattggatcactcacattcttcttctcgggaattccaaccagatcctgttccagggcacaaggtccgaagcggacaaagtcatgcacgtctggaagcatcttccaaagaaggccaagaggttctcaacgctcagtgaagaggaacacaagatactggacaacgctcgaaaggatatggagtcgggcattctcgaccaacaactgctctgggatctcaatcttatcaaaactagctcgggccgaagcactgcagtggcaactcatgggggagagccgctgatcgagatggaaggtgttcgtgtgcaatacggcgacaaggtcgtccttggtgggtggaagcaaacggtcagcgatcaaaaaaaggagggactgcattggaccgttcgtcgtggccagcgttgggtggtacttggggccaatggttcagggaaaaccacattgctatcattgatcacctcggaccatccacaaacatacgctttgccgatcaaggtctttggacgctcgcgtttgcccgaggcaggcaagccgggcatttcgatctttgagcttcaatcgcgtcttggtcactag

SEQ ID NO: 13103 - DNA, 855 bp, A.fumigatus
tctcatgaaattcatgcttttttcccccggcaacttagcatacgacaggccatcgagtctgcctttgccgaaacattccttgcgaagccgactctggatcacgaacgagacttggacgtaagtgcagcgctgaggttcttcaaagccgaattagacccagatgcggccgtcaccactcaacaggaaccacccgctgtaaatttccgcgcgatggacttattccccaagatcgaacagctcaaatttaccaaaaagaatcgcgattttgtgcctacagactatgatgtcgagtatgccgactctgtacggttcggagaactcagcactgcccagcaacgcctcgtgctcttcattcgtgcattgatccacaagcccgacattatcatccttgacgagcctttctccaacatgtctgcgtccctcagagacaagtgtatccacttcctcgaggccggtgagatgcgcggcaatctcaaatcccccatcacgaagcgcgcagcaaacccagaggctacgtggctcaagggctccaatgtcaaccctagtgaagtacggcaccgaggcctatccaaggaccaggctctcatcatgattagccacgttaaggaggaaattccggacagcgtccggtactatatgcgtctcccgtccgatcccggcgacggaggcgagccacttgacttccggtttggggttctacaacggggcagtgtcatgagtgacccaaagatctgggatctggcatggtctcctccttcggcgttcgataaagcagccaagcaagtaccgcagaaactatcctccgataagaataggcgccatgacgagaatatctatgaatggtacacgatataa

SEQ ID NO: 13104 - DNA, 309 bp, A.fumigatus
gagtcccgggaagaaaccgactggacggttcgccagtatcttcggggccaaacctctctgaatcccttagagggagaggagggtggaacggtccgaaacgaggagttgttgacgcaggttatcaccgacttgcgcttaggcgagctgctcgacatgccggttgccaatctgagcaatggccaaacaaggcgtgcacggatcgcaaaggcccttctcagtgagccagagctgttattgcttgatgaacctttcagtaagtcactgtccacagcaagtgaacatatgggaagggcgttgacatctccttag

SEQ ID NO: 13105 - DNA, 519 bp, A.fumigatus
cttgaacttccaatactcttatcaaaaagcatggtcccgtgcagcatctgccagccccgaaatgagagactccgaccgagtcatttgtggcttctcgccaccattatcatgcagatccaaacccttggcaacaaggtcaacgaaatctacaccgacttcggtcaaagagtcggcatgctcgtgtacaatatcgatgcatttctgccagacagtcgtgcctcgctgtacgctgctgagctgccgggtgagaagggcattgaatccatccaaatggtgtttggcccacttgatgcaggcacttgtcagaacagccgggaagcattgctggtagatgttgattgtgtttttgatcagagtgaaatagacgtaggaaacctggaatatatagaggggaagatcgccctcgaagacacatgccctatatccgtctccgttagtcctaagttcaagcttggggtcctggcgatgaagacttaccggacccgtttggagatcacgtcggatcgagctttcaagtag

SEQ ID NO: 13106 - DNA, 414 bp, A.fumigatus
ctaactagacatcttctacaggtagaaactggtcttcctgcggggtgggaggttcgccattccaactccaagaaccttccgtactacttcaatccctcgactaaggagtcccggtgggagcctcccagcggcacagacaccgagttgctcaaggtctacatggcaaactaccacagcgcccctgccgggcggcctgatggcacagcccagggcgagggcaagatccgttgcagtcaccttctgattaagcatagagacagtaggcggccaagcagctggcgggaggcagagatcacccgatcgaaggaggaagcgatcgagatccttcgaggtcatgaacagcgcatccgctcgggtgaagttagcttaggtgatatcgcagtctcagagtcggattgtagcagtgccaggtaa

SEQ ID NO: 13107 - DNA, 294 bp, A.fumigatus
atcagctccaacttgctctatcccaaagaagaccgcgtcaacaaccgtctcatgttcacgtgtcggacgtgccacgttggcgagcccgccacctcatactgtgtttaccagaacaagctcaacagccaagttggagacactgctggtgtgacccaggatgtgggatctgatccaacggtttgtctccctggtttctgtgcccattgcggggaagagattacctgctttacctgcgggcagttgcctgaagacaccctgtctgactgggattctgaggattccatgaacatctaa

SEQ ID NO: 13108 - DNA, 219 bp, A.fumigatus
tacgtggtttacattttaactatgaagatgcagggcacaatgtttgtatatccctctgaaggctccgctagttctatgatgctaatgcggaatagatttattgaggagaacaacctctataaaattcagcaaaaacaaatccaggagaatcaaagaatgcccccgggaatggcctcccaggatctgatggcatactggggtacggttaccgctccatga

SEQ ID NO: 13109 - DNA, 204 bp, A.fumigatus
  unsure (40): Identity of nucleotide sequences at the above locations are unknown.
aatgcaaactcaggctacaaatttgaaaccttgtgtttgntacaacagccatgggatccgacccctcgggccgagatcgaaagtcgcgaagatctcgtggtcaacaacaatgcacaatactgctctgttgttcgaacaggcatagggagtactcgtttgattattggtggtgaagttgatgctggtatgctctcctcactctag

SEQ ID NO: 13110 - DNA, 402 bp, A.fumigatus
catccagccaattggccgcttctatggctcaaataccacaatccgacgtccaagggtatgtccttttccgtgttaattcgagacaaaaatttgagaaataacccgaaacaggagatcacttgcttctcatatgatgctgagcataagtttcacctcggggattcgtccctgcggtactattatacgccgcgcctccccgcggatttgaatcgaggcttcgacactttccagaagctagatgataccgccgacgagcatctagacgctttgctagagaccattatggctctggaaaaagagacaggaaagcgatgcgaggccgatatcatcacatggagaggcatgatgacgaaagtaagtagctcaagactcttgttttatccggaaggtggcgatgactga

SEQ ID NO: 13111 - DNA, 615 bp, A.fumigatus
ttattggtggtgaagttgatgctggtatgctctcctcactctagtcgaatgcttctggcgattcttaggggtcgtaccaaagcctgtgctgatgctggtgtgctagtgtgggactgcaaacccgaccgcaaggaagaccccatcaattgggtagagctgaagacttcggcagagatcaggaacgaccgggacatgatcaagtatgaacgaaagctcctaaagttctgggcgcagtcgttcctccttggcgttcccaagattattgttggttttcgcgacaatcatgggatagtccatcgtttggaagagcttgaaacggccagtatacccaataaggtaaagaagcttggacggggtacgtgggatggcaacatttgcatcaacttcgcggctgcattcctcgaatgtaagtctgaaaaaaacgaactcgaatgccccttctatgtcccttcagctaatgggttcaaagggctcaaatcaacaatcaaggagggaggaacgtggcgaatccgtaagctggagaagtcgtcgcttattcaggtgttcaagattgaggagactggaacaggcgatattatctccaggtcgtttctggattggcgatcacgctcatga

SEQ ID NO: 13112 - DNA, 234 bp, A.fumigatus
agggacatagaaggggcattcgagttcgtttttttcagacttacattcgaggaatgcagccgcgaagttgatgcaaatgttgccatcccacgtaccccgtccaagcttctttaccttattgggtatactggccgtttcaagctcttccaaacgatggactatcccatgattgtcgcgaaaaccaacaataatcttgggaacgccaaggaggaacgactgcgcccagaactttag

SEQ ID NO: 13113 - DNA, 456 bp, A.fumigatus
cttatgcaggacctttctttcgcaggtgaacttcgaacttttctgctcgcttgccgcgcatcgtacaattcatttgtcctctaccataattttcgacatgccattgacgtgctgcaatccgtgttttgcttcctggtgcatataggtgcattgcccccatatggctctgtcggccccaatactgattcgccgtcctccatcgcatctctcttgacaccgtttgacactttgaccctgcttatttccgcaatcggtcacgacgtcggtcatcccggagtcaacaatttcttcttagtcaagctcaatgctccgttggcacagctatacaatgataattcggtcctggaggctttccactgcgctgcattctcacagatcctgcgacgccactggcctgccgcttttaaggatagaccactccggatcttcaccacagggccggccaccgcgcatgcc

SEQ ID NO: 13114 - DNA, 186 bp, A.fumigatus
catacatattttaatcatctgttaaccgccaccataggcgataatgatggcaccactgatagggtccacaacatcacgtacaatgttggcatctgcatgcctggccagaccaactttaccggcttccgaaaccacttccgcatgcccagcgctcagtctggtggtgtggagaatttctggtactga

SEQ ID NO: 13115 - DNA, 384 bp, A.fumigatus
ctgccgtcgcagggtcgaaccctcttcactggcttcatcgtgactcctaccacccagaagaatggaacttatcctatgcaacttcgtctggcatatggcggaccacacggcatgaccgtcagctggaacacctactcgcagttgcctcatccaacagtttgctttgggcgcagccccaagcttctaaaccgatgtgtctcttctagcgcctccataatctataccacttccatgattaacagcaatcatgtctcaatagccgagttggaagcggatacactgtactactacctgcctcagcatagcaatgcgacttctccctacaccttcaagactagccgtcaggccggtgaccagactcctcacaccgtcgccacggtgtaa

SEQ ID NO: 13116 - DNA, 186 bp, A.fumigatus
ctcaaggaggagatccaggggttccttcctaacatcaccatagccgatggtgccaaagtgtatgagagcctgctgaaccagaattacgtcgaactagcagttattactgctcaggagccgtatatgtttggtcctggtaatcatgaatctaactgtatgtacctccctctagcatacatattttaa

SEQ ID NO: 13117 - DNA, 198 bp, A.fumigatus
cgcatttgcgagaactgccgcgaggtctgggaaccgctgttttggaagtacaatgttgacttggtcctctctggccatgccaactactacgagcggaatgccccaattgccaacttcaacgttcacccgaacgagttgaacaatcgaatgccccatggtccattaccaacggagctgcaggtcattataatggactag

SEQ ID NO: 13118 - DNA, 312 bp, A.fumigatus
ctgtttgtcgcaaagaactgcgccttcgttgagtttgcggagcctgccggttatgccgctgccgtggctgcaaaccctcaccaaatcggatccgaacaaatattcgttgaggaacgtcgtccgcgcggtaacgcttatggcggcaatgctaactacggtgctggccgtggtggcgcgggtcgtggccgcggtgaccgtgctggcaaccagggccgtggtggcttccagcgcgacggacgtggcggctttgctccccgtggccgtggaggaaacgtgaacggcaagccccgcaaccagcctcaggctgcttaa

SEQ ID NO: 13119 - DNA, 336 bp, A.fumigatus
gatttgatcaacaacctcggtaccattgcccgttctggcaccaagcagttcatggaggcgctctccgccggtgctgatatctccatgattggtcagttcggtgttggtttctactctgcttaccttgttgccgaccgcgtcaccgttgtctccaagaacaatgatgatgagcagtacatctgggagtctgccgctggtggcaccttcaccctcacccaggataccgagggtgagcaactcggccgtggtaccaagatcattctgcacttgaaggatgagcagaccgactacttgaacgagagccgtatcaaggaggttgttcgcaagcactgtctt

SEQ ID NO: 13120 - DNA, 399 bp, A.fumigatus
tccattgcggatgccctggccgtggtgaaaacatccggggctgcagctcctgttgtccctgctattcccgttgccccgcctaagcctactcctgctcctgccgcatctcagccttcccctgcccctgccccgtctcagcctgctccttcttctgcttctactcctacagctgccgcctctgaaatcactccggagcaaccaacttccactgacagtgctggctggcaaactgctggtcacgatcataagaagacccaatctcgtgccgccgaagagcagaacgtccttgcatacatcaagaatgtcaatgagaaggtcgatgcaagcttgctcaagcaaactctctctcgtttcgggaaacttaagtattttgacgtgagccgccagaaggtatgttga

SEQ ID NO: 13121 - DNA, 351 bp, A.fumigatus
caatctgtcaaacaatcagaatccatctttctcatatctcgctctccctccgccatcatgtcttccgaaacctttgaattccaggctgagatctctcagcttctctcgctgatcatcaacactgtctactccaacaaggagatcttcctgcgagaactcatctcgaacgcctccgatgctctcgacaagatccgctaccagtccttgtcggatcctaccaagctcgacacgggcaaggacctccgcatcgacatcatccccgacaaggagaacaagaccctcactattcgtgataccggtattggtatgaccaaggctgtaagtttactccggaaacctagactgcagtga

SEQ ID NO: 13122 - DNA, 417 bp, A.fumigatus
aaagagaatcttcgacagacccttttaagcagcctgaggctggttgcggggcttgccgttcacgtttcctccacggccacggggagcaaagccgccacgtccgtcgcgctggaagccaccacggccctggttgccagcacggtcaccgcggccacgacccgcgccaccacggccagcaccgtagttagcattgccgccataagcgttaccgcgcggacgacgttcctcaacgaatatttgttcggatccgatttggtgagggtttgcagccacggcagcggcataaccggcaggctccgcaaactcaacgaaggcgcagttctttgcgacaaacagtcaggtcagttcgagctatcttcaaagcgttcaaagtcaacggtcaacataccttctggcggctcacgtcaaaatacttaa

SEQ ID NO: 13123 - DNA, 309 bp, A.fumigatus
acttacagccttggtcataccaataccggtatcacgaatagtgagggtcttgttctccttgtcggggatgatgtcgatgcggaggtccttgcccgtgtcgagcttggtaggatccgacaaggactggtagcggatcttgtcgagagcatcggaggcgttcgagatgagttctcgcaggaagatctccttgttggagtagacagtgttgatgatcagcgagagaagctgagagatctcagcctggaattcaaaggtttcggaagacatgatggcggagggagagcgagatatgagaaagatggattctga

SEQ ID NO: 13124 - DNA, 309 bp, A.fumigatus
cctgtcagatcaaccaggcatctgaagtactcttctgtactcgcgtacggagtacagccatctgatatatcttcaacatggaggtcgtttgatgatcatctaaaacgagggatcgtcttctacctagtcaaggcttctacctttagcatcagctcaaacaatggcgaaatatccattattaatattacacacccggccaatgctgcccgtagcgagagcacacttggcctgctctcgactcgcaagctatgtagcccaaggccatttctcactggaaaaccagctcgccacctattgcagccccaatga

SEQ ID NO: 13125 - DNA, 2535 bp, A.fumigatus
  unsure (2517): Identity of nucleotide sequences at the above locations are unknown.
atagacggaggctgcagcctcctcccgtcgatcatcgtcttcttcccccactcttttgggttctcgagatatcagcttgccgccatggacgttcttgatcggctccagtctggtctcttcttcaggcccgatgtcgccgacataacttcgaccgtcatccagccttacattttgtccaaccaagtccaacccacaagccattaccagaagaatgcttcgtccagcatcccggctgcaactctcacttcgatacatagttctactcctgaagtttcactcccgttgctgagcgtctcggccgacgtggacatccatgggaggctctgtactacgaaagtgacacagcagttcagtaatgcttcctcctcgaccacacaaaatgcaagatacgtctttcctatctatgatggatcggttgttacttcatttcgctgctggatcggcaacgacaggcttcttgagggagttgtgaaagccaaggaagcggctagagcagaatttaaacatgctgtgtcccaacgcaaggttgccgtactggttgaagagctggtgccggagattttcgagacgagcgtgggaaatatctctgcacaaaccacagtcaagattgagatcacgtacaccaatctcctcaaggtggataacagtactggtggactggtgcttacgatcccaacatcgatcgcaccgcgatacggagccgtgccgaaaggatacagcggaaatgagtcgcttctcacagagggcctgagaattaacgtgcaagcatcgatgccgacagccattcgcaagatggagtcgcgatcacaccccatatctgtcgagatgggagcagtttcccacaaacgctttacagatttcgcagcaagtgcatcttcagacacactggattactccaagggccgcgcgacgctatcaggcagaaaggccgtccttggccaagactttgtcttgcacattttgtgtagctctcgcgaattttcgcggtcacaagctattgcggcgtcgcagcctggccaaccccgcctctccacgattgccgtcaccttgcaccccagcgatctgtttggtcaaaatgttcatatggaggattttgtcggcgaaattatcttcatggcggatagatcagggtcaatgagttcaaagatcccctctctcatcaatgtaatgaatattttcctgcgaagcctccctgaagcatgctcgttcaacatcgcctcctttggttcccaagttacctggctgtggccttcctctatgagatacagccaaacaaacttgaatgtcgccgcgaagcatgtcgaatcattccaagcaaactatggcgggaccgaaatctatgacgctctgcacagtgttctggatcactacaatgagcggaatgacgtgccaaccaatgtgatcttgttaactgacggtgaggtctgggatgtagacaatgtgatacagctggtgcacagaacggcctcaaacggtaattcaaacatcaggttcttttctttgggaattggtgatcaagtctctcatcgcttggtcgagggtatcgggcagcaagggggcggttatgcagaggtcgtgccagagtcctcgatgggttcatggcaggaaagagtaatacaaatgctgaaggcagcattgacaccatctcgccttcagtgcaatgttgatcttggcgaggaacttgccaggaagacatctgagaggcagattgccggatatactgtgcaataccctcagtgggttcaggctcctcaccagatccctgtgctgagtaccttttcgcatttatccctctactacattgtggagagcggattggactcactgccaaaaacaatcaatatcactacaacgaatgagagaggagagaagctctcggcgcagctgccaatccagacagtcgctgaacaaccagccattcaccatctggcggcgaaagcactgatgaatgactttgaaaccggtcaaagctggctgcattcacttaacccaatcctcaagtccactaacccaacaggattcgaaaaggttttagagcaggaagcacagcatgtcgggcagacgtggtcgatacccagcaagtggacgagctatgtggctattgatcgtaccacggcccagcaacatgcgatatcggtccataaagcggatgctatcgaattttcgcaattgaccaggccacgacatacctctatctttccggacccgcgtataagtaataagggagacccttttgcccggggatgtctgctcagttatcctcgccgcgaattccttgcctccacttcaaggttatccggggaagatacgcagcctctttcgccgtctgcaccaccggcggctgggccttatgctttagataccttttttgagcccacatatgccgcgagtccaagctcgttcttggcgggatttgactaccaccataaccagccaagtcaatatcagggccagcccccagcttcaccggtgacgtcccaaactgcggaggtatgcccacgctcaaagaatgcaagngtagtttggtacgtctga

SEQ ID NO: 13126 - DNA, 225 bp, A.fumigatus
cgggatacccgcgctaatcagacattgaacctaagtctgccttacttccccaccgctcaaatcaacgtgccaaggtggttgttctactgtgagtctggcactccttggacgccaccgcaagacgggttgggttgcctaggaagacctcaccatgtgggcactgctatctaccagtccaagaatgcggaaaggacaatctcgttcgttccatatggggagatgtag

SEQ ID NO: 13127 - DNA, 213 bp, A.fumigatus
catttatcattcaggcgacctcatttgtgggtcttgggaatatgggatgcgtggcaatggccccagaccaccggacagaagggcctaccactagcaggcgagtgtatcaagtggccgcgacaacgagtactggttgggttgtataaagtccctcagattgcccgcggaaagcctcttactcttttgccattctattctacccaccgctattga

SEQ ID NO: 13128 - DNA, 390 bp, A.fumigatus
aggtctgtgcttcatccctcgccccgttccttttccggtgttattggcgagctgacggagagctgtcaggatgctgatggcaaggaaatcatcgatttcatctgcatgttgagcgccaccaacctcggccaatgtcacccgaaattgctccaggcgatgaccacctctatgcagacaagtaagtaccggccccatgagccccgacgattcactctggaggtcccgcaattcgaccccgtgggagcttgtaagctgacggcatcaaccacaagccactctcaccaacatcgccaccaaagtgggcgactgggcggaattcacgcgggacatgtgcgcccggttcggctacgacaagatggtagggatggtctccggcacagaaggcgctga

SEQ ID NO: 13129 - DNA, 792 bp, A.fumigatus
tcatggagtgtatccacgggaaaaaacggtaagcttctgggagaacttttgtcaagaccgtggccgatcctgacgaccatgggtcatctctacaacctaacatcacgcggtgccagctcctgtcaggaagagctcagctttgcaattggcgtgcgccagctctgcaagaggtacaatatactcatcattgccgacgaagtgcgaatggggtcgggcaaaactggaaagttcctttgttccgactggatgggtccggagaacaagcccgacatggtggttatgggaaagtccatcaccggcggggcttatcctgcctcatacatcttcgggaaccacgaggtgatggatctgatcggcggttacgagcccgtggcaaccttcggcatggcaccggcggcgatcgcggccactcgtgcgacactggagattatcgacgaggagaagctcgtcgaccgcgcgacctggattggacaggtctggaagaaggaaacggccggctggagcatgccgtggcttgactataccacaaaccgtggtgctgatttgggcctctacctgaaacgaactggcaacccgcggctcaccacccggcgactcagcatgctgtgcctccacaagggcattctcacctacccagatggggaccgcgtgcgcatgggcgtggcgttgaacattccggaggcggatcttcttcgcggtatggcgattctgaaagaggctctccttgaacttgatgattacgacgagatcgagactgggccgccaatgaaaggtgttattccagagatgtaa

SEQ ID NO: 13130 - DNA, 354 bp, A.fumigatus
cggcatcaaccacaagccactctcaccaacatcgccaccaaagtgggcgactgggcggaattcacgcgggacatgtgcgcccggttcggctacgacaagatggtagggatggtctccggcacagaaggcgctgatgcagccgtcaagtttgcccgtaaatggggaatcaagaggaagggcattccgcctcgagatgtcctcgtgcttggggtttcggacaactatcatggcgttggctccgggatctggcccatcatgaatgatatgggccaagcatcgggtaagtatattgcattctccgttctcacttgttctcttactcctgccctttctctgccgacagatcagttttga

SEQ ID NO: 13131 - DNA, 366 bp, A.fumigatus
agtccctcagattgcccgcggaaagcctcttactcttttgccattctattctacccaccgctattgatcaccttacatagttgcttacacgcttcacgagttcctgtaaatcgtttcatcagttatcccactagtgcgacaatcatgacccgggaagatcagagagagggcaaggtcgtgcgactgtcctccaagacgaaggagctcttggagattgatagcaagcattccgcgggaggaatctttccgcttcctgtcttcatcaagagcggcaaggactctatattgaaggtctgtgcttcatccctcgccccgttccttttccggtgttattggcgagctgacggagagctgtcaggatgctga

SEQ ID NO: 13132 - DNA, 1326 bp, A.fumigatus
ccatcttatattgatagagtcagagtgacaatcatccaccgacgggaatcaacaatgacgggcaatctgcagtggctaactaactatggccatgattcgctggcggccggagtctcctttggtatgccttggccaaaaggcctgtatcagccgggccagtcatttgtcatagaagagaatggtcgggaatatgctatagattcgagagaaatagcctactgggcagacggctcgctcaaatggacggcgcattcggtcagtggacacgttgggtacagcgaggggtacactgtcaaaggcacctccgaatccaaggacaccgatgctggtgtcttcatcgaggaaggtgatagtctcacagtcactacgcgccgtggactgcaggtcacatttgcacgcgaggggacttcgtccttgttcggaagcctttcgctgcgtggccacgcgttgtgttctggcgccacacttgtcgcgtccatcaatgacacggagtattcggccattgtcaagaaagttgaggtcgagaatgcctcgtactcaagagcagtcatcaagatctccgggacaatggctgcttctgactccgagcacctcccgttcgatgtgcgcgtctgtatatactccgatgcgatacccatcaagatcctgcactctttcgtccacgatctagacgcagatgaacctctagcctcgctgggtatccgtttctcagtccctctggagaatacggagctctataaccggcacatacggtttgcaggctccaatggaggcatcctcaaggaagaggtccagggactgtctgggttacgacacggtccgacagtcaagaacaggattgatcaatcagcaggacgggctgtcactctcaagcaagaagagtggtccaagactgatctccgccaaggtctctcgtacattccttcgttcgattcttacaccctctcgcagctatcctcggacggcttcaccatcaagaaacgaacaaaacagggctgctcctgggtcaaggtaaccggcggtggtcgcgcagatggaaccgtgtatctaggctcagccagacacggcggcatagcagttggcatgtccgacttctgggaacggtacccgactcagcttgacctgaccgggctcgctcagcgcgagggtgcgatcaccgtgtggctttactctccccttgcagaaccgctcgatactgccccttaccatgatggacttgggctggactcgtacgagaaacagctgcacgcactcgacgtcacatacgaggactacgagccgggctttgcgtcttcaccacggcggatggaacgacagcgtctcaat

SEQ ID NO: 13133 - DNA, 327 bp, A.fumigatus
tctccgtgcggcggcggtcgacgccccggaacaaatcccagtacgagctggacgcgttcatcgcgtcctcgatcttcaccgtgtgcagcatcatggccagcgtgtcggctatctcttcttcgctggcggcgttggtacgcagccggcggagggactgggcagcgtcctcggtgcggcccttgcggatcagccaccatggcgattccggggcgaggtaaatgccgatggccagcgggatgggtagagcccactgcagcgcaaagggggtgcggtaggcccattcgcccgacatgctcaggaacccacggaggacacaggtccccgtga

SEQ ID NO: 13134 - DNA, 186 bp, A.fumigatus
ctccacttccccggattttccaccacagagaaggacggacatccacacggaatgggcgcagagaagaaccacaagcttctacttggcgaggcttataaagattggccgtccttggcttcttggagaaaaggtcatgcgacatctatctcttcgcggacaaaatggccgctcaccaggaagacgtga

SEQ ID NO: 13135 - DNA, 849 bp, A.fumigatus
tgggcctccccctggggtgtcttccagacgatcaccaccacatatgccgccgaggtatgccccaacgtgctgcggccctacctgactatgctggtctcgctggcctggagtatcgggtacctcacggggacctgtgtcctccgtgggttcctgagcatgtcgggcgaatgggcctaccgcaccccctttgcgctgcagtgggctctacccatcccgctggccatcggcatttacctcgccccggaatcgccatggtggctgatccgcaagggccgcaccgaggacgctgcccagtccctccgccggctgcgtaccaacgccgccagcgaagaagagatagccgacacgctggccatgatgctgcacacggtgaagatcgaggacgcgatgaacgcgtccagctcgtactgggatttgttccggggcgtcgaccgccgccgcacggagatcaccgtcttcacctacctcatccaggaactgtgcgccccgctggtggcgtacatagtctattttctcgagcagtccggcctcgatccctcgtcgtccttcgactttggtattggcgagtatgcactcgccatcgtgggggtgtttgtcgcgtggtgtctggtcccgcgggtgggtcgccgcaccctcctcctgtccggaacctgcttcatgacggcgacgactatcctgatcggcttcctggggatcgtcagccgcaagacccatcccaagatcgggtacgggattggcacaatcctgctgatcgagtactttgtgtttttcataacgatcggtccgatcatctacaccattgtcaccgaaatcccgtcatacgctctgcgggcgcagagcgtcgggttt

SEQ ID NO: 13136 - DNA, 1413 bp, A.fumigatus
agattggccgtccttggcttcttggagaaaaggtcatgcgacatctatctcttcgcggacaaaatggccgctcaccaggaagacgtgacagaccctaccaccgtgacggtgatccgggaaaaagacgaggaacactacgtcgtggccgaagacattgccaaaggcgcgcaaaaggccacggacgatgagcacgccatgggcctgagggagggtctgcgcaagtaccccaaggccgttttctggtccatctggttctcgtcagcactcatcatggaaggcttcgaccattccttcgtcagcgggttcatggctttcccggccttccagaggaggtatggtgttctcaccaccaacgggtcctaccagattccagcaaacctccaagcggccgtcagcaatggagtaaatgcgggagagattgtcggtctcctgcttaacggtctgctgtgcgattggttcggctaccgctggctgatgatgggctctctcttcctcatggggtgttgtattttcttgcaattctttgcaaccgatatctacatgtacatcggcgcggaggtcatgatgggcctccccctggggtgtcttccagacgatcaccaccacatatgccgccgaggtatgccccaacgtgctgcggccctacctgactatgctggtctcgctggcctggagtatcgggtacctcacggggacctgtgtcctccgtgggttcctgagcatgtcgggcgaatgggcctaccgcaccccctttgcgctgcagtgggctctacccatcccgctggccatcggcatttacctcgccccggaatcgccatggtggctgatccgcaagggccgcaccgaggacgctgcccagtccctccgccggctgcgtaccaacgccgccagcgaagaagagatagccgacacgctggccatgatgctgcacacggtgaagatcgaggacgcgatgaacgcgtccagctcgtactgggatttgttccggggcgtcgaccgccgccgcacggagatcaccgtcttcacctacctcatccaggaactgtgcgccccgctggtggcgtacatagtctattttctcgagcagtccggcctcgatccctcgtcgtccttcgactttggtattggcgagtatgcactcgccatcgtgggggtgtttgtcgcgtggtgtctggtcccgcgggtgggtcgccgcaccctcctcctgtccggaacctgcttcatgacggcgacgactatcctgatcggcttcctggggatcgtcagccgcaagacccatcccaagatcgggtacgggattggcacaatcctgctgatcgagtactttgtgtttttcataacgatcggtccgatcatctacaccattgtcaccgaaatcccgtcatacgctctgcgggcgcagagcgtcgggtt

SEQ ID NO: 13137 - DNA, 1284 bp, A.fumigatus
agcttcttctcttctccgacgaagaccatcgatattacaaaacacaacaaacctgacatcaaagccttcattgtggaggagctgaagcgcaaggggatcttccagggcgcagacgaggactcgcagcgaaggaaaacgatggtcgaagagcgactctgggtgcgatccaacaattcgtatttgaccattcaacaggatcttcgcaaggttgaagagatcatcacctcgggtggcacggaggaagagcttcaccgggtgttgcacgagtccagcacggatccaaaggagctggtccgagcggaaatcgaaggattggaagcgatgctcaaagcgcgcgagattgaggaaatcaatgagctactggtctgggttatagctagcgacaaatccatgcttctggtggaactggaagcggccttgttcctccgcttcaagaccgtctctctccagccgctcgacaaaaagatcacgggaaaatactccaagatctttaccttgatctacgggaagtacctggcattgaaagatcatgtgcgagactgcgttgttgcccaacgagacaggcccagacagtccgcggatgaccccaagatcacggccacgatcagcatcaccaacggcgatctcaagttggtccagcgcttcttctgggatttgaaccactactccttcctaggcggatttgcgtttgagccaacttccgatcagacaaacgtaggccaacggaagatccaggtgtacgaagctgatgctcacctcgagattgtcaaaagaaccttcgatatcctttcacaaccggtggtcgatgaaaggggcaaggcactggttccgtacctgatgcgatccctcacaacccatctcaaggccttatccgaggtaaccgggctggacgagctgcagcccgcagacaagcagttcattggatcgcatgtctacgagatgttcaacgagggtgatgtcatcgagcggaattgggatttctgctacgcagtccgctggtacgagcgggatgacgagatggacatcttctgggagtggttggatgacccagtggccatcgctggcctagggcctcgggacaaacgatggctggcagagttaaagaaagacaaaaagcatcgcaactcgggtctgttgacgccggccatgaccatggttgctcgaaattggctgcaggacaccaaatggtccaccttcagggtattcagatggatcaggggattcctgcgcctggtatgtagtccttgtattctattgttcgcgcctgggctcgatctctgttaa

SEQ ID NO: 13138 - DNA, 294 bp, A.fumigatus
  unsure (258): Identity of nucleotide sequences at the above locations are unknown.
cgctgcgagcgagcagtacaagaaggtgcgaaagtttctcgctccgcgcagaatcaactgtgttctaacctgggacgacaggctgccgaaattctccaggctcaagaccccatcgacaaggagcagctgcgagacgtgttcaaaaccctcgctgaatttgcaaccgaccccgattatgccttggaatatctgaaggaagccgccaggctggatgcagaagacgtggaaatcccctgtgcgatgctccggcaatgtatnaccagcaaaaacgaagatgaagcgcggtccatgatc

SEQ ID NO: 13139 - DNA, 417 bp, A.fumigatus
atgcagggcgccgagccacagcaggaggatcggaccaccgtggccgagcagactgggaagtcggacaccggaagcgggcgaatcatcatatatgacaacgattcaaacgtgcgaaagatcctcaaagctgagcagtggtgcaagcagctcttgggtgttactgaattagactacacctggtgtatccggttaggggacacctacgctgacgtgcgcgagtatgacgctgcgagcgagcagtacaagaaggtgcgaaagtttctcgctccgcgcagaatcaactgtgttctaacctgggacgacaggctgccgaaattctccaggctcaagaccccatcgacaaggagcagctgcgagacgtgttcaaaaccctcgctgaatttgcaaccgaccccgattatgccttggaatatctga

SEQ ID NO: 13140 - DNA, 549 bp, A.fumigatus
  unsure (526),(527),(528),(535),(539): Identity of nucleotide sequences at the above locations are unknown.
ccagacatgggatcatttgtggaggacctctggtcgagcatctttacccccggtcccaccccgtcactcctgatcgcaaccaatgtcaccttcgctgcgctgcaagtcctcctgctcgcgctcctcctagccacatacagcatccacttcgtcgtgctctccatcctctccgcggcgctctggtggtcgatcaactggtttgctcaggagttgagccagatacaggcacaggaggcgcctaaggaattacacgaggacaaggagcggagaggcggtagcacgaagccaccggggtccttggaaagcagtgacagtgataccgagactgaggttgcgaaggagaagagcaaggtcacagctgccacaggcgttttcacgagcgctgcacctactgctgctgcctctacgtcggctacactccagcccccgactgaaccgcacgcgcgaaagcggctcagcgtgagtggtgagagctcgggatacgtcttcaccacggggctggaaggatccgacgcgggctcagttnnnttccacncggngttcaatccc

SEQ ID NO: 13141 - DNA, 708 bp, A.fumigatus
accgacctatataaatcatgctttggctctgtaactttttcctgtccttttccatcccgaccagccacaagtcttgtcctccgccacaaccttattgtactcccctcttgccctctttgtccctatactcagtacaagccaggtatggcaaaccaagacactgcccttgccaaggatgtcaccccaggtggccgagtaggattcagccatcatgaagaggacattatgattgaccgagagccctatgggcctcccggtcttcgtggtctaatctcgaacccctttgtctttctctgtgccgcatgttcgacgctcggtggcctggtctttggctacgatcagggggtggtgtcggtcattctggtgatggaccaattcctggaacgctttccagaggtagctcctaatgcagctggtgctggtttctggaaaggtctcatgacggccatgattgaactgggggctctacttggtgcgctcaaccagggatggatcgcagacaagatctctcgacggtactccatcgttgttgccgtcatcatcttcacgattgggtctatactgcagactgccgctgtcgactatgccatgttgacggtggctcgctttattggaggggtggggatcggtatgctgtcgatggttgctccgttgtacatttccgagatcagtaagtggcctgggcatacccattcgagacagcgctaa

SEQ ID NO: 13142 - DNA, 1659 bp, A.fumigatus
  unsure (31),(36): Identity of nucleotide sequences at the above locations are unknown.
ctgtccaatactcggaaccttccaggcttcntaccntatcctcccaggcgtccagaccttcagcggaacgtcttagaaatggcggattgtcttcctctggtgtcaccagctacaacctcgcccatgtatggttctcacaacggctccgcactgtcgtcgcctgtgagcatcacgccgtcgcataaacgcaaagtttcggacgggcattctcgatcaggttctgtttccagcattgacgaagcgactctgagtcgatacggctatccgacctatcggcatcttccaaagtacaccacgcaagcgcacccttcgccatctgctccagccacccctgtgacaccaaacattgtggtccatcggccgtactctcagacctcacccaatgacggcactccgtccccgatccagtgtcagactcagatgccacttgtccttccaccctccccattcggggggtacgctcgagtttcgagtgcgcagccttcgcctgttggccttgcgcctcatgcagcggtgatggtgccgcagtcgactaccttgctgtcctacctgacttcccccacgcaagcgatcaatcttgtccgtaatgtcagtgtgattcccacacgaggaatgcacgactatttctggtgggacattagaaacctgcgtagctggacatcgttcacgcttcagacgtttaactcgatcaatggcctcaccaaacttctgagaactgcaatctcctccgacttgactccgcccgtcgcggtagccccgtctcgcctgtctccggactcagaggctgagttggttaatcttatacgagacatctatgggccgcgtgtcaatgccgcgctcgctgtatcccaaggaccagagcacctgaaactctacctggcgcctcacctacgggcttcaaacagcaaaaacacaggtggaccacacttccttgccaactatgcatctgataccgagcagaccagttcgggtatgccgcggggacggctcgtcggtatcgtaaaaagctttgaccgctggaacacgggcatgcgcaacgaagcgcctcaccggcgggtggagtacctcaacggtctagcccatctacaacgatgcatgcgagagcactcctgccgatacggcttcatcatcaccgagattgaactcgtttgtgtgcgggccggctgcgacgaaggggacgatgtgccgtattttggattcctggaggtatcggcgccaatcccgactaacatcgccgtgaacccggaagaacggggcctgcagccaacttcttttgcccaggcccagtcacccgaggcttcccacgactgccgattagctgcagaagaatgcgaccccacatgtactttcgccgacggtctcaacgtcccgatgactgcgagcctagcattgtactttctgctgatgctgtctaaatcggtgcccttaccgtctcagccctctgctcacctcaacgtgggcggacctggagcgctgacccggcagcggattcttccagaggggaaagataaatggattccagaaccgcagattggagagcgacgagacgcgaagcgagttcgaggatgggtgtggcctcaagacgcctggcatcgtcgcgagggcggaggggtgccgcgggggaatcgaagcagaaaaaatggaccaagtaatgtctga

SEQ ID NO: 13143 - DNA, 291 bp, A.fumigatus
  unsure (267): Identity of nucleotide sequences at the above locations are unknown.
atattgagcaaagttctcaatcattttggcagcacccaggaccatccaggcatgagtgggtttgatcccctcttgtactctaggcgtgccattcctaatgctgatcgccccaatgtcgttgaatgggtttgtggccaagtcgcgcgtcaggtctcggagccttgcgggagacaatgcacgaaacgggagaagatccatatggatttgatcaaagtcgtcaatcacaacgggaagccctactggtggcgtattcgtaccatttatcanagcccctatgtaacagtcagttga

SEQ ID NO: 13144 - DNA, 297 bp, A.fumigatus
catatcttagtccccgtcattggtattccaatccaggctctggtcaaccagaagtgcaagcagaacattgcctgctgccagaactctccttccgatgccgtaagtgttcctctatatatttgtagttctctactaacgtccatcagagcggttccctcattggactgggtcttccttgcattgcccttggttctatcctgtaagctactcgtcgcttctgctgttggcgctctcagccagcatttggagattccatatggcagctggggtagggaacagggtcccgggagtctttag

SEQ ID NO: 13145 - DNA, 2652 bp, A.fumigatus
gttacttgggccaagtttctcaatgcccatggtttggaaaaaagatttttctttgccaaactggcaataacccacttggaacggacttcaagacccatacgcattgccgtggatatctcgatatggctgttccaggtgcaggccggtcgaggtggacgaaatccagagctgcggactctgttttacagactattgaagttcctagcgctgcctatccatccgctttttgtttatgatgggaaggacaaaccgcccttcaaaagaggcaaggcggtctctggtcgcagctacgggaacgcgcccatcatccgactttcaaaggttctaatcgatctgttcaagtttcctcgacacgatgctccaggtgaggctgaagcagaatgtgctaggttgcagagagcaggtgtcgttgatgccgtcatgagcaacgatgttgacgccttgatgtttggctcgaccctaactgttatgaatttctccaaggagagtggcagtggcacctccgcagccacccatattacctgctacagaatgtgtggtgatggacatcatccctcaaatgtgccacttgaccgtgctggtatgatcctattcgcgatgctcagtggcggtgactacttgccgtccggagttccaaagtgtggcagcaagttggccgcagagattgccagagccggctttggcggggatctcttggacgctatcaagtcggacgggcctgaactcgacatgaagctagaagaatggaaagaaaggctacagtacgagctggatgagaacgaaagcgggtacttccaaacgaagcacaaagcagtacgcattccagagtcgttcccagataggacagtcctatcatactacgccaaaccagttgtgtcctcgcctcaggatattgaagtgctcaaaacccgcctgatgaatgcttgggaccaggaaatcgacgtcctcgaactgcgaagattcacagctgatgcattcgagtggaattaccgttctggagcaaggaaggtgatcaagttgctcgcagagcctcttgtctcctatagacttcgcttgcagaaaagcccgtcacctcttgccgggactacctcattgtcaggcagcgatgtgcagatgttgcaaaggatctacaagagccgaactagctatagtactgatggcctgacagagctgcagttggagattgttccgatagatgtcgttggcttggacctacttgccgaggaacctaatccaccgattccttcccaggaaacgacaatagtttccggggatgaagatgaggatgcggaagtctatacagaggctacaggtcagccaccgaccaaaaatcgaaccgggaagcgtttcgacccctatgccgccgaaaaagtctggatcttcgaaaccattgccaccatcggggtgcctgaggtcgtgcggacctggaaaaaagaacaggccgaaaaggcttccgcgccgaagaagtccagcaatcgaaagacaggtcccaagaagaagggaccaatcgaccccggcatgaaaagaggcagtatcctcaagtatggcacactcaccaagcagagatctgacatctcagagttcaaaggagcacaactatttgaggcggcgatgtccgcaactcctccaagtaaattgagagcaccagagcttctgcgtgctgagagctctccagacgccttaatgaggagcaccccagtctacggcccatacagtcataagcgcaggttggatattcaaccgcaaaaacatcagattgtagatgatttggttgactcattcacttcttcgtgcaccatatcctctatgccggacgtcaagcgacatccaatggccacgctatcccgcatggggagccggctggcggttgtacgttctggcaatgtcgaggtgcagactctcgacttctcaagtgctgaacctgtcttcaattcctctccatcatgtgcatctcccggtaggatcaaaatcagttactccaatgtcaggtacggtgacaccgccgattcagacctatcctcacacacaaagtctgtcgtatctccgtcatcgcctggaagcgagagtcatcagcagaagaagtcgaggcccgtcaaggcgtcagttgagcctcgaaggggggtagaagttcaggagttggaggacattatgtctgcggttacactcagtgatggaagcccttatgaacagttcgacaggttggcgcaaacaccgaccggtctcaaagttcgatcactaagtggactgaaaattcatgaggttcatgctctcgccgctgaagctcaaatagcgcgttcttctcggacgaaggagctcgtctctccgaccgcagagcgttcaatcgtgaaggcccccggtgtacgcctgccgccaagtgctccaaagactttggcaatggacgcgggcgtggatgatgcgctcgagccgacaacgaaggaggaaaagcgagttgaatcgagcagtaaggtgtcaaggcctcgccagacttcttcacatctagaatccgtcatcgtgtgcggtggcttctggacgactgaggctaagtcccaatctgagctggcttcagaggagacagagcgtgactcgtccaacaatgacgaaaagagaaagaagaagcgcatcccccgtgtaagcattttggacttgagttga

SEQ ID NO: 13146 - DNA, 273 bp, A.fumigatus
ttggctgccgacgagttttcttcatttgctgatctcgacgtagtggcgaagcgcaagacgctctttgatgacagacctgtcgagatctcggagttgacctacgtcatcaaacaggacctggcgtcgctgaaccagcaaatcgcttcgctgcaagcacttacattatcgcaacatccgaagacgaatcgatcaaaagcggatcaggaaggcgagcacaatgacaatgtacgtgaactccgagtggctggcttgcgcaatgctaatgcaacctag

SEQ ID NO: 13147 - DNA, 609 bp, A.fumigatus
gttgtggttatgctccaaggaaagctggcggatgtcggtgcgaacttcaaagaagtcctcgaggtgcgaacgaagaatattcaggcgtcgcgatctcggacagagaactttgtctcttcggtatcgtccaagtcgcaagtcttggatccgcaacggtcggactctccgctgtacatcccctcgggacgaaggacgccccaaccaggtttccagggaggctcttcagatttactgactctagatccctcaaatccctcgcctctcgggcgcccatcgttccaaacagatcagcaattattggtcatggaggaggcgcagacgaacaacacgtatattcaggccagaggcgaagccattgatgccatcgaacgcaccatcagtgaactcggcgggatcttcggccaactggctcagatggtcagtgagcagtcagagatgatccaacggattgacgccaacaccgaagacgtggtggacaatgttgaaggcgcccagcgcgaattgatgaagtactggaaccgcgtatccggtaaccgatggttgattgccaagatgtttggtgtccttatggtgcgttttctctcttctcgatgccattgcggaagctaa

SEQ ID NO: 13148 - DNA, 2649 bp, A.fumigatus
  unsure (1916): Identity of nucleotide sequences at the above locations are unknown.
tctgtcgcttgctctcaatggtctctatctgtcgatttttggactaccgatgaggaggatgcccggaggccgctctatcaccttaccttttcattctcaggactcatgcgcccggctctccttcgattattgaagagaccgtccgccgtttcggttctcgactctctaatatcgaaatccatcagcatcgatcaactggaaagtaaaaataaatgtttacgatgcagcttacggagggtgcaccaaaatgcgagcgcgcggcactgggaggttgacgaacccaggaacgaaacttctacgcatttgaatcaatcaccgacctcgcgcccctacagctttcatgtgtataatatacagtcgcctcagaatacaggacatgactgtacaatgcgacaagataacgctcccacatcctcaatggccaacaatgacgcctctttgcgcttggatctacagcccgacaagctagaattcgaatcggatatcggccacacccaggacatgggttctcgccttgtcgacgatccagcctaccgacagaggatggatctttgggaacagctgcttcgctatcgacagcgacactatggagacagaggaacactggatatctggatagctttgacggaccgagtagacggtgtcgacctgcccgtagtcggggagcaagcagatttcttctggcatagttttgttgatttgggtctcaagagggaagttatcatgggagagatcatggcttatgcaatggagctttggaaggagaccgggagccgatgggacaaattttacgaagtcgtcgttggtggatacctcgagcgaggtatgatccagcatgctattcgatggcataagaaacttcagtatccccatctatcctgtccaaatgatataatgagggtctttgaaccagctctaactatgatcaatggatcgaccaaaattgtcctaccaacgacgaccacacgacgctctgtatctcctggcattagcgctttcaagagcatatgccgacttacggacggtcatcagatatatggcagagtcatttcacagctgttgaacttgggtcgtgttgaggatgcattttcgcttcattcgtttctggtcgagagacatgaccatccgcaaacctacgaggagatcctgcctctgctcgaatgtgcgaaggagctcaacccgagaaaattctacgaactccaagcttacagtaaggatcgcttccccgaccgaatgacatcggccgaggggagtgcccctgctgaagaggatgataagcgggagcctagcggaatagcttggcttcaagaaaagccgttcaaggatgaactgggcgctcggctcttcgccaccaaagcccttgccttcgagacaacggtcgcgggattacggatgttcggtgtacaggctattgggccgcagtccctacgagaaatggcagttagggctcaagggagccaggacattatagctcggttgcgagaacttcacagagcgggcatctccattggcgattcggttttcgcacgactaatccgtaaattggcctcggaaaatcgcaacatacttctgtcggacttactccatagcgatcagcatcccgatgtactggaagacgcggtgatgcaagagtcactgttgatatcttactatatcgctcgcgactggcgtccttataatatgactcttgccatacttacagaaatccttgacgacgggtctaaattgagcaatatccactttcgcaaattcatcgcctcgggagaatgggcttctgcgtctaaaattgtggacgaaatgacactaaacggtcagaaactcacccaagaaagcgtggactttatggtcaagcatactcttactccgcgtcgaccaggagttggaccaatccaaggaacagatgtcccatccagcanagaagtttcgtttgttttccgtgttttgcagcgcgtcgttccaatgggtacatccgtgtctcctgacctttggattgagatgctgaaacgactcgggatgacgaaccactgggatgagcttcgcagatgctgcctttggctcgctcgccaatattccgctggccccaaaccgagcgatgcagtttctttcatcataaattctacggaccagccaaggcgcgaagctgatggtgtagctcggaacgatggcgaccgaatgttgcaagctgtctttagcaaaaacgtgcaggcagctattgtcgcgtggggattcaaaatgcgagtgtctccaaatcccgaccacaaaagctatagtgccttgggagttgagaaccttgtaccctgggtacgtggtttagtacttctacgcgaactggagcacaacggcatccgtctttggcacagctggattcgtcgggcctgccgacatcgcttggctgttctcttcggccactcaaggcaatctagccgacacatgaaccgcatgttacgaagggaatgcccttattctccagagcgtgtgattgcagacatcgaccgtgtgtgggggcatccaccccttttcagcggtcagcaagacgatttgtctcagctggtcaatcctccaagttcgaacatgtctcaacgcaggactggacgaacgctatggagagaagctcgcctgaaaggagcggcctttgtcaaaactaaatga

SEQ ID NO: 13149 - DNA, 2910 bp, A.fumigatus
  unsure (67),(85),(94),(96),(114): Identity of nucleotide sequences at the above locations are unknown.
cccattcttttagttccgggtggcagtattggcccccggatgtattcgtcaatggtacagggcaggntacttttgtccttcgccngaccctgcngnattgtcgcccatcgccgntaccccccaactctcgctttgtttgcacgtcgctttcatctgacgccaaaatggttgtcaagtgcaccgtctgatcccagcgactttaggaactcacctccggaaagcgtcgctcatgatattccctcactaaactcggagcataccccttccaaagacgctcccctgacaagtccggtagcaccaacagaacaagtggtgaagaaagatccggggccctatgggtcaggtgtacggagggcgttaaggaaccggagacaaggcaaagatctcatagctccaatagcaactgtcccacaatggttccgggaacggaatactgttttgcatggcgttgaagggcaagccgtcgcacagtcccaaccacaggttgagataaaacggttagaaacggatgaaaagaaagcggaagtgcatgcccaatcccacggcggtgatggaggcaacccattaccatctgaaacacaaagcggcactagccatagatatgttctaagcgaagcgctttgggaagaactctgtgcatctgccaaagcaggcctacggcttccaccacccaaatacgcgcaggaaccttcggcgcaaaagtcgcatctcgtcctacagtacccgggtgcggatggcatcttatttttggatgcggtggtgaagcgattagcccaggagctaggcgcggacgttgtgacgctggatgctcaagacattgctcagctatgcagtgagcaggatatggtggacagcggtgcgacgtcccctatcaggtcgctaggctacgaggtctaccggccgtctattgcggaatcgtggcaggagtcgggagacaacctcaacgagagtgaagcagatgacaccgactttatcgacgctccggtgccgccgaggaattttcgacccggtttaaagggggcgaaatttatcacgatctcgagcgcgagcaataacggtgatattccattgccgagtattcttgggctcaaatcactaatgacctcatttaatgggcctctggatggtacagctacggcacagagcccgagtgatcgagttgaagataggcggcttcgacttgttcacgagttaattagctcacccagcaagcggtccaagcaagtatctgagacagaatcgtcgtcggaggctccggctgccgccgttcgcgacgtcatcgtgcaggtgcaggactatggggaaatccaggcgacacgtgaaggtgctaagtttatcaccctactacaaaaagctatcatggatcggagaaaagccggtactcgagttctgttcattggcacctcggcgcaggaagtcagccccgattcggactcggcgagactcatgcaaaatgcctttgacgaccatttctcccaaatgctggtcattacgccgggaatggagtcaaaactggtggagaagacgtttacagaggaccgcaagatgcgtacgctgggcatcaacattcgtcacatgcaggatatgcttcgtacccggctgaatgagagctcttcagcagtgagagactccatttttgaaaatcggtcttggccactatctccatccctagtgaaagagtctggtttagatgagcgctactggccttacagccagatccactgggcgacaacacttgcccttggaagcgtcggcccaaatgagcctttgggcattgaacacatccagcgtggtattgagatgatgctcaagacggaccaaaccaagaatgcctggctacgagagagagcgccaagatctacccttgaggcaggtaccgaccgggagcgtttattgaactccctgcgtaaaacctgcaactcccatgagaagaagttgctgaatggcgttgtcgatgccaacaatatccggacaacatttgccgatgtgcatgtcccaccagagactatcgatgctctgaagacgctgacctcgttgtcccttatccggccggaagctttcacatatggagtgttagctacggacaaaattccgggattgttgctctacggcccgccaggaaccggtaaaaccctgcttgcaaaggccgtcgctcgggagagtggggcgactgttctggaggtcagcggttccgaggtgtacgatatgtatgtcggcgagggcgagaagaacgtgaaggctattttcactctggcgaagaaactcagcccttgtgtggtattcattgacgaggcagatgccattttctgttcccggacgggcaccagtagtcgcacctcgcatcgagagctcatcaatcagttcctccgagagtgggacggaatgaatgacatgtctgcatttatcatggttgcaaccaaccgaccattcgacctcgacgacgccgtccttcgacgtctcccaaggagacttcttgtcgaccttccgacggagcaggatcggttagccattttgaagatccacctcaaggacgagaccctcgatcagtcggtcgacctagcagaattggctcatcgaactcctctctattccggctccgatctgaagaatctctgcgttgcggccgctctggcctgcgtccgagaagagaatgacctcgcagccaaacatcagggacccgaaccgtatcaatatcccgcgcgccgcatattgactcgggcgcactttgagcggggaatggaagagatcagcgcctcgatcagcgaagacatgtcctcgttgtcggccatcaggaagtttgacgagcagtacggtgatcgtaaaggccgtcgcaagaagagcgccggatggggattcatgcctctcggtacggagcaggctgaaacggatgctgcacgtgtccgtacttga

SEQ ID NO: 13150 - DNA, 873 bp, A.fumigatus
caggctatacctgggatgaatccaggcaatttcgctccagctatggcgtatagtgcgttattaaacctagatggtcaagggaaaagagaccatgtgctcatcctgtgtaggcatactttcggcacaaagtaccccgtcgatacccctaggtcgcgccaagtcctacccatccgtcctcgcagcgcgtcgtctcttgaacaacgcaccaatagcgctaacgtcgttgcgcaaccgcgcaactcggacgacgatggtactctagcggtggacaaaggccgggagggcgccgtgaaagtgatggcacgtttttctgagagcgggggtcaggaagcaaaaaccctggaggagtaccagaggctggctgcggtagcagatccccaatacaactgtctcctgaggcccctggagatgaagcgattacctagtcgcgatccagagcgcgagccgccactggtggtctgcatctacgagagccctggtcagaatgacctgttgaaattcatcgactgcggcctgacctggcatcatgggtctctcaatgtggatggtcatgatacaagctccccgcgctgctatcgggacaaacctatgccgctttccaccattctcgggttcgccatcggcgccgcggaatgcatcaaaattctccatagccagcagattgttcatggggagatctgggcggattctttccacttcagtgaagagaccggggaggtaaagctgattcacctgggagccggtctacggcattatcactccgacctcagaaatgcaacttggtccgctctggcaaaccaggatggcgctacggccaggatatcatatgagcccggagcagacgggccagacgcccattcaacccgacagtag

SEQ ID NO: 13151 - DNA, 1200 bp, A.fumigatus
ctctttgtactaatgaaggtagttttcccattcctttcccctttcccgtggcctaaacctaatcctatcaaactagcagggttccgaaaggcaagagatgtaggagtcaccgctatcaccctatcaccactcaacgaagacagcgtgatggagtatgtcgcaaacaccctatacccattcgtccctcttatttggcccttgggggcgctcattcaatccctggctggtgggaacccgttctatgtccgagaaatcttaagcgtttgctaccgacagaaattcgtgtggtacgactaccaggacgggtcgtggtcgtttgatcttcgccgcatatcagattatttcaaggcagatgactaccatgaggctgtcctcgatgatttcttggtcagtcggttgaacagcttacctcctgttaccaagtcaatcctagcctgggcgtcctccgtgggaatgagcttctcgtttcaactggtgcgcaggcttctcagaggcgacaaggcgacttctaaagcaggcctgcccgaggtggcaatgatccaagaacttcagcctgccatggaagcctatgttattgcacatacgaagtaccacgacgtcttctctttcacgtataaccgttatatgcacattgcagcctcattccacacaaaggccaaagaccatgtccactttatcctagcacaagttctgttccagtattattcccacgacgataaatatcgcactatgctggcatcttccattattgaatccgctgcggtcatcaaacgctccttgactagaagacagcccttccgcaagtttctggtggaccatgcaaaggctgccaacgagactggcttccgctcaaccgccgttgactcatatgcgtgttgcatcgtcctgcttcaggataatatgtgggatgataacgctgaggatgtgagctatgacgagacgctacacatttttactgctgctgcagagtgctatctgtatcaaggacagcatgccaaagctggttgcttgctgcagtcgatactctctcatacgcggagtgcggtggacaaggccccagcgtggatcttgcaatctcgcctgcttgcgcagcagggtaacttaactgatgctttcaaggcgctaaaagcgtgcctcgggactttaggccttggtattgatgatgatctgactttcgccaaatgtgacaatcatttctag

SEQ ID NO: 13152 - DNA, 384 bp, A.fumigatus
ttcacctgggagccggtctacggcattatcactccgacctcagaaatgcaacttggtccgctctggcaaaccaggatggcgctacggccaggatatcatatgagcccggagcagacgggccagacgcccattcaacccgacagtagagcagatatttattcccttggcattctcttgtggggcgttctggtccaggaggctccatttcgcgggaggacccccatggaaatcatcagagcggtgctgggagaggaacttcctctcgtatcgagcttgcggccggatgttccggacatcatcgcgcgagtgatcgccaaagcaactgcgaagaatgcctgggagcggtaccattccgttagcggcctacggcatgacctcgtgtag

SEQ ID NO: 13153 - DNA, 1032 bp, A.fumigatus
ctgcggaggctgctggctgccagagagccagacggcaaggacaacgatgaaagggcagcatctactgctgaagaactcgagaactggaaaattggcagcaaggatgtctcgccgttcttcaccctgccccgcatcatggtgggccggacacaggagcgcaatgccattgtggagattttggaccgtatgtatcagatgtaccaagcaaggaaagggctacagctgtcattgttgcctgagggtcagttcgatacgttcgatgctttggccttcccaagcgacaccaccggcgaagaggatggccaccactctatggacgtatttccaagattgttggcctccacaaacggcgtccgccggtcatatacagccaacacgactcgtatgcggtcccctgccgactcccgatatgcttcgttcgagagcattgaatccacagcagggtcgtcagacacaaagactgcagacaagcgactgtcgaccccgtccattgacagcgctagtgtggagggaagctcgcgatccagcgacagtgctgggaggacagcagcgcattgcatgatagtcccaaaaggacgatgcgagctgatcaccatcgagggaggtgctggcttgggcaaaacccggctgatcacgtccgtgcagattgaagccagacagcgaggcttctttgccagttccaggcttgaccctgccgccaaagaacggttgcgcccagttctgcaactgttttccagcctgttcgagcaggagttctcggagaacacgattgtgccgagcttcctgcccatgctgaggaatcatattgggttcgcctggaatactctacacaaggttttgggtcttccgaagttccttttaggatccggtcccgatttgccagaccagacatcaaagcgtgctagtaccacaagtcctacctcctcccggcacaccgggacccttagagtttcttcggaccggatcgtctaccaagtccctgccgctcgtccgcaccctgctggatattctgcgagctttctcgcgatataa

SEQ ID NO: 13154 - DNA, 189 bp, A.fumigatus
  unsure (78),(161): Identity of nucleotide sequences at the above locations are unknown.
gcaagaaggcatgcaaatgatttgctacccttcgtttctccattgacaataggcacatggtactacctgagaatccantactcttattgtaaatacattcaagaaatagaaggcagcatctcttattacaatgtgaagaataaccgaaagggttttcatantgtcagcgcatacacagtctcggtataa

SEQ ID NO: 13155 - DNA, 552 bp, A.fumigatus
cccgtttgctggaccagcaatcccgacaatacaggacttggagttacgaaaaggtgcgtacatcccgctaccattacttttcatgcggctaacgctgtgtgtttaacagagtccgccctagatgatgccatcgcggctcgccaggacgcaagaaaacaacatcgtgcagaggcacgtctccacaagtctgagatgcggcaaatagaggatgagatcgcaccgcgcgcggaacctggaacgcgtgaaaggcgcatggagaagcgtcgagaggcggcccttgcaaaccgtgccttcgctgaatcacggcgaggtggctcacccatagaggctgcaccagatgacgaacttatgggctccggcgagaacgatctagatgccataaaaaaagcacaggctagagagcagcgaaaaaagaacgagcgtgaaatcagaagggaagagatactgcgagctcgagcagcggagcgcgaagagcgacttcaacaatatcgaaagaaggaagaggagactattggatggctcaaaacattagctaaacagcggtttggctaa

SEQ ID NO: 13156 - DNA, 420 bp, A.fumigatus
agatggttatcgctgtacctgacaactttgaaagggatacgatcaccacctgaggaactccacacaatgtctacccgcgattatcgccatagggaaagatcccaccgcgatcacgattcgcgctcgcgctcgcgctccccagaccgaagtggcagacacaaaagacatcatcaccatcggcgccgtcatagtcatcaccgtcaccgagactacagtcatgatcgcgatcgacattcacaatcagcttcttcggcgcctgcagtacttccctttaaagcgcgagagctttcgaaaagggatctaacctattacgcacccatgttcgcgatgtacctcgatattcagaagggactgataatggaagatttgagcgaagaggagatcaagggtagatggaagagctttattcgaaaatggtaa

SEQ ID NO: 13157 - DNA, 285 bp, A.fumigatus
cattttcaacccagtatatctactactcccgtctggcaatttgataaagaaacgactaacaatatggcactgcgtgaaataaagggtactccaggtaatcatatcctctctgacgtgatagaagatatcctcaattacaagcagatctcgtcagatcagacaagatttgggcgttggtctagagatgtaaatgatgcagagaccatcaaacgagcatccgtcccctactctcttatcctgctgctcccagtgatcacttgcaatctaatcgtaaacctgcactga

SEQ ID NO: 13158 - DNA, 1659 bp, A.fumigatus
ccatggctaattgtgttctaccgccaaggagtcaatgtccgcgtgtcaaacatctacaagttgaattctgaattgctggccgtattgtcttcatcgccacaggcggatgctgagccaatatccgataagtctgcacacacgaatgggccactgcaagcgcaggcgaatgttaatccaagttccgatccttttgcctcgactacttctcgcagtgattcaggtaccagccatgggagctctgccttgtgggaaaaactaaatggaagcacagtaagcgtggcgtcatcgggagtgccagcatcaatcgtgcatgaaggagccgaaacgccgagtggtcaaagcagcggatctgatgagttccggttagctaacggaatgaacggcgcggatgcttcttgggaccctcctttagctcctgcaaggaaaaacagaacgatccaggcaataagcggcgagtatccaatggaccctcctcccaagatgaaacccactgggatccgaccaaggacaaggaccaggactgagccggaggaccaaatttcagcccagatagaccgggaggcaacaaatgcgcccagggtcggggaccgcaaacgaactgtttctggtcaggtagcgcatccaccgacgtcacaacccacagaaccaggagcaccccagcggcggagtgtgcgactcttcaaccagattaaacccacgaccagcaaattgtcggcgtccgcgctgggagtcaaggatgctagagaagtcaagaaagcgaaagccacaggtacgaaggggcgtacgacaaccaccaccatgggacgagtagtgagtggcagccgaaaacatgccagcgaacatcatgatgcagatggtaaagacggacggtcggtaccgtccgcccacactcacgccatctccaaaggcgctgctcaagaaagatcgaaagaaatcgaggcgttgacctggctgctggagctattctcgaaacttgcttctggattctttgccttgtgtcgctaccgatgcccagagtcaatccagatcttcaattcgctctctcaaggccaacgggaaacaccgtgggttctcgctcagattggacgagcgtactatgagcaggctatgtattccgaggcagaaaagtacttctaccgtgtgaagaccatggcaccctcgcgcttggaagacatggagatctactcgactgtcctttggcatctgaagaacgatgttgagttagcctatttggcgcatgagttgatggaaacagaccgcctgtcgccacaggcgtggtgcgccatcggtaattcgttttcccaccagcgagatcatgaccaggccttgaagtgctttaagcgggcaacccagctggatcctcagtttgcctacgggtttactcttcaagggcacgagtatgttgccaacgaagaatacgacaaggcgcttgatgcataccgtcacggtatcagcgcggatagtcggcattacaatgcttggtacggactgggcacggtttatgacaaaatgggcaaactggactttgccgaacaacacttccggaatgcggcaagcattaacccgaccaacgcagttttgatctgctgcattggattggtactggaaaaaatgaacaaccctaaatcttcaccacggggctggaaggacccgcgctcc

SEQ ID NO: 13159 - DNA, 504 bp, A.fumigatus
tcatccgaaaagaacggcctgcgatcacggccgacctcatgctcgcctatcgctcgagactatcccctcaccgactctgacccgcgtaccctggcctcacaacaccaacacttctcctctagtttcgcgtacctagaacacgcaaacatgtcgccatcaatatcctacatttcaggccagcttaggcagctaatatactatcatctcgataacaatttgtgccgtaatgcgctgttcctcgccggtcgtttacatgcttacgagccccgaacggcggaagcgtcgtatttactcgctctctgccatcttcagaacgggcaagtcaaagccgcatacgattacagcaggaattttggatcgagaagcacccacctcggctgctcctatgtcttcgcgcaagcgtgcttggacctaggaaagtatctggaaggtatcacaacgttagagcggagtaaaggcctttgggcttcaaagaaccactggagtaagtattccatgcgctga

SEQ ID NO: 13160 - DNA, 222 bp, A.fumigatus
tatactatcatctcgataacaatttgtgccgtaatgcgctgttcctcgccggtcgtttacatgcttacgagccccgaacggcggaagcgtcgtatttactcgctctctgccatcttcagaacgggcaagtcaaagccgcatacgattacagcaggaattttggatcgagaagcacccacctcggctgctcctatgtcttcgcgcaagcgtgcttggacctag

SEQ ID NO: 13161 - DNA, 405 bp, A.fumigatus
agcggagtaaaggcctttgggcttcaaagaaccactggagtaagtattccatgcgctgatacttgcagtcgacctgcatttatttcgttgctttctgttactgacacatttccaccttgtgctctagataagcacagtgagacgcgaagacaacatctgccggatgcacccgcagtattctgcctgttaggtaaattatggcatgcgcataaggacatcaacaaagctgtggaatgctatgttgaatctctgaagctgaatcccttcatgtgggatgcgttccaagggttgtgcgacaccggtaagctttggagaataaacctaatacatctagccatggctaattgtgttctaccgccaaggagtcaatgtccgcgtgtcaaacatctacaagttgaattctga

SEQ ID NO: 13162 - DNA, 453 bp, A.fumigatus
ttccaaacgtcgagctgcttctctaatcttcctgactctcggaacccgcaccctaggataggcgctctgatcaatttcaaactgaatatccccttctatcgggactgcctctgggaaatcatcaagcgtttgatggataaaagaaaactcctggccttcggcaggtttttcaaatataaattcttcgttctggagctcccacctcaaaatcgcaccggcttcacagaagaacttgcttgtgcgtggatccacagcctcagagaagattacgggggttcgctttatctggtccaagatgtcgtccagagtcttcggaaaccggaaggcggctcttgcacgggcaagggccccagctcggaccgctacaagcccagcctctgtcgagaaggtgccggtactggaatgaaacgtctgcactggattcatgaacatagcgtaaggtgccatgagtga

SEQ ID NO: 13163 - DNA, 2817 bp, A.fumigatus
  unsure (1445): Identity of nucleotide sequences at the above locations are unknown.
gcagtcatacgtttcggcttgccaggtatgaatcgagtcggacgtccgaagggaacccccaacaaaccaaagctcaagaaggaacacctgtctgaattggatggggatgccattcttgaacaagaccacctggctatcaagcggttgaagaaagctcaacgcgacgaagagagattccgggggatgtctgaaaaagagaaactcgaggcgctggggctggatgagacgtggactgaatacagtgtcttgctccttgagcgcacggaacctggtgtgtacatcacgcctcgcggacgtcgcaggccagcggggaaacgacaaggtcgtccgagaatctcgcgccttgcagttttcaggtcgccaaagttggcatcactgccttggtttactgtgagcccggaaggcgaattagaagatgaagctgctagcgctagtcgacaagtttctcgggctcagagtgttgaaacacctgctgttccctcgtttactgcgatcaacacccctgcgacgacttctgcagcgctagacactccttcgagaggcacaaaaagaacgcttcggagtcggattccccttgacgcagaagccgagccggaccatcaaagaccgtccaaactgcagcgtcttgaagacaccgaggtttgtcgacaagtcgctgaagcggaaacctcaaggtctcaggaaccattgtcagacgaacagcagactgatgagccctctgtcgacaccgtcccgaacgcaacttcccgggccagcaaacggagaaaggaactgtctccaatcgctcctgaggaagatgtcgcagtccacaagagcttggaaggactagtctcgcagaaggcacaagccccgtcaccagtaggaaaaaggcaagtcggccggtcgcagcctcgtcaaaacttagagacaccgcacaaaaaacgtcgatatgaacctcaagctgagcgaggtggagagactgcctcactccttcctccgacagccacgattaaaaacgtcgctgagcaggctgctccatcggagtcccccaaagttggggatggtgaacaccgccaggttgaagcagaagcaattggcaggccattggaggtcacaggacacgtgaacgtagtggcggatgaagtcaccccggctgcaactgccgagttaagcgccgctatccataacatccaagaagccaacgatatcgacctgaaacccacttacgggacaccggacgtccagcagcgcgacgcatcgcagacgccagaggggcatcgaccgcgcacaaagaggcaagacaagctaggctctgtcgcggtcttgcggaggagcattatcatggatattattgagaaagccggaggcgcatactccatgggtaccgaaatatggtacccatttgcaactgcatggaagaggacgaagtacaaggaaaagccagacatgcgaaccgtcaagacatntattaaacacctgattgatgcaggcaaacttcggcagttcacattcagtgggagggacagcaaaggggtaatggtgacaaagagcattgtcgccaagcctgaactgcagcctgatcatccagtaatcaaagacttgcagcacaagatgctcaccacgaccgctcgatactacttcccacccggtgttgatgtagatcctgaactgaccaagtcaagtgcgaaaagtgcgaagagtatgccgagcggcgaacctaagatggcgaaactccccattgagcgtgggattaccgtgcatttacatcaaaagccagcctttgtcctggctctggagaagagaaagggacagagcattcaacggcggctgctgcaacgcctccagtctgacacggagattctacgtccctctggagtcgttcgactcgccagacttcaacgcgggcccgcacgggactctctggaacgcgaactgggccccatctccaagaagcgaggaaaaagccagcaacagaaacgcatcctgaagcatcacgccccagcggacggcgccgctgaagaagaggaagctgacagagctccccgcaggttgaaacgcctctggatgcctatttcactcatggcaccttacgctatgttcatgaatccagtgcagacgtttcattccagtaccggcaccttctcgacagaggctgggcttgtagcggtccgagctggggcccttgcccgtgcaagagccgccttccggtttccgaagactctggacgacatcttggaccagataaagcgaacccccgtaatcttctctgaggctgtggatccacgcacaagcaagttcttctgtgaagccggtgcgattttgaggtgggagctccagaacgaagaatttatatttgaaaaacctgccgaaggccaggagttttcttttatccatcaaacgcttgatgatttcccagaggcagtcccgatagaaggggatattcagtttgaaattgatcagagcgcctatcctagggtgcgggttccgagagtcaggaagattagagaagcagctcgacgtttggaattagttgaacctgagaaatttccaccagaagagacagaagaggcagaggaatccgaagagccttcagaatcggaagtttcctctgacgctgaagattcggacgactcactggatgcactggatctgctgttttccgctgactctcgtagacggcgcagcgactatgtcccgcaaaaccgtcggctggagaaactagccgccgaaggtcctcgacatgtcgtcctgcccaaaccgtcaaatcgaccggctgcgcgtcggaatcgagctcttctgctcttcaccccgagggccgaaggaaccgcgcaagcgtaa

SEQ ID NO: 13164 - DNA, 468 bp, A.fumigatus
gatatcctgcgagccggtttcgggagctttttccggcgaccactggaaaacacattggctcggttagtggaatgctggcagttgtcccagcctctgcacctgcgccacctagccattgtgcgggacacggcacttgagaagactatcacacattatatccattactcaacggccaacttccaaaaactcgtcgatgccggagaggcatcgtgggaagctgtcgaatttgtccccaggaacactaaggcagagaaaatttccgtaccgcccatcgatgctgttcccgacctggacgagaatggattacccaaagctgtccctacgaaggaacttgtcaagaatggcaatgcatcgcttttggctggcatcttgactgtcaatccagcagattacaattgcactggaaatgatcctatgccgttacggctgaaggataatagctatggtaagtttagcccctggcaataa

SEQ ID NO: 13165 - DNA, 351 bp, A.fumigatus
agagtccgcgaagcgaacacggcagtgttaacggaagccatagaagcagaaagaggagcagaacccgtgacagtgaacgccgtcggtctcgcggtgatcgctacggcgacgactaccgttcttctggcgactattaccgcggacctggacggcctcgcactcgatctcgctccccttatgatgaccgatactaccgcccttcgggtcgctctcatcgagaagatcgggaagatgagcgacgttcccgccgtgaacgcaagcgcagcccaagccgagagaagtctccagagctcaatgaggatgaacgtgacaggcgtacaatctttgttcagcagcttgcggcacgtctga

SEQ ID NO: 13166 - DNA, 627 bp, A.fumigatus
  unsure (578),(587): Identity of nucleotide sequences at the above locations are unknown.
gagcaagggttacggctttgtacagtaagtgacgaatcttcctgttttcgtgattgtcctgcttcagctgacaaacgactttgcaggttccgtgaccccaaccaggcccgagaggcattggaaaagatgaatggttttgaccttgctggtcgcgcaatccgcgttggccttggcaacgataagttcacccctgactcgtcagcgcaacgctcgcagagccatggtgcgaaccaaccgaatttccagggctcttcgttctccggccagggaggacgtggtatccaggctggcggtactagtaacttcgatcgtgccggtggccgcgattctgaaaagggagctggcgctagtgctctggatgatacggacgttgccggtgtgaacttcaacaactatagtagggacgcattgatgaggaaacttgcaagaacagatgaacctgccgaacctgctgccgatgataagcagaaggtgctccgccccaaaacagaaaccaagccgttgccggtcaatgtcaacatggcaagtcgatgcgttttgcttcgtaacatgttcgaccctgcagagtatgtcatctntacattctnagagagctacctcccatgtactaaccaatccacacgataa

SEQ ID NO: 13167 - DNA, 252 bp, A.fumigatus
ggcgaggcctgtatcaaggagctggaggatgacgtccgcgctgagtgcgaagacaaatatggccatgttgttcacattgcactacatcccaactctcaaggcgacatttacctcaagttcgacagagtccaaggcggcgagaatgccatcaagggtctcaacggtcgattctttggcggtcgacagatcaccgctcagcctgtcgtcgatgccgtatacagcagtttgttctcccgcacaaaagcaatttag

SEQ ID NO: 13168 - DNA, 294 bp, A.fumigatus
ggactgcaacgcggccacataaggtatgtcaggatatcaactgagtgtgcacgtacttgggggcaatgccctcgtcaaataggatcgacatacgttagtggatatgataggaaaacctatggttcctataacgcagaagacaagcacattaaatggcctccttatctaccatatactttccggcggtatacgacaaaggcattgattttagagacggaacttaagatttcaattcaggctgagtacctcagcatattaaacacatctcattcacaaaaccatgtgctctcttga

SEQ ID NO: 13169 - DNA, 459 bp, A.fumigatus
gacgaagacatgaagagtccgcgaagcgaacacggcagtgttaacggaagccatagaagcagaaagaggagcagaacccgtgacagtgaacgccgtcggtctcgcggtgatcgctacggcgacgactaccgttcttctggcgactattaccgcggacctggacggcctcgcactcgatctcgctccccttatgatgaccgatactaccgcccttcgggtcgctctcatcgagaagatcgggaagatgagcgacgttcccgccgtgaacgcaagcgcagcccaagccgagagaagtctccagagctcaatgaggatgaacgtgacaggcgtacaatctttgttcagcagcttgcggcacgtctgagaacgaaggaactgattgctttcttcgaaaaggttggacccgttaaagaagctcagatcgtcaaggatcgtgtgagtggaaggtctaaagggtaa

SEQ ID NO: 13170 - DNA, 360 bp, A.fumigatus
gtgtggctcctctacttgttgctagtttgtcgactaatggctcatagtgtgggctatgtcgagttcaagagcgaagaatccgtcgcacctgctattcagctcactggacagaagcttctagggattccaatcatcgcacaattgacggaagcggagaagaaccgccaggcccgtaatccagaggccagcagtggacataatcacgctgcgccatttcacaggttatacgtgggtaatatccatttcagtatcactgaaaatgacctccagaatgtgtttgaaccgttcggtgaactcgaatttgttcaactgcaaaaggatgaagcaggtaggagcaagggttacggctttgtacagtaa

SEQ ID NO: 13171 - DNA, 1170 bp, A.fumigatus
  unsure (876): Identity of nucleotide sequences at the above locations are unknown.
cgagaagccctgtcgccgatgtcaggaaaagaatctggtctgccattgggcgcagggggtcagttcgatcgacggatcccctccatcccaacgtcaaggtgggtgcgagaggactcagttggccaggcccaccaactaagggaatcaaatacagtatgtgaaagcgaccaggcgccacatctcccgatcgacaggcaaatcacgcccggtccaccccagatggtcagtccccatgcgcagatggacaattacctccctgcggggcttcaatcagggctgcctacgatggatagcgacagcggcgtgttcagcgtcgacggaaccttctttcccgactttatcccggactcactgatcccgtcattgactcgaatgagcgatctggacccgctgccggtccttccacaggactccatccacaatgtctttgaccacaatgtcgacttcgacttcgatttgaccgacttggattatggtctcattgacctgttcaactcgcggggcgctgtccatcatcatcatcatcatcatgcctacaatagcgacggagccaccgagcatggtgatgcggacagcggcattgccatcggcgccgaggcgtatcatcggtcatctctgtccgcgtggaaacccgcccgcgaagatcatgcctttgctgaccaggagaatctgtctgtcccggaggcgattgacagccccgaggccaattttagaccagatcgtcagatggtctcggaacggttgtcccccagcggccgtgatcgcatttttggcctagtgctgcagaccagtcagcgaaccaacctcactcgcatcatgaaatccttcccaagtacccaactgctggacagcttgatacagtactactttgagtcncaatgtcatgacatcgactcctggatccacggaccgacctttcggatgaatgacgaaacccccgatatgcttgccgctctggccgcggctggagcccttatatcaaccatcccgaccatccgcaagttaggttatgccttgatggaaatcgtgcgtctgcagctgtcggataaggttcgttggtatctgtacctcccggcggcgaaagaataccagctaacgctgctcacatgtagtacgagagcgacaataccaccatacgcgatctgcgcgcctcgcagacgtttgcgctga

SEQ ID NO: 13172 - DNA, 288 bp, A.fumigatus
atctgttgcagggacctgatgaagcgacacgcggccggtcatattcacccacgcgacaccaaacgaaggcgcctctcctcctatcccaagaatggtcgtgtgtcgcaggcctgtaagacctgcgctgcatcgaaactcaagtgtgatgacgagaagccctgtcgccgatgtcaggaaaagaatctggtctgccattgggcgcagggggtcagttcgatcgacggatcccctccatcccaacgtcaaggtgggtgcgagaggactcagttggccaggcccaccaactaa

SEQ ID NO: 13173 - DNA, 1086 bp, A.fumigatus
tcgtttgtgcctgtagctggaccaactggtttactgattcgagacagactcgtgcatcacctgtttctgcacgatgcccagtcggccatgatgttgaacgtgaacccaatcatttcgtactccgagctggagcttcccctgcctgctcctcgctcgttgtgggaggcgaaatcggccaccgactggaaggaagcgtacttggcgagcggactgtcgagccatggccgaacgccctcgttggttgacacgctccaagacatgtcgcagttgtcggcctttcagtcgcgaatcgatcttcaactgtccacctcggccgtcatccacggtctcttcacgctgatcagcgaatatcatcgccacaaattcatcgcgaaaggccattccaaacattggaatgctttggtgatcagttcgcgacatcaagagttgtcacaagcgatgcaacatctacgcatgctgtgtttcgagatgtccagcgctctcgggccccggattattctggtctcggagctcatctccatgttcctccacatgtcgctggaggaactgcagctgttcgccggcaaggaggataagaaccaagcccgtcgggtataccagagcgcgctcgagtggatcggcagtattgactcgcgccgagcgatttggcacgccggccaggtgatacgggcggccaaagtcatgcccccggggtctttgactgggttctttgcgttgggcgtgtactacgctagtctcgcgttttggtcctacagtgtcgtctccagagccaaaggttctccagcggccgtcgtcaggccgccatcggattcgcacttcggcgggccctggcctaccgtctacctggacggtgaggaaacggccgacgtgcagaggttcatctctttagggtgcggctgtccggctttgcaggctcccagtggtgccgcggtcatcactgatcctggtcagatcatggatgcaattcaggggattctgcgcggtgatgctcaccatgataatatacctcctttggtccagggtcttactcagttgatgtgcgatctgggcaacgcagcgcgatccaagacctatgcccccacatga

SEQ ID NO: 13174 - DNA, 222 bp, A.fumigatus
aaggccgacaactgcgacatgtcttggagcgtgtcaaccaacgagggcgttcggccatggctcgacagtccgctcgccaagtacgcttccttccagtcggtggccgatttcgcctcccacaacgagcgaggagcaggcaggggaagctccagctcggagtacgaaatgattgggttcacgttcaacatcatggccgactgggcatcgtgcagaaacaggtga

SEQ ID NO: 13175 - DNA, 537 bp, A.fumigatus
tccatcactcatttttgtccctctttggcgctcgtcatgcgtatctcctacggctcagccgttgctgctctggcagcggcagctaatgctgcatctctcgctgacgtgtgcaccatctcccatgtgcagtccgtgcttccttcaaacggaactcttctgggtatcaacgtgattccgtccgccgtgactgcaagtgcagtctacaacagtacctccagcggcggcatgggcggcatgggcggctccaacagtgccaactacccctactgcaatgtgacggtcacctatacccaccccggtaagggcgacaaggtggtcgttaagtatgccttcccccagccttccgacttcaagaaccgcttctacgttgccgggggtggcggttactccctctccagcgatgccactggcggtctagagtatggtgcggcgtctggtgccaccgatgcgggttacgatgccttcagctacagctacgacgaggtggttctttacggcaacggatcgatcaactgggacggtcttcaccaagggtga

SEQ ID NO: 13176 - DNA, 285 bp, A.fumigatus
  unsure (19),(47): Identity of nucleotide sequences at the above locations are unknown.
gcttattctccgggggttntggtgtgcgagattggcaaaaataatgnacatgcatttagctacatcctactggtactaataggaagagaactgcttcctctacccaaaatgagccctgtcggagacggcctggtcactccttattcaaacgctcctttggttgaacggtacttagtcaatacaactcctgctagcaattcgatgttgatcaaaggaagcgctcgtctgatggctaaattgacagtttccggttcccacaattctggcaacccctacctttcgtag

SEQ ID NO: 13177 - DNA, 201 bp, A.fumigatus
  unsure (84): Identity of nucleotide sequences at the above locations are unknown.
aattatttattgattctaattcccattgtgatgatcttctcgtggcccttttatctccgtacaaagtcacaaaagggtgcttanatgtttgtctcgatccaacggaatcctcattatttgacaagcaacgctgttgggttcgatgaaacgcactcaacacctctttatcccctgtttattgagggtctctggttaagttga

SEQ ID NO: 13178 - DNA, 417 bp, A.fumigatus
tcgccgacgtcctgggcccgtcgcttcccaccactcgggcccctccctctccttgttccgcaacccggcgccggtactcggccgccgccgctgccactcgcttctcctcttgtgagagccgccggcgctcgagctcgcgccgcatctccggggatatatcctcgctgctctcctcgccactcgaaccggccgcgtagtggggcacttccgatgttgtcacagaaggccatggtttcgccacgtcctctgcagtgggagacggccatttatcctgattgctctgttcgaagcggcggaaagcgtcgccgaatcggccggcaaacaacgtcttggtgccggacagcgacagcgtggaaagactcgtgcgcttactgtgcttgtggctgccactgtaccgcttctcgcgcttccggttga

SEQ ID NO: 13179 - DNA, 2022 bp, A.fumigatus
aagcgctcatcggtgagttgccacctgtgttggattacgcaaatactgacagccagtagcatggatgttgaaggagcatccacagaagcgtcctactatctacgaggtactgcgcgaggtatgcagcatgcagggaaaggaagttcctattcgcgatgtaagcggtctgctctacccacaagcggattcgagaatctcacgtcttctccaccccagatatatgccaatcgctctatctcagaatctcgtcgttatcaggaacttcccccctccccggtggaagcacctcaagtgggggcagtgttctctccacctatccaggaaacacagataattccggaaattgcgccgatgcgtcgaggacgtccgactcgaccggatcattctcaacacaactcggcgaaaccgagcccgtctcccttccgcgctggttcttctacagacccctttgctgctctggacggcactggccacaagtcgcgaaactccatcgaggagttttcgaatcgcttcccgtctcttgatcagttccagatcctgaacgaggaaaaggacaagtttgaattcgagccgaccgtggtagagaagaagtcggaagatgaggatcttgcacgaagactcacgaatgctcttgcggacgacgcctttgcgaagccgcagaatgaagaacgaccgatcaaccagcgacctcagacgtcctcagtggagacaaagcctgtcgagccaccccgacacgttcccgagcagccgtcactgcaggctccattgtaccagccggttccccagcgacccaccatggtgtccactgggacaatgacatcgcctccacccacgccaggagagatcaaatcatccagccgtaatatttacaggttcccttcatcggatcatcaccgccagccgtccaatccgtcttggttggctgaggcagatcaaaagtctgtgcgaccgaacaaagcgccgtcgcctcccaccctatcggcgagaccggagccacaccccaagacctccttcgacaagttggcctcgctgtcatcactgtcgtcacggccctcgttggatggggcgcgaccgaacttggacgtcgatgttcccgtaggccggtccaagtcggccaacggcaaggcgcgcccggtctctgtccataccggatcgaggctggagttctcgcgggggtccgagagcgctcggtcgtctctggaattgagcagaccgatgtacgaaggtggcgcgccgctgcagcacgcgcgcaccgatatggacatgtccgaacgggccaatatctcgtcggatgtggactttttgcgcgccagggaagaggaactcaaccggaagcgcgagaagcggtacagtggcagccacaagcacagtaagcgcacgagtctttccacgctgtcgctgtccggcaccaagacgttgtttgccggccgattcggcgacgctttccgccgcttcgaacagagcaatcaggataaatggccgtctcccactgcagaggacgtggcgaaaccatggccttctgtgacaacatcggaagtgccccactacgcggccggttcgagtggcgaggagagcagcgaggatatatccccggagatgcggcgcgagctcgagcgccggcggctctcacaagaggagaagcgagtggcagcggcggcggccgagtaccggcgccgggttgcggaacaaggagagggaggggcccgagtggtgggaagcgacgggcccaggacgtcggcgattaagagcagggtgcagacactgctcgggcagagcaacaagcccccacctcacaagacggcgacgggctacgggcggtacacagacgagtcgagtgctgctgctttgcaggcgaagcagacggaaggccgaccggagtcgcggccaggcacacgaagcggagccacgtacttggctcaagaacagcagactgcaagaccggcgagcgcctccaggcaggagaccgcgcgcacggtcttcaccacggggctcgaaggatccgcgccatgcgtaaccgcgcaa

SEQ ID NO: 13180 - DNA, 489 bp, A.fumigatus
caacatcggaagtgccccactacgcggccggttcgagtggcgaggagagcagcgaggatatatccccggagatgcggcgcgagctcgagcgccggcggctctcacaagaggagaagcgagtggcagcggcggcggccgagtaccggcgccgggttgcggaacaaggagagggaggggcccgagtggtgggaagcgacgggcccaggacgtcggcgattaagagcagggtgcagacactgctcgggcagagcaacaagcccccacctcacaagacggcgacgggctacgggcggtacacagacgagtcgagtgctgctgctttgcaggcgaagcagacggaaggccgaccggagtcgcggccaggcacacgaagcggagccacgtacttggctcaagaacagcagactgcaagaccggcgagcgcctccaggcaggagaccgcgcgcacggtcttcaccacggggctcgaaggatccgcgccatgcgtaa

SEQ ID NO: 13181 - DNA, 801 bp, A.fumigatus
tggagaataacttcttcggagggtgtttggcccaggttaacgtcgtgcgaatctcccagcccggtggttgggtccgatcgggcagtgtggaagcgggttgcgtcccccgataagcctgcattggcgaatatgcggacggaggtcgagacaatgaagaaactcaaaggacaccggcacatcgtcaagtacatcgattcccatgcgtcccagctgcgagggggcgggtacgaggtgtttctgctcatggagttttgctccgggggaggtctgattgattttatgaacacacgattgcagaaccggctgacagagccggaaatcatcaagatcttctcggatgtggcggaaggggtggcctgcatgcactatctcaaaccccctttgctgcaccgcgatctcaaggtcgagaacgtcctcatctccttccagggaaatacccctctctataaactctgcgactttggctctgcggctccacctcgtccggctgccacttcggctgcggagggtcgtttgattgaggatgacgttcaacgacacacgaccctgcagtatcgaagccccgagatgattgacgtctaccgcaaacagccgatcgatgagaagagtgatatctgggcgctaggagttctgttatacaagctgtgctattacactactccgttcgaagaggtcggccaaatggccattctgaatgcgagctacaagttccattcatatcccccattctcggatcgtctgaaagcgctcatcggtgagttgccacctgtgttggattacgcaaatactgacagccagtag

SEQ ID NO: 13182 - DNA, 363 bp, A.fumigatus
gcggtctgctctacccacaagcggattcgagaatctcacgtcttctccaccccagatatatgccaatcgctctatctcagaatctcgtcgttatcaggaacttcccccctccccggtggaagcacctcaagtgggggcagtgttctctccacctatccaggaaacacagataattccggaaattgcgccgatgcgtcgaggacgtccgactcgaccggatcattctcaacacaactcggcgaaaccgagcccgtctcccttccgcgctggttcttctacagacccctttgctgctctggacggcactggccacaagtcgcgaaactccatcgaggagttttcgaatcgcttcccgtctcttga

SEQ ID NO: 13183 - DNA, 249 bp, A.fumigatus
aacctctgtatactcgccatggctcagcttcatcgtaacccgcccttccgtgccgagcaccttggctctctcctccggaccaaggagcttttgaaggtcaagacagcgttcgagaagggacaggcttctgcagccgagctcaaggctgtcgaagagagggatatcaaggatattgtcgagacccagaagaagctgggctatgccgctctttccgacggagaatactgcagacacagtaaggcttcctaa

SEQ ID NO: 13184 - DNA, 630 bp, A.fumigatus
gaaacctggaaattgcacgtcctggactggccagcagacatactaacccacacaccagacttctgctcagagaagatgctggagggctggaaagccgatcctctaaacaccgccactgccgacgagatgtttgacaagtacgtcaagcaatataacgaactgctgtccaagcgtcctgccgatctccacgtcggcgttcacatctgtcgtggtaacttcgttggtagccgtcacttctccgaaggcggctatgaccgcatcgctaccaagcttttcaaggagctcaacgttgacacctactacctcgagtacgacactccccgtgctggtggattcgagcctctgaaggagctgccccgccacaagaacgtcatcttgggcgttgtgaccagcaagttccccaagctcgaggacaaggaggagatgaagaagcgcgtctacgacgctgccaagttcatcgctgagggcaacaacatcagtgttgaagaggccctcaagcaggttggcgtcagcccccagtgtgggtttgccagtcaccgtgaaggtaacgctattgactgggatggcatgatcaacaagctaaagcttgtccgcgaaattgctaacgatatctggcccggtgagctgtga

SEQ ID NO: 13185 - DNA, 483 bp, A.fumigatus
ttcgatgtacgtgcagtgttttggggcagtttcttccctggtctcgagggtttcgaggaagttactgactttgacgccgatatcttccgcccctatgctcctgatgttgctgcgttcctggaagcaggccacaagcctggcgagactgtcatctgtactggcaagatcaagcacgttggcagcacatacgtcgaccagttcaagcatctggctagcctggtggcccctgaggaggtcaagaacctgaagctcacccttgctgctcccaactggtaccaccttcgttacaagaacggcaaggctttcccaaaggacgtgtacagcaccgaggacgagtacctgagcgatatcgccaaagcctaccaggaggaattgcagatcctgtacgatgctggctgcagaaacgtccagtttgatgatcccaaccttgcttgtaagaaacctggaaattgcacgtcctggactggccagcagacatactaa

SEQ ID NO: 13186 - DNA, 213 bp, A.fumigatus
  unsure (22),(109): Identity of nucleotide sequences at the above locations are unknown.
cgtatgaatcttgtattaaaanaaaaatattatattgacatgatagcctataaccctcttcagagttctaacaaatgttcggcgaaagaaatgatccgttataatcaancggggaaaagggtggctaactttaattacggagttactttgggggcttttaatatattccgcatgagtgctaaacctcaatgttacccaacccttgggtgttaa

SEQ ID NO: 13187 - DNA, 663 bp, A.fumigatus
gcacaggacggatcacttgcggtacaaggggctcgctccattgcaccactcatcaactccctgctcgccaacccaggcttcgtgatacgcgtagcctcgcaagattatcacccccgggatcatgtatccttcgcgagcaaccatcctgagcctaacaatcggccatttgagtccgtcatccagatgaacaatccggcgcctggaaaggaaagcgagaccaaggagcaaaggctatggcccgttcattgcgttggagggactaagggggccactatcatccctgagattgacagcagtaagatcgacctgcacgtgaaaaagggcatggactcgcgcgttgagatgtactctgccttctcggatgcgtttggcaaccttgacccagctgttcatgctcagtccgtggacgttgatctcaaagcagtgctggcggagaggggcatcacgcatgtgttttcagcggggatcgcgggggactattgtgtcaaatacacggctatggatgccgcgagggctgggttcaaaagttttcttgtcgaggatgcgaccagaagcgttgattccggtgcaggatgggaggaggctaggcgagagtgtgaagcagcgggtgtatcgataattcaatcggacgggcctgagattgcggctctcacggcgtcttag

SEQ ID NO: 13188 - DNA, 342 bp, A.fumigatus
  unsure (296): Identity of nucleotide sequences at the above locations are unknown.
ggcgaagcgcttatacataccagccacgcaatgtctacaaacatgagtatctcaacacaagcagcgacgtgcacaactactgatgagaacatcagcgcctcaacgacacgcctaaatcaagataagaacttggcggagaaattaccgtactggctcgtcaatgtgcccccatcacagtggccggcggaatgccctccgttcctgcgcgacttaccggccaagtctatttcaattctgtcgactccagatgcggagtacaagaaacaggattgggagacggtaaaggagattgttantaattggggccgggtcggcggatattgtacggcaacttgctgctga

SEQ ID NO: 13189 - DNA, 861 bp, A.fumigatus
aagcagtgtttgttcagcacattttcgttgaccactacctacatttcagctcgctttctccgaacgttcgaccgatcccagtctcgtcatgcatcccctcgttccacccccggctggcggccgttcgccttgcgcccgacatatctctccatactcggtattctcatgctgataatgttggcggtgcttgaggcgctccgtcgatataccgatcgctatggaggcctcgtcttctaccaggataccaccaacctttccagccccgccacattcgcctacaactacgtgcctgttatcgttgccctgatactcgtcacatcctggtctttcatcgactttgacgtcctgcgacttgagccgtatttccaactttctcgccccgagggcactccagccacaacgttattcatcaattacaattttggccaatcctttctgaccccacttacttcggccaagaggggtcattgggtcgtattgcttgtatcacttcttacagtgttgatgcggatcttcctacccgctctgcagagtgcggtgtttgagttgagggaaataagcatcctgagcgacgaaaccatgcgaacatggccgaatcttgtggacctcgatagccaggctcggtggattgtcgcacaggaaaagaacaattgggacttttcgacgctctcggcaggcagtccctttcagaagactcgctctgccaagtacgccgttgcccctgtggaaattcccacggacgacttccgagaaagcacggtatggacactgaaccaaacgatatactggtcggagctttcttgccaggatgttatggtgaatgagagcctggaagttttcgcaaaggagacgacggactga

SEQ ID NO: 13190 - DNA, 429 bp, A.fumigatus
ctgccgatcatctcatggaatgtcaagggggtccagcttcagcaacaaggccaggatcaacggtgtaccctggatttccaatacagcaacatattcttcccttcgagcgattatgtccagatccgctactgggagccagtctggacggacaatgtttcccagtcattcttctacgacagttgcaacccgtttgatctctacggcatactcattagtgtcaacgctacgcgcgccacggacctcgatgcggatgacatgtcactatctggcgtcaccttcgcatcctcggcaaccctttttgcctgcaatatcgactatcgcaaggccgacgcaaagctccagcttcatgccaatagctccatcacatcagtggacgtacaccccggcaccaccactgtattaaccgacgatcagttcaacattgacgag

SEQ ID NO: 13191 - DNA, 249 bp, A.fumigatus
  unsure (197): Identity of nucleotide sequences at the above locations are unknown.
cagagggaagacgggcaaacattcaggtcaagttgtcatgctggctttgctctcttttatccctgctgctgtctgacgtggcagtctaaattcttcgagcaggtgtatggcttaatctgtgctctgtcgattattttcctgcaatctgaccagaaagtgactcaggatcagctcgtcggtgtttgccgggtaaacanctggcagatcttgggtgcccctaagaagtgctattggttactaatctgtctc

SEQ ID NO: 13192 - DNA, 186 bp, A.fumigatus
tgctggaccaggacagctggagattgtacagtcatctcatggatgcttttggccaggtcagtcggatcattgaattccgacatcacaccccgctgtgtgatttttagcacacaggatgataagatgctgctgctttgggaggaaggcgtcgtccttcctaatacagttccacttgatcctgtctag

SEQ ID NO: 13193 - DNA, 384 bp, A.fumigatus
ggacattgcagttcgaacggacatcaagatcagtcaggacgctgcatccctcagatcacagacttgatcacttacatgatgtcctacaccaatatatacgcagcaaaggggagtaatttgctccttctgaaagacattcgcggaccaagttctcccgtcctgtccaatgtcgacaaactaggagagctttctccagtgttttgccagactgttacacacagaactagtaagtccacttctccagatggcgagaaaccaaaaagcctcgcccctattcattctagcccctggcccgggcctcgattcgagcagtttgttggccctaacgacccggatggaaccaattatgccctgacgctggaggttcatctccagctagtatga

SEQ ID NO: 13194 - DNA, 789 bp, A.fumigatus
atcttcttgtcgaatcagttcacctacttcatactatgtcctgctatcaagatctccatcatatgcttctatcgtcggctgttcaacacaaaaagttttcaattagtgacattcgctctcaatatcctcatcgccagctggggagcaggtattttccttgcttgtgccgtacagtgccgtcctctcagagcgtactgggacaaaagcattgacggtcactgttttgacgggaacaagttcttcatcgtcaaccaggccttcaacgtcattatggatttcgtcatattggccttgcctattcccatgatttgggggctacaaagagcatggcaggacaagctcgctttgaatggcgtattcgccctaggtgcttttgtctgtttcgctagtatctaccggatcgtcgtgctcttctggatcaaaacatccgatacgacctttactgtctaccaggccacgctttggacgcatatcgagccgtccatcgggcttatctgctcttgtctccccatcatccgcgggctctttccgacactcaagctgtctggcagccgcaagactacggctccttactacatcagaaccgactacactggctcccacctcgccactttgtcaagcccaaagtctcctgcatccgcctactttaagatggaggaaggtctcatgtcccgagccactaccgataccgaggtcccgccagacgattacctcagtcctaaggacattgcagttcgaacggacatcaagatcagtcaggacgctgcatccctcagatcacagacttga

SEQ ID NO: 13195 - DNA, 855 bp, A.fumigatus
  unsure (193): Identity of nucleotide sequences at the above locations are unknown.
cgaacatctcccttcttcatccggagcatcgcctccttgagaccctcctcaccgatttgcagctcccccacccaagttcttcaggcccttgtcggccgccagttgaagcatggccagcatctccttccggctgcccagatgactcgctccgatcagaactccgttcgagatgaggtgctgcgccttgatgacntggccttcttcctcgggcagaccgacgctgatccagcggccatgcacatccatcatagacaggtacttggacaggtcgaagccctcggaggagttcgcgcagttgatgatgaggtcgaacgagaaccggtgaggcttttcccagccctcctccgccgtggcgatgtatccgtccgcaccaagcttgcgcgcatcggcctccttggcccgactgcgggagatggcccagacctccgcgcccagcgccttggcgaacatcacgccaaagtggccgatgcctcccaggccgacgataccgaccttcttaccgggcccggccccgttgcggaccagaggcgagtatgcggtcagaccggcgcagagcatgggggcgacgaggttggtctcgagggcgtcggggatgggaaacacccagtgctcgtgggtgcgaacgtgggaggagtagccgccctggctgacgatgcccgtctcgggccactcggcgccgtatgtgtcgatcatgaggaccgggcagtaggtctcgttgtcgttcttgcattgcttgcattcaccgcaggagtaggactgagcgccgacgccgacacgctggccttccttgatcagggtcactttggggccaacgcgaattgcacggccgacgatctctgttggaagcaactataa

SEQ ID NO: 13196 - DNA, 462 bp, A.fumigatus
ggacgcttacttccactcggcgtgaagagtgctacgccgtcggcaacgacgagaccctgtacgagtacttcaccgccgtcgcggacggctccccgctccccgtcatcctgtacaactaccccggggccgtcgccggcatcgacatggactccgacctcatcatccgcatctcgcagcaccccaacattgtcggcaccaagttcacctgcgccaacacgggcaagctcacccgcgtcgccggcgccctcaacgccatcacccctccgtccccgctcgctcccaccacaaagagagcctccaccaagccggtcgaaaaccacccctacgttgcctttggcggtatcgccgacttcaccctgcagacgctggtgtccggtggctcggcaatcctggccggcggcgccaacgtcatcccccgtctgtgtgtgcgcatcttcaccctttggagcgagggccggttga

SEQ ID NO: 13197 - DNA, 252 bp, A.fumigatus
agccttttggtgattacggtgagtgggatcttgaatcaagctgccagcatgacgtttgcgatggctgacacaatccgcttagatgtcgacatcaaggttgaagcgtgcggtatctgcggtagcgatgtgcacacgattagtggtgagtcttgggtttggtccaagaaagaaattcaaaggatagccccgctcacggcgttgttcaggtggttggggagagcagaaattccccctttgcgtaggacatggtaa

SEQ ID NO: 13198 - DNA, 477 bp, A.fumigatus
agagtgctacgccgtcggcaacgacgagaccctgtacgagtacttcaccgccgtcgcggacggctccccgctccccgtcatcctgtacaactaccccggggccgtcgccggcatcgacatggactccgacctcatcatccgcatctcgcagcaccccaacattgtcggcaccaagttcacctgcgccaacacgggcaagctcacccgcgtcgccggcgccctcaacgccatcacccctccgtccccgctcgctcccaccacaaagagagcctccaccaagccggtcgaaaaccacccctacgttgcctttggcggtatcgccgacttcaccctgcagacgctggtgtccggtggctcggcaatcctggccggcggcgccaacgtcatcccccgtctgtgtgtgcgcatcttcaccctttggagcgagggccggttgacagaggccatggaggcgcagcagttgctcagcaaggctga

SEQ ID NO: 13199 - DNA, 801 bp, A.fumigatus
  unsure (657): Identity of nucleotide sequences at the above locations are unknown.
ttgcttccaacagagatcgtcggccgtgcaattcgcgttggccccaaagtgaccctgatcaaggaaggccagcgtgtcggcgtcggcgctcagtcctactcctgcggtgaatgcaagcaatgcaagaacgacaacgagacctactgcccggtcctcatgatcgacacatacggcgccgagtggcccgagacgggcatcgtcagccagggcggctactcctcccacgttcgcacccacgagcactgggtgtttcccatccccgacgccctcgagaccaacctcgtcgcccccatgctctgcgccggtctgaccgcatactcgcctctggtccgcaacggggccgggcccggtaagaaggtcggtatcgtcggcctgggaggcatcggccactttggcgtgatgttcgccaaggcgctgggcgcggaggtctgggccatctcccgcagtcgggccaaggaggccgatgcgcgcaagcttggtgcggacggatacatcgccacggcggaggagggctgggaaaagcctcaccggttctcgttcgacctcatcatcaactgcgcgaactcctccgagggcttcgacctgtccaagtacctgtctatgatggatgtgcatggccgctggatcagcgtcggtctgcccgaggaagaaggccangtcatcaaggcgcagcacctcatctcgaacggagttctgatcggagcgagtcatctgggcagccggaaggagatgctggccatgcttcaactggcggccgacaagggcctgaagaacttgggtgggggagctgcaaatcggtga

SEQ ID NO: 13200 - DNA, 678 bp, A.fumigatus
acgcttacttccactcggcgtgaagagtgctacgccgtcggcaacgacgagaccctgtacgagtacttcaccgccgtcgcggacggctccccgctccccgtcatcctgtacaactaccccggggccgtcgccggcatcgacatggactccgacctcatcatccgcatctcgcagcaccccaacattgtcggcaccaagttcacctgcgccaacacgggcaagctcacccgcgtcgccggcgccctcaacgccatcacccctccgtccccgctcgctcccaccacaaagagagcctccaccaagccggtcgaaaaccacccctacgttgcctttggcggtatcgccgacttcaccctgcagacgctggtgtccggtggctcggcaatcctggccggcggcgccaacgtcatcccccgtctgtgtgtgcgcatcttcaccctttggagcgagggccggttgacagaggccatggaggcgcagcagttgctcagcaaggctgactgggtgcttaccaaggcggccatccccggcaccaagagtgcgatccagagctactatggttacggcgggtaccctcggcggccattggcccgacttagcgaggagcaggcgcaagccgtggccgagaagatcaaggatgccatggaggtggagcagtcattgcctgacattgcatag

SEQ ID NO: 13201 - DNA, 276 bp, A.fumigatus
aacatggcgtttgacgatctacctcaactggacgactccaaggatcgacccggtctgtggtctgccgggaacagtaccgctgtctcacttcagcctaccgatgagatttccggcccggagggtattcgctcgatcttcatccggcacttctctgccgacatcaataccaaatacaccgatctgctcctgatcgtctgcggcttcgtgagcggcctcgtcgatggcctgtgcttcaacgcatggggcagttttgccagcatgcaaaccggtccgtaa

SEQ ID NO: 13202 - DNA, 750 bp, A.fumigatus
gatttccggcccggagggtattcgctcgatcttcatccggcacttctctgccgacatcaataccaaatacaccgatctgctcctgatcgtctgcggcttcgtgagcggcctcgtcgatggcctgtgcttcaacgcatggggcagttttgccagcatgcaaaccggtccgtaacccaagctccctctgaagacaattcagccactgacatagctgaaggcaacaccgtcttcatcgccctgggcgccagcggccaaccagtctacccagcctacctctgggccaagtccctcgccgccgttgccgtcttcatcctctccatgatcgttcacatctacttctcacgtctgctgggtcctcgccgccgctcgacgctcatcctgtccttcagcgcgcagaccctggccctgatggccgccgccatcctcgtcgaaactggcgccgtcagccggcgtgctgagaacccccgcgccccgatccaatggatgcagatcctccccatctcgttacttgccttccaggccgcgggccagatcgtggcgtcacggatcctcgcctacgacgagatcccgaccgtcgtcctgaccacactcctgtgcgacttgatcgtcgacaaggacttgctggcgcgcgggtggacatccaacccccggcgcaaccgccgcgtcggcgccttcctagcgctctttctgggcgccatgacagcgggagggctgagcaaggtgacggacatggctgccagtctgtggtag

SEQ ID NO: 13203 - DNA, 282 bp, A.fumigatus
tcgatgggtagatgctccacacgacacaattatcaacttagtgaagaattcaataccaagcatagcttcgtggatgctaggggtgagtcccagagtacctatgttcaggactaccctcgaacaatattatctatagagcctggtaaatatttcgggcccctgtccaacgttgcactcccccagattctcatgctgaaacttgactcctacgtctactggctaccatatcacatttatgatataagtacctcgaagagtgttcgaccaccgccatcgaactga

SEQ ID NO: 13204 - DNA, 270 bp, A.fumigatus
agacaggacggggctgaactgcccgagcgtgacgagaagccattcggtgacccctggaacttgagtggcgctaccgaagattactttgacaattacaccggttactatgacggcaggaaagggtggaaaactcgtcctggcggcgacaccctggacattaccacctggagttcagcagatcgcaagaaggcgagctttgacggtaaggaccccctcggtaaggaagaacgtgacgccatcaagaaggggttggtcatgtctcttgcttaa

SEQ ID NO: 13205 - DNA, 285 bp, A.fumigatus
atcccacaaagcctttttgcgcgtctgggacggtggaacatgtacaccgacatggcacacaaaatctccgtgaacgggatcatggatcgtcttgtcgttgacagcttccagtgccttctcagctgcagatacagttacagtcccattggcaccctggtcatgatccatttcctcgccttcctcctcgcgaccatctcctctctcgatcactgcgctctctggagctgggtggagcatgatccagcccatccggtgaaacttcttcgaaggattcggatcgcttag

SEQ ID NO: 13206 - DNA, 642 bp, A.fumigatus
ctctctctggtcaattcttacgttctcgatcctgcccgaattgccccctcgcgttccgatgccaacagcaatggccatttccctctcagctccagtcaaaaccagaccggtacccctcgtggtttcagcctggccaatttaccgccctatcttgcaaacaacgtcaacatccctggcggaacccatggtctccccggcgctgctggtattccaggctttatgaacgtaaataaccaggcctggaacgcgaacggcttggtaaccggcgagcatgctgctaatctccatcatcctggtgtcatccgtcgtggtgggggacgttacaacaatcggtccggaccgtatgaccggcgcagcaaccgtcaaggagcctctggaggccatctgagtcccgcccgtggcatgtcgagcatgtacggtgccggagctcgtatgggagcgagtggtgcagtgccgtatattcctcctggccaccctgccgccgctgcgttgatgggagcaggtccatttcctgatgcgatgggatcgggacctggccagcagggcatgggaccccgtgaagccacccaaggccgcagcattaagagctatgaggacctcgacgctgtcggtggagcaggcagtggtgaattgaattactaa

SEQ ID NO: 13207 - DNA, 216 bp, A.fumigatus
ttcatccatacacttttttttcttttcttttcccctgtctacattatcactggcgtggttctcctttcatcagactggtatatcttcttctatcactttcttctatcacttgtactctctttcctttctattttctcccgttccaaggatttttgggattacattatggacctcacgcatccccttatgtgtaccatacttgcggccgagatctag

SEQ ID NO: 13208 - DNA, 1794 bp, A.fumigatus
  unsure (11): Identity of nucleotide sequences at the above locations are unknown.
gacaatgatcngctacggcggcttgaagtaagatcccttcggcgacccctgatggatttccgtgtgggtgcttatcagcaatgggagcgggaccttgaaggcggtctgtttgacgatttcaccctggaaggaatctacaagactgaaagcgatggcgcaggcggcgttatcgagaaggaagagggcgaaacaactgccgttggcgagacactgggtgttttggacttgctacccgtcagatgcggcgacttgcgcgatgaggcattgtcacagccggccttgcttattaagactttggcacccaatgtgagccgcgcgaagattgaggaattctgcaaggagcatctgggggagcaggacggcggcttcaagtggctcagcctaagcgatccgaatccttcgaagaagtttcaccggatgggctggatcatgctccacccagctccagagagcgcagtgatcgagagaggagatggtcgcgaggaggaaggcgaggaaatggatcatgaccagggtgccaatgggactgtaactgtatctgcagctgagaaggcactggaagctgtcaacgacaagacgatccatgatcccgttcacggagattttgtgtgccatgtcggtgtacatgttccaccgtcccagacgcgcaaaaaggctttgtgggatctattctccgccccagagcggattgaacgtgacctcgaactggcccgacgtctggtctgtaagcttgatggtgagatgggtggaaatgccgacggttattccaaaattgaagaccgtgttgaggagttacgcgggaagggttggcttcagcctcctgtcacaggccctgtcagtgtcaagaagcggaaacctgactttgatcccgcggatattgacgagggtgaggcggaggaaggtgaagagcaagaaggatgggacgatgacgaagtcgacgatgaagaacttctggccaagaagaaaaaattggaccttatggtcgaatatctacgcagagtctacaacttttgctttttctgcgttttcgagagtgactctgtgcacgaacttgcacgcaagtgtcctggaggtcatcttcgtcggccgcgagccggcctctccagccagtcgaaagccgtcgccagagccagtgctcttggacagcctttccctgtgaagaaaaaggagcccagcgaagagggagaggaacagccgcctgcagaggagaagagaacgcaccgtttgtctaaggcagagcaacagcttcaacgcgcgtttaactgggtccggacttttgaagataagctcttgcagattctcgagccagataatgtggatattagaaaactcggtggcaagcccgtggaggaggccctcgaggaggaattatcgaaatttgtcaagcaagaagacgaagcgaagttccggtgtaaggtgccggagtgcacaaagctgttcaaggccgagcacttctggcgcaagcatgtggagaaacgccacactgaatggtttgagaacatcaagagtgacgtaagttgcgcaattacgttgccatactggatggtgcttacagctaacaaatacaatagctctctctggtcaattcttacgttctcgatcctgcccgaattgccccctcgcgttccgatgccaacagcaatggccatttccctctcagctccagtcaaaaccagaccggtacccctcgtggtttcagcctggccaatttaccgccctatcttgcaaacaacgtcaacatccctggcggaacccatggtctccccggcgctgctggtattccaggctttatga

SEQ ID NO: 13209 - DNA, 1509 bp, A.fumigatus
gaccatcctataatccagtcagagctcaagaaggaacctcggactttgccagacgccttatggaagatttttcgaaaatatggtttggttcgataccccaaagaggaactttacaaaatactgcaaacttctgaaacggtgggtttaccggaaacagtcttcgcatactctgtagcccacactctccgcgctctcctccgccttgacccacgaacagagaacaccaatatagtttttgtccgctgcgtatctgacgtggttgatatggcgtatcgagcggaacgagacaccctttatatacatgagaaatggttgtggcctcacaccacttgccaaggcgctgaacaactggcaatacccgagcccgatgtgtttgtctggcagcacactgtggaagatttatatcaccgattactagcaatcattctcaatcagtctgaaggacgccgcgcaggtcaaaacacgcgacatctactcagattggctcaccagaaactccattacatgccgcgaaacatccaggtgaccgtcgaggatgaagggtccctaaccgtgtcattctatacaggacacagcctcctctacgtcgagcaatacggagcatgtgttcattatctaatcgtcatacatcgaccagactgcgaggttaggactaatatcctgacatacgatagcaccaacgacacttgcgcttgtcctcgaaaggccgtctccttagcttcacggacagccaggttctccggccttaacggggtgacttggaccccgacggtcgttaggatgcaaggaagggacaacattgccaaagatggaagtagcgcttctaccttaaaggccatggatggcgagctgatcggaattgcctcaggcgcagtctcactgttgccttcgactaccagcagccatgcagtcacagacgatgactgtgatgttctactttcctcgcattgttttcaaagcgacaacgctcaatccgttgccaatctcgcgagcgagcaaagcgtggcagatgccgctcctgttcctcctaagattgaggggacgcaagagagagcgacagtgtccaggaacgtttcccctcaaccgcccgccgatatcggacacagtgtagctgtcgaaggtaacacctgtgcagcttcgaacggaacactagttgtcgagagcgaccaacgcccgaaggacacgatcccctgcaacctatcggactctggcgcgttgatagcgggcccgaaagaaaccttagccaaaaccagagaagcgaacgaccgcgtagaaactgatggaattgcaaaagacttcttacggggagccaatgcacagcactcttccactttttctacctgtcctcatccggcggcagcaatggacaaccttgaggcatgcgaggtacaggagaatgggcagcagccatgtgaagttggccatgacagttcaaatcacagttcaacagtaagcacgacctcttttccacttcatcattatctcctggcacagattgtcgtttgttga

SEQ ID NO: 13210 - DNA, 396 bp, A.fumigatus
aacattaagttcggatcctgccaggtccgtggtgaagacccgaagaatccatcgcctaagcttgtggcctacaacacttctaagggcatccactctactggctattcttgccttggttcgacaaactctcctttgtacaaggatcagacgctcttgcaaattgcggaaaagaagggtaagacccctcagcaggttctgctccaatggggtctacagaagggatggagtgtaattccaaagagcgtatccgaagaacgcattggaaagaactttgagctcgatggctgggaccttacagccgacgaggtaaatcaattggataacctcaagggccgcttcaaggtctgtggtgacagctggttgcccgtcaaggttttctttggtgatgacgaataa

SEQ ID NO: 13211 - DNA, 1350 bp, A.fumigatus
gaggtatacttcaacagcctaactctccccaggttcgcctatgagaaggccctgaagaccttcaaggccaagttccctgagccaactcagcaagtctcgcttcgacttcaaccagcttatgcacgtattcctacccgtcagccaatcagtcgagctgccgctatccgccaatcccgcagcaatcgctatttctctactcgtactgcaaactccttcgtttcctctctcaagaatggtttgcggggggaacacacagcgtatcgtccatcccgtgttgcagccaatatcagtcgcttgactagtcgtgccccttttgcgtcgactctccgccccaacttgaccggcggcactcttggccgcacggctggaggttatgccattggcgctggacgtattggtggtgcccgttatttctcgcatggtccggcttctcctgcacaggtgatcaacaatgtatcaatgggtgtgcgagccttcttcctctcgggacagaaagccaggtttgacggcatcgaccctattacgggacagaagaggtacaaggctgtgagcgcgctgcaagatcaggctgagcgtaaaatggcggcgatccctcgtacggcttccggttcattcatcgacttccagatttctccagccattacagccttcggacttcagaaaaaggctgcctctgctggtgctcattatgtggaaacgttgaactcggacaccttgtgcttcctttctgccgacttcgcacgtgcgctgaaagatttggctgctgtacttaatgatctcgagcgtttatcctcactgggtgatctgcctatctctttacatgacagatccacgatccgagtgcgatttccggggtgcgacgctgagacggttgagcgactgtgcgatgaggtcggtgtccggcagggacggattggccaagatgaggatttcaacctccgaacaggagctgatctcgctctgctcttcccttttgctcgtagcgtatcggctccttcggatgtagcagaattctttttccgacaagaaacgtcggagggacagtctcctgatcaggtcgattggcaggcaatgatgacctccgaggatgggacaggtcactcgcctgagaatcctcgaaagtcgagcaatgggctcagtttcgaggattctccgctctttgccgacaagaatccctgggcatcctcctcttcaggatattccagcatcaacgtgagcgaactgggtgatcgtgccttctttcctgaggtttccagcgccggtttctatgaaagcgcatcagaggacgaaggagtcgaaggtattcacaggttcctggctgaatgtgatcgtgccgagcactttcgttaa

SEQ ID NO: 13212 - DNA, 210 bp, A.fumigatus
tttagcgactatacctactgcgggctacaggagccactgcagctaaatatcgagggaggtgtgttgtacattaaccttggaggtggcgcaacgccatctgcctatttcgagggcctaatcatgccagccattcgtagagctgaggccacaaatactatatcagagtttaggaaggactacacaacattgacatcccatgttttgacctga

SEQ ID NO: 13213 - DNA, 333 bp, A.fumigatus
agacgttatcctcaatgggccgaggatcttccgaccacgctggacgtcgataagtcaactgaagattatccgcgggcgctcgctcggctgaaggagtacctttctttgccagagtatgggctgaaggtgcaatggtcctataattcaacacgtgaaatccctgcagactgggaggcaacattatccttgcgtgaagttgtgaatatcaaatacagtcgcatgtttcggttccagcactccgagcctggcaccacctattcctacgaagactggaaggcaggtcgaacggcccacgcaattgtcggtcgtcgggattaccacaacgttgactga

SEQ ID NO: 13214 - DNA, 807 bp, A.fumigatus
ttatcggaactttggcagaaaagccacgaaatcaaggatccgatggtccataatgagatattgagagcaaaagacgaggtcgatcatcaatttcagaccgtgaaactccaggacgagttccgcgaaaaggggctgcagattattgtcaagctggggggcattgagctcgctcctgataatccgtccttcttgggcgaggattggcacgtggacggcctggcgaatgaacatatagcgggggtagccttgtattgctttgatcttggaaacgtggcgaatccccgaatctccttcgctcatgagatttccatggatgccgatgatttttcgtttagttattttaactgggacattccgtatctggaaaggctgttcggtgttcagaatgagaaaccatcgtttcaagaactcggatctgtgtccatacgtcaagggggtctgatcgcttttccaaactgtatataccaccgccttgaatcatttgaattggtggacaaagctcgacctggacgctgtcgctttttgactctgtggctcgttgatccttactaccgcatccgttccacgcgaaatgtgcccccccagcgtctcgattggtgggaacaggaagcccgatcccatctatcatcagcccatccacttccccaagaattggcggatcagatcattacggaggctggtctgtggcttatgaacttaccagaggcccagcaccaccggcgtgagcgagccaaggaggaggcattggcttatgagaagatcaggagtcagattgagcgtaacactatatgccttttgaagcaatga

SEQ ID NO: 13215 - DNA, 393 bp, A.fumigatus
gcatggcgaataggtgtcacacccggagcgaagagctcaggagagtgggacagcattcatgtcttcgaggcgactgatagggcgcgcatgtctcattacaagctaacgagcacggtcatcctgcacttggcgaacgagaatgaggcccttggcgagatggatctcagcggcaatatgacccggcagatggaggttgatcttcctgtggaatcggatgcgagccatgtcgccaatgtcggtaggctcgttgaggatatggagttgaagatgcggaacttgttgcgtatgtgtcacatctgtgaagatttgttctgtcttgacacgtcacatgctaatatgacttgcgacggcagaggaggtctactttggcaaggccaaggatgtggtgggtga

SEQ ID NO: 13216 - DNA, 489 bp, A.fumigatus
  unsure (176),(189),(247),(259): Identity of nucleotide sequences at the above locations are unknown.
ctggaagtttttattaatgaagtgaacagaatcaattgcctggatttctccgacgataatatgctcgttgcagctggtatgcaggagtcgtatattcgtgtttggagcatggatggcaagaaaatccaaacaacctacgacaacgtggatgatgcgcccccgtcgaactctcgtcngtttattggggcnatctggtccagtttatgcagttgcattttgcccctccggcaaaacccctcaaagggcncttgtccccccnaccaaacccccgtggggtggctctcctcctctggagaaaaaaaacatcccaaatcgggttccttgaatttttggagtggcttggtgttttacaaggcccataatcaccctgttggggaatctccatggggggccctttgggccctaacttgtttccggggggaccttaacaaaacactcgtctcgtgggtgacgaacatattcctcccccacgctttttcctcggcatga

SEQ ID NO: 13217 - DNA, 192 bp, A.fumigatus
cttgcgacggcagaggaggtctactttggcaaggccaaggatgtggtgggtgagcttcgaagtaagccacttctctgtcacggtagaaccaaggcaatggatgctgacaagaatacaggcctcgcaccgctttcggaaaccaataaagagaaggctgcacacctggagatgattagatccatgcagcggtaa

SEQ ID NO: 13218 - DNA, 414 bp, A.fumigatus
  unsure (78): Identity of nucleotide sequences at the above locations are unknown.
agtaccaccgcggatccttccagccccgtggtgaagacgaagaccaaccgcgattacctgctctgcgattacaaccgngacggggacagctaccgctcgccctggagcaatgagtttgatccgccactggaggatggcacggttcccagcgagcgggtgaggaagctcgaggttgcggccaacgaggccttcgatgtgtatcgggagctgtactatgagggcggcgtgggcagcgtttacttctgggatttggatgatgggtttgcgggcgttatcctcctgaagaaaggtgggctttgttacgctatgtcttgtgaggtgcgggctttgctaataggcatggcgaataggtgtcacacccggagcgaagagctcaggagagtgggacagcattcatgtcttcgaggcgactga

SEQ ID NO: 13219 - DNA, 900 bp, A.fumigatus
gctactttgtcatcattaacacgggcaatgcttatctttggacagcccgaacttaggcgcgttctgtggccgctctttgtctattctttcctcaacatggtgacatccttttaccctcaagaggccaaacagttctttgatatcaacaagaacctgttccttcctgagcacacagacgatatccgtaaactcgagcccatcagtcttcctgagcatgttcaggacaacgccacggccaaactctaccggaataacaagtatcgcttagtactcagcaacccagcattttcaaaccttatgcagtttctcgaaaacaagtccaaagaaggaggctctgttatgtccgctattctgagcagctactgcaccatcattaccaaagagcgtgcgtcagacgatcgtttcagctttgctgctatgttaggccaagctggagcagggcagacatttcccgctgaagacgaaggtattcccggtcaccatcctggatcggcctacaccggcgacaatccggcaatggctggaacattaccccggctccggctgggcaagcttcctatggaatcaacgcttgagaccgacgtacgaggcgaattagcagacgaagacgtgaagaaccctccggcaccaggccacaacagtctcgtgcaggagtttgaccagatgatcaaaaaggaagaagatgaagaagcgcccagtcgtgccgatattccataccctccctcgactgctcgcgatgtggctctggaagttcaaaaggtaaaagagaatcgtgatcggttcaggattgagggccggacgggaggtgttggtcctgcagtcagtgtttgcatgttcacattccacaacacttatgacgggtgcgtaatgaccgtttctgtgactggaagtttttattaa

SEQ ID NO: 13220 - DNA, 222 bp, A.fumigatus
cgtgtcaagacagaacaaatcttcacagatgtgacacatacgcaacaagttccgcatcttcaactccatatcctcaacgagcctaccgacattggcgacatggctcgcatccgattccacaggaagatcaacctccatctgccgggtcatattgccgctgagatccatctcgccaagggcctcattctcgttcgccaagtgcaggatgaccgtgctcgttag

SEQ ID NO: 13221 - DNA, 213 bp, A.fumigatus
acttctgacacatgttttcccctcttgcttcccagccgcttgaatgtactgtccagtgggacgatcacacacaaagctgtgtctattggctacacttgttattccggcacaaaacccttgcttttggatgctgggccctggactgatagtaaggtctcttttaatgacctcacgggtaatggaccgggcagttccaattttgctcgtccaatt

SEQ ID NO: 13222 - DNA, 468 bp, A.fumigatus
gccgatagagcagttgaggaaatggataagagcagagtcgaacggaatgcacgaatgaccgtccggaccatccgagaagatctcgcccaagtggcccaatccacacgaatcgtcatccgctgtctgagtagcggtcgcgatgctcatgattcggcggcaaaggctctttcagtgttaatagacatcctagattgtctacaccgggtcagagaccagatcagctggggcgaggagaaatggctcgtggaacccgcccggctcaacgccctcgccgaggtgatcgtatggtttgggaccacgctcaggtctatcgagttctacttccagccaggcggtgtgagtgtgtactactttaggaagcatctactcggcggcacttttcttccgcgtctggagcagtataagatcctactgttgctggcgatgcagcctgattcgaggttggttgcgctcacagtgctgatgtga

SEQ ID NO: 13223 - DNA, 2391 bp, A.fumigatus
aatgtgccaagaggttgtccgcttggtgatggaaaaaagccatggtgtgtaagtaactcagatcggtccttgatctgtttagccggacatttcttggctaatcgcgggtgtccatacagattcctcttagcgaagatacatctggacctactggcgagatatacagataaaagtctgcttgaaagggctgttatgcatctaccagagagcttgagcgaggcatatggtgaggcaatgaaacaggttgtgagccagaatccaactgccactcgccatgtatactggacattgtatgcctatcggccactcactgtcgcagaactcaaggctgctactcaaagcaagattgctagtgaagacaaagatgaattagtcagttttgagcagtctttgcagacccagagcgcaggccttctgacggtggatgccgtgacgggcaccgttcgcttcgtacataagactgcaaaggaatacttaaatggaacagcggctcgtgtattcttcccctctgctcaaagagatattgcggaggtttgtcttacggcaatcatcccggatgaggttgtcgacgactgctactatatcggagggaccactcctcgcaactcgagcggcggcttcctcagctacgccgccacatactggggctatcatgcgcgcgaggtaacagaagacgaacaagcaatccaggtgttgatcaagacatttctcaacaaactcctctggaggcgaccccctatcaagggtttgatcaggaacaagtgtttgccaactgagctgggcctgggaaaatatcccgatgactggagtgcgctgcatatcctatcctttttcggtatttctggtaagttcaagcgcctgttggtgcaaggcgctcaaatcgatgccaacgacaactcgctgaaaatcacgcccttgcactgtgctgcctatcgaggcaatgatgaaatggtagactttctgcttgaaaacggcgctgatggcaatgcaaccaccaataatggcagcacggcattacacctcgccacggagcgcgggaatagaaagtcgatgaagttgttgctttcacgacatgtcaatgtacaagtcgccaatgaaaagggcgaaactgggctgcaggtggctgttggtaccacagccgacgaagcgaccgttcccttactcatcaagaacaaggtggacgtgaatattagaaacattcgtactggtgacacggctctccatctagctgtcgaatggaaaaggcctcgaataattcttttccttcttgataagggcgcaacaattgatatgacaaacgaagatggctttacacccctgcaactagccgcgaaactggacaactgcgaagcagttgcgttgctccttcagcgtggtgcccaggtcgaagcgcggtctctctccgggctcacagctttacaactagcagcccatgaaggtcactgggttgcatttgacctgttgcttatcggtggtgccgacatcaactcttggaataaggagggtgaaaccttgcttcacgaagaagcgaggaagtctcgcaacgtatcaactgccgcaaagctactcgcccaaggggcaaatatcgaagctcgtacgtcacaaggctatacaccgctccagtgtgcagccatttcaggaaacctaaacatgttcaagttcctgctcagcaagggagccaaaatagacgtggaaacggcaaaaggcgagtccctgcttcatattactccaccaataaacaatgactgtctcgaaatcctcaagattgccctcgaccatggtctcgatgtgaaggcgatctccagtcacggttggatgccgctacaccacgcagtgtatatagggacaggcgtgtcagaccttgccttccataagacctctgactatatcattcttctcttgagttatggagcagacatcaattgtcagactacttcggcttacgcggagaccgcgcttcatctggcagtcatggccatcaacccgaacacatctctggtatcgctccttctaaaactcggcgccgacatcaacgccatgaccaacgaaggaaaaactccccttcatcttgctgccgaacgcggccgagaatcaatctttcgagtcctcatccaggcgggcgctgacatatccctggaagtgccagacagtgcgaaagcgattgatgggcgtggcacgggcggcggaaacactgcccttgacctagcacgcaagaatcctttcaatgctctgtggctggacgatcatggtcagctccgcccagagccaaaagtcaagcgacgagacagcgtctatactatcatcgaggaggaattcaatgatgatgtttcggaggatgagacatgcgagtcgacgctcgttgggagcgatcagccttatattttggtttag

SEQ ID NO: 13224 - DNA, 570 bp, A.fumigatus
ttaatgattagttctgttatcatcgacttcctacagaggactttcacttctcccaacgttgcaacggtgttcgtcttttgtcaagacgagaaggagaaggaacaaacatccttggatcttctccaaaacatcctcgcgcaactcgtttatcgtaaacgcagtctttcctacgcgacttcgtctctttattattctgagtcgctgacgaaagggagagcgtcacccaaagcctaccagaatgctattcgcgctgaggtgaatcgattttcaaaagtcttcttcatcgtggacggcctggacgggttctccgacaaagagcgtatcctgactcgacttcagaagcttcccgagcaagcacaactgcttgtcaccttgcgagagataaatcagattgatagtgattcgggatatgtgagagtcgtgccctcaccagaagatctccaactttacgctctatctcggatacagaacgacccaggtcttaagagcctctgtaatgacgggcctgccggcgttgaaatgtgccaagaggttgtccgcttggtgatggaaaaaagccatggtgtgtaa

SEQ ID NO: 13225 - DNA, 1581 bp, A.fumigatus
ttacctttaaccaggcgtgtcaacgaagacagcatcctcgcaattcagatttttgaccagaagaaattcaagaagaaggaccaggggttccttggtgtgatcaatgtgcgaattggagatgtgatcgatttacagatgggtggtgatggtgagtcacttccaattcggcactcctgcgacgtcagtcggctaacctttcgtctcctactcctcgaaacagaaatgctcactcgggatctcaagaaatccaacgacaatctggtcgtacatggcaaattgatcatcaacctatctacgaacttgagcacgccgaataccaatcaagctaatggcctgcatcggtcacatgttcagtcatcaacatccagcggcctcgtcccgcaagtggccccgtcgtcttcgcatcccgccgcaagtggtacggccccagtcgatccgtctgcgtcgaatccatcccttaatccccagcgtgttccttccactactcggccatcgagcaccgccgctcccgccagtgcagctggggcggccgtcagcaatagccatggatctcgcaccaatctcagctcgttcgaagatagtcaaggccgacttccagcgggctgggagaggcgagaagacaacttgggacgaacctattatgtggaccacaacacaagaaccaccacttggacgaggccatcatcgaattacaatgaacatgcacaacggtctcagcgcgaagctaatatgcaacttgaacggagagcccaccagagtcgaatgctaccggaggatcgtactggcgccaactcacctaacctgccggagagttcgcagcaggcccacaccccgccggccgggggcagtgccaatgctgtttctatgatggcaacaggagccaccactgcaggcactggcgagcttcctcccggatgggagcagcggacgacccccgaagggcgaccatactttgtcgatcacaacacccgtaccacgacgtgggtggatccgcgacggcagcagtacatccggatgtatggacagaatgccaatggcacgaatactacgatccaacagcagccggtatcacaactgggacccctgcccagcggttgggagatgcgtttgaccaacacagcgcgggtgtacttcgtcgatcacaacaccaagacgacgacatgggacgatccccgcctgccgtcatctctggaccagggtgtaccgcagtataagcgtgatttccggcgcaaactgatctacttccgttctcagccggctctgcggatcatgtccgggcagtgccacgtcaaggtgcgccgcaacaatatctttgaggactcgtacgccgaaatcatgcggcagagtgcatcagacttgaagaaacgcttgatgatcaagtttgatggtgaagacggtctcgactatggtggtctttctcggtacgtaccttgtctcgttctcgtgactgatatgctgactattcgcctagtgaattcttcttccttctctcccacgaaatgtttaatccgttctattgccttttcgaatactccgcacacgataattacaccctacagattaatccccattccggtgtga

SEQ ID NO: 13226 - DNA, 510 bp, A.fumigatus
atatgtcgagtaagttgctatcttccattgcctctggctgcggaggacgatcaggataaaatcactaacgggttctttaggctggtcactgagtggaagattgtcaagcgtgttgaggaacagttcaacgccttcatgtccggctttaacgagctgatccccgcggatcttgtcaacgtttttgacgagcgtgaattggagctgttgatcggaggtattgccgatattgacgtagatgactggaagaagcacacagattaccgtggataccaggagtcagacgaagtcatccagaacttctggaagattgtccgaagctgggatgctgaacagaagtcacgtcttctccaattcaccactggtacatctcgtattccggtcaacgggtttaaggaccttcagggctctgacggaccgagacggttcaccattgaaaagtctggtgatccggcagcattacccaaatctcacacatggtatgtgaaattcccgctatcaatccttttgtga

SEQ ID NO: 13227 - DNA, 228 bp, A.fumigatus
cgaagatcttcaccgcaatctcacatggactttgtaagttattacgccggcaaccgggttggttcagggtttctaacaatctgcagggataatgatattgagggtgttctggagctcaccttctccgttgatgacgaaaaatttggtgagcgtcgcacgattgatctcaagcccggtggccgggatattcctgtgacaaacgagaacaaggctgaatatgtcgagtaa

SEQ ID NO: 13228 - DNA, 378 bp, A.fumigatus
gcggagaagcctggtagattagccccaaattacttaatacacggcgtgacagctacacctaaggaagagtggaaagtccatcgctgcgggacccagagaacttgcccgcgcgtccattccagccttagctcttcttactctcgttatcatcgaactttcgacgtcctctcctcagtcatcgctttaatagagcctcaaaagaagaagaacgttgcgattctcgtttccccccttctccctttccactcccatcccgctcgtcgtccctccccctcctcctcctccgtcccacgaacctccgcccacttttccaccactcgcgaccgccaatcccgcatccatcgacgtctgctcggtccggaatatatcaagtgctag

SEQ ID NO: 13229 - DNA, 252 bp, A.fumigatus
cttttgacagttatcgcagcggatgggttgtacaagcgtgatgtgttccgtaagtcttacattcttgcaatattgcttgtcgtccgaatattaacttctggtgcgttcgcaggattccctgatccgttcgctgtagccaccgttggtggtgagcagacccatacgacatcggtgatcaaaaagacactgaacccctattggaacgagatgtttgatctgtacgtcgccttgcatctgctgttgagaatgtag

SEQ ID NO: 13230 - DNA, 318 bp, A.fumigatus
tatgctgactattcgcctagtgaattcttcttccttctctcccacgaaatgtttaatccgttctattgccttttcgaatactccgcacacgataattacaccctacagattaatccccattccggtgtgaaccccgagcacctcaactatttcaagtttattggacgagtcgtcggacttgccattttccatcgccgtttcctcgattctttcttcattggtgcgttctacaagatgatgcttcgaaagaaggtttctctccaagacatggagggtgttgacgaagatcttcaccgcaatctcacatggactttgtaa

SEQ ID NO: 13231 - DNA, 432 bp, A.fumigatus
atacagcgtgctgtcggggaatatatgcagaatcgtcaagcgttcaaatacatcgtgaaggtcaaacagagacaggttgtttggccgtgtgacaaaaatgctctcgtcctgaccacttcagctttcgaccgtctgctcttccgattcggcaagtttgagtgcctcatccacactggggacgaaatgcgtcattcctccgcattgttccactataccgcttcgttcaaacattcggaaaacgtcacgattgggaagacgacagaagaatactcgcgtcccctggtccacatatccttccactatctcggaaagaacctgagtgccagatccgtcaatgctagtaacaccatggacatcgaagatgatattcttattattctctggagaacgcattcgagggaaggatggatgtactcggctcgagccatataa

SEQ ID NO: 13232 - DNA, 309 bp, A.fumigatus
tcgtacacgcaatgcgcggctccttccagccccgtggtgaagacacccgacctgagccaggcacaacgcgatattgcgggtctatttgctatgggagtggcaggaaataaggaagatcacgttctccacacagtacattatatcgttcaaagaagtgcttgctcgtctggactccacagctatggaaattcgcaaaccttatccaatgaggcaatcttgcgctggctcaatgctttttcaagactctataaatacagcgtgctgtcggggaatatatgcagaatcgtcaagcgttcaaatacatcgtga

SEQ ID NO: 13233 - DNA, 675 bp, A.fumigatus
atcagctacatctcgtattacatcccatttttcaattggattggccagtaccaatggtccttcttccgaggggacctcatctctgcattgacagttgcatcgatctatatcccaatggcactctcgttgtcgtcgaacctggcgcatgcgccgcctatcaatggtctctattctttcgtgatccaccccttcatctatgccgtcttgggaagcagccctttactggtcgttggcccagaggcagcagggtcattgctcaccggtaccatcgtcaaaacgagtgttcgacaaggaacttcgcatgaggataatgctgctgaaaatgccatggtggtgggagtagcgactgccatggcaggctcgatgatcctgattgcgggactgactcgtctgggattcctggataatgtcctcagtcggccttttctgagaggattcatcactgccattggttttgttatctttgtcgatcaattgattccggaggctgggttggcagagatggcgaaagacgctggggtcagtcacggcagtactgtggacaagctactgtttttcttccgaaatatcaggaactgccaccgcctcacagccgcaatgtctttcagcagcttcgccattataatggtcttccggtatgtgctgaatcctccctgcagggtatgtaagtcctaa

SEQ ID NO: 13234 - DNA, 555 bp, A.fumigatus
ctcggtacgctgttcaggacgttgaaaaagaaactggaaccgcactatcctcaggtcgtttactttccagatcgcatcttggtagtcattcttgcggcaattctgacgtggcgtctggactgggatgagaaagggctcgaaatcctgggtcccatgaaaaatacaggaaatggcgtctttgcgttcaaatggccattccagttcagtcatatgaaccatgtgcgcaccgcaatgagtacctctttcattatcgcgctgcttggcttctttgagtcctctgtagccgcgaagggactgggtgagagcaggggaaccggtatcaagggtatgacggtgagtcccaacagggagatggtggccctcggcgtggccaatgtcgttgggggttgctttatggccctacctgcgtttggtggatatggaagaagcaaggtcaatgcttccactggagctcgaagccccatgagcagtattttcctgagtcttattactctggtctgcattctagtacttctcccttatttatattatcttccggtgggttccccgttatag

SEQ ID NO: 13235 - DNA, 696 bp, A.fumigatus
aaagcggtcctgtcagcgatgatctctgtcgtcgccttttcactgattgaggaatgtcctcacgatctggcgttcttcattcgtctacgcggttggactgaactggccttgatgcttctaatcttcgcctcgacgatcttttactcgctagagttgggaatcgcacttggcatcggactttccgtcctgatactgattcggcactcgactcagtcgcgcattcaaattctcggacagataccggatacgggtcgattcgacaatgccgagctacatcccgagaatgtacaactgatcgagggcgccttaatcgtcaaaattcccgagcctctcacttttgccaatactggcgaccttaaaaatcgcctacgccgtttggagttatatggctcgagccgagtacatccatccttccctcgaatgcgttctccagagaataataagaatatcatcttcgatgtccatggtgttactagcattgacggatctggcactcaggttctttccgagatagtggaaggatatgtggaccaggggacgcgagtattcttctgtcgtcttcccaatcgtgacgttttccgaatgtttgaacgaagcggtatagtggaacaatgcggaggaatgacgcatttcgtccccagtgtggatgaggcactcaaacttgccgaatcggaagagcagacggtcgaaagctga

SEQ ID NO: 13236 - DNA, 651 bp, A.fumigatus
cgcggatccttcgacccccgtggtgaagacaagaaccgccaacccgcgcggctgctggaatatgacatctcctcgggcacaccgaagtacaagcacgagtatgccgtactcctacccaagtacagtgattacacggaaaaggatccatcggacgcggcgaaagtggcctcacagtctgagatccacaagcttcccactggagactttcttgtcctctcacgcgactccggctttggacacgggcagcccgagtccctctccgtctaccggcatgcggacgtcatctccatttccgagtctacgactgatctgaagggtacgtatgacgccgcggacggatccatcgccagctcaaagggtgtcttgaactcgagtatcaccccggcagagtactgccccttcctcgacttcaatgtgaattcggaactagccaaattcggccttcacaacggtggtgcgcaggacgctggccttctgaacgagaagtgggagagtctggctcttgtgccggttgatccgcacggacacaaagatagacattccaagaaggcaagggaatatttcctcttcagcttcagtgataatgattttatcacacaggatggtaggtttcaggcagcgtttcgcctcctcccagcacaaatatgctga

SEQ ID NO: 13237 - DNA, 198 bp, A.fumigatus
acgcagagaacgaccatcaccatgtcagatcctcgcccacaggaatcagaaacacaaccgaaactccccaaatcgctcttcccccaccaaacccccgccgccgcaagttcctccacagcctccaaagacgacgatgtgcccgccggcatgaccaaactgcccaacggggtgatcctagacaaggaagggaaaccgtaa

SEQ ID NO: 13238 - DNA, 360 bp, A.fumigatus
caacagaacagctgccgcctctgcacctccgccgcgtcctggcgcgcattgacaaagcaagccaaaagccagaccgcagctgggaccaccccaacaacaaccccctccaacgcctccgcatccgctcctgccccgtcacccatgcaagccgaatgccccccggacgtcaaggaactgggtcgcgcaacctggacgtttctgcactccctgacggccgcataccccgccaaggcgtcgccagagcagcagattgagatgcggtcgttcctgagcttgttctcacggctgtacccctgctgggtgtgtcccggaggactttcggaagtggatggcggaacccaacggccggaatggcccccc

SEQ ID NO: 13239 - DNA, 798 bp, A.fumigatus
gaggtgcaagacaggctcgcacaggaaccggcgcaggaggaggaagtagaagtagctgaagaagatattaccttgtctccccaaaagacctcgaaacctaccaaacgcgcaaaacctacaagtacgcatacgtcaaggaaacgcaggaagacagcaacgctagagcctaaggtctcagatgacgacgaaaccggtgcgctcagcgccagcgagaacgatatcaagaacgctaccggaagacagtcaaaaactgaatcagaacgggctgactcggctgacgcagccaaggatgccgccgatattgacaatgttgcttcggagagtgaaatgtcggttgtcctagatgaggaacccaaacccagccgcaaacgaggaaaaagctcagagagcacatcggcgaaaggcaaaaagaaggtcccagccaaatcaaaggacgcgaatcttgatcccaacgaagccgaaatcaagcgtttacaagggtggctagtcaaatgtggtattcgcaaggtgtggtctcgggagctggctccgtatgatacaccaaaagcgaagatcaagcatctcaaggacatgttgaaggatgcaggaatggatgggcgctactcactagaaaaggctaaacagatcaaagagaaacgagagtttgaagccgacctcgccatgatcaaagagggtgaaaagcattggggccgggggagtgtggaagaggaaagtgacaactctcgacctcgacggagactcaatcggggtcgacagactctggctttcctagaaagcgatggggaagagaccgattga

SEQ ID NO: 13240 - DNA, 186 bp, A.fumigatus
cagtgtacaggcgaatgcaaacaccttatttcccagtacctgaaatgtctgaaactgaggaaaggggttaacgacgaagagtgtcgcaagctagccaagggatacctgagctgtcgaatggagaagtatgtctgggccgtacagggcccgatgcaaacctttaatctcgcaaagaatgggtgctaa

SEQ ID NO: 13241 - DNA, 360 bp, A.fumigatus
  unsure (62): Identity of nucleotide sequences at the above locations are unknown.
acgcaataccttcctacccctggcgtggatgacaagcttgataattgtctgactctttatanggatacctggattgtagtgactgctaacaacatttacagtgtgagtgctacccatactcttttgccatggatgttgtatgatgatctcttgattcgctgtgttctgactgaatacatcttgaagaaaaacatcatttcaccttggagaactgatacctcgtcttctctgatcgtcaatcttggaaccctgaaagtagctgtggctaacctgtcatttgcagacgattactcagttacatatcctagggaaatgcaactagcttcaatgcttcataaattttgcgtaaacatcatgtga

SEQ ID NO: 13242 - DNA, 222 bp, A.fumigatus
ctcctcctggccaacaccctggtcacccctttgaattcacagatagtgacacggagcgttacaagcgctggcatcagcagctctaagataagcaacgctcttctatgcgactccctccatcacggtaacgacaaatgctggccttgggactacttcatataccgcacagtccacacccccaagtctgatcaggcctggtctgcctgttctggaggaacttga

SEQ ID NO: 13243 - DNA, 201 bp, A.fumigatus
ggggataaccattgcgcggatcctcgccctcctgtggtgaagacacgtatgagcagcgtgaagcaaacaggctgcatgctgtgcttgaataatacataccatctgggcttgaaaccggggcaggaggttctagaccaagtgggcggcgcgcataagctgcaaggatgggatcggaatatcctgacagataccggcgggtga

SEQ ID NO: 13244 - DNA, 270 bp, A.fumigatus
acgacgtcattgcgactacctctcccgatcatgccagaattcacgaggccatgggaacggtccgttcggtggctagaccgctgtatcgatgcgcacaagtatcccgagagacagaacctattctgtatcatccaaggcggtctagacctggagctacggaagcagtgctgcgctgaaatggttgcgcgagatacaccgggtattgccattggaggtctatcgggtggtgaggcaaaggaggagttttgtaaagtgtatgtgttggcgtaa

SEQ ID NO: 13245 - DNA, 1131 bp, A.fumigatus
ttctgcttatcagcacgtgatctcgcgcgtcgcgtttacgcgttactcaaaaaagtcctccgcaaccaataccaaagacgaaacatctcaatcaccatgacaattcaatccaaagaccaaacaagcatcatgtcgccggcagccgtgttgccgcaagatacccccagccaaactggcacaccgactcctcctcataaccctgcacatgaggaacatcaatacctcaacctcatccgcaccatcctcgccgaaggcgagcatcgtcccgaccgcacagggacaggcacccgctcgatcttcgcaccaccgcagctacgattctcgctctccaagcctggtgcaacaccctcctcggacccgatccccatcctccccctcctcaccaccaaacgcgttttcctgcgtgccgtcatcgccgagctcctctggttcatctccggatgcacctcctccatccccctctcggaagcaggcatcaaaatctgggacggtaacggcagccgcgagttcctggacaaagttgggctcgggcaccgcgaggtcggcgatctaggccctgtgtatgggttccagtggcggcatttcggggccgagtacatcgacgccaagacggattacacaggccagggcgtcgaccagctcgcggaggttgtgcgcaagctgaaagaaacgccctttgaccgccgcatcatcatgagtgcgtggaacccggcggatctgaagaagatggcgctcccgccctgtcatatgtttgcgcagttctatgtctcatatccgaatgggctgggcaacaaggggagcctatcgtgtctgctgtatcaacgttcgtgcgatatggggcttggtgtgccattcaacattgcgtcgtatgcgctgctgacgcatatactggcccatgcgacggatctgaaccccggcactctgattcataccatgggtgatgcgcatgtgtatctggaccatgtcgacgcgctgaacgagcagctcaagcgggagcctacagagtttccggaactgcgcatcaagcgtaatgatcgtgggagtggagttgtggatggttggaaggaggaggagtttgaagtcgttggataccagcctcacaaggctatcaaaatgaacatgagcgtttga

SEQ ID NO: 13246 - DNA, 375 bp, A.fumigatus
acctggagctacggaagcagtgctgcgctgaaatggttgcgcgagatacaccgggtattgccattggaggtctatcgggtggtgaggcaaaggaggagttttgtaaagtgtatgtgttggcgtaaatgcgtacgggctacatgtgcttacaattctagggtggatacgtgcactggactccttccagagcacaaaccccgatacgtgatgggagtggtaagtactaggtggcccattcggttggcagtctcttttattgacgctgctcagggttatccagaagatctggttgtagcagttgcccttggagcggacatgttcgattgtgtgtggccgacgagaacagccgtaaggacaacctccggaatcgtttga

SEQ ID NO: 13247 - DNA, 453 bp, A.fumigatus
caattcaatccaaagaccaaacaagcatcatgtcgccggcagccgtgttgccgcaagatacccccagccaaactggcacaccgactcctcctcataaccctgcacatgaggaacatcaatacctcaacctcatccgcaccatcctcgccgaaggcgagcatcgtcccgaccgcacagggacaggcacccgctcgatcttcgcaccaccgcagctacgattctcgctctccaagcctggtgcaacaccctcctcggacccgatccccatcctccccctcctcaccaccaaacgcgttttcctgcgtgccgtcatcgccgagctcctctggttcatctccggatgcacctcctccatccccctctcggaagcaggcatcaaaatctgggacggtaacggcagccgcgagttcctggacaaagttgggctcgggcaccgcgaggtcggcgatctag

SEQ ID NO: 13248 - DNA, 198 bp, A.fumigatus
tttctcaacaggctcaccattcataatgttcactatttgctaaacttgatgggatctgctcgtcaagccattttggaagatcgatatccagcatttctgcgcgaatttttcgacaatctgtatggagataaagcgaaattccctgagtgggctgtcactgcgctgcgtggtgttggtgttgatctgctggcagactag

SEQ ID NO: 13249 - DNA, 189 bp, A.fumigatus
gcactattggtagattataagaaaagcgtgctcaatgcgcagcagcaagtagaagaaagcccggattatggaagaaaaacaaatgcaatcaaaaagaccaaggttgaggcaagtccgtctgatgatgatgataactccattcttaaagccgcgatcattattaagccgggcctaagtttcgggcactga

SEQ ID NO: 13250 - DNA, 348 bp, A.fumigatus
cacagacccgatggaaataggctgggcaactccggcctgaagatctccaagatcatcctaggagccatgtcctatggctccaaaaagtggcaggattgggtcctcgacgaagacgaagcccttcctctgattgagcatgcctacaaacgcggcatcaatacatgggacacggtgagtgggcgctcatgggcacaaataacgcgagcgcaaccagaccctctgacaacgggtaattgcattgaaggccgacacataatcccatggcctctcggaagagatcctcggcaaggttctgaaaaaataccccatccccccgaacacagaatcgtcatcctaaccaaatgctaa

SEQ ID NO: 13251 - DNA, 516 bp, A.fumigatus
  unsure (87): Identity of nucleotide sequences at the above locations are unknown.
catttgcagatggccgcttgggaattccaaaccctccagaatatcgccgcccgcaacggctggcaccagttcatctccatgcagaantaccacaacctcttcgcccgcgaggaagaacgcgagatgatcccgtactgcctcgactccggcgtcggtctgatcccctggtcgccgatggcacgcggtgtcctggcccgaccttggggctcccgctcctccgtccgtgagaacaccgacgcgacgctacagctgctggtccgcagccgtgagaccgaagctgacaaggcgatcgtcgagcgggtcgaggagatcgcgaagaagaagaatatctccatggcgcaggtcgccattgcttgggtgttaagtcatcccaaggaaaacccgattctgggtctgtcgagcaaggagcgaatcgacgaggcggttgccgctatcaaggtgcagctgacgccggaggagatcaagtacctcgaggaaccttatcgccccaaggcgcttacagcactggagcggtga

SEQ ID NO: 13252 - DNA, 639 bp, A.fumigatus
tcggtttgcggcggttgtgctgagctgcccgtctgtccgttctccggtttcgcccttcccgctgttttcctttttttttcacttttcattcttccccatcgatcgctttccatcggatattcccccactcccaatcgctacttcgcaaacagcacgccattcctcaaagtactccattgtatatttgagtccttcaggatgaacataatgaggctgttaccgcgctccaaagctttgtcttcaccgacggcagtagcaccagcgtttcgtggtcgtggggcaggcgtgtattctccatcatcacagaccgtatatatgtgtccaacctctgccgtcagcttaatgcattgctcgccctgttccacatctgcgccgttgctatcgagtcagaagtcggtggcccagacgagtgctaataatgactcactttcagacaaattctctgccgcgctggccaagaacaaggaatgggctgccaaatgctctcaagatcacccggagctgcttcccacacttgctgtcggtcaacacccggaaatcctgtggatcggctgctccgactcccgcttgcccgagaacaccatccttaggccttctgcctggcgatgtcttcacccaccgggattattgccaacttga

SEQ ID NO: 13253 - DNA, 351 bp, A.fumigatus
tatgtggtcacaccaagtgcggaaggcgtagccgctgccctgggcaacaaaggcctgggcatcctcgacccctggctgatcccccttcgtcagctccgtgagcagcacctcgctgagctgcaatctctgtcccgggacgaggccgtcgtgaggctggccgagttgaacgtcaaggagggcctgaaggcattgacgcagaagagcgtcgtgctggaggcgatgcaggagcgaggccttcaggtgcacgggctcatctatgacgtcggatctggctttcttcggcagctcgacgccgctgaacccgaggaagcgctcaaggcacggttgacatcgttcaagaccgatgcttag

SEQ ID NO: 13254 - DNA, 606 bp, A.fumigatus
  unsure (217),(466): Identity of nucleotide sequences at the above locations are unknown.
aaaaataccccatccccccgaacacagaatcgtcatcctaaccaaatgctaatttgggcgttcctaacgaaacccaacgatggcaaaatggcctcctatctccggcctgcaaccgaaaaccacggcgactggggtgaaccgcgtgggatcccccgcaagcacattttcgatgcggtcgatgcctccgtcaagcggctgggcacgtacatcgatgtgntgcagatccaccgtttggatcgggagaccccccgcgaggaaatcatgaaggctctcaacgatgtggttgagagcgggaaggttcgatacatcggcgccagcacggtccgtttctttccccgtctcctttccgaacttgtccgaaatgaaccctattcgttaacatttgcagatggccgcttgggaattccaaaccctccagaatatcgccgcccgcaacggctggcaccagttcatctccatgcagaantaccacaacctcttcgcccgcgaggaagaacgcgagatgatcccgtactgcctcgactccggcgtcggtctgatcccctggtcgccgatggcacgcggtgtcctggcccgaccttggggctcccgctcctccgtccgtga

SEQ ID NO: 13255 - DNA, 294 bp, A.fumigatus
attggcgtggtcggggatttgctcatcctgtattgctctgcgtatgtcaacctcgccagctttccaacccccctggacagtccccgactatattcctttccttcctggcttgtagacaaaatgaccatattcgacgagatcaagcacgtccagaggctagccgaggccgaagctgcaggagatcccaatgctcacaatcaactgctggctgcgattcgcaagcttcaattggcagccgaaaagccgattgacacaacttctcgagtaaactttcaagtaagtcctatggcgtaa

SEQ ID NO: 13256 - DNA, 207 bp, A.fumigatus
ttggtaggtgccttacatgcgtccctccgtattgagagcaatactcaccctaatgcatcagtccgtgtaatgcgcgtgctgaccgcaattgggttcgccattgagacggccaaccagacatacgcggcgaatgacacgacccattttgagatcctccctggatcaattgccgcagttaagcatcagtacgtatttccatgttcataa

SEQ ID NO: 13257 - DNA, 363 bp, A.fumigatus
gacgcattccccgtaccaacagatcaaacagaactgacaagtaaaggtgcccgggcttatttcttccggcaagtgctgcataactggtccgatgccaaaagcaagcagattctgtcgcatatcgccgatgccatggagccgggatactccaccctgctgattgacgactatgtgttgccggataccggggccgagctgagagcagctgagatggatattctcatgtggttgcacacggccggtctcgagcgaactgtctcgcagtggagggctttattcgatgcggtaggtctcgagctggtgcagatctggaataccgacaagggcgacgagtcggtgctagaagtgagaaaaaggctgtga

SEQ ID NO: 13258 - DNA, 840 bp, A.fumigatus
  unsure (661),(677): Identity of nucleotide sequences at the above locations are unknown.
tctatactcattattgcgacaagcgtccgttgccgattcgattacaacactgagcaggtttctatccaattgcaacccacaatgtcgaccctaactcgagccttcaccaagcgccacaagcgtcccgaggtctctgcgccaatgccctatcgcgaaggtcaggtcaagttcactgcggggactattaagcggggaaagatctctggaccagtcgagttaatctctacaacgaacatgttggcctacaatgcgcccgaccttcactcggctgtctcgtcatcttcttcttcactgcagtctcccgacgactccgagctgtctttctctcagagaagctttggctctcccatcacaactccagacgattcaccggttgagccgaacccattgtcgtcatatttcccgaagcgatccgcaacagtgactagccatcctcggtcgtcaacctcgaccacctcgtcgacagatgcacccttggttcccaaacgtgctctatcgcatacgaaacggtcccaccaagagttggctcgccagcgttccttgtcacggttgtccccgccaccattgaactccatgcgcagcagcccctccatccgaacgaaccaagattttttcaaatcggagccccatccgttcggaaaggaattggagcaggtcaacnaaatggcaaaagagtncaatagtggcgctaatcgcgtgcttgacgaggaggagatgatcttgctcaacaaaggattgaggaaatttacagcgaacgactatcttgtcgagatagaggaactctatgggagcatcttcgacgatcatctcgggccggtagccactgggtcttggctttga

SEQ ID NO: 13259 - DNA, 201 bp, A.fumigatus
cagcttctcccctatcaactccaaataataataaaagcacaaactcaaacacaagcaaaagagcaacaaccagaaatggagaggatcgattgtgtgcaacatgagcccgaagatcgtgtctgggtaggctacggctccggccctggggtgaaggtgtttgggaacccctctaagggtgatgtctatgtcctggatagctga

SEQ ID NO: 13260 - DNA, 399 bp, A.fumigatus
gtggtggccttgtacaggaacggttctctctcagtcaggtcacgctcacgcttctttgtcgggtgttcaagcatcattgcaggtcttctaaaactcatgaagatggccggggataagacggtcgaggtcactccttcgccacggatagggattgaagactccctagagtgtcttcctagtatcatggatgcgtctatcacgcatggggagctgactcaggagctatgccttattctctacctcacatactccactggcggtggcagtttatattgtttgacgctcacttcggtagcaccatttcccaacattgcttccattggtggggcaacaactcagatcttttgtcaggggctagcagcgccctgtgctgaagtgagagcctcccaagggccttga

SEQ ID NO: 13261 - DNA, 195 bp, A.fumigatus
gtcgtccgtctgcggtgtctccttcatatcccaaacgcagtaaattcttttaagcctatctacccctcaatcggactcgttcatatcatcaatcaaacacttctgtcaaggctcagtatagcgtcagcgcctactaactcaaccagcgcaagctattccaatcacgcaactgacatcatgtttgaggtcctataa

SEQ ID NO: 13262 - DNA, 630 bp, A.fumigatus
cttttcataatggcaggcatcacatcaaccgacggtcttccaccattagcggtggtaggcttctcctttaaattccccgaggatgcaacttcatcagactccttctggcagatgttgctcgatggcagatgtgtgtcgtccgagtttccagccgaccggttgaacatcgatgcccactactatcccgatcgcaaccgtctcgacagcatctcgatgcgcggaggacactttctcaaggataatatagcaacatttgacgcgccattcttcgcaatgagtgctgcggaagcggaggcaatggatccccagcaacgtatggtcctagagactgtgtaccgagccctggaaaacgcaggtcttccaatggagaaagttgccggctccaagacgagtgtgatcgcaggctcattcagcgatgactactttttgctgcagactaaggatccgctagatatgcctaaatacacggccgtgggcacgtcgcggaatatgcttgctaatcgagtcagctggttctttgatcttctagggccgagcgctgcggttgatactgcatgttcaagcagcttgatcgccttggatatgacatgccaatcaatctggagtagagatgctgatatggtatgttga

SEQ ID NO: 13263 - DNA, 507 bp, A.fumigatus
cagaaggacaaatccttgtggcttttcttgctaaagttttggcagggtctggcaattggaagcaatgtgatactaaccccagaattgaccatgagcttggacaatctgggactgctatctccggatagccacagctacagctttgatagccgtgcaaatggatatgcaagaggcgagggaattggtgtcatagtgatcaagcgattcgataatgctatacgtgacggagacactatcagggccgttataaggtcatcctcttctaatcaggatggaaagacacccggcatcactcagcctagcaaagaggcgcaggtccgcctgatcagagatacgtacaaaaaggctggtctggatatgtcactgactcgatatttcgaagcgcacggcactggtatttactcaatgagactccaggaagttccctctcagttaaccagacttagggaccccaattggagacccaatcgaaataagagcgatagggacggcttttcgccggtatag

SEQ ID NO: 13264 - DNA, 288 bp, A.fumigatus
gtctcccgagcagccattatacgtgtaagtcccgcctggtcactccgagcgagaactaccctaagacactgtagtggatccgtcaaatcgaacatagggcatctcgaaggagccagtggggttgcaggtgtcataaaagtaattctagcattagagaaaggcatcatcccaccgaattcgcgaaacttgcagttcctcaatcctcaaatcgatgaagagttcctcaatttaaaggtttggaagagtatccagcttgagtcgaccgtcctaactgctttcgcgcaatag

SEQ ID NO: 13265 - DNA, 573 bp, A.fumigatus
gttctgcaaaaggctattccatggcccgagaatgacctacgaagagcgtctgtgagctcgtttggcttcggtgggtcgaattgccatgttgttttggacgatgcgtacaattcgcttcgacttatggggatcgaaggtagccgtcatcagacagtggtcgtacctccatcgcttgaagtcactgctctagtggctcacgggaagtgtggttataccacgaatgccggaagcgatcaaccaaacgacgatcatccgaatggattgcatgacgaggaggaaacccatcagctccttgtgtggtcaaccgcagacgaagaaggaattgagcgacttgtagaaacctggaagccgtttctatcagacaagcgggagttctccagaagtcagcgacgtcaatatctgctcgacctggcatataccctcggtcagcgccgcagtcacctccaatggcggagctatgctattggggatgctttggaggatctcggaagcctagcagaccgctttacgcctgcaatcagatctaccgacgagtctcacatagcgttcttgtttactggagtaagactataa

SEQ ID NO: 13266 - DNA, 1323 bp, A.fumigatus
tacaatctttccaacagctactggctcaaatacttggtcgtcactcccaaccaattaactgccgcggcgctcgtgatatcatattggctcgatacaaaggatgtaaaccctgggatttggattacggtatttcttgtagtcattggctctgtcaactattgggccgctcgattcattggaccatacgagttcgcactttcaactttcaaaatcctggtcttgtttgcgcttacggtgctctcggtggtcattgcactcgggggcgggccagatcatgatagaaggggtttcagatactggagagacccgggcgcctttgcttcctatggcaatcatgaactggtgggaaagctacgagccgttagcaagactatgccctccactatatttgcgtacttgggtagtgagctccttgggatggccatgctgcaaaccaggaatacaccaaaggctgcagcgcgcgccatcaagcttacattctatcgaatcttcattttcaacattgtcagcgtaacgctgctcggcatgctcattccatacgactcccaagacttggcatttgcgaacaacgcctccaagccgacgacagtctctgtttttgttgttgcaatcaaaatggcccatttaccgacccttccaaacattctcaatgcgtgttttctgctgtttgtcctatcagctgctaaccaagcccttcatatggcgacccagatcatccatgggctatctcaggaacaaaaagccccttccttcttatcaagaactgaccgtaagggtgttcctgtctattcgttgggcacatgcgcaattctagcatcattggcatatctgaacattcacaacgactccaaggttcttttcgggtactttgtcaacataatcaccatgttcagccttctcacttggatctcaatcctgatcacacatatttcatttgtgcgcgcgcgcaaggcccaaaaagttcctgactcggcgctagtctttagagctcctttcggcgcttgcgggtcatgggtcgctctgattagctgcattctcttttctttgatgggaggcttggatgtcgcagagctagcaacccatccagaagcatttgactatatgactttgattacctcctatatcgctgttcctctctatctgtcccttgtcattggatataaggtcgtaacccgctgcgagagcgtcaacccagctgaggctgatctctggaccgctacaacgattcgtgagcgccatgagtcttcagaaccggaagacacagggctattagatcagaaccactggttatggaatcgtttcgtcgccgcatggttgttgtga

SEQ ID NO: 13267 - DNA, 381 bp, A.fumigatus
gtttcggaagagaccgtctacactcgagttcttgcagcccgccagtctagcgagacctatccctttgaccctgtgaaattcattcctcgatacctcgctgaataccagttgtcctggggtattcgcggcgacaacaccccggaatacgcgaagtatctgggctacctggatgcgaaggagctctatcccgatttcagaccaaccgacttccgtgactacctcgagtcggtcgttaggggcaccgcgaagggtatctacacagaccgtaccatttcgagggcccaacaacgggaattcccacggacggagtctagtgactcgttgtacactcggatctttcccagggctgagtcgagcgattcgctatacatgagcagataa

SEQ ID NO: 13268 - DNA, 186 bp, A.fumigatus
cccgtcaagcctgccgcgattctgatctcttacacagctgtgggtatagttgtctatttgactctatgtgctctaggagaggttgctgcttggtttcctgagccatcaacggctgtggatcatgcccgttcgttctgtgaccctgccgttggctttacactgggctggaggcacggatttccctga

SEQ ID NO: 13269 - DNA, 243 bp, A.fumigatus
atttcccacgacccccttcacagtctctctccctcctccaccgcatccttctcttcacttctcttccgagtctgccttgcccactcaggcgtcaaggtcattgctctccttgtgtctactgcgccgatgcggcgggaaatgtacacatgtgagcgtcatatggctgaactgaacctcctgtcgtcttctcagccgctacacatgttcgccgcaattcctaccctgcaacagcattgctgttga

SEQ ID NO: 13270 - DNA, 1197 bp, A.fumigatus
gtcgaatcactgctttatataatttgcatgctttcgtcttggttctttgatattaatatcttttcccattcgtctgaggtctcgactgcgtggttgcaaagagatacaactcaatttacccggagtttgacacagatcaagccaggtgattcacacttccagaaaacattcctccttgcgattgtgacagcacaacttatggtcatgaattggacttccgaatctttcgcgtccgcttcaacctatgctccctcttcatctgaggacaactcgatgatgatagagacaagtcacggttacgcgacagaggccttcgagcatgcgaatcatcccaacaattcacagccacctactggtcttggaatcacttatgttggtatggaggctcagttcagtcagatgggactttgctctgttccagaaacactgtcccagccgacgaccgactggcctgatcaattgatgcagtccgtcttcgagccctgtctggatgttgaaaatcttactactgggacatgctacgaatccttccctgttcatcacgatttgtctacctctccccacagcctttatagtccgcaaaccctaagcgcatcaccgagttactgttcgaccttggatgtgggaaatcagggaacaacgtgcagccagacgtcccgtaggtggccgggtacgccttgttcggacaacaccactcctttcgagggatggtctcacgtaaagcaggagtatgacgactgcccggatcctcttctctactctgaaccgagtgatgcgtctggagtctctacgtccacaacaatacctcagctgatggtgaacaacacctttgcagtcacggcatctcctggaaaagagaaaggcgacaccactcttaagcctgatccgatatttgaagactccatagaccacgatcagacggcaacaatacctcagtccaccgctcaggcccgcacgacgatatcaaatgataatgagtcatgcaaagtgacatctgctagcggcctcgtctgtaccgtgtgtggcacccgtttcacccgacgctcaaattgccgggaacatatgaaaagacacgatcccagctgtaggaaactctacccgtgcgaggcttgtggaaagactttcggcaggagaactgacttgaagagacacgtggacagtgtaagtctagttggtcggctcgctgtctgttgctaa

SEQ ID NO: 13271 - DNA, 960 bp, A.fumigatus
ctgaccgaggaggacaggcatgctgaaccggaacaagtacgaacaaattgccgtcagacagattgcctaccccccgccactgacttccagcaggtcgcccagatgatcggctccatgcaagtctcctcacaaccgcaggcccagcgacctcctcgaacatcgtctcatgctccgcccggcgggcacccccagagagtccccgtcacgaatgctcagatcaacaaacccctccctgcgaccgggccgcctcccgcaagccatgcgcggccgcatcccctccacccctcgcctccgccccaaaactacggcttcgggccccctccctcgcagcccgtacgcaatcgcccttctccagtctcgcgtccacctcaatccccccatccgcctcctctgtccgccccgcacgatgaccctcagcagctcttcccactcttccgcgctgccaatgcctcacactcgggcgctctgaccgagatggagctcggatccgccctcgtaaatggcgactatacctctttccatcccaagaccgtcaagatgatgattcgcatgttcgaccggaacagcagcgggaccatctcgttcgacgagttcgtggcgctgtggcggttcctcgctgcgtggcgggagctctttgaccggtttgacgaagatcgcagtgggcgcattagtctgcaggagtttgagaaagcgctggttgcgttcgggtacaggctcagccagccatttgtcacggtgctctataccacgtttgagagcaagaaacagcaaataaacggggggcatggacctgccaaggatgggatgagcttcgatctctttgtgcaggcatgtatcagtctcagacgaatgacagacgtgttcaagcggtatgacgaggatcgggacgggtatatcacactgagctttgaggagtttttgactggtaagtggcgcttcgaggcagtctggtctgattga

SEQ ID NO: 13272 - DNA, 879 bp, A.fumigatus
tcaggctggtcttctcgccttctgcaaatgtcgtcccccgaaagccccaccggaatctcttttgcaggccaaacggtggtcctgaccggggcgacttctgggctcgggtttgaggctgccatcaaactgctcaatctcggtgtggactctcttgttattggctgtcgcaacctggagcgaggagaagcgacaaaagctgagctggagctgcgcaccaacagacctggggtaatacatgtctgggaattggacatgagtagtttccaaagcgtcaaggatttcgcagctcgcgtcaacacagagatcgaacggctggccgtcgtattgctcaatgcgggattgtggaatcggagttacatagcatctcctgatgggtgggaggagacgttgcaggtcaatacattgtccacttcgttgctggcaatcctgcttctccataaactccggagtagctcgtcggctgaaagccccagtcacttgagggtggtatcaagcaaattgtttaccagagtggaagcggacagtctgcggactgacggctcattactggagcatctcaacgatcccaagcattttaatggaccccagcaataccggatctcgaaactcctgatggaatatgtcctcaagacggtggcgcaacacgctcgtgaggagaatgggtcagtcccagtgatcatcaacactgtcagtcctgggttctgtgcgtcctctctgggacggcagtacgaccgattctacgagcgatggatgatgtggttagtatataagctatttgctcgcacggcggaacaggggagtcggtccctggtcagtgcaacgtatcaaggagtcgagtcacatgggaagtgctggagagacgatggttacgtggagtaa

SEQ ID NO: 13273 - DNA, 642 bp, A.fumigatus
gacaaaatttgtactcacctagatctatcggcacagcctccagtcgaggcttctgacgctctccgcgcaagtgtccttcaatcatgccattcaacacttatccgtcttggcgatctgtctcgctaccgcgaaaccgaattggtgagcaaggaccgcaattggggtcccgctattggctactatgacttggctatagccatctaccctgcttcaggcgcatcgcacaaccagttggcagtgatagcccttgctgacggcaatcacttgcgggccacttaccatctttaccgggcccttgctgcccaggagcctcatccctctgccaagggtaacttggaaatcgaattcagaaaggtgcgccatgcttggtgtaaaagagagttgattcgtcccgaggatgcaggtattcctgggcgagcgttggccccttggtttgtttatcttcacgctcaatgctacaaaggaaatgattttccagagcatgatgagcttgagagtgaagtactgaaccagctagccgttgatctgaaggagcgctcacttgaaggtacacttcaaaagttctgcctcattaacatcgcagcagaggacttctcgtggacgcagccccatggtaagtctccctcatgtcgcaattactaa

SEQ ID NO: 13274 - DNA, 702 bp, A.fumigatus
  unsure (366),(663): Identity of nucleotide sequences at the above locations are unknown.
cggtctcgatctcgttgtgagcaatgtacgaagtgtcctgtgtattcttttgtaccaattcgattacttactgatactgctttgcgatctcagagaatccctatagtccttgtggatgatgaggataagaagacctttatctacaaagaggagggccttccttcccaattcttcgccagcccctccggccatcataacacgctctccacggcgagcgttgaacgatatgatgttcatcatgcgaccaaagacgccaatcacattgcagattcgaggagcacttttggcggttcgcagtctgcatctgcttctatgtccgctaatatgcatcgcattgtcgaaggagtcgaacggctggttgagtcngacacttacgaaaacactcctgcactttcggaacagctggctttccttcgaagcaacaatcagcaatctatacccaacgatttcttcgagtcgagcctcaatactactcatcgcgaagcaaatgcccctactcgctatcctcctattgcacctcctggcctgcaattctcgatgccaaacccccagctgggtccgcaacttcatcctccagtcctaaacttcttgacctacccttctggttttccccgtttttggacccccgaatggtcaatgaaatcggtggatctcggctccccnaaacccttccagggtttggacacttcaagttccgccaac

SEQ ID NO: 13275 - DNA, 390 bp, A.fumigatus
gacatgtctaaacgccctcgcatctcaaggtccccctcaccgggtcaaacacctgagacttggtcaacatcaccgtcaccagcagcttcaacgccatcttgtcaacggtccaagataatattgcaagacaccaatgaacctgctgtggaagcgatgcattgttcgctaccgccgcatagggaagtcatttatttctcctcctatgaagactatgaggtgcactatacgcaaacacatgtcaaccgatgttcagagtgtgggaagaatttccctacagatcgattcctgaatttgcacatcgaggagaatcatgacccactagttgctacgaagagagacaagggagagaaaactgttcgtcagccctgggaccattgttttcgaaattaa

SEQ ID NO: 13276 - DNA, 543 bp, A.fumigatus
cttcgaacaattcctcccgagcaacagcgattgaacaccgttgcacaaatattctaccattcgccgggcaatttcgccatgcgactctttgtggtgccaatttcgacgcaacgagcgttgatctactctcggcccctcagcagggatatcgttagggagctctcggtacttgatcgcgtcacgaacaaggctgcggaaacatgggctaaatgggaggaagctgataaagggtggaagaaacaccttgtgacttggggcaataaggtccagcagcgcatcccgttcgaagaatggggcctgaaaagcattccttctctcaaggcccagaggagactggataagtcgtcggagacgaagaaagtcgacgttctgttccccgggaacgcaatcaaggcagagaaaattcgctcaatcctccggaaaatagcgacagagagacaggacttgcatcgcaagaaaatgtggtggagtttggttgcagcgccattgacagccccaattgcgttgattccagtgtattctttgtgcctgacagagtactga

SEQ ID NO: 13277 - DNA, 210 bp, A.fumigatus
tcagcgagtcatcgtgacgatctacaacgcaaagcaatggtggtggcggaaacagccgggcagggatccgtgacttacaccattgacgatattcctgaatcctacatcccgccgcagcgctcttggggtcgcgaatatatgcatggcgtcaaccacgtaaatgaagtcgctgcctataatgtgccggtgggatggaagtcgtccaccact

SEQ ID NO: 13278 - DNA, 228 bp, A.fumigatus
cagtgtttattgactgatcgttgtatagatccaggccaagcatccatgactctagcaaagctccaaaattcagttaagtcatcattcgacgcaatcaatgacaacctcaaggaacaccacagcgctctgaacaagtacagcaaagcactagataaggtcttgtctccgagtcatttctacatatttggtgctctcgaaactgacactgtggcagctcttcaaagataa

SEQ ID NO: 13279 - DNA, 219 bp, A.fumigatus
gtcgagattccacttccacccccttacctattccattcgatcttggtctgtccggtctccaaggaacagtctacagacgagaatcccccgatgatgatgccttgtggtcatgttattgcagaagagtcgttgaaacgactttgcaagggcacaagattcaaatgtccttattgtcccaatgagagccatccgcgagaggcaaggaaggtcttcctatga

SEQ ID NO: 13280 - DNA, 762 bp, A.fumigatus
ataaggtcttgtctccgagtcatttctacatatttggtgctctcgaaactgacactgtggcagctcttcaaagataagccacttccgagcaccgagcatgatgctctatcttctagagagcatctcatcaaccgcgcaatcgcgatgcacctgttacgagagggacagttctctgtagccgcaaccttcctttccgaaatagccgaaaagaaagcttcgacgcgagagaacgatatggatacggatggcccagacgccgctaagagtcttctcgatatcgacgatgttccttcggacgaagttcgcaaacaattcgcaaccatgtatcacatactacatgagatgaaggagaacaataacttgcttccggctatacaatggtcaagggaaaacaaagaatctctggaagcacgaggcagtaaccttgaattcgaactgtgccggttacagttcgtctggctctttcatggcggacaaggccctgctgtcgctggcccacaggctgcattggagtacgcccggcgcgaattccatgtttttctccccaggtacttggtggaaattcagcagctgatgggggcaatggcgttttctccaaacctccaagagtccccttatcggaatattttcgacaatccgtcggcatggtctgatgtggcgcaatctttcactcgggagttctgctcactgctgggtttgtctgcggattcgcccctatacattgccgctactgccggtgcgattgcgctacccctctgttga

SEQ ID NO: 13281 - DNA, 261 bp, A.fumigatus
cagcatgcttgtatctgtacctgcgtctgtaagtacgacgatcaagggggtgacactgatgatgtcggaacagctgataaacagagcacaaactccagaaaccaaaccatcttggaaactggtttctcttatatattctctgctatgctgagtaattcagacagctacaactctaaagacacccgtcaaccttgttggatcctttctttgttgcatctatcacaaatgagccagtttgagggacgaactgtgggcgcgtaa

SEQ ID NO: 13282 - DNA, 291 bp, A.fumigatus
caaagacaacttcgaacaatactccgtgcaccagtactctggtataccccagtaagaatgttagtccggtgggccttacaaggatatgactcctctgaagtggtgaggcctttaaagcaccgctttcctgttcagactagttttaaagctagtaaaacctctaatatcaccatcctcctgagatccatggtggtgagcattgctaatatggctatccccaggcctagcacccctccagaggcgcctttagaggtgactgaaatatctaaaagaagccaaagttctagatag

SEQ ID NO: 13283 - DNA, 312 bp, A.fumigatus
agcccaggattccacactagaggaaccagggaatcccgacaaggtcctttgcacttccgcgaagtgccaaattccttgactggttcttggatggtgcggaaaaggacattggagtacgccaaagatgaaaaggagctgttcgctgcgcagggcgacaaggcattagcggcaggcaatggcgaaacgctcacatacgatgagctcaaggtccttattgactttgcttctcggaaattctcagaggacctcgcggagccgaaaatcgggaagatttcatggctgcgaagaaagccagcgccgatgcgctgctga

SEQ ID NO: 13284 - DNA, 225 bp, A.fumigatus
tccaatggctcatatatctgtccagctattgtcacgaaggtctcgcatcgcaatcacggtcaagtccgcctcaaggccgcagcagaatttgccgaatctggtgatattcatgatacagttcgtgatctctgggagaggccagaagacgctaagaaggaactcatcgttaaggtggatactctcccttcttctgtcggtcttcaactgattattctaggaaattga

SEQ ID NO: 13285 - DNA, 714 bp, A.fumigatus
caatggcttgcaagccaccttgccaagctgcgccgaatcacagcctcggagtcaaagcagccacaacctgaggctagagcaactcctcgtcggtggaccctgattggggccatgaaatcgaggcgtgacagcatcagtcagccagtgtatctgcccctgaatcatgaaatggccaacgcgtttgacaccactcttcaatcgctgcgtaatctggcctcgaccgcgctctttgctcttcacattgacatccgatgcggcgtcattcacatgttgacccgtacaatgactggccccaatcccccgagcaaccgcgattcggaacccacaacaccatcaccgaactcgaacttgaattggtggcatatccttgtaaatcagccgacagccgcatctcccacgattctcgagctgaacaatgacctgatcgccttcgatacgaacatttcgtcatatctcggtcccgctgaacactggttcatcacctcgggtcttgctcgatttattgatcaagcatttgtctcatctactcgtcatattggagccatgaatgagaacggagccttgcggctgcaacttgacgtcctcgttttacagcagaacctcaagaatattattattgacccgacagcagataaagcccaggattccacactagaggaaccagggaatcccgacaaggtcctttgcacttccgcgaagtgccaaattccttga

SEQ ID NO: 13286 - DNA, 204 bp, A.fumigatus
gcatttaactataacaaagttagcctcgcctcacgtatcctggttcccgaagccatgtctattgacctttgttgcagatgtggatctgttgatatttgcatggtcgtacaggctctcaaattctttcaggctagtgcacggtttttccgtcaagcctacgactacagtcttcccaccattgtcccggagaggcaaccctgctag

SEQ ID NO: 13287 - DNA, 306 bp, A.fumigatus
acaaataatatgagtgttcgggtagtggcccgtgttaggccacttttgaaagcggaacgtgagcaagatataattcttcgcactggcccgtcaagtcagactttaccgccaaagggagaccagaagagcacccggggtaattcggcggttgcaaaactgagggaccgaaacacaattgtcaggatccccaaccccaagaatgaaaacgaggaatattctttccagttcaatgctgtttatgatgcagatgcctcacaacaggagctctatgacgccgagggttcgttacgcgcttctctgatttga

SEQ ID NO: 13288 - DNA, 477 bp, A.fumigatus
ccgccacgatacgctgacattattccttcagttgctcccacagtcaagcacctcttcaacggcttcgatgtcacaatatttgcatatggggtcaccggaacggggaaaacacatactatgcgaggtggtaaaagcctggctgagaggggtgttattccgcgtctcctgagtagcatatacagacgcagccggaagatcgagaaggacagcgaaggagaaacaactgtcaaggttgccttgagctactatgagatctacaatgacaaagtcttcgatctgttcgaacccccagagaagaggacactagcagggttgcctctccgggacaatggtgggaagactgtagtcgtaggcttgacggaaaaaccgtgcactagcctgaaagaatttgagagcctgtacgaccatgcaaatatcaacagatccacatctgcaacaaaggtcaatagacatggcttcgggaaccaggatacgtga

SEQ ID NO: 13289 - DNA, 300 bp, A.fumigatus
ttaaatgctcactcatcccggtcgcatgccattctgtgtgtgaaagtgactatcagctccggtgacaaggttcgcgttagcactgcatctgctatcgaccttgctggttcagaggataaccgacggacggacaatgacaaggaacgcatggttgaatcggccagcattaacaaaagtcttttcgttctcgcgcaatgcgtagaagcgatcagcaaaaaacaccaacgaattccatatcgtgagtcgaaaatgacgagaatattatccttgggccagaacaatggcttgaccgtcatgatc

SEQ ID NO: 13290 - DNA, 369 bp, A.fumigatus
  unsure (32),(35),(36),(42),(45),(46),(49),(50),(52),(53),(55),(56),(57),(59),(60),(61),(62),(63): Identity of nucleotide sequences at the above locations are unknown.
ggggtcagggcctcgaaaatcccaggccggcngannttttantgnncgnncnncnnngnnnnngccccccgtagactaaggcttagtcttactaagccgctacgtcgaaggggtcggttagtcgggattattggcgctacggaatatgtggttaatactccgaaactgctctatagatcgacgccacaggattgtgactactcgcatatgacctctatgtcagttcgatctttcaatttgaatgagggactcaggattcctgtgtctatcaatttaatccagctgctctatgtgcattttagccgcccatggaattgcaatccatttttccatatccctccagcccgtgtccaagatatccagaattga

SEQ ID NO: 13291 - DNA, 207 bp, A.fumigatus
agaaaaacatcagtatttgataggatcatctatactcctattatccacttactgtgggaagttttcaactacactctccaaaaggtagaatccaaagcattcattggctttggtggaaatcaatttttggaagataccaaggatacggaccagttgctggttttccaagatgaactgagaaccacgagggataatagaagaaagtag

SEQ ID NO: 13292 - DNA, 231 bp, A.fumigatus
ctgtaccagaacctttcgagcaggctattgtgctacggtcaatccatggatgaggacctacggtggccatgcatggatgagcacgatatgacggctaagcaaacagctgtgtttgatctcaaggcgtcatggtgtcgaggcgccaccacttggctggccaatattcgaaccattggcagcgtcgactccgtacatgataaccacgagcatctttccgaggtgatacgttga

SEQ ID NO: 13293 - DNA, 648 bp, A.fumigatus
  unsure (262),(268): Identity of nucleotide sequences at the above locations are unknown.
tcctatcaaatactgatgtttttctctatcacggcagtaaagaagtacttcgattctatcatgcaggtcatcctcacccgccttcaaaactccaaaaccgagcatctcattctcagatttgtccgattctatcacttcatctccgctcatgacgacaagggatatagtgcggactactttatccaagttacagataaagtccaagcagagtatgtcgagatgaatttttgtattgccgatcttaaacatatactgacggacnacagcnttttcacccccatctatctcaacatcattctccctgaaacacagaaactcgcacgtccattggatcgcaagacagccgtgctgtctttcacaaagacccttgcgaactcagaagcgtttgcaaacagatacaagaagggatgggccttcacatgtgaggctttactgaagttgttggagcttccccctcttcccgccagcaaggatgacatcattgccgaacatgacgttgaggatatggctttcggagtgggtttcacagcactgaacaccgtgcggccacaacccagggacccatggcccgacacgggcgctgatctcaaggcttgggttggctgttttgttttacccggcggggactggaaagagtatcaccccccc

SEQ ID NO: 13294 - DNA, 426 bp, A.fumigatus
ttactgagaggatgtatgctgaccttaagaattagtggctccgagctagtctcggatcatgctagccggaacctgcacttgttactcgccaagcgtcccgagttcgaccaaggcgactatgaagcagctataagaggggcattgatcgatgaagatgctgttttgctggagaccttcaacaatctaaccacagaacctgccgtttccggttccactgtcgcgctgtgcttcgtcaatctcaccaagggcgatctcgttgtagccaatctcggagactcacacgtcatcctggccgagcgcgataaccgaaccgaccacccatcccacatcgtaagtgaggagggtttgctgattcccaagggattttggctgattgatgccttagcgacggctttcaaaatcccacaaaccggatacacccgatga

SEQ ID NO: 13295 - DNA, 420 bp, A.fumigatus
catttgccatctcgactcctcctaggcagcctgaacatgtcacgagcgctgggggatcttcagtataagaacccaatcaacaatgccggtgacgaatattcatcctcaaagaaccgacgggcgtctgctagtacttcagcaccagagacccgaggtaactttctgtctgtggaacctcacatgaccgggatgacgctttcgccagatcgacgttatctcgtggtggtcacatccgacggcgttagtgataacattgacgatgcaacattgatccatcatgtaatgaggttatccatgcgggggatgagagctggcgacatagctcaggaaattgcgactactgctgctgctcaaaaggcaaaggagggaagcgataacgcgtcctgtattgtggctctattggacggtcaaaacacctag

SEQ ID NO: 13296 - DNA, 507 bp, A.fumigatus
gtatgggaatcacttttcgctcatttctcggtttggagttctgacacacccagattcgctgcaccggccaatcctgagaagctcgaacaagcgctctacccacctttcgcgaatatccttcaaggcgacgttcaaggtattgtgcaatcagaaaggaacagggggttagggacaagtttgagtgctaatgtttgtgcagaattcatgccatacgtcttccagctctttgcggctcttttggaagccaacccttcgggatcccttcccaactactaccagaacctgatcgctcccatgcttatgcctgttatgtgggagtcgaaaggcaacattcctgcccttgtccgtctactttcttctattatccctcgtggttctcagttcatcttggaaaaccagcaactggtccgtatccttggtatcttccaaaaattgatttccaccaaagccaatgaatgctttggattctaccttttggagagtgtagttgaaaacttcccacagtaa

SEQ ID NO: 13297 - DNA, 201 bp, A.fumigatus
tgcaggagcaggccaagtgagaagccccttctactctctaaatcaatcagcaacacagctgttattcttcgactaatccgactccaggtccaagggggtcgaccttttcaggaggatcgttgcacattcgtcttgcccgatcagtttccttcccagacaaacgataagctcacctatttcgcggtctacgacgggcagtaa

SEQ ID NO: 13298 - DNA, 1308 bp, A.fumigatus
  unsure (13),(14),(15),(16),(17),(19),(20),(21),(23),(24),(26),(27),(30),(31),(34),(40),(41),(44): Identity of nucleotide sequences at the above locations are unknown.
tctacggggggcnnnnncnnngnngnncgnncantaaaanntcngccggcctgggattttcgaggccctgaccccttatgtgcagaactccatggacgtattcagctccccatgtcggtcaatttgtgcagaagcttcgggaaccttctgaacaacattggccaagaaacaaaatatgatattctggtcagcaaagcgcttcaatttttgacttcagttgcgggtatgccagaacatgcctcggtcttccaggcagaagagacccttggccaaatcgttgagaaagtggtcctaccaaacgtgagtctgcgtgaatcagatgaggagcttttcgaagatgagcctattgaatttatccggcgggatcttgaaggatcggatagcgaaacaagacggcgggctgccacagacttcttgagacggctggcagagcaattcgaggggccagttactaaggtcgttctcagatacagcgaccactatctcgctgaatattcgaagagccccgccacgaattggaaggccaaggacactgcggtttatctgttctctgcaattgcggccaagggagttgccacagcaagtcacggtgtcactgccacaaatccccttgtcagcatcaccgacttcttccaaaagaacctcgctgcggacctggttgtcgatgaaagtgcacaccctatcctcaaggtggatgcaatcaagtacctttacctcttccgcagtatcatcacgaaagaccagtggcaagaagttcttcctttgctggttaagcatctcggttctccgaactttgttgtctatacttatgcagctatcgctgtcgaaagagtgctttaccttgcagacagccaaggtcaaccgattatcgctcccgccactgtcactcctctagcgaaagatcttttgcagcacattttttcattgatccagaaggaccctgcccctgagaaggtgcaggagaatgaatttttgatgagatgtgctatgagagtcctgattgtcatcaaagaagacgtggtcccatatacagacattgttcttcaacatctcattaacatcactgatgtcatcagcaagaatccaagcaacccccgcttctattatttccactttgaagctatgggcgcatttattaggtatgggaatcacttttcgctcatttctcggtttggagttctgacacacccagattcgctgcaccggccaatcctgagaagctcgaacaagcgctctacccacctttcgcgaatatccttcaaggcgacgttcaaggtattgtgcaatcagaaaggaacagggggttag

SEQ ID NO: 13299 - DNA, 294 bp, A.fumigatus
ggtgatttgctggattacttcctgtactatattcattggcctaaagtctgcttgaagggaagtattaggaagcttacgagcagctttatatttaataatataccccaaatagtatggtacgctcctttcactgctgttgtgattacacaacagttctgggttggcgcgaatggtctgtttaatgggctgtacctgtcccgcctcctgtacagaattcatatgattttcaaagattatccctccactgagcagcaacctgcattatgcctgtatgtaatccacctaacctattag

SEQ ID NO: 13300 - DNA, 435 bp, A.fumigatus
  unsure (423): Identity of nucleotide sequences at the above locations are unknown.
cgtggctggcgcttgttgaagaatgaataccttcaatacctatgtcagatacaggccaatgagcctcatatgaacaggcaatattcccttaccatcagtagagtggaagacgccaggcttgtattttgtattgagaccagcacatatatccgtaagagtttgtggtatgttaaacatgctggcaattccattattatccattattctaaaatgcttcaccattgctggccgacaatagaccctcttctgttctcgcatcaagatcgacgatcgacagaaacgcagtggtctgccaagatcgccatgaagattcaagctgagaaagccatcgtcttcaagagcgtccatatttgtacacatccgtatccctataagcgggatcgtgagtacttctccaagaaaatcgactggcgcagagagacnacgtacaagtga

SEQ ID NO: 13301 - DNA, 207 bp, A.fumigatus
tcactccatttcctcatccgcctccaaaactataagcgttatatcgcggctgtcgactcagctcccctcctcaagttcgacggttcaattgctttaggtctcccaatgctttcttttttttctagctgcctcccaaccaaaagaaaggaatggcggaaatggaatgaaatcgaaggtttgcgtccctttttcttctttgcgatctga

SEQ ID NO: 13302 - DNA, 456 bp, A.fumigatus
actaatgcggtaatagaggaagcgagtcgtctggatcagttcccgtcctgggatgcaccagacaatctccttctgatgcaaacctttgaatggcatatgccagctgaccaagctcactggcaccgtctacggcatattttaccgagtctcaaggagatcggtgtcgacaacatatggatacctccaggatgcaaggggatggatccttgtggaaatggctacgatgtatatgatctgtacgactttggcgaatttgaccagaaaggatcacgagcgacgaaatggggaaccaaggaagagctcctggagctcaccgcagccgctcgggatctcggtattggcgttcattgggatgctgttctcaaccataaagcaggcgcggattttacagaacgatttctggctgtccaagtagacccggaaagtatgtatcccttcagcagagaggttggttaa

SEQ ID NO: 13303 - DNA, 633 bp, A.fumigatus
tataccgcgttaggacggaatgttgagatctcacgtccaaaagagatcgagggctgggtggggttcgatttcaagggccgtggcgactgctatagctcgatgaaatatcggtggtatcatttcagtggcgtcgattgggacgaatcacagaagaagaatgcggtctacaagattgtagggccgaacaaggattgggctaacgatgtcagtcacgagttcggcaactacgattatctgatgttcgcaaatctggattactccaatgcagaagtcagaagggatcttcttaactggggcgaatggatcggcactcaactgcctctcagtggtatgagactagacgctgcgaaacacatgtcggctgctttccagagggactttgtcgatcatgttcggaagactcagggacctgatttctttgtagtctcggaatactggcgttgtgatctcaaagaacttctgcatttcctggagataatggaacaccgagttcatctctatgatgcggtattggttgaccgattctcgaaaatctccctgacccccgaagcggacctgcggggaattctcgatggtacattagttcagagcaaacctcaacatgccattgtgagttttctacttgtgttctga

SEQ ID NO: 13304 - DNA, 492 bp, A.fumigatus
  unsure (491): Identity of nucleotide sequences at the above locations are unknown.
tcctactacaaaataaaggacaaccctgtatcttctggggtgatctttacgggatcaggggaggcaagcatccaacaaagcgttcgtgcggcggcaggcttccgattctcacaaaagcccggaagctctacgcatacggagagcagcgggattatttcgacgagagaaactgcatcggtgcgcgctgcctcacttttggccctcgttttcaccatactgacaagacaaataggatttattcgttatggcaaccggcggcatccctcgggtttagcttgtatcatgagcaacgccggcccatcgcagaagcgcatgttcgttggtcagcagcatgcaggagagcaatggacggatattctcgagtggcactccggaacggtcacgattgaccgtcgaggatacggcatatttcccgtatcgaaggtgagtgtcagtgtgtgggtgaatgcccaggcagaaagaagagagagcctcaaagtcacttgtacgtng

SEQ ID NO: 13305 - DNA, 432 bp, A.fumigatus
gtgccggtcgcatctttcttcaagccattagcatacgctctgatcctactacaaaataaaggacaaccctgtatcttctggggtgatctttacgggatcaggggaggcaagcatccaacaaagcgttcgtgcggcggcaggcttccgattctcacaaaagcccggaagctctacgcatacggagagcagcgggattatttcgacgagagaaactgcatcggtgcgcgctgcctcacttttggccctcgttttcaccatactgacaagacaaataggatttattcgttatggcaaccggcggcatccctcgggtttagcttgtatcatgagcaacgccggcccatcgcagaagcgcatgttcgttggtcagcagcatgcaggagagcaatggacggatattctcgagtggcactccggaacggtcacgattga

SEQ ID NO: 13306 - DNA, 255 bp, A.fumigatus
ctccgtggcgcaatggctaggctggcggatcagtccgttgatcttaatctgaaacttatgaaatggaggatcagcccggatctcgatcttgagaagatcaaacgcaccagatgtctcttacttggagctgggacgttaggaagctatgttgctcgaaattttatggtacgtcttcccattattctattgaacatacattcaccgtgctgctggtctataggcttggggagttacgaagataacatttgtggataa

SEQ ID NO: 13307 - DNA, 522 bp, A.fumigatus
gcttggggagttacgaagataacatttgtggataacggaaacgtatctttttcaaatccggtgaggcagtcactttttaactttaaagactgcctagaaggtggcgccagaaaggcaactcgagctgcgcaagccctatcggaaatctaccctggtgttgagactaccggacacgttctttcggtgccaatggctggccatcttatcacggacacggagaagacacgaaaagagttcggtattctcaaggctatagtagatgaccacgacgttattttccttctaatggatacgagagaatcgcgctggctcccgacagtcattggtaaggcggcaggtaagatcgtgataaatgcagcgcttggattcgattcttttgtggtcatgcgacacggcgtcagaaacgatgcagacccaacatcagagcttggctgctacttttgcaatgacgtagttgcgccgatgaacgtaagccaccattcccaagtgtcgtgtctttatgcgactgacttctttaattaa

SEQ ID NO: 13308 - DNA, 540 bp, A.fumigatus
gccaccattcccaagtgtcgtgtctttatgcgactgacttctttaattaagtctgtaagagatcagacacttgatcaacaatgcaccgtcactcgaccaggtgtagcaacaatagcgtcagccttggcggttgagctgctcatttcactcctacagcaccctcaaggtgctgcagccccggctgctttgccaggcgatgaccgcggttctcaccctcttggtctggtgccacaccaaatcaggggatttctttcgtccttcgaaaacatttcggttataggaagaagctatgactgttgtagtgcctgctcaataaatgtcgttaacgcatacaatgagcagggctgggaatttgtgatgaaagctttgaacgagcccggatatgtggaggagttgagtggtcttagggaggtcagtcggaacaagcctcttttaacctaccctgtgttcctcgtctttcacttcccctgtccgcgccaaatcacccaaccccaaccggaaatatctggcactggccataaacaaggcaatttctcttga

SEQ ID NO: 13309 - DNA, 270 bp, A.fumigatus
gacctctgccgcgccgcgttgcaattcagctttgacaccttacggactggagggcatttcatttgcaaattctatcaaggggtagaggacaaagaactagagcggcagttcaaagcactgttccatagagtgcacaggatcaagccagagtcttcacgcaatgtacgtgccgggcatttcgaatattgttataagtcatcacgcactgacttgcgcaggaatctagggaagcgtactttgttggcctcgacagaaggaataacgcgttga

SEQ ID NO: 13310 - DNA, 276 bp, A.fumigatus
tattacatcgacaggattcccaccaaccagaatttatcgcagacaccatcaattggggtctacctcacaaagaaaggtcccagcaccatgttcttttcgtcctgcccaaccaagactataatactcgaaatcaataatacaacgtcctccctcatattcaagagacattcatcctcgaagagatggcaagcacgtcagatcaaagaccactttacaagggctgcggcagtacaagggttgaagagccgtgcagcattcaaattattgcaggtatag

SEQ ID NO: 13311 - DNA, 465 bp, A.fumigatus
ctctgtcaggtggcagcgactcgaactcaaccaaacggtcgagttctgggcgtagacataatcccagctcagccccccaaaggcgtttctaccatacagggcaacttccttgccccagatattcaggcctacgttcgggagttcctccgcgatccctgtagaggcagactgcgttcccctggttcgtgtgacggagacgaacacaatattacgacctcgagttcgaccgcgggcctggagcaaaatagagagtgcataggacaaaatgatgctgtgtcggagagaacggtagatgtggttttaagcgatatgtgtgccccctggtttcaaaccaccggcttctggaagcgaagtctaagtgacccttataataggatgatgaacacaagcggcgtgaattttcgagatcacgccggcagcatggtacttcaacaaatgtcacacttatcgtacatatttgactga

SEQ ID NO: 13312 - DNA, 492 bp, A.fumigatus
atacactcaggccttcctccccacggcctccgccctcgaggaaaaagccgcgcaggccctccaagccggcaaacacgaggaagcctcaaacctcctctgccgcgccgcggttgtctaccgcatctcccgcttcccctacgtggacattaccaagcccaactccatcaagcgggtggccttcgagcgccagaagcaggcgtacctgaaggcaaccagcctctggacccagcccatccgcgaggtgaccgtgcctcacacctaccgcaccggcaacgacggcgcccacatccccatttacatccgcaccccagccggcgcagaccagtccaaccccgtccccatcgtgctgatcatgacgggcctagacgggtaccggcccgacaacagccagcgcacgcacgagatcctcgcgcgaggctgggcggctgtcgtcgccgagatccccggcacggcggactgtcccgcggaccctgcggacccggcctcgcctga

SEQ ID NO: 13313 - DNA, 993 bp, A.fumigatus
aggtcctgtgggagtcgagatggaagtttgctgtatgtctttcccctagaaactagaggccctctaatagtcgtcagtgttcaaaatccgtctatcccttccacgacggctccatcgaggactttgagcccatcttcaaccatctcatatcggtatgctcttgatcttcacgacacgacagccagcctgctgacccgacagaaaaacatcaacgacgccgcctcggatgaatacactcaggccttcctccccacggcctccgccctcgaggaaaaagccgcgcaggccctccaagccggcaaacacgaggaagcctcaaacctcctctgccgcgccgcggttgtctaccgcatctcccgcttcccctacgtggacattaccaagcccaactccatcaagcgggtggccttcgagcgccagaagcaggcgtacctgaaggcaaccagcctctggacccagcccatccgcgaggtgaccgtgcctcacacctaccgcaccggcaacgacggcgcccacatccccatttacatccgcaccccagccggcgcagaccagtccaaccccgtccccatcgtgctgatcatgacgggcctagacgggtaccggcccgacaacagccagcgcacgcacgagatcctcgcgcgaggctgggcggctgtcgtcgccgagatccccggcacggcggactgtcccgcggaccctgcggacccggcctcgcctgatagactgtgggatagcgtgctgagctacctcgaccaacgcccggagctgaacaccgccaagatggtggtgtggggactgagtgcgggcgggtactacgccatccgggcggcgcatacgcaccgggaccggctgctcggcgctattgcgcacggtccgggatgccactattatcttgacccggaatggttggccaaggtcaatgaccatgagtatccgtttgagtatgcttccttggcccgggtacaaaagaagaacaagctgaccggatag

SEQ ID NO: 13314 - DNA, 621 bp, A.fumigatus
ttaatcgcgatacccactacaagatctcgaaattctgtttttctctactgccctcgatcagtcatcttgctgagcagtcttaccatgcggacttcggtgcaacccaccagcgtcctgctggccctcatggccattcccttcgcgtctgctgagaaggttcttggagcttatatcttcgctcgccatggtgatcggacccccaaggtgctgggaaacactcaactcaccgacctgggatacaaggaagtattcctcactggcagctactaccatgaccgctacatcaactccagctccttgcactacattcagggtataagcgaggagattgtcaatctcaaccagatcagtgtttcggctccctcagacaatgtacttcagaattcggccactggtttcctgcagggtgtctatccccccgtcggaagaatggccagtcaaaccttggggaatggcacgacagttgaggcgcccttgaatggctaccagttgatccctctggcactcatcgagaccggtaccaacagcgagagcaatacctggttgcaggatgcgacccagtgccaaaacgccaaggtcagcagcaacaactactacagttcagcgctgtacaaggatctg

SEQ ID NO: 13315 - DNA, 252 bp, A.fumigatus
  unsure (200): Identity of nucleotide sequences at the above locations are unknown.
gccgctgatgaattgcgagagcacaaagacattggctctttcatcggaaatgttccccaggaactgtgtcaaagtgcttcatttaactctaccaacgtcaaatgcccgaatcaccgagcttttgcgtccattaactcgcacccgtttcggataacgcccaccattccaccggtctgcatggtctccgatccaaccgctgnaaagcgggaattcattatcggcaagacttctaacccaatgaatcctgtctga

SEQ ID NO: 13316 - DNA, 192 bp, A.fumigatus
tgtggagctatgagctcccaaatgtcacctcaggccatgagcccagtaggcaccagtatagcatctaatagtactgatttggctggcaaggtcaagaccaggctgatcgctaagcgtcctagcgtgatcatctgtttcagcagcttggtcgaggcgagaactcgatttgtacaatgtcaggtggtcccataa

SEQ ID NO: 13317 - DNA, 204 bp, A.fumigatus
ttgctcaagatggctcggttgaagcaaatggagctgtccgctccatttgacttgtcgcatcacttctcctctactacagttcggcgtgagtcgagtaatctcaagagattatacaagtactatgtcattccgggcatgggaaacctttctggcggtatgcagggcgagctttttctgatagtatcgttgaatcaatgcaagtaa

SEQ ID NO: 13318 - DNA, 1089 bp, A.fumigatus
cgattccgcccgttctcgcgtggctgcaggattggtcaaaatcccacgggaggcaccatgtcaatccatcgaaggaaagagatctacgctctatgccagcggtacgacgttatcattgtcgaagatgatccgtattggaatttgcagtatccatctgctcaaagattggcggctcgttaccgtaacacacccattgacgagtcacttaccacgcaaaatggtaatgctcatggaaattcgtccgggtacccatttctagactctcttgtaccatcctttatgtctctagatacggatggacgagtcattcgattggacacattttccaagaccattgcgcccggttgccgcctgggctggattactgcgcagcctgccgtcatcgagaggatcacccgccttactgagacttcgacacaatttccatccggtttcgtccaggccatggtggcggggatgatcctaggtcaacaggctgatgaagatgtcagaggccccaaaagcaaaggtaaatcaggctggaagatggatggctgggttcgctggcttgagggtcttcgaggatcgtacgagcggcgcatgcaggccatgtgcatcactcttgaagaaggcaagtatgtcatcaaaggcgatggatcggagccctccgagtcgagcgaggaaagtggctgggaggtgattgacaaagtccaaatgtatgacttcacttggcccatgggggggatgtttgcctgggttaaggtactcttcaatacccatcctctgtatgacaaatattcgcttgaaacgctgtccaaggcactgtgggtgcatatgacacaggagccgtttttgtgtcttatggttccgggcgacttgtttgcgccctcacagaaggccatggatcaagcctggcagtactttcgattatgttttgccccgatgcctgaaaaggatgtggcggtgattaccaacagactggtggagggatttcgcgcattctggcaaaggaaggatctggatggcttggatgatactgaggaattattgcagaagttcagaaatctgcaggtagaaggcatgggccatatgatgggaattggttgttga

SEQ ID NO: 13319 - DNA, 1038 bp, A.fumigatus
  unsure (241): Identity of nucleotide sequences at the above locations are unknown.
atatctgtttctaaggctacgggaataatgacatcagttattaattcactttcggatactgacctcgccgaagagatcgaggctatcaatgcaatttacgacccagacaccgtcactgtccatttctcagcaacatcagcgtcagcagccacagccaattcaacactaaacttgggcagctccgaccccggcgaatcattgaacactacggttaaactgcaaatccccgatcatcccaatntatctttcttccttggtttccatgcgtcatacccagatacccctccgaaaattcttgggacggcgtcgaccggtgcacgcggtgagagaaagatagctgtggatgtactggaggatattgtagggagaacataccagcccggcgctgtttgcctgttcgatgtcatcaatgaggcggtcgaggcgttccgagagctcagtttgggcggccacaacagcagcagcaacacgaaccaggacagcgagaagaggggagcggaagcagagacaagggcaacccctgcgcgggtcgcagcggacatcgctaccctcgcactgcaagacccatttgggctggacagtcctcccgaatgggtgctgtcggatgtggtaacggagaagaaatcggtgtttgtgggtcgggcggcgcatgttaccagcctggaacaggctcaggggtatctggaccatctcctggccacggataaaaaggttgctgctgcgacgcataatatcagcgcttggcgtattagacagcagaaaccggccaacggaaagggcgagtctgcagagatgattgtgcaggactgcgatgatgacggggagacggccgctggtgggcgattgctccatctcatgcaattaatggatgtgtgggatgtggttgtcgtagtatcgcgatggtacggtgggattctcctggggccggaccggtttcggatcatcaacgccgtcggtcgggatgcgttgatcaagggtggtttcgtcaaggagtctacaggggctgctgaaaagggtcgaaagaaagggaagagatga

SEQ ID NO: 13320 - DNA, 2340 bp, A.fumigatus
gactcgctggcggatatgctctctgttctcgggatgacgtacggggacgaggagaagctcgagacgctgaaatatcgccttctcaccaaagcagaagatcttggctcgtggggtcacgaatatattagacatttggctctggaaattggccaagagtaccaaaacaggttgaacgcagagaaagatgtacaggacctgatcgatctctcattgtcacttgtcccctacttcttgagccataatgccgaagccgatgctgttgacctccttagtgagctggaaatcattgaggagattccccgttttctcgacgagaacacctactccagagtctgtctgtatatggtcagcatggttaacctgctcacctatcctgaagatcagcagttcctccggacggcacacgagatttatgtccgctataaggagctcacaaaagcaattgtacttgccattcgacttaacgacacggatcttatcaagagcgacatcaatgctacttctgatccggtgctcaagaaccaaatggctttcctagttgccagacagcagatttggctcgatatgcctgaagaggaggagaacacatccttcatggactgtcttaacaatataacgatatccaagcatttcaaatccctgggcaaagagcttgatatccttgaacccaagaatccagaggacatttacaagacacacctggaaagcagccgaggcgctggtttgacaaatgttgactccgcgagacataatttggcaagtgcgtttgtgaacgcttttgtcaatgctggttttggtaaagacaacctgatgctaggagacgatgacaaaggaagttggatctggaagacaaaggacgatggcatgttgtcgacaacggcttcattcggcatgctcttgtcgaaggacaccgacactggcttggacagaattgacaagtttacctatgctaccgaggagcaaattaaggccggtgctttactgggcacaggtatgatcggttccggcgtacgactagaggcggaccctgtcctggctctcttgggtgatcccgaagtttggcaagaaaagagtgtaccggtcagagttgctgccataatgggtcttggtttggcctacgctggctccaataaggaggagctcctggaaatccttcttcccgtcgttgaagatgtctccctggatatgcagctctcggcaatggcggctgtctcgttaggtcttattttcgttggctcttcgaatcaccaagtcagtgaagccattgctacgactttgatggacgaggagcgacagaagcatctgaaagataaatggacccgcttcatggctcttggtctggctctactgtacttcggccgccaggaagaggtggacgtcattctcgatattctgaaggccgtcgatcacccaatggccaagccgacctccgttcttgcttctgtctgtgcttgggcaggaactggaactgttttgaagctgcaggagcttctccacatttgcaatgaccttattgaagagaatgacgagaagaaaggagatgaacttgtccaatcctacgctgtcttatgcctctccctcattgctatgggcgaggaagtcggacaggacatgattctcatacagttcggtcatcttatgcattatggtgccagcaacattcgaaaggcggtcccacttgcaatgggtctgatcagccccagcaacccacaaatgaaggtctacgacacactgtcgcggtacagccacgacaatgacaatgatgttgccatcaacgcgatcttcgccatgggtctttgtggagcgggtaccaacaatgcccgtcttgcgcagctgctgaggcaattggcaagctactaccaccgtgaccaaaactcattattcatggtccgcattgctcagggtcttcttcacatgggtaagggtacgatgaccctgaacccgttccacaccgaccgccaggttctttcccgtgtagcagcagctggcctactcactgtcgttgtatctttgattgacgccaaacaatttattcttgccgaacatcactacctcctctacttccttatcaccgccatgtacccacgattcctcgttacgctagacgaggacctccaaccactcaccgtaaacgtacgtgtgggtcaggctgtggatgtggttggccaagctggtcgccccaagacgatcacaggctggcaaacacagagcacacctgttcttctgtcctacggtgaaagagcagagttggaggatgagcaatacattccccttagtaccacccttgaaggccttgtgatcttacgaaaggtgggtttatcggatgatacttccgcttga

SEQ ID NO: 13321 - DNA, 240 bp, A.fumigatus
gcagcttccacggacctttctagcctatctttttaccgtcctcacccaaaccgagaccaactcgccaggtacccgtcagaaatggcgaaagaaggcgagaggtcagctcccgccgacaagggcaagggcaaggttgatgatgtgaaagatctgcctggagcgaagaagacacagaatgacgagaagacacaagcgaatgggaaaaagaaggaggaggagtcgaaggaaggtatgtcataa

SEQ ID NO: 13322 - DNA, 225 bp, A.fumigatus
gatttgaatttgttgaccgatgacgttaaccctggtgtcttccttcatcaggaaccggatacgactctctacgctcctgccttagatgcgatcaagaatttcataaagacctcgacttcttctatgaccgctgtccccaaacccctcaagtttctcagaccgcattacgatgagctgacagagctgtacgagaagtggcctgcgggcgctgtcaaggttggttaa

SEQ ID NO: 13323 - DNA, 189 bp, A.fumigatus
agagatctcattaatacactgtctgctgctgtacgagattataagcagcttccacggacctttctagcctatctttttaccgtcctcacccaaaccgagaccaactcgccaggtacccgtcagaaatggcgaaagaaggcgagaggtcagctcccgccgacaagggcaagggcaaggttgatgatgtga

SEQ ID NO: 13324 - DNA, 309 bp, A.fumigatus
tttccctgtacttccgcatatgtgggatttaatgtgctcaacttactgtgctcgtttcagcccaaactgaccgcgttgaatgtgaagcatcagatcaccaccgctgatatattccataacaaagtacacccgagtttccgtctggaaacaggcgtgaaggttgagaaggaatggatggcgttccttattagcgatcaggaagacacgcttttcggatttagtgctctccacttcatcattctcaatgatgaactccttcttcagcaccttgatggcataaagcttcttggtgctctttgtctctgctag

SEQ ID NO: 13325 - DNA, 561 bp, A.fumigatus
cattcgatcgtttccccgggtttactgattttccatcgtgtgactaggttcgaagtctctcgggaaaacacgactttctcgtcttcggaccatcttgccaccatggacggggacgacctcattgcctcggtctaccgtaagatcgagcgggagaaggctctcatcactgccgcgtcgaacatgcggcagtcgaccgataatccactcgtgcagcagagagtcgatgcgaatatccgcgatggtcggaaaaacatcgcctacctcgaagagaagatgcgggagttgcagctccgacagatgaagcaagaaggggcttctcccacagacaaacgtcttcctccgaatcctgacgggtcggctccagtccctcctcctaaagattacgcaccaggctattctggtcacgagagggagtatggcgatgcttctggggcttatccacatggaggggcagggaccatgccgtccggagcgcccttcgcggatcctcgtccttttgctcccgtccccaaggctcggccgaattacactaaacttggtaggtttctactgcttgtttga

SEQ ID NO: 13326 - DNA, 516 bp, A.fumigatus
atttgcgattctcttgcagaatgtggtcttacttgtcatgctcaatgtactcaccttgtccctgacttttgtggcatgtccatggaagcagccaatcagatcttggaaactctcattcgagcgaagaaccataataaatcagcctctgtcagttccggtctgagtggacgtacccttcgaccaggcggtccgccccaggctcctcaagataatgttgctctcgcctatccgcaaaagccagttgagggtgcctacggtgcccctcagagacagccatcagcagaggctatcagcgccgcaaccaacacttatattcctcctcagtcacccacagcggctcagcgtcagcacatacctccgcgaacttcttcctcgcaaagccccgcagccgccgccgccgctgctgctgccgcagccacaggactgcgtacgccccagcaagcttcaggtacgctcgatcgattttccttgcaccactcggtgcgcaacatgtgcccttgcttaccctgcctctag

SEQ ID NO: 13327 - DNA, 465 bp, A.fumigatus
gtatctgtataccacatttttcactacatcagcgcactgacatattttatagccaagcaattgaaggatcgccgccctttcgatattggtctcaaccgtcaaggtgccgtccgacagaagaaggaggaggttcacgagaagcagggtcacaagtttgtcacacagcaattctacaacatcatgcgttgtgcgctttgtggcgatttcttgaaatatgctgccggcatgcagtgtgccgactgtaaatatacctgtcaccgaaagtgttatccaaaggtcgtcaccaagtgtatcagcaaggccaactacgaaacggaccccgacgaggagaagatcaaccaccgtatcccgcatcgcttcgagggattctccaatatctcggccaattggtgttgtcactgtggatacctgcttccttttggacgaaagagcgctaagcgctgtacaggtatgtcttcattgtga

SEQ ID NO: 13328 - DNA, 369 bp, A.fumigatus
gatcgtctactgactggggaccgtttgcgtatagatctgattaagtacgacactccttatcttggaccgaagattcagcttatgttatctcaactggaatttaaattgagcgttgagaaacaatacaaggccggtatcgagaaaatggtccgcctatatcaagatgagggcgataggaagagccgacaggacgcagagggaaggcggatcgagagcaatcagaaaattcaactactcaagcaggctctcaagcgatatgaggaccttcatgtggatattgaatccgccgaagcacctgacggtatgttgcgagccctgccactgcttgttgtgtggcctttgcattcagcagttactgacttcgtttga

SEQ ID NO: 13329 - DNA, 630 bp, A.fumigatus
acagacgaaagcttgagcacaccaaacttgcgcaagccgttgaccggtttattaacattgcgtattcatgctgtagaggatgtcgatcatgctgccagctcaaggttctccagaggccccgagacttttgtcgttgtcaaagtagaagacgccatcaaggccagaacgaaagctaccagaaccgacaaatggcaagatgagccatttaacattgagattgacaaagcgaatgaaattgaacttaccgtatacgacaagtcgggcgatcgacccacccctattggcatgctctgggttcgcatatctgacatcgccgaagaaatgcgccgcaagaagattgagtcagagtttaatgcgtcgggctgggtctccgcagacaagatggagcatggggccgcgcatggcaggcaagacgctggcggagcgccaggctcgtccaatcgaccaccctctgggggtcattctggcggaccaggtcagggatatgcgggtggtgctcccggcggcgcttccgcatgcccggtcctgatcgacagttggttcgcgttggagccagttggtcgtatccacctgacgctgagctttggtgagtatctgtataccacatttttcactacatcagcgcactga

SEQ ID NO: 13330 - DNA, 816 bp, A.fumigatus
gggtgcctacggtgcccctcagagacagccatcagcagaggctatcagcgccgcaaccaacacttatattcctcctcagtcacccacagcggctcagcgtcagcacatacctccgcgaacttcttcctcgcaaagccccgcagccgccgccgccgctgctgctgccgcagccacaggactgcgtacgccccagcaagcttcaggtacgctcgatcgattttccttgcaccactcggtgcgcaacatgtgcccttgcttaccctgcctctagatcctaaccgtccagtgcaaccaccgccgtcctcgcacgcccactatgaccctgccgcgtatgcatcctaccagcaagccatccctcctcaagcgatgcaaaagatgggtgcaccctatggcatgcctcaacagcagcagcagcaagccgttgcgccaatgcagcaacaagttgccgtaaaggaggaaattcctccccagcaaccgaaagtcagaattggattggatcatttcaacttcctagccgttctcggtaagggtaacttcggaaaggtcatgctagcagagacaaagagcaccaagaagctttatgccatcaaggtgctgaagaaggagttcatcattgagaatgatgaagtggagagcactaaatccgaaaagcgtgtcttcctgatcgctaataaggaacgccatccattccttctcaaccttcacgcctgtttccagacggaaactcgggtgtactttgttatggaatatatcagcggtggtgatctgatgcttcacattcaacgcggtcagtttgggctgaaacgagcacagtaa

SEQ ID NO: 13331 - DNA, 417 bp, A.fumigatus
aagaagaccgacgccgaatccggcgaagaatctgcccgcgacgaacaacggaatcgcagtggcggcggtctgaaggatgacaccaaagcagaagacgcccgagttgataatcataccaaggcggcgtccaaagtaatcggcaaccggcgcggcgcccagagctccgaagaaagtgccagcagacaacagggagacgatcatcgacgattgcgaggatgtgatatccgggtagttgtcgtccggattgatgtagccggtggagaagagcttgcgccagtatggcatggcaaggatgccgctgatggtgccggtatcatagctatgtgcagtcctctggtcagcggttgtgccaaggtcagtgaggccgagagacttacccgaacagaatcccaccaaacgcaacgaacaaaccaatga

SEQ ID NO: 13332 - DNA, 894 bp, A.fumigatus
taccggcaccatcagcggcatccttgccatgccatactggcgcaagctcttctccaccggctacatcaatccggacgacaactacccggatatcacatcctcgcaatcgtcgatgatcgtctccctgttgtctgctggcactttcttcggagctctgggcgccgcgccggttgccgattactttggacgccgccttggtatgattatcaactcgggcgtcttctgctttggtgtcatccttcagaccgccgccactgcgattccgttgttcgtcgcgggcagattcttcgccggattcggcgtcggtcttctttcagcgactggtatgttcctcatcatctttttgtccatcctggtggccgtgtgctgacgggaccagttcccttgtatcagtccgagacagctcccaagtggattcgcgggaccatcgtcggagcctatcagctggccatcacccttggtctgctgattgccgctattgtgaacaatgccaccaaggaccgtatggataccggctgctaccggattccagttgccatccagtttgcctgggctattatcctggtgactggtatgctggttcttcccgaaaccccgcgattcctcatcaagaaggataagcacgaggccgccgccagggcgctatcccgccttcgccgcatggatgtcaacgatccagctctcattgaggaattgtccgagatccaggccaaccatgaatacgagctcagcatgggtacggcaagctacctcgagattcttcgcggcaccatcggcaagcgtttggctaccggttgcggtatccaggctctgcagcagttggccggtgtcaacttcatctgtatgtcctcatttcttttcgtactcgaactcacagctcatatgtgtgtctag

SEQ ID NO: 13333 - DNA, 519 bp, A.fumigatus
tcagaaagcccgatgatgcagtgggctccgcggctcctgccatcatcattggtttgttcgttgcgtttggtgggattctgttcgggtaagtctctcggcctcactgaccttggcacaaccgctgaccagaggactgcacatagctatgataccggcaccatcagcggcatccttgccatgccatactggcgcaagctcttctccaccggctacatcaatccggacgacaactacccggatatcacatcctcgcaatcgtcgatgatcgtctccctgttgtctgctggcactttcttcggagctctgggcgccgcgccggttgccgattactttggacgccgccttggtatgattatcaactcgggcgtcttctgctttggtgtcatccttcagaccgccgccactgcgattccgttgttcgtcgcgggcagattcttcgccggattcggcgtcggtcttctttcagcgactggtatgttcctcatcatctttttgtccatcctggtggccgtgtgctga

SEQ ID NO: 13334 - DNA, 468 bp, A.fumigatus
atacgagctcagcatgggtacggcaagctacctcgagattcttcgcggcaccatcggcaagcgtttggctaccggttgcggtatccaggctctgcagcagttggccggtgtcaacttcatctgtatgtcctcatttcttttcgtactcgaactcacagctcatatgtgtgtctagtctactacggaacgacctttttcaaggcctcgggcatcagcaaccccttcatcattactctcatcaccaacattgtcaacgtgatgtccaccttccccggtctctacatggtggagaagtggggtcgtcgtcctttgttgatgtttggagcttttggcatgggcctaaaccagtttatttgccccatcgttggactttcccctttttcgaagtgggcaaaaaaaaccggaagcccttggggggatttcaatttttttttttcccgctcccgggaacccggggttgggttgtaa

SEQ ID NO: 13335 - DNA, 393 bp, A.fumigatus
actggcagtcgggctgaagcggcgagttcacggccacgagcccctttatgcttacagggcatgtccctcactgaccttttttcacttcatttaggtacttctaacgacatcagacgcctcctctctcggcttcccgtcccgtacttgccgaccgctatcccccataatatctccagccatcaagatatccaaactctactccaggacgagtcaccccttttctacaaggttactggccctcccaaaagcaacactatgtcccgctcttgcaaccacttgtatggagctcgagtagaatggtgtgcaccattcctgcttgctgctcttggaaacgtgcgccataccgtccacggcgataagttcccgggaagcaggtccccggtaactctgtag

SEQ ID NO: 13336 - DNA, 336 bp, A.fumigatus
gtcgaccgatccttgtcctccgcatcgtccttctcccagccgatgcaagagctggtgaccgaggccggttggggcgccgtctggtcccgtcccggcctggaccgcaaatccaggtctctgctcaacactggtatgctttgcgcgctcaaccgcggcgccgaattggcggtccatgtgcgtggcgcgctcaacaatgggctttcggaggtggagatccgcgaagctctgctgcaggttgcaatttacgtcggcatgcctgcaggcctcgagggattccggatcgcagaaaaggtcctaagtgagatcagggaggaacaggggccgggttctgggtga

SEQ ID NO: 13337 - DNA, 345 bp, A.fumigatus
ctggcagtggcaatagttggctacggcggggccgccccgtgggttcgtggagctgtcgtggttgaccttggaaagcgcatgaatcggattctcgatatcaacccagaggactgcacctgcttggtcgaacccggtgtttcctactacgcactgtacgaggagatccagcgacgcggctacaagcacctctggattgacgttcctgatctgggaggtggctccgtgctgggaaacgcgctggaccacggcgttggttataccccgtacggggaccattgggccatgcattcgggcctggaagttgtcacacccaccggcgaggtggttcggactgggatggtcttc

SEQ ID NO: 13338 - DNA, 432 bp, A.fumigatus
gaccttttctgcgatccggaatccctcgaggcctgcaggcatgccgacgtaaattgcaacctgcagcagagcttcgcggatctccacctccgaaagcccattgttgagcgcgccacgcacatggaccgccaattcggcgccgcggttgagcgcgcaaagcataccagtgttgagcagagacctggatttgcggtccaggccgggacgggaccagacggcgccccaaccggcctcggtcaccagctcttgcatcggctgggagaaggacgatgcggaggacaaggatcggtcgacctaggtccttccggcgacttcggagcggattcggaggccctcatcgaagaggcgcttgtgcgcgtcggacagggaggattcttgttctgccatgactgcggacggactgatcttgcagttgcaagtgtccaaaattga

SEQ ID NO: 13339 - DNA, 714 bp, A.fumigatus
acggcgttctacctcagaacagcacctccaatgtcccaaccagttgccgtcgtcaccggtgcatcgtcgggcatggggctcgccgtgacgaaacatctggtcgcgaaaggatggcgagtcgccatggccgatatcgatgcagattctggacggaaagttgctgctgagatcggtgaccaagtgctgttttgccgcacagatgtcacctcatacccccaacaagcatctttattcgaaacggcctttgcgtggggaggcgacaggctcgacctgtatgctgcgaatgctgggattgccgacacgcaattcctctgcaacaacgattaccggtacgacgagaatggcctgcggctccctgtgagcctccagaccctggatgtgaacctcaccgcagtcatccaaggcgtgtggctgttcaaacactacgcccgacggaacaaggtcgccggcggcaaggtcgtcatcacctcgtcttctgcagggttatatcccatggagtcggaccccatctacacagcctccaagcacgccctggttgggttgaccagagccctcgggccggtgctgcagcggcagaatatccaagtgaacgccatctgtccggcgtttgtgcccacgggtctctgcccgaaagagatgctgggccgctttccaaaggagcatatgataccttcctcgaagacgatggcctttctggacagactgtggaactga

SEQ ID NO: 13340 - DNA, 999 bp, A.fumigatus
aaaccaggcggttcacccggtgaacagacctgctctgctgttgtgcaggatgcggccacggcgtcctcaccgtcggcggcatcagtcgatgccggcacaagtcaaatcagtagtactgacacctccacggcatccttgagcgatgagcaagagttggcttccgaggttatcgaaggacatgggttatgcgaaaagccagagctggccgcattgcagcgacccagacgtaataccgataagggagcttccgaggatacccctgcaccaccagtggaaggaaaagcgcctctggctgtgactcttggccatgaaccgcagacgcaaggaggaagccccaagttaacccgccccgccggcacttctgacgtctctaagacccctgatgatgacttatcagccgcgacacctccttccgccagggcgtctgattctaccgcggacggcaaaccctcaagatcggcaccggtgacagcccaatcctctagaaaagtggccaccggactggtttccccagccagagaaccaagtcttcctgaacgtgcgcggactcgacccgtgcccgttcccttgtccttgaacaccgcaggccagcagtctttcggggcaacgagtccgggatcagctacgcctggcagttctgggactgagcgtgcagccgttcaacggatatcacgcccatcaacctcggtcgcctcgtctacttacaccaaatcacgccggtccgacagtttcggcagccatcgggagaagcgtccagtcactgccggatcaactacgtcgcaggtttcgagcaagctcaagggccttattagtcgccaaaccgactccgctacgttccttgttcgcagctcttcagaaaccagtagagcatccgctgtcacccatgactcagtatatgatgatacatcggggttggatgaattgatccagagcgaggagacaatccattataccctgacacccaagaccgtgagagatatggaggtttggtcaacctga

SEQ ID NO: 13341 - DNA, 471 bp, A.fumigatus
acgtatccagatggagttgcgaacccctacaagtctgtcgagctcgatgtcgagatcggcgccgatgcccgtgactggtccagcgttcaggctgcggagaagctcaagccggtggaaactgatctccgtcgtattgaggagatggtggcggagatcgtcaacgagatggaatacctgcgggcccgcgaacagaagctacgggataccaacgagagcaccaacgagcgcgtgaagtggtttgccttcggcactatgggaatgctggttggtctcggtgtttggcaggtcgtatacctcagggcttactttaggtatgttgacttccccgtgtcgtggagggttgatggtgttgtggctaactgctgctcttgttgcgaacaggtcgaagcatcttatctaagatctagtcgtgttgtgttttggtccccacttgtcatgtggacaaggctctcatggttgattctccgttga

SEQ ID NO: 13342 - DNA, 324 bp, A.fumigatus
acgcggcgtggcatcaataatgttgtagagcccccatcgctgatcaaatataccgacagaacaagccacaacctcctttgtcggccaatttactcatcgacaatgggcagctccccacaatcaagcacgagggcactcctcggtcttttgttcctgctccttgtccagctctcctccgccttgaaattcgacctgcacgccagcagcgggcacaacgagcgatgtatacggaattttgtctttaaggaccaattggtcgttgtgacagctattgtgagcgggcagagaggtgatgggcaggttgtgaatatgcacgtatgttga

SEQ ID NO: 13343 - DNA, 207 bp, A.fumigatus
gaatcaacatacgtgcatattcacaacctgcccatcacctctctgcccgctcacaatagctgtcacaacgaccaattggtccttaaagacaaaattccgtatacatcgctcgttgtgcccgctgctggcgtgcaggtcgaatttcaaggcggaggagagctggacaaggagcaggaacaaaagaccgaggagtgccctcgtgcttga

SEQ ID NO: 13344 - DNA, 585 bp, A.fumigatus
acaaggccaacgacactccgctcccttggcccacccaaggccggtgattatgtggccgccaagtttactgaggatggcgactggtatcgtgccagagtgcgtcgcaacgaccgtgaaaagcagcaggcagaggttgtatacatcgactatggtaactctgagatcctcccatggtcccgcctccggcccctgagccaaccccagttctccgtccagaagctccgcgctcaagcttcggatgccgtgctctccttcgtccagttccccgtctccgccgattacctccaggatgccgtcagctatcttgaggagctgacgtatggtcggacattggtcgccaatgtcgactatgtcgcttctgatggaacgatgcacgttaccttgttggacccatccgtatcgaagagcctggaccagagcatcaacgccgagattgttcgtgagggtctggccatggttcctcggaagttgaaggcctgggagcgtgcagccagcgagactctatctaacctgcgtagcatcgaggacgaggctaagcaggagagacgcggaatgtgggagtatggagacctcaccgaggactaa

SEQ ID NO: 13345 - DNA, 1521 bp, A.fumigatus
gttgcggggaatttggcgccccggccggcgaagcggttcaatgcgggggccaaggagcagcctggtggacccttcggggacgaggcataccagttcgtcgaggcgcggtttttgcagcgcaaggttcaggtgtctcttctgggagtcactccccagggacaactgatcgctactgtcctccaccccaacggcaacatcgccaagttcctcctggaagccggtcttgcccgctgcttcgatcaccattcaacgttgctcggacccgaaatggcagcgttccggcgctcagagaaggaggctaaggataacaggaaaggcatgtttgctggacttgtcgcaaagggtcctgctggcggggccgccggccaggattacattgtcagccgagtgctgaacgcagatactctgatcctccggaacaaggccggtgaggagaagaagatcagtctgagcagtgttaggcagcccaagccctccgatcctaagcaggcaccgttccaggcggatgctaaggagttcgtgcgcaagaggctcattggcaagcacgtcaaggtcacaatcaacggcaaaaagcctgcgactgagggctacgaggagagagacgtcgcaacagtgatgcagggcaacaccaacgtcgctctctcgctggtggaggctggttatgcttcggtcattcgtcaccgccaggacgacgaggatcgctctcctgactatgactccctgcttatcgccgaggcggaagctcagaaagacggaaagggaatgtggtcccctaagccctctaagcccaagcagtaccaggactactccgagagcttacagaaggccaagatggaagtttcgattctgcaacgtcagaagcgtgtccccgccattgtggacttcgtcaaatcgggatcccgttttaccgttctcgtgccccgtgagaatgccaagttgacattggtcttgtccggtattcgtgcgccccgctcagcccgcaatcctggtgaagcaggtgaaccgtttggccaggaagcccatgacttggcaaacaagcggtgcatgcaacgtgatgtcgagatcgacattgaaaccattgacaaggtcggtggcttcattggcactctctacgtcaacaaggaagactttgccaaggtcctgctagaggagggtctggccacggtccatacctactccgccgagcagtccggtcacgctacagagtacttggcagctgagcagaaggcaaaggaggcccggaagggtctgtggcacgactgggatccaagcaaggaggccgaggaagctgaagaggaagctgccaatggtagcaacggtgcggaaggcgagactaccgagcgtcgtaaggactaccgggacgtgatggtcacctatgttgaccccgcttccggaaagatcaagatccagcagatcggcacaggcacctctgccctgacggagctgatgagcgccttccgttctttccacttgaacaaggccaacgacactccgctcccttggcccacccaaggccggtga

SEQ ID NO: 13346 - DNA, 282 bp, A.fumigatus
ttttttttagagtcggatgttcattacgttgatgattatctatttacctcagtacctaaggtaactaactactactttactgacattcccaccactcaaaagaaccaaggctactactatcaaagaggggcattttctggcatccttctatgccatctcatcagactggccagtaccaagagcaaccaacagcctctcgacggccaaaccactttctctgatcgctttcctccgatcttctccatcgcaaatctgcgatattcaccttacactacggagtaa

SEQ ID NO: 13347 - DNA, 975 bp, A.fumigatus
gctttgtccaactctcactgtccctccaccccactcgctcaattgacattgacacattgtgctttctgcgggactgcaacatgtcctcatgactgtatgactgtcgcactgaacagaccgttcgtagcggatttacggcaacctggagtcaccggccggaggtgcggacctaccattgtcgaaatgattggagcggacgataagccacaggcgctccctccttactccggccctcccccccctcaaatgcatcatcgcattcctcctgaggcggcccatggcctggtaaatgcgccgggagcatacgatcagccatggcgcccctacccaccgtccttcgagcatcatcacgccgagcagcgacgggcctccaacccccctcaaccttccctgccccctcacgggtatcctgtcataccgaatcgagagttgcctcagctacctcccgaaggaccgtatggtcggccaaatagtttgcctgctcctagtctcaccccgacagagtcgcatgcgccgacttttcgtcctatgaatggagcttcgcacgattccatcccccattcagcacccacgcatccagggcctcctccacattcggcaccctccgagtttcgtccgcggatgacatatccccctcaagaacagagcagtaatggcgaaaccccccccgcccctcctccagccccgcatacgatgcctccagctcagtttccgacgccgatcccgcatatttcgcatactcctgctccctatgagccgaactattaccagaatcaagcctttggtatgcgtcagcgcaaggctgctcgggctcaacaggtaatcactgtctttttttccaattggcgcagaggaaataaactaacttttatattctttccattgtctaaaaggcctgcgatcagtgtagagcaagaaaagccaagtgtgatgaagggcggcctgcctgcagccattgcaaggagaacaatttga

SEQ ID NO: 13348 - DNA, 525 bp, A.fumigatus
cttctgtcttcggttggttggttgttggatactgaccatcaagctagacaggaaaaggccacccagcagatcttggacaagatacaatatctagaagataagctcgacgagcgtctaacgcattttcaaacggtacagatggaacatgggatgacactaagtaagatttctaacgaggtcggactgaaagaacccaaaattttggccgtcaaagatgccacccgatcaatgccacccaagcagacactcgatagattgctgaaaccaagtgctactgatattttgcttgagtcagaatcaaagagtggagatggaatgcagccattggactcgaatgaccctccagggcagagttatgtagagagggaggatggtgagctgtctatcccagtggaacatacaacagctgcccacaaattgctctcctggccatcgattaggaacctgctctatcctcgcgagtatgacgaggattatgtgatgaagcgtcttcaccacggggctggaaggggcagcgccatgtgt

SEQ ID NO: 13349 - DNA, 243 bp, A.fumigatus
atgcgccgggagcatacgatcagccatggcgcccctacccaccgtccttcgagcatcatcacgccgagcagcgacgggcctccaacccccctcaaccttccctgccccctcacgggtatcctgtcataccgaatcgagagttgcctcagctacctcccgaaggaccgtatggtcggccaaatagtttgcctgctcctagtctcaccccgacagagtcgcatgcgccgacttttcgtcctatga

SEQ ID NO: 13350 - DNA, 660 bp, A.fumigatus
aacggcgggggcattattacgagattgatgacagacgatgagaacggagaatcgttgggcggccaagttttcatttcacgggagcactacattcgtcatgttgaaaacctcctgcggcgaacgaggggaaaggaactcccgggtactttcaactcgacgattatcaacgacctgttcctcgagcaatctaagccgtgggagaaacttacatcggagcatgttcgggaagtgtgggaggccgcgaaagccttcgtcaagatcgcggtgaccgaagtcactgatatgagcacctccagcgccattctgatggaagtgttcgacccgagtctcgataacatcctgaaatccctggagcacaaaaccggcgagatgttccgcgcgtatcgagaaggtcaccccatcacctacaaccatagcttcaccgatagcctccaacaaacgcggcaggacattttgatgcccaggctctcctatgccattcgaagattcttccaagtacctcagctcacctcctcgcaatgtctggatgatactttcgaccttcttcatctccgtgatagcttgatggagtctttgaaggcagacacggcacgcttcgctgcactgcaggctctagattgcatgagagcatactacgaggtcaggcgactagcatggtga

SEQ ID NO: 13351 - DNA, 195 bp, A.fumigatus
gagatagaatcaaaaacccggggtatgtatcacactaagggcggaacaatcaacagtgcatgtaatattcactggcctaagttgatcgaacatcatagaactaggcaggccaacacaaggatttgcttgttaagtcatgaatatggccccctaatgcccggcattcagtcatttcaagttgatgctgtggtttag

SEQ ID NO: 13352 - DNA, 483 bp, A.fumigatus
gccatgcgcttcgcatacattgagtctctgccgtcggttcttagcaatccatctcatttcctcaccctttcatgctcgacattgctattgcttctccctctggtgtccattaaactttacaaatggcttgacgttcttctgtccgtcactatttctatctccatgtgtgtgctcggcgttcgccttgttaaaactctgggatccatgcttctcatgtcctattcgggtccaggggtctcggatgtgattaaggatattgaagcagatccttctgtttttgggatcgatgatgcgaggttctggcaagttcactatgggttgtgtatggcaaatctgaaaattcgggtatctggttcggaggagaacctggtacgtctacgtgaacgcatctccagcttgatcaagaatcgactgggcgggggatatggcactggtggtcagaaatgggaggtttcattacaatttactgtggataactcatga

SEQ ID NO: 13353 - DNA, 258 bp, A.fumigatus
tatctccctccattaggcattgccgtccgactctggcaactcggtatcgagatgcgtcctattctcgccaaggaatctctttgggtgtaccctctattcgccggcgttggtggaagcttcggttattggctacagggtgttgaagaccgacagctcaagattctcgctcaacgacgggaagcaattctggagaagcgccggagacgggacgaacgtgagggaacattggaagcaggcgctctggctgcgacatcgtga

SEQ ID NO: 13354 - DNA, 1005 bp, A.fumigatus
ggactggcattagctactcccttataccccatggcggctatgttgactaacgtcaattcttggacaggagttcgcgaaatgggaagtgttgtcaattgtgctttgacactttttaattcgaagaaagattcaaaagcacaatttgctttcgaagcgaaagagcctgagaaactcactgcagctgtcacggaagttgaagggccgaagaagaagttcaacaagcttccagaaatttttgacaagctccgtctgcgttccccaaaaaccgttccaggtcttaaccccgagtgcttcatgcctggaaagtactcttatgatttcgaaatgatactgcattccggtctccccgaatccacattcattgagggaaccatagtccgttatcatcttaaagcaagcgtaacgtgtcactccatgctccggggaatgtacaaatcgattgaggtcgacgctgttcgctgtcctaccaatgcgtacgtcgaagactccgtgggcggcaattgggctttgcatgttgaccgcgttttgcatgcggacattcacctccggaggaaaggcatcgctttagaagatcaccttcccggctcattcaagtacaaaggatacaacaacaccaagttccgcaaacttcaggtctttctggttgaggatgtcaggtatttcatgcgggacggaacacaggccggtaaggctccttataaaaagctactcatatatgagaatagcggccacaggccggatgtgcacccccagcaagaagaagtctctgaagaggagctcaacatctttgaagcaacatcgacaagagtccctttatcttctacaaactccgacactccagacggcgatgcttttcctccttccgaaacaatgggcttcgacttcgagctagatatgccaaagtgcatatcgcacagaggtgctccagatttcagatacatgcactacgacaccaaaattcggagtgtgatggtgtcacatttctttcaggtaagactcccctga

SEQ ID NO: 13355 - DNA, 270 bp, A.fumigatus
gacttcgaggattcctggcttgagggaacttcaagagctcacattacgagcggcttcattttgttcttccaccccttcgacagcaagatggagtcagcaattgatatgtactggttccacaatgacacctctactgtcgtgactcagatccttcgcgacttggacgagaagaggaagctggctattgtgttggaactgactgagcctgccttttccttcccgaggccacgggcaacagacctgttgtgcttcggggccgctgcacgttga

SEQ ID NO: 13356 - DNA, 297 bp, A.fumigatus
tggataaataccttccggcggcgtcgtgtaaaatttttccggagcactaaagtccctatacacttccttcgcctgttctatccgcccttgtcggttattgtccacgggggtcttgttgcagtctacatcgtctctgctcggtaccaggccggccctgatatgtcggatcccgcgcacccgcagcccggtgcgccgtggtacatcacaaagaagtgcaccgtcgctgcgaataaaaacaatatcaactactgtcgccagtccaaggccctgtttgcgttcacaataattatcatgtga

SEQ ID NO: 13357 - DNA, 1200 bp, A.fumigatus
  unsure (845): Identity of nucleotide sequences at the above locations are unknown.
tcactccgcccttcctggttccgcgcgaccatggaaatcgctcctccggagtcggacactgtgagattaaacaagacatacgcattgcagcacgagagagacactcaagatacaatggatgtgcaaacggctccgcggtcaattcctagcactgaaagcagcaacaattattcgaatgccattctccaagatgccgaaccgcagccatctcttgatgccactacagaacaggtttgggtacagcgtgccctcgccgaaatgacggacatgctcctcctcctacgtcgcgatggcaccgttctctacgcttcgccatcctgcaagtggattaccggatacgaatcaaagcagatcgaacgtgacgccctatcccgcttcattcacgatgacgacaaatccgtcttcacccgtcaactcgaagagtgcatcgccacggcccgtccgctccggtgccaattccgcttctacaagccgaataatacgttttgcgtcatagacgcgcacggtcatccacatatcaaaaacgagaataacacctgcaacggtgtcttcctagtctgccggccgtatcccaccaagagctcggcgctactcgattcctttctcgaacacaagatcgaaaacatccggctaaatcagcgcatctcacagctcagggcggaagaggaggaagatacaaatgcaagtcgacaggcatacctcaagcaaatttcgggcccttttgcccagcgccagaactgccttccattcggtacctacgatgccaccggctcaggcgaggagaacgagtcgtccgatacggtcaacaccgatgatggagaaccagggtcgcttcttgaaagcantatgcgacaggcacaagacatgacccacatcgacggaattgagatgatgacagggctgcgttaccgcgagggcgagcggtctcatggtcttagcacgggcatgcgccaaggctgtctcgtcaattgcgatattgatacggccaccattgagcagcaagttcagagcgcacaggagattgaccgaaggaaaagattgaagggggagtatctgtgtacagactgtgggacctctgattccccagaatggagaaagggaccggacggtccaaagaccctgtgtaatgcctgcggttgtaagtcgccccgacgctacccctgttgttgctcgactgaaactgactgttttcctcaatag

SEQ ID NO: 13358 - DNA, 189 bp, A.fumigatus
gcccagttgaagataatcggaaccatcctcaaggagttgaatttcgtcagcaattatctcagttatacgatcaatgagggtgatttcagcgtcatcgctactcctggcaattccgacaccattcatgtagtcgtcaagaagctcttcatcagacaaattttgagctcccacaagggaagtagcgcatga

SEQ ID NO: 13359 - DNA, 2697 bp, A.fumigatus
agacccaaaatcgatcacgcatcgaaattggtgtcacaactttccccctatctacccgaatctcatatccagtgctttaggccgtcccctttcctgtatgacctgaagccttcaccttgggagaagcttacttataaactgacatcgtcactgctctcactgggctccaattttcccccgttacgctcgaccactctcagcgctatcaacgagtacttgtatagctgtgcggatgctatagatgccattacgcctcttcagcgctacgattctgcaggcgacaaattcggttctgttcaagagcacaaacgcatactgtcactcgccgtttctcttgttggatttttagaagcatccgcacagtttccttcactttggtccgccagtgaaaaactgcagattgttgagcacgtacgatctatgttgtctgaaagtttcatggttgcaattgagaccgcctcttctaccgtgcgcaatgcgagcttggctgatcctacgttgagggactggagaaggtacacccggcaatatgcggcaaacagacgtcctctaggcgctatgcttctgcagcaagggttcatgcgtttcgtcaagtcatgcgctacttcccttgtgggagctcaaaatttgtctgatgaagagcttcttgacgactacatgaatggtgtcggaattgccaggagtagcgatgacgctgaaatcaccctcattgatcgtataactgagataattgctgacgaaattcaactccttgaggatggttccgattatcttcaactgggctcacccttgcaaaagcagctcaccttttctgtgaaagcgtttgctcttattggatacttgaactgcgtcatattgagtggaaatgctgccaacagtggggcctttctatcttggttggaagacacactggcagaccccaatcaaatggcaagtcttgagcttgcaactgccaccctgaaaagcatagctatcatctcaaggatgtctctggccagtgcatcctctggaagccgctctcttttgaggttcattattgaagggtgcgtgctaggggaatatactgggtctgttgctggaaagtgtctggctcaagtacttggcattttgtctcaagatgccgtcataacaactctttactctctcgggaacgctttgagccctggctcaggctctgacaaatattatcatagtcagctcttgaatgagaatgctcggcaagccgacagtgtttcttccgttccaccaccaattggtattggtagtacggtctccatttcagccattggtgaccacgataatgcaacctgcagaaacattctccgtgctattgtgacaattgcagtcagctccaatgacgagaaaatcagtgcgctagctcagtcaatgcttttgcaaaagatcggcaaagtcaacattgcagtggatgctctcatcattagagaaactgcctccctctcattgagcacaggacaagcagactttcaactcctgctcaagttttatgaccgtgcttatcaagacagtatcgcccggaatttcagtgatgtcacaaatgcagtcaagggcgcaatggcatacatatctctcacgctgaggagggattccccacttttccgggtctatttggttcatctcttggaatgtatcgtgaataaaggcgatgcagtaagcgaaagtgagcggcagaaggaggttgttctagcaccagaggccatcagttttctcctcagacctctggctctcctcatttcatcagacgaagggggagctgagacacaacagacagatgtaatttatgatgaagacgtcactgccctgttccgtgatgcttggtttaatatctctgttcatgggatctcgactcagtcagctgttactcgaagccatatccgagaattacgcttgctcgcaaagaactctccgcccctgattgctgaaagtcgcttagagatgctcgagagtgacgtagagctgaacacaatcctcagacgcggaatgagcccccaacggttgatagagctcaagagaattctcatggccgagctacctgattgcgaatcagggattaaacatctgaattatccaaaagtggtcttcctcaacgcttctttgttggttgagagcctccgtgcgtcgtcgggaaattgcaccaaagttctcaattatttccgcgacccagccttgactacagctgacatggccagttgcatgagctccattgcagataaagtcgtcgctgactacttatccctgaccctatctgcggacgatgagaatttctctgttccttatttgtcaaaggaattggctcaattcttcatggcttgctgtcatcgtatagaacgagtgcagagcgtcgccatgttgtgcgccgacaagatcattagagaatgcccatcagctctctgtgataaacattccctattcgctcttcttgaattgctgactgtaatgtggctgtcgtgtcttgaggaagagcttgatgagtttgagtggaaggcttcctatgcatcaccgatgggaattgttaaggttgatcttgccgacgactacaatgccaggaagagaactctgaacacactccttgagcgagctaaagcttgggtagcagcagttatagatattgcacctctggatgtgaaaggccttctccaggcgagtacctttacgaaggcttttgggattgattgctga

SEQ ID NO: 13360 - DNA, 228 bp, A.fumigatus
  unsure (169): Identity of nucleotide sequences at the above locations are unknown.
gttgtaagtagagggcagaggcgtacagaatccgtctttctcgtctacaagcgtaatgtctactgggatgtggtgctgtggtggtttgatctccgtgtcgtagttgaagcgggagggttggccgcgggaaagatcgaggagggtgagggctgcgctgaggccgctgtangaggcgcctgctatgaggacgcggaagcgacgcgcgagggagacgaggtgttcgtttga

SEQ ID NO: 13361 - DNA, 498 bp, A.fumigatus
cctggctcaaaacgggcgatgaagccatcttcgatgaggagggttactgtaccatcaccgggagattcaaagacatcattatcagaggtatccacttttctctccccgaccgcacaaaaatcaaatctaacccacacaggcggagaaaatatctaccctctcgaaatcgaagagcgactggctgcacacccagccatcgaggtagcctccgtaatcggcatcccagaccagaagtacggtgaggtcgtgggggccttccttgcactggctgctgacgtgagcgcgagaccatcggatgaggagctccgcgcttggacgcgggaaacgctgggtcggcacaaggcgccgcagtatttctttgtgtttggcgaggagggcgtcgaccgcactattcctgtgaccggcagcggcaaggttcggaaagtggatttacgcaagattgcagcgagtgttttggagagacggttggcaaaaacggcagcaataaaggaaaaatag

SEQ ID NO: 13362 - DNA, 333 bp, A.fumigatus
  unsure (144): Identity of nucleotide sequences at the above locations are unknown.
accgaatccacagcctttgtccatctaccacacgcacctccatacccctcaatctgctcgcaacgctcacaaaagaacatgccatcaaacgaacacctcgtctccctcgcgcgtcgcttccgcgtcctcatagcaggcgcctcntacagcggcctcagcgcagccctcaccctcctcgatctttcccgcggccaaccctcccgcttcaactacgacacggagatcaaaccaccacagcaccacatcccagtagacattacgcttgtagacgagaaagacggattctgtacgcctctgccctctacttacaacctaagtgcgctaacgagatag

SEQ ID NO: 13363 - DNA, 390 bp, A.fumigatus
  unsure (356): Identity of nucleotide sequences at the above locations are unknown.
cgcaggttgcaattcccatcgactgtcgccaatgccaactaccactttgccgtcggcgacctggctgcgtggtccggtatcaagcgctgcggtgcggcgatgcacatgggccactacgcgggatacaatatccaccagttgatgttggccgagtgcatcgcttctaagcctgtcttccaggaattgcaggagattcccccaatgatcgggctgtgtctgggtaagacggctgtctcgtatcacccggtggacggagtcaaggacggtgaggatattctggcgtccatgttcggggatgatatggcgtcaaaggtttgtttccctcctgcttgtcaagggttgtgcctatgtaaaanaacgtgttgctggaattatatgccggctgtcgga

SEQ ID NO: 13364 - DNA, 774 bp, A.fumigatus
agcgaagtaacagaagaaagggtgcaggagcagagggtagaaagtagaggcggacggggggaggacggaacgagacgtggagcgaggccaaatcgaagtgttccaagaaggagaaaaaaatgggactgctcggaagtacaggaggggagttcatcagcggggcggcttgtggccgggcggctcatgaaccggaggcaggaggaagtgaacgtgcccgaggatcccaggcaatttcggaatgcatacccaggttccgtgagagggtgcgcggtagctaacgaacttcaggcatcgccaaagcctcacccgcttgtatcaacgcgcctaaccaccgacagtattgagcgactccttacaaccgtcggcaaggtcatgctccacgctaaagccaagatcatcgacacacagggccacatcgtccccatcggccagcgcggcgagctctgcattgccggataccaactgacaaaggggtactggaacaacccggagaagacagctgaggcgctaatcaccgactcggatggcgtaacctggctcaaaacgggcgatgaagccatcttcgatgaggagggttactgtaccatcaccgggagattcaaagacatcattatcagaggtatccacttttctctccccgaccgcacaaaaatcaaatctaacccacacaggcggagaaaatatctaccctctcgaaatcgaagagcgactggctgcacacccagccatcgaggtagcctccgtaatcggcatcccagaccagaagtacggtga

SEQ ID NO: 13365 - DNA, 1308 bp, A.fumigatus
  unsure (1304): Identity of nucleotide sequences at the above locations are unknown.
aatgcaggctgccgtacgtgtcggatccggaaagtcaaatgcgatgaggaacggattatcgttgatagcaagaaggaaccccaatgcaggcggtgttctgtcgcacgaatctcttgcgaatggaagggtggacccatcccccgtcggtcaacgacagggaatagaaaaagtctgaagtcagggacccatgcgagttcgcatggctcgatgaggagaccggctgatttgcaaactgccttgcttcctggttgcacccatgacagtagtctgcaagctgccaattcacttgtcctctcgggatctgaccggtctcgcttgaactatcttcaagattctgtcctggtcactatactcggcaagcagtggccgtggtccaccgtttcctacacctaccatagagtagctgtcaaggaacctatggtgatgagcatgatcctcgccacgactgctagtgaaatccatcgatcacgtctccacgattccgacagcacatgtttgtattccgcagccggtgatttctctgacatcgatggcagggtgcactacggcacagcgttatcgagactccgtgaagcactagccgaaggcgtgaagacgtcgtcgaagctcgaggcggtgttcataacgttgtggctgatgatcgattacgagaaccggtttggtagtggggcatctacaatcaatattcatttgcaaggcattgaaagcatactgcacaaccatatcttacctctgctgaaatacgaggactgttcggccgccgcaattactgccgagagccctggagcggcaggattgctgtttgacaattctgccgaaggtgcgagtttgactgagagagtggccaggagtccggtcgattcggtagctggtccatctgcggggaaactagtttacacggcagtgcctctattcttgctgtggaccctctacttctttacgcccggcgcgcttttctttggccctggggctgtatatgaaccagggtttgagaaagtcaacgatgatctctaccgtctcttccgtctcttccttcatgcagaagatgaaaacacgcggttgaacctagagaacctctatcgtatcagtaggcagtcgccttcgaagttctggggagaagcctacccagccaaagcacaactagacgacctggaaaactaccctgggttagcgctctaccacaagagccatgtggttcaattcagaatcaccgagctatttcggcaagcaagaggcaccccgtggaacgaagcaccttatcagcagactgtcgtattcgccaccgaacggaagagcgtgcattncaat

SEQ ID NO: 13366 - DNA, 810 bp, A.fumigatus
ccgtttcagatctggtcgaatccggaactagcttatgaggagcacaaagcacacgatcacatctgcgagctgttcaacacgcttgaaggctacgaagtgcgtagaaaggcgtatggcctgagcacggctctagaaattgagtacaaacatggtgccggtggtcgcgtcgtggtgtttaatgcggagtacgacgcactacccaatatcgggcatgcatgtgggcacaatctcatcgcgacaagctccatagctgcgttcatcgccacttgcgaagctttgaaaatccactgtcccgaggggctcggatataccgtgcgtcttttgggtactcccgccgaagagtcgggtggtgggaaggtgcgcctgctagacaatggggcgtataaagatgtcgacgcgtgtctcatggttcatcccatgcctctgatccccaatgctccggatttgctgtgtatagctgcaactgtgccgggaggctttcttgccaacgataaggtacgcgtgacatttactggcaaaccggcgcatgcggctgccgctccatgggaggggatcaatgccctcgatgctgtggtttctgcatatgtgaacatctccctcttgcgacagcagctccggcccgctgagagagtccacgggatcattgtcaatggaggagaccggccgaatgtgattcccatgtctgccacggtggactactacatccggtcagacacagttaaaagcctgaaagtccttacgaacaaggtgatcaagtgctttgaggcagctgcagtggctactggttgcaaagtcgactttgaatggtga

SEQ ID NO: 13367 - DNA, 195 bp, A.fumigatus
tcagagaagatacacaagagccacacaagcacaatgcagtttcccgtttctcaacaattattcatcggaagtgttcgcaatgccattcacaagtatgacgcgcagcttaaagatatcaacaacaaggtgagtttgactacaattacaagtgtagtgctcgctaaccgtttcagatctggtcgaatccggaactag

SEQ ID NO: 13368 - DNA, 339 bp, A.fumigatus
atccctgacgcctcgtatgattgtccaacagattggcacgtagctgaaccaccccctcatatgaataacatcatagctgatccccttcatctacccaccgacattatgtcgattagagttaacaacatccgctcaaacgagaatcatcaagccaatggcaagactacccagagcagcgaggccaggcaccacaagggtggagcccaggttggtatgacgggacgtggtgggtttagagctttccttagcgtcgtcattgctgctgctgctgctgctgctgtcactgtcactgtcgctgtcgctgtcgctgccactgctgtggctgctgctggtgcttga

SEQ ID NO: 13369 - DNA, 186 bp, A.fumigatus
acactatggcctagagcaaacttcacaacagggttatttacatgtaacactaatccgcagctcattcaactacgaaaggattcatttctagccttttgctttacttatctttatgagtgcctaactagggttaactctgatgaaacagcgcatatctctgcttcggcacgattgtctcatccgtga

SEQ ID NO: 13370 - DNA, 711 bp, A.fumigatus
actgattcctcgaacttcgcaacttgctgcttgcctcagactcttctagcaccgtgctcttcaacccaacttgtctctacatctattctccatcccaattcattaaaaatcacaatgcgtgtctccgctcagctcatcgccggcatggccttcgtcgccagcgccaacgcaggcctatacagaagagcacacgagacatccactagcaccgaagtaaccactaccccaaccgaaaccgccacggccacccccgttgtcgaccaagaggtttccgccaccgagaccaacacctccgcaacaaccgagagcgaggatgtcgccaccgtcgtctctgacgcggatgcccatcccaccgagacgacaagcatccctcttatcaaggccaccgtcgccgtatcctcctccgctgctgctagttcccccgccgccggcatctcgactagtgcgagtcccaaggctactggcactggcgactacgttggtttcgttgatcctaacgaggagtcaagcaccagcagcagccacagcagtggcagcgacagcgacagcgacagtgacagtgacagcagcagcagcagcagcagcaatgacgacgctaaggaaagctctaaacccaccacgtcccgtcataccaacctgggctccacccttgtggtgcctggcctcgctgctctgggtagtcttgccattggcttgatgattctcgtttga

SEQ ID NO: 13371 - DNA, 480 bp, A.fumigatus
ccactaccccaaccgaaaccgccacggccacccccgttgtcgaccaagaggtttccgccaccgagaccaacacctccgcaacaaccgagagcgaggatgtcgccaccgtcgtctctgacgcggatgcccatcccaccgagacgacaagcatccctcttatcaaggccaccgtcgccgtatcctcctccgctgctgctagttcccccgccgccggcatctcgactagtgcgagtcccaaggctactggcactggcgactacgttggtttcgttgatcctaacgaggagtcaagcaccagcagcagccacagcagtggcagcgacagcgacagcgacagtgacagtgacagcagcagcagcagcagcagcaatgacgacgctaaggaaagctctaaacccaccacgtcccgtcataccaacctgggctccacccttgtggtgcctggcctcgctgctctgggtagtcttgccattggcttga

SEQ ID NO: 13372 - DNA, 279 bp, A.fumigatus
  unsure (170): Identity of nucleotide sequences at the above locations are unknown.
tcaattcgagatcaaagtccagcttttctctacatgaacagcatcattctgacaagacttgcaaacacatgcacttatggtgttaatgacaatgactcgttctctatatgcagctcgaagatcatgacgtggaaacccaatttacccactgtcacgaacaacccccccgnccttcatcaactacatacttgcagtgtgaacctcttccacgaagaagaggagggtgaatatgccccgcggcagggtttgaccattgttccaaccaaaccccctgtctaa

SEQ ID NO: 13373 - DNA, 501 bp, A.fumigatus
aatcacagttcacagcattcagtatggggtactggggagacatcttcagctctgggcgtcgaactcaccatcaccatcttccagaacggcggcgttgtacgtcatcaccaacggctgggcctggtctccggacagcatcgcacctttctgaagctaacgcggctaatagtgcttcccgcttacagggctgaccaggcggcctctgtcagtcctgctaaggaggtgacaaaggtcgctctgcggctgaaatatcagatcgaacaggtcattccgttcgagatcgacgagaattccatcactaagcctaacagccgaatcatcaccgacgaggtgatccagactgccaggcaggcaggtggtgatgaccacaaagactgtgtggtgtattgtctccttgtttgtctacggtggttcaagctccaggcagaggccgaactctgggaatctgatctgcacctgcgtcgcgcgctggcatgtgaggtcactgcaaagcgcatgtaa

SEQ ID NO: 13374 - DNA, 870 bp, A.fumigatus
gagaagcgtccagatctgtctgaaaaagttagagctaacaatgctttcagtatcgagtccgaggaggaccaggactccctcatgaaggacgccctgttgcagaggtactccatcatcttggacggagaaccaactacaccagccaacgtcattgagcgagccgtggatctccatgctctgagagtcataggctcttcgggataccagaagtgtatcaagtatctctggcgtgggtggttctgtcaagaagagggtaacccgaccaatttcgttccctaccatgacaaagacaacacagacttcaggattcatttccaccctgaccgcatgagagcgcccctttatcaaaacgcgtgtcagatattattctcattgatatacctcctcctgtataccatcgtcatcaatactgtcaacgctaccggagatcttgacgttgttgaaggaatcctctatgtgatgactttgtcttatatctgtgacgagctcaccaaactctggaaggttggaagggactacttcgacttttggaacgcattcaactccactctttataccatcctcgcggtatccttcttcctccgtgtggctgcccttacgcgatcgagctccgtcgaagatgagcagaggaaaacactcaaccagctgagctataatttcctggccatggcaggcccgatgttttggatgcgtatgatgctctacctcgattcattcaaattcttcggcgccatgttcgttgtcctgagagtgatgatgaaggagagcttgattttctttgcccttcttttcgtcatcattggaggattcttccaggcgttttacggaagtcttcaccacggggctggaagaatccgacgctggcgctat

SEQ ID NO: 13375 - DNA, 267 bp, A.fumigatus
ccgattctgaccgtgcccaaggaccctccgtctaacaggttccgtctctgtacaggttacatcgatctctccaagcgtcgagtttctccggaagatgttgtcaagtgtgaggagaggtacaacaagagcaaggcggttcactccatcatgcgccatgttgccgaagccactcagactccccttgaggagttgtaccagaagatcggatggccactgaaccggaaatacggccatgctcacgatgccttcaagatctccatcacgtag

SEQ ID NO: 13376 - DNA, 531 bp, A.fumigatus
gatcaaccagtccgtctacattttttcgatcgtatgactcatcttatcaataggaaccccgacgtgtggcaggatgtggaattcccgagcgaagccgtcaagaaggagttgacacagtacatcagcaagaagctgactccctccccgaccaaagtccgtgctgatatcgaggttacctgcttcggctatgaaggaatcgacgccgtcaagaatgctcttcgtactgccgaggcgaacaacacccccgagaaccagatcaaggtcaagctggtcgctcctcccctgtacgtcctgaccagccagtgcctggataagaacttgggtatcaaattgcttgaggaggccatcgagagaatcgacagcgagatcaagaaagccggaggtggctgtgtcgtcaagatggcacccaaggctgtcaccgagcacgatgacgctgccctccaggagctcatggacaagcgggagcgtgagaacatggaagtcagcggcgatgagagcatgtctgaaagcgacgagggtgtccctgaataa

SEQ ID NO: 13377 - DNA, 1107 bp, A.fumigatus
catgaaacagctgtcaaatccgacaatgagtcatgccagaaggctatgttctccaatgccaaactacgtctccttatgtctttggttcgcttcgaacgtctaggcatggaggatgttcctggagcctcctgggtcgttccctcatcactcaactctcaagaacttcggcacacgagatctatcattgagcagtgtttgactgagcctgtcacagagaactctgaccgggacttgagccagttgataaggagaaaatcaggaaacaatacaagacgagacagagatgaccaaatggccaacgttgattttgggtccgattctgagggagacgacaacgtcccagacggaccgctattcccacccaacccacgatcaagggccaacgctctagagcaattgaagaaacaacgcaaaaagagacgcaagcaagccggagaagaagaagaacccgacgaagaagacttggaggcacgacgtcgagcacgcctggaaaatgctttagctcgacaagcgaaaataaagagcgatctgtatatccacgccagtgacgaggaaacagatgaagaagcagaccaggaattctttcgacttgaggagcagagacgaaaagaacaggcagaaagaatcaggaaagctctgcttcacggggtcgtcgaggaggtcagtgagaactcgcgaaagaaaagcagcgggcgtaagcggcaaagcgatcaatacactgcctcgaccgcagatagtcagagcaagcgacagcggcgcctgcaacaaactgaagggctcgatggcaatgacgatcttgtcgtggctggtacggaagctcggtcaccagactctctcggacaaggctcaccttctttaaaaggtgctaacgacgtcgaagacacacttgttacatccgaagaaaatgaactcgatttcgacgatgatttagctttcagccggaatcgtactagagacaaggtccttagtgcggagaacgacgacagcgataccgaaccccctgcacctgatactatagatgaagacggtgaagaagcagcggctgtcgctgcaccgcctcggcgaagagtgcgggctgggtttgtcatcgaaagcgattcagagtga

SEQ ID NO: 13378 - DNA, 2157 bp, A.fumigatus
caaaggacagtggaattgctggtgcctctgacatggccattggaggtgcacagtgaaatgacagtcaaccatcatcgacacacgccctatttgcaacaagcccaggttctttataaacgtggtattctcagtcatggtagcggcagcatcctccgaactatcatccgaatcggcctccccagcatggcagtccctcgatccgaacgaacgactcgcgatgaaggcattttgaagctcatgctctacttccttcgaaatatcgcagtgatttcgccgaatgcgcgccttgctgcggagggcgatgaagaggaaacgtcaagatcggcgaccatcaatgcttttcagaatcaagatgctttcgctcttctcctaaccatgtgctccaatgtgggagaagatttcagccttcaagatgtggttctcctcgaaatattgttccatattgtcaagggagtcaacgtggagaaactcttcatgaacgacgcccaacgaaaggcaaagcgcacagacgaactgggtgaacttttacagaaggagtcctctctgcggcgggaatatgcgaaaaatgcgccaactcggcatggtaggtttgggacaatgatttgggtcaaacgcgatgacgccaaggtctccacggtgtcgggacaagatgtgctcaaagatagccagacaaccctccacaagatggatcagagcaagaagtggaacaagcctcagatacgtcgaagagcagccgaggtgacggcaaacaacgactttaatacgcctgtcaatatcaactcgacggcgaccaagaacctacggatgtttgtagaagagtttttggattctggtttcaatccactcttcactcacgttcgaaaagccattgaacgtgaagctgatcgagtgatggatatcaacacaagacagttcttttataccgttgcctggtttcttgaagccgagcgtgtgcggcgagcacatcaacgcgaaatacggcatctgggtgacacgccgttaaaggagatagaacccgatagttttgcgctcgttgccagcgtcctcaaccaggaaacatttgtttttctgaaccgctcaatgcaatacagctatgacaacaaagacgtggaagaccttactgcagaaatgcgctgtttcacgcagattctgttgactgtacaagagatggctcagtcaccacttgaagaagatcaagagatcgccgataacatccagaaccgaattttctacgaagaaaccacccatgaccgcatcgtcgccatcgttcgtgggtacaaagaccaaggatttgggtacttggatgcatgcacagagcttgctcatgtattcttaaggatgctggaacattactccaaagagaatgtcgatatgcatgtcagatcccgtcgccgcgcaaagcgcaaagccaaacaggccaaacaggccgatatcgaaggcgatgacgaggaggaagcatctgaagaagaagacttgatggacgtcgaaagaatctcgaaggagcgcaaattcgatttcagacgttttgccgccaagttctgcaaccagagctgtgttgacacattcatcgcttttaccaagtactatagagaattgaatgtggaccaattgaagcgagcccatcgttacttttacaggatagcattcaagcaagagatgagcgttttgcttttccgccttgacatcatcaacctcttctatcgcatgatcaaaggtccgggtgccttggactcaaacaagccgatcttcaaggaatgggaggaactggtccggcagattattcggcgcatgatcaagaaaattgatcaacgcccggctttgatcacagagctgctgttcagtaagatcaactcgaccgtcttctacctggaatatgggcatgagaaacaaacaatatccgcctccaagagaccaccagctgagctggaggttgaacccagagaagccaagacaatcgacgagaaaataaggatagttgtgcatgtcatggtcaaggatgagcacactgacctggtcaaatgggtcagtgatgtcttaaattcggcagctgatgagagagaggcctgggaaagtcaggaacagcactcaggaggacaaaaagctcccaacccaatgattcgtacgtcttctggtttctcctggctggtcgtacggtga

SEQ ID NO: 13379 - DNA, 2460 bp, A.fumigatus
  unsure (2383): Identity of nucleotide sequences at the above locations are unknown.
acccttaaaatgcccagcccggccaaaaagcgcaaaagagaggctccagattcaaccccacagcgtgttcggagcatagcgtcattcttccagggacaatccaacaagaaggccgagaagacggaacaaattgttgactctgctaccgaaagtgcagcagacgaaacactatctgacgaagctcttgctcgcaagcttcaagcggagttcgataaagagggtgatgcgccggccgtggagcatgaggttccaaatcataagcttatccaggaaccttacgccccgacagagtcagatagtggaccgcttaagaaagtcccgaaaaccaatacaatctcattgcagtcttccgttgggacagaagatacaataagtctttccatccctttcgaccagagtccgttgacgttcgactcgacaaaatgcgcggcagagttgcaggtccactgggctacggagggtggaaacgcctcatatgctctgctgactagagcgtttgtgttggcaaatgcaacgactagtcgaatcaggattgttgataccctggtcaatttccttcgagttctgattgaaggcgatccttccagtgttttaccagcagtctggctagcgaccaactcgatttccccgccatacgacgaattggagcttggtttgggaggctccgcgatatcgaaagcactgaagaaggtctacggactcaatccttatgggctcaaaaatctctacgacaagtatggagacgctggcgacgtggctttcgaggcaaagaaaaggcagagcttcaccttaatgaagcccaagcctctgacgatcaaaggtgtctatcaatccttaaggaagattgcgacgagcaaagggagtggtagtcaggagtccaagcagagaatcgtggagaaacttctacaagacactcgaggtgcggaagagagccggtacattgtacgcacgctggtgcaaaatttaagaatcggggccgttaaaacaacaatgctcatcgcgctggctcgagcctttctatattcaaagcctgaaggcgcagagtttacgatacgttcacgacaagatctgacgcgactaaagaaggaggaactggccgaaatctacagccgggcggaagaaatcgtgaaggcatcatatgctaggcatccaaactacaacgacttagttacatgcttacttgaaagtggagttaccgaagaacttcttctgcggtgcggcctgcagcttcatgtacctctgagacccatgttgggcagtatcacgagagatctctctgaaatgctaacaaagctgcaaggacgggatttcagttgcgagtacaaatatgatgggcagcgtgcacaggtgcactgtgacgagaaggggaaagtatcgatattttctcgccatttggagaatatgacggagaagtacccagaccttgtgtccttggtctcgcaaatcagaggagagagcgtctctagcttcatattggaaggagaagttgtcgcagtagataacaaaacgggtgaactccagacgttccaagttctgacaaatcgagcaaagaagaacgtggagataggagcaatcaacattaacgtttgcctcttcgcgttcgacttgatgtatctaaacggcgagccactattggatcggccattccgcgagcgcagagagttgttacgcagcctatttgtggagatcccaaacagattcacttgggtcaaaagcctcgacgccacgtccgcagactcggagacggtcttggagttcttcaaaagcgccctcgagaacaaatgcgaagggatcatggtcaaggtgcttgacaatgcacccaagacgagccttgaacagaataaggaggcctccacgagcaatggcatggatgtgacgagtggggaaccgctcgaaaaggcgggcaaaggcggcagacgaaaagcacttttatcaacatatgaaccagacaagcggctcgagtcgtggctcaaagtcaagaaggattacagtacctcgtccgagaccctagatctgatccccattgctggctggcacggacaaggccgaaaagccaaatggtggtcccccattctgatggccgtccgcaaccctgaaacgggaagcctcgaagcagtcactaaatgcatgtccggcttcacggacaaattctaccaagcgaacaaggacaagtacgccgagggaacgcccaatgtcatctcacggccggcctatgtcgagtactacggcgaacctgacgtctggttcgaaccgcaggaggtctgggagatggcattcgccgacatcaccttgagtccgacgtacacagctgccatcggcttagtgagcgacgagcggggactgagcctccggtttcctcggtttctcagagtaagagacgacnaatcaatagatgaagccaccacatcggactatctggctctcctgtggcggaggcatgccgaacggaagaaagaagag

SEQ ID NO: 13380 - DNA, 348 bp, A.fumigatus
agcaacccccggggatctagcattacagctacctatgcgattaaccttcaattttatttaaccactgctgacacgacagctcagttagcagaagcccaacaggcactgctcagtgcatcaaaagcctccaacgaccatgccgaagccacacgaaagcgagccgaagccttcaaggaggagcaagaggatatcgataagcgattgaaagccataacaggttccaacgccagcgatgaggcagcaaagcgctttaaagtgagcatagacaagctccgacggctggagatctcgaagggttatgtgaccctcctgagggaagcagaggaattgaggtacttgcggacctaa

SEQ ID NO: 13381 - DNA, 183 bp, A.fumigatus
cggaccatggactcctctacctccgcgtcgtccaacacccacggcgaagccaagtatatcaacttccccactcttcctgacgacgcaaagcatgaagatggcaccactgcgctgaacagatattcttcttatatcactcggggccatgactttcctggtgctcgggtttgttaccctcattga

SEQ ID NO: 13382 - DNA, 270 bp, A.fumigatus
gctatgctttttgcagcggggatcccggatcgcgaagcgatggctaagagcccacaggtaggaattgccagtgtctggtgggagggaaatccttgtaatatgcatctgctggacttgggcaagaccgtgaagaaggccgttacagatcagggtatgatcggttggcagtataataccattggagtttcagatgccatttcaatgggtagtgagggtgagcgtattcagggcttgaggagcattgctactctctgcgtgagatattcctga

SEQ ID NO: 13383 - DNA, 1467 bp, A.fumigatus
  unsure (853),(860),(862),(892): Identity of nucleotide sequences at the above locations are unknown.
cgtgtattcccaggcatgagattttctctccagacgcgtgagatcattgcagacagcgtcgagactgtgacttgcgcgcagtatcatgatgcatgcattgcaattcctgggtgcgacaagaatatgcctggagtagtaatgggtatggccagacacaatcggccttcgcttatgatttacggtggaacaattcaggttggatactcgaacctgctgcggaagcgggtcaacgtgtcgacttgctttgaagcggctggtgcctatgcttatgatactttgcgtcaaccggacgatgggggtgacaccagtaaaagcaaggacgagattatggatgacattgagagacatgcttgtcccagtgcgggtgcatgtggaggcatgtttactgcaaacacaatggccacggcgattgagtctatgggcctgtccctaccagggtcatcgtcaacgcctgcctcgtctccatcgaagatgcgagaatgtgttaaagcggcagaagccatcaagacctgtatggagaagaacattaggcctcgggatcttttgaccaagcgctccttcgagaatgccctcgtcatgacgatggctctgggaggaagtaccaatggtgtcttgcatttccttgccatggctcggacggcggatgtgaacctgaccctagatgatgtccaacgggtcagcaacaagatccctttcattgctgacttggcccccagtgggaagtactacatggcagacctgtacgatatcggagggatcccgtccgtgcagaagttgctgatcgcggcgggccttcttgacggtgacatcccgacggtcaccggcaagaccttggctgagaatgttgcgtctntcccatntntacctcaggaccaagtcatcatccggcccntgacaaacccaatcaagacgactgccaacctgcagattctacgcgggaacctggcgcctggcggagcggtggccaagatcactggcaaggagggcaccaagttcacaggcaaagcacgtgttttcgataaagaatatcagctcaacgatgctctgacccaaggcaagattcctcgaggcgaaaacttagtgctcatcgtccgctacgaaggacccaagggtgggccaggcatgccggagcagctcaaagcgagcgcagcgctgatgggagctaagctcaacaatgtggccctaatcacagatggaagatattcaggggctagtcatggattcatcgtgggtcatatcgtcccagaagctgcggtcggagggcccattgccattgttcgcgatgacgatgtgatcaccattgatgcggaaaccaacacgataaacatgcatgtctcagatgaggaaatccagcagcgactgaaagagtggaagcccccagtgcctcatgtcacacgtggtgtactcgccaagtatgcaaggctggttggggatgcctctcatggtgcaatgacggatttgttctag

SEQ ID NO: 13384 - DNA, 444 bp, A.fumigatus
tacttcccactgggggccaagtcagcaatgaaagggatcttgttgctgacccgttggacatcatctagggtcaggttcacatccgccgtccgagccatggcaaggaaatgcaagacaccattggtacttcctcccagagccatcgtcatgacgagggcattctcgaaggagcgcttggtcaaaagatcccgaggcctaatgttcttctccatacaggtcttgatggcttctgccgctttaacacattctcgcatcttcgatggagacgaggcaggcgttgacgatgaccctggtagggacaggcccatagactcaatcgccgtggccattgtgtttgcagtaaacatgcctccacatgcacccgcactgggacaagcatgtctctcaatgtcatccataatctcgtccttgcttttactggtgtcacccccatcgtccggttga

SEQ ID NO: 13385 - DNA, 3519 bp, A.fumigatus
cgattcatacttccacgccggtcgtgtagacatgggggcttcaactggaatacgactaaattctacaacttcccaaatgaaaggggtctgtacggttgtcacgatatcaccgtcacttacgaccagcgcaatcctgctcacccacttcgcaatatcatgaagcgcatgtttgaaatccgggagcactatcccgtcgctaatgatggcttctatctccagaccctttcccagcttaccaaggatgtctatcttcctggttcatcgaacacccccacagtgactggtctgtggtcggtcttgcgcagctacttccccgaggtccagccagaggcgtccaagggcaacaatagtatttggcttgtgtatcataatgacaacaagactgtaacctatggtggtgactgcaagaaccggaacaccgcgttattggctccttacaagtcgggaacgaagctgaagaatgtgttcgccccttacgatgagctcactttggaagatggtcctggtgatattgaggtccatggaacgactgagtcatacggctgcgctcgcaacatgactctccttccatgggaataccgagcctatgtggaggccgatagatttgttgagcctggtcccactgttacggagtttgttcccggccacgacgcacgcttgctgtcagcggaagacacgggagaaaccgtcgatattcagcttggatactcaaaggagatggactgtaccggcgtgactcgagcgatttccctaaactctaccaccgaaaagggtatcacaccaactctcgatacgtccagtgtcaactgcggcaatatcactccacggacaagcagtcatcactacgtcggggaagtccccactgtctggacatggtctgccaagctgaaaaatgttcatcatggtatccatgaactgaccgtcaaaaacgtttcaacaacgtccggagttcggaccaacgccgtcgaccggtttttgttccggatgggaactccaacgaacccgctgataacccctctcgccaactactccaccagccttgtgcacaaatctgacgacggcagcatttacattcagcacgaggccgccggagctgacatgttccgctactcgacgactttcggccggacatggtcaaattggacaacgtataccggtgggaacacgacgattgaaattgctccttttaccggcacggatgctcagaaatggaagggcactcacgtccgcgtgcaatacttctcgaggcttaccggtagtagtgactacatccaagaaggcgaccatgactgggaggacggtgtgccacgaaggttccctcatctgtggtggatcggaccgtacaatcagtttggttatgatgctgggctggatagcaaaatgaggtacgacgtcaaggagggtcgctggaagtatgacttcgtgtatgagtggccatctactggacaaatcagtgtctggggagtgggaccagatggcttgccagatcctacagaggtttatggcgacgtggacaatgcatctgtagtccagaagcttcctccgtcctatctctcgtcgaacgtgatcaacataaccacgccgcctccatttccgcacctcggctggaccatctcgctcaatgatgccaatcttcgatatgagatgaccccggtcgggtctggatgggttcagctcgtcctcttcgtcctcctgtgggttgttcccatcctaatgggccttgctggtgcctttatttttatgagaaccttctaccgcgtcaagctgaacacggatggcactgcagctaaagaggataagctgccgctgctttggcgtaaggtcagagcgcagttcaccggggctgattactcggaaatggcgatatctgacaaggctgtgctgccggacagtgctattgcaggtgcagctgcaggcgcccccgaacaccgacggacggtcttgatcgccactatggaatatctcatccaggactggaaggtcaaagtcaagattggtggtctgggggtcatggcacagctaatgtccgagcatctaaggcatcagaatctcatctgggtggtcccttgtgttggtgacattgaatatcccgaagacacaccagcggagccgatgatggtcaccatcctcgacaagccctacctggtgaatgtgcaataccacgtcgtcgagaatattacctacgttctcctcgatgctccagtgtttcggcagcagacgaaagccgagccttaccccccacggatggatgaccttgacagcgcagtctactattcggcatggaaccagtgtattgcagagacgatcaagcgattcccttcgatcgatctctaccacattaacgatttccacggttgcttggctcccctttatctgctgccgacacgaactgttcccgtctgtctatcactgcacaacgcggagttccagggcctctggccgttaaggacccaacaagagaagaaggaagtctgctcagtcttcaatatttctatcgaaactgcgaccaaatactgccagtttggaaatgtattcaatcttctacacacaggcgcaagctaccttcgatttcaccagcgcggcttcggtgcagttggtgtgtccaagaagtatggaaaacgctcatgggctcggtacccaattttctggagtcttgataagatcggcagtctcccgaacccagacccctcagatactggtgccgtcggtgatggggctgagacaaatgtttcaatcccgtcccctgaagatcggattagagacaaactgcaggctcagaaatgggctggcctgaaggaagatcccaatgctgatcttctcgtcttcgttggacggtggtcgaagcagaagggtgtcgatttgatcgctgatgttatgccagcaatactgtcagctagacctcacgtccagctgatctgcgttgggcccatcattgacctgtatggcaagctggctgctatcaaactggagcgcatcatggccatgttcccaggtcgcgtgttctccaagccagaatttactattttgcctccgtatgtgttttccggcgccaactttgctctgattccgtctcgggacgagccatttgggttggttgcggtcgagtttggtcgtaaaggtgcgctgggtattggctctcgtattggaggtctaggccaaatgcctggttggtggtacacggtggaatctgacgcgacgcgccatctgctgcaccagttgaggactgctatcaaatccgctctggactctgaccaggaaactcgggaagaaatgcgcatgaattctgccaagcaacgattcccagtgttggaatggatccagaagttggaaaccttgcaacagacggccatccagatccatcatacaaggaacaagaacactggcgctggtcccatgccccaacccacagatctactgggagatgcagaacatccgggacttcacggcgagtcttgctggattggcgccatccctcccagaacggcttggaagacccccctttcaaaaatggaggcttaa

SEQ ID NO: 13386 - DNA, 432 bp, A.fumigatus
tcgcgagttgaaggcgactctgtaatagtgtctatccgacccgggttgttggatagaatgctgcagatgaatggttttagttttgcgggtgcgcctctcacgatcgaagcgtacgggccgtccgcgaatggaatgacggatcagccgatgctttcggatatcgcgcagaatggcggtgctccctcgaccgccgataccaagagcaagatgactgcgattttgagcaagcgatattatcaacagacaaagttgcttgatctttccaagctaggcagtgaccccgatcttttggccatgggcatcttcaacagcacatccaccgagtccaagttcttccctgcgctgatgaaagtctgggaaatgagcttcgacaattctacgacgaggcgcgaggccgtggagatcttcaccacggggcgagatccgcgtcaa

SEQ ID NO: 13387 - DNA, 633 bp, A.fumigatus
gaagagcgttccaatccatccctcggagaagatcgatggcgcttctctgcaccagagctcccagacggttatgactcgtacttgaacgactccaacgcagcccttaccgagctgatgacgcctcttccgagtgtgcctcggataggtatccatacatacccgtcctccgattcgatcctaacctcggactcgctgagctcgatccaccttccccttaaggttgaagagctgactggtgataatgacaatatgaagccctatcccgatcggcaaccaagggacacgtcgagtttgcaccagatgcagaggacttgttctaacggaatcgtggccagtgattcatgctcttcacaggacgatgcttcggagatggtaaacaagcctgagatactgtcaccatcagctcatatactgccgcatccatcacaagccacggagtcgtcatccggggaggatatatacccacttcatttgccatcgccacaccaacacgaggcacattttgctcctctcaatgcttcaacccgaggttcaatggaaggaaacaccccagaggtacagcgaccacgccgtaagcttccagggattccacggcctatcagagcccagaaagatcctgaaggtatggtctag

SEQ ID NO: 13388 - DNA, 198 bp, A.fumigatus
ggtacttgcacacgtcgtaaggcatttgtgtccaagaccagatatcctagagaagcgagtccatgcacattgatggcagtcggccaaagctgcacacgtggagtctacccttacggctttaagaacttattcggtcaacccttgcagatcaattctgtcgtgttcttattctcttatttggagctgcttcaagaatga

SEQ ID NO: 13389 - DNA, 255 bp, A.fumigatus
aaatggtgtatggaatccgaactgcgggccaggttaccatggggagacccgagaccggagccccccaccgccggtgagcaaacttcgcccggggaagctgttgaactggttcagggtcaaggcgctgggctcaacttcgatctgatcactttccgttccagaggggatgagaagagcgttccaatccatccctcggagaagatcgatggcgcttctctgcaccagagctcccagacggttatgactcgtacttga

SEQ ID NO: 13390 - DNA, 1134 bp, A.fumigatus
ctatattttcattgtaggacattggtcggattcggcaccagaagcagacacattggcgagggcgcaaagacacaagaaatgtccaacctgaagaacacggttggcaatctcaagcgtctcatcggccgttcattcaacgaccccgatgtggagattgagcagaagtacacctcagcggctatctgtgatgtaaacggtcaggctggtgttgaagtgagctacctcggcaagaaggagaagttctcggcgacgcagctggctgccatgtacctcaccaagatcagagacatcacatccaaggagctgaagctccctgtctccgacgtcacaatcagcgttcccgcttggttcacagatgctcagcgtcgcgccatgattgatgccggtgagattgccggtctcaaggttctgagactcatcaacgataccactgctaccgcccttggctacggtatcaccaagcttgatctccccggccccgaggagaagccccgcagagtgatgtttgtcgatatcggacacagcgactacactgcctccgttgtcgagttcagaaagggtgagctcaacgtcaaggctaccgcctacgatcgtcactttggtggtcgtgatttcgacatagccctcacggagcactttgccgatgagttcaaggagaagttcaagattgacgtccgttccaaccccaaggcgtatgcccgtactgttgccgcggccgagaagatgaagaaggtcctttccgctaaccctgctgcccctatgagcatcgagtcactcatggaagacgttgatgtccgctccatcgtcaagcgcgaggagctcgaaaccatggtcaagcctctgcttgagcgtgtcaccatccccattgaagaggctcttgctgaggccaagctcaagcctgaggacattgacacgatcgagatggtcggtggctgcacccgtgtcccagctatcaaggaggccatctccaagttcttcggcaagaccctgtccttcaccctcaaccaggacgaggccattgctcgtggttgcgccttcagctgtgccatcctctcccccgtcttccgtgtccgtgacttctccgtgcacgacattgtcaactaccccatcgagttcacatgggagcagtcggcc

SEQ ID NO: 13391 - DNA, 363 bp, A.fumigatus
ggccgactgctcccatgtgaactcgatggggtagttgacaatgtcgtgcacggagaagtcacggacacggaagacgggggagaggatggcacagctgaaggcgcaaccacgagcaatggcctcgtcctggttgagggtgaaggacagggtcttgccgaagaacttggagatggcctccttgatagctgggacacgggtgcagccaccgaccatctcgatcgtgtcaatgtcctcaggcttgagcttggcctcagcaagagcctcttcaatggggatggtgacacgctcaagcagaggcttgaccatggtttcgagctcctcgcgcttgacgatggagcggacatcaacgtcttccatgagtga

SEQ ID NO: 13392 - DNA, 600 bp, A.fumigatus
ctcgatgctcataggggcagcagggttagcggaaaggaccttcttcatcttctcggccgcggcaacagtacgggcatacgccttggggttggaacggacgtcaatcttgaacttctccttgaactcatcggcaaagtgctccgtgagggctatgtcgaaatcacgaccaccaaagtgacgatcgtaggcggtagccttgacgttgagctcaccctttctgaactcgacaacggaggcagtgtagtcgctgtgtccgatatcgacaaacatcactctgcggggcttctcctcggggccggggagatcaagcttggtgataccgtagccaagggcggtagcagtggtatcgttgatgagtctcagaaccttgagaccggcaatctcaccggcatcaatcatggcgcgacgctgagcatctgtgaaccaagcgggaacgctgattgtgacgtcggagacagggagcttcagctccttggatgtgatgtctctgatcttggtgaggtacatggcagccagctgcgtcgccgagaacttctccttcttgccgaggtagctcacttcaacaccagcctgaccgtttacatcacagatagccgctga

SEQ ID NO: 13393 - DNA, 510 bp, A.fumigatus
  unsure (68),(200),(377): Identity of nucleotide sequences at the above locations are unknown.
gcggaggtgtcatgtctgtattccctgcgatcggacatttatgacttcgtttctaatgtctatccctntcatagagcaggaatcgccggcatcaacaagacagtcgccatatccaccatcgccgaaaccgccgaccagacgtacgccatcgccaaactaaatacctgggtgctgacagagatgtggtttattttcgtctntgggtcaattccggtcctgcgccctttcttcgtgcggttctctcagagcatcaaatcggtcgccggatactcgggttcgcgcagccgcactcataccgatggcgatcgtcgggggagtcgtcccaataacgagacatggataagcctcgatggccagcagcgtagtccctggattgntaatgggcctcgtacgaagaagggagtgtccggggggatccatggaggcagtgaggagaacatcctgtccgcgacgtatcctgatcagatcgttgttacgaagagaactactgtgatggaggagcctcgctag

SEQ ID NO: 13394 - DNA, 426 bp, A.fumigatus
ttgagaaattcccgcaatccttccagtactttctgggatttctctcgcgtctctccccagaccaattgcacccgaggtttccgattgaaggtggattggtcgagtcacgttgtattggcatcagcttatacaatggacgacaaactccccacacagattacgtcgggtggaatcgacgaggacgaagaagccctggaaggatatgtcgttgaccccagccgatatgcgaacaatgcggccggcctgaagacaactccagacggccgttatgtgctcatcccacaaccgttggacacgcccgatgatccgctgaattggagctcgcgcaagaaatggctcattgtctggatcatggcgtatatcgcattcctggcggactatactgggggcacggcgatcatcactattatcccccagtccatgtag

SEQ ID NO: 13395 - DNA, 708 bp, A.fumigatus
ggtccgtacttcctaaccaaaggccttccgctgatgatgactagagagtggaatctgtctcaggccacggtccaacgagccgtcgtaggcaacctcttcaccatcggttcctgcggtatcatcgtggtggtcctggcaggctacttcggtcgcatgcctgtgcttctgctgttccaagcagtcatggtcgggacttgtgcctggtccgcagcggccaccagctttgagtcatacatggcggcgcgaatcatcaacgggctcttctgcagtgtcggccagggaggcgcgttgctctggatcaaagacctgttcttctttcatgagcaccccaaggtcattaactacatcgagttcttcatcatcatgagcccctaccttggcccgctgctgacctgctttatcgtgacggatgtcgcctggcgctgggccttttggctgtgtacctgcatgtccgccgtggcctttctgcttgtctttcttctcgacgaaacgccgtttgatcgcaaagggcgccaggtcccaagagggtcctatatcgcccgtctcacgggagtccagcaagcacagctgtggcgggagaggagattcctccagtgcgccatgaggcctatcgtcgcgattaccaggattccggtgctgattatcctgatctactatctcctcaacttcgcctgggtgattggagtcaatacaaccatcggaatctgt

SEQ ID NO: 13396 - DNA, 609 bp, A.fumigatus
ctcgccatctttctccttacctcttcttcttcctcttccctctctctctctctctctttcccccctctcttcctccttttcttatccctttcgctcattgttgtgctcttcccactcctatccgccactatgagtaccatacagaatctcaaaaatttcatacgtcatggcaagcaggctcggcttgtcaccccccacgccgaacccaccaccgacgtttctcctgttcacgcagaacaacaacgtcaaccacagggctcatatcctcccgcggctgacaatctcgatgccatcgatagcaaaatgggtcatgcgcacactcatcagcagcaatcggaacccccgcagtctcaaccccagaagtctcccgaaaacaagcaagtcagaactgccgagatcgaacagattgtcgccgaggaacggagtagcaggacaaaaatgccaaaatatcctggtctcgagcggtatatcttactggagaagatgggcgatggtgcctttagcaacgtttaccgtgccaaggataccacgggcgagcatgatgaggttgccattaaagttgtgcggaaattcgaaatgaacagccatcaggtaggcagtcagccctga

SEQ ID NO: 13397 - DNA, 189 bp, A.fumigatus
gtactctacaatcatgattcattccggccagctctcatcgccgtcaccggtctcatggtcatgttatgttattcgtgggaatttagtgattttgcgggggaaaagggtgttgcctcaggcactgccgagggcgatttcattggtccttgtgattgttccgatggcactccccaagcattgattctttga

SEQ ID NO: 13398 - DNA, 978 bp, A.fumigatus
acgatagaccctcgtgacacaaacgatctgttcgaaaggatgtaccgagcctctatgttctacggcagaaagggtcttcctgtcgctgttatttccgtcattgatttggctctctgggatctcctggggaagattcgcaacgagcctgtttataagctcatcggcggtgctacccgtacgcgcctgcacttttactgcaccggtcctcaacctgcggcagccaaggcagcaggtttcattggcgcaaaggtggccctgcctcatgggcccgatgagggtacagaaggattgctcaagaacgtagagtacctccgcaagcagcgtgagagcgtcggtcctgattttcccctgcgtgtggactgctacatgtcattgaatgttccatacactattgagctcgtcaagcgttgtgaagcggaaggaatcaacattgattggtgggaggagtgtctcagtcccgatgactttgatggccacgccctcctcaagcgggcccaccccacaatcaagtttactacgggtgagcacgaatactctcgatatggcttccggaagcttgttgagggtcgcaaccttgacattctccagcctgatgtgatgtgggtcggtggcatgacagaactgctcaaaatctcggcaatggctgcggcatacgatatccctgtggtgcctcacgcatcgggcccctactcgtatcattttgttgtttctcagaccaactcgccattccaggaatacctggcaaactctcccgacggaatgaccgttgagccagtgtttggcaatctcttcgtgaacgagcccatcccaactcagggttacctcgatgtttcgatcctggataagccaggtttcggtctggaactgaaccctgcggcgccactaatctctgctgccgccattcttacgcccgcccctaagaagagcctcacgttgcctgccgaggacgaaaagttggccaacggcgctactcattag

SEQ ID NO: 13399 - DNA, 222 bp, A.fumigatus
gagcattccttgggcacgtcttacgacttcatcgccagactttatggccgtcatgaaaacagatggaataatttagactttacccagaagttttctgctttcggacactcgcttggtgtctctggtcccttctcgtacatcttatccttgatcgtccacgccaagggaacaaccggtgtcgctcaggccttgaagctcaggcttcttcctgtgaacagatga

SEQ ID NO: 13400 - DNA, 210 bp, A.fumigatus
caagttgacagctcctacttgttctacgctataactcatctggcccaaagcgccaggatgtgcgaggagggtcgctctaatagcgtcaaggagccccatattgccgtcgcctttgagaaaaagattgtgtgcctgtattgcgcggcatgggagggtgatttagaaaagcatccgcctcgaacattttcttcacaaatctccgtctgttag

SEQ ID NO: 13401 - DNA, 213 bp, A.fumigatus
  unsure (73): Identity of nucleotide sequences at the above locations are unknown.
gcagcattggggtttcaatgctacacaatctcagccgaaaactttgagatgaacccgaacacgacatatccgnacatctcaccgagtcacgttgaacagcggggtcagaccatggctaaagtcgcacaactgaactcgaggctagtcaaaggaagatcaaactactctgaggcagatgcctgcaatacttaccagggtaaggccgcatggtga

SEQ ID NO: 13402 - DNA, 549 bp, A.fumigatus
agcccagcagcatctaggaggcgtagatcaagcgaaagttcatcggatgaacagtttgtcaggaacaacgccaacaagcgcgcttgtgcaaaacagggcgtccgcggcctgtacaatctcggacaaacatgctatctcaacgtcatcctgcagactttactgcatgatcccatcttgaatgcctattttttagggaatggccatcagtcacacgattgtactctccaggattgcataggctgcgcagttgcagaagcatttgccgacttcaacagcagcgacaaagccgaaggttttgccgcattgaatcttcttctagcatcatggcgtgcaagtcctgtaggtggtctcttgaccaactgctaccatattataatactgactcatcatagactttggcaggttaccatcagcaggacgcgcacgaatactaccaattcctcgtcgacaagttacatacgagcaccgaaggacacgtggatgaccacgaccaagggtgttcctgcttttttcaccaaacattttatggcaagcttaaaagtagtgtga

SEQ ID NO: 13403 - DNA, 765 bp, A.fumigatus
actttggcaggttaccatcagcaggacgcgcacgaatactaccaattcctcgtcgacaagttacatacgagcaccgaaggacacgtggatgaccacgaccaagggtgttcctgcttttttcaccaaacattttatggcaagcttaaaagtagtgtgatgtgcgataattgcggaaacattacaaaaacggaagatcctatgctcgatctgagtctggacgttcaggtacaggcgaagaaacgggccatgggcggtggtgtcgggccttcagcgacacctacactaaatggttgcctagagagctttacgtcaccagaaaggctgatggcaggtgtctacaattgcagtgagtgcggcggtacgcctcagaaagcaacaaagcgtttgcggatcaagaaattgccggcgatcctctgcatgcagctgaaggtctgtctcttctctctgacgactgcggtggacctggctaatatgacatgcagcgctttgagcatagctcagcagtgtccgagaaagttgagggcagggtcgatttccctttgtcgatcaacatgctcccatatacaacacatcggcacagggaggatctcgacaaatccaaattcgtttatgatctctcttctgcagttgtccacaaaggcaaattggacgctggacactactacgtctactgcaagcagggcgaccaggtttgtgtatccgttatctagtggcctatgcctcgtgtctactatcaggaggcaacgctcgacattgttgacatga

SEQ ID NO: 13404 - DNA, 240 bp, A.fumigatus
actttcactttcgtccactttacaatctacgactcggagaacatatcccgtcgcgcagcacagattttgggtctttatcatgtgctcacgaaggaagaccgtagaaacacgggttgcccgccactttctgctgaaattacccgtttcaatcccgcaaagcagcattcctacttcgtagaatctatcatgagaaaactgctgcaatcaattctaggaatcaccaagctatgtcttgggtga

SEQ ID NO: 13405 - DNA, 381 bp, A.fumigatus
gcaggagaacaagctcacagccatccaagccgagctccagcgccagacgaagctagagccatcattggtaagtgcatccttcggagtccagtaccattggtaactgacggtgtggtttgtcagactgaaatcaagagtgttcttcgtcagtgcatctcactggtaatggtcgtcaaggacaatatcatgcagctctgccggtttttcaaggccattagctcgaccattgatgtcgttgtggaacacacagtgaacgactttatcgagacgatcagcagtggagccagcgacgtgcagatgagcaacttcacgctcagtgtcctgcaaaaatcggtgagtccaaaagacgaatcagccactctcgccgcgagttcccactga

SEQ ID NO: 13406 - DNA, 339 bp, A.fumigatus
ccgatggttatgcagatgatctacaagtacgccgtcatcctgcgggcgtactttgaaacctttggagacattgccacgatgtggaaagagctttccgaggagaacatcatacccgggttgaagatgattgacggtctgagtgtggaattgaccaaagaccagatggcaaccaaggtggccgaactctccagctggtcgcagaatgcatcggccaacatcgtcagcatcggctccgcaaaacgcaaggaaatagaaggcggggatggaagagggagtcgagaacattgcacagtctacgcagagtctcccgcatatcctccggccaagaagcccatttga

SEQ ID NO: 13407 - DNA, 276 bp, A.fumigatus
gctcctctaatggccaccaccgaagaccctgccgtccagatcgcaaagaccaatgccaaatccgcccaggcgcaggctggcctggctgcggctaaggatcgactgcacacgacccaacaaactttcctctcaacgcaaaagatatatcaggaggcctcgtccacccttattgagcaggagaacaagctcacagccatccaagccgagctccagcgccagacgaagctagagccatcattggtaagtgcatccttcggagtccagtaccattggtaa

SEQ ID NO: 13408 - DNA, 282 bp, A.fumigatus
ccgccatccgaggcggttgaaactgaagctgtcagagtgaaatgcccgatcccggaaaagacagacctcgattttgacaaggctgaggccatcatgctctcaaccctgtccgcgtccacggggatcatcaaagacaaaacgccgaccgcggtcgatgtcgacgccgaggtcaagcagtggaaggaggaatttggcgacgaagtggccacaaagctggagatgatggtgcacgatgccatgcccgactatgaatatctccgaagtcgacgcattaccgtctga

SEQ ID NO: 13409 - DNA, 183 bp, A.fumigatus
gatgcactgacgaagaacactcttgatttcagtctgacaaaccacaccgtcagttaccaatggtactggactccgaaggatgcacttaccaatgatggctctagcttcgtctggcgctggagctcggcttggatggctgtgagcttgttctcctgctcaataagggtggacgaggcctcctga

SEQ ID NO: 13410 - DNA, 192 bp, A.fumigatus
cgggccactcaacttggctttgtcaatctgcacacctataccctcgaaccggctgacaaccttgacggctgtcgttttcaacctgagataatgtgtctcaccgacaacatcaaagacgattccacctacacgagcgttcactttccaggagagttggggattggctggaagaatattctcaggcggcggtga

SEQ ID NO: 13411 - DNA, 234 bp, A.fumigatus
cgaggaatgggggtcatagtcgttgagagcatatgtttgaccgggaatgtgatcaacgtatttgatgctgaagtcatggagagtgagagcgagactgtgtcgagtctgcacagattctggtgcgggttttccactggaaacattcccaccgtcacgaaaggcatggagaaccctttgaccgatcttgacaacaagccacccaaccgcattatcaaatcgtatatctacagctga

SEQ ID NO: 13412 - DNA, 3999 bp, A.fumigatus
gccgctggttggctcgtttcgcccgagatggcttacttcttgccctcattcttccagaaacggttgctccgatatgccttgtctcggctcgagcttgtcgacaccgaagcactagatttagatagcctgggcatccgatggggtcaacgaagcaccgtcgaacttcgggatattggcttgaggcttgaggtgagtttctatcgtcggcagatatcacatacgacgagacaaatccacccaccttgcgctctccgtggacgatgtataactaacaactatgatgtctccaaacagaaactagctacgcttcttcagctccccgcctcaagtgaactgctgagtgctaaggtccagtttctcaagatcaccgtccctgcggatatctacagtagcggcatcatctgcgaggctagcggaatcaatgtgcatctccaactaccatcagaagaatctttcagcacagcaaaggatggaaatccaaatagtcggagcccatctaaagctggtacccatgactctagtagcgatcacattcttccgactccagccgatcttgcggagtcgttcctcgatgccgaaccgaaagaggaaaaagaggaactacaagctgctatcacatctcgatcacagatgttacagcgtacatcagcgtccattagcgacgatgaggaggaacttggtctaggaaacgagggtgtatcgctacccagtttcgttgctgcttttttgaagggggtcgcggagcgcctgcaggtcagggtcgataatgtgtcaatacgagtcgatatggaaatgaagcaggaaggcgtcgtcaaaagagaaccggagaataaacctgataacgtgacgggacttcttacggtgcgagaggtctccgtcggtgctgtgagcagcgcaacatccagttctgagcaagagaagcttttccgtaatcggcccatcgtcatttctgatatcaacatggctttgatatctgaaccgatagttttctcgaattattcccgattcgctccgcccgcttcgccgactacacccgtgcagccaaagtcaagcgagccttcgagcaggatcccgtcgcccttgcccgggcacacacctgatgcggactcgttcctagctatgacgcggtcgacaatcttggagacacagcaagaacattggattcaggatatagaagaacccggtgttggtcgaatggagggatccgcctacacatatgatgggcgcttctctgatgccgataccgatgctgaggatcgaagtgatggatacctggaaggcgcgcagcagtttttggacaatgataaattattagacaaccctgcatatcttgactccgtcattgactcccagttgcatgacgatgatttagaaccaccagaggacctcgtgcctcaagatgatcagtttcctcccagcagtgcaaccccgcgccctccgaaacctgaggtgcacatgtaccgcgagacttcaccgtccggaattgacacggagcaaacagctcccttctcacattacggtgatgggttcttcatggacagatccccacacggcagtcagccttacctcggacctgatcacgttgcaacccgaaatgcgtcacattctgcctcctctccttcaggctctttgccctcgcgagaaatctcaaacaggcaaacagcgcctccttctgaatctggcagcataggctcatctgattttgctaacggcggggaactatctgagtccaagttgttctcaactgaagaggctcagagtatgtacatgagtgctatcagtcatgggtcgagtagaagtttcgttcccaatgtaccaggcgcttgggatctgtgggagtcaacagttgcacaagatatgcacgcaggaacgcagctcacagacgcggcagatgcgaaacaggatgtgcaagatgaaacatcgatatctacacctaagctcactgctcaggcagcctcggcctttacagagaaacgatcattcggcgaacaaagtgagtgtctgtctgaggcacgggaacctgatttggcaccgctctcgcctacgctgagcaaactttcagatgttgccaagcggtttctccgtatcgatcgaatatcgatatctatccctgttggtgaagatagacgtcatacagatgagactgtccattcatcagacctaaatttagcaagtgacagcccgaaagactcaacagtgcattctggtcattcatcagccgaatccgaatttctctcttccaccatgtatgcttctgcacggcttcgcagcgactcgatcaattcagccccttcattcgagggcaccttgcccagatcgctgcctcgtcaaggaaagaaggccgaccacgatcccatctcaaaatctcagccaggtgacattgctgtcgaaatatcagctgtagatatacgatttgataatgcggttgggtggcttgttgtcaagatcggtcaaagggttctccatgcctttcgtgacggtgggaatgtttccagtggaaaacccgcaccagaatctgtgcagactcgacacagtctcgctctcactctccatgacttcagcatcaaatacgttgatcacattcccggtcaaacatatgctctcaacgactatgacccccattcctcgtcattttttggcttgccccatgaagatatcattctacgagcggaggcatccggcctaacggcacgctatttggctgataaaagtgctacaaagttcagcctagatgtctcaaagttcgtattcggcttcgcctgggatgacttgatctcattcagtgaaagcttgaagatgcgggagtccacaagagatgtcctagcacctgtgaatggtgatatctctctttctctgaccaagtcttccgactctgcaagcctcaccattacaacacttcctctccggctacatcttaatgttcagcgcctggaagaaatcttcgggcgggttggcggcctcagtactatcctggagctcggaagttcaatctcctctgcctccaccggtttctcaaccgctaaaaacatgcagagggattccccaaggcgggctcgtggcgtgcattttgagagctcaccgccgcctgagaatattcttccagccaatccccaactctcctggaaagtgaacgctcgtgtaggtggaatcgtctttgatgttgtcggtgagacacattatctcaggttgaaaacgacagccgtcaaggttgtcagccggttcgagggtataggtgtgcagattgacaaagccaagttgagtggcccgttacctcttgacgactcaagagatgcgccagcaaaaatcaacctaagcaacatccgtgtggaatttctctactcccccaaggaacccgatctggacaggctgttggcaataataacgccgtcaaaagataagtatgacgaagatgatgacattatgttggatacgctgtttcgccagcgtagacaaggttctgttcttcgtactacagtcgcggatgcaaagatcatcatctcgcgcacgagtgacctcgagtccctttctcagcttgaagaggaattgggcaagttatctaccgtcgcaaagtatctacctgaagacgatcgcccaggcatcctcactcttactctcattcgagaacttgagtgtcaagtctacctgggtggccccgtcggaaatatcacgacccatcttagaaacgctgaggctgcttatatcagcatgccgtcactcatcgctgcgcaactggggacaatcaaagtcgtccgcaacgggagcgaggagctcgtgggtgaagcactaccggcaagcgggagccagggtcaaaaccagagccaacttcccatactgatggctcgctacatcgccgatgagatggatccaactattaagatcaaatctcacaatttacgcgtagaatacaccataccgtccatcatcgcgttccttgggctgagtgaggatcagacgacaggagatgtcgctgctaatatggccaattctttggccaatatg

SEQ ID NO: 13413 - DNA, 261 bp, A.fumigatus
aagactgtgatcggctatcttgagtgtttctgcacccgcattctgaccgtgggtgtccctctcagtggtaggggtgttgttaacaacatggaaaaggcgtcggagccgtcgcaaacccaacccgctcctgaggagccggtcaaatcgattgaggatgatggcaagggcgatagttcttcgacgggcggcgtcaccgacgagcaatggaggtcgatgatggacgttgttctggctatctatgaattcagagaagaggagtag

SEQ ID NO: 13414 - DNA, 1473 bp, A.fumigatus
atccctcacaatgcgcagacatataatcggccaaattcacaagcatacgaggatgcgctcgtcataaaggttcgtaccactcgtaaagactttgactcgatatccgttggtgaataccgtggtgctgatcctctttccccatataaggacgtgttcatagcagaattcgaaaagctggtcaaacaagggatcatcaccgcagaagaagccgagcttcccgatctaggagagattccggaggcggatcctcttcccgaggaggaagatgaggaagatgaggacgatgatgacgaggatgacgaggatgattcggatgatgatggtcgtcgcaaaaagaagcggggcccccgccctggctggaaacgagacgcagggaaggatgatgggcataaatcagccgacccagagctcagaaagaagcggggccggcctccgcgtgtcgatacccccatggaagccagaattaaggcagttttgaaagggatccgcaagctcaaagggcctcttggcatgctcaaggtgcgacactttgaacgcttgccagacaaagctacatatccggactattatgttgaaatcaaggagccgattgcgatcgacattatcaagcggaagtccaagcgcaagaagtacaactcagttgaccattttatgcgcgatatggatttgatgttcaacaatgccaaagcctacaaccagccggacagtcagatatacaaggacgctgttgatttgcaggtggaggcgaggaggcttgctgagattgagaagaggaaacctgatagcgaatatctgatggaggacggtcgtctcccattgccggatggcattctgtacaaaggtgagctctggaaagtgggtgactgggttcatatacagaatccgaacgatgtgaccaagcccatcgtcgcacaaatctaccgcacatggcaggattctgaaggcgaaaagtgggttaatgcttgctggtactaccgtccagagcagacagttcaccactttgagaaacatttctatcccaatgaggtggtcaagactggccagtaccgtgatcatcggatcgaggaggttgtcgaccgctgcttcgtcatgttctttactcggtacaaccgcggacgccctagaggccttcctcccgacaaggaagtatacgtctgtgaagcacgctataacgaggagaagcacaagctcaacaagattaaaacatgggcgagttgccttccagatgaagtgcgagaaaaagattacgagatggacctctttgatgtccctagaaggatcaagaagataccgagtccgatcaagcacttgctgaagagtgatgcaaaggaaactgacgatctgccaaaaccaacctggggcgccgataatgcgccgcccattgttggagcggtacatcgacgtccacgcgacgagaatgtgagtatctcaactcctagttggtccgggagtttcgttcgtagacccttttga

SEQ ID NO: 13415 - DNA, 1032 bp, A.fumigatus
cttggatttatcttgctctctttttttcgacaggaatctccgccacctgaaccgactccttctccgcccccgtcattaccccagccagtactgtcaactgtccctcctcgtctgccagcaattacccaaccctctacgcgaccaagcgtcggtagtcccggctcggctcctgcggttggggctgtccctgtccctgcgcgctctccagctgccccaatacctcctacacagggctctcctcttcctgcgcctccagttgcctaccaacagcctcaagtaccaccagtccaggtttatcagccagctctgcagaggcgccctagcgcgtttgtaccacaaactcctcactcccctgcttaccaaccttcgccggtaccgcacccgtatgcggcggctcagccaaccccatatacgccatatcaggcaggtcgtgtgcacgtaccgcctgcgtcggtgtacaaccctaacgcgcctcgtccaattgaggtcttccgcctcagcgaggcggcaaatgcagcaatccccgaggatattcgtgaacagtttcattgtgacgactcgggccatgtgcttttcttctctgctccgccactcgatatcgtttcatcccttcagcaaaaactaggtcattccctaaaatatctggctgctaaggcggaacgtcggaaacttgtcgagcagcggaaacggaaagacgatcttgagagagtcgagcgagaggagcgagtcaaacgcctacgtgctgatgaagagacaagcctcgctgcccatgtagaggcgttgaccgccaaagctattgagatcatgacaagccatgtcatgattggcacggaaaaaatctacgatcatctatactcgaaccaagcagagacagcgaagcaagcggatgccgacgctcgcgcacgcaggatcacagctgatcacatctcccaagagaagacggctcaaatccaggcttattccaacaaagcgaccactgttagtcttaaaggtagtgctatgtatatggacgatattgaccccacgatctag

SEQ ID NO: 13416 - DNA, 324 bp, A.fumigatus
ctttcttcgctttacagtggccatgacccgtcaagactgtttcagcgcagcgtgaacaagcgcaatgttcctgattactatgagatcatcaaagaacccatggctctcagtatcttgaaacagaagataaacaagcgagagtacaagaacttcgcggagtttgtgcgagactgcgctctggtaagtttcgcaccctttttgttattatggaaccacctagtcataacttttactcatgctgttatcttctcttttagatccctcacaatgcgcagacatataatcggccaaattcacaagcatacgaggatgcgctcgtcataa

SEQ ID NO: 13417 - DNA, 558 bp, A.fumigatus
tccggatatgtagctttgtctggcaagcgttcaaagtgtcgcaccttgagcatgccaagaggccctttgagcttgcggatccctttcaaaactgccttaattctggcttccatgggggtatcgacacgcggaggccggccccgcttctttctgagctctgggtcggctgatttatgcccatcatccttccctgcgtctcgtttccagccagggcgggggccccgcttctttttgcgacgaccatcatcatccgaatcatcctcgtcatcctcgtcatcatcgtcctcatcttcctcatcttcctcctcgggaagaggatccgcctccggaatctctcctagatcgggaagctcggcttcttctgcggtgatgatcccttgtttgaccagcttttcgaattctgctatgaacacgtccttatatggggaaagaggatcagcaccacggtattcaccaacggatatcgagtcaaagtctttacgagtggtacgaacctttatgacgagcgcatcctcgtatgcttgtgaatttggccgattatatgtctgcgcattgtga

SEQ ID NO: 13418 - DNA, 606 bp, A.fumigatus
ctccacacctactctgggctagcgcgtgttcacaaaccacgtcgcctgttattgaaggttgggcgaaggggggctgttcaagaagcccttctcatccttgagaatatgacggaccctaatcgtcctccgtttttctcctatggatcctatccatcttcatcagatttccgggagaatgagcctgtatacagtgactggacatcttctcagttcccacaggcacactttggaccacagatcaattatgaaccgtcccctagctatgtcgaaaaccccgcaggcccccgagttggcactgcggaacgatctgtgaactccaaagttgccatcccccggtcagcgaaccccagtagttggaccagcagcgggcgagttagccgggcctgcgaaaactgtcgtgagcagaaagcccagtgtaacggtcatcgcccaacctgtcaaagatgccaggagtcgggtatccgttgctcatatggcgaccgcaagcgagagaagatggcaaagtgcgtttttttttttttttttttttttttttttttttttttttttttttttttttttgccattctcttctttgttctgagaagatcgagaagattttcctaa

SEQ ID NO: 13419 - DNA, 270 bp, A.fumigatus
actccaaagttgccatcccccggtcagcgaaccccagtagttggaccagcagcgggcgagttagccgggcctgcgaaaactgtcgtgagcagaaagcccagtgtaacggtcatcgcccaacctgtcaaagatgccaggagtcgggtatccgttgctcatatggcgaccgcaagcgagagaagatggcaaagtgcgtttttttttttttttttttttttttttttttttttttttttttttttttttttgccattctcttctttgttctga

SEQ ID NO: 13420 - DNA, 438 bp, A.fumigatus
ggggtggtcggaatgacaatcacagatgactccgatgagggtaaagtagcttctgcggacgacgaagcaatcgcggacgaatgctcttcccctgcaggtgttggcgatgctgatatctcagtagtgctagacgtcccactatcggctgtcgcacgagaactgtccgctgcagatgagggcaaaggaatttctgtagataccaacggagtgattgtccccaagtacccttctgctggaagtatcgacgatgcaggtatctcagtagagctggacgacccactatccactgtggcacgagaactgatccctgtagacgaagccaaagtagcctctggagacaacaacggtgcaactgtccccaaatacccttctgccgaaagcactgacgatccaggaacctcagtagaggcgtacgaagcctgtggcaccgtcgtctga

SEQ ID NO: 13421 - DNA, 1833 bp, A.fumigatus
atcttcaaaatgcagttaatgcacttcaacaacgcgttcgctcttttcgcaataacgtgctcggctggcccgatcgcccagtttgcccacaagcttcgagatctggaacaaagcagccagagtcctggacatatagcatattctagcctgctgccactcgataaacatgtactagcggccttagatgaagcgaatggtggtttggatgtcattcctattactccttccgtgacggcggatggtactcagacgacggtgccacaggcttcgtacgcctctactgaggttcctggatcgtcagtgctttcggcagaagggtatttggggacagttgcaccgttgttgtctccagaggctactttggcttcgtctacagggatcagttctcgtgccacagtggatagtgggtcgtccagctctactgagatacctgcatcgtcgatacttccagcagaagggtacttggggacaatcactccgttggtatctacagaaattcctttgccctcatctgcagcggacagttctcgtgcgacagccgatagtgggacgtctagcactactgagatatcagcatcgccaacacctgcaggggaagagcattcgtccgcgattgcttcgtcgtccgcagaagctactttaccctcatcggagtcatctgtgattgtcattccgaccaccccctactcacattcggcgtcccacccagcgtcaactccgagtgtgtacaattctacaacctcaacctcgatccatcttatcaagcacagaccgacggcagaaccttcatctaggcttttcgcatttacacccatttcaatcgttatcgtttcaccaagctcggtcccagcaagcacacccaccacgacacccagtctgaccgttggtgtcgttggaccattgtctggtgtctggacggccagctcgtctcctccagctactctctttgcaacggctctgtcagagactccttctttaacgccaacggtgaccgaaaccgcgacgtccagccagactgccagtgtcgtagaaccgcaacctgagacagatacaaccatgtcttcttcctcttcaacagcatctacatcctctcatccagacgctacgccaaccgaggcagcaggccagcttcgcaccacttccagcgcagagtccacacccaccacgacacaaagcgcaagtacagccgagagctcaagtactcgcccatccctcagctcagcaacaccagcccccttcatcggagaattcacaagcagtcagctccagagcgctagccatacaaccagcacccacagtcacatcacccccgtcctcacaccggttatcgtcctgattacaccaggcgcagaaccgaccgccccggcgacgacaacgacgaccacaaggcacccagatccgtacgccaacgccaacgccaacgccaacggagatctaacaagcagccctgcatccggccctacggaaggagcggagataaccacaatccacgcgacagcaaccataaccaagagcgtggttgtatttgcttccagcattcctacggctgagacgctagctccagctgctaataccgaggagtctgagtcgggggtgggctcaaggacagcacttacgactgctacagtgacatctctgccttttgcaccctatagagatccgggtgatgcgtatctgtccattgtgcctgttacgccgggggtgatgactgtgacctctaccaagactgagactgagaccgaaacggtgactaaaacggaaagggagactgtaacgcagactgttacggagactctgacggagaaggagactgtcattttgcgggggagttag

SEQ ID NO: 13422 - DNA, 228 bp, A.fumigatus
gatatcagcatcgccaacacctgcaggggaagagcattcgtccgcgattgcttcgtcgtccgcagaagctactttaccctcatcggagtcatctgtgattgtcattccgaccaccccctactcacattcggcgtcccacccagcgtcaactccgagtgtgtacaattctacaacctcaacctcgatccatcttatcaagcacagaccgacggcagaaccttcatctag

SEQ ID NO: 13423 - DNA, 249 bp, A.fumigatus
gcttttcgcatttacacccatttcaatcgttatcgtttcaccaagctcggtcccagcaagcacacccaccacgacacccagtctgaccgttggtgtcgttggaccattgtctggtgtctggacggccagctcgtctcctccagctactctctttgcaacggctctgtcagagactccttctttaacgccaacggtgaccgaaaccgcgacgtccagccagactgccagtgtcgtagaaccgcaacctga

SEQ ID NO: 13424 - DNA, 1563 bp, A.fumigatus
ttcattgcaattttgtttgtttctttttgtgtaatgaggttgagtaggcggctgacggttgatttcaagcgtttagtggagcatccggattccattgaaggccgcgaaagacaacgcgagagagacgtggcccgtgaacgggaatgggtcggtgactcgagatcgagtccagaacctgatcttcgatcacccattgaacgattcagaaagccacccaacaaggccttttccgtaacggatctgatctcccctgcatggtgcgagctacagtactggtataccttgaccaagcatgggaggaagaggagaacgcctgctatgaagcaggggagtactattcacaaaacgcttgaggatgaggtacacacgactgttcccgtggagatcacaaccaaggaagatgcgttagccttgaggctgtggaatgtcatacagggcttacggacgctgcgagaatatggtcttactcgggagctggaggtctggggtcttgtggatggtgagctggtcaatggagtcattgaccagctctcgtatgagtgcccagacccagagcttgaggcgacagccgccacatactatgccgatgtggaggcgtccagggcggtaatgcccgagtatcagatgtctctgacagattacctgctggctccctcacagggcgggaagaggctgtcagagatgacgtggaaggatgaacctgatgagcatgtcgaggatgctcccagtaccgaatcgtcagaggcgtttaacatccctcgagtctatctcacagacatcaaaacacgagccagcggctccatacccactatcaagagcacgtcatttcggccgacgctgctccagctccaaatttactaccacatgctgaaccatttgaccaccaccgatgaggtgtccattgagacgctcgcctctcgctacgatttagaccctcaacgtactttcaccgacgcttttatcgccgaagttggcggcctaaatgatcaattcttcgacgctctttcagcctccgaattcgatccagacttcatcccctctccggaagatgcggcacgcagacagtccatccggtcatcgggatccctcccctccgcaagccaggactcaaccagtatcctcttggaacacaataacctgtccagtctctggaaattcatgaaagaccaactccgccttactttccttccctcgccgcagccctctgtgtccgttgcgccctctatcccctcggaattccagcctagcatgctagaaccatacccgacgatcatatcacctcttctgacagcacgctatctctcctcggcacccacggcagacctccacacccgtgtcctgggcagccgtagctttcttttcgatccaacctccatgtcatcctatctctccgatcagatggactggtggcgcggtaatcgtgacccgcgcggcgtcgagatcatggaagcatggaaatgccgcatatgcgaattccgcgaggaatgctcttggcggcaggaaagagaatggtccatagcgaggcggaagaagggctcgaagggtcttgatgctactgtgtga

SEQ ID NO: 13425 - DNA, 777 bp, A.fumigatus
  unsure (102): Identity of nucleotide sequences at the above locations are unknown.
cataccttccccggaaagataaccccttcccatgtttccgcaaaacccgccaccaggcattgcccaaaaactattcattggggattccttttaacaccaccnaggggccccttccccggagacccccagggggacttgcgcgggaattcatcccaagagaacctggcacttatgttcgaaaagcccgagggcgagtattacctcttcgcaggcgcgatctttctcgccggcttctggcgcctcgaagacaaattcggcatgcgcctctcagagatccacacctccggcgacgtgccgggcttcaagaccaagctcgaaaagggtatgatgaacttcttccgccggattcggcctgaagaccccgtgcttcgcaacaactacttcatccaggtcgacaacgagctcgcctggtcgcatagtatcgggtccgaggacgcggccgtcgtctcgtggaacaccgcgcagaagaacaaggccatcgagcatcattacttccggtccgagaggcagagtctgcgccggctgccgcggtccggggcggtggtgtttacgatcaggacgtactttgagccgatcacggagattgtgaaggagccgtatgtgcctggtcggcttgcctctgcgattcggagttgggatgcggatgtggcgcggtacaagggccgggaaaagtacgaggaggtgttgctggagtatctggataagaagcacgcggagcaggttgctgcgggcctggatctggacagggaggatgaggttcgaagttatcctttttga

SEQ ID NO: 13426 - DNA, 414 bp, A.fumigatus
cgtgatgtggagctttcaacaaatcccgtcacgatggacaggaagagcgctaacatgatcagttggttccccatatactttccactcaaggtgagcattcatgcatgtcttcgagatatactcgcatctaacaacgggcttctagacgcccctcaatgtacccgacaatggggaaattgttgtcactatgaccaggcagaccgacgaccggaaagtatggtacgagtggatggtcgaagtattcgctctggaacgcattgcagatgcaccggcaatagaattgcccatcatgagcggcgcacgggcggtgtctccagctgcagacggtgcccgcggcaaaggcaatggcaccgacaagccacagaaatctggaaagcgcagcggtttccgacgagtgagggttggaatgagtga

SEQ ID NO: 13427 - DNA, 954 bp, A.fumigatus
catttttcatcctatccgcaggctgcttcgcgaaatctccgggaagccctttccttagcaccagaaaatccaactgttcaagctgccattatcaagattcagcaagaggaaaataatggccactacctgttagacctctgccgccgatatacctctggaaaggacgagaatgcgggaaaggatgcagctatctatctccgcaccgatggtcttaacccctcagaggaggtggctttggaatccgtcaaactcatactagcgcgcgaaccttctagcctatcttcgctccaagatgatattatctcgggattggtgcgccagaacgccagcgtgcggcaatacttttcggaccgacttcaggtatctgtcacgactttctttgacgagatttatgatcggggtgatggggcggcagtctgtctggatacggtggtcttggatcatgccgtgtggccatcagaggatacgcgcctccactgtgaaagcgaactctttcagctcttcatcgctaagctcatggaatcgggacatgacttggatggtcggtccctgaaaggcattgcgcgcctactcgcggtcgatgcggtcaagctgcaacatcttgttgatgacgaaggacttgacgtgattcttgcctccttggacatccgacttcctctcgaggtgaggaaccaggcgactctcgcgacagtcaagtacctcgaatcttcgaagcaaacgggacaggagcgtttctcgcgacttctttccacgaaagtgacgaatgcacgaaatgacgaccacatagttgcgttctccgccctcgctgccgttttccctgttgtgccagatattgcggcctccctgttcctgtcggaaagtttcattagttctctcacgccatttacctcgaagaacctgaacagccggaacgtagaaaccgccattctggaactgcctattgcgcctgcataa

SEQ ID NO: 13428 - DNA, 951 bp, A.fumigatus
ctaccactaccgttgaggactcgaacaccgagactcgagtggtcgtgcccactggaactgtgcctaaccatcctctggttccgacttctgtcccgacttctgtcccaactcaaaacgcgacttcaatcccgacttttgtcccgactcaaaacgcgacttctgtcccgacttcagtcccgactcaaaacgcgactactattgtgccacctccaaaggttgtcccaacgggtgtccccggccagaacactactgttgtcccaccccccaggcccgctcctttcaccaacagcactgttcctccccctgtgcagccagttcctgttgcccctggacagcctacagctcctagccagccttctgtccctggtcagccctctgttcctggccagccttctgttcccggccagccttctgttcccggccagccttctgttcccggccagccctctgttcccggccagccttctgttcccggccagccctctgttcccggccagccttctgttcctggccagccctccgttcccggccagccttctgttcccggccagccctctgttcccggccagccttctgctcccggccagccttctgctcccggccagccttctgttcctggccagccttctgttcccggccagccctctgttcccggccagccttctgttcctggccagccctccgttcccggccagccttctgtccctggtcagccctctgcgcctgagcagccttctgttcctggccagccctctgtgcctgagcagccctctgctcctgagcagccctctgttcctggtcaacccactgccgtctcgccgccgccagctgagactgctctcactggctctgcttcccagttcgagcctgccgccggtctcctggctggtatctgggttgtcatgctcatgctttagagcatccatcgatggccttccgtattcaaggtga

SEQ ID NO: 13429 - DNA, 378 bp, A.fumigatus
ccagccttctgtccctggtcagccctctgttcctggccagccttctgttcccggccagccttctgttcccggccagccttctgttcccggccagccctctgttcccggccagccttctgttcccggccagccctctgttcccggccagccttctgttcctggccagccctccgttcccggccagccttctgttcccggccagccctctgttcccggccagccttctgctcccggccagccttctgctcccggccagccttctgttcctggccagccttctgttcccggccagccctctgttcccggccagccttctgttcctggccagccctccgttcccggccagccttctgtccctggtcagccctctgcgcctga

SEQ ID NO: 13430 - DNA, 1098 bp, A.fumigatus
gcctcactgggtcaccaggacggcaacgtacttgaccacaacctgcccaggtatgatgctccacctgaccttttcaagcgcatgtgtcttaatactatcatcgcagtttcccacacgaaagtcacttctggaaccaagactttgactattcctatcactctgactagtacaatcactgtgactaccactaccgttgaggactcgaacaccgagactcgagtggtcgtgcccactggaactgtgcctaaccatcctctggttccgacttctgtcccgacttctgtcccaactcaaaacgcgacttcaatcccgacttttgtcccgactcaaaacgcgacttctgtcccgacttcagtcccgactcaaaacgcgactactattgtgccacctccaaaggttgtcccaacgggtgtccccggccagaacactactgttgtcccaccccccaggcccgctcctttcaccaacagcactgttcctccccctgtgcagccagttcctgttgcccctggacagcctacagctcctagccagccttctgtccctggtcagccctctgttcctggccagccttctgttcccggccagccttctgttcccggccagccttctgttcccggccagccctctgttcccggccagccttctgttcccggccagccctctgttcccggccagccttctgttcctggccagccctccgttcccggccagccttctgttcccggccagccctctgttcccggccagccttctgctcccggccagccttctgctcccggccagccttctgttcctggccagccttctgttcccggccagccctctgttcccggccagccttctgttcctggccagccctccgttcccggccagccttctgtccctggtcagccctctgcgcctgagcagccttctgttcctggccagccctctgtgcctgagcagccctctgctcctgagcagccctctgttcctggtcaacccactgccgtctcgccgccgccagctgagactgctctcactggctctgcttcccagttcgagcctgccgccggtctcctggctggtatctgggttgtcatgctcatgctttag

SEQ ID NO: 13431 - DNA, 549 bp, A.fumigatus
gcggaatgcgccggttctgtagacggaagacgcaagcatgcctgtgagagcgtcaacaatgggttcaatcagctcaagacacagggtggtttcacggtaccccaggcagtcctcgagggccccaaggccgagtttgagagcgagcgggtgagcaacggcgagaccattgaccagattaagtccacctacacctcttcgttcccctccaatttcggccctggcagcgccaagagctccaagactggcggttacattctcgaccctcactctgccgtcggtgtgcgggcagctctgcggtctatcgagcggaatcctggtgtcaagcatatctccctctccacagcccacccggccaagttcgccagcgccgtcgacctggcccttggcgccgaagacgggtatgacttcaccgaggttcttcctcaggaattcatcgggctcgagcagcgcgaaagccgagttactcctatccgcgccggcgccggatgggtaggtgtccgggaagtagtcaaggccgaagtcgagcaggagctgcagggcttgaggtag

SEQ ID NO: 13432 - DNA, 495 bp, A.fumigatus
gagcagtctcagctggcggcggcgagacggcagtgggttgaccaggaacagagggctgctcaggagcagagggctgctcaggcacagagggctggccaggaacagaaggctgctcaggcgcagagggctgaccagggacagaaggctggccgggaacggagggctggccaggaacagaaggctggccgggaacagagggctggccgggaacagaaggctggccaggaacagaaggctggccgggagcagaaggctggccgggagcagaaggctggccgggaacagagggctggccgggaacagaaggctggccgggaacggagggctggccaggaacagaaggctggccgggaacagagggctggccgggaacagaaggctggccgggaacagagggctggccgggaacagaaggctggccgggaacagaaggctggccgggaacagaaggctggccaggaacagagggctgaccagggacagaaggctggctag

SEQ ID NO: 13433 - DNA, 816 bp, A.fumigatus
caaaaatgtgcctttcccgcctgtatggcagccagtcaccttgaatacggaaggccatcgatggatgctctaaagcatgagcatgacaacccagataccagccaggagaccggcggcaggctcgaactgggaagcagagccagtgagagcagtctcagctggcggcggcgagacggcagtgggttgaccaggaacagagggctgctcaggagcagagggctgctcaggcacagagggctggccaggaacagaaggctgctcaggcgcagagggctgaccagggacagaaggctggccgggaacggagggctggccaggaacagaaggctggccgggaacagagggctggccgggaacagaaggctggccaggaacagaaggctggccgggagcagaaggctggccgggagcagaaggctggccgggaacagagggctggccgggaacagaaggctggccgggaacggagggctggccaggaacagaaggctggccgggaacagagggctggccgggaacagaaggctggccgggaacagagggctggccgggaacagaaggctggccgggaacagaaggctggccgggaacagaaggctggccaggaacagagggctgaccagggacagaaggctggctaggagctgtaggctgtccaggggcaacaggaactggctgcacagggggaggaacagtgctgttggtgaaaggagcgggcctggggggtgggacaacagtagtgttctggccggggacacccgttgggacaacctttggaggtggcacaatagtagtcgcgttttgagtcgggactga

SEQ ID NO: 13434 - DNA, 225 bp, A.fumigatus
cccagtgaggctcagcagtggctggccacttggtgggaggggtgtgaccagggtaaccagaatgaccctattaccgcaatgtcagtgtcctccatgcagaaggtaagagaggctagggcgggctacgcatacctcgtcattgcccttgtttggcacaatgccacccaaggctggcccagccagagccagaagtgcaatgccagagttgaccattttgaaaattga

SEQ ID NO: 13435 - DNA, 465 bp, A.fumigatus
ttacagctcatctggggccctctatgcttttttgtagcatacctgattctcgaccaacattcactccgtcatccactgcaactgatcgtctgcatgagccatctgtacggtgatacattgtactatgccacgagcttatacgatcactatgtccatggacggtcttactgtcgacctgaagcgtactacttttggatctactactttctcatgaacttcatctggatcgttatccccttctgtaagttccaacacctgggtgtggaggccaagacacgctcatttaggtcacagattacctttctcagagtgtcaagacaatttccaatgccatcaacgctttgcagcgaatgtctgcagaagaaaaggctcgataatgctcgacattgtcgcacagatggacttccggttgaagcatacgactacagctggatattgattcgatcggaatatggatggatgtga

SEQ ID NO: 13436 - DNA, 2715 bp, A.fumigatus
gtcctgcttgatcccggcgtagacacaattgccacgatcctcgccatacttcgcattggtgccgcctatgtaccgctcgatacacggagctccgatgcagttctatctgatattctacaagaatcccagccaggcattgttatccaccacagcgccaccgccccacgcagccagatccttttcaaagcctccgccaaaaccaagctggtcactttgaacgccgtccctcagaagaccatcagaaagatccaagacgtttcagttcccgagggccttgcaatgatcctttacacaagcggttctactggtagtccaaaagggatcccgctgaccaacgccaatatccgaaccccgatcctcggcgtttcagagagagtaccacttgggcgagaggtggttctccaacagagtggacaagggttcgatgccgcagtctaccagatcttcattgcccttgccaacggcggcaccttgatcatggttgacaatagagatgatcctgcaaaagttgccgcgctaatggcccaggaatccgtaacttgcaccacccacattgtctctgagatgcaagctttgttgaagtatgggtacgatgagcttcgcaactgctcctcctggcgcattgcaatggttgctggcgaggcgttcactgtccacctcttggaccagttccgcgctctcaaccggcctgacttgaaggtaatcaacgcgtatggtccgactgaagcgtccatctgctcttccctgggcgaagtgtcattcaacagaatcagctccagtgaaactagcattcccatcgggaaggctattcccaactacggcacctatatcgtagatcagcattgcaaacctgtgccacttggctggcccggtgaggtcgcaattgctgggcctggcgttgccagtgggtatctcaacctcggtgagctgacccaggctaaatttaggtctacggccaccctgggagaagtgctgggatcggattgcctttatctcactggcgataggggtcgaatgctgtctgacggctccattgtcctctctggtcgtgtagatggagacgatcaggtcaagattcgaggtcatcgagtgcagctcggcgatgttgccagagctcttgtccaagcctcccgaggcgtctttgcggatgcggctgttatcctgaagggagacgatacatcaaatccgcagctcgtggcttacgtcgtcttctcccgaaccagcaatattcaggaccagcagacatatctgcgtcaactgaaccaagatctcccagttccagcgtacatgcgtccggcaatcaccattcctctggatactctgccggtgacagaccgtggcaagctggactccaagaagctggcgtcgttgcctcttcccagcatttctgttgactacgaagaggacgagcagcttacaccaacagaggcgcgattgcgagatgtttggaagaatgtcttgggtgacatcgcttcatccattccaatccgccgtagctccgacttcttttccgttggcggcaactccctgatcctgctggctctgaaggctgagatcgctcaagtctttggggtgggactttcagtctccgaacttttccaagccagcacacttgagcttctcgctgcaagactcgacggaacttctttgttagcacagatcaactgggaggaggagacagccccggatgagacgcagttcacaatacccccgcctatcaacggaatcaacggacatggatcatcgaatggccatgcacaagggatatctgttctccttactggcgccacaggctttttaggtggtcatgtccttcgccaattggtgcaactgcccagtatcgagcatgtacactgcgtggccatccgtcccagtaaggttgatgtacgccgacaactgagtgtggaatcacccaaaatcattcgttactctggtgatctggccctcccgaacatgggcatgagcgagtccgagttctccgatctattcaagagtatcgatgtcattgttcacaacggcgctgaagtctcgcacatgaagaactatcgcagtctgcgggccgccaactttctgtcgacagtcgggctggcgcgggctgctgtcagccgtgggatcccgattcattacatttccacagggggagtcgcgcgcctgagtgtcgctgacgagcaacccgaggcatcgctggcagcgtttcaccctcccatcgacggatcagacggatacgtggcttccaaatgggccagcgaggtctttcttgagaaggttcaaagacgcttccaaggccaggtttggatccaccggcccagcagcatcaccggtgacgatgtcccggacaatgatattgcgcatagcctgctcaagttctcgagggagctcggggctgtgcctgagctaaccggaagtgggttcttcgactttatcaatgtcgaaactgtatcaaacaacattgctgctagcgtggtcagaagcagcgaaaagagcggtggcggcctgatctaccttcaccaaagtggtgaacaagtcatccctgtcggagacttgcagaagtatgttgaagaactggaagggcgaccattgcaagttctgccattgaaggagtgggtggatttgtcgatccgcaagggcttggacgaggttctggggtcctacatgttagcctccaagggagtggttcgggcacctctgttgcagagaggtcctcatgtcgagtag

SEQ ID NO: 13437 - DNA, 417 bp, A.fumigatus
ggggagaggagacagaaggagaaacaattgccggcaacattctattgcgaggaacctcccttcttctcttccttctccttggccgccaagtcttctgactgtgtctgctcggccttatcgccttccttctcagcctcaacagcctcgttggattgcttttcttggctgttcgaggcctcaaactttgcgtcctctgtttcgtcgatatcctcaatgtcctttggggtcgtaacgcccttctcttcatgcttgctgttctgctcattttcctcctcgatgagttcttgctgctccttgataacctcaagacgctgcttgttggtggcagcgccctcggcattatggacctcgagctcaatttcgtggaacaactcttcagggatactagacagcacagacttgagcgcttcaatctga

SEQ ID NO: 13438 - DNA, 1140 bp, A.fumigatus
gtcttttgctacccttgcgaagtaacgctagtggcctcaactcacacactgaacaatcagcttcaacgaacggtgaaagatcttggccggttgatcccattctcgatgttcgtcattatccccttcgccgaactgctacttcctgtcgccttgaagctgttccccaacctgctgcctagcacctacgagggccagaaagcacgcgagaaaaaggctcttaacttgagctcaacccggcaagaggtttcgacctttctgaagaatactctccgagagagtggtctccctgtgactcccgccgctgtgaagaacgaggaatttggagaattcttcaagaagattagaacaaccggggaaaccccctcaaccgaggacgttatcaaggtttgcaagatctttaaggatgacttgaccctggacaatctgtcccgccctcaacttgtcgccatttgcaaatacatgaatctaaattcgttcggtacggacgccatgctccggtacaacattcgacaccgtatgcgtcagattaagcgcgatgaccgcgcgattttctacgagggggtggactcgctctctgttccagaactgcagatggcttgtgcctcacgtggcattcgtacgcatggtatttctcccgctcgcctgcgggaagacttggcgatgtggctggatctgcgcctcaagcaaggcgttccgtccacgcttctggtgctgagcaacgcgtacgcatatgcacagggcggcaaggaggcagagatggcgtctcagattgaagcgctcaagtctgtgctgtctagtatccctgaagagttgttccacgaaattgagctcgaggtccataatgccgagggcgctgccaccaacaagcagcgtcttgaggttatcaaggagcagcaagaactcatcgaggaggaaaatgagcagaacagcaagcatgaagagaagggcgttacgaccccaaaggacattgaggatatcgacgaaacagaggacgcaaagtttgaggcctcgaacagccaagaaaagcaatccaacgaggctgttgaggctgagaaggaaggcgataaggccgagcagacacagtcagaagacttggcggccaaggagaaggaagagaagaagggaggttcctcgcaatag

SEQ ID NO: 13439 - DNA, 183 bp, A.fumigatus
ttgctggtgatgtattgtctcgatagatatcaggaagttcgacggaggtttgaccattggggagggtcccttcgcagtggcccactaccttatctgttctacattatgattatattcatggccccctctctacctttccttttcttgttgattaatttcgttgacttgctaaaatcgatgtaa

SEQ ID NO: 13440 - DNA, 486 bp, A.fumigatus
gcaacgcgtacgcatatgcacagggcggcaaggaggcagagatggcgtctcagattgaagcgctcaagtctgtgctgtctagtatccctgaagagttgttccacgaaattgagctcgaggtccataatgccgagggcgctgccaccaacaagcagcgtcttgaggttatcaaggagcagcaagaactcatcgaggaggaaaatgagcagaacagcaagcatgaagagaagggcgttacgaccccaaaggacattgaggatatcgacgaaacagaggacgcaaagtttgaggcctcgaacagccaagaaaagcaatccaacgaggctgttgaggctgagaaggaaggcgataaggccgagcagacacagtcagaagacttggcggccaaggagaaggaagagaagaagggaggttcctcgcaatagaatgttgccggcaattgtttctccttctgtctcctctcccctcaccttctgcccgagatga

SEQ ID NO: 13441 - DNA, 651 bp, A.fumigatus
ccgtatttcgctgcggccggtgggcacttggtatctcagcaccgcggctatgccacagaaacttctacttcgacatcatcgccctctaacccattgccgcctccgggcttcaacgccgaacaggccaagaagcccattcccaaggaagatgtgtcgcgacttgcggctgacaacgggaacacgcaggtcgctcccaagtcagagacacctcttgcatccgagaacagcgtagatgtacagaagcgcgccgagctggaagcggcgaagaaggggctggcggacgatgataagaaagtgactgaggcgaaaaaggagcagaagaagttgacgattgggcagaagatcaagaaggaagttcagcactactgggatggtacgaagcttcttgctacggaagtcaggatcagttcgcgactggcgttgaagatggctgctggatatgagctcagccggagagagtaccgtcaggtaggtcttttgctacccttgcgaagtaacgctagtggcctcaactcacacactgaacaatcagcttcaacgaacggtgaaagatcttggccggttgatcccattctcgatgttcgtcattatccccttcgccgaactgctacttcctgtcgccttgaagctgttccccaacctgctgcctag

SEQ ID NO: 13442 - DNA, 804 bp, A.fumigatus
gggtctagtttatgtgaaggcaaactcccacttgaagatccagagcttgcctatattggacaatctggtaagaaatacttcttaatatcttatatggatcctctagacatcagccctgacacatgtgcggttcagtctactcaaattctctctcttctggccaaatccacctatcaggacattacctcgtttgtggcagagccggagtcagaaaacggacaagcttatgcgaccatgagatctctttttgatcatacaaagaaagtgtattcctctaaggaatctttcctgtcaccgactgaacttggtctcacggaaccttcgcaagttgacatcatcagaaaagcaaacctggcctcatttgtttcaagcatctttggcacgcaagaaatcggatttgctgaactgaatgagcattttctggacgttttcgtccccgaagggggccgcctgttgaaagtgcaaggggctctgtttctggagctcaagacccaagcgttcatagcctccatgaataacactgagagaacaaggaccgagttgctatatgacctgtttccggatgatctggagcagcggttacttgaccgacggccaggaactcgtcagctagcacctagtgaggctgatttcgtgaaacgtgccggctcacgtcgggatattcttttgaacgatatcaacaacgaagaagcaatgaaagctttgcccgataagtaccactgggaagattttcttcgagacctgagctcgtacattacgaagaatttcgatgctatctgccatcaacaggtttgttttctgtga

SEQ ID NO: 13443 - DNA, 267 bp, A.fumigatus
ggcgcaggtgtagggcttggggagaatgtgagacggacgggacggcgtgatagatttttcgccggtagccggaagcggtcaggagggacgaatcagatgggcgaaactgtgaatgcttctactttgtgggtgtattctgtctgttcaattattaactattcgttcgataaggtaaactactatggagtactatttttcaaccgtcaaggcaaattgatctcagttacaaatctagattcctcttgcttgacgaacaggcggcaataa

SEQ ID NO: 13444 - DNA, 2334 bp, A.fumigatus
agaccatccaccaattccacatacttggccatcccaggctcagttgccttctcacactcgcgtggacgggcaattgcggccagcatcggggccctggatgttcgagctcagtggatccactacgtccacgctgaacgacctttggatgctcagcaacagggcgtcttggagcagttgctccgttacggcgatatcaccgatgttcccgcctcattcggccccgaggacggttccttcgatgtcttttatgtctttccccgcactggaacgatttccccttggagttcccaagccactggtatctcgcatgtgtgtggcttgcgtcagtacgtgaagcgcattgagcggggtatcaagatctcatgccttcgcgagaagtcacaagagttcaagcctggttttgaggatgttctccacgatcggatgacccaattgctcagccaaactgagcccgacctgcacctgatgttttccgaacatgctccccaaccgctcgagacgattccccttcacggcagcgacaaatctcccaaggaagtactacaggaagccaacaagcgactagggctggcattggaacaatcagagattgactatctcgctgatgcttacgggcccaatggtcccctcgcgcgtgaccctaccgatgtcgaactgttcatgttcgctcaggtcaactcggagcactgtcgtcacaagcagttcaacgcttcctgggtgatcgatggcaagcagatgccaaacagtctcttctccatgatccgcaacacgcataagaagcaccccgatcacaccattagcgcctacagtgacaacgccgccgtgcttgagggacccaacgccgcattctgggctcctgacccattcactggcgaatggaaccacacaaaggaggtcgtccacttcctggctaaggttgaaactcacaaccatcccactgctgtctctcctttccccggcgctgccaccggctcgggtggggagattcgggatgagggtgcagtcggcagaggctccaagcccaaggccggtcttgctggatactgcgtttcggatctcctgattccggatctgaagcagccttgggagctcgatgttggcaagcccaaccacattgcgagcagcttggacatcatgctggaggctcccattggcagcgctcactacaacaatgagtttggtcgtccctgtacgctggggtacttccgtactcttctcacacagattgacgtcggcaacggtcagactgaggttcgtggttaccacaagcctattatgattgctggcggcgttgggacagtccgaccacagcatgctatcaagaaacccgaggccgtcaagcccggctcctacctcgttgttctgggaggtcctgccatgcttattggactgggcggaggcgccgcgtccagcgtcgcatccggtgaaggatctgcggacttggacttcgctagtgtccagagaggcaacgctgaggtgcagcgtagagctcaggaggttatcaatgcttgcgtggctatgggggagaacaaccctatcaagttcattcacgacgtcggtgccggtgggctctcaaacgcgcttcccgagctgattcacgattcgggactcggtgccacttttgagcttcgtgaggtcgatagcgccgacaagagcatgagccccatgcaaatttggtgctgtgaagcccaggaaagatatgtcctcgcagttggcgaggaaggcatgaataaattcaccgccatcgctcatcgtgagcgttgtggtttctcggtcgttggccgtggtgagggtggctctgaggaggacaagagactcatcctccttgacagagactccaccgagtatcccaaacccatcgacctccctttgtcagtcctcttcggcaagcctcctcggatgacaaggactgtggactcccgcaaactgaaactccccgccgtcgatgccagccttaccagctatcttccttcccttgcgccgaatcgcgtcgagctgatcagcgaggctgccaaccgtgtcctttccttgcctgctgtaggctccaagtccttcctgatcacaatcggcgatcggaccgtgggtggtcttactgctcgggaccagatggtcggaaaatggcaaaccccggtctccgacgtctccgtcacagccactgcgttggttcagggaatgaagactggggaagccatggccatgggtgagaggccgactcttgctcttatttctccggccgcatcggctcggatggcagttgcggagtcgctcatgaacattgctgcggcggacttggtcgaccgcctgaaccatgtcaagctttctgccaagtcttaa

SEQ ID NO: 13445 - DNA, 501 bp, A.fumigatus
tccccccccttccggacgcgttatgttccatcccggcggttaagacttggcagaaagcttgacatggttcaggcggtcgaccaagtccgccgcagcaatgttcatgagcgactccgcaactgccatccgagccgatgcggccggagaaataagagcaagagtcggcctctcacccatggccatggcttccccagtcttcattccctgaaccaacgcagtggctgtgacggagacgtcggagaccggggtttgccattttccgaccatctggtcccgagcagtaagaccacccacggtccgatcgccgattgtgatcaggaaggacttggagcctacagcaggcaaggaaaggacacggttggcagcctcgctgatcagctcgacgcgattcggcgcaagggaaggaagatagctggtaaggctggcatcgacggcggggagtttcagtttgcgggagtccacagtccttgtcatccgaggaggcttgccgaagaggactga

SEQ ID NO: 13446 - DNA, 300 bp, A.fumigatus
caaagggaggtcgatgggtttgggatactcggtggagtctctgtcaaggaggatgagtctcttgtcctcctcagagccaccctcaccacggccaacgaccgagaaaccacaacgctcacgatgagcgatggcggtgaatttattcatgccttcctcgccaactgcgaggacatatctttcctgggcttcacagcaccaaatttgcatggggctcatgctcttgtcggcgctatcgacctcacgaagctcaaaagtggcaccgagtcccgaatcgtgaatcagctcgggaagcgcgtttga

SEQ ID NO: 13447 - DNA, 990 bp, A.fumigatus
gagcccaccggcaccgacgtcgtgaatgaacttgatagggttgttctcccccatagccacgcaagcattgataacctcctgagctctacgctgcacctcagcgttgcctctctggacactagcgaagtccaagtccgcagatccttcaccggatgcgacgctggacgcggcgcctccgcccagtccaataagcatggcaggacctcccagaacaacgaggtaggagccgggcttgacggcctcgggtttcttgatagcatgctgtggtcggactgtcccaacgccgccagcaatcataataggcttgtggtaaccacgaacctcagtctgaccgttgccgacgtcaatctgtgtgagaagagtacggaagtaccccagcgtacagggacgaccaaactcattgttgtagtgagcgctgccaatgggagcctccagcatgatgtccaagctgctcgcaatgtggttgggcttgccaacatcgagctcccaaggctgcttcagatccggaatcaggagatccgaaacgcagtatccagcaagaccggccttgggcttggagcctctgccgactgcaccctcatcccgaatctccccacccgagccggtggcagcgccggggaaaggagagacagcagtgggatggttgtgagtttcaaccttagccaggaagtggacgacctcctttgtgtggttccattcgccagtgaatgggtcaggagcccagaatgcggcgttgggtccctcaagcacggcggcgttgtcactgtaggcgctaatggtgtgatcggggtgcttcttatgcgtgttgcggatcatggagaagagactgtttggcatctgcttgccatcgatcacccaggaagcgttgaactgcttgtgacgacagtgctccgagttgacctgagcgaacatgaacagttcgacatcggtagggtcacgcgcgaggggaccattgggcccgtaagcatcagcgagatagtcaatctctga

SEQ ID NO: 13448 - DNA, 237 bp, A.fumigatus
gcgctgccaatgggagcctccagcatgatgtccaagctgctcgcaatgtggttgggcttgccaacatcgagctcccaaggctgcttcagatccggaatcaggagatccgaaacgcagtatccagcaagaccggccttgggcttggagcctctgccgactgcaccctcatcccgaatctccccacccgagccggtggcagcgccggggaaaggagagacagcagtgggatggttgtga

SEQ ID NO: 13449 - DNA, 558 bp, A.fumigatus
gtcctggcatacgctgtccatcgccacgtcctccactccaagaaatatagtgtcgcaaagtaccatgaaacatggtaccattcactgcgcgcaccgtttcccctcacagcgcactatgatcaccccaccgtgtacctcctcgccaacttcatcccaacatacgcacctgccatgctcttccgcctccacatgctcacctacctcatctacctgtccataatatctattgaagagacgttcgccttctccggatactctgtgatgccgacgagtttcttcctgggcggcattgcgcgtcgcatggatgtgcatttgctaagtggggcggaagggaatttcggaccttgggggattctggactggatctgtgggacgactgtcggtgacggtgaggacgaagcggcaagtactgtagatgatgcgcagagtcagcttagtgctagcctgagccaggacggggatctcgacgagaagattcggagggctgtggaggagtctacgagaaggtttagggatgggagtcgtcggcggttgcggaggaagcggagggatgagtaa

SEQ ID NO: 13450 - DNA, 384 bp, A.fumigatus
catggttgtgcgtttgaacaggttcgcaaggctattcgtcccaccaagctccgggaaagccttcagcccggtactattctgatcctcctcgccggtcgcttccgtggcaagcgtgtcatcctcctcaagcaccttgaccagggtgtcctcctcgttaccggtcccttcaagatcaacggtgttcctcttagacgggtgaacgctcgctacgtgatcgccactagcaagcgtgtggacatcagcaacgtcgaccagagcgtcctcgagaaggtcagcgcttccgactacttcaccaaggagaagaaggccgagaagaagaccgaggaggctttcttcaagcagggagagaagcccgaggtatgtggattctgccgatcaacttaa

SEQ ID NO: 13451 - DNA, 240 bp, A.fumigatus
tcagtcacacttcaatccaacaaccacccgctgttgacaaccaccaccccgtcgtacattcttttcagaccaccttcgtccccggtagccaatatgtcggactctactgttggccagacgaagcagtttggaaagggccagaggaccgttccggctcagaaggcccagaaatggtaccccgttgatgacgagccgcagcccaagaaagtcagtacgccctatacaaagagaaatacttga

SEQ ID NO: 13452 - DNA, 756 bp, A.fumigatus
tcagctagtttcggacccattcttggtccaattatatcggggtttgcatctccctcgtatggctggagatggacattctggattgcttccatccttgcgggctgtgcttggatctgccttctctttgtgcctgagaccttcgggccggttttgtcaagacgcaatgcacctggattgggggatacagttccaaagaacactgtcaacgttgttcagattgtcaagcgacctttggccatgctgctcttcgagcccattatcaccttcacttcgatatatatcgcgctggcttacggtcttgtcttcttttattttcaagcttatccgattatttttgacggtttgtctcctgttctcctggctacactatgcatgctgacttctcaggtgtctacggcttcgatgtgcagactacctctcttgcttttctacctggtaggtatatcatttcctgtcccctgcgccacgctaatagagatagtcggcgtcggtgcagcctccaccagtctcgtcgccctttactgggatatgacctacgacaaagccaagaaacacaacaagccatggcgcttcggtgcagaactccatcgcctccctatctcctgtctcggcgccgtcctcctcacagccagctcgttctggcttgcctggacctcccgatcagcagtccactgggcagtgcccatcgcctctggcgtagtgttcggtttcggctaccagaccatcttcgtctcgctgttgacgtacgtgaccgat

SEQ ID NO: 13453 - DNA, 930 bp, A.fumigatus
cagatacaagggacacccgaatctcgacaagcatgctcgaggcaaagcaaattcacatctccgaatgactggccggtacataaaaagttggccatcgtcgtcgcatcctttctcagtgtaattaattcgggcatcgggacctcgctgccgagcaatgcggtcccctacatcatgcaggagttccacgtggaggatgccacgcaaagtaatttaccaacctcagtgtttctcatcgggtacatcgtcgggccacttgcgtttagtcccctgagcgagactgtcggacggcggctggtgctgctgcctacaattaccgtgtttactttgtcgaccgtagcatgtgcgttgagtccgaattggggatcactactctttttccgcttcatctgtggaaccatgggctctgcgcctcagactgttgtgggtggtgtatatgcagacatgttttttgatctcagagaaagaggtagagtgatggcattctatatggcggtatgtctttggtggttcgtccagcttaatggatgcgtatcggctgactgcgcatctagtcagctagtttcggacccattcttggtccaattatatcggggtttgcatctccctcgtatggctggagatggacattctggattgcttccatccttgcgggctgtgcttggatctgccttctctttgtgcctgagaccttcgggccggttttgtcaagacgcaatgcacctggattgggggatacagttccaaagaacactgtcaacgttgttcagattgtcaagcgacctttggccatgctgctcttcgagcccattatcaccttcacttcgatatatatcgcgctggcttacggtcttgtcttcttttattttcaagcttatccgattatttttgacggtttgtctcctgttctcctggctacactatgcatgctga

SEQ ID NO: 13454 - DNA, 624 bp, A.fumigatus
ttctttcgatccgttagtcctgtcacagtctccaagcccaccccgtacaccttcgacttgggctacctaatggccaatgatcctaatccccttgaactcccccgctcagagcccttgaacgcctcgctgaaggcccctcgcacaagcggccacccagtcccttcctcaaccagctcttcaatacttgcccgattacaatgttccgctcagagcggtgtcctcctcactctccctcccccagcgactgtactcccacgacacaagcccttgcccacacccaagccacctagcaagtgggagctggtcgcacgcaagaagggtattggcaagtatagcaacaaacccggagctgcgctggcagacaaggagcgccgcaagaagctggtctacgacgaagagaagggtgaatgggtacctcgatggggctacaaaggcaaaaacaagtcagatgatgagtggctggtagaggtcaaggagaaggactggaagaaggaagaagaggcggcggctaagggcagttcgatccgtggcttgtcgcgtgccgaacgcaaggagagaatacgccgcaatgagaggaagatgagatctaatgagcggaggtcccgcaagtccggtggtggataa

SEQ ID NO: 13455 - DNA, 840 bp, A.fumigatus
tgtcgcggtccagtcagctccgaagtgaagatcatgtacctcaattataagggctgtgaggaagaaggactttaccgtgtacccggtagtggtaaagaagtaaagcattggcaacggcggtttgatacaggtaagctgagctggaccagcgttcatatctctctcgctaactgcgcagaactcgacatcaatctttttgacgagccagatctttatgacatcaatacaattggatctatgtttaaggcttggctacgggagctgcccgacgaacttttcccgaaggaaacccaggccatgattgcggagaaatgcgagggcgcaactaccgccccgcagttgctgaaggatgagctctcgaaactgccaccctacaactactaccttctttttgcaatcacctgccatctcaatctcctccactcgtatgtcgatcagaacaagatggattaccggaatctctgcatctgtttccagccttgtatgaagattgacgcgttctgctttcatttcctcgtatgcgactggaagaattgctggcagggttgctggaccgaaaaagagtacctgcaacttgaaagggagatggacgaaaaggagaaagccgcatcttcgaagacgggagatgttgatcactcctctctaccttattcagatgctaacgaaagagccatatcttcttccggcagcagtcaagcagctgcagaggatgagccagcgtatcgtcctgagacagccaagagcaggaaacagaagcccaaacagattgagacgtcacacacaaggagcatctcccagctccccgagctcgggccccccttgtctccaattcagatatga

SEQ ID NO: 13456 - DNA, 1410 bp, A.fumigatus
tctcggacaggtagtgatgtttgttcaaacctgtcaaccatcatgtcgtccgaacagctggctcaatcgcagaagccgacaggcgaatatcgccagtatctcccggatctcagtctgaaacgcttccaggtgatgcgcggccaggatgcgcatgagtacgcgcatgacttcaagacgctgcgccagccgccgtggctgcatgcgctgtatatgcactggttggatctgctgcaggagcctttcaagggtgttacaactgatggtctgttagcccttatgtatcttgtcgggttagtgttgatgttgactgattgtcaggaaacgtgcgccccggtctgttcacattacaagacgaaggcgtccccatcgacaagatcgtcgctgcgacacagtcgctgctctccattcttgaccgacaagcagcgccagtccctcagctaccacatcgactcgcctgaatggcgcacatggtccaaccccgaattccttctcagccacaaaggcttgcgtctcgacgaagtcacccctcccatccgcgacgccatcatgcacatcctcgagacgacgctctctccagaagggtacgacaaggccgtcaaagccatgcgcatcaaccactttctcggcgagctggtcgactccccccgcatcatgaacgaattctcctacaacttcgtgctcttcggccgcccctcccccgacaggccctggggctggtcgttctacggccaccacctctgcctgaacatcttcctctacaagtcccagatcgtcgcctccccctggttcaccggcgccgagcccaacgagatcgacagcggtccctacgcaggcacccgcatcatgcaagtcgaggagcggcttggcctgcagctcatgcagtcgctcgcccttgagctccaagcccaggcgcgcatcttcgcccagatgcatgatcccgcgatgccgccgggccgctggaacaaggacgaccagcgccacctctgcggcgcgtaccgcgacaaccgcgtcgtgccctacgagggcatccccgccatctccctcacggaaccccagaaacaactcctctacggcattctggagcagtacctcctctatctgcccgcgcgggcgcggcagctcaaactggcccaggtccgccagtatgaacccgagacatacttctgctggattggcgggttcggcgaccaggaccctttttactatcggatccagagccctgttattctcgtcgagttcgatcaccactccggtgtgtttctgaataatgaggagccgaagaaattccatatccatacgctgttaaggacgcccaacgggggcgattacgggatggcgctgcggccgctgattccggcagtggaggggctcaacgggaaggagattacctgggagaagtcggcgttgtag

SEQ ID NO: 13457 - DNA, 564 bp, A.fumigatus
ggcggatccggcagtcccgtggtgaagaccatgggggtcgaacggcgaccaggagaaagacctctgcaagcaaaatatccagatcttccggccgattactacatcccgaaggactcctggttcatccgggcgcgtcttttgaagcaaggcgtcacggccccgggccgctcagctagtgtgcagagcagcaagagtgatctggacgagcttcgccgtcgattcaacgtctccagcctgtcgcagtcggccgaggagaagaatcctctgacgatggagaatgtgaccggctccggcccatcctccgcaacgccgtcacacgtgcctggacgaattttccatggggtgtgggtgtttgtggacattcagctataccagctggaggaaaacaactacatggtggacttcaagtgtgacggataccagaacgtgatccgcgcggagggcgagacggactggcatcccatcagcaaacgatacttcaacaaggagaaggagatcacgagcccctatcctttcctcgacgtggcgtcggacttggtggctcaactggctgtcgccagctaa

SEQ ID NO: 13458 - DNA, 243 bp, A.fumigatus
ccgacaagcagcgccagtccctcagctaccacatcgactcgcctgaatggcgcacatggtccaaccccgaattccttctcagccacaaaggcttgcgtctcgacgaagtcacccctcccatccgcgacgccatcatgcacatcctcgagacgacgctctctccagaagggtacgacaaggccgtcaaagccatgcgcatcaaccactttctcggcgagctggtcgactccccccgcatcatga

SEQ ID NO: 13459 - DNA, 519 bp, A.fumigatus
acatcttcctctacaagtcccagatcgtcgcctccccctggttcaccggcgccgagcccaacgagatcgacagcggtccctacgcaggcacccgcatcatgcaagtcgaggagcggcttggcctgcagctcatgcagtcgctcgcccttgagctccaagcccaggcgcgcatcttcgcccagatgcatgatcccgcgatgccgccgggccgctggaacaaggacgaccagcgccacctctgcggcgcgtaccgcgacaaccgcgtcgtgccctacgagggcatccccgccatctccctcacggaaccccagaaacaactcctctacggcattctggagcagtacctcctctatctgcccgcgcgggcgcggcagctcaaactggcccaggtccgccagtatgaacccgagacatacttctgctggattggcgggttcggcgaccaggaccctttttactatcggatccagagccctgttattctcgtcgagttcgatcaccactccggtgtgtttctga

SEQ ID NO: 13460 - DNA, 1419 bp, A.fumigatus
tcagagaccccagtcatcacaaccagacggcccaagttggtgtccatcacgtctcgccttgtcgcaggcggctgtcggcgcagcttggcccatttcttcagcacgactaccgcaatcatgacgccacgagagactcgaattttgtcggtccgacgactaaacaaagaagaccccgggacccgatcactcgcagaatggtgggcaagcgaacgcagccagaagacgcctgaatcctcggcgatcgaagaggctgcccatcttctccgaacgagcgatatacctgttgcatttcctacagagacggtctatggcttgggagctgatgcaacacggagtgctgcagtgcaggggatttacaaggctaaacagcggccgtcagacaacccattgattgtccatatcgattccatagagatgctagaacgacttctcaacccggcgtcgtcgagtcccacgcgcacaacgagaaccgcgaaaaataccatccctgccatctaccagccattgattgagcgcttctggcccggtccgctcacaatcctccttcataacccgtctgggtcgctcctcgctgacgaagtcaccgcgaatttgaccacgtttggtgtgcgtatgcctgcgtcaccgctggcgcgcctattaatccatgttgcggaccggccgctcgcggctccttcggctaatgcgtctacgaagccctctcctactgcggctgaacacgtttatcatgaccttgaggggcggatcaatctgatactcgatggtggcccctgtggggtaggagtggagagtacggttgtcgacgggctgagcaaacttccggccatactgaggccaggcggagtcgggattgaggaactaaggacagttcctggatgggagaatgtccaaatcgcgtatcatgatggcaatctcgacgtcaaggaggtccctcgggctcctggcatgaaataccggcactactcgcccaaggcgcgtgtagtattattctgcgccgggtctagcgaggaggagatcgcgaagtatgtgtacaaggacttggaagatactgcgattcgggcacatatgattggtgtcgtacgaactcggcaatggaagcgaggcttgggtctagtatcagaggaggacatccagaagacgttgaaacctatcccatccctggtggatgacctggtgtgcttctctgtgcctgtgaagggcaggattaacaatcgcgagatcgccagggcggcctttgactgccacttgggagacaacatcgagtctatcgcgcggggacttttctcggctttgcgagccatggatgaaatggaggtggatgtcatctacgtggagggtgtttcggattctcagggagacctcgcggctgccgtgatgaaccggctcaggaaggctgctgggactgtgctaaaactataa

SEQ ID NO: 13461 - DNA, 813 bp, A.fumigatus
aaagaagccaaccgaatttttaaacaaacagcgaatggtgtaccggcacccgtgaaatcggccagtgcgaagaaagcagcgccagcgccagccaagggaaagaagggcaaaggcaaaaggggggcggataaatatgcccaccaggatgaagaggagcgtgagcttgcctttcgcctggtaggcgctaagagtgcgaaagctgagaaggccgctgccgccgccgcggcgaaagcgcagcgcgaacgagaagctgaggcggcaaaaaagcggcggaaagcgcaacatgagcgcgctgcagaagcagagcggagacggcaagcgctttttgatgagggtgcagctgatgattacaatgaagagactgcggcagcagaggcggcagacctttcttggattcccgctctgattggtacgcctcgcccagaagatgaaatccttgccgccattccgatctgtgctccatgggcagcgcttgttcgttacaagtaccgtgtcaagttacagccgggcacggtaaagaaaggcaaggccgtcaaagagatccttggccggtgggtggcagaaaccaccaccggaaaggtgaaaaaggagcaggctgaagaagccggtatcagcatagctgacgcagagaagctaagggcacgcgaaggagagctctttaaggcatggagggatacggagatcattaacactgtgcctgttccaaaagtccgcattatgactggaggaggggctactggaagtgacgcaaagggcaaagggaaagggggtagcagtgggaacaagggaggcaaaggtggaaagaaaaaatag

SEQ ID NO: 13462 - DNA, 330 bp, A.fumigatus
acaatgtgtcaatcaccactgcacgatttcctgcatggcctgcccaagtgcgagcatcatgtccacctggaaggctgcgtcacacctgaattgatcttccaactggcagagaaaaacaatatacaactaccaaacccagcaacccacccagcctacgcctcagtcgaagcgctcagagcccgctacgctgagtttacatcgctaaacgacttcctcgacttctacttccatggcatgtccgtgctgcaccaccagtccgatttcgaggaactcgcctgggcgtatttccagaaagcacacgcggacggcgtgcaccacgccgaggtcttc

SEQ ID NO: 13463 - DNA, 219 bp, A.fumigatus
ttcctcaatcccgactccgcctggcctcagtatggccggaagtttgctcagcccgtcgacaaccgtactctccactcctaccccacaggggccaccatcgagtatcagattgatccgcccctcaaggtcatgataaacgtgttcagccgcagtaggagagggcttcgtagacgcattagccgaaggagccgcgagcggccggtccgcaacatggattaa

SEQ ID NO: 13464 - DNA, 1425 bp, A.fumigatus
actgtcatcaggccggagcccctgcaggtctccaaatgggagttgacctactccctggcagatggtcgtccgcttcaaactcttgtcggggaattcgaattcagtctgcgtaatggcacgaatattggttgtacggctgctcgaattactcccgacattggggctgctgcctcggcagcctttgcctaccttccggccgccattctcctcctggtgggcatggcttcgtggtgcagacagacccagcagcgaagacgctcagtgtcggcgcacggaaccacacccacagccccggattccgtaagaaagattgtagtcgatgtggccgactacgtgcggtacctccagttcatcttcctgactggttccctcacgatgcaatacccgggtttctaccagcctatcgtcagccaactggcctggtcatcgctgttattttggagcggacccatcgaccacggcttcaggtatcccgggatcgaagacggaatctacgcggtcaacggtacttatggactggagtacatggcgcagaacctcggatttccctccatgttggatatcaagttcgacgctctgataaatctgtgcattgtcgtctctgcaatcgtggttatatggctggtcggatggctgctcaagtgtggatcgtggcatggcgtctcacttgatgctgtccttgtgcaattcccggcagcatgtcatagcattgcgggcgtcacgcttttgttcttcagcctccctctcttggcatatctggcgtatccatttgccctcgtcccacatctgcccagttacaacatttgtctgatcgtgctgatgattggggtcctcgtcggctcgaatctcttcgttgctcgttatcagacgaaacagaaacccaggagatccgaccacaactcgtccgaggcttcccctcggttcgacacctccatggaatatatcgcccattatcttctctactgccttccactcattcaaggtctagccatcggcggtctgcagctctggggctgggtgcagctgcttctgctcggcggatgcgaagtgatcactctcgctcatctcattattcagcgacggacgaaatttatgctttcgaaaagtgcctggtgtactgctgtccgcttgttgacgctcatcttgggcgttgcctttgtgtgcccgtctcgcgaaataacaagacaatggatcggctatttcatcctggttctgcatagtgtggtaatcgtgttcggctttttgttcatctcagtctggcatataggacgattcgccgttaatcgatccgatcgtagggttgccgacgatcgatgggtgggttcaagcaatgttccagttagtgtcgaatctgctttaaggcactattcagcgacttactggtgtccagcatttcaatttcgccgagctctcaagccccagtga

SEQ ID NO: 13465 - DNA, 747 bp, A.fumigatus
  unsure (43): Identity of nucleotide sequences at the above locations are unknown.
ggtgtctgcggaattggtggcttcctgccgtccagcgaagtcnaagatcttgttgagaaaggatccatgaacttcatcttcggcggaaatggcttctttggctacttcttcagcaccagttcgtcgatcgctgcgcaccgggactcgccgcaccatgtctctgagccgggtgaccttcttgcctggtggtcgacgtattctgtcgatgagtgccccgaccccaacatgctggacatggatgatgtccttcagcagctgcaaaagcgacatgaacactggggagatcccgtcgtgcaaaaggttctcaagtcagcacgcgtgaagagtatctatccgacctggacatcgccacagctaccgacgtgggagcgggacggcgtagtcttggtgggggacgcggcacatgcgctgccgtcaagctcggggcagggatcgtcccaggcactggaagatgtagagtcgtttgcgaagcttttgagttacttccttggcaaggcggacgacagtgacagtagtgtccgcgagtgcaaggaggcagtcaagttagctgccaagcagtacatggatctacgccgaccgcgggttcaggccatcctcgacgacgcgagaaagagacaaagcaaaaagcgggatatgggagtgatcgaggagtacttgatgtattcaatcatgtggattatgggtatgtatgccgtgggatttgggggtctcgctaacatggagttacaggcttctttccgagcgtga

SEQ ID NO: 13466 - DNA, 201 bp, A.fumigatus
ccattcgcgactacaaccgaccatgtgcattggcggctcatctcccacgcctggagcagaattgtccatacgtataaggagacggccgtgcttgcttttgagatttccgtgcggaactacatagccaccccggacaatgtcgcggaggagatcctcgtcgagacgcttgagaacatgcaaaccattcggcccaatacctag

SEQ ID NO: 13467 - DNA, 864 bp, A.fumigatus
ggagaagtgagtatatgcaggtcaggctcacaatctacttcattttgcagtctactcctctgtatcagatcggtcagtatgaagagtcttttacgggccactttctttgctacagcagcaattgctgctccggattcacggcgctgccgatgtcaaccccatgagccatgctggccatccccacgagagtggaatgccctcaaccggtcaattgacggcaacctggtcgcagtgcagcctgtcgctgccccttgtcacatcaaccccaacagcaccgcctgccaggacgtcacggcgcagtggtccaactccgtctggcgcgctgcgcagcccggcgccgtgcagtgggagaactgggcagcctggccagaacacaatgagagctgttatatcgagactgctccagatacttgtaagcaggggcgtatttcgctctactccgccgtggtgcaaaacgcgcgacacatccaggaggctgtccggttcgcaaggcgacacaacatccgtcttgcggtcaagaactccggtcacgactttctgggacgctcagcggctccgaactcgcttcagatcttgaccaaccgcatgaagggactacagacagtagatgatttcgtgccaaagggggcgccgaaacataagggcgaaggtccggcggtgacgctggatgctgggatcagtctgcaggagatgtatgctgctcttgccaagcagaaccgaacggtagtggggggcaccgctcacacggttggaccgaccggcgggtatattcaaggaggtggccattcgttcttgagcccctggaagggaatggcgtcggataatgccctggagttcagtgttgtcacggcgtcggtaagttga

SEQ ID NO: 13468 - DNA, 681 bp, A.fumigatus
gggcctggtactgacccgctccagggagatctagtgactgccaatgcctaccagaattcggagctgttctgggcgctgcgagggggcggtggaggcacctttggcatcgtcaccagagtcaccgttcgtacattcgaggaaatccccgtggtcgttaccacgatgaacatcaccacggctggcggagatcccgcattttggaccgcggtggctgacttccatgcggtgctaccggccgtgactgacgcgcgaggaggcggatactacttcattattcccaatctgccgtgggagaataatcagaccctctcagtattgaggttttatctcttccataccaatacaagcaacacaacggaggttggacagatgtacgaacccctgatgaagaaactcaacgcgaccgcgggcgtgtatacccagtacatgtccctccccatgtccagtgtccacgaggcattgtcaaagctcatgcttgtcggcgattccgacgagacaggatcaatcgccgtcatcttcttcaggctgttctcgaaagacctcctcaccttcaaggacggacccgccaggctcgcgtctgccatgagcaagttccgctatacgccctggcaaaccggggtcggtatggtggatggaggcggcgccgtggctgagaatgctgcaaagtcgacaggtcactga

SEQ ID NO: 13469 - DNA, 570 bp, A.fumigatus
  unsure (565): Identity of nucleotide sequences at the above locations are unknown.
attcagctgctcgtcctaataaacgaaaccgccatggcatcgaggcagctcgctcgagcccggcttcttcgaacgcccgctctatcaccgaaccgtgtagtccgtccatcccagacattacgttgtctcccacaaacacagtcccttctccctagggcttctctcactgccgccctgcagtcgatatctacagttcgccactatgctaacggacgaccgcatcccccgggtggtacacatcgaatgaatctgggtggcgagccagaaaagtccgcattggaacaatttggtgttgatctcacagagaaggccaagaaagggaaactcgatccagtcattggaagggactcggaaatccaccgcactatccaagtattatcgaggagaacgaagaacaatcccgtcctcatcggagcggctggtaccggcaaaactgcgattctggaaggattggctcagcgaatcgtgcagggggatgttccagaaagcatcaaggacaagcgtgtcattgcccttgaccttggctcgctcattgctgtcttcacacacagcgccggaagaatcncataa

SEQ ID NO: 13470 - DNA, 210 bp, A.fumigatus
cacttgccttccatttttatcttatactttattgaaacctacgatcgagaattgaattcagctgctcgtcctaataaacgaaaccgccatggcatcgaggcagctcgctcgagcccggcttcttcgaacgcccgctctatcaccgaaccgtgtagtccgtccatcccagacattacgttgtctcccacaaacacagtcccttctccctag

SEQ ID NO: 13471 - DNA, 189 bp, A.fumigatus
gattcttccggcgctgtgtgtgaagacagcaatgagcgagccaaggtcaagggcaatgacacgcttgtccttgatgctttctggaacatccccctgcacgattcgctgagccaatccttccagaatcgcagttttgccggtaccagccgctccgatgaggacgggattgttcttcgttctcctcgataa

SEQ ID NO: 13472 - DNA, 411 bp, A.fumigatus
ctaacctgtcaaaatagcgatgctccttcccaggccgatgttgtgaccttcaaggccttctctggcgcccctgacgctgagaagtaccctcacgttgctcgctggtacaagcatattgcttctttcgagcctgagttcgccagcctccctggtgatgcctccaaggcctacactgcctatggccctgagagcaccgagctgcccaccaaccccaaggacaagcctgctgaggacgacgacgacatggacctcttcggcagtgacgaggaagaggaggaccctgaggttgttgcccagcgtgaggctcgccttgctgagtacaagaagaaaaaggagggcaaggctaagcctgctgccaagtccattgtgactctcgaggttaagccttggggtatgtttgaccgttcatag

SEQ ID NO: 13473 - DNA, 183 bp, A.fumigatus
gactcacatctttcgggctgtctcgataaaatgtatcccaagcacaagcttcacctcgattgcatgatgaaaacaaattggtccgtgtttaggaggcggcttaagaccccgccggatgactacacaacaattgcgagaaatcgcgtttctgattacgaggaagaatctgcgtgctattcttga

SEQ ID NO: 13474 - DNA, 312 bp, A.fumigatus
cgtgaaactaattgcgctcgtttagatgatgagaccaacctcgatgagctcctcgagaatgtcaaggccattgagatcgatggtcttgtctggggtgcctacaagtgggttcctgttggtttcggtatcaagaagcttcagatcaaccttgtcgttgaggacgagaaggtttctctggacgagcttcagcagcgtattgaggaggatgaggaccacgtccagtccaccgatatcgtaagtttcaaccccgaatttgacggcgacaccatagatgctgacatcccctcccaggccgctatgcagaagctgtaa

SEQ ID NO: 13475 - DNA, 963 bp, A.fumigatus
ttagcttcagggtggaacaacactcagaatcgagataccgtccacttcacctttcccgtggaaacgacgataccggagctttcgacggcaatgccgatagccagtgagagcagcactacgaccaccaccatgaccaccttctccgctccggtcacagtgcccatgtcgatgccaaacaatcaatctgcgttggcggcatccttcacgaactttctcaccgtgtcaattcaccaaattctctttcttcggtcggtctatccgcgagcaacatttttaccggtccgggcctacaactacccagtgcgacaatcccgtcacccaaaggtgtgtgactacatcaatgatgcgtcaatcgcggttgggacggagatcttgaaaggcaccatcaccgctgtcagtatcatcatttcatctctccgcacaaatcagcccctcgaacgatatgcctttgatctgtcggggttcccccgtgtttccgccggagatgtcaacacaacatttgaagacagaagcgaagattcatccaagccaggtgtccccgttcccgatcggggttcagctcctacaactgtcgaccttgaagcgcagttccgtgcttgcctcgcgagactggcctctgcttgcgcccggttgaccccgttgcctcgagatgacgagttcagttttaccgtctgtatcgaagtccgggaggacgcattacccccggctggcaccacaaaggaagaacagacctggattgtcgccgaacccgggaagattcacctgaggtcgtgtacggctccctactctgtttccaaatcgaaaaatggcgacctgcatcaacttcctcccaaagtgtcgaatggtagggccaaaacggtacctgtacgacgtgtagaagctggcgagcttcgcttagaactatgggtggaagaggcgcgacagaagtttaatgaaccagtggattccgaacatcctccatga

SEQ ID NO: 13476 - DNA, 345 bp, A.fumigatus
atagtcccagatatggttgtgaaacatatccagcgcaaacttcaggagaaatccgacaaacacagcgcagagttacagaagctggagatgatcgcttcagaagaacaattgtcggcaaatgtgtttctcatgcctcagaccccgcaattcatcagcatgaacacaatattgcaggaccctgccacggaacaggttgattttgtcttttattttgaccgcctcgcttgtctactaatagagaagtgcgttgacccttatgtgccagcgcctgaaaagttcaagtttgggactgaccataacatcggattaatagggccttggactgtactcggtatcaaccggtga

SEQ ID NO: 13477 - DNA, 240 bp, A.fumigatus
  unsure (31): Identity of nucleotide sequences at the above locations are unknown.
cgacatgagtcttctctttcttcttacttcntcgccacgaagaagagatactactctccaccatgggcggatttgagtatcattggaattgcaggcagctcgggctccggcaagacgtctgtggccatggagattgttaagtccttgaatctgccatgggttgtgattcttgatatggtactaaggacccgttcgaacatcatttctatagatataagccattttcgtgcatcctcgtga

SEQ ID NO: 13478 - DNA, 249 bp, A.fumigatus
agaaagaaagcaaacatacctgtctactcttttgctgaacatcagcgccaaccgcagacgaccactctttactcgccgcatgtcttgatcttagagggaattctggcgctccatgatcctcggatcatggagatgttggacgtcaaggtaattctactttcacccacttactacctcaagatacttatcagacccttttcagatttttgtcgaggcagatatggatgtttgccttggacgcagaagtga

SEQ ID NO: 13479 - DNA, 498 bp, A.fumigatus
catcggattaatagggccttggactgtactcggtatcaaccggtgaaggttgagacccctcaagggatgaattataacgggttacatccggaaggtctagtgtctgcagtagcaattttgcgaggtggttcttgtcttgaaacagctctcaagcgaactattcctgactgtattactggtcgactgctcattcaaacgaacgagcggaacgaggagccagagctgcattacttgaaactgccgccaggcattgaagagcacgcaacagtcatgctccttgatcctcaaatggctagcggaggagctgccctgatggcggttcgggtcttagttgatcacggagtcgcggaagacagaattgtctttgtgacctgtgccgctggaaaggttggacttaagcggcttagcaccgtttaccctgaagtcagggtcattgtagggaggatcgaagaggagcgagagcctcgatggttggagaagagatatttcggatgttag

SEQ ID NO: 13480 - DNA, 465 bp, A.fumigatus
aaaatgctaactcttgactgcctacttctagctgatcccagatttgctaatatccagaccgatccgcgatatcgccttcccagcaaacgccagacccatgtgaagctcgacaagcgttttgcgcacatgctgcgcgacaaggatttctctcgaaatgccgcggttgatcgctatggacgcaagcttgctcgcgatgacacgaagaagcagttggagaggttttaccagttggagggcgacgaagagggagataaagatgaggacgaggacgaggagggagatggaatggtcgctgatgacgatgacgaggttcgcaaggagttgaagcggatagacaaggcgtatgatcctgctcgggacggaggattctcatcttcgtcttcggaagaggagagctcgagtgatgaggaaagtgaagaagaggacgacgaggaggaacagagtattgaagaactggactttccc

SEQ ID NO: 13481 - DNA, 258 bp, A.fumigatus
cactatagaccaagtaaatgcaatccttcaccggcatcgacactgtcaatgtacaaccacctgatccaacacggtcccgtcaagaatctaacatccgaaatatctcttctccaaccatcgaggctctcgctcctcttcgatcctccctacaatgaccctgacttcagggtaaacggtgctaagccgcttaagtccaacctttccagcggcacaggtcacaaagacaattctgtcttccgcgactccgtgatcaactaa

SEQ ID NO: 13482 - DNA, 246 bp, A.fumigatus
attgactcagggctacccgaagtcatttctaagtatataaccttcttgggagacttgactgcattgacgctctggagtcttagtaacctgactgctcccagcacatatcaaatcattgccatgagaaaaaagggctttattcctctagttttcctgacagggttgaacattcaccagacaaggattcatcataatgttacttggagtaatatactattcatcaagtcccgacacgtcacatcatag

SEQ ID NO: 13483 - DNA, 237 bp, A.fumigatus
gtgacatgcttccgacgacaaagtcagacgaccttttggatttggctaaccgtgtgtcgggatagacgaccattgggctcccttatctatttcacctaccgatatacatgccgtctttctccactgcaatacaacactggcaatcactctccatcagtatcacctgtctttgacaggaacaagagcctcgtctccacctttctagtccttaagctgactacgagccccctccgttga

SEQ ID NO: 13484 - DNA, 234 bp, A.fumigatus
tgtcgtttagcagccgggaataaggctattctccgtccaacaggagaccacatttacactgatctcgagcccagagccacaggcgacatcatcgcgcctgtcgtctccacgactgattataccagcccagccgcggcagtctggagcggtacggcttgccgatctccacaaagttcacacaggagctccacaagtgcaggaagaggaagagctgcagcggcatcccaacagtaa

SEQ ID NO: 13485 - DNA, 267 bp, A.fumigatus
gccaacagactagatcagttgatcaaccgccatctgcatcaccctgtgggaattatcgaatcttggtttgtcgcctcatcttacgacccgtcatttggcttttcttttggctttttgcccctggcagcatcagtggagtcgaatgaattgcaccagaacggctctgaatggatcatcgtacagtcctaccagcactgtttaagcaagtgttccccagaaggatgcctcgtcgtgtattttcgatattcctgcactctggatggataa

SEQ ID NO: 13486 - DNA, 966 bp, A.fumigatus
aggccttgcaggactctggtaggatatcctgatgaaaggtacaatcttttgggagggtttcttttgctaactttagccgctcatgtagtcgtaaagaacacgcggacccgaggtagtctagccaattcggcaagagctcagcgcggacgtcatctggatgccctaagacgccgaagggctggtgggaaagaggagaacgacgcggcgttagaacaagactcagacgctgagcactcggatgaagcaggccctgatgacgagcccgacagtgaagccgaaagccaagttcgtcagcagcagtttcgcctccaggaagggagcgatgtcgagtcaattgttgcagaggacgaggacctcgaccaatacgaggacgatttcgtattagaggatgataatgccgaactgggagtgccatccagtctagaagatttaccgtttgagttttctcggcatgcctacaaacagctgaaagaatacttccaagacgctgttgaatggatggtaaataacaagatcaaccctgccttccctcgttccgatccgctctacgaggttgcgttcatgaaacttgaagatgaggtcaaaggacgcactggttctcagctggtatcttccgtctggaacgtcaaattccgccgagcactcctggcaagacctcatgtcgaaaccactctatacccgatcacagacaatcatccttgcgacgcgtgctacaggtctaagcatcctgcttcgtttgatatgaagctatatggccacgcttattccctggtagacactccaaacaattgtcccatgacgataccgaccacgaccaataagagtatcgccccgaaagagacagagaccgttaccgctttcccaaatgacgacacgcggtttctccttggaaggtttggtttcccttcctacctttcggtatcccctttccttctggttgatcctttgaacgcccattggcaataa

SEQ ID NO: 13487 - DNA, 1374 bp, A.fumigatus
  unsure (96): Identity of nucleotide sequences at the above locations are unknown.
catgattgcagctttggtattttgaatcctcagctcagtctgagctattattgctccaatccaatgtactgtcaacaacatcttatcgctttactntacgctttccttgcatattttgtcaacgtcacagaaagtttaggacaattgccagagaagtcccttagcagtcaaacatatgagcccgaatattgcaatcagacactgatcaactttagtgggctcaactactcggacgctgaagtcgacgaactaggatatgcggtctccctgggtcgacgactgtgttggactgacccaggagcaatacgtggccgaaatatctcaatatactcacaaagctcggaaggcggaattcaaacagttgttaatctgacggttaccctgacaatctcagtgggaaaagaagcgagcatgcaactaaggaagcggttattgacgcgacctcataacagcccagaagctctcataacgctcggcgaaattatagtacttgactctcgcttggagcacagcaatccgcagtgggaacgacgcagcaaggctcggaacggtcaactggaggcagcttcgggatcggatccagagtcagcatctcaacgtggaaaggtacgaactgagacacaaatatcagaagatacccttggcttcggcagtggctcagatggtgatgctcaccctcatgataagaatggtcccgtccggaaaaattcccacagtcgtcgcagtgtatgtgtggacaatttttgcgaagggttcgatctgaagaacacttgtgcaccagggggtaaaattccggctaaagaggaaatatgcgcactatgttatccaggaagaaaccttgcagtcattgagagacactgctcaaaacaggaggttagtggacgtcaagccttctacagtgtttgcgtgttgctcggctgctttgttgtggtagctgttcttctgtatctgctgcgcagcttctacagaggagtgcagaggcgatatcggatatttcggggtctatgtagtgcccagacttctcgaagtcctgccacgagatcggggtcttcctcggtcttccaggtcaactctctaccgtccctctttcctggattttcctccccaaccaagctagaagtattgcagagggagagcgtgactggtacggacgatgccagtgatcgcacgttgcctttctccacactgaaacaaaaatggcgtcaactcggtgcatttagaagggactctcgcggaagaattcaagttatcttcgacatagagtcactcgatacggaacatgcgaaaggcggacaatccgctcataaaactccagttctccctcgagcaccgaatgcaagtattcgaaggtactgtgaagagacaaggtcttga

SEQ ID NO: 13488 - DNA, 300 bp, A.fumigatus
ctatcttcgcataatatggtcacacatttaatgatcacatctattgattacctccatgctgcgggatcaatagaagttattctaactaactatcctgcgtacgtacagttcaggccctttacaaacacctgtgcgaggtcccagatcaggcctgtgcagccgtatgcaacccgaggcgatggtttgctgtctggcgagaaattcaatcgtggatacataggctgtatgctgcccagagtctgtctgcagatcctcgcggtttgtccacgagcaccattctccctcgctgtcggccgctag

SEQ ID NO: 13489 - DNA, 345 bp, A.fumigatus
aacactctaaaggatcccttgattatgaaaaaacaggctggagcttcccacagtttctcagcgccaaccgttccgccatcatcacctcgtacacgtgtcgcacccatccacagcagatcttccttgtatccttgggatcgacaatctcctggaccccaaacgcattggccgtccgcacgggattcatcagccgcagatattcctcctccagctccttataccgggccgccttgccctctttcccaccccgttgctccgcctctcgcagttcctggcgatggcccacctcgattcccccatccagtggcagagacccccagttcccggacggccaggcacacctga

SEQ ID NO: 13490 - DNA, 756 bp, A.fumigatus
agcaaatctttcgcaaattcgccatcaaatccagaattccaacaagcccgcgcagagctcgaggctacactgacagacttaactgcggatctggatgatctcgtcgagagtgtgcgcgcaattgagcaagacccgtaccgatatggcctcgaaatcgacgaagtcgcacgccgacggaagttagtggacgaggttggagatgaggtcgagaagatgagagaggagctgcagagggtggtcacaactgctgacacagctggcgggaccaaggcacatacaggttctacgtcaggactgcccaatccgtctgactttgataatgtgctctctccctcggatgatcgaggggacgattactacactgctcttgagcagcagcggcagatggagctgatgcatgaacaagatgaacagctagatggggtatttcgcactgtgggcaacctacggcagcaggcagatgacatggggagagagctggaagagcaggcagtcatgatcgacgaggtggatacattggccgatagagttgggggcaagctgagcaacgggatgtcacggataaagcacatcgtgcgaaagaacgaaggtaagtgtactctgtctgttcgtcgaaagggattccgcagaacgtattcaaagcagtcaaacagtcaactaatcatttttggttcattagatacaatgtcttcattctgcatcgcggctctcatcttcgtcctggtgctactactaattttggtaatcgcattgtga

SEQ ID NO: 13491 - DNA, 189 bp, A.fumigatus
ctctcccggctatgggacgttttgtactgttccctagggtactatggatggaagatgtctgagattggagtggacattcagccgagagctatgctattcgagatcgaagtgagaaataagtcagggttgaatgagaagaagagtacaattaacggaagagccacaacagccaccaaggtgagactctga

SEQ ID NO: 13492 - DNA, 300 bp, A.fumigatus
  unsure (3): Identity of nucleotide sequences at the above locations are unknown.
tcnccggcgggataccgggaacagctcgaagccattgaggtggtctttgggcagtacaacgcgccttatttccctcagcccgagttctcccgtcctgcggccggctcgcccaagggtctgggacctgccaatggtaaaggggcgggggcgggaatgatgcagggtcccggaggggtcgtctcacttcgagtcaccgacgaggctcgacagctgtgggagggctggagagacatggaggaatatgcgcgagaagtgttcccggtagaagaggaagccaatggactggactggatgttgtga

SEQ ID NO: 13493 - DNA, 1179 bp, A.fumigatus
atcttaacaatctgctcaattgattgctttatacccttataccccagctcgctcactgttctcctttattccccccttttctccttgcttatcgctcctcatccttatcggtcatcatgggtgccgaaaacggtcagaaatcgctctctgagcgcattgagatgcctggggtccccatggaggttgcgcgagagtttgcgctcctcgagcagagatttatccgcgctgagaccgaccgctgtaagttgccctcgccatttgtctgcctttggtgttactcgtccgcctcatgagcacatcaatctgactcgtttagtgcgccgctccactgttgagaaccgccctctgtgggagaagcgtagcgaaatcatctccaaagtccaggacgacttctggattcgcgtcctctccaacgctcccgccgaaatcgacgaatacatccagcactccgacgccgctgttctgggctccgctctgaaggacctgactgtcgaaagatttgaggtcgacgagaagggcaatggcgagccgcgaagccttcgtttcaccttcgtgttccgcaccggcgaggagaacccctttttcgagaacgaaaagctcgtcaaagagttctactggcgcaagaagatcaccaagactcccaagggcaagcgcagaacatgggaaggcctcgtctctgagccagtccgcatcaactggaagaaagacatggatctgaccaagggattgctcgatgctgcctgtgatctggccgaggccgagaaaaagggtggcgaccgcaagaagctccccgagttcgaaaagctggccaagaagatggaggagctcgaggccgctgccatggaagataacgatgaggacgaggaagacctccccacccctgctggaaccagcttcttcggtttctttggttaccggggcaatgtcgtctccgctgaagagtctaaggaagcccagaaggaagatgatgagcgattcgagagggccctcaagggcgagaaattcgacgatgaggaggatgatgacgacgaggacgacgacgatgaagactccttcgacgagattgagatcttccctgatggggaggaccttgcgatcgctctcgctgaggacctgtggcccaacgctcacaagtattatggtaagacaccctgctatagagccgatgcgacggtgtga

SEQ ID NO: 13494 - DNA, 1446 bp, A.fumigatus
aaggtcacgatccgatctattcggttgcactattcagaaatgctgagaagattcaaagcgtttgtcttgtcaaccttacgatttctctggtgccctgaatctccttctcacccacaaatggcggcgctacgggacgtcatcgcgcggggggaatttccaactttgtcaaacaccgaggccattcatcttttcgcatcttcattcccaacagagctctctcatctccgaaatgccagtgccacagttgaatccggatccagcacgcctccgggctgcttggaggggaaaacaccgtcggcggtgatctacggcgcagatttcgcagaggtcaaccgcacactggtcagcatgctggcactcaagtggactctggcagacgactacgagtctttcacacgcggtcaatcagaagggaaattaacactggagacgttcaagcgcatgcgggaggtgatcatccggaacttgcacgacccaggagacatctacgcgttactggtagcgatcctcatcgacgacatcggcaaagactctgccctagccacaaccgctgaggctgaagctgaagcaaaccattccgagctagtctatcatgctgcgcaaggagatcgcatcccggcgctggctggtgtccccaaccgcggcagggaagcgatcatgcggagcctgcagatcggaagcaagctgaatctctcgcagctggtgcagggtgagtgcgcgccagcgagcctctcggtgctacggtcgatagacaagggcggatgcggctttgagatgcgagcgatagtgacgctgctcgatgtcgctggcgcaggtgcccaccgcgatgcgaggggttgcgcacttatgaccgagtcagtctgtcgggcttatctgcgcactattgaagtcgttggagagtttattcgaggaaatattcccactgagcgcgcatgctacgaccgaattctgacggatcgggcggaacttctacacaagaagggatttgccttgctttctgttgagaatgctgaggaacgaacgctactccggctgctctgcatgggccgaggcgatagtctagagtcagctgagatgttccaggcggcttttcagatcctaccagagcctaccagacgccgcctggtcgatgggctcagtgtagctggcattggcgatggggtggcgattgttccctactatgctcccggtctgctggccgaggtcctgcgaagtgtttaccacaaagagcgcagtagtatcgttgctgcactgtctgcattcctgcggtttctggcgcgtgtgtttgacggtccacgacctaatacagacggaattcaagaacgcgacctgtcgtttgttcaggatgtgatcaaaagtgacagattcggtgacgacccgtctatcctggataccgtcaggctgccttggatagacttgagtgatactatcgatccacgcttatga

SEQ ID NO: 13495 - DNA, 210 bp, A.fumigatus
accgagcggtttgaccgaaccgagtatgcgttctactacgcaataacatatcaaagaaacatggccatggatatggtcatgagacctgcaggaaaatcggtccatctctctgtagaggtgcgtactacggagtacaatagtagccccccgctgtcagggcccttgagtccactatttgccaactatcattaccgcattgggcattcctga

SEQ ID NO: 13496 - DNA, 420 bp, A.fumigatus
gtgtttctactcgtcttatcatccctggtatccgtactgattgcttttgacgcagccgaccaggagctccaacgcaccctccagtcgcttgcatgcgccaagtatcgggtcctcaccaagaagcccaagggacgagacgtcaaccctacggatgaattctcgttcaatgcgagctttacggacccgaagttccggatcaagatcaatcagattcaactgaaggagacgaaggaggaaaacaagaagacgcacgagcgggtggcggccgaccgacatctggagactcaggcggccatcgtgcgaatcatgaagagccgcaagcagatctcgcacgctgaactggttgcagaggtgatcaaggcgactcggagccgaggagtgttggatgtcgcggagattaaaaacaatatcgaaaagtga

SEQ ID NO: 13497 - DNA, 873 bp, A.fumigatus
  unsure (1),(15),(19),(20),(27),(29): Identity of nucleotide sequences at the above locations are unknown.
ncgccctcggtctcnagcnnaaaaccncncgttcttgcccaatcgaagcgattcttcgtatcgtgggctcagcgagagtcctccggatatcttgccacatttgtggagaacggccataatctaatcgcgagagaagtcaaacgctgcgagctattctcgttgaaccgaagcaccaagcagaaattgtctgaacttctcgatcgggtcttggtagcagatcaagagtcggtgttgcttaatgagaaggacgttcttgggttgcttcggactggcaacaagactgctctggagaagctctacaccctcttagagcgaaggcaactggggacgaaattgaagccagctttcaagaattatattgtggaagaaggctcgcagattgtctttgacgaggagaaggaggcggaaatggtagttagcttgctagaattcaaggcacagctggacgacacatgggttaactcgttccaccgcaatgaggagctgggtcatgccctgcgcgaagcttttgcaacctttatgaacaagagccggaaatcggaatctaccggcgggacagacaatgtcaagaccggcgagatgattgccaagtacgtagacaggctactgaaaggtggatggaagctggcacctgggcgcaatatggcggacgtgccgctggccgacgaggacgctgagattaaccgacaactggatcaagtgctggacctgtttcgattcgtcaacggcaaagcggtgtttgaggcattctacaagaacgacttggcccgtcggttattgatgggccgaagcgcaagtgacgatgcggagaagagcatgctagcaaggctcaagacaggttggtttcgatatgcaccatcttttttttcgtag

SEQ ID NO: 13498 - DNA, 471 bp, A.fumigatus
gcagaatgcggttctacgtttacacacaatctcgagtccatgttcaaggatatggatgtcgcgcgagacgaaatggctgcatatgcctcgattcagcgcgaacggaggaaaccgctgccgatcgatctaaatgttagcgtgctctccgcctctgcatggccatcgtaccctgatgtgcaggtgcggattccacctgtcgttgccgaagcgattgatgactttgagaagttttactacaacaagtacaacgggcggaaactcagctggaagcatcagttggcgcactgccagctgcgagccaacttttcgcacggacagaaggagctggtggttagctcgtttcaagcgatcgtactactgctgttcaacgacgttcccgagggcggaagcctgagctatgctcagcttcaggaagggacgaaactttgtgagtgtttctactcgtcttatcatccctggtatccgtactga

SEQ ID NO: 13499 - DNA, 240 bp, A.fumigatus
ggcactcctctcgatgacaattacacgggggccattcttcaaaccctccattgtcgaatggtggttgacacttggatgtcgggtattacaggtacaggacagatcgccaactgcggcagtgctctctacattgcggctcatggagccgaatacggggttcccaaaaagggtgccgatgtgactggggtgccatatgaagacaatcggtgggctgttgctgagagcgcatctactaattaa

SEQ ID NO: 13500 - DNA, 576 bp, A.fumigatus
ggtcggtctggtcaccaaattcggacggtatggaatacttgcctcaagtgcgacaagtatacttactcctgtggtagattcgagcgtgcggtcgatcctggtctggtcaaagttaacccgctgagcgaacatcttacgaccgtcgacgttaagatccagatcgttgaagtccctcgccaagtttgcatgaccaaggacaatgtcactctcaatctgacctcggttatctactaccaaatcatttcgcctcacaaagcagccttcggcatttccaatatacggcaagctctaatcgagcgcacacagacaactctgcggcatgttatcggagcgagggttctgcaggatgtaattgaacggcgcgaggagatcgcccagtcgacatctgagatcatcgaggaggttgcagctggatggggtgtcctagttgaatcgatgctcatcaaggacatcatctttagcaatgatttgcaggactcgctctccatggcagcgcagtccaagcgtattggtgagagcaaggtcattgctgctcgtgccgaggtggaatctgccaagctcatgcgccaggtatga

SEQ ID NO: 13501 - DNA, 699 bp, A.fumigatus
cagtgccaacctccaaagttcccacagcgtttagcaagcacaacaatacacctacaaatgagcaataacatcctcattgttggtgccagccgcggccttggagcctcgctaagacacttgtatgcatctcaggcatcaacaacctgtgtcttcgcgacatgtcgatccagtgcccctccacaagacagtgctgaatctcgtgtctcatggatcccgaatattgatgtctcccagcccaacgttggtgaaaccctggtatcccaactgccttcatccaccaagttgtcccgcgtgatcatcacggcaggctatttcggattcgagacatttgatgaccccgactgggaaaaggaagtaaggatgtataccacatccgccattggccccgtctttgtagtgcacacgctcgtcaaagcgggcttgctggacaaggggagcaaagtgatattggtcagcagtgaaagcgggagtatcacgttgcgacacgaaaaggagggcggagggaactatggtcatcatgctagcaaggccgcattgaatatggttgggaaacttctcagcatcgatctgaaagagaacggcatagctgttgggctggtgcatcctggtttcatgcgcacggaaatgacaaagagtgtcggctacgacaagtactgggatgccggtggaggtaagaggccattgacgtgtctatcgtga

SEQ ID NO: 13502 - DNA, 246 bp, A.fumigatus
gctgcggacattctgtcctctgctcctgccatgcaaatccgctatctcgaggccatgcaagccatggccaagaccgccaacagcaaggttatcttcttgcccgccgtcaaccagacggtgcagcagcagctggctgcagcagataatgccggcgagggtccaagcaaatacggagccgggcagcctgtacaggcggacgacgggttccagcgcgcgatcaatgcccgagtggtggaagatatctga

SEQ ID NO: 13503 - DNA, 1230 bp, A.fumigatus
tggggcccaaggaggacaaacaagagtaagagaatgagtctatacgctagagcttggtgtcaaccatgtgcatgcctaattacttttcatacgtgtaggagaaagcgtccgggtttcttgaggcccagtctcgcgaggaccaaggcccagtccttccagctcggcatggccaaaccagcaccggaaagtcaagcaccgccgttcaagttccagacccgagggaccaagacgtcgttgagcgcttcaacttctttggaggatatgttcggggaatcgccgcagagagaaaggccgattgcacggaacaattctagcactcttttgaacaaccctcgtcttagaccaccgctcggtagtggcagcaatggaagccatgcccgtggaaacggatccccctccgctgcatcgattcgcaagagctctcaccccctgatgcgccctcggaaacaatgcagacggtcactgagcatgtttgagcaccccgaggaggtgattgccgaaaaggaggccaattatactacaaatgcaccacttcaatcgatcacagatgtcgataccacacccagcctgcagctccctcacttcatccctgaggactcggctgatacattgcctcgcatcgacaagacaatccttgtggatctcatggatgggaagtacaacgatcgattcgaccacattatggtcgtcgattgccgatttgaatatgaatacgagggcggccacatcaacggagcggtcaactacaacgacaaagagtacctggccgctcagcttttcgcggacccaaagcctcggactgcattggttttacactgcgagtactcggcacatcgggcacccatcatggccaaatacatccgtcaccgggatcgcgcttttaatgtggatcactatccacacctgacttaccctgatatgtacattttggacgggggttacagcgccttctttgctgagcatcgatcgctatgcttcccccagaactacgtggagatgaatgccaaggagcatgaatttgcatgcgaacgcggcctcgggaaggtcaaacagagatcgaaattgaatcgcgcacagacgttcgcttttggccaacattcgcctcaaatggaagacagccctactggaaggtgccgtaataatccaggcgaacgtactcgtttcttggactctccttttgaggggacgccctcctctcgcggtccaggccgccgtatgctgtcgtactga

SEQ ID NO: 13504 - DNA, 216 bp, A.fumigatus
agacctcctcttccatcttcctcaccggctcccatcatggacaccatggagatgtctcccttgcctcacaagccgccgttcattgccgcaaaggaaatcgaattgaacccacctacaccaggaggttccccaatcgattcgcccatgatgtcggctgctcccagtccgcttcaagagtccccgttgatggggcccaaggaggacaaacaagagtaa

SEQ ID NO: 13505 - DNA, 1389 bp, A.fumigatus
tacctcaagttagcaaatcaacttcctaatggaaccaatacgcacaccaagatcgttgcggagaagatactctgtcgacatcccgaatacgaacccttccataaccaatccttaaatcccctggatgtaatcaaggcacttgcggactctggaaacgtaggaagcgaggcacttactgccataaaggagggactggaatgctgcaggtcaataaaccgccccgacaatgataagcagctttccgaagccaattcatgttatgttgcgacaaaggctggagtatcaggcaacttagaaaaagacttcaccaccaagggcacgcagggaagtttgcgttgtcccttttcgaagcctaacaataagccctctgaaaatgaggggtttaacgggattgaggatgcctttgttacccagaacgatgatacgtgcgggcacgaggacctcgatcccattaaagctgaaaagaatgatagacgctctagtttaacgacatccgcaaagtcgagctcaaccagatgccccgtgtctaggtgtcctatcagattcatggacaagcatagtccggaggagattgccgactatgtggagaggcacaagcatgagatcccgcgcagccatgcaatatgcgttcaacgttatcagaaagattctcaaacgatgcggcaacttgacgcaaagtatggtaatcttatcagtatgatacaaggcctgtcagtcaaacatcaagcgttcctgccaggccatagccaggatggcgcgccagcatccagttcgtctgctgaacgagtcgaaaaatgggcggaagacgttggaatggaagcgcctgagcaagaaacaccgaactctgccaaccgacaagaagcacaaggcgcagacgatgatgacgagagaaagggacgtttcgatcgtcctttgcgcgaggtgcgtgttggcgaatccccaagcaggccttggggtataccggttccagtttcccaaccttctttcacacctaccatgccctcgccgcctactccgctctcagactctaccaagcagccattgaaagagccatctgacattccagcaactgcggagcctgccaaagttccttctggcacaagaactggccagtgtccattcggccatgatgctcccaaagcgaacgacccaaggcgcgatctggagattgaacccatccgtcaggaaacaagcaagagcgaaaccgcagacacacctcggccccctcacggagatggcgcggacggttattttcatgctggccaaatcaacccaacgtcgtccgcaaaagttgtcttcaatgggcccgttttcttcgggttctcaccggagcagactgcatcgttcctgcacgaattgggcaatacggtgccaagcaagccatcataa

SEQ ID NO: 13506 - DNA, 258 bp, A.fumigatus
tcccaagctatccgtgccaacggccagctcttcatctccggccagattcccgctgatgcttccggcaacctcgtcgagggcaacatcggcgaaaagacacaggcctgctgcaataacatcaaggccattctggacgctgccgggtccagtgttgacaagatcgtcaaggtcaacgtgcgttattcctctgttccgacagttctgaagagagtggggctggtgctgactctgagtccttttacaggtcttcctcactaa

SEQ ID NO: 13507 - DNA, 693 bp, A.fumigatus
tcgcggatccggccgcctcgtggtgaagagtcatggcgcgcctggtggaaagaggttcttgccaccatcgaaggcttgctcgttcctccgttatcggataaaccttctcatcaaaagcctcttacgatgcaagaagtcgacattgtgtcgcgttggcttgtacttctcttgaatttcttccatgctgttgatgaggaaacgggtgaagcccacggcgtttcgcttgatattctgaaatcacccaagtaccatgagatccagacactgaactttttctattttgaacccacggagagcttgatccgtacgtctgagcgcatggcatcagcgacgatatcacggcagcaagtgagtaaaaaccgagtgtcagcgccaccacatatcggatctggaggaactggcagtatccttggggtgccgaacacgcggcgagtcaagagcatcatgttgtcgcggaacctcggcacaatgaaaaagatgaaagaggagagaaggcgtgaggctcaggcagaaccgaatgatgatatgattttacggattctccgtatgagaccagaagccgctggatatctacgtgatcgaagccgtcaaaaggaacggctcgcagctgcagctgcagcggatgctattgtgaagcaaagccttatggcaggaatgggtggaagaatggcgggcactcttggacgaagatga

SEQ ID NO: 13508 - DNA, 228 bp, A.fumigatus
tcgtgtctattactgagtaattttttcttgcgcttgtctttttgtctgcaattctgcatcctagcatcgttcgatcacatgaactttatgattctcaactttgtttgcttggcgagtttcagatgcaattatgtttacttcgcgggattgatggtgttgaatatgaaacctagacagcaaacatataacgaggatctaattgctaatgagaatgaaattcacagatga

SEQ ID NO: 13509 - DNA, 201 bp, A.fumigatus
aacgtgatagtctttgactttctgtggttcccggggaaaatgaaccctagctacagcaaagtaggagttgagttcatgagattcgcctatactcacggcctcattgatccattaccatggtatcttgatatcagtctggctgcatcctccatcctccctctcggactccccgaaggacatatgtggctgcaaccacgatag

SEQ ID NO: 13510 - DNA, 774 bp, A.fumigatus
caaagcgcaagaaacagtgatgggcttctttactacctcaatctcaacacatcatttgatacagcaatctcaaacctgactgcgttgttcggcaacatatcgaaagctggaggaatcgcaaacaatattgccccaacctatcgcgatggagcgatgtttacgaacgacaacgagctatatctttacgggtacttcgactctctcttcaccaattcccggctgaccatatgtagtggcctcctccgtctcacagacagtcaagaccccccagctggcaacaccgttctcggctacgaacgataccagtatggtccggatcgagaatcctggcaacccggctttatcatcgacaacctcgacactggcgtgacccgatacgtgacgaatggcgccggagtctctgcaccgaacgaaaacctcgggttctacttcagcggtatgcggggaaaggactggggacctatctacgctgacgacaaatcggccaacgtgacgtctgactgcatgatcaaggtggatatgtctagtatgcgcgacaacaagtggtctaatctgtcgttaccggcgcatgttcctgcgcgggctaatggtgagctcgtttgggttcctgtcgccgagtccggggttttggtggcgattgggggagtgattaatccagccacgatcttctcgtcggacgggttgacaagtgcccagcagaatgcgagtaagcgtgtaagcccagggcttatggagacagtgtctgtttacgatgtcagcggtgataaatggtga

SEQ ID NO: 13511 - DNA, 390 bp, A.fumigatus
cggcattgcaggacgactctcaacgatatcatatcccactcgagtgaccaaccatatacgttcgaggcttttgtggatttcctcgctaggaaccattgcctcgaaacgctcgagttcatctccgaggtgaagcactaccgtgagagctataatctttccctagctcgtttcagcgtgtcaggtaaagacccgaaggaaagagaggattcgtacctcttccgggaatggcaacatataaaggatgcatacattgctcctaatgctccgcgtgagattaacataccagggtggatgcgagacgctttaatggaaatcgcacctgaagtttcttatcccccacctatcctagtcttcaccacggggctggaaggagccgggcgatctaagggg

SEQ ID NO: 13512 - DNA, 543 bp, A.fumigatus
gcccagggcttatggagacagtgtctgtttacgatgtcagcggtgataaatggtgagttcttggaccagcaaaacagtcgactactcattgagaataggtatctgcaaaacaccaccggggatatcccccctcagttgacgcagttctgctcgattcatgcgagtgcacaagacggctcctcacataacatctatatttacggcggctacgacgggctaagcatggagaacacgccgtccgacgatgtctacgtcttatctctgccctccttcagttggatcaagctttacagcggaaatactacccatggccggagtggtcaccgctgtgtcaaaccatatccggaccaaatgctggtcctcggaggcgtgcatcttgacccgacgcattgtctcgacggtggagtgattcaagtgttcaacctgaatactggcaggttccaaaacacctacaatccgaacgtctggaacgagtacaaagtcccggacctgatcactactgtcatcgggggagagtacgtatccaagtttgctaaacaatga

SEQ ID NO: 13513 - DNA, 252 bp, A.fumigatus
  unsure (210),(237),(239),(245): Identity of nucleotide sequences at the above locations are unknown.
caaacaactcctaacaactcagaacaaaggaaagttatccgatcaactcagctttctactaagttcgcgcatgacttcggaccgaagaacatcgctccaaaaatgtccgaagttgtacctattgaggggtttgtcgcgcaagctttaaaccgactggcctacaaacatcggttgctccacagggtcttcaccacggggctggaaggatcnacggctggtgctattggcaatcaaacncncaaccngggaccc

SEQ ID NO: 13514 - DNA, 291 bp, A.fumigatus
gtatgtcagcagtttctctgccggaattccgctaacgaagccattcctgccacaggaattgtccagctcttccaacacctgcaaccaggttttgagcaatctcgtatctgcatcaaaattccgagtacatgggagggtatgatggcttgccgagctcttgagatggccggggtgcgaacgctagccacgacgctcttcacaatgtcccaggccatcttagccgcggaggttgggtgcacgtatatagccccttatgtcaaccaattaaaggtccacttcgaaccagggtga

SEQ ID NO: 13515 - DNA, 393 bp, A.fumigatus
ctacagatcgatatggcagttgcaacactgcttcctggatcctcactggatgcggtgaagcaagccgtgcattcaacctcaacatgctgcaatgccacagtgttgtccctccaatctcttttacgcggttcaataaaacctgtctccgacgtcgagagcgaacctactaagaagacgaatcggacgaaaaaggctgtgtctgcatcctcgagacggagtagagcgacaatcaaaacaaacgtttcggccaaaggcgcaacaacaattgctgctgtcgagtatgatgcaccgcgtttgtcatgtcaggaaaaagtttcactggcgacagagatttttaatacaacgtttgaagacacttggcagaagcatcaaaagtcatccaaaacttcgtga

SEQ ID NO: 13516 - DNA, 363 bp, A.fumigatus
cagatcgccagattcacggacccaaacaagctcttgcctctttgcgtttctattcagaagcattacaagtccatcaacgcaaaaacaaaggtcttgccagctagcttgacatccacagacgagatatatgctctggcaggggtcgaccatatcacaatcgcgccatacctactgcaacagctttcgcaacccagctctgtacctcatacggagtctctctttgactctgatgttccaccagcaatctctgtggcgcaagagtcatttgtcaacgacgaatccgcttacaggattgccttcacgcgggacttgcatggagcaagcgaagagaaactcacacaggcaagtttggatgaaggttga

SEQ ID NO: 13517 - DNA, 429 bp, A.fumigatus
gagtttgcttgccattcatccgattgcttcagttattgctcttctgatctcaaaggcaagtactcggaggatctcgcaaaatattctgaaagccttttttttcctctggcgcttccccctcgtcacttcttgaatgcttatttaattggtgttggtagatcgctggtcccctactccaccagacaacgaaacgcaatcgcgcctccctccacgagtggcacctgtttatttgtcactagccagctttttgcagcttattgttgccaaactctctcctcttttgaagaaaagaatactccccagaagcctacgtgcggaagtctcattgaccttggcttatccacctattcttccttatcgcaattcccccacacgatcggttactcttgcaacgttgttgttttcatttatctgaccgactcctgttga

SEQ ID NO: 13518 - DNA, 2676 bp, A.fumigatus
cattctagtatcatcccgcgcgatcgaccaaatctagaaacgataaaaatgtctacaagtgatccctttgctttcctggaaaaagagcccaggccggttgccgtcaagaagccacattggagagagaagctattctcgaaagggagggagagggacaaggagaagaacatcaaaccctccacgacggaccagcaaattgaagcgtttctctctccagttcgttcaaaatccgtatcgcatgctttaaattcagccaatggaacagctcgagggtatcaaaagccccgcctggacacctcccatcgatggccttcggctcaagatgtcctgaacgctacttctccaatttccaagcctgcttccgcaaccgagatctaccccccgacgagctttccatccccaccacggaagacccgcgcccgaaagggcctcaaggtccgattttccgataaagatccagaagtgataggagaaggtggcgacgagactgaggctcctacgatagaaatatcgttgaaccgtgggcgtcgggctgagtatgaatcaaaggcacctcaactccagcttgacacttcgttgggagacacggatggtgtatcgcaggcgagaacacctcaacggaaggatacaagcgaagggatcaacacagcggaacggaagccactactcgtccagagccctcaagactccgaattcttgttgacattgaatcttggcggtgctggttctcggctttcgttccgagcatcacctgagtccaactcgtttgctcagcgtgttcgggcgaagatgcaagctgaggagggtcgtgctctgcagcatggttgtcaagactatccctcctcgccggaagaggatggaccactcgctgagaaaaaatccactgcagcctcacccgagagccccaactcgctgtatgaaacaccgcctgtttcggagactgagccttcccacccggcgttgacccttcgaattcccgcgaactcaagcacgcacaagcagggcggcacgagtcctattgagctgaacttacccgctgctctcacctctggccccgaactacggagtctttcacctcccaagccgcagccgattccccgaaatcctgtacaaaatcatccagtcagccgagacgcgcgcgacacgactcacgggggacagttaccgaaagcttccctacgatccctagccagccaagtaggtgatactgccttcacggatctcaaggcgtatgtggcacagtattctccttcaatccgcgttgcagcagagactggcaagccttcgatggaaatttctctagccgaatggataagggcagcggtgtggtggtttctacgtgggaagaagaagcttgaagtttatgcacgatctcgctcttccagttctggggggaggacaccccaagggagctccctgggcgccgccaaacaagccgtggtggaccttggcaaagccttgtggatttgtgagaacgtcgtaccacagcacagtgaactatctcgttatggtactagggggattgatgcaattattgctgtggcaagcacgacaggcaataaacatctagcagattgtctctccctacaccaagcgattataagtcacttgcgctctttagcgatgtcaatcaggagaaataatattctttctgaacttgcttctgaaggcgatgcggctgtccaacctgacaccaatgtgtgggtggggtacccggttttcgcccctgacgtctcagcggtattatctggagcagccacaaggtctgttttggtggacaactccggaaagggcccaagcattattcagatgatgccgctgggcgatacaagccgttatttcagctatggaagtatgtttgtggaggcttgcatcagctcacaggaagacgactcgcaggagcaattttcaataccatgtgctttgtctatactacgtgaccgcggagactggtacgtattcgcagcaattacaagccaaagtgaattggtcaatgtcatgatccagtcggacagaaagaaaggtcccacctgggatgatgtggaatggcatgtcaggtcgcattccatgagggttagactgccgcggggcttcgaattagatgtttcgtttcaagatgaagatttcaagaatctctggaacattgtccattatacgctcaaaaccgaggctagccttcaaccagaagctggcgaaaccgtcatcttcgaatacacgttgaagaacttccagtatatggactcggggactcccaaggcttttcctacggaacctgtggagcgctgtcgactacggttatttgagcgttcagaaacggtgaccgaaggcaccggctcccggagcgctcatcgaggctttcggttgacagtacttaccagtcccaaggtgaagacattgagcagtgtccgccatattattggacatggcgctccgatcattttcggactgctcagaggagaagatggagctcccgcgcttatgcttaaggtaaaagaagatggaaggagtcggtcaatggtgatgacgtttcaagaagtccaggaccgaaacaccatgcatgccctgctcttggggatgactacgagtgatcaagaattcaagataccggacatatccctacaagcctacagtatcgagcaacccgcggacaagttcaatggccaaccagttaaagtt

SEQ ID NO: 13519 - DNA, 1014 bp, A.fumigatus
ttttcctttttgacgagcgttgtacgtctttggtgtatagctgacttactcctttacagaggcaacacccctcttgagaagaagatcgccatccgcccaacatcagaaactgttatgtacccttactacgccaagtggatcagaagtcaccgtgacctgcctctcaagctcaaccagtggaactcggtcgtcagatgggagttcaagcatcctcagcctttccttcggacaagagagttcttgtggcaggagggtcacaccgctcaccttaccgaggatgccgctcgcaagaaggtcctacacatgctcaacctctatgctcggatttacgaaaagctcctcgctgttcccttggtaaagggccaaaagccaaaaagcagaaaatttgctggtggtctttacaccaccactgttgaaggttacattcctgctactggccgtggtatccagggtggaacttcacacggtcttggccagaacttcagtaagatgttcggaattaccgtcgaggacccgtctgccaagcctgatgagaagaagcctcctcttcacgtctggcagaattcgtggggtctttccacccgtactctgggcgttatggtcatgatccacagtgacaaccgcggtttggtccttcctcctcgcgttgctgagactcagacgatcatcgttcctgtcggtatcactgccaagacttccgacgaggagcgtgagaagctgtacgcggagatcgacagccttgtctccgtgctcaaggctgcaggcatccgtgccgatagcgacaagagagaaggctattcccccggctggaaattcaacgactgggaacttcgtggtgtccctctgcgtattgaattcggtcccggtgagtccgtcggtcgttacgtcacggccgctcgtcgtgacattcccggtaaggatggcaagtcgactattcccattgatgagctgtccaccgccgttcctggctctgctggaaaccatccacaaggatctctacaagcgcgcagatga

SEQ ID NO: 13520 - DNA, 210 bp, A.fumigatus
aaattgctgatgaggagacagcctgcttcttactttatttgggaggaaatccaaaactggttcaatgcagaaatcaagaaggttggcgtcaagaactgctcattccctctgttcgtctccgaggatgtgctgcagagagagaaggatcacatcgaaggttttgctgccgaggttgcttgggtgactcacgcgtatgattttcctttttga

SEQ ID NO: 13521 - DNA, 786 bp, A.fumigatus
tccacagtgacaaccgcggtttggtccttcctcctcgcgttgctgagactcagacgatcatcgttcctgtcggtatcactgccaagacttccgacgaggagcgtgagaagctgtacgcggagatcgacagccttgtctccgtgctcaaggctgcaggcatccgtgccgatagcgacaagagagaaggctattcccccggctggaaattcaacgactgggaacttcgtggtgtccctctgcgtattgaattcggtcccggtgagtccgtcggtcgttacgtcacggccgctcgtcgtgacattcccggtaaggatggcaagtcgactattcccattgatgagctgtccaccgccgttcctggctctgctggaaaccatccacaaggatctctacaagcgcgcagatgacgagttccgcgctcatcgcaagctcatcaccaactgggatgatttcacccccgcactcaatgagaagaacatctgtgtcatccctcactgtctcactgaggagtgcgaggaccagatcaaggaactcagcgcccgcaaggcagaagaggactctggtgtgccccaagacgccagggctcccagcatgggcgccaagtctctctgcatccccttcgatcagcccgagggcatcgtccatggccagaccaagtgtgttaaccccaagtgcacccgtatggccgagaagtggtgcatgtttggacgtaagctccctccctatgccttcgctctagaaggaatcgaacaattcactgacaatttgcgcgcaggttcctactaa

SEQ ID NO: 13522 - DNA, 231 bp, A.fumigatus
gactatcgtaatggacgaagtcatcacgggccgcgaacatcatctaggaagcatggtctcaagcatttcctggccgcgtccctcctttggatgtactcaacttcccctgccgatgtctcatggtctaattcagatcctaactccggggaccgcgcaaatggcctatgtttgtggctcggaaagggtacagtgtcgctcggtatgtcgttaacctctgttgatgtgttgtag

SEQ ID NO: 13523 - DNA, 450 bp, A.fumigatus
  unsure (437): Identity of nucleotide sequences at the above locations are unknown.
cacagatttccaacctacgccatatttctacagtcatccattgttatcctccttccgaccgtcatcatcatcctcactatcaccatgactgccacgcttgaacgaagtctttcccgtacatcgagcatgtcaatacccatatccagtcctctactttcagtcagacatgatgtgactcctcctattctatctgaaccctctttgtcacaaatccacgaccgtttgaacctcctagattcacgagtccttgagctacgctcaacagttctcaccaaagatggctatgttgatcgacgtaaccgcgaagacgaacatattcgccgagaattcgaagccaaccgctcgatatcaaatcgaattgatctgaacgtggttgcattgaggacggatgtcgaccaactcaagtcaggcgtgttccaacttaaatctagcattgngcaggccggtaac

SEQ ID NO: 13524 - DNA, 417 bp, A.fumigatus
gaaggggagagtacccaggtcaagcccttcgccgactgctttcatcccgttgtaatcgttctcgccatcgtcagcgttgtcttcaccgttaaggttctcttcattgtcgccgttttcttcaatgccgactttcccttcctcgttatcgccctcatccttgtcagttctatcggctctggaccgtgtatagcttctcctcttgatgcggactttgctgccattgctatcataacgaggcaaagggatctttcggaaatcccagaaggcgtagttttcgaagtatacggtttccgatccggacacaacatagcagtcacactggcgcttgtagaagtcaatggcgagtctaggagatgtggtaccactgttacttggagcaggataagagaggactgttgtggtgaagagcgagggtag

SEQ ID NO: 13525 - DNA, 1416 bp, A.fumigatus
cttttattacctattattctcacgtcgacctacacttttttgagaatgaagttgtaccttttgtctctcctaccctcgctcttcaccacaacagtcctctcttatcctgctccaagtaacagtggtaccacatctcctagactcgccattgacttctacaagcgccagtgtgactgctatgttgtgtccggatcggaaaccgtatacttcgaaaactacgccttctgggatttccgaaagatccctttgcctcgttatgatagcaatggcagcaaagtccgcatcaagaggagaagctatacacggtccagagccgatagaactgacaaggatgagggcgataacgaggaagggaaagtcggcattgaagaaaacggcgacaatgaagagaaccttaacggtgaagacaacgctgacgatggcgagaacgattacaacgggatgaaagcagtcggcgaagggcttgacctgggtactctccccttctcacacactgcgttcgcaagggactggaaaccccaagagtggcaccgaaaaagcaacaaatatgggcctctccctatcattaattcaccagaaaacatatttttcgcgagcaacaccctatatacaaatgatgccgaatcaactcaccttgtactgcgcacgacgcggttccctaaccacacggcgacagccgaactcgaatatcaccttcgcaacatcttccactgctccctacgagtccggatgcgcgttatgacagtcggctctgtgaacagagagccaatgctgtatggccggccagtgcttaaaggaaaccctacaagtcaatcagtggtacccataggtgcatgtgcgggtatcttcacctatcgttcatcgacctgcgagtccgacatcgagatcctgacttcagatccaaccaatattgttcgctatgctaatcagcctgactacgaccccataacggatgccatgattccaggggcggcctcaatcggtaaactttcccagccatggacgaaccctaccacgcaccgagtcgactggctgcacaatatcaccaattggtacgccgacggcgagatcaaagcctccaacacctaccatgttcctgatcaaccgagtatgatggcaatcaatctgtggagtaacgggggggagtggacaggcgaaatgcccgtgggacaaagcgcctacataggaattgagtggatcgaggtggcctacaacacatcaacagaggttaacgacataccgagcgacactgtaccctttccgagccacaaacataggccatttgcgcggtccccggagttaggatctgaattagaccatgagacatcggcaggggaagttgagtacatccaaaggagggacgcggccaggaaatgcttgagaccatgcttcctagatgatgttcgcggcccgtga

SEQ ID NO: 13526 - DNA, 498 bp, A.fumigatus
ttttacacggtaatcctcgaatacgaccgtgcgatgtcgtctttttttacattacccgcttcacagcgaaagcggaagagagacgatcgcgctgcagctccggcatcaaaaaagcgaggtgtagatgcggacggagattctggcgcgaagggaaagggcaggacgagggaaagagatcaatctatttctggcagtgacctagacgatgacgatgaaagtgtggcgtcggcagtatccgaagaggaaagtggttcggagtctgaggatggtgaaacggcagcagagagaagattgaagctcgctgagaggtatttggaaaatgtgcgggaggaggtggacgactacggtttcgatgctgctgagattgatcgagatttgatcgccgagagactaaaagaagatgtggtatgtaccgtctctctgtttttttttatcaacccacccatactgcgcaatatgtgccagatggaccagatggctgacgctcggaaaggatga

SEQ ID NO: 13527 - DNA, 342 bp, A.fumigatus
gagctcgcgcggcttcaggtgagcttattaattacaatcaccatcagcctccatcctcttttctcctcatccatcattttcatctcccctttccagaacagattactattaatatgtgagattggaattcatttatttccaagagggcacgctctaactgttgcttttagggaggttctactaggtatcaccggcaaggactttgtcatcctggcggcctccaaagccgctatgagagggccgactattctgaaagcagaggatgacaagacacggcaactgagccagcacactttaatggctttttcgggagaggcaggagatacaggtacgttgagatga

SEQ ID NO: 13528 - DNA, 264 bp, A.fumigatus
ttgcggatagtgcaatttgccgaatacattcaagctaatgttgcgctatacacgatgaggaacgacacagaattgcgtccgaatgctgttgccaactttgtccgaggagaattggctcggagtttgagatcgcggaacccctacacggtcaacctcctgttgggcggagtggactccattacacaggaacctcacctgtattggattgactacttgtctgcgcttgctcgcgtaccctacgccgcacacggctatgctcagtaa

SEQ ID NO: 13529 - DNA, 588 bp, A.fumigatus
catgtttgcacctttgatctgtcgcgtcttctacagcttagccttggcgaaggtttcggaataccagctccatctccgcgacatctcaacccgattgataatttcactgccacgatgtcgaagagaccggcggaactgtcgcttgaggatgagcctgcagtaggctctcctgtttcgaagaaggctcgtgtggaagacgagcttgaagagggtgacccccgcaacggagcattgcctttgcgacgagccagtggccaggaaatggaggagcatgaacgcaaaggccaaaatattcttgcagcagctgatcacgaagaggaagaaatggaagaggcaattccagagaacgaagaggcaattccagagaacgccgaagtccccgaatcgtccgatgtcgacgaggaccggccagtcatcaaagcgccgaaacgccaaagtgaacctatggaaggctacagcgacctttacctcgacacgataaatcgcgaaattctcgattttgactttgaaaagctgtgctctgtcagtctttcgaatatcaacgtgtatgcctgcctcgtatgcggcaaatacttccacgggccgggg

SEQ ID NO: 13530 - DNA, 801 bp, A.fumigatus
cccccccaattggccggatcctcgctcttcgtggtgaagacctcctgtctaccgttcccctcaattgacgcacccacattcggtttggtgcaagagcagctcgcgcatgatccatttcgtctgctcatcgctacgatctttcttaatcggactcgcggcggcgttgctttgccagttctcttccaagtttttgaacatttcccgacagcccaggacatgagtacagccgagttctcgaagttggtctctatgatccattctttgggatttcaaaacgagcgagcgagaaaatgcatcgatcttgctaagacatggctggagcgtccgccgacaaaaggcagacgataccgcagactgcactacccacgcaagatggatggaaaagatgtcggccgcgacgaatgcattggcgacgacgagaatgacacgcgtgtagcatgggagatcgcacatctgcctggtgtgggcccgtactccttggatagctggcgcatcttctgccgagatgagctgcggggactagcgaaggattggaaaggcaatggcgcggcatcagcagattttgaaccggaatggaaatcggtcttaccgcaggacaaggagctccgggcatatttgacgtggatgtggctcaaggaaggctggatctgggatcggcacacgggcgagcgcaagcgagccagcgagaagatgatgcgtgctgcacgccgtgggggcgtggctcaggaacaggatggcaattttgtgttggagatgtcgcctgttaaaaaggtcgcgaatggtctgactgcatggagttga

SEQ ID NO: 13531 - DNA, 1341 bp, A.fumigatus
acgaaacacacaactccagtcgaacagagacctcgaagaaccgacgggaccgccctgtcgtcttccatctcttcgtccattcatcccaccccagtcctccccatgtcggacctctctcatcctgtcatactatttcccttgagactaaatgacagagatagcgacagggaccgggatagaaagccatcctcctcatcttctacatcgtcaaggcccaaacaacgtcatcaccgctcgtcccacggacggccctcccgcgcctcaaccaaggatcgagaccgtgacatccccacgggtcactcgtccaccacatcgttatctacttccatctccgcctcgcgccaacagcgtcggttctccatgccgggcgtcgacgccgccagccgttccgctacggcctctttactcgagtcgagaaccagcctgccctaccctacattctcgaaagcccatagccgagaggccgtcgggaaaccgagtattcccacgccggacccgaccgacttgacagagaataaagagagcggggatgcagacaacaagcatcgtacggatagtcggcatgcgcctcctagcccgcccttgacgagtctggatcagggcacttccggcaagggaagcacggtcggcgacaaggaagagaaggcggcagaggagaagaacgcgaaacccaaggatatgaagacgaagattcgaattcgagctgagtctacaaagtcgtcttccagtctgcgctcgaaaagagacgaaacatccaagtctagcaaaacggcgaggccagagactccgaaacccaacaaagacaaggatacaccgactcgggttgcaagcaagaagtcttccaaagcgaagatcgctgacgaggacaagctccccaaacgctcgtcaagccggggtacactgtccccgcctcgatctcccgcgacggtgcgtgaagttgggtcagggtcggcaaatgggtctgacgccacgattgcaccgcatcagccatcaatcacttcccggaaaccacaaacacctcctgtcaaaccaccttcacgaaaccaaacgcggtcgtcgatgttacattcgttcagaccagggagcggttcgccagttgatatcgcatttgattatggtcgtcccccaactactgctagttccacattcggcgctccccctccccctcctccgccgcccgaggtgcccgtttctatccctagagttgactatttattacagaatggcggtctggaccaccgagtaccgaagacattactgccgggcccggagcacccagatttgcctcagcagcagtggcaccctgtcttcacctcggggatgacaggccggaaagtattt

SEQ ID NO: 13532 - DNA, 360 bp, A.fumigatus
atgacagagatagcgacagggaccgggatagaaagccatcctcctcatcttctacatcgtcaaggcccaaacaacgtcatcaccgctcgtcccacggacggccctcccgcgcctcaaccaaggatcgagaccgtgacatccccacgggtcactcgtccaccacatcgttatctacttccatctccgcctcgcgccaacagcgtcggttctccatgccgggcgtcgacgccgccagccgttccgctacggcctctttactcgagtcgagaaccagcctgccctaccctacattctcgaaagcccatagccgagaggccgtcgggaaaccgagtattcccacgccggacccgaccgacttga

SEQ ID NO: 13533 - DNA, 414 bp, A.fumigatus
agagtacgaaggcgagtacgaccgagtgcggcagctgtacgagcgtcttttgcagaagacagaccatgtcaaggtgtggatcaactacgcgcggttcgagatcaacgtgcccgaggaggaggaagaggaggaagaagaagaggaggaggagcggccggtcagcgacgaggccaagcggcgggcacgcgcagtgttcgaacgggcccacaaggtgttcaaggagaaggaaatgaaggaggaggtgagttattggcgcttatgtccggcgacgatgttactaacgcagttacagcgagtggaactgctcaacgcctggcgggccttcgaacacacacacggatctcccgaggacatcaagaagatcgaggagcagatgccccggcgggtcaagaagcgacgcaagctggacgatga

SEQ ID NO: 13534 - DNA, 756 bp, A.fumigatus
tatccaaccgatatgatcgttccgaagccccctgtaaaattggagggccattgctcggtcattcacaacaataccctctacacctactccgccaatggatttgcggccatccctctcggacgtggaacctggtataaattgcccatgcccccgggagagccggtctccgatgcggtatgtgtgacgggtggaatagacggtaaggaagaccaacaggcgctctacgtgatcggtggcacgagctcctcgtcgaattccccagggttgcagcgattcgcgttcggttcccaaaagtggaccaccatacagactgctcagcggaccatgcaaaatcggacgtcccatggcgcggtatatctgaagtcttcgtccactctgctggtctacgctggcagtcagacggatagctcgaacccttcatcagacacgtttactatcagcaccgttcctccatatatcctcgacgctcattcagcacagtacccctcctcatcgccggtgcttctgccttggagcgatggtgaagcggccttggtaggtggcgcaacgactcccaaagaggtccatctgttctcagtctcggatggctggcattcctccggtgtatttctcccccagcctctgtccagcgacgtgaaatgcgcgatagtacatggatcggacggaagcaaggcgcttgaagcattcaatctgagcgtctcgcccaacaccatgagtagcatcgcattggctcaaatcccagttggtcacccaacc

SEQ ID NO: 13535 - DNA, 807 bp, A.fumigatus
gacgccaagccattggggatgtgccccaaggacaagctcttccggggttatattgatctcgagcggcagctgtttgagttcgtgcggtgccggaccctgtacgaaaaacagatcgaatggaacccggccaatagccaatcgtggatcaagtacgctgagctggagcgaggactggatgactcggaacgtgcgcgggcgatcttcgagctcgggatcgatcagccgatgctggatatgccggagctcgtctggaaggcgtacattgactttgaagagtacgaaggcgagtacgaccgagtgcggcagctgtacgagcgtcttttgcagaagacagaccatgtcaaggtgtggatcaactacgcgcggttcgagatcaacgtgcccgaggaggaggaagaggaggaagaagaagaggaggaggagcggccggtcagcgacgaggccaagcggcgggcacgcgcagtgttcgaacgggcccacaaggtgttcaaggagaaggaaatgaaggaggaggtgagttattggcgcttatgtccggcgacgatgttactaacgcagttacagcgagtggaactgctcaacgcctggcgggccttcgaacacacacacggatctcccgaggacatcaagaagatcgaggagcagatgccccggcgggtcaagaagcgacgcaagctggacgatgaccgctacgaggagtacatggactatgtgttcccggcagacgaccaggcagcggcgagccttacgaaaattctgcaggcggcgcaccggtggaagcagaccggggggcaggttgtcccgtga

SEQ ID NO: 13536 - DNA, 204 bp, A.fumigatus
tcttggcgcaaatttaaccccgccaataacaacatgatgcagactgacctgatccggaatagagtgggagattcacggaggagattgctgaacaggaagaaagggggaggttttcggatgctcgtcgcctacaagaatgagatcatactactgatgataggacagagtacggatactccgtactctagaaatttcttgggatga

SEQ ID NO: 13537 - DNA, 1050 bp, A.fumigatus
ctctgtactagattgtctcaactagctttgtttagcagtatttggaggatcggaaaccggagagagtttctgttcatgtcatacggcaatatgtcaccctctaaccagaagactcactttagattactccagaggttcaagcctgactactcaccgagcgagttcgttcaatatgaatctgagagaaccgggatgagagttgtggtcattgatcagaaagggcccaaggtgaccgggtactttgtgctcgccacagagatcctggatgattcaggagcgcctcacactctggaacacttgtgttttatgggatcgcgcaattatagatataagggattcctagacaaactcgctacgcgcgtgtattccaacacaaatgcctggacggccacggatcacacagcctacacgctggatacagcgggctgggaggggttctctcagatcttgcctgtctacctggagcatgtgattgcacctactctgacaaatgaaggctgctacacagaagtgcaccacatagacggttccggtaacgatgccggagttgtatactcggagatgcaaggagtgcaaaacaacgcggcagagctgatcgacttggcggcccgacgcctcatgtacccgcctggcgtaggcttccgctatgagactggaggcatgatggagcagcttcgtgttctcactgcggacagaattcgcgcgtttcatcgtgagatgtaccaacctcgtaacctgtgtctgattatcacgggtgaggtggaccatgataacatgctggaaacgcttgacaaattcgaagacactatcctggatgttattccaagtcctgattcgccatttaaacgaccatgggtagattccaaacaagctcctccgttggagaagtcgattgtgaagacggttgaatttcccgaggaggacgaatcttttggtgaaatagaaatcaggtttctgggtcccgattgcactgatcctgtacaaagtgagtccccaagtcttcatcattctagtgattcgtcgcttatgtgtacaagccggtgctcttaa

SEQ ID NO: 13538 - DNA, 348 bp, A.fumigatus
aaatcaggtttctgggtcccgattgcactgatcctgtacaaagtgagtccccaagtcttcatcattctagtgattcgtcgcttatgtgtacaagccggtgctcttaacgtcgcacttttatacctggctgggtcgtcggcttctcttctagagaacatactggtggaaaaggaacagctcgccagtgctgtgtactatgccacggaagatcatccaagtgtcgaaatccgcttcactctgaccagcgttgaaaccgccaaactcgctcaggtggagaaacgattctttgaagtccttgatgacgccttgaagaagaatctggatatgaagtatctgaaagagtgcatc

SEQ ID NO: 13539 - DNA, 264 bp, A.fumigatus
ggtcgtcgcgacactatggggcaaggctattccctcacaaccctttcaacgggttcggctgggatagatgttcccgagctatcagatctgatgtatgagaagtctatgggcggtggccggttcatgaaaagtatccgagcaagacagcgaaatggcctcgttcttgtaaaggtaatcatgaagccttaccccagcatgaagctagaatcctatgtgaaagccatcattcgtgagtttattttgccctgcaacagcttcgaatag

SEQ ID NO: 13540 - DNA, 198 bp, A.fumigatus
aatatcccagtcagccttacaccaatcggcgcatcccaagatattgagagcggtaccatctctttcaaaacaggtatctatgcgcagcagtttgtcagtgtgtattccagaaggtggttccccagcatgaagaagctagtccggcgtaccaagctgccaaaatacgggttcaagctcactagtgagcaaatcctgtga

SEQ ID NO: 13541 - DNA, 435 bp, A.fumigatus
gtttattttgccctgcaacagcttcgaatagactctgacaatgtactaggggagcgcaaactgctttctgatgtcccaaatgctttgagccatcaaagaatcttggagaccggcaccgggggttatcttgttcgccaatatattcacagctctctatatgacaggatgaggtatgcttcgtacatattatcaaccagcaaattttctgacctcggcagcactcggccatttccagaagaaatcgagaagaaatggattgcatttcaacttttatgtgctcttcgagattgtcactctttggatgtattccatggcgacattaagacagagaacatcttggtgacatcatggaattggctgtacctcacggacttctcctcgtctttcaagccagtcttcaccgcggggctggaagggtccgtgcaatcagaaact

SEQ ID NO: 13542 - DNA, 201 bp, A.fumigatus
tgcgatttcatcaggcacgttccttctgccgtatggggcccgattgttactggttatgctgaccagcatataggaaagctctgccctcgagcgatgatcacaagcaagatcctgatggaggacgtggtggccaagggattcaaggctttagttgacgagcggggcaagcatgtcaagatcctagttgaggtgtctacatga

SEQ ID NO: 13543 - DNA, 387 bp, A.fumigatus
ttaacgcgtgtccggggcagcgctgttccttccagccccgtggtgaagacggtcctggcagcatcgcctcgcgttgccgaaggcgaggactcgcacgctggacccgtggagctggtcacccctcccgctgacgcacctgccggtacccgcattggcttcgagggttggtttgacggcgagcctgagaaggtgctcaaccccaagaagaaggtctgggagaccttccagcctgggttcaccaccacagacagtttggaagttgcgttcgacatgagcgctgttcccgccgtgcagggccaggagggcaagccggccttgggcaaactggttgctaaaaccggaggtgtctgtacagtaaagtctttgaagggagctacagttcggtaa

SEQ ID NO: 13544 - DNA, 567 bp, A.fumigatus
ccgattaaccttgcggtgcatatgcagcccttgttcaaaccccttactgtgccctggcatgcagttagccgtgcctcgttccggcccgaggacactgtctttgtggtggggggagaacccatcggtctcgctgtcattcaggtcctgaaagcccgcggagtcaagtccatcatagtctccgaagtatcctcacagcgtaagaagtttgcgagacaactaggtgcgactgaggtctttgatccgcggacggatgatattgtggcttcagtccgcgcaatgacggcaggaggaggggcagccatcgcatttgaatgctccggcgtgcaagtgggcttggacacagctgtgcaggctattggagccaggggaacggtaaccatagtatcgctgtgggaggagaagccgaagatcgatgcgctcgatatggttttacacgagaaacatatcattggcgctgtgatttgtgacgatggcgattttgaagctgtcattgatgcgatttcatcaggcacgttccttctgccgtatggggcccgattgttactggttatgctgaccagcatatag

SEQ ID NO: 13545 - DNA, 225 bp, A.fumigatus
tacaaccatttagcacagttctatagatactctatcttctcactctcttgtacgttgatggaggccaaaactcggacttctgaagtcaaatctaccaccacttctcgcggccaaaagactcagaccctcatcgtctacggagtagatattggtgtgcttcgccaagtggctctcaccccactcagtccgctggctcatttgactagtctatacccagtggagtaa

SEQ ID NO: 13546 - DNA, 282 bp, A.fumigatus
cggcgcttgcttacatggcatatagacctacatgagtaccttgcaggtcccatcacagttccctcaacaccgcatccaatcacgggcgggagcgtccccgtcaccctgggccatgagttcagtggtgtggtagaggaggtcggcgcgggtgtctcacgactgaaagtcggtgatcgcgtggctgtcaagccgaatctgtatgatgggacgtgtgcgaattgtatagttggtaggcgtaactgttgtcagaacttgggatttattgggtatagcagtgagtga

SEQ ID NO: 13547 - DNA, 213 bp, A.fumigatus
ctagtctatacccagtggagtaagttctggttcagctcacagcatctgggttttgttcaaatcgttattatccctatttacagttattgcatcaatctcacctttggtttttcctttcctttccttccttttttttgccctttgctttcaatcgttatcatacagttgtacattcgttggtctggtcctactacagcgttgatttcttattag

SEQ ID NO: 13548 - DNA, 504 bp, A.fumigatus
agccttgaatcccttggccaccacgtcctccatcaggatcttgcttgtgatcatcgctcgagggcagagctttcctatatgctggtcagcataaccagtaacaatcgggccccatacggcagaaggaacgtgcctgatgaaatcgcatcaatgacagcttcaaaatcgccatcgtcacaaatcacagcgccaatgatatgtttctcgtgtaaaaccatatcgagcgcatcgatcttcggcttctcctcccacagcgatactatggttaccgttcccctggctccaatagcctgcacagctgtgtccaagcccacttgcacgccggagcattcaaatgcgatggctgcccctcctcctgccgtcattgcgcggactgaagccacaatatcatccgtccgcggatcaaagacctcagtcgcacctagttgtctcgcaaacttcttacgctgtgaggatacttcggagactatgatggacttgactccgcgggctttcaggacctga

SEQ ID NO: 13549 - DNA, 294 bp, A.fumigatus
tatccgccaaccttatttagaagaccccccaggggtgggcccgctataaggccgaccatgcttcctgttcccatatatcccaaggcctccccgagaccttgttttccggccacatccttcagaagggcaagaccggcgacctcaaccatggcggcggatgcaccttgcaagagtcgtgcaatgatgtacatcgcgacagatcgtgccaccgtgaaaaggcacatcgacgcagcgagtagaacgagaccccccaggaacggagctttgcgccgccccgttcggtcaacgcagtaa

SEQ ID NO: 13550 - DNA, 1044 bp, A.fumigatus
gaagctcttttcttcatttctgtaaatcgtcccactgcgggttgcacattaaagtacattaaatctatcctgcaaaaaagatattcccgcgtcatgttgcctcctctggaaacgggtcgtttcttttttccgcccgagtggcatccccatattgctaccatacttggtttcccgtcccaagctgcgacatgtggcgagctctaccttcagaactgccgtgaaatagtcgaccttgccgctgcaatcgcagagtttgaacccgttcggctgtacgcgcggccagaagacgtacctggtgtccagcaactagtccacagaacagtagacgacccctcccgagtgaccgtcatccccacgtccatcaaccactgctgggtacgcgacaccggcccggtgtatgttcacgacgcatcgggcgagttggatccaaagcagagactcgcgatcagcttcgaattcaacgaatggggcaataaaaacgggtgggagggtatcgatggggattaccgatatgccaacccttccatgtcgccggaagctttgcaagaaaacaccgactttgctcgcaatgtcatcgagagcgacaccgccccatcgcccgtgcaggtggtcaagtcacgcatccgcaccgagggcggcggtctcgtcgtcgacggcgagggcaccttgattgttgccgagagctatatggtctgcgaccagcgcaacccgggcatgagtcgggatgagatcgaggcggaactgcgccggctcctgggcgtggagaaagtcatctgggtcccgggacggaagggactcgacatcaccgactgccatgtggatgcggaggtgcgattcatccgcccgggggtcctcgtctggtcacgccatcaccccagtgttccacaggtgtggctggacatgtcccaggagatccggaacatactggaagacgaaacagacgcgaagggtcggaagttcgaactgcatgccattgatgagcctggtccggaggacctcggcattcaagagcacgacgagttcgtttcgggcctacgccacttt

SEQ ID NO: 13551 - DNA, 729 bp, A.fumigatus
cacttccaacggcaagaggtctactggactagtatcatgctcgttgcggaaacagcggcggcctttttcacctgccccgtctttggttactgcgttgaccgaacggggcggcgcaaagctccgttcctggggggtctcgttctactcgctgcgtcgatgtgccttttcacggtggcacgatctgtcgcgatgtacatcattgcacgactcttgcaaggtgcatccgccgccatggttgaggtcgccggtcttgcccttctgaaggatgtggccggaaaacaaggtctcggggaggccttgggatatatgggaacaggaagcatggtcggccttatagcgggcccacccctggggggtcttctaaataaggttggcggatactatgccgtttgcgccctggggtttgctattgtcgccttggacgcggctctacgtttggctgtactagagccgggtgaggtagagtgcggcgataatcctgcgcggtaccgtgctattccgtcaacagacccagaagaccacgacgtggcttcggagggagatactaccaatgcaccgtcaggctcgaatgtgcaacgcgacgacgcttttgcctcgctgaaattgctgaagcagccgcgagtcgcaatcacgctttgggcactcgcggttgatggaattattatcggtgcttttgatgcggtaggtgctcacagtgcctcaagcaaacgcggtagatttctaacctag

SEQ ID NO: 13552 - DNA, 669 bp, A.fumigatus
aatatcagaccgtgcccagctttgtggaaaagctgttcggatgggactcgtttgcagccggtctggtctttctcgtcatggcggcaccgtcgcttttggaaccactgtttggtgagtcgacaactgaggccagtcctgttgcccaccaaaggacaaaatgctaatagttctgtaggcaggctgtgcgaccgctttggggtccgtctcatggcagtcattgggtattccttgctgacaccttcattggtttgtctgcagtttgtgagccatgactccgtctcccagaagattctgttcggcgtgttggttgctttctgcggcatctctcccgatctgggccagccgggattgtacgtcgagtcacagatggtgatcgaagagatggaacagcagtcacccggaattttcggtgcgaaaggggcggttgctcaggcctttggtctgcaaaccatggctaactacgctggcctggccatcgggcccatcctgggtgatgctctgtttgataactatgggtggaaagctgtagcttgggccttgggggcactgtctgcagccacggttataccttctttttggttgagtagtcggacctatagtcatgagactgaggagacggaagaggaggacctgacagtagcagcaggggttccctatgggaccatttga

SEQ ID NO: 13553 - DNA, 429 bp, A.fumigatus
tcatgcggcgtctttgctgatgaaattcagaattactactgtgcctacgttggtgctttcggagaattctcttgtaacccgagaactctgggatctactcacttgaaccgaatgatctcactcgagggtattgtcacaaaatgctctctggttcgccccaaaatcatccaaagtgtgcactacaacgagcggaaagatagattcgttgcgaggcggtatagagatcaaacaatgacaacgaccggaataaccaacatgaatgtctatccccaagaagatgacgagaagaatccggtatgcgatcgaaggaagagcctgtactggaccggtatcgctgatagttttgttttcgtctttttagttgatcacagagtacggatactcgacatacctggatcaccaaaccatttctatccaagaaatgcctga

SEQ ID NO: 13554 - DNA, 639 bp, A.fumigatus
  unsure (167),(186),(245),(265): Identity of nucleotide sequences at the above locations are unknown.
ggaaagttcttgatgatgaacgccgcaagaggagaaaggtcacgacgttcgacgaagactctgaatccagcgaatcggactccgaggatggataatacttctgcaaatacaaccgccacgccacggtcgagcagacgaagtggaacaatgcgaacacgttcagcagntacgcgttccacaaacggngacgagatggatgctgacggagacgtcgtgtcggaagacggggacggtttgtactttgntagccttcgaggccagcgantacgttcaagccagacaagccgcacgcagacgcagacagatagtcaatctcggatgtccgttgcttcttcgcaaccggcatcgcagctcattcagtctcagaccgatgattcacagtcacaaaacgcaatgagttctacttcttcgtcccagccaatccaacctgcgcgcttgaccgtgttccgtcaggccctaggcccgctcatgggcacacggctcttcactcacggcgacaccgccgatgtcgaggagctcattggagcagttaataccgctgtgcgggaatctccctcgctcggagcaggccatgtcttccagcgcgctgaggcaatcgaggcattgaaagccatgaacgaaagaaacgagttgatgtaa

SEQ ID NO: 13555 - DNA, 1449 bp, A.fumigatus
ttgatcacagagtacggatactcgacatacctggatcaccaaaccatttctatccaagaaatgcctgagagagcgcctgcaggccagcttcctcggagtgtcgacgtgatcttggacgatgatctggtggacagtgccaaaccgggagaccggattcagctggtaggaatttaccgctctttgggaaatcgaaatgccagctctgggtcttcgacttttcgcacggtcgtcatggccaacaatatcattcaactatcttcaaagtctggtggaggcattgcacaagctactatcacggacaccgacattcgaaacatcaacaaagtggccaagaagaagaacgtatttgaattgctggcaaactcccttgcacctagcatatacggacatgattatatcaaaaaagcgatcttgctgatgctcttgggtggaatggagaagaatctcgacaacggcacacatttgcgtggtgatatcaatatcctcatggtcggtgatccctcaaccgccaaatcgcaactccttcgtttcgtcttgaatacagcgcctctcgcaattgcaaccacaggtcggggctcttcgggagtcggtctgacagccgctgtcacctctgataaggagactggagagcgtcgtttggaggccggtgcgatggtcctgggtgaccgcggtgttgtctgtattgatgagttcgacaagatgagtgatgtggatcgagtggctattcacgaggtaatggaacagcagacggtcaccattgccaaagctggcatccacacaagcttgaacgctcgttgcagtgtattggcagccgctaatcctatctacggacaatatgaccctcataaagaccctcacaagaacatcgcgcttcctgattcacttctctcacgtttcgatttgctttttgttgtgacggacgatattgaagatgctagagatagaatggtttcggaacacgtcttgcgcatgcaccgttaccgtcaacctggaaccgaggaaggtgccccggttcgggaagacctcaatcaaaccttgggcgttgggcttgaagataaccaggactccaaccagccgacggaggtgtacgaaaagttcaacgttatgctccatgccggaatggccaactcgagccgcaagggcaagggcattgaaattctgagtattcccttcatcaagaagtacattcaatactctaaatcgagaattaagccggttttgacaaagggtgctgccgaccatattgttgcgacgtactcggctttgagaaatgacgagctctcgggcaaccagcgtcgaacgtctcctataactgcacgtacgctggagacattaattcgtttgtctaccgcacacgcaaaggctcgcttatcgaaccgagtcgaggagcgagatgcgaatgttgccgaatctattctgcgctttgctatgtttaaggaaagttcttga

SEQ ID NO: 13556 - DNA, 1719 bp, A.fumigatus
gggagtttcagtcttgaattcgtaatatctcctgactgtacagaaaacgaagcttggaaaacgcgacagccaaagaatataaataagccttgcttcgccgcgaattcgagatctttcagcactcacagtcggcatattttcacaaagccccctttctatacagactccagatgcatctatcttgttaggatggccgcttgctttgtctatgccctagctttcgggctctttcttccaatctcaagtacgaccgccacaagcacaagggcatccaccactgtccagcctttggatactgtccccgttgactttcgccctgtttaccacttcgtgccagagcagaattggatgaatgaacctaatggtcttattaaaatcgggtctacatggcacttgtttttccaacataatcctaccggaaacttctgggggaaccttagttggggccatgcaactagcaccgacttggtatcctggactcaccaaccaattgcgatctctagtggagatggcattcaagcattcacagggacggcgtatttcgactcggagaatctttcggggctgggatcgccatcaaatgcaccatatcttgcattctatactggctatttcccctcgactggggtgcaggatcagcggctggcgtatagtctcgaccatggcactacctggatcaaatatgcaggtaatccgataatctcaaaaacccaggaagagccgcatgatataaccaagggtctggagacccgggatccaaaggtcttctaccataccccgtcgggcagatgggtgatgattctcgcacatggcggccagaataaagtcactttctggacctcgagcgatgcagaatcgtggacctggagaagcgacttcaatgccaacagcattccaaacttacccggcgggatcaacggatgggaggtgccggactttttcgaactcgcgatcaaaggcacgacgcagaaaaaatgggtcatgatcattactcccgccactgggtcgcccgctggtggcaatggcgtcttcgcagtcgtaggctcattcgacggtgctgttttcaccgcggaccccgtagatcctatcgcattttggcttgattacggccgtgactttgacggggccctcagttgggagaacgtccctgcctcggatggacgtaggattctcgcttctgtgatgaatagttatggggggaaccccccaaccaacacctggaagggaatgctatcgttccctcgcacactggagcttcaacagtttaatagcaagctgcgcttcttgcaattgcccgtggccgagctcagcgcgtacacatggctcatcgcgaatatcacgaatcaaaccatcgcccctggacagacgttgctgtctgacatccattctcggacactcgatatagagatgtccttcaccccttcccccggcgcgacgctgtctctctctgtccgcaagggagggtctcagcagacttttatcaggtatgcggagagtgctcaacaactctcggttgatcgcaatgccagtggaaatatctcgtatgatcccgcggcagctggtgttcacactgctactgtgcagcctgatgcaagtggggagatgcatttgcgtgttctggttgatacatgttctcttgaggtgtttggggggcaaggggaggcggtgatttcgaacttgatcttccgtcttcacgccgcggctggaaatatcacgtcc

SEQ ID NO: 13557 - DNA, 1368 bp, A.fumigatus
atcggaagccgacgtctgagctatattctgtacctgactgatcctgacactccctggcagtcagaatggggcggtgctctacgcttgtacccgaccaccaccaagaaagacatcaacggggaggatgtcctagtccccagccctgacttcagcctgagcatccccccggcatttaaccagctcagcttcttcaccgtccagcctggcgagagtttccatgacgttgaagaagtgtatcaccccaaggagggcgaggataaatcggccaagcgcgtgcgcatggccatcagtggatggttccatattccacagaagggagaagatggttacgaggaaggcctggaggagaagctggccgagcgaagcagtctggcgcagctccagggccgcggcgacatctacgatttgccccaggccaagccggtcgtgtgcgagaaagagccggagatcaagggcaagggaaaggccaagatggaggaagagcccagctccgagttcagcgaatccgacctcaactttctcctccagtacattgcgccgtcctacttgacgcccgacatcgccgaggaaatgtccgacacattctccaacgagtcatcgctcaaccttgaccgtttcctgtcggacaagtttgctgcccgggtacgggcctatatcgaagagcaggagaagcaggaacttcccaaatcctccgacgagatccaggccaagaccgaatggacggttgctcgcccgccgcacaagcagcgctatctgttccagcaacatggaactgccacatcggaccagaaaactcctatccaggaactactcaacgatctgttcccttccctcgcattccggaaatggctggctctgattaccggtgccgagcacattacgagctatgatctcctggcacgtcggttccgccgcgggcaggattacacactcgcgagcggatacgacggcgaagaaccccggctcgagttcacgctgggcctgacgccaacacccggctgggagaaggaaacagacgaagatgaagagatggaagacgaggacggcgaggcgcaggagaaattcaagaaggagactgcctcggcggacgagcctgcggtaggcggctacgagatctatatggctggcgacgacggagacgacggcgacgcagctatctacaagtccgccgcggcggacgaggacgacggcatcctcttcagcaccgcggccggatggaatcggcttagcatcgtcctgcgcgacagcggcactctcaagtttgtcaagtatgtcagcgccgcggccaacggagaccggtgggacattaccggcgagatgggcgttgattttggcgacgacgaggacgatgaggatgacgatgaatag

SEQ ID NO: 13558 - DNA, 543 bp, A.fumigatus
tcctcccatccccgtggtgaagacctttatcgagaagcccatggcgtcggcgcttctgttccattcccggggacgcggcaaggatattactcgacgcactcggacacgttgcaggacattgtgtcgcagctcgagatctacgttgcgctgcatcgggagaagtgcgttaatgggtcgtctttcaatgctgcggatgggcagactgtgagctgggctcaggtttggccgggtctctgtgcgtatttcggtcttgttggctgtgagccgcagaccagccctcagacgagtatggaggactttgttaatgggcatatggatctgtggaagcgtcttgctgaggtccatgagttgaagagcgacactgtggagaaccagaactggggccatacgcactttatgctcgtcgattttgacttcaacagggaatattcgctggagaaagttaggtctattgggttcatggaacgtattgatactgtagaaggctataagaccgttttcgatcggatggttactgccaaactgatcccgtcgtttcgctga

SEQ ID NO: 13559 - DNA, 222 bp, A.fumigatus
  unsure (80): Identity of nucleotide sequences at the above locations are unknown.
ctcaatcgctcgagccttcttttttccagaacatactggccccggtttgccggtcgcggactcttggcggttcgttcggncctactttgggtgggttattttaactcccgctcaaaccagtcaaagcattacttaaaggctggttattggaaaacccctgcctactatgtatcccttttgaagaaacgcactaatggcgttgatggacttccgaagttgtga

SEQ ID NO: 13560 - DNA, 261 bp, A.fumigatus
ccctggtgggcgactgctgaaaagtggggctactacatccccgacacaaaggaatccggccgcaatgaaaatggtggagggtcaaagggggaagctcttgcggatttgaactggctgtcagcaggtatcgtggtcaaaaccatggccgcccacgcttacataatcccgctggctgcatgcacgcttccctttttttccctgcagggtggctatcttattgcagaagatttcacaacttcggaagtccatcaacgccattag

SEQ ID NO: 13561 - DNA, 2970 bp, A.fumigatus
tctcaagactcgccggcagacgccgataatcaggccaaagagttgccgcaccctgaagaggagttccaagctgaggctactcacgctcaagaactgccagaggataccgagatcatcaacaaaactgacgacttgagctcgggcatagatccttcaggacaagcagggggtgacatggtgaatgaggcggcctctcctgaggtttggcatgatgcattggcttcctctcccgaggataagaacggcgaagccgagcaagccgaccttaaatccaatgagccacagaacgaggggaaggcaccagtatctgagctgccggcacttgacaaagaactctctgagatctcagaaagacctgccgaggtggacgctcctgccgacacgcctcttgttgattccccctctacggatcaggtcgaagcagctgattctggcgtacagaacgaagagcccacacccactgctgcagaattggaaactcccttgtcacgcaagaacagcaaaaagaacaagaaaaagaacaagcggaagaacactgctgaaacgccagttcagaatgaggccgttcatactgcagaccctatttcttcaattgaaggcgtgcctgaacctgggcctgaggctacaaccactgctgtagaggaacctcaagtaacgttgccggatgaggctgtcgatgaaaataagggagaatctcgggacgttcaagccgtcaaagaggaaacctcacccgaaaacgctgccgaagtagcaaacgattcccagccaagtacatttgaggaaatccatctggcaggagcggaacagtccgcgccagacgcgatagctgagatcatgggcgaatcccagcccgctgaacctcaagacgtcctagccacagcacccgaagagcccattgacggacagccaaaaaagaaagccaagaaaaagaagaatcgaaaaacagctaatgtttccgagtcccagcctgagtctgaggcagaagccaaaactgaaaagctccaatcagccgaacttgcagagaacccacaacctcatatacgcgatgaggtagcgggcgacagtcaggtaccgccagagtcgggtgcctcagaagcacctgcagggattgaagatgtcacgcccatttctgcagcggaggcagttgaattcgatttacctgtggagaaagacgagaccaatggcggagaaccacatgtgtcagagctcaacaagcaactaaataatgagactgtgcctggccctgaaacggggtccgagcctgtgcctgaagcgggagaaattacacagtctggcaaaaagagcaagaagaacaagaaaaagaagcagagcctgtctcttgcacctgatgaaacgccagcctccgatccgtcaactcctgcaggcactgcagatgggaacgcggatttgcctgccgcgcccgaagactccttgaaaacagatcaagaaccaatgccagaggagccaactgtaagccaaccgatcgttgacttggttgctgaaacattaaatctgagcatggcggaggaagctgtcccgatgaccgccgcacagaagaaaacaaagaaagaaaagaagaagaaacgccagtctgccttactggatgaaccaactgcaactgagtcgattgaagaagctaatgccaaggatgttacttctgaaggtactcagatgcccttggaggtgccatctgaaccgcaatcatccgggcctactttggatgctattgaacacgcggaagcggcagctgagcactcacaagaacaacccaacaaggatgtgactttgcacgcggatcacagccccaactctgatggagagttcgtgctggtgccagaacatgtaccctacggatccaatgacgaacataaaacgcagcctggttccatggaattggatgtcacacaagtgaacactgaattggaaaaagagccatcgacccaggaaggcgtgttggaagcaaacgaggccactccggctgaaacaccttctgctgctgaccaacatgtccaagaagaatccagccctacgccagcaatggagggtggtgctgctgccgaagaactagttgccgtagaaccggacgtacttgaaggctctcaagacaagataaccgaggacaatgatactcccgacgatagcttgacagcgaaagagcctcaaacagaactagtcaacgcagagactactcaaaagactgagcaaggcgatgtcgtgctggacgtcgaagctggctctgaaggcctcgttcgggatgatcagcctgtcgctccctcgaagaaaaaggacaaaaagaaaaagaagaagcgccagtcgcttaccatagacgatgagcaacgttcctctacaaaggaagaaccaacagctgaattttcgtccgaccatgttccagagccgtcggccgttgatgagtcggcgaccactccttccgcctctgaagagcagcagaagcctgagacagatatcactgagaccgttacacaaacagctgctgaaccaacaccatcttccgcttcagaagaaccagagaacattgcagaagcgccttccaatgaatccacacaggagcctgctgcagaggaagctcaaacagcaaagtccaagaagaaagcgaagaaagacaaaaagaaacgaaagtctgtctccttcgagattggagagcccttgactcagcagagcgagcctggccaccctactgcgactcctggcgaaacagtaactccacatgaggatccaaagcctggggacaaacctacctccccgaaagatagttctgaggagtttcagtccggagaagcagtccctgagagccctcaagatagcgcaggtattgttactcaacctgagcaacccgagccaaccgctgaggctacagtagttacagaacaacacaagcaggtgacagagccttctctagtttcaataaacgaggagtctcaccaagcgggccgaagatccgagcaatgcgct

SEQ ID NO: 13562 - DNA, 1689 bp, A.fumigatus
  unsure (73),(106),(116): Identity of nucleotide sequences at the above locations are unknown.
gaggaacggaactcgggtggcgaagccgtttcagttcgactcccggcatccaattcttcttcgtccgcgccanatacgggcgccattacgacaggaaacaactcgntggccactgntgtcggccctttggtttccaaagcacccggtatgacctctatccttcaagattggcacatcgagtttagcgtagacgacaagcctgtctcaagtgacaccacaatctaccgtgctgtccaccacaatcgtgaacacgcggatgcagggtcaaggaatgtgtggtctgccattcacaccgtcaaattcagacgggttccaggaccgccgcccccggagccttctaccgttgcgccccacctcgaagaagaattatccggcaacggtgctgagatgccatcctctctcagcaaagattctatcacagcgccgattctacggctccttcggtctctgcacgagatgaatgtcactctagatgacatacttgctgataccaaggagcttgtagcactaaaaccggagccgctggcgcaatttatcaacaccaagctcactgccaagctgaaccgtcagctggaggaaccactcatcgtggctagcagctgcctgcctagctggagcgaagatctagcacggcttttcccctttctattcccgtttgaaacccggcatctatttctccagtcgactgcttttggctacgcccgagctatgatgagatggcaaaattcccagaatgcggatgacagccggagcgaccaccgacgtgatgacagaccattcctgggacgtctccagcgacaaaaggtacggatctccagaagtcgcatcctggagtcggccatgaaggtcatggagctctatggttcttcccctagcgttctcgaggtggaatacttcgaggaagtcggaacgggattgggcccgactcttgagttttattccacggtctcgaaggaattttccaagaagaagctcaagatctggagagaaaacgactgccacaacgacgaagaatttgcctttggcaagcgtggcttgttcccagcccccatgagtgaggaacaggccaactcggagtctggaaagaaacaactgagcttgttcaaaacgcttggaaagttcgttgctcgctcgatgctagactctagaatcatcgatatctctttcaacccggccttcttccgtattgccgacagctcttcctcggtggctccgtctctgggaacggttaaagccgtcgaccaagaccttgcaaactcccttatgctgctgaagcgcttcgcgaacgcgaagagggcaatcgatcgcgatcggactctctcggccgcagcgaagtcgcaagctttgcagaatgtcgaaattgacggcgtcagagtagaggacctaagtcttgacttcactctgcctggttatccttcaattgaactaatcgataacggttctaacgtccctgtgacgattgaaaatgtcgatacgtacgttgaccgagtggtcgacatgacactgggtagcggcgtgcaacgtcaagtggaagcgttccggactgggttctcgcaggtcttcccgtactctgcgcttcggactttcacccccaacgagctcgtcatgcttttcggaagagctgaagaagattggactattgagagtcagttaccttccatatttgataaccgagaagctgttcactaa

SEQ ID NO: 13563 - DNA, 381 bp, A.fumigatus
cactgggtagcggcgtgcaacgtcaagtggaagcgttccggactgggttctcgcaggtcttcccgtactctgcgcttcggactttcacccccaacgagctcgtcatgcttttcggaagagctgaagaagattggactattgagagtcagttaccttccatatttgataaccgagaagctgttcactaacatcatggctttagctctcatggactcaatcaaagccgatcatggatttaatatggacagcaagagcgttcgaaacttactgcagacaatgagcgagttagatacccagcaacggcgcgatttcctccaatttgtcaccggcagcccgaaacttcctattggaggtaaacatcaccttctctctttgttttga

SEQ ID NO: 13564 - DNA, 216 bp, A.fumigatus
ctttctattcttcttctaggtttcaagagtctcacccctaccttcaccgttgtctgtcgtcccagtgaacctccttacactcccgatgactaccttcccagcgtcatgacgtgtgtgaactacctcaaattgccagactacagcagcctggaggttcttcgagagcggctgtccgttgctattcgagagggtcagggtgccttccacctgtcctaa

SEQ ID NO: 13565 - DNA, 201 bp, A.fumigatus
tctcaaagacgacagaggcgaagtaatagaaataattattcccgttggtcgtcacgagaatacatcgccaaggggtatgatgctgttactagataccgtaccaatatgcagaccgaaaacgctgtcctttcttctttcttcctttttctttttatgatccgccagttgcttcataagtttttccttcattttcgattgtag

SEQ ID NO: 13566 - DNA, 315 bp, A.fumigatus
accatatatgagtctatatcggtcatgcatgactctatcatatattctttagttttcagtccatacttcaagaatgccctacaagtacaactaattagtatgactccgagctcactctctcataaacaacgtacagtatcagtctgcagtccgttacaaaaattgatcggagcccatcatcataatgtctcaccaaaccttcatgttcctagtttatacacaagacgtacggagcatatattctcgccattactgtctcggcaaaccgataccaagaaccagactctcggcatgccgatcttcttatctaagtga

SEQ ID NO: 13567 - DNA, 849 bp, A.fumigatus
cttaagaccgccatgtcgtggttagcaaggcccttccgctgcctgagcagggtcaacccagcgaccagacttgtcgctcccgtatctacatgccgctcctctcaacgatgcatccagggagcatcagccgttgctcaagatcaccactcgagtcacacgtcttccaccgttgatgatggctcctcaattctcctcaatcagacagcgtcagcggcacaacgtccccgccctcagaccaatcccatcgacgacttaatctcccaaacacccatcgtccaagccctccgtcgcgatcccgcctacaccgaatcccgtcctcatctcgcaatgaaccccagccttcgcccgaatcactttgtcgcaggacccaactctggcccaggcaagatctccgtcccgccctatgtctggatggcgaagaagccgcacaccgccaccggaacgacgaccagccgcatggtgtcggtgttccatatcggggtgcagctctgcggtcatcccgggtttgtgcacggcggtctgctgacggtgatgttcgacgaggcgtttgcgcgctgcgtttcgacttcgtttcgcagtgggctgggcatgacggccaacctgaatgtggatttccggaaacccgcgctgccggaccgactctatgtgcttcgggccgagacggtcaaggtcgaaggccggaaggcgtgggtcgaggggacgttaacttcgctgccgcccgtgggtgacacgagtgagcctgttatggttgccgagggaaaggctttgttcgtagaaccgaaattcgcagaggtatgttgcaaccataagtttccgcaggatgattgccatactgattcagccaattag

SEQ ID NO: 13568 - DNA, 261 bp, A.fumigatus
aaaccaaccgtcaccatgaagttcactggaatcgtcgcttccttggctgttgccagctctgcctctgctctggccatccctcagacccctgttgatgccaccctgagcaagctgaacaatgctctcaacaatgttgagggtctcgtcggtggtctcctcggcggtgtttgtgaggaggtcgacctcacccaggttcagaccggtatgtcctttacggaaggaacctctgaaacgtgcaaaagcatagtctggcctcgctaa

SEQ ID NO: 13569 - DNA, 339 bp, A.fumigatus
tcccaattctgtgcattagagctcatcaccatcaagggccagctgaccaagctcgtccccgtctctgccaccaagcgtgatgtcatgagcacggctaacaatgttgctacgcccgtcaccggtgcggccggtagcgaactcgacaatgttgagggtgctgttaagcccgtcactaatgtcgctggcaacgcagtcaacaccgttgaggatgttgctcagcctgttgctgatgttgccggtggcgccgttggcaccgtcaagaacactgttggcggcgctgttggcaccgttgagaacattgcctctggtcccattgacactgttaccggcagtatgtag

SEQ ID NO: 13570 - DNA, 2520 bp, A.fumigatus
ttggcgacagggggatatgagtttctggcctttggtaactcgcagttccgagagcatggagcctacttctttgcgcctctgcccagtctgacggctgcgaacatccgagcctggatgggaacattcaacgatatacgcaacgttgctaagcatgctgcaaggctggggcagtgtttctctaccactcgagctatagctggctgtccggtacagatccgattgatagacgacgtcgtccgaaacggatacaccttttcagacggtgtgggacgaatttcaaagttcctggcgcagatggcagcttcagagctcaagatcagaacaccaagtggtgacccaccgtcggcgttccaatttcgtctgggaggctgcaaagggatgctgacagtttctcccgaggctcagcgtcaagaggtgcacatccgcaagagtcaatacaaatttgcatcggtccacaacggcttggagattattcgctggtctcagtactccatggcaactctgaatcgacagttgattattgttctttcctccctaggcattcaagatagtgtctttcacgataagctcagagctatgctacagagtctgaacgaatcaatggagagtgattctcaggctctgtgttggctaaagaagtatgtggatcctaaccagatgacgcttgttgtcagtcagatggtccttgatgggttcaggagttccagagagccatttgtcacgtccataatgagactctggaaggcgtggcatctcaaatatttaaaggagaaagcaaaaatcgtgattgagaagggggcgaacttgcttggatgcatggatgaaactggcattctcaggggctattctgaatggattcctgccaagggcgcctctgatgaagagaagttagccgcgttaccggaaatcttcgtccagatacatcaccctgacactgggaagtgcgaagtcattgagggagtatgcatccttgcccgcaacccatctctacatcctggtgacatccgggtagtaagagccgtcaatgttcctcagttgagtcatctgaaggatgtcgttgtcttcccacagaccggggatagagacattcctagcacgtgctctggtggagatctagacggcgatgattaccttgtgatttgggatcaagatcttgttcccgaagattggttccgcaagcccatgaagtacacaagcgacaaagcccaagatctcgatcaggatgtcacggtgaaccacattacttcattcttcgtcttatacatgaagaacgatttccttcctaggattgcccacgctcatcttgcctgggcagatcgtctcgaggacggtgtcaacgaagaaaagtgcatacgactagcccagcttcactccgacgctgtcgactacaacaaaacaggcaagccagcaaacatggcacgcagcctgcagccgaaggtgtggcctcacttcatggagaagaagcacaagccaaaggaaatgatatataagtccaataaaattctcggacaactatacgacgcggtggagcgtatcgactttgttcctagccttgaaatgccctttgacgaacgaatcttgacatgcagcctgggagtcagtgatgatcttgtgcaatttgctcgcgacctcaaggctgactacgacgcagccatgcatcgtatcatggcacagcatgagatcacgacggaatttgaggtttggtctacctttgtgctaagtcacagcaatatgagcaaggactacaagtttcatgaagagttgggactgatatcatcgtccctccgcgatatgtaccggaagaagtgctatgagaaagtcggtggtcgcagctttgagctgcttgctcctctcgcagttgcaatgtatcgtgtcactcacgaagaaatgacctctgcgcttgaaaagtgtcgatctgaaaatcattctgacggacagctgttccataagccgacacctaaaatcgatcagctgccattcatcagcttcccttggatcctgtacaacatcctgggtaagattgccttgggtcactatgaagattctgagccgggttcagcacccactgtgatagcacctgcaaccgcaagcgtggatccgctcgatcctgtccctggtcaggccgtttctgtccacaaagagaacagcaacaggaccgagcccacgtcagactctctcaatggcattcacgaggatccctttggtctcttcgagggcgatcaggaatccagaccgtcatcgcggcccagtcgagaggcagaggtatcggcaacccagaatagacgcgagagtattccatctctcgaccagctgcttgatttcggacttgtagaactcagcctccctatttcctctgaccggttacatttgagtgcacaagctccagatggctttaacttgttagaactcaatgacaacacggcactcgacaaacccactgagggtagggcagaggaaactgatctggcgacacagatgagcttggtcttcaccacggggctggaaggagccgcgtcaact

SEQ ID NO: 13571 - DNA, 204 bp, A.fumigatus
ttgttcactgtcgcaaacggatgcaacgtcaagttctctacctatatagctaatagctttctgagctctctaaaccattgcgcgctcaccgctaaatcttccggactttctggacctcccggactttctggactttctggactttctggacctcccggactttctggactttctggactcgtctacatagaattcaaggtataa

SEQ ID NO: 13572 - DNA, 726 bp, A.fumigatus
gtgctcctgctgatcccgctatggatggccaaggtgaacaccgtcgttccggatccgtatttggacgaggttttccatgtccctcaggcgcaggcgtactgggatcataggtggtttcattgggaccctaaaatcacgactccgccaggactttacatctggtcttacatcctttgtgctgctgcgctagtactccgtggctctccgaaggagctcaacgctggagccctccgtgctaccaatgttgcagctgcagcggtctttcttccctggcggctgcagactcttttggatgcattgcgtaaggtgcgcaatacgcgcccttctggagcttggctgagccatacggtgctgaatatttgccttttcccgccactgttcttcttctccgggctctattacacggatattgtctccctacttgcggtcattgaagcttataattgcgatatcaaacgttctgggggatcctggtcacttctcaagacggcagtttttgttgcgactggattgaccgctcttgttctccggcaaacaaacatattgtgggtggccatctttcttgggggcctgcaggtggttcggagacttcgtcagtcctcgaaggccagccaggcctccagtctgcttcaaatcatccagagcggtttcaacaatgaactgtacgacccgcttgtgtcggaggcctccttctttggtgagtgtctctcctggccgcctggatga

SEQ ID NO: 13573 - DNA, 987 bp, A.fumigatus
cccaggctctgtggatgtgtaactgacgatgtgctaggacacaaagagtttcacacagcaggtctgcatctctcgcagatgctctatatctggccttatttcatgttcttctcttggcccatcctgattttcccagtcatcaatctggtgcttccaaactctgtgatacccgcattctttgactacggatttaccaaaaagcaaaaggggcttcccagaatatggacggccctggtcattattcccatcatgctggccgtcgtccatttcaacaccatcatccatccattcactctggctgataaccgtcattacattttctacgtcttccgtattctgcgttcgcaccccgctatcagatatgctgctgttcctactgcctactttgttggtggctgggctgtgatttccgcatttggattctccaccaccaagccacagcctcaatttgtgccaatcacaaagtcaaacgaactggctgctgctcagaaggggcagttgaaggaggctgcccgcaagaaagagaagtctgaacgcaagtccaagtcgaaaaaggccagccaagtgacggcctcgccgcccgcccaagatcagttctcacccgaggttcttgctcgaatccaggagcaccttgcgcagcgtcagaagcaacagcaggaagtcccacgagcgagcttcgtgctcgtctggcttgcagccacggcactatcgcttgttaccgcgccgcttgttgagccacgctatttcatcattccttgggtaatgtggcggcttcatctacccccacagccggtgcctctcgtgtaccgccaacaacggcctcgtgatgagcgggaggccctgcacgccgatctggcgactaatttctccttgttcatggagacgtactggttcttggcgatcaacgccgccaccgggtatatctttttgtacaagggctttgaatggccacaagagccggggaaagtccagaggtttatgtggtga

SEQ ID NO: 13574 - DNA, 615 bp, A.fumigatus
gggtactctacaggcggttacgacaatcgggtccaggagaatgtccaataccatcgagaactagaccagctcgccacaagtttgggattacagaccgcgacctctaaaacagtcatctccgccctatccatccccgactccatcgacgttctgttcttgctctccgtaccaactgccttccgggatacgctcctctcgcaggcaaaactgcttctctacactcccatcaacgaacactttggtattgtccccgtcgaagccatgcgcgccgggatccccgttctcgcatcaaatacaggcgggccattagaaactatcgtggaaggcgaaacgggctggctccgggacgcaacggttgtcgcggattggactgcggtcatggaccgggttctctacgagatggaccagaaggacttggaccgcatgtcagccgtgagcaaggcgagagtggagaaggagttctcgctgactgcaatgggtgacaggctcgaggaggagatcaccgatatgctcagcaaggaaagacggccgttcagcggttttcaccagctaatcctcgtctttgccctgttgggtattatgtcttctattcttgccgtgtgggctttgaaatga

SEQ ID NO: 13575 - DNA, 2064 bp, A.fumigatus
gtgtacttgaaacacatcttgaatggtggatgccacgtgacttcgtgcaaagggcaacgcgggcccatcgcgacacgcgtgagaaactgcagaaacgtcgcagcggcgtcggataagccatcaactaatccacaacctcggtgcgcttcaacgaggaaaatgccagaggttatcaacctcctgtcctcgacgccgccgcccccggcatctcaaccccgtcagcgattcgtggccacgcttccatccgatccgcccctctcatctgctcctcggcctctgttatcggacgatattgagtccctttttgcctacgatgatatcgataaaccggccaaaagacgtcgcttaagcgaggaggttgaatcacctatggatgtatacgctcaactctcgaccacaaatctgtttctgttctccgatgatgatgtcgccttagcgtctgacggaccgtcaacgttggggatcccggcgcggaacgaggagtcggatcctattgttttcacttcgccagcgcctgttccaggagcaaggtcgcttacgagccatcaaacgaatttcatagagactaacacgatcacaattgacgatgacggtgacgacgacggtgatgcgcatgtcgatatctgcaaagatgccgccaccgggaaggaccacatcgaagacttcagtgatcagcttgcaataccggatattgacgagttaatgaggcaggctagagagacaaaggaatctggtaatgaaaactcgctcttttcgagtcgaacggccagtcttcttgccggtctgaaggagcgctcaaaagctaccagtagtacagggagtaggccgagatcaagagccgcacgtccttccaagaagtcaaagtctcaggcgcgaaatgtccttgaccttgactatgatctgtccgaagtagtggttgaatctcgcaggccagcacgaaagacaaccactttgaccgccgcagagaaagatgcaagggccatagagcgagaatccgcaaaggcacagcgagagtatgagaaacagcttgagaaagaaagacagaagaagctgagggaggaaaaagcgcgagaaaagcaactcgctgcggacttggcggaggtcaataagctcaaggtcgacaagagggagtcgacgcctgagatgatcctcgatctcgcttcctcgtttagggaaacaagtgttggcaatcagagcattgaactcatgaaacggctaggagtcgagcatacgttcttcacgagctctatcccgaacctcgtcaaatggcgccggaaggtcacagcccggtacaacgaagccgccggccattgggagccatgtccgcatcatatccgcgaagaagaccacgttttgtgccttgtgacagcccaagagttcgtcaatatggccatcgcgcccgcagacccggtaacaggcacaaccgagctggaactccatctctcgcacatcaaaaaagcctaccctcgccacaaattaatctacctcatcgaaggcctaacctcgtggatgcgcaagaaccaaaactcccgcaacagagcctttcaagcccaggtgcgccaacaactcgtcccagacgatccttcctcctcgacccgccggagaaaaccccccgccaaaaccgccgagtccaccccgcccgtcgacgacgataccatcgaagacgccctcctcgagctgcaggtcacacacgcctgcctcatccaccacaccagcgccgcatcagagtcagcagaatggatcaagaacttcaccgagcatatctccacgataccgtacaagcgcgagcgcatggacggcaacgactcggccttctgcatggacacgggacaggtcaaacccggcgaggacaaggccgatacttttgtcaaaatgctccaggaggtaaatcgcgtcactgcgtctatggcctacggtatcgcggcgaagtatccttccgtcgtggaactggtgagaggaatgcggcggcatgggccgaccatgctggaagatgtcaaagtatgctatgtgctcagcggcctatctaacctaatgcaagtgtcgagttacgctaacttgttttga

SEQ ID NO: 13576 - DNA, 786 bp, A.fumigatus
ccttcggcggcgtgggacaaaatgcaatcccgcgggcacagagtcaccatctacacctcccaccgggacaaatcgcactgcttcgaggaagcacgcgacggcacgctcgacgtgcgcgtgcgcggcaactccctcttccccgcgcatgtcggcggccgactacacgtcctcatggccgttctacggcaattgcatctgaccgtctcggtgttgagggagattgcgacctctgaagaaaaagacaacatcttcatcgtcgaccaggtccccgcttgcgtgccgcttctgaaaacgctgggcccgcgcgcggcgcgcagcagtcgcagtcgccagcgcatcctcttctactgccatttccctgatcagttgcttgcacgtcggaatgagggcggggagctgttgcgacttgcgaagacgctctaccggtatccgtttgattggtttgaggggtgggcgatgagcgcgtcggataaggtcgttgccaactcgaggttcacgcgcggggtcgtgagcgaggtcttcgggaaggagaagctgggagatgttcggattgtctatccgtgtgtcgataccaaggctggcgcgccggttgggaccgaagaaggtcctttatggggtggaaagaagatcttcttgagtgtgaatcggttcgagaggaagaaggatttggcgctggccattcgtgcgtatcacggtcttgggcaggagaagcggagggggacgaagttggtggttgctggtatgtcctcttccaagtgggttcctgatggagagagcagctattga

SEQ ID NO: 13577 - DNA, 267 bp, A.fumigatus
acaaacctccagagggtgtggttctgccacctaaagacattcgaggttcgtccccctaaaggtttctgctggagatatatgctgacatttcatgtagctattgtggagaaaaccgcaggctatgttgctcgcaacggatttgttttcgaaggtgcgctatcggtctacgtcgattcatcgattttcatgttccattttaagctaacagtactcttccagaacgtgtgcgcgaaaaagagaaaaacaacccgaaattctcctttctga

SEQ ID NO: 13578 - DNA, 1464 bp, A.fumigatus
gctaacagtactcttccagaacgtgtgcgcgaaaaagagaaaaacaacccgaaattctcctttctgaaccccggggatgcttatgcgagcttttaccagtggcggttgaacgaaatcaaagaaggaagagggaccgcagtagcagcaggtcgtccaggcgagtcaacagcagctccagaaccagagaagcccaaggggcccgcacagccaccggaatttcacttttcggctcggatgcctatcatcaacgcacaggatctggaggtcgttaaacttacggcgctctatgttgcgaagaggggcaagtcatttatgaccgctctgtcgcagcgcgaagcgaggaactttcagttcgattttcttcgcccgcagcacagtctctatcaatttttcactcggctggtcgatcagtataccatcctgttaagagcagaaggaattgacgagtccacatcagaaaagcgcagaatcgccgaactggaaaacaatgtgaagaacaaattccatatcttggagcgggcgaaacagcgcgctgagtgggtgaagtaccaagagcaacagaaacagaagaaagaagaggaggaggagcaggagcgaatagcctatgcgcagatcgactggcatgacttcgtggtagtagagactgttctcttcactgaagcggacgatcaagccgacctacccccacctacatctctcaacgatctacaatccgcctctctggaacaaaaagctatgatgtcgctaaacccactgcgaatcgaagaagcgatgccaacagaccagggagcccaagtctactacaacgcctatcctccaacacaacccgagccggtggcacatcctgcccctccgtccgtttcaccatatcctcctcaagccccggtaccgcaaccctatcctatggcctctgccgccgcgcaggaagaagagcaacggattcgggagcggatggaggctcgagaacaggccgccgccgcacaagcagctgccaaagcgggccccggacagcagccgatgcgcattcgctccgactacgtaccgcgcgcacaagcgcgtcgtctcaatccttccggcgctactgcactctgccccaactgtcaccagcagatccctgtggctgaacttgaccagcacatgcgtatcgaactgcttgatccccggtggaaggagcagtgtgccaaggccgagtcgcgaagcgccaccacgaatctgtcgaccgccgatgtggtcaataatctgacacggctggcgagccagcgaagcgatgtattcgattcatcactcaccgcaggtctcgatcctgaggaggaagcaaggaagcaaagaatggcttacgagaacccccctggagcggggcccacaccgccgatggttggtcctgcagggggcccgcccaaccctcagagtctaaacatcgaggagcagattcgacaaattcacgaacgttacaagcagggttag

SEQ ID NO: 13579 - DNA, 1134 bp, A.fumigatus
tgtactaatgatttctcgtgcatgcagatcatataccccgcactgtttttcgctatcatcggcgctggcggtgtgttcatgggctccaattctcgcagccaacctcaagaactcgagcatatcctgcatttggcagatccgaagctgatcattacgtcgcgcgatgctctccccaacgttctcagcgtctccgccgcccgtggaatgctctcgagccaggtgtgtttgctggatgaatacgctcccaaccatattgcccagttgcttttgtcgggcccgcaggccttggttccggacaacgacgctgtgtatctgaatttcgcgcaattgctcagctatggagagaacgactgggtgcgattcaatgacccggagatcgcaaagtcgacgccggccgccatgttctccaccagcgggacgggcggcctgcccaagggagccctgctttcgcatcatgcaatcgtatcacatcacctcagcatcaactatgatgtcccctacgtagttacacggctcatctctctgccgatgttccatctgttcgggtcgctctggacgcacattttccccatccgttacggccagccgctcttcgtcctcccgcgcttcgagctgacccagtatgtcgccgccatctaccactaccagatcacggagacctacatggtccccgccatgattcacgttttcaatcgcagtgcccccccgatcgcagattacatgaggacgctgcggtacgtcggcgtggcgggtgcgcccatcgacggcccttcgatggagcaattccagcggctcctgcacccgcacgcgcgcgcaactcagctctggggcatgaccgaggtcggggtcgtgtttcagacgcgatacggcgagcaagggaaccccggcagtatcggacgcctgctacctggatacgaggtgcgactggtcggtcaggacgggaacgtggtgcagggggagtctcgaccgggggagctgtatgtgcgcgggtccggggtgctgatgagctacaagggccgcaacgacgccaaagatgcctatggctggttccggacgggtgatgtggcctatgtccagaacgggcagtactttatcgtcggccgaaccaaggaactcatcaaagtgcgagggtaa

SEQ ID NO: 13580 - DNA, 405 bp, A.fumigatus
tcgggaaatagatggcaagttgcccccgctgaactggaagcggttctcctcaaacaccccggcatcgaagacgccgccgtcacaggcgtcacctccaaagatggtagcacagaattaccccgcgccttcgtggtccgagccaagggaccagctgcaaatcgactgacagcggaagaagtctaccaattcgcacgccgtcaactggccagctacaaggcgctagacggggggattgtctttgtcgaggaaatcccccgcacagccagcgggaaaattcagcgcttcaagctctcgcagatgaacacgtaccgcgacatggtatctagtctgctggcgcggtttaagggagccgctagtggattgggggggctggggttggtgcacaagggccgtgtggccgtgtag

SEQ ID NO: 13581 - DNA, 183 bp, A.fumigatus
aagcttcctaagaaacgatcgattttcagcgagtatgaattgttaaaggccaacggccaatggatcactgggatcttggccgttggtctatggataacatctgttctaattggtcgcacgaatatgttttgcggtacccagcataattactcgggcaagtttgaaatggtccctggcccttaa

SEQ ID NO: 13582 - DNA, 255 bp, A.fumigatus
aagatgacactgtcgttgttaatggtaggttgccgctgttctggccctactcggttgtcctctgtacttagatttgtaggaagaatacgtgcctatagactggccgggagcaagttgatattcttcgatatcttccaggatgggcacaaagtccaggttatgtgcaacattcgcaagctggacggagtagctcccgatgctttcaagagattttaccgtctccttcgccgcggcgatactttctgtatgttgtga

SEQ ID NO: 13583 - DNA, 522 bp, A.fumigatus
ccgtcccccgtatcactacccgagactgaacgattttccatagccgtaactggtaaccctcaccgcacaggaactggggaactcactgttcttgcaaccgagcttcctcgactcctggcgccctgcctgcacgatgtgcctgtcgacgccgaagagcatgagacatctccctacccacgccatgtccagttccttgccgaccagaaggcggcagatatcatccgagcgcgatcagctattattcagtttctgcgccaattcttcctcgacagatcgtttatggaagtcagcactcccatcattggctcgatagctggcggagcgattgcccgtccgtttcaaacttctgctaccgaatttcccgataggcaactatccttgagaatcgcgccggagctatggctgaagcgcttagtggtcggaggatttgacaaagtgttcgagattggcccttcatttcggaatgaaggtaagtcaggacagatacttgatcgttggatcgacatggacatgagtgactga

SEQ ID NO: 13584 - DNA, 783 bp, A.fumigatus
tatgctgcgacaggactggacaaaacgcataacccggaatttacaacatgtgaattctaccatgcatacgccaacctcgaagatttgatgtccatcacagagaacctcctatcaggcatggcggctcatattcaggagttcaacaagaacgccagtctgaaacccccagaagtcgacttctcagctcccttccgtcgagtagactttaccaccggcattgaaggcaagattggccgcagactccctgacctcaccacaccagatgccctagaccaagtcagccagctgttcagagacctttcccttcctattcccaaggaacctactctccttcgtctcctggacgagctgtgcggcacctaccttgaacccgaatgcatcaacccaacctttatcatcaaccctccagagtgtctctccccgctgtcaaagtccttcattcacccggccaatcagcagcgtgttgcggcgcgcgcagagctcttcatcgacgggcgggagatcgtcaacacctacgaagaggagaactctccctttgaacaaagacggaaattcgaggatcaagtccgctacaccaagggcacagacgagccagcggagatagatgagagctaccttgaagcgttggagtgggggctcccttctaccggtggctggggatgtggcattgatcgcctctgcatgctcttcacgggcactaagaggatcggagacgtcctcccttttgggaatctccgcgccgtaacccgtcggcatactggactgtcaaggagtacgaattga

SEQ ID NO: 13585 - DNA, 303 bp, A.fumigatus
gggttaccagttacggctatggaaaatcgttcagtctcgggtagtgatacgggggacggctatatgtcacaacatacagaaagtatcgccgcggcgaaggagacggtaaaatctcttgaaagcatcgggagctactccgtccagcttgcgaatgttgcacataacctggactttgtgcccatcctggaagatatcgaagaatatcaacttgctcccggccagtctataggcacgtattcttcctacaaatctaagtacagaggacaaccgagtagggccagaacagcggcaacctaccattaa

SEQ ID NO: 13586 - DNA, 207 bp, A.fumigatus
gcaacgggactgatgatcctgcacgtcccagacgaaacagaggtcctgaacccggatgcgatttatgacaggggccgctacgtgagattgactgcgttcattgcggagaaagaggagacccaccccgatcccaggatctatgtggagcaacggttttaccagggcaaccaggagattcttcaccacggggggcaagatccgcgctag

SEQ ID NO: 13587 - DNA, 342 bp, A.fumigatus
atatatgcgactgcaggaagcgaagcaaaggtagactatctagtacacaacatgggaattccgcgccagcggattttcaactcgcgcgacagttctttcctgccggctttgatgcgtgtgacccaaggccggggagtcgatgtcgttctaaactccttagctggggagctactgcatgcctcatggaaatgcgtggccgaatccggcaagatggttgaaatcggcaagagagacttcctcgaacacggcaagcttgacatggatgcgttttgcggtaacagagccttcttcggcgtcgatctcattcgccttggggaaaaaccaggcttcatttcaaggtag

SEQ ID NO: 13588 - DNA, 1080 bp, A.fumigatus
attggaggcacagggatgcagcgcagtcatgatacagggagatgtcggagtactcgacgatgtcaaggccgcaatccaacacagcagccaccccattggaggcgtgctgcaactgtcaatggcgcttcgggtaagttcaatgccaagagaagcagacaaactcaacgggttgctaatctggcaaaggatcactttatcccagctatggcgcactctgactggaaggaaggtctctccgcaaaagtggcgggcacttggaatcttcatgaagcactgacaggacacgatagccgtcttcaatttttcgttgtctgtggatctattgctggcgtcatgggaaatgctggccaggccaactactcgtctgccaatgcgtttttgacgtcctttacccagtaccgactccgtgccggtcttcctgcctccgttgtgaatctgggcgctgtgaacgacatagggcatctagcggtccaggatcagaagttgcgggacaggatgttcgcaggtcatgttcgccttctcagcgaacaggaggtgcttgatgcatttgagattgccatgcttgagtgtcaaccatcgagcaagccggcgaacgagtcgtcggacgagattctgcgcgtccgaaacgatgttatcatgggcatgaggagcacaaaatctctggcagacccctccgtccgcccactctggggaagggacgcaagattcagcgtctatgcgaatttgcgcatcaacaaacagcctctctcgaaggacctggagacaatagagggcctgcagcaggaattggcggcatgcgaaaagaatccggaccggctgaaagaccccgcatttccgaaacgaatcgtgagggaggtcatcaggagcatacgggaatattcgaattttgcccgcggacaagactacgcgcaggtggctgctttacctattgattccctgatgactgtggagttccgcaactggtcccgtcgttatttcaatttgaacctccccttgacagcgattgcaaaagcaggcaccgtggaaggatttgctgaattggtcgtcgagtggctgcgctcgaagtatctcaagcaatga

SEQ ID NO: 13589 - DNA, 642 bp, A.fumigatus
cgaaaacgcggcattaggcttgtcgctcaagccatggccctatatgaagagggccggattacccccgtgcgaccgctggaagttgtggaagcaactgatatccaccgggccttccgactcatgcaactggggtatcatatgggaaaactggtcgtaaagatgccggagagccccagggaggtggttgtttccaagtcacgcttaaagctgactctgccggatgatgtctcttatcttctcgttggcggtctcgggggagtaggacgagcgctggcaaccatgatggtagagcgcggcgctcgtcacttcgtattcctgtccaggtcagcgggaaagtccgcgcaggatcaagcattccggggtgaattggaggcacagggatgcagcgcagtcatgatacagggagatgtcggagtactcgacgatgtcaaggccgcaatccaacacagcagccaccccattggaggcgtgctgcaactgtcaatggcgcttcgggtaagttcaatgccaagagaagcagacaaactcaacgggttgctaatctggcaaaggatcactttatcccagctatggcgcactctgactggaaggaaggtctctccgcaaaagtggcgggcacttggaatcttcatgaagcactga

SEQ ID NO: 13590 - DNA, 225 bp, A.fumigatus
ttgggggggggaaaagccgatccgccggggcggtgtcttactgtctgtctgctagttctctccggcagtggggaaattgttaaggtcttgtgctcccggctgataggagacgtagataaacctgataagcaaatggacgattctccagactccattgccatgatgcaagagcacaaggtgacactgtacagcctcattaatatggtcgtggtcgtacctgagtaa

SEQ ID NO: 13591 - DNA, 1137 bp, A.fumigatus
aatatcaacaagaaaacacagcatcctgctgttgcagaatacattattttcatcccaaggcccaaaatgcatcttctctccgaaccagacgtctctcgtattctgagaaacctaactccagaacaatgccacatcttactcgacgctctgagcgaagcgctggtaaccgtctcatcagagaccacaaaaccagaaggggagcgtctcatccaccagcccctccgcaccaccatcgccaccaaagaccagaacctatcgctcttcatgcctgtctccaacacagccaacacgagcatcaagatcgtcacggcctcccagcgcgaaggcatcatcggcgtgatcaacgtattctcgccggagggccggctcctcggcctgctcagcgccgcagaagtcacagcctttcgcaccgccctcgcaaccatgacgctgtttacgcgctgcactaccatcccgaagaaacacatcttgatcttcggctcgggacgccaagcagagtggcacgctcggctggcgctgctgcctgctccaagcctggtgcagcggatcaccttcatcaaccggggtcgccggcggctggaggagttggagagggaggttatcgcggagctgcgagcttctcatccgaagatcgtattcgaaacgctggctaaggaggggaccgatgatgcggagtatgaggcgcggctgcgcgcggaggtcgcctcgtgcgacgtcatttttagctgtacgccgtctacggagccgaattttccctacaagtatcttctttcgtctacgtcggcggctgcgtctaagcagcggtttatttcgctgattgggtcgtataagccgcatatgtgtgaggttgactccgagaccgtcctctcgggtggtgggcagatctatgttgattcgcgggaggcttgtcttgaggaatctggggagctgatcaaggcgcacgtaggaggggagcagttggttgagattggcgagttatttgggagattgggcaagtcggagccggttgtagtgccagaggggtgtaatgtggttttcaagtgtgtgggtatggggattatggatttggtgattgggaagaagctgttggatattggtgttgagcagggtttggggatgaatgtggacggtttctga

SEQ ID NO: 13592 - DNA, 678 bp, A.fumigatus
gagttcactaaaccaagtaacttaaaatatcaacaagaaaacacagcatcctgctgttgcagaatacattattttcatcccaaggcccaaaatgcatcttctctccgaaccagacgtctctcgtattctgagaaacctaactccagaacaatgccacatcttactcgacgctctgagcgaagcgctggtaaccgtctcatcagagaccacaaaaccagaaggggagcgtctcatccaccagcccctccgcaccaccatcgccaccaaagaccagaacctatcgctcttcatgcctgtctccaacacagccaacacgagcatcaagatcgtcacggcctcccagcgcgaaggcatcatcggcgtgatcaacgtattctcgccggagggccggctcctcggcctgctcagcgccgcagaagtcacagcctttcgcaccgccctcgcaaccatgacgctgtttacgcgctgcactaccatcccgaagaaacacatcttgatcttcggctcgggacgccaagcagagtggcacgctcggctggcgctgctgcctgctccaagcctggtgcagcggatcaccttcatcaaccggggtcgccggcggctggaggagttggagagggaggttatcgcggagctgcgagcttctcatccgaagatcgtattcgaaacgctggctaa

SEQ ID NO: 13593 - DNA, 321 bp, A.fumigatus
tttcacgactgtcatggatgttcctaccccggcatcgctggggaatccgaagcgtccccgcgtttcggaggaaaaccgcaaaagagctgtgagagcgtaagatccatccttcatgcccctcataatgctgcattttgtttgttactgtattttgagagattccggataattgactttcgcagatgcgatggttgtcgtcgagtcaaggagaagtgcgagggaggcgtgccctgtcggcggtgtctgcgttatcggcgacagtgtgtctttactcaccccgatcatgcagagaaacttgctcgctcatcgtcagtctcgtaa

SEQ ID NO: 13594 - DNA, 204 bp, A.fumigatus
cataccagcaacagcttttcgttaaggatattaccaccaaccaccgcgatggtcttggactacagcaaatgggatgctctcgaactgtccgatgattcggacatcgaggttcacctaatgtcgacaagcgctccttcattagagcaaagcaggctcagatccatcagcaacggcaccagcgccgtatggagattgagactctaa

SEQ ID NO: 13595 - DNA, 438 bp, A.fumigatus
gatagtctgatcaacagtatcacaactaaagaccatcaagcggcgacacttttccgcaacgacgtgaacgaaacctacaacaaaatcaaaacccgtgcagcggaactcgccaaagacagttcggctgccaatgatcctgctggagtagagcagattcaattgcatgccgtcgatcctaacaccaagatcactatcaatatcccacccgcagacagcaatgacccggcagtaattgaagctcgcaagatcttcgagtctttctcggaagatatgcagaaggcattagcctcggagtctcttgatgaagtcaacaaggtacttggtaaaatgcccgtcaacgaggctgaagaagtggtggagaagcttggggctggcggcttgctaagccttgaggaagccatcgttgatctttaccacagggtcgaaaatccgcgatag

SEQ ID NO: 13596 - DNA, 915 bp, A.fumigatus
ttcggacatcgaggttcacctaatgtcgacaagcgctccttcattagagcaaagcaggctcagatccatcagcaacggcaccagcgccgtatggagattgagactctaaagtacgagcgaatcatcaatgatggtctcctctcacgtatagacaagctcctcgcattgcttcgcgagcatgaaggatcttcacgggatcccgaggagctggtctttcaagccgttatggaatcggcaagcaacccagctgaagaccaggcacctgtcccaccagagggcgttcatacacacgaaaaggagcagccgaagtactctcagatgctaagttctttagttgatcaagttaagaaggagatcggcgagtcgagtcccgataaccgataccaggcatacatcaagggtgtagagggtcaccaggacaaagttcaggggttacagaaagaattgctggctcgacttgcgcagctggagaaggaagagtccagcaagattacgagcgatatgctgcatactggatttgacacatcctacatatcaaagtcaaaggataagggcaaggcaccggctacggcgaaatcagaaaccgtggaacttttaaatccacgtgcagtacaagatgatgcaccgaaagctgacgataatgagcaagtcgacccggacgacgtcaaagcgagcgatctggccaagaagtttgctcgcatcaatcgtaatgactacagggcattgcttcaatttatctcggagcacccggagattgtcgcggagaaagagacggatggtcttctagtcgaagctttcaacagccagatggaaggaaaggaggagtatgctcgccagtgcgtacaccaggggctgttgttgcaatattgtcgctctctaggtcgagacgggatctcacttttcttcaagcggtaa

SEQ ID NO: 13597 - DNA, 1416 bp, A.fumigatus
atccccgtccaattccgcatcttctctccaaatttccagatgcgcgggattaggtcgcttccctgctgggctcctgggttgagcacgaagcgaattcctccacgagaactgtttgcagacctatttcctaatgcctgcgtaatttctgcgagacacagcgctcgcaatggtctcatccgacagttttcgggttgctccgggtcaataagcaacagttgcaacccgcgtccgtatcgatccgcaattacgtccttgttatccgccaatgtctgtagtaaaggggtttcggccgttcaaccgcgatttttgagtacagtcaggctgttttctacctcccagcgatcattggagccaaagtcgaacgtcaagtcgacaggcggtcaggtagtgaggccagagttacaccaggatcaggagcatgaggacatcgagaaaggctttgagctatcggagagagccgctcaggcagcacaggtcaacctcagcgcgaagctcgccaaagacggtgctgctggaaagaaggccgggttcaaggaaatatggaggctcttactgattgctcgaccggaggcgaagaagctcgccttagccttccttttcttgctggtatcatctggtattacaatgtccatcccattttcgattggaaagatcatggacacctcgacaaaagcgactacagaaggtggtaatgagctctttggtctgagccttcccatgttctatggtgcgttggctggaattctcactctgggcgctgcggcgaattatggtcgcattatcatcctgcgtatcgttggtgagcgtattgttgccagacttcgctcgaagctcttccgccagacatttgtgcaagatgcagagttcttcgatgcgaatcgggtcggtgacttgatttctcgccttagctctgataccattattgtcggcaagagtattacacagaacctgtccgatggactgcgcgctgcagttagcggtgcagcagggttcggcttaatggcctacgtcagtctcaagctctccagtatactggctctccttctccctcctatcggcctcggggcttttttctacggacgagcgattcgaaacctgagtcgtcaaatccagaggaatcttgggaccttgactaagattgcggaggagcgcctaggcaacgtcaagactagccagtcctttgctggcgaggttctcgaggttcgtcggtataacaatcaagtgcgaaagatctttgaacttggcaaaaaagaatcccttatcagtgccacattctttagctccgtacgcaactgtcccaacccttccgcttatcttagatctaacttctgtctagaccgggtttgctggcaacatgaccatcctggcattgctgtacgtcggaggaggcatggtccaatccggtgccaaaacgct

SEQ ID NO: 13598 - DNA, 1875 bp, A.fumigatus
aaatgcgaagtttgtggcaagtccgaggatcgaccttcgatacttgtgtgcgatagttgcgaccagggttaccatagaaactgtcttgatcctcccctgacgaatatccccgagtatgactggcactgccccaagtgcctggtcggcacaggcgagttcgggtttgaagaaggcggagtctactcgctcaagcagttccaggagaaagcaaacaccttcaagaagaattatttcgcctccaaaatgccttttgacccggtgctgaatactcaccggcgggagtctgaggatgacgtggaacgcgaattttggagactggtcgagagcttaactgaaaccgttgaggttgagtatggcgctgacatccattcgaccacacacggcagtggctttcccacaattgaacgcaatccccttgatccctattcaacagacccttggaacttgaatgtccttcctttccacggcgattcacttttccgtcatataaagtcggacatctccggtatgacagttccttgggtctacgtgggcatgtgtttttcgacattttgctggcacaacgaagatcactatgcctactcggccaattatcagcatttcggcgcaacaaaaacttggtacggtatccctggatccgacgcagaagcattcgaagaggcaatgcgccaagcagttccagagcttttcgaaagtcagcctgatctacttttccaactcgtcactctgatgccacccgatcagctgaaaaaggccggagtaaatgtatacgctctagatcaacgagctgggcaatttgtcatcaccttccccaaggcatatcatgctggtttcaatcacggattcaacttcaatgaagccgtgaacttcgcccctgcggattgggagccttggggcgcaatgggcgttgaaagactccaggctttccgccgccacccgtgcttctcccacgatgaactgcttctgacagcagccgctcgggatacttcgattacgacggccaaatggctagctccggctcttcaacggacatgtcaccgagaggttgcagagagggcagcattcatccaccggcatcgtgaaatagcaccgcacaactgcgcgcttggttcattggactcctcggcttctggtgaatgccaactgaagtttgtgattgaggaagaagatcttccagaagatgactaccagtgtcagtattgcaaggcgtatacatatctgacgcagtttcgctgtcacaagtccggcaagacagtgtgcctgctgcatacggagacttttgattgctgtggagactcgtcctctcagcggctgttaggcccagaccatacgctgcgttacagaatgagtgatgacacactgaaagccgtcgtgcagaaggtccaggagcgtgccaggatcccagaagcgtggggggagaagcttgacaaggttctggaaaatgagccgaaaccccaactgaaggtccttcatagcctactaagcgaaggtgagaaaatcccataccacctgcatggtctccaagatctcgcggccttcgtccagcgctgcgataagtgggttgaagaagcaaacaactacatcacccggaagcagcaaaaccggaggaaaaacgagaaggcttggcgcaagagtacttctaaggccgcgcagctggaggaacgtgatcgtgaagttcgcaggatagaaaacatgtacgcccttcttgcagaggctgataaactttccttcgactgtccacagatggcggctctggaagagaaaacccgcgagatcgagaaattccgccaggacgttaacgttgcccttatgaacccccatatacggtcgatccaggaagtgtcttcaccacggggctggaaggatccgcggtag

SEQ ID NO: 13599 - DNA, 1041 bp, A.fumigatus
agcgccaccgcggatccttccagccccgtggtgaagacggactcaggaacccgtgcaaacttgaattatcttgaccagctggccaagtttcacaagcaacatggcaccaacctgaaccgattccctagcgtggataagcgtcccttggacctatataagctcaagaaggccgtcgaaatacgtggtgggttcgatcaagtctgtaaaatgaagaaatgggcagagatcgggcgtgatcttgggtacagcggcaagatcatgtcctcattgtcgacctcgctcaagaattcgtatcagagatggcttcagccttacgaggaatacctccgtgtggtcaaaccgggagtgcagcagcagctggagctagaacatggtggtccatacacaccgtctccgaaccagtcgcctatggcgaagaagcccgtcttgtacgaccacaccacaccgtccactacgccgcaagctcctccgggtattccggccactggtggtccccatggcactccaaaggaaatcgaagccactcctgataaacccacccctccggccgaatctgcagcccctcggcctgttacgtccggcttcactcctgtcaatgccggtggcggcggttttactgctgtcaatcggtctccatccttcgtcgccgtgaatagcggcccagttgtcaagaaagaggctgagactggctcgcttacgccgcaaagcgttgctgaacaccctcaaagttcgacacctgtcaccaacggcaatggaggccatcccatgaaacgtgccatcagtcatgaaagtggctccccgactgaaggtggggaaacggacgcaagtgggcgaagaagcaagcgccttcgaaagggtaagcatgtgttttctcaacattcctcgtggctcgatatgtctgacgttctcctagatgcaccaccacctaccgtcgcgggttcacacatgagcctcctccgtcctgctccgcctcgggcacgcaaaagcgacagtcggaagatcggcgatgtaagcaaaaaaaagtcttcgatcgttatgtaa

SEQ ID NO: 13600 - DNA, 828 bp, A.fumigatus
  unsure (215),(220),(268): Identity of nucleotide sequences at the above locations are unknown.
aaaacaacctcgttaaataaatatcaagatatgacctccccatcagactcatggcccgcaatcctcactaccgccaaacacaccccccgaacatcaacaccgaaacccgacctcccctccccacagcagcaatccctcattgactccctgcggaccctccctcgcatgaaccaggatgtcgaagccgatgcagctcaatcgcaagcggaactaanatcanctatcgccgatattctatccgagtaccaagacgaagacgaaagacaanaacaacagtcctgcacctcaacatccaacgaaaataaaaccacaatcgaggaatgggaaaacctccacgccttcctagcattcatcaccaaggaacggattgtccggctagaagacgtcgggatccatgttttgagggttgcgctggagaggggtgagccgcaccagcaccagcaccaacaccattattcgcaccggcggtacccggagacgggaacgaagatggagatgaagacggagcaaggggggaatcggaaaaagatggctgttttcgtctcctgtgcggccatctgggcggtggtcatgggtgaggagctgtgggaacggaggcatgagactgacgaatgccccgtgggattgtctctgtcgcctgcgcagcgcgcatctgcggctgctgctcctactgctgcaggggaggccgccgcggcgactactgtctccaaaagtcgctggcagatgtggattgatcggtttcagtttctgagtctggctgaagatctggatatcaagacgagggaattggctgccgaggcggccgccgtgatgcgtcgcgtgacttag

SEQ ID NO: 13601 - DNA, 1017 bp, A.fumigatus
gctgacattactagtttgctatcatcgctgaacctgccaggatctttgcaggcgcttgagaagccccttggactgcctccaacgctggtagctcacgccgaggagatgcgacagcagaacgggctgcaccggctgcggaggtcgcttgaagatatagccaaggtcaaggccaacgacaaggcggtctacaatgagggcgtcgagctgctggcggccgaaaaggcggaggatgaagcttcacggcgaaaatacggaactgatcgatggacccgtcagacctccgaggcggcggcgccgaaactgtacaccacgtcgagtgagatcagcgggtattttacgtcggcgcaaagcagcgacaatctcgtggagcagaagctacgggactcggaaacggtgtttcgggtgctcacaggcaccaatcgcgacctggagatgtacgttcccagcagccgacgggctgcaatccctccggaggtggagcgcgagttgatccggctgcggggatgcctgagcgaagtgagtcggttggagagccgaaggaagcggcgagcgcaggcgttgaaggagaaggcccgagcggatgatgtcacgcaggcgcttttgaaggagactgcgcggctggagcgggagtttcccatgcagccgatccaggcgagccaatttgaggatctgttcgaggatcaacttcatctgtacgactcggacctggagatggttgcgcaggagcagcatgatcaggaccagattgcggcgcaggtgcgcgaagccaaccgggcattcactcgggcgcacaagggggatgcgtcgaccaaggagcgggagaaggcgctgcaggagctggagaacgggtatctgaagtacaaggagatcatctcgaacattgaagtgggccgaaagttctacaacgatctggccaagattgtggggaggttccgggatgactgcaaggcgtttgtgcaccagcgccgcatggaagcgagtcagctagaaaggtattttctcttgtcatcggcttag

SEQ ID NO: 13602 - DNA, 996 bp, A.fumigatus
gcacctgaccgttgtcaagtctcacagaataaccttcgcttcgaattggccaacatcctcttcaatctggcggcgctatactcccagctagctttctcggttaaccgaacgacttccgacggactcaagcaggcatgcaattacttttgccagtctgcgggggtcctcctgcacctacgagccgatatcctgcccgacctgcgaacgtccccgccagaggatatggatgaaatgaccctgcagagtttggagcaacttcttctggcccaggcacaggaatgcttctggcaaaaggcggtcaaggacggtctgaaggatgcatcgatcgcccggctggcggccaaggtttcggacttttacgccgaggccggtgactgcgcggtcaagtccaatgcggtcagccctgagtggatccaccacatgacggccaaacaccatcactttgcggctgcggcgcaataccgccagtcgctggactgtctggagaagcgaaaatacggtgaggaagtggcgcggctgcgggatagtgaggcgtgcgtcaacgaggcgctcaaggagtctcgctggataaaccgggccgtgctgggagatctcaatggcctgaagagccgcgtgtcggaggaccttaagcgggcaaccaaagacaatgatgtcatctatctcaaccctgtgccgcccaagtcggagctcaagatcattgatcgcgcgtgtatggttgcggccaaggcgccatctcaggtgacggatgcgatatccatgctgggggagaacgggcctttggggcagccgctttttgccaaattggtgccatatgcagttcatattgcggccagtatctactcggatcgccgtgaccgactggtcaacgagagagttattggggagttggagaccatgacagacaaactacgggagtacgttcttgcaactctgaatgtcctggccgctttttttaagtggattaagctgacattactagtttgctatcatcgctga

SEQ ID NO: 13603 - DNA, 198 bp, A.fumigatus
tatcgacatagcattcctgttactctaagttttgaacaagcgacaggaaagaatgtattactcttaccgatgggtagctcaaccgacgctgcccactctgtcaatgagaaactggacaagaaaaattacatcgaagggaccaaattacttggtgcctatctgcactatgttgcggaggagcccgccagcgaagtctag

SEQ ID NO: 13604 - DNA, 633 bp, A.fumigatus
agaagtgcaactatcatcgtgcggctgaagaaccagggtgatggagcctttatgcctgatgactatggaaagtcaatcataatagagcgtcacttctcgaaaaatggtacgagtggattcaagatcaaagctgagaatgggcgtataatttccactaagaaggcggagctcgactcaattattgactatttcacactccaatttgataacccgatgaacgtcctctcacaagacatggctcgccagtttctcagcacgtctagtcccgccgataaatataggttttttgtgaagggtgtccagctggagcaactggaccaagactacaggcttattgaagaatctgccgatcaaattgaagagaagctgagaaacagagagcaagacatcaaaatcttaagagatctaaaagatacagcggatcgcagattggaaaaatcagatcagcaggaatcactcagaagccgcattaggaacgttcgaaaccaagtggcctgggcacaggttgaggaacaggaaaaggcaagtcacacagtctttagggccagtattcctatgtctaagaaacaactagttgagagactccctggagggcgagctcgcgcggacagacagagagatagcagcggctga

SEQ ID NO: 13605 - DNA, 624 bp, A.fumigatus
cctggcagcccggcggttaagaagtcaaaacttgttgaccccaggggcaacattctgattcctggcattatggacctcgttgcgcccctcaccgaagaagaaaactcattgtacagcaagatcagctatacgatggacaatctccacgagtcgctaggtagtaagacgaatattcatgaaacaaaagagagaacactcatggcgagatggaggtacccatccttatctatccatggcatcgagggcgcattctccgctcctggcgccaaaactgttataccagcgaaggttatcgggaagttttccattcgaaccgttccaaatatggaaagtgacgctgtgaacaagctcgtgttcgactacatcaaggcggagtttgccaagctgaatagcaaaaatactttggacgtgtggcttcagcatgacggaaagtggtgggttgctagccccaagcactggaacttcaccgctgcaagcaaggctgttaagcaggtcttcggtgtagaacctgatatgactcgtgaaggcggcaggtacgtaaactatttgagtttactttccagatttgactacttgcatcgcgatacatcggctaatatcgacatagcattcctgttactctaa

SEQ ID NO: 13606 - DNA, 582 bp, A.fumigatus
ttacaatttcatgaccaaaaacttatccgctccttgatgatggcgtctgcgaagcgcttacaggcgtcccaggaccctgaaagcttcaatgatgaaagcaatggcacatctctgacgtccacttcggtacgactaccatacatgttatgcattcaacaagttaacctagttatacagcgcaaacgtattcgtaggtctgaaacatcccggtcggaagaagacaacgaatcaagcgatgctgagacaacgagatcttgttccatcaccgaggctctggatgatgacgaggatgaattggaactgcgtgctacacaagcaattcaagagaaatactctttcgtcaatgaagaaccgaatattcctgctgagcacggcatcctcgagcgtgtcgaatgttacaatttcatgtgtcatgatcatttccgagtcgaattgggcccgttgataaattttatcgtgggcaagaatggtagtggaaagagcgctgttctcactgccataactctctgcttgggtggtaaagcttctgcaaccaaccgtggtcagagtcttaaaagcttcatcaaagaagggaaagagtaa

SEQ ID NO: 13607 - DNA, 228 bp, A.fumigatus
atcttggttgacgaggatgcccctgtaccctcgaagaagaattggatttatccacgtgaaaagaaccctacccaagacaccatagagttcctctggagattgttgtttgttgagctcactgaatgctgggcgaccctggacgcaacattcaagtatgaggagtgccgagtgcatgcagcaacgaagaaggaccggacgcgagatattcgcgtatctagcgatctttga

SEQ ID NO: 13608 - DNA, 639 bp, A.fumigatus
tcgtcagtctttcttgcttatgctaacattccactcaagctgtcaaccgctgtgtaccaacactctataaacaagctgaaacttatgactaggagtgccctcgtggggcttatccatgacaagaccatgaagtcacccagcattgcttatgataacggcgaagccaccacactcatgagtactgatgcagatagtctcgataggatcgccgaaatggtccacgaaacgtgggcccaagtcatcgaagtgctaattggtattggacttctagctagtgaagttggttggatttggcctcttcctctctttttgatttattgtaagtatatttgcatgactttcttgttgatactgagatgtgtagtatgttcatacatgagtcgttttgttgcaaagcatttacagcctcaccaaaaggcttggagcaacgcaacgcaaagccgtatagccgctaccacctctgtgctaagcgcaatgaaagatgtcaaaatgcttggacttcaacacaaattgacccatcgcattcaacagcttcgggatggggagctctgggcagcgtcgaaactcaggtggataatggtatattataacgcctcaggtgtgtcaggagcactgaatgaagttgaaagatatgtataa

SEQ ID NO: 13609 - DNA, 186 bp, A.fumigatus
atggcgcaccctatgggcgagatcatgaggctgtttgcagctttgactactgaggacgtcttctgttggaactgtggagctggccagctataccaggctcaagacttgcacgatagtgttcgactagacgttctcacgatgatctacgtgtataaactaaagtacataatgatatcaatgtcatag

SEQ ID NO: 13610 - DNA, 2313 bp, A.fumigatus
  unsure (15),(16),(17),(19): Identity of nucleotide sequences at the above locations are unknown.
ccccgccccattttnnngnagcgcgttcccttctatcacggcggtgtagaacgcgcccgcaagttggcccaggagcacgagctgttctcacagggcgaaccagatcttcgatgtcatgttgtagttacatcctatgagactattattgatgacgcgtctcgacgagttctcatgaagataccgtgggcaggtctggtagtcgacgaagggcagcgcttgaagaacgacaagagccagttatatgaatctctgtcgcgattcaagttccctttcaagctactcctcacaggtacaccactccagaacaacacgcgggagctcttcaatttacttcagttctgtgatccaaccaaggacgctgcaagattagatgaaaagtacggcacactctcaaaagagaacattcctgaactacacaacatgattcgaccattcttcctacgacgtacaaaagcacaagtgctcacctttcttcctcccatagctcaaattatcgtgcctgtgtccatgtctgttgttcagaagaagctgtacaagtctattttggcgaagaatccgcagctgataaaggcgatttttcagaggaacaataactctgaaggcgttaagcaggcagatcgccataatctgaataatatccttatgcagcttcgaaaatgtctatgccatccctttgtctacagtgaagcaatcgaggagcgcactgctaattctgctgcatcgcataagcacctggttgaggcatcaggaaagctcaagctgcttgagattatgcttcctaagcttaagcagcgaggccacagagttttgatcttcagccagttcctcgataatctagatattgttgaagattttctggacggcctcggcctgttgcatcgccgtctggacggacgaatgacttcattggagaagcagaaacgtattgatgaatacaatgctgacaactcaccatattttgcattccttctttccaccaggtccggtggtgtgggaattaatctcgccacggcagatactgttatcatcatggatccagacttcaatcctcatcaagatatgcaggcactttctcgcgctcaccgcatcggtcagaagaataaagtacttgttttccagcttatgactcgcggaagtgtcgaagagaaaattatgcagattggaaagaagaagatggtccttgatcatgttctcatcgacagaatggttgcggaggagggtgatgggcgggatttggaatctatattgcgtcacggagctcaaacactgtttaacgatgacgactcaggagacattcagtacgattcggagtctgttgacaagctccttgatcggagtcaggaagagcaagcgaagatgcctgacgaaagtgcgcctgagtctcaattcagctttgccagggtctgggcgaatgacaaccaaaatctggaaggccaactgcaggacactgaagataaagatgaagatcccgcaatcagtaatacgctatgggagaagattttacaggagcgtgagcaagcggcggcagaagaagcaaggagaaaggcagagacgcttggccgcggcaaacgaaagcgagcagcagtagactacggaatagatacgatggacgtctcgcctgtgaatgttcgccacaaggccgacaatcacgacgaatacaaggcggacgaggtcattgactctgaatcagacaatgaccctgggatggattctgaaggggtggaccggtcctccaagaaatccaaaggtaacgcagctccctgcctaagcactggtttctcggtactaaccacgcgtacagtccgtcccttcaaacgtatcgctgccgaagaggacggagtccctgcatacggtgcaacaggtatggacggcaatgcggaggcgcgtcacccaccctgctttgtctgtaccaagcatcatccggtgggttcttgccccttgaagcatgccggcgttgaacattgcggtctatgcgggcttgctcattacgggattgcacgtacttgtccccaccttcggtctgagacacaagtggcaaggatgttagatgccctgaggcacagcactgaggatggcgagcttattgagaaagccaagaaatacctgcaaggaatacgcggctcccttgcacagcgtcgaagaattttggccagtagggctgcagcaagccagatcagtaatggagttcctggtacaaccaacaccggttctactggttcacccgttatcgatctgaccagttacccggctcgcaatgggacaacgtcattcggcccgagtcagccgggacaaaagttcccaacatcgggatga

SEQ ID NO: 13611 - DNA, 1410 bp, A.fumigatus
tctatgattatagttcctgactttcgctctaccgatggcctcttcaaatccctccagaagaaacacaacctcaaagcttccggcaagcttctgttcgacgctgccgtctaccaggatgagtccctgaccgcctcctttcaggatatggtgcggtcgctgtcggaagaagcggccaagacctgcccgaccgcattccaccacatgctcgctcgtctagcacaggagaaacggctcacacgactgtacactcagaatatcgatggtatcgagacatcaatgcctcctctggcaacccagattcctctgaacgtaaaggctccctggccgcgcacgatccaattgcacggaagcctggacaaaatggtctgccaaaagtgccgtcatctgctcgatttcgaccgggaaatgttcaacaggcctgacgctcctgaatgccccgagtgttcgaagaataaccaatttcgcatcgagaccggacagcgcagtcatggaattggcaagatgcgaccgcggattgtgctgtacaacgagcacaacccggacgaggaggcgattacctcggtcatgaacgcagatatccggtcgcggccggacgccctgatcgtggtcggcaccagtctgaaaatccccggcgtacgtcgcctggtgaaaagcctctgctctgtgatccgcacgcgtcgcaacggcgtcaccatgtggatcaacaacgagccgcctgctggcaaggagtttgaagactgctgggatttgatggtcaagggcgactgtgacgaagtggcgcggctggccggtctgaaacggtgggatgacgattcggaggacgtgtttgacgaatgcaactcctccgaagtcgagcgggtgaagaaggaacaaggtgctgtatccattgtcatccgaacaccgaagaagaagcagaagacgcaaacaggaattcttacgccttcctctagccacgacgaggagtcaacagaactgcgacacaagcacccatcgaacggcggctctctccataatcccgccagccggggacgcagtctcaaagatgtgctccacaaggcgaaaggcggcgaacccacgaaagccgcaccgaaaaagagtgcgcccaagaagcgaggcaagaaagtcgagccggcgcacaatgcaaagatcaccgcctttagcaaagtcaccaaaaccgcaagggccgcgactggcgatgctggcaaatccgtcaaactggagaaggatgatgcgaaaccgatgcacccacttccgcctggtgcggcgcgcaataacgggcctctcttccctaaccttgtcggtaaaggaaacacttctccgtgcggtggattctggagcaaccctgacacgatttctcccaaatcggtcccgaagggaatgaaggatctgctcaatcctccaagtccgtga

SEQ ID NO: 13612 - DNA, 594 bp, A.fumigatus
cagctccgattagttgctgaatcaataagacgtgtcaatgacacgagttcatcgaacaattcttctgtatacgtggtgcttatcaatcagtattcattgcgtagtctgatgtctcctcttaagcaaagcaattttttgtgtctatcccaaaccaagcccgctctgcagctgcgtcccaggtcccgactcattttcgctttctgtgtcatctgcagcatcaggatccatcgttcgcctcggtcgcgaatcgcgatccagatcttctactcgatcgatgtcctcttcttgtgtctcatcttcatcctcctcctcgccatcatcctcatcctcctcctcgtcttcctcggcctcctcctcattctccaagcccggttcttgttcctcctgggtgtcatcgtcatcttcctcctcctcatgcccctcctgagcactagacgaacccccctcaacccgcttcaccctcttcacctcacgtaccgcgctctcctcgtcatctacctgtgttttctggacagccccggcctcgtcaccgacccccgcccccgacttcctccccttccgcttcccagccttcatctccgtaaacgcctctag

SEQ ID NO: 13613 - DNA, 540 bp, A.fumigatus
gggtccttccagccgcgtggtgaagaaacctcttcaaccaccaccgcttcctccttaaccacctccacctctagctcttcctcacaaacctctacagtctcagacgagaggtggaatcctaaattcatggatgatttcgacctttcagagctatcagagctgagctctccgccagcatcccctcaatcccctccaagcttcattccctcgccgcctccatctcaagacgcgggcgagtcgtctagcgccgcacgcggccaagacggtctctcccccgccagaaagaagcgtcgcgtagctacaccaaaagagcgcaccacgcaacacctcgatttgtccagggattcagggctcagttttagggaacagcaggcgcaggttgatttactcgtcaaaactcttcgtcgtcaccgcaagattgtcgtcatcgcgggtgctggtatctccacgtctgcaggcagtatgcactcccttcagcctcatggtggacgacagaagaacagacacgctaattggctgatctatgattatagttcctga

SEQ ID NO: 13614 - DNA, 585 bp, A.fumigatus
agcggctgggttgatgctgacgaatgtagcgcgaacgaggcgacgctcaagcgaacggttgcgcccgcggacgtgttttctgcgctatccgagctggagtttgaggcgttccggcctaggctggagaaggaactagaggcgtttacggagatgaaggctgggaagcggaaggggaggaagtcgggggcgggggtcggtgacgaggccggggctgtccagaaaacacaggtagatgacgaggagagcgcggtacgtgaggtgaagagggtgaagcgggttgaggggggttcgtctagtgctcaggaggggcatgaggaggaggaagatgacgatgacacccaggaggaacaagaaccgggcttggagaatgaggaggaggccgaggaagacgaggaggaggatgaggatgatggcgaggaggaggatgaagatgagacacaagaagaggacatcgatcgagtagaagatctggatcgcgattcgcgaccgaggcgaacgatggatcctgatgctgcagatgacacagaaagcgaaaatgagtcgggacctgggacgcagctgcagagcgggcttggtttgggatag

SEQ ID NO: 13615 - DNA, 1905 bp, A.fumigatus
cgcaagcacttgtccaactggctcactatatcccccctattaaacgtaccattcaggagaagctcctggatatgcttagcccggatccttcatgggacacccttccgtcccctcggttgcccagagagcaggctacctcccatgccgtctttcgcaaaggacttcgctccacaagagttgcactctgatgcagagatcgctctggcccttcataccctggggagctttgatttctccggccacattctcaatgaatttgtgcgcgatgtggccattaattacgtcgagaacgacaaccctgagattcggaaggctgcagcgctcacctgctgccagctttttgtccatgatccgatcatcaaccagacaagcagtcattccatacaggttgtcagtgaggttattgataaattattgactgtcgggatcggtgacccagacccagagatccgacgtaccgtactatggtcactggaccgcaaattcgatcgtcatctggcgagaccagagaacatccgctgcctgttcttggccgtaaatgacgaagtatttgccgttcgggaagctgcaatttgcatcattggccgcctttcgagcgtcaacccagcctacgtgttcccgccactacgaaaattgctcgtgaaccttctgacagggcttgggttcgcgagcacagcccgacagaaggaggagagtgctcagctcatcagcctatttgtatcaaatgcgaccaaacttattaggtcgtatgtcgatcctatggtgacaaccttacttccgaaggcgacggatgccaacccaggtgtcgcctcgaccacactgaaagctgtcggagaacttgcgagtgtcgggggcgcggaaatgagaaactacctcccgcggctgatgccaattatactggactctttgcaggatctctcttcgcattctaagcgagagtcggctttgcggacgctgggccaattggccagcaactctggctatgtcattgatccgtttctcgaatatcctcatttacttgccgtgctcataaatatcatcaagactgagcaaactgggtcgctgcgcaaagagacaatcaaattactggggattcttggtgctcttgatccgtacaagtaccaacagatcagtgaaatcgaacccgatgtccaccatatcaacgaaattcagactgtttctgatgttgccctcataatgcagggcctcacgccttccaacgaggagtattatccaaccgttgtcatccataccttaatgcagaatatcttgcgtgagaattctcttgctcagtaccactctgcggtcattgatgcgattgttacaatcttcaaaactctgggtttgaagtgcgtgcctttcttagggcagatcattcccggcttcatatcggtcatccgaggttcgccgcctagccgcctagaatcctacttcaatcagatggctatcttggtgaatattgttcgacagcatattcgagctttccttccagagattatcgaggtcatccaggaattttgggattcatcgtaccaagtgcaagcgactatcttgtcacttgttgaagcaatagccaagtctctggagggtgagttcaaaaagtacctggcagccatgattccttcaatgttggacactcttgagaaggacaacacgcctcgccgccagccttctgagagaattctccacgcgttcctcatctttggcgccagtggggaagagtacatgcatctaatcatcccatctatggtacggctctttgagagagcccagaatcctcaaagtatcgggcaatcagccaccgatagtctcacaaagctgtcgcgaacaagtaatgtttctgactttggcatcttgaatgaatccctcttgggctcgggttggttgcaggcaacaaccggaacc

SEQ ID NO: 13616 - DNA, 981 bp, A.fumigatus
tattcaatgatttcgaaccccacagattggcctccagagaagttcctcgaattctataacgctgtcagtcaacgcatcgcgcagctcgtggtcaccggcagtgacgcacatgaacggatcggcggccttttggctctcgatcgcttgattgatttcgatggtgtcgatgcggctcagaaaaccactcgattcgctagttatttgcgcagcgccttgcgcagcaacgacaatgcagtgttggtctatgcagctcgatctttgggacgtttggcgaagccgggcggcgctcttactgcagaattggtcgaaagcgagattcaatcagcattagaatggcttcagtctgaacgacaggaaagtaggcgcttcgctgctgtacttgtcataagagagcttgccaaaggctcgccaactcttctttacggcttcgttccacagatcttcgacctcatttgggtcgctctgcgggaccccaaggtccttatccgagaaacagccgcggaagcggtctctgagtgtttcgagattatagccgccagagacgctcaagtccgacaattgtggtttgcaagaatatacgaggaagcacttctgggccttaggtcaagcaacgtggactcggtacatggatcgctcttagtactcaaggagcttctcctcaaaggagccatgttcatgaacgagcattatcggaatgcatgtgagattgttctccgtttgaaggatcaccgtgaccataagatccgggcccaagttgtccagacgattcctatacttgcctcgtacgcccctgtcgactttacagaaacatacctacataggttcatgatctacctgcaggcgcaattgaagagagacaaggaacgagacgcagcattcatagcgattggaaaaattgccaatgctgttggtgctgccatcgcacagtatcttgatggaattattatctacatacgcgaaggattggccctgaaagcgtaa

SEQ ID NO: 13617 - DNA, 219 bp, A.fumigatus
aggttgacttcaaatgtccaccctggggtgtggcttaccaacatggcgcaagcaggtcctattacggacatcactcagcgactcttcagtgaattgaagtccaagaatgaggagacgcgggtaagagcttcatttgagctctatgataacgtcctggctatctcgagaggtaacacttcgcactttggtcgcaccccgaacttggctaatattcaatga

SEQ ID NO: 13618 - DNA, 381 bp, A.fumigatus
aagcgtaagtctctgtgctctcaacttatggaaagtgagctaacatttgctagtcgaaatcgagctgctgtaaatgaagcaccaatgtttgagtgcatcagcatgctctctttggctgtcgagcagtcgctcagtaaatacatggaatctttacttgaccctatatttgcatgcgggttgagcgagtcgctgacgcaagcacttgtccaactggctcactatatcccccctattaaacgtaccattcaggagaagctcctggatatgcttagcccggatccttcatgggacacccttccgtcccctcggttgcccagagagcaggctacctcccatgccgtctttcgcaaaggacttcgctccacaagagttgcactctga

SEQ ID NO: 13619 - DNA, 237 bp, A.fumigatus
agtatgattcttccggtgccattgtctccgacattctttcgcctgcttgatctggaagatggcttacgtgcgagtagtaaaccagtatatggtctaatctttctgtttcgttggcgagaagatgatcctgataaacaggaagcaagctgcccagaagggctttggtttgcaaaccaggtctgtctccttatatgtctcatactcatttcccttgacttatcttgcaaagacggctag

SEQ ID NO: 13620 - DNA, 321 bp, A.fumigatus
tccgtcgtatcaccgtgttatcgtcacttcaactcacatctgaaacgcagaaaaatggacatactgaactcagatctacagctgaaggtggaggcgacatccaaacgttctcgatcgggcaaggacaggcatgatgagtttgagactgacgctggattccattttatcgcgtttgtcccggcgctgggcaaagtctggaagtttgacggcttggagcgtcagccccaagctctcggtaagtatgcttcgatctgcacaaacgagggtagacatgagttgattataatccaggggaatatgcgcccgacgatgactggttga

SEQ ID NO: 13621 - DNA, 405 bp, A.fumigatus
tctttctgtttcgttggcgagaagatgatcctgataaacaggaagcaagctgcccagaagggctttggtttgcaaaccaggtctgtctccttatatgtctcatactcatttcccttgacttatcttgcaaagacggctagtaatgcctgcgcaagcgtcgcactcctgaacattgtaaacaatatcgaaggagttgaccttggggaaaatctacgacatttcagagaattcacaatgccgttcacaccagcgttgagaggtgacgccatcaacaactttgaattcgtaaaaaggatacacaactcgtttgcaaggttggtcgtttgttacactcccactcctcccctggttcttcttcataatccgtcgtatcaccgtgttatcgtcacttcaactcacatctga

SEQ ID NO: 13622 - DNA, 201 bp, A.fumigatus
aggagcaccgtggatacttccagccccgtggtgaagaccataacgtacttcaaagactatcgtttcaaagaactattcatcgcggactatccgttcaggtccttacatatcatcatcagtttacaagtatctccttgtgcttattctcaagatatcattacgactaccatactccgtacacaagataccatctatggataa

SEQ ID NO: 13623 - DNA, 234 bp, A.fumigatus
caaaaatggctgcaattgatgtcgtcgagactcatgtggatgtttagtcggccgcaattgcgcaaaacagactcacagcagactatatgctatgtgatcaccatcttaaacacaggctgcagatttagacaacatggtacctctctatgccttgaacttatatcttcccgtcacaccatgtacatagaatataagcatatgatttacttcattgaagacccatatctgctctag

SEQ ID NO: 13624 - DNA, 315 bp, A.fumigatus
cctcaattatacttgcagtacgcccggtgcggtgtgaactcgcaaataagtgtgcttgcatacgatccagtccagtctcttatggccgtaggtaccagcgacacccagtttggcagtgggcagatctatgtgtttggacagcgcagggtgtccggcgtcttttcgttgccgcggaaggcatcggccaaattcctacagttctgcgccgacaagatgatcagcgtcgactcgaacagcgaaatcactattttctcgctggagacccagaaagcgctggtttcgtacgccccgccgagccatgccacggccctatag

SEQ ID NO: 13625 - DNA, 840 bp, A.fumigatus
gcgctcttggcaggggacattattgcttacgacttggatcgggagtccctgacaccatttagagtacctaatctctgggccgagcgcaatccccgggcgcgactgtgcccagtcttttctctggccttttcgcctcgggatattggcaagattttggtcggatatcccgaaggggccgtcactttcaccttcaaacagaatgtcgctcagaagtacttccaatatgaaatacctccgggtgcagttgggggcaattccgagataccctcccaggatacacgcagacccaagttgaccagagcgctgtggcatcctaacggtatctttgttctgaccgttcatgacgacaacagcctggtgttttgggattcgaaggatgggcgcaagatcctcgcccggacgatggagaatacacatattgacgaacctggcgccagcccaaaccgacggttttcaacggctgaagccattttcagagacccaatcactcaggttgcatggtgtgttaaagccaacggagaggacagcggccttcttattgcaggtggtcggcctaaggctgagagtaacaagggtctgaccttcatagactttggagcaactccaaactatcaaacttcaacatggccaatgatcactaattattttgaaaacccaaaacaagttcagaatattccagcacctcctggcgcggaagtcatcgacttttgcctcattccccgttcctcgccattctatgctggcgcccatgaccccatcgctatgattacgcttctttcttcgggagaactcatcactctaagctttcctagtggtcattcaatcacacctacgatcatg

SEQ ID NO: 13626 - DNA, 945 bp, A.fumigatus
ggttggtgcagcgctgatgcctcctgccgtctggtgaagattagacgggagtcggtgatggagggcaagaggtcggcaacagtaagctttcgtgacgaggtcagtccgtattccgtaggcttcgcgtgctcttgcacgcctcctgttctccgtgatggcttgttcgtagattctggctccaaggcattgacgaagctctgtagtttcgaaagaccatgctcatctacttcagcctcgtcacctgacattgatagcccgctttcctcgtcagattcatcgtcgctctcttcgctatccgagtcatattcctccgactcatccggttcagcctgcttctttttagatgcggctgccttttccttctcctcctcagctgtattcagatcccaggcagtagtaagatcgatggcatcctctccaagatcgtcatcttcgtccatatcttcgtcttcctcctctgattcctcgacatcctcgtctaggttgatttcgcgcacgcgtttggatttctttggtttcggtttcgacccggcattggttgtcgagcttccgcgaaacgtaaaaccctcaaagcgttcttcgtcgcttgtgcccaaggcctcgtcactgtccaactcttcgtcgtcatcgctgtcaacttggcccaatctccatctgtgtccttccccgtcactgccggcattactgctcagttctgattcatcatcacccccaaatcgacgccgtttgttatcagggccatccgagtcgtccatatcacggttggggttccgtttgcgcttggaagggtcatggatcttgcctaagcggttgcgccttactcctaatttatcggttacctggctttctgcgattgacagcgcattcagtgcttttttcccagtgttctttttgggtgccggttttttggaagacgggtccttgtcctttggaccccgcaactga

SEQ ID NO: 13627 - DNA, 318 bp, A.fumigatus
tgccgcccggcttgcacgaccttttcacaaccccaacaacggccacatcctcgacggctgcatttatcgcactactgcagcgccgcatctcacacaatggcaatgttcaagccttcgcaaccgatgatggcgcgattgcgcctgaccaccaagcaggtcaatggcggttactacaagggaaaccggactggatcaatgggttacttcgcgaagaacggttcttatgtgattgattggaagaaagtccgcacatatgttgtccctgaaaatctggccgatttcaaggtgcgttgcttaacattagccataaatatttga

SEQ ID NO: 13628 - DNA, 243 bp, A.fumigatus
cttctagcacttgagataacatctccaaaccagctcacgccgtttgtgacgaaacgcatggctccgacaaagggcaagtacacgagagagatcgagaagaacggcagaacggttatcgtcgagcgagcgtttggtgcgaaggactatcttgacatgtgggcttcggataacggacaagaggtgctggagcaggaaagactcgagcaagaatcagcagcgagtgagacagcgtcccggcaatga

SEQ ID NO: 13629 - DNA, 273 bp, A.fumigatus
ccggctacgaatccccgcgttgtcgacgtccccaagtccgatacatccgcgatctccgatctacgagtgtattatatgtacagtatgagtgttggtgcttgctgcgtcgcggccgagtccgcagtctttcaggatatcatcaccagctatgtgaatggtggctactgcagtggacgattcagcatttcccctggtgtttacttcgttaaacggcgcaatttggtttttggcatcttacaagacatgtccatggttcattgttataccagctag

SEQ ID NO: 13630 - DNA, 216 bp, A.fumigatus
gttgatttcgcgcacgcgtttggatttctttggtttcggtttcgacccggcattggttgtcgagcttccgcgaaacgtaaaaccctcaaagcgttcttcgtcgcttgtgcccaaggcctcgtcactgtccaactcttcgtcgtcatcgctgtcaacttggcccaatctccatctgtgtccttccccgtcactgccggcattactgctcagttctga

SEQ ID NO: 13631 - DNA, 1038 bp, A.fumigatus
gtagccacattttcagtctctcatatttactttttgactttggtcttgatcgggtttctagattttctagattacacgatgcctcgcagacaaactcagttgcggggtccaaaggacaaggacccgtcttccaaaaaaccggcacccaaaaagaacactgggaaaaaagcactgaatgcgctgtcaatcgcagaaagccaggtaaccgataaattaggagtaaggcgcaaccgcttaggcaagatccatgacccttccaagcgcaaacggaaccccaaccgtgatatggacgactcggatggccctgataacaaacggcgtcgatttgggggtgatgatgaatcagaactgagcagtaatgccggcagtgacggggaaggacacagatggagattgggccaagttgacagcgatgacgacgaagagttggacagtgacgaggccttgggcacaagcgacgaagaacgctttgagggttttacgtttcgcggaagctcgacaaccaatgccgggtcgaaaccgaaaccaaagaaatccaaacgcgtgcgcgaaatcaacctagacgaggatgtcgaggaatcagaggaggaagacgaagatatggacgaagatgacgatcttggagaggatgccatcgatcttactactgcctgggatctgaatacagctgaggaggagaaggaaaaggcagccgcatctaaaaagaagcaggctgaaccggatgagtcggaggaatatgactcggatagcgaagagagcgacgatgaatctgacgaggaaagcgggctatcaatgtcaggtgacgaggctgaagtagatgagcatggtctttcgaaactacagagcttcgtcaatgccttggagccagaatctacgaacaagccatcacggagaacaggaggcgtgcaagagcacgcgaagcctacggaatacggactgacctcgtcacgaaagcttactgttgccgacctcttgccctccatcaccgactcccgtctaatcttcaccagacggcaggaggcatcagcgctgcaccaa

SEQ ID NO: 13632 - DNA, 186 bp, A.fumigatus
  unsure (6): Identity of nucleotide sequences at the above locations are unknown.
gttctntgcggcccatttgtcagtgcctggctttacatcgcagaccgcgacgagttcgatccgaggctgctggaaggcgaggatgcgggctcgaaggacacccaggcggccgaggccaaaaagcgcaaacttaacacggcggtcccagctcgtcatggtctatgcggtggtggtctttgcgggtaa

SEQ ID NO: 13633 - DNA, 1089 bp, A.fumigatus
actcagtcaactttaccgtcacatcgtatcttatcttccaagggcctagcaccaagtttctggggcccagtctccgacgtaaagggccggcgcaccgcctacatctgcacatttatagtctttttctgcgcgtgcattggcctgcaggagactaagaactatacgacgttgatcgttgtgcggtgccttcagagtgccggtagcgccagcacgatcgcgattggatctggcgtgattggcgacatcaccactcgtgctgaccgcggcgggtatatgggtgttttccaggcagggcttcttgtcccagtggctgtcggaccagttatcggaggggcaatcgcaggctccctgggatggaaggctatcttctggttcctggctatctacagtggtgttttcttgtgtctgctgactctcgtgctgcctgaaacacttcggtccattgttggcaatggttctcgaaagccttcccatccagtactcaggtacccactgaacctttatcagaagtcaagcaagatgccatggcagcagcctcaggatggcttgtccacagcggaagcaaagaagaagattgaccttctgggcccgcttcgcatgctgctgagtaaccacgcagcgccgatcatcctcttcctggcggtctactatgcagtctggcagatgagcattaccgcaatgtcttcactcttcaaaagccgctacggactgtctgagctccagatcggcctaacctttatcgccaacggggttggctcaatggtcgggaccctcgtgacgggcaaaatcctcgatgccgattaccgtcgcgtcaagacaaagtatgaggcttcattcgacaacgagcatcgagatgcaatgtcccagactgctcgagaggagaattttcccctagagagcgcgcgtctccgccttgtacccatcttctccatcacccagtgcgtttccatcattctgtttgggtggacaatccagtaccccgataaagtcccaatcgcagtgcctaatgtttcaaccctttatcacagggtggaccgcgttctccacgcagtctctgatcatgacatatttggtgacctttttccctga

SEQ ID NO: 13634 - DNA, 411 bp, A.fumigatus
  unsure (154): Identity of nucleotide sequences at the above locations are unknown.
accatgacgagctgggaccgccgtgttaagtttgcgctttttggcctcggccgcctgggtgtccttcgagcccgcatcctcgccttccagcagcctcggatcgaactcgtcgcggtctgcgatgtaaagccaggcactgacaaatgggccgcanagaacctacccacgtctgtcaagtatttttcagaccctcaagaatgcttgacgaacagcggcgccgaggccatcctcatctgcaccgcgacagctacacacgcccccttgatcctgcaggcccttgatctaggcttacacgtcatgtgcgagaagcccatctctgtggacgtcgcaaccaccaaggcagtggttgagaagtctgtgtcgcggcctgacctcaaattcctcgttcccttcactcgccgatgtcagtaa

SEQ ID NO: 13635 - DNA, 510 bp, A.fumigatus
gtcgacgccgggcgatacctgttagatgtcaagtcaggcctctccaaccccaagaagcaagtcaacagagtcattgccttcggccaggtggctgtctacggggacttggccaagtatggcgacgccgacaacgcatggggcttggtggaatttgccaatgggaagattctcaagacttacctcggtcgcacgctcaccagcggtttcgaggacacgactcggttgtgtggcaccaagggacatttgatcatcagcgctacctcgaatgttgagattcgcgaccatctcggtattcgcacgcaatccgtgcctgacgcgttcactctcttcgatgcaacgttcctggccgaccttgctgaattcgccgatgcggtgctggacaacaagcccttgacttgtcaaccagaggatgcctttgaggcgggaaagatttgcgctgctctgcagtactcattccgcaagggggtgcccgtatacttcgacgacaacggtctacccatcatggattaa

SEQ ID NO: 13636 - DNA, 1206 bp, A.fumigatus
cactctccgctctcctcctcaaaaccgatgataatgcctcactccgagatgtccgcacctgtcgttgtctcgaaaactccttcgggagtccctcccaccgtcgaggaggtttcctcgcttatgaacacaatcttcacggccgagacctcacaacagtctctcgatgctgcctacgggctgaccaaccttctcatccagagcgtcggaacgtttggtcttcaaagatacaacatcctcccggagatcaaaagggctgccaccgataagaagagcggtgcccgacgtgagagtgccatgttgatcattggtgccctgttcgagcgttttcctcgcgagcaccccctcagcgaagtcgtctttcttcttcaggatggtggtgtcttgaatctggcactcgattccctggctgacaagggcgccgtcgtgcgcgatgcggcccagtacgccatcgacgcgctctttgattgcttgaaaccagagtcgttggtcaacgctctcattcccgccctctcggcatatctcaacaagagctccggtaaatggcagggctttgttggtgcgtatgccttgttggaaaagatggccatcaaggcgcagattggtatgggaaccatggaggaggagcgccagaaggatcttctgcgcagcgccatgggcaagactctcaaggagctgattcccctggttgagtctgggatgcacgatctcaagaacgaagtggccaagcaggccagcaaaaccatgactgcactcactaccctgctggacaacgacgatgtcgctcctcgcattcccctgcttatcaagaccatggagcagccttccgaacagactttgcaaaacgctatccacgccctgtctcagactacctttgtcgccatcgtcacctcgcccgtcctcgcccttttgaccccgttgctcgaacgttccctgaatgcccccacgacgccccaggagaccctgcgccgcaccgtggtcgttgtggagaacttgaccaaattggtccatgacccggcggaagcacgcaccttcttgcccaaactcaagcccggtgtccaggcggtcaaggatcgcgcttcgctaccagaagtcagagaactcgcgacccgcgccatgaatgtcatcgacaaagctttgggtgacagcagcctggcggccggctccctggcgaagacgaccggtgaagatgttctcactgtgccttga

SEQ ID NO: 13637 - DNA, 783 bp, A.fumigatus
  unsure (27): Identity of nucleotide sequences at the above locations are unknown.
acggccagttcccatttgaccaaccangtccgcgcgttctctcgagagctggccgagcagtcccacctgccgcagcatattttggacctgatcaagtccttcccccggtccatgcatcccatgacccagctgtccattgccgtggcggccctcaacaccgagtccaagttcgccaaggcctacgagaagggcctcagcaaggccgactactgggagcccacctttgacgacagcatctcgctgctggccaagatcccgcgagtcgcggcgctggtcttccgcccggacgaggtggaccaggttggtacccaggctctggacgctagccaggactggtcgtacaacttcgccgagctcctgggcaagggcggcaaggagaaccaggacttccacgacctgctgcgtctctacctggcgcttcatggcgaccacgagggaggcaacgtctccgcgcacgccacccacctggtcggcagcgcgctcagcgatcccttcctgagctacagtgcaggtctgctgggtctcgccggtccactgcacggtctcgccgcgcaggaggtcctgcgctggatcctggccatgcaggacaagatcggcaccaagtttactgacgatgacgtgcgcaactacctttgggatacgctcaagtcgggtcgtgtggtgcccgggtacggccacggcgtcctgcgcaagcccgacccgcgcttccaggcgctcatggactttgccgcgacccggccggacgtcctggtgctagccgccggggctagaaagtacgcgtcc

SEQ ID NO: 13638 - DNA, 348 bp, A.fumigatus
actgcccgcttggctctcaccaactcccgcagatactcgacggccgagccagatctcaagaccgctctgaaggcggttattcccgccaaacgcgagctgttcaagcaggtcaaggagcgtagcgatgaggtgattggtgaggtcaaggtcgccaacgtcattggcggcatgcgcggtctcaaatccatgctctgggagggttcggtgctggatcctgaagaaggtatccgattccacggcaagaccatcaaggactgccaaaaggagttcccccaagggcacatcaggcaccgagatgctccccgaggccatgttttggctgctcttgaacggccagttcccatttga

SEQ ID NO: 13639 - DNA, 423 bp, A.fumigatus
  unsure (223): Identity of nucleotide sequences at the above locations are unknown.
ttggtgaggtcaaggtcgccaacgtcattggcggcatgcgcggtctcaaatccatgctctgggagggttcggtgctggatcctgaagaaggtatccgattccacggcaagaccatcaaggactgccaaaaggagttcccccaagggcacatcaggcaccgagatgctccccgaggccatgttttggctgctcttgaacggccagttcccatttgaccaaccangtccgcgcgttctctcgagagctggccgagcagtcccacctgccgcagcatattttggacctgatcaagtccttcccccggtccatgcatcccatgacccagctgtccattgccgtggcggccctcaacaccgagtccaagttcgccaaggcctacgagaagggcctcagcaaggccgactactgggagcccacctttga

SEQ ID NO: 13640 - DNA, 285 bp, A.fumigatus
ccaggactggtcgtacaacttcgccgagctcctgggcaagggcggcaaggagaaccaggacttccacgacctgctgcgtctctacctggcgcttcatggcgaccacgagggaggcaacgtctccgcgcacgccacccacctggtcggcagcgcgctcagcgatcccttcctgagctacagtgcaggtctgctgggtctcgccggtccactgcacggtctcgccgcgcaggaggtcctgcgctggatcctggccatgcaggacaagatcggcaccaagtttactga

SEQ ID NO: 13641 - DNA, 825 bp, A.fumigatus
ggcttccagcggcttggccaacccccgtataacccttcaaagggtcccccaaggccaagttggaaccaacctttttcattttgcaaagaactttttgtcggttccccgttttgcgatttccatcagcatgttcgaaaagcgttcagaccaattatggtgtccgaatgcaagcgcgtgcttcgacctggtggttatatgaagataagtgtgctcgatctggacatggtgaacatgggaattcggaaccgcatagccgtgaggatgctcaaggagaagacatacttggctgaccccaatatcagtttaaagcttgcgagtgacagcctacagaagctgctgggactacaagggttcgatggcttgcggcgctgcatggtgcggattccggtgacaggagtgattgtcagatcttcagcctcatcttcctccactacgtcttccaatccctccacctctgttgccaggggtacaccgtctaccgctttttcggctttgacaaattcctcgacgagcgcgcaacaacctaaagtgtacggaaaatcgccatccaacgacaccaatttgtctcttggagacctactctctgatccctccccatctccctctaacgacgagtcgatacggaagattgtcgctaaagtcggtcgctggtggtacacaaggtgttatgagatcccagttctgccaaatggggatgcgtcgtccagtatctgggccgataagcgggttctccgtgagtgtcagaaacgaggcacaggattccggctgttgattgcatacgcacaaaaacccagcgaggtgaaacgacgaactgcaagtgtctaa

SEQ ID NO: 13642 - DNA, 921 bp, A.fumigatus
gtccccagttgggtccatcttccttgcggcagcctcgggacacgccgatggcgtccacttcctttccgattgggtgcttgcccgcgcgggactggtcttgcggtatacatatctattgagcggcgccggaatggtatggaacgactggatcgaccgcgacatcgacgcccaagtcgcccgcaccaagaaccggcccttcgcgtccggccgtcttgccacgcgagccgccatcatctggatgctagtccagtatgcggcctccgtctggctgatggaccgcatgctgagcgggcagaacctgtaagccgatatcttggtaggtcatggaagaagctcattctccgtagatggaccttcatgctccccctcaccaccggcatcatcctctatcccttcggcaagcgcccgaccacgcgcaaactgggcatctacccccagtacatcctcggcgccagcagcgccctcaccatcctccccgcctgggcctccgtctacggcgacagcgtggcccctcccgacctgctcgccaaatgtctcccgctctgcgtcttcctgttcctgtggaccatctacttcaacaccgcctacagctaccaggatgtcaaggatgacagtcggctcagcgtcaactcgtcgtacgtcctggcgggccagtacgtgcacggcttgctcctgctgcaagccgtcgccgtggtcatggtgatcccgtggattctgcatgagaacggctccgcgtggctctggttctcgtggctgggggtgtggacggccgctctcgccgagcagctctatctcttcgatacgaaggacccgagtaccgggggccgcgtgcaccggcggaatttcgcgctggggatttggaatgttctggcttgtttcgttgagctgctgcttgtgtccgggtctctggatatgttctag

SEQ ID NO: 13643 - DNA, 429 bp, A.fumigatus
  unsure (65): Identity of nucleotide sequences at the above locations are unknown.
ttttccccgattaacccgaaccaccggttaatttgccggagatcccctggaaaaaaaacccttcnttcccccccccccccccccctttcaaaagaattcataccagggttacccactcccaataggtccccagttgggtccatcttccttgcggcagcctcgggacacgccgatggcgtccacttcctttccgattgggtgcttgcccgcgcgggactggtcttgcggtatacatatctattgagcggcgccggaatggtatggaacgactggatcgaccgcgacatcgacgcccaagtcgcccgcaccaagaaccggcccttcgcgtccggccgtcttgccacgcgagccgccatcatctggatgctagtccagtatgcggcctccgtctggctgatggaccgcatgctgagcgggcagaacctgtaa

SEQ ID NO: 13644 - DNA, 504 bp, A.fumigatus
atcaccgatggcaactgcctctcaacatgtgcctactttgtcgatcgaatgcagcgacaaggagttcgcacggtcgcgttcggcggaagacctcagtatggacctatgcaggccattggcggcactcgtggcggccagaatctggcatacggtgggatctactcttatgttgaaacggcgcacaatttgatccggaagtctctacggaatggctcgacacctctgatgtcatttcaagagtgggcgcaattcaaccgatcgatcccccgcgaccccgatgagttcccgttcgtctttggcggaggagtcaacctgcgcaacgagtacgcgcccggtgacgacgcaacaccgcagcaattcacctaccaggcggcggactgtcggctgttctacacagcagaaagctggttctcgcaggaagaagtgtggcgagctgcagcagtggctttgtttggaggcaaaagcagctgtgtccgggggtccatgtccaatgcgaggcagtag

SEQ ID NO: 13645 - DNA, 1206 bp, A.fumigatus
catggctacaaggtagtctggccctgctctgctgaacttccagcccaaactgacaaagacaggatcatcgcttcgtggtatcaaatgaaccaggattccgacttcccgtctcctggcgctggcatgccgtccgacatgtatgcacctcatcagcgggtaatagggagagatgcgtcgtccaagcagacattactccggggtgctattgagggccacgttctcgtcaaaaataaccacagcgccctgccgctcaagtcacctcaactgctttccgtgttcggatacgatgccaagggaccgaatgcgctgaagcaaaacttcaactggttgtcatacagccctgccattcaggaaaaccacaccctatgggtgggaggcggctctggagctaataacgctgcatatatcgatgctcctatcgatgccatccagcgccaggcctacgaggacggcacgtccgtgttgtacgatatttcatcagaggatcccgaagttgaccccacgactgatgcgtgtctggtcttcatcaactcctatgccacagaagggtgggaccgtcctggactcgctgacaactcgagcgataccctggtgaagaacgttgctagaaaatgtgccaacaccattgtcaccatccacaacgccggcatccgagtggtgggcgagtggattgaccatgagaatgtgacggctgtcatcttcgctcatctgccaggtcaggacagtgggagggcattggtggagttgctctacggccgggccaatccgtccgggaaactgccgtacacagtggctaagaaagccgaggactacggcagtctgttgcatccgtccctgccagagaccccatatggactgttcccgcagtcggactttgacgaaggggtttacattgactaccgcgcctttgacagggccaacatcaccgcacagttcgagttcggcttcggactgtcatatacgagctttgactattccggcctacagataagcaatcctaagcaatctccgcaatatcctccgtcagctgctatccagcaaggtggaaaccctcatctgtgggataatattgtcacggtgtcggcggagatcaaaaacactggacgtgttgccggtgccgaggtggcacagctgtacatcggcatccccaatggtcctgtacgacaattgcgtggattcgagaaggctgatgtctcaggcaggtga

SEQ ID NO: 13646 - DNA, 570 bp, A.fumigatus
ccaattcaccacctcccaggaaaacgtaaccttcaaacgggattgatccctcgccgaagccaaggacagactaacggagttcgatgtgctgattgttcctggggcgcgaccgaaccatattctcccgttcctcatgccagatgggcatctgtacgaactgttagagttgattactgcgtttgcaaactcggccccaaaagtcctggaccgctgggcgagagggttcttttttctgtttgcagcgggtcatatcttctagccgcggcaggagttctggatggactcacggcgacatcacaccggttggggctcggagccctgcgacaactaggcgacgagtataagagtcggacaccgggggcgaaagggatggaggtggtgccggagaatgtaacgggcactgttcactatgtcgatgcaggaatgaacgcatcgcaggtgcgcattgtcacgtccgggagcatcaccaacggcattgatgcggccttgtaccttatctcgctacggtcggggagaccggacgcggtggaggtggcgtcgtttatggggtatacatggcgggaaatgtaa

SEQ ID NO: 13647 - DNA, 261 bp, A.fumigatus
  unsure (23),(83),(206): Identity of nucleotide sequences at the above locations are unknown.
gccaagactctggatgttgtttntaaagccggaactcggattcccaagttgggccgtcgtcgttccaaattggcctttcaagntgaccgatcaggatatgtgatgaccgactggggcgctcaacatgccggattcgccggtgctaacgctggactagacatggtgatgcctagcaccgagacatggggagctaatctcactaccgntatttccaacgggacgatggacgcatcgagattggatgacatggctacaaggtag

SEQ ID NO: 13648 - DNA, 366 bp, A.fumigatus
gcaatcctaagcaatctccgcaatatcctccgtcagctgctatccagcaaggtggaaaccctcatctgtgggataatattgtcacggtgtcggcggagatcaaaaacactggacgtgttgccggtgccgaggtggcacagctgtacatcggcatccccaatggtcctgtacgacaattgcgtggattcgagaaggctgatgtctcaggcaggtgagataacacaggtgcagttcgcctggaaccgacgtgatctgagcacatgggatgtcggggcgcagcagtggtcatggcagcggggaaggtatcgggtgtacgttggccggtcgagccgggatctccctctgacagggtcattcaccctgtag

SEQ ID NO: 13649 - DNA, 201 bp, A.fumigatus
gatccttcatacccactctctgcgtcagacacatgtcccacacggtacaatcgcgaatataatatgccaaccgtcttcgtcttcgtctatccctccgtcaatactctcgacattaacggccctgtcggctcctattccagggcggctactccacgctcatcgccgcccatgaccaattcaccacctcccaggaaaacgtaa

SEQ ID NO: 13650 - DNA, 441 bp, A.fumigatus
tacgccaagtgcggttccttccagccgccgtgggtgaagacagcagtcactattcttctctctctgatcaacattggctcccaggttgccctggcggccattgtatcactgaccatcacctccttgatatctgcctacattctttccattggctgcgtgctcctgaagcgtatccgaggcgagcccctgccacctcgccgatggacccttggccgcttcggcatggccgtaaacattgctgctttggctttcttgattcccatcttcgttttttccttcttccctctgacaaagacagtagacacgaaaacaatgaattggagtgtggtgatgtaccttgctatgcttacttttgcgtctggatactatgtgctctggggccggcacaacttcatcgctcccgtggcgctggtgaagagacagggcggatactgcggatga

SEQ ID NO: 13651 - DNA, 1143 bp, A.fumigatus
ctagagatatttgagtcaaggtctgaccgttcatttactatagtgcacgctgttttaccaccgatgacgtcctcgacaaaggattcgaggttcagtcactccagcaatggagactaccgaaccatcccggtttcttccacctcccacccagacaacccagtcccggaagaacctcgcactcggtcactgtcaatcactgacacgagcttcaatggctcgtctcccgctcaagaaaccgaaggctcgaccgacttagatactccgccgacgcctctcactccgctagatgaagagcaacctgattcgcgcgatagccgaaaggagtttacagacagcgggaatgggcatcaaagacgagcatccactgtcctcatatcacagaactccgaggacatgagacgggtcttggagagcgtgggtactgcaggcacacagaaggtccagcctctctgctgtggtggtggatgctgtcgcagccagccgttgaccaagctcggaccgctacctagtgctaacgctgtcactcctccggacaatgaagcctttaaaaaactcaacctcaatattgaatacctcacattggacagcgaactcaccaacattgttcccgtaccagagaagacagtgtccttctcagcggtagcagcgtcagccttggatctgaagctgggtcccgcggatcacccgcccactttcgttcagccacatccaccgtacaatgtgtttcgggcgcctttacatcacgcccgagagctcaccaagcctggcgcggagaagcggactttccactttgacattgacgtgaccgactaccctgcggagagcggagatgttgattttgttgtgggtggggcgattggtgtctgtcccaagaataaggaagaagaggtggatgatatcttcaaccagctcggtatccccaaatcaattcgtgacaagaaaatcacgttgcatactactaagggccggtggcctacgatatggggagatgaccagcctcgggacctgatcaccacccggagagagctcctgacctggtgctccgatattcagagctacccgccgacaaagcctctattccgactgcttgctgagtatgtcttcaccaggcgccgagatccaaataggtggttagaaggggcg

SEQ ID NO: 13652 - DNA, 201 bp, A.fumigatus
actgacctcaaacaattatcatctacgccttatctgatctcaccggctccccaactgtaccccgtaaagttcattgtactaggatccgctcctgcagctaagcggatcattctacattaccctacaaccaagtcagacaacgatgctaatcgccagcagctgaatggacagcttcaaaaattgtctagccagcagtgttag

SEQ ID NO: 13653 - DNA, 1389 bp, A.fumigatus
catgggttgctctctttccgctttgttggcatcatccgcgtcgtcgattgggtcagagctgaagaacatattttgggactggtcgctatctctcctcgcgcatcccctccaacccctgatgaagtcgcgtcataccgtcgccttctcagaattccagaaagtatttttgatatgtggcgctattgggaccgacgtggcgggcttcacagtgcaagtgtgaaccgattagtcggcaccgatgcagaccccgatacaagggagcttcagatgcgctacaacaaacaaagcaaaactcctgtttggaggcgtatggcctggggaactctccctacctataataaggacggcaaggcgatcggaggtattccaggagaagaagtctgggctggtgtcaagacatctgtcctccttgttgcgggtgagtctgatgcggtaactaagcctgcggaactccgaaagcttctcaaattcttcggtgaagttggaccccatgcagatgtaggggctgatggaagcgccatcatacccgatgcgtccgaaactcatgatacagtttcagcggcgtatgatcgttttgcacatgaagaggaatatggtctcgaagcacaaacgagtgagaagacaataatcgatgattgtcgagcctcgtgtgaaaagaagcgtgctgtcaagacagtcattcttcctgcgccagcttctcatgctcttctttacgatcgtgccacatatcgcactttggcaggcatcatccaagatttcctctcgcaacacattgacgaacgcctgagtcttggatggcagttgcagtacatgaacacctctggcaagtgggatgttaaaaacctcgccaaatggaagaaagtcacacctgtatctcaacgaattgcgggtacctttgtcgcgctcaagatgctgagagaggtcgatgaagagcacaatcctgtgcttttctcgcagaagtaccgcgaccaaatttacgcggtcattgatatcagctacgagaacccggtatataatccggcttccctcgaaaagggaggcatccattatcagaagcaccccacagtatcgaagattccgccgacagctgacgaggttcgggattttattgctttggtagatcggcttcagaacgagatctccgaaaagatgaaaatgtccggtaaccctgacggtcccaggcctgtggttggagtgcactgtcactatgggttcaatcgaacaggcttcttaattgtcagctacctgatcgaacgattgggcttcagagtccaggatgccattgatgagtttgaaaggcaacgaccacctggaattcggcacggacattttattgatactttgtttgtgcgatactgtgttgggctcaagagggcgcctacactgtaa

SEQ ID NO: 13654 - DNA, 222 bp, A.fumigatus
gaatactgggtttcagggacatatagatgtattagtaaaaatatatatatgtcaatgatcagaacaaaccacttagtctcccccaagctattcagaactcctatttctactgagtgcgttcggaatcgggtatataattacccgagcgagagggggcttgccactggcggctcgctgggcttatgttgttctgagcatgtgacaataactttaatgagatag

SEQ ID NO: 13655 - DNA, 195 bp, A.fumigatus
tggtcaatctccacaaaattagacgctcatgactgtctcaattttttttccctagacttggttcaaatttgtggaattaagggcctcgggctatcccaagaattctccttgcgccagggaactccagggcaagtcttcatcccagcaacgctgcatgagggtacgagcattttgaatctgcaaaaaaagtattaa

SEQ ID NO: 13656 - DNA, 1008 bp, A.fumigatus
tcaaagattgtgataagtaaactttcctaccctatattaattagattactactaacaacgccagtttcccctacaaccaacccggcgaaacagccgcctacgaacaacaaatctccaaactatggaaattcttcctccccaacgaccgcaggccccacggctacctcgtggagtctgtcgttgaacgcatgccctggacagaagatttccatgtgcttccggccccgcacaagggaaatccatctccttccacaagaccatgcgcgggagcaagaaacctggacagagcgctgcgagcgcagcctcgatgcccttatcgcgctcgccagagcaagaggagtcttcccccgactgggcaagccacgcgatgagcggtttcccattatcggggcccagttccccgtaagtatcgagcgctcggctatatccctgtttgggattgtggggcgcggagtgcacatgactgtgtacacgaggacgaaatccgggttgaagatctgggtgccgcagcggaatccgaaaaagtcgacgtatccggggatgctggatactgctgtcgcggggggtgttgcggcgggcgagaggccgatggactgtttgatccgcgaggcggaggaggaggcagggatggaagagagcatggtccggaaggcgcatgctgtcggcacggtgacgtggttcaatatcagtgatgaccgggcgggtggcgagccagggctaatgaatcctggtttgctgtacgtttacgatctggaggttggccctgaagtagtcctcaacccggtggatgaggaggatgtttgtgcatttcatctaatggatgtgcgagaggtgcttgatgcgatggcagaggggaaattcaagcccgcgagtgcgagtgtcatggtggactttcttgtccgacatggcttgattacagcggaggacgacgatgattacccagagattgtttcaaggttgcatagattgctaccgtttgctacaagtcctactgctgggaggacatga

SEQ ID NO: 13657 - DNA, 810 bp, A.fumigatus
ctggttgtgctgcttctgacacctctttcccagaaacctctgatcattgctcgtgtacgcaaggattctgacatcccgaagccttacccaccaggaatgaacaccggtccctgggatggcaatatccactgggccataaagggatatagtatatttgagagtcagcaagaagaggccgctgctttctcttatcgtccgaacctcctttctcggcaacccatctcggatctctggatattccagtacgggctccgatacatccccgatggacgggagtcaaatgtctttcgcactgtccgcatcgagaggctcgcgtcgaacgtgactctgaaccaggtactgccatccgttccaggcgagatctattcagcttctctctgcaacacaagccctatcactgggtataacactgctatcgttgtgtttgtgctcgagaaggacgcactagactttgttcaaaaatcgaaggaagggctacctttgggcttctgtgtggccagcgttttcctcgtgaacactccgacttaccccatgacgttccagatgagccaattcatctttcatcagggctacacccggtgtctggtaatcagccatcttcggaggtcactgaggggggagattcaccgcgtactgaagcggtctgcctactacaactatattgaaagcgtggaggaaggaccggtggtgggagatatctatgttcgtttctattcagtcaaaatggcagcagcagcgtatgatctttttcaaggccatcaaagcttcgaaagatgcagcaccaagtttcttaaaaaggcggcagagtga

SEQ ID NO: 13658 - DNA, 225 bp, A.fumigatus
gtgctagatatcaaggtatttgcagtttgctctattcttctctttctcatccactctaccatgcagctcaccatagagccgttttgcacctcggttccagtcaagtacttctcacagggttcatatatcagcatcatatttccagtggacctcctaagcaagcgtaagtcaaattcagatcaccgagacattgcctacattaacaactcactgagacatttataa

SEQ ID NO: 13659 - DNA, 606 bp, A.fumigatus
ttctttcccaaaatggaaggatgtgttacactcaccaccagttccatcgtctctcttatagttcttttttctcttctgctttgcctattcattctctttcgtcgtctagatgccgtagttctggcaatggctcaagcctctcaagcttcaaaacccctctgctctccggcgaacaaggaaactcagcatggagtaaacaacactagcgcagaggacaataacaacactgcctctgaaaatgtctcccctaagagcttctctctctcacctgtctatttcgaaaagaccgcagtagtcgtactcaatccacgaaaatgctccaacatcctggacagtcacttggacgatattagcgtcccgactttgcaacctaggacgcctcagaaacggctccatcccgctgccgcctatctgaatcagttgagaacggtgtcgctgcaacgtacggactctgatgacctgcttgatgccggcatagaggacctgatgattccggtgttagagcctgagcgggtgagcagcgttaacgaaatagctggttgtgctgcttctgacacctctttcccagaaacctctgatcattgctcgtgtacgcaaggattctga

SEQ ID NO: 13660 - DNA, 354 bp, A.fumigatus
ttgctgattcaactgtcacaatttgcaggaaaggcaacttcattagaaccatggttcccccctcacctccagcgagacatctacttctcccttctccatcttgaccctccggcctcaacctcgtcgaaagagaaaaaggccccagcggtgccggagacggtactaaaggccgcgcttctccggcgcgcaacagaggatatcaaacgcgttatggcgctccgaaaccagaagcaggcgctggctatgcttctgcaacggggcagtgtcggggacgatctgtggcagcgtttccagcgggcggagaaggagatggaggatgaagtccgggatgtggttactgaggtttgtttttga

SEQ ID NO: 13661 - DNA, 642 bp, A.fumigatus
aggccgcgcttctccggcgcgcaacagaggatatcaaacgcgttatggcgctccgaaaccagaagcaggcgctggctatgcttctgcaacggggcagtgtcggggacgatctgtggcagcgtttccagcgggcggagaaggagatggaggatgaagtccgggatgtggttactgaggtttgtttttgaaccttgtttcattctgtccctgcgtgggtgggaaggagctttgctgatgtctgtgctttttctccaggccaatgcgtacgtgccgaactggggccaaacgatctttcaatccgcgaacgagatgctcaacaatgcgctgttccgtgagcggctgcagagttaccagaacaagttggctgaggagcgggagtggtgggataagaagaaggcgagcattcaagaagggtttatgaaggagctggatgcagagagttccgctgccacaaaatccgagcaagctgtatctaccacgacgactaccagctcgacacccggaaccaagactcctgagtcatccgctgcgccatccactgcagccccaagtgatgacgaggctgtattggttgaggctgccgacactgtcgcgggtggatcgagcggtgccggtaagaagaaaaagaaggggaagaaatga

SEQ ID NO: 13662 - DNA, 786 bp, A.fumigatus
atgatggactcgatcaaggatacgaagagttctacgccatgggtactctcgattctagacgttgttctgatccgcgttcagaagggacgggatggaaagccatacatcagaaggtctccgctcatggctctgtttgagtttactgaagagaactctggatatgctcatggcccccgtactcgtctgtctcagtcccagcagggtctcaacaaacaagacagtcacggcgccaaacagaaagacacatccccaggagaaagcgatgctgcagaagaggacggtgctgcttccgatatatcagcggacccagcggccgcgggttatttcaccttcatgctgatgtaccacttcttcaatgcggctgccgctgagaggcttgctggtacgaggtctcttctgtttcccaatgagatcttgtccttgatcatggacttttcagatatgcgtacatatttggcgcttgcacaatcatctgcgttctgccacgagctaagccatcacaagctccggctgaacgatgaatacgctgtgattgggagtggcgaagattctgagacctttgtcctagaagacttgcattcggggaagaagattcattctaagctcagcatgtaccaaaagaattggcttggccatccaatcgcagatggactcaaattgagtcctgttataggcgtcacgaatacaaaaagactcagtatcatggatgacgtgaccattcagttatcggacgtgacgccaaaagatccagtgtggtctgaggcagaagaaggttcttcgcagtaa

SEQ ID NO: 13663 - DNA, 870 bp, A.fumigatus
ccccaccattccgtgggttgcggagggctaacaatgttgatattcttgaactttaaagggacggggaagatgtttctttcctttaaagaagacgggaatagatttattcccatgcggaacgcttcagcacaagcgcgtgctgtggcacctgccagtcagcaaacagaaaccacggttaacctgacaccgatccaatcacaaatgttcaagaccatgacccgctctctcactatcccgcacttcctctatgcggatgagctcaagatcaacgacattacagctctaaggaagaagctggcatctgaccccaaagatcccaaaaaggtcacctttctccctttcgttatcaaggctgtgtcccttgctttgaatgagtatccgcttcttaacgctaaggtggacttgagcattcctgaaaagccgaaactaatcatgcggccgaaacataacatcggagttgcattggataccccacaggggttgatcgttccgaacatcaaagatgtcgcaagccggacaattatggaaattgcagcagaaattaagcggctaagtgcactgggcaaagagggtaaactcacgcccgctgacttgagtggtggcacgataactgtctcaaacatcggcaacatcggcggcacctacgttggaccagtgattgtaccaactgaagtggctattctgggggttggaaaatcaagaacagtaccagtctttgatgatgctgggcaggtcaccaagggcgagctagtgaatttcagttggagtgcagaccatagagttgtggatggggccactatggcaagaatggccaacaaggttcgcgagtttatcgagtcgccagagttgatgctcttgaatttgaaatag

SEQ ID NO: 13664 - DNA, 1113 bp, A.fumigatus
gagaaacaccatgattctggatgctgtgcacactcactgacacatttgttttcgctagattggctgaattcgatgagggagatgtattcccgttctgcacagaagttcgaagatcagatcctcacggtggatgtcaaaatcgagcaagacgatcttaccatcagtgagcgtcatgcaatgagttatctggctatcgatgaccgccttatatatgctccaattcagacgatcatggacagattctccaatgatctcatcattgaatggacttacaccatagaccttgaccgggagatgttcgccgttgatgatgccgcatgcttcaagctgttcaatataccccgcgggggacggtggatccgatatctcgctgaggacgcccagcggcgcagaaagctgagtgataatacacccaaggatattattgctgatatctcatggaaaccaaacattaatcccaacttgagggttttgggtgaagctctcaacattgagcttctctcgcttaccgattttgctgccgaaactatgctccgcttggacttggataccactgttgacaagcaaatgatgcctgtccgcatcaactttctgatgaccacgtttttgcagatgtgtagggtgtatcggaagattcttgatcgctttgtccttgcttgggagcccagctgttttatgttcagggaaatggcgttcgcagtgctgtcgctcgctgctggagaagtgtttttcgaattctctgaagtcctagatgcgaagtatagggaaaatggctattacttgcttccagattccaggactccaaaataccatacgaggatgctcccgcggttcatacatgagagtcaccttcctggcatcgagcctggatcagcaccgaagagcactagcttctggtttcacgacgttctcgttcatcttaattctagacttgatttagatgatgtcgaagaagcatcagtggtagcggtggtaaatgatggactcgatcaaggatacgaagagttctacgccatgggtactctcgattctagacgttgttctgatccgcgttcagaagggacgggatggaaagccatacatcagaaggtctccgctcatggctctgtttga

SEQ ID NO: 13665 - DNA, 345 bp, A.fumigatus
actaaccgtacatgtgaccagcttttcctccaattcgacggccctacaaaaatcctgttgcaaacccgtggacctcgtatcaatgatatcatgtctgcccgtgaaatcaacgaaatagcggatacgccgagaggactgaccttcgaccctacgaatcctgctaaacaaccaagggtagatggagaggaattcaaaaacgtcgctcacgacgctgtccatgcaggtcccggaccctcgcggacaatcgaggaactggaaaacgagatgaaagggataagccagagtatcgcgacgctcacaagggaggggaaagttatcattgaaaagattgctgagaagaagtaa

SEQ ID NO: 13666 - DNA, 186 bp, A.fumigatus
acgcagcagccagggtactaccctgattttgtcaccgatcttctgaatgatggtttcaggaggcaaatgctccggatccttcctatgtctgtatgcttcaccaagctgaagaatatggctctgcgtgtgaatatcgcccaagtgatcgtcttcatgagtatcctccgcctgaagtatactacgtaa

SEQ ID NO: 13667 - DNA, 2628 bp, A.fumigatus
gatgtcctcagttgttcacattacaccgccctaataacgaacaggtttcaagccgattctattgcaacccggttccccactacaggttatctcatcgccatcatctctgttctcggatttgccatcatgccacgggcaaaattcatccagatgatgctcctggacgtgctggcggtctgcgtcgcaacggcctttgctttgcttatgatgttctgcagtgttaaagcacgacagaacacacagtctgctgcggatgcggcctctatctctaatttggatcctacagccaacgagtacaattcatccgcctccgctgtgagtggcgtgctgctgtttttccagatatacctggtgcactcgtttcgcgcccactatcaacagttccagtttccggtgatcatctactccataattgccaatatcaccgcgtcatatgcccctcggctcccaaccatggccgcaggtattgctttggtaaggaccttgttcgaggcatgtttaattgggttgggactttgcacgggtgtctccctctttctctttcctgtgacctcaagacacattgtattcaaacagatggcaagctatatcggaggacttcgcgcaggtctcaaggctcatacaaagtactttgagagtctggagcgcgatgacatgtttggacgggccgagacatatgacgagacagtcgagaaattttccaagaagggcaaggtttatagtccagaagcagaagctattcgaactgcggtccagaagattacggacctccatggtaaactgcacgcggacctgaccttcgcgaagcgcgagttcgccattggaaagctcggtcctgacgatcttcaagccatcttcagacatctacgccaggtgatgattccggttgtcggtcttagcttcatcgtagacatttttcagcgtctgtcggattataacaaatggaacgagcctatcgacccactcgcaccggacatggcgaccaacatccgcagtcgtgttgtacacgaatggaacgagatcatgaaggctgtgcatgacccttttgcctctattatcgagactattgatagcggcctggaacacatttctttatcgttgcaactgacaaaaccacccaaaacctctctcggaaagaaagatgccccattggacggggcctcggatctggaagcatccgcagagaaacccccgtccccaggagaagcagggttcgcggcttattatgagcgaaagctcagcgacttcaaggtggcaaaacgcctcgctctgaggacctggagtgaggagaagggcatcactttacctccggatttcttcgagcgtccttcttctgacttgcccgatctggacgaattcctcctagacaaatcctcggtcggtcgcgataggagccgtcgacagctctttctttttctctatgtaggtgcaaaggcgacttcctcgcatttccgtgctgacatgccgaatcagatggaacaactactctacgcgacaggccatacagtactagattttattcatttcactgatgagaaagtcaaaagtggaaagctgacaagatcacatctgatcattcctggtgcgaaacgtttactgaagtggttacgtagtatacttcaggcggaggatactcatgaagacgatcacttgggcgatattcacacgcagagccatattcttcagcttggtgaagcatacagacataggaaggatccggagcatttgcctcctgaaaccatcattcagaagatcggtgacaaaatcagggtagtaccctggctgctgcgttcatccgaatcggcttatggatttcgagtggcttgcgctactatgactatctacgtgattgccctacttcatcagactcagaccttcttcattcatcaacgtctggtctgggccatgatcatgatcaacatcagcatgtcaccgaccgcgggacagagcatttttggctttgtgcttcgtctggttggcacggtgatagccatggctctcacccttttggcctggtatatcccaggccaaaagacacccggtgtcattgtcttcttctggctctttgtcgcctgtgggttttatgtccctatcaagcttttccgatttcggatcgttgggatcatcgtcatcatcaccacttccatgatcattggctatgaacttcaggtgcgcaaggttgggcaacaggctgcgacctctaacggccaagcctattatccgatttatcttcttgctccatatcgtctggccatcgtggctgcaggtatcgcggtggcatttttctggacgtttttcccattcccaatctccgagcatggagttctccgccagagccttggagcttcgctttatctactggcgaattattattccatcatccacgagtcggtgtctgcgcgtttgcggggtgacgaaggtgacctggctttgaaaacgtcagcagggcgaaggctgcaaaaagcacgaggcaaagtgttttctaagcagatgctgatgttgaatggcttgcgcacatcgtcggagtttttgaaatgggaggtacccatcggaggtcggtttcccaagaagcggtaccaggctatcatatcatcggttgagaagtacagccccatctcactcccttag

SEQ ID NO: 13668 - DNA, 186 bp, A.fumigatus
actcttgatcctaccatggcctcgcgtgttagctcgcgccagtcgacaagttcgtcacagtactcgcagaatgacgagccagacaacaagaaacagcacgagaaatggaaccttttccgcatgatcgagagcggatggtccagcttggacctggatcgacgaacggtaatcttgatgatgaagtga

SEQ ID NO: 13669 - DNA, 444 bp, A.fumigatus
aaaagcgccctcgcagccaaagtacaagccaagtatggtcttaaaggaaacgacacaaatgtggccagtcaaaagcctacgcggcctagacggattgccggatatggaagccctgattcaggtgacggacaaatccctagagaaaagggtcgcattaggacctggttactgggtggccaacatagagcagcgctaagaaacaaactttccttccaggccggtggtctgatgagcagtggccatggcgttggttcatttgtccttgttgacgccgtgactgccaataccctatctggcaccttgacctcgctgtacagtaccaattccaccgcatttctcttgcagaatgttgaattctacaacattgagaaagccatcatggcggaacgacgcgccgatcccatcctcgcgggggggggggggggagaacgacgtgctcattga

SEQ ID NO: 13670 - DNA, 576 bp, A.fumigatus
atcatttcccctgcagattcccacttccgggttggaggcgcaaagggctcccatctgcaagcttctgagtgcccaaagaagcaattccctctcatcaaacaagcttatatagctgcttcgttactgcttcgtattacttcttccgcttctgcttacctcgagaacgtgtgggcatggaccgcagatcatgatctcgatgtgaaatctcaggatccaatcgatgtcttttctgctcgtgggatcttggttgaaagccacgggccaacgtggatgtacggcactgcatccgaacacaacgttctttaccagtatcagcttccgggcgcgcagaaaattgtgatgggaatgatccagacggaaacgccatatttccaaccgcttcctgcagcacccgagcctttcaagcccggtcagtttcccaatgaccctgtcttcactaactgtggcaacagtatagccggctgtgccatggcctgggctgtgaggatcatcaattcctctactgtatatattctaggctctggtaagacattccgcgcgttttccattgcattatgtgtgaacctatggatctaa

SEQ ID NO: 13671 - DNA, 387 bp, A.fumigatus
ccatctgttgtaggactttacagctggcttgcgttctacacgcaggattgtctcgagactggccattgccaggagcagggcttctacgttgagcagagcactaatacctgggtgtacaaccttgtcaccaaaggaatcacggagtccatcagcccggcaggggaaaccccactctatgcccgagatgtccagaatggctatacctcgtctctcctcgcttggctccacaccggaacaggggccattggaaagcgcaaattcccgggcttctacctgtgggacggtgagatggaccgggatgttttgagccgcgtttcctctacctgccaaacatcctctaaacgctgggtcgaatgtcatgatccaatatacatgctcaggggctta

SEQ ID NO: 13672 - DNA, 417 bp, A.fumigatus
ccctatttcttacaacaaagggacattcaacttttcacccgccgtcgaccacaatacgccgatattggacacagccaggtgttcgacgtcacgtcccatggggccaagggggacggcgtgactgacgacactatcaatctcaatagtgtgttcactgttgccgtgaatctgtcgtccatcgtctatattcctcatggtgtctacaaagtaacagataccctgaagattcccaaagggtcccgcatcattggacaggcttggtctcagatcatggcaacaggacccaaattccaggatgctgacgatccccatgtggcggtccaagtgggccatgaaggcgacatcgggattgtcgagatccaagatctactgtttactgtttcaggtcccaccgctggagctgtcttggtggaatga

SEQ ID NO: 13673 - DNA, 195 bp, A.fumigatus
aatatccatgaatctagccaggggtcggcaggattatggggtgagttttctgtcctcgacctgttcgtttttcttgtgattaaatcatttcccctgcagattcccacttccgggttggaggcgcaaagggctcccatctgcaagcttctgagtgcccaaagaagcaattccctctcatcaaacaagcttatatag

SEQ ID NO: 13674 - DNA, 189 bp, A.fumigatus
aaccttcgggccgatctcattaaagggtcctggagacggcgatcgtcactcggaaggatattctgtttcagttgttgcttcaagctttcgtatgaatgtgagagcctggatattacccacgaatatcctggtctttatgcagccctattcatctcattatcaaatgccagtttaaggttctttgaatag

SEQ ID NO: 13675 - DNA, 243 bp, A.fumigatus
ttcaagcgcgcaaaaatgaagctctcagcccttctgagtcttccccctttagcctctgcggcaaccacgttgatcccctccacgtgcttcgactcacactgttctctggaacagtacttcgcctacctctacccctggggctcagatcataatggctccgcgcgcatggtcggcaactcgacaaaccacgagtatgtttccgtcaactcaggcacaactgactctggttgccaaacgagttag

SEQ ID NO: 13676 - DNA, 234 bp, A.fumigatus
gagttgcacttgaagccgtggtatcagatgtgtgctgatcagtcgcctctacagacctcgtctgaagtcaaagccttggatgtcaaatacccctctccccgcgattttcaaaagatcaaggctgagattcgtgatgtcaatggcaaggacgtctccgtaaacgtctacctcgatggcaagttgatcacgacccagtatgggagaggttatattggcaagccaatgcatttgtaa

SEQ ID NO: 13677 - DNA, 1494 bp, A.fumigatus
  unsure (1292),(1313),(1321),(1373),(1387),(1418): Identity of nucleotide sequences at the above locations are unknown.
cctcgaatgatatatttcgatgttaccgtgttagtgtgttggagtatttatgtactagcggagatagtggaaataagagtaactttatgctggagaaacaactccatgactaagcacaacatcacccaatatccttctgatcttctcttctccacactcccgtcacttgctatccccaagttcgaaacaccaattggagccaaaaccgccattgctctaccatccaagatggtactcaacgacacgtcaccgcagtccgagtccggaacctccagcgcgtcatctcaaaatggctccgaattatacagcagcggctacatcccaatacccgggtatcccctcgtgctcaagaccgaatgcctttcccgccccgacctattcacgctgtacttcggcttcttcggccagagcaactggctgcacaagaacagcgcacacgtccgcgaccgcatagaatcgtgcaaagtcatgatcaaccggctccccacgcaggaagagctcgacgccttcgtctaccacggcagcaaatacatctaccaccagcgcctcggcgcgccctactccggcgccattggcacggcgtacctgtactggcgcgtccgcaactcaggcgtcgtcgcgcaccttgcccccggcttgaaaccgggacagaagccgtcgccggcgcaggtgcttgcggctgtgaagctgtactcgacgattgagccggcgaatttcagacagttgatggtttggggatcgtttaggtggctcttctgggtggcggcgggttcggtggtgacgggtgtgtgggggatgttccatgatctgaaggagacaatgggtgatccaaggctaaagcagttctttgcggagatgcgcgacaaggatccagaggaggtgcgcaagcggaagatccagagggttgtggagagaaataaagcggccaatgaggcggcggaacggcgggcgcagggcttgccgcctgtaaaggttgggatggatcagggtgccagtgcgggagggggttacgctgaaagccaaaagtatggccagggtgctgggccgtatgggtctttggattcttactcttcttcctctgcacgggagtctgctccgtcggcgtcgtgggataagcctgctaatctgggacgcttgtacggtgataggtcctcgacagaagcgatgcgtggtgttacttctgtcgatcagaacaagggtacggacttcttcaagagcgatgatgcgagtcccgttgcggcggagtatcgattaggcggggactcgcaaggaagtgcctgtgatcgcatcanacagcaggccggacaggatancaggctanggtcggcgtggactccgtccgtcaatgaaaagcaacaacgcgaacatgatantggcccatgctcancatggagcggggtctcttcaacaccatacantgagatgcgacatctcgaacatgcccaggtccaatatgacgcctgctatatgccgatagaaacatgccgcccgtga

SEQ ID NO: 13678 - DNA, 378 bp, A.fumigatus
caggcttatcccacgacgccgacggagcagactcccgtgcagaggaagaagagtaagaatccaaagacccatacggcccagcaccctggccatacttttggctttcagcgtaaccccctcccgcactggcaccctgatccatcccaacctttacaggcggcaagccctgcgcccgccgttccgccgcctcattggccgctttatttctctccacaaccctctggatcttccgcttgcgcacctcctctggatccttgtcgcgcatctccgcaaagaactgctttagccttggatcacccattgtctccttcagatcatggaacatcccccacacacccgtcaccaccgaacccgccgccacccagaagagccacctaa

SEQ ID NO: 13679 - DNA, 219 bp, A.fumigatus
atggacaaaactggccaaaaattcttttactgttatctgtttgtattacctatggccactatttccataattaactacatgcagctgtgccaagttacacctgctcactcaagtaatgaaagagtatcggcccgaatcagctcagcactccaggctatgaaaagaactgatatgaatagagctacacggctgcataatgaactgcataatagtagttaa

SEQ ID NO: 13680 - DNA, 426 bp, A.fumigatus
tccatcccaacctttacaggcggcaagccctgcgcccgccgttccgccgcctcattggccgctttatttctctccacaaccctctggatcttccgcttgcgcacctcctctggatccttgtcgcgcatctccgcaaagaactgctttagccttggatcacccattgtctccttcagatcatggaacatcccccacacacccgtcaccaccgaacccgccgccacccagaagagccacctaaacgatccccaaaccatcaactgtctgaaattcgccggctcaatcgtcgagtacagcttcacagccgcaagcacctgcgccggcgacggcttctgtcccggtttcaagccgggggcaaggtgcgcgacgacgcctgagttgcggacgcgccagtacaggtacgccgtgccaatggcgccggagtag

SEQ ID NO: 13681 - DNA, 2370 bp, A.fumigatus
tctaacgcaccgcagcccaacatcaagttacatgtagccacagtgagccagacagcctttattgtgattgaccaatcggtgttactgctctcgttgggctcatatggtgactcgcccacctcgcaactcttactagactctggtcgacttccctctcctttcaatgaccatatcacctttcgatccggagctgactacaagctactgggcagcggctgtgaggatgaaacgggtgaaggatcttcctccgcatgcttggtcatggttcgaaattttggggtcattcgaatcgcagtgaggcctcgacaaagcgcaggcaatgagattgaagatgctcaaatcacagctaaaaccaaaatcgaacaagccgtattctacggcgcgaggccaggcaacccactcgatctaactgacaaaggcggcttcgactttagtccccaggagatcgaggaagctgcacttgaaatttgcggagaattgctgcggtctacctcgcattatattcccgccacgtcggtcactctagaacagaacttgaaattacgagcaaaagctctagatgatcttgcgagtctgttactgcagcataagaaacctttgcatcgtcaaacctggtacgagctattgtggggtgcagagaaacttgctgcacaaagggccctgtggaaatctgaggataaggcgaggcgggcaatgggccaagggaatacgtttttggctcatgtgattgggtcgatgaatgaaaaattcagaacaaaatctgaggattatgaggacaaagataatgtgcgcgactggtttctttttgacacgtttcgaatggaacatattattccctggatcttcaaggcgctcaaacttcagaaggggatttcaacgaagcagggccggagggtattagaagaaatcgtccaagccagtgagctttccttggccgtcttggagacagcttttcggtttcgtgatgagcacgctcgtcagtacgggcttgaagacgagcacatagaggatggcgtgttgtcgtctggctatgatggtctctctgagttctggacgtctcgagatattgtttttcttgaaacgggacatcttctggatctagaactcgatacatgtagggcatggacccaacaagcaacgacttctttggatctacgggagcagaagctcgtccggcaaattgcagaaaacagcgcccgccaactccgtgtgctcagtttaatgcactacgaaagagtcaggtggctttcctcacaggataatcccaaatcagtcgatgagggcattgaacttgagcaaacatataccaagcagcgcaggtggcagctattcaagttggctggcattgggcagctagaagacgcaatttctttggcagagaaattccgggacatgagtgctttggtagaactcatcattgagcttcaggatcagacattggcggactcggaacatgccgaaaatgtcaccaactatgaatcagaacagctcggtaggagaatctcgacgtacttcgagaagttcggcgaaccctgggctgatgccttcttcactcgccaaatatcgatgggtcaatcagagattctgttcacaatgagaaggtttcaacctttcatcaaccgcttcttgcataaaaatccgacctacgctcggctctgttggattaatgatgcgatcggtgaggataactatgaagcggctgctcgatcgttggagaccttggctctcgagcgtgaatcagatttgtggtgtcatcgcgttgagttgtccttgtctaaacttgccacgctagcagcctgggaagaaagcagtgcagctgccaagcctatctttggaaatgagataaaacgcctagaggacttggctgaattagatgctgtccaagaagttgtctatgcttatatgatgccagctttgcagggcgcgattgatcaaaaagccgaaactgaactagcaattgaccagttcggaagatttgtgaatgacaccccatcgctccacgaagtactatctgccttactcactaaagtgatcagccggcaaatcctcagggttgaccagttggttgatttgttgacactgatcgatggcggccaggtttcggaggaaacgcagaatgaattcattggcaaggaattctacctggctctgcgggtaattcgattgaactcttccacccaggagggtcctctctactgtatccctctgcagaagcttgtgtggcgcagatgcatgatcagagatgattggcaattggagaaaaatgctgacaacacagatcatgaacctggagatcacatgcactgtgtctctcttcttcgcacactcacactttgtttaagagatagtaagcatatctcccaagtttga

SEQ ID NO: 13682 - DNA, 255 bp, A.fumigatus
gtgtgtgctaataaatgtcaagtgtacaaatacatgagcaaatcactccccctggaatggccttccaccctcctcggtttcctatccatcattttcatcaccccaatctacatcttctattggaacggccctaagatccgtgaacggtccaaattcgcccagattcttgcgtccgataggaagaaggccggacgccgggtctcccaatgcggttctggagatgccggtcccgaggagtactactttgatccatga

SEQ ID NO: 13683 - DNA, 216 bp, A.fumigatus
gctcctctcaggattgctagccttgtcttaacgctgagacagtattccatctacatggccacaatcgactacatgattgcctcctacgggccatattccgcctcagcaaccggcggcaatgccctagcacgagacttcctggcaggcatcgcagccatgtattccgttccaagtaagaccagcaccactgatgaaaattatctaggtgtgtgctaa

SEQ ID NO: 13684 - DNA, 195 bp, A.fumigatus
aaactgaacaaatctaagatcggcaggcagtaccctatgtacgccctgtcattggcgggatcttatatctcaatgtccctggccactaacagccctgtgggtttgccgttgctgccaacttttttactctgggtccgtagcagttgggttggtaagagaatccatatctcattgcacagtccgaatgctgtatga

SEQ ID NO: 13685 - DNA, 573 bp, A.fumigatus
atacggctgatggcattgcactcggttgttccctattctctaatcagcagaaattccatcatttctatctacacccttaagaccgcatcgtctgtttctcaatccaccggactattccctaagtttgtcaaaatggcacgtaccaacgcagctgcctggctttctgaggaaaagaagcatccttttgaaataaaggaatcacccctcggcaagccagaggccaacgaaatcctaatccgcaaccatgctctcgccatcaacccgatcgatggattgattcaaacgaaggccttcttccccttgcactacccgattattcttggccaggatgtagccggggaggtgatttctatcggcgacaaggtcactcgattcaaacccggagatcgcgtcctaggccatgccgtcgggctcatggccggacgcaacgaggcctgcggtttccagacctacactatcctacaagacaacctcgcctgtgagataccagaaaacatttcctacgaacaggctgtcgtcgtacccctggtctctccagtcttcaccacgaggggcgaaggatccgcgctaagc

SEQ ID NO: 13686 - DNA, 201 bp, A.fumigatus
tgtaataggcactccgcatataatagtcaagcttcccgtatatataatgtctgcgaatgtgaatcaattgctgcttttcgcattttccttagtctgtgtttagattgcttctaccagcaggatgtcatggagcgcgaaaataattcccaattgcatgagatcaacggtatgtgtcccctctatcaccacagctcgtcctaa

SEQ ID NO: 13687 - DNA, 459 bp, A.fumigatus
gatcaacggtatgtgtcccctctatcaccacagctcgtcctaatctcaacagatgtccaatcccaccactgccaatcccacgaaacaatacagcagccgtcccacgaccgtggggcaatccagtatgctcctaaacagtattccctaacaggctcaaaccgccccccgccataccatggcggtgtctatcttcaccctgattacatgcactacaaccccaattatggccagccacaaaacgccccagtctggagtctgtcgcaaccgttgcctcatgttatgcgatcaggaatgaagaggggcggcgatcaagacgcaaaagccacagacaaacgacccaatgcacaccaagaagaagttcccgcggcagacgaaccaccaaccgagcacccggctcacaatgccgacttcgacgcagaaaagaaccaacccgaagcccgagtctcccaaccggacgag

SEQ ID NO: 13688 - DNA, 840 bp, A.fumigatus
gtaaccaatcccagaatcccatacacgacaaccgcctccggcaaaacagtcaaagactgggacaccgtcgaggccatcgacgtgccgttcatggttgcagcactgtcctacatccggcagcatggccggcttcccccgcgtttgaagagcaaggaggatctcaacgaggcgtcggattcgggcgtcagcgacgagacgattacccagctgcagcgccaggtttctgacaagctgcggcagtttggaccggctttggcgggagacgggggagagggaaagcgaacggttgtcttcttcgaggggtttttgttgtttagcccgcccgaggcggaggtcagggagcatgtgctgcggccggtgcacgagcagctcgatgtgcgtttatttttgccgtcgccgtatgaatctgtcaaggaacgccgcgagaggaggagtggctatgtgactattggaccggcccctgtcccgccgctgccgcaccgggattcggcggcttccaaggatgcaaagcagcaagttgacttggaggcagaggataatgccccgccgcagaacttctggacggatccgccgggctacgtagatgatattgtttggccacgatacgtacgagatcatgcgtggttgctgttgccagaaagcggtcttgacaatgatcgataccagagcaccaggaattcggatactgacgagttgatcagaattgtagggcaaggtacgaacgtgaggactgatgccggtgtggctgtcgctcctgggaaagggacattgcccatggttgatgtattaaaatgggctatacaggaggtgatgaagccattggagatggccgagcaatga

SEQ ID NO: 13689 - DNA, 207 bp, A.fumigatus
atgcgacattcaaaccatccacatcatccggcaggagagaagtctccagttgcggctccggagaggcagaacaattatattcacgctggcccagtaacacattacaacaagtacaacccttataagacaacctggcaagaagcaacaatcgtacaccgcaaagaaagttatgtaccaatgcaaaagccctattcaggggtagaataa

SEQ ID NO: 13690 - DNA, 246 bp, A.fumigatus
ctgggcatcccgacggccaatatccccgctgagggactggaagagtatcccgatctccaggtgggggtgtactatggagttgttgcgcttgatccagccaagttccagtatcaggagggtcagggctcgacctcgacctcgtcgacagggggagcagaagcggcggttctgcccgctgtgctgagcatcgggtataacccgttctacaagaataagacaaagtctatcgtccgtctccctcgctga

SEQ ID NO: 13691 - DNA, 1995 bp, A.fumigatus
tcccccacctttcaacatgtagaccaactccgaggggttcgaagtaacagcttgtcatcctcggtgaaccaacagcctcccagcacgaccgtatcaggcgccacccagagtcagaatcccttcgcgggaccattctttgacccaagcgaccctgctctcttcaactttgacctttctagcatgaactttgagaatcgctacggtgcgttggagtttgggatgcttggccacatggcgaccggtgctggtgactcccccaccgattccgccacgcagcgaggatcgatcggccggagtggctccacacagtactccacgacacccctcactggggcccctggctttggggagagccctggaaaccagcaacctttcctgttcggcaacgatccgctcctgaacgaatggccgaatagccaggctccgaatcaagggcatctgaacgttagcggcgtctatccccagggcggcatgatgcacatggccaagtctgatgcgccacatgcgtttgccatcgagagtggaccagccagtttctccagcccgagtgcaacaaccagccctcatatcaacagcgggcatgatgaaagttcgctgagcaacgcggccgtgaacaagtcgaccggcttaactgccaatggacaacggccggcgatcacgacgcccagcctgaagcaccagagcctgcagtttggagtgaagcgacgtcagcgaaacccgtcgactgtgtatgagagcgtgaaagagccgtatgcctatacgaaccgcttccacaatctgacagccttcatccaacggcgcttttccccacaaaagaccttgcagattgcgaaagcattagcgtcgatccggccgtcgttcattgccacgaccaagacactcaaccgggatgatttgatcttcatggagaagtgcttccagcggacactctgggagtacgaggactttatcaacgcgtgtgggacgccaaccatcgtctgcagacgtaccggcgagattgccgcggtcggcaaggagtttagcatcctcaccggctggaagaaggatgtcttgctgggcaaggagccgaacctcaatgtcaacaccggaggctcatcggcccccgggtctggcaacacatcccgcggcagctttacgccgcgaagttctacgctggaaactgcgactcctggacgcccgcagcctgtgttccttgctgagttgttagacgacgacagcgtggtagaattctacgaagactttgcccgactggcctttggcgactcccgcggcagcgtcatgaccacctgcaagttgctcaagtacaagaccaaggaggatatggagcttgcacagtccgatgacaatcagaggtggaataatcacctgcgcaaaggcgggattgctggcgaggcggggatgaatcagttagggttcaaggatggcaaggtcgaatgcgcctactgctggacagtgaaaagagacgtatttgacattccaatgcttattgtgatgaatgtgagtggccagtgtatttggacgagtcgacatatgctgatatcgactacagttcttaccgtgcatatgacggaatcacacacttgttggtggttcgcacacggatgtccttggaatgctttggatgtgttattgatcattttgtgcctttttttttttttttttttttttttttttttttttttaatctcataccctcggatggacaaaagtttcccccccggccgactgtttatgtcgatgttcattattctacccctgaatagggcttttgcattggtacataactttctttgcggtgtacgattgttgcttcttgccaggttgtcttataagggttgtacttgttgtaatgtgttactgggccagcgtgaatataattgttctgcctctccggagccgcaactggagacttctctcctgccggatgatgtggatggtttgaatgtcgcattcaagtatatgtttatcttctcttgtctccgcctgtctagttag

SEQ ID NO: 13692 - DNA, 249 bp, A.fumigatus
aatgaacagactgagatactcaggccatccacattgttctggttccctattgtaattttggtttctgagaagtacagtactgtaacgtggcactcaactgagtctgcctttatccactcatgggacgaggtagcttttccccctctcctgcctcttacccacctggaggccaccaccacttatcagaggtgctcaggtgctcttctgggaaattctcctccttttcgacagatcaatctgactgactga

SEQ ID NO: 13693 - DNA, 423 bp, A.fumigatus
gccgcccggtcgtgtgatattgggggagacgggccccgcgtgatggagacattttattgggcagccatcacatattacagcacgatggtctacttccacctctgctttgacaggctgctcccagacaatttgcagacagtgttgatgccgcaagaaaaggccgtctccctagtcctggagctatcgctcaagctccatcgaagcaggccgcatctcatggtgcgcatcacgtggccactcttcatggccggcgtggctaccgccgacaggatctatcaggattgggtatctatccggctgcgagagttggggcggtatgggcagaattacagccgtatcagccaacgctttgacgagattattcgcggaagcgacccttttgcatattctcagaaacaacttccgtattacaacgctgattga

SEQ ID NO: 13694 - DNA, 504 bp, A.fumigatus
acaatcgcagtcatcgcagggctacaggacaagacgacgggctccttcatgggcgacgaatggggtgaattggacacccgtttcgtctatggtgcctttaatgccttgtcattattaggactaatggatatggttgatgtctctaaagccgtggcatacattcagaagtgtgaaaacctggatggaggatacggcatctgtcccggagccgagtcccatgctggacaagtcttcacgtgcgtgggagcgttggccattgctgggcgtttggaccttgtgaacaaggatcgtcttggtagttggctcagcgaaaggcaattggacaatggcgggttgaatggacgtcctgaaaagttgccggacgcttgctacagttggtgggtcgggtccagtttagcgatgattgacagactgcactggattgatggccataaactggctacatatattctgcgctgtcaggtgtgctcgcctcgctgtctaccagagtgtcgtcagaactga

SEQ ID NO: 13695 - DNA, 462 bp, A.fumigatus
aggcgggatgagctggaatattggctcacagagcatcttcgtctgaatggtgtatactggggcttgacagccctccaccttcttggctttccagaggctctccctcgggaagagactatcaacttcgttctctcctgtcagcgcgaaaatggcgggttcggagctgcacccggccatgatgctcacatgctttacactgtctcagccgtccagatactcgtaaccctggacgcggtggacgagctggaaaaacgtggtttggggggcaagcagaaagttgcatcttgtatgattttgcttcccactcttgtaatcaccttccgttcacacctcgctcatactaaacaatcgcagtcatcgcagggctacaggacaagacgacgggctccttcatgggcgacgaatggggtgaattggacacccgtttcgtctatggtgcctttaatgccttgtcattattag

SEQ ID NO: 13696 - DNA, 237 bp, A.fumigatus
ttgacagactgcactggattgatggccataaactggctacatatattctgcgctgtcaggtgtgctcgcctcgctgtctaccagagtgtcgtcagaactgactcgatgcaggatcctgaagctggcggttttggagaccgcccaggtaatatggttgatgtcttccatacgaacttcgcaattgctggcttgagtctcctgaaattcgaaggcgtccaggaagtagatcccgtttag

SEQ ID NO: 13697 - DNA, 741 bp, A.fumigatus
  unsure (547),(589): Identity of nucleotide sequences at the above locations are unknown.
ctcaatcgagttgaccgacccgggcaagacagtctggttgatcgcctgtacagtgtccatgggaggattcctgttcggttagtatccacccccgaatacgccatggatcgaaaattaatgcacgtagggtacgacactggcgtcatctcggcagtactggtcagcctgggaacagacctaggcaaaaaactctcctctagcgagcaagagctgatcacgtccatcacgtctggcggcgcgctgataggcgcagtattagccggcctgacctctgacaagtacggacgtaagctcggcatctatgtgggctgtgtgctcttcgtcgtgggcaccgtactccaaaccgctgcgtactccatcgcccagatgacggttggtcggctggtcgtcgggtttggtgtcggcaacgcggccatgatcatcccgctgtatatcggcgagatggcacctgctcgattccgcggccggttgatcgtctttgacaacctctgtgtggcatttggccagtttgtgtcgtacgcactcggggctgcgtttgcgaatgtancccatggctggaggtacatggtcggtatcggggcgattccanccctgatgctgggcgccgcaatgcgatggtgtcccgagactcctcgccaattaatctcgcatcggccgtggcgaaaaatgcacggcaagtgccgaaaaggatcttccccgcaagccaccgacccagcaaatcgatgcaaaaaccccggttga

SEQ ID NO: 13698 - DNA, 192 bp, A.fumigatus
ataagatcaattggtgccatggattctgacgccgactcaacaaagctgtcactggatggcaaagcggaagccgtccatcaagaacatctaggcgacgagaatccagatgactcaatcgagttgaccgacccgggcaagacagtctggttgatcgcctgtacagtgtccatgggaggattcctgttcggttag

SEQ ID NO: 13699 - DNA, 333 bp, A.fumigatus
agctggatgatactgaggaagtcaattcacaacctgttgctgaacagtgacctcaagcattatatatcaagcccctccacaccaaactttgtcaacgaacctagcacacttgagagtgatcaaaaacatgacgccaagcaactctacgcaacggaggccccaggattccccgcactgattccccagacgccatgctttagtgcattcatcagtggacatcggcaatcgacatcagataccggcgtggcttgcgggaatgagttctcttcacggaagcaaaagccggcctttagtttggtactgctagcagtggcaactctttttgcggggtaa

SEQ ID NO: 13700 - DNA, 1512 bp, A.fumigatus
gttaaacctgacataactagacaaaaagctaactggttaggcctccggaggtatcccaactttcaccccttctcaggcatgtctgccattcctttcatggtgctcgcatcccgaggcttccgttccatggagctcttgaacctacaccggaaacatcccgtcctccgcaccggacccaacacgctgtcgtatggcgacgtccgcgccatcaaggacatctacgggcacaacaccaagtgtatcaaggatccgtcgtacattgtcacggcaggcacacactaccacctagccgacgtggtcgataagcccgaccacgcgcgcaagcgcaaggtgctttcctcggcgtatgccctcaagaatctggagacgtgggagtacaaagtcagcgacaagctcgagcggctgatcgcgcactttgacccggtctgtacgaagcctccctcggcagctgtggcggagggcaaggcggcacccgatccggcggatctgacggtcgactttcgcgcctggaccaacttcttcactcttgaagccatcgccgacattcgtctctcggagaagctgggcttcctgatagcggcaacgacgtgtgcacggccgcataggaaagccgggacgacgtatgaggtccacctccgcgaggcgctgtatccgaccgcgcgcaagcagtcgctgattctgtggaactacgaatggtaccccgtgctcaacaagctagtaaacatcatcccgttcttcaggcggatgcaacgctcgtcagacaactgggagaacatcgtgtggcggcgcgcatcccaacgcctccgccgctacgaggccggcgagaaactggacgatttcttccaggcactaatggaggacaagaatggacacccgaacaatcttgaatggggcgagatcgtcgccgaggtcaacatcatgatgaacgctggcagcgtcacaaccgccatcgccatcgccaacgtcatgtaccagctgctcaagaacccgcgctgtctggccaagctccgcgaagaagtcgacgccgttctagacgaggaagacatcattgccccctacgacaaagtcaagcacctcccctacctccgcgcttgccttgacgaatccctccgcatcttcccgcccacctcgcacggcctcccgcgccagaccccgcccgaaggcatggagatactgggccagtgggtgccgggcaacacctcggtgagcatctcggcgctggtcgcccaccgcgacgagtcagtcttcccgcaggcggaccagtacatccccgagcggtggctgggtgaagaaggcaaggcgctgcagccgtactttgtggccttctcggcaggcgctcggtcctgtatcgggcggaatatctcttacctggagcagaccaaggccatcgccacgttggtgcatcggtatgagtttgccctgcctcatccggggtgggagttgaagcggttggagacgatgaatctgattttgggagatatgcctgtgaaggtgtggaggaggcaaacgtga

SEQ ID NO: 13701 - DNA, 627 bp, A.fumigatus
gccgcaactaagaacccactcggtaggtctcccgtcttctacgtggcacacggaaagcatgataaggcccaaagcgcactccggcgcttacacggcagttccgaccagtacctccacatccgctacggggccatcgtccacgcgctcgacgaggagaggaaacagcagtctgaatcagcgtcctggcccgagctcttcaagggctgcaatctcaagcggaccatcactattgggttcatcatgtttagcaccagcgccattggcgtgccgttcctgacgcagaatatctattttctcatcacggtgggcctcaacgtgaccagcgttttcgacatcgggatcggcgggtttttcctcggctgtctctttgtgatgctcggctggctctccaacgaagggatcggtcgccggagactgtggctctggggcttaatcggcaacttcctctgcatggtaactatcggtgcgttgggattcagcaccacgaaggcgagccagttggcaattgcggtaatcatgtcagttctgccacgctctaaactaccccggagaatttatctaaatgtcgtctttctgcctacaggaacgtcctcatctcgtacggtgtctatgccacggttggtgtag

SEQ ID NO: 13702 - DNA, 459 bp, A.fumigatus
ggcccttcagcatcgactgctggccgtctgttctcccgcactgcagctgcttaccgagtcacacacctagctatcctccccttcgtttgtgcgagtaactatggctatgatactgtctccaacggttccagtattgccatgccggcctttattatgtcctttggcgccatgaatcatgccacagggtctatgtatctgccgtctatctggacatcgctctggacttccatgaccaacctcggccaggccctggactctctgatagccgggttccttgccgagcgcatcggtcgtcgctggactgccgtgtcactcgccatcctttctatcgtgggcaccttcattctcgtcttctcctcgaccaggggcatgttattagtcggcaagacgatgaatggagccgtggtgggaggattgatggcgattgggaccacgtacgccgccgacgtacgacattga

SEQ ID NO: 13703 - DNA, 411 bp, A.fumigatus
actaccccggagaatttatctaaatgtcgtctttctgcctacaggaacgtcctcatctcgtacggtgtctatgccacggttggtgtagcctggaccatctgccctgagatctcgtcccaccgtcttcgccaatactcgcagtcggttgccttcattgttggcgccgttggcggttggctgttcaattttatcaccccgtacatgtataatgtcgattcgggcaatctgggcgcgaagactggctttgtgtatgccgggttgacggtggtcgttgccgttatctcttggttcttcgttcccgagacggcaggcctcagcgtcgaagacattgatagggcatatgagatgggaaccgcaccacgacacttcaagtctgccaaagcgacagtcagtgccgagagtggacattga

SEQ ID NO: 13704 - DNA, 786 bp, A.fumigatus
  unsure (6): Identity of nucleotide sequences at the above locations are unknown.
attcgntacggcatcacaatggctccggtcgcccttcgagatctcgcggaaagccctgagcttgagggaaccgaggttgtctcgatgaaggctcgctcatctcctcctctcactcccccgtctcctccttgcctcgttacggactacatcagacaccaagtcgagtctaaccctgatgctccagcagttcaatgcgagcaggagcaaccgtacagctatgccgcgctgtggcagctcgtcgagcacattgcggcagcgggtcaatttcgtgctggccgtatcatgcctttgtgcatggacccgtctgtcgagtttgtggccaccgtattggccatcctgcgggccgggtctgcctatgtcattctcgaccctgaaggttctgcgcaacgtaaccgcgttattgcggaggattgcggttgcgaacctgtcatttttcacgaaaagtatgcgcctttctttgatcacagcgtcacaatcgagagcatccagttgattcagaaccacggacaacttgaccttccttcgataaccccatccgaccttgcatacttgatttatacttctggctcaactggtacccccaaggaagtcctcctcagccaccgtgctgtctctcatggcatcgaccaattccaactcaacggccgcaagcgatggctgctcttctacaaccccattttctccgcagcgcaacggaccatccctggccaccctgtccaagggcgcctgtctttgcctcaccaggcgagaccgacttgcaactgcattgcccgaggtgttgaataa

SEQ ID NO: 13705 - DNA, 2370 bp, A.fumigatus
tttatacttctggctcaactggtacccccaaggaagtcctcctcagccaccgtgctgtctctcatggcatcgaccaattccaactcaacggccgcaagcgatggctgctcttctacaaccccattttctccgcagcgcaacggaccatccctggccaccctgtccaagggcgcctgtctttgcctcaccaggcgagaccgacttgcaactgcattgcccgaggtgttgaataaccttcagatcgatgccctgggtatcactccctcggcactcgccttactatcccccggcgagacaccagcttgcttgcaacagattaccactgttggcgagccactcagccagtcccttgtcaacaaatgggcagacagagtccacctgcgcgtctcatatggacttagcgaatgtgcccaactgaacttctcccgtcaactccagccaggtgataacccccgcaatcctggcctcccgtctgacacaaccaccgcgattgtcctggagcctggcaccatgactcgtctttctgtcaacgaacccggtgagctctgtctgtatggtcctcaggttgccaatggctaccaccaacgacagaaggaaacccaagctgcctttgtcaaggcaccaaaggatacccacggcacgatgatgttccgcaccggcgatctggctgtccagcgtgaagatggaacgtttgagattttgggtcgtatcgatcaccaagtcaaaatccacggtcagagggtggagcctgaggaagtggctgccaagctagcaacggtgaagggcgtagccagcttggcgtgtgtgggatgttacatcaacgagcgcatgtcgcttgttgcggctattgtcccttcacccgaggctgactggggaacgctcgtgcagtacctgcgcgatcatgctcgccagtcttttccgccgtacatggttcccagctattggatgtcgtgcaccgagtttcccaccaaccagaatggaaaagtggatttccgggccattcgtcgacttgctgaaagcactgaggtcagcaagatgttgggccacagcacttcgccgaaagacggtgctacagctggcctgagcgagactgcctcgaagattgcacaggtttgggcagcagtgctaaatctgcctgcgtcctctatcataccctccgattccctggtggcactgggaggaacctccattgacgcaatccgtgcgatcagagaattaaagggacacggaattcacgttgagttggcggatatgcttcaggcgcacacgatcgaggaaattgcggataccgtccaacttgactcgagtccaactcacgttagcaatgagccagccgcgcctttcgactacatctctgatgcagtgctcaaggcggacctccttgccgaccgtcgtgttgtcgatgcgtatcctgtcaccgcactccaagaaggcatcctggccagcacgctgcaaggtagtcaggactacctgtaccaacgcgtttttgatgttcgccatctcgaccttgtacggttgcaactggcattccaagtcgtcttctggcgtaccgaactcctcaaatctactttcgtcgccgcggccaagggcttccttcaggttgtccgcaatgactttaacctaccttggtcggaagtttccctgagtctgtccgagtacctcgaacaggacaagaacaacggtgtcacactaggcgagccattcatgcgtgtcgccgtcctggaccgaagcattctcgtggtctcggttcatcatgcactcttcgacttctggtctcacagattccttttcgacgacgtcgctcgtgtgtactacggccgccggcctgagaagcgccccgagtggaagtcgttcgtgggccttcttcacacaagagacacaaaggcatctcaggacttctggagagaacaccttggcgaagctgttcccacagtgctcaattacgctcctgtgacaaagacatccacagccagacgcactgtcagccaggaggtgagggccgcatcatcggcgttgcgtgctcctctgggtgcaattatccatgcggcctgggctctcgtcctctcctcccacatcgcctcaaagtctgtcacaatggcgacggctgtttcaggtcgcgagctgcctgttccaggtattgaggctctgaacggacctacctgggcttgtgttccctacgcaatcgccattgaatccggaacaaacacttctgcagttgggtgcacctctgtcatcaccacttctctgggaaaggtctctcaaccactctccagttccgaattgcggaaatcccctgggccgctttctgaacttccatgggttttattctccttccaacacgaggttctatatctctgttcattgcgctag

SEQ ID NO: 13706 - DNA, 273 bp, A.fumigatus
agtaaggccactaccctgacacgacatgggcgaaaactcactctaaaaagttatcgtctcggtgcattcggcttccttacttctaatgaacttcgacgggctgggtataacgccaacaatgggctcagagatcagaaagtggccatgcgatgggtgcagaagcacattgcagattttggtggagatcctgacaatgtgacactcgcgggaatgagcgctggaggaggtatgtctggctcatcattgatttccactacattacaggcatactga

SEQ ID NO: 13707 - DNA, 465 bp, A.fumigatus
tttccactacattacaggcatactgacactttgctagcgtgtgtaacgtaccacctcgactctgacgagcaactctttaaacgggctattgtaatgagtggtacctgtctactcatccaacccttgccttacgaattacatgagcagaactaccagcaagccattgcagcgttaggactgaccaatgccagttcagaggagagaatcagagctcttctggaaacaccaggtgatgacttagtcgccaaaatacccccgaccgttctagcagttcctgcgattgatgggaccatggtgacctccccggtcacctatgcgcaagtggctgacaaaaattctgacttcccccgcggaaagaagtggtgcgaagatctaatgattggcgacgctcagatggatgtaagctgtcatgaaacgctgtcaaatcgtctactgaccgcgactctgtctctcttcccaggctag

SEQ ID NO: 13708 - DNA, 234 bp, A.fumigatus
cagatccgccacgatctgagtcccttgataccgcaggctgattctgtccaggttcgggccccgcgggccccgaggcagagggaattgaatcatcgcctagacttaaatcctcaaatcctcgtcaaactattatctcttctcaaattcttcattaagtgcctcttccgtatgtctccatgggtggtcgataactctaaggttctgtgtccgtcaacttctcttcgtgacctctga

SEQ ID NO: 13709 - DNA, 303 bp, A.fumigatus
actaatgcaaggaatcctagtccaactgctttgtctcctttgtttgggtgtgacttcgaacttggccatattcaacatattctcccaaagaaagagcttcctcaatcggacttgaaatgtctgaacttgaacattaccgtcccggcgggcacaacagcagcctccaagcttcctgtgtttctcttcattcacggcggagggctggtgcttggagccaactcctggccacaattcgattatgcacgctttgtcaggttgtccgttgaaaagaactttcctatagtggcggtctctatgaagtaa

SEQ ID NO: 13710 - DNA, 636 bp, A.fumigatus
ccgcgactctgtctctcttcccaggctagtatcatggcttttttgatgtctcatacgaagaaagactgtgcgagcaagtttgttaccgcgatcgaaaccatactttcatccaaattagatgttgcgcaacagatcttggacaagtacaacatcacaagggaaatgacagacgacgaggccttcccagctattctcaactacgtaaatgacattgctttctttgctcccgttctgacatttgcgaagggctggaaaaacaatgtatacgtctatcacttcaacgaagggaacccatgggatgggccttggaaaggtcgagcgagtcacatccttgacttggcctacctgttccagaacttccgagagtttatggcgccagatcagcagcaacttgcaattaccttcgctgaagacctcttcaaattctgtcatggcgtgaagccatggccttccgttgcccatgatgatgtagaagctggtttcacggcacgagtctacggtcctgcacccaatgcagcgcaagtgaatgggccatactatgaaggaagcttgagaagaagcgttctcttcgaccacactgaccaagcgtcgctagatgagtttgcacaagtacttgcgttgtttagaactctctag

SEQ ID NO: 13711 - DNA, 189 bp, A.fumigatus
gaattccaagctacggctttgttacccgccctgcgcgctgcgattgccttgaactgtgacatccagccggtcagtcggttcgatcgaaaacactacttctaccaggatcaaccagcgggatatcagattacacagtactacggtagctttctttctcactcggtcgatgccgattacagtctaacatag

SEQ ID NO: 13712 - DNA, 327 bp, A.fumigatus
aggctcatgttgtcgcgggcccccagtcgggctccctccggcatagccctctaccaaccgcacctcatcgttgcattagatcgctacagacatcggctacagaatccaagggaacgtataccattactgaagcagctgaaacaagacgcaaaggttctgaaggctcagaagagccagaagagagcaagcgaagaagcatcccggacaaagtgggagttgactgttggcattgagattcacgctcagttgaacactgaaaccaagctattttcgagtgcgtcaaatctatgttgccgtcccttcttggcccaaaatttacaattctga

SEQ ID NO: 13713 - DNA, 345 bp, A.fumigatus
ctttctttctcactcggtcgatgccgattacagtctaacatagacatagaaccgtttgcgaaaaacggctacgtggatctctttccacatgacggcattgcacctgaggacggcgaccatgttcgcattggcatcaaacagatccagctcgaacaggacaccgccaagtcccaggaatatcctccctccactcaactcctcgacttcaaccgagtatcccatcccctcattgagataatagccatgccgcagatccacaaccctgccactgccgcagcatgtgttcggaaagattcaggccgttctacaatcctgcagcgccgtgacaactgggaatggaactag

SEQ ID NO: 13714 - DNA, 249 bp, A.fumigatus
tctaaggtgaatttgcaacgaagtgtgcagatatcccaaaattccaagctctcctctgtcttgctgagtggatacagctcggtcacctgtcacatgtctaaatgcagcacttcagctgtcacacaaaccctacatctgttcatagaacaagttggacaacatggcttcaagatgctcgattcttttaagagtgtggttgtccagggtaggatgagcacatctcaatcacatcagatccttatacattaa

SEQ ID NO: 13715 - DNA, 228 bp, A.fumigatus
  unsure (24),(28): Identity of nucleotide sequences at the above locations are unknown.
accttaatttccggaaaaaagganaacntaaaaccctggcaggtccttcctctcgacaggccctttgcccgtcaactcgctctccgcttgtgctataacggagacatcctcgggtgtgatgcgctggccaacttcggccgcgcgtttcagttcgctaacagaagggaggtcaaaactcatgcttacattacagttaaacaaaacagtggccaatacagtgaatcttga

SEQ ID NO: 13716 - DNA, 687 bp, A.fumigatus
ggggcccccccccatttccccggtggctggaaacagatacgatggagcttcaggggcatttccccgagccctaaaattggttcccccaacgagcaaataatattccggggtagtggtggggagacgtcgccaaacggttattcggagtacgaacaggggcaaaccaggtacctgcgttggttgaggaataatctttgccatcggaccagggtgaggctgtcaatgtacctgcagatagtctgcaggcatatctcgacgggcaacatcatggaaggcatggcccggtcggataacgtgctgaacacaggattctgtcccatgccggcgcgagacaatttggatctgttctcacgcgcgctaacgttcaaacctcactcaaaagaggaggtgattctaccacggaaaaagagcgacaaaggcttgaatgggaaaaccgatgagtatgcgcccgcctttagcgaattcaacgtcctcgcgacttgtttggggcccggggagacggagacgcacaaagccatcttaggtccgagtcttatgattgtcgtaaaaggtaacggccatatgaacgctccaggcgacaagcggttcgacctgaaggaaggatacacctacttcatcggacagggagttgccctagacttctacacagagaagggaatagcggtttatcgaccttatacggagtaa

SEQ ID NO: 13717 - DNA, 243 bp, A.fumigatus
actgaaccatcctcggctccatgtcaaattaccgaccacccgtatcgttctcggcgtcctttccaggatgcaggcaagatctccccgtttgctcgccattcgaaatctgtcattcgcaagggagcaaagttgagtcccgccctcctggctagtacttccgctcttcgacctgcatccttcattgccgattgcgcaatctcgacctctagagaacggatagtctccctgctgagcagccagtga

SEQ ID NO: 13718 - DNA, 276 bp, A.fumigatus
ttggtgtcacgcgaaatgaccatactggcagtcgttcttcaggcaaaagaagcaatgcttgttcgataccaatcacatacgcgaaacactgagaagaaccttgatcggctccccagcctctccatcaacgctgtcggatcattcttttatgatgaccggaaagaagagaatattaaaccctgtcatattgataagctcgggtctgatcacggtcctttgtttcagaaccatgagtttaaagctatgttgggggtcaacaatgcaggattgcagtag

SEQ ID NO: 13719 - DNA, 315 bp, A.fumigatus
gttgcgagtgtccaccggtctcgggctcagggtaatgctctgagcgcctgtccaatcaacgacagcaacattggcatgttccctcgttcccccagcgaccaaggcagaggcttttaccacactgctaaggtcgaatggaaccttcgtggactgggaatcgccctgaataatggacaaagcctccgcaagcaattcgcgtggattgacatcatcagctgcaatgtcattgaacgcgacgactgtagcgtacggcgggagagcttgtctgagagccaagaactcgcacgtctcgggtccttgttccatgtgaattag

SEQ ID NO: 13720 - DNA, 2691 bp, A.fumigatus
agatttgtgatgagctcattcctccctgcttcggagaaggacgacaggaggttttacctgcagaacgtgtggggacaggagatgctttctggagccctgtgtgcagcagctgaacgctgcgtcgcacccacagagagcgagtcgaagatcattgatacgtgtgaaaaggctgtgcactattacctgtcaaaactcaaggcggccggactcctcgaccagtgggctgacaagaaccccgggctccgctctctgatgaacgagatagaggctcgtgttactagcatcccggagcaatcggatctggtctcaatgctgggagaagtcggcgagcacatcgatcttgtccttgtgcgcactattggcgagagtctcctcaactctccgagtgagggccttggcccaatcacaccttcaccgatgggggctctgatatctcgttggcaccatgaaggcctgggtttcgcgcaacttcagcgccatttcgtgagcgcagctaaacaaatctcccaccagcacgcgaatttgcgaatccttcaagtcggcccatcttcgccagggctcgtccgttcagtttgccaggagctgggtcgcagcttggagaggtatacgctagtcgatgattcagagcaaaccatcgaggagatgaagagtgctcttgctgcagaccagttacgagtagactttaccacagccagtgttgaaaatgggattgatgcggtcaaccatctgactagtgccggcggtttcgacttggtgatcgtccacaaggcctttaccaagcaagttacggcgctgaagactgtccgaaatctgctgcgcccgggaggtttcatgctcatgatggcggcaactggtgcccagctccgtttccccttcatgttgatgtccaccctcccttcgctcgacgacgaaagattggcacagaccaaattcatcaacgctacacgcgcggagacccacgacctactccgacagattggattctctggagttgactcgattgctctagacaatgtgcctgacaagcatacgttctcggtcgtcgtgtcccaagcccttgatgatcacatcgctttcttacgcagcccattgacgtctccgtcacctgttccactcagcggaaatctcctcgtggtaggcggcttctcggcggatatagccaagctggctacagctatacaatcactcgtatcgactgtgtggcacggcgacattatcaatgtgcggactctcgcggagctcgacgacgaagcgagcaccgttgaggctgttctgagcttgactgacctggatcgcccagtcctggaggatgtgagagccccaacgttcaggggtttgcagagactcttctccgaggcgaaaacggtcctctggattacccaccgggcgaaagctgacaatccttaccacaatgccaccatcggccttggccggtcgttccagtctgagaacccgcagaaggtactccagtttcttgatgtggacacgctggatggagttgagtcagccattgccgagaccttcctcaaactcatcgggggcgtgaacatgaggaatagcaatcccgcggaccctactcgtctctggacgattgagccagaagtctccctggagaacgggaaatacctcgttccaagacttttcccagatacggagcgcaacgaccgactcaatgctctgaggcgcaaagtccagacacaagtttctgtcgaaacgcagcctatctcgctcagcagatctgcgcagagtgaccaagtcgcctatactgcggaagcagtccacttccacagagatctcgcagatggggcaactgatcccgttactattcaagtggagctctgctcgacggagcctgtcattccgaacattgacaacgaggatcttttctgctttgttggacgcacgtcagaaggtgcacggcttgtgggcctatcaacatccaattcctcggtggtcaaagtgccacgcgaatggacgatacccgtcgacaagcatacatcacacgatcaaggtgcatttgttttggagctgcggaacgaaatccaatcccttgtcattgccaagtccattcccccgggatctactacattgatatacgagcccgatcctcatcttgcagcctccttgcagcggccagggcgaccagctacttcgtcggtcagtttcagagcccgttcgacatggtcaatccccgggagccatattttgatcgatccgcatgcctctagaaaggatatacaagcaaaggtaccccccaaaactaggatgctaattcacatggaacaaggacccgagacgtgcgagttcttggctctcagacaagctctcccgccgtacgctacagtcgtcgcgttcaatgacattgcagctgatgatgtcaatccacgcgaattgcttgcggaggctttgtccattattcagggcgattcccagtccacgaaggttccattcgaccttagcagtgtggtaaaagcctctgccttggtcgctgggggaacgagggaacatgccaatgttgctgtcgttgattggacaggcgctcagagcattaccctgagcccgagaccggtggacactcgcaacctattttctcccaataagacatatcttcttgtcggccttaccgggcatattggtcagtcaatttgtcgctggatggtccaaggcggcgctcggcatatcgtcgtcacc

SEQ ID NO: 13721 - DNA, 396 bp, A.fumigatus
atcctaggtatcatctccgggtccctgcacaccaccgcagttaaatacggatacggtctaccggacgcaaccgtccccgaacctgtcgcgacgacgggtcgaaaattctacattataggactggcctctctgatcctttgctcagccgtcggccgcgccgccttcgtgctatacctcctagccatcctgggcgggcagaaagggcggcgcatcatcttgacggctctggctatcttggagatggtttttaattctgtgtccgtcatcttaatatttgccacttgcacgcctgtgtccatggtctgggattacgcggctgaggggacctgcacggcaacctccatccaggttaactttggatatttccagagtagtacgtctacgtcccataactga

SEQ ID NO: 13722 - DNA, 969 bp, A.fumigatus
actcacggtcatctacagcctaggactagggctaaagacctttctgaagcgcaagtgagacaggtcgcgcatgatctcgacagtgctcttgatgttctgtttgacgataacagaggtaggcttggagaaaagctcgtcaatctcctcgagggacttgttcttggtctcgggcatgaagaggacctggtagaaccaacccaggacggcgatacctccgtagaaacggagcgtgagaccgatacgagtcatcgaattcatcatcgcggtaaagttgtaggtgccgatgaaggagcacaggaagaggttggcgtccgcagtggtcatgccgtaactccggagataagtggggaagacctcggcgggaatgacccaggtcaagcaggcataggagccgaagaaccccatgtaaaggatgataccggtcaaatagagaccttcagccgtggccggataggtcttgtagtcgatggtgtagcctgctcccacgagcaccagaccgatgaagaaaccaggaagcataacgttggcccagtagcgtcgaccgaaccgctccatgtacagcactgcgggaatagtaccgatcaacagggatccacctccaacgagcgacatatagacactggtacggtcatcgaagccgatcttcgtcatcagaacacccatgtagtacataactgcgttcacacccgtaaattgaccgaggaataccatgatgttggcgtagatcatggcgcggcgagcccggccattcctgaaaaagtccagccaagcccacttcttcgtgttggcttgttcttcgttctccgcggcgacagcttgacgcatgcccagaaattcctccttggactcgtaagagtcgaagccgcgaatgcgcttccacacaccatacgcctcgaccggtcttcccttgtgcatcaggtaacgggggctctcaggcatgaagagcataccgaccagaaggatggttga

SEQ ID NO: 13723 - DNA, 846 bp, A.fumigatus
atatcccccgggtttcttcttcccttccctcgtttgaaatgttcttctctccgacgtcctttttacaggcggttgacctcttcctatctagaagactgtctttgtagggaacggcaggtcctcccctttcccctttctactttaggtaaaacctccataggtgaaggtcttctgtacacttacctacctctggctacccatctcctttctaatcattctccttcgcccgtcatggctgttaaagatgttgaggttcctctcgacgaccacaaggaggtcgccgaagagatggatgatattcaaaatgacctcaagtccgaggctttcaacgaagctgccatggatgctgagctccagcagctggaagcacagctcggcagcgtaaaacagtctcggcttgagctcactttcgccaaccccgcttacttcacttacgttctggtcgcctttgcgtctatgggtggtctattctctgttctggatcagtcgttgatcagcggtgcgaacctcaccatgcccaaggctttgcatctgtccgcttcgcaagctagtttggtcaacgccggtatgccacttggtgccgtcggtggtgccctgatccttggtccatgcaacgagttccttggtcggcgcatggccatcattgtctcctgcatcctttacactatcggtgctggactcgaagccggcgccatcaactttggcatgatgttcggcggccgattcgttcttggcatgggtgtcggtcttgagggtggtactgtccctgtctacgtcgccgagtctggtatgcttcctcgtttcgcttcaatttttggcgaagcacggttactgactgatatctag

SEQ ID NO: 13724 - DNA, 1107 bp, A.fumigatus
tatctagtccccggtaagatccgtggtaacctggtctctttgtatcagttgaacattgcttttggtgaggtcctcggctatgcagttgccgcgatgttctttggtgtcgccggcgactggcgctacattctcggctcttccctggtcttctcaaccatccttctggtcggtatgctcttcatgcctgagagcccccgttacctgatgcacaagggaagaccggtcgaggcgtatggtgtgtggaagcgcattcgcggcttcgactcttacgagtccaaggaggaatttctgggcatgcgtcaagctgtcgccgcggagaacgaagaacaagccaacacgaagaagtgggcttggctggactttttcaggaatggccgggctcgccgcgccatgatctacgccaacatcatggtattcctcggtcaatttacgggtgtgaacgcagttatgtactacatgggtgttctgatgacgaagatcggcttcgatgaccgtaccagtgtctatatgtcgctcgttggaggtggatccctgttgatcggtactattcccgcagtgctgtacatggagcggttcggtcgacgctactgggccaacgttatgcttcctggtttcttcatcggtctggtgctcgtgggagcaggctacaccatcgactacaagacctatccggccacggctgaaggtctctatttgaccggtatcatcctttacatggggttcttcggctcctatgcctgcttgacctgggtcattcccgccgaggtcttccccacttatctccggagttacggcatgaccactgcggacgccaacctcttcctgtgctccttcatcggcacctacaactttaccgcgatgatgaattcgatgactcgtatcggtctcacgctccgtttctacggaggtatcgccgtcctgggttggttctaccaggtcctcttcatgcccgagaccaagaacaagtccctcgaggagattgacgagcttttctccaagcctacctctgttatcgtcaaacagaacatcaagagcactgtcgagatcatgcgcgacctgtctcacttgcgcttcagaaaggtctttagccctagtcctaggctgtag

SEQ ID NO: 13725 - DNA, 249 bp, A.fumigatus
gatagatttaaaatattcaagtacctctggtatatagcgtctattctacaatacaaaatctcatgtctatacacccttcctacgatcatccgcaacaacagtgacctcaacctgcttccgaatcccagccgacccctcctgactactcccacccgtctccaccccatcgagactatttcgactaccgagtatacgatcaacacttgccccatcatcggcccgattcctggtcgacagcatcccacgtaa

SEQ ID NO: 13726 - DNA, 861 bp, A.fumigatus
  unsure (830): Identity of nucleotide sequences at the above locations are unknown.
ttattattatctggtatgttgggctgtatagtggaatcttgtcacacttgggcgtgtatattggtatggggcacatctggtctccttgcttcggcagcggtttgtactcacttatccgtccggacctcatataaagagagtctcccatgccacgaaaaggagcctaagtccgtcgtttggagcagtcagctactcttcctaccagtgagccggcgtttcatcataatggtcctgcgaaagctgtcgtccccgtcgttagaggcgctctgttcgaaggagcagatcgagctcttggactccatcgatcatctccgtctccagggaatcaatcactacatctccttgcctcagattatcgtctgcggcgatcagtcgtctggtaagagctccgtgttggaagccatatccggcgtctcttttcccatccggagcagtctttgcacccgattcccaacggagctcgttctacgcaagagtagccaggttggcgtgtgtgtgtccattgtcccacatcggtctcgtagcgaatccgaacgggaggcgctcgcccaattccacgaggagcttgatagctttgagggtcttcctcaattgatcgagaacgcaaagtctgccatgggcatttacacctacgccaaatccttctcgaatgaccttcttcgggttgaggtatccgggccagaccgtcgacatttgaccattgttgatcttccgggcttgatccattccgaaacaaaacagcagtcggcggcggacgttgaattggtccacgacgtggtgaaatcctacatggaggagccacgaagcatcatccttgctgtggtatcgtncacacgcccgggcctagaaggtaatgcgatc

SEQ ID NO: 13727 - DNA, 393 bp, A.fumigatus
gtcgaattctgcccaagcgagatgcccttcatgtcgtcacaaaagatgtgtttagaggcaaatgtgtatttagtgcaccatgtttttcttcctccgaaacttcctcaggaggacgattacgaccccgaatacgaactcgtgctgcttgagaagtgcattgaagcgctcgagcagttcaaaggttatgtttcgggcccagaagcagacagtattgctgctgctgcacttatgattactcgattggctcgaatatttgggccacacggtgacgtggatgaaaagaagttccgaaacgctttagcacagctgtataccgagggtaaatgtgctgattcaaatggttatgtactgtatattgaccgcgtgcaggtggaattctgccagtatatgtga

SEQ ID NO: 13728 - DNA, 696 bp, A.fumigatus
gggggagtttcagttcgccgggatggggcatatctagattggggatggaaggggcataataaaggtgccatgggaatggttttagccagggtgaccatgtgtccgggcagcgcgtttatgattttaacattgggaggtttggcgaccccttattcgtttggccgggattatccacggtccatgcgaaagcaaatgggcgctcgattgcggtcatttactcccagggagctggaccagctggaaaatctcgccccgctcaacgccttctacggaatgaaccactactccaccaaattcgccagggctctcgccgaccccccggcggacgacgactgcacgggaaacgtggcagaactccccacaaactcccaaagaagggcaattggccccgtctcagggatgtcctggctgcgggttgcgcctggggggttccgaaaactcttgaactgggtgtggaataggtacaagcggcctatcattgttacagagaatggatgtccctgtccgggggagaaccagatgtccctggaggaggcagtgaatgatgagttccggattacatattttgggctgtatctcgatgccatttcacgagccatctatgaggatggggtgccggttgaggggtactatgtgtggagtttgatggataactttggtaagttcttgcccccacccactgattccattgtttga

SEQ ID NO: 13729 - DNA, 1062 bp, A.fumigatus
agcgacacgttaacatggtacagtatcaacgccagcgtcatcgccaacaagggcttcgtggctcgtttcgccacggagaaatcgcaaaatggttctcccgcactcgcctcctcgatcctcagcgcttggagctcaatcatgtcctgcggtcaaatcgtaggcatggcaagcgtgccattcttgtcgagtcgatacggaaggaaaatcaccatgtatacctactggttaatcttggtcggtagcgtgattgccgagtgcaccacacggtcatggcagggttggttggtggccaaactcctggccggaattggagtgggatgcgttcagtccaccgtgccagcatacatatcagaggtggccccaacacgcattcgtggtgccttgttgatggcatatagtttctggtggactctaggctccttcttcgcccaggtagcgctgcaacatctctcacggagtgaccggacggattacctcactccggtctacacccagtgggcccagctcggcgtcatgttgctcatctatctcctggttccggagacacctgcatggtgtgtcagcgccggcaagcttgacagagccaaaaaggagctgttgaagctccatcgaggagtcaaggactacgacgccgaccatcagctacaggtcctggtcctggcgatagaacacgagcgtgccgtggcaattgagcagcgccgcgagaaatggtacgccatcttccggggaaccgacggattacgaacgatcatctccctctggacgaatctctcgcagcaattcattggcctcaccctgttcgggtcgtttggcacgtatttcttccagcaggccgggattgatgacccgttcagagtcaaggtcattacctcgtccattcagatcggcacggtgttggtactggtggccgtcgtggactttgtaggacggaggtatctcgcatgtggtgggaccacgctctcgtggctgtcctgcgtcgccatcggaatcataggggtcacaccgcgggtgaaggcctctacatatatcttcgtcatgtttgcctgtttctggagtaagtag

SEQ ID NO: 13730 - DNA, 291 bp, A.fumigatus
ccaacggtatcagatgtcggtctggccgcaaatggagccaccggatggggatatatcggcgagatctcctcccagcgtctgcgcccgtataccgccggcttcggtgccgcaactacctgcgtggtgggggttttgatgaacgtcctagtcccttacatgactaacgccaacgaatggaattggggcctcaagacgggctggttctacgcgggtgtcggctttccctttgccctggggatgtggtttctgattcctgagactgctgggtacgtttcctacttgggatattga

SEQ ID NO: 13731 - DNA, 582 bp, A.fumigatus
ggtctacgtctgctttggagatatcgacttggagaaaggtcaacgcctggcggcagagctgccaatgtaggatccccctcggcactctggcttgaacgtagtccatcactgaccagaaacctttttgcctcatcaaggacgaaatttgtcccctgcgatgcgggccactgggatgaccaagtccgactgtttgaaaacgcagtctccctctccccaaacggccgcatcgcctacgtggtagccaacgccgggattcatcgcccggatgaagtcttcgagcagccacacccggaccaggagcctgccaaaccggatctgaccatcgtcgacatcaacatcaagggcccgttgtacactgccaagttggccgcccactatttcatccgccaaaacggttcaacgcccaccctcggccaggaggatacctgcctcattctcatcggctcaggggcggcgttcctggactgtccccgagcgccgcagtacagtgcgagcaaatgggccatgcggggcatcatgcattcgttacggaggaccacctactattatggctcccgggtcaacgtgatttccccttggtaa

SEQ ID NO: 13732 - DNA, 1254 bp, A.fumigatus
tgtccattcctgactcaactgcctgagagccaagggtctcggcatgacgacaacgtccctcatggtgcgtccgttgcaagggcctatctgcaccggagagtaccgatgatgtacaacgatggcgtgcaacctccagcgtgcttatttataccaccggtcgaaccgtgcctcgatccagagacgaaatcattctctcctggacctcaaccaagtctcctagtctttatcgaacaagtaacccgacgcaagaccatgaaggttccgacagcccttagcctggccgcactactctgcgcagggtcggctaccgcccagaacctctcctatggcgcagacaacttctaccgcagtgacagtgtcaccctgcggcctatcacattcaagaaccagtttcagatgacggtggctggcaacctctttgtcccccgtagtcagaacctcaccggcagcggtgatgtcccagctatcatcgtgggccatccgatgggcgccgtgaaggagcagagcgcgaacctgtatgccaccaagctggcggaacagggattcgtgactctatccctggacctccagttctggggcggaagctccggggagccgcgtaatggcgtgtctcccgatctattcgccgaagtcttcagcgccgcagtcgactacctcggcacacagaacgtcgtcgccgtcgaccgccagcgcatcggtgcagtgggtatctgtgcgagtggtggttttgtcatcagcgcggccaagattgacccgcgcattcgggccatagccacagtgagcatgtacgacatgggcgccgtcagccgtaacggactacgtcactcccagagcctcgccgaacgccaggccatcatcagtaacgcagcacagcaacgctgggtcgagctggaggaccccagccagacccagtacaccggcggcactccgaacgagttgactcccagcaccgacgccgtcagccgcgaattatacgacttctaccgcacctcccgcggcgaggtcaccccccccggatcgacccccgagctcaccactcacccgactctaaccagcagcctcaagttcatgaacttctaccccttccacgatatcgactcgattgccccgcgtccattgctcttcatctccggcgaccaggcccactcccgcgagttcagcgaggatgcgtatgcccgggccgtccagccaaaggagatgctctggattcccgctgccgttttcaccacgtggactgccagcaccgcgctaact

SEQ ID NO: 13733 - DNA, 237 bp, A.fumigatus
aacaaccatcttcattttcaggcttgtggattatcagaaataccaactggtcattacgaattgctcattgcctataagaatgcgggaggtacaatccgagacactattcaggagattgttcagcaatgggcaggaacgtcaaagattgaggtctattacactactgtctgccttagtatagtcataacacaacgggtaggtctctggtgcttttttaattatcagagtaattcttaa

SEQ ID NO: 13734 - DNA, 255 bp, A.fumigatus
  unsure (2),(11): Identity of nucleotide sequences at the above locations are unknown.
cntaagttcgnccgtgatacccacgctatggacactacagctgcccattggctcgcgccagtccaaaatgacgaccaaagcgaaacgacacctagtgaggcaaactatgggatgaaaataatggagtttgaaaagattgtcaactctccgggcgaaggagacgaagtcggtcctaattgggaacgaccacctactataacctctggattttggttcacaaagatctgcctctgtcgccagaaaaatcatctgtga

SEQ ID NO: 13735 - DNA, 588 bp, A.fumigatus
atagaattcaccgttgatccttccagccccgtggtgaagactcctccgcattatttcgcaaggattgccgattcaggaaatatgtggtgtgaatcatgccgccgtcagccgagctccgaaatcagttataaatatgtcaatgtcgacgttctaatacgttctactcgcatgctggtcgtcttatgtaccaaaacgtcaattgcgcgcaagatgacagccaagctggtccttcccctgctcagcgtgttcgcgctgtacgccatcttctacttcgccgaaatcaatggcttgaatcatctggcacagggagccatcactgcaaagacgctgccaggcaccaatgagcctctgcggactatctacacgggtattgagccggtggataatgtgctggctgcgttgaccacctttttctggcctgccacggatggcagtaatcctacgctgacgttgcattccatcgccttctctggcacctttggtgctgcctggacgctcgtaactctggagtcctggagacgcggaaatgcctggacggttgctgcattgtctgtgaacctcagtcgcatctataacacaagaagctga

SEQ ID NO: 13736 - DNA, 786 bp, A.fumigatus
caagaaggcagtcccacgatgttcggcctcctagcgcaggtactcacctttgccttcgccacgcccctgtactgcgcttttcagctacgcaactccgtcacggcgcgcaagcccaatgctgagaatattcgcattcctcgcgcagttctaaacgccattcctctggtctttatccttggttttatggttcctacgttgttgatgatcctgcctgtttccgagcacgtcaccgtcgacatgaagcaaatcttcattgcctcctggcacccctggccagcatacgtcgcaattgctctcaccataatcaactttgtcttcggtcccgatgtgagcaacgatgggtcggttgaaagggagcgagcgaatctccggtcgctccgattcgtgtatgcctttgcattcgccaacgctgcgttgacccatctcatctcgtggatcatgtctctggctactgtacttacacccgtcatctttgagaagcggctgttggcagttttgcatccgttcaaggtgttccagattgccttgccctggtcaaagccagtattgcaagtgagcgatatcggggagggagtacatgtgttcctgcgctgggattatctgatcggctccgcgggcgtgctgttttgggccttgagcctgtataacgctgctcatcgggtcgtttatggtaaggttagatggctcgatctgctaaagaaagctgtgttgttggtgactctggtcgggccagtcggggctgcggtcgagttgatgtgggagcgcgatgagttgatcatcccctga

SEQ ID NO: 13737 - DNA, 1149 bp, A.fumigatus
aagatgcgcaacttgaaaaacgtgcgcctcgccgaggtgcatcttcagaatgagcttcctctcacggctaccgcgtgggatacagcttcggacgctgtaatttgtacctttggacctacagaggcaaaccccatcattgagcttcggaggaaacaccaagacagctactttacggaccctgtaggcgcagaagtatttgaatgcatcgcatcctgggatgcgccatgcccactacctgatttgcgctgcgatcgggttctctcactacattacttcgcggacaatctcaccgcgtgcttggtcttggagggaggtgatatcgtcgtcgttcgtgaagatccccttccgggcgaggagaagatcgagatcgtgggttcagtcgatgttggtatctcagctgccgcttggtctccagatgaggagctactggctctcacaactagagccaatacctttctctatatgactagagagtttgagaatgttgctgaaatcaccttcacccccgaagatcttaaagtatctcagcatgtttctgtcggctggggcaagcgagaaacacaatttcagggaaaaagagccaaagctctcagggaccccacgatacccgaaaaggtagacgagggccgattgagcagcaacgatgacggcagaactactatcagctggcgcggtgacggtgcttacgttgctgtgaacagcatcgaagcgggttttcgtcgcgtgattagagtctattctagagaaggcgctttggacagcgtcagcgagccagtcgacggtctagaaggtgcccttagctggcggccctacggcaatctgattgcgggaattcagagacttgaagacaaggtcgaggtggtattttttgagagaaacggcttgcgccatggagagttttcgcttcgcctcaacgaggaagaaagagcatcctgggcctccgatatacacctcagctggaatgtcgattcaacagtcctggccgtactgttccgagatcgcatacagttctggacgatgggtaactaccactattatctcaaggaagaggttcctgtggtggtcgacccggattatcctcatccttttgccttcaaatggcatcaagagaaggctctacgctctgttgcttgtggctcaggtacttga

SEQ ID NO: 13738 - DNA, 600 bp, A.fumigatus
ttcgcaaaagaaaccctcaagttgacgcccttgaagctatcgggagttcctccaccaatggctcacaacgacgtgccagtggactcgaacgtcgtcgatgtcgcattcagcaagtctggcacccggatagctgtcctcatgaaagattgcttctctatctacatgtggtcactgaagactcgtcctgttccttctccaatactcgagtctagccatcccttgccggacaatctagacaatcggccgcgacagattgcttttttgaacgagaatgaagtctacattctcaggaacagcggacctaacagtacatgtattcaaaagacaacgctcgagactcgatcaacgacgaccgtctaccaaacaacagactcggggcagattctcacaattttcccggccgttggacatgaagctttgtggttttcgcatgtccctcaacctggacgtccaatcgcgtactgtatcctaaaggcctctcctgaagaagacgtccaagttgactcctgggaccagagtcctgctgtcgacactcactgggctcgggctgtccacttgtcagatgatgaggtattattttctttgcttacaattgactga

SEQ ID NO: 13739 - DNA, 348 bp, A.fumigatus
aggcctctcctgaagaagacgtccaagttgactcctgggaccagagtcctgctgtcgacactcactgggctcgggctgtccacttgtcagatgatgaggtattattttctttgcttacaattgactgaaccctggctgacggctttaaagcgcattttgatttctttatcgaggaccggagccctttatgcaaataaccagctgcttgcaaagaattgcacttcctttctcgtgacccaagcccacatcttgtttactacttcccagcatcttctcaagtttgttcacttgacaaaagcagaaggtttgttgagtattacgatctcatcaccaattcctagtggctaa

SEQ ID NO: 13740 - DNA, 360 bp, A.fumigatus
tttcaagcggcagagatggaggttcctgccgacacccccgagacagacgaacgatgccgaagtatcgagcgtggaagcaaactggtatccgtcatgccctctaagttcgctgtcaccctccaggcgcccaggggcaacatagagacaatctaccctcgagctctggtcttagccggcatcagaaactacatcgacagaaaggactaccgctccgcgttccttgcctgccgcagccagatggtagatatgaatatccttcatgattatgcacctgaacaattcctggaaaacgtcgcattatttttagatcaagtgaagagagtcgatttcatcgatgagttcctgtcccggttgaggtga

SEQ ID NO: 13741 - DNA, 273 bp, A.fumigatus
ccggtcctcagtgaggatgatgtctcacaaaccttgtacaaggacaccctgaagacacccagggaggttcaaaccacaactcagccagagggtacagcctctttcaagccgacaactaagaccagcaaggtcaaccgtatctgtgatgcttttctggccacccttgagaaacgcatggacaccaacttgcataacctcgtcactgcacatgtatgcaaatcggcaccagatctcgaagctggacttcagcttgtcgctcgcctgagagtttga

SEQ ID NO: 13742 - DNA, 192 bp, A.fumigatus
cggggaggtcatactaacaatcccatcatgcgtcacaagggccctgaacttacggccaagtgcatggccctgaatccagttgaccatgtatcctccgtggccggcacctacagcgacggagcgagcagtatcaatgtattggatgctctcattttgctccagatatttaaaacctcgctcagatctgtataa

SEQ ID NO: 13743 - DNA, 231 bp, A.fumigatus
tcaaattcactgagaattctgatcactcacagcagcctagttgagacccctacatggaatattgttgacctagtcactctaaccgagtctccaaacatcttatcagctagtcgcataaggaatatagaattctctaaggcgcaagtcgatgtgatttggttcgatagcactgggaatcgcagaatccatacctgggtgatcaaaccatccaagttcaacccacgacaatga

SEQ ID NO: 13744 - DNA, 204 bp, A.fumigatus
  unsure (49),(81),(82),(109),(138),(143),(158),(181),(186): Identity of nucleotide sequences at the above locations are unknown.
ctaggtcagagttttgaaagccagaactcaatacgtccgctcggcccanaaagaaaacacatggagcggtgggtcaaaaannaatcccttatggcttttgagggtatantatcgtcctccagggggcgtctgactgancatanggaaatctcgcatancaatgaacaacagcatgaggtanctaanctcctttcacaaaactaa

SEQ ID NO: 13745 - DNA, 405 bp, A.fumigatus
cattgttttcagagcagggctttgttgttgttgcgactaacccagcagggagctctgggtttggacaagctttcaaagatcctgtccaaattactgaggtgggttgccttatacagatctgagcgaggttttaaatatctggagcaaaatgagagcatccaatacattgatactgctcgctccgtcgctgtaggtgccggccacggaggatacatggtcaactggattcagggccatgcacttggccgtaagttcagggcccttgtgacgcatgatgggattgttagtatgacctccccgctagcaaacaatcggcaacattccgttgaagagattggaggtcctatttgggaaactccggatgaatggatgaaattggatccagcacaacttactgtgagctag

SEQ ID NO: 13746 - DNA, 189 bp, A.fumigatus
gagctgaattacaagaaggtcattgctgatgaattagccgctctcaacgttctccagctcaaaagcgtgtatagtgctctcctggtatttctagaagaaagggaaccgattttaaacccggaagataatttgctttggtattgcactgtaatcaattggatgaaaaaatacagcgatcagaaatcttag

SEQ ID NO: 13747 - DNA, 2466 bp, A.fumigatus
  unsure (2465): Identity of nucleotide sequences at the above locations are unknown.
ctttctctctctctcatagaaaatcccgcaaatcgacctgcctcgaaaggagggggtggtgaatcccccaaccccggtccctccaatagtacagcacagcttgccttgtcacgatcatcactgagagagccgctgtttgtggtaccagcaggcttccatccaaatgccacttttgttggcatgaccagagagctggatatcttgcacgctcggctatacagagctaagaagcgggccgagcgcctggcagccgtcttgatatgcgggggcccgggagccggaaagtctcatctggcaagacaatatgtgtggacccagcgcgactgctaccctggcggcatattctgggtagatgcaaaatcgcgcgagtcaactagcaagtgcttctgggacatcgcgcaggctgcgagtttaacggacgagcttgaattcgagtgcccagacttcaaagctccgcaaaagtacgtagagatggttcgcaactggttccaagctcgagaggagtggcttctcgtctttgatggtctcagcttcaatcacgaagatgatttgaaccatttccggcagtttttgccgttcaacaaacagtgcagcattatgtacacctcggtggatcgaacactgcgaaagaagcagcgtttgtacgagccctactgccttcaagtgccccctctgtcggtcgaggatgcgtgcaagctcttgttcaaggatttgggaatcaagagacccaccaaagagcaggtccgcaaggcaactgaactggtcatgcactatgagtgtttacccctggccattcatgcgatcagtcaccgtctcagtgcgacatccaagccaattgagaggtatcatattaactcgcacctcaccgatgaaaaacttgcggagcccttcctcagtattatgcacgacctctaccggatggggcattttgaggccctgaacctgatcaatctcctctctttctttggacaccatgtgccgctgggactcatcaacttgggcaaatcagttctggagacctggaacgtcgatatcctcacaagcagtaggcccggggagcggggagatatcgacaccactttaggaattttaattcggtacggtctcatagagaggacctccgatgcttatgttctaaaagatctttccccgcagtccgagaaggaactgatactcgacgccagagccgtggtgcccgaactatccgagtcgcaaacggagagcagtagccaggaagccagcttctccatctaccaaaaggcgggttcgatcgacgtcatcaagatccatagcgtggttcaagaattctgccgcgacgaactgaaaatcatggatgaagagcaaaggaagcagtcatcgaggctcgaagctcggcgaggctcggcggctggatcaggccctgcgtcagggacaggctctggagtcgtcaaagccgaggccggcttctacgaatcatggctcgtcgtggccatccgccttctctgcaagtcgtacgagaacgcgaaaaagcgcatggaactggtcgatgattatggcctggttaaggattaccgggaatatgaaactcacgcatcccggttgatcgagaactttccaaaacgggcggcgaaagggaaaattgtccaagaggcgcgtaacgaattaaaacagctaatgaggagcatctccagcgagatcgaacgcctgtcgccgcattcttcgcaggactccattcgcaaacaccggtccgtgttcgataggtcaagcagctcttcgtcctctgtgccggattctgacgagagcccgtcgaggcaactaacctgggatctcggcgacgaatcggcgaaagtcgagtcaccgaaggagctgcccgctacggcgcacgggttcaacctgagcccctttctgcctcatatttttcgcgaatcgagtagcgaacaggaggccgagagagccaataaggagaagatggaagcgtcttcgctctcgcagacaagccaggctacggaaaagccatcgattgcttcgagcccgccacgggacgatcacggctggcaggtggtagagaagccgcagaaaatttctaagcctgggaaggagaggcagctgaaacagcgcccaaagtttcccacccacatacatggctccaaaccggcagctcctgtgctcaaggtcttccctgtggaaggaaggagcgcgtcaagcagtagcatggagaagggccgcagtagttcctctgtctctgccacggaagcactgacatcagtgcagagtgccagtcctcggcgatccgaggaagacctgcctgccggtcaaacaaacagaacatgggctgccgtggtcgccaaggccaaccgcgtcgcagaggcacgaaggactccgtcgtcatcaccgaaacagcggccctcgtcgtcacctgaggagacggatcgcccaggtttgcccgtgccaaagctgttggaaagcaaatcttcgggtgaaacgtng

SEQ ID NO: 13748 - DNA, 1539 bp, A.fumigatus
aaactccgccctttctaccctccgttggagccgctacaatcggtcaatcttcgtgccgctctatctcgagtactttcagatctgaagaagaatggcgatcttggccgggaaactatcttccgcaagtccatgttggacgactgcaaaggggagaaggtcgatgagctcctggcggtcttctccaccgccgtcctgcgcaaggtcctggcttcgtcgatggacggtctgccaaatcctgccgtgagattgtctatggctaagggcgtcactccggatgagtatcagctgatgctgccgctgattcttgcccatcgtgtctccctggccacaatggatggacgtcggtcccggattatggacgttcacaagaagttctctcagctgctggacagcaagaaggctcagctagacggtcgttctaaagagggtccgcctgctctttccaaggatgtcgccaaccttgatgcactagcacgcgaactgaaagagaattggatgggtagtgaggagtgggctgataccctgcttcagggcggcgctcgcagtagcagtgatgccttcttggagctgccgtttggagcagcatggtccaaggcaaatgagacgaccgtggaagatctgaccgtcagcacgacgcccgacctgctggttgacttggagtcccgcatcgcgcgtcagcgcaatcggttgcagaaatggcgcgaggtcgctcactccatgcgcgagaaagatggagctggcggccagatgtcggaaaatacagcagacaaggcgccactggcattcaaggaccaccagactctcaccgtggccagtatctcaaaggccgttcgccagccgctatctcgagctgctccccgacaagacgaccaggcccttctacagtcgatgaatgaagctctttcccgcattgatggtaagcctcgttcttccggacgaaccgctcctccactgcgtgtccctgccatggagccgaccaccacaataccctccgacgctgaatcagcaaaaccctcgatttcacagtactccagaccttcctactgtaaagaattgaatgaaaacgaggcagtcccttcaccggacaatcaatcagctggaacaagctcgcctgccgttcaaatcacgcctgaccctgatagtgaacccaaactcgacccccgcctcaacacattcaccctcgtcgaacgcacccgcaaatccatgtcgctgcttccgccaccaagcagccgacccccacagcaaccccgtcgctcgcgcaagtcgcgtgtctcccttcccgtcaaccagttcgaaacaccagagaaactgccgcagactcgggcgtcgaccccgcgggatgagctgttcgaggaggaggcagactacaatagcgttttcaagtcacggccacgcgtcgcacttagtcccattgcctcgccggcggtgcatgtagcgccggtggaggtctccgatccggatgcatatgtggactccgtgggggaccttgaggatatggacctgaacgcttccccgtctgctcgtgggaggaggatttga

SEQ ID NO: 13749 - DNA, 645 bp, A.fumigatus
ttgcttgtagttctgtccacgctgcctcaccctcccgaagaaaactccgcctcccccataccatttttccatctcctcgaacgtctaaagaccaccaagcgcgaaggctggcgtcgctttggcatcagcaccggcgaatcgatttctgaccacatgtaccgcatgtcaatcatgaccatgcttgctcctcctacactcgcgtcccgcctgaacctgccccactgcatgaagatggcgcttatccatgacatggccgagtcgattgtgggcgacatcacccctgtggacaaggtcaacaaggccgaaaaagcgcgccgcgaggccgaagtgatggactacattgcaaagaacctgcttggcggtgtacctggaggcatgttgacgggcgaggagattctgaaggtgttcaacgaatacgaagcgaacgaaactctcgaggcacaatttgtgcacgacgtcgataagatggagctattgctgcagatgctcgagtacgagcgcacccacaaggttgacctctcggagttctgtcacgttgccggtcgtatccagctggacgaggtcagggaatgggcggccactgttctcaaggagcgggaggctttctggaaaggaatggccgcgaacacgaatggtacagcatag

SEQ ID NO: 13750 - DNA, 366 bp, A.fumigatus
ttactctcacatcaacatggcatcatatccaaagaagaagtgcggtatgggcttattgttcattccacgtctcccttaagtcattactcacatcacaaaggtgtcctgggcgccactggttccgtcggccaacgatttattctcctcctcgcggaccaccctttcctagagctgcacgccattggcgcatcgaatcgctcggccggcaagaaatacaaggatgctgtcagatggaagcagactacggctatgtctgagaggcttagcaatctcgtcctgcgcgattgcagggctgatcagttcagtgactgtgaccttgtcttctcggggctcaacagcgatgtagctggtgagattggtacgtga

SEQ ID NO: 13751 - DNA, 1071 bp, A.fumigatus
gcaattgctgaattgcggaccacactcggtgatgatgctattagtacagatgaggacgaccttaaacagcatggatactcagaatggtcttccgtgaacgcagatcgtcttccggtcgccattgcttacccaacgtgtacagaagatgtggtgaagatcgccaaagtttgccataaatacagaatgccaatggttccttactccggcggttcaagtctcgaggcaaatttctcagctccttacggcgggttgaccatcgatttcgcaatgatgaacaagataattgagattcacgaagatgatatggatatcgtcgtccagccatccatccaatggatggaattgaatgaaaagatcaagcacaccggtctcttttttccggtcgatcctggtccatccgcaatgatcggcggtatgattgggaccaactgcagcggaaccaatgcagtgcgctatgggactatgaaggactgggtgatcaatctgacagtcgtccttgcagacggccgggtcatgaagactaggagacgcccgcgaaagacctcggctggctataatttgacaggaatgtttgtaggctccgagggtactctgggtattgtcaccgaagcaactctcaagctcgctccgattccagaacagactcgagttggagttgttgcgttccccacgattcgggatgctgcgtctactgccatgcagcttatacgaaagggaatcccagtacagtgcatggaaatcctggacgatgtacagatggatgtcatcaaccgtgctggcggtaccggcaggacttggaagactttgcctacgctttttttcaagttctcgggtactaaggctggagtttctgacagtatcaatctgacgagagagcttgccaagagcaacaatgcagcatcattcgagtttgcccgagacgaccgggatgcacacgatctgtggtcggcgcgaaagcagtcgttatggagcatgatgtccttgccgaaggaaaggtcggaagtgtggtccacggatgtcgctgttcccatcttcaggctacctgatattataggttggacttcaaggtag

SEQ ID NO: 13752 - DNA, 876 bp, A.fumigatus
ctggtgagattggtacgtgatactattatctcgagattaaactgcggtggagcggcgctgaccttcgcagagatggaattcatcaaggctgaaatccctgtgttctccaacgccaagaactatcgcaagcacccccttgttcctctcgtcgtccctaccgtcaacccccaacacttggatctcattcctcatcaaaggaaagagttcggcctgaagaagggtttcctggtttgcaattctaactgcgccgtgattggcgttgttattccttttgcagctcttcaagccaagttcggtcctgtggaggaggtggaagttttcacggaacaggccgtgtctggcgctggctatcctggtgttcccagtatggacatcatggacaacgttatcccctacattagtggtgaagaggacaaacttgagaatgaagcccaaaagatcctgggttccctgaacgcagatgccactgccttcgatgagcaaaaggggcttacggttggagccacctgcactcgtgttggtgttaccgatggccacatggctttcgtctcgttgcggttcaagaaccgccccggacccagcgctgaagaagtcaagcaggctatgcgagaataccaatcagaggcccaaaagcttggttgcccttctgctccccgagaggcgatcaaagtctttgatgagcctgacagacctcaacccagacttgaccgggatatctccaagggatacacagtcagtgtgggacgtgttcgtgaagcagcaccgggcagctactttgacctgagattcgctgcactctctcacaacaccgtcattggagccgcaggatcgtctatccttaacgccgaagttgcagtcatcaaaggctacatttga

SEQ ID NO: 13753 - DNA, 285 bp, A.fumigatus
  unsure (223): Identity of nucleotide sequences at the above locations are unknown.
ataggaatcttcaaaggaaggagctcgacaacctgggttggttcccccagtattttgggtcacatcggagatggaaactttcattcgagtataatgtacgacaggagggatgccgaccaaatggagcgggttgagaagttgttccacgatatggtcgaccgcgccctagagatggaaggatcttgcaccgttagtataaccaagcgcctgagtgtatccacanagaagctaacttggacggacagggcgaacacggcgtggggctgggcaagaaagcatctttga

SEQ ID NO: 13754 - DNA, 204 bp, A.fumigatus
tcagccctgcaatcgcgcaggacgagattgctaagcctctcagacatagccgtagtctgcttccatctgacagcatccttgtatttcttgccggccgagcgattcgatgcgccaatggcgtgcagctctaggaaagggtggtccgcgaggaggagaataaatcgttggccgacggaaccagtggcgcccaggacacctttgtga

SEQ ID NO: 13755 - DNA, 615 bp, A.fumigatus
  unsure (10): Identity of nucleotide sequences at the above locations are unknown.
cagacacctncttgtgccaccgacagcaacattgagctggcatggcgaccggccccgtacgaacccgagcggtgctgggacgtctatgccgccctgaagacctccaccgagcgggagttgtggaggttcgcccaggaaaacaatcccgctttcgtcgtcaacgccgtcctcccggatttcatcgtggggcccatcatccatgcccggcagaatggcagcactggccgctgggtgaaggagttcttcgatgaccccgtccattactccaagcccctgcagaccttcattccccggcactttgtcgatgtcaccgacgtggccttgctgcatctggcggggttgacgcacgaggatgtgcagagtgagcggctgctggcctttgccggcccgttcaacttcaacagctggttgcatgtgttccgccagatcgatcctgcgaagccgtggcctgcggatgatcccaatcaggtccatgatcgcagcacggtggacactcggaggtccaaggagcttttgaagcggtactccagacttgactttacgtccttctttgacagtgtgcgggataattgtctcaacagcgacccggagtggaagcggtcgaactttccctga

SEQ ID NO: 13756 - DNA, 609 bp, A.fumigatus
ggttgggccacatttggaatctgggtgtactacgccgccgtcttcgtcatggagctgaaccacgtcagcccggtgctcctggcggcgtggtacagcccggtgatcccctccggactgggcgcggcgctcgccgtggggaagcttctcggtcgggtctcggccgcgtgggtcatggtcatcggcatggtcgcgtacctgatcgggtcgattctcatcgccaccatgccgacgcaccagatctactggggcaatttcttctggagtgtgctcatcatctgtgtgggcatggactcgtccttcccggccgcgaccatcatcttttcggacgccgtgccgcccaagtaccagggcatcggcgccagtgtggtcatgaccattgtgaactatagtatttcactggggctgggctttgccgggacggtggagcgggagatcagccatgggggtcacaccgatgacgatcggaagaaggggtatcggggcgcattctacttcgaggtcggcttggctggcttgggcctgatattgagtcttgccttcttggtcaaggatcactttcgcaagaaggccaagcaggcagctgctgcgtatgaggaccggagtgcttaa

SEQ ID NO: 13757 - DNA, 450 bp, A.fumigatus
gctgattctaagaccctctctccagttgatcgcgtcacgtacttccaagaaaccgttgcgaaagaatctaaaccgttctcagaagatgatatgaaggacttggtcgtgcggtatgtctatgtcattacttttcctgcacagtcgcatgctgacacctgcttggctaggtatattaaccgtagcgtccctgagatcgaacaattacagagtgagcggaggaaaggccggcctccaagcaagcgtgaagaagccttactacaacggacagaggtcgagaacaaagagtttaagactggattttggatgcccgatttaagccaagaagctgtgatcaaaggcctcgcatcgtggaacggagactggtccagccttagcatgatgaaattcatcagaataaccaaagatggtgggaaacagccgtcggcttttccacccaagggactttcatga

SEQ ID NO: 13758 - DNA, 216 bp, A.fumigatus
atgacagagatactgattgattatgcaggactccacggccttctcaaatcaattcagaagccatgtcacgttaaaaagttcaaagggcaaaccctcggagtagatgcgtatggctggctacatcgcggcactgttgcctgtgctgtcgatctcgtactcgacaggcctacaacgaagtatgtgatcagccaaggcgtttcgcgatggcatgactaa

SEQ ID NO: 13759 - DNA, 1827 bp, A.fumigatus
tttttgtccagacatgtcgaattcgtcctcaatcgtgtccgcatgctcctctacttcggggtaaccccgtaccttgtcttcgatggagacaatctccccagtaaatccagtaccgagtcggagcggcttcagaagcgggaggcaagtaaagctcttggattggagcttcaacgcaagggccgtatggcagaggcctaccaggaactacaaaaggccgtggatgtgactccttatatggctcgccaattgatcgaggaactgaagaagatggaagtccaatatgtcgtcgcgccgtacgaggcagatgcacagctggtatatcttgaacggcagggcatcatcaatgggattatatctgaagactcggatttacttgtcttcggcgccaagagattactgtctaaactcgaccaacatggcgattgcattgagattgatcgagcagactttgcggcctgtcgcgaggtcaacttgataggatggacagatgctgacttccgacggatgtgtatccttagtggctgcgattatcttcccaacatccccagaatgggtctgaaaacagcttatcggagcatacgaaagtacaagaacgttgagaaagcacttcgtatgctgcagtttgacggtcaatttcacgttcccgctggttaccttgagaatttcaagcaagccgagctcacgttcctataccagagagttttctgtcctaaggccggcaagctcgtccctttgactcagcccgaaaaggatgtgaacttggaggaactgcctttcatcggtcgcgatgtggatgcagaaatcgcgctcggtgttgcacttggcgacttggatccaacgacgaaagagcaaattgtgctaaagcccccagctcctgggaagatggcaagcggaattactcggcggcagacgctcggctctgcggcagagttgaagccgaagaaacccatcagcgcattctttactccaaagcggatgccgttggctgaactcgaccctaacagtttaacgccgtctccgagtcagcaacgactgctggagcgtcatgccaatagttcgtgggagagcagccctgcgccatcgcggccagacgttacgaggtcggcgtctgccctgggttcctccaaccgtttatcaagtccccttgtcagaagtgtggagcgtacctctttcttggctcgcgcggctaaagcgtcaacttttcaacccgccaaacggcaacgcctttgcgccgacacggaggaagaaaacttaccggagcgtgcagactgccgtagtcgtttcttcgcgccttgcaccaacagctctagtccaagtggctcgaaggctgctcgaaccaaacgcaaatcgactttggaagttttctccgatgaggtagcagagcaaataatgacgtacctacctgaccccgctcacaggtctagcgactccaaggaaggtgttgattcgcccagatcgtctatgtcagacgagaatgatggcaaaccagtgctgtcaaagtacatcttcaagccccagtctaaggagagtacctctggcgcgtcccgcaatccgacgttatcaaccttgtctggtcctttcccgcggcgccggctcactcccttgcagcgccttggtcaaaccgctcttgctcgtcctcgatctgtgaatgccctgccccagacaaaggcattcgtccatcccagcctggttgaacgttcagcgacaacctctacccagggcagcgaagacttgattgttccgaacaccgatgacgaagatgatggcgatgataccaacaaaacgcaggacccggtcaatctggaacaattcttatatgccagataa

SEQ ID NO: 13760 - DNA, 216 bp, A.fumigatus
cgaatagagtctctgagggactacttctcccagtttggcgaggtccaagagtgtactgtcatgcgggacagtgctactggtcgctctaggggcttcggcttcttgaccttcaaggatcctaagactgttaacacagtgatggtcaaagagcactacctggatgggaaaattgtaagacgcatattctgtctattttgtcgcatgcaccagaaatga

SEQ ID NO: 13761 - DNA, 1311 bp, A.fumigatus
cagattgaccctaagcgtgcaattccccgtgacgaacaggagaagacgagtaaaatctttgttggtggtgtgagccaagaggcaacggagcaagagttcaaggagttttttacgcaattcggccgtgttattgatgctaccctgatgatcgacaaagacaccggacgtcctcgcgggttcggttttgtgacgttcgacagtgaagctgctgtcgaggctgctctgtcccgtcctttggccatatgtgggaagccgatcgaagtcaagaaggctcagcccagaggcaatttacgcgatgaggaagatcgcaggaaccgtcgcggcagagatttccgtgatggaggtcatggtggcgtcgacgggtctcagcagcaacagggaatgcaagggcaggcgggtatgcctgcaggtttgacaccccagatgatggcacagtattggcaacgtatgcagcaatacttcgccttgatgcagcagcagatggcggtcgccgctgcccaggggcaaggaatgggagccatggggatgggagcaatgaacccggccatgatgcagcagatgcaacagatgcagaagatgcaacagatgcagatggccaacaaccagcagcagcaaccacagcagcagggcagcctaagtcctccctcacaaagcccgaccccgcagatgcagaacatgatgaaccctgcaatgatgcaacagatgcaaaatcaggttcaaggaaacaacatgggagctatgcagggccagatgggcaacaatgctgggaacatgaacatgggcgcaaactacccgggcgctcggggcggaccaggctataatgctcaagagcagcttgcattcgagcagcagaaatacgagcagcagcagcaacaacgccgggcaatggagtcccgggcattctcgccatatcaacagggaggtccgacatcgtgggagggcatgtacgatgaggtcccccagcccaatatccccactggtcctcaaggtatgaaccgagcaggcagcattggacgcggtacgtattcctttgatctcgttacaggcataactccgatcaacggacatttgtatccgttacatacagctaacgtcaagcttcaggaacaacaccacagccgactcccagcgccgcgcctgccaacgccccaactggccctaaaaatgctggaaagcccggtgcgaactatcgtggcggcggtcgcggaggccatcgtggtttccatccttactctcgtggataggattggagctcgatcattgtcgattcttacttgccttttcgccttctttttggtttcatctctctga

SEQ ID NO: 13762 - DNA, 1323 bp, A.fumigatus
cgcagcgcttttccttccagccccggcggtgaagacggcgacgtaatgggttggttccatagcatggctaccaatggcatgctcagtgtcagctatccgcccatctatcgcagtttcaccaagaactttgccttcagtaccggcttgattccatggggtgacatgcaaacggctatagacaacttcagagcagccaccgggggcaatctcactgaaaatagctatgagtttcttcgcaatgccactttgacgtactcggatggtacctcggcgaatacaacctcaaaagtcaagcggggactgagtctgatagtgggtgctgtcgatctggtaaccagggatctttcgggttctttcagtagcgacaccacgtcgagcaattcgactgacggcgatgagagtgccttccacaaggccgtttctggcattgaggcctacgcggagcaactcaccattccccaggcgaacacattcatgacagtcctgttgatttttgccatcgtcgtcgcctccatcgctgtgggcatcctgcttttaaaagtcatcctcgaaatatgggctctctacggatcgttcccggataagctcaaagacttccgcaaagattattggggtcttctggccagaacaattactaacttgatcctcatcttgtacggcatgtgggtgctgtattgcatctaccaactgactacgggggactcgtgggctgcaaaggtgcttgcagccgtcacacttgccgtcttcacgggtgtgctaatgtttttcggactccgcattatgcatctggctcgaaaatacaaaaagaccgaaggtgatacgtcggcactgtacgaggacagagagacctggcgcaagtacagcctcttttacgacagttacaaaaaagactactggtggcttttcatccctgccattgtctatatgttcgtcaaaggctgtgtcattgctggggcgaatggccatggtcttgttcagtctgcaggtcagctgatagtcgaagctcttatgctgggtctcctactgtggaatcgcccatatgttgccaagtcctcccagtggatcaacataacgattcaagtcgttcgtgtcttgtcggttgtttgtgtcctggtatttgttgaggagcttggcctttcgcagacgaccaagaccgtgaccggtatcgtcctcatcgcagtgcagtctaccctaaccggcattctggcgattctcattgctgtcaatgccatcatcttatgtgtccgtgagaaccctcatgctaagcgacaaagagaagctggtaagtccatcgtacgcaattcgtttactctcgtcggataa

SEQ ID NO: 13763 - DNA, 627 bp, A.fumigatus
ggtggtgactctaagatcccgcctccatcggccttttgcggcttcacgaacatcaaccactggacactcagcgcccctctacataccgcagcctcatcaacagctgcgaatcgatctattgtccaattgaacccagagcggttgtcgccagtctataccgttttttacagatccccgaagtacctctttagcatatttggcaggggtcctctatttagcgtcgccctcacgattatcgaccggctcttcgaaggaacactgccagagtccgtcacaataatcacaatgtctgctcgccctttgtcgcaagccctgcgtgctcgttgtcttttccgtgggcctcagaacactaagggcttctcgacccggaacactctccgcgccgctgaccacggtaatcactatgaccctcccaccgggtggctcttcggcgtcaagccaggtcagaaatatgtgaaggagggatgggagaacatttggtactacggatttattggcagtttgctcgctgctggtgttgcatacattttcaagcctgatacctcgtacgcttcatccccactttcagccattcatgggcggccttttccttcagagcggctgtaccatatctacttgattatctga

SEQ ID NO: 13764 - DNA, 306 bp, A.fumigatus
tcgcctaatgcggaacaggcattattcctaccagaggcagcagactacattgcctcttcgccagcagaaagcatatcacttgtacgatccgtgcaagacagtgtgtttgtgcagggactccagcgcgaagccaggcaggcaaacctacatatcaacgttggcatccatgaaccggcgcccaacggcaaagtcaagaatactctgatctggattgatgataatggtattattactcaacgctaccagaagatacatctgtttgatgtagacatcaaagatgggccggtcctcaaggagagcgcgtaa

SEQ ID NO: 13765 - DNA, 384 bp, A.fumigatus
gctcataatcttacatactatttacagctgcgcttccctgaaatcagtctagccctgaagcgtcagaatgcccaaatcatcacatatccgtcggctttcactgttccaacgggacaggcgcattgggaagcgttgctccgagcaagagctatcgagacacaggcgtatgtaattgctgcagctcaatctggtccgcacaatgaaaagcgaagaagctatggccattcgatgatcgttaatccatggggagagatcgtggcgaaactcggagacgaatatcgagagcccggaatcgctaccgcggagattgacctgaacctcttggagaaggttaggagggagatgcccttattaaggagaactgacatatatccagaggtataa

SEQ ID NO: 13766 - DNA, 555 bp, A.fumigatus
gagcttcttcatctgatttcggtgatgatgacttggatgagggttttctcaccttggccgaagccttctgaggacccattccttgaactaacccggcccaacaactatacgaatccaatgaatgcccaagcccctgtcgaatctactatggagcagcgtcgaagacaactcggtactttgggagactcgaaccataacgcaagagtttctgattcgggcaaccgggagctcagtttcgacaaagctttgaacagtgacgaattcgacgatgactttgacgatatagaggaccttcttgccgaatgcgatggaacagcaggcttgattcctccaggaccgacagcgtcagagaagctgttggctaatgaacaaccttgtataaaacagaatacgaaacgaccatctgaaacagaaggatttaacggcacttccaaggagaatttggaaacatcctctggtgacgagtttgatgatgacgactttgatgtggaggctatcgagcattttatgcagccaggtagaaatggatcagtcaaacgttggtccttcacccca

SEQ ID NO: 13767 - DNA, 210 bp, A.fumigatus
gaatattggcctcatggttcagatgcattgaagtacgagatcaataatgccgaaaaatacatcccggtcagcctctgcagttttgagtccaaggccgacgacaagcaatcgcttctcgtcaggtgtctttgttgcaataacacttgctatttggcgggcgtagagctgaccaactgtttcatgtccaggagctcgacccccaagcagtga

SEQ ID NO: 13768 - DNA, 546 bp, A.fumigatus
ggcgctatctgcctcgatacgctgtcgtcggcatggtcgccggtgctgaccatcaaatccgcacttttgtccctccaatccttactcagcacccctgagcccaaagatccgcaggatgcagaggtagcgaccatgctattgcgaagaccgaaagagtttgagcgtgtcgcccgggaatgggccgtcatccacgctggagctccccgaaaacacgctggagagggtagtggaggagcaacagacgaaactctccggcaggaggaactcagggctaaggcagagcaagagagggaagatctttccaagtacgtaaccacgcaggtgccatgtttcgttacctctagagaatcgcatctcatgcatgtcaataggtacgacggatataacaaagacctgatcgatcgattctgcagcatgggcttcgatgtggatcgagtggttgcggcattcaaattttacggcattgatcgaatgaatggagaggactatgaattggatgaagcttatatgggtgatattaccgcacggctcctgggtgagccataa

SEQ ID NO: 13769 - DNA, 510 bp, A.fumigatus
cggaaatctattagccttggtataaagaaaatataccaccttattatcgcagctatacagttctttctccttcttgccttcttcccaatcgcccacgtccgtggggccgaacgatcgagctccatcaaaagcaggatgttcgaggacgacatctatcggacctcatcacagtataaactttggtctttcacagaggcctccttacggtcgctaagggagaacacaaatgctgttgctagccaacgagtccgagcggctctgcggagagcacgggaggcgcgacagtcagccaacccgtcggctgcggggactgctacagcaggaactactgcagatggcaagggagcggacgaaaatgacattgactgtttgacaccagaagaagagacggaattagtgaggttttattgtgaaaaggccgtagagctggcggacacatataagccaccgttgccgacaacagtgcgggtgcgtatctcgtccgatgttgaagcgcatgaccgcgaatga

SEQ ID NO: 13770 - DNA, 972 bp, A.fumigatus
caggccactgcgattcagtacatccgtcgattctacctcagcaactcgccaatgacctactcgcctaaaacaatcatgccctgcgctctcttccttgcaaccaagaccgacaatttctacatgtccttgcgccagttcgccgaaaaagtcccaggagacacaacggcagaagacatcattgctcccgagttcctcatcatgcaaagtctccgcttcaccttcgacgtccgccaccccttccgcggccttgaaggcggcgtcatggaactccaagccatggccgaaggcctaggccaacccgcacctcacctccctcaccagacctcagaagacctacgccgcggactcctcgccgtcccacccccaccaaacgctccccagtcctcctcaatcacagaccgcatcgcccgcgcgcacaccaccacccgcgaactcctcaaaaccgccgcccaaatgaccgacgcctacttcctatacacaccctcacagatctggctagcagcgttcatgctcgccgatcgccccctggccgaatactacctcgacacaaaacttggcgggccaaccgctgagagtgccaatgcacaagcagggaacccactctacgagctccgcgtgaaactcctccgcacactcaatcagtgcgctgccctcctgcaatcatacaaacccctcaactctgaccccgagcaaatgaagaacctcaaacgcatcgggaagaagttctactactgccagaacccggagaagatctccctggctggacagaagcggattcctgctgctgctgccgccgccgccgcgtcggcaggcgagggcgccacatcggaaagtgaagtcgagcggcaggcgaagaagcggaagctggaacgggagcaaagagatcgggaggcgagagatatctttggcggggagctggtggcgcaacgggtcaaggagggccaggttggccagcagcaacatccgtcgtag

SEQ ID NO: 13771 - DNA, 192 bp, A.fumigatus
aaacagtcaaaaattggcttggcttcaattttccccaaagcggtaaaaccacacgcaccggctgccctttttacccaatccagcaagtggcatcgcgatcttttgtccgagattaaaaatagcacgactcctaactataactatacattcgcaaagactcatcgccgcgtcctcatggcctcaacctgctga

SEQ ID NO: 13772 - DNA, 255 bp, A.fumigatus
cattattttcaggctgggccgcatatgcataggcactcagaaatgtgtagcaaagccgattcttccagttcgatatgtatatccgccaaggcccttttctacttggaggccctgctgtatcgccattccatcatgcttgacgaatcggcaatgagtagctacgacgctccccatgattccttgaagcaggcgaggaagattgtgtacatagttaaatatatacatacatacatacatacatatatatatatataa

SEQ ID NO: 13773 - DNA, 489 bp, A.fumigatus
gactcaacattctcaagaaagatagcgagttttaaggcagttaccagtccgttactaacagtgcatgcaggtagactggtccgtctgatccctgactcgcctccaaactcggaacgggccgcgatcaagaccctgttcaaccaccggctcccttcggacgccgtcgcggcccacggagcatggcagtcaatcgtagatggtacttccgagctctggaaaaccatcacacccgccaagaaagagctgatacgctcgttcttcaatgtgctgaacctggagatcctcaagcgggcacgaccgccgtcgtcaacctttgacttcacatcggccagcgtgggtaatctcttcctcaccggcgcgcgcctcttcagcggcagctttgagagtgccatctacctcctaggaagcatctgcggtgtccagtccgacgtagtccgcgtcatcccagccatcaattcgtattcaccacggggccggaaggatccgcgc

SEQ ID NO: 13774 - DNA, 1185 bp, A.fumigatus
  unsure (934): Identity of nucleotide sequences at the above locations are unknown.
atttgcaaactgacgatcatatcacagttcaagggaggcaacgatgacctacgacaggacgccatcatggaacaagtattcgagcaagtgagcagtcttctcaaggatcatcaggcgacccagcaacggaagctaggaattcgaacatacaaggtcctgccactgacttcaaacgcgggaatcattgagtttgtgccgcacaccatccctctgcatgactacttgatgccggcgcatcagcgatatttccccaaggacatgaagcccaacgtgtgccgaaagcatatcagcgacgtacagacacggtctttcgagcagcgagtcaagaccttccgccagatcacggaccatttccatccagtcatgcggtacttcttcatggagaagttcaacagcccggacgattggttcagcaagaggctctcatatactcggagcactgcagcgatttccattctggggcatgtgcttgggcttggtgatcggcatgggcacaatattttgctggacgagagaaccggagaggtcgttcatatcgatttgggtgtggcttttgagcaaggccgagtcctaccggtccctgaggtagttcccttccgactgacgcgtgatctggtcgacggtatgggcatcaccaagacagaaggggtcttccggcggtgctgcgaattcaccctcgaggcacttcgacaggaatcgtacagtatcatgacgatccttgatgtgcttcggtatgatcctctgtacagctggactctctctccactgcgcatgaagcggatgcaagacgctcaagaagccggtgatgggccccccatgatatcaggtgccgctgaagatcaacggtcagcgaatgaacctagtgaagcagatcgcgctctgacggttgtggcaaagaaactgagcaagactctcagtgtcacagcgaccgtcnatgaactgattcagcaggcaactgatgaaaggaaccttgctgttctctattgcggtatgtcattggagcttctgtccctgacgagattgaaggctaacattattttcaggctgggccgcatatgcataggcactcagaaatgtgtagcaaagccgattcttccagttcgatatgtatatccgccaaggcccttttctacttggaggccctgctgtatcgccattccatcatgcttgacgaatcggcaatga

SEQ ID NO: 13775 - DNA, 240 bp, A.fumigatus
gctcaggtcaccatgtcgaccgtgtcccccaacaggggcatcgtggtcttctcgggaggaagcgctgccaacaatctcgtcgatgtcttcggcaggatacgtgagagtaaggattgtttgctaagctacattatcccgatcagcgacaatggaggttcttcctctgagctgatccgaatatttggtggtcctggcatcggtgatgtgagaagtaagactcaacattctcaagaaagatag

SEQ ID NO: 13776 - DNA, 1329 bp, A.fumigatus
  unsure (1247): Identity of nucleotide sequences at the above locations are unknown.
tccatcatgctgattaccaacccagctcttctgggcattcttgcctctcttgtcccgctggctttgggagctcccaatcaaccgatacaagctcgctcgagaaaatgtgtgattccttcgagctacgcatcgtctcacggaaccgccgatgattcccctgccgttgccagcgcctttgcccaatgcgcagagaattcagtcattgtctttcaggaaggtgttgactacaacatcttccacccgatcaaagcgaccaatctcagcaatgtcgagattagagtgctcgggaacctgcatcttccccaggacattaccgccgtacagaacatcgtcaaatccggccaaagtacctggttcacgttccaaggcccccgcgtcgactggactggagccgacgacatcaaaaatggctggataaactcgtacggccaggcctggtgggacgcaaacccagccaacagcagcagtttcccgaaccggccgcacctgatgagctacaagacgagccaggcgtcgatcaagaacttccgctcgcgcaagcccatcgcgtggaatgtcaagctacagggcgacgacatcaccgtctcccacgccatcgtcgacgccacatcgacgggcggcttcccctttaacaccgacggcttcgacgtcgaggggaccaacatcagcatcaccgacagcgtcatgttcaacggtgacgatgctatcgctgtcaacacaccctcgcacaacatcgtcttcgcccgcaacaccatcggctaccagtcgcacggcatgagcatcggctcactaggcaaagaccccaccgacttcgctaacatcactaacctgcgcttcgaggacgtcaccgtcatcgacgcgttgtacgccgcgcgcttcaagtcctggtcgggtggcaggggtctcgtcaagaacgtcgtctggaagaatatccgcaccttcaatgtcacgttccccatcttcgtcacccagagctactccgaccagagcgcctcgcggtcgggcacgatcgaccctttctcgtccgtcatgatggaggacttcacctggtccgatttctcgggcaccatcaacacctaccaccccggcgatgggtcgtgcgttaccgatccgtgctggtacaatgtcggtctgcccaacctgaaacataccgaggccatcgtgctcgagtgcaacaccgagtcctcctgcaagaacttcaggacagagggtatccggcttcacccgcagagtaaggactcacctancgttatttgcatgaaggctacggcggaacttaaccccaaactggggtttgagtgtaagaacggtacttttgttccccattga

SEQ ID NO: 13777 - DNA, 237 bp, A.fumigatus
caaggttataagagcgcaacggcccagcagcagcctggtcctccatcgaatccaacgtcgccatcatctgcacctgcctaccgccaatccaacccctcctcgcccacatgtgcccgtgcctgctctcttcgcgcccgcgcccgcgcccgcgcccgcgcgacagtaaacgccaacgccaacgcgaaaaagacctaccctctgtctactcgttccgtctcaataacccgttcgctatga

SEQ ID NO: 13778 - DNA, 276 bp, A.fumigatus
tacttgacttgggtcactggctctacgcaatcacaaagaatcatggcttctacgtctgcatccccgtcccttagctccaactcgactcccaacatctccgcatccgacgccgtcctccacctcaacagtgctacgcgcattgacgcacccttacaagatgtctggaacgccctaatcgacacctcaacctggccaagatggaacacctttgttccgcgcgtcaccattcgcgaacaaccagacaccctcgatgcctctcccgacgccctctccccg

SEQ ID NO: 13779 - DNA, 705 bp, A.fumigatus
cgcgctcatcccgccgccaccatggggtccaacgacacgactgaaaaactcttccacatccttctaacaacgagccaccttcaaaaaaatccaaacaacgtggtcgaaaaggtccgaatccccggcacctacacaacggtccaggcagccaaagctgcagcataccgctgtctgtttgacgcgggctacgaaaaggagtggttcaccacgtacgagaccaagccggagatctttgaaaacaaagaccttcccgagcgatctggattagccgtctttgcggtcgcacccgacggaacagaattccgcgttcatatcatcacaaccccgaaggacgacaagctcctcgacgaggtcattgagggccacgtcaccaagccactgtactacgtggtacaagccaatgtggagtacagcgccgacgagggcagccgagtgcgcgatattgacatcgagggagtcttcctgacttaccaggaggcaagagacctcgccagccgggtactgctgtccaaggagaacgcagtcacgaaagagagctttgcggaatacactgaagcagcagctacggagaaggactgtggatatggcgagaatgttgttgttcgagctgtgtcagaatatgggacgaattatttgatttcggtcatcaagaatcaggaactggaggccgtacatctggctgaggcggctatgaggatattgtga

SEQ ID NO: 13780 - DNA, 828 bp, A.fumigatus
gaaactccggcattcgatcgacatccactaacattacatcaatcccagtttgaatttcagatcagcccttccctccgaacaaaacctgcgtctattggtgacactttccagtccggtgatagtgcatcgcctaaaggttttggcccaggcagtgatattgccaacactgatccaaacttggtgatcactattattaaccacactcatctcctcgtaataaacaaatttcctgttttccggccccagttgctcttgttgacatgcgactcctaccggcggcagcatgaaccgctcaccgtggaagactttgcggcgattcaaagcgtcctgagctcgtcgaaagaacgccaccttgttatatacaactgcgggccgatcgcgggcgcaagcaggaaccataaacatgtgcagattctgccacgccctgcccatctatttccggacgacccgaactgtgaccctgagtggattccgtttcggtatggtctgcggtatctggggggtccagatttcgaagatccggagtatccctcgcagctctcggcatcctaccaggaactgttggcagaggcgaagggaagtcctgggagctcagccgactccaacaatgcagggtactttccccataacgtcgcgttggtccgagagtggattattgtcatccccagatgcagtaacaatttcaaggccatttctgccaatgcggccggaatgatgggctctgtttggctaaagagtgaagaagagttggatcgttggaaacaggtcggattatccaaagctctggctggtttgggatacccgagggagtctgagaagacgagctag

SEQ ID NO: 13781 - DNA, 801 bp, A.fumigatus
tggaaaagttcggcctcgggccaccccctcatttccccggctttatctgacaacatctggcctgacctcacttgcggtatcgccctcgctctttccaccgcatataccccccctttagtggtcatggcacaggatcaggacaatttcccgcagaccacatctccacctcgcaaacgtcgccgaccccccaagtcctgtgacccgtgccgtcgtcgcaaagtccgttgtgacagggaggttccttgcggcccatgccagcgtgcgagaacgtcgctgcactgtttttaccgccctgcagtcactgccagaagcccatccacagacgaagactgcaggctcacggcttcttgtgggccggagggacatacacctcctccccaagccgttgacctgcagacgaagatccgtccagcagcacccacagcgcaatcgcagcctcagggtccgaattacgatcaaaccaagatcatccaggatctgcaaaatcgcgttcggcgtttggaggaacagcttttcgaccttccgctctctaaaggcgcgatcggtcccaatcccagcgtctctccaagtcaggctctgcgccaccttcacgaccgggttcgtggagccgaacaacagctgtctgatgcatctcggcccagtccttcggtcaatggatggaccataccggccacgcttcctcgtctgcgtatcgccccgaataacacgaagctttttggccccagtcactggctgcataccgctgagaaagtatgggatttcggagttacttccctcaacctacaagagtcttgtcgctga

SEQ ID NO: 13782 - DNA, 1233 bp, A.fumigatus
tggtcatggcacaggatcaggacaatttcccgcagaccacatctccacctcgcaaacgtcgccgaccccccaagtcctgtgacccgtgccgtcgtcgcaaagtccgttgtgacagggaggttccttgcggcccatgccagcgtgcgagaacgtcgctgcactgtttttaccgccctgcagtcactgccagaagcccatccacagacgaagactgcaggctcacggcttcttgtgggccggagggacatacacctcctccccaagccgttgacctgcagacgaagatccgtccagcagcacccacagcgcaatcgcagcctcagggtccgaattacgatcaaaccaagatcatccaggatctgcaaaatcgcgttcggcgtttggaggaacagcttttcgaccttccgctctctaaaggcgcgatcggtcccaatcccagcgtctctccaagtcaggctctgcgccaccttcacgaccgggttcgtggagccgaacaacagctgtctgatgcatctcggcccagtccttcggtcaatggatggaccataccggccacgcttcctcgtctgcgtatcgccccgaataacacgaagctttttggccccagtcactggctgcataccgctgagaaagtatgggatttcggagttacttccctcaacctacaagagtcttgtcgctgacgcaacgtccactcaccagtttcaagttattggcaaattcgacgccaaagaagtagaaccatcgctgcaggacgtggataccagatcggagttcgccagcatcttcaaggactgtcgacaacttcggcaggccatcaaggaccaagagtcggttcgtctcaaccatccggttccggacttgctgggcacgctccccacccaagcagtctgtgatgttctcgtcaatgcctatctccgcactttcgagctcatctaccgtgttatccatatcccatccttctggaaagagtatcgtcagctgtggacccagccgcagtcgaccacgacctcctttctgatgaaactggtcttgattctcgcgctgggtactacattccacccagatcgaaacaatagggtgcatctccgccgtctcgcacacacgtggatctatgccgcacaatggtggctagtcggaccatcggaaaagtcgactgtcaatctggatggcctgcaggtcggttgtctcctattattggcccgccagacaaatagcctcccggctacgagc

SEQ ID NO: 13783 - DNA, 234 bp, A.fumigatus
tcacgctccccctgcttaccaacacgcttctcgttcactatgtcggatgctcgtttggaaaatggcccggccgagcctgcaacagaggcctcaaaagccatccgcaagtgtccccgccgggtgcctctaggcatggctggcaagtcactagggcatctgtcgctatgtttgtctccttgggctgggtcgactgtattggtctcttgcaggctgagtacgaggggaaccagctga

SEQ ID NO: 13784 - DNA, 357 bp, A.fumigatus
gtacgaggggaaccagctgaaggactattcgagctcggatgtatcttgaatcacatccatggaatgtatgtcactgtgcaatgtacttgcgttctgctcttggcccagctgacaattccagttttcttcatgccttttacctcccccttggcgggtaagtggttcgactgctatggaccgcacttgcctattaccatcgggtctggcctgcatgtctttggactgctgatggccagtctctcccacaagtactaccaatttacgctcagccagtctgtgatgtctggaattggttcctcactgatcttcatcccggcgatgagtgcagtaagtttcaaaagaaccaatctccgttaa

SEQ ID NO: 13785 - DNA, 432 bp, A.fumigatus
gtaggaactgcccctaacaaagcttccgagaatgcagccccagacctggttccgtcagaagggccaatcgttggtggtttggcggtagcaggttcatcattgggcgaggtcattttcccgctgatggtacagcatctgctgccgcaggtgagctttggctggacgatgcgcatcatcgcgtttctgatcctggaactgctggtcattgctagtctcaccatctcctctcaattccgacacgcaccaaaaccacgtccgttttccgtgatgcattatcgcggaccgttgtggaaacttaatctcgatcttctgtgtgtggctagctttttcatgtactatgagtacagcacacccaggctgaagaagggaatgttgcagcagatcactaactactctttccctatgagggaactgtttattcctcttgattag

SEQ ID NO: 13786 - DNA, 582 bp, A.fumigatus
cgcattatttttcctttgttttttgtcgcttctccgttttcgttgcgattgaatttgaactgcctcgtgtttctaattttcttaaactatggtaacgaggatctacaattagaacaaccagatgtatatgcgaccggacatcttgcgaacagaccactgtatccagcctattgctggaaccggagcctccataagaggagtccgcaacgaagaaatgcgcagaaaatcacctcctggtctaagttatggctgccttcccatccgcagctcttcaagactcttctgctgcccaccactttcgtcaaagttgctctcctgcagccactcctccatagcccccttgacacccccttcccattcctcacgcagcatcgaaaaccacgccgtatctctattccttcctttaatcaccatatgctgccgaaagatcccctcaaaggtaaaccccagtctcagcgcagcccgtctggaaggcgcattcagcgcattacacttccactccacgcggcggaaccccaaatcgtcaatcgcgtacttgagggcaaggtagaacgcctcggtagcgactgtcgtccgctgtaa

SEQ ID NO: 13787 - DNA, 777 bp, A.fumigatus
attgccaaattgataacccagaactgtaacagaacacatctgatcacaacaatcatgtcccatcggcccctgggtccagttgtcgcattgcctccggcccaactgccctcggaggttaccctcatcggccgcacggttgctctgaccaaactaagcgcagaccacgccgctcagctattccctctggtcggtggtgacgatgcaacaaaaatcgccctctgggactacatggccgatggtccattcagcgaccccataactttccaagaagcaatcgcggccaaatcgcggtcttcggatccgttctatttcgctgtcatagacattcgccagaaccccgaccccgagaaaggacatgctgtgggctatctttcgttaatgaacattgtccctcagcatctcagcattgagattgggaatgtactgttttctccaacgttacagcggacgacagtcgctaccgaggcgttctaccttgccctcaagtacgcgattgacgatttggggttccgccgcgtggagtggaagtgtaatgcgctgaatgcgccttccagacgggctgcgctgagactggggtttacctttgaggggatctttcggcagcatatggtgattaaaggaaggaatagagatacggcgtggttttcgatgctgcgtgaggaatgggaagggggtgtcaagggggctatggaggagtggctgcaggagagcaactttgacgaaagtggtgggcagcagaagagtcttgaagagctgcggatgggaaggcagccataa

SEQ ID NO: 13788 - DNA, 1494 bp, A.fumigatus
agacactttacaggcacgaatcctacaacgattgaacaggcttcggatgaatggttagaacacttcatcacagccgcagaagcaccagaggatggccccgtcaaggagattctcaccgatctccgtaacagctgccgaaagtcgttgtacatgcaggactacagctactttcgcaaggcggctgggctggacccgactgccgtcatcaaatgcgagtttgatgaagcaggcaagaaaagacaccgctatggttgtgcttcggtgtgtctgttttatctcaatgatcaaggccagctttaccctctggcaattgtcatcgactggcggggcaaggctgagacatctgtgaccatctataaccgggaattgatcaagcggaaggatcttcgggcaggaggcgaaaagcaggaccagaaacacaaggtaaccgacgaggctcatgactgggcatggagatatgccaagacctgtgttcagtgtagcgactggcttcggcatgaagttactgtgcaccttacgaacacccatatgattgaagaggccattattgttgcctcgcaccgacaactcgacccagaccatccggtaatgctgttgctctatccgcattggcaaaagaccctggcactcaatgccgctgcccgaaacacgcttgtcccccatgtcattgtcgatttaatcgggtttcaggcaagtgaaggctttgcatttatccggcacgcgtacgagaacttcgacttcaaaggacgttacgtaccgacagatcttcgccagcgcgggttccctccagaggaactcgacagtcccaagtttcacaactacgcctacgccagatgtatcaacagtatgtggcataagatcaggtcatacgtgcaagacatgcttgctctagcctaccccggaactgatgccgaccacaaagtccggaatgaccaatgcattcaggcctggtccgacgagatgcgcagttccgatggtgccaggttgccctctttcccgaccatcagcacgtttgaggagctggttgactgtgtgaccatgtgtatccacatcgcatccccccagcatacggctgtcaattatctacaaaattattaccagtcatttgtggtcaacaaacctccctgcctgtacaccgagccaccaacctctctacagtccctccttggctacaccgagaaagagcttgttgaggcgctgcctatgaaccaccctcgggaatggcttctggcgtcacatataccgtacctactcagcttcaagccgggtaataaagaaagtctgattgtctacgcggcgtcaaagtttcgcgtgtatcacaacaaagcgacagagaaggaccaggccatcgcagcagcgaccggaaagttctataccgcactcgcggaaagccaagaagaattcaagcgttacggacaggcaacggacgattgggagaccatcgagtacgaggtgttgagcccagaatggaatgcagtgtccattttgatttag

SEQ ID NO: 13789 - DNA, 303 bp, A.fumigatus
gtcccaaggccggcggtgcattcgttggtgcagacgctggcggcggagttggtgggtgtgcaggtgcgtgtgaatgctgtgtcgccgggcttcgtgaggacgcctacgatgggggtggtgggggcgtcgagggaggagttggtggagtttgaggggcagggggtgaagagtacgccgatggggaggattgcagagccggaagaggtggctcgggcggtggcgtttctggggttcgaggcgaccttcacgacgggggagcaagttgttattgatggggggttggctacgttgcggttgcattaa

SEQ ID NO: 13790 - DNA, 192 bp, A.fumigatus
gtacccttcaccgtcccaatcgcagacaaacaccgacaacccaaaatgaaaccaaccctcttcgtcctcgcgctggctggcgtcgctctaggcgcaaaaacatgcacgccgagcttcgattactgcgctaaaaagctcattgctgataagggtactcctttcctcgcacatttccatgatggcatttattaa

SEQ ID NO: 13791 - DNA, 183 bp, A.fumigatus
cggacagtggatgcaggattcaccgaggcggacctcgaggttgttctcaaggcggaggatctggagactacagacttgaagaacgtgctcttccactgcaagaatccgggggatgtggggcatgcaaaggtgtgtccgaatgggtgtacagacccggcgacggaagggagtcatggttgttag

SEQ ID NO: 13792 - DNA, 300 bp, A.fumigatus
tgcaaccgcaacgtagccaaccccccatcaataacaacttgctcccccgtcgtgaaggtcgcctcgaaccccagaaacgccaccgcccgagccacctcttccggctctgcaatcctccccatcggcgtactcttcaccccctgcccctcaaactccaccaactcctccctcgacgcccccaccacccccatcgtaggcgtcctcacgaagcccggcgacacagcattcacacgcacctgcacacccaccaactccgccgccagcgtctgcaccaacgaatgcaccgccggccttgggacg

SEQ ID NO: 13793 - DNA, 753 bp, A.fumigatus
aaagtgcgatccaaccctggcggatggagacgaattgtcatgaacctgctcggcaattcatttaagttcaccaagtcgggtttcattgaggtcaccctcgccaggaagatggagggaaccggcggcaccaagagggtgtatgctcatttgacaattacagatactggatgtggcatcgctccggagtacctggagcacaaactatttcaaccatttacccaggaggacatcctgacggaaggggtaggcctggggctaagtattgtcgaccgactggtgacaaatgcgggtggccagattgacgtgaagagtaccgtcggtattggaactcgattcgaagtgtacattcccgttgaatttgtcgatacactggacgaaggtgctcctgagcaacagcaaccacagagtgtgtcagtctctcgggtttgtctggtcggcctgaacgtgttttccagtatgaagacgtcaagccaaaggctgagtgttaacacgaagaggaggttgtcagttcgcagtgcattgagcaatgcaatcctcagccaacctggctggacagtctcctttgccgacactttgtctcaagcgaagggagatattggtattatcgaggagagcagtctggctgaaaaggcagacctagagcaaataactacagacctgacgagactgatcatactaggacagtatggtagtggcccatccgtcgatcctgccacgaaaaagctggatgtggtctacgttcctcaaccgtaa

SEQ ID NO: 13794 - DNA, 354 bp, A.fumigatus
aggtcatttctttttctcccaatgtggaactggaaatcatcgcgctggctggctggtgccctgttgtggacatgtgacatccaacgatcttttgaacaaaccgatttgttctatgtcaaggcatacggtgacgcaattgtgtccgaagcggctcaaatggactggcaggcgacggaaaagtccaaatcagatttactgtcatccgtcagccacgagctaagatcaccgcttcatggcatgcttgccagtgtagagctgttgcgcaccaccgatcttcaaccggctcagctggatatgctgacgatgattgaaacctgcggcctgacactgatggacacgttgaattatctgtga

SEQ ID NO: 13795 - DNA, 189 bp, A.fumigatus
  unsure (148),(154): Identity of nucleotide sequences at the above locations are unknown.
aggctggattttacgaaaatcaacaatctgaccagtgcggacgcaaagaatgataccgaaacctctctcgtcgatctagcatgcgaatttaatttggacactctggtagaggatgttgcggacaaccctgtatgcagtcatcggtccncgatcnatgcttcccaagtcggtggtcgggtacctgcttag

SEQ ID NO: 13796 - DNA, 753 bp, A.fumigatus
gacagtatggtagtggcccatccgtcgatcctgccacgaaaaagctggatgtggtctacgttcctcaaccgtaagcagcaccaaagtctgagcaagagtgaaactaaccggacagacagactcacgcctcgaaagctcatcggcgccctacataccctttccaacttgcccgaagcaagggaacagatcggtagttccgatagtatgccacatcgtcaacgcagcttatcggaagcttttgtcctggccaaacagaccgagtcaccaccagtggtggagggtttagagttaggcgagttccgtggctcgacacccaaggcttcaacaacgaccgatcgccacgtcctgattgtggacgataatgacatcaatctcaaaattttggctacttttatgcgccgcatcggctgcagctatgaggcagcgaccaacggactcgtggcgctggagaagtaccagcaggcccagcgccagttcaactacgtcctgatgggtaggttgcctcttttgggagttatggtccagctaaccgcaatagatctttcaatgccggtcatggatgggattatctccacaagcaagattcgagagtacgaggaggagaattcccttccccgggccgccatcatggccgtgaccggggttgcatcggcgacaatgcagcaacaggcatttgccgcggggatcgacgattttcttgtgaaacctctttcactgcgtgatttgaaacgagtgatgatgaacattgcatga

SEQ ID NO: 13797 - DNA, 306 bp, A.fumigatus
cactcgtctagtcgccaaatccgccctccaatttactcactgaagcaatcgaagctcaggaagagaagagtcatccgctttgctattctctactttgggatgctcattctgttccttgtccttctcattgccccacttgttgttcgctctatgggattggttaaaactcccaatcttccattcaacttgctccagcctcttgacaaggacaacaacgatactatggtgacatacaccggcaacaacattcccgctggatttgagccagttgagagcgcctcgagcgtggctactgcaacgagctag

SEQ ID NO: 13798 - DNA, 2400 bp, A.fumigatus
cagcgcggttccttccagccctgtggtgaagacgagaagctggaacgcgaacttgagaggatggctcgtcgcaagttcaagattgtcgtttctatgcaacgctacgccaagttcaataaggaagagcgtgagaatacagagttccttctcagggcttatccagatcttcaaattgcctacctggatgaggaacctcccgtcaatgaaggtgaagagccccgtttgtactctgcccttattgacggacactgcgagctgttggagaatggtatgcggaagccgaagtttaggatccagctttctggaaaccctattttaggagacgggaagtctgacaaccagaatcactcaatcatcttctaccgtggcgagtatatccaagtgatcgatgccaatcaggacaactatctggaagagtgtctcaagatccgtagtgtcctcgccgagttcgaggaattgactactgacaacgtctcgccctacacgcccggcattccctctacgaacaccaaccctgtggccattcttggtgcccgcgaatacattttctccgagaatatcggcgtgctcggtgacgtcgcagctgggaaggaacagactttcggtaccctttttgcccgtactttggctcagatcggtggtaagcttcactatggtcaccccgatttcctcaacggcatcttcatgacaactcgtggcggtatctccaaagctcaaaaaggtctgcatctgaacgaggatatctatgccggtatgaatgccatgattcgtggtggtcgcatcaagcactgcgagtactaccaatgtggtaaaggtcgtgatctcgggtttggctccattttgaacttcacaaccaagatcggtacgggtatgggcgaacagatgttgtccagagaatactactatctcggcactcaattgcctctcgaccgcttcctgtcgttttactatgctcatcctggcttccacattaacaacatgtttatcatgttgtcggtacagatgttcatgatcgtcctaatcaacctgggagctctgaagcacgagaccatcacttgccgttacaaccctgacttgccgatcactgatcctcttcgacccacttactgtgccaatctcacaccgatcgtcgactgggtcaaccgttgtatcatctcaatctttatcgtcttcttcatctctttcgtcccactggctgtccaggaactgacagagaggggagtatggcggatggccatgcgtctagccaaacacttcggttctgtctcattcatgttcgaggtttttgtctgccagatctatgccaacgctgtccaccagaacctttctttcggcggtgcgcgatatatcggtactggtcgtggctttgccacagcccgcattccctttggtgtcttatactcgcgttttgcaggtccctccatttacgctggcgcgcgttcgctgcttatgcttcttttcgcgacatccaccgtctggacggcggctctcatttggttctgggtctctctgcttgccctctgcatctcgccgttcttattcaacccccaccagttcgcctggaatgatttcttcattgattaccgcgattatctcaggtggctttcacgtggtaattcgcgctcacacgcttcttcttggattggattttgtcgcctctctcgtactcggatcactggttacaagcgcaagcttcttggtgtgccatccgagaagggctccggcgatgttcctagggctcgtctcaccaatattttcttcagcgagattattgcacccctagtacttgttgctgtgacgctggttccttatctctacatcaactccaggactggagtacgtgataacccggaacctacggatgccatcctgcgactcgccattgttgccgctggaccaatcgccatcaacgcaggtgttgctggtgttttcttcggcatggcctgctgtatgggacccatcttcagcatgtgctgcaagaaattcggtgctgttctcgctgccattgcgcatgctatagctgtcattgtactgctcgccatcttcgaagtcatgttcttccttgaatcctggtcctggccgagaatgctcattggcatgattgcagcagcggccattcagcgtttcatctacaagctcatcattgcccttgcattgacccgcgagttcaagcatgaccaagctaatatcgcatggtggactggcaagtggtacaacatgggttggcactcgatgtcacaaccccgtcgtgagttcctgtgcaagattacggagttgggatacttctctgcagacttcgttttgggtcacgtactcttgttcgccatgctgcctgccctctgcgtcccattcattgataaattccactcggtcatgctcttctggctgcgcccaaggtaa

SEQ ID NO: 13799 - DNA, 2862 bp, A.fumigatus
ccggtgttatcttcgcaaatgctagggtcgaacgaggcgccgcctgtggagaattggcgcacgatacggagattgatcggccatgacaatgatgttcaagatctaggatggtcgtacgattcttcaattttggtatctgtaggactggattccaaggtcgtggtctggtcagggcatacattcgaaaaattgaagacattgtccatccaccagagccatgtcaagggaattacgttcgatccggcaaataaatacttcgccacggcgagtgacgaccgcacagtccgtatctttcgatttacgtcgccttcgccaaattctacggctcatgatcagatgaacaattttgtgctcgaacacaccatatctgcgcctttccaaaactcaccacttacagcctatttccgtcgctgctcatggtcaccagacggaatgcacattgcggctgccaacgcagtgaacgggcctgttagttctgttgcaattatcaaccgaggttcgtgggatggagatatcaatctcatcggccacgaagcaccggtggaggtatgcgctttctccccgcgattgtattcgagtcaaccggtcagcaaatcggcggttgataatcagaatcatgcaatgcagaatgtgacagtcatcgcatgcgctggcggagacaagtcactgagcatttggatcactagtaaccctagacccattgtggttgcccaggagatggctgccaagtcaatctcagatctagcctggagccccgatgggaaatgcctctttgcgactgccctcgatggtacgattcttgccgttcgcttcgaggacggggagctaggctacccaatggcgatggaagagaacgagaagtcgcttacaaaattcggcaccaacagaagaggcgctggtatcgctgagactacggatgggctactgcttgaagagaagagtaaagctggagagatcaaagacgtcgaggggcgaatgggtgctttaatgggcgacggtcatgccacagcagaaagtatggtcaatggcaagacggcaccgcttccgtcaaacggtgcaacacccgcgcgaggtccctcgcctgctgcagatacgcagaaggctcagcctaacggcaccgcagcaacacccgcagccccagaaccggagaagccagatccgtaccaggcgaagttggagaggctgaagcagcgcccgacgtacacgaaggatggcaagaagcgaatcgcgcctcttctggtatcaggagcgggggcggcagagtcatctcttcctcaagcacggcttatggcttcagtcagtagccaagtgaaggccgatgtgccacagtcgattgtcgatctttcgaaaccttttgatggattacctaagggtggactttctgcgttgcttttcgggaataagcgaaagctcgcgcaactcgagggcgatgaagatggacatgtggagaaacgggtcgcactggcaagtcagaacggcgcgacaccaatcctcgcaaatacgccggatggacttcttccggcgcaacctcaacctgcaccaacgggacagcagccaacgccggagttcataaggcctgctgtaacgaacccctgcatggcgatcagccagctccgtctcgcggtaccaaaggtccgcagccagatcgtgcgagccattgattccaacggcaggccgacggaaccgcctagcgctacaggagagccggggaaatcgcgggctgacgttgtcttcgaggctcgtaatccttcccccgcaagcttgacaggtagagctgtagatcgcgagcctgtacgactcacgctgtttcgcggcgaacagccactgtggcaggatttcctcccacggactgtgcttctggtgactggtaaccagagcatgtggtctgctgcctgcgaagatggatcagtctacatctggtcacctgcgggccggcgacttgtcagcgctctcgtgcttgaagcgcaaccagtgattctggaatgcaatggcccatggattctgtgtatatcagcggtgggtatgtgctatgtctggaacgtcaagcatctttcttcccctcaccctcccatctccctccaaccggtcctcgacgcggcaattcacacgctgggtgcgcatccgtccgcggctccagcgatcaccaatgcgcgaatcaactcggagggtcgggtggtggtcgcattgtccaatggcgaagggtactcctattcgccttccatgtacacttggcagcgcgtctccgaggcatggtgggctgttggcagtcaatactggaactccacagaagctccggtgggtaacctgcagtctgcgggaccgcagcaagacaaagagaccacggccgccgtctcagctggtattattccgttcctggaacgcaatacgacaaacgagacgcctctccgcggacgagcgtacttcctgcagcggctgatcaaagtcctcttatctcgcgagggctacgagagcttcgagtcaagtgtgtctattgcccatatggagaacagacttgccgcagcgttatcgctgggagctaaagaagagttccgcctctatttgtctatgtatgccaagcgtctcggggcggagggcctcaagatgaaggttgaggagctgctgaagggtctgattggtggcctatttgaggaggaggacgagacaggcgcaggccgccggttacaagcgaacgaaaaggaggatcgaaactggcaggagagctcggacaccctctgtggctggccacgcgaggtgctgttgaaggaggtgattttagccttgggtaagttgcagggcattccttcctcttcacttgatgcacatatgtcgctaactctactttttctttgtgccatcaggtaa

SEQ ID NO: 13800 - DNA, 2097 bp, A.fumigatus
attccgcttcaagcagaaatcccctgccagtcgattcaccagtcgactcagcagcgtcatgcagaagccccttcccagagaatggcttctcagtggttctctccctgcgcaagttcgaaccccgatcttatcaaggaaggctttgtcatacccttcggccctgacaacttccggctgatcgttgtctcccaggagtatgcaggagactgggactccaaggagaagtggtacggtaccgagtacaaagtgggcaagatacccgaggacttcatggccgacatccgcgaagcgttggacaccactccagagaccagactgtctgatcttcatatgccccacaagaacgagttcgtcccaactagactctcggtggagaagaaagaagtatcagagccagcgaagacgcccaaactcattcgccatgacgaccatgtgcgcctctggttcaagaaggacgaccgtttctgggtccccaaaggcaccgtccatatcacgctcagaaaccccctggcatgggccacccctgcaaacttggtaaagtcgaagctgtattgcgaacttgtcaaggatgctttggtggaatactcatacgatgcggaacttgctgggcttgactatcacctttccgccagtgtctttggattagacgtgtctgttgggggttacaacgacaagatggctgttctactggaaaaagtgtttacgagcatgcgcgacctggttgttaatccgaatcgcttccatatcataaaggaacgcttgtctcggggatatcgcaatgcagagtatcaacagccgttctatcaagtcggtgattataccagatatctgacctctgagaagacatggatcaacgagcaatacgcggctgaattagagcatatcgaagcggaggatatctccagcttcttcccccaactactcagccagaatcatattgaggtccttgcgcatggcaacctgtacaaggaggatgcccttaagatgacggacttggtggagaacattctgcaaagccgccctctgccccagtcacaatggcatgtgaggcgaaacattatcatccctcctggaagcaattttatctatgaacgcacgctccgagaccccgccaatatcaaccactgcattgagtattatgtttacgttggaagtatcacggatgacatgcttcgagcaaagcttctgctgtttgcgcagatgacagatgaaccggcctttgaccaacttcggagcaaggagcagcttggatatgttgtttggagtggcgcacgctattctgctacgaccattggttatcgagtcattatccagagcgagcgtacggccgagtatctcgagtcgcgtatcgataacttccttattcaaacaggagagacattggaaaatatgtcggagaaggatttcgagggtcacaagcgcagcgtgatcaacaagaggctggagaagctcaagaatctgagctccgagacatcgcggttctggagtcacatcggctcggaatatttcgacttcctgcagaatgaaagcgatgcggccaacgtcagggctttgactaaggctgatatcgtggacttttataagcagcttattgaccctcgctcacccacccggggtaagctttcaatatacctgaacgcccaagggggtgcgcacaccaaactcgaaggtaaagaccagcagtcccggctagtgtcactgcttggaaagcaattggagggcgccggatttgccgtggatacgagccgcatgagctctgtatttgagagcgctgatctctctgctagtgacgcagaccagcttctcgccgttttgaagaagttcctgctctctgaaatgagcttatcagagcagcagacagcaccggtgcttgagcaagcgcgacagaacattggtcttcatgcgaagcaacttggcattgaaaccgtcgaaaagggttccaagcctgtgactaatggcgttggccagcccaagactgatagaaaggtgacctacattaccaacgtgcctgagttcaaggcacgcatggttatgagcgctggacccatcgcggtcacagatattaccgagtttgaggatttcgacgccaaactctga

SEQ ID NO: 13801 - DNA, 738 bp, A.fumigatus
aagtacggcagtgagtttatcaagttttaccagaagcattattcagcgaaccgaatgaaattatgtgtactcgggcgagagtctttggatgagcttgaaaaatgggtcgaagagctgttctccgaagtggagaacaaggacttgccgcagaatcgatgggacgatgttcaaccctggaggcacgaggatttgggcattcaaatcttcgctaagcccgtcatggatacccgctccgtggacatctacttcccgttcctggatgaggaaacgctctacgagtctcagccgagccggtatatcagtcacttgattggccacgaaggacctggcagcattttggcttatatcaaggcgaagggatgggctaacggcttgtccgccggcgtcatgcccatctgtcccggagcggccgctttcaccatctcgattcggttgacaaaagagggcctgcagcagtaccgagaggtagctaaggtggtcttccagtatatcgcgatgctgaaggaaagggagccgcagcagtgggttttcgatgagatgaagaacttggccgaagttgaattccgcttcaagcagaaatcccctgccagtcgattcaccagtcgactcagcagcgtcatgcagaagccccttcccagagaatggcttctcagtggttctctccctgcgcaagttcgaaccccgatcttatcaaggaaggctttgtcatacccttcggccctgacaacttccggctga

SEQ ID NO: 13802 - DNA, 1044 bp, A.fumigatus
cattacaagatccgtgttgcgaaattctcggaaaggccagcagcaggatgttctggagcggttactcagtctagaaaaagtctgctggactggtgggctactttaccagaggagaccgattgtcgagacttgaacccctccggacccctatttcgttcgaatgtacacttgaaacttgactactgcttaacgagaatcttcattgggcgacccttcctattcagcaacatgaagtccaccaacccagctggattccaaggtccaccattcaaggcaacccctggactttcgaaaaactggtcaacgttggtcactgactgcgtcgaggcggcactcgagatcatcgatctctgccggctcctccgtgatgaatccggccttgcccgagcatccttcaccgaattcagctcctgtcgcgccgcgctgctggtcattctagcccagagcttaaccaagcggacagagaggctgcgcgaagcgctagaaaaaggcatggccctgatcaaaatcatgtcgatgggagtgggctcggcgaggtccgccgtcagcgttatcgaagcactcgagcgggccattcgccgtctcgaagagtggagcgaatctcaggctcaaagaaacgccggtgtcgtcgagtccgcctacgaccgcttcaaaaactgggagatgctatggaagaccggaccgatctcgccagggacaacggtcacgttccctgaacagtatactccggcacgccctggcacagggatccccgctgtacctgtcacacccatgactggcacggaggcaggcaacgacgccatagaaggcgatgtcgccagcacagatcttgccagctcttcggacttttccgcgccccatgcgttctctcaaatgccgcccttgggcttcgaccactttgtctctaactttccgcaggaactgggcgagtttactgccattccttgctttgagaccgaccctcaacagggccttgggagtgacatgaaggcgtcccaaggatgtccaccggatacgaggtggatgcagtttatgagcgaataa

SEQ ID NO: 13803 - DNA, 1128 bp, A.fumigatus
cggatacgacagagtcttaatttccaggcgacggcggagaaatacctcttcaagcagcttgtcaagacgaagcggattgccgagtcgcctgtctttctgaagttcaaggagcggaagaatatctctacggaggggccgcgcagcacggctgaggcgaatgtcacggcgaggctttacaaatcgaatccggtgaagaatgtctttccgggaattatggatgggatccggcaattacttgggttggaggctgcggctgcagggaagaagaatgtgtcagaacagaagaaggggtccacagaccaacggaagagtgaaagcaaagagccatcgttagatggaggatcagagctggaggaggaatctgacgcagacagccgaaagactgcgtccaaggccgctgcgaggtccgcgaaggtagcttccgaggaagcagacagggaagaaggaagcgatgtcgacatggacgacgccgagagcgtagactactcgcactttgacgcacggctggcctcagactccggttcccacagcgatggcgaaagcgacgccgaagaagcctcagactccgacaactccaacatctcccgctctatctcccgatctccctcccccgaaaaacccacgaaaaagtccaaaaaagccacctccaccccagcaacaagcacaaccttcctcccctctctgacaatgggagggtacttctccggctccgagtccgagcccgaagacctcgaaggtacagcgggcccgccgcgccggaaaaacagaatgggccagcaagcgcgccgtgccctctgggagaagaagtacgggagtggagcgaaccacatcaagaagcaaaaggagaatgaatggaagaacagggatagtggctgggatgcgcgccggggcgctacggatggcactgaagggccgagagggaagcgtgggctgggccagggacgaccctggcaaagaaataacaattccactggtggtgaccggccgcagcgtggtcctccaggcggctccaacaagaagaatgtcaaggatgataagccgctgcatccttcttgggaggcggccaggaaggccaaggagcagaagtcgatggcggcgttccagggaaagaaggtcacgttcgattag

SEQ ID NO: 13804 - DNA, 429 bp, A.fumigatus
ggtaatctttcacaatccgcatttcggccttggtggtgcctgcttagacgtcatagtcggtccggagaacctcgatgggatactgttaccagctcacacgatcgaccaacatgggccaaatccgttgaatgggctaaggcagatttacttcaacctgacacatataaaccattcttgcgtgatgccgacgtcgtggtccatagtatgggcatcctacttgaagcggattacaaaggcgtggtacgagggaaggagcccgttatcagtggcctacagagagcgttcagctcgtcgaagctaggtagtcagaaccctctgacaaggcgggatggagagcggctggagcctaaggaaagggacggacagttgacatacgagatcatgaacagggattctggttcgtatatgttgggactatcaattcgctaa

SEQ ID NO: 13805 - DNA, 456 bp, A.fumigatus
agctgcggagctgacagcaaactggaaacaacagccattgcactagcgaaggagtcatccagcgaacatgttccaacattcgtatacatatcagccgcctcaggagcaccaatactacccagtcgatatatcacgacgaagcgagaagctgagacgaccatagagtctaaactgccagagctgcgaagtatcttcatcagaccgcccttcatgtatgattcaagcagaaaattcacacttccgatagccttgggtggctttgttgcctcccaattgaacgcactcttgggggacaggcttcgattcctcggtgcgatggtcgataagcctttccaggtggatcttgtgggcgaagctgtagtggaagcgatggaggacgagtccattcgcggcgcggtaggaacgaagcagatagaaaacctggcaaccaaagcgtggagaaaaagcatgctttga

SEQ ID NO: 13806 - DNA, 816 bp, A.fumigatus
gtaacctggtcgcaaccgtcaactgatcctccatttcttcccacttgccttccgacagtcgtgcatatgctgatgctcaaacagaaaaatgcagctgagcgcaacctgaaagaaacggcggccgaaactcagcgtctagccaccgatcctgcattgctctcttcattgtcgcgcaagcacgcatttgcatctcacaaccttctcaaagcagatacagaagctgccggcgaagacttcgagcgtaagagagcctgggattggaccatcgacgaatccgaaaaatgggatcggcgtatggagaagaagcagcgtcaccgcgatgatgttgcgtttcaggactacacacaggatgcacggaaagtatacaaaagacagctacgccaaatgcagcctgatatggcagcctatgaaagggagaaactggctgcgattgagaaggcagctgcaaatggtgacttggagatcgttgaaaccaacgacggtgagatgattgcagtcgacaagaacggtactttctattcgacggcagatacgattggttttacggagaacaagccggatcgagccggagtcgacaaattggtcgcagatttgagaaaggccgaagaggtccgacttaagaagcgcagggagcgccgcggcgatgaagaaccagacgtcacatatatcaacgagaagaacaaacaattcaatcagaagctggcacgattctacaataaggtatgccctttcacaaagacttccgcttttcgaacggaactaatgcctttcagtacactacggagattcgcgacagtttcgaacgtggtacaatga

SEQ ID NO: 13807 - DNA, 3018 bp, A.fumigatus
tatcgcttcagctgtcttgtcagcatgggtgttacgggcttgtggacagttgtccagccatgcgctcgacctatcaagctcgagacgcttaataaaaaacgtctcgcggtcgacgcgtcaatctggatatatcagttcctcaaagccgtacgagacaaggagggtaatgctctacgtaattcccatattgttggtttcttccgtcgaatatgcaagcttctgtatttcggaataaaaccggtgtttgtttttgatggtggagctcctgtcctgaaacggcagacgattgccggtcgaaagaagcgccgtgaaggccgcagagaagatgcagtgagaacggctgggaagctgcttgcagtgcagatgcagcgatccgcagaagaggaagcagccaggcagaaaaagggagcttcgagacaggatgaagaggaggtgccggacaacccggtttatgatgaggagacctacctgacagagaaagagaagcggcagggccgagcgttcaggaagacggatgcgtaccatcttccagacttgcacgtttcgttggaggacatgggagctccaaacgaccctcgcattatgtctcgcgctgagctggaagaatatgcgagacagttccaccagggggaggatatcaacctctacgacttttccaagatcgactttgacagccccttcttcctcagtttacctgctactgatcggtacaatatcttgaatgctgccagacttagaagtcgcctacgtatgggctactccaaggaacaattagacaacatgttcccagaccgcatggcgttctcgaaatttcagattgagcgtgtcaaggaaaggaacgatctcacgcagcggttgatgaatttgaacgggatgaacggtgaagaagccttctataactcagggcagcgaatcgccggcgaacgaggaagagaatacgtgctggtcaaagacaacgcagttgagggcggctgggtgctcggtgttgtaggcaacaaaggtgaaggtcatgccgatagacctattgatgtggaccgatacggccagaaagatgtgacttatgaccacgaagaagcttcagatggggatgatggtgcatttgaggacgttcctattgaaggtctcaaccgacttcccaagcttaatttccctcaaaaagacgcattcaacgaaccgattgagaagccggtgaccagtgtttccagaaggcgcgattcgttgttccaggagactgaggataactccctctttgttcaagacggtgacctagcaggtgcactgcctcatcagcgcctccacattgatgactttcctggcggcactgtcgacagcgaagatgaagatctccaaagagcaatcgcaatgtctctggagccctccgcttctcgtattgaagacatgccagatatcccacttaaccgcaacgacgtgcccgctgcgccgccaaaggagacttcgcctggtcttgcggagagtgacgatgacgagatggactttgccgctgcattggcacggtctcgcaggaaggaaaggaagccatacaattcagttccccgcccggtcatggaccatccgttcgagggaccatttccttttgaatctatcagattgaacccttccaaggcggaaaatcctccacatgaggagcttgatgaggaaggggttgggtttgaaaaagagtccgcgaagaaggaggaaagcttgccgctgcccccttggttctcgggggagcagctgaatgaagaatttgtcgccgataagattgacaatacctcattggaagcttatcgggatagagcgatgaacccagaccatctgttccagaaagaacatcgatctccggatgtgatagatgtcgataagataccaggaccagaggaggttatcgacctagaagcagaaccgaaggcggagaaaccagatgttgcagtactttcacgtccagaaaacgcgcaagtacacttggacgatattgcagtaccaaagttctccggtaaagacaaggcagtagaggaagtgacatgtgaacagagagctacaggcggcaaaaccccattgaccgagaccaagaaaaatgttgcacatgcctctccatcgcctgagcccgagttcgaagatgttaccatacagacagaaacaaaaccgacagaggtcacggtgaccagaaaccagcctcaaatctttgacgagagtgatcaagcacatgtggttgtcgaggatgacgatgacttttccgacccagaagacgaagagttgatgcgacaacttgcggctgaaggcgaagagcacgttcgattcgctgccactctgaacaacaatgtgcaacaaagcagcacatttgactacgagcaggagctcaggcagttgcgatcccagcagaaaaaggaccgtagagatgcggatgaggtgacgcaggtgatgatcaccgagtgtcagcagctcttgagcctttttggcttgccttatataacagcgcctatggaagctgaagctcaatgcgccgaactggtctcattaggtctggtcgacgggatcatcaccgacgacagcgacattttcctctttggcggcactcgcgtttacaagaatatgttcaaccaaggcaagttcgtcgagtgctatctcacctcagacatggaaaaggaatatgcgtttcatcgacgaaagctcataagtctcgcgcacctcctcggtagcgattacacagaagggatcagtggcatcgggccggtgaccgcgttggaaattctcacggaattttccagcctagaagagtttcgtgactggtggacacaaattcagacggggatgtacgtccctgagacgcacgcagctttctacaaaaagttcagaaagacagcgaccaagatctttatccctcctacttttcccaatccgcaagtagataaggcgtacctcgagcccgaggtcgattccgatccatctccgtttcaatgggcgttcccgacctacatgggctgcgaaccgtccaccgacggggatgaaaggatacgcgtc

SEQ ID NO: 13808 - DNA, 213 bp, A.fumigatus
attacccacattggcttgcttaagagatcactattacaacggcggttttggattatgaaaggcatttttgtggctaacaaggcgttttcattgcaggtattcatgaacatcgtcctcgacgaggctttcgaggagaagcaggggggagagaaagtcgctatcggcatggtggtacgttgcgcaaattggaggactgcagtgagcgaaggctaa

SEQ ID NO: 13809 - DNA, 1392 bp, A.fumigatus
tattccgatcatttctacgtcgccactttgatgcagtcgctatgccatgccatgcttggcaaagtcgaatcccgtgatgtcgacatcgatgatttcgacatggaacgcatgcttgagatccaagctgaagagcagttggaaaaggacgctattgcggaatttgatcggtacaggagaatggacgaatggtctagttcgtttcagaacgtctactctcgtgcagcactgcgctgtcaaatgcaactcatgcgtgccaagatattggacgtggacataatgcaatttctaccatacacccgggccggaacttacgatcttctacgcgccgatgcctttgaatgtctcgtcgagctcgatatattcaaaagtcctgagcttgtgaaatggttcatgttcaccatgtcaagcgactcttccctttggctcagacgacggcttcatgatttgttcggcaaggccttggcgccagttgcctttggtcgtgaaccggaaaatgagccctccgctactgccgacagcttgataatcgagcaagaatcttcaaccaaggttcgtcaggcggatctcgcgaggaagcaaaccgtcactggagccattgaggcgctcaaaggggaaatatctggagatcaaaatttcaaagaatgtctctgggctgcatgcaactctcccggcattggaattcttgaactttctgtattcacagatctgtgcaaagtcctgtatgactcggtcacgtcggtgatggtaaagttgaagtacccgcggtattggcaagtcaagcatcttggcaaggtaatcccgttccaatcttggatttcaaatctgatactaatagcctcagggccgcatgcatttctcacggtccaaccgaatcaggactaccctcgcaccctcaaaagattcctccacaagtgggaagcgcaaacgcgaagagaaacggatgcctccacctgggccccgtatcacattcaagcaatcgaagctgggctcaaacaccccctcagcaagtcctcatccaacctcgcaacccattccgaagctgcacatcccaaaactctccgcttcgccggcacctcagccaccgaagacgccggctgctccatcgacgccgtcgacaccaagtggtggcggcggcgggctcaaactgaaactcaaattcgggcagaagccgaaataagttgcctacccgccgtggtattctatcgaaacttcttcacctctgtactttttacatcgcatttattcgaaacctggaggggaatggttgaacaagcgtcacggcgcatggttggcagacctgtttcaaacgatttatacatgttgacttttattatcttctacgacggagctgcgtgctcacttgcattggggttcatcgggttctttgtgtga

SEQ ID NO: 13810 - DNA, 753 bp, A.fumigatus
agatcacgcatgtgcctgaatgcccgaatgggggacatacccaatggagcgatcacctcttcccaattccaaaagatatgcgaacgacttggccacgcgaagttggataccttcttccaacaatgggtttacggtgctggatgtcctcgatttcaagccacgcaaagattcaataaaaagaaactggtggtggagatgatgatcaagcaagttcaagctgatcagccaagtacccgtgatctcgacaaaaacacattcatgcgcgatgtcaaagaggaaattcgaggagtctatgccggaaacattcagccggtgttctcgggttccatgacgataaggattcatgaagctgatggtactccttatgagcacatcgttgagatcaaagaaggtgtcaccaagttcgacataccttacaataccaagtacaagaggctcaagcggaacaaacggcaaaaagagcgtgcagctgcggtatccggtggggacccaaatgcggaaacgcaagaggatgtgctattgtattgtcttggtgacgtacttcagactgaagaggaaatgcaggagtggagactcgcagactggagtaaagaggatgaggatcgaatgggtcaagagtcgtacgagtggatccgcatggacgcggacttcgaatggatatgcaagctgtcgctagtgatgccgggttatatgtacctctcgcagcttcaacaagatcgcgatgtcgtcgcgcaattggaggtgagcgcataa

SEQ ID NO: 13811 - DNA, 450 bp, A.fumigatus
tctctacaatacatggcagctcagcgagagcacccccttatctcaaccatctttgttcggacattgatggatcggagatacttttatggtatccgtgaagccgcagcgagagctttagtaaaacatgcaaaagaagaaaccaactggttaggactctttcaccttgaaagggctttccaagagctgttctgcctccctgggtcacccatgactcgctcgaacgatttctccgaccgggcggcatacgcgctccagcttgcgattccagaagctatatctaaagtgcgcgataatgacggaaagacaccgttgagagtcaagcgctttttatatgataagctgaaattcaatgacaactctaacaatgaggtgagcaagtcgttctacaagacgcttacgatccgcttacactttattagtattccgatcatttctacgtcgccactttga

SEQ ID NO: 13812 - DNA, 423 bp, A.fumigatus
tcaagatggtacctactagatggtcaacccgccaaacgacgcggtcccaagccagacagcaggcctgccttgacacgacgacaggaactgaatcggcaggcacaaagaacccaccgcgagcgcaaagagcaatacatccggtccctggaaattgaagtttcccgactccgggaggctttcactcaggagatgtctgcagcaaacctcgccgttgtccagcatcgagaaatgctgcagacggtcaacgatgagaatgcgatcttgaaggaacttcttaccgcacatgggattcaatttgaggccgagttggagcgtcgcagggcagaacgacgctcagcaggcagaggtttccagtcaagcccgttggctggcagtagtgtggtatcccaggcgccggcagcactagtcttcaccacggggctg

SEQ ID NO: 13813 - DNA, 1197 bp, A.fumigatus
gtgtttcttgggtccttggacgagaggcagctaggctcacgcacatcttcagccgtattgcctgacacggtcgccaaagaatcccaattgacggttcctacgacagcccccgaaaccaccatccccgaagcaactgctgccgaggccgccgctcccgtacccgtcgtcactgacgccaacgcaccagtgtcggaggtgccggcggaaacagcgctgcccgagagactcaaggagaaagacacctctccggccgaattgacagccgcatccccgtccgagagtgtggacttgactggccatgcaaagcgcccatacgagagcagcctcttccacaaggacgaggagcacaagcctcccaagatggccaaggtcgaggactctgaagccgcgcccgcagccacagaaaccaaagctggggacctgcaacccgagaagccaagcgagtctacagtgcaacccctggttgtcccagggcttggtgctgaatccgcagacacgtctcagaaggtggagtctgcagaagctgttgccccgaccaccgctccttcagctgcccaggctgctgcctccactacatcccctgtcgttcccgctgcagttgctaccgcaggtgcagagagcgaagccgacgcggaggccagacagaagcaggaggttaaagagagcatccaagctttcaccggcgagggacaggcccccccgtccaaggagccccagcaagagccccagcaagagccccagcaagagccccagcaagagccccagcaagagccccagcaagagcctgaggagaaggccaaggaaaaggcccaggagaccgcgcccgtcaaggcgactccggagactcccacaaaggccaaacccaacgtcgctgccgctgctgcggccgcagccatgagaggaaagtcggctgcttcgccggcacctgccaccgaagccgccgagaagacagctgccgaacccaaggagactcagcctgatactcatgaccaggtccccaccgagactccacggggagaagagacggctgcaaaggagacccagcagcccgaaacagccgagggcaggaagtcgcatgaggaggcacaaacggccgttgacaaagctcaagaggcagctaaagccgaagccgccaaggcggacaagcgcaagagtggcttctggtcatggatcaagcgcaaggttaagggtacttga

SEQ ID NO: 13814 - DNA, 606 bp, A.fumigatus
ctggccatgcaaagcgcccatacgagagcagcctcttccacaaggacgaggagcacaagcctcccaagatggccaaggtcgaggactctgaagccgcgcccgcagccacagaaaccaaagctggggacctgcaacccgagaagccaagcgagtctacagtgcaacccctggttgtcccagggcttggtgctgaatccgcagacacgtctcagaaggtggagtctgcagaagctgttgccccgaccaccgctccttcagctgcccaggctgctgcctccactacatcccctgtcgttcccgctgcagttgctaccgcaggtgcagagagcgaagccgacgcggaggccagacagaagcaggaggttaaagagagcatccaagctttcaccggcgagggacaggcccccccgtccaaggagccccagcaagagccccagcaagagccccagcaagagccccagcaagagccccagcaagagccccagcaagagcctgaggagaaggccaaggaaaaggcccaggagaccgcgcccgtcaaggcgactccggagactcccacaaaggccaaacccaacgtcgctgccgctgctgcggccgcagccatga

SEQ ID NO: 13815 - DNA, 471 bp, A.fumigatus
gtctccttgggttcggcagctgtcttctcggcggcttcggtggcaggtgccggcgaagcagccgactttcctctcatggctgcggccgcagcagcggcagcgacgttgggtttggcctttgtgggagtctccggagtcgccttgacgggcgcggtctcctgggccttttccttggccttctcctcaggctcttgctggggctcttgctggggctcttgctggggctcttgctggggctcttgctggggctcttgctggggctccttggacgggggggcctgtccctcgccggtgaaagcttggatgctctctttaacctcctgcttctgtctggcctccgcgtcggcttcgctctctgcacctgcggtagcaactgcagcgggaacgacaggggatgtagtggaggcagcagcctgggcagctgaaggagcggtggtcggggcaacagcttctgcagactccaccttctga

SEQ ID NO: 13816 - DNA, 831 bp, A.fumigatus
gacgtgtctgcggattcagcaccaagccctgggacaaccaggggttgcactgtagactcgcttggcttctcgggttgcaggtccccagctttggtttctgtggctgcgggcgcggcttcagagtcctcgaccttggccatcttgggaggcttgtgctcctcgtccttgtggaagaggctgctctcgtatgggcgctttgcatggccagtcaagtccacactctcggacggggatgcggctgtcaattcggccggagaggtgtctttctccttgagtctctcgggcagcgctgtttccgccggcacctccgacactggtgcgttggcgtcagtgacgacgggtacgggagcggcggcctcggcagcagttgcttcggggatggtggtttcgggggctgtcgtaggaaccgtcaattgggattctttggcgaccgtgtcaggcaatacggctgaagatgtgcgtgagcctagctgcctctcgtccaaggacccaagaaacacctaccttgtccctcaccatctcctgcgtccaacgatccgaccagacccgccttcgaagcctgggtcttgccgacggcgcccttcagggtattctcattcgcttcggattcggcagctgctcctgtatccggcaaggaagacggcatgcggagtccctatgcgtcacccggatgctccgccaacgagaacctcttggcggtgccgggacccgaaacctgctctacttcctcgttggatgagtcgccattgtcagtggtttccgcggttgacgtgccttctgcgcctgtgctcgttttcaccacaggagccaaggacccgcgcaaagcggaag

SEQ ID NO: 13817 - DNA, 618 bp, A.fumigatus
ccagaagccactcttgcgcttgtccgccttggcggcttcggctttagctgcctcttgagctttgtcaacggccgtttgtgcctcctcatgcgacttcctgccctcggctgtttcgggctgctgggtctcctttgcagccgtctcttctccccgtggagtctcggtggggacctggtcatgagtatcaggctgagtctccttgggttcggcagctgtcttctcggcggcttcggtggcaggtgccggcgaagcagccgactttcctctcatggctgcggccgcagcagcggcagcgacgttgggtttggcctttgtgggagtctccggagtcgccttgacgggcgcggtctcctgggccttttccttggccttctcctcaggctcttgctggggctcttgctggggctcttgctggggctcttgctggggctcttgctggggctcttgctggggctccttggacgggggggcctgtccctcgccggtgaaagcttggatgctctctttaacctcctgcttctgtctggcctccgcgtcggcttcgctctctgcacctgcggtagcaactgcagcgggaacgacaggggatgtagtggaggcagcagcctgggcagctga

SEQ ID NO: 13818 - DNA, 1848 bp, A.fumigatus
atatgggcactcacaagaagtacaggcatcagacaattcaaggactttctcacatccatcggtcagaccgagaaggagggtgaaaaggccaagaagtttcgaattctaaaggcctattgtgatacgcaaatctctcgtaacggggcgggagatgaggccatctgctttcctgaccttattcaaacatggagctttgcggatagtagcaataacgagtccctgttgactgttgtcccgtccgtgctagctatttttctcaaaacgatttccactcaactagatcttcgagacttcggtttggccctgtgcaagcatctaatgcacaaagatcagctgagactctttaatcgtggtctaactgcacttaagaccaaggaacatctgatctcgccatgtcttcgtcttcttacggagattgtcagtttcgacggcggtgcggtggcccgacatgtctacatggcacggtacatcacattcaaacgcctcgatgtctttttgacaccgaataaggcccaattagaggaggccgacgaatcgcacaaatctacattgcgaagaaatgcgcaaaaatatgttcttgcaaatcttagagttcaacatgtgaatgcgaagactgatttagttgagcaacacaaggtgatcaaagcattcctggagtttgttaggaaggatccacgagatgttgttctggaaattatcaaatctatcgacagggatatcattcaggataccactcttccgcgaagtgcaaaaaagaagttcttcagtcgatggaacctcgagcgacttgtaacgctgtatggttacgaccgcgaatccgaggagccaaacccggctgggatctccattgcagacgaggttcacaaaatccttatgaatatttgtacagatcctgctctgggcgtcttgttaccagaaacaggctggtacccaaatggaactgaccccgagaccttaccgactgaggatgactcttccattgaattgggattggactccgctttgtacgtggataaatacaaggaatcagtgcctgtccgcaacagcactctgtcttatctcattcaagcgcttcgtccggatatggaccgcctgcagatcgagttattgattgccatctttaagaagacgccggaacttgtcgccgattacttcacgaagaagacaatgttcatttctgacccaaaacccacgtcctcctggatggccgagtcagctcttctctattcaattgtcagtcttccaatcccgttaaattgtggttggaatgacaagctccctactttgccgccgcctgtttcggttgtcatcgagaacattcttccccgtccgcttacccagaaaattatgactcgctgcttgaacctcaacgcggagattgtaacactgttcgctgttcgaatcctgacgatcgcgttcaataagctacgggctgctttgaagatattcaacgccgaccacggatccagccagccattttggacacaagctgcgggaaaattagttgcagagttttgtcgtcggtgcccggtggtcaaagatgttgtagtcttgttcagaagaacgagcaaagaggacttgcagcaacaggaggccgttagtgagcttctggcttgctactacgaaatcgtccctgatgctgcttttgacgagaactttgacgtttcccttgttctggttgatatattggaacggctagagagttccaatctacaagcagaggatggcgagtcacttctgagccaactgcaaaatgtccttaaaattgcacagttgtcggcttccatgcgatggtggcaacaaccaggtaagcagcggcggcaacgtcatttgaaggtcctacattaa

SEQ ID NO: 13819 - DNA, 843 bp, A.fumigatus
cagcacccaggatctatgcaatattcagcctttacatccattctcaaagtgcttatcaaaacctcggacaaagaatcctctaaggaaatcgagaatttgttgacaacggttctgaaagagaactcgatcatccgaaattcctccgccttctcctccctccggtctagcttcgatgctaccgagtcggaaagcatcggttatcaattggcattttttgataattgcgcatgcagaatcgcgaagaagccagtccattacgatgatttactcgcatctctgactgaaggcgagaatcaaccgactagccttatcgttgctgctatcaccgaacaatggccatttgttgccaagaatgggaatgcagccgcagaacttgctgtatgcacgtggattgctagggtgttcggtagattgaagcaggcaggagacgacccaaagactctgaaggccgctcgagataacgttttacaaacaatcgtgagcaagcaaattaaatcaacgctcaagaaagtcctaaaagacactgatgagactaccgataaagatggcatgcctcaggatggagtgagtcgctcggagcccaatggtacgaaagacaaagcggcgcaggtggatttgagggagatctttggcactcttccgactgaaagcaaaacccataatgagcttcacaaatgggagaaagaagagctcgagatcgcggtggaacagggtcgcatctctgatttggtgctgtgcttgtgctcggaacatgaggaaattcggagacaagcatttgctaacctgcatcgattcatggcaaagcttagggtatgtttctcatgcacaattaacgaggaatga

SEQ ID NO: 13820 - DNA, 363 bp, A.fumigatus
ctaacaagatctcaggagtccaaatatgctgaatggcgatcagtgtacatcctgactggcgagttgctcgaaaccgtgagactgacgggattcgaaagtcccgtaccgtggatagttggggaatgtgctacctgctgtctctccgtgctcacaaacccaatgcacaaactttatggcaaggtcaataagtttctccagaaggcaccatcttgggaggttggaaagatcccgtcgtattggattgacaaggttttgttacatgaacctgagttggacgatggttactttgaggaaactagttggcttttggatctgctcataaagggccttcgcactgagcgggtaagcgaacatttcttgtaa

SEQ ID NO: 13821 - DNA, 327 bp, A.fumigatus
ctcctacaggatatggacatctaccgtcgcgcaaatgtgttcgagcgcgtgctctcattctatgactcacctactgtgggagtctctgccaaaaggaagattttgcatctcctgtaccggtcgacacaggtcgggggcagtacaaccttagttaccagggcaggcgttgtcagttggattcaaacccagctcccggtagtgaatgctaaagaggctgctacctttgcagctatggccgataccttgcatctaacagcggaccaggaccgagtcacgaaatggagtgacggggcagtggctcaggatattgaacatatagcaggatag

SEQ ID NO: 13822 - DNA, 234 bp, A.fumigatus
  unsure (176): Identity of nucleotide sequences at the above locations are unknown.
tatacgctgggcgcctttaacccctttggggcattgcacaatggtgaacacacgttttgcgggccgaaggactttttccatcccgaactctctttcttcgcccgcaaaatcgaatggcccccatcgttccccctgaataaatttctcccggtgaacaatgaaatgttgttcatttnatcttcctacccacattatccttggacctgcgctggtcaaaccaatcccaaaacataa

SEQ ID NO: 13823 - DNA, 237 bp, A.fumigatus
tgcgttgggtttacgcgtagcgcggatccttccggccccgtggtgaagactcttgaatttggcatcaatatcattatcagcgaacatctgccgggagtcaattattacggcgtgtctggttcgacctttatgaaactcacagtatatttcatgccattttgtctgttggggaaaatcgccataagcgttgacgccgtatggacggtgcccagattctgcatcaacgcctccgagtag

SEQ ID NO: 13824 - DNA, 183 bp, A.fumigatus
tgggccttaaaacggttcctcaaccctgtcatggtggttaaaaacaacctaatcaacctgcagcccctggcccaacacttttgggacaaggatgctttgcccaaaagggataatccccctggaattttggcacaacgggaacctaaacagtccagttggacttctggcaacggtatttcttaa

SEQ ID NO: 13825 - DNA, 1017 bp, A.fumigatus
atcaactttctgcaatacggactgaccttgacagaaccaaacaccaaggtcactgcagtcagcatggttgtttggtccagacaggatgaacgcatcctggacatggacaaaatttcgtttgccttggactcggtcagctgcaccgatgggatgaccctcaagttcaaaaacaagctgttctatcttgctgccaagttcgcatgggagtgggtgaattacaacgacatgcgcagttttgtaatggtctccagctgggagggatgcggtactccccgcgagcgagacccctgggtggttagcaacgctgtctttgacgacaaggcctcaacggccaagctcgcagcgaccaagagtacgtggcagaaggtatccaacaccacggttcttgactttggagatatcgtcgttggccatcagggcaccaaggacaagcggttcctagatgtcagcttgaacaaggcctttacgctcgatgtcagctcctcgtttcccacggagattgtcaactggaccatgaacaccccgttcgtggatgccagtctcgccatcaactgtgtcaactgcggcaccacaggcactctcgcattcgccggccatgtcgaagcgagtctgtttggtgggttggagaagttcgagctgtcggctacccctcgtaacatcgctgcgaatctggacctgagcctggagttcaaaggtgaggttgattttgatggcctcccggctccgggtaaggagtggacactggtggagctgccactacccagtggctggcgggttccaggggtgttgacattcggtcccaatgtcaagatcaatgcaggttacactattgaatacattggaggcgaggcatctgtcactacaggaatctcagcccgagtgcccgatagctcggtcgccaaggtaaattttggccagcaagaacccggtgaccatctcgggatggattccagaaatcgaaaccaagcctctcgagatcgaggcgcaaatccatgcgagagcaaaactctacactga

SEQ ID NO: 13826 - DNA, 345 bp, A.fumigatus
cctggtatgcacaaaaacaaactgacgaaagtagcggaacatatctatgagggcaactgggtccgtgactttatcgactatctggtaacgaattattatccagcaacgatcgaggatcccaacgtccaggacaacactaaatgcaagggagcgatcaacacttttggcatccagcgcgatatcagcacgccaaatcctaccgtcgcgttcaactactcggaggcgttgatgcagaatctgggcaccgtccatacggcgtcaacgcttatggcgattttccccaacagacaaaatggcatgaaatatactgtgagtttcataaaggtcgaaccagacacgccgtaa

SEQ ID NO: 13827 - DNA, 423 bp, A.fumigatus
gcagtaagcgttttccgggaggctgatgatttattagacttgataatcgtgccgacgcggtccgcaagcgacggatcgagaagtgaaatcaggcgagaaagacgtgatgcagattcagatgacttggtgaaaatgagaactgtcgtccttgcgggtccacgatgggaattagtcttttccttttcgtcggttccagatgatatagatacgtcagacgacgactctggtccgtcgcttgatgagctaccgtcttctgaagagtctgattccgattcatctgagctagactcgtcggagcttgtgtcatccgagctggtatcactcgagtcagagtcctcagagtccgacccatcagagctcgtgtcgtctgaacttgactcttctgtgtctgaagatctcgagaaacgctcggcagagcgttga

SEQ ID NO: 13828 - DNA, 297 bp, A.fumigatus
agtgagtatttatcctgccaaggcaagtcaaatggcacaactaacgtagtatgtagattcaatgaggaaatgatgactgcgggacaccatgtgaagaaaggcgatgaaatcgggcttttccaattcggcggctcaagtattttagtggcttttgaaagagaccggattcgatttgacgaggatctggagaagttgagccatcagcagatcatggtggatgttgaggtgggaatgagcttaggcaaagcaacgcagaaagggcatactgcaacaaatgcagtcacagcaagtctttag

SEQ ID NO: 13829 - DNA, 2019 bp, A.fumigatus
aggaggcagccaaggcgaagaatgacagtgcgcataacgggggcacctactgggccacttaccgcagaacccgtcattgcacagggcttagagcctcttccacaacctgaacaaattacagaagaaactgagaaaccaaactattcgtctctccctgcatggctggccaatcctgtccgagagccggcaagcaagcgcgccagattctcagaattagggatcaactcaaatcttcttcgtgtgctcgaagatcatggatacaaggaagcttttgcagtacaatctacggttattccacttcttcttcaaggcctaaggagacaccctggtgatctttgtatatcagccgccacaggttcgggcaagactctgtcgtatgtactgcctttggtcactgcgctgaaaccgacaccggcacccagaatgagaggtcttattgtagtgccgacaagggagttggtgaaacaagccagagaagcctgcgagctatgtgctactggttctgggcttcgtatcggttctgcagtgggaaatgtggcgatcaaggacgaacagcgcacattgatgcgtgttgaccaatgctacggacctgaactttccaaacaaaggcagactgtcgatcttactggagaagattggacgaatttcagtctcatgaattaccttgcagaggcaggagaattgagcgagtccttgccaggctatgttcagagggcggagccgaacattgatatcttgatttgtactccgggtcgtcttgttgaccatctccgttacaccaagggtttcactttggagcatcttcaatggctggtcattgatgaagcagatcgacttctgaacgagagctttcaggaatgggttgatgttgttatgaattccctagatgcccgtaaagctcccaagactttcggctccagcggtaaattcatggctgagctagggcttccgattcaaagcagggaacctcggaaggtcattctcagcgccacaatgacgagggatatctccaagttgaattctctccgactggcaaatccgaagctggtgatcattggatcggcagagcctactgcaaccgaagaagcggagcacgatggcgtccctacaacgtctgatgaacaattcactctcccctctaccttgaaagagtactcggtatctgttggcgatggttcgcaaaagccgctttacctccttcagctgttacagtctcatatcaacctggacacacaaaatcaacgctctgccgagcgtttctcgagatcttcagacacagaagagtcaagttcagacgacacgagctctgatgggtcggactctgaggactctgactcgagtgataccagctcggatgacacaagctccgacgagtctagctcagatgaatcggaatcagactcttcagaagacggtagctcatcaagcgacggaccagagtcgtcgtctgacgtatctatatcatctggaaccgacgaaaaggaaaagactaattcccatcgtggacccgcaaggacgacagttctcattttcaccaagtcatctgaatctgcatcacgtctttctcgcctgatttcacttctcgatccgtcgcttgcggaccgcgtcggcacgattatcaagtctaataaatcatcagcctcccggaaaacgcttactgcctaccgacgaggcaagatctccattattgttgctactgaccgtgcctctcgtggtctcgatctggtgtcgttgactcacgtcgtcaattacgatgttcctcccagtgtcacgacatatgtgcatcgtgttggacgtacagcaagagcaggcaaagagggctcagcctggacgcttgttgcacatcgtgagggtcgctggtttgtcaacgagatttcgaagggctcggacggcaagattacacgatccgccaaggttgagagggtgaatgtgaaactggacacctcggccgagatcaagtcgagatacgcggctgcactggacacccttgagaaggaggtaaaaacaggtggtaaataa

SEQ ID NO: 13830 - DNA, 273 bp, A.fumigatus
aaagattcaccgggcgactcggacgacagctcggaaaggaaagaggacaagcccggcaaagcgttacaatccaccaaagattctaaagacgagagaggcacaaattctgcgaagaacaatttttccggcattctgtccaagttcgaaagatccgccaagttgaaggaggcagccaaggcgaagaatgacagtgcgcataacgggggcacctactgggccacttaccgcagaacccgtcattgcacagggcttagagcctcttccacaacctga

SEQ ID NO: 13831 - DNA, 621 bp, A.fumigatus
agacgaacaagatgttcatggccagcacacagagtggcgggagcgagcacgcttcgcttaacccagggtgagggtgaaggcggcaccggtgccgcaggcacgagtattgtggtcatcggggaactgataggactcagcgcagttgacatcgccgggggcgcaggaggccgtggggcagctggcgtcatcgatggagacgccgaagccggcggcaatgaggggagaatcgggggagagattgatggaggagagatcccagaagagagtctcgccggcctcggtgtactcaaactggaggacggaggcgaggtcggcggcggtggagatcttgatggagacgccaccgccgttggggttgatgcgccaggtctcgacgtaggaggagccgggttggacggtctgcatgtcgctgctggtgtcggagacggaccagagatagacattctcgcccatgttgttgacgatctggacgccgccgctgggggcgcggggagcgagagggagggccgaagcagtgagggcgaaggcagcagcgaggctgaagaacttggagaaagacatgatgattgtggtgttggtggtagtgatatttgttgttgtgaaggagtgacaacagtctga

SEQ ID NO: 13832 - DNA, 624 bp, A.fumigatus
cactttggcgcgaggttgatcctccactgtcctttactttcaactgtcactctctgtagatcagactgttgtcactccttcacaacaacaaatatcactaccaccaacaccacaatcatcatgtctttctccaagttcttcagcctcgctgctgccttcgccctcactgcttcggccctccctctcgctccccgcgcccccagcggcggcgtccagatcgtcaacaacatgggcgagaatgtctatctctggtccgtctccgacaccagcagcgacatgcagaccgtccaacccggctcctcctacgtcgagacctggcgcatcaaccccaacggcggtggcgtctccatcaagatctccaccgccgccgacctcgcctccgtcctccagtttgagtacaccgaggccggcgagactctcttctgggatctctcctccatcaatctctcccccgattctcccctcattgccgccggcttcggcgtctccatcgatgacgccagctgccccacggcctcctgcgcccccggcgatgtcaactgcgctgagtcctatcagttccccgatgaccacaatactcgtgcctgcggcaccggtgccgccttcaccctcaccctgggttaa

SEQ ID NO: 13833 - DNA, 789 bp, A.fumigatus
tcctccactgtcctttactttcaactgtcactctctgtagatcagactgttgtcactccttcacaacaacaaatatcactaccaccaacaccacaatcatcatgtctttctccaagttcttcagcctcgctgctgccttcgccctcactgcttcggccctccctctcgctccccgcgcccccagcggcggcgtccagatcgtcaacaacatgggcgagaatgtctatctctggtccgtctccgacaccagcagcgacatgcagaccgtccaacccggctcctcctacgtcgagacctggcgcatcaaccccaacggcggtggcgtctccatcaagatctccaccgccgccgacctcgcctccgtcctccagtttgagtacaccgaggccggcgagactctcttctgggatctctcctccatcaatctctcccccgattctcccctcattgccgccggcttcggcgtctccatcgatgacgccagctgccccacggcctcctgcgcccccggcgatgtcaactgcgctgagtcctatcagttccccgatgaccacaatactcgtgcctgcggcaccggtgccgccttcaccctcaccctgggttaagcgaagcgtgctcgctcccgccactctgtgtgctggccatgaacatcttgttcgtctttacactcattttctacccctggaggatatgaaagttgtcaggaacacatcgaggcaggccttgtttttacgagtcatgactcatacggctcacgattatgccgaggatggattataccaacgatga

SEQ ID NO: 13834 - DNA, 1881 bp, A.fumigatus
tcctattcgccgaggcctggatccttccagccccgtggtgaagacctgcgctctgcatatatcgataagccaccctccagatatcaacttaggagcgcactttccaagatccttccgacagacgaaatggcagctgagacccgaagattctggagctctgagctacagaaatactctgagcttgatgcccccgcatggccggacctgacagggaagaggaagccagagaccgccgtacaggagcacaatcttatctccgagcaaatgcgcatgacggagcctcttgaaaagcttcagtccatctcggccgagttgggtgtctcctccattgcttcgctcattcgtgcggcatggggattcgtgtctctgagttaccttggtgttccagcggccgtgtttgctgagacagtttctgatcgtatactgcatgctgacctcgacaatggcattggtcccttgatatccgttgtgccagtgccatttgatcctgaagggaccgcccgggaggttcttgcagaacagcagcgaatctctacccagtcgaggaagtaccgccatatacacgctcgcgaggtgcgcaggatgttaaatcgtcctcgtggtgagcccttgtatccggcagtattcgccttccacccggcgggcgcagaggccgacggcacgaccaatcccggcctgtggcatgagcttgaggatcgaattgggttgcacgtggagcatcctatggcattcaatgtactgcagaatgctgatagttccctggtcttagaagtattttccgatgcatctctcatgagtcatgaacacctctctatctttgtccgtcaggtcgacagtctcgtcagcgcaatgttggcaaacccagacaaggagctacgggaactcatcaatcaccttcccccctcactcagatcaaaatcgtcgcagcatgtgtctgaggcggttagaaattcagttaccctcagtccaacgcactggctggaactcaacgccagggaacatccggagtggaccgccgtcgaagtggccagcagcatcagcgcaagcggcatcgagaagcaaagtatgagctatggtacgctcaatgctgccgcgaactgcgtggcggcctttatcgcttctgtgggatacaaaaatagaatgattgcagtttgcgctgggcggaatcttccgtcttatcccgtcattgtcggtgtcttcaaatcagggaatacgtatctcccaattgataataacctcccaaatgatcggaaaacatttctcattgaggatggaaactgtccgctggtcttcactgagactgcatttgcagccacattctcagatgtccctgagacgtgccgtgtgttgtgcattgatcatccctcctttgtagattcgctggcgggcatgcccaccgacaatcgggcttacgcaagtgatccacaagataatgcctacctgctttacacgtcaggctctacaggaaagcctaagggtgtcatggtgtccagggcgaatctgtcggcattcatcgaatcgttctcggaattcgtttgtcgagtggcgccatccactttggaacttggtggccgaggtcgatatcttgcacaggccagtagagcgttcgatgtccatttgctggaaatgttcttcgcctggcgtcatggcatggcctccgtaactgctgagcgaacaatgcttttggatgatcttcagttgacaatcacgaagtggggcattacgcatgccagcatggtgccatctttggttgaccagaccaatctacggcctgaactatgcccggaactcaagtacctgagtgttgggggagagaagatctcgaagagagtattggacacttgggcgtcttcaccacggggctggaaggatccgcggtga

SEQ ID NO: 13835 - DNA, 735 bp, A.fumigatus
tcgaaacagaaggtcatcttgtacggccttgaaaactgtcaagggaaagcactccaggcgttagtgatattagctctggacctggtgggatcgtctaatggtccaccgggctggaaattgctcgctcttatcacccgttcggtcgtccagctgggattggcagtcgagtctaagtcgtctctcatcgcacctgtttatccgtccatctacaccctaagagctgtcattctaccggagcccggttcctggatcgaggatgaaagcaggcgcagactgttctggatggtctactttctagatcgatattccaccattgctacggctttcgactttgctttggatgacaaggacattgaccgcaaattgccatgtaaggatgaatacttcaccaaaaacgagccggtagagacgagatggttccaacacacgagtgaacgccctgattatttaaatcgggcagagaacgtcggttcgttcggtttgtatgtagagattcttggcatcttttcacgcatacatctcttcttgaaaagaccagtggatattggatctctgtccgatgttgaggaatggcaaacaacctatcgcaagttggacaatgagttgacgtcttgggagtttaacctaccccctgaatatgcctacgaaaactcctcgcggctgttcaatggatcgaagcatagcaaaagtctgcactgtgactgggtgcaacttcattccacatttcaaacgtaa

SEQ ID NO: 13836 - DNA, 567 bp, A.fumigatus
aggcttcccaagcagcactgctgtatccgagatcaaatatcgcgttgcgggattgtccgtgcaatcaagaacgatatcgtaatctttgaaaatacccggagcttcttgaggcgtgaggtgtgctctatacggtacgtatgtagggtggggattcagcctgagacgcgggaagcaaccagtcagtgcctgaacagattcgatggggatcatcattgtactgactctcggagatattcgatcgcgctgtctactttgaacgttccaacattcttgcttctatgcagaacctgccggtgcaggttcgagttttccacagtgtctccgtcgaccaggcccaaggtgcccacacccgctccagcaaggtacagcgctgcaggacatcccagtccacctgctccgacgatgaggacccgtgcggcgcgaagttttaattggcctgcacaagtgatcagaagcattagcaacgtcataatcaccaagccgacgcagaggattgttgttttcctggggggctcaatgcacataccttgcaatccaagttggggtacaatcatttgccttccatag

SEQ ID NO: 13837 - DNA, 633 bp, A.fumigatus
acttcagagacggccgggaaagcgccggagtttgaggtgatatatctatacattcgttattggctttttatggaaaatttagagcagacatgcgcgtccttacgcgctcaaatcgctgccaccgaggcccagcttgcaggtctgaaacgcgagctcgaaatagctgagcaagccgccgaagtcaaggctcaaagtaccacgagaacaatcaccgcagaagacgggaaaaccaacgagacaagggagtggccgctgctcagcgaggaatacaagcgctatggaaggcaaatgattgtaccccaacttggattgcaaggtatgtgcattgagccccccaggaaaacaacaatcctctgcgtcggcttggtgattatgacgttgctaatgcttctgatcacttgtgcaggccaattaaaacttcgcgccgcacgggtcctcatcgtcggagcaggtggactgggatgtcctgcagcgctgtaccttgctggagcgggtgtgggcaccttgggcctggtcgacggagacactgtggaaaactcgaacctgcaccggcaggttctgcatagaagcaagaatgttggaacgttcaaagtagacagcgcgatcgaatatctccgagagtcagtacaatga

SEQ ID NO: 13838 - DNA, 1140 bp, A.fumigatus
aagcaagaatgttggaacgttcaaagtagacagcgcgatcgaatatctccgagagtcagtacaatgatgatccccatcgaatctgttcaggcactgactggttgcttcccgcgtctcaggctgaatccccaccctacatacgtaccgtatagagcacacctcacgcctcaagaagctccgggtattttcaaagattacgatatcgttcttgattgcacggacaatcccgcaacgcgatatttgatctcggatacagcagtgctgcttgggaagcctctagtctctgcttccgcattacggacggaaggacagctcatggtgttgaactaccctcctcggccggtcggagacaagagcggaggaccatgctatcgatgcgtgtttccgaaaccgccaccggcgaacagcgttgtcagctgtgctgacggcgggattctgggcccggttgtaggcacgatgggggtccttcaagcactggaggcaatcaaggtcatcacttctccggctgtgaatccgagcgcatcgcctccatctctgcttatattctccgcatactcgacgcctctgtttcgaaccattagactccgcgctcggcgtgcgaattgtgcggtgtgctctgccgatgccagcgtgacgctagagacgctcaagaacgggtctactgattatgtcttcttttgtggtgttgcgggcctggaagcgacactttccccagaggaacgtatctcgcccctggagtttaaaaagagacatccgaaggaagtgccacaagacggaggccgcattaacaaggagcccacgatcatcgacgtgagagagaaagtgcagtttgatatctgtagtttggagaacagcatcaacatccccatctcgaccattttgtcatcagcgtcaagtcctacaaatgtagacgccaatgcgcaaccttcgctacccttctggcttccgagagaactagcctctgccgactcgacggacccgatatatgttgtgtgtcgtcacgggaatgactcgcagatcgcagttcggaggttgaaagagttgggtcttgatcggggtggacagagatacgtcggtgatatacaaggagggctacgcgcgtggcgtgaacaaatcgatcccgattggccagaatactga

SEQ ID NO: 13839 - DNA, 510 bp, A.fumigatus
aactttgcaggatccatgatgtcaatcaatttaaccatatcagacattcatgctttaggcaaagatcaggcatttgacatcctcgcacaaattgcacggattgagaaaaagacttttccggctaacgaggcattcccctttggagaagacctttggaagaagaagcctaacaccagggtcttatatgcggtcagcacagcttccggtgtaccgcgtcgtttagttgcctatgctgtctatgttcggcagaaaggagtagctttactgcacaaagtctgtgttgtggaggcatttcgtcgacagggtatcgggatgcagcttatgaactacattcggcagcgtctccagaaggaaggctgccaatacattcaattatgggtggacaaggctagggaacccgctcgttcattgtacaatcgcagtgggttcgaagaacgagaggagattgccgattactatgcgccaggtcgtactggaattcgaatggtccttgacctcaaacgcggttga

SEQ ID NO: 13840 - DNA, 2199 bp, A.fumigatus
cgagctatggcactcattgcattggtcgtcctggcactgctggtcgcagtcaacgctagtctagtttcaaactacccggtaaacgcacaattaccacctgtggctcgagtctcacggccttttcacttcgtcttctcaccggggactttcagcggtacagaaacggaaacacaatattccctgcaaagtgcaccttcatggctacacctagacagttcaagccggaccttgtctggtactcctacgagtcgagatatgggaccgaacaaattcaaacttgtggccaacaatgggccagattccgcaaacatggaagttactctggtcgtcacagcagaggatggaccgaagcctggaaagccactgctgccacaacttgaagccattggtgctacatcagcaccatcaacaatcttcgtgcactccggcgattcgttcgtgatctcgtttgatcatgatactttcacgaatactcgcaagtcgacctttttttatgcaacatccccggggaacacacctctgccatcgtgggtccagtttgacccgtctaatctcgagtttttcggtacgactcccaacactgggcctcagacatttacattcaaccttgtcgcctcggatgtcgccggcttcagtgcagccatcatgagttttgagatgaccgtcagcccgcatattttgtctttcaatcagagcacgcagactctgttcctcactagaggaaagcacttcaatagcagtcacttccgcgacattcttaccctagatggtagacaaccagaaaacggcgaagtgacttctactgaggcccaggctccgagctggttaaccttcgacagagataccatctctttgagtggtacgccccctgccaatgccatgaacgaaaacgtcacaatttccgtgagagatacctatggagatgtcactcgaatgattgtcactctgcaatattcacaattcttcacagacaacatcaaagagtgcgacgcagtgattggtgatgattttgtgctggtcttcaacagcgcgatcttgaaaaatgactcggtccaactcgaagtgaatcttggtcagcaactgtcctggctgcgatacaaccctgataacaagaccctttatgggcatgctccctcagatcttcaacctggcaggttccctatcacattgactgctcgtgaggggactgcggaagacagcgaacagtttatcatccgtgctgtgcgaggggaccgacaagatggtggcgaagctaaactaaccaacacgaacaatggcggtggtggccacggaaagaaagccggcatcattgccgtcgcggttgtgattcctattgttttcgtaatggttatcttgtcactcttctgctgttggcgctacaagcgcaaggcgaaagctgcagcgcaagaagaagggcaatttccgactgagaaagattcgagactaactccgaggaatctccctccgtgccggccgtacgaaacgatcaaacccaatgaccctcctatcatcttcaggagcccgtcgctatcatcatcaaagcctccaaaattggaactgaggcctttgtggagcgaaaaatcgctggaagacagcaggcaagcgcgcaattcggatgacaaggaaaactctcttgcacattcgacgatcgaatgggactttgcccccttgacatgccataacccgcaggaagagaaacaaacagacgatgtttctccccagaataaacgactgtcgttccagagcagtccttcattacatagaagaacaacggccaattccacaaaacgagagcccctcaaatctatacagccaagaagatcacttaagagaaattcggcggcctcttctaggtcccgaaggtattccaggcgctcgagcggcatttcatctgtagcctcggggcttccggtaaggctgagcggcgcaggtcatggagctggaggattcgggcctcctggacatggagtggttcacgtatcatggcaaaacactcacgcgtctctgcaaagcgatgagagcagcgttggaaatattgctccccttttcccccggcctccccctcgtgggagaaacagcgtggaattcaggatccttgaccatccaagacagctcactgtgcgggccgtggagccagaaagcccaactatttcagaatccgattcactggaagccttcgttcattaccgggctaagatg

SEQ ID NO: 13841 - DNA, 267 bp, A.fumigatus
ttcctgagctatagaatccctaatactatattatactatcctgttagcacaatattaaagtttagatatttaatatatcttaatataactattaggactggtcctgattcagtcataattaagagagttcctaaattctctctatttagacctgtgattagtttaggtactgcctttatttttcctagaatccctagcttccttataaatactaggtttataaagttgcctattactcctgagttaattattactttagttaattaa

SEQ ID NO: 13842 - DNA, 264 bp, A.fumigatus
aagacagcttttagaataaagtttaggcattttaaatacctagttatactatttagattaactaacacaccagcattatttaaaaggtttattaaggaagtactatataaggttctgcactactttatagtagtctacttagataatatcttaatctttttagaaaataaaaataaatatatagaatatgtcaaggaggttttacaagaactccagaaagtaaatatcagactaaaactcaagaagtgtgaattctatgtctaa

SEQ ID NO: 13843 - DNA, 228 bp, A.fumigatus
agcctggggccgagtgagtaccccatttccccagttcttttttctagtactaataagtctccttttccaaagccaaggaacgatgtatatgggccttacaatccgtcgtaccttcagacttctggccccaagtcacatactcagtctccggctgtgacgggcacgtcggtagtagcggtcaaattcggtggaggagttgcaatcgccgctgataacttgggtacgtaa

SEQ ID NO: 13844 - DNA, 714 bp, A.fumigatus
cggtcaaattcggtggaggagttgcaatcgccgctgataacttgggtacgtaaaatgggggatctgctttgcagcacacgcacaactgacccgaagaatctatcaatagcatcatatggctctcttgctcgattctcggacgtcaagcgtctacgtgtattcggtgaatctgccgtcattggattcagtggtgacgtgtctgatatgcagcatatcgatcgccttctggagtcgattgatatccgagagaactactcaacccatggaaacacgctgaatgcgaaaaatctccatacctatttgtccaaggttttttacaagcgacgttcggagttcaatccactgtggaatcaagtccttgttgccgggttcgacggtaacaaccagcctttcttgagctctgcagatttgctcggaacaacattttcagcgccacaccttgcaactggattcggtgctcatctcgctattccgatcctgcgtcgactgtttcccgaggaaaagcctgttgaagaaattaccaaggaagaggcggtgaatgcgttgaaagagtgtctcaaagttttgtggtacagagatgcacggagtctcgacaagttctcgttggcagtgattaccaaggaaggggtggagatgcatgaggaccagaagattgagaagcagagctgggcattcgctgagtccatcaggggatacggagctcaggttaactga

SEQ ID NO: 13845 - DNA, 765 bp, A.fumigatus
ctgttcaaatgcttatccatatcatcattgtccggacagcgactcattcgattcttggccaaagacggccaggtttactacggtgatgccattctcccggtgggcgtcagcgaccttgccaaagtgaccaaggcaaaggtgatccagggtgacatcttcggacagcactatgtcacagaccaggtctccgaagttcagatgcttcttgcgcctctggccaggaaagacatcaggacggtccgctgcctgggtctgaactatgagcaacatgcaagagagtccaacctcccaatcccaaaatatcccgttctattctacaaaccagtcacgtctatcgcgggccccagagatgacattccgatatccaccatggcgcaagaaggtgaaggtctcgattatgaatgcgaactcgttattgtcatcggcaaggaagccaaagatgtccctgagagccgggctctagactacgtgctgggctacgccgtgggtaacgatgtctctcaccgggattggcagatcaagcgagggggcggtcaatggggtcttgggaaagggtttgatggttgggcgccgtttggaccaggcatcgtgtcctcgcggttgatccgtcatcccaacgcactccatatctcgacgaggctcaatggccaagtcgttcagtcttcctctactagggacatgattttcagcgttgcaaaggttgtggcatttctgtctcaaggcaccaccctgttaccgggggacctaatctttactggaacgtga

SEQ ID NO: 13846 - DNA, 237 bp, A.fumigatus
tgccgcctggacctgtcacgagccctcccgacatcagcaccgttcatggcaagtgaagatcttgctgctcgccaaggcgccggttctaatgttcccgtcgtcagatctcgtggtgctagtgcctgcgagaaatgccgtcttcgaaagacaaagtgcgacaacaggcgcccaagttgcggattttgtttgaagcgacgggtcacttgcgtataccaggatgacaacaatgcagggtga

SEQ ID NO: 13847 - DNA, 669 bp, A.fumigatus
ttgtgtggggtttcgatggtaaacacccgggcccccaattcatccggatccagggtggtggacattcccataggcgccatgttgaacggcttgcagacgttcccgcaatggcgggatactttcggccaacccaccggcgattttttcggctttatgaatgccgtttgtcccgtcgccaaggtcatcggattgttccccgccacctggatcggagatcgatacggcaggaagaaggtgttgtatactgggtttgccctgcttccgatcggggctgccgtgcaagccgcggcgcaaaataccccgatgttcatcgtcgccggattcctgatcggcttcgcgacgtcgtttctctcccagccttcgcccatcctggtgaccgagctggcatatccgacgcacagggcgacggcgactgctctatacaacacatgttttgtaagggaccttatttttgaggccggaacaatactaatctcccacctcagtacctcggggccgtcctcgccgcgtggtcaacattcggaactttccggctgcagtcgacgtggtcctggagaatcccatccttactccaacaagccataccggcctttcaaactgcttttgtcttctgggtcccaaagtctcctcggtccgttgtccctacacatgccgcggctccattactaa

SEQ ID NO: 13848 - DNA, 1116 bp, A.fumigatus
tctcccacctcagtacctcggggccgtcctcgccgcgtggtcaacattcggaactttccggctgcagtcgacgtggtcctggagaatcccatccttactccaacaagccataccggcctttcaaactgcttttgtcttctgggtcccaaagtctcctcggtccgttgtccctacacatgccgcggctccattactaacaagaccaggtggctcatggccaataagaaggaagaagaatcccggcgtatcttgaccaaataccacgcgggtggcgatgaaaattcgcccttggtcgagttcgagctgaatgaaatcgcccaggcgttggaattggaaaaggccagcgagcacgcgcccagctacttcgagttggtccgaactggtcccaaccgccatcgcacggcgctggcttttctcatcgcgtttttcacccagtggaatggctgcagcgtcttgtcctattacttggccctcgttctcaacaccattggaatcacggcgcctgcccatcagacactcatcaatggtatgctgcaaatcttcaactggatcgtggcggtctgcggcggcgccctcctggtcgaccgcgttggtcgccgttcgctgttcctggttggcacgtccggcatgcttctttcctacattgcttggacggtgttgaactccgagtttgcgaagacccacgatcaacggctgggaagcgcggtcttggctttcatcttcatctactatttcttctacgacatttcctggactcctctgcccgtcgcgtacaccgccgagatcttcccttataccctgcgaggccgaggaatgacgatcaactttgtcggaacatatttcggcctcatcagcggacagttcctcaatccaatcgccatgaaagacttgagctggcgatactacatcgttttctgcgccatcctgttcgtcatggtgctcgcaatctacctctgggttccggaaacgaagggtcgcactctggaagagattgcagaggtcttcgatggccctcgcagtcatttgactgccggcgccgttgatgagaacagtgcaaaaggctccggaaaggtacctgaagtggaatttcgggaggatgtagcaactcgaggttaa

SEQ ID NO: 13849 - DNA, 453 bp, A.fumigatus
gccagaacccacgcaaacatgaatgaaagtcatgaagctggaaaaaattcctctaccaatgtggaggagagggaagaggaggttcttcggctagccagacagttcacagagcagagcagatattccacggcgggacaaaccccctttgctgcggaggccggatcggccctggaccccaatggtgaacgcttcaacgctcgggcatggtgcaaggccatgctgcagatgcacattggggacaaggaggcacacccactgcgaaccttgggggtcgccttcagcaatctcaatgtgcatggtttcggttccgacactgattaccagaaaagcgtcggcaatgtctggttaaagacgctcagcctggcaagaatagcatttggtcaaaagcagcgcaaagtcgacattttgcagaacctggagatcttcaccggcagcgccaggacaacgctaagt

SEQ ID NO: 13850 - DNA, 255 bp, A.fumigatus
agccggaatattttcccgcacatcatatatccgatgaacattgttccgatcctaaggttggtgagtgatctagtggcaaaatatcaatcgaaagagttcggtttaccttacaacaaggtctgctttcgtcccgattactcctcctctggtagttatagtgcccaggttggtgagacggacgccagcgacgagggctctcatctcgcatctaactttgaaggggaagaagctgtggatcgggaaacagaggagtga

SEQ ID NO: 13851 - DNA, 420 bp, A.fumigatus
aacatgttcagcgaccggtctgttcgctccaccaagtcaaaggaaaaatgttacacatgccgacggcagcggatcgtgtgtgatgccgggaagccatcgtgtatgcgatgcatatcccgaggcgtcgaatgtctgggatactcggcgacacctattcgctgggtagcgcctacgtcaactctttcttcggaagccccaacaccttccaacattagccatatcaaaggccaggaaaggagaaaacgaggacggccgaagctattcctcatgcaggcagcgccgcggtcttccaaagatggatcagatccacagcggtctgatgaagagctcgaatcgcagaaaggtgcgcgtcgcggaagtactagcaggactgcagccgtactgccgagcacgtcttcaccacggggctggaaggatccg

SEQ ID NO: 13852 - DNA, 2115 bp, A.fumigatus
tggtctaaaccgctagccgcaccaattgtggttaattcgaaggatctgggtccatcgggccaaccgccgacatcgtccatcaccgtggcccccatctctaaatctttcccccccagtggccgactaaacgggcaatgggggatgcctcctctgtcggcttacactccttttgaatctctcctcttcttccagtctctcgccaccttgggtacccgtcctatcaacttcgcatccatctccgatattctacgcaacaatacgttcgttcgcgagaatgtcgcatttaatgcggacaggctcagcccggaggctctcgaggaattgtacacgaccttgatgcgagaaggactagatggcgccagagccgtctcacttcccgaacaaaacggtgtacatcccgaaggcgctcaacccactaaccccctgaaacgtaagatcgcgagtccacgtccggaggtgttagtcgataatggaagaagccatgctagctttcttccggagttagtgtctcatctatatgccagatacaaggaactcgcgactagagagatccggaatgaggagaggagatataaagaaatcagtgatgaaattgaaaggctacagaaggaggagcggcagaatccctcacagtcagcacctgtgccgacgtctgtacaggcatctacagtacgaggaccacaaacaaaaaaagactttgcgccggagcccatggacttggatgtcaaggaggagaggcccgctcagcaacttcggcaggaacccagccggcccgcagtccagccaccgttggattccaaggtcaagcaaatcgagcaggaatcgccgcgcaacgatattttaccctcttcaacgcgagaagagctagcgcaaccgaccgggccgtcggtatcggccgcagcgacacaacaaccccaggtgctatccactcaaccgccagctcaaccgcatcaagaacagccccgaccgcagcagcagcagcagcaaccgcaaccgcagccgcagccggatgatggtcatgcaccctcggcagttcaacaagcacaagccaacgtgcctccgacagcgtctttggcgcaaaaggcaaagaatggacctgctgtacattcgcagcagcccgccgctgccccaagtccgagtttgggcaatttgccaacttttactgccgtgtcctggcaagctcagcatgacgttcacaaacctactcctgttcctgctcctgctccatcaccatctccagcagccagacctgtagagaagaagggtgctctaggtgccacatctgtctcagcacctcaacctcctacaccccagccaatagttcagcagtggcccttacatcagccaccacagaccccgcagccaccgcccttggcagataagagtgccatggtggaaagaacatccaccaaccctctccaacacgcaccgaaacccgagcctgagaaaccatttcaagctactccccgaacgcctgtacctcctactccagggcctggttcggcaccgattgtatcaacggctgtcaatggccatgcccggggttaccagacgcctgtaggagcagcgcaaggattgttttcggaagcgcaaaatgtccatcgccctcagctctctgccgatacgagatcttctacaccttggaagaagacacctcgcctaagcattcctccgtcgcctagatcaccgattcggcctcggccagaggacgtcagccctatcagcgaaagggccccatcgccaattgagtttcctgagccacttctagaagaaacagaaagccgacagaacaaacgcagagctgttgaagaaaagggggcgcgaacaatccaggaacccagcctgccgcaagatttggaacttaaagggcggctgaaacccaaggtagaaaaagccacagggtctgctgctgcgaagaaacgggatcgaagcacgacctcctcaagaagccgcggaaggtccgtagtatctcgcgatgaggaatctgttgctgaggttggaaacgtgcctcttgaaaaaatcaagcatgagttgccaggtacaccgactaatatccaagagccgccagaattagagggtcgtgccagtggagcccgaaaaggcgctgcggccttg

SEQ ID NO: 13853 - DNA, 216 bp, A.fumigatus
ctcatccctctgcacccagcaacgtttcatcaccatattctcaatccatcaaatatatgtccttttcatcaaatacaaacctttcaagttaacttttctctaatcctaaagcattatttccgcccctattcttactgggccgtttttgtcggtttttggacacttgtctccctttcaagatttttctccctgcgcttttctgcactgatggtctaa

SEQ ID NO: 13854 - DNA, 417 bp, A.fumigatus
aaggctacagaaggaggagcggcagaatccctcacagtcagcacctgtgccgacgtctgtacaggcatctacagtacgaggaccacaaacaaaaaaagactttgcgccggagcccatggacttggatgtcaaggaggagaggcccgctcagcaacttcggcaggaacccagccggcccgcagtccagccaccgttggattccaaggtcaagcaaatcgagcaggaatcgccgcgcaacgatattttaccctcttcaacgcgagaagagctagcgcaaccgaccgggccgtcggtatcggccgcagcgacacaacaaccccaggtgctatccactcaaccgccagctcaaccgcatcaagaacagccccgaccgcagcagcagcagcagcaaccgcaaccgcagccgcagccggatga

SEQ ID NO: 13855 - DNA, 1542 bp, A.fumigatus
  unsure (10): Identity of nucleotide sequences at the above locations are unknown.
gtgctgacgnatatagatgaccgccgcaaatactcccgttctccatcaagcagccgctctccgcacagtagacggcgcaagtccttttccgagcaggccctgggtgcttttggtctgggagcggcggcgtcctcggcttccagacaccgcgattatagccgtggtcgctcctatggtcaccatggccgatcacactcgtactctccctcgcgctctcgcagcagagactgccaccgtcgcgacaagagcgagcagcgcattgctcaggctgctcgggccgcactgacagcggcagctgtcgaggccttccgtgttcgcaaggaacctggcgagtggacaggcgagaaaggcaaacggattctcacggctgcaattaccgctgcgggtacagatgggctagtcgaccgtaacccaaacaagcactcgaagcgccacatcatcgagtccacgcttgcgggactggcggccaaccatttcgtgaatgggccacggtcaaagtcgagatccaaatcccgcggtcgtggctccgacagcaagctcaagaaccttgccgccacgggcgctctggctgcagtcggaaaggaggcctatgagcgcttcaagtcccgttcccggtcccgtcaccgcggccggtccagctcacgcgacagctacgatgaaagcgactcaccgcgtcgccatcgctcgcgcaagcgaagtaagagcgtgtcggagtttattaatcaaggtatggaagcgctggggctgggagacaaggacagggacaaggactgggatgaccggcgaggaagacatcgtgggcggccctcacgctacgatgactactcggacagcgatcgggatagtgagcctggggagagacgggccaggcactccagagatgtaggtcgacctcgttctgtttatgccacgcaagcaccaagttctgccatcaccaccacgtcgggagccaggggctcacatgctgatgacggcggctaccaccactccaccccggacagtgaatcatcttctgacctgggagacagttccgatgagaaaaagcagcgcaagaagctcaaccgacaagccctaatgacggcaggcctagccaccatcgcgacggtccacgccgcacacgggctgcaccagaacatggagaagcgcaagcagcgcatgcagatggtgaaggacggcgcgatatcacctgaagaagctcgccggctccgcatcaaagccaacctcgccgacgccgccagcatcggcctctccgcgctgagcatcaagggcgccgtcgccgagtggaaagaagccgacgagaaacgcagggaacgcgccgagttcagaaagaaatgcgagcaacgtcgtcaaaagcgacaggagcgcatgcgaagcaagagccagagtgccgccggctcgccccgtttttcctggcggaccgtcgacccggacaagattgaggaaaatgccagttcttcgggatatttgcactcacatgctgggaaggtgcgatcgccgagtgtcggggcggattttagataccggtcttcgtattggagttga

SEQ ID NO: 13856 - DNA, 999 bp, A.fumigatus
cgtgctgcctaccaaggcctatgtcaggccaatgacaaggaccgtctgagcttccaggatcagggcatggaacccctggctcgttcggcctatcccatggccaagagtgcagctccgctcgcgtccacatcggtagactcgctcgccatcttctctggcagggctgccgatgaaaagactcctcggacagccggtggattcccgggccatggacctaaatcgtcgccgctcaaaccaagtcctctgaccactatccagtccagcggtgactggacgccatccagcacaaactcggccggcgcagacaaggctgttgaggcacaagacatgaccctcggggacaaaccgcgcggtgaccgtacgacggacgagggctggggcaagtacttccagaacaacaatggcaccaataccaacttagcgaacacaccggccatcgcggcccctcggtctaatgcagaggatcggatcagtgcctggcccggagcgccccttcctcaattgaattttggcttcctggaagagcccgcgccgctcggccgggtggtcaccggtagccccacgacggaggacggccccaagatcaaccagatgctgaagcgcgccgagtcgcagtccgcccgcatctccactgccagctccttgagcgccgcgtccgacacagatgacgatcacgaccatgaccatgaccgccgcgacggcgcctcaacgattagtggtccggccccggacccgcagtggcgcggcgctccgcaccacagctggatcggccgtccacccagcagcacctacagccgcagcttctacaaccccagcggccgcgaacgtgataccatcaacacccgcggctcgagcgtcttgatcccagatgcgcttgagcccatgcccatgcccatgcccaccacgcccttcccaggtgcacctgcgcctgcgccggccaacccgcgcaacaacgcaaactcggatctaagctggttgaacctcaacgccgatcgatag

SEQ ID NO: 13857 - DNA, 813 bp, A.fumigatus
tcagttaaccacctctctcaaccattcacctcgattagtacacatatccagatcatgcatcgcatgacccactgtaggtcagcatcgaccaaatatctaaacccactcaagaatagaccgctcactatagacacagtcaaccaccatgacgacggctgcccctgcccagcccaaatcaaacacctcgcctccactctcccaacaaaaggccccttcgacttcagcttcctccccaccctccctcagcccctcgccgacctctgcagatccatcgaggcctgccaacacccctcccacaaatccaacccagacctgagtcccccgctggtcgacctctccgacgcggtgctctccctctgccatgccgcctgcacgacctaccatctcctcgatgatgagctaggttccaccaccagtaatggtaatggtaacggtaccactaccactaccgctacttctcctcctacacaaacagggaatgcaaaccccccgttgacatgcaccaagtcccccatgtcgctgggcaagctcaccctccaggctgaggaggagaccctcctcgcgcgacaggttgtctacgccgtgcttgagcgcctgagtactctcctgcgcggtgtgtatgctcgtggcaagggcgcagcaggtggtggtccggcgattggtgctactgctactgctactgtcgtgatggacttggacttgggcatggccttggggacgagacagggcctgtacggtcgggagggcgacgaacctgtcagtcagtgcttgtctagggggttggcgctgttggggaaattgttttccgagtga

SEQ ID NO: 13858 - DNA, 594 bp, A.fumigatus
cagggttatgcaaccattgtgggacagaacggtatcaaattgagtggcggtcagcgacagcgccttgctatcgctcggagcatcgtgaaagaaccaaagatcttgatattggacgaggcgacgagtgctatcgacgttcgtggcgagaagatcgtacaggcagcccttgatagggtttccagaaaccgcacaaccataatgattgctcatcggctgtccacaattcgacgagcagatcatatcgttgttatgaaaggaggcgtgaatgtcgaagagggaacacacgaggagctcctccagcgagagggtggagtataccgagaccttgtcaatgctcagaggcttgagctgttggcagaagaggacagccacacaggtaacgcggtgctcgagttgcaagatgaggcccagtctcccaccatgtctgttcaagagaaagtgcaggatgaagataacacccaggacaaaaatcgagggtttattaggactattgggctggtattgtatgaacaacgtgcgcggtggccgttgtacgtggcggtcctcatcagcacagctggggctggaagtaagttaatctctgacgcttcatga

SEQ ID NO: 13859 - DNA, 759 bp, A.fumigatus
aatgttgctgacggttacaggtatggtggccagcttctcgcctctagagagtaccaaccgacctcattcttcgttatattcatggctatcattcaaggcggacaatcggccggccagttttttagtttcgcatcaaactttgcccaagccgctgcgtctgcgaaccggatattgaattcgcgcccacaatcagatgaactcggtgccgccagcattgaaaagcaacaactcgtgcgtagcggggacctaacaggggctactgtcgagttccatgacgtttcgtttagatacgcttcacaggatgtccctcttttcactggacttaatgtcagtattcaaagcgggcagtttgtcgccttcgttggaccatccggctgcgggaaaaccactgtgatctcactcctcgagagattctatagtccgtcgcagggcacgatcacttttaacggcgaagacattcgtacccttgaaatgacatcctatcgcagggaactatcgttggtcgctcaggagccacgcctctttgaaggcagtattcgcgagaacattaccctcggcctcgaccagtccgagttcacggaggaagaattgatccaagcatgcaaagacgcagagatccatgacttcattacatcgctttcagaaggctacgccacggaactcggcatcaaagcgcaaacgtcactcagcggtgggcaacgtcaacgactctgtattggcgccttgcattgctcccgaaagcggcactcctacttttga

SEQ ID NO: 13860 - DNA, 690 bp, A.fumigatus
accgacagagtgttctgctcggtcatgattgtggtaagtgtgttagggaatattgcatcgcccctgatcatcgtgtccaaagccgccagcgctgcgggctctttcttcgagttgatcgattccgaaaaggtagattccgggggccttcgagaaccggatgcctcagcccatgtcgatataatctttcgagatgtgcgcttcacgtaccctacacgaccagacgtgcctgttctcaaggggctagacattcggtttcaaaatgggaaaacaaccgcattggtcggtccctctggctcggggaaaagcaccatcgttgccctgatagaacgatggtatcagttggcgatgagtccagaagaccagaaccaagggagtatctacgctgggccgcatgatatcaacagtctggacctgaaatggtggagatcgcagattgggctcgtccagcaggagcctttccttttcaatgataccatcttcaacaatgttgcatttggccttatcggaacacagtgggaaaaggagcctgacagtgtgaagaaagaactgatcgagaaggcctgtagagaggcctttgcggaggaattcatccagcgtttaccagaagtatgtttgtctgtggaataccgaggcatatctgactgtgacagggttatgcaaccattgtgggacagaacggtatcaaattga

SEQ ID NO: 13861 - DNA, 735 bp, A.fumigatus
aggatatccgaggcttgccgaaaggagtattttcagaacatccttgcgaagcctataccatttcacgatttgagcgaaaacgcttctggctccattgtttcccgacttgccaccgatccaaagcaggttcaagagcttatcggtctcaatggtgcattccccctcatttcaacatttagtatgataggttgtattgcgattgccttttcctttggatggaagctgagcctggtgacggtgtttgccgccttaccatgcacattcctggctgcctttatgcgcatcagatatgaactgcagttcgaggcaatgaatgccgcggtttacgcaggaagttcgcagtttgcagcggaagccattgatgcatttcggaccgtttcatccttgacgatggaggacgccatccttgaccgatacacccaactcttgcgggaacaacaaaagaaggctttccggaaggcgagatacgcaactttgatctttgctttctcggatagtgtggagttgtgtgcaatggcactcactttctggttcgtatcattgtgtgatagctacactagaatgttgctgacggttacaggtatggtggccagcttctcgcctctagagagtaccaaccgacctcattcttcgttatattcatggctatcattcaaggcggacaatcggccggccagttttttagtttcgcatcaaactttgcccaagccgctgcgtctgcgaaccggatattga

SEQ ID NO: 13862 - DNA, 561 bp, A.fumigatus
accatcacgacgctgtccaatacagtccagcaaagcatatcggacaagctcgccattcttttccaatccctcgccctgttactcgcagcattcatcatcgcgttcaagtattcgtgggccttgactctcgtcacaagttctgcgctgcttttcgtggttgtcggctgcagtgtgactctaccattcatgacaaaaattcaacagaagattgacaaggcagatgagaagcattcctcaattgcggcggaagtatttgggtctattcggactgtggtttctctcggtgcccaggaaagcctttccaaaagatataccacctgggtggaagaagcacgaaaacgtggaaatgggctgtctcttatcttcggcatccactttgctttggtgttctttgctctgtacgctagcttttccctcgccttctggtttggtttaaagctatacagggagggccatatcggggagatcaacacagtcatcacgtatgtatatccccccgcttctataccccagcttgaccaacttctaattaaaccgacagagtgttctgctcggtcatga

SEQ ID NO: 13863 - DNA, 843 bp, A.fumigatus
cttacttccagccccagctgtgctgatgaggaccgccacgtacaacggccaccgcgcacgttgttcatacaataccagcccaatagtcctaataaaccctcgatttttgtcctgggtgttatcttcatcctgcactttctcttgaacagacatggtgggagactgggcctcatcttgcaactcgagcaccgcgttacctgtgtggctgtcctcttctgccaacagctcaagcctctgagcattgacaaggtctcggtatactccaccctctcgctggaggagctcctcgtgtgttccctcttcgacattcacgcctcctttcataacaacgatatgatctgctcgtcgaattgtggacagccgatgagcaatcattatggttgtgcggtttctggaaaccctatcaagggctgcctgtacgatcttctcgccacgaacgtcgatagcactcgtcgcctcgtccaatatcaagatctttggttctttcacgatgctccgagcgatagcaaggcgctgtcgctgaccgccactcaatttgataccgttctgtcccacaatggttgcataaccctgtcacagtcagatatgcctcggtattccacagacaaacatacttctggtaaacgctggatgaattcctccgcaaaggcctctctacaggccttctcgatcagttctttcttcacactgtcaggctccttttcccactgtgttccgataaggccaaatgcaacattgttgaagatggtatcattgaaaaggaaaggctcctgctggacgagcccaatctgcgatctccaccatttcaggtccagactgttgatatcatgcggcccagcgtag

SEQ ID NO: 13864 - DNA, 261 bp, A.fumigatus
atctctttggttggacatcttattatcagacttgagaagccttcgtacgaggaacacgaaggcttgaatggtaacgcatccaacgccgatcagaggaggcaggacttgggacaatatccctccggtagaggatctaagaaggccacagacccagcggactatcatggagtcgaaacgcttgggatggaaaggtctgaggtaagacaaatacctgcatatttcattaaccgagaatttagcatgaccaccgctggattctaa

SEQ ID NO: 13865 - DNA, 252 bp, A.fumigatus
ctggattttcatcggtgccgcaaccaaggtcgagaaggccagcagacagcagcgtatgtttttgagccaccgcccgctagcaccctggggattggatcagacgtgcatacatgccttccatatctccgggggttactcattctagccatcgctaacctctcttcccaatctataggcaagcaacggaagaaccgttccaagaagttccgtggtaccgccaagaccaagggacccaagaagaacaaggactaa

SEQ ID NO: 13866 - DNA, 204 bp, A.fumigatus
ccccgtcgatgccttcgccggctggtgaaaacgtgctcttgccgccaccgcactcagtacggtggtggcaagagcactggcttcgccctcatctacgactcccacgaggccctgcaagaagtccgagcctcacaactgactggattttcatcggtgccgcaaccaaggtcgagaaggccagcagacagcagcgtatgtttttga

SEQ ID NO: 13867 - DNA, 204 bp, A.fumigatus
attttcatcccagagaattaccccaaatctcgaattttccctgtctgtatcatcatgggtcatgataaagggcgtaacagtatgcgccaccgaaaccaccgctattatcacatccagcagggtcagcccctggccgcgtcgtccgctcccagatccgagtccacctccaactcctttcaccagggtcaagccgaatgcatttag

SEQ ID NO: 13868 - DNA, 225 bp, A.fumigatus
tcgctctttatctaccaaccttaccatatcaatctcaatatattcatcaaaatgcgtttcttcgctactgttctggctacccttgccgtgggcgccgtcgcctccaacgccgttgccgatgaggaatacagcaccgttgtggtcactgagtacagcacctactgcccctcggccacctccgttcctgaggcttcctccagcgctgtacgtctttgttatatataa

SEQ ID NO: 13869 - DNA, 414 bp, A.fumigatus
aacatgctaatccctcctctgcaggctccctccatcaccgtctccgacggcgtgacctactccatctcccggcccctgatcacctctaccatcaccaagtgcaacaagtggtatgtcttgtctcactgtcttctcgatgagtcgccagaatggttgaagatgatgatactgacaaccagtagcccctcttccacccccgtcatttacacccccaccccctccagcagctccatcgtcgtcgtcccgacttccaagcctgtcatcccctccggtgcaagccccgagaccaccagcgtcccccccgccgccagcacccccgtcactcccctggcgaccggtgccgcctcgcgcgctgccgtctgtgcgggcgcgggtctggccggtgtttttgccctggctgcttacctgctgtag

SEQ ID NO: 13870 - DNA, 498 bp, A.fumigatus
tccagatatgggggatccggactcggacgaccaccagttatcaatcaccattgcccccggcgccgcatgctgggtcaggagctcttgaaacatctggacgatgctcggttcgcttctctcgccagcaagaaacagagctttcaggtgcctcagtcccccgcggcgtgcaacctgcaggaaatacttgttgtccggatcgtctttgcggattgcccgaatggccgtcggtgccgtggagagcaccttgactttgtgctcctcgacaatgcgccagaaagtgcctgcgtcgggtgtccccactggttttccttcgaacaggaccgtcgtggcacccaccagcaacggtgcatacagaatatacgagtgaccgaccacccagccgatatccgaggcgcagaacatcacatcccctggcccgtggatgtcaaacagatacttgatggacaaatggagtccgactgcgtggccccctgcttctcggaagactcctttcggtaa

SEQ ID NO: 13871 - DNA, 1314 bp, A.fumigatus
tttaacgatgctgatgtgtgggtagggacaactggattaccgaaaggagtcttccgagaagcagggggccacgcagtcggactccatttgtccatcaagtatctgtttgacatccacgggccaggggatgtgatgttctgcgcctcggatatcggctgggtggtcggtcactcgtatattctgtatgcaccgttgctggtgggtgccacgacggtcctgttcgaaggaaaaccagtggggacacccgacgcaggcactttctggcgcattgtcgaggagcacaaagtcaaggtgctctccacggcaccgacggccattcgggcaatccgcaaagacgatccggacaacaagtatttcctgcaggttgcacgccgcgggggactgaggcacctgaaagctctgtttcttgctggcgagagaagcgaaccgagcatcgtccagatgtttcaagagctcctgacccagcatgcggcgccgggggcaatggtgattgataactggtggtcgtccgagtccggatcccccatatctggattagcgctgaacagcgcagcaggcctggtggaccagtggcaaccgaatcaggattccaaaccgctagccgtgcgacccggatctgccgggctgccaatgcccgggtttgacgtgcgtgttgtcgacgatgaaggccgggaggtgccgcgcggaacaatggggaacatagtcatggcgatgcccctggcgccgacggcatttaccagtttattcaaagacgacgagcgcttctacaggggatatgtcaaacggttcaacggccgatgggtcgacaccggcgacgcaggcatgatcgacgaggacgggtacatccacattatgtcgcggtctgacgacatcatcaatgtggccgcgcaccggttcagcacgggggccatcgagcaagccatcctgtcgcaccccgacattggcgaggccagcgtggtaggcatgccggacccgctgaagggccatctcccctttgcgtttatccagccgcggggatcaggaccacttcccgcccgtcccagcgcggagctctttcatgctgtgaaccagctggtgcgcgagcagatcggggccatcgcttcgctgggcgggatcatccaggggcggggaatgatcccgaagacgcgcagcggcaagacgctgcgacgggtgctgcgcgagttggtggagaatggggtgcggggggagtttgatgctcctgtgaacgtcccgccaacggtggaggatgcagaagtggtggaggttgcgcgggagagggtccgagaatactttgccgccaaggcgaggctataa

SEQ ID NO: 13872 - DNA, 450 bp, A.fumigatus
atgcccctctcatcaagagctcaggggtccaccaacagctacctacagcaggtaagcagccagggcaaaaacaccggccagacccgcgcccgcacagacggcagcgcgcgaggcggcaccggtcgccaggggagtgacgggggtgctggcggcgggggggacgctggtggtctcggggcttgcaccggaggggatgacaggcttggaagtcgggacgacgacgatggagctgctggagggggtgggggtgtaaatgacgggggtggaagaggggctactggttgtcagtatcatcatcttcaaccattctggcgactcatcgagaagacagtgagacaagacataccacttgttgcacttggtgatggtagaggtgatcaggggccgggagatggagtaggtcacgccgtcggagacggtgatggagggagcctgcagaggagggattag

SEQ ID NO: 13873 - DNA, 900 bp, A.fumigatus
gtagctgaactgcgggacgggatccgccatccgcatcccctggaagctactccagggactgaaccgaatccccgtgcggtccgccccaacagcgtccaccaccgcgcgggtcacctcgagcgcgaagcgcgcccgcttctcgacactcccgccccacgcatccgtgcgcttgttcgccgtatcctgggtgaactgatcaataaggtacccgttcgcgccatggatctcaacaccatcgaagcccgcggcgatggcattgcgcgcagcttgcgcgtagtcgccaatcagggcgtggatctcctcctcggtgagagcgcgcggcgcaggcgccttctcgttcgtggggacgtcgctgctagacacgaggtcgaagccgccttctcgcttgaggacttcggggttggcgacccggcccaaaccccacagctgcatgtagatgtaggaccccttcgcgtgcacggcgtcagtcacctggcgccactgagcgatttgcgcctcgctccagatccccggcacgttggcgtagccgcctgcgcgcggcgagacgagcgtcgcttcggtgatgagaagggtgccggggacgacggcgcgttgttcgtagtgctccttgactatggggagggggacgtggtcgtcgtccacacggaatcgggtcatgggggccatggccaggcggtggccgagccgcatgcgcccgacctggatgggggagaagagtttcgacatggtggttcgttgcatttggatctagggatcactccgaggcgtgatgatagcgcaacttatactctgtatggtactgattggggcgaggcagtacggggagggaggccgttggctttttatcctacaagctctggagagcattgtgccttgaagacaacactacagaggttgtag

SEQ ID NO: 13874 - DNA, 864 bp, A.fumigatus
atccaaatgcaacgaaccaccatgtcgaaactcttctcccccatccaggtcgggcgcatgcggctcggccaccgcctggccatggcccccatgacccgattccgtgtggacgacgaccacgtccccctccccatagtcaaggagcactacgaacaacgcgccgtcgtccccggcacccttctcatcaccgaagcgacgctcgtctcgccgcgcgcaggcggctacgccaacgtgccggggatctggagcgaggcgcaaatcgctcagtggcgccaggtgactgacgccgtgcacgcgaaggggtcctacatctacatgcagctgtggggtttgggccgggtcgccaaccccgaagtcctcaagcgagaaggcggcttcgacctcgtgtctagcagcgacgtccccacgaacgagaaggcgcctgcgccgcgcgctctcaccgaggaggagatccacgccctgattggcgactacgcgcaagctgcgcgcaatgccatcgccgcgggcttcgatggtgttgagatccatggcgcgaacgggtaccttattgatcagttcacccaggatacggcgaacaagcgcacggatgcgtggggcgggagtgtcgagaagcgggcgcgcttcgcgctcgaggtgacccgcgcggtggtggacgctgttggggcggaccgcacggggattcggttcagtccctggagtagcttccaggggatgcggatggcggatcccgtcccgcagttcagctacctagcgcggaagacggcggagatgaagctggcgtatgtgcatgttgtggagtcgcgaatctcgggcaacgcggacaccgagtcgacgttttcaccacgacggcgccgatcaacataa

SEQ ID NO: 13875 - DNA, 1758 bp, A.fumigatus
gcatccaaacaccattattggaaaccggaccaaaggtgggtgagaactcggaggttcatggggccagcagaagagactacggtgaagcgaagtggtctacaactacagaacggctcgaaatcacgtccccaggataccatcaactccgagcgcagcaggcatgagtcagaatcccacgatcgctttccaccagaagcttctttgatgccgcaagaagctgtcgcagagcaggcggtggaagagcaggtgacaccagaacaagccaaagccgacgaaggcacacagcagcctacgcgaaccccagaggtaccaagtgaacagcacatcgctagtgaaatgaaggagttacagcctcagcgccagaagcgagcaaggggcaggccaccggcatctagccggaagcaatctgctattggtgaaccctcagagcgaaatggaggtgacgaactggagaaaacggcggctccagatgacccgagcaagagacttcgaggcagaagtaccagaaatgcccgaggcacaccgaatgctcctgataccgagaacgctgtccccaatagcagcttaggccgcggacaggacacagcacaacccgatatggatggcggcgacactgcagcaagggcccaggacgttgagcaatcagtttcggtgaaacaaaacgagaagaagaagggcaggcgtgctggacgcgttggcatggcccgtcatgtggaggctgagcaagacaaatccgatgagtcgaatgagagaattccgcaagaggagcagctgcagccaggccgggagcaagagcataagcctgagctgcaacctgaggccgagcccgcaccagaggttgcaagcagagcagaatctccaacaactcaggaggcttctccacggcctaagaaacggcgtggaagaccgtcattagcatcgagaagggatgacaacacagcaacgcagcctgaagaacgacaagcgacacagcaagaggttgacgcggaggattctaaacctacgagaaagaggactagacaacctcgcagtgaaactgtacctgtgactgtccaccggctggtgaatgtcgcttcgctggcgccaggaccttctggtcctgattcaccagtcgaggatggagactcggccgatgaactggccgccaggggaaagactaagctccccagaagaggaggcgtcaacccagccgatgtactgagccagatttgccgagagacactagaaaagacactcactactcttaagaacggaatagccaatgagaccaatcccgcacgacgtgcggaatggacccgcaagaagaaagccgtcgaggcttacgaaacagaacttgagggtcggctttttgagttgagcgagatgctggatagtaactttgttctcggcgtccagctgaagaaagcaaagcgggaaatgatggacttgcgaggccggctgtaccaaatccgcaaagagagagaggcggtcgctttacggatggatgcagtgcgcagcaagcatgcggaagaggaaagtgcgagaatggtaagctttggcctagttccgaagtctataagtacgttttcgatgtgcgtgtggttggtagctgacgtttccaggcccgcatttctatcaacaattccttgcatagcctcgagcttgctattgaacgaagtcagaatcgcgcatccgccgatgctgacgacgcagaatcggcagatgcttcacccacagttggcctggagtttatgctccgtagcgttgcagaagcagtga

SEQ ID NO: 13876 - DNA, 1572 bp, A.fumigatus
ttggagctgaaagcttcaaacgcttctacctgcatgagctgttcaacgttaatcgtctacttcatctgttggtggcagtctcgacctgaggctgaaagtatcattttaacttaccctgctatacctctccatgcaccgctgaatgtaatatcgccgtcctcaagttattactgggatgaaatgaccagcgaatctgttcagccgggtcttactccactttcacatctcaaggccgtgcctactacttccagctccaagccactcgcattcaaagactcgtccgttttgcaggcaactcctcagcttcgacatcggtctcgattatcgaaaaatgtcaatcgtgatgagccggttagcgcgacaagtgacaaggcaactgttgcattgataagacgtgttctttgctcgcaggcgggcaatcaaagcggaggtgcttcaaccccacagccattggaagaattgttgcctcctttgacgagctcaaatgaagttgatcttcaactgtatgcattaattgctataattatcaaggaattcgtcctctcatggtattcgaaaatcacatcggatcagaacctcgtcaaggaagtcattcaagtgatcgcgcactgtactcgtgctcttgagcagagattgcgtgaaactgacattgcacagttgatcttcgatgagattcctggtctaatagaggcgcatataatatgtgagatatctccctatagcagctggctggtcttctatactcacgcgcggaatctagcgtacaggctggcccgcgatgaaagtacactatccggactctccccctctgttcgcgaaacgtaccatgccttacatccacatccgagtctttcaccaatcccagattcctcggatatgcggacgattgagaaacaacgcgagaacgaggcaatataccggcagttgctggcccatggaatgttggccattctcctcccgacggaggatttggaaaatgtcccgctacgaactattatcggtgacatactagcagatttgatacttgggaacgcagtcagcgaaaagatgtgtcagggatggttcttgtgggagactaccaccaagctcctatcgacagcagaacgacttgacgaacatgaggaagacacggcagatagtcaccagcaagatcgcctacacaaattcggcctgctcactgtcaacgatgatcccaagtcggaccaatcgtcttcacagactcaatcttttggacaagcgtggctatggaatatcctgcaatatctgtatctgacctatattgttcttcaattcatcgtgacgggactttttcgcgtgatgacaaatgctaaagcgaatgtctcgtcagctgctataacgccagaaatttccgagaccgagaaatcggcgcccatgggcggcacatcaactaagcgccctattctcaactatcgaatttatagtatggttttgcaaatgctggacattcctcggagaatgccatggctggcaggatttctctctcttttccaatatttgactttggcgggaccgggcaagttgggcgagaccggcagtgtccttgacaggtga

SEQ ID NO: 13877 - DNA, 651 bp, A.fumigatus
gagaattggaaatacaacaccctgggcagagttcaatatttatgtgcgtatatcaacatcgcgtcggatttcccgatcgcttctaacctcatcttcggtcaacagtgtgatcctgaggcttccaaatctattttcaacaatcctaccctggcaccgaagacaacaatgatcgggttggatttgactcaccaagtgcttgcttctcgtagtgtgcagaaccgcatactccatggatccagcgattccaccaaaacaccctcagttctcaggagaatgatgcacgctctacttgtcttttttgctcagacctacgacagcgtcttcggcttgtcgtccggccctccccttcacgatccgctcgcggtggcagtcgctatctcaaatcttaaccccacctttgcgaaaaagcaccccgatcaagccttgaagttcaatgacaagaatggtgagcggtttgctgtcgacgtggttaccgatggcatccattcaaccaatgcgtcggagactgggcagctaggccgcacactagctactccaatgggcggacatggagtagctatccccagaggagtggacctagaggccttttggaacttgattttggattgcctcacgcgcgccgacgaatgcaacgcgacgcgaaagtcatga

SEQ ID NO: 13878 - DNA, 510 bp, A.fumigatus
cccctccccttgcataattctgccagcagaaatgagacgctaagggctaatgttgtaataaatacaggcgattctggactcgatgggactgatttgttaccgaaagcaccgaggcttcctgtgatagacaaaaacccaattgtcgcaatgcgtgatgctctcatggcgcaaccaaagggaacggcttgggttatcgcaacgggcgccttgaccaatgttggattgcttttcgcaacgtttcccgaagtagcggctcatattcagggtcttagcatcatgggcggtgccattggtggagggttcacagatgctcccatgagtcgactgccgggggaacatgagagaattggaaatacaacaccctgggcagagttcaatatttatgtgcgtatatcaacatcgcgtcggatttcccgatcgcttctaacctcatcttcggtcaacagtgtgatcctgaggcttccaaatctattttcaacaatcctaccctggcaccgaagacaacaatga

SEQ ID NO: 13879 - DNA, 357 bp, A.fumigatus
tcagctgtatccaggacacgatgtaagtactggacgctgaaacacaaccttactataggtttcatgaggattctggctaaaaccaaaatgtctcaggacgcattcgctattctgctcgctgcgcatcatccgtcgttgcatctcttaggaattacaaccgtccacggcaactcttctctcgagaatacgacgactaacgctctaagagtcctcgaagctatcggtcgtccagatgttcctgtctatgccggcagcaggaagcctttttgccggcctgcagttcacgctccggacattcatggtacgatccatgacccctccccttgcataattctgccagcagaaatgagacgctaa

SEQ ID NO: 13880 - DNA, 2721 bp, A.fumigatus
tttcagggtttgggaccgcgacttttcagggtaatgctggaacgggctgccggatgccttgagaacgcaggtcggcgtttcttccgggattccaaaggggcacttcggagtcggagatcttggtatcctcatttcgcgcagagcaatgggacaagtgcggacactgtacatttgtcacactcggcctccacaacatcagaccgccaggattcgcttatctctgtctcttggagggcgaggtcagcaactgccgatacatggacccctgttctcgatttcctgtatcctccacgtacccaggaatttgctgcatcactcttgttacgcccatcccggagacttgccgtacggcggaaaaagaagccgatacctgctctcactagggcttacacatcggtggctgcgagcctgtacaagcccgtcattccagataaacctgtggtggatcttgatgcgaagaaggcggatcagctcgaacgatttcgagccaaggaagaacttcggtcaattctcaatcaaagtaaaccgggtgtctatggagactatgacagggcttgggaactttatgagacagctcgccggccgaaagatgtgactccggctttcttggctcacttgagtaggtcaacactgctccgtaacaatctacgggctcagtgggtctttcggagaatctatcctcgtgaccgttcccccgaagattatctgcacctggcaaagtcttacttggctgtcgggaagcccgatgagataatcagaatttgcaaggacgcgaaaggcggtggcggcgatgttctttgttgggctttcgctttttcgcattttgtcaataaagcagattgggactctgctgagaagttctggaatgcgcggccgccatcctcggagaaggtgttgctcaatgcagtcgcttctgagctgaatgactctaaccttcccacgaagcttttcgatctcgctgaggtattacggagtcaggagacctcgatgtcctggagtgggcttgtccactttctcctggactatgctttttccaattcccgaatcgcggcggacgtatcgacagaaaatatccttcttctattaaaggagtacaatctactggggtttctcacggcgcagcattatttccgcctgattcgggctctccagtcctccgacgttcgctctacatttacgaagtcaattgtggtgtaccgtaatcttcgttggcagatggaacaggaagtgcctccagcggaccttctgggcgcatttttgcggtgtctggctcgtttcgagatcacaactgggatacattatttcctgggtgaatatgcccgtttccacggccagccatccattgacgcatacaaaaacgcgctcattgcattttcaagagccggagatgtggaaaacacaaacaccgtttttgaacagcttgtgaagcatcacgggaagccctcgagtcgaaggcttttgactccgctcctttacgtccatgccaggcttggcgatgtaacggcgacgcgtcgccaattcgagagagtatcaaaggagttcggtctgacacagaacactgtgtgttggaacatcctcctcactgcgtatgccaatgcagatgactttggaggagccttcgctacctttgacaaaatgctggaggagggtgtccagcctaactctcatactttcggagcgttgatgggactttgtgcaaatagaggggatatagacactgtccgtcagttgctcgaattagcgaagagaagccctgtgcggatcactacgccattactggatacaatcgttgaggcctattgtaacaatcgggaacttgaaaaagctgagagtgttgctgagacctgccttggtctggatgtcaaagggtctcgagtgaggatgtggaatgtgcttctttggaactatgcatttcgcatggacttagagtctatttcaagaatacgttcccgcatggattctgctggagtgcaacctgatgccatgacatatgcagctctcatgctcagcttggtactgcgagggcagaccgatcccgcgcgccgaatcctcagaacacttcatcgaagcaatcacatgtacgcaacagaatttcactatgcaatcatcttgtacggctatgtgaaagaccggaaccgagacatggttcacatcatctttcgcgagatcaaagaacgtttcaagcgtcctggattcacatcacggcttctcgttctcagaaatcagctgcaacgtgatctggaacttatcaaaactggtgggcgggcaggtagtggtgccaacgttcggttagagaacgcggaaagattccttgcagaaacaatcgccgactttgacaaagccaatatggcgtcaaaagaaccattgcctggcgcgggcagattaccaatcacccaagccttccctgctatgtactatgaatacctcatcacggcatatggcactcggggagttttccacagggttaaagaactcttcgatcaattcctccgcgacagaaaatcctccacttctgagcggcccgcctatgatgtggcgcccctccgtctcgtttctgcactgatgctgacttatttgaagtcagagcagtataaaaaagttgaagagtgttggcaaattacttttccccgtgtcgtcaagatggcttactcaagcccctgggaacccctttgggggggaaaatttgggaaaaaaattttgggggggggcccctttttgggg

SEQ ID NO: 13881 - DNA, 330 bp, A.fumigatus
cgatgcccgcctacccacccgcactctagactatccatattgattccaagcgaccacggattccgaccacctctctatttttgtggtggcctgctctcagttaatatggaaattacggatttcgttttcagagagagagaggacgtcctcctcgccggagattacaacgcttaccgggcacacacaacacgcaggttgcacaaacttcgcaagaagctcggtcagactactcctaaaggtcgtaaatatactgccaaacctcctgtcagtgcagaggatattagcaacaatgtggcgtatgtttcccccgatatgcttgggtgtggctaa

SEQ ID NO: 13882 - DNA, 612 bp, A.fumigatus
  unsure (70): Identity of nucleotide sequences at the above locations are unknown.
gagtatcacttggaggtcgcgtactgttgctctggaagatgcacaatctcacaggctcttgcttctgcanctgcggcagagtcgcgtctcaagtctgggcttgcggatgtggaaagggagtcggtttcatcaaaagataaagctgccgcctatgacagtgttattattgccagccaggacgcagtcgatgctactaagaccgccattgatgatttagctaatgaaggggtggagccaagcgataagaggatgcaaagcttgcaaatcactcgtaccgcggtcaactatgccttggtgggatggagaattggacgtaaccgggttctgtgcggtactaacgacggcatgatctttgaaactgacaaagccgagtgcctcaagaggggaaagggcgcaagtcgagaggagtcgactgggaagaagttgacaaggctacgcgaaaaggttgtgctatatgactctattctgcagagcatcgagttcatcctggagttgcctggtgtcgctgcagacaccacctttgtgcaagagctggaagcgaaacgctgctacttccgtgctttgaggtacgaatatccagttttgctggccattacaattcaggctaactga

SEQ ID NO: 13883 - DNA, 1458 bp, A.fumigatus
aattggacttacaagaataacactgcatccacgttcacagccatgcctcttcctctctcgccttccccaaccatcctcatcccccaccttccggcaaagactctcgtcggcattgacctcgtcaccttcacatcgacacccaattttcatggcatacgagacctaccgaatggttggcactttttatacactggaacaacagaaagtctctctctgagatccgggggttggttctacgtcggcgatatcagcgtctttgatgagagtcacaatggaaccatagtaacggcgtcatccagaagtctggggtcggatattttcgtatggaaatggaattcggagacagaatcactggagcttctgcgagcaagcagtgatgcggaccggcaggaggcgatgcgacataaagctaatttaggcgctgtctggcagcgtggtgggctgttccggtaccgcagtcgtgtctcgtcatcgcggacatcgcagtcgcagtcgcagtcgcaagagcaccagagtcctgttcaggaagacattgatgaagaagacgaggaagagggaagaaaagattggacagacttgacgaacaatatttccccaaggcttctgtcacggatagttggcgacccagaactagacgttgatggtcggcctcggtggatggttacgtccggtagtactgcagaaagggatagtgataagattccaggacttccggatatcaactcagagaatctagctaaggttactggggagcaggaaactgcattctcatttcttcccgttgatctgaagcgcacatggagagaaggagctattgggcgggagaggaccgaggcggctcaagatcgttcatgggcattgggggacctgattcaacgacactcaagtggtggagaccgtggagaacagacgggagaggcacagatcttgggtgaactccaattcactttcttgatggttatgacattgatgaactactcgtgtctgcagcaatggaaaagattgctggagctagtcctgacctgccagaatgcaatcaaggatcgtgagcctttcatggtgagcgtactccgattgcttctgctacagttaaaacggtgtgacgatgtcgaaggtggactgttcgatattgacggagtcgatggcggggaatttctgcgcaagctcctgatgaagttcaggcgaaccctttatgaagttgtcgacaaccctggtcctacgctgaaggcagaattcgacaagctggctacatgggtcaaagacgaatacgactgggaattggatcgcgaagcctttgtccgccggggcataatccagctggaggacggcgaggaagttgagctagaaatggaagatgatggagacgacgagacaggggagtatgctcccctcgttgtcgatcttggcgaagggaacacgacgcaggatccggacatggccaatgtggatacgccatag

SEQ ID NO: 13884 - DNA, 282 bp, A.fumigatus
ggttcgttttttgacctccgcagctttcggccttgtgcgattgataccctcgaagagcgatgcgcattgaggtcacctctcagacaaggaactaacatggtcctctttaatagtggtcgcgaaaccatctgccgtgtcaccggtggtatgaaggtcaacgctgaccgtaacgagtcttctccctacgctgccatgttggctgctcaggacgtcgctgcccgctgcaaggagctcggcatcaacgctctccacatcaagatccgtgccactggtggtatgtag

SEQ ID NO: 13885 - DNA, 204 bp, A.fumigatus
tgcccatcttcacacgatagcgttttgctattgttgaagaccaactattttactgatccgccagggtatgggacagatacaatggtccatctgatgatcgactatctgtctctcaccgacaattcaatgctaatcatggccaacgttggggttttcatggtgtacatccgctatccgtcaaccattgatcatttgccgcattga

SEQ ID NO: 13886 - DNA, 195 bp, A.fumigatus
ctgacccctcgattgtccaagggacagggtcagggaattccagacaccttccctgcagattaccttaagcttctttcacaggtcagatcatgcaacacaacacaagcctgggatgacggcctgcaagaagcccattacttgaccgctggcaaggtcatgcctcataagggtgcgtggctcacggcggctcactga

SEQ ID NO: 13887 - DNA, 741 bp, A.fumigatus
  unsure (681): Identity of nucleotide sequences at the above locations are unknown.
gtgcggcgtatgcggttctcagtcacaatcttgctcacatttcgtgaaggacttaacaaagatgtattcccgctgggcactctaacctaccccatcactcgcaatatccgcgtagagcttgcggtcacagtgattgttgccatcctaggtgttgtatcgcagctcagattgtggaaagtgatcagagacaagcgacgcaaggaggaagcagtcaagaaagaggaagagaaaaggaaagaagaggccgaaactgaagtggcccgcaggctcgaagagaataacatgcgagaaagacaagcatgggaagctcaatacgcggatgcagaagcaaagctcatgcccgagcttggagatggcactcaatgtgctgctgacaaggaggatctcgaaaaacgtgacggggcagaggtcagcagcatttcgagctcatcccaggtctcttatcgctgctctgactgtaggaaacaggagggcagtggggcttcgttctcagatgtgactcgggctacgggaaatactgagattgaaaggcatggagatgcaactgagaagacagctgacggcgcacatccaatgccattcagggtctttgacggcgcgggcgctgcgagcctgatggatgacaaggaatcggatgtgactgccatggctggctcggacaccgcgacggtacgctcgaancgcttctccggaataaccatccgggaagagaatggtctatccgagccacctgaagactgc

SEQ ID NO: 13888 - DNA, 279 bp, A.fumigatus
attattcgtttctgcagcatcgataccgcatgttggtcgcgatggaatccagccacttggcgctttagaagcccgagacgaatcgccaactacgacgatatcagggaatcaagctccaagcgcttcagtgacgcgtgcagtaaatgcgacagtcggagtgaactctacggccacgtcaaacaccagcgctccggcatcaacgacaatcctgtcgctcaacaaatcgactctttcgggaagtgggtgcatactccctcgttgagacattctgaaagctaa

SEQ ID NO: 13889 - DNA, 264 bp, A.fumigatus
agtctgatgctgatcatttcttgttttaacataacccttgtgtacgttgagggggatgcccccatgcgttcgtacgaagactcagatggcaagaaaacgcacgccctgaacattgttgcaagtaagccaactaccctgttcatgcatctctatgttagagataccatactaatgcattgccgggggccagggaagctcaatgtcctccaaaagcccgttccaaggccaaacgctactgaatctggaaaccttcctccgcattaa

SEQ ID NO: 13890 - DNA, 471 bp, A.fumigatus
gctattcatgccattgaaacatccaagccttcatttgcctggacgctgacgtccaatgcagctcgtctgtgtcagaatcttggttatcaccggagttcatcgatgagtcagtttagtgacagtgagaaagtaaaagcactttcactctttttgtgtgtttactgtctcgacaagtctctttcactcagactagggcgtgcttcatctatacaggattttgatattatcattaccatccccgaggatttgggagggcccagagtggacgaaccgtggagaacaatgtatcatctatgggtgaaaaccgccgagattcaaggaaaggtctacgaacagctttacagtccggcggctttaagtcgaccggaacgcgaaaggttattttgcgctcgtcaattggcatccgagatggaagtagccgtcatggaaccgttcaaggtaggcattccctggagatcaagtttaccataa

SEQ ID NO: 13891 - DNA, 714 bp, A.fumigatus
ctctcgcctgccggagcgtttatcttccaccgcgtggtgaagacttgcgagtgtgacggcgtggatgtctatcaatggcatgcggccgatgggtcagaatggaggagagggtcaatatgtcctgttgctggggacgggcggggtctcgattgcgggtttgcagattgccaaggcatccggcgcgaaaggtttgtcgtaatgctaacgcaatttttttttggcatacgattgacaatgtcagttatcatcacgtcttcatccgacgagaagctggagcaagcgaagaagctcggagccgactataccatcaactaccgcacgaaccccaactggaacgaggaagtgatgcgggtgacgaacaaccacggcgcagacatcatcctcgaaaccggcggctcggagaccctgagcaagacctttgactgcgtcgcctttggtggattgatcgattgcatcggctacacatccgggaagcagcagaatccgaacgacactctcaacatgaatgtgctcacactgcgcaagaacctgacgatcaagggaatcatcaacggtcccaaggaccgcttcgaggagatggtgcagttctacgagaagcaccagattcaccccgttgtcaaccggatattccccttcgaagagtccaaagaggcgttcaagttcctggcaagcggagctcatttcggcaaggtcgtgattaaggtgaaggactaa

SEQ ID NO: 13892 - DNA, 318 bp, A.fumigatus
acaaagcctgacattcctagtttagctcatggaatgcactttgagatggatgttatcgagttttctaaaatcaagcgtcagttgtcagcgggaggcacggataccagcggagacaaacggactcgctttgaagatagacatggtatccaaggttggactagccgttcgatcatacagggaacccatacacccgttgaacaatgcctctgtaacactgacaatgacctggacatgctcggttccgaaaccgcgcaatgcgatgtgtgctttggagaggtaggagctgcgcgtcacccagctgtagtatatccatgctaa

SEQ ID NO: 13893 - DNA, 240 bp, A.fumigatus
cagcagttagcatggatatactacagctgggtgacgcgcagctcctacctctccaaagcacacatcgcattgcgcggtttcggaaccgagcatgtccaggtcattgtcagtgttacagaggcattgttcaacgggtgtatgggttccctgtatgatcgaacggctagtccaaccttggataccatgtctatcttcaaagcgagtccgtttgtctccgctggtatccgtgcctcccgctga

SEQ ID NO: 13894 - DNA, 213 bp, A.fumigatus
tgtagctcgataaaggggatcgtaaccttgataaataggtatcgcaggttgagctctccgagaatgtggattgacacttgggcattgctgagcgaaaacgaaattaagaagctaaatgactataagattaggcctgtgagagtgccttggtatactaaggaaggtaaaagcatctattactttggggacgagaaatacatgcaacgaacatag

SEQ ID NO: 13895 - DNA, 669 bp, A.fumigatus
agatgcggaggtaccccttccagaatctcttctcctaccatccattcctccagttccatcttctcatccgtggaaactcttttcaccgtctccaaacattatgtctaccaacccaggccaaatctccccccttgcgggaataacccggtacattcaccacccacaacccctcgggccaagccatcatccactcggaacagcccgtcatctggggctcctaacgagggcggcgcgttaggcatggggttcgcctacagaacttccgaattccccggcaccttaaacaacgagggggacatcaagacccacggtaaactcatggagaagaacaccttgggcctggtgaacccggcgggaccggtgtgtcggtttgtcgattttaagcccggtggagagccgttcatgcatcgcacgcagagcctggactacgggattgtgctgcagggagagattgagatgattctggattcgggggagaagaggacgttgaaggcgggggatattgctgtgcagcggggaacgaagcatgcatggaggaatccgagcgaggtggagtggtcgcggatggtctttatcttgcaggacattcagccgatagtgattgggggggttgtgctggaggaggatgtcagtgggtcggacgagatcaagcctagccagggtgattga

SEQ ID NO: 13896 - DNA, 1287 bp, A.fumigatus
agacgtcacacgatcggaggaatgattgagctcggtcttggtcgcatatctaggctcctccaacagactcctctgtcatggaaggccatccacattgctggaaccaatggcaaaggctccattagtgcctatttgtcgcacatgttgactgcgggtggtgtacgctgtggtcgctttacttctcctcatcttatcgatcgatgggactgcatcaccataggtgagagcgttgtgcaggagtcgctttttcggcagattgaggaaagagtcagattaagggatcagtcactgggaataggggcaagtgagtttgagctgctcactgccacggcatttgagatcttcaatcatgagcatgtcgaggttggtgtggtcgaggtgggaatgggtggtcgtttggatgctacgaatgtactgagcgatgtattggtgtcggtcattgcgaaaattgggctggaccatcaggcctttctgggagatacgctagaactaatcacccgagagaaggccgggataatgaagcctggtgttccatgtgtggttgacggcaccaacgctcccgaagtgattaggacccttgaaaatcgtgttaacgagttgaagatcgatgctgtctatgcgcatcctgatacaatatgctcccagtcgccatgcctgggccgtatcttcagggagcttgatctacagcgtcatcagcgggctaatatgtcctgtgcagtatcagcgcttcggctcgccctggcgaaggtccgcccagggctcgaggtggacatgcttctgccttccctcaaaaatgtagagtggccaggacgtttgcagaaaatctccctcagtcctctcaccgcccgcacagagcctgtcttgctcgacggtgcacacaatagccagtcggctgaggttctcggagagtacgtgaacaaaaatctgcgtcctcagggtaaaatcacttgggtcattgcagcgtcgcgtgggaaggatgtgaccgcgctcttccattcgataatcaaatctggagataaggtcgctatcacggcattcggccctgtcgatggaatgccatgggtgaaagcagcggatacagaagatctggctctctgtattcaatcaattccaggcgtccaagacgtacgtacatttgacggggacgttcttgctgccatcaactgggcttgtaccgaagccggcgactgccccttggtgattgcagggagcctataccttgtatcagacgttcaccgtctcttgcgtgaagcgcgcaaaagcgcagaaatataccggggtcattag

SEQ ID NO: 13897 - DNA, 228 bp, A.fumigatus
gttgctaacgctggcacgttgaagcaattgggcgactgtttgggtagaggtgcattcggttcagtgtatagggcgctaaactggaacactggggagactgttgctgtgaagcagatcaagttggccgacctcccaaaaagcgaattacgagttataatggtatggcatctggatctgacggtctggtgccaagaacggccgtactggccatttacgcaatggagttag

SEQ ID NO: 13898 - DNA, 459 bp, A.fumigatus
agacaacctggttaccacgacactatagccgatgacactgcgatggttctggatgacgatgatctcgaaggatttatagctcaaccggctaatctaaacgacctcgatgaattcatcaacgccattggcggtgacaacagtgacaacggtgacaatggtgacaatggtgacaatggtgacaatggtgacaatggtgacaatggttggaatcccatagacttgttaatgctacctgctgacagaaatcgtctcacggctttcaccaatcagccatcctatcccagtgctgcaaataccgcggacccagcgacagacccctttacaattgaccctgcacaacttatcccgcaaccgggtgattacccgcaggttgcacgcccaactacgacactggcaacagcagatgttccaggggattcacagaatgggggagacaatgacggttttcagcagaactaa

SEQ ID NO: 13899 - DNA, 267 bp, A.fumigatus
gcagacggcacagctatatataaatccatccaacttgagcgaacactcattcgaagcacaaggatcaagcacacactttttcctgacacgcttaaatactatcttaccctcgttttcaaaccactgaactcaagtcactcattcttttcccttggtctcaagcatccagacatcatgagattcaccttctttgctgctctcgccctcctcggcaccgctttcgcggctcctactgcgcctactacctccacggctactgtatgctag

SEQ ID NO: 13900 - DNA, 186 bp, A.fumigatus
tgcactgtgatcaaaatattctgcagtttaggaatctctctacggagtattgttgagcaagctacttcttcaggatttagtaactttttcgcagtgtatacatttcgacactcacaaggtattttaacgacatttggaggagaaatgaatcaatccatccctagccgtacagtgctgagcaattag

SEQ ID NO: 13901 - DNA, 186 bp, A.fumigatus
tcatcaggatcaatagttcataataacagtatgaaaacagctttgcctttaacctatctcctgctgtgcgtccgcaaggtcctttttgtgtatcacacaaggcttgtcttcacccactcgattcaggaaataagctctttctacttgtggttagcaatattttggctcagacaccaggtgggatga

SEQ ID NO: 13902 - DNA, 3354 bp, A.fumigatus
ttgcggaggaaaagaaatcagttgaaccccgagtcgtttcctgtcttctcttctcagttgaagaggcgactgacaacacatgagaatctcaagtctgaactttcagttccaaatacgcgcggtagaagcttacgttttgtttgtagcctgcgaacgaacaagagccgcgcaactaatgctaccgttgctgacctgctcaaggagttagcggcagacgaagtgaaatacatgcgcgaactcaagactctcgtcggcggcgtaatacctgtattgttgacttgcgtcctctcaaggtcagactcggctattgcggcaggtctctttcgtccgtcaactgatccgaaagacgagctgaactttactaagccgatagtcgatatgggtgtggccatcgagcgtttgaagacgctgcataagcgaatcccgcaagataactcggattccttgctaacttgggcccagggagctcagcgagtctatcgtgaataccttcgagcctggcgattaggcttcagagacgttatcgttaacttggctcctttagaagagggtgaggttgctcagaatgctgatacgaagagcttggatgagggaatggctcgagacgaaaatggtgacgtggtcaacagcgaaggtgagaaggtggatgtggcttatctgctcaaacgaccgctggtacgactcaagtaccttgcgaaaactttcaagggcatcaatatgctcgctccgtctgcaaaagcggaagagatagccttgatctatcagaatttggttacggaagctcgtcgccgcgcaagagaggaacgggcaagacttgaagacgaatccgctgccagtattgactcaactcgtgcgcgtgatcctgcgactctggaagcccttactgatgtgaccatcgacaagactcgacgcgtccgcgcccgtgacttcttcaatctgtctctgtatcattctacaggccaggtcgtagactgtcgggcggagcttcttttaagagacaatggcccaggtaacggggcgggcggagatctgctgatttgcgaaattgaccacgcggatcgttggttactgttccctccaatggacgtggcgtgcgtttctgcgcgtaatggagaccttaaaggggagattgtggtcatgttgcgtagccctccgggacaaacgaaagcgtggcaggagctgttatcgctacggatcgatgaggaggatatagcatttgaatgggttcaactattgggagtgaacccaccaccaccagccctctgtcggacccagagcttcattgagagagcaaagcaacggcaaagagcgcaagcaactccttcaagcgatgtaccgccggctcaaaaaggtccaccaagtcctacaagtgtagatatacctattggagaaagggccacgtttcgaacagctcggcggtcttcaacccctaaagggtccttgtcggaacccagcactgtttgtgaaaccacttcagctattgagtcatccgtctactctgcaattactcgcgagtctgattacgcttcaacatcacaatctccaccatcaatactccacgctcgtgagtcgcgcaagactccccttgttgatgaaagaacgtcagccggtctgaaacgatcgaaggctaatcgagttcacctacctgtagagagttccccgtcaagcctgcagaaagatgctctttccgacagagagcaggcgtcagcgacttctcatcgggatcgccaagaagatcagaagcctgtccaatccccagtcgttgtccacgaaaagaagcctgacacagagcaacgatctccaaaaactcccataagagacacggttgatcagggatctccgcgaatatcgtctgtgccctcaatggatctgcccagcatacccaaaatcagaaagggcagtagtcaaagttacataacggagtcgttggcagcggtatcggacgacgaagagtacgctcctgtggactcgtacagtctaccaggaagtccctcgaaaagcaagagtcactctcgatcgaactccgactcgagtcaaacgaacgacgagcagcctccgccacctcctccacacagtcgctcgccgagctccacggggccgagtctatcaaacacacctgttctcagtcctactaatgtgagacagagaaggcgtggatcgtcgccattgaagcacgaatatgagccttccacagcatcagatacctattccgattcagacacgtcgactgtgcgacgttacgacatggattgggattcggatgattacactgcgtcggacacgtccgatggtgactctgatgacgagctcgcctcctcattacctcctgctgatgcacaaaaccttgccaattcgactctggccgcatcatctaacagctcgctgtcaccctcgaattctgcatctcaaggtggatatagatctgttccctcgcaaccaacaaaatcttctaccgccgttgcctctgtctttgcatggtccgaaaaagggacatgggaagctatagctcccactgactgcaagattgtagtcagccctgggctcatcgaggcgtatgaaataagctccaaggccatgccggacatggatgatgaagagcatagaggtcaaggactgctactggttgccctcgagctcacaccactagttcccatccggcggggtacagccatcgatattagcgttcgttcgcctccgactgagaaatcgaagatcgattggagcaacaatatcatgttccgctctcggaatgcagacgagtgcgaggcgctgtatggtctcataaaccaggcacgtataaacaacccaacctacattgctttgcaaaacgcacgtggcccttttgcaaaccagcccgtccctatggaacgttcaacgaagacaggaaggtggttcggatggccccaacgccgaaagagctaccgcgcatcgaactcgcctcggtcgctcgccgaccactctgaaagtagtgttggaaccatgagtagcgcgttctcggcgttgaagaaatttggttccggaagcaagatgttcaatctctcgcgctcgtccatcacttcccggagcgcaaaggacgatagcctgcactcaagctctgccggctctggttcgcatcattcatcttccggcatcggcagaatagccgctgccatgaaggacgccgatggaatcggcctgtccaacgccaaaatccggctgtacgtacgcgagactcaatcgaagtggcgtgatatgggtgctgccagactcacaatcatgcccgctcgccctgcacctcgccgcccggggacatctagcagtagacgcagtgataccagcgtcggggctgacgaaagaagcccgccaacttcatga

SEQ ID NO: 13903 - DNA, 273 bp, A.fumigatus
tcccactgtctgtccaagcagaagaaagacgcaacagccgttcgactgcccctcagcaccatgttccctcaacgcaacatcctccgcgccgctcagcagctgcgtagcgctcctgctcgcgctgctttccagcgccgcctcaacagcaccgacaacaagcttccttggatggttgacaatgcgttcaaccgcgagagagctgctgtcaagcaccatgctgctgccaccagcggttcgtatactccaattggccccaagaaattttttggatga

SEQ ID NO: 13904 - DNA, 231 bp, A.fumigatus
cgcagtcgacttcgttttccgcgaatttatcgaacactttactcaccaatgcctagtgctgtcatcccctgcctgattctcggcagtatcaatgcttacaacctttggaacgagcactgggagcactgggagcatatgccccctctcgaggagcgtaccgagtacccctatcagaacgtccgtgttaagaacttccccttcggcgatggggacaaggttagtttcatttaa

SEQ ID NO: 13905 - DNA, 642 bp, A.fumigatus
aagggctttgtgcattaccgtctgcccacgtaccgtgtgtggtccaagaagaatccatctactgaacgggaccccgtggacatcaatttattggagcttaatttggactccacgagccacctcgctcaggtggcttatggaaatatcgaaatgcaagaggagggtggaatctatgtcagcactaaggatgtcgaacgactcctagagtttcagattggcgagctacaaagtacgcagacgtcccctttgaacgtgcgtattcatgatgcacacttactaacggaatgcaggacttggaggaagagtcccagacggcatgaaggtgcagctcgaacgtatcatggcgtctggcgtcgcaatacccaacctgacttactacctaaggtgagatggagctcgcgaacaaacccgccgtcgctaacgatctcagattcctcgatgcatggagagctggagactacccttcatccttcgacaatcttcacagatattttgactatacaatgcatagtcgtgaccggagctcatatcaatatgcgctgctcaacctcgcaatccttcaggctgatttcggatgctatggagaagctgtttctgcaatgcaagaagctgtctccattgccagagagtcccacgatatga

SEQ ID NO: 13906 - DNA, 504 bp, A.fumigatus
ggtgagatggagctcgcgaacaaacccgccgtcgctaacgatctcagattcctcgatgcatggagagctggagactacccttcatccttcgacaatcttcacagatattttgactatacaatgcatagtcgtgaccggagctcatatcaatatgcgctgctcaacctcgcaatccttcaggctgatttcggatgctatggagaagctgtttctgcaatgcaagaagctgtctccattgccagagagtcccacgatatgaactgcctaaacttttgtatgagctggctgtatcactttggcaaagccttcccagagcagatgaaagacgtccagaatacgggaatgcttggaaacgaaaaggaaggccttgctttcctgaaggctaaagcgaaggagactgagatgtggagtctgctgagcactacattgctgagcgaagccaaactcgagctgcaaaacgtgagcattcctacgcaccgttgttctttttgtatacagtcctga

SEQ ID NO: 13907 - DNA, 783 bp, A.fumigatus
ggcggcacatctgtcggtatgttccctcttggtgcaatgaagaagtggcttctaataatgcacagggatgataaagtggcagcagactaccttctctcccagcttcaagcgattcagctacctgacaatgacgcctctcttctcctatctttcctttcgattgaatacaaaatccgacaaggcgactatggccgggcgttggaaattgtcgagcagacggctcaatccatgcaccaagacaacttcgacatccacagtcaggtgaagctgctttgtttcaaagcgcgaatcttcgagaaaacgggccatccgcaacgaggcttctccttagcaatgcgagccgccagtttagcgcaccgctccaggcttttaccgggtctctgggaagcaatctgcgtgcttggtggagtcctgctaagtctacatgaatttgaagctgtgaatgagatggttgagagcatcatgcctcaggtcctcgagaccgacgactgtgatctagcggcgcgggcgtactcgcttctcgtcgacgcaaatatgggcatggctggcaaggcgtggagtcaaggacaggacacgcccgcgaaaaaggaacacatgaaccgtgcgcttggctacctcgactgcgcctacgaccaatatgaagaaattgaagacatcaagggtcaatgtgagatgatggccaagaaagccacggtgatgcacctcactggcgatttggtccttgcgaatgactacgcggctaagtacctggatctgcagaaattgagtgagaagggggtatag

SEQ ID NO: 13908 - DNA, 222 bp, A.fumigatus
gtacttactgcgttccatggtgacacaagaaatattaccaagggcggatcttcatttcaactattggataaatacttttcaaccccaataataaagcaatactgccgccctgtttcgacctcggcgcatatctatatcatatctgatcagaatgcatcgatccacatgatccgccatactctcatgtcacatgtggtagcggctgtcgttcttgaccggtga

SEQ ID NO: 13909 - DNA, 183 bp, A.fumigatus
gaactgattcaattatcatctatcacattggccacggggggaaggcaagaagtaatcttaattcagtactccgcggacagtgggttttgccttttcagcaacaaagcaacggatgtttatcagagtacacttgcaactaatgttacagcgaaattacacaagagtagtggggtgactttttaa

SEQ ID NO: 13910 - DNA, 1374 bp, A.fumigatus
aatacccatagggagatgctgaagttgcatgttgctaacagccttgacaggatcgggattgttttccatttccagaaccaagttgaacgcctgctaagctggaggaaatcttcccatacattctctttcctttttatctattcctttatatgcctggatcctaatctcctggtggtactacccatcactgtcattctattattcatcatggtcccagccttcgcggctcgtcatccgcctcccccttcaatgtctacttccagcaccacaccctattactcataccaggggccggcacttgcacctgcaaagactatcaagccagcgtctgagacatcgaaggactttttcagaaacatgcgtgatctccaaaatgtcatggctgacttctctgatgtgcacgatgcgactgtgtcgctcttcgcacccataaccaacttttcaaatgaaaagctctcatccattgttttccttgtgctaacgatcactgccgcgctattgtttctgacagcccatctcctgccgtggcgctttattctactacttggtggcaatgcggctgtcctatccaatcatcctggcctacaagaattcttgcagaacctactaggagacagtagcggtgctgtgaaggccgacctgcaggctgaacgggcggagaaaaagaagactctagacatgtatgggttgtcgatgcagtcgaacccatccgccgccgtgtcgttgcttgattcattggctgatatttctctggactcttatcctgaagagcgtgaggtagagattttcgagatccaaaaccgctccctagctccttattccgagtcagagtgggaccatttcattttcagtccagtgccatatgaccccttgtcgccgtcccgaattgcaggagaccgccctagaggatgtcgtttcttcgaagacgttcagcctccgcctggctgggcatggaagacaaagaagtggaagttggatcttgactgccgcgagtgggtcgttgagcgcatgattaccggagtaggctttgagatacccggagctggtccggaaggaagcatggccaacgaagagattggaggctgggtttgggatctaccttctcaatccgcgtccagagacgaggatgctgtggccactgccctagggtatcaagactatggctcaagttcgaagccagcctcaattcaagagaagaagaagacgcagaaaggtaagcagaagtcgtcctctcgagactgggaggagcaaggacattcaggattcaatggcatgggcgaatggcggaggagacggtgggttcgagtcgtgcagagagccagcgtgtcctccgagaccgacaaagagaaaccttcaaaccaaggaaaaacatga

SEQ ID NO: 13911 - DNA, 183 bp, A.fumigatus
tctgatttgttgattctgggcggtaggctcaactgtgctcaactgcgatcaacagtctggtccgcttatattgaggggctaagcaaccattcaggaacgtccatccttttctggcctagctacagtaaatggggattgaaccgtgatattatcgtgaactgcatgaattggtgtcgcaactga

SEQ ID NO: 13912 - DNA, 468 bp, A.fumigatus
tatgacatctcactagcggctcaagttagacgcgtcattatcaagggacttccttccgcttggagtactccagccaaagttctgtcacttatccatggtggtatggttgagagcatccacatcactcctaccggcaaccaagctcatatccttttctgcgaccacgaggcctgcaagactttctttgacaagtaccccaatggcattgacattgacaaggagaagagaaagaccgtcttcgtggagatgggtaaagaagtcgatgtcatcagctctcagctttctttcaatctctccattggcagcacccgtgttgtccgcgccgttggtgtcagcatgaacatcaacatgggcgagcttctgaagctagccggcgccaacaatcgcaaggtggagaaaatcgtggactcttgcgtccctggagaggtaagctggtgtggtcatccccaagaggggcttgtatgttaa

SEQ ID NO: 13913 - DNA, 432 bp, A.fumigatus
gctgtctctatgttttcctggctagcaaacgtctttgatactgctctcagactccctgagaccatggatcttaaacaagtctcagacatgatcattaacgctttcgacaatgtcatgggaaaggactctcagggcctgcaggaaagcagacatgcacctaagaaggaagataaagcaaaggagttgaagtattctcagcaggttggtcctcctttcgtccatttctctgttctgggtagtgttcgtttcggcattgtgttctgtgcacctggtcacatcggcgtctttgcacaagcaggccatgcacacatcgtgagagtgaagctaattgcattttttcaacaccaaacagtactcccaggttgtccccgtcaacaaaacctcacgtacctctggtggactttcttctccttccaacacccgcccccttaa

SEQ ID NO: 13914 - DNA, 345 bp, A.fumigatus
catcgatctgattatgaagaagccccccactcgcgtaatgctgaaggctttggtgactttgaaaccaacaccgataacaataacgcctctctgatgcctggcattgaggaagacgctggagcttccaaggcatttgcttccggtttccgcgacgatgcgactgagttcatcatgcaggatactcctgttgcagcttctgacaatgctgtcgttgaagagggtcgtgggaatcttactaccttcaagtcctggggtactcctgtcacgcgtgacaagccaggtatgaaatcaattttcctgattcctttgggcggacttgtatatgctaatatgacatctcactag

SEQ ID NO: 13915 - DNA, 210 bp, A.fumigatus
atcattccagcgcagacattacagaagctccaggctcaagtctccttctcaggtgttgaggattatgtatacatgcaggctgctcctcaactctcagtcgatgttcttaccatgccgctaactgctcacttcctcttagtattacgtcgatatcggcgaaacgtccttcctccgggcatcataccccttctcggaatagcccacttttga

SEQ ID NO: 13916 - DNA, 399 bp, A.fumigatus
cgctccctattttgccagcatcgtggggaccagtttgcccagagggctaaagcaatctacgaggcttcccttcctcggttaaaggcccccacgttggtgtacttgcaggggcttataactcttgcattttatctctatgctaccgaacctgattctcagggctggcttttgatcggcacctgcgcgcgacttgcgtatgcactggaactcgataaactagacgaggatagtgaggctgttcaagcacaaatgggccttccagaagaatggtctatgcaagaagaacggcgacgagcgtggtggtgtatttgggaactcgatgcgtttgccgccgctattgcgtgtcgccggccaactattgataaaaaaaaacatgcaagtcatgctgccagtatctga

SEQ ID NO: 13917 - DNA, 234 bp, A.fumigatus
aaccacgtatcgaagaagcaattgggtggtctcgacacatattatgttgcaggggttaggtctcttacccaatgtaaatcagtctgtaccctggcctctgacattaatacgtctatagggcattcatcttttgccgattcatcaatgctagagaggcacgtagaccactatcaaactctatcaaccgccttctcgcctttttggctgcgggatctcaatttcaagctcgcatag

SEQ ID NO: 13918 - DNA, 234 bp, A.fumigatus
ggagcaccaaatgtaaataaagcagctcatgagtacctcttcccgtcgtgcagtgccaaagacgattacgcgcgcgaggaggacaaggggggggtgcgggggggggggggggggggggggcaggtgttcgcgactgcatcagatatgcaggatacgtactgtccttcaacgactctggactataatgctttgctctacggcatttcatcagcagtctttccagggacttgctga

SEQ ID NO: 13919 - DNA, 516 bp, A.fumigatus
gtcttccttttcatggcgcacaccatacctcatcctcgcatgtctctccgtcctcttctcagccgcctcattcctcttcctcgtcccgtccccccgctggctgacactccacggccgccacgaggaagccgcaaggacgtgggacctcctcggtgtcggccatgccgaacgcgagaaggtggaagtcgaacagacccgagaagcaagaacccagatccagatcctccccgcctgcccagcaactactctcaccccggaccttaccccccacacccccgccccgccgcaaagacccctcaaactagccagccacaagctcctcgacatcttctccaaggacgtccgcgcccgcaccgccctcgccgtcttcctcatgggcttccagcagctctccggcatcgacggcgtcctctactacgccccgctcctcttcgaacaagccggcctcacctcctcgaccgccactttcttcgcctcggtcttcaccacggggctggaagggccgcgccattaaaa

SEQ ID NO: 13920 - DNA, 372 bp, A.fumigatus
tacaccgtgctctttgaaaagactattgacaagctaaacaggatggacactggcgtcatcggccctgtcaccgtcatggacagcttcgtgtcgaagtttgggagtcaatctgccaccgtccacggattgatagtctcatccatcctcattccagcagctatatcgtctttcttcgcaggctacttagcagataagctgggcagacccacaggaatcagcatcggggctttgatattcggtatcggcgctgctatcgaaagtgcagcagcccgacttgccatgttcattgtcgggaggtgcattgagggtataggcgagggcctgtacctgggtacgctggtcgtgtacgtccaattccctgaccacaaatga

SEQ ID NO: 13921 - DNA, 639 bp, A.fumigatus
aacaggtacatctgcgagatctctccaacgagcgtaagaggcgcattggccaccgggccgcaattgctcatcactcttggtctagtagtgggctttttcacctgctacggaaccgcccggcttgagtcttccttttcatggcgcacaccatacctcatcctcgcatgtctctccgtcctcttctcagccgcctcattcctcttcctcgtcccgtccccccgctggctgacactccacggccgccacgaggaagccgcaaggacgtgggacctcctcggtgtcggccatgccgaacgcgagaaggtggaagtcgaacagacccgagaagcaagaacccagatccagatcctccccgcctgcccagcaactactctcaccccggaccttaccccccacacccccgccccgccgcaaagacccctcaaactagccagccacaagctcctcgacatcttctccaaggacgtccgcgcccgcaccgccctcgccgtcttcctcatgggcttccagcagctctccggcatcgacggcgtcctctactacgccccgctcctcttcgaacaagccggcctcacctcctcgaccgccactttcttcgcctcggtcttcaccacggggctggaagggccgcgccattaa

SEQ ID NO: 13922 - DNA, 186 bp, A.fumigatus
cagactcgcttcaaggagacatttcctaaagaggataatgaggtggcaatgccatttcttaacttcaacaaaatcttcctcatacaggccctagcactgagggtgttctggattgagatgcctaacactgatgctcttacagaccccctatctcttatcaatcactgcatggagttactaaggtag

SEQ ID NO: 13923 - DNA, 276 bp, A.fumigatus
tgccgactttcggctcgttatctggacgaaagagtcataatacaggcatcaattctctgtccttcttttatatttctattccttcttgatctccaatcttcttccagcaagctgaattcatttatgaagcatatcagcaaatcaataagcttcctccgatctttttcttatttgtccgcattcaccccttcggctagaacgagcaatttcacccctgcatctcagggcgactcttataatacgcacaatggcaaccgcaatggcaaagcgccttga

SEQ ID NO: 13924 - DNA, 408 bp, A.fumigatus
gcttcctccgatctttttcttatttgtccgcattcaccccttcggctagaacgagcaatttcacccctgcatctcagggcgactcttataatacgcacaatggcaaccgcaatggcaaagcgccttgaaggcaagacaattgtgattactggcgcatcgtccggaatcggcaggagtaccgctaaggagtttgcccggacgtcgccgaaggccctgaagctgatcgtgactgcgcgacgacttgactctctgaagcagctggccgaggagatcaaggaggaggtcggtgatggtgtcaaggtgctgccagtgaagctggacgtcagcaatccggaagaggtcaagaacttcgtcccgtcccttccagcggagtttcaagatattgatgtgctggtcaacaatgcgtaa

SEQ ID NO: 13925 - DNA, 246 bp, A.fumigatus
ctgttgtattcagagctcgagaataccgccccccggatacagtcagattacaagccagaacatggcgatctcatcgaagcacagaagcgcaaacgcctgcgcaaggaacgccgtatcaagcgcatcgtgaccgtcattgcaggctatgctatcatggcatggatggcctatctcattgtcgtcactgcgcgaaccgcgcccaagatctgggatccatacgaaattctgggtatctcaagggtatga

SEQ ID NO: 13926 - DNA, 2826 bp, A.fumigatus
atggcgaaaatggctgataacaatgccggttacaacctcttcgaacaatcgaacaatttcacatcgtcagagtcatcgcccgatgcggagatggaggacgagtcgtatcatagcggctctcctgacgctgagggggttggcggttactctgctacggatagtagcgagaaaggtagcagcccatccagcatcgggaactcctcgtcatcagagatcaagcgtggcatcaaacgtaaatcgtcgtctctgagtgaatcagacttcatcagacagaatccagatttgtatggtcttcgccgtagcggacgagctcggacaacacgccaagttgttcaatccacctcctcagagtcagagtcggtcgttagagtctcacgcaccaagcgtcgacgcccggtagcctcacagcggtcctcgaagcgtccatcccctccagccagtcagtcttcctactccgccgagtcagacgatgacgagtatggcggaccttctcgtacgagtaaggcgaaacgtcgtcgtatgctgcagccagcgtcgaacaaggaaccttcacatgctgagattcgcttctcgacgcgaactgcgtctcgtcgtgtctccaattacaatgaagacgacgatgatgacatgtttctggatgaagctgatgaagttatggacaactatcaggcaaacactgttgaagacgaccgtccagctgtagatgtcgtgctaaaccatcgccccaaagagggggtcagcccaggtgacagcgatgttaatgagcactcctttgaattttacatcaaatggcaggagaaatcacattaccatgccacatgggagacttacaaattcctcatcgataactgccgcggcacacgcagagttgataactacatccgcaaggtgctatatgaggagctacgtatgaaccatgacggcgatgcccctcccgaggagcgtgaaaagtggaacctcgaccgtgaaagagatgtcgaggctattgaagactacaagcaggttgagagggtgatcgccatgcgggatggcgatgagggaaccgagtacctcgtcaaatggaagcggctattttacgactcttgtacctgggagagcgaaagtctcgtcagcgagattgctcaacgcgaggtcgatcgctttttggaccgttcctctcatccacccttgtcggacaagaccgagatgaaccctgccactcgcaagcccttcgaaccaatcaaaggcacaccgagctttttacagaacggcgaactgaaagatttccaagtcaagggggtcaatttcatggcctttaactgggttaagaaccgtaacgtcgttctcgctgacgagatgggattgggtaaaaccgttcagacggtcgctttcatcgcctggctgcgtcatgtcagacgccagcaggggcctttcatcgtcgtcgtccctctctcaactatgccatcctgggctgaaacgtttgacaactggacccctgatctgaactatgtcgtttacaatggcaacgaggccgcacgcaccatgctcaaagattatgaactcatgatcgacgggaatcccaggcgtgcgaagtttaacgtgctccttactacatacgagtatgtactccaggactcgactttcctgagccagttcaagtggcagttcatggccgtcgacgaagctcatcgcttgaagaatcgtgattcgcagttgtatcagaagctgctggaattcaaatcccccgctcgtcttctcattactggtactcctattcagaataatctcgctgagctgtccgcactcatggacttcttaaatcctggcgtgatagatgtggacgtggatatggacctcaatgctgaagcggcttctcagaaattagctgcattgacgaacgccatccaaccttacatgcttcgccgcacaaagtccaaggtcgagtctgaccttcctcctaaaacggagaagatcattcgcgttgagctttcagacgtgcagctggagtattacaagaacattctcacgaagaactatgccgctttgaatgatggtgcacagggccaaaagcagtcacttctgaacatcatgatggaattgaagaaagctagcaatcacccattcatgttccccaatgctgaagcgaagatactggaaggaagcacgcgtcgtgaggacgtattgagggcactcatcacaagtagtgggaagatgatgcttctcgaccagctgttggccaagctgaaacgagatggacaccgcgttttgattttcagccagatggtaaaaatgcttgaccttctcggcgattatatggagtctcgtggctactcgtatcaacgcttagacggaactattcctgctgcttcgcgccgcctggctattgagcatttcaatgcgcccggcagtagcgacttttgcttccttctgtctactcgcgcaggtggattgggtatcaacctgatgactgctgatactgtcattctgttcgactcagactggaacccgcaggctgatcttcaggcaatggctcgagcacatcgaattggtcaaaccagaccagtcagcgtatatcgccttgtttcgaaagataccgttgaagaagaagttatcgagcgagctcgcaacaagttgctgctcgagttcatcaccatccaaaggggcgtcactgataaggaagcctcggagatccagaacaagatggcccggagtggcatttctgttagcgaaccgaattccaccgaggacatttcccgtattctcaaacgccgcggtcagaagatgttcgagcagactggaaatcagcagaaagtcttcaccacgggggtggaaggacagcggtggtct

SEQ ID NO: 13927 - DNA, 234 bp, A.fumigatus
agtattgagctgattgatcagctacctttcacaaactatactcacaagcacttattcacttatcagactgattgtaagacagggcttcccgaggaatgtgcctatctattgtgcccactcccttcctgcgtgagagctcttcccggtcctctcgatattgcccacagtcgatctacttttcatattctgatttatcctatcgcgctatgggtcctagttattcttcaagcatag

SEQ ID NO: 13928 - DNA, 2034 bp, A.fumigatus
tattcaacccgttcaggaactctgaagcttaattctacttcaagaatcaattttgtctccctcacagggggttgtccgctcctctcccacggcgaaacagaaagggggacaaagggaggccaccgaaccgcacagcagcaggctggtggacacctgaacaactcaggattccccgacagcactagctccattcaccgcagccaaacaatctacattcctcagcccaccaccttcgtctctccagtacctccattctacagtagttcttgcgacaccaggccagggcggtcgcctcgtggattagtatccatgcacgccgtattccccagttcgactgcctccactgctaccagccagctcgcagatcccacacccaaccctgatagcaacaacagcaacgaccctttcgcgtcgcaggtttcctcgcccccgccgccgccacctcctcgtcctgcagtatcggtctccttaccagagaacgagcccttaccccgtcggatcaagtccaagtcctccctgcggagcattcggagcctcggcagtagtcaccaggaggacgaaggctacgacagccaggaccagagcggcctcgataaaagtcttgtccggccctcgattctacgtcgtttgtctcctgggttagctgcgcgggtgaaactgttggatggtagtagcagggtctcgacaccatctcgcagcccaggcaacgtcggtcgaatccctgaggaacaaattaaggaacttgacaatcttcatcatcagaatttatctatcaaggtcgagaggaagggccggtcttggaatgctttgcagatagctggcaagaagcaagacacgcagcagactccttctgaagcgtcggagatcctgcagcacggttcggtcgaacgatcgggaaccccaacagatccgcagccagcggcaccagtcgtcgagaaccctaaatcgcatacctccggaccgcttgagaatatcgatcctgaccatttgcccgctgcggcggtagcttccccgcaagaagactcgcaggaggactcgctgaacgaagaagcggtggatcagacaccagccatgtctgccgtggagcagtctcaaatgccgctggcaattgggtctgcgacagcatccgagactcccgatcagactgactttgagagatatatccagagtaccagcgacaacgaagcgcaatcgcctcgtccgtcaccgcccccaaaagactctcctccgttgtccagttcctcatcgaatgtccagtcatactttaacccaaagggcttgcaacgtactgaatccatctattctttttcgagagcctcctttagtaatcagctctcgcagctcacctcgatcactcttccacaaccctcgtcactggcggctagtatcgctggaatctcgaatgcacccgctgctgtcaaggcgttgacaggggccgcggagcagattcagatatggataaagaaggcgtccgatgtgttgagtggcctggatgccgaggatgatgtggagtgggcagcagccggcggacgagaaggattagaaggagtggacaaagccatcacacggttcgagagcttggttcacgtgtatgtcaacgctattgaacaggttcagctgcggcaagacatcggcaacgtcagcccggacagtctgaagacgatcgtcgtccaaatggactctatcatacagagttgggcgcagatcaaagggcgactgaagggggtcaaggagcaggtagaattagccatggagtgggaagagctatgggccaatgtccttggcgatgtcggtatggaaattgagagtctcagccgattgatcttcgagatggaggagaagcgacacttcacgatggcgaatgagcaggaagggaccagcaacgggcttgatatcaatgaacttgagacgatcgttgaggagacgccatcgaatggcgacatggcaagcaaacgcttcagcatggggcctttcttctcagaggcaccgccgttgggcatgccgattatccagacctcttcaccacgtggctag

SEQ ID NO: 13929 - DNA, 579 bp, A.fumigatus
tcttcgctctcgattcctgagctaaatctagacctctcagacctctcctcgctcttcaattggaacacaaaacaaatcttcgtctacgtctacgcttcgtactcgtcctccgacaagaagtcctctcttattcccaactctgagtccatcatctgggatactatcatctccgccccagaatcgccttactcattcaatgccctgctccagcgctttttcccgaccaaatcgtcctcctcgccgcgcaagaaccagaaacgaagtgtttccgcgtcgaagaaaacctcggcctcaaagaaggagactccggcgccgggcgtgctccgtttgagcaaccaacgggctaagtaccaaatcagtgacattacagggaagctggcggagcgtaagaacgtgacgctctctgtgggctggaatgtgcagccctgggttggtgcgttgtggtggagccccggctccggtgctgtgccgcggaccgccggcactgtggtcagcagcgaggcgtttgattttcctcctgtgaagggaagcaaggcctctgctacaaaagcggctgcatcaggcgctcagacggcctag

SEQ ID NO: 13930 - DNA, 267 bp, A.fumigatus
gacaaaatggcaagcacggcgtcaatgctatgtttgattttggtcactctcttcagtaagtctcctgttgctcttcattacacagacgaatttccatcaatcagacggagtttagtctgtttgatcgattttcttcaagctgtatcagcaagaaagatcactccgctaacctggatttggttccaagtacctcctctcggcgtacttatgatttcgggttgtagtgtggatttcttcatcaatattctgctcacgatcctagggtga

SEQ ID NO: 13931 - DNA, 792 bp, A.fumigatus
agaatttcacgtcgggtcattgcagagcagcacttagccttgacagaaactttcagctctccctggcacttcccaggctcgcaggaccggaccgacatgaacgcagactttgttggcgaggtatttctcaaatgcaatgcgaaagaggtgattgaacgttgcgggaagcttgcacaggacatgatgcggcaaagctcgggaacagataagattcccgagatccttgtacagggacatcttgacgcaactttcccgtatattctgagccatttagagtatatcattggcgagtttctgcgcaactccatccaggctgtcattgaaaaatacaaagagtcttttgaaaagcctccgcccattgaggttcttatctgcgaggcgccacaacatgtgatcatgcgagtatcagatcaagggggagggataccccgtgaagtcatgccatatctgtggtctttcgacaagggccctctgagcaaatcacgactccaaaatttgaaacaggtccctgcgatggcagctacgatgcaagagctgacagtgtccaaggaacggaaacatgccgacagggaaacataccgagagggctcgctggactcgctcacctctcgtccacctaatctacgacttggtattggccttccaatgagcagggtctatgcagaatattgggcaggcagccttgagttacatagccttgagggctatggagtggatgcgtttttgcagatatcaaagctcggcaacaaaaacgagcaagtcaccacaagagcgtccattgatgctgtttga

SEQ ID NO: 13932 - DNA, 870 bp, A.fumigatus
agaccacccagtctcccagtggactgcagagagttgtgctgcatccatctcgccatggcgtcccaatcccccaattacctcgggctctctggaagagccctgcactgggcccaggtagctctggtaggtgcccctgccttcattgtcttcggatacaaccaagctggtgtcggtcccctggcgacactccagagctgggtcaagaccttccctcagatcgacacgatcaacacgacaggttctctcgaagcacacaattccacctccaagggtgctgtcattgcttcgttccagatcggagccctcatcggggctctgtcttgcacgctgatctcggacagactgggtcgccggaagactatattcctcggttctatcctcaccatcattggggaggtcctgcaagtggcatcctacggactggtgcaattcgttatcggccgtattatacttggtatgggtgttggtcagtacagtgtcgctgtaccagtatggcagtcggaatgttcgtcggcaaaaaacagaggacaacatgttatcatagatggtatattcatgtgtcttggttactcactgtgcaactggatcgattttggcctgagtcgcatcccccagagcacgacacaatggcgagtcccgcttgccctgtcgctgctccctgcccttgtcatccttctttctgtctttttacttccggaatcgccgcgatggctggtccaggtcaaccgcgccgaggaggcaacccactcgctcgcatcgctaaagggcctgcctgccaacgacgaggcaatccgggccgaaatttcgggtattgaatcatcgcttgagttgaccgcgtcttcgaccacgggggctggaaggacccgcgct

SEQ ID NO: 13933 - DNA, 486 bp, A.fumigatus
gcgcaatcgcggatgcttccagcccgtggtgaaaactgcatcttccgcggcacagagtcgcctctccgcagatgcaagaccggcgatctggactgggtgatcattcgtgagaacagcgagggcgagtatgcgggtcagggcggacgctcgcaccgaggcaaggcgtgggaagtagccaccgagacggccatcttctcacgacacggcgtggagagaatcatgcgctttgcgtttgagacggcgcagaagagacctcgaaagctactgacggtcgtgacgaaaagtaatgcgcagcgcaatgggatggtgctctgggatgaggtggctgcggaggtcgccagggactttcccgatgttactgtggacaagatgctggtggacgcgatgaccacgcgaatggtgctcaagcccgagacgctggacacgatcgtggcgacgaatcttgtaagtgacctaccagattctgattcggctatcttgccttga

SEQ ID NO: 13934 - DNA, 369 bp, A.fumigatus
cggtgggataatctacagcatgcagacatcctctccgacctcgctgcagcgctggctgggtccatcgggattgccccgacctcgaacctggaccccacgcgggagaatcccagcatgttcgagcctatccacgggtctgcatttgacatcacgggtaagggcattgcgaaccccgtcgcgacgttttggacggctgcggaaatgctggcctggctgggagaggaagatgcagcgaagaagcttctgaactgcgtcgaggatgtgtgtgagatggggattctcactcccgatctggggggaaatgccaccacaagggaggtcaccgaggccgtggtggggcagattcggaagttggccgctgcacaataa

SEQ ID NO: 13935 - DNA, 411 bp, A.fumigatus
ctaccgtctctaaatttgttttcgtcagaccgcattctcaacatcatccccagcttattgtgcagcggccaacttccgaatctgccccaccacggcctcggtgacctcccttgtggtggcatttccccccagatcgggagtgagaatccccatctcacacacatcctcgacgcagttcagaagcttcttcgctgcatcttcctctcccagccaggccagcatttccgcagccgtccaaaacgtcgcgacggggttcgcaatgcccttacccgtgatgtcaaatgcagacccgtggataggctcgaacatgctgggattctcccgcgtggggtccaggttcgaggtcggggcaatcccgatggacccagccagcgctgcagcgaggtcggagaggatgtctgcatgctgtag

SEQ ID NO: 13936 - DNA, 414 bp, A.fumigatus
atttgttttcgtcagaccgcattctcaacatcatccccagcttattgtgcagcggccaacttccgaatctgccccaccacggcctcggtgacctcccttgtggtggcatttccccccagatcgggagtgagaatccccatctcacacacatcctcgacgcagttcagaagcttcttcgctgcatcttcctctcccagccaggccagcatttccgcagccgtccaaaacgtcgcgacggggttcgcaatgcccttacccgtgatgtcaaatgcagacccgtggataggctcgaacatgctgggattctcccgcgtggggtccaggttcgaggtcggggcaatcccgatggacccagccagcgctgcagcgaggtcggagaggatgtctgcatgctgtagattatcccaccgttag

SEQ ID NO: 13937 - DNA, 1128 bp, A.fumigatus
ggacttcaacacgcaagggaaacggtgaacacgttcggtgtcttccaaactttctatgagattgaactactcaaggaccagtccagctcgaatgtctcctgggttggcgccatacaggcatttctcttgcttgtcgtcggtgtcgtcactgggcctctctacaatgccggatacttttacgtcttggggaccacggggtctgtcctgattgtggttggttttatggctttgagtgtgtgcacggaatactggcaggtgctcctcgcccaggcattttgcgttggtgttggtaatggatgtttgtatattccctctgtggccattattccacaatacttctcatctcgcaaagcgattgccactgccgttgcagcatccggaagtacccttggaggggttctatacccaattatgtttcggcaactgcagcctcaaaccggatttggatgggccgcacgcgtgctaggtttcctggttcttggaacgacattgttctcacctagtgtgatgagcgttcgtcaagttccaaagcaaagacgcactttgatcgagttttcagcgttcaagaaggtcccgtgtacgctgttctgcgtagcgatgttctttggttatattggattcttcaaccccattttctacattgaagcgtttgctatccaaaagcatgcaatgggagagacgcttgcattccaccttatctcgatcctaaatgccacctcagtcccaggtcggattgttcctggccttcttggcttgcgctttggtccattaaatatccttctaggcagtgcaatcattagcggcatcctttcactctgctggatagccatctacaacgcgggggccctaatagtgttagctgtcttgtacggcttctccggcgctttcgtctcactcctggcggtagcattgacgaccttgaacccgaatctccagacacttagaactcgaatgggaatgtgctcactgttgtgtggttttggatctctctgccgtgcgcctgttgccggcgctatccttgacaatacgcgatcgtatctaggggttcaactatactcggggctcaccatcggtacgacaggtgttctcctctttttcgccaatcatctaaagagaagaacaaattag

SEQ ID NO: 13938 - DNA, 537 bp, A.fumigatus
tgttttgaaagaaagccagcgactgcatcctattacgactggtacaatacaaatcctgggcccgtcggatacctgcacatttgctcaccgtttgctctagggacattttcgcgctttacccggcagaacatcaagctgaccaatggcacggagattcccacgggaacgcctgtcatggtgacgaacgacgtcgcgggggatgcggccatctatcctgatccagaggtcttcgatgggtaccggtacttgagaatgcgcgaaggagccgacaaggcccgagccccgttcacgacgacgggccaaaaccacctggggtttgggtacgggaagtatgcctgtcctgggcgattctttgcagctacggagatcaagatagcactctgccatatgttgttgaagtacgaatggcggctagtgaaggacagtccgcatgatatgcttacgagtgggtttgcgtcgttccgtgaccccagagcaaggatagaagttcgaagccgcgcgccagatccacaagaagtagtattgactataaagtaa

SEQ ID NO: 13939 - DNA, 639 bp, A.fumigatus
cccattatcatccagaacttgcttcatttcatttctataccgcatcccttcaaagacaagacagccgctgccatggacgggtggtcagatctctcatcggcacctccccagtacagagaagttgccgggatagcggattgggctctgctggcccaaggattgggatggtctatcaactacctggccatgatataccactcgtacaaggaccgcacctacggcatggccatcctgccactgtgctgcaacttcgcctgggagttcgtctacagcgtcatctacccatctcacaattccgccgagagagccgtgctcaccacatggatgatcctgaacctcttcgtcatgtatacggccatcaagttcgcccccaacgaatggcagcacgccccgctcgtccggcagtgccttccatggatcttccccgtggcgatcgcagccttcacagcgggccatctagcactggccgcgacggtgggagtgagcaaagcggccaactggggcgcctttctgtgctttgaactgttgacctcgggggcagtctgccagctcatgagccgcggatcaagccggggagcttcgtacacgatctggtctgttctttttgcacttctgatcttacgtcaaccgtccaactga

SEQ ID NO: 13940 - DNA, 651 bp, A.fumigatus
cctgggtcattcctagactggacggaggtgacgctgcttccgagcatgctggggctgattgcacgagtctcgtctctcatattcgtgggcgagccgttgtgccgtgatcccgcctggctggagacagtcgtgaatttcaccatcgttcgtcaccaggcaatcctcgctctgcacatgtgtcctgcggtgcttcgaccggttctgcactggttcctccctccgtgccagaagctccggcgggaaatcaagaccgcccggagcctgatcaattctgctctggaggaattgcggaagaacccgcccacggacagattctccagcctcgcctgggtcgacgctttcgccagtggcaaaaagtatgatgcaaccatggtgcagctaagactggcgaatgcctctatccattccagcgccgatctcctggccaaagtgctcatcaacctatgcgagcaaccgggcttgatccaggacctacgggatgaggtgatttcagtcctcgaggagaatggatggcgcgcctcgacgctgaaccaactgaaactccttgatagtgttttgaaagaaagccagcgactgcatcctattacgactggtacaatacaaatcctgggcccgtcggatacctgcacatttgctcaccgtttgctctag

SEQ ID NO: 13941 - DNA, 246 bp, A.fumigatus
agggcatcacagtcgcccgtctttggcgtggtcaccgacctgggcccaaaacttgtggtgtccggggccttcatcgaagatttcaaggatgaaaaactcttagaccattacagggcgatggtcgaggactttatggcagaggtcccgggcttcgagtcgatgtttctgggcaaccttcacaacacggttctgcgcgacgtgatttccgttatcacgcgagaattaggtgactgctctcccctctga

SEQ ID NO: 13942 - DNA, 2895 bp, A.fumigatus
ccgcttcgccgaatgaaccagatgcatctcgctatgactaccctgagcactctattgctgtcattggagctgcttgtaaattcaccggtgcagagactatgcagcaattctgggagctcatccgagcaggaggcacaatggtggggggaacttcttgaaggcagaattgcgctagacaagaagtcattgcggaagccaccacgggaagaacctctacggggtaacttcctttcccgtgcaggccactttgaccacggactcttcggactatcccaacgggaagctagatacatggatccgcaacagcgcattgcattgcaggtggcataccacgctgttgagtcatctgaatacttcaggagcggcatcaaagataagaatgtcggctgctacgtgggcgtcgggggttcggattatgatcataacgtctgctctcatgctccaacggcattttcgttcacaggcactgctcgagcctttgtcagcggccgcataagccaccactttggctggacgggaccatcgatgaccattgatacagcgtgttcctcgtcagctgtcgctatccatcaagcatgcaaagacatcagaatgggtgaatgccgcatggccttagcaggcggagttaacataatttcctgtccaaatatgcaacaaaacttggcagcagcgaggtttctaagtccgactggcggcccttgtcgtccattcgatgcgtttgctgatggctattgccgtggagaaggatgtggcttcgtaatgttgaagaagctatcatgcgccgtggccgacaaagatgaaattctaggcgtgattgtgggatcggcagcgaatcactgcgatggcaatgacgccatcactgtcccaaaatcacactcgcagatcgacctctacaggaaggctctgtcgctggcagccatgcaacccaaggacatcacttacgttgaggctcatggcactggtacttcgcggggagacccagtggaatgcagaagcatccggcaagtctttggaggtgagagacctacgctgcatttcggttctgtcaaagccaacgtcggacacacagaagccgcatcaggaattgcaggtcttctcaaagttctgttgatgatccgaaatcaacggataccaccacaggccaatttcacacaattgaattcttcaatacctccccttgaaccagacaacttgtcaatcacaactaatgaactcgaatggaaggccacttttcgtgctgcttgtgtcaacaattacggggcagcgggaaacaacaccgcagtgattgtttgcgagccacctcggttaaagcctagtgctggtaataatcacatactctccggctacccatttttgataactgggcagtctggaaggagtctcaagatgtactgcactgcccttggtgaatggttggaaaacaccgacgcccccttgtcagatatcgcgttcagtgtgactcggaggcagaatcggactcttcgacgtcgcattaccttcgctgcacgttcgctgaaggatatgaaaaacattcttggacagcaggcgagactagaccaacagtcgtcgccctcacctaagcccaagccggttgttctggtctttgcaggccaaactggaaacgttgtctacctgcacaaagatgcttatgaagggtcaagtctgttgaggtcacatattgatgagtgcgacaagatactccgcgaaatgggcctccgcggcctgatcgcattcttgtttgaccaacaacccatagaggatgtggtgctccttcattgcctgttcttctcgctgcagtacgcttgcgccgctgcttggcttgatgcgggattgcctgtccagcgtgtcataggccatagcattggccagttcactgcaatgtgtatctcaggggttacaacacttgccgatactctcaagatagttgcagggcgggctaggttaatccagcaaaaatgggccaaagaacggggctgtatgcttgccattgaggcagacaggcagggagctctcgagcttgcccgctcagtcccaggccataagatagaggtcgcatgcttcaatggggccagaaaccacgttctggtgggtactgaagtagccatccagacactcgaagctaagacatcctgtaagactcgaaggttaaagactacccacggctttcattctgagttggttgaccactggctggatgactatatggctctggcgcagagtatcacatacgcgacaccgattattcctatcgaaacatgttccgagggcggtagctggaaggagttcacccccgaaatgcttcctcgtcattcgcgcgaagctgtatatttcttcgatgccatatcccgagttgacaaagaattaggaccttgcacgtgggttgaaggaggcgtcggatccaaaggcatagcacttgtgaagtgcgccctcgggacaaacacttccgggcattctttccatcggctacaattggattcatcggaaccgttggcatcactaactgataccacaatacagatgtgggatgaaggcgttgatgtgcagttctggctgtatcatgacacagagaagataacatttgactcctgtgatgttccggcttaccaatttgacgagacagaattctggcttttacgttctgaccaagcacgccagagcgacttgcagcgggggagggtcatttctgacagatacaagccactggtatatttgctgcgggacgaaggcttcagaggagaaccccggaaactgcatttcggagtcaatcaatatcatccagacttcgacaggtacctgcacggacgcgaagtcctcggagaggttttgtgtccagtgtcggtgtttgtcgagctagccgcgacgttttcaccaagtggcaaagcaccgcattgcatt

SEQ ID NO: 13943 - DNA, 636 bp, A.fumigatus
gtatacatatctgtggagctcgacaatagaagcatcaccgtcacagccaaacagtcacaggtgtcattactgcggggcgacctggcagcacgaggcgctaagctgacgagaattcccatctacggacggtaccatagcagaacacacgccgagattcttcaagatctccttgagatctgcagcaacgacgagtctctacgttttcccatcatcagcgcacctatagtcccactgagaaataacaccaccggaggcctgatcacatcagcggagaagctgcacgagcttgccttgaaatgcatgttgacggaaccagctgactggtactcaaccatgtcagagactgtttccagcttgatgttgcagcctgtgatcaatgagcacccgctcatactggagttgggccatgtgagctgtctcccacggtcacttactgcatccgccaacattcgagctttcacgccgctgttgaccctgaccgcttcgccgaatgaaccagatgcatctcgctatgactaccctgagcactctattgctgtcattggagctgcttgtaaattcaccggtgcagagactatgcagcaattctgggagctcatccgagcaggaggcacaatggtggggggaacttcttga

SEQ ID NO: 13944 - DNA, 237 bp, A.fumigatus
atggggttcggtccagataaaactcgcgtcaatgattctgaccttgttcaaccccctaagtttgcgcagacacagcgccaaaagctctttcgattcaagtgcagcgctgacccaaccacttggcggctgaagccatctctcacaatctctgcagaaatgaaggacaccttcgcgaggaataccctggctgatatcgactgtcaatctaacacaatcttgacagagagcgcccgctga

SEQ ID NO: 13945 - DNA, 708 bp, A.fumigatus
cacttgtggtttcttgctaacttcgtctctagttctgtgcaagtgcggcagaaggtccctcataaacgaacattcctctatctggaacagctgattctcaagcacaacgctcatcaagatacggtcaatatcaaggaagcaaaggatgggttggactttttcttcgcgcagaggaaccatgccgaaaagatggttgattttctgtcatcggtcgcgccaattaaagtcaagaagtctcaggagttaatttctatggatatccacacgtctaccaagtcatacaaattcaccttctccgtcgagttggttcctatctgcaaagacgatttggtggctcttcccatcaaattggccaggtccctcggcaacatctctccattggccctttgccaccgtgttagcacctcagtcaacctgattgatccaaacacacttcagacggccgaagtgcccactgcagtttattggagagcaccattcaagaacctcgcagatgttaccgagctcgtggaattcatcatcatggacattgagcccgttggccgttcgaatggacgattccatcttgctgaggcgacggttgcacgtgcctcagacctgggctcgaacaatcagacctacttcactcggacgcacttgggaggaattctgcatgttggcgactctgcgtcttctaccacagggagtcgaagatacgcgcatgcgtta

SEQ ID NO: 13946 - DNA, 456 bp, A.fumigatus
acttcggctgactcctgtgtctctagaatcctctgttgcaactgtggagctcctatcgatggaacaacatcagcgggcgctctctgtcaagattgtgttagattgacagtcgatatcagccagggtattcctcgcgaaggtgtccttcatttctgcagagattgtgagagatggcttcagccgccaagtggttgggtcagcgctgcacttgaatcgaaagagcttttggcgctgtgtctgcgcaaacttagggggttgaacaaggtcagaatcattgacgcgagttttatctggaccgaaccccattcaagacgtatcaaggtcaagatcacaattcagcaggaggcgttccaaggaactattgtccagcaagcttttgaagttgaatatgttgttcacactcagcaatgccccgactgcgcgaagtcatacacccacaatacatggcgagcgtga

SEQ ID NO: 13947 - DNA, 630 bp, A.fumigatus
agacgatttaaaatggagccttaccttgtagacctccttgtaggggccggaggcaccgaagcggttgagaccaaactgctcgtgagagtagcgctcccaacccatggtggacagagcctcaacggacaagacgggaatgccgtcgggaaggaccttgagtctgtagtccttgggctgagcatcgaagacctcgaagcaagggacggagacaacacgagcgacgatgttgtgcttctccttgaggtatgtagcggcctcgatacagatgctgacctcggaaccggtggagatgagggtgatggcggcgttgggggcctcgacgacggggtaggcacccttcagagcagcctcaatggtcgagttctcgagctgaggcaggttctgacgagtgagggcaaggacgctaggagtgtgcttggcggtgattgcggagtagtaggcagcgctggtctcgttgccgtcggcgggacgccaaaccatgcagttagggagggcacggaagtgggccagagtttcgataggctggtgggtgggaccgtcctcacccagaccgatggagtcgtgggtagcgatgtggatgacgcggacgcgggagagggcggacagacggagagcaccggcggcatatga

SEQ ID NO: 13948 - DNA, 315 bp, A.fumigatus
caacttgatagcatcacccccggtcaccccgaggctcacgacacccctggtgttgaggtcaccactggtcctctggggcagggtttcgccaacgctgttggtctggccattgcccaggctcacaccgccgccgtcttcaacaagcctggctatgatttgatcaacaactacacatactgcttcttcggtgatggctgtgctatggagggtattgccagcgaggctgcctccatggctggtcacttgaagctcggcaacttgattgccatttatgatgacaaccacatttcgatcggtgagttcttacagaattaa

SEQ ID NO: 13949 - DNA, 1410 bp, A.fumigatus
ttggcatatttttatctagacggtgacaccaagtgtgctttcactgaagacgtcatgaagcgtttcgaggcctacggctggcacaccgtgtgggtcaaggatggtgacaacgacctcgagggcatcgaggccgccattcacgaggccaagaaggtcaccgacaagcccaccgtcatccgtctgacaactaccattggtttcggatccaagctccagggcaccggtggtgttcacggtaaccctctgaaggccgatgactgcgagagcgtcaagcagaagttcggcttcgaccccaagcagagcttcgtcgttccccagcaggtctacgacctctaccacaagcacgccgccgagggcgctgccaaggagcaggcctggaaccagctgcttgagaagtacgccaccgagtacaaggctgagcacgccgaccttgtccggcgtctctccggcaagcttcccgagggctgggagaagagcctccccacctacaagcccaccgacgctgccgtcgcctctcgtaagctgtctgaggctgtcctcgagaagatccacgcggtcgtccctgaactcatgtccggttccgctgatttgaccggctccaacaacactcgctggaagaatgccgtcgatttccagccccctgaatacggcattggtgagtggtccggtcgctacatccgctacggtgtgcgtgagcacgccatggcggccgttatgaacggtcttgctgcctacggtaccatcattcccgccggtggtaccttcctcaacttcgtctcatatgccgccggtgctctccgtctgtccgccctctcccgcgtccgcgtcatccacatcgctacccacgactccatcggtctgggtgaggacggtcccacccaccagcctatcgaaactctggcccacttccgtgccctccctaactgcatggtttggcgtcccgccgacggcaacgagaccagcgctgcctactactccgcaatcaccgccaagcacactcctagcgtccttgccctcactcgtcagaacctgcctcagctcgagaactcgaccattgaggctgctctgaagggtgcctaccccgtcgtcgaggcccccaacgccgccatcaccctcatctccaccggttccgaggtcagcatctgtatcgaggccgctacatacctcaaggagaagcacaacatcgtcgctcgtgttgtctccgtcccttgcttcgaggtcttcgatgctcagcccaaggactacagactcaaggtccttcccgacggcattcccgtcttgtccgttgaggctctgtccaccatgggttgggagcgctactctcacgagcagtttggtctcaaccgcttcggtgcctccggcccctacaaggaggtctacaaggtaaggctccattttaaatcgtcttca

SEQ ID NO: 13950 - DNA, 186 bp, A.fumigatus
agcgatctatcggagcaacgtgctaatcacatcattcaggtcgatgccaccttcaaggccaactccggtcaccccggtgcccctatgggcatggcccctgtggcccacgtcctcttcaacaagttcatgaacttcaatcccaagaaccccaactggctgaaccgggatcgtttcgtcctctcgtaa

SEQ ID NO: 13951 - DNA, 1071 bp, A.fumigatus
agtaatctaaccttgggggcccaagctgaaaaaaagcagatcaatgaactcaatcaactgctcagagaccaaaatcgctcacacgagtccgcgcgcaacgaaaactacagtgatgaggtggtcacgacgccggaccgtcagtggaagagctcgatatcagcggaaagtcccgacgcgatagttggagacagggtctctcgtggagagaccttccagaagtccatcttgttcccctcgagcgagtcgccgtccgccaaggacaaggtggtcgagcccgatatgcttgaccatatgcctaccaaacgacaaagccatatactctacaaaggcttcatgtctggggtccatgctataagtccggtcattcacccacctactattctgaaactgtataatgctttttgggattggtatgattatagcagctactccggggagccttgtccagatccatctttcatcccgctactctacgctatctggtatggcggctcagtcacgatctcaatacggatgatcaaggccgagtttaatgtctcgtcacgttctgcgctttccaagacctaccacgacgaggttacacggtggttgaccgaaatatcctttccacgaagcccatcattacagggccttgctgcctatcttctagtacagacaattctctccagagaagaagaacctttgacgagcagtttattcataagtctttctatgcgtgttgcacaaacaatgggcctgcatcgggaccctgctaatttcggcattgaaccctgcgaagcagagtaccgtcgccggatatggtggcatattgtgcatatggatggtgttgtagccatgtccagtggacttccacctctcgtcagtgacgaaaagtactgggatgttcaggagaccagtgaagtcaaagacacgctcttgggcaccgctgaagccgaacagtatgagagattggtcactgctggtctgcggccacgagataacccagatgatccgacgatctgtggcggaccatcgatggtaaacgtgtactatctatcagcaaggggcaaatatatcatggctcgtaagtga

SEQ ID NO: 13952 - DNA, 1062 bp, A.fumigatus
  unsure (249),(293): Identity of nucleotide sequences at the above locations are unknown.
aagacgctgatagagggtagcgccctgcgtcactgtcatggcttcatggaaaagtttatatctctggccactgatccagatttccagccctttcaatggagctggcccggcaatcatcagccgatgcacgcgaccatgatcatgttgatcgatctctacgaacgaccgtatagctccgaggcttccaagtcacgggcattcatcgacaagatattctcactttcaggtcctgacggggggtgtcgtcgncggagaggatggcatcacgactcagcgacctttaaagatggagnccgcgaagcatgggatatgatccgacgactgcgccagaaggcgtggcaaaaagcaggcctagatccacagcggttatggaccgaacaagctcagatccgagcgggcgtgccctccacacctcccgaatactctccagtctcaaacgcataccccacccaagcgtccggcaacccgtccactattccaccattgacctcacgaaagcagctgacggatttctcgaaattgttctacaatatgacacgctctcatctagcccctcggcccagtcctctgagataccaactacctcctccagtcccaagtgcagtccctgcatctccccgggtggtttctgatctccgtttctctacgtcccctgcaacatccatccccacgatcgaaccaactttcactggctcgactatttctcccccggcaagtataccaccgctcagctcgactaaacccttcgctcagcccaccttcacgtcatcctcagccaccttgccttatattgatacgtccttgcctgcctcacaaccaggagcagcacccacgcctccaagcatggttgatccaaacctgaacttcgactgggcggagtgggatgcagtttttggacagcatctccctgttgcggacgagctgatggagctcgatccagtctccggattcgagtttgccgacctggctaatacacgggatgttggtgaccatacggctgctgggaagactgatacggggatgagtgatgtgcgagatccggagtggttctcgtattgctga

SEQ ID NO: 13953 - DNA, 1095 bp, A.fumigatus
tattccattactccattgaagtccgccagtccgtctgtcgatatggacccacgccgaaggcgagactcgactgttgatgaccgtcatcgcccgtatagacgcgacggcagccgggagcgcagccgctcacggagaagatacacacctcgctttgatgatgatcgtcgacgggaacgatctcgtgatgcttctagtcgcccgcgtgatcgtaaccctgatgatagggttgccatacgggatttcagggctaaccgatatggcgaccgtagctaccgccctaaccgcagaagtaggagcaggtcaactggtcgtggctatgaccgggacagggaccgcagcaggggtcgagatcgcagtgcttcacgcgagaaagatcgagctcgagatcgctcgcgtctaacggatgaacgggaacgagaccgtgatcatcgcactcgtgatcgcagcagagatcgagatcgagagagagagcgtgatagggatcgggacagagaacgcgaaagggacccgaatcgggattatcggcctcgcagttactattctcggtctcgttcacgagctcgacgcggacgatcgcgctctgtatcccgcgctagagatcagaaccaagatctgactcgagctgcacgagaccgagaccgagaacgagatagagagcgaaatcgtgatcaagaacgatatcgagacggagacaaagaacaagaccggcttcgggaaggagaccgtaaagatgagcgaggaagatccaggtcgcgcattccgaatccctctcgaagaccgtctcgctcccgacggcgttcccccagtactcttgacattgaccactatgtgcccccaacgagccatcggagcagatccccccgaaggcgtgtccgatctccacatcgcccagagcgagatgatcgtcgagggttcgtggagattgatcggtacatacccggtagcgagcgggaacgcgaaaaggctcgagatggagagaaagagaaggaaaacgaagaaaggaaagataaaggcgcggagcttcctgatcgcgaagcggatgaccgcgggatacggaaacttagcgccagtcaaaggagaagcaggagtcgatag

SEQ ID NO: 13954 - DNA, 630 bp, A.fumigatus
gcgggtaggaatctggggaaaatttcagcagaaccaaccaacgacgatcgaacgacgatcgaacgacacggaatggaggacggtgtcaggaagcgcctacgagctgacggaaccctgtccctatcatccttcgacgaaacatcgccctctagacgagccaaagccagaattgtccccacttatcgcaatgacgataagggcctgccgacgtactcatccgctgcagagcattacagcacagagccggagaaccccagcaaggtagcctccacatctagcgaaagtgaggacgacgacgacgacgatgatgattacacttcctcctctggctccgatgacgacagcgacagcgctggagatggcgaagatgaggatcaaaatgccgattatagttccgaacgggcgtcccgcgctggttcttccctaccgcgtgtttcggcgcaacagaaacctcggatacaccgcatgacaaaggaaccggatctgctctcccgactttctgcatttctgccgaaattgaagagtgcctatgaggacctaccacgagagatagccgcagggagagggaaagatctccaactggacgaagtggaccaggaggagggccagtacattgaaatggtgggttga

SEQ ID NO: 13955 - DNA, 609 bp, A.fumigatus
aggcacgaatacgcttcttggataacagcgccgatcagtcagccctttgcaactcatcctaaactccagcagcacaagatgagtgcgcccaaactacacttcaacaacgaccaaagccctataaaagacgaaagctctccaacgcaaaaagcaatggagtgcccatcctcttccacaagaaagtcgctgcatcagaacatcctcggaaaactacgccctctgccactgcaataccactggacagtatggtacgatagatactcggaatccaccgactatgacaaccgattgtatgtcttgcatgaggatgtagccgacattgccactttctatcgcgtctacaacaactatccttgggataaaatccgcctacgagactcagtccatatcttccgcaaaggcgtccgtccggtatgggaggatccagaaaacctcaggggtggttgctggaaattccgggtccccaagagcaaggctcaagaattcttccacgagattgccattctctgcatggccaacgaattccaggctgctttggagaaaggtgtgcgaatccgctcatcggcgtctgcgagcattcgggtacttcgagctgactgcttcccctag

SEQ ID NO: 13956 - DNA, 249 bp, A.fumigatus
ctgcttcccctagaacatgaccatgtcctcggtgtttccacctctgtccgtttcaactcccatatgatctccgtatggaacaagatgggcacgaacgaacgctccatcaagatcctcgagcaaacgattatcgaccgtctatcgcctgagctgcggcccaccagttccggtagccactcgtatttctataaacgacatgatgagaatgatggataccaggaagctgtcgcagcgagttcttcacattga

SEQ ID NO: 13957 - DNA, 1110 bp, A.fumigatus
ttgataacatttatttgtcgcatatttactcagtttagacttgcttcatacccaaagatcatagattttttttttttttgctttaccttgcattttgcttgcgtttatctaaaaatggaagaactattagcgaaacatcgcaaggagcagaaagatcttcaggcccgcatcacgcagaagaagaaagcagctacaaagaagacacgtcgaggagtcaacgaggaatgcgagaggctgcagcgagagctctccgatcgtcaccaagccgaaattgcagcgctcagcggcgaacctattcagccagttgatggcttcgaagaactcagtcttcgtgatcccgatgttggagatgcagatacaggagagaaatccacatcagatgatatgcaaggcacagacagcctcccggagccttcaaagaccgactcgacaccaacctctccacctgcctccgccccgcgtacgaagaaaccgaatcgacaaaaggctcgtctagcacgtcgggcagcggaacaggcggcgcagtctgcgcttgctgcagaagaggccgcgaaacaggttgaccatcgtggtaacgaaaagggggtgatggaggctgttttcaaacgcctgggcttgaaggaggtggaaatcaacccagatgggcactgtttatattcagctattgcccatcagctggaagaatcagggcttgggcttaggcctgatccacaaagggtagtcattcagccccagacgcagtctcggcttgatacggttgcttcgcccaaacatgatggctacagagcggttcgagcagtggcagcggatttcatcgtcgagcacaaggatgacttcgagccctttatggaggagccgtttgattcgtatacccggaagatcaagcttaccgccgagtggggaggacagctggagctgcaggcgatcgctcgggcgtatggagttaatattaatgtcatccaaggcgatggcaggatagagaagatcgaagccggcgatatggatgggattgatgaggaggaaagaaacaggcgggtcatttggttggcatactaccggcatacgtacgggctgggagagcattacaatgcacttacgaagcaatcatag

SEQ ID NO: 13958 - DNA, 258 bp, A.fumigatus
aagtatcccgtacgagatgcggagattggtcaaggcaaaatcacctacgtgcagggtgacttcttcaaggatacttggttggagaaactacaattgcctcgaaattcttttgatttgatctatgactacacggtatgtggatctcagaagtcctttgtacaaagcactcggcctggtttctgtcttctttctcaggagaagagtccagttagcccccatcgcagtactgtgcgtctctcgctaaacagctgtggttga

SEQ ID NO: 13959 - DNA, 348 bp, A.fumigatus
ggcaaagtggtgctggtcaccggcggagccaaaggcattgggcgtatgatctccgaaggttacgtcaccaacggcgcaacagtttacatctcgtctcgggatgccaaggcttgcgagaaggctgtgcaggagctgaatgctattggccggggaaaggcgtatgctattcccgcgaacttctacaaggaggaggaatgccagaagctagctgaggagattgcgaagcgcgaaagcagtaagttggttttggggggcccctgctcaggcggaaggctaatctcatgctctatcagagcttcatgtcctcgtgaacaactccgggtcaaactggggtgctccttacgatga

SEQ ID NO: 13960 - DNA, 354 bp, A.fumigatus
tctcatgctctatcagagcttcatgtcctcgtgaacaactccgggtcaaactggggtgctccttacgatgagtatccctcgtctgcatggaccagagttctcactctgaacctgcaccgagtctttgatctcaccaagctccttacgccacttctcgagaaggccggtgcgccgaatgatccagcccgtatcattaacattggtagcattgatggattgagggttccggctctggagacgttcgcatacagcgcgagcaaggctggcttacatcatctgagccgtgtcctcgcgcatcaccttggcaagaggaatatcacgtccgtacaccttatgctagttacttgcctctaa

SEQ ID NO: 13961 - DNA, 219 bp, A.fumigatus
gaccaggacgagttcgacgtcccttccttctggtctgtattctgggttctgcgctgggtctcctggtctgctagttcccgtaagggatccaatgcctctagtgtcgaaaccaaatttgccaatctgcaaaccagaaacaacgcacctagcgcgccttcccccggtgccggttccgccgtcactgtggaagccctccaattctggagccactcgacgtaa

SEQ ID NO: 13962 - DNA, 897 bp, A.fumigatus
atgatcattttgatccgccatgcgcagtcagaaggaaacaaaaatcgggaaatccaccaaacgatccctgatcatcgggtccagctcacacccgaaggacatcgacaagcaagggaggcaggtagcaagctgcgcgctcttctacggcccgatgacacgatacacttctttacctcaccctaccgtcggactcgggagactacagaagggatcctcgagtctttgacctccgattctccgtccccgtcgccatttcccaggcatactatcaaagtatatgaagagccacggttgcgagagcaggactttggcaattttcagccgtgctctgcggagatggaacggatgtggttggaaagggcggactatggacattttttctatcgaatcccgaatggtgaatctgctgcggatgcctatgaccgaatcagcggcttcaacgagtcgctttggcgactgttcggggaggatgattttgccagtgtctgcgtactggtaacccatggactcatgacgagggtcttcttgatgaaatggtatcactggagtgttgaatattttgaagatctacgcaacatcaatcactgcgagttcgttatcatgaaacttaaccccgacaatgggaaatatgtccttcagaacaagctgcgtacgtggtccgagctgaggaaagagaaggaaaacgagagacaacgggagcgaacgagcaaagacctcggttcagctacttctctcacccctgcctccactcctgtcgtaatcagacgcaaatggggcggatgccccgacgctgtaaccacggcctccacagaaaatggtccttacggtcttcacggacgactggaggtgaccccccccgtgttgggagttgagacgcaatcgtccacgaagaaataa

SEQ ID NO: 13963 - DNA, 732 bp, A.fumigatus
gctggttacgtcgagtggctccagaattggagggcttccacagtgacggcggaaccggcaccgggggaaggcgcgctaggtgcgttgtttctggtttgcagattggcaaatttggtttcgacactagaggcattggatcccttacgggaactagcagaccaggagacccagcgcagaacccagaatacagaccagaaggaagggacgtcgaactcgtcctggtctcacggccaccagacagaaaaattcttgaaacggtacattgagatctttagggagcagagctttgcaattgtttccttgtataagaacatcttcaccccggaccaagccgagtcagagtcagttattgcaggattgcgagggattgattcccgtgttaaaacgaacttgtcacagccaactcgcccggatgatcccttacagtgccttccaccagctttggcaacctttcctatgcatctcgtccagctgctgactgacacattacgcacctatctaccgaatgtccaagataagagctcgcgcgaaagtctcctgactcaagtgttatactgcgctgctagtttgggaagactgggaggggacttcagcatgatcctgacggagatgagtgccgcctatgagtgggaagaggttacacggaagcaccgagccttggcagggcggttggatcaactcacgggaactgcctccagagtgaccccgcgggtgacttctccccttcactga

SEQ ID NO: 13964 - DNA, 237 bp, A.fumigatus
ctatctttacgacttgttagctcctcatttctctccagcagatgctacctcaacaccgttggctccagatcacgacacaacaacggctcagtacttaaaccgactctcaacgctgtccctggaggctttagaaacatcagaaccgcaatctctggcgcaatcatcgcattctaccttcctgtctctccaggccttatcgaatcgctcgcacaaggctttcatcacttctgccggtaa

SEQ ID NO: 13965 - DNA, 987 bp, A.fumigatus
acaataaacaggatgctgcgcatgatgattccggaaaacactctacgaggttcgagaagaagcatcttgaaggggcggagggacagaagtagagggagtagcaagagatcttggcgaccatctcaggggccaactggtaccgatgagcaaaagacagcgactgattctgaggcgcgggacaaccctaaaccagaaaccaagcccaaggtcacgctcaggctgtttgcctttctaagttgctgctcgtcatctggtgtcgacccggacgactctgcgattccgccgaagaagactaccaggcgaccctcagcccctgcgacccagcctacaccggagaaagccgatctcaatgccaatcattcgaaccggacggaatctgaagaagcaaagctctttggagaagagaagccgaacttgactgtgacttcacatcaaccttccagggaggaggagaaacctgccaggacctccgaggaaggcgctcagctcgatgccaacctttcctcgtctgataaagtcgagtccagccacgaaccagcctcacagtatggccaagttgatactactcgcactggcgcccctcaaaatgctcaaatcccagtcatagtcgcaactgagacagagaaggcgaacgatctcgagatcaaaccggaggagcctatggggtcactgccactgcccgctattgaggacagctcaacctctaccgaagcgcaaccaacttcgtctgcagtcgagcataacgatgtaaagtcatcgcatgaagaagaaactactctgccagccaagattcctcctcctccgcctccgcaagttcctatgggaaaacaaatacagatcgcgactccagagagaccccagcaatggcttctaccccctcccttgccacatttgcggaaccggaaatgcctggttctcgacttggatgagacgctggtccacagtagcttcaaggtaactcgccagcctctaagccctttcatgtaa

SEQ ID NO: 13966 - DNA, 213 bp, A.fumigatus
gacctctcacaggttggccgtgaccttcgagaaacgattatcatcgataattctccaacctcatacattttccaccctcaacacgcgataccgatcagcagctggttctctgacgcccacgataacgagcttctcgacttgattcctgtcctcgaagaccttgccggcgcacaagtaaaagacgtcagtctggtcctcgatgttacgatgtaa

SEQ ID NO: 13967 - DNA, 249 bp, A.fumigatus
gcagattcccgaaatcagccaacctacagccgccgcgcagtcgagtggtacctcttcattttgcgggcctctgtcgcttcttcccctaacacgaccctggtttggtgttgccacgtgacttccccggcttcattcatgaggttgaatttcatccatcatccatcgacctccatcctatcataccatcccacattgaacctggagcgcgtttctctcttccttcatatcgccggttgcgtggttttctga

SEQ ID NO: 13968 - DNA, 279 bp, A.fumigatus
  unsure (240): Identity of nucleotide sequences at the above locations are unknown.
gccctttcatgtaaagagctacatgtctctgacatacccccccaggttctcgagcgtgccgatttcacaattcccgtagagatcgaagggcagtaccacaacatctacgtgatcaaacgacctggggtcgatcaattcatgaagcgtgttggagaattatacgaagtggttgtcttcactgcctctgtttctaaggtgagctcgcccatcccaatagcattatatggactatctctgatntggacgaaagtacggcgatcctctactcgatcaacttga

SEQ ID NO: 13969 - DNA, 1167 bp, A.fumigatus
gccagcatcatcctcacaggatcacacccaaggtgttcatcgtctctatggtatgtcgatcctggctgcaaggatgacagcgactcaccgccacagttcaaacccgaagccgctgtctggtggaacattcctgaatttgatctcctcgcgcacaacgtcaccgtgcctggtgcttcgcctgtgtatcccgacgtctactgcactgccgactacagcatctgccagctcatcaccggcgaaggagagatcaacgcagccgtcaccgtctcctcgatcgccttctcctccctcttcgacctcacgcacacctacttcctgatcgcaggcatcgccggcatcaaccccaaggtcgccaccatcggcagcgtcaccttcgcccgctatgccgtgcaagtcgctctgcagtacgagatcgacatccgcgacctcggaccgaactacacatccccctacatcccgcagggagcctacgcacccgaccaatacccggggagcatctacggcaccgaggtcttcgaagtcaacgccgagctgcgctcgctagcggcctccttcgcccgcgcggcgcagctggccgactccgacaccgccaaggcctaccgcgccaagtacgtcaccaacaatggcacctacgcagcgggcacgcagaccccttccgtcgtggagtgcgacgtctcgaccagcgacgtctacttcagcgggacgatccttgacgacgtcttcgacaataccatccgtgttctgacgaacgggacgggcgtgtactgcagcaccgcgcaggaggacaacgcgacgctcgaggcgctgctgcgcgcggcgtcgcacaaccgcgtggacttctcccggattatcatcatgcgcacggcgtctgactttgatcggccgtatccgggtcagtcggcgattgagaatctgctgtatgcggaccagggcgcgtttgggcctgcgatacagaatatctaccttgcggggatcaaggttgtgcagggcatcatggacggttggaacaagacgtttacggccggggtcaagcctagtagttatattggcgatgagtttgggacgctgggggggaggccggattttgggccggggaggacgattgcccggaaggaggcgaatgctctgcggaagagaggagtggctaagcgtggaagacggttgtag

SEQ ID NO: 13970 - DNA, 573 bp, A.fumigatus
tctcctcgcgcacaacgtcaccgtgcctggtgcttcgcctgtgtatcccgacgtctactgcactgccgactacagcatctgccagctcatcaccggcgaaggagagatcaacgcagccgtcaccgtctcctcgatcgccttctcctccctcttcgacctcacgcacacctacttcctgatcgcaggcatcgccggcatcaaccccaaggtcgccaccatcggcagcgtcaccttcgcccgctatgccgtgcaagtcgctctgcagtacgagatcgacatccgcgacctcggaccgaactacacatccccctacatcccgcagggagcctacgcacccgaccaatacccggggagcatctacggcaccgaggtcttcgaagtcaacgccgagctgcgctcgctagcggcctccttcgcccgcgcggcgcagctggccgactccgacaccgccaaggcctaccgcgccaagtacgtcaccaacaatggcacctacgcagcgggcacgcagaccccttccgtcgtggagtgcgacgtctcgaccagcgacgtctacttcagcgggacgatccttga

SEQ ID NO: 13971 - DNA, 423 bp, A.fumigatus
gctattccgtcattcaaatcaccgggaaccgctgcgctgaccgcccctggtacaaggacctgtcctagtctcctcggctcttatcccggacgccagcaagcttcacattcgcggcgtgaagaacggccgggtcatgcaggactgccctctgacgtatggaaacatcaatctacgaatccacttgcttgttctcacgctgacccgtgctcgaatagtgatttgatcttcagcgtccctcaactcgtcagcttcctgtcccagggaacaactttgccggccggtaccattatcctgaccggtactcctcccggtgtcggagcggccaagaaccccaaggagttcttgacggcgggtgatgagttcgctgtcgaactactccctcatgtcggaacactgatcacgaagatcgaacaccagcaatga

SEQ ID NO: 13972 - DNA, 360 bp, A.fumigatus
tatgtctcgcacgctgcagagatgaagctgactattcccaatgtaccgacactctttctgaagccgtccaccgcgcttgcggacccatggccggcaccgactattctccccaagatcacacaggtcgacaacacgggcgattacgaatctgaaatggtcattgtcattggccgtgatgcgaaggatgtcagcgaggcagaggtcctggactacgttcttggttacaccgccgccaatgatgtttccagccggacatcacagatgaaccaaagccagtggtctttctccaagggcttcgatacctcatgccccattggtaagctattccgtcattcaaatcaccgggaaccgctgcgctga

SEQ ID NO: 13973 - DNA, 183 bp, A.fumigatus
ccgcccctggtacaaggacctgtcctagtctcctcggctcttatcccggacgccagcaagcttcacattcgcggcgtgaagaacggccgggtcatgcaggactgccctctgacgtatggaaacatcaatctacgaatccacttgcttgttctcacgctgacccgtgctcgaatagtgatttga

SEQ ID NO: 13974 - DNA, 690 bp, A.fumigatus
ccttcatcacagatcaatggcggtcagttcattctgtacctcttcttcgggccagaaacccgctacatcggcggcgacgaaaacccgaaagagcccgcctggaaacgagagtacctttctttgcgacgaatcgatctaactccttttatgtggtatgagtttgtcaagcctttgacgatggtcatgcaaccatgcattgccatacccgcagcggcctatgccatggtcttttgtctaagcaatgtcttggccacagttgaggtaccaacgcttttggaacgcaggtgggggctcaacccagaacagctgggactacagttccttggtcccattattggatcagtactgggagagcaacttggtggcaggatgtccgatctatggatgagacagcgagagcgcaagactcgtaagaggcctgagccggaataccgcctgtggctcagctatattgggtacttcctatccattgtcggcctcattgtcttccttgtatgtacccaattgtccgggaaccgctgggaggttgctcctatcatcggcatcgccattggcgccgctggcaaccaggtcgtgaccacagtgctcattacgttcgctgtcgactgttatcccgaagaagccggaagcgttggcgttttcatcacgtttgttcggcagatttggggatttctcgggccgttctggtaa

SEQ ID NO: 13975 - DNA, 693 bp, A.fumigatus
agccgcccaatgaaggtccagttactgatgaggcatttcaacagcattgcggaggactttggcgtctctatcaacaaagcgagttaccttacctctcttcagatcgcgatcctgggtggagcaccattgttctggaaacccttgtctcaacgctacggacgacgccccatctttttgctgtcattaatgtgcagctgtgtctgtaacataggatgtgccaaaagcaccaattatgcatcagtcgctgcctgtcgagccttacaagcgtttttcatttccccggcttctggtaagtcttgtgtagacgcaggtgaggaaggttctcggctgactactgtgacagccatcggaagtgctattgtgatggaaacaactttcaagaaggatcgcgccaaatacatgggaatctggactctaatggtcacagttggcattccttgcggtccattcatcttcggcttcgtggcgcaccgtgctggttacgtgtggatttactgggtgctggcaatggttagttggacgcatcgaccacacagctcaccagcggctattgaccttcatcacagatcaatggcggtcagttcattctgtacctcttcttcgggccagaaacccgctacatcggcggcgacgaaaacccgaaagagcccgcctggaaacgagagtacctttctttgcgacgaatcgatctaa

SEQ ID NO: 13976 - DNA, 1080 bp, A.fumigatus
ccctggggtgcgttgtttagatggaccgatgactccacatggagaatccttacgcatcttgattgtgctgacgatgatggtctgcaccacaggcgattctttggctccaatgcagaggggccgaagaccgcaccaaaaaagcaaacgactttgtcattctccagcaagaaagataagaagagcgatgttgtcgacgaacaagcggaagctcgggaatcttcaggcatccctgaagcgaagtcggagccggcaaacagcgaagacgtgaaaatggaggatttgtcggagacagaggtggctcatatgaacggttctccaggctccaagtctcttaaacgggaaaagagcagcgacgaggaaagtgactcagatgttcaaccattacagaaaagacgccggaagagctcacgaggggccgaagcggctcccaccatacgaagagagtcaccgtcaccaatgatctctgaaatttccaaggccgaggtcaaggaaagctccccacctgccatcttgaagaaggcatctggcgaggaaacaccagagaaagaaacggagcattcggaagaagaagaggtcgcgaccgctagcgaagaggaagatgaagacgagaagccagaagtgatgaagaagacgatggaaaaggtgcaggccacattgaaagcgacgggcacggaaccatatcctgactggaaacctggtgaaccggttccctacgcagctctctgcaagaccttttctcttattgaaatgacaacgaagcgactgatcattctggcccactgctctctcttcctccgccaagtcctccgtttgacgccacaagatcttctgccaacggttcaactgatgatcaacaaattagccgctgactatgccgggatagagttgggtatcggcgaatcgttcatcatgaaggcaatcggcgaaagtacagggcgtagcttggctgtgatcaaagcagatcaacatgagattggcgatctgggcctggtcgctgccaagagtcgatcaaaccaacccaccatgttcaagcccaagcccttgaccgtcagaggggtgcagtcttcaccacggggctga

SEQ ID NO: 13977 - DNA, 336 bp, A.fumigatus
ggaaccggttcaccaggtttccagtcaggatatggttccgtgcccgtcgctttcaatgtggcctgcaccttttccatcgtcttcttcatcacttctggcttctcgtcttcatcttcctcttcgctagcggtcgcgacctcttcttcttccgaatgctccgtttctttctctggtgtttcctcgccagatgccttcttcaagatggcaggtggggagctttccttgacctcggccttggaaatttcagagatcattggtgacggtgactctcttcgtatggtgggagccgcttcggcccctcgtgagctcttccggcgtcttttctgtaatggttga

SEQ ID NO: 13978 - DNA, 183 bp, A.fumigatus
cgcgagacaaggacagatcacgtgctctatcattacttctcagaaatgcaacccgaagaagcttacattgcaataagagactttcggagtttcaatggtcaaattacgactacggatggcacagttatcgcatcaagtaatattactcgagggctcagacgttttgctatgtgtgtcttttaa

SEQ ID NO: 13979 - DNA, 726 bp, A.fumigatus
tgctcaactgcggacactcagtgtcgggcttcgtggcaaaatctgcacagccaaagcaaaatgaagtcctatctcttgtttgtcgccgtgcttctgcaggcagtgcttgtacggacggcggcattgcatccctcgtctcgtcgcacttgccagacctcgttgaggaattgtcctgagggaactgtcatcgtttccaagtctcaccccaaagcgcacttctccaccgtccaggctgctatcgaatctctgccgaatgacaacagcaagcagaccattttgatactggcaggcaactacacggaacagctgaatgttacccgctccggccctataaccctgcttggtcagacggacagcgtcaccgatgcctcgaagaacaaggtcaccatcacatgggcccaagcgaaccacgacaacactggacagagcgtagacaatgtcttttccagcgtgctggtcgttgcacctacactcgaggccagctacaccggctcaggcccaacggggtatcctgtgccggaggatactccgttcggtaacaccgatttcagggtctacaacatcgattttcgcaacacatgggctgattactccgacggaccggcgcatgctctcagcttcagtcgcgccaacggcggcttctactactgcggattctactcttaccaggatactgtacgtctctttgctcatgcttctagtcggttgcagggatggacaaactga

SEQ ID NO: 13980 - DNA, 867 bp, A.fumigatus
acaatgtcttttccagcgtgctggtcgttgcacctacactcgaggccagctacaccggctcaggcccaacggggtatcctgtgccggaggatactccgttcggtaacaccgatttcagggtctacaacatcgattttcgcaacacatgggctgattactccgacggaccggcgcatgctctcagcttcagtcgcgccaacggcggcttctactactgcggattctactcttaccaggatactgtacgtctctttgctcatgcttctagtcggttgcagggatggacaaactgaccatgcacaggtgtacgttggcaagctaggaaacgcctacttctacaagaacatcatcgccggccagaccgacttcctgtacggcttcgggaccgcctggatccaatcgtcggacattctcctgcgcaactgcggcggcggtatcaccgcgtggaagggcaccaacaccacctttgagaaccagtacggcgtgtacatagtggattcgactgtgagagccgcaaacgcctttattgccccggtgattgctggcaaatgtgctctgggccggccatggaacagtctacaccggtccatcttcgccaatacctacgaggatggcagtatcgagcccagcggctacattgattgggtcgtctccggcgtaagccgattcaccaaccagacagtcatggccgaatacaaggcgtttggacccggtttcaacgcgaccggccgtgcagaagggggagtcaccatcgttatggacaagaagcagtacaagcgctacgactcaccagcgaaggtattccagtcgccggacggcaagacgggcaacatcggctggatcgatttccacgcggatcgcgtctag

SEQ ID NO: 13981 - DNA, 192 bp, A.fumigatus
  unsure (21): Identity of nucleotide sequences at the above locations are unknown.
gctatacttcgcgatagagtncccgtcggaccttccagccccgtggtgaagaccgccatgcttgtttccccggtcgatattcgtcagtgtctgcgtttcaagcactgccagccgcggggatactctcccggcttgttctaccccggtttttgctccccgcaatttctccaaatttctccagaagcacaataa

SEQ ID NO: 13982 - DNA, 234 bp, A.fumigatus
gattcccatgcccactccttgtcctctccatcgacttcttcgtctccctttccgcaaactcccgctgcacctcgcccaactggtgcgtccgcgccaggtacgccgccccggtgtcagcccacacacggtactcctgcaccttcaacccgccgcctcccttcccctgatcctctgccagcccaatccgataacagaacgtctcattccacccttcccccgtctccttccacgtga

SEQ ID NO: 13983 - DNA, 990 bp, A.fumigatus
gacttgagtcaggtacagttctcgcgacacgtcctctccctattttcatccaacctacgatcgaaatcggtcaaaatggcgatggatgcgaaggaaatcgagctcaaggcgaaggccctgacgaaagccgccacccagaacgagcccgcagccaacatcgtatcactgctcaaggagctgcaatcgggagtgaaggcaacggaggatctgctgcggtcgacgcgcgtcggaatcatcgtcaacaagttcaagcaacacaagtcacccgaagtcgcgcgtctatccagcgagattgtctcgaaatggcggaacgaggttaacaaacacaaggccagcgggtcaccgtccgtcagtcagcgttcaagcggctctccgcgcccagcacagaacggcaccgcatcgcctgccgggacaaccccatcagacaagttgtccaaactctccgttcccccagacaagcggacgtggaaggcggacggtgtggatatcaatcagacttcgaacaagatccgggatagttgcattgggctgatgtacgatggattgtgcctcaactcgaccgagtcgcctcgagcggtgctgtccaaggccagcgcggtggaggcggcggcgttcaacgctttgggcccggagaccaaggaacagtaccgcaccaagattcgcagcttgtatcagaacctcaagaacaagtccaaccctacactacgggtgcgcgtgttgtcgaatgaagtgacgcctgagcagtttgtgaagatgtcgcacgatgagctcaaatcggatgaacagcgcgaacaggagcgcagaatccagaaggagaacatggataaggccatggtcgcgcaggccgagcgcagtatcagtaccagtctgcagtgcggcaaatgcggacaacgcaaggtcacctacaccgaggcgcaaacacgcagcgcagatgaaccgatgacgctgttctgtacgtgtatgaactgtggtaaatcgtggaggcagtga

SEQ ID NO: 13984 - DNA, 621 bp, A.fumigatus
aaaaaattaagcgttataatgaccaccgcaaagacatacacccgcagcgcactagttcaacccactctagccctctgcgacgcctttgcttccgcagcccctgtccccgtcctcctcagccatttcaccgcggaccccctccccatggtccacgagcacgggctgcccgtcctagccccattcctgggccgcacattcaccggcacagacggggtatgccggtacttcgagctcatcgcggacctgctcagcttcgagaagatgagcttcgacggggaggacgagtggatcgttgatacagtttccatggctgtttcgctgcgggggcgggcgcggttcacgtggaaggagacgggggaagggtggaatgagacgttctgttatcggattgggctggcagaggatcaggggaagggaggcggcgggttgaaggtgcaggagtaccgtgtgtgggctgacaccggggcggcgtacctggcgcggacgcaccagttgggcgaggtgcagcgggagtttgcggaaagggagacgaagaagtcgatggagaggacaaggagtgggcatgggaatcttattggggagggacagagggtatattctgggggaagtgggacggcatag

SEQ ID NO: 13985 - DNA, 324 bp, A.fumigatus
caccggggcggcgtacctggcgcggacgcaccagttgggcgaggtgcagcgggagtttgcggaaagggagacgaagaagtcgatggagaggacaaggagtgggcatgggaatcttattggggagggacagagggtatattctgggggaagtgggacggcatagatgagtacattgcttcatgtgatatagattcaagtatatggctagatatctctaagttacggcaggccgtgagtgtaaaactagacgcgatccgcgtggaaatcgatccagccgatgttgcccgtcttgccgtccggcgactggaataccttcgctggtga

SEQ ID NO: 13986 - DNA, 1413 bp, A.fumigatus
agcatcgataaggcggactctggacacacagccatggcgttacagaatgtgattgattacctcgaactcataaaagcaagtgaattaccaagcgtcctcgaggaacattggagacgcgttcaggctgggtacatattatcccaatcactggccgtgtccccttgcgacagcagagcggtgtctgggtcgagttctccaagtaactcgcggcgtgtcaggcaaatagtaccgactgattcactgactcgtcaaattattgaaattttcaagggcaagtccacggtctcgcccaagtaccattgccaaagcaaagtaaagatcggaaatcgcacactggccgaatggcttgactccaccttatggatgcacgacgatgagcaaaagcatatagagcttctgggggcacttgccaagtcgaaaagatgggttcagcctggcatgggcagcgcgagcaagctcgtacaggaattatcttggggcggccgaatgttcggggccttcacgaacgatgaattggatgcgctcattgcatggattgacctccttgacccggaaaacagcagctggttatattacaggttcactctccgggcgccggtggcttctagagatgttgtaggcggccttcaagatccgacatgccatcatctaaccctgccagctcggaatgcggatgagacaattgatggagctttcatggagaagcttccagactgtcgcttggacacggagtgcccagatcagaaaacacctttgaatacaccttccaaaacccaactgccggatatcgtggcactctggtttgcccacatcggtctcctggaaaatataatcaatgtacccgctcgaactgccacctcgctctactccggtatcctacttgctctccgggcccaagctggctttgcagcagaagcacatgtccccgctggcatggccgaggtaaggcgtcaaccagcctgtagtctggtggacatcggccttgagataatatccagagcccagtggacaagggatgggaacccttcatgtctaaaagatgtgtttgtcctagctaggaaacaaggacaaagtgctgaaagcatcaagctatctgataatatgcttcgttgggcgaatcgccccaatgaaaactttgggattcttgttggtctggcactggcattcctcggattgaaagaggctattgctgggtcacatgagttgctcagcgaggaaagtcaagctgcattgaaggcgatcatcaaaagggagcaaaaggggttattcagctgcatgcaagaaatcaaatctaccggtgatgggcgctacaaagacatagaaaagggctattgccttggaagatcggctctcgagaaattgttgggaaagacagccggggtcgaaaatactttgctaatgcgcaccgcttaa

SEQ ID NO: 13987 - DNA, 540 bp, A.fumigatus
acgaacatggctctagatggtcgttcgccttctccttctatctcggacctagagtgtgcgtgcctttactttgcttacggaagcaacatgaaccttacgcaaatggcgcaaagatgtcccgaaagcgtcatctttgcgaaaggagcactttgcaactataaatggcagaccaatagccgtggtggcggaaatgttatacagggaaacaccgaggacgtcgtgcacggtattgtcttcatcatttcctcatctgaggttgaagctttaaggcgttacgaaggggtcgacaagcaattcttcgttgaaaaaaagcttgttattgagctagaggccatctcagatccgaggtttagccgtcagaagactgctgatgtggtaaaagtgctggcaacaaaggattctgactatgggaaacacaccattttagccacaaagaggccgaccagctcagatgagatttgccaggttgaaactagactttcaggtactctcactttaaagagatgggatcttgtagacatactgacagatcatgcttaa

SEQ ID NO: 13988 - DNA, 1623 bp, A.fumigatus
tacaggctcacgcggactatcatggctcctgccgctggtcctcgcactggcaagcatgcaaagccacagcgatcgaaaacattgaaacgcaagcgcgggcaggaagaactgtcgtctctcatccagcgggtggaagatcttgacctcaaagggatctttaaatctttctctgatctgcctctatccgaaccaaccgcttcaggccttgcgtcttcgcactacaaaacgttgactgatatccaatctcgtgcgataagccacgcgctcaagggtcgagatatcctgggagccgcaaagacgggtagcggcaagacgctggcttttctcgttcctgtgctcgaaaacctctaccgcaagcagtgggctgagcatgatgggttgggcgccttgattttatctccaactcgcgagctcgccattcagattttcgaagttctccggaaaatcggtcgctatcatacattctcggctggtctggttattggtgggaagagtttgaaggaggagcaggagagactgggacggatgaatattctggtgtgtacgcctggtcgtatgttgcaacatctggatcagacagcactgttcgacacatataatctccagatgctggtcctcgacgaagcagaccgtattctggatttgggcttccagcagacggtggacgccattatcggccaccttcctaaagagcgtcaaacgttgctattcagtgcaactcagacgaagaaggtttcggaccttgcccggttgagtcttcaggatcccgagtacgtggctgtccacgagacggcatcttcagcaacgccatctaaacttcagcaacattacgtgattacgccgcttccgcagaagcttgatatcctgtggagtttcatcagaagcaatctaaagtccaagaccatggtatttttgtcttcggggaaacaagtacgatttgtatacgaatccttccgacatttacagcctggtattccgttgatgcatcttcacggccgccagaagcagggtggacgattggacattgtgaccagattctcacaatcgaagcattgcgttctcttctctaccgatgttgctgctcgtggtctggacttcccagcggtcgattgggtcatccagcttgactgtccggaagatgcggacacttatatccacagagtggggcgtacggcgcggtacgagcgggaaggttgtgcagttttgttcttggatcccagtgaggaggaaggcatgctgaagcgcctggagcagaagaaagtacccatcgagaagatcaacatcaaggcaaacaaacaacagagtatcaaggatcagctacagaacatgtgcttcaaggatcctgagcttaagtatctcgggcagaaggcgttcatttcttatgtcaaatctgtttatattcaaaaagacaaggagattttcaaactcaaggaactgaagctggatgagttcgcggctagcttaggtttacctggtgcaccccggatcaaattcatcaagggagacgatacgaagcaacggaagaacgcacctcgagccgcagcgcacctgttgagtgacgacgatgacacggacgaggaggacggcgagaagaagagcaagaagaaggaggaaccacagtaa

SEQ ID NO: 13989 - DNA, 594 bp, A.fumigatus
  unsure (8): Identity of nucleotide sequences at the above locations are unknown.
cggaccanatatgaccggatgtttgagcggcggaaccaagacgtgctggcagagcattactcgaaactcatcaatgacgatggcacaatggttgcacccaatgccggcgccggggctgatgcggacgaagatgatgacttcctgtccgtcaaacgtcgcttcgacgccggtgataaggacctgggatcgtcaggtgacgaggacgatgagagtgagaagggtaacaagaagaacgtcaaggtggtacacattgacggcagtacacctctggtcatcgattccaagcgtcgcgagaagctcctcaaatcgaagaagaagttactcaaattcaagggcaagggaaccaaactggtctacgacgacgaaggaaacccgcacgagttgtacgagttggaagacgaagagcaattcaaggcccgcggcgacgccaaggatcaacaggccaagttcttggcggaagaggcggaacgcacacgtctggcagacatggaggacaaggagattgccaaacagaagcggcgcgagaagaaggagaaacgcaaggctcgcgagcgtcttcacacacgggccctagaaggaaccgcgattggcgta

SEQ ID NO: 13990 - DNA, 840 bp, A.fumigatus
tcattcaacaaacacagagtaactgaagcttgtggcattcgtaaggctgaatttacaatgtcgtccgacgagcaagatgctttggacgcactggagaaggaggcgtcagatttcatcaaggtatgtgagagctgtcccagccacaattggcgtcagactgacatttgctacgatgtaggatgcggaaatcgatcgcattcgaaaggcttttcaattagatgcgtgagtattattctttttctgttgtttcttgacaccttctatgcgttctacggtctgccaactgacaatttcgcaataagatatgcggtccttgatcttcagcccggtgtccccgaatccgacatcaaattacaatatcgcaaaaaatcccttctcattcaccctgacaaaacaaaaaaccctgctgccccagatgcctttgaccggctcaagaaggctcagacgactttattggatgagaaggcccgcgcgtatctggatgaatgtatcgctgatgcgcgacggctcttgatccgggaacataagtacacagtagactcccccgaattacagaccgaagaattcaaaaaagaatggcgtcagaagaccgttcaggtgttgctagaagaggaagcgcgcagacgaagacagcttaaggccaagctgcaggaggaaggacgagagaagcgcaaagaggaagaagagttggaggcaagaaaacggaagcgagagctggagcaggcttgggaaaatacgcgagatgagcggattggaagctggcgagaattccaaaaagggcagaagaaggggaccgatggtgacaagaagaagaagaaaaagatgaaagttctaggctaa

SEQ ID NO: 13991 - DNA, 525 bp, A.fumigatus
ctacgtcttccaccaggaataccgcacccgatggcaagcacccatcctctccatccctacttccctctaatgaaagccaggttcgacaacgacatgtacgcccacctcaacaacaccgtctacgccatgctcttcgactcgatcgtgaatagctggcttatcgccgagtgcgggatggatccgttcaacaggaacaagtcaacaacaagcaccggcgccagtgacgatgacggcgctgtctcgcagcaggtcgggatcatggtcaactcgtactgcgactacttcgcctcagtctcatatcccgatgtactggatctggggctgcgggttgcgaggctggggtcgtcgagcgtgacgtatgaggttggggtgttcaggaggggggaggaggatgtgaaggttgttggggggtatacgcatgtgttttgtgcgcgggagacgatgaggccggcgaagggagggatggaggagaggattcgacgggggttggagaagttggttgttagggagggggcgaagctgtga

SEQ ID NO: 13992 - DNA, 723 bp, A.fumigatus
cagcatcgccgtctatccccgatcatcttcttccagccactacgaagtcttttcgaagtacgaccgtcacgatggatatcaatttatgacctcgctgttttcctatctcatttctcgaatcataaaagttctgcaactgagcgcttcctttcaaatttccactcgtcttctccgttttccttaatccggcctcttcctcttttcgtcattcagatatctaacactatggcgccaaatcttttcatctgccttcgcgcagtcttctgcccgacttactggttccaacgcggcgagcgcattcaaggatccatcttccaagaggaacattgggaaagccctgttcctggcatctacaagtacatcccgggtcggggatggcatctcgttcagagggacgacagcgaatacgaggagaaagtccccgtccctctggtctactgccgcatcctccatcgatacatcttcgaacacgaaatggaggacagatgtcgctggcagtcggtgactctgcacgaaggcgcgaagcccgaacgactgctcttcttccttctcgatgatggctacacctgggtcgccgggtgggacgccaaaggaacgttcattcctggcccgtaccaaaagtggcactacgaccatgacaccaagacgatgcagcgcgtcgtgtctccagaaagttccaacgtctctcggtgcagcagcatcgtcccgaccaagatgggttag

SEQ ID NO: 13993 - DNA, 867 bp, A.fumigatus
tatccttgtgatcgacaagcccgcgggcgtccccgtccacgccgccggccggtaccactacaactcgatcgtcgagatcctgcgctcgcagcgcgggcaggagttcgtcccccggccctgcaatcgcctggaccgcctgacctccggggtgatgttcatcgcgaagcaccccaaggccgcggacgccatcaccatcaagctgaagcagcgcaccgtgcaaaaggagtacatcgcgcgcgtcaagggccgcttcccagacggggtggtcgtctgcgaccagcccatcatgtccgtcagccccaagctcgggctcaaccgcgtgcgcgccaccggcaaggacgcaaagaccaagttccgccggctagcgtactatccacctgcctcgcccgccccggaacgcgacgaggacgaagtgaccgccagcggcgaccggcccgcgacgccgccgccgctcctcgccaacgaatcggaaggctacagcatcgtgcactgcctcccgctgacggggcgcacgcaccagatccgcgtgcacctgcagttcctgggccacccgatcaccaacgacccgatctactccaaccggcgggtcttcggcccggacctcggccgcaacgaaaccaccgccgagcgcgaccaagagatcatggaccggctgtccgaaatgggcaagaccgaagttgcagatacgaccacgtaccgcacgcacctgacgaccgtgccgcccgtaccgccgggcacgcacccgtccgtcgtcgaggagatcatgtcgcgcgagcacgaggccgccgtgcacgactaccacaagcgcaagggcgagcgcctctccggcgaggtctgcgacgtctgcggcacggagctctactctga

SEQ ID NO: 13994 - DNA, 252 bp, A.fumigatus
atgaatcacagcttcgccccctccctaacaaccaacttctccaacccccgtcgaatcctctcctccatccctcccttcgccggcctcatcgtctcccgcgcacaaaacacatgcgtataccccccaacaaccttcacatcctcctcccccctcctgaacaccccaacctcatacgtcacgctcgacgaccccagcctcgcaacccgcagccccagatccagtacatcgggatatgagactgaggcgaagtag

SEQ ID NO: 13995 - DNA, 1275 bp, A.fumigatus
  unsure (1212): Identity of nucleotide sequences at the above locations are unknown.
acgcggtcgctaatgcaaatgcaggtacaagctcttgcggacggcaaggtcaccgtcaacggcaaaaccgcggcccccgataccgtgatcaagaacggcgaagtcatctcgcataccctccaccgccatgaaccccccgtcaccggccatgagattggaatcattcacgaggacaatgatatccttgtgatcgacaagcccgcgggcgtccccgtccacgccgccggccggtaccactacaactcgatcgtcgagatcctgcgctcgcagcgcgggcaggagttcgtcccccggccctgcaatcgcctggaccgcctgacctccggggtgatgttcatcgcgaagcaccccaaggccgcggacgccatcaccatcaagctgaagcagcgcaccgtgcaaaaggagtacatcgcgcgcgtcaagggccgcttcccagacggggtggtcgtctgcgaccagcccatcatgtccgtcagccccaagctcgggctcaaccgcgtgcgcgccaccggcaaggacgcaaagaccaagttccgccggctagcgtactatccacctgcctcgcccgccccggaacgcgacgaggacgaagtgaccgccagcggcgaccggcccgcgacgccgccgccgctcctcgccaacgaatcggaaggctacagcatcgtgcactgcctcccgctgacggggcgcacgcaccagatccgcgtgcacctgcagttcctgggccacccgatcaccaacgacccgatctactccaaccggcgggtcttcggcccggacctcggccgcaacgaaaccaccgccgagcgcgaccaagagatcatggaccggctgtccgaaatgggcaagaccgaagttgcagatacgaccacgtaccgcacgcacctgacgaccgtgccgcccgtaccgccgggcacgcacccgtccgtcgtcgaggagatcatgtcgcgcgagcacgaggccgccgtgcacgactaccacaagcgcaagggcgagcgcctctccggcgaggtctgcgacgtctgcggcacggagctctactctgaccctggcgtccatgagctcggcatcttcctgcatgcggttgcatactctgatctggaaggccagtggaagtatccttacaagatgccctcgtgggctatgccgcccaatgggctggatgggccgcgtgaggccccggactgggtgccctgtccccggaagaagagngatattgtctttgggccagacgcccgattccccaggggaatcgttgttcaagccttcctgaac

SEQ ID NO: 13996 - DNA, 543 bp, A.fumigatus
acctgtatattatttttctactatcgatacgtatataatgagattattcagttgttggcttatgtactctcccgatctgatctccccgcaacactaatttactttctgatattttttttcggtggctattttttgccttcgccaggacacagtcgtacacgaacgcacacaataacgggatcgtcgatatcacccctggctccttctcctcgtattactgcatatctgctgcgacgaggcagaatacctgcgtccagcatggctgtcgttcctgtcgacaccaccctcaaagtccctcctccggaccccgttgaagaaccccccaaagtggccgtcactccatgcgatccatggccgatcccatactattttgaaggcgggctgcgcagggtcaagccctactactacacttacaacacctactgcaaggagcgatggcggggtcggcagctgcaggaaatcttcacgtccgagttcagagatcggccggccgagtactacgtgggtcgtcagcctgtgaatgagattgaacgcggtcgctaa

SEQ ID NO: 13997 - DNA, 384 bp, A.fumigatus
  unsure (323): Identity of nucleotide sequences at the above locations are unknown.
cgaccgtgccgcccgtaccgccgggcacgcacccgtccgtcgtcgaggagatcatgtcgcgcgagcacgaggccgccgtgcacgactaccacaagcgcaagggcgagcgcctctccggcgaggtctgcgacgtctgcggcacggagctctactctgaccctggcgtccatgagctcggcatcttcctgcatgcggttgcatactctgatctggaaggccagtggaagtatccttacaagatgccctcgtgggctatgccgcccaatgggctggatgggccgcgtgaggccccggactgggtgccctgtccccggaagaagagngatattgtctttgggccagacgcccgattccccaggggaatcgttgttcaagccttcctga

SEQ ID NO: 13998 - DNA, 834 bp, A.fumigatus
tctttctctctaccatcctgcaaagcttccagcactatgactctccctacaaacaatgctgaatggggtgccgtgatctccagctacaaggaccagcttccggaggtctatcccgtataccaaaccccgcttccctcctccgtgaaccgatacatcgaccatacccagctgtccttagatgcgacagacgaggatattgacaaactctgcgcggaggcagctaaacacaacttttctgcggtctgcgttcgcttgcgacatgtccgcagagccgttacaaatctccagggtagcccggagtgcactgtagcctgcgtcgtgggttttcctgaaggcacgcacgacaccatggagaaggagaaggaggcgctggacgccgcagaactgggagcgagtgagctagacatggtgattaattggccaaagttgaaggaagggcagtacatggatgtctacaccgatgtcctcgaagtacggaagggggcaccgtcgccagtcaagttaaaagtcattctggagacctcacaattgaccaaggatgagattattgctggctctgtcatatcgagcatggccggggccgactttgtcaagacaagcacgggattcaagggagcgggggccaatgttgacgacgtcgctatgatgcgggctatcgttgagctggtaggaaggggaaccaaggtgaaagccagtggaggagttcgctccgccgaagactgtatcaagatgttgaaggcaggcgcagaccgcattggaacgagttcaggggtgaatatcataaaccagctcgcaggaaaggagacgcaaccgacgacacccgcagcgtactag

SEQ ID NO: 13999 - DNA, 582 bp, A.fumigatus
atccctgcctgcacgtacacacggttggcagtgatgcacgcctggcctgcatgccgccatttcagcgccatcagctggtccagggcctggtcgaggttcgcatcgtcgaacacaatgaaggggcaattcccaccgagctcgagggtcaccttcttcagcccctcggcgcagtgcgcagcgatcagcttgccgacgcgcgtggatcccgtaaatgtcacctttttgacgagcggatgcttgcaaagcgcctcactcagcgaaggcgtgttttccaggtcggtggtcagcacattcaacacgcctgctgggaaacccgcgcgttgcgctaggtgcgccagcacgagtgtcgtgataggagtctccgggctaggcttgacgatcatcgtgcagccggcggcgaaggcggcgcctgctttacgcaggaccatggcgatggggaaattccaggggaccagagcggcggccacaccgatgggctgcttgaccgtgaagacgcgacggttgggcgccgagggcacgcttaccgtaccgtggatgcgctctgcctcgccagcaaaccaccaggtgaagcccgtggcgtag

SEQ ID NO: 14000 - DNA, 480 bp, A.fumigatus
tcacatgcaaacgcgccatccggcaaattgacgcaattttcaacaacatacaagaacttgctagtactgcccttcgatagtcagggttccagttttggtgatcagatactcgttgacagccacctctttcccactctccttgccgtatcccgactccttgatgccgccaaacggcgactccgcagccgacgcattacccgtgttcatgccaatcatgcccgcctcaagattctccaacatccgccacatacggtcaatattcttggtaaacgcgtagctggccaggcccatgcttgtattgttggccatgcgcacggcctcctcctccgtctcaaaccggtacagcgccgcaatgggtgcaaatgtctcctcgcgcgacaccagcatctcctccttcatccctgtcaggatggtgggctggaagaagtaccctttctgcccaggaacctgtccgccgccgaggatgacatccgcacctaa

SEQ ID NO: 14001 - DNA, 474 bp, A.fumigatus
ccggcgcgcatcttcgacctgctcccgcgccttgtccaggccccgcggtgtcgtgagggggcccatagtagtgccctcctgcgcgccgtggccgacgaccaacttctccgtgcgttccttgagcatctgtgcgaatttatcgtagatccctgcctgcacgtacacacggttggcagtgatgcacgcctggcctgcatgccgccatttcagcgccatcagctggtccagggcctggtcgaggttcgcatcgtcgaacacaatgaaggggcaattcccaccgagctcgagggtcaccttcttcagcccctcggcgcagtgcgcagcgatcagcttgccgacgcgcgtggatcccgtaaatgtcacctttttgacgagcggatgcttgcaaagcgcctcactcagcgaaggcgtgttttccaggtcggtggtcagcacattcaacacgcctgctgggaaacccgcgcgttgcgctag

SEQ ID NO: 14002 - DNA, 528 bp, A.fumigatus
gtgcgccagcacgagtgtcgtgataggagtctccgggctaggcttgacgatcatcgtgcagccggcggcgaaggcggcgcctgctttacgcaggaccatggcgatggggaaattccaggggaccagagcggcggccacaccgatgggctgcttgaccgtgaagacgcgacggttgggcgccgagggcacgcttaccgtaccgtggatgcgctctgcctcgccagcaaaccaccaggtgaagcccgtggcgtagtcgatctccccgtacgattcggcgaggggtttccccgtttcgtgggtgagaatctgggcgaggtcggaccgcgccgcccgtatgagagcgtcccatttcatgagccattgggcgcgctgccgggggttggtcttcttgtaggtttcgaatgcttcatgggcggcctggacggcgggattcacgtcttccacgccattggcaggacaactggcccagggtgtgtcggtaccggggtctatcctgatgttaccgtagactcaataagaggagaatag

SEQ ID NO: 14003 - DNA, 1404 bp, A.fumigatus
gtctacggtaacatcaggatagaccccggtaccgacacaccctgggccagttgtcctgccaatggcgtggaagacgtgaatcccgccgtccaggccgcccatgaagcattcgaaacctacaagaagaccaacccccggcagcgcgcccaatggctcatgaaatgggacgctctcatacgggcggcgcggtccgacctcgcccagattctcacccacgaaacggggaaacccctcgccgaatcgtacggggagatcgactacgccacgggcttcacctggtggtttgctggcgaggcagagcgcatccacggtacggtaagcgtgccctcggcgcccaaccgtcgcgtcttcacggtcaagcagcccatcggtgtggccgccgctctggtcccctggaatttccccatcgccatggtcctgcgtaaagcaggcgccgccttcgccgccggctgcacgatgatcgtcaagcctagcccggagactcctatcacgacactcgtgctggcgcacctagcgcaacgcgcgggtttcccagcaggcgtgttgaatgtgctgaccaccgacctggaaaacacgccttcgctgagtgaggcgctttgcaagcatccgctcgtcaaaaaggtgacatttacgggatccacgcgcgtcggcaagctgatcgctgcgcactgcgccgaggggctgaagaaggtgaccctcgagctcggtgggaattgccccttcattgtgttcgacgatgcgaacctcgaccaggccctggaccagctgatggcgctgaaatggcggcatgcaggccaggcgtgcatcactgccaaccgtgtgtacgtgcaggcagggatctacgataaattcgcacagatgctcaaggaacgcacggagaagttggtcgtcggccacggcgcgcaggagggcactactatgggccccctcacgacaccgcggggcctggacaaggcgcgggagcaggtcgaagatgcgcgccggttaggtgcggatgtcatcctcggcggcggacaggttcctgggcagaaagggtacttcttccagcccaccatcctgacagggatgaaggaggagatgctggtgtcgcgcgaggagacatttgcacccattgcggcgctgtaccggtttgagacggaggaggaggccgtgcgcatggccaacaatacaagcatgggcctggccagctacgcgtttaccaagaatattgaccgtatgtggcggatgttggagaatcttgaggcgggcatgattggcatgaacacgggtaatgcgtcggctgcggagtcgccgtttggcggcatcaaggagtcgggatacggcaaggagagtgggaaagaggtggctgtcaacgagtatctgatcaccaaaactggaaccctgactatcgaagggcagtactag

SEQ ID NO: 14004 - DNA, 294 bp, A.fumigatus
tcacagatattcgcaagtgaacaaaggaagatcgaaggcagaggaagggcacaccacagcgtttcccgaacggaagcacggtccaaggaagctaatcgaccagaaggagcaaacggacggacaatcacaagagaagaaagcaaaaagcggatcgaaagtcaggagagaaagcagaaagaaggaagagcaggagaggagagagaagaggaggaagagaggagtcagagcaagtcaggagaccacaggagcagaggcaaaattccggatgatagatatagatcataccctccgtag

SEQ ID NO: 14005 - DNA, 507 bp, A.fumigatus
aggggcaccggagaaaaaaaaggagaggagaaagagaaagcagatagtcacagatattcgcaagtgaacaaaggaagatcgaaggcagaggaagggcacaccacagcgtttcccgaacggaagcacggtccaaggaagctaatcgaccagaaggagcaaacggacggacaatcacaagagaagaaagcaaaaagcggatcgaaagtcaggagagaaagcagaaagaaggaagagcaggagaggagagagaagaggaggaagagaggagtcagagcaagtcaggagaccacaggagcagaggcaaaattccggatgatagatatagatcataccctccgtagaatggaacagcttctaaataaaaaccttctcgaaaaaagtgccagcaaagcggaggcggcaaaaaaagagcagacagagatcaagagacacagaaagaatgagaaccacagggctgggcaccatgggatgggcaagatgcggccacatggggcgaattggccatga

SEQ ID NO: 14006 - DNA, 396 bp, A.fumigatus
agccccaaattcaatatgcccgaaccttcccttgaagcgcaatcattgaccccggatgccgtgcgctctgcctacgccttgatccagccgtacgtccaccgcacccctctcctcacctgtcaaacgttgaacaacatcgcctcgacccctcaatcagccgaatcattggtcggaacaccctttgaaggccagacacctgcaaatcctaagtttcgattcttcttcaaatgcgagaattaccagcgcatcggcgccttcaagcctcgcggtgcgtttcacgctttgctgcgactcctcgcagagtggggtgaggaggaggtcaagagacgtggcgtgattacgcacagttcaggtacacaaatttacccaactctgcttaagttgagggtttcatga

SEQ ID NO: 14007 - DNA, 849 bp, A.fumigatus
gggtttcatgatgctgacaacagaataggaaaccatgcgcaagccctcgccctcgcagcctctaccctccacgttcccgcgtacatcgttatgcccagcatcagcaccccgtcaaagatagctgggacacgctcgcacggcgcagaggtcatattcagcggctcgacgagcaccgagcgcgaagccgttgtcgcggagatccaggccaagacggatgcgatcctcatcccgccatatgatcacttcgatattatttgcggccagggcacgaccgccttggagatggaagagcaataccgagcgcttgttgccgacaagccgcatttgagtgctcatgccggcggggccgaggctgactccggatcgagacacctcgatgcggtgatcacgcctcttgggggcggggggctgaacgccggtgtcgcgacgttcttctccgggaaacctacgcgtgtctttggcgcggagccgagcttcgaaggcgcagacgactgtcgtcggggattagaagcgggtcagcgtgtggagtccgtcaagacgcttaccattgctgatgggctgcgcaccccggtaggggtcttgaactgggaagtcatctcggaccggagcaaggtggctggtgtgttcgccgtgactgaggaccagatcaaggctacgatgcggctggtcttggagcgcatgaaggtagttgttgagcctagtgcggtcgtggggctcgcggtgtgcttgttcaatgaggagtttaggcgacttgttgagaaggaagctggtccggatggatgggacatgggtattgtattctccgggggcaacactaccgttgaggcaattgggaagttattcagctga

SEQ ID NO: 14008 - DNA, 687 bp, A.fumigatus
  unsure (20),(87): Identity of nucleotide sequences at the above locations are unknown.
tcaccaagggcaagaccttntaattttccccacggtttctctcctgtcttcaaggagctcaccaaggtggacgtccccaaggatgtngatgtcatcttcgtcgcccccaagggttccggccgtaccgtccgcacctttttccgtgagggccgtggtatcaactcttccattgccgtctaccaggacgttacgggcaaggccaaggagaaggccattgccatgggtgttgccgtcggttccggttacctttacgagaccaccttcgagaaggaggtctactcggatttgtatggtgagcgtggttgcctgatgggtggtatccacggtatgttcctcgctcagtacgaggtcctgcgtgagcgcggccacagcccctctgaggccttcaacgagaccgttgaggaggccactcagtctctctaccctttgatcggtgccaacggcatggactggatgtatgccgcttgctccaccactgcccgtcgtggcgccatcgactggtccagccgcttcaaggacaccctgaagcctatcttcaacgaactctacgacagtgtgcgtgacggcactgagacaaagcgctcgctcgaatacaactctcagaaggactaccgcgagaagtacgagaaggagatgcaggacatccgtgatctcgagatctggcgtgctggaaaggccgttcggtaa

SEQ ID NO: 14009 - DNA, 2130 bp, A.fumigatus
gtcccgcttgttgaaagatggtacccgcggaccttgattgtctgtccagggaccttgatccagaactggatttcggaattcaaccgttggggctggtggcatgttgatacataccatggggacaataaggagctcgcactgcaagccgcgagatcaggccgcttggaaattctcattacgacctacggtacatatctgcacaacaaggatgccgttaacatggtggaatgggactgcgtcgtggcggacgagtgccacatcataaaggaacgcagctcggaaacaacaaaagcgatgaacgtggtgaatgcactttgcagaatcggactgacgggcaccgcgattcagaacaaatacgaagaattgtggacgctgctcaactggacgaatccgggaaagcttggcccggttacaacctggaaacgtaccatctcagagccattgaaaattgggcagtcacacgatgccactctgtaccaactcagcaaagctcgcaagacggcgaagaagctcgttgaaaatctcctacctcagtttttcctacggcgcatgaagacattgatagccgatcagcttccgaagaagagcgaccgggttgttttctgtccgctcaccgagacgcaggcaagtgcttacgaaaatatcctcgacagcgacatcgttcagtacatcaagacatcctccgacaagtgtgactgcggctcagggaagaaagcaggctggtgctgccggcagttcctgccctccgggggcagatggcagaactatgtatttcccgcaatagctatactccagaagctcagcaaccaccttgcaacactcataccgcaaggggcggactccttggagaagcaagagaaggataaagagatgctggagattgccgttcccgaccagtgggagcagctctatcggacccgagactccattgttaactacgccaaccctgagttctgcgggaaatggaaggtcctccgcaagcttctgaaatggtggcatgcgaacggtgacaaggtgctggtgttttcgcacagcgttcgtcttctcaagatgctacagatgctctttcattacacgagctacaatgtgagctacctggacggctccatgacttatgaggagcggacgaaggttgtcgacgagttcaattccgacccaaaacagtttgtcttcctaatctcgacccggtctggaggcgttggcctgaacatcacctcggcgaataaagtcgttgtcgtcaacccaaactggaacccttcgcatgacctacaggcccaggaccgatcgtaccgaatcggtcagtcccgcaacgtcgaggtcttccgcctgatctccgtcggcacgatcgaggagattgtatacgcacgtcagatatacaagcaacagcaggccaacatcggctataacgccagctctgaacggagatacttcaagggagtgcaggagaagaaagaccggaagggcgagattttcgggcttgacaatctgttcgagttcaaaaccaacaacatcgtcctcagggacattgtcaacaagaccaatgtcgccgagagcaaggccggcgtccaagtcatggacctagccattgacgaatccgacacaaaaactaccacggtcgacagcagctctgaaaccaagaatcaagacgaccaagtcatgagccagttagccgcaatgatccgcggtgatgctgacgacgccgcgctgcaggcgcaggccgccgtaactgcgcagaaacacgatcccatccaggccatcctcgcaggcgcgggcgttgaatacacccatttgaataacgaagtcatcggctcgtccaaggtggaagaacgactcagtcggcgtgccgagctagccgatgaaaaactaggcgaggtacaggtcttcgggtcctcgcaagacaggaccgagcagggtggtattctggacaaggacggccggcccatccggtacaagttccatccgccacgggaggtaatgaaacgccagttttgcagtatggcgaagcggttcgggttcgctagtgccactgagtttgcacttgtggtggagggtatgacgcaggctcagagacgggcgtgtttggagcggtggtataccgagcgacgggagatacttctaggccggagatga

SEQ ID NO: 14010 - DNA, 669 bp, A.fumigatus
aaaatggaagcccacctccggctctcgacggcgccctctcccttccccgtgatttcattcggaacagggtccctggtccgtcttccaggaccatccatcactcaacctaatgtctacaacttcaacactacctcatactcgcaaatgtatgacgagctcctcgccaaggacgaaagactctaccgtaataatggccttctgaacatgcttgatcgcaatcggaatctgaaatggggcccggagcgtttccaggactgggttcccggaatgccgcgagtggaccacgtgtcgaaaggcgacaaaggtgctctgggcacagaaggaggtacggtcgacgtcatcatcacctgcgaggagcggtgttgggatgccgtcgtagacgatcttatgaacaagggcgcggctctcaatcgaccggtccacgtgttcaatgtcgacatcagagataaccatgaggaggccctggtaggaggaaaggccatcctcgaattagctacgcgactgaacgatgcggcgacccaggaacgtaagattcatggtgccgagggctgggagaacggcaatggtgaagcccgtaggagctttgacgaacgcgtacctgagattctggcgtcgtggcaggagaagtggcccaatttgccggctttgtggactctggcttggctatag

SEQ ID NO: 14011 - DNA, 237 bp, A.fumigatus
tatacaaatatcaccaagcagccaaataaatgctgttttgtaaacccaactccaactaagcaaaagggtatctctcaaacaaaacccccaatcagatcggaggccgtcttccaatcccataatatcatctccggcctagaagtatctcccgtcgctcggtataccaccgctccaaacacgcccgtctctgagcctgcgtcataccctccaccacaagtgcaaactcagtggcactag

SEQ ID NO: 14012 - DNA, 225 bp, A.fumigatus
gctcgcagttgtaagcttttactgaaatggactgactgcccagaggactataccgaattcgcgagtccgttcaaggaggtttctatcgcggagtggatcgagcgcgcattgcaggccggtatcgactcactgatcacggggtacttggaggcgaaggtgataaagggcgagacgatccggtttccatctatgggagacacgggtcgtcttgaggatttggcctag

SEQ ID NO: 14013 - DNA, 309 bp, A.fumigatus
cttctgcgccattgtctgggcatcaacccgacgaaaaactcatggctccctgtccaccaagtccaagtgtgcggcagaggatttgccctttccggtaagtacttgttcccccgtttccccacggtccataacaccggtttctccgcacatgccggcagcttcaagcctacagtagcctctagtaatagccctaagtatcgatgcggatctggcacctcaattgccgatttccctgtcctccgcttccatgatcgaggatgggttgcctaccccacgtttatgtctcgttgtagtttctctgccatttaa

SEQ ID NO: 14014 - DNA, 1275 bp, A.fumigatus
  unsure (945): Identity of nucleotide sequences at the above locations are unknown.
ctcgtcgactctgtgtcaccgttcaggatgaagttcctccagaggtcctgtctcagcctcctcgtatccctctctagctccctcagtcttcccgacggccatggtcgccacgacatcatcccaaagactgttgtgattgatggcacccgtctcgtggagaacaaactgcgcctccgagctggcgatgcctcactcacagccgctcttggtcatctcaccgctgaagctgatcgctggctgagccagggcccgtggactgtgaccgccaaaacgcaggcaccccctaacggcacgatccacgactacgcatcccaagcaccgtactggtggcccagtaataccaccgatggctgtccctacgtaaaccgggatggcgagcgcaaccccgaagtcgaaaaataccctgatcacagcggacgtgattcgatgttcagatccagctacatactctctctcgcctggtactacaccggccaggcaaaatatgctcaacgtgcctcacttattctgcagacctggttcatcgaccccgctacggccatgacgccgaacctgcgccacgcacagatcatcccgtgccgcaatgacggccgctccattggcatcatcgacttcagcatggagtacagcaacgttctggatgcagctgttatccttgcctcgaccaatgctcccggctggacaagagcaaatcagcgagcgttcatgaactggaaccgtcagtttctcgactggctagtcaactcgccgtttggcaaggaagaggcaagccacgagaataaccacggcactttcgccaacatgcagattgcggcgcttgcgctcttcaccggaaacacgtctctctcgagaaagacatcccagggagcaaagtctcttatcgacctccagatccggccgaatggctcccaaccgatggaactcgcaaggacacgcagctggcantactccaatttcaacctcggagcacacgtgcgctttgcgcttgtcgccaagaaggtcggcgtagacctgttcggttataagggtcctgatggacagagtctgtttggagcgacgaatttcctgttgaaggcggctgtggaagggaagagcgcatgggaattcgaagaattggagtttaagccgtatgcggcaactgataatgtgcacgcagcagctgatgcaggagacagtcgagccaaggcagctgtgcctcggcttcatccgccgccgactggggatatttacctgcttagaccggccgccgagcagttggataatattgctggttag

SEQ ID NO: 14015 - DNA, 840 bp, A.fumigatus
tcacgatttaattggtctcgcggccctaaacgcaagtacacccgaaccgatcttcagttctcttcccggcatctccaggacttcttcaacgctagcgaccaagtgggcgacttcgaatctggtgtggatgttgtcactgaagatagtgtgctacaatccttacaacagtgggcgacaaacactcattcgcagatgctcgcggtgggcggatctccacccaccacctttcccaacaccgttgcccttttctctgcttgtttcgccaccttcgcgcgacaggcacgtcttccggtcatttcccacttttgctccctcccgacccagtctacagatgctttgactttgttccaacagggtcttattgccctcgcttacagtctgatacggcaactaatcgattacctcccgccagttgtggagagtcacgaagcttgtgatttgtgcttggagcgttttacatccctgaatggcacccttagttcgtggaaaacactcctctccctgatcgatgcgctgttgcactacgcaccaccactgctagtctgcgtgattgatggcctcgataaactccaagacgagtccaccgatgcccatatccgggagctggttcgcactttgatgattcataccagacatcgggtggacgatacggcagacggttcttggaaccaaaaggtgctcctcaaggttctctttaccgtggctgatcggcccagttccctggttgaaacgatgtcggagaatcaactcatactgagcgagccaaagggagcagacgagccgatcccaacagataccactccagcctcgggcgtcggagtggtgatgatgaatgcatag

SEQ ID NO: 14016 - DNA, 600 bp, A.fumigatus
cgtactactccaacccctggctgcgcctcatcgccgagtcctggctcggcccagcctaccgcatcacagcccaagtcaacatcgtcaaccccggcggcgcggcccaggaatcccaccgcgactaccacctcggcttccaggccggcaccaccaccgcccgcttcccgcgcaccctgcacctcgcctcgcagtatctcacgctgcaaggggccgtcgcgcacagcgatatgccggcgtgcagtgggccgacccgcttcctccccttcagccagtgctttgagcctgggtacctcgcgtggcggcgcgaagagttccgggcgtttttccaggagaactacgttgcgctgccgctggagctcggggacggggtgtttttcaacccggcagtgtttcatgcggcgggggcgaatgagatggcacctgaggatgggccgggcgggggtttccagcgcaaggcgaacctgctgcagattagttgtgcgtttggcaagacaatggagagtattgatacggtgccgattgtggagaggtgttggggggatatggtgcggcggtgggaggaggccggaggccggttggatgcggagctcgaggcgctag

SEQ ID NO: 14017 - DNA, 1404 bp, A.fumigatus
ctaccagagcacgttgttggagtcgtcagcatctgtggagtccagttccatctgttccccgcagttcttagcaccatgattcgatcctcggaattcagaacggaggcagagatcggtttaaaaagcccgacatcgtcgcgcagcgttgtgcacccagacgacctgttcaggacatctgctacgacactctgcgagatgaatggaaatcatttggccaccagtcgactgttcgagacgactcctcgaatcgaagacttcaaagagatatgcagccagaccaccgacaaagcctcttaccctttatcctcgcgcatcgagaagaacatccccatctacgatataaccacccttgaccacctcaacggggaactcaccacctgtctccaagacgaatggcacaacgccctcaacaccggccccggcatcgtcgtgctaaaaggcatgtaccacccaacccaccatggcccaaccctgacagccaccaccgaggccttcgcccacatcattgcccaagagcgccgcactgcaacaaagaaaggcgaccacttcgccgccagcggcaaaaacgaccgcatctggaactccttcagcaaacacgccctcctcgacccccgctcttttgtagcgtactactccaacccctggctgcgcctcatcgccgagtcctggctcggcccagcctaccgcatcacagcccaagtcaacatcgtcaaccccggcggcgcggcccaggaatcccaccgcgactaccacctcggcttccaggccggcaccaccaccgcccgcttcccgcgcaccctgcacctcgcctcgcagtatctcacgctgcaaggggccgtcgcgcacagcgatatgccggcgtgcagtgggccgacccgcttcctccccttcagccagtgctttgagcctgggtacctcgcgtggcggcgcgaagagttccgggcgtttttccaggagaactacgttgcgctgccgctggagctcggggacggggtgtttttcaacccggcagtgtttcatgcggcgggggcgaatgagatggcacctgaggatgggccgggcgggggtttccagcgcaaggcgaacctgctgcagattagttgtgcgtttggcaagacaatggagagtattgatacggtgccgattgtggagaggtgttggggggatatggtgcggcggtgggaggaggccggaggccggttggatgcggagctcgaggcgctagtgatggctgttgcggatgggtatccgtttccgacgaatctagataggaggccgccggctcccagtgggatggcaccggagagcgagcaggagattgttctccgagggttgaaggagggatggggggtggacagggtggtggaggagttgaaacagatgaagaaggattcaagtgcttga

SEQ ID NO: 14018 - DNA, 465 bp, A.fumigatus
gcttatgatcgatactaccagacgtccaatatgctcttgatatatcaaaggtacctcctctcagacccgagggcccttccaagtgcccattctgccggctggttcttcaaaaagctcatctatctgcttgggcccaggttacctatccagcgacagatcaagcacttgaatccttcttcatctgtttcaactcctccaccaccctgtccaccccccatccctccttcaaccctcggagaacaatctcctgctcgctctccggtgccatcccactgggagccggcggcctcctatctagattcgtcggaaacggatacccatccgcaacagccatcactagcgcctcgagctccgcatccaaccggcctccggcctcctcccaccgccgcaccatatccccccaacacctctccacaatcggcaccgtatcaatactctccattgtcttgccaaacgcacaactaa

SEQ ID NO: 14019 - DNA, 195 bp, A.fumigatus
gagctgtcgatcattcctagagttgccgcttcttttatattcaagccgagtatgatcgcaaccatgcttctgcctgctcgcttcgactcgacatacttttctgagaatgagtgttcggaagaaggctggaaggctacggattcaatgtgtcagtcgaagtcagatatggccgatattgagaagcctatagtatga

SEQ ID NO: 14020 - DNA, 633 bp, A.fumigatus
cccaaacttccggggccggccaagaccttttcttccttgttctctggcactagttcagccggtgacgcaacggcgcacacagttgcgcctcataacccatttgccagcatatcatcgccgtttatgccattcaagacgccggtgactgagcagacggctccgactttgcctgctgtatccagtagccatcaaccaacctcaatcttttcgacaggaacatacagtcttacgccagggaagcccgacacagcccctgcatccgctacgtctcagcttaaagccccaaacgtcttccaaccctatacaacaccttcagcgtcaccgttcggccttccccagacaccatcaatatccagacctgatcaggttcctggcccgactgctgctcagccgtcgataaacatattcaatactggcaagccatcctctgctccgcagatttccagctctgtcttcagtctcactggtcagaatgctctcctcggaaaatcggaagctgaaaatcgtcaaccaagtctcttcaattctgcgaagacaacatccgcaccatctccgtttgcgcaagcaagtaatttgttcgctccagcgaaagacggtacgtttttctgtcctacagcatcgttgtcagtatag

SEQ ID NO: 14021 - DNA, 330 bp, A.fumigatus
cttgactgcccagaaatacaccagtcaaggcgacaactctgcacaattctttcaatcatcaaggtccacagaatttttcatgttggactactccaacggcgtttcgcctcttcctccttgaccaggcatcttactaccacctcggctgtggaaagagccaggaaagcaatcactctctcatgcttagcacaggtatctagactccaacatagaggaatgcgaattgccacattacaattcgcccctaaggtgggcgacgtggaaggcaacatcaaacggaccaacgaattgctgaacagcggctatgccactgggatcgagaacctgaac

SEQ ID NO: 14022 - DNA, 993 bp, A.fumigatus
gacgaacagctcctttccgatattcgcacaccaaagcaattctttcagtcaaccaatattctgatccgatatatccttggcggtcctgagcctcttggcttgatgcacaagtttgtctgggatcggacacgatcgattcgtaacgatttctccgtccagcagctcacccaggaggaggacgtgaagatagcagtcacatgcctggagagaattgcccggttccacattgtgtctcttcacctactctctagtcctgcgaacgaagagccctttgaccgccaccaggaacgagaacaactcaacaataccatgttgtcgctgatgtactattacgacgacaatcgaggccgcatcacgtttcccaacgaggacgagttccgggcctattacattatcttctccattcacgaccagcggccggatttagaagcccgtgtgcaaaaatggcctgcagagctacgcagttcgcctcgggttcaagtcgcccttgaattgttcgccgctgctggcaacacttgggagtatcaaggcaccctggatgccaaacgacccaacgccattgcacagggattctacgaacgcttcttcaacttggttgattctccagctgtctcgtatctgatggcctgtgttgccgaaacctatttcaaccacatgcgccaaacggctatccgttcgatatggaaaggatattgtcgttatcccgcttctcaacagcacaagaatgaggagtggaccgttgacgaactgaccaatgtcttacactttgatgatgagagccaaacaattgaattctgtgaagagcaagatctacaatttgctgaaaatgctcatggtaatctttatctcaactggggcaaccgtccggttgactcgattggtacgtgtgctctcgacaacactatcgcattctttccttcgttcactgctctgtttcgccccatcggattacggcaatcatactataggcttctcaatatcggccatatctga

SEQ ID NO: 14023 - DNA, 297 bp, A.fumigatus
tgtctcgcagggtggtgtctttacggagtctcccgcatcggcttcaagcctgcacaacgcattcacagaactttcgcagagtacaacaaacgcagaagcggcacctacgcaaagcagcccgacttcttcgattgcacaaatgaccaatataacccaaacttccggggccggccaagaccttttcttccttgttctctggcactagttcagccggtgacgcaacggcgcacacagttgcgcctcataacccatttgccagcatatcatcgccgtttatgccattcaagacgccggtga

SEQ ID NO: 14024 - DNA, 186 bp, A.fumigatus
aataatccttgttcggttggtcgggtaaacttccgcctcccggagccaaagggaaggacgtatgaggaacctgacctgttgttcgagcaggaggtgtcggcgcgcaagttcagagagacggtggttgatccatacgcgggcgaggaggaacacgtggaggtgcgagaggagcatcacaaggactaa

SEQ ID NO: 14025 - DNA, 417 bp, A.fumigatus
  unsure (40): Identity of nucleotide sequences at the above locations are unknown.
tcaatgccgtcgaacacttttgtgtggcgtgagggattcntgcatcgcgttgcattaggtcttatgctggccccacgggtccctcctggccgtgtttattttaaatcaatcgatgccgctcatcgtcaaatttcccaaattccatcctctttctatctacacactgatcatcatcatcaccatcatcatcatcaccatcatcatcatcatggcctccggactcatcttcgatcccctccagctcctccgcgtcgcgccattagccaccagcaccggcagtctcgtgcatgccctggtcgagctgttctccaactcggcctttctccaaccgtcaatccgaaaaccctccgacgcggtcctgccgaaatggtactcatacgtcttcaatcgccagattgtctctgtccttgcgcttaa

SEQ ID NO: 14026 - DNA, 417 bp, A.fumigatus
cagattgagaaaatcttcgaggtagcctgcacgctcaccgatgtcatggcttgtctatcgacggcgggactgcgctcgtccgggttcaacctgggcccgcaggattacttgaagcatttcttctcgcttgtaaacactctcccaggtggtcgacaacggtttctaccattgctattgacaaaggtgggacagaccttgccgtccatgctgcaacccgtaacacagcacttgaatctcccagcagcgaccgtggaaactcttgtgccccccgaaaaggccgagccggaggcctttggcgacacgtggccggatgaccaatcgtacagcgacttcaactacgccgagatgagtcggattggtgacaaaacgccggaaatcgatgaagcgtttatgcagtatctgcaatcgagtccttga

SEQ ID NO: 14027 - DNA, 645 bp, A.fumigatus
gtcttatgctggccccacgggtccctcctggccgtgtttattttaaatcaatcgatgccgctcatcgtcaaatttcccaaattccatcctctttctatctacacactgatcatcatcatcaccatcatcatcatcaccatcatcatcatcatggcctccggactcatcttcgatcccctccagctcctccgcgtcgcgccattagccaccagcaccggcagtctcgtgcatgccctggtcgagctgttctccaactcggcctttctccaaccgtcaatccgaaaaccctccgacgcggtcctgccgaaatggtactcatacgtcttcaatcgccagattgtctctgtccttgcgcttaacctaaccaccatctccaccggtatatcgaacattctactgagtcggtcgcgcagtgccctgcccctgtcgcgcacaacgttctactgggccggcgtcgcgggtgcggtggcgcatctcttcttcgtgccgtttgtcgcgcctcggatccaacgtatagtggaggacagcaatgcgaatgggccaacagtggacatggaggattggctgggatttcatcgcattcggatgttagtggcagatctacccgcgtggctggcatttgcaggagcggtcatggtggtataa

SEQ ID NO: 14028 - DNA, 1500 bp, A.fumigatus
gaacttcggcccccgcttcattgcctcgatacgggttattcttggcgtgggatgacgcggaaaacctccacattttctccgtttttcgatcctccccacaatttctctcaaatcattgcaactagcaatcagacttgcaagatgccccgcgacacgcagatggtgaagcaggcctgcgatgcctgtcgacgtcgtaaagtcaaatgtaatgctcaaagaccctgcagccagtgtcgatcggccgggctaagctgccgtacctcgctggtccgacagaagaaagggcgacagggccggtccgccaacgttctctctgaattgcgtacacagaatgctcaagggaatgagccacctgacccgacgatagcaagtctaacagtggcggcttcgattgtgagtccccctggcggacgatgtcgatttgcgcgcaaggaaaatgtccttcctcgggagctgatccgggattgctccgagtacttcttcgcgcgcatgcaaggtacggttcctattctacaggcggaaactttccagagacatgtagagcagatggatcattgcattcatgcatattgcttggtggttgccttttgtgcttttgtcatgatgcagacggggtattcgtccgcccaagcggcaggctcaagatggacccggagtatggacgccgggcgcgaattgctcgaggaagcgacagaagcgcgaaagcatctggatccgctcactgtccctgtccggcagagcatcaccatcgcgtttcttctgtacggctgtcatatcgcgctagggaatcagcgccacgcgtactatttcctccgggaagcgaccaccttgtacacggcgggcatgttggatactcaatcagacgcagaagagggcgaagagaagctctcttctggcaagctcttttggctgcttctgatttcggaacggtattttgactggatggctcaggtagaaatcgttctaattcgaaacagagcccatgccattcgaagacatcggcccgtcaccctacaggttaccgccaacagtccgactctggaagatccttcccctgacgacacatcctgtattggattccgctgtctggccgatctctaccgcccgttcgacgagtcgttcctcgggctgtggaacggtacgcatgccacatgctcccgcgagtcgctcattctgctcgacaaacatatctgtgatgcagttccccccgacctcgagcttcccgacatcccgatggcggatctccgtgtctcacaacagtggctacggaccatgatctggcaattgtccaccaccgtgggctttctgtccagcaaagccagccatccgtgcatggaattccggtatccgctgcagattgcccgagacctatccctggcgacatggaagctgtcaacacagagtatggaaacgcatgggattggactggttggtgaaccttcccctctgtacaccaaaatgctgatcaactgtgacagattgagaaaatcttcgaggtag

SEQ ID NO: 14029 - DNA, 357 bp, A.fumigatus
  unsure (154),(186): Identity of nucleotide sequences at the above locations are unknown.
cgtcgagaggaattttcccgcagatggagtagctcggagacggcgaaatcatcttcagctgcaaatcagaccatattttttgggatccagccaaccggggtaccgcaccttggaaattatctgggagctctacgtgaatggttacggctacaanatgctgcgaaggagggaacaagattgtttttntctatcgtcgacttgcatgcgttgacagtgccacaagacgcctcccagctacgaaattggagaaaagagacatttgcaacactcattgccgttggtttagacccgaatcgctcaacgattttctaccagtccgccgtatgcagtatgaatatgggttgtaaagtttactga

SEQ ID NO: 14030 - DNA, 465 bp, A.fumigatus
cggctatcaatagcgcctgctaaacgggttatgtccctcaaagaaccgacgttgaaaatgtccaagtcccatgccgacagacgctcaaggatcattcttacggattcgcccgcagaaatctccaaaaagatcaatgctgcgctcacagactcggaattaaccattacatatgacccagtccgtcgacctggagtggcgaatttaatagagatcttgagtcacttcgatggacgaacttgcgatgagattgccatggaataccgttcagccagtcttcgcgctctaaaggaacatctggccagaacgttgtccaatcatcttgagccaataagagagaagtatctctcacttgtaggagatcagactgactaccttgattctatagcagaacagggttctgaagccgcgcgggccaacgctgaattgacaatggagcaagtcaaagtcgctatgggcttaatttag

SEQ ID NO: 14031 - DNA, 195 bp, A.fumigatus
atcagagctactcatgttcctgtcggagatgatcaaaggcagcacctcgaattttcgaggaacactgcgaatagtttcaatcatgtatatggacccattttcccgtcaccagaagcaattatatgtaagtggtttttgcttctggcggaacggtcctgtgttgggaaattgacggctatcaatagcgcctgctaa

SEQ ID NO: 14032 - DNA, 660 bp, A.fumigatus
cgggccaatatgcggcacatattctctctcctttcgattgtgtgtctaatggtgaaacatggtgcctgcttaacactgcatcagagggatgttcctgctgtggtctcactggatatcaagcgtagcattgtttcagaccccgtggtgagagaccgagttcggcggaaacgagacaaaacaatcggccaaacgctcgataatgctgtgagtaatgtaacccatcggaagttgaccttccggttcatcagtcggaccatgttaacagtcaaccaggaaactctgtacttttgcaacgtgactctcggcacccctgggcaggccttgcgccttgttctcgacactgggagtagcgatttatggtgcaacgcggccaattcaacactgtgctcggattcgaacgattcctgcaacatatccggttcttatgacccttcttcctcatcaacatatgcttatgtttcatctgatttcaatatatcatacgctgatgggaccggcgccgtgggtgattatgcaactgatatactccatattggagggtcaacgctgaggaacctgcaatttggaatagggtactcgtctacttcttcaggtacgcccaccacagccttggatttggcgaatgtctgctctacatgtacctgcattgttttagtgtag

SEQ ID NO: 14033 - DNA, 222 bp, A.fumigatus
tctcctccgtgtccttgcacttgcatcttagtgatccagtctgcggaagcctgcctaaacatgttaactactctgtatggattcgccaagcagtacggcctcaacgttcgcagtccacaaattactaccctctcgcatggatacattccggttgagagtctaggcagtcatgctattctcggagatacacaaataacgtattggtctgggtctagcacctga

SEQ ID NO: 14034 - DNA, 681 bp, A.fumigatus
atgtcattatatgcgactacattgaagtctgctaattcatgtctcctaacagaccaaggatgcaaagtaacagcatatgacctccgcccgttcgaggtcccagacactattggcgagagttacgcccgactcaacatccagcgcggcgacatctccgacgaagagtccatcagatcgggcattgcactcgccgtcaagcggttcgggcccatcaacatcctcattgccaacgccggcatcaccgatgaaagccacgactatcccatctgggagctcccactggaaacatgggagaagacgtacagcgtcaacgtccgcggcacgtttctcaccatcaagcacttcctgcgcgctgcacggaccgcacagcaggctatgggcagggagctggagaatctggccattgtcgtgacgggaagcgagacgggggtgttcgggcaggagggccatgccgagtacgcatccggcaaagctggtctccagtatggattggtgaagagtgtcaagaacgagattgtccggctgaatagtagggcgagaatcaacgccgttgcgccaggatgggtggacacacctatgatcgaagggagactggatgatccaaaggaactgtgggccgaagcccaagctacgtatgttctttcaaccagcctggagagactctccctgacaaaatcatag

SEQ ID NO: 14035 - DNA, 1167 bp, A.fumigatus
ttctacagccatattttgctgacctggaccaggcaatatcggagaacggcacacatgaacactacacatcgccgccggcaagcgttttatgctcttccatcgtcgcactggcagatgctggcagagcccccgttctccctcttggacaacttcaaccgcgtagatgacgctatcgatgtcaatgctgacatcgcggactcgattctcgcggcaggcctcgcgtcgttcggtctaccagccgatccggatcccaatgatccacggcagaactggcacggcacggccacgtcttcagatgtcaacaaggcgcactcaaccatccgccagttctaccgcgactggagcgccgagggaagagccgagagagagatatgctacgagcctgttctccgtgatctgcgcgacgagttcgacacccggcactctgacaggaacgagatccgggtgctcgtcccgggcgccggcctgggaagactggtgttcgagatctgtcaagcaggcttcgccgcagaaggcaacgagatctcatatcaccagctgctggccagcagctgggttctaaaccacacccgcggtcctcagcagcacgccttgtacccgttcgcgctgcacttctccaacctcctgtcgcgcgaacaacaactacagaaaatcatgatcccggacaagcaccctgcaacagtgatgatggaggctcaagccgaggactcgtcggcatttggaacaatgagcatgtcggcggcggatttcgtcgtgctctacaacaatccctcaaacaaagaggcgttcgatgccggggctaccgtttttttcattgacacatccccgaatcttattcgctatatcgaaaccatccgacattgcctcaagcccaacggtctttggatcaaccttgggcccttactgtggcactttgaggacggtagtaacaaaggccatggcagtggaagtgatcactctcagggcatcggggagccggggaatgtggaactgacagaagaagaagtgtgttgccttgttgatcgaatgggcttcagcatcgaaaaacagctgtcggcggaaaaccgacccctgtgtggttatatccaggatccacagagtatgctgcacaacttgtaccggccctcacattgggtagcgcgcaagaataccgaaatccaaaattga

SEQ ID NO: 14036 - DNA, 222 bp, A.fumigatus
tatgtcccgtgcaatgccacagttcctgcgtcgacattcatctggaagtttgaagatatcgagtccttttgtttggttattacattttctatctttagtatctcattcccagtcaagggcactgcgattgacagctctcctcgccatggatatggatatccgagcccgactcagtccctggttgccagtattgtcatgtattgtactttaccatacatctaa

SEQ ID NO: 14037 - DNA, 225 bp, A.fumigatus
gggccggtacaagttgtgcagcatactctgtggatcctggatataaccacacaggggtcggttttccgccgacagctgtttttcgatgctgaagcccattcgatcaacaaggcaacacacttcttcttctgtcagttccacattccccggctccccgatgccctgagagtgatcacttccactgccatggcctttgttactaccgtcctcaaagtgccacagtaa

SEQ ID NO: 14038 - DNA, 279 bp, A.fumigatus
  unsure (266): Identity of nucleotide sequences at the above locations are unknown.
tttcatagcctgccggcatttgttccaaacgatgatatgcatcttataacatcgaataagtcgatgacgtatgacagcgccattctccccgttcggtcatatcaactgtgtctatactcctccccctcgacggaggaatatacgtcccgagtcgccaagatcctggcccgacggatgagcctccctgtctacgtgggctgtagcatcgatcctcgggcccctcagttggccgttgaggaggagattgaggggttgagtaagatggnggacgtcaaataa

SEQ ID NO: 14039 - DNA, 1191 bp, A.fumigatus
tttcccggctgtaagacggatgagcagcttcggactgccccaagaccgaaaactggattctttcattctctcctttcactactaagtttgggtaggagcaacaatggacacgccttgcagaaatttgaagacagtcgacgaccacctaacagcggaaacattgactgggttcggctgggtgataatcagcaatcgaataagccacacaacagtgctgctcatgatcgcaaagaatctgagagcgtttcgagccttgccgacggcgatggcttcatcattggtgtgcaggactggcgagatccagatcttgtacccgccagaaccatctctctgccgtcgccgagtagcgttgcaagctcggcgaagactgagtcgggcaacagtgcgaagagccaaaagaagacttctaattcaccgaagggcggtagcatcactccaggaagcggtgaatatcggagcgttgatagatctagcgacaacgaagaagtcccttcgcgtgatggctctccggtaaattctgctggaaacgccggatcagacaagggttggtttttcaagcgcttctttgcacctagacgtacagaaggcgccaacttgtataaaccagcaaacaacaagatgcgcaggaataccgatcaaaatgccaaggttaccgaacatgagggcctgtgggtgacgttgaccccaacaagcatgtctacaagccccttcttcgataccctgcttgttctagttgtcagtcccctgctcactttgacggtcgtgtatgctctgcttttgattcgatctcgtattcgtcgaaggcgttggcgggctccgaagtccatcgtggaacgccttccggtgaggacctaccacacaatcccgacgccttcgtctgcagcaagttcctctcgatcttccagtcctggaccagtctcgccgacttccccattgctaggttctcggagtcggccggagctggccccatcacgctcctcgttcttgcgtagcggtacagctgaagccaagaagactcggaacatggactcggcaaaaggcgagaagtccggttcggcctcctctgtttggcgccgcaagtacactggacggcaggtggaatgtgttgtatgtctcgaagaatacattgatgggcaaagcagagtgatgagcctaccttgcggccatgagttccatgcggaatgcatgtaa

SEQ ID NO: 14040 - DNA, 636 bp, A.fumigatus
catataatgcagggcattctcttcttctcctaccacaaagacctttggcgccctttcatctctcgtgctgtccagaccatcggtcttggcctcggcgtcacaaccgccatgttcttcttcacctacgtcccgcaagcagccatcatgaccttcaccagcggcccgctggccccgatttccgccgcgctgctcgtcctcagcgaaagctcgaccatcaccaatcttctcgcgcggtcgtttgtcctcgctgacgcgctgaccgatacctttgatggcactcttgtcgcacgcggacacacggagctggtggcaaaagggcgccagatcaaagcctctggtggaggagcggtgtctagactggggaggttgctgaaccggccgctggagcggatgagaccatcggcgctggtaaggtcgctgatgctcctgccgttgaattttattccagtcatagggacaatactgtatgtgtatatgcaggggaagaagactgggccagtggcgcatttgagatattttcagttgaaggggtgggatgagaggaagagagaggagtgggtgaagaagaatcagggagggtatactgggtatgattcagcttggcttttgtgctatgcttatgagattgctaattga

SEQ ID NO: 14041 - DNA, 297 bp, A.fumigatus
gttgatacgtgttgtctaagggcgtccgcgcccaggtctacgatttcaactaacccgccgctcttttcgcagatgcttccgccgttggcgcgaatccattctcctgcagatacgatacccgtacgacacctacaccaatcgatcggtaaatcgaagaaacctatcacagttgtgagatggacgccagaagggagacggttgttgaccggaggacatactggcgaatttatgctgtggaatggaacggctttcaactttgagacagtcatggacgtgcgtctgcttccactcgactaa

SEQ ID NO: 14042 - DNA, 1413 bp, A.fumigatus
tcatttgagcaggcacattatgatcaattacaagcaggagtaacttcgattgcgtggtcgcatagccatgactggctgatttcaggtggacaaaagggcgacatcaaatactggcgacctaacttcaacaatgtggagacgatcgatgatgcacatcacgatgccgtacgagacctagcatggtcaccgagcgacacaaaatttttgtccgcgtctgatgatacgaccctaaagatcttcgacttcaccgcacgaactgccgacaccgttcttacaggtcataactgggacgtcaaatcgtgcgattggcacccgacaaaaggtcttctggtgtcggggtcgaaagaccaccaggtcaagttttgggatcctcgcaccgctaggtgcttgacgacccttcacagccataagaataccgtcacgactacccgattctcgcgagtaaacagcaaccttctcgctacgtcatcgcgtgatcagactgcgagagtatttgatctacgtatgatgcgagatatctgtattctccgggggcatgagaagcctatctcatctcttacatggcatcctattcacagttccctcatttccacagggagcgaggatgggtcattataccattatttacttgatgaacccaaccttccatcaggacaagttcctacaattgccccgtacgacagtcctgatcctgcgaataccccagcacaggtcatctaccccgcccatcggatccaatatgcccacagtgccactatctggtcactcgactggcatcctctgggtcatatcttggcgtcgggctcgaaagacaatttcacacgcttctggtctcgagcaagaccaggtgagactagttacatgaaagacagatttcatatcggcgaggaggctgcagaagcccaaggaacatggagtcgtgggtttggaaggcgacagatgcgtgaagaggaagagcaagaggcacaagacgaggctgaaagcttggttgaccagaagaatactaccgcccaatctcttcccggcatccagattgctccccccggtcttggttctctgcaaacaggatctggctcattgttaccaggcattggtgctccacaacctgcaccgcaagctgggatgtctgcatccatgcctcaaatggaccctggccgcttggcagcgattctgtctcaacaaaacccctctcagccacaaaattttccttcggccacaggcattcctggattccccatgccccctgctatgtcaggtactccgccattgaacatcgaccttgcggagctacaaaagcagctcctttcccagggcatttctcctcaaaatttcgcctctttggctgcatctctaggttctgcgggtcttcctggtctgcaaagcagcacgcccgataacacgtatcgaagatga

SEQ ID NO: 14043 - DNA, 189 bp, A.fumigatus
acagccccgagcctgaaatcaattagcctggatctgccatcggagattgttgaggtcacttacatgagaccaaaatatactccaactagaagaagcttcaatgcaccaatgcagagaacaccaacgtacggcaagcagaccttcaattccaacttgcgtgacacagacaaccacgacggcaggggctaa

SEQ ID NO: 14044 - DNA, 198 bp, A.fumigatus
  unsure (156): Identity of nucleotide sequences at the above locations are unknown.
tcccaggcgtcgagggagtactgcgctattcctaatcgggagacctccaggcatgcaggcatcaacgcccgttttgacaccccccatgtggtgtctacggaaggccaagaacaaaaatatatacggttgagacaaagtctcctgcttctagctaanactatatgcattgctaatatgccatctctaagaaaacactag

SEQ ID NO: 14045 - DNA, 306 bp, A.fumigatus
cgaccgaatctgggtctgatgtccggaaaaagattggcgatgcagtggcggaggtggccagacagtacaccgataacggtatgcccaacttcatgggtggtgaaaaagagttccatatctaatgaaaggtcttctctaggcgatcaatggcccgagcttctcggcgtgcttttccaggccagccagtcacccgaggcaggtttacgggaggccgccttccgcattttctcgacgactcccagtatcatcgagaagaaccatgaggatgccgtttgcaggtgtgttcggcaagggtttcaaggatga

SEQ ID NO: 14046 - DNA, 330 bp, A.fumigatus
cgagcgatcaacatgtcgctgctcccacccgaggttcactccgcgctgtcccagctgttgcgcgcgttgaccacacccgataacgctatccgtactcaggcggaagaacagttgaataatgactggatccagaaccgtccagatgttcttcttatgggcctggccgagcagattcagggtgcggaggatacagtagtaagtgatacaagttctgtcaggagacatggggaccgtgtctggtgtaggcaaagagacagccttgaagccttctacttactacgacttgagccctgttgccgcgccttgctggattcgactgattttggttaa

SEQ ID NO: 14047 - DNA, 411 bp, A.fumigatus
gtgatacaagttctgtcaggagacatggggaccgtgtctggtgtaggcaaagagacagccttgaagccttctacttactacgacttgagccctgttgccgcgccttgctggattcgactgattttggttaatcttgacccgcagacgcgtacattcgccgccgtgcttttcagaagaatcgcgaccaagacaaggaaagatccggtcacaaatgaggccaaggaactcttctcaacactctctggggaacagagattggtcattcgacagaagttggtgagctgtttgacgaccgaatctgggtctgatgtccggaaaaagattggcgatgcagtggcggaggtggccagacagtacaccgataacggtatgcccaacttcatgggtggtgaaaaagagttccatatctaa

SEQ ID NO: 14048 - DNA, 1986 bp, A.fumigatus
gttcgcattgctgctatggaagccttcgcctcgttcttccggtctatctccaagaagtctcaacccaagtttttcggactggtacccgacatgctcaacattctgccccctttgaaggagtcctccgagagcgaggagctgtcttccgccttcttggctctcattgagcttgcggaagtttgcccgaagatgttcaaagctatgttcaacaacctggtcaagttcagtattagtgtgattgccgacaaggacctcagtgatcaggttcgccagaatgccttggagttgatggctacatttgcagattacgccccctcgatgtgcaagaaggaccccgagtttgctcaggaaatggtcacccaatgtttgagcttgatgactgatatcggagttgacgacgacgatgcttcggaatggaatgcgtccgaggacctggacttggaggagagcgaccttaaccatgttgctggagaacagtgcatggaccgtttggccaacaagctcggcggtcaggttatccttccggcaacctttgcctggatcccccgcatgatgtcgtcctctgcttggcgcgatcgtcacgcagcattgatggccatctccgccatttctgagggttgccgtgacttgatggtcggtgagctcgatcaagtgctggcccttgttgtcccggctctccaggaccctcacccgcgtgtccgttacgcgggctgcaacgccctcggccagatgagcaccgatttcgcgggaacgatgcaggagaagtaccacagcgttgtgttgaacaacatcatccctgttctggataatgctgagccacgagttcaggcccacgcggccgccgctctggtcaatttctgcgaagaagcagagaagaaggtactcgagccgtaccttgctgatcttctgcgacaccttctgcagcttctgcgcagcgagaaacgttacgtgcaggaacaagcgctgtccaccattgccaccattgccgactcggcggagaacgcctttgatcaattctacgagaccttgatgccattgctcttcaacgtcctgaaggaggagcaatccaaggagtaccgtctactgcgtgccaaggctatggagtgcgccactttgattgctctggccgtgggcaaggagaagatgggacaggatgcgttgaaccttgtgcagctgctcggcaacatccaacagaacattgtcgatgcggacgacccgcagtcgcagtacttgctccactgctggggccgtatgtgccgcgttctcggtcaggatttcgtcccttacctgccagccgtcatgcctcctcttctgtccgttgcggctgccaaggccgacatccacctgttggatgatgaggaccagatcgaccaagttgaacaggatgagggctgggagttggtgcccctgaagggcaagatcattggtatcaagaccagcgcgttggaagacaagaacaccgccattgagctgattaccatctacgctcagatcctggaggctgcttttgagccctttgtgctggagacgatggagaagattgcggtgcctggacttgcgttcttcttccacgaccctgtgcgggtttcatccgccaagctcatccctcagctgctgaactcgtacaagaaggcacacggtgtgcagtctcccggattcgctgccatgtggaacagggtagctgagaagatcatcgaggttctgagcgccgagcccaccgtggacactctggcggagatgtaccaatgcttctacgaatccgtcgaagtggttggcaagaactgcctcagtccgcagcacatggaagcgtttatcgagtctgccaagtccacactggaggattaccaggttcgtgtgaaagctcgtcttgaggagcgcgccgatgccgaagagggtgacgaagaggacctcgactacgagtacgcggttgaggatgaccagaacctgctgagcgacatgaacaaggccttccacaccattttctag

SEQ ID NO: 14049 - DNA, 294 bp, A.fumigatus
aaccagggcacgactttcctgccttcatggcaacgcttgctgccattctatgacgcattcatcaccagccaggaccccacgcaacggcgatgggctctgtgcatcatggacgatgtgctcgagttctgcggccccgagtcatggaattaccaggatcacatcatgcagcccctggccgcatgtttgcgcgatgagaatgccgctaaccggcaggccgcggtttacggagtgggtgtagccgctcacaaaggtggccttgccctgaagcgacttcgtcgctgccagcatccctaa

SEQ ID NO: 14050 - DNA, 336 bp, A.fumigatus
aaaactatgtccatggtattctttctatttcgcacaatgccggtcgaaaggttctcattcattccagacattttcgtcgataacgtacacatggagttgtcgctgtgggatacagccggtcaagaagaattcgatcgattacgagcactgtcctacgaggatacacatgttattatgctatgtttcagcgtgaggctcctgcgccatctggagggacgaagattggagacacggcctgaccatgtccttctcttgtgcaggtcgatagccctgactcgttcgaaaatgtggcgacgaaatggattgatgagattcgcgagaattgccccggcgtga

SEQ ID NO: 14051 - DNA, 231 bp, A.fumigatus
gcttacaattcaatttgtgaatgggagatgttggactcgagtctcttttacggtcgactaatatacagcgctgttgggccgcaaagcatctcagatgtctcgaaaaaagcgcaaacatccatattccatgttaacactatgtataaattcctcagttcgcctcaatctgaatcgacgaagatcgagcctgggaagctcactatctctaagctccagcttccagagcactga

SEQ ID NO: 14052 - DNA, 273 bp, A.fumigatus
ccatgtccttctcttgtgcaggtcgatagccctgactcgttcgaaaatgtggcgacgaaatggattgatgagattcgcgagaattgccccggcgtgaagttagtcctcacggcactcaaatgcgatctgcgaaaagacgacgagttgaacgacaacccgaacgccatcacgttcgaacaaggattagcgaaagcaaaggaaatcggcgctgtaaaataccttggtgagagactctccccaatgatgagtcggcgatcacctattgatgcttga

SEQ ID NO: 14053 - DNA, 789 bp, A.fumigatus
cgatgtaggtcgtcggttttcggcagtcgcctggtcttgacgaagactgattactttcaggcagtcgagcactatcgagagctccttacctatgttaaatccgctgtcactcgcaactactctgaaaagtcaatcaacaacatgctcgattacatcgaaaaggcttcggacgacgacagggcatttcagtgcatggaagaattctactccctaaccctcaactcatttcagaacacgaacaacgagcgcctgtggctcaaaacaaatatcaaactggcgcgcctgtggttggagcgcaaggaatatgggcaactgagaaagaaagtgcgggagctgcatcgtgcatgccaacgagaggatggctcggatgatcccagtaaagggacatatttgcttgagttgtatgccctggagattcagatgtacgctgagacaaaaaacaacaaacggctcaaggcgctttatcagcgcgctctccgcgtgcgctcggccgtaccgcaccccaagatcatgggtatcatccgcgaatgtggaggcaaaatgcatatgagcgaggagaactgggaagaggctcagagcgactttttcgaatcattccgaaactacgacgaagcaggctcgatgcaacgaatccaagttctgaaataccttgtcctcacgacaatgctgatgaagtctgacatcaaccccttcgattcgcaagagacgaagccttacaagaacgacccgcgtatctcagccatgacagatttggtcgatgcatttcaacgggatgatatacatgtcttc

SEQ ID NO: 14054 - DNA, 267 bp, A.fumigatus
tatctagacacctatctcgactctcttctctcgaccgccgctcttttcacaatgtctgacgatgatgacttcatgcaagactctggtgacgaggagtatgccacacacatcctccatgcgacctctgccgtgctagttactgacgatgatctaggtatgattttgaatacgaagacgcagacgaagatgagtcgggggacgtcggaatcgagaacaaatactacaatgccaaacagatcaagatcgacaatccggaggaggctatag

SEQ ID NO: 14055 - DNA, 417 bp, A.fumigatus
tattgtatcttccctcaggttctcgtcagcttgtcgaatctgcaggcggccgtctctgatttgactcgcgcctatatcaaccacaccaacactgtgctcaatcctagtctctctacgctggacttgggccacgccagcaacatcactgctgcgcttttggagaatggattgctgggcgcacgctccagcagccctggcgccaagtccgaagttggcgagaagaagaagcgcaagcgcgctcctccggacccgaacgcacccaagcgtgccctgactccttacttcctgtacatgcaacataaccgccccatcattgcgcaggaattgggccccagcgcgaggcccaaggatgtctccgacgagggcactcgtcgctgggctgagatgcccgaggcgcagaaagaggtatgcctatga

SEQ ID NO: 14056 - DNA, 474 bp, A.fumigatus
cactatcggcaggtctggaagaagctgtatgctgataatctggccgtctacaaggaaaaggtcaaggcctacaaggccggtaagccttggactgaggatgacaacaccaaggcggccagccagctccagcaggacattgctggcgcatcggcctcgggtggcgaaaagtccgacgagcaggagcaggaggaagaagcggatgaggacgaggagacggaagagtcctctccggagccggtaaaggagcccactccgccccggaacaacaagcgccgccgcagcgaggtgaagaccccctccaagaggaatgaatcccccgagaagaagaagcgcacgtcggcgcgcaagggcaatgaaaaggacaaggatgatgagccacccgcttcgactcgcaaggctgctgctgccggcgccgacgccagcgccaagcgctccaagaagaagcgcaagagcgaggtgggcggggatgagtga

SEQ ID NO: 14057 - DNA, 756 bp, A.fumigatus
ttcccaaggaggtacgtgacagggacctgctaccgacgacatacatccacatccgcagtaaagtcagcactaaccattttgcacccgcagctggacaagctcgtcatctcgcaattgggatttctcgcccagcgtcgtcttgcgcgcggtgtgcggctcaatcatgcagaggcagcggtatggatttccctcttttctcattgcgcgatccacttaggaggcttatcgaggctaattcccgtccaggctctcatctcgtcgaatctgcaagaggtatcttccccacatccgagctggaagctggatatcatggttgcttactcgcagcagctgattcgcgatggccactactcggtggccgatctcatgtccatcggcaaaactatgctcggccgtcgccatgttcttccctccgtcgtacatactctcgtcgagctccaagtcgaaggaacgttccccaccggcacatacctcgtgaccgtccaccatcccatcagcagcgatgacggcgacctagagaaagcgttgtacggcagcttcctccccattccaccggcggatacgttcccagatccgaacccggacgactacctcccggagaagatgccaggtgctgtcctgccagtgaagaacgaacggattactctgaacgatggccgcaagcgcatccgactgaaggtgatgagcaagggcgatcgcccaatccaggttcgttcgttgcctttccacacacatacgcgcaacaagggtttttga

SEQ ID NO: 14058 - DNA, 1116 bp, A.fumigatus
  unsure (1110): Identity of nucleotide sequences at the above locations are unknown.
gtcggatcccactatcacttcatcgagaccaaccctcagcttcattttgaccgtctgcgggcctacggataccggctcgatatccccgcggggacttcggtacgattcgaacccggtgacaccaagacggtcacgctggtcgagattgcaggcaatcgcattatcaagggcggcaactccattgcttcgggcaaggttgatatcagtcgagccgaggagatcctgcagcgcttgcaggtcgagggtttcgctcacgttcctgaacccgcgccgaccgcggacagtgcgctgatcgcgcctttcacaatggatcgcgaagcttatgcgcggatgtttggacccaccaccggggacctggtccgattggggttgaccaacctttgggtgcgggtggaaaaggactgtacggtttatggagatgagtgcgcgttcggcggcggcaagacccttcgcgagggcatgggccagtcctcggagaggtccgcaaccgaatgtctggacaccgtcattacgaatgcgctgatcatcgactggagcggaatctacaaggctgacatcggtatcaagaatgggctgatctcggctatcggcaaggctggcaatcccgatatgatggacggcgtgcatccggacatgatcgtgggctcgtcgaccgatgtcattgctggagaaaacaagatcgtgacggccggtggatttgatacccacattcactttatctgccctcagcaggtggacgaagcgcttgcttctggcatcaccacatttttgggcggagggaccggtccgtcgacgggcacgaacgcgacgacctgcacgccgggacccacgctcatgcgccagatgattcaggcgtgcgacggtctcccgatcaacgtggggatcaccggcaagggtaatgacagcggtggcaagagtattgaggagcagattcgtgccggagcggccggcttgaagttgcacgaggactgggggtcaaccccggctgcgatcgacacctgcctggacatgtgcgacaaattcgacgttcaatgcatgatccatacggacacactgaatgaatccggcttttcttacaccgacggggctcgaaggaaacgcgtcaatgcnctctag

SEQ ID NO: 14059 - DNA, 1101 bp, A.fumigatus
cccccagtcctcgtgcaacttcaagccggccgctccggcacgaatctgctcctcaatactcttgccaccgctgtcattacccttgccggtgatccccacgttgatcgggagaccgtcgcacgcctgaatcatctggcgcatgagcgtgggtcccggcgtgcaggtcgtcgcgttcgtgcccgtcgacggaccggtccctccgcccaaaaatgtggtgatgccagaagcaagcgcttcgtccacctgctgagggcagataaagtgaatgtgggtatcaaatccaccggccgtcacgatcttgttttctccagcaatgacatcggtcgacgagcccacgatcatgtccggatgcacgccgtccatcatatcgggattgccagccttgccgatagccgagatcagcccattcttgataccgatgtcagccttgtagattccgctccagtcgatgatcagcgcattcgtaatgacggtgtccagacattcggttgcggacctctccgaggactggcccatgccctcgcgaagggtcttgccgccgccgaacgcgcactcatctccataaaccgtacagtccttttccacccgcacccaaaggttggtcaaccccaatcggaccaggtccccggtggtgggtccaaacatccgcgcataagcttcgcgatccattgtgaaaggcgcgatcagcgcactgtccgcggtcggcgcgggttcaggaacgtgagcgaaaccctcgacctgcaagcgctgcaggatctcctcggctcgactgatatcaaccttgcccgaagcaatggagttgccgcccttgataatgcgattgcctgcaatctcgaccagcgtgaccgtcttggtgtcaccgggttcgaatcgtaccgaagtccccgcggggatatcgagccggtatccgtaggcccgcagacggtcaaaatgaagctgagggttggtctcgatgaagtgatagtgggatccgacctattcgcagtcaaaaacccttgttgcgcgtatgtgtgtggaaaggcaacgaacgaacctggattgggcgatcgcccttgctcatcaccttcagtcggatgcgcttgcggccatcgttcagagtaa

SEQ ID NO: 14060 - DNA, 582 bp, A.fumigatus
tgcttcttgccgtctttttcattcaggcagcgttcaacgcatggcaggactggtcgtcctcccgagtcatggcatctattacgggccatgctgccagaaagctgtctggtcatgcgtggtggtcactcccgtcgatatctccggatattgtgccgggtgatgttgtgcatctcaaggcgggcaataaactcccagcagatgtccgctttgtcgaggtctcgaatgatgcatgctttgaccgatcgatactcaccgcctagtgtcgtccggtcacatgtgtctcaggcgtgttgcttacgaacggcaggcgaatcgcttcctatcaacgggacggtggacccaacagatgaaaactacctcgagactcacaacgtcggacttcaaggcacgcattgcgtctcgggaagtgttacgggcattgtcgtgtccaccggagacgcaacggtgtttggtcgaatcgcaaaactcacgagtgagccgaagacgggcttgacaaccctggagaaggaagtcttacggtttgtcgctcttatcgtgttgattatgctgaccatgattatcgtcattattattgtctggtaa

SEQ ID NO: 14061 - DNA, 312 bp, A.fumigatus
catgtcaatagggctacctggctgcgacgcgatcacccgggctggatcaacgttccaacgctgatagtggaatgcgtcagcgttgccattgcctttatccctgaaggcttgccgattgctctgactgccaacttgaccatcactgccaacctgatgagcaagaataagattctgtgcaagtcgctcaagacagtggagacccttggctcggtgtcagtgatctgttccgacaaaaccggtactttgaccaaggtaattatgcatgctaaccgatcgaatactccgatcctggccccaagaatcctccgctga

SEQ ID NO: 14062 - DNA, 273 bp, A.fumigatus
acagcagagtcgactgtagtgggggctcaaccagagaaatctatctggttggtagttaaagcctcaagcatggacgactcgatcaataacgtcgtctctttccaacagaaagaaaacaaggttgcagataaggtcccgtcgcagctcaatcattgggtggaatttttctttgaacttcgcgaagagggatttattgacgtctcaggaagcttgaactggtatctcagccaccaccgacacagctgttggctaaagagctatggctatcgttaa

SEQ ID NO: 14063 - DNA, 549 bp, A.fumigatus
atctcagatctttcccatctcgactggcataccatcgccgtcgaagaactccagaaacgatggcaggtagacatctcgcagggtctctccccgaatcaggtccaggaacggctccatcaatacggcaaaaatgcgctctcccctttgccgcaccaatggttctggcagatattcggctacttcttcaagggattcggtgcaattctcctggttggatgtattctagtctttatttcctggaaacccctcggtcaaccgccagctctggcaaatcttgccctagcgatagtgcttcttgccgtctttttcattcaggcagcgttcaacgcatggcaggactggtcgtcctcccgagtcatggcatctattacgggccatgctgccagaaagctgtctggtcatgcgtggtggtcactcccgtcgatatctccggatattgtgccgggtgatgttgtgcatctcaaggcgggcaataaactcccagcagatgtccgctttgtcgaggtctcgaatgatgcatgctttgaccgatcgatactcaccgcctag

SEQ ID NO: 14064 - DNA, 465 bp, A.fumigatus
ttatgcatgctaaccgatcgaatactccgatcctggccccaagaatcctccgctgactgtcagcagaacagaatgcttgtcaccgactgtgcggtttccatctccacgttcactttggacggagcgagagatgaaatggtcctaaaaggaaaagcctcggcgattcatcaacttcgtgcggttgctggtctctgcaacgccgccgagtttgacgcggccaccatgaatctgcccgttcacgggcgaaaggtcatcggtgatgctaccgaccaggcgattctacgattctccgaagaactgggccccgtcgccgagctgcgtagcatgtggaagaagacatacgatcttgccttcaacagcaagaacaagttcatggtgcgcacgttcgatctggtggacagggcaggactcggccacgccatgtcgcccgctgagtcggcccaatttggtcatgatgatacgtga

SEQ ID NO: 14065 - DNA, 234 bp, A.fumigatus
tgtgtggtcttggaacggggaagacctaattccagtagaaaaaaccgattttttgaattgttggcgctactgatggtgggagacaccggagagacggattttgccaacgtctgtctcctaagcgatcgaggatggagtatgtttatgactactctgtgcgaagtagatccaagctatatgggtatgatttacgtttctaatagatgtgagctgtttattttgctgatgacatag

SEQ ID NO: 14066 - DNA, 207 bp, A.fumigatus
gactcgagagtgaaagtgaggagtggttatcggtgtcgtaagcatatcatactaaaacagctacctgttagcaggccagacaattcagaggatcaatgggtacgttacgttactgtcatgcgccgactgcacgatctgggtggtgatgggtatggtacggttgctttcatgttgaccaacgcagaatgcgggggccaaatcttctga

SEQ ID NO: 14067 - DNA, 198 bp, A.fumigatus
caaaagccaccgctgtggcggcgacacctgcctatctgggttagactacttctcgccaaaattattattctgccgcgcgataattattcaagtaagattatgattgaattcgtccgcagaggcgatctcattcactgtcgtaactccactcatttgcagaactcagatcgctatggtcgattcacgctcagactctga

SEQ ID NO: 14068 - DNA, 978 bp, A.fumigatus
ctgtcatgttcaagggatgagtttctgcagctttaccagcagtcccagatcctagtctttgtcggtgagactggctccggaaagactacacagatccctcagttcgtcttgtacgatgatttaccgcaaacccagcgcaagatggtcgcttgtactcaacctcgtcgagttgctgccatgtccgttgcgcagcgtgtggctgctgaattggatgttaagcttggagaggaagttggttacagtatccgtttcgaggacatgacaagttccaagacctgcttgaaatatatgacggatggtatgcttctgagagaagctatgcatgatcatgaccttacacgctacagcacaatcattcttgacgaagctcacgaaagaaccatggctaccgatgtgcttatgggtcttctcaaagaagttgtgcagcgtcggcccgatttgaagattatcatcatgtccgccaccttggatgcacaaaagttccagcgatatttcaacgacgctcctctacttgccgttcccggtcgtactcatcccgtcgagatgttgtatactcccgaaccggaacaagatgatgtagaagcagccattcgcacgatccttcaaatccacgccacagagccagagggtgatatcattgtgatcatgactggagaggaagaaatcgaagaagctgcgcgcaagatatcgcttgaggaggacgagatggagagagaagccgacgctggtcccttgaaagtctatccgcttaacggcagtctgcctccgcacatgcagcagcgtatattggagcccgctcatccccatcgcaggccaggcggtcgtcctggccgtaaggtgattgtttcaacaaacatcgcagaaacgtctcttaccatcgacggaatcgtgtacgtggtggatccgggattctcgaaacagaagatgtacaacccccgaattcgggtcgagtcacttgtggtgtctcccagtcttcac

SEQ ID NO: 14069 - DNA, 381 bp, A.fumigatus
ttgaattcgtccgcagaggcgatctcattcactgtcgtaactccactcatttgcagaactcagatcgctatggtcgattcacgctcagactctgaagatcgctcgcgtgctaagcgccagaagatggacaagtcagagacggatcccaggaacaatccttacctggctcatatgtatgcggatgcgtctaccaacggcaactctagctcgtcagggacgaatcctgctttcgcgaagttgaagagacatcagacgacagcggcacttgcaaaggaagtagaggatggggagattaatcctcttaccggccgacctttctccagcaagtacttctctatcttgcagactcgtcgtgatcttccagtgcaccaacagaggtaa

SEQ ID NO: 14070 - DNA, 201 bp, A.fumigatus
  unsure (130): Identity of nucleotide sequences at the above locations are unknown.
ccgacagcactatccttaccaaaacaacttcctcccatgtccgtccagtctcgctggcattccgagccggttcacctgcttaccatggatgccaatacttttattaagaaccagaagggctaccctgtcntatcaaaagcacaccaggcattgatttccaagttcatgcgtcttcggacgcccccgtggattctcctatga

SEQ ID NO: 14071 - DNA, 1218 bp, A.fumigatus
gacgttggcccgattccgggagtagaggcaagtgagacgtctgaggcgacgcagtcgaacttgtccagctctgaatatccaagtctttcgcaagccgcggtctcgagcaagaagttcattgatccgacacctcatttgtcatatatcagaaatctccagcaacgccaaccacctcgctctgcgatcgagagatttggcatgggctatcaagactacctccaggcgccacttcagcccttgacggtcaacctggagagcatcacgtatgaagtttttgagaaggaccctatcaagtatgagtggtatgagagagccatcgcgaaagccctcagcgactgggccgagcagaagaagcctacctctaacccggatggtcgggtagtactcgctgttgtgggcgccggcagagggccgttggtaacacgagcgatccgagcaagcgctgaaaccggcgtcgatatcgacctttgggtcgtagagaataatcccaacgcgtttgtcctccttcaacgccacaatgaggaactctggggcggcaaggcaactctcgtccagtcggatatgcggagctggaaaggtccccaaagggcgaaagattccggcttacccccggccgcagttggacactcgctcggtattgaggattcgcttctctataaaccagaaccagatcaaaaaggcaacacgcccgctcctgagtcagtgaagagcatggcatcgtccgacctgtcttctggtatgatcgatattgtggtctcagagcttctcggatccttcggggacaatgaactgtcgccggaatgtctggacggtatcactcatttactcaaccctgtgcacggcatctccatcccggcctcatacacggcccacctcacaccgatttcggcccctaagctgcatgcggaggttgtgaacctatctatatcgaatccagcggcctcggagacaccgtacgttgtcatgctacatgccatcgacttcttgtccacgaatcagtcgtctgccggtacgacgtcgggcgacagcggcaacagctacatcagtcaaactcgatcctctatatcgaccatcccagtgcctgagtctacaaccccttatgtgcagaccgcatggtccttctcgcatcccaacagagatattcctccccagtcgccgtatacttccatcatctctaactcacatctgcccgacggggcatggaagatcacgcgatgc

SEQ ID NO: 14072 - DNA, 681 bp, A.fumigatus
tatgatatgcttacgacaccgataaccactcctcactttcactctcgagtcctaagtctgctctctggtcacttgtctaagttgcgggcagtatcgtccgatcccaatggtactctggcaacaactgagaatacgagacctgtgatcatccctccacttggcccatcagacactcatctcaccccgaaccaaacgatgagccagttgatgggcgtcactagcccttggattgacctttgttcccccgatccattgattgcagatatctcccgtcaagttcttatgttagaagtggcatatgcagctttctgcggcattggctatgtcctaatcccgggaccgaagctccaccatggaaatctgcactcagaaggcttggttttctacgcgagagcagttcaagatgccattaacttgggtccatatattcagtttcatatctggctgagaattgtggacaacccagatttggaagtggatagtatgggcgacctcgctcctcttgcccgtgatgagttcctctggggttccgatgatgggcagtcgctcaaggtggacctgtttggaacgtgggatgcttgggacgtaattagaagaacctgtaaatatcacacgagactcttcgtaggtaagaatttatttcccgtttctgcagcccttgatgcgttcttacatctgtga

SEQ ID NO: 14073 - DNA, 369 bp, A.fumigatus
aactcgagtatagtcgtatataaagactggggagtggccgatgtgctttgctgtgacgaagcaaccaaggcgcaaatgaagtatttcaaaatcctcctcgggcttctgcccacagcgctggccgactctatctatgtctctcccacaggatccagcagtggctcagggagcatcacctcccctctgaactccattcaatccgctgtcgacctcgcaaagccaggcgataccatctaccttcgcgggggaacgtactcgcccaccagcaacatccagatcaccaagagcggaacatcgagcaagccatacatcctgcgcgcctacgagggcgagaaggtcattatcgatggagaagctctgccagggtag

SEQ ID NO: 14074 - DNA, 216 bp, A.fumigatus
ggaaatgaaaatagaacaccagcacccctcgacgcctctctccccaacgaagatcgcggtatcctccacatccaaaacgctaattattggcagttctacgacctcgagctgatccacggcccgtacggcgtgtatgcgcgcgatgcatccaacaatcactacgagcggcttatcaccagggataactacgagactggtattggccactgcctgtag

SEQ ID NO: 14075 - DNA, 468 bp, A.fumigatus
ctttgtagatggggtttctcccccttcgaaggcgacggcaacgggttcaaactcggcggcggagacgcagcggataagggccctgcgaaccatgttattaccaactgcattgcctttggcaacgtcaaggacggcttcacggataactcgcagccgggcgatttcacgctccgccgcaacacggcgtggaataatgccaaggtgggcttcaagttcaacacagctgtagctacgctcaatgggaatgttgccgcggttaatggggagagcgcgacagccttgagttcgaatcagatttcctccgggaattcctgggatggaagtgcgtcgtggtcgaatagtagcttcaaaagtgtggatgtgagtctagtgcagggtgctagacaggcagatgggaggatcaaggccagtgatttcttgctgccaaagtccggggaggcgatgggagcgaccactgtttgggagtaa

SEQ ID NO: 14076 - DNA, 330 bp, A.fumigatus
  unsure (37),(61),(70),(72),(81),(149): Identity of nucleotide sequences at the above locations are unknown.
attttcgctattggcttcgccagacataaaacgggtnttctatcggaagttgcccaatgcngtagtcaangnggggtcttncatctcgtccacacccggattgcgcatcatgtccagcagccgtttatcaaaaattccttcgaatattntgacttgccgctggaaaagaaactcgagatcgaaatgttcaacagcaagcatttcttgggctattcccgcctcggtgcggagacgactgcctccaaaaccgactaccgggagcagttcgatgtaagttcccacctactacaatcaccaagacatgcacttagtagactaacggtaggatag

SEQ ID NO: 14077 - DNA, 789 bp, A.fumigatus
tttgctacggaacttccggctccgggaccggatgagcccgtctacagaaacattcggggaccaaaccaatggccggctgaagcctccatcccgggcttccggaaagccatcgaagcctacctggctgaaatcagtcccctggccgaggccttcaagtccctcatcgcagaagcgctggatctcccctcaaacgctctctaccccttcttcgaccaccctccccagcacaaactcaaactcatcaaatatcccccacccagaagcgcatcccaggcgcaaggcgtcggcgcgcacaaggactcggagtttctgaccttcctcctgcaggcgacccctcactcggggcttgaagtgcagaacaagtccggggattggattccagcaccgccgctggacggctcgctggtggtgaatattggacgggccctcgaggcagtcacggggggagtgtgcacggccactacgcatcgagtcaatctacgaccggagaattttatagatgcagaaggaaagccactggggcctcggttctcctttccggtttttcaggggatgagtctcgagctgtgtgcggacgatatccacttggatatcccggcgcatattagggagctagtcaaggatgagcaggttcggtcggatgcggaggctacatttaacaaaacgtttcagggaaagacaggtgagggaacgctgatccatcggatcacgagtcatcaggatgtgggacggcggtggtatccggagttattggactgggcgctgaaagagaggcaaggtagccattga

SEQ ID NO: 14078 - DNA, 579 bp, A.fumigatus
ctacgagactggtattggccactgcctgtagatttgcagcaaacattgctgaccagggacctaggcttccaactgcagggcgcatcctcgaataataaagtcctctatctcgactcctacggcaacagagacccccgcaagaacggcgagagcgccgacgggttcgcctgcaaggagggctcgggagagggcaatctcctcaagggcgcgaggctgtggaataatgtcgatgacgggctggatctgtgggagttcaagtctgcggtgacgatcgaggatactatctcctgggggaatggatataatcggtacgctgccacttgttctctggttaagggtaacgcagctgactttgtagatggggtttctcccccttcgaaggcgacggcaacgggttcaaactcggcggcggagacgcagcggataagggccctgcgaaccatgttattaccaactgcattgcctttggcaacgtcaaggacggcttcacggataactcgcagccgggcgatttcacgctccgccgcaacacggcgtggaataatgccaaggtgggcttcaagttcaacacagctgtag

SEQ ID NO: 14079 - DNA, 189 bp, A.fumigatus
  unsure (32): Identity of nucleotide sequences at the above locations are unknown.
ataggtgtctgctcacgtgatcagactttcanattcgccgagaacccaggctccttcccattctctgggccgctctccttcactttctcttcccgcatcatcatcatcatcatcatcatcatcatcatcatcatcatcttcccctttatctccttcacccagcgcgggacggagcgaaaagaaggatga

SEQ ID NO: 14080 - DNA, 2964 bp, A.fumigatus
cgcattgtgcaagcgttggcccttttgcgaattgcgcagcacatcaagcccgaccttggtctggatattccagcccgagctgaaggggatgggccggggcacgtcggcataccggcagtaccagtcgagaaggaaattggtcgcttcccagtcccgggccagttccaggaccagctggtctgtggtcggcttggagaaaaagccgcgggacacttcggccatcacgtcccgatacagcgcttctcgcgacagcttcagcacggcgggatcgctccggccaccgaagcacttctcgtcgttgttgccgtacttggacacataccatttgcggatctcggtgtcgtcggtgcgtcggatgttctggtaccaggtaacccatttggaggcgacggaccgcaggctgagcagcagcagtccgatgaagatgtagagcacaatgaggtagatgaccacatcgtgatggctccagttggtcacgatcggcgagatgaacaggacggggatgcaggcgaagatggccttgcggcccgagaggaacttggagcccgggtagctgaaacaggcgagcgaggcgaagatgctgaagtagagggtcagggcaatcaggtagaggtagaagacgatgccgggcccggggcctttgacggccgacatgacgatgaatcccaccagccccacggcgatcgtgaaggcgaaacaggcgatgagtcggataaagacaaacatgttggtggcggcaaacgccatggagatcaggtagtaggacccgccgcaggcgatccaggtgcccgccgcacccgacaggagcagagagatcatcagcgcgatggacgcactgtgcatgacctcctcgggcatgtggccggagaggtacaagccgcggccatacagcgtcagcagcagaatgtcgatcagggcgggcaccgcaaagacactgaggaaggtgaagcgctggtacccccgcatgggcttgaccttgtcgtccgggttgacatcgatctgtgccccggcatacgaggtcgccatctgcggagcgccgttgatccagtccggcagttcccggtcctggtagtatcgtctgaatcgacccgagagcaacttcccgaaggcgctgggcgagaggtcgaagtaggcttcgcagcgcgacccaagcgcaaacgactcggcgaaggcggccgcttgatcggactggtcgttgaacagggggttgcgatccgtgacttccatgtagatctcgtcaaaggcgcctttgcgggcggcgcagaagagggagagcgtgaggatatcggcatagacgtcgatccggtctttctggaccagctggcacagggcgttggtgatctgagccagatcgctctcgcggcgttctcggaggatgcgcgtgaagacagcgtccgtttcctggaacagggccaggcacgcggcaggggcaggagaacggcacccctgatcgcggtaccagtggatgcgggacttgatcagggcctctggcgggagggatccgtcgaggtacgcgacggtgttgagctccttgagctgcgccagggacggggcatcgatgagctgccggcggatgtaccggcagatcgtctcggacagttcactcttggcgtccgtcaacgaaagatgctgcagcaggagcaatcgctcctcgggactcagggcgtccacatcttggatgagccggcggggcagtccgatgtcttcgttcacgtccttggaccattgcgccagagccgtctcggcttcgaagcagacatgacgggggaaacctcgcgcggagaggaacgtgtgcagcacggtgcccgcgaggccttgcgcgcttttcgaggcaaacacttcgaatccgtccgcgtcggactggtagacggcccagaagcggacgtcggcgctcttgcgcagaccggagtcgaggcccagattgatgcgcagggaatcctgggaggcaaaattggcgaggtccttgatcgtcgccggcagcgtgggcaagtcgggccagtgcgacacggcgaatttatcgtggaatcgtcgcaggagggcgcccagcttctggattttgtccgagggaaccgggtgcagcagtcccagagacttcagccgctgttgggacttgaggatctcgacaaaggccacggcggtggcttcggatcccagggggaaacagccgaactccttgtattccacgccggccatggagatggacagcgggctgccctgcgacctgacctgggccacccattccggcggatcacgaaccgcgatcgtcgcgctgtccatgtgcgaggggggctctctttcggacgaggtgagcacgttggaaagcgtgggaaagtactgcagcagagcggtccatgcgtctctgggcccgacctcctcctcctggaggttcagattggcgcgccagatgtcgtggactttcatgatctcggcttccttcagccaactaaaggccgacaagggctcgggaatcttgacgttgagagaggcatcgtgcaaggccgcctggcggccgatccaggtgatggcgctgtagaagttgcaccactgcagagatcgctggatgaccgcattggacaggtgagcgttgtcgtcgaccgtctcccaggccatgaccacgaagtcgcgcatgcaggcttccgacacgaacgctttgatggtgggctgcatcttgatcatctgaaagtagtcgcgtttctcgccgtcaggcatgatggaggcattgcggatgacgagaccggcgatggcatcggtctgcagagtcttatggtcctggaggaagtccgggggcgctgtctccagatacacgggcaggccaaaggcatggagagcctcggccagtatcctgatggcgggcgggttgaagctgctctcccagttggccaggagcatgccgctgaacggcgcgccatcgaacctgctgagtgcgctctcgattcggtcgatagccgccagagtcgaccctga

SEQ ID NO: 14081 - DNA, 3393 bp, A.fumigatus
gtcctcatcggcttgctgctaggtagcgtagtgattggatgttcatacctcctctacgcaggtctgtcgagagctcgcaaatggtaccaggtaggtatccggtcgatgtcctcggtcgatgccctcgaggagattgctgacattttacagtcgcgggcccaatccgcagtggtgcccagaaatgtcttggataggctggaccgactatcaaggcagcagctgtccttgcccaatgtccagtgggccaagaagccgtcgtcgttcggcgtctacttgggctctttcgacgcatccccaaccagggatcagtcgagactcctgagtcaatgggatctgctgatcgttgaccccgcgcagtctggtgtggtcgaggccctctcgcgggccgagaggaagcagtttctgggccgagtagacgtcggttcgggctcagggtcgactctggcggctatcgaccgaatcgagagcgcactcagcaggttcgatggcgcgccgttcagcggcatgctcctggccaactgggagagcagcttcaacccgcccgccatcaggatactggccgaggctctccatgcctttggcctgcccgtgtatctggagacagcgcccccggacttcctccaggaccataagactctgcagaccgatgccatcgccggtctcgtcatccgcaatgcctccatcatgcctgacggcgagaaacgcgactactttcagatgatcaagatgcagcccaccatcaaagcgttcgtgtcggaagcctgcatgcgcgacttcgtggtcatggcctgggagacggtcgacgacaacgctcacctgtccaatgcggtcatccagcgatctctgcagtggtgcaacttctacagcgccatcacctggatcggccgccaggcggccttgcacgatgcctctctcaacgtcaagattcccgagcccttgtcggcctttagttggctgaaggaagccgagatcatgaaagtccacgacatctggcgcgccaatctgaacctccaggaggaggaggtcgggcccagagacgcatggaccgctctgctgcagtactttcccacgctttccaacgtgctcacctcgtccgaaagagagcccccctcgcacatggacagcgcgacgatcgcggttcgtgatccgccggaatgggtggcccaggtcaggtcgcagggcagcccgctgtccatctccatggccggcgtggaatacaaggagttcggctgtttccccctgggatccgaagccaccgccgtggcctttgtcgagatcctcaagtcccaacagcggctgaagtctctgggactgctgcacccggttccctcggacaaaatccagaagctgggcgccctcctgcgacgattccacgataaattcgccgtgtcgcactggcccgacttgcccacgctgccggcgacgatcaaggacctcgccaattttgcctcccaggattccctgcgcatcaatctgggcctcgactccggtctgcgcaagagcgccgacgtccgcttctgggccgtctaccagtccgacgcggacggattcgaagtgtttgcctcgaaaagcgcgcaaggcctcgcgggcaccgtgctgcacacgttcctctccgcgcgaggtttcccccgtcatgtctgcttcgaagccgagacggctctggcgcaatggtccaaggacgtgaacgaagacatcggactgccccgccggctcatccaagatgtggacgccctgagtcccgaggagcgattgctcctgctgcagcatctttcgttgacggacgccaagagtgaactgtccgagacgatctgccggtacatccgccggcagctcatcgatgccccgtccctggcgcagctcaaggagctcaacaccgtcgcgtacctcgacggatccctcccgccagaggccctgatcaagtcccgcatccactggtaccgcgatcaggggtgccgttctcctgcccctgccgcgtgcctggccctgttccaggaaacggacgctgtcttcacgcgcatcctccgagaacgccgcgagagcgatctggctcagatcaccaacgccctgtgccagctggtccagaaagaccggatcgacgtctatgccgatatcctcacgctctccctcttctgcgccgcccgcaaaggcgcctttgacgagatctacatggaagtcacggatcgcaaccccctgttcaacgaccagtccgatcaagcggccgccttcgccgagtcgtttgcgcttgggtcgcgctgcgaagcctacttcgacctctcgcccagcgccttcgggaagttgctctcgggtcgattcagacgatactaccaggaccgggaactgccggactggatcaacggcgctccgcagatggcgacctcgtatgccggggcacagatcgatgtcaacccggacgacaaggtcaagcccatgcgggggtaccagcgcttcaccttcctcagtgtctttgcggtgcccgccctgatcgacattctgctgctgacgctgtatggccgcggcttgtacctctccggccacatgcccgaggaggtcatgcacagtgcgtccatcgcgctgatgatctctctgctcctgtcgggtgcggcgggcacctggatcgcctgcggcgggtcctactacctgatctccatggcgtttgccgccaccaacatgtttgtctttatccgactcatcgcctgtttcgccttcacgatcgccgtggggctggtgggattcatcgtcatgtcggccgtcaaaggccccgggcccggcatcgtcttctacctctacctgattgccctgaccctctacttcagcatcttcgcctcgctcgcctgtttcagctacccgggctccaagttcctctcgggccgcaaggccatcttcgcctgcatccccgtcctgttcatctcgccgatcgtgaccaactggagccatcacgatgtggtcatctacctcattgtgctctacatcttcatcggactgctgctgctcagcctgcggtccgtcgcctccaaatgggttacctggtaccagaacatccgacgcaccgacgacaccgagatccgcaaatggtatgtgtccaagtacggcaacaacgacgagaagtgcttcggtggccggagcgatcccgccgtgctgaagctgtcgcgagaagcgctgtatcgggacgtgatggccgaagtgtcccgcggctttttctccaagccgaccacagaccagctggtcctggaactggcccgggactgggaagcgaccaatttccttctcgactggtactgccggtatgccgacgtgccccggcccatccccttcagctcgggctggaatatccagaccaaggtcgggcttgatgtgctgcgcaattcgcaaaagggccaacgcttgcacaatgcg

SEQ ID NO: 14082 - DNA, 567 bp, A.fumigatus
tcaagtcccgcatccactggtaccgcgatcaggggtgccgttctcctgcccctgccgcgtgcctggccctgttccaggaaacggacgctgtcttcacgcgcatcctccgagaacgccgcgagagcgatctggctcagatcaccaacgccctgtgccagctggtccagaaagaccggatcgacgtctatgccgatatcctcacgctctccctcttctgcgccgcccgcaaaggcgcctttgacgagatctacatggaagtcacggatcgcaaccccctgttcaacgaccagtccgatcaagcggccgccttcgccgagtcgtttgcgcttgggtcgcgctgcgaagcctacttcgacctctcgcccagcgccttcgggaagttgctctcgggtcgattcagacgatactaccaggaccgggaactgccggactggatcaacggcgctccgcagatggcgacctcgtatgccggggcacagatcgatgtcaacccggacgacaaggtcaagcccatgcgggggtaccagcgcttcaccttcctcagtgtctttgcggtgcccgccctga

SEQ ID NO: 14083 - DNA, 3468 bp, A.fumigatus
cccctgttgaagacgcctagtgctgtgatcaggcgttgggtccaggctgggggaccaggagacgagatacgatccttcgacgtgctcacgtccctaaatccgttccaactgtcacgaaaagaaagagaggaactgtaccaggtatggacgaaagacgtcactaatctggtgtatgataaagtcatgaagctctgctcaacacaccatatggctaaagccaatctcgacaatgttcgagacgaagtggatcttcgctgtctggcagatgcggatgtcatcggagtcaccacgtctggtctggctcgaaatttgaacatgctgcgaaagctacaatccaaagtcgtgatgtgtgaagaagctggtgaggttctggaagcacaccttctcactgctctgttgccctcggtcgaacacgccatccttattggtgatcacctacaactccgtccacaggttcagaattacgagctctcacgcgagaatcctagaggtggcgaaaagtattccctggacgtttcgttgtttgagcgactggtggaatcgcagagtgccatgggtctgggtcttccgttcagtacactcgaaacgcaacgcaggatgcacccttccatagcccaactagttcgggataccctatatcctcagataaaagatgcagaatcagtgtcaagctatcctgaagttgtgggtatgcgtcggagactgttctggctggaccatcgcgagcaagaagcggacgcagccaatacaggtccgcttgcgagctcgcactggaacgagtacgaaattcagatgacaatggctgtggtcaaccatctcgtgcgacagggcagataccatagcggcgatattgctgtcattactccatacctcggtcaactccatcgactacgccagctgttctcacaacacttcgctgtcacacttggagaacgagatgccgatcagctagatagtgctggctttggagctggtgaaactgatgtcacgcctgccgcgagagctactctactgaagactttgagggtagcgaccatagacaatttccaaggcgaagaggccaaagtcgttgttatatcgctggtgcggagtaactctcagaatcgctgcgggttcttgcgtacatccaacagaataaacgtcctcctgtcacgggcgcagcatggaatgtacattattggcaattccgagacttgcgctcacgtccccatgtgggcgcaggtcattgacatccttcggcattcgggcaatataggatcacaactggagttgcagtgtccccgtcaccctgacacgccactcctggtctctacgccgcatcaatttttgcagctatccccagaggggggctgtaatctacgctgcatcaaccgtcttccctgtggccatgcttgtgagcaaaagtgccattcggaactgcttcacaacgccgcgtattgcccacagccgtgccctcgtccgcgcaaaggatgtactcatccgtgtgtcaagcggtgcggtgatccttgtcctgtcaggtgtatggtggacgtgtataaggaggataggaagcttgaatgcggccattcgatgccgaatttgccctgctggcaagatcaggacttgtctactgtccgctgcaaggtggctgtcaccaagacggtcgaacgttgcaagcacgaaattgcggtgaaatgccatcaagatgtgagcttggctacgtttaagtgtaccgcgcagtgtaatgccctcttggcttgtggacacgcatgcaagcggccatgccaccattgtgtacagcttcttgatagggaggaagtccgcatcgaccatggaagatgccagcaaaagtgcggccgcaagcactcgacttgcgcccacttctgcagtgcggtttgccatggcgatgagccttgtcccccgtgtggagaaccatgtgacgtgcagtgtggccactccaaatgtaccaagaaatgtggggaaccatgcaccccatgtgccgaagagcgatgcttctccagatgtccacacagcgcgtgcacaatgccttgtgcggccccgtgcaaccacattccgtgctccaaacggtgcgaccagaagttgcagtgtggtcatcagtgtccgtcgctatgtggcgagagatgtccttctgacaagtactgccaaacgtgtgcaagcgaagaaatcaaacaccaggttgtggactttatcctgggtgagacttacgagaacatcaacctggatgagaacccgtgcatcttcccccggtgtggccatttcttgacgatggaaagcatggacgggcaaatggcactgcaagagcactacgaactcgacgaacaaggaagacctatgtcgattaaggatgcgacgcgtccgttctccatgaatgatatcaagacgtgcgccacctgtcgtgggtcactgagagatctcgccagatacggtcgactcgtgcgacgagcgctactggacgaatccaccaagaagttcatcctttatttgaaccgggaatacgttcctctagaggaggagctcgcccggcaggtgaaagttatgcaggaaacagaggttgcaaatcgaaaaggaccggtctggcccgaccatctgccgctcgagggctcaatccagcagaacatcaggacaatgacagaattagtccaccacacgtcccctggccggtggaaggatataaccaagcttcgcagcaaggtcgttgcctaccgcaaacgagtcgccctggacgaacagccctacgaccgagtccgtagcatggtcgagaatgccaaacgaaggaagaagaccgacggagactttgactttgacgacaccatcctccagtcaaagggcctcctcctcgctatcgcgctgaacctccgcctcgacatcgccctgctaacggatttcctgtccgtcaaggatcgtgcctcatcgcaaacaggcaagatcaccgtctccatcagcctgcaagacgcaagagacgagtgcgctacactcatcagcctcgcaggctcctccggccgcatccgccaacaagcagagggctacactttccttgcgcacctccacgccctcgaacgatcccaagccagttcaccgcaagccgcggagacacgccttcgagaagggcgagaggcggccgctcacgcgcgatccctctgcgtgcagcacccaaccccgacgagaggtcttttgcctgatatcgagacaattgatagaatgctccgcgactccacgttttacgccgtggtgacgaacgaagagcgcatggcggtgatggcggccatggcgcgcgagttccatggcacggggcattggtattattgccggaacggacacccgtttacgattggagagtgtgggggtgcgatggagcagacggcgtgtcctgagtgcggggagccggttggggggagggcgcaccgcgtagccgagggggtgacgcgggcagacgatttggagatggcgtttggaaggatgcatctgtga

SEQ ID NO: 14084 - DNA, 531 bp, A.fumigatus
ttcgtcggcatcaacgccctcatctactactcccccaccctcttcgagaccatgggcctagactacgacatgcaactcctcatgtccggtgtcctcaacgtaacccagctggtcggcgtcatgaccagtgtctggacaatggacagcctcggccgccgcgtcctcctcctctggggtgcattcttcatgaccgtctcccacgtcatcatcgccgttctcgttggcctcttctccaataactggcccgcgcaccgccctcaaggctgggtcagcgtcgccttcctcctcttctacatgctcagctttggtgcttcttggggtcctgtcccctgggctcttccttcgggtacgtctactcgtcccagtatacctactccctccagatcacaagtagaactgacaaacaatagaggtctttccttcctccctccgcgccaagggtgtcgccctctccacctgctcaaactggctaaacaactttatcatcgtaagctcccgatcatttgcaccgccagcctcacaaatagctaa

SEQ ID NO: 14085 - DNA, 255 bp, A.fumigatus
ggcctcatcaccccgcctctggtcgaaaacaccggttacggcgcgtacgtcttcttcgccgtcttctgtctcctcgcacttgtctggaccttcttcttcatccccgagaccaagggccgtacactcgagcagatggaccacgtcttcaaggataactccagcgaagcagagaaggcgcgccgacacgctatcgaggcagagctgttgcgtgcggagtatgagtatcagaatgcgtatgcgaatgctgcgccttga

SEQ ID NO: 14086 - DNA, 510 bp, A.fumigatus
cgagcgtgtcttcatcggcgggtcgagaagttttgtattgtccttggaatcgtcatcgcatactggatcacatatggcactcgattcatggcaggcgaatggtcctggcggctccctttcctcctgcagatgattcccggatttgtcctcgctggcggtgtccttgccttgccgttctcccctagatggctcgcagccaagggacgcaacgaagaagccctccagagcctgtccaagctgcgtcggctgcctccatccgacaagcggatccgtcaggagtacctcgacatccaagccgaggttcgcttccaccaggaattgaacgcagaaaagcatcctactctccaaggaggggggactcggcaatccttcctgctggaaatggcctcctgggcagactgcttcaagaaaggatgctggcgacgaactcacgtgggcatgggcctcatgttcttacagcaggtaagtcctcccgctttcctcgccctctcccccttcggaccccactaa

SEQ ID NO: 14087 - DNA, 249 bp, A.fumigatus
gcacgtggtgatgtatgtattcagattaccagtggacagctttcatgcaatcaaatttacaaagtttacaatactgtcacgtattcaactatgcaccagactaagaaaatctccgccaagctggtccagatacatgagctatcgaaatataagaccactaggctaaaaagatgtctggacatgaatcctatcagtctaggttcttatatatttcagcatgaacggtccggacctttcaagcttcagtga

SEQ ID NO: 14088 - DNA, 414 bp, A.fumigatus
agacattcgctcgccctgacgcagcttctcgacttcaacggccccgatacccagccacccacatacatcctcaaccacctgcaatcatacatgaacatatggacggatatcgttacggaacttgcggaaggtactgagggtgatcccaacgacccccgcagcggcgattatctcatttactggaacaacgcgccgaacgccaagtacgatgggcctgagccgccagagaacgaacgccgacgacattgggaaacctcagacgtgatccataaaatcaacatccgggactttgtgcgccagcacttgcattccctcatcgtggggtgcggtggtgagcagcggttccaggaagagtggctcctcaatgtagatcgtgaagtggtggccgcatttgccgctttgggattgttttag

SEQ ID NO: 14089 - DNA, 855 bp, A.fumigatus
tcgatcttcatggtggtaagtggcgaagaaatgttgttgcaagtcgcatgcgaagctcatatgtcccccgaaacagccccaggatcccagaatggctttgacaacagcggacgcaagggacctattgcctggcagcagggcgataccgtctcacaaaccgtagacgccttccgagctctggctgagcgttatttgccacaaagtgacgtagtcacggctattgaagctcttaacgaacccaacatcccaggcggagtcagtgaggctgggttgagaaattactacaaccagattgcggatgttgtgcgccaaattgatccagacacttctgttttcctgagcgatggctttttgtcgacggaatcttggaacggattcaagacgggtgaggatgtggtcatggatacacaccactatgagatgtttgataactacctgatcagcctggatatcgacggccacgtgaagtctgcatgcgacttcggcaagcagattgaagggtcggataaaccagttgtcgttggagaatggtcaggtgctgtcacagactgcacgaagcacctgaatggcaagggtgtctccacgcgatatcaaggagagtacgccaacaacgtgaagtacggtgattgcgcaaacacaactcagggctcggtggcagatctttccgaccaggagaggactgatactcgacgattcatcgaggcccagctcgatgcctatgaaggaaaaaatggctggctattctggacttggaagaccgaaggggcgcccggatgggatatgcaggacttgcttgctaacggtgtcttccccagccctctgacggacaggcagtttccgaaccaatgtgcctaa

SEQ ID NO: 14090 - DNA, 531 bp, A.fumigatus
atcgtgagttttcatagcaaatgctggataagatttgctgactgtaaatctaggcgcgttgtgtcaagagcttccacattcgactacaacggcatcgtccgcggtgtcaacattggtggctggcttgtacttgagccatggattacgccttcgatctttgacaacgctggagatgctgctgttgacgagtggacgttgaccgctactctaggacaggatcaagccaaggctgttctatctcaacattggtcgactttcattactcaggatgacttccagcagatcgcccaagcgggtatgaatcatgtccgcatccccattggatactgggcggtgagttctcttcctgatgagccgtacgtggacggccagctggaatatctcgacaatgcaatctcctgggccagggaggctggcctgaaggttgtgatcgatcttcatggtggtaagtggcgaagaaatgttgttgcaagtcgcatgcgaagctcatatgtcccccgaaacagccccaggatcccagaatggctttga

SEQ ID NO: 14091 - DNA, 1143 bp, A.fumigatus
caagttatgacagaccgctttgctcgtccagcgggctcatctgacgcaccttgtgaccccgaaaggtactgcggaggctcgtggactggcatcattgacaagctcgactacatccaggacctcggattcaccgccattcaaatctcgccggtcgtggaaaacatcccagacaataccaagtacggcgaagcataccatggatactggcccaagaatctgtatgctctcaatgaacactttgggaccgcagatgagcttcgcagattagtgagcgaggtccatcgacgagacatgtacctaattgttgatgttatgatcaatgatatggctcaagctgtcaatggctccatgaaagatgacccgtcgctaaagattgactattcccagctctttccctttgacgatgagaagtactatcatcctttctgtgccatcacggattggactgatcctaaaatatacaagaattgctggtttgccgtggaaacggttgccctcccggatctgaacacaggagatgcctccgtcgccacaatgatcggagattggatcaagcaatttgttggtaactattctattgacggactccgcattgacgctgcactgcacatggatgacgactatgtcgagggcttctccaaggcggctggtttattcacgataggcgaagtcagcaacggagacacaagcctggtgtgcaaatacgaaaatttggtttctagcgtcctgaattatccactatattacgccttgatccaagccttcacagcgggcaatatgcttggactcgctgaaagtatccgagccgtgcaaaaggactgcaaggatttcacgcttctggaaacgttcgtcgagaatcacgatctccctcgccttgcgtcactgaccaatgacaccaccgtaggtttggatgattgcaccagacattttacatcagctgacagatacgaattagttggcaaagaacgcgatggctttcaacatactctcagatggcatcccccaaggcacgttcctcgacatgacccaggcggtccccaggcagcgcttatagacacaaccagtataccaaggccaagagcagcacatgtcgggcaactatacgcctttcaaccgaggcgccctttggacaacgaactatga

SEQ ID NO: 14092 - DNA, 309 bp, A.fumigatus
  unsure (160),(265),(271): Identity of nucleotide sequences at the above locations are unknown.
acacaaccagtataccaaggccaagagcagcacatgtcgggcaactatacgcctttcaaccgaggcgccctttggacaacgaactatgataccacgagcccgctattcaagctcaccgcaacgctcaacaagctccacaaccatgcccttagcatcgacnaccactatgtgaccaaccctagcatagagcttcattccgacaactccaacgtacgccaccaaggaaaggccgcgagggattgcaggctggtttcagtcctcccanaaccantggcaccaatggtgggtaaattaccaacttgccgttga

SEQ ID NO: 14093 - DNA, 1488 bp, A.fumigatus
gaatatctcggatttctctcatgggcaactcccttcctctactccatctccttttctcttaaaagcccctctgccagatttcccacatcttcaaataacgatatgaccgagccaacacatattatagatacggaaggagaagtgattatcttcttaaaatgtccggaatctccgtttgcaccatggaatgacgatgtggcggagccggaaccgttaaagagccatggcgatgtgcaaaaaagggacaatggcgacaacgctactcaggaaggatttaacaagaaagtaacgaagaagagactgaagaaaaagaataagaggggaaatccaatgcccctccagtcagaaatggacgaatcggccgacaaccctgctggaactccagagccggctgacacagctatggtgtctgctgatgagacagttgatgacagtgttactgagtcggccaatgggcctaccactgagcctttggaggagcaacttcaagaagcacagccaaatgcctcacttgatggccctagagaaaatggaagtgaaatagactgcgaaggtgccctgcaggaacctgcgagcgatgtgcatatgcgaggggattgcttccgcatccaagtatccgcgaagcatttgactctggcctcacccatctttaaggagacgcttagtggacgttggaaagaaggccttcgtttgcttaaggaagggtcggtagagatccctatacgcgattgggatctcgaggcgtttctgatcttgatggatatttttcactgtcaagcccagaacctaccccgggaaatatgcctggagttgcttgccaagattgccgttttagcagactgttaccaatgccagccactggtgcgattcttcgccgaaatatggatcggccaactaagaagaaaaatctttcccaccatatattcccgtgattcaatgctctgggtgtgggtctcgtggaacttcagacaactctttgagtttgagaaatcaacatccattgctatctcccaaagtaacggtttgattacaagtctcgacttgccgattccagcgaaagtcattagtaagtgtcaagccctttatccgcgagaacctatcataacagctcccgtaggtgaaatgaataggcgcaggaatgacgcaatctccgccgtcctctcatcgctcgcggaactacgggacgcttttctagatgggagtcgaggatgctgttttgaatgtagctcgatcatgttgggagctcttacaaaacacatgcactcaagcggcctgctctctccagagcctgcagccccttttccaggtctgagttactgccaacttgtagagactgtgcgtggctttaggtctccacaatggcactctgattcaggctactcgagatactcctggcatacttgtggggaggcatccttttcttctctgataactgtaccggagacttacgtcaaaggattgagtttgattgctttttcatttccttag

SEQ ID NO: 14094 - DNA, 231 bp, A.fumigatus
ggcagaagagctgggagttcaagtgatggagacgacgaagaaggtgctgggtgcggagcatccctacactctgaccaccatgccaacctggcgtttacttggaaagagcagggccgcatcgcggaagcccttgccctaatgaacgactgtgtacagctacagtcaaaaattctaggcgttgaccatcccgatactctcatcctctgctacattgatcgattggcagactga

SEQ ID NO: 14095 - DNA, 456 bp, A.fumigatus
atgcggaatttcccacaggagagtatgagaattggatgcagtgtcaagtacttttcccgcatgcaaacatcggcggccagtcagcggccccatgaacgggactcattactggagtgggctgcagtgtgcaaggcggcgtggtacgacatgcagaaaggcaatggggctgagggggagagactgtcggtcaaagcaatggaagctctgacaaagcatctaggtccagaacatgaagatacgctagaaagtgggcatatggtgggtttaatatatacgcttgaggatcgacggaaagaggcagaagagctgcaaatgcaggtgatgaagatgaggaagaagttgctgtgtgtggagcatcctgacactctggtcagcatgggcaacctggcgtggacgtataggaatcaaggaatcaagggcgatggaatgaggcagaagagctgggagttcaagtga

SEQ ID NO: 14096 - DNA, 1665 bp, A.fumigatus
tggccaggcgacataggctcgcaagaaggaagctcggacgatgaaatggaagacgctctgagagacgcagacgaggcagggaatgataatgatgccgatggagacgccgaggccgatcaagatgcggaaagcccgtcgaataccagccacgcatccgaagggcctggtatcgcatctcaagccaatcccgatatgccagtgacctcccctgactccacaaacatcatttccgacttgacctccgtctttcaccctccagttcgtccggaatgtctaacagcatccacttacgacatagtaccaaccacggccgcacctcacagtacatccataaatgcagtaacagcgacagccgacatgcgatgggtgtttagtggagggtctgatggatatgtgcgaaagttcaattgggtggattcgatcaacagcaaactgatgctgaccgtggcgcaacgacatcccttcgtcgatagcgtaatgaaggcgggcgtgttgatgacatattgggagtgcatggatggcaatgcagtgtcaccagtctattctctagccagccatagcgaaggcctatggctattatcggggttggagtcaggcagtatccgtctgcagtcagttcgtcatgatgagggaaaagagattgctctcctgcaacagcatacttcggccgtctcggtactgcaactcaccccagacgagaagtccttgctatctggtagttgggacaagcgagtgtttgactgggatttgaatactggacagacgcggcgtgtcttcggtgccagcgccgggcaaattgcggcgatcgagattcggccagaatccacaatccctgttccaacagatacattagagctacctcagacgaatggcacctactcatcaaactatcatgccagcggaactgacagcttcaatttcatggatacatcgaacgatttaggtgaaggtggcgctgctgcaaacttgcaggcgggatccccagcagattcactctttggcgccgccgattcattattcggagatgcagatggcgggggtggtgaaggtgggggtgcatcgggaaacgcgtttggaatagacgaggatgatgagttcggcaaagctcttgccaacggcattcttccggatgctgatgccgatgcagatgcacccggcgagcccgacgtgatggatcaacaaaatgggactacagagggcaacgcaagtgcagacgctaccatgacgaacccaaagagcgaatctctggacactagtataaatgctccgtcgcaaccagtgacgaacggcctaccacacgcggaagaattaaagccaccttcacaggcgcaggagtctgctgcatcaacacaacaagagtcgagtgtagtaacagaccacacattccttgccgcatccatcgacggcacaatcagagtatgggacagacggcaagcagaccccattgctcggatcacaccctataactctccaccttggtgcatgaatgcatgctggtctccggacgggaattatatttatgcagggcgtcgaaatggaactgtggaggaattcagtctccataaaggtttacgagagcctgagaggaccttcaaatttccccagggcagtggaccggtgacagcgctcaaagcgatgcccaatgggcgacatattgtctggtga

SEQ ID NO: 14097 - DNA, 246 bp, A.fumigatus
catctgctgaccatttgttccagtgcgtcgcatgatattcttcgattatacgatttgaaacacgaacaagtcagccgccattccacggtaccttttctcatcatccctgggcaccgcaccgggactatatcacaactgtatattgatcaggcttgtcgttttatgatctcgacaagtggtaatagaggctgggaaggcaataccaccgaggttttgctaggctatgagatcaacgttcctcgataa

SEQ ID NO: 14098 - DNA, 819 bp, A.fumigatus
  unsure (784): Identity of nucleotide sequences at the above locations are unknown.
aaggtcttcgatttgaagccaccaaacctgctaatagcagacctgagacatgttgcatcaccagcgtctccgcttacctttgggctggttgtcggggcgactatcgataagagtccgtcttggcacagcctccgcgccacgccctgtcagccacagctggttttcttgcttttcatcaaacttccgtctttttcttcatgggcaaccctgaagtcgatttttcgattcttctcgacaagtcgtcccctcgtgctgatgcgagtgcccttctgggacaatcgtggctattcaggacccctagtccgcggtgtcaaccccgccacattgttcgagaaagccgttcgcgaccgcattacagactcatattactggaaagaacagtgcttcggtttaaacgcggcaacgctttgcgatcgtgcggtcgaactgacatctattggtggtacatatggtgtcgccgaggaacccaccccgtttctctgtcttgcgttcaagttgctgcaacttaaccccgagcgtgaaatcatcttggaatatctcaactacactgatccgggcagtgacggagagacagaggctacggcagaggggcaggctcgaaatggtgtgcttggacaacgaggggactgcaagtacctccgcgccctggcggcgttctacgtgcgtctaacctttgacccggtcgacgtctacaagacactggaaccgctccttctcgactatcggaagttgaagcgacgagtacgcgctacatttgtgcttacatatatggatccatttgttnttctctctcaaaggcgccggatccgcgctatttgt

SEQ ID NO: 14099 - DNA, 1158 bp, A.fumigatus
tcgtgtgttgctaaaattcatgtgccgctgtctttcgtgcatctcaggaacataaaaccacattaccatgcgcacttcaagttacacacaatcatggtgcttctgacctcctcgacagtttcagtcattctctccaccggcgtggtctgcctatttactcttctcctttttctgtccggatacgtccttcagcagcagtctgtcagaagtatccagagtgctcttcgacctcctggggttccagacccagtcaccggccacggatcagcagggtcgtcgtttcaaaaacgagagcagagtactctctcgaatctgattcctgaggagcagcaaaaacatgtcgcccatcatgcgcagcctggagcaggaggcaactacgcatatctgcaactcctgtcttcccccaatccatctgatatctgctccgcaatcctctttttcaaacaactcgccacaaagggcacagcaatcaatgatcgattgtttatgtatccccgggattgggatttgctgtcatcagacaaggtctcggactccgtcagaacagctctttctctgctccgagccgcaagcatcaagtacaacgtctggcttctccccatcgacatgacggcagtcacctctgcaggctacgaaccgacagacaccaagcttcttcgtttaggccagatccagttcatgcagtacgacagcgtactgtatgttcgaacaccgggtctgttgctcgacactggcaagctagacgagatgctcctctcccggccattgcccctaaaatatgacaaggatcgtcccgagtccttcaataatgaagcatggattcccatgcctcttagggcggaccgcgatgctaatcttccgccagtgtacctgatcacagtcaacaacgtgaagaacgggcagattgaggcgcgaggccatatccctaacgtggctctcccgggctttgggggtctgctcaccagccccaggggtgttcacacacttgagaataagggtaatgatcctgctgatgagccagggtatgtcttctttgaacaggatggggaaggtcacgttcagtgggcgcagaatccgctgttcggtgcctggagagcgcagcaacatgaagtttgcgaaggcgtcgactttgatgaagtcgcttatgatcatgattag

SEQ ID NO: 14100 - DNA, 735 bp, A.fumigatus
gtcgtttctccctttcaagccattctggactacgagattgcaaacaacatccccaagggatgggtaaatttcagtatctcgcgcacgtctccaaatggcagctggcacaggcttgagcgaggcgagatcaaactggatgcggatttctttaaagcgttcaacagagatctacgaaacccgtatttatggaagaagttccatgagagactgcagaagaagcaaacaaccggggtgccaatatcggcacccccactgcccgaaatcgacgcagaatggctcttctgggagatgatgcgagtgtcaaggaccccagacccatacatgtacccagcgctgcagaagctgaaagcgtcagggcagttcattattggggctctgtcaaatacggtcatattccctgatggacatccttataacagcgactcaaacggtgtcaagtcgcaattcgactttttcatctcatcggcgcatacagggctcaggaagccagatcctaagatctatgcagccgcgctgagggagatggacacattggcgaaaaagagaggcttgcaaggggttgagccttctgatgttgttttcctcgatgacatcggggagaacttgaaggccgcgaagaatgctggattgcgaaccatcaaggtcaaccttggccggacgcaggatgctatcagagaactagagaagatcactggcctgcaattgctagacactggggacaaggccaagctttga

SEQ ID NO: 14101 - DNA, 225 bp, A.fumigatus
tatttctcaaatgttctaccgacgctgcgtagcgttgtctatacggggtacttcgttgtggttgtccccccgctcgtggccaacctcaatttgcgctgggatgcagccacgctaagcgaaaccatccacaaagtcagcccacaaaatttccaacctcttcagtcctcctctgcagccaacgtcgacaattcggtcttcaatttgcggcaacagtcaagatggtga

SEQ ID NO: 14102 - DNA, 906 bp, A.fumigatus
aatcatcatttgtgtgtccgccgaactaacaatctctaccatagtcgctaccagactaagtaccgccgccgcagagagggcaagacagactactatgctcgtaagcgcctgatcacccaggccaagaacaagtacaacgctcccaagtaccgtctcgttgtgcgcttcaccaaccgcgacatcatcacccagatcgtctactctgagatcaccggtgataaggtgttcgccagcgcctactcccacgagctcaagcgctatggtatcacccagggtctgaccaactgggctgccgcctatgccaccggtctgctccttgcccgccgtaccctcaagaagctcggccttgacgagcagttcaccggtgttgaggagcccgatggtgagtacaagctcaccgaggccgtcgagaccgacgatggcacccgccgccccttcaaggccttcctcgacgttggtcttgtccgtacctccactggtgcccgtgtcttcggtgccatgaagggtgcttccgacggtggtatcttcatcccccactccgagaaccgcttccccggttacgacatcgagtctgaggagctcgacgctgagaccctccgcaactacatcttcggtggccacgtctctgagtacatggagaccctcgccgacgacgatgaggagcgctaccgcagccagttcgccaaatacatcgagaacgagatcgatgccggtgacctcgaggagatttatgctgaggctcacaaggccatccgtgaggaccccttcaagaaggacgaggacgagaagcccaagaagtccaaggaggagtggaaggccgagagcaagaagtacaagaaggccaagctgtctcgcgaggagaagaaggctcgcgttgagcagaagatccgtgagcttgctgcttaa

SEQ ID NO: 14103 - DNA, 420 bp, A.fumigatus
agggtgcttccgacggtggtatcttcatcccccactccgagaaccgcttccccggttacgacatcgagtctgaggagctcgacgctgagaccctccgcaactacatcttcggtggccacgtctctgagtacatggagaccctcgccgacgacgatgaggagcgctaccgcagccagttcgccaaatacatcgagaacgagatcgatgccggtgacctcgaggagatttatgctgaggctcacaaggccatccgtgaggaccccttcaagaaggacgaggacgagaagcccaagaagtccaaggaggagtggaaggccgagagcaagaagtacaagaaggccaagctgtctcgcgaggagaagaaggctcgcgttgagcagaagatccgtgagcttgctgcttaagtgcgtttcagtgtag

SEQ ID NO: 14104 - DNA, 1686 bp, A.fumigatus
acgagctgggccaaggttgtttatcgcttcttgatgaagataggaacaccatcagtcggtcagataagggaaaaaatgcctcaattctcgcataccaagagagctattaacgtatcggcgcaagatgtacatgcccgagcagtcgcttggtacaatctgggatgggcagaatacagagctcagagatgtgtccaggtgcattctggcaccaagggcaagaagccggcacgccggttcctgaagacagcaatgcgttgcttcaagagagcgattgaattagaagccggcaattcggagttttggaacgccctgggtgtggcaactacaagcatgagcccgaaggttgcccaacatgctttcgtgagaagtctgcatttgaacgagagaagcgcgcaagtgtggacaaacttagggacgctttacctcatccacaatgatattcaactagccaatgaagctttcacccgcgcgcaatccaccgatccggactactctctggcctgggttggccaaggattcctggctttgctttttggggacccacttgaagcaagaggtctttttgagcatgccttcgacatctccaactcctcatccacattgcccagacgccagtacacgctcaccttgttcgaccgcctcctctcagactcttcagcatcgaatgagatatcacagctcattcagccgttgttcgcgctcctgcagctttcctctcaagacccgtccaacctgcagtttatgcatcttaccgccctcatggccgagagaattggcgaactttcagatgcggagactagcttgcacgtcgtctgctcaggtgttgaggcggagtatgaggtgtctgagtcgagctcgtcgctctctagatatgctcagtcgaatgcagacatggcacgtgttcttcttgcacgccaagaatttgagcaagcagtagagaaagcggaagtggctcttaccctctctggtgaagaagacgcggagaaattcgacccggaggcaaacagaaaactacgtctgtcagctcatctcactgctggattggcgcattactacttgaagtcaatggacaacgctatcgacatgttccgcgacgccttgcaagaggcggataatgcgccggaggtggtatgtctcctagcacaggttctgtgggcgaagggtggtgatgaggagcggactgtggctcgtcagcagctgttcgactgtgtggaagaacaccctgaccatgttggagcggtgtcactattgggagcgattgcgctactagatgatgacaaggatgtcattgaagcggtagcttcagatcttcagaacatgatcatgagagatgacattgatatccacgaccggactaggttgactaagctgttgacggcgatctctactttaggcctgactgaggactcgcaaattccagaggacgtccgacgcctcggagaggccacggctgccgtcatgagatcgccaggtcagccacaaggctggcaggagctagcagcagcatctcaggatctgtatcccgcggagatggctgttgacagagcactgcggagtgttccaccacggagcaatctggatgctgtcgacctctgtgaagcgtatgcacagactggcaaggcaggtgatgccatcaaggcaattatggtggcaccgtggaaacaaatgtggatgggaagagcttaa

SEQ ID NO: 14105 - DNA, 960 bp, A.fumigatus
ctccatctcctatcatttacgtttctccccccgactgtcatatcatttcaaaaatcactctggtgcctttcgctggccacaagaaagttctgcactgccttcataatgtcgacactctcgtctccccgtccgtcgattgcttcctctcgcgcacactcacccacgccagcatcatcacgccggccatctcttgacacgttgaattcgaatgtcggcggaggtctaagtgcttcgtcaaccccctctaccgtccgagccgtctctccatctctccatccaagacgcaatcgcgccgcacttcgggactattacaatttaaggccttccgctgctgatcccttaggcaatggaagcaactttcgctcccgcagcatccccagacacactgatgccggggacatgtccagtccgtcatcagtagtagctacgggaacagaattggatagcccggacttcgaccctcaacgttatgttaatcacctgctggctacttcttcgttggcgactgtactcaaggcggagaatactcttgttggcgatataaagacacttgacagtgaacgcaaggcccttgtctatgacaactactcgaagctgatccgggctgtggaaacgattggcaagatgcgccgaagtatggacgagcgtggcgctcctctgactatgacgaagactctcggtccggctattgcatttgttgccgaaacggccacaggtctgatacaggaaggcgaagagcagcagcggcgcatgcgagaggccaaggctacagacggaacggaccgccgaaaggcagaaaaggaaacggtcaagtgggttcttggagcaccaagtcggctagagaagcttctgtccgagggcaaggatgatgaggccaccaatgattgggaggagatacggaacatgctggataagtggcagggcgttaaaggggtggctaaggttcgtcaggcttgcgag

SEQ ID NO: 14106 - DNA, 225 bp, A.fumigatus
tgtaacagggccctaataaatataaagctttccacagagcaagaggcggctcttataaagtatattaatatacttattaagctagatattcccctgtggctaaaggcaatcagtaatatagtaaatttaatactcttttatagatatactaatctgataacccccccccctttaattagcatgcattggataaaatactttcttaaacactatccagaatattaa

SEQ ID NO: 14107 - DNA, 945 bp, A.fumigatus
ttttcgggacatctgggatggtgcgggagtttggcggtggaaccgaacaacgaatggtttgctagcggtgcaggtgacagaacgatcaagatctggaatcttgcgacaggtgctcttcgtctgacgctgacgggccatatctctactgtccgcggcttggccgtgtctcgtcgacacccgtacctcttctcctgtggtgaagacaaaatggtcaagtgctgggacctggaaacaaacaaggtcatccgtcactatcacggtcatctgagcggagtatataccctcgcattacatccgcgcctcgaccttctagtgaccggtggtcgagatggtgttgcccgagtctgggatatgcggacaagaagcaacatccacgtcctgtcaggccacaagggcaccgttgccgacttgaaatgccaggaagccgacccacagattattaccggttctctcgacgctacagtgcgcctgtgggaccttgcagccggaaagactatgggtgttctgacgcaccacaagaagggcgtgcgcaacctcgccatccatccgcgagaattcaccttcgccagcgccagcacaggaagcatcaagcaatggaagtgtcccgagggtgacttcatgcagaacttcgagggccacaatgccgtcatcaactctcttgccgtgaacgaggacaacgtcctcttctccggtggtgataacggctccatgtgcttctgggactggaagacaggctacaagttccagtccatcgacaccatggcgcagccgggttctttggacgccgaagccggtatcatgtctgctacattcgatcgcaccggcttgcgtttgatcaccggagaggccgataagactattaaggtctggaagcctgacgacgaagcgacgccagagtctcatcctgtcacttgggcaccgacccttggcagacagagatattaa

SEQ ID NO: 14108 - DNA, 1587 bp, A.fumigatus
cctccaatgctactccccaatcgcgacgtaagaaagctcttattacgccgtcgcacaagaggtatggattcatgtctaaacctctggggcaaggttgacaagctgctcaataggatcgtcgttaagaagccgttagagtttacaccacttggaactcgagttttgcctccttctcatttcgattcaccttatcgccaagcacgtaccctactgcatgtttcgactgtacctacatcacttccttgccggaagacagaattcgacactgtgtataatcatctcagtgcagcaatcatggaaggaaatggcacctgcatttacatctcgggaacaccagggacaggcaagacagctacagtacgtgaggtggttgcgcagttgaatgctgctgttctcgctgaggaactggacgacttcatctttgtggaaatcaacggaatgaaagtgacggaaccccatcaatcttattcattgctctgggaagcgctcaagggtgatcgcgtttctccttcacatgcgcttgatctgctcgaaagagatttctcgcatccctcgcccagacgagtatcatgtgtcgtcctcatggacgagcttgatcagttggtcacaaagaatcaatcagtcatgtacaatttcttcaactggcctgcccttcgtcattcacgccttatcgtccttgctgtggcaaacactatggacttgccggagagaacgttgagcaacaaaatctccagccgtctcgggttgactcgcattacattccccggttacaagcacacagatctcatggagattatcagcacccggctggccaatgttcctggaaacatcgtcgatgcggatgccattcaatttgctagccgaaaagtagctgctgtcagtggagatgctcggcgtgcattagacatctgtcgacgcgctgtggaaattgcagaacagtccagcgagactgcaaagattgaggatatggatgccgagcagaacggagacgaaaccgagtccctgccccctactcccagtaaaaccccagcacgacgacagaaacctactagcaagcacacagtcaagctcgaatcacctcagaaaaacgcggcacagaaacagaccgcaggccgagtcaccatcgccaccatcaagcaagctatccaagaagccacctcaaccccactccagcaatcactccgctcccttccgctgtccgcgaagctctttctcgctgctttactggcccgtgttaaacgaactggtattacggagtcaacattcggcgacgtcatcgacgaagcgaaaagaatcgccgatgctgctgctgcaggtgccagcacgggcatcagggatttcttactcgcggggaacaacggggcgcgtgtgagagctctcggctttgccgctatggaactcatgaactcgggagtccttgccttagaaaacggggcaggcgtcaaggggcccctaggcggttctgtcattccgagcagaggcgacagaagcgggaaggtgaggcttagagttgcaccagaagatgttcgagccgcgttccgggaggacattgaggcaaagggattgggactgggtatggaccagtaa

SEQ ID NO: 14109 - DNA, 708 bp, A.fumigatus
cgcgtcttaaactctttctttagtttcaacgccgagagcaggccagaacttgcaaacccatttccgcttacaccccaattgaaggaaatggctgtggcctctgttgacgagcatgagagcactccttctcggaggcgcagtgctcgacaacgagcacaattatggatgaccaaaggtggtctagtgcgggatgattccgacgacgagttgggggatgaagatcttccatggcattggatctacgacactgaagaagaagatactgagaacaaagaaaccacatcggctaccgatgaggccgagacaaagtcagctcgcagacgcgcagctcgccctagtgtgaagcgccgacggaatattataggggcacggatgggttccttcgagtgtcggttaggtcaagtcgtgctgctcaaatctccagaaccggggaaagattgggtcggcatcattactgagtttctagaggaagatgatgaggaggcagaggatggggtggtcaagtcggctaacatcatgtggtttgcatccccggacgagttcatgtcgaccaaaaacaagcgaagggcggacgctttgccgaacgaacaatatctgacagcggattttaatgtcaatcccctcacgtcaatcaatggcatagctacggtgatgtctaaggacgtgttgtttgccaaatatccgaatggcacgcccccaaagggctag

SEQ ID NO: 14110 - DNA, 219 bp, A.fumigatus
gaggagttggccgagttcaacaaatgcattatttgccggagaggtgtgaaccagcttcaaggcagatataccgacgaatttatttgggaggacgtgtaccgggaggataagatccatgacctcattaccatggtcaaggacgggttgagagcggccaaaaagcgcaagcaggtcgatgatgatgtgagtttttctgctcgcgtgagaaatggctgctaa

SEQ ID NO: 14111 - DNA, 909 bp, A.fumigatus
cgggcctttaggaagttcgatatgggcagtatctccgaggtagaagtcatgaaacccgccctcaacgtcccccttgattcacaagctgcgctgcttcgcgacagaactgagcgaccgggcgcggtgccagggctccggctcaataccgtccagcaccgccaacgaatttctactgcagatcagatcgattttcgcgtcaagttgctccgcagcctccgcctcgggtgggagaaggacgacaccgaggccaagtttttgaagttagttgatatggttgaatcagacggttgcgccctatttggcggcctgatcgacccggccattttcgagaatctcgtagcgaagtacgacaaggtccagtcacggtcgggcaacaatgctttcatgcactcatatgtcaaccttgcaactgaacatgatttctttctaggggggaactatattgaggcatttagccatccgctgctcattgcccttgtgtcctaccttcttgggggttctatccgcatcgtcgatttcagggggaaagataacgatcccatgtcgatcaatgcccaggacaacatgctccatgtcgacaacacacctttcaaggaggagtacaaagttttgctgaactggcgccgaggacaagtgaaaggtccctccggtcagaacttcacatttttgccgtggacccacaagggcaatcgagatgttcttgtagacgaggagggactgccctggtctacagagagagatagtcttttcgtaagtcatgatgccattgacggtctcttgaactttcaaaaggagatcaaaggcatctctcgtgtcgtcgaggcgaagcatcccgaccagccattggcggttctctttccagcaggagccctggtgcatcatcgctatcgtactacggagggcgatcca

SEQ ID NO: 14112 - DNA, 432 bp, A.fumigatus
atattcctatcaaggggaggccccgtttttgagttgaggaacggaaatgtaaatttttcgccgatcggacaaggcgtaaattacgctgaaatggaggaaatccagcgctatgataaggcacatggaatccggaaaaaaatgattgaggcattggagacgcgattctcggacctggaattgaagtacgcaatcggtgggcaaacttgtttcgatgcttttcccgtcgggtgggacaagacctattgtttgaggcatatagaggccgaaaaagacaggagtgggatcgtttataaagaaattcatttcttcggggacaagatatatgaagggggaaacgatttcgagctttacgaggacgagaggacgattggacattttgtaaagggcccggaggatacaatgaggcagatcagggaattgtttgacgtatag

SEQ ID NO: 14113 - DNA, 2787 bp, A.fumigatus
agtggtatcggggtcaaaggcaaagttcatactactgtcgaggaaagtatgatggtgtcttcggactctgaatcggagtcggaaagcgaggacgaactcgataaggagctcttcgggccgaaggcaagatctcagccggacgcaatcaaagcctatgaagagagtaaaaaactatcactgaagcaacagggtcctgtcaaaaagatcaagcaggtgcgctctgcgaaagatatgcgggcacggctcgcgccagacctatcttctttgcatcgtacaatcctcgcttgggacttttttgcaaatggtgatcttccgccaaattctggtcgcactgactacagcctggtatcgaacactttcaaagacccgctcgagtaccaaaaaacgttcgaacctcttctgatcttggaagcttggcaagggttcaactcaacgaaggatgaaggaacatttagaccattcgaaatcaaggttgccacccgtctctccgtggactcttttgtcgaagtcagcacagttctaccgtcgcttgaggtcaaagacctcggtctcagcgaagccgatatcgtccttctttctaagtcgagcaggccaacatccgattcttctgcccctcactgcttcgcaagggttgccggcatcaacaagaagaggggcacggttgaaatatcgtatcgggtgaatcccgggagccccttcatcaactcactcggacctggagttacaatctggggtgcgaagataacctcattgactcctcttgaacgagagtatggtgctctcatggctctgcagtattatgatttgtgcgaggaagtcatcaaagccaaaccatcgccgatcctccactactccgatgctagcctgaaaccgatcgcggacaattacaatgtcaatccagcccaggcaaaggcaatcaaatcagctttagacaacgatgcctttaccctgatccaagggccccccggttctggaaaaacgaagacgatagtcgcccttgtgggtgcccttctcagcaagtttctcggtgacaagggcgtgacaatttcacggccgacgggagtgacaaatccgagggtccctggaagaactacaacgtcgaaaaagctactagtctgtgctccgagtaacgctgctgtcgacgagttggtgatgcgattcaaggagggtgtcaaaactatccacggacgtcacgaaaaattaaacgtcatccgtctgggcagaagtgatgctatcaacacgaatgttctcgatgtgaccttagatgagctcgtcaacgctcgattgagccaaaatccacgtaaagactcgggcgaacgggacttacagacgatttatatggaacacaaagctgcggataccgcgtttaaggagacccgcgcaaagatcgatcaatgcagagctcagggcttacccgtgccagaagaattggaacgagagttcgatctgctcaagaagaagaagacgcagcttagccaagagatcgatactgcgagggacaagaatcactcggcagcacgcgatgcagatttgaataggcgacgcattcaacaggaaatcattaacaatgcccatgtcatctgtgccactctcagcggtagcggccacgagatgttccagaacttgagtattgagtttgaaaccgttgttatcgatgaagctgctcagtcaatcgaactcagtgcccttattcccctaaaatatgggtgctccaaatgtattctggttggagacccgaagcaactgccgcccactgttttatcgaaagttgcttctaaattccaatacgagcagagtttgttcgtcagaatgcaggccaaccacccaaaggatgtacatgtactcgatactcaataccgtatgcatccagaaatcagcgtttaccccagcgctgcgttctatgacgggaaactaaaggacgggccgaacatggccaaacttcgtgctcgtccatggcatcagagcgagcttcttggcccatatcgtttcttcgatgtgcagggcctccatcaaaatacaacgaagggtcactctctgatcaacttggcggagttgcgggtggctatgcaactctacgaacgactgatcacggatttccgcgagtatgacttcagtgggaaaataggtatcattactccgtacaagggtcagctgagggagctgaagacacagtttgccgcaaggtacggaaacgctatctttaacatggttgactttaacacaacggatgccttccaaggtcgggagagtgaagttatcatcttctcttgtgtcagagcatccaacaaaggaattggtttcttggcagacattcgccgtatgaatgtcggtctaacgcgtgccaaatcatccctatgggttcttggtaattcgcagtctttggtgcaaggcgaattctggaatgggttgattaaggatgcgcgtcgaagaaatgtatataccgacggtgacattctgggcattcttcagcggccacaatttactggttacaaaaacatcgatatgatggatgccgagtctctaaatcctacagcctcactcaaggctgctggttccgaacccgcctcgagaccgacctcagcttcctttgaccggccaacttcagagtcctccatctctacatcagtctctaggagaggcactccaactgaacccccgccagacctgccgtcaggcggtcccaacggtttggatgatacccgaacatgcggttactgtggcagctttgctcatatgacccacaattgtgacaatattgacgcgaaggaggcatcgcgtggcacctga

SEQ ID NO: 14114 - DNA, 459 bp, A.fumigatus
  unsure (359): Identity of nucleotide sequences at the above locations are unknown.
tacagatgtgggcgctcagggcatacacgcgtggtttgtatggcagaacgctgcctgcaatgtggtgagttcggacacgatgcacagcgttgtcaatctgcgagggagctgtcaaagaaagagaaaagtcgtattgcacgagaggagcatcaacatgctcagatgaagaagcagaggaccgaacgtcagcgtcagaaacagcttggaggacatgatccgaaagtgccggttctacaggtctcttccgatccgccgccgcgcgaggataagaagcctgagaaacgtaagcccgaccagagcaacgcgccgggcaagcgcaagcgtacgggttcagaatcgcccgatacttctaaggtttntaaacctcgaagctcggactccgttcccaatccacccaaaggcccccgacgcaagattgatgctaatgtgcctaccaacaccgctgtaggtttagattag

SEQ ID NO: 14115 - DNA, 237 bp, A.fumigatus
ggtgaagactcattccgcacatctctcacatcagcctcttcggtctcattcggtctgacgcagcagactcggtcattctccgccagtgcgtcgctggccggtaaacgggctacctacaatccctcgcgtagagtgcagaaacgtcgccatgggtttcttgcgcggttgcggacgaggggagggagaaaggttctccagcaccggagagcgaagggacggaagtctctgagctggtag

SEQ ID NO: 14116 - DNA, 519 bp, A.fumigatus
  unsure (148): Identity of nucleotide sequences at the above locations are unknown.
atgaatgccgtggagggtcctatatgggtcgccgtccgcggcaaaggcttggcttacggtacgaacttcgcctataacatcgacactggctttgtgaactttgatgtatatcggtcaccgaatgcacacaaggcattcgagtccaggntaaaacagattgtcgaggaccacctctcgggtgcaatcccatttgaccccttaatgctagagggggctattagcagcattgttgtcagctttgccaatgagcaatcgactatcgccagtgcggcgcaaggcagcttcattcgtcaggtcattcgcaatctgcccagcgactacaaggaaaagacgctcaaacaagtacgagtcactggtgtcgaagacgtcaaagcagccttgcgcgaaatcatcctgccattgttcgcgccggacaaggcaaaccttgttgtcacctgtgcacctgtactcgaagaggtaagagttcccttgcacgtgcagaatgaggttgtgagctatagttacttactctcaatatag

SEQ ID NO: 14117 - DNA, 204 bp, A.fumigatus
acaatcaaacaaggtctcgaagcggctcgtttcactcctgtggtgcagccactgaaggactttgaagatgattatggattgaaaaatgatggcgacgacgacgaagaatccgacgaagaagaagatgatgacgacgacgataacgacgaagacgatgatgtgtctgaatctgaggaagatgaagaatctgatgataacgagtga

SEQ ID NO: 14118 - DNA, 306 bp, A.fumigatus
ttatccccttctctcaaccacgatgaacacaggaataatgctgataagtccggagaggatcgagactgcatcgtctccatatccaccgagacttgtcatccagccagacatagcccacgccgattcccgaacgagtcacttgaaaaccacgaccaccgcaaaaaggaaaacaaccacactaccagctcagagacttccgtcccttcgctctccggtgctggagaacctttctccctcccctcgtccgcaaccgcgcaagaaacccatggcgacgtttctgcactctacgcgagggattgtaggtag

SEQ ID NO: 14119 - DNA, 1824 bp, A.fumigatus
aaaagcccctgccaattgataataagccctttcttgaagcactccgtacgatatttttttgccgtctgtactatggcgatggctcttgcggtaggcgcaccctccgaacagagaggtaatcttccatacaatacgctcaaggacggtccgacggtggacagcatgaaagcaacgacagacggcaagaatggacagggtgaatccgcattttgggacacttgcgtacataccgtctttcgtgagcattgccagcgagctccaaactcacccgcagtcaatgcatgggacggatcattcacctatgccgagctcgacagcctgtcggatgccattgcgtcagtcttgatcctctctggagtcggaccagagagcattatacccatatacatgcagaagtcccgatggacaacggttgcaatattgggcgttctcaagagcggaggagcattcacgcttctggatccatcccatccacggagcagggtggaggagatatctaaggaaatccaggcaaggtttatccttacgagtgagaaactcagtaaacagtgtttggagatgttttctgtcctggtcgtggagcatctaagccgggcatgcttgccgaggcccggccaagctggccacacacgatctcgacctgaaaacgccgcttatatcgcgttcacgtcgggttcgacaggaaagcctaaaggcattgtcattgagcatcgatcatattgctcgggagctcgttcacacctgaaggtatttggcatcgattcgacgtcgcgcgttcttcaatttgcctcgtatgccttcgatgtcagcatcatggagacgctcagtactctaatggcgggcggctgtttatgcgtaatgagcgagtcggaacgaagcgacccaaacctcttcgttgtgtcttataagaacctacggatctcccactgctttatgaccccatcctttgcgaggacggtgccatggacagaatgttgcaacccgccacccaccctgatcgtgggaggcgagttgatgcgcccctccgatgcaagagcatacaaagaaatgggaattcgctgcatgaacgcatacgggccagccgaatgttccgtcaacgtgtctgtacagtctagggtggaggctgcggttgatcctcggaacatcgggtacaccacaggagcgacagcctggattattagtccggagaacccagaggagctgatgccaaccggtacagtcggggaactcctcgtggaagggcccattgttggtcgcggctatctcaacgatcccaaagccactcgccaggcatttattgatacacccgcatggctgcgccggcaccgcaagggcacctcttatcagcaccgagtctaccgcaccggggatttggcctccctggacagcataaccggtgcgctgctgctacacggccgcaaagatgctcaagtgaagattcggggccagcgggtcgagctccctgatatcgaacaccatctccaactgaccctcccgaacgacaatgccgaggtcattgtcgaaaaggtcaccttttccgacgatggatcggaaaagctcattgcctttgtcttagtccgtccatctaacactgattccgtcataggcaacacgggagatcgtctcttcctggcgccgcaatcgcagatcatggagcaattcgccatcagcaagaagcatctacaaacacatctacccagctacatggttccagatatattcattcctatatcaactctccctcaaactgcatccgggaaaacagaccgcaaagccttgagaacccgcgctgtcttcaccagcgagtggacggacagcgcttaa

SEQ ID NO: 14120 - DNA, 183 bp, A.fumigatus
tgtgtccgccctcttttgtcctccggctttcagactgcgaagagactgccgaactgggacgctcgtcaagcgtttcctagagtgcagactctgatgattgatattcgcttgtctttggaggatatctgttttgcttattttgccttgcgtgtctcaccatgtggtgctcatcagcacttctaa

SEQ ID NO: 14121 - DNA, 192 bp, A.fumigatus
catttgggctttgactatgaccaggtcaatgcttcgagagtgaccctacttaccctacaaaacaagctcaacgctggaaaaccgaactattactggaaatctttaaacaacaacaacaactgtgattgtagcagcagcacaccatccctcgatcgtcagatgtcttgcgcgatcagttccagttcgacctag

SEQ ID NO: 14122 - DNA, 603 bp, A.fumigatus
tctgcaggctggaaatgctgcaaaacccgcgttctgacctttgaggaatttctgaccatcccaccatgcaccaccggcaagcactcgacggtggacgacacgcccgccgagccagagaaggagtcggatgcctcatctgtccttgagcagcaagtcgccgccgcctcaccggcgcctgctcccccgcggcctgcagtctcgcccgccattgcccctccctcgaacgccgctacgcccgctgtcgaagacacagaggaggatgaccccgcgctagagatcccggccaatgccacctgccgtcgcagaggatgtaacaaagggtacgatccgtctatttcgcgcgacgaggagaagtgtgtctatcaccctggccagccgatcttccatgagggcagcaagggctggtcatgctgcaagaggcgggtgctggagtttgacgagttcatgaagatccaggggtgcaaggagaagacgaggcatctctttgtaggaaagggaaagcccgctggtgaggagaaggtcgagacggtcaggtatgcaatcttctacgaaccaacaacgatttcaagagacaaagctgatggtgctgtcgtgcaggaatga

SEQ ID NO: 14123 - DNA, 216 bp, A.fumigatus
ttcatatacagcattaagatgggatcagccggtgagatgaaggatgagacccttctccctctgagattcatccctctgtcatacaaccatgccgactcccaggcatcagcgctcaggcttgttctgacgctgaacccgcagtgggagggcccggacaacaagatcgagttcgtgcgcttcacggacggcatcacgaatactgtgtgtttcttctag

SEQ ID NO: 14124 - DNA, 420 bp, A.fumigatus
gaaagggaaagcccgctggtgaggagaaggtcgagacggtcaggtatgcaatcttctacgaaccaacaacgatttcaagagacaaagctgatggtgctgtcgtgcaggaatgacttctaccagaccccctcgacggtcaatgtctcgctctatctcaagaagattgacaaggacaacgccaaagtcaccttctcctccacatcggtcgagtttgatctgcctacgacggacaacaagcggtacaaggacacgtaccctctgtttgcgccgattgacccggaggggtcttctttcaaggtcttgggaacgaagctggagctcaagctggtcaaggctgatgggacaagctggccggtgcttcggagtgacgacaagtggacgggagagagaattcaggttggacaggccggcagggcttag

SEQ ID NO: 14125 - DNA, 198 bp, A.fumigatus
ctttatatttttctaagctgcggtttctaccctgacttgatttactcgtgttggattggagcatcaattgccggtcaattcatgcttctgactaccttttgtgaagataatcatcctcttggcgcaagattactgattgttacagagtacaaaggggccggaactaagtgtacaggttcgtccccaagcgttgcatag

SEQ ID NO: 14126 - DNA, 309 bp, A.fumigatus
tatgcccggggacccttttctcttgccgaatgcgacttgctgagtagatatgctctatctataggagaaaccacgtcccatgcgcttctggccagccgtggcctggctccttcccttctggctcgtttccaaaatgggcttctctatcggttcattcgaggccgtccagcaacccatttggatctggtcaagcctccgctctggcgtggcgttgcccaaaggctcggacagtggcatgcggtgctgcctatcaatggacacagcgcgtccagttcatctgccaaagagctccccttatcccaccagtag

SEQ ID NO: 14127 - DNA, 195 bp, A.fumigatus
tataattcgcccctcgtccacttacagagtcttacatgccgcatctacctttatacttgcgcttctatcgcgcttgacgtcaaaaaggggactcggcaccagaattacaaggcgtatacgctggtccgtttaggtacgcattctcaacaattgcatgtgattctcaaccatgtgactctgggtccagccaaatag

SEQ ID NO: 14128 - DNA, 183 bp, A.fumigatus
tcacgtgatgcttcaccgaattgtcatcatgtgtcgttgcataccctaaccctaacaaagacccatctcggcattctcactagtcccgaacccgctagcgccaagcttctgatcacctacaaaaagacttgttcagcggcgcttctactctttccttttcttttctttcctcatcatcagtag

SEQ ID NO: 14129 - DNA, 321 bp, A.fumigatus
cgccaagcttctgatcacctacaaaaagacttgttcagcggcgcttctactctttccttttcttttctttcctcatcatcagtagaggtttacattgaccatgtaaatttcaaccccggagctcagtcaaagtactgctcgctgaaggttattcttgcgggatttttttctcttatgggtttccttccgttcccagctctggagagcagcgtggattcactctgcgtgcgtccttctttttccctacacaatacatggctgagcgagggctttttccgaaaggttaaagccccatgcgcttatgctgtggagggggcgtga

SEQ ID NO: 14130 - DNA, 216 bp, A.fumigatus
actacatgcacgtcaagtcaaagatcatctccttgtctatccatccacatccgcaatccaacctacaaaatttatttctctgtcttaaccccggggggagagaaaatcacagtatgctatccgcaaaatgccctcccccctaacaacgaccctaatccaatccaccctcctaaacgccctttccaacatcctcgcccaaatcatcgcccagcataa

SEQ ID NO: 14131 - DNA, 552 bp, A.fumigatus
ggcccgttcacactcaacaccctggccctcctccagttcctcacctacgccattatcatcgtccccattaacttctcctggcagaagtatctggaggcgagatggccagggtttcctgggaggaagggcaggagtacgcctactgctgttgctggcgccgaggcgaagactggcgctgtggtggtgacggttgagtcggcggatctgctccctgttaaggagaaggtggaggagaagcagcgggtatctgcagcacgaccacgaccacgatcacgatggcgctggcgctcgcggtcgcggttgcggtcgcgctccggactgggcaatttcctaatgaagttcgtcctcgatcagacggttgggtcggtgatgaacatcctcttgtttattgttttgattaatgtgctcaagggggtggggtggagcaggattggagagttgatctatgaggtacgcttggtccatttcgttataggtccttttcatggagaaaaaatggtgattgaagtaatgagggtaggactttgggccgatcatggttgcgcggcttaa

SEQ ID NO: 14132 - DNA, 597 bp, A.fumigatus
cccggtttgggtgctgctggattatttaccggttcgatcctgattatcgcccagtccgtgccgctgcagaagcgtccaatctacaccggtgtgctgggtggtatgtatggcatttccagtgtggctgggcctctgatgggtggtgccttcaccgaccatgtcacctggagatggtgtttctatatcaacttgcctatcgggggggtgacctggctcttcgtccttttgtttttcaaggcgccaaaatcatacaaggataattcgggtctcaaggatcaggtgtcgcggctggacttgccaggtctttttgtctttctccctgctatcatcagcatgctactggcgctgcaatggggaggcaccaagtacaactggggcaatgcgcgtatcatcgctctgttcgtcgtgttcggcgttctgatcgtgatcttcgcggctcggcagcattgggcgcaggaaaatgcgacggtgcctcctcggatattgaagaaccgtaacgtctggggtgctgcattttatagcttctctgtatcggctgcgttcatgctgttcgtttactatgtacgtgtgcagattgactcgctggccctgatctag

SEQ ID NO: 14133 - DNA, 789 bp, A.fumigatus
cttccaatctggttccaagccatcaaagacgtctcggcgaccaaatctggtatcatgaacctgcccatgctgcttggaacagttctgatgtccctcgtctctgggttcctggtttcggcaatcggctactacacccccttcatgctgatctcttcggtgatcatgacgatcggggccggtctgctatcgacactgaaggtcgactccggccatcctgcttggatagggtaccaggccctgactgggattgggattggcgtcggacttcagcaagcaatgattgtggtgcagactgcggttcaggacacggatgtccccagcgcaacggccatcgtgatgttcacccaatctctcggaggcgcgctgttcgtttcagtcgggcagaacgtattccagaaccaactgttcaaaaacctggccatcgaggcgccgagtgtcaatgctgcacaagtcgcagggactggtgccactatgctgcgacacgttgtttccgaggatgtgctaccggcagtcctcgttgcctacagcaacgccatcaccgagtcgttctacgttgctgttgccatggcggcaatttcgatcatcggcgtccttccagtccagtggctctcccctgaagggaaagaagatcgaagcactccctgcttagacttgatcgctgcgcgcggatatagattgtttattgcatctaaacttattgctgaattgatgcaggcgttggcatggggtcgggacacatgcttacaaggcggctgtctatcgctgtcctttagatggcctgtcgcttag

SEQ ID NO: 14134 - DNA, 525 bp, A.fumigatus
cctcaatcatttcgcaaggacaatactattctggcgacggcaattcccaagattacagatcagttcaactctttggatgatgtgggttggtatggaagttcctacttgctgaccacttgctccctggtgcttccatacggcaagctttacacgttctactcgactaaatgggtctatctcactgcgatagcgatcttcgaaattggatctttgatctgtggtgtcgctcctaattctgtcgcgctgatcattggccgtgcggtagcccggtttgggtgctgctggattatttaccggttcgatcctgattatcgcccagtccgtgccgctgcagaagcgtccaatctacaccggtgtgctgggtggtatgtatggcatttccagtgtggctgggcctctgatgggtggtgccttcaccgaccatgtcacctggagatggtgtttctatatcaacttgcctatcgggggggtgacctggctcttcgtccttttgtttttcaaggcgccaaaatcatacaaggataa

SEQ ID NO: 14135 - DNA, 513 bp, A.fumigatus
caggtgacaggctctaacttcccctgcaaaggataccagaccaacactccctggcgcgcaaccgcacagtataccgcaggtcagacctacaacatgaccataacgggctccgcaacccatggcggtggctcttgccagctctctctgagctacgacaatggcaagacgttcaaagtcattcaatccatggagggcggatgtccacttgtgtccaagtataacttcaagatacctggagacgtcgccaacggccaagccctctttgcgtggacttggtataatttgatcggcaaccgggagttgtacatgaattgcgcagatgtggttatcagtggaggtactggcactccatcatcctttgagagtgcttatccggatctgttcgtcgcgaatgttggtaatggctgttccactgttgaaggacgggagacggtctttgccaacccaggtgatcaagtcatttatggcgggacagtcactccatcaagccctgcatttcccatttgccattga

SEQ ID NO: 14136 - DNA, 192 bp, A.fumigatus
ccatcgtatagaggctatcgcttcaagatgctgatcagctttaagtcccccttcagctgtaccgccctttataaatcgaatcagacaaaggcgagtgccagtcatgaatcgaaagcaaatggagataagtacgacaagtcattgggacaaaaccgaaataacgactccaggagttttatgagttccacctaa

SEQ ID NO: 14137 - DNA, 1338 bp, A.fumigatus
tctggaccgcccagacgtcatcctagtattttcggagctgcggccgctcccttttccacacgaaagctctatggactcgtcttgacagaactcaacatgactctagacgattttgaaaagtctctggtggaagatcaagagcggcgacgcgaacgaagcggcagggagaaacatcaacacagagatcgggaccgagatcgcagcaaagaacggtcaaggcatcatcgtcatcatcaccatcatcggcgccattcgtcgaggtctagagaacgagagccgggtcgccctcgtgagtcgcatgctgatgaggaaaacagtcatcgacacaagcgatctcgccattccaccgaccacagcgatgatcgggatcattcccacaagcggcgacacaggagggagagtaaagacaatgaatcggagtctacagctcccgtgaaggagatcgtccaggaggagccgaagcagttgaggcgggatgcctggatggaagcaccatccgcccttgacgttgattatattcaccggcgtgacactacacggttggaggaagaaccgaaagccaagatgctccaagcggacttcgagttgaagatacacgaccgagagctgaaccagcatctccgtgatttgaaggaagagaaagggctggctgaagtagaggaaaagccagtacagcatgaggtggattacactttcggcgatgctggctcgcagtggagaatgacaaagctccgaggcgtataccgggaggcagaggagagtggaaaacctgtggaagaagttgcaatcgaacgctttggggatctgcgctcgtttgatgatgcgcgtgaggaagaggcggagttggaccgtcgcacacgatatggcgagggttacgtgggcaaagaaaagccaacaggagacctcttccaggagaggaagcttgaacaaggggttcatagggaacctcttgaacaccatcgagatcctgaacagaagcttgcagctcgtggtcaaggccagaagatcgacacagctcctccctccggcgctactcagcatcttgatctgacggcgctcaaccgactcaaagcgcagatgatgaaggcaaagcttaaaggatcggctgaagcagcagagcttgaggagcgctacaatgctgcggccgcggcgatggccaatcgcaaggagtccgatgttgtagtgcttggagttatggagaaccgaatgcttgcaggacaaagaaatgaagccaaacccgttgagactaggagaggccgggaacgaggacagctggaggaaaatgaggatttgactattgaagacatggtccgagaagagcggcggacgcgggatcaa

SEQ ID NO: 14138 - DNA, 1197 bp, A.fumigatus
tgccactttactttaggctccgggaagacgaccttcatgcagagaataaacgcgtacctccattcgaagaagaagataccctacgtgctcaacctcgaccccgctgtatactcggtcccctttgagagcaatatcgacatccgtgactcgatcaactacaaagaagttatgaagcagtacaatctcggacccaacggcggtatcttgacatcattgaatctgttcgcgacaaaggtcgatcagattatatcattactggaaaagcgcaccgcacccaatcccgaaaacccatcagccaagcccatcgagcacattttggtcgatacgcccgggcaaattgaagtcttcgtttggagtgcatctgggagcatcttacttgagacgctagcctcttcgtttcctactgtcatcgcttatgttattgataccccgcgtacgacttccacaagtaccttcatgagcaacatgctttacgcttgcagtattctgtacaaaacaaaactgccaatgatccttgtattcaacaagacagacgttcaggatgcggagttcgcgaaagaatggatgaccgacttcgatgcattccagcaagcattgcgagacgaggaggagtctggtgcttttggaggggagggcagcaccgcgggcttcggggcaggcagcggatacatgggctcgcttctcaatagtatgagtctaatgctggaagagttctatcgtcacctgagtgtcgtgggtgtaagctcaatgacaggcgacggcatcgacgaattcttccaagcagtggaagagaagcgtcaggagtttgaacgggactacaagccagaattggaacgcaagaagaaggagcgcgaggaaaccaaggcagcccagcgcgagttggaactgggcaagctgatgaaggatatgagtgtgtctggatcttcgcggaagccgcgtcccgcgaacgaagcggagaccgtcagcgaagcagaggaggaggaagaagaggccgctgctgcagcaagcaaaggggatctggagttttcggagaacgatgatgataccgacgatgacgagggaggtgttcctccagctggcgacgaggcggggctgtcccagcgatacaaagaagctctttcagagtctcagggcggtccgaacgacgcagatttgagctttgcacggtacttacgttctagtaatatcaaccgatag

SEQ ID NO: 14139 - DNA, 567 bp, A.fumigatus
acctatcaaaggcaggtactgatggcatcttgtagtgtcggacagaatcctgctagacaatgtgcgcttggtgctgggcttgaagagtcgaccatttgtaccaccgtcaacaaggtttgcgcgtccgggttgaaggcgatcatactcggtgcccagactatcatgaccggaaatgctgacgtcgttgtggctggcggcacggaatcgatgtcaaacgcaccacactatctcccaaacctgcgtacaggtgctaaatacggccatcaaagtctggtggatggcatcatgaaggatggcttgactgacgcaggcaagcaggaactcatgggattacaagcggaggagtgcgcccaagatcatggttttagcagggaacaacaggatgaatatgctatccgcacctatgaaaaagctcaggcggctcagaaggctgggcttttcgacgaagagattgcccctatccagcttcctggatttaggggaaaaccagatgtgaccgtgacgcaagatgaagaaccgaagaatgtgagcacctccatcagacgcactatgttcatgtcagactga

SEQ ID NO: 14140 - DNA, 516 bp, A.fumigatus
ctcaacccggagaaacttcgagccatcaagcctgcgtttatacctggttctgggaccgtgacggcgcctaactcttctcctctcaacgacggcgctgctgctgttgtccttgtctcagaggctaagttaaaggagctcaatttgaagccggttgcgaagatccttggatggggagacgctgctcagcaacccagcaaattcacgactgctccagctcttgcaattccgaaagcgctcaaacatgctggtgtaggccaggatgccattgatgcttttgagatcaacgaggctttcagcgttgttgctcttgccaatatgaagttacttggcattcctgaggaaaaggttaaccttcatggtggagctgttgctatcggtcaccctatcggtgctagtggtgcgcgtattttgaccaccttgctcggtgttttgaaggccaagaaaggaaaacttggctgtgctggcatctgtaacggcggcggcggagctagtgctctggtggttgagctactttag

SEQ ID NO: 14141 - DNA, 1203 bp, A.fumigatus
  unsure (103): Identity of nucleotide sequences at the above locations are unknown.
gggacacgccagaaatggtcttggaaaatacggatcctggatggcaagttcaattcccggttcttgcacgacgatttcctcgggtaccggataccgggccatnttcttctcatactcccaggcatttggggaacgggggtcttgattgccacagctttcgttcacttgctacccacggcattcgtttctcttacggatccttgcctccctcgtttttggtcggagacctatcgtgcaatggctggatttgtagccatgatatcggtttttctggttgttgttgtagaaatgtttttcgctacgaaaggtgctggtcatgttcatgggagcgagtacgatcatttaattggcagtgttgggcggggttctagcgaatctgttcgtgatgacgcaaattatctgaggcttggccgtcatcactcgacggaaaacctgcgccttaatctcattcaagcaaatatttacgcggatggggcgcaggagcaatccagttcattgtcccggatgtcaacagatggtgttgaacaatcgcggtctaagaaaatggagccttacggtgaaactggcgacgctgaatttggaggtatcgattctctggacaatcacagtcattctccggtctctgactcgcatcctcgctacctgccatcccagcagcgtgatttgcatccaaaatcgagtcctgtgttaccaatgcaaagcccgcagcgtcagttgctgcaatgtcttctcctcgaggctggtatcctcttccacagtatctttatcggtatggccctcagcgtcgccactggtacgtcatttgttgttcttcttgtggctatctgcttccaccaaactttcgaagggttcgcccttggatcgcgtattgcatccttgataccagaccttttttcaccgtcgtcgccgaagccctggcttatgtcgcttgcctacggaactacaacacctgttggacaagctatcggcttagttttgcacaatctttatgaccctgcaagcaccacgggcctgctcatggttggcatcaccaatgcagtcagcagcgggttattactttttgctggacttgtggaactcttagcggaggactttctaagtgagtctagctacgcgacactcaggggtcggcggcgtattgaggcctgtatagccgtcgcgagcggggctctgctgatggcatttgttggcgcctttgcctaa

SEQ ID NO: 14142 - DNA, 186 bp, A.fumigatus
ctcaaccaccagagcactagctccgccgccgccgttacagatgccagcacagccaagttttcctttcttggccttcaaaacaccgagcaaggtggtcaaaatacgcgcaccactagcaccgatagggtgaccgatagcaacagctccaccatgaaggttaaccttttcctcaggaatgccaagtaa

SEQ ID NO: 14143 - DNA, 420 bp, A.fumigatus
ggttgcattgccccctttccctcatcatccaagagcgacaagaccgtcgatgaaagccatgagaaagcggaagaccattcaatttccgcctaccaggcccatgtactgtatgtttccgcaacgcaggtggggaacatacggatcggcgcaagcattctacatcccgataacgtcctagttactacacgatcgggcagcaatcacagtagcatttatatcaatgcgaagcctcatccatactacactttgggtgatgtaaagttcgagcgagaaaacacggttcatggggctattcagggatcgataggtgttttttccagtatcgctcaagtgggaccaagacaactactaccttaccagcaagagatatcctttcaagatggccagtgtttatggcactcagcaaaacggacagggtga

SEQ ID NO: 14144 - DNA, 225 bp, A.fumigatus
  unsure (188),(213),(219): Identity of nucleotide sequences at the above locations are unknown.
cgggggccaactatgcaagtggactctccaggtcgagcagaaggtgagccagatccagtatcggatcggacaggagaaagagaggctcggagatggggaaggacaagatcaggatgcctgaactgtcggaagaagcggaggaagtgcgatgagggaaaaccaacgtgcctgttttccaccacggaagnagccaaggatccaaagcgatccgtntgcggncgcaat

SEQ ID NO: 14145 - DNA, 714 bp, A.fumigatus
ggcgcaaggtgcaacagacaatgtcaccccaagcaccggcccaaacgggtaccgttccttcgccacgtattttttggagtcattgctgctaacagtaaaacatctagctccgaagactggctcaacaccggcatcaccaccaccggctggaagcctcccttcctctccatcgacgacgtctacaccatcagccttcaagacttctacaacggcattggttccgcctgcgcccagtacgacagctacttccaaagcagcgcatccaagtacggtgtcaacccggtcattctcgccgtcatcgctatgcaggagtcctcctgcaatgccaacgcgggaggtcccacaccgggcttgatgcaggtctcgtgcgacaactacccgaatggccagtgcacggatagcatccaggataatgtggacgcgggcacgcactatctcaagtcgcagcttgatgcgtccgggggtaatgcgatcaaggcgctgggtgcatacaatggctggtttacggcagggtccgggcttaatgggaacagagggctgacgaaggactacccctgctcggctgagggtaaggcgcatggtatgccacagaacctggactacttgcaccaagtgctgaatgggtggatgatgggattggatgtttatggaaaggataactggattggtacttatcactgtgatcagtcgtgcagtgatggcagtttatgctag

SEQ ID NO: 14146 - DNA, 318 bp, A.fumigatus
gtgttttttccagtatcgctcaagtgggaccaagacaactactaccttaccagcaagagatatcctttcaagatggccagtgtttatggcactcagcaaaacggacagggtgaggttggcaagcagcattgctatgctatcgggagtattaaaagtaacagactggtgatttgtctggccgataggctccgcacaatccaagaaaagtacggagttaagaagcgctacatctgcaatgggagaggcttaagccaatatcctggtcagttaaagggggatatatttgttaactgttactcgctggaagatccagggtaa

SEQ ID NO: 14147 - DNA, 480 bp, A.fumigatus
atcacaccccaaaaaaccgcaagagaaataatggcggtctttaagagcatcaccctgacttccctggccctcgctattggcgccaccgctcagtccgccaacccaggtgtcggcaaaaaccctaaggcgcaaggtgcaacagacaatgtcaccccaagcaccggcccaaacgggtaccgttccttcgccacgtattttttggagtcattgctgctaacagtaaaacatctagctccgaagactggctcaacaccggcatcaccaccaccggctggaagcctcccttcctctccatcgacgacgtctacaccatcagccttcaagacttctacaacggcattggttccgcctgcgcccagtacgacagctacttccaaagcagcgcatccaagtacggtgtcaacccggtcattctcgccgtcatcgctatgcaggagtcctcctgcaatgccaacgcgggaggtcccacaccgggcttga

SEQ ID NO: 14148 - DNA, 198 bp, A.fumigatus
gtctctcagcgcagaatcattccaatgcagcacaaggacatatccaacgcaaccaagtcagaacaatctgtggatataaagcaaaggcagggcgtcgaaacattgtcaactatgatagagtacatatacaccttcttctatcagcaacataccgggtggctctatgattttgagcccattggtagcttttcattttga

SEQ ID NO: 14149 - DNA, 1035 bp, A.fumigatus
cagctgcaattctgctatcatctttgcccagacgcccacatgctctcaaacaaactagctatcgccagcttatctctgggtcaacacccttcgcatcacctggaccacaaaatccaggctgcggcagaagccggatacaaaggcattgaaattgtctatttcgaattggaagcattctctcaagctcaacacatttcgattctcgagggcgctgagaagatccgcttgatatgccaaaagctcaacttggatattctctctttggcgccattcgagaattacgaaggggacagatcgcctcttagtgacagattgcagaacgccagacactggattagcgtcgctagagtcctcaacgcctcatatttgcaggttccttcaaattacaaactagacgcgatcggtgacaaggacgtggtcatcagtgagctaaagcagttggctgatatcggaagtgcagagcagcccgttgtatcgatcgcatatgagtatttgtcctggggaacacactgttccacatgggaggtcgctttgcaatatgtcaacggagtcgatcgaccaaactttgggttatgtctagatacgttccatgaagctacgaagctatgggctgaccctttcgcctcgtcggggcgcttccctgactctgatagatcccttcgtgaatcactcaatcgctttgtttctacctgtcccgtggagaagatattctttatccagctatctgatggcgaaaggttcgatcctgccttctccaaaggtcacccgtggtatgtccaaggggaggcgccgcaatttacttggtccaaacatgcacgactatttcctttggagcatgatcatggtgcctatctacctattaccgagattgccgaagcttggatacacggggtaggcttcaaaggctgggtatcgatggaaatcttcgaccgccgcatgagggataggcgcactcaaccagagactgccgcaatgaggggactaagatcatggaggactctaagaagagagctcgagcctgtatcaaaagtttag

SEQ ID NO: 14150 - DNA, 291 bp, A.fumigatus
  unsure (148): Identity of nucleotide sequences at the above locations are unknown.
agctgctgccccaccgacgaaccccacacaacgcatcaaaacctccccttgctccgacccgcccccctggactaccctattcataatagaccggggaccaacccttcgtttttgcttttacagccctccccccctgctgcccccacgncgaaactacctctctccacccccacccccccacccccccttcctagctcccctcgtgccgcccccagccttaccccccgaaaattagcttctttgtggccccttcaaaaaacctgccccccccccttccccccctccaacttt

SEQ ID NO: 14151 - DNA, 1719 bp, A.fumigatus
ggtacaggggctgatttggacatctacaatagcttaaccccgacaccaatgctttccagcggacttttaccaaggagattcgtcggttggataacgtggagagacaactgcgtatgtataatgtcctgtggttggaggatcaatgcattgcgaggctcttgctggttgtggtggtggtggcatcgggttgacattcatgatcttttggcaggctatttccaagcgcagatggacaaggcggggattcccatgagatcttctaccgagttctccgatacgttggcggctcctctggcttcggaaattgacgaactcgccgagcgaagtgagagcctcgagcagagaatcgcctctctgaacgatagctacgagacactgaagaagcgcgaggttgagcttacggagtggcggtgggttctcagagaggccggcggcttctttgatcgcgctcatacgcatacggacgagatccgacagtcgttcgataatgacgaagctccgctactgcgggatgttgaacaccaacctagccgtggaccgaatggtgatgcccaggctcaccagtcgttccttgagatgaacattgggttcgttgcgggtgttattccccgggatcgtattggtgcttttgagcggatactttggcgaactttgcgcggtaacctctacatgaaccagtcggagattcccgagccgatcattgacccgactactaatgaggaatcgcacaaaaacgtatttgtgatcttcgctcacggaaagcacatcatttcgaaaatcaggaagatttccgaatcccttggggcttcgttgtatggtgttgatgagaacagcgagttgagaagggatcagattcatgaagtgaacacccggctgagtgatgtcggcaatgttttgcgcaacaccaagaacaccctggatgcagagcttacccagattgcccgctccctggcggcttggatgattattgtcaagaaggagaaggccgtgtacgatacgctcaacaagttctcctatgaccaagcgagaaagacattaattgccgaggcatggtgcccgaccaactctctggcgttgatcaagtctaccctgcaagacgtgaatgaccgcgctggactgagcgtgcctaccattgtcaaccagattcggacgaacaagaccccgcctacctatgttaagacgaacaagtttaccgaggccttccagaccattgtcaatgcttacggtatccctaagtactcagaagcaaatcctggattgtacacggtcgtcacattccctttcttatttgctgtcatgtttggtgattttggccatggtgctttgatggcaatggccgcttctgctatgatcttctgggaacgaaagttgcagaagacgaagctcgacgagttgacctacatggcattctatggtcgttacattatgttgatgatgggccttttctctatgtacaccggcttgatctacaacgatgtcttctccaagtctttcactgtcttccctagtcagtggaaatggcctgacagcatcaagaagggacagacagttgaagcttcgttgacgaatagctaccgttacccgttcggtctggattggaactggcacgaggctgagaactctcttctttttaccaacagtatgaagatgaagatgagtattattctgggttgggcacatgtaagtgatattctgctgcttgtcaaatggcctggctga

SEQ ID NO: 14152 - DNA, 207 bp, A.fumigatus
tcgtccctgtggtggaaggaacctgctgcaggcagcgacgctttcaccatggctccgagggacaccttcttccgctcgtctgatatgagcttgacgcagctctatatcgccaatgaaatcggacgagaggttgttagtgctctaggagaacttggccaggtccaatttcgggatgtaagttgtactgtacctgcacgaggtgggtga

SEQ ID NO: 14153 - DNA, 498 bp, A.fumigatus
atgacatatgcgctctgcttgcagtatgtcaatgcgcggcatttcaagtccaaggtcgacattattggaaatttcatacccggcatgatcttcttccagtcaatctttggttaccttgttctcacaatcatctacaaatggtctgtcaactgggaagcccggggccagtctcctccgggtcttctgaacatgctcattttcatgttcctttctcctggaactgtggaagagcaactgtacaagggccaagctggggtccaagttgtgctactgttgctcgctgttgttcaagtcccaattatgctcttcttcaagccattctaccttcgctgggaacacaaccgtgctcgtgccctgggataccgaggccttggagagcacgcccgtgtgagtgcgctcgaggatgacaccgatatgaacggtggagtctcacggccccgtgacagcatggccagcgacggtgaaggcgtggcaatgattgcccaggatctcggcgat

SEQ ID NO: 14154 - DNA, 3051 bp, A.fumigatus
tctaccatagcttttccgctcaaatctattctcaaaccgacaattcctgtctctcccgttcgaaacattccatctttcgaagaaacgcgcaaacacactccagcgcgcggcgcacaacaggacggtgtccatggcgataataaagataaagggaaaggagatttattggtagacattgagactcccgcgcagccgtcagcgtctggcccagaggatccagccaatccattcgatagcttcaatgcgtcatctgcgatcgccgccgcaagagaacaggaggagaaggagaggagagagcgcgagcgtcagattattctggaaaagagagaagcgcgccgaaaatcaatgggtaagtcagcgtcttcttcggaaatcataccgttggctaaaacttgtctgcgtaaagcgaaccgccgcgtttctttcgctccggaggcaacactacacacgtggaacgtagtcgaaattcctgatgattcgacttcctcatcggcttctaactccacccggcgtgcttcgtccctcgctgagaaccaagcgccgacaccagcggccattcagagagaacccccgtccacacctgacactgtagcggaatcagacattgcattttctccggtggagtatccggacctgcaagagctcaggaatcgttcgttttcagcgtatgatgaacacgcaacttcgcaagatctgtcgtctagtccattcagcggagggtctgcagatggcttggaggatactagccttcaagacgttccaagggaaggtgacgatgacgatgatgacgacaattcctcaggctccggatttgatggggagagtacggcgatgagtatggacaacatgactgttcattcaactgcgagtgcccgttcagatcggtcgagctctagtaccagttccagcgcccgcctgaacgaggccctacgccaagcagctaaagaagctggaacgagaggcattgactacgatgaggatggggagatgtcaatggaaatcgctgaccaagaaatcactggcgctttccagccatggatcaaaaagggccaaaggcaaagttttgaatgggaggatattagcgctttgcatgaccaagagaatatcaacccatcgcacaactcaatccagtcatcgactgttcccaatgattccgcggatatcgcagacgatgacctcagcatggaggtaactaacgcaattgggcgtatcatccagccaagtcgtcgccagagcaccgtccggcgcaagtcaatgagcgaagagacaaactatgatgagcaaacaatggaattcacgaatgtgattggtggcattaaacaatctgcatctcccaccaggtccgcaggtggcgaaagtaatgctagcgacgaggagatgacaatggaattcacctctgttgtagggggtgttctcaacaaaccgtttcagactcagcattctgaggaagcaaataccggtgggtggaacgatgaggatgatggtggcagcatggaaggcgaggcagacatggagatgacaggggcagttggcggcattctttcagcaaccgggactcgagatgggcaggacgaagaccagacagttggaatggagcttacaactgccatgggacgaattttgccagcgactgtcgaccaaaaccaggaaaggagggacgcgaattctgagtcagagaatgaacaaccccaaagctctcccttccaggagaatgtccgacaatctccttcaaaatcgccagtttctttccacctggctgctattgcctctgaaagtggaagccccagtttagccagtgtccgacctcgatcaactaggcaaagcctgagccgtcggatgtcgaacacgccgtcggcacactcgccacaccaatcaccagtgaagaatacattgacttcgccaaaggactcaacaccccaagccagtcaatccatgacgcccagcaagactcctttgagcatgacaaataaccgaagtgcatcgccgaggaagctttttcagtctgagacccacctttctgccagcaaggataaatcccttggccgcaagagtctctttggatctactgcggtgaccggtgaagccgtcccccttttcgtactacgccctcacgagaaacggcgttcatccggtcttggaatcgacaaagagggtctaggctcgcctcgcgtggctgctatgcttgataagagacgatcaatcggagaggacgctccacgcttcgttcctcaagagcagccaaaatcgggtgtgcgctttgaagatcctctgaaactccaagaagaagtcgacatggagcgtgaagaagaggagaagcgggaagacggtcatattcccccattgcagttggatcctactgcgaatctaaaggatatgatttcgagcctcacaccaaagaagaacaagctccgtggccgcaagagtttacacgtgggtgctgcccggggtttattgggcaagcgacccgtagagctagatcaggatgatgaagaggaggccgataatactcctaagcgcttgaagggccgcaacgccagcccagtgaagagcatcaaacttccggcaccgccgacaaaggatgagacggtcggacatttgaagcgctcacccactcgtagatctgttgttgcaccacccattgaaggtagcacgaccccaagtcaggagccaaagaccagctccttgtcgcttactccggcgaaagacgtatccgagtctttcaactccagtacagaatcaacatcaactgaagagggcaatgtcgctccgcaagatagcgagcccgaatttgaacctattcagctacaggatttcttgaacatgactaacatccatttcatggagctgactacaaccaaacgaaggcatactacagcccctgggagtgtgagtaagaggacggctaggctctctgctgagtccaaggccgccacagccagttttgaagattgtgtcgctgccggtttctgtactgtgcccatgcttgagttgtatcagcatgtaagctgtctgctttccgttcgacctagatgtttgctgaccccttcctag

SEQ ID NO: 14155 - DNA, 702 bp, A.fumigatus
tcgtgccgcgagttgaaatcctacatctctgaaggccgacaggtgattcgatccattgaagccgagacatacgctgagaacccgccactcttccgagaatatgccactgctccgccagacatccggctgttgatggacaaccagttccggaatgtcaagacccatgctagattacagagcaaagccacatggtacgaatggcgtatgaagcttcttgaaggtctgaaagaaggcctctaccggcatgttgatgagatgaaggcggatggagatctattgacaaaatatgagaccttgctcgatggcatagtacctgctcttgtcgagaaacaatcagcgctgcaagaggaagccgcgaacttacagcaacttacggacgagatggagagttgcgaccaggatgaactgcgaaatgcgcgggagaagctctccagcttagaggatgagatagagttgaagaagaagcaactgcaggagcttcaaggccaggtgcaagagaagactaacagtcttgagtcgggagcggaactcaaagctgagttcttggcgcagatcaaggaagctgaaagggtaaaagaggagtgccatggctggagcgcaaaggaaatcagtgaattgacgggtaagattactcggtcacttgaatattatgcatgctcgacgattgctcacaatctcgatagaatccgttcggaaaactga

SEQ ID NO: 14156 - DNA, 210 bp, A.fumigatus
  unsure (146),(196): Identity of nucleotide sequences at the above locations are unknown.
cgagaaagacagcccgcatctttgagtgaaataccacccaggaaacggcgccaagtcgacggtacgagcgccgcagctgtctcctatcgccttgctaagtctcaaatctcttcagaggcacctcaaaacctagagcacaagacggnccctattagctccaagcaattcttgcgcttcatctcaatgcctggaactncgggctcagcctaa

SEQ ID NO: 14157 - DNA, 213 bp, A.fumigatus
gacacgaggtgcatagctgcactaaagctcgctgcctttggtattgattctcagtggctgacaggcttcccaagccctggattccgcaacaccctggcggcccatcccgctgacaatagcctagggcccaagccatctgggtttcatgattcgcgcattagaacctgccattcgtgttcaagaacagatgctttctctagcatgcgctgctga

SEQ ID NO: 14158 - DNA, 1620 bp, A.fumigatus
atgatctcaacagccatgacagagcaacacaagaaaggaagtctggacgaaagtagtggtggtcaccaagacacacagactacgatggattccccgagaaaagataccatccagaacgacaaagtctccacgcagccaaaaaggaccctctttgttcggtcgcttcccacctcagctacgaccgagagccttaccgaatacttctcccaatcctacgttatcaagcatgcgatcgtcgttaatgatccggaaacgaagctgtgcaagggttatggtttcgttacctttgccgatctcgaagacgcgcaagctgcgctaaaggagttcaacgggtctgtcttcgaagggaaaacaatcagagtcgactacgctcagccgcgtcaccgtgagattgatgagaacctcgggaaaagcgtgccggctcctgctgcccttgaacttaagaaacagcggcaacaacagaaaacatctacccaacccccgaagctcattgtccgaaacttgccttggagcatcaaggaaccagaagatctagcggtacatttcagaagtttcggcaaagtcaaatatgtcacgcttcccaagaaaggtgataagctggccgggtttggcttcgttgttttacgaggaaagaagaacgctgaaaaggcgctgcaggccgtcaacggcaaagaggtagacggaagaacgctggcagtcgattgggctgtagaaaaggaagtatgggagaacttgaagaaggagtctgagaagaaggaggatacccaggaggaggctggatcgagcgacgttgagatggcagatgacgcagaaacgacatccgataatgaaggcgtcgagtctgatgacgacgatgaagatgaggatatggacgatgacgacgaggaggatgaggaagatatggatgaagaggaggacgaggacgagggcaacgaagacgaaagacaagagaaagaagacgagcgaaatgcttgtacgattttcattcgaaatctacccttctcgtgtacagacgaggcgctttacgagcattttacgcaatttggccccttgcgatacgcacgaattgtcgttgacccggagacagaacgtccccgtggtaccgggtttgtttgcttctggaaggttgaggatgccgcattgtgcgtgcgcgaagccccgaaacaacaagatactttgatcgcggagaaggataaaggaaagaagtcttccaccgcactcaagcactctatcctgcagaatgagaactctgaccccagcggccgctataccttggacggtcgtgtcctccaggtcgcccgcgccgtcagcaaatcacaagctgccaaacttgaagaggagggtgtatcaaaacgactggttcgtgatactgacaagcgtcgtcttttcctcttgcaagaaggcactatctctcccaactcccctttgtaccataagctttcgccgtccgagatcaagatgagagaggacagcttcaagcagcgacagaacttcatccggaagaacccggctctacattttagtttgacccgactctcggtacgcaacatcccccgtcacgtcacctctaaggacctcaagcagctcgctcgacaggctgtggtcggcttcgcgaaagac

SEQ ID NO: 14159 - DNA, 201 bp, A.fumigatus
tcagagtattcatcaatcaactattcaacctccgttttcccgaagtctcgcaagggctgcgctaatgccttcactcatttcctcttgattggattgccgtggagtgtcgacttctggggctccttttttcgcatccaccccactcctctgtcccgcttccgaaaggtacaaggctgcttcatcttcgtcagccgtatttga

SEQ ID NO: 14160 - DNA, 642 bp, A.fumigatus
agcgcctcgtctgtacacgagaagggtagatttcgaatgaaaatcgtacaagcatttcgctcgtcttctttctcttgtctttcgtcttcgttgccctcgtcctcgtcctcctcttcatccatatcttcctcatcctcctcgtcgtcatcgtccatatcctcatcttcatcgtcgtcatcagactcgacgccttcattatcggatgtcgtttctgcgtcatctgccatctcaacgtcgctcgatccagcctcctcctgggtatcctccttcttctcagactccttcttcaagttctcccatacttccttttctacagcccaatcgactgccagcgttcttccgtctacctctttgccgttgacggcctgcagcgccttttcagcgttcttctttcctcgtaaaacaacgaagccaaacccggccagcttatcacctttcttgggaagcgtgacatatttgactttgccgaaacttctgaaatgtaccgctagatcttctggttccttgatgctccaaggcaagtttcggacaatgagcttcgggggttgggtagatgttttctgttgttgccgctgtttcttaagttcaagggcagcaggagccggcacgcttttcccgaggttctcatcaatctcacggtga

SEQ ID NO: 14161 - DNA, 1059 bp, A.fumigatus
cagcactatcgaagtcttgaggattgtgcaaaaatggctaaggacatcgatactaataacgccgatccagaccatggccttcctgaaaggagcgccacccctcgggctgcagggggcactccgaattcagctactgctcaatccacggcccccaaggttcaacaaccaaaaccacaggcacttgccaaccgaaccggtccctccgcgattcttgtttcgaccaggcaaaagggcaatccaatactgaaccacatcaaattgttgccctgggagtatgcagatatacccgccgactatgtcgttggagcgaccacatgtgcgctgttcttatcgttgaaataccaccggttacaccctgaatacatatactctcggataaaggctcttggggggaaatacatgctccggattattttggtaatggtcgatatcgaaaatcacgaagatagtttgaaggaactctcaaagacctcgatcatcaataattacactctgatgctctgctggtcggctccggaagcagctcactatctcgaactatataagtcgtccgaaaacgctcaaccgaccgcgatccgcacccagcaagcccagtcttacaaggagtctctggtggagtttgttacaactcctagaagtatcaacaaatctgatgcagcgagtctgatatccacgttcgggagtctacaaaacgctatcaacgcccagccggaacagatcagtgccgtgcccggctggggcgaaaagaaagtacgtcaatggaccaatgcagtaagggaagactttcgggtggaaaatgcgaagaaagcgaaggcacctgagaggaacattgagcatgaccaaaatccttcaggcctcggcattgtgagccagacagggccctcaaatacggctgacgaagatgaagcagccttgtacctttcggaagcgggacagaggagtggggtggatgcgaaaaaaggagccccagaagtcgacactccacggcaatccaatcaagaggaaatgagtgaaggcattagcgcagcccttgcgagacttcgggaaaacggaggttga

SEQ ID NO: 14162 - DNA, 771 bp, A.fumigatus
ccatctatactaagggttactattgtcgatccttctgttggacacgtcgtctctacgatttctgccgaaaatgtctttgagctggggttctcccccttgggaacctacctgatcacttggcagcgaccctccaaggacgccaacggagacgccgtcaagaacctcaaggtctggaaggtgattgaaacatcgcctgagagcaacggagacgagcatacggttgtgggcagcttcgttcagaagtcgcagacaggttggaacctccaatacacgttcgatgagagcctgtgtgctcgcgtcgtcaccaacgaggttcaatttttccagagcgacaacctgtcaaaggtctggaacaagctgcgtgtggagggtgtgtctgactttgccctctcccccggcaagaacaactcgattgctgtctttatccctgagcgcaaggttggtttccttttttttcgttttgatcgtggatctttcacaaagatttacagccgacttacttggttctttgcgtccagggtcaaccagcagcggtcaaggtgttcaacgtgcctcagttcggagcgcccatctcccagaagagctttttcaagggtgacaaggtccagctcaagtggaacagcaatggaacgactctgctggtgcttgcgcagaccgaggtcgatcgcagcggcaagagttactacggagaaacaactctgtacctgcttagcgccaatggtggctttgattcgcgtgtggaccttggtaagtctttccggtgtgtcttag

SEQ ID NO: 14163 - DNA, 825 bp, A.fumigatus
cgagtattactgtgctacagaggcacaccaaactcaggaacaacctccctctctgcactgtccaccaccgctatcaaagacggccatcagggccagcctctaccacacaggcgccatgctcaccactcatcttctgcttcggcgacctcgacatctaccttggaggccgagcgagccgatcgcatctcccgtctcgccgggctggaacgtgtcgcgaccgcccgagcaggaggcgttcctcagtcgaatctcatgttcgcgacggcgcacggccctggctactttgacggcggatccggtttcaaagaaagaagcaccgtgggcagtgccagcgccaccggtagcgtgggtgctcgtactacctgggcaagcggtagcgatgcgctcgatgcggacaagatgagcgaagacacgaacgacgacgacgaaacctctagcgtgggaaatatcagtgaaggggacgcgagcctggttgcatttggagagggcgccagtacaatcagtggcccgatttcgcaccccactctcaaccgaatgtcgtcggggggtcgtccgagttcgctgggagctggaagtcctaacatgagccgagcgaatcccctcacatcgtatcaacctggagttgaagattctgccgccgtgtcctcctcgctatctcctgcgggatcgaatatgccggaacagatgcatgacgctcgcatgctggatggggtaacctatgacagtgatgtggtcgacacgactgtgagaaccccgcgggctgggccaccccatccagccatggccagtctgccaaccggaacgatgactcgggagggcaattga

SEQ ID NO: 14164 - DNA, 219 bp, A.fumigatus
ctccaccgtacagacaaggaaggtccgattcacgatgtgtcctggaatcccaactccaaggaatttggcgttgtgtatggatatatgccagcgaaaaccaccatcttcaacttccggggagtggccaagcacagtttccctctggcacctcgcaacaccatcctgttctctccccatggacgtttcgtgttggtcgctgtcttcaccactgggaactag

SEQ ID NO: 14165 - DNA, 573 bp, A.fumigatus
tcgtggatctttcacaaagatttacagccgacttacttggttctttgcgtccagggtcaaccagcagcggtcaaggtgttcaacgtgcctcagttcggagcgcccatctcccagaagagctttttcaagggtgacaaggtccagctcaagtggaacagcaatggaacgactctgctggtgcttgcgcagaccgaggtcgatcgcagcggcaagagttactacggagaaacaactctgtacctgcttagcgccaatggtggctttgattcgcgtgtggaccttggtaagtctttccggtgtgtcttagcccatcgtacatttgctgactccaccgtacagacaaggaaggtccgattcacgatgtgtcctggaatcccaactccaaggaatttggcgttgtgtatggatatatgccagcgaaaaccaccatcttcaacttccggggagtggccaagcacagtttccctctggcacctcgcaacaccatcctgttctctccccatggacgtttcgtgttggtcgctgtcttcaccactgggaactaggacgatcccgcgagcattaatccccccc

SEQ ID NO: 14166 - DNA, 498 bp, A.fumigatus
tctctagtaatcagtgcatctatctgcagcctttctttgagaatgactcgagcctggcgatacgcccgcggcatttttgtgtctcgtgacaatttaaaaatccattcctgcccgcccgtgaggtcgtgctttcgccttcaaccaagttctcgatcgccacctttctcgaacactaatcgcagaacaatgtcttcatcttctttgagagtgcctcatgccctacggtcgtttccaagctctggctttgagttgattgatcactctgaaaagattgaagaggagacactacctacttaccacgccgaaaagtactatccggttcacattggggaggtgttgaacaaccaatatcaggtgcttgcgaagctaggatacggcgtcacatccacagtttggctttgtcgtgacctgaggtacactgaagcaaacctgcttttgagaaatctgactaattatgtgtcaaaaaaaaaagcagtgaatccaaatatgtggtattaa

SEQ ID NO: 14167 - DNA, 384 bp, A.fumigatus
ttatgtgtcaaaaaaaaaagcagtgaatccaaatatgtggtattaaaggttaatgtctctggtgtagagaggaaccatgaaattagtgtatacgaccgcataaatttagtggaaacaaaccatctgggcaaatccttcatccgcaagttattgggacacttccacatcgaaggtcctcacggccgtcatatctgcctcgtccaccaaccttttgggcccagtctggaccaatttctgtcttttttccccgaacgagtcctgagtctcgaagatctaaagccatgtctcaggcaaatcctagggattctagatttcctccacaccgacgctcatatcatacatacaagtgagatttctgtgccgaagaacagtcactgtttttga

SEQ ID NO: 14168 - DNA, 360 bp, A.fumigatus
ttttgtgaagatcttcaattgaagaacctgttgcttcctgcagatgacccacaaatattttcagccattgaagaggcagaaatcgaagagccatcacctagagaagtacttgatgacagtcggacaatatacttgagccgactacttcttccaagcaatggattaccactgctcagtgattttggtgaagcccgatttggtgatgaggaacataatgaagatattatgccaaacgtatatagggcgccagaggttgttctaaaaatgaattgggattacaaagttgacatctggaatgttgccatgatggtaagaaaacagacttgcttgactctcaaatttatctgtgtgctacactaa

SEQ ID NO: 14169 - DNA, 210 bp, A.fumigatus
  unsure (155): Identity of nucleotide sequences at the above locations are unknown.
aggaacgcttcaatactgaaggagatgtcgacttccttgctggtgatgagtactacgatgttcatgctgtggccagtctttttaaacaatatttacgggagctcccaacaactgttcttacacgtgaactacatttggattttttacgtgttctncgtgcgtgccgctgctttccctcgtttctccacttgttccaaggcactatactga

SEQ ID NO: 14170 - DNA, 3018 bp, A.fumigatus
  unsure (88),(170),(2259): Identity of nucleotide sequences at the above locations are unknown.
caaggaatgggcgctcttaaggttactggagaagaaccaccacaaacatgcgatcccagtcatcttttgggcaaaacccctaccgggngactgaccgccggggtatctaaggacctgtggcaacccatttcgtcgtcctctccaattgaacgtcaggattctctaaattntgcacaaaaccctcagaaaattcatgcaccatctttgaacgatcaatctgcattcgcagtccccaaaagtccgggactgcttctcagcccaagaccagaagaccgccctataggctctcccttgccccggatgcccagggaagtgccgaactccctggcacatctgccgatgtcttcagagaatagcctcgcaggcttggccctctccccgcgccctactaaccatccgaatccctctgctaccggagcctctaagcctaacgatactagtccttcgcatattgatgctcacaggcatattgccacaatcaaccatggcccgagaaaggacactcctcggtcacattggtctcctgcccgcgagatatatcaaggcttgatgtcggaggattaccccggtcttcttttgcctccgaacgcccttcctttgatacgagtgaaagtctcttcgtcgcgacttaggccttctagaaacagctatctggcaccaaagccttccgaagaagagccggtattcaccctgggtgttttttcgcggtcagaaaacttggaactttggcgcgtagagaaggtcgtcgcggccctcccgcagctggatcaacagataagacaatcgtctgctttgtggatgaaactgccagatagatcgatcttcagcggccattcccccgcgaaaattgatgcgagacgtgcggccttgaattcctacttcgaagctctacttgatacacccgtagacgagagagcggcattagcgatctgtcaatttcttactatggatgcaatcgagccgcgagatgacgagtcaagtttgctgaagggcaactgtaaagcggcatcggaagttttgccaggtcaagatagaaaacctcaaaaggagggttatttggcaaaaaggggcaagaattttggcggctggaaaacacgatacttcatactttatgggcctgagttgaagtattttgaatcgccaggcggtcctcacctcggaacaatcaagattttcaatgctcagatcggcaagcaatctcagcccgcaaataacacaaacaaccctttgtccgggcccgaagatgactctgaaaaccaataccgacacgcttttctcatattggaaccgaaaagaaaagactcatcagcgctcgtgaggcatgtgctctgtgccgagagcgatgaagaaagggatgcttgggtcgaagcactcctggcttttgttgatgggcaatcggataatgagggcacagagaacgcgtcgccgcagagtcaagtttcaacccaggcaaggcatctctctcagtcaacctcaaaacctaaactttttgcgggtgggagcaaaaagagcggcaaggggatgaacaacgcggacgcggacctgactgatactgtgcaagggttcagttatgatgatgctgttcctgctgaaccgccccttctgggtcctccatccgaaaaacaaccaccgaggtcccctatgtcccctttagaggcagcaatggaaccttcggacacgaacccggcttcggaccatgttcagctctcatctaaagtgatatctggacctaccaacggtacagtgatccaggatgcaggggcctggggcaataaaaccgtcactactaccaaggagaagaagcgcagcatctggggtttccgcacaaggtcatcgtatgatcttgcctcgcagctacaggcgagccaagaaccttcgtcagctcaagctgtcgtgaatccttctacagaaagaaaagacctcgttaggcctgtattcggaataccactggcagaggctgtgcagcactgcgccccgcatggtatcgacgtcgatttaccagctgttgtctatcgctgcattgagtatctcaaagcgaagggagcagcaacagaggaaggtatatttcgattaagcggttccaatgtggtcgtcaaagcgttgaaggaacgcttcaatactgaaggagatgtcgacttccttgctggtgatgagtactacgatgttcatgctgtggccagtctttttaaacaatatttacgggagctcccaacaactgttcttacacgtgaactacatttggattttttacgtgttctncgtgcgtgccgctgctttccctcgtttctccacttgttccaaggcactatactgatgaactcctatttagaattggatgagcgacagaagaaaatcctggcgtttaattcacttgtccacaggctcccgcgaccaaatctggccctattacgggcactagttcaatttttgatcatcattatcaacaactccgatgtgaacaaaatgacaatcagaaatgtcggcattgtcttcgcaccaacgcttaacattccagcccctgtattctccatgttcctcacggacttcgagagcatatttgataagatgccagaaggttgctcagaaccagtcaagcttaaagttgatcgtccggcgcttccggaagacattcgctctccgcgccatcagatgttctcagatttgcccacgcctgcttatagccaaacaacctttcgcagaccgacagaagtggttgatgattcacgccatgacacagggtttatttcaattcagccaacttatgagcaatcctctcataacctagtggaacattacaaccagcagccggattccgcagctatgaatagaatgttgatgcctagcgttgatagttcccgatctgctaaggccaagagaagggagagttctatgctgttcatggaatacaaccaccaagactcaggtctcccagctatgcgcaatgatcagagtaagagtccgccgattacgcccgaactcagtcatcgtttgcaaactgacctgagagaatccaggtga

SEQ ID NO: 14171 - DNA, 516 bp, A.fumigatus
agaccgttcttcctctccatcttcagtatcggctcacacatcgtgtacgcgagcaatttgcgacgtttcccaatcgtcaaactctctgatccattatttatcttatcatgtgtgctcgtcggcttaaatcactggctctggttccgccatttttcgaaaccgttaccctcatcacgagtgggtgccaactggcgtcagccgtaccaggttgatatcgaagatataccgactttcaccgaggtggcttcttactttggactctgcgtgtggctagttccatttgccctttttgtcagtctcagtgcaggggaaaatgtcttgccaagtatgggatctgagtatgcgacaggcgagcatgttcctaccggtggacgtactcgcattgctctgtcatcagaagggaaaatgaagaataaggggatggcaaaagccgtggtagacggcgtcagggattggattagcgaaaacggcgcactgatgggcttctggaggagtgagaggacaagaagattctag

SEQ ID NO: 14172 - DNA, 375 bp, A.fumigatus
tgtgatggactaatgacactggaggggaaaggaatatgctcaggcaagcacgccatcgcagattacctcattgaacatcaagagttcaaactcctcgagctgaacaacaaacactaccctcggataactgatgacccagaagacgatcttcggttacaagcttcggaactcagcaacaagaggaattcggaattcacattcgacagcgtcgaatccctcctagactttgcaacgaaaagatggaaagagcgctgggtcacaacagatatcttggatactgcgaccatagagcgttttcttcaacgaccttttttcctcctagtgagcgtcgatgcgccagttagtcttcggtggaagcggttcacagacaggtaa

SEQ ID NO: 14173 - DNA, 642 bp, A.fumigatus
tgtttttactccgtttctaggtgccgaagaagacagctcgatcctcctcctcttgaaagatttgttatatggaatgatcggcacctttacgataaagatattggacgtgcttatctgacggatcgtgcgcaagtgcgattgttcaactcatgctcttctctggaggagctgcatgttgctcttgaagccctgaatctcgccgacgagcgacgtcttcgtccaaattgggacctgtatttcatgcaactagcttcactcgctgcgcagagaagcaattgcatgaagagaagagtgggctgtgtgctcgttagggaacgccgtgtaatcagcaccggatacaacgggactcctcggcatcttaccaactgcaatgaaggtggatgtatgaaacctcccgaaagcttgcagctttctctgatcttatcgtgctgttctaagagagactcacatcgactaggcccgcgatgcaaccgtggagaaggaggaggtgttggcctatcgacatgtctttgccttcatgcggaagagaacgctttgttggaagcaggccgagagcgtatacgcgaaggctcaatactctattgcgatacgtcagattccccggcccctacttgctgctttccagatgttgatgacccgtag

SEQ ID NO: 14174 - DNA, 207 bp, A.fumigatus
tatctagtcggtgaatcaacacactctccgggctctttcttcctcggaatctttggcatccgggtattagtactacagtatcctgtggcctgtgctgtatttctgatttctgttactattagcttccctctaactggactcatagatgtatatatatataataatagcgagaggctacacgatgtgggattggctgataagaagtag

SEQ ID NO: 14175 - DNA, 486 bp, A.fumigatus
gcccgcgatgcaaccgtggagaaggaggaggtgttggcctatcgacatgtctttgccttcatgcggaagagaacgctttgttggaagcaggccgagagcgtatacgcgaaggctcaatactctattgcgatacgtcagattccccggcccctacttgctgctttccagatgttgatgacccgtagatgcccttgcttgacgtgtacagtcaagatcgctcaagtcggtatatcggaagtcgtgtattcccaaggatacaacatggatcaagaagtttgtctaaatcaccactctttagtaaacgcagctaacaggaggcagagtgctgcgatcttgaaagctgcgggagtatgtctgagacagttttctccggtaagctacacgatctctaccggactcgacaaagagggcttacacaaatatagcctcgaaacggcctcatctatctccaaaattctcagaccatttcttcggatttacccttga

SEQ ID NO: 14176 - DNA, 204 bp, A.fumigatus
ccgaacaaaatgcagtacgctccatttgcctcggacattgagctcccgttctacacagccctagctacattgaagatagaccgtgacaaactcgatgactctgctcgcaaagtattaggtctgtacgaagtgcgctctacggacgcaccgaaaaattcttgtcggatgcagatacatggaaatgccctcaccagcgacgagtga

SEQ ID NO: 14177 - DNA, 303 bp, A.fumigatus
tattccggaaagatactggatgccatagaggacggcagcatctacctgtgtccgtcaaaattatcctacttcatgatactgtctttcgcagatctcaagaagtataagtttcactactggttcgcgtttcctgctcttcattcaaccccttcttggactcctgtaccatattctgaggagatcgtcggtgatactccggttgaaccgattaataggtcacctttcaaggccttatccactctcgaaagttcgactcttgtggaagcagtgcagacctggtctggcagtgtcgaagcttgtttt

SEQ ID NO: 14178 - DNA, 330 bp, A.fumigatus
agcgcttgttcctttttctatttttcttttgctttttcctattcgtgcctcattcttaagaacgctcgtcctctggaggaaaactttttttttagccggcttatgagagaaaagtcgagattgaaaataaaagatctcttcgtagacaagatagaaggatttagcaccacttttgatccacattgtataatttattatttcaactgcataagtgacagatcaatcttgttgtcatcttggtccccgttcttgtttgcccttctcttctccctctttgtcctagtaattctgtttctccacacaattgtctggtccccaaccccttcataa

SEQ ID NO: 14179 - DNA, 213 bp, A.fumigatus
atattcacaaatcccctcgagattgtcaagattcgcctgcaggttcagggtgagattgccaagaccgtcgagggagccccccgtcgctcggccatgtggattgtgaagaacatgggtctggtgggcttgtataagggtgccagcgcctgcttgctccgtgacggtaaggacaaaccgacgcgctccttcgacttctgtgaacatgctttctga

SEQ ID NO: 14180 - DNA, 567 bp, A.fumigatus
cgatttcggactatagttccattatatgccatatatttccccacctatgcccatctgaagagcgacgttttcggcgagtctcccacacagaaactcggcattgtgcagctgctcactgccggtgccattgccggtatgccagcggcgtatcttaccacaccctgcgatgtgatcaagacccgtctgcaggttgaagctcgcaaaggagatgttcgttataatggcttgcgccattgtgcagccacgatctggagggacgagggtttcagggccttcttcaagggtgggcctgctcgtatcattcgttcgtcaccgcagttcgggttcaccctggctgcctatgaactgctgcagaaatggcttcctatgcccggctcgcaccctgaggtctctcccacgggacaagttgagcccggcgttggtttacagagcgccaaagcacctcttccctatctgaggtcaaggaacgctctgaagctgctcctggacctcgacgagaacattggtcgcgtctatatccctcaggccgataaatggcccaaattcctccagccgtcgaagcaatga

SEQ ID NO: 14181 - DNA, 384 bp, A.fumigatus
tttctggaattgacgttgacggatcaaagacacggagaatgcttcgttctcgatgacggcggtgaggccgacctcgacctcggaaactacgagcgctacctcggagtcactctcgggcgggacaacaacatcaccactgggaagatctaccaacacgtcattgagaaggagcgtcgcggtgattacctgggaaagacagttcagatcgtgccacaccttaccaacgagatccaaaactgggtggaacgggttgccaaggttcctgtggatgagtcagggcgggaacccgacgtttgcatcatcgagttgggcggtactgttggagacattgaaagcgcaccttttgtggcggcgatcagtcagttcgtttactggacgagcgga

SEQ ID NO: 14182 - DNA, 1371 bp, A.fumigatus
cagcacaaaatcaagcgcgaacactatggactcctcttccgagtcgccgacaagcgaagggccggtagactcaccctcagtgactgggcgactttcgagaacctcctgaccaagcccgatgccgaatatgagattgctttccgactcttcgatctcgatggaacgggcacggtcaagtgggagacgttcaagaacatatacaatatgaataagagcggtgacagtatacctttcgattggaattcggaatgggcttccctgtactccggacggagcaaggcccggcacgacatgacatacccccagttcgctcagatgctccgaggattgcagggcgagcgcattcggcaagccttccacatcttcgacaaggatggtgacggttacatcgagcctgaagatttccagcggattatcctcgagacctcgaaacacaagctgtcggattatgtcctggagaaccttcccagtctgtgcaacatctcagcgggcaccaagatctcctacgctaccgttcgtgctttccagaatgtcatgcgcgaaatggacatgatcgaccttattgtccgcgaagccacccagaagagcgaagacggcaagatcacgcgcgccgacttcctcaacgaagctgctcgcataacccgattctcccttttcacaccaatggaagcggatattctgttccatttcgctggcctcgatgcgccttctggccggctatctcagaaggatttcgccaaggtcattgatgcctcctggcgtgtgcctttggctgtggctggacaggctgtctccactgcaacaaccaccgctcaggtcgccgctgagaagactcggtcggtgttgcacagcgttttggaatcagttcaccacttcgcgcttggcagtcttgcaggtgctttcggtgcctttatggtttaccccatcgatctggtcaagacacgcatgcagaaccaacgttcgacgcgggttggcgaaagactgtacaacaactcgcttgattgtttcagaaaagtcattcgcaatgagggcttcctcggcttgtattccggtgttctgcctcagttaatcggtgttgctccggaaaaggcgatcaagctgacagtgaacgatctcgtccgcggccacttcaccaacaaggaaaacggcaagatctggtatccctatgaaatccttgctggtggtacggctggtggttgccaagttgtaagtgctgttgagctctccccacactggaagactgttctgatttcgcctcttattagatattcacaaatcccctcgagattgtcaagattcgcctgcaggttcagggtgagattgccaagaccgtcgagggagccccccgtcgctcggccatgtggattgtga

SEQ ID NO: 14183 - DNA, 960 bp, A.fumigatus
tctgataatgcgggcattctttcgcatgaatttcatgttctagttcaagtcatctcgctgccagtcaagccattgatccacgttcatctagtagcagccggacgctgtagtcgtcaattagaacgattcggcaaaatgtcgtcgcctgttattttgctcccaggtgatcatgtgccgtcagataaactgccctccaacaaatctgctccactgagactaggacctggccttcgactgctttctccagcaattccttctccgtcatctggtcatgttattgcttctacacaggccggtctcctctctacagattacaagaaaaatgctgtttccgtcttgtcgtttcctaatcgccgctacatccccacgcccaacgatttggtgatcgcacaagttcatcattccagtgcggaatacttctactgcatgattacgccgcaatcgcctcatgtgctgctcggccagctggctttcgagggtgccacaaagaagacgaggccaatgttaaggcaaggcgatttggtctatgctcgagttctatccatcggtctcggtgctggcgcagaagttgagcttacctgcgtaaacccagcaaccggcaaggctgagcctggaggattgggcccattgaacggaggaatggtgtttgacgtctctactggcatggctgccagattaatgagagctagctcgtcgacctccgagcaagaggatggtgtagatggattagtggtcttggaggaacttgggaggaagttagaaaaagtcggaggcttcgagatcgccgtgggaagaaacggaaaggtctgggttgactgctcaaatggaggcgatgctgctgttaaagcgacagtggcaataggacgctgtctcaccgcgattgacgagcatgatctgaatcaaacggatcagaggaaacttgtgacgcggattctacgagaaatgaaggttgagtcttga

SEQ ID NO: 14184 - DNA, 834 bp, A.fumigatus
gaatccaggtatgctttacacatagtgccttttgcgaaagaccatatacgtacttttgaaagaattactgcgctgtactttgagcctgactattactatttgcaagatatgaatgaagaacgcgatgctgttggttctccggactctccaacaacctccatgaaagggaaattagaaacacaggtcggagagacagccactcccaagcgaaaaagaaagcagaccgtcaacgataccaacactggcatgccttcgaaaaccccaaaccagtcgcaagaatcacccctggaccgggcaggcgcgcgcccagtgaagcgcacgaagatcgtcccctcgactacaaacacgaaggaggcccgcagaccagaaaagaatggcagtcgagaagccattccgtctccagaaacccctgtggttgccaacatctccgagatgacggaagctcagcgccagtcgactggtatgcaacctctagcggacgtagcgcatacgaacgaaaccgcgtccaagaaacccaagaagtccaaggcgaagaccacacagcaggacgaggaaagagacttgtcggcccctcctcagaaccctgccgagactaagccgattcggatggcgtctgcgaacccatcactggcggatagctcaacggaccagaaggatttgacggacacatcggccgtccggggacccagaaaaggaaagacggacaaaatgatcggcttcttcgctccatccgaggtcagcgcgctggagaccttcaaacttcagttttgcaaccagcatgctatctccagcgaaaaatgtcctcaccacggggctggaagggtgccgcagtag

SEQ ID NO: 14185 - DNA, 762 bp, A.fumigatus
acaaggagaaacagcgttaattatgtaataactctagacataaatacccatatttgtatccttcttcttggcttgcacctcggcgatagcatccacgtagttctcgtgtccgaccttgctcatgcctttccggagagcaatcataccggcttccacacagacggccttcagctgcgcaccaccgaactcatcagtacttcgagccaattcggcccagttgacggcgtcgtccacagccatcttgcgggagtggatctgcaggatgtttgcccgtgcctcctcattggggagagggaattcgatcttgcggtccagtcgaccggaacggagcagagcaggatcaaggacatcgatacggtttgtcgcagccaggaccttgatacgatcatccgaagcaaatccatcaagctggttcagaagctccaacatggtccgttgcacctcacggtcaccggacttctcggagtcgaaacgcttggtacccacggcgtcgagttcgtcaatgaaaatgatcgaaggggccttctccttggcaagagcgaagcagtcccgaaccagcttggcgccgtcaccaatgaacatctgcaccagctgaggtccagcaagcttcaggaacgtcgcgtttgtctctgcggcgcaggctcgcgcaagaaggttttaccggtaccaggaggaccatacatcagagcacctaaagaagaggagatatgcgttagaatgctggccgacgacgacggaagaaccgggggaaagaacggttaa

SEQ ID NO: 14186 - DNA, 1428 bp, A.fumigatus
acggggaaaagtgccctcgagccgagcatcttccttcgcatgttccacctattaccctcgctgcgtcatctttgcatctcatcatttgatgcggatgccttcgccgatagtgctttgctgtgtctaccgccactggagtcccttcggctggaacgcctgccaggcatcactgataccggactatcacagtatacctcccggccggagtccggctcgctgaagtccctggctcttattgaacagaacatccaatccttgcttgtaatttcaaagatcttagcatcgcttagaaatctggagcgtttcaagatcgtgcagaccggccattgtccgacgttaaacgctgatgggattgttttccagccgctgtttgcgtcgtccagtctcaagcatctgcattgggatgtcgcctgtcccaatccgaatactgccctgacgagattagactgtgccccattcgccaagccaccaaagcatgttgacacaccaaactcgcatttagctcaaagcattctgtgctcgggtttcccctgtctggagacccttcgagcaccctcagatatagagcctcccggaatactccaggctgtctgccagcctattcctagagggcaggccctgatcaattctgaccgatacagcctgcctcggagctctcatggctctgttaacacccgcccattggccctcccagcgggcaacaatctaacatcggcacgaatacgggcgcagaccttcattgacatggctgccaaggatacggaaaccggaatgcaagttctcatcactgatcactccgattcatatgtacccgacaatgccttggaggatgcttcagatgatgagcctgatccaggcatgggtcagtacggatcgctgtcctctggaagggcaaaggaagagcccaatgggccagtcacagtgttcaacttccgaatgccagcgtatatgggccgagtgggtagtagaacgacggagaaagatgtctcaatccctcgattcatactccgccccgacctacctggccaggacgcagatggcggcctcattggatggaagcacatccttgcctcaaaccagtcgttgacctacgctgccggagtcggagtcaactgtttcggcagcaaaggtagcttgattccccctccgcctcccgaagaatcaccgccatcccccgcttccacgactgtcacgagatttggatggggcagcattggtagtcgctcagcgttgggaacaagtcctatcacaccgacgacgccgtctactcccatgagcctgtcgtctccgaccgggcttccctgggacaaggatacttgtactggatcctggaattacagtcacaagagaggcagggactggtggttccatatggaacgcgatcgtccgggaagtgttgaaattgtcgatgtcaaaggtctcttctga

SEQ ID NO: 14187 - DNA, 495 bp, A.fumigatus
ttctcgtgtccgaccttgctcatgcctttccggagagcaatcataccggcttccacacagacggccttcagctgcgcaccaccgaactcatcagtacttcgagccaattcggcccagttgacggcgtcgtccacagccatcttgcgggagtggatctgcaggatgtttgcccgtgcctcctcattggggagagggaattcgatcttgcggtccagtcgaccggaacggagcagagcaggatcaaggacatcgatacggtttgtcgcagccaggaccttgatacgatcatccgaagcaaatccatcaagctggttcagaagctccaacatggtccgttgcacctcacggtcaccggacttctcggagtcgaaacgcttggtacccacggcgtcgagttcgtcaatgaaaatgatcgaaggggccttctccttggcaagagcgaagcagtcccgaaccagcttggcgccgtcaccaatgaacatctgcaccagctga

SEQ ID NO: 14188 - DNA, 441 bp, A.fumigatus
ggtccagcaagcttcaggaacgtcgcgtttgtctctgcggcgcaggctcgcgcaagaaggttttaccggtaccaggaggaccatacatcagagcacctaaagaagaggagatatgcgttagaatgctggccgacgacgacggaagaaccgggggaaagaacggttaaaataccctttggtgccttgataccaatcttcgtgaatcgttcagcctccttcatcggccatacgatggcttccactatctcttcaatctgcttatccaaaccaccaatgtccgtgtacttctctgtcggcttctcgtcgacctccatggccttcacacgattatcgtactcggcgggtagtgtatccaaaatcaggtatgaatccttgttgacaccgatcaggtcaccgggcttcagtttctcgtggtctaccagaccgatgagaggaagatag

SEQ ID NO: 14189 - DNA, 471 bp, A.fumigatus
ctttcagactcgcacatcaaccttgtcaccatgtcgacccttgaagatctggaggatctcgaacgcgaggagagagacaagaagaaggaccagggcgatggtgacggccagcagcctggaggagatggagatgctgaaatgaaagatgccgatgcaaagaagaaggacgaagaagatgatttactggatgaggagattctcaactcgagcacagcagacattgtcaagcggcgacggatgttggagaatgagctccgcataatgaaaagcgaataccaacgattgacccatgaacagaatactatgcgggagaaggtgagggataaccaggagaaaattgagaacaacaggtacgacatgcttgtcactctagtcacttcatctctgccctactgtcataggtctccggatggccggagcggtggcgatgttgcaaatctatcatcgggatttgtctggaaacctgtataa

SEQ ID NO: 14190 - DNA, 210 bp, A.fumigatus
agatcaatatcacgtgatgtaggcacagcagctgacgttgtttggtcggagctcgagcatcgccaggacagcttcaaccctcccaccttctatcttgatctcccatccttcctcttttccccgattacgcaccctcagtactctttcgcttctcagattcaattagctttcagactcgcacatcaaccttgtcaccatgtcgacccttga

SEQ ID NO: 14191 - DNA, 624 bp, A.fumigatus
gtctccggatggccggagcggtggcgatgttgcaaatctatcatcgggatttgtctggaaacctgtataattactcttactgacacttgtatttataggcaacttccatacctcgtcggaaatgtcgtcgagcttttggatctggatgttgaggcagaggccgccgaagaaggagcgaacatcgatcttgacgctacgcgagtgggcaaatccgctgtcatcaaaacatcgaccagacagactatctatcttcctctcatcggtctggtagaccacgagaaactgaagcccggtgacctgatcggtgtcaacaaggattcatacctgattttggatacactacccgccgagtacgataatcgtgtgaaggccatggaggtcgacgagaagccgacagagaagtacacggacattggtggtttggataagcagattgaagagatagtggaagccatcgtatggccgatgaaggaggctgaacgattcacgaagattggtatcaaggcaccaaagggtattttaaccgttctttcccccggttcttccgtcgtcgtcggccagcattctaacgcatatctcctcttctttaggtgctctgatgtatggtcctcctggtaccggtaa

SEQ ID NO: 14192 - DNA, 624 bp, A.fumigatus
aaccttcttgcgcgagcctgcgccgcagagacaaacgcgacgttcctgaagcttgctggacctcagctggtgcagatgttcattggtgacggcgccaagctggttcgggactgcttcgctcttgccaaggagaaggccccttcgatcattttcattgacgaactcgacgccgtgggtaccaagcgtttcgactccgagaagtccggtgaccgtgaggtgcaacggaccatgttggagcttctgaaccagcttgatggatttgcttcggatgatcgtatcaaggtcctggctgcgacaaaccgtatcgatgtccttgatcctgctctgctccgttccggtcgactggaccgcaagatcgaattccctctccccaatgaggaggcacgggcaaacatcctgcagatccactcccgcaagatggctgtggacgacgccgtcaactgggccgaattggctcgaagtactgatgagttcggtggtgcgcagctgaaggccgtctgtgtggaagccggtatgattgctctccggaaaggcatgagcaaggtcggacacgagaactacgtggatgctatcgccgaggtgcaagccaagaagaaggatacaaatatgggtatttatgtctag

SEQ ID NO: 14193 - DNA, 363 bp, A.fumigatus
gatgccagcctcattcatctccgcatctgccacagagctctatttctgcctcttccaaaaccattaatggctttgaagtccgtgaaagctttgctttaccccaatccaaagcatgttgtccagttcatgcagcagccctatagcggagctacccagctagacaaaagctactacactgagggtgcaaacaggagttggaattttgccatggtcgaggaggagatagcagacctagttgatgggaaggatttcgacgatctgacaagtaacattccatggttcctggctaagactctatacagaacccgtttctccacacgcaagccaaacgtaccagacatcactgcagcaaatggaacataa

SEQ ID NO: 14194 - DNA, 267 bp, A.fumigatus
gccgcctcctgcgcatgctgctcttcttccggcccattacttctaccagtgtctccaagcgcccgcatccgcgccacaaactcgaagtcgtctactatcttccgtccctgtatcgcacgcaccgaggccaccatcgaaaagggtgagggttcgatcttcagtggtgcctgcgctgctgaaaaagagattgactacaagctaatgcgcacccagaagccatgtgtaatgttgcttgacccagtgcatagagatcacttgggccactaa

SEQ ID NO: 14195 - DNA, 1056 bp, A.fumigatus
tgggtaatgttgtcgtctggaagccgtctcccgccgccatcgcgtccaactggctggttcaccagatcctcttggaagccggactgcccaagaacgtcatacagttcgtccccggcgatgccgaagaagtcaccaacaccgtactcaaccaccgcgaattcgctgccctgcatttcaccggaagcaccgccgtgttccgttccctgtacggaaaaatcgctcagggggtcgccgagggcaaataccgcagctaccctcgcatcgtcggcgaaactggtggcaagaacttccacctcgtccacaagtctgcggacatccgcaacgctgccgtgcagaccgtccgcggagcgtttgagttccagggacagaagtgcagcgccacctcccgcgcgtacgtcgcatcctccatcgccgatcagttcctcgagcaggttgtgtccgaaacaaagcagctcaagatcggcgagccatccgacttcaccaacttctgcggccccgtcatccacgaagcctccttcaacaagctcgctcaggtcatcgaggaggccaagagcgactcggaactcgagctcctcgtcggcggtacctatgactcctccaagggctggtacattcaacccaccgtttaccgcacctcgaaccccgatcaccctctcctctcccgcgagctctttggccccatcctggttgtgcacacctacaacgacgccacagaggccgacttctccaaggtctgcgagaagattgaccagaccggtgagtacggtctcacaggctccgtcttcgcgcaggaccgcgaggccatccgggttgcggaggatgctctccgcaacaccgcgggtaacttctacatcaactgcaagagcaccggtgccgtggtcggccagcagcccttcggcggtgcccgtgcaagcggcaccaacgataaggccggcagtggaaacttgctctcgcggttcgtcagcttgcgctcgatcaaggaggaattcgtcccttcttacaaggttgagtaccctagcaatgcgtaagctaggcatgacatgtgcttgtcattga

SEQ ID NO: 14196 - DNA, 447 bp, A.fumigatus
cataccgcttgtgattgcaggcaaggaggttcgttttatcaagtgaacaatctactaaatcaagagactgacaattcccagatcaagagctcgcaaaccttcacacagtccaaccctgcctctcgtgccccagtggccacctactccaacgccaccgcctccgatgttcaggcggctattgacgcagcgctggaggctcgcaagtcttgggccgctacatcgttcgcagaccgtgcaagtgtcttcctcaaggctgccgatcttatttcgaccaagtaccgctatgacattatggccttgaccatgcacggacagggcaagaacgcctggcaggcggagattgatgctgccgccgagctgtgcgatttcttccggtttggcgtcaagtacgctgaggaaatgtacgcccagcagcctgttcatcatgctcctggagtctggaagtaa

SEQ ID NO: 14197 - DNA, 228 bp, A.fumigatus
attcgtttccttccaggcccgtcggtgcagacaaacttcacaaagatgcattcctcgttgctcccccgcatgcgcgcgcagcaattcgccaaatgccgtcctcttactagcagcttcgttcgtcctaatagggcgatgggcacgtatgctactttcaaggtgcctcgcatcgacaatgaacctaacgtgagtttttcgactcttgtgccctcgagaaatggattctga

SEQ ID NO: 14198 - DNA, 1320 bp, A.fumigatus
ccatgcacggacagggcaagaacgcctggcaggcggagattgatgctgccgccgagctgtgcgatttcttccggtttggcgtcaagtacgctgaggaaatgtacgcccagcagcctgttcatcatgctcctggagtctggaagtaagtttactttgcatttgcgatcaaggatgacaatggctaaccagcgcagccgcgttgaataccgtcccctcgaaggtttcgtctatgccatcagccccttcaacttcactgccatcggtggtaatctggccggcgcccctgctctgatgggtaatgttgtcgtctggaagccgtctcccgccgccatcgcgtccaactggctggttcaccagatcctcttggaagccggactgcccaagaacgtcatacagttcgtccccggcgatgccgaagaagtcaccaacaccgtactcaaccaccgcgaattcgctgccctgcatttcaccggaagcaccgccgtgttccgttccctgtacggaaaaatcgctcagggggtcgccgagggcaaataccgcagctaccctcgcatcgtcggcgaaactggtggcaagaacttccacctcgtccacaagtctgcggacatccgcaacgctgccgtgcagaccgtccgcggagcgtttgagttccagggacagaagtgcagcgccacctcccgcgcgtacgtcgcatcctccatcgccgatcagttcctcgagcaggttgtgtccgaaacaaagcagctcaagatcggcgagccatccgacttcaccaacttctgcggccccgtcatccacgaagcctccttcaacaagctcgctcaggtcatcgaggaggccaagagcgactcggaactcgagctcctcgtcggcggtacctatgactcctccaagggctggtacattcaacccaccgtttaccgcacctcgaaccccgatcaccctctcctctcccgcgagctctttggccccatcctggttgtgcacacctacaacgacgccacagaggccgacttctccaaggtctgcgagaagattgaccagaccggtgagtacggtctcacaggctccgtcttcgcgcaggaccgcgaggccatccgggttgcggaggatgctctccgcaacaccgcgggtaacttctacatcaactgcaagagcaccggtgccgtggtcggccagcagcccttcggcggtgcccgtgcaagcggcaccaacgataaggccggcagtggaaacttgctctcgcggttcgtcagcttgcgctcgatcaaggaggaattcgtcccttcttacaaggttgagtaccctagcaatgcgtaa

SEQ ID NO: 14199 - DNA, 765 bp, A.fumigatus
ccgagttgtcggaacggatttgctgcaggtacgccactccgagtccgtcctcagagtagctctacttgcaaccgtgtaacccaagttaatgacattaatgacaaaaaggtcggctcttcagacacccccgccgagaaaatcaccacggaccgcaaccagattgtctccgacctccgcgaactggccgacctgctcgcaaaatgcaacatgcgcctagcctacgagaactggtgctggtctacccacgcccccacctggaaagacgtctgggaaatcgtcaaggcggtcgaccgccccaatatcggcctgtgcctggataccttccagaccgcagggtccgagtggggcgatccccggaccatctccggccggatagacgacatggacgttgacgagctgaaccggcgcttcgcagcgagtatggacgagctggcgcggtctatcccgccggagaagatctatctgctgcagatttcagacgcgtataagcccacccggccgatcgaggataaggtgatcaatgggcttcggccgcgggggcgctggagccatgatttccggccgatgccgtacgacggtgggtacctgcccatcgaggaggtggcgcgggcggtgctcaagaccgggttccgggggtggttttctatggagatctttgatggggggaatcaggggaaggggaagaagtacgatatgatcccgtacgcgaagaatgcgatggagagtatgcaaaggctcctgaagaattgctcagatgatagatag

SEQ ID NO: 14200 - DNA, 474 bp, A.fumigatus
acgaaaccttcgaggggacggtattcaacgcggctgcgctggttagccattgtcatccttgatcgcaaatgcaaagtaaacttacttccagactccaggagcatgatgaacaggctgctgggcgtacatttcctcagcgtacttgacgccaaaccggaagaaatcgcacagctcggcggcagcatcaatctccgcctgccaggcgttcttgccctgtccgtgcatggtcaaggccataatgtcatagcggtacttggtcgaaataagatcggcagccttgaggaagacacttgcacggtctgcgaacgatgtagcggcccaagacttgcgagcctccagcgctgcgtcaatagccgcctgaacatcggaggcggtggcgttggagtaggtggccactggggcacgagaggcagggttggactgtgtgaaggtttgcgagctcttgatctgggaattgtcagtctcttgatttag

SEQ ID NO: 14201 - DNA, 894 bp, A.fumigatus
tgcaaacttgtggactcgcagggccaagtatgtcgaggattttcgtcatttgcaaggcataccgttaagcgcaagactaacctgtgtcgtatgtcttttagttccgccaaattgtctctgtccatgacaggaaccgacggaaaggacggtggcgcgaaagtcgatcttccccgcggacacacatcaaagcgtttcggcccggatagctcgcacggcggtcgatcgaatcccttcaatgcattatcccccctctcgggtggcgtttcttctccttccactaacgcatcctccgcatttggcttgggttcgggcgcattcgcgtcctttggtactcccaagacgcctggcaccaatgcgtcagacctgaattcgtccaaagcgctgggggagaagcgagagacggcttcggagcaggattcggcagcggatgtcaaggccaaggcttcagcctcctccttgactggcccgaaagaacattctctgaagtctacgtgggtgatctggtaccgtcccccgacacccaagtactctgactatgagaagtcaaccattcctcttgcatctatatcctcggtcgaaagtttctggtcgatatatacacatctcaaacgcccatcgcttctccccaccgtctccgactatcacatttttaagaaaggtatccgtcctgtatgggaagacgatgccaacaagaagggtggaaagtggattgttcggctgaagaagggagttgctgaccggtattgggaggatcttctgttggccatgattggtgaccagtttgcggaggctagtgatgaggtctgtggcgctgttctcagtgtaaggagcggagaggatgtgttgagtgtctggacccggattgacggtgggcgcaatatcaagatcaggtaa

SEQ ID NO: 14202 - DNA, 321 bp, A.fumigatus
  unsure (151): Identity of nucleotide sequences at the above locations are unknown.
atcatctgctacttcgatgaaccctgctgtctttacatgccacttttggggacaatatccgagtttctggctccgctaatttctcccaatcgccggtcaaatcgtcagaatcccatccccgctccgccatcagatgtcacttctgatgagntacaacggactcaggtgtccggcgtaagcgatgctcctcatctaggttctttagcgtctgtcattcaatccgggattgaaccatctattcaggcccgcaatgtgagttggaattatgccctctcaatcgttctagtttcttctcctatcccctctcgtgtacacttttaa

SEQ ID NO: 14203 - DNA, 855 bp, A.fumigatus
ccgttgacaatggacgaccctccgccgcctccaccgcctcacggcgagaatccgaacacaactcacggattcaagaaaggctccggtcttccggacggaaactacgatatctttatcatcccacctcattcctcgggctctggttttctataccttccctccctacagactcaccggaacagcttcctggccggcgctgcgtccgcgctagcggtggtttacatctggcagacactgtctcccattgtgaaggcatggtatcttgctacagccgccaatggtggcggaatgggagttgcggtcctactggccatcgttggcattgcgggatggggatttggtgcataccaagcacatatagccggttcaaaccgagactccggaggaagctctcaatcccgccagtctgggccaggggcccgggggggacctggtggagctagatttggaggacatggagctgccggcggtggcggctcttaccatcagtcctcgggtgcaggccctggcccggactattcgagagggcccaatttcggtggccctagtccagggccgcaagggacttacggcagtgggggtaactatggagccggccccggcccaggtggcccataccctgggaatcagtatggcgctggcgccgcgcccccaccgccgaatgccgggaccccaccccatactcctccgaatgccgacccgggtccagaaaaaccagagccgacttctgaaaggagcgaaagcaaaagtaagagcggcgaagattgggaacgagctcgtgaagaaacgaggcggaaggaggagctcaggcgaaagagttttcaccaagcggccgacggatccgagcaaagaacc

SEQ ID NO: 14204 - DNA, 282 bp, A.fumigatus
gatgtcaatactccggagtcgtttactgattcttggaatagcaacgcttactaccccccacatagtcatagcggcttgacgacgcatctcatccgacggggcactcttaccatcacatatccggacgataactccaaattgcacaatggagaagtcaagaaagagacgtttggagtgggcgcaaggatcgatgtgcccgctggtaagctacatgaggtgttggatggaaaagatggctgcgaatatgttatcgggggatttaaatttccgatcagcttttga

SEQ ID NO: 14205 - DNA, 279 bp, A.fumigatus
  unsure (37): Identity of nucleotide sequences at the above locations are unknown.
gtcgtccaggcactgtccgacaatatgctgggcgacntggggatgaacacgaatgactacaacaccggacagacgatgttcttcctctgtttcctgttcgcggaactgccttcgcagctcatctccaaggcactcgggccggatcgctggatccccattcagatggtctgctggagtttgatcgccgctttccagtctctcatcaagggcaagagcgcgtatttcgcttgtcgagcgcttctcggattattcgagggcggattgtacgttgagctctaa

SEQ ID NO: 14206 - DNA, 237 bp, A.fumigatus
gtgtccggctgggtcagacacgagtgtctatatcctattaacgatgctcagatctatcgcgaaaatgacaaaccgtattaccggaccggtaacaaggtgctcattgccttggcggtatacagcttggttctcttcgttgtggctcggttctactatgaatggcgaaacaagtacgttttttcttttccatgtttcaaaagatggcttcaaaaattaatctgtgtcgtgtgtcgatag

SEQ ID NO: 14207 - DNA, 192 bp, A.fumigatus
gtgaccgacccgacgacccctaagagttcgaggattcgatatttccatcgggtgatctccagtccagattggaccgatttaacactagacacaggtaaattcaatgcatccaaagaggagaatgatcctcgcaaggacgcaaacaccacctcttgtcaaaaatcaagcttatgctctggaaacttcgggtga

SEQ ID NO: 14208 - DNA, 933 bp, A.fumigatus
gctctaagccaccggtcccataagactgactttttacccccccatagcattcccgacacgatcctcttcctctccttctggtacaagtccaaggagctgcccatccgcctgagctacttctgggtctcgtacgaagccaccgccatcgtaggcgcattcctcgccttcggcttcctccacatccgcgacagcgacggcaaaggcggctggcgctacctcttcgccttcgaaggcctcattacaggaattatcggcatcatcgccgcattctggatgcctgcgtccccgacacagacgaaaggcggctttcgcggaaagaacgggtggttcaacgagcacgaggaaaagatcctcgtgaacagagtcctgcgcgacgaccccagcaaaggcggcatgcataaccgacaagccatcacccccaagatgctctggcaggcgctcggcgactacgacatgtggatcatctatctgctgggtctgacgtggctgatccccaacacgccggcgacgagctacatcacgctgcagctcaagtcgctcgggttcaagactttcgagacgaatctcctgactatcccggcgtacgcgatcttcatcgccaacctgctcttctggacttggatctcggagcggttcaatgttcggttcctcttgggtgtcgtggcggaagtctggtgtctggttctgctgattgctctggaggtgttgcccgccgaggccagtccctgggcccgatgggtcattttgatacttcttcttggggcgccgtatatccatgcgattattgtggccatgacctcgaggaacgcaggaacagtgcggacacgaacggttgccagcgcgctgtataacatgatggtgcagacctcgaatatcattgccaacaatgtaggtgtccggctgggtcagacacgagtgtctatatcctattaa

SEQ ID NO: 14209 - DNA, 450 bp, A.fumigatus
caaggggaccaagtgtccgtctggatcgtgctgcagccagtatggaaattggtgtgtttcttctttttcttcttttgttatctttttcaccccctactcaactctactaagacgcttctgggcttggctaatccgaacagcggcaccggcgatgacttctgccaggcaggctgtctctcagactatggcgagtgcaagggaatttccgttactgattcctggcgtcgtgcgctcaaggacggcaagacggatgaggaggcaggcggacagtactactgggatagcacagtcaatctcttctggacttgggatacccctgcgatcatcgaccgcaagttcaaggatatcgtgaatgctgagaagctgggcggtatcatggcttggagtctgggagaggatactctgaactgggagcatctgaaggcgatgcagaagggccttgggaagtag

SEQ ID NO: 14210 - DNA, 918 bp, A.fumigatus
ctgatggtagatatcgactgggaataccccggcggcaacggcgacgactacaagaaggtccccaattcccagaaaactagcgagattgagacgtacccgctcttcgtgcaggccatccgcgacgcaattggcaaggacaagattctgtctgttgcagtcccaggtaaacgcggcgacatgattgccttcaccaaggaacaaggacccaagatctggtcggctgtcgacatggtcaacgtcatgtcgtatgacttgatgaaccgccgtgacaacgtgacgaaccaccacagtggcgtggccggctctctggacaccatcaaggcgtacaaggagatcggcctagacacggccaagatgaacctgggattcgcgtattatgccaagtggttcatgactgatccgaacagcgactgcgctcagcagccgatcggatgtgccgtcgttccgctggagaaccctgacggatcggaccctggcaaatctggcacactgacctttgagaagagcagtatggctgctcctccggataacctgaggaccagcacggatggaacctgcggctatagcaaggggaccaagtgtccgtctggatcgtgctgcagccagtatggaaattggtgtgtttcttctttttcttcttttgttatctttttcaccccctactcaactctactaagacgcttctgggcttggctaatccgaacagcggcaccggcgatgacttctgccaggcaggctgtctctcagactatggcgagtgcaagggaatttccgttactgattcctggcgtcgtgcgctcaaggacggcaagacggatgaggaggcaggcggacagtactactgggatagcacagtcaatctcttctggacttgggatacccctgcgatcatcgaccgcaagttcaaggatatcgtga

SEQ ID NO: 14211 - DNA, 768 bp, A.fumigatus
ccaatccggaggcgggatgcggcacgggatcgggatggtggctgccattccatcagcaaatatctcaatgacgcagagaccagcacgccgcctcgtgtcgctcaaagcagtttaaggggaactggacctcaaggggagcagcatggggtattcatctttctctccagcaccacccgcgctgccgcgatgcgactcgtctacctccttctccccctaagcctggggctaccaatcacaattcccgtcgatggaacagaagtataccaactccaacaccctgaacatcaccggcagcaacaacaacaacaacagacaatcctcgcacaaaaccgctcagaccaggaccaacctcaaatccaacctagctcaagctcccacggctcatttatcaatctcaacctcacccgccacaagctcaagcccaaccactaccaccagaagaacactaccaatcaatcaaccgacaaaatcctccaagcatatctccacaccctgcacacctcccacttctgcgcgcacaccctctcgcaatacgcccccgagctcctcgcccttgcgctcttctccctcctcccactagccctctgcatcctcgccctctcagagcgcatcgcccgctcctggaccgtcgaggcgtatcccgagcgcgggcgcagtagacgccggtttctggggcgggagaggcgatgtctgatgcaggcgaggagggagagggagaaaagggctgcgcttgacacggtgtggtggattgcggagcgagagcgttga

SEQ ID NO: 14212 - DNA, 324 bp, A.fumigatus
  unsure (34): Identity of nucleotide sequences at the above locations are unknown.
gcttacgattcagataccacacggttgatctccncaggtagtgaccagacccagggcgttacacacgccatcatggctttcgctccatccaagcagttcaacagcgactcttcgttcactccctttgacactgtcaacaatatgcgtaagcgcttcgcacccgacaccaaggtcatgatcgccattggtggatggggcgataccgctggcttctccgagggagccaaagatgaagcctctcggaccaagtatgcgaagaacgttgcaacaatgattaacaatctgggcttcgacggtgtcggtaagttcaaaatcgcgggatga

SEQ ID NO: 14213 - DNA, 1545 bp, A.fumigatus
ataggttcaacaggcagaacttttccggaaaacaacaccacatcctctacgctaccttcctatccccccgaaagacgagatctctacgaccgagtctccaaccatgctacgacgcctctatacagaagatcgatcccagcaccccggcctacgggcagcggccgaagcaaccctcccaggctgggccggagagacagcggcaatatgtcgttcgtcatgctcacggagtcacaggtcggcccaccccacaccagctcgaacaacaacggagaaggtcagtcgtgggcgaacaaaaggccgtctggcgtcccgaacagtgaacgggaaccagaagaaggttctttctcggatcaagtagagagatcaaatcggctatttgaaatcatatcagctcgctccgatatagaccatccgatttgtgtcgagtgcacggaaatgcttgtggatgggctacaaaaacggcttgtgtctgccaccaaggagcgggacgcttacatatcattcctaagggatttgaactcttcagcacccacagcggaggagatcgaggcggctgaacagtcgctcaaggagaccctcgcggcggaagaggcggcatttgaggagcttgtcgcattggagaaggaaaaggccgccctggacgaggaaatcgcagctctggaggaagagtcgcgacagctggacctcgaagaggagaagttctggcgagaccggaacgcatttgcgttgacgctgtctgaatttcaaaacgaacgcgatgccctgaatatgcggtacgatcatgattcacgccagctggaacggctacaacgtaccaatgtttacaatgatgccttttgtattgggcacgatggctacttcgggactatcaacgggctgcgactgggtcgtctgaccaatccgtcggtggagtggccagaaatcaacgcagcttggggtcagacgacactattgttggctactatcgctgagaagttgggattccagtttcaggggtatcgactgaagccaatgggatccatgtcacggattgagaagattgaatatccacgaacgtcaccagctcagtccgcgctcggtggggggaacgcagagacctctccggcggcaaaaatcactactctcgatcttttctcttctggagatctcccgctcaatcttccttggcttcaccgccggtttgatgcaggtatggttgctttcttggaatgtttacgtcagctgggagaattcgtggagaagactccagcacctgtctcgtcgactcgtcggggtcacggtaatgctcccgtagcagggttaaaactcccgtacgagatcaagcgggataaaatcggcgatgcgagcatcaaacttggtttcaaccaaaacgacgagacctggacgcgcgcgtgcaagtacacgctgacctgttgcaaattcttgctagctcatgcaagcaatgttgccagtgctggatccagtaattccgcagctgtggccgctgcagctgtcgcagcgggcgaacaggcccgactcgcaacggccagtccgactcgaaagtag

SEQ ID NO: 14214 - DNA, 1635 bp, A.fumigatus
acctcaatcatcatggaaaggcctcggaaaagaccccgtttatccttgggtgttcatggcgaagacccagacgatatcgacctgcaggaagccagagcccaaaatgacctccgcctcaaatcgatctttgaacgcatcttcgaaaaatacgggaaagatttcacggatattggggatgaaatcgatttacagacagggaaaattgtggtcaataatggtcacttgcagagaatgtcctccgaaggtgatactggggaaaaggacgaagcaggatggttcttcaaggaagatctgcccacgtctacggttcagatctctaaagctacgctgccaggatctgtacatgacttggaggtagcaacagaaactggccatgacgatacgacagacggagtgcagctacagcgcacgcttacgtcgccgcagccgctcccagcgctgcggttagaccgggcatatgatgaaaagcggcctcccgagacaggcgaggcggatttggatgacgattccaggagtgtggactccttgttggactgtgcattgatcgtccccaatgactcagataaacctgatagtcaagccctgccgcttgaaagtgaggcttttcccacaaaagcaattactacggctaaaccgcccgtccaatcccaacagacacgtggagtccaagcgaacgagccagtagagtctatctggcgcgtgcctgagattaaaggcgggttctcgacgccagttttttaccgatcacgccccaagcttcctttgactgctgtccggtctgtatctcctccaaaagcggggtctctgtgggcacttcctggacagtcgaggtgcaacacagacggcagaaaaggaaaacgcagaaagaaacctggagttgaccaacgaaaatacaagctccaatcaagccccgtcttgcacgactggtcctttgcagaaacccctgacggaaatgaatcagacgatcctctgcaggaagactatcaaccatcgccaacaccgaaaacccccattcatatcagggccaaatctcatttggaaaacactccgagtcgcacaaaggatgagcgcagacggcttccccctcagctgaatcctggttcccaacccaccatcaatgctcttcatggggcaacagagcccagaatcgccaacagcgcagcttcacagttagagcctgagaccattgaaaaacgtgcagatcagtgtctttccgtagatacgcatatctctgcagcaaaacaacacgccgacccggccatagcgcaggtgtccactcctactagagccaaaaggacactgatgacgccagacgaggcgaagctgatcatccgcatgaggcagattgaaggaaagaaatggaaggaagtccacgagcattttccccagcgaaaactaatttcactcatccagtggaaccagacgcattggactgaacgacatgacaaaccgcgtcgaatctccaagccttggtcaaaggaggaggtagacaaattgcaggctttcaaggaccagcaaggtttaacttggtcccatattcgtgccgccgttcccggccgttcacacgcggaaatagagtttgcactattgagactgtgggctgagctgggacaaagtacggatgtccaatattga

SEQ ID NO: 14215 - DNA, 2841 bp, A.fumigatus
atggttaggaaactcgaggcccagattctcaaagtccatcagcgtctgtcgcagccagttggcacgtctgctcgagtccggttagagaacgagttgaacaatctagaatctcgcaacgcctcgctagagaatgacttgaaagaaatccaaaaacgtattgatgacaggcatgaaggtctcgaagcaggcactcaggcaaccgggacaggacgcatgccaaatgaatctcggagagattatcttatccgaaccgggaagataacgcctttttctaggatgggcacaggtccaaatgagggtcctcttgccagtcttcatgacgctctgattgatgccgaggatgaacgtgacgaggacgaggcgttggagcaactgaaagatcgctcagctgtttcacacaggaatctcgtccgacccggattcgattttgaccatgagagtactgatacaagtatcgcacaaactcggccaagcaagagacgaaagctggagggtgatgcacgccgaaagaaggcggccatcaagcaagaggactctgattccatagcagcagacgaagggattgagatctctgaagataatgacgagtcggcagattatgtggcatctgaagatcaagaatcattgctgggggacgaagaagaatttttccctgacggaaagccagagcggcctttagctcacaaaaaagggaagaagcctggggatgaaatggaagatttcagtggattagacgacggcgacgagagactttatcaatcaagactgcagagctgggttagtcggagaagcgccgctcggaagcgtgcttctaaggcgctacaagcaacagaagggcatgagagtaccattgatgagcaggcctcgaccgaagaggatgaatggtttctgcctcatccaacggtaccagatgtgtcttacgacaatggatatcgcttacctggggatctcaatccttacttgttcgactaccaaaaaactggggtgcaatggctatgggagctataccagcagaaagtgggaggaatcatcggtgatgagatggggttggggaaaacgatccaagcaatagctttcctagctggactgcattacagcaagaaactggaccggcctgtgattgtggtatgccctgctacagttatgaagcagtgggtcaatgaattccatcgctggtggccaccttttcgtgtttccatcttgcacacgtctgggagtggcatggttaatatccggagcgagagcagcagagaggatgctctcctatctcagacgtattcttctaattcgcggggaatcaccagcaaccagaaggcagcaaggaaggttgttaagcgtgtggtggaagagggccatgttctggtcactacctattctggattacaaacatactctcattttctgatcccagtggagtggggttgtgcaattcttgatgaaggtcataagattcgaaacccgaacacttctattaccatccattgcaaggaacttcggactccacacaggatcatcctctcgggtacccctatgcagaataacctgaccgagctttggtcacttttcgattttgtgtttccaatgcgccttggcacgttagtgaactttcggaaccaattcgaattccctatccggcaaggtggatatgcgaatgcttctaacctgcaagtgcagacagctgccaagtgtgcagagacgctcaaggatgccatcagcccatatctattgcagcgcttcaagatcgacgtggctgcggatttgcccaaaaagaccgagcaggtgctcttttgcaagttgaccaagccacagaggatggcatatgaatcgttcctgaaatctgaagagatggagtccatcctcaagggacgcaggcagattctctatggagttgatatactgcgtaaaatatgcaatcacccagatttacagaatcataaaatgcaatcgcatcaatcaggctatggaaacgcgaacaagtctggcaagatgcaggttgtcaaatctctattggagttgtggagagataccggccataaaacattactttttgcccagcatcgaatcatgctggatatccttgagaagttcgtcaggtcactgtctgggttcaactatcggcgtatggacggcaccacacccatacagaaccggcaaaccattgttgacgagtttaataatgacccgaatatacatgttttcctactcacgacaaaggttggagggctgggagtgaatctcacgggtgcggacagagtcatcatctacgatccggattggaacccatcgacggatgtgcaggcccgggagcgagcatggcgattgggtcagaagcgcgatgtcagcgtctaccgcttaatgaccgctggaacaattgaggagaagatatatcatcgacagatcttcaaacaattccttacaaataagattctcagagaccccaaacagcgccagacttcctttcagttgagcgatttgtatgacctatttgcgcttggcgacgagaagccaggtgccacggagacgagcaagctcttccaagatgctcaggttacatttcatggagacggtgacggcaatactgcacagcctaccaaagccgaggacgtctcatctgacatgcaggccgaaaagaacgacatcagcaaagtagtgggtgtctcgtccgtggagaggtatcagggcgagtcggagcagcccagcgatcaggagaaagggcctggaggagttaattcagaatcacgcatcatggaaggcattttcgctcgctctggcgtacattcggctttggagcacgaccagatcgtaaacggcaaacgggttgtccgagcagaccccaagatc

SEQ ID NO: 14216 - DNA, 345 bp, A.fumigatus
catgttatttcgtcatatagcggtgccgtgatgaactgctgcgacaactctggtgcccgtaacctgtacatcatctcggtcaagggagttggtgcccgcctgaaccgtcttcccgctgccggtgtcggtgacatggtcatggccaccgtcaagaagggaaagcccgagctccgtaagaaggtcatgcccgccgttgtcgtccgtcagagcaagccctggagaagacccgacggtatctacctgtacttcgaggacaatgctggtgtggtgagtacaccttttttttgtcccttttttctggagcggcggttacgatttgtactcgtgattgcgggatatgaatga

SEQ ID NO: 14217 - DNA, 240 bp, A.fumigatus
aacttgaaaaatataaagccatatgtaacgtcgaggatgccctccaaacgccagcaacaactgcaatataccaaccacaagcacaccaacatcgaagatgatagccaatgtcagtacgatccttcccctactgcctctgttggccatggcaatgccttcgacaccagaaatagccaccaacaaacgatcagtcacctgtctgaaagtcggcgctgttgctacagccacttgggtcaatag

SEQ ID NO: 14218 - DNA, 1716 bp, A.fumigatus
tgcgtcagtccttcacgggctcacccacgtgcgggagaaccttcacaactgtccggttccccttatggcatggagaatggaccgccaacgagcagtgaagactggcaagagcgtggtgcagctgtctccgtcaggcaagaaattgatgccaatggcaagccggtggcgcggtatatcaaaaaaggggtccgcgatttctccttcggacagacattgggagagggttcatacagtactgtcgtattagcgacggatcgtcagacattgaaggaatatgcgatcaagattctcgacaaacgtcacatcattaaggagaagaaggtgaagtacgtcaacatcgagaaagacacactgaatcgactcacagaacaccccggcattgtccgactctactacacctttcaggatgagcgctcgttgtatttcgtgctggatctttgcaaggggggcgagttgctaggagtgttgaagcggatgactacctttgatgaagagtgcaccaggttttacggtgctcagatccttgacactatcgactacatgcacaaacgcggcgttatccatcgcgacttgaaaccagagaacgttcttctggacagccaaatgtacatcaaaatcactgactttggcacggcgaaaatccttaacaatcaaaagaagaccgatcagaactcaagtgggatgccaccactcgactcctctgagatccctgaagatgaacgagcaagctcattcgtcggtacggcagagtatgttagtccagagcttttgacggataagaatgcctgcaaggctagtgatctgtgggcgtttggctgcatcatctaccaactcctggccggtcgtcctccgtttaaggctgcgaacgagtacttaacttttcaaaaaatcgtcgcgcttgagtacgagtttcctgtgggcttccctacggttgctcgagacctcgtcgagcgtcttttggtccttgagccggctaggcgtctcccgattgaacatattaagaaccatgagtttttccaaggtgtgaactggggctcggatttatggacccgcaaagcacctcgactcagggcgtacgtgcctccacctcgtgagcccatcaagcttaatgggggtggtgacaatgatagtttcccccccgttatctccacggcaccttcgaacgctcccaattccaacgcccgagtagtgccgagattggtaacagaactgcctcctccgagtcaactcgatattgagtggtcccctgtcctgaccaagacgaacgaaaggatactcaaattaggaaactggatggtccttagctctcccgccggccatagtcctgcctcgaagaatgggagcagtgaagtcgaggcgccaaaaaagttttcgcgcttcttcggtgggagtacgacaaagaagcggcagcgtttggtcatgattacttcctcaggacggatcatcatggctgcagcaggaggggacgacaagaaggccaagatggagatttctctgctcgcgccggggacgtcgtatcgtagtgcgacggattcgaaagggttttcatgttggattgtggatactgtatgctcatcgttacttcccttcaagtcttcttctgctaagtttcatgcgtacagcgcgacaaacatctcgtctttgaagatccaaagccatcatcaagtaccatgggtgcgaccgccttgtctgtccaagaatgggtggatacgctag

SEQ ID NO: 14219 - DNA, 744 bp, A.fumigatus
gttctcgtccgtctggcatggcatgcaagtggtacctatgacaaggaaaccggcactggaggaagcaacggcgctaccatgagattcgcccccgagtccgaccacggtgccaacgctggtctcaagattgctcgggacttcctcgagcccatcaaggcccagtttccttggatttcgtactccgatctctggactctggccggcgcctgcgccatccaggaactgggtggtcccaccattccctggcgccctggccgtcaggacaaggacgtagctgcctgcacccctgatggacgtctccccgacgcttccaaggaccagagacacatccgtgacatcttctaccgcatgggattcaacgaccaggagatcgttgctctgatcggggcccacgctctgggccgtgctcacccagaccgttctggctacgacggcccctgggacttcagccccaccgttttcaccaacgagttcttccggctgcttgttgatgagaagtggcagaaccggaagtggaacggccccgcccagttcactgacaagaccaccaagaccctgatgatgcttcccgccgatcttgccctgatcaaggacaaggagttcaagaagcacgtcgagcgctatgccagggacagcgatgccttcttcaaggatttttcggacgctttcgtcaagcttctcgagcttggtgtcccctttaccagcaaggctgaggaccgctacgtcttcaagacctctgagtaa

SEQ ID NO: 14220 - DNA, 243 bp, A.fumigatus
accccctctcatctccacaccggcacccccgataccagcacagtagtccctccccatcgcccatctcctcacatacaagatcctccaaatcaactacctcgagacctgtatgaaacgctgcctccgcgcccttgtcccccttccccgccgtcacccgctcaagtcggaggacacgatcatattccgcccgcagggcagggtcagaaagcgtcttgtaagctgctgttatctcgtcgatggtga

SEQ ID NO: 14221 - DNA, 234 bp, A.fumigatus
agacaaatccgaggcacggatcagaatgggaaaaactgtaagatcaccggtgacgagatgtggcaggcttaccaggatattcgcaatattgggggctgtgggaagtgcgggaccaagcattttgggaatggatgtatggtcagcgtcgactattactatggctgtgataatcgagataagggcgtgcaggttatggcagctttcgctgagactaacctaacggactctatgtag

SEQ ID NO: 14222 - DNA, 282 bp, A.fumigatus
gacttgaggatatcctcccttctcatccattcgtctgccatgcggtacttgcctcagccaatcgggtccgatgatgacagcgacacgagcagcgacattccagatatcttctcagatagtgttgctgatgatatctcagagagtgcatccaagctagacagcagcgatgacgactctgacgattccaatgatgatttaatcctagatgatgaggaaggacaggagctttccgccttgcactaccttgaagaggctaaatctctcaatgtctcacagctctga

SEQ ID NO: 14223 - DNA, 198 bp, A.fumigatus
aacctttcgctcagtctagtccgcaatccagatggaggacgtccttggttattcatttactcaaccccggagtttaccaaaactttcttgggtgagaaggatgattgccacgccgttttcgacgcgacatccacaactgaactcaactgtgcttacattcataaggctatatcttcggctccacacttatatccttag

SEQ ID NO: 14224 - DNA, 555 bp, A.fumigatus
ggtcgaccattctctcgaggaactccattttttttctctctcctcttcatcattgttcttttgcagaggaccggatcttgcggtatcactgttggaccagctgttatggctccaattcagtcacagggtgccgatgtggaggtttgccctggcgacccatcattgcgcgatgatggcgtctctaagaagccaataacggccgaagaggccatggagattgccatcggagaaagcaatacagtcgagtatacgatcgattcggataactcgccctatttggaagtccgggctaatgtgcccaacactgatgatcctacgctacctatcaacacatttcggatgtggttcctgggggttgttttcaccttggtaggtgcagttcttcatcagctatcgatgtacgctgtccctactgacttgggtattgatgcaggtcggcacgggtgtcaaccaattcttctcgatgcgttatccgagtgttaccatcacgtcccttgtggcgcagctggtcagctaccctgtagggtgctttttcgcaaaggtactgccgattaa

SEQ ID NO: 14225 - DNA, 468 bp, A.fumigatus
gcaagtgctatcattcaagcacaaagagtcttcctcaatatgccaaccccagttggttaccaaatcttgctcgctctgtctatgcagatgttcggccttggcctggctggactatcatatcgatatattattgaacccccgcagatggtatgcagagcactcatgcaggaagaggaagaaactgaccacctacagatctggccttcgacgttagccaatgctgcactgtttcagacacttcatagcggcgcgaacccgatcgctgatggatggaggatctctcgttatcgctttttcttgtatgtctttattgggagcttttgctggtattggctccccggctatattttcaccggactaagcacattcgctttcatttgctgggccgctccaagtacgtcctcgattcctcccaatgagataggtgatttttctaacagttcactttgcagacaacaaagtacttaa

SEQ ID NO: 14226 - DNA, 186 bp, A.fumigatus
gtaaacgattcagctgtctttagcctgaatcaatcgaacccgaagttggccatggttatcgctgttattcgcttatccaccgttttggcgtcggattacgaccgagcatggtatcttgctccaccgggtccatccatcacatatcgattgtggttggatttggttgacaagaaatggtttgactga

SEQ ID NO: 14227 - DNA, 561 bp, A.fumigatus
gtgcagttcttcatcagctatcgatgtacgctgtccctactgacttgggtattgatgcaggtcggcacgggtgtcaaccaattcttctcgatgcgttatccgagtgttaccatcacgtcccttgtggcgcagctggtcagctaccctgtagggtgctttttcgcaaaggtactgccgattaagaaggtccgcctcttcaatcggtgggatctggtcatcaatcctgaccaccatttcaacatcaaagagcatgctgtgatcaccattatgtcgaatctcagtttcaaccagtcatgggtgagtgactaccgaccttggaccaaaggagtgcctctgacaaagagtaggcaagtgctatcattcaagcacaaagagtcttcctcaatatgccaaccccagttggttaccaaatcttgctcgctctgtctatgcagatgttcggccttggcctggctggactatcatatcgatatattattgaacccccgcagatggtatgcagagcactcatgcaggaagaggaagaaactgaccacctacagatctggccttcgacgttag

SEQ ID NO: 14228 - DNA, 585 bp, A.fumigatus
gtgatttttctaacagttcactttgcagacaacaaagtacttaacaatttgtttggaatgaccactggacttggataccttcccacaacctttgactggagccaaattgcttacaatacctcccccttggtcatgccattctgggcacaggcaaacgtgttcgccggctggttctgcgtttatgcagtgattgcgccaatcctatactacaccaacacatggttcactgcatacctccctctgaccggatctgatgcgtacgacaatactggcaacgtctacaattcgagccgaattctggatgcgagcggtgtcattgacgaaaccaagtatcgcgaatacagcccgatctttctgcctgtgacctttgccctgagctatggactcgggtttgctgtcctcagctgtctgatcacccacgtcctgctctaccatagcaaggatatccttagcacattcaagggcaacaataaaaaggatatccacgcaagactgctttcccgctaccccgatgttccatggtggtggtttgcagtcctgacggtaagttcaggcgtttcagcaatctcccctggcaaaggctga

SEQ ID NO: 14229 - DNA, 318 bp, A.fumigatus
gttcaggcgtttcagcaatctcccctggcaaaggctgacccccgacaggtcatcgtcgtggcggtagcaatcatgacgcagtatatctggcatacaggacttccattctggggcctctttatcactcttgcccttgcggcaatctatgtgatacccgtcgggaccgtctatgccgtcgctaatctgaacagtaatgttctgactgtactgggagagattatctcgggctatacgctgaaaggaaagccccttgtgcttcttatattcaaggtaaagcgcagtcttcaccacggggctggaaggatccgcggtggcgat

SEQ ID NO: 14230 - DNA, 594 bp, A.fumigatus
ccttcctatcgggcgtataaagctgaccgtcacggtgtctggcaccctcattctgcgaccagccagatcaacacaacaagtctttcctttttgactctcatagtgttcctgaaatcctcaatatctcattttcgtactcttcaggacaaggtcatggcggtaaccaagtcatcttcccttttgatcgtgggggcaggcacctggggcacatcgactgctctccacctggcacgaagaggatacacaaatgtgacggttctagatccctaccccgttccctcagccatctcggctgggaatgatgtgaacaaggtcatctcctccggccaatatagcaacaacaaggacgaaattgaggtcaacgagattctggctgaagaagcgttcaatggctggaagaacgaccccttgttcaaaccatactatcacgatactggattgctcatgtccgcctgctcccaggaaggcttggaccgccttggagtccgtgtcaggcccggtgaggaccccaaccttgtggaactgacacggccggagcaattccgcaaattagctcctgacggtgttctacagggagatttccccggctggaac

SEQ ID NO: 14231 - DNA, 1665 bp, A.fumigatus
atagctctatgctgcaccgtgaaggattggtataaagatgatcactctgttgatgtcaaaaacaccgtcatccatcctccccctgtcttccaccctcctccggtgcaaggcttccggaagcgcgatgatggagggtctcacattggcactccaaactcccataagcagggtaaggcggccgagggcgacaagtctggagcatctgccaagcacggcggagttaccttgattaaaggtccctccggtaacgatggtggcaacagcgctgagatcgagtttgacagcaagtatgcatctgcggtggaagatcattacaaggatgaccattctgtggatatcaagaaccacgtcgttgcgccacctgcggtgccaaagggcttccgcaaacgcggcagcgacccggttttgttgggtggtcccagcggggatgatgaagggaatgatgctgactttgtctttgatgacgactactcgtcgacggtcgacgaccactatgtggatgatcattccgtcaaggcagagaattggattgtgcacgttcccccgcccccgtcgccgcctcgtcctgagccctcgcatcctcaaaaaccctctttcgtgcccccttatgctcagggacctcctccccaggcaactgcgcctcctttcgctggcaacccagaaccgcctcaaggagtggacccggcagcaagcgagccatgcaccacatccacattcattgagactgtcatcaagacctttgcagatgacccggtggcaactaagcccgctgccccatacagcccgcctgagcattctcaagctcatgtgcctcagacatatgctccatccgagcccagccatgggttcgagccgacgcatcccgccgaggctgtgccaactggcggttttcccccccatgaggttgagcctcccaaggaccacgagaagcctggcccccagaagccagagcctacccacccctcattcaccacgtcgaaggtggaaggtcatccccagcccactggcgcttctcccacccacgaggttgagcctcccaaggagtacgagaagcctggcccccagaagccagagcctgcccacccctcattcaccacgtcgaaggtggaaggtcatccccagcccactgttccgtcataccccccgcaggaaaacctccaggaaccccctgaggacagcgctcccactgaccctggtcccggccagtctgaaggcgatgcgtttccttgcccctcgggtaagcccggaggtcaccagcctgagcatgccgctcatgagtaccaaccgcatcaaacccagggtgttgacccgcaggaagctcccaagcacgcgcccaccgcggtagagcccctgacctccatcacgtccaccatcaccgtcagctacacctcctccttcgcggtcgttcccgtttacatggactcgagccacaagacttcctgcacgtcgggagcccaccagcgacccaccgacgttgacgcccacaacagtcaccacgcgccttcctcggcacacagccaggccgtcaaacccacgcaccacgctgctccgtcgccgacgcatagccagactctgttcactggcgccgccggccgcatcacacccgctgctggcgttgtgtcagccatgtgtggtctcatggctgttcttgccttcgtgttgtaa

SEQ ID NO: 14232 - DNA, 462 bp, A.fumigatus
aacaagcttcgaatagacatgtcttccgacgacgctcacacaggaggtaacctcgccgagatggctgaacacggcaccaccatgcccaacgacgcaggtctccaaaatactctcccctccgtgccacgccccgaccagcgcagcgaaagccaccagttcgataaccagggccttgcggagccatctctggctttcgccgcggataacgccactgatctgcctcggagcaccaaggagatgggcgcaagcggtgaggtcgtcacgggaactggcgatgcgttccctgtttcgggcgagtcgaagaggattaaccccggtgcgatggaccctggtgcgcgcggaaatgcgcggacgatcaagcatgcgaacctcaatcggagtatatttgatcggttggcgagggaagatggaaatgcgcatgagtttattagggagcatgagtttcggaatcgggatgagtga

SEQ ID NO: 14233 - DNA, 462 bp, A.fumigatus
cctccatcacgtccaccatcaccgtcagctacacctcctccttcgcggtcgttcccgtttacatggactcgagccacaagacttcctgcacgtcgggagcccaccagcgacccaccgacgttgacgcccacaacagtcaccacgcgccttcctcggcacacagccaggccgtcaaacccacgcaccacgctgctccgtcgccgacgcatagccagactctgttcactggcgccgccggccgcatcacacccgctgctggcgttgtgtcagccatgtgtggtctcatggctgttcttgccttcgtgttgtaagctgtcattcgtgccgttgatagctgtggcatttgtgtttctaattaacattctattctctcgtttttcgtatttaatgtcctttatatcattgggacttgactttgctcttacgctcgctctactgtctgtattcgtttctttacaataa

SEQ ID NO: 14234 - DNA, 558 bp, A.fumigatus
  unsure (54): Identity of nucleotide sequences at the above locations are unknown.
acatcaactggcacgcacctcgttacagccggtcaagatgcccgaatccgagtntgggacgcctccacaggtgccaatacccttgtccactttgggcccagggtccggaatggcgtgtcttctcatcttgccgagcgggctccgctgattgtgccccgtggactaatggctccagggcaagagaccttcctgtgggccaatttcaacgagcacgacgaccgcggcgagattttcatgttcgaacttcgagaggggacgtttatcaaacgtctcaaggtccctggtttaatggccggtcggcagcaaatccgcgggcgatccaacgccctcagcgctgcccggatcaattctctggcatggcgcggcaacggcggctcaggcgaagggctggagatgttctccgcgcacggcgacgggaccatccgcgcgtgggtctcacggcagcccgagggcgagcccgacgaggccgaagaggccgagcaagcggatcggaaacggaaacgagacatccttgacgagatctaccgggggttcgtcgccccttctacgccagcatag

SEQ ID NO: 14235 - DNA, 201 bp, A.fumigatus
aaacagcatgaacttcaccaggtaaaaccgacctgtgctcatcacccattcgccatcttcgctaactcgaatacattgactagcttcttcgaactcgaaatcctgcagcagctctatgcgattggcatactcggggtcatttttcaaactgcgctttcgccgccgtgcaagccattcgggaagtggtcgagcggtgtttga

SEQ ID NO: 14236 - DNA, 1617 bp, A.fumigatus
ctatggtgttgtaaaggaacatacaagcctcaaattcatactcactaccttccccaactgtctctatcttgggcgcggcatacagatgcgctcaatacgacgttcctccttctgtcctctgattactcaaagtcgatccatctgcaatccgatcgttcgctggagttccatacaccctcaggctgccattacgggacgaggcttcccagatatggtcacgatgtggtttacgacaggcagtcgactgaggctctagtgccggctgttggtgttaatcaagatggtatgggagaagtgttcaggctcaatctagagatgggccggtatatgcggagtttcgaagtagatgttggtggggacgatttcacatcgaccggcggtgggacgttacaaggaggtattcacacgggagcagtgaacacgggggctattgcggaggaaagccacaaccttctcgctttcggtacctcgatgggaacggtagagctatgggatccacgagccaagggcagggcaggagtcctattaccccctaatcagaccggcccggatgatggacgatctgagataacggcattagagttccatcgctcgggattgacgtttgcaacaggttcgtcgaatggtctgattcatttgtacgatcttcggtccccagtgccccttctcaagaaggatcaaggatatggcttccccgtccacacgctgaagttcctccagccctcgacattcgcacgcgaacagaccatggagcccaaaatcctctcttcagacaagaagatcatcaagatttgggacccccgcgatggcaagccctggacatcagtcgagcctgccgtcgacatcaactcagtcgcctggtgcaaagatagcggaatgcttttgacagccaacgaaggccggcaacagcatgcattcttcattcctcaactgggcccagctcccaggtggtgctcattcctggataaccttgttgaggagatggcagaagatcctaacgatcctaatgctttcagtacaggccagacaggcgctgtttacgacaactacaagttcttgactgttcctcaactcaagactttgaacctggatcatctgattggcaggaccaaccttcttcgaccttatatgcatggttacttcgtcgctcaacgcttgtatgaggaggctcgtctgatcacgaatccgtacatctgggaggaagagcgcgcaaagagagtcaaggagaaaattgacaaggaacgggagtctcgcattagaggcaagaagaaggctgccgtcaaggtcaacaagaaactggcagagaaactcatggctatcgaagagaagaacgagcggcgccaggcacagcgcgttctgaaacagggcggagacgagaacatggttgaagctccccgcaccgagaagccggcgactggtctttttggcgacagccgtttcgcgaagatgttcgaggatgaggaattcgctgtcgacgaaacttcacgggagttccagctccttaacccaagcaccattcccgagccagtagaacgcaaggaacgcggcctcaccgccgtcgaacaggaagaggtggacgaagtccccggctccagttcagaagaggacgacgactag

SEQ ID NO: 14237 - DNA, 381 bp, A.fumigatus
tcatccgcaagcgatgcagaaagacgtgttcggagcaggtccccgcactccggaaagatctccacatcctcatacaagcgcactaaccgtcccccgccccagatgcgcgtctcgtcatcaacaacgagccattccacccgcgatcggtcattcgcttcacgcgcccagaatatgcgcacgaaaaccaaacgtgcgcgtcgtggcggcgtggttggagaaagagaattcactttcatgccgcaggataagtcaaagcaaaagaaggcacctgcgcatacgcctgcgagcagtgattacaagtctaaggagcgccgcagcgcttctggtaacaccttccgaaagagtgagtttacaagacaggggccggaaggtatgcagtac

SEQ ID NO: 14238 - DNA, 804 bp, A.fumigatus
tgtcgacaaacgagacaaggcccattcatttatccagacagctccgttcgatgccatcgagacccgacggagtttggctcgggccgcctcgcccaatcaagtgtaagctgcatccgcattgtcattgtcacgtgcccgctcagctatcgattgtctccacccaaactttttttcttttatcagagagcgatatctttggagagcggtaacaattttcgctgtggtggtcgcggcaatcccagtgtcccctcgatcgttggagcagttactgagcaaaatatgaagctctccaatcaatccgaggttccagtatataccatttcggggtcaaacaccgctcgaccacttcccgaatggcttgcacggcggcgaaagcgcagtttgaaaaatgaccccgagtatgccaatcgcatagagctgctgcaggatttcgagttcgaagaagctagtcaatgtattcgagttagcgaagatggcgaatgggtgatgagcacaggtcggttttacctggtgaagttcatgctgttttcattgagtctcgcaactgactatggtgttgtaaaggaacatacaagcctcaaattcatactcactaccttccccaactgtctctatcttgggcgcggcatacagatgcgctcaatacgacgttcctccttctgtcctctgattactcaaagtcgatccatctgcaatccgatcgttcgctggagttccatacaccctcaggctgccattacgggacgaggcttcccagatatggtcacgatgtggtttacgacaggcagtcgactgaggctctag

SEQ ID NO: 14239 - DNA, 198 bp, A.fumigatus
atatattttttgaacttcgacatcaaggcgcagagggactttgagaagagtacacttgaccagatagcatcatgggaagcgtctttggatatctttcgatggttctctgtcggtggtgagggcctacctcttgagagcgttaatcaagacgactggctgagggaaatatgggaagaagacgagtggtatagatgctga

SEQ ID NO: 14240 - DNA, 300 bp, A.fumigatus
ctgtcgttagtcacctgctcgactatgactcccttccatcgactgagtcgatgttttcgacaggctccatcgccgccacgagcacctgtatcctccaactttcccatactcaattccgtcatgaaaatcgaggaagagcaaatgcctgcatttgagcgaggccttttctaccctgttaaacttggggatgtgttttgctctagatatcaggtactcagcaagttgggttttggcgcaaattcaacagtctggtttggccgtgacctccagtattccatggctttactacctcaacagtga

SEQ ID NO: 14241 - DNA, 402 bp, A.fumigatus
tatggcttcgctaatcttcaaggtagtcatcattgttacattgccctgaagatttacatccgcagttctgaggggaattgggaagtccaggtgcttaagcatctctcaagtgtgaaaacacatcatcccggcagctctcttgtccgtaaaatgattgaggagttcaaaatcacaggacctggtggtagtcatcagtgcattgtttatgagccgctattaatgagtcttttgtattttcaagctaccttgaacccacagagccttcctgaagacttactaaagggagcactgcagcaacttttacttgctcttgactatctgtactcggaagcccatgtcatatacactggtttgtgtctctccaaaccacatactgtttgtccagagctgatatcctgttaa

SEQ ID NO: 14242 - DNA, 324 bp, A.fumigatus
gatatacaagccaagaacattcttatcagttcaaaggatgattcaatttttcgcgagtgggacactagtgaggcagctgagcccggcccgcggaagttggatagcagccatgttatctatcaatcgcggccgttccatcgtaagaagggatggagaggctttggaatgccacttctgtcggactttggagaagctcgtctaggagatgtgcacaatgggttgattcaaccagatatctatcgtgctcccgaggtcatccttgggatgagttggacgtcgaaagttgacatttggaatgttggagcctttgtatgtgaaggataa

SEQ ID NO: 14243 - DNA, 213 bp, A.fumigatus
gagccgttggtatccttgccagcgtttgccatgcctagtatagttagagaacggcgacgttcgagtcaatggttcaaggagtgccgtactcagaagtcctttgcgggtgtgcctaagcttgaagttctcatccgcgaatttctcgccgtagatcgactttccaccggtacctacaagtcaaatactgtcagcacattcgctgttaccaattga

SEQ ID NO: 14244 - DNA, 351 bp, A.fumigatus
aaatccctcgagacgttcttcggtgttggcccccaggtttctgcacgtctcctcgcccgcttccacatccaccccacatgtaaggttggcgagcttgcgaacaagcaggttctggaccttacagctgctttatccgacatgaagatcgagaatgatctccggaggcagattcttgatgatatcaagcggctgaaggagtcgggttcataccgtggcagacgccatgcgttgggattgccggttaggggacagagaacgaggacacaggtgggttatccttttacgtttgcgggtttgatccggactcgttcgtgttacgagttggagacaaggaaaggtggtgcatactga

SEQ ID NO: 14245 - DNA, 201 bp, A.fumigatus
ccaggaacaggtctacagctcctcgtggctacctttggtggattcgtctttgatctctccacttttgacgatcttgactgtctccgcaggtttgtcgccaggacccttgggaacattttcgatctgttcgacgacctcgtagccctcaagaacctcaccaaaaacaacatggcgaccatcaagccaactagcagtacatga

SEQ ID NO: 14246 - DNA, 483 bp, A.fumigatus
cttgtaggtaccggtggaaagtcgatctacggcgagaaattcgcggatgagaacttcaagcttaggcacacccgcaaaggacttctgagtacggcactccttgaaccattgactcgaacgtcgccgttctctaactatactaggcatggcaaacgctggcaaggataccaacggctctcagttcttcattaccaccgttcctactccgtgagtttaccttctgtgatttgcttgccggtttatacgaaccgccaactaatacctcatgtactgctagttggcttgatggtcgccatgttgtttttggtgaggttcttgagggctacgaggtcgtcgaacagatcgaaaatgttcccaagggtcctggcgacaaacctgcggagacagtcaagatcgtcaaaagtggagagatcaaagacgaatccaccaaaggtagccacgaggagctgtagacctgttcctggtcagtccttgctgctttga

SEQ ID NO: 14247 - DNA, 186 bp, A.fumigatus
cgctcagaacaagatccagctgatgggctttacgatggtgagccgtcagaaatatcaactctgtccgaatcttccgcttattctcttcgcaacgttgcattcctttccattttcatcgctatggttttcatcgcggtgaagatcagtaagaaggccaagcagttcaatgagaagagcgaggtctag

SEQ ID NO: 14248 - DNA, 309 bp, A.fumigatus
gcatggcaaacgctggcaaggataccaacggctctcagttcttcattaccaccgttcctactccgtgagtttaccttctgtgatttgcttgccggtttatacgaaccgccaactaatacctcatgtactgctagttggcttgatggtcgccatgttgtttttggtgaggttcttgagggctacgaggtcgtcgaacagatcgaaaatgttcccaagggtcctggcgacaaacctgcggagacagtcaagatcgtcaaaagtggagagatcaaagacgaatccaccaaaggtagccacgaggagctgtag

SEQ ID NO: 14249 - DNA, 195 bp, A.fumigatus
cctggggtgagtaccggcaacgattggaccatattcatggagcacagcaacatcccagtactacctagcacccagaaggatgtatttaggatcagaacaacaagcggaaggtctggactagtacaactctgggcaaacgccaccaacatcatgtggactggaggacgatattacagggttgcgttgtgtggatag

SEQ ID NO: 14250 - DNA, 630 bp, A.fumigatus
gtctgttgcgtatctgtatctgtcatgccaactaatttgtttagcttcatgactgcctccaatggtattgctctccttgtcgtcggtcatgtcatcgctggtctttgtgtcagtatcacctcggctatggttcctgtctaccaagcagaggttgctccaaaggagattcgtggccgagtaatctccctccagcaatgggccatcacctgcggtatcttaattcaatactttattgtgagtgaccagctatttttgagcaaatggagacggtttctgaccattgatagcaatatggttccagcaacgtcgacggaggtcccgataacccgactcaaagtactgctgccttccgcattccctggggtatccagatggtgcctggctttatcctcttcgtcggcctgtttttctaccccaagtcgccccgttggcttgcaagcaaagaccgctgggacgaagcgatggaggtacttgccaaccttcacggaaatggagaccgcaaccatcccaaggttttggctcaatatcaagaaattgaggaggccttggctctggagcgtgagcaggcgtctactagctatcaggaactggtcaagcctcgcattctcaagcgtgtgttccttggtatga

SEQ ID NO: 14251 - DNA, 456 bp, A.fumigatus
cattataatagctttctggtgatactcccctctgtttctcagcgagttgtcaacaattccaaccttgttctcgtcgatgcaagtgtcatgcaacctcgcccagattcggtaatcctcactatgcagtctgcactcaaactgcccatcggacttcccgtccgtatcgatcccatcactttggacctcttcaaccggggcgagtccggaaacagcaccttcgccaaattgtacctcaacggaacaactatctcaggcaacaccactttgggagttactagtcaattcactccactcaatgtggatcagtggaccaaatatgtgcgcggtgtggtattcgaggagcatgcaccattgtcgctgaagggtactaccatgtcgtatctgggcaagctcaagtcccgagtgacaatggacaaaacgatcaagcaaaatagtaagcgaacgtcttatcagtaa

SEQ ID NO: 14252 - DNA, 540 bp, A.fumigatus
ggcacaaccgtgttgggactcaagagcggcgatctcgtcatcggcaatgcaacgattgataatcttgtcctcagaccgggcaaccattccaatcccgtccgcggcagactcgatctcaaaactgtgttgaagaaccttggacctgtcctgcagagccagaaagactccatccgtaacgggtatctgtctctcgacagcgttaccaagacggtcgtttatgagggcgtggaagtgccatattatacgaatgtgatgaaggacctgacccttactgcaaagattcctatcggcggactgctggtcaacaccctccgagggattttcaacaagaatgggacaaacatcctcgaccagctgaatatcacggactcatcgtcgtcggaaagcacaagcagcgtgctgtcggaactgcagcatctgaacttgagcagtctgggcggaagcctgagcagcaaattgaccagtcgatcgctggctgaattcctggaccgtcctgacgataagttattattggttgatgtgctgaaagcattcttgtga

SEQ ID NO: 14253 - DNA, 957 bp, A.fumigatus
caatatggttccagcaacgtcgacggaggtcccgataacccgactcaaagtactgctgccttccgcattccctggggtatccagatggtgcctggctttatcctcttcgtcggcctgtttttctaccccaagtcgccccgttggcttgcaagcaaagaccgctgggacgaagcgatggaggtacttgccaaccttcacggaaatggagaccgcaaccatcccaaggttttggctcaatatcaagaaattgaggaggccttggctctggagcgtgagcaggcgtctactagctatcaggaactggtcaagcctcgcattctcaagcgtgtgttccttggtatgagtctgcagatgtggtcccagttgtgcggtgagttgatcgtacccttctccatgaggcaaagactaatggctgctgctataggtatgaacgtcatgatgtattacattgtgtatatcatgcagagtacgggaactggaagccctctcctcaccgcttccattcagtacatcctgaacactgcgttgaccctacccgccatcatatacctggacagattcggtcgtcgccctgccatcctgattggttttgccttgcaagctaccttcttgtacattgaaggaggtctacaggctggatttggcaagcctaaccctcatgacgaccccaagctggatgccatttcttgggttgtgtccgaccatcccaacgtcggcaaagcaatcattgcgctctcctacctcttcgtctgctcattcgcgacaaccatcggtccgacttcgtggacctaccctgcggaaatctacccggccaaggttcgcgccaaggctgtctctcttgctaccgcgtcgaactggatctggaactgtcttcttgctctgttcgtcccgcctctactgtggtcgatcaactggaagatgtacatgatcgtacgtacttgcatggaaaacttatga

SEQ ID NO: 14254 - DNA, 465 bp, A.fumigatus
  unsure (465): Identity of nucleotide sequences at the above locations are unknown.
acaatagatctactgcatatcaacccgtctcacccccgccagagcacgacccccaccgctgcgtaccgaaacatcgaaccaaacacaatgctcataatcggcctaaccggctccatcgccaccggcaaatccaccgtctcagccctcctcgcctcacccccctactccctccccataatcgacgcagacctcctcgcccgtcaggtcgtcgaaccaggcacgcccgcctacaaagcaatagtcaactacttcggacccagcacgcccgacctcctcctccctccatcagacggcgatgcgacaagctcacaaccaccgctgaaccgcccggcgctcgggcggcgcgtattcggaaccagcgaggagcgcaagcgcgaccgcatgatcctcaacaagatcgtgcaccccgctgtgcggtgggagatttacaaggcgctgatatactactatgtgcgcggccattgn

SEQ ID NO: 14255 - DNA, 543 bp, A.fumigatus
aggctagtactgatggcaggtgccagatacataattgataactatgagcatctaccggacgtgatgctggtcatccactcgcagcgcttccaatggcacaacgacgatccctactacgacggagtccccgtgctccgtcgtttccaagtgtcttatctccaaaagcaaggctatgtcaatctgcgctgtgcatggactctcggatgtccggcggagatccacccgcacacggatacccaccgtgacgatgtgcatgcgggggagtatttcaagaacggcttcatggagctgttccctggggttgacgtaccagacgaggttggcgtatcgtgctgcgcgcagtttggagtcacgaactggaaggtccgcgaaaggcccaagagtgactatgtgcggttcaggaaatggttgtctgagacgccacttaaggatgatctcagtgggcggattatggagtactcgtggcatagtatgtttccaacccccctccccctgcgtcacagtgtctttataaagcaatgcggtgctaacagccatcagtga

SEQ ID NO: 14256 - DNA, 297 bp, A.fumigatus
gcaagtgtagccaaaggagcagatgagtccaagtcaacaacctgcttcatctcgacagtttccaggtcgaccacctgccctaagaaccagttcctacctatctccacatcctatctcttgctattgacttctcttactattctaggaatgactttaaattccaataggaaatactataaaactcctagtactatagtagcaagcctacttaaaatctataaagcagcagattatatactactaaataagtataaatttaatcatactaatgctaggtactgtattaatgggctatag

SEQ ID NO: 14257 - DNA, 306 bp, A.fumigatus
gcaccggatgccctcgcggaagagaccactggccagtcctacgtcaacggcgatgcgttgaccaactcagcctacgccatggtgatcttcaaccatcgtgtattcctagccggcgagtatgtcacggctgagaagtccaagcctgagatagaatctcgtcttccgccgaggattcgcccctggacttgccagctgagtcgtcaggacgttgaagggttaccatcgggcccggttacagatttcctggagaacccggacaacggcaacaattctagcagggaggtaggcatcttttcttcatggtag

SEQ ID NO: 14258 - DNA, 234 bp, A.fumigatus
gaacaaaacgccacaatacaactacaggctgcaacgagcggatggtggattcttggtcctagtaccatcaactatctttccagggatgagacgctcattcgagaactacatggtcttatatacaccatctaccatgaagaaaagatgcctacctccctgctagaattgttgccgttgtccgggttctccaggaaatctgtaaccgggcccgatggtaacccttcaacgtcctga

SEQ ID NO: 14259 - DNA, 555 bp, A.fumigatus
caagcggacagggcgccatcatcaacactatcaccaactttgaccggtctcagcttgccaatggtggagcccatgaggatgacttctacaatgtccagggccctccccagggaccaatggcccacagagcctgggaaaacagtcaagctccaggagtttacggatccatcaccgttctctatcccagcaaagacagccatgtcccgtatcatctatagcacgacaaatgcaaatggtactctggtccctgcttccgcctatatcctgtggccgttccagccaaaagctctccgacgcaagacccagaacaactctgggttatcatctgcccctgttgtgctatggaaacatggaacctcgggcttctacgccaatggagctccctcaacacaccgtggcctcttttacgcggacattgtgccttttgcactggccgaggctggatacgctgttgttgccccgactatgccggcctcggcgtggacgtctcctgggacggaagtcacattccgcaccagtactttgttcgcgaagctggtgctcacgatgctctga

SEQ ID NO: 14260 - DNA, 273 bp, A.fumigatus
gcaaaaatatccattgctagtaaatgcgtcgcgtcaagcagcggtacctccatcccaggtgagtctcgtgtcatcctattctcagccctcgtctccgcggagggcgaatcaagcaccgactgcaccagattaagatactccgccggtgctttgttcagaaaactcatgatgatccgccggagtatctgcggcgactccatcgaagtgacactgatcatgtatcttgcgacccatggtgagactctacataatccgccacctgattttggctga

SEQ ID NO: 14261 - DNA, 528 bp, A.fumigatus
  unsure (281): Identity of nucleotide sequences at the above locations are unknown.
tcgcatgatccaagtgagatttttcaggtgtacttcgcctgcaagcccatttcggaccgactgagcaatgcttgcaagggtgacattgtggaagaaaagcatggttttgcggagatattaagcggcgcagggtggcaaatggacgatatcctggaagccctcgagtctgctgatgacttttattgcgagcgactgggggtagtcaagatggactgttggtcccgcggcagggtgctgggagatgcagcgttctgcccgtcggcaaccactggcatgggcantaccagaatccttgtcggtgtttatattttggttggcgagataggtaaacaatgcaagagaagttttgggggtgatatcgatggaagtacgacaaaggatgctctgtctcgcgcattcaaagcgtacggaatctttcggcctttccttgaccaggtccaaaggggcttattggatggttatagtttctcggaccgacttccatcgacatctttggtgttgctgttctccattttgccttcgctatag

SEQ ID NO: 14262 - DNA, 837 bp, A.fumigatus
ttatggacaccatcatcatctaaactactttctgtgcctcttaaaatgaactcccagagaattgcatattttggcgccacaggcggatgcacaaacgcatgtctggccttgtctctccgacaaggcctcaaagccgtcgcactggcgcggacgcccaagaagttgcacgatatgctgctgtcccaaggaatcagtgaggaaaccatcagcgcaaacctgattatcatccaaggcgatatcaccgacgtcgcagccgtcaagaagaccttgatgtccggagacgaaagaaaactcgtggataagattgtctctggcgttggtgcgcggccgtcgttccagctttccgtgactactcccgtcaaaatggataatccgcatatctgcgagcaagccatcacaaccatcatcaaagcactaggggagatatatgccgaatatcccgacgagcgactgtgcaaacctgtcatcaccgtcatctcaacaacgggcgtggacggtccggatgatgtgccgtttggtttcaagtcactgtattccgttctgcttgcagtgccacatgaagataagaaaaaactggaggagctggtcaagtccgatgagctgaaggacgcatcgtcgagggtgtttggtggagcagtaattgttcgtccgtcgttgctggtcggagaccaccaaatcgccagcattggcgcaaagaagctgcgggtgggaacagaggagaatccgcctattgggtatacagtgcatcgtgctcgtgtcggccaatggattttcgaggaagttgtcaccaagtccaaggtggactgggtgggaaagattgtgactttgacttattaa

SEQ ID NO: 14263 - DNA, 483 bp, A.fumigatus
  unsure (410): Identity of nucleotide sequences at the above locations are unknown.
cacatgctggtcaccatgaggctatcccggagtatcgcagtcttcactctcgtcacctacgcgactggccttccctccctccaggtcattccgcgaggcgagccacagttgccgctgctcgatccgtcaatgaccatcaaggaagctgcgcgcaaatgtggggataaagcgcagctttcgtgctgtaatcgggtcgtcaaagctggggattatacctcagtctaccaggggatcggcgctggacttctgagcaacctcgctgggggtggttccggaataagcagcattctggcttttgatcaatgctccaggttagatgcgcaaggtgagcatcctaatcgcatctcttccgctcgtgaaatgactaacagtcgcagtccctgtggtccttttacctatccaggatctgntgaaccagcactgcaagcaaaacgtggcttgttgtcagaagaaccccggcgatgcggtatgtatctgacatga

SEQ ID NO: 14264 - DNA, 369 bp, A.fumigatus
accactacccttcctcttgattgtgtctatccatacggactacctagaagcaatctccgcaaatcaaagatgcctcacctaaaccccccgtctaatgaaggcaaggagccatcgactggaactcgacctactggctccgccgggtatgcatcattagacgccctatccacaagagaaggcaacgccagtggacgagtttttggtacaggcaccggcggcaccgtcacatcgccagagtattcgaccgccctgaattcggatgtcatgcagaacgcggagagtgatcgggcaatgagcaaggaggaggccgataggatgcatgagcagcgtatggaagaggaatatgcgaagagggagggtggtgcttag

SEQ ID NO: 14265 - DNA, 222 bp, A.fumigatus
gacacacccacagcagcgtacaggagtgacgttgtcgccacagctgtcactcactctatccacctcagactacataaacagatcgcaggctgccacaaggctatttgggtttacatcactcgcctggttcaatcgtctgaaccactacccttcctcttgattgtgtctatccatacggactacctagaagcaatctccgcaaatcaaagatgcctcacctaa

SEQ ID NO: 14266 - DNA, 669 bp, A.fumigatus
atactcttcacgttcccttcaaacttctttcatttaagcttactgtcattccagagggcattatcctgtaatccgttgaaaacatatccatcacatactatacttaccttcagcacgacactccttttggctttaaccatgcagtacaagacccttcccttgctcattatggctgccactgccctggctgcaccagaggccaggcccgaggctgccgccgaggctgctcctgaagccgttcccgaagctgctcccgcagcttctccagaagatgttggcaagagacagtatgaatactactcgagcctcatgaacgagctgaacagcttgtcagtatatccccagaaggcaagcaagctgaacgatactaaccgatcttgtggctacagggctgacaccagcaactgggacaaattcttgaccaacattgactacaaccaatacttgaccaacaccgagtacaagcaatacctgaccaacaccgattttggcggtatcccaactaataccgccgctgacaacgttcctacaaacaccaagctaggcggcgtcccgactgacctggaaggtctcccttccttctccatgccaaccgctgccttcacctacgacggcatgcctcctccgtccatttcgtctagacgcccggggctggaaagaaccgcgctc

SEQ ID NO: 14267 - DNA, 222 bp, A.fumigatus
aaaaaaaagctagatacaaaacgcctgggtagaatgtcgtcattgcgatgtgaactggaaatatgttattcgggcatgatcagccgcaagcctatggggcttatactcaccggcaccgatcgcaagagctgccagagtcaatcttggactgtgcgcgcctataacactgagaagtataccacacactgtccacgcagagtatggtccgataaatttccctaa

SEQ ID NO: 14268 - DNA, 264 bp, A.fumigatus
tcatgcccgaataacatatttccagttcacatcgcaatgacgacattctacccaggcgttttgtatctagctttttttttcaacgacctgtgcggtattattcgcccgcatgcattatttagtccatatatgaatgtcatgtcaattttctcactgggtaggaggcgtcagcatatgaaaatgggtgttccatggtttaattattcccgtcataataccaaattatcccgcggctggagggaatgggcgttgatagttaagtga

SEQ ID NO: 14269 - DNA, 405 bp, A.fumigatus
agccagacacctgtggagctgactcaaacagtcaacatgaccaagctctctctactgcctcttctcacattggcctctgcagttctggcaaagcaggatgctttccaagccaaatgtgctagctttggacgcaaaatcaagcttcctaacgtccatgtgaactttgttgaatatgttcctggagggaccaacctcacactgcccgacaacgatgtcacctgcggcgcatcctcccaggttgtgtcagcggatatgtgccgggttgctatggctgttgatacctcgaagagtagccagatcaccctggaagcatggtttccgcgggagtacactggccgcttcctgagcactggcaatggaggcctttctggctgtatggcttcttccaaaccgttgcaaaaatag

SEQ ID NO: 14270 - DNA, 1182 bp, A.fumigatus
agttccgttatggctaatattattataggcatccaatactatgatcttgcctatactgccggcttaggcttcgcaacagtcggcgccaacaacggccataacggaacgtctggcaagcctttctaccagcatcctgaagtcatcgaagatttcgcgtatcgttcaattcataccggcgtcgtagtcggtaaacagctcaccaagatgttttataaagaaggctttgacaagtcctactacctggggtgctccactggtggtagacaaggcttcaagtcaatccagaaataccccaatgacttcgacggggttgtggcaggtgctcctgccttcaacttcgtcaacctgatctcgtggagtatccacttctactcgatcaccggatcgaatacatcagacacatacctctcgccggagtcgtggaaggtcgttcatgatgagatcgtgcggcagtgcgatgaaatcgacggggctaaggatggcatcatcgaggataccgatctctgccagcctgttatcgagacaatcatttgcaagccaggtgcctctgacaagaccaattgtatcaccggtgcccaagcgaagactgttcgcaatgttctctccccattttatggcgtgaacggaactctactgtaccctcgcatgcaacccggctccgaactgttcgcttcgtcggtcgtgtacaacggtcagcccttccgttacagcaccgattggtaccgctacgtcgtctacaacaaccccgattgggatgccaccaagtggacggtcgaggacgccgcggtcgctctggcgcagaacccctacaacatccagacctgggacgcggatatatcctccttccagaaggcgggtggaaaggtcctgacctaccacggtatgcaggaccaactgatcagctcggataactcgaagctgtattatgcgcgtgtcgcagaggaaatgggcttgggccctgaagaactggatgacttctaccgcttcttccccgttagcggtatggcacactgcaccggcggagacggcgcgtacggcattggcaacgggctgagaacatacaacggtgctgagccagagaacaatgtccttatggcaatggtccagtgggttgagaaggggattgctccggaattcatccgtgtgccaagtctgacgccgccggctggaagatcagcgtcc

SEQ ID NO: 14271 - DNA, 1434 bp, A.fumigatus
caattgacaattcggatccaactagatgaccgtccccttgacctgtttccgatccacgttgtagttcttccacatggcaatcgccgggaacgccagaaccacaaccgccgtcgccgtgatacactcatacttctgactctccgtccatgcatggttgattgcattccgggccgcactgccgggcgggtacatcacctgcgccgtcgagccccccaggtagatagtcgcagaatcgcctttcaggtcgtccgggagccctcggagcagcgcctgtgggaaggtgttggcgtagatggccccggcaaccgcgtagccgatcgccccgccgaaactgccggccaggctgatcatggcgatcatcatgggcacgccgtcgcggtccgcggccgccatgacggccatctcgtccccgatcacgagcgtgccgccgccaaaggcgatgaagatctggcacatcacgagatacccgatcttgctctcggcgccgcggaagtggatcatgaggccggcgccgaggagcatcagcggggcgccgaaatacaggcaggttttctggaagtgtttggtctggcggatccagatgccgaagaggacggcccagagggtcgagccgacgctgtagatctgtgtcatgtagccggtgttggcggtgttcaggttgtagacgacctggaggtagtagtagtagtactggtcccaggtgtaatagttgaagaaaatgaccgcagccaaaatgcaggccccgagcaccgtccggttcttgaagagctgccacttgatgaaagcggtcggggcgaagaatctctcccatatcgcgaagacggggaagagcagcacgccgatgacgaccatgctgataaaggtggccgaggagtagccgctgaagccgtacgtctcgaggctgaagggcaagagaaacaggacaaaggcagccatgaggagaaaggcgccgacgaggtcgaactcgcgaaagtaatgccggaaggactggagaggcgtccggccgctggggtcccggacaaacacgcccgtcttctcggccttgcgctggtagaacttgaagaccagcgcgagaggcacaaaggtgaagaagatgacgatggcgaaacagccgtaggcccaccgccacgtggaatgggcatagaacgcctgcgcagcgagcgggccaacaaaggctgtacagatggtcggggtgccaatgaatgcgtaggcaaatgcccgattgcgcagcccggacgcgtccgcgacaaagacaaccaggatgaagttgacggccgtgtagccaatccagtacagcgtgtatccggctgcgaagccattggggccattgcaagaggcgatcacgataatcccgacgatcaagaccccgacgaaaaccagaaagccctcggctcggccccagagattgagggttttggcgataggcagctgtag

SEQ ID NO: 14272 - DNA, 1476 bp, A.fumigatus
  unsure (120): Identity of nucleotide sequences at the above locations are unknown.
cagcgattgctaatggatacggtgaacaggatctgggtgtgtttcttcatttctaaacctgcagttttccatcagcaacaatatgatctattacgcttatgcgggcttctcatcggctcnccagatctcccaggcgtatattctctcgactatcatcgggggagtgctacagctgcctatcgccaaaaccctcaatctctggggccgagccgagggctttctggttttcgtcggggtcttgatcgtcgggattatcgtgatcgcctcttgcaatggccccaatggcttcgcagccggatacacgctgtactggattggctacacggccgtcaacttcatcctggttgtctttgtcgcggacgcgtccgggctgcgcaatcgggcatttgcctacgcattcattggcaccccgaccatctgtacagcctttgttggcccgctcgctgcgcaggcgttctatgcccattccacgtggcggtgggcctacggctgtttcgccatcgtcatcttcttcacctttgtgcctctcgcgctggtcttcaagttctaccagcgcaaggccgagaagacgggcgtgtttgtccgggaccccagcggccggacgcctctccagtccttccggcattactttcgcgagttcgacctcgtcggcgcctttctcctcatggctgcctttgtcctgtttctcttgcccttcagcctcgagacgtacggcttcagcggctactcctcggccacctttatcagcatggtcgtcatcggcgtgctgctcttccccgtcttcgcgatatgggagagattcttcgccccgaccgctttcatcaagtggcagctcttcaagaaccggacggtgctcggggcctgcattttggctgcggtcattttcttcaactattacacctgggaccagtactactactactacctccaggtcgtctacaacctgaacaccgccaacaccggctacatgacacagatctacagcgtcggctcgaccctctgggccgtcctcttcggcatctggatccgccagaccaaacacttccagaaaacctgcctgtatttcggcgccccgctgatgctcctcggcgccggcctcatgatccacttccgcggcgccgagagcaagatcgggtatctcgtgatgtgccagatcttcatcgcctttggcggcggcacgctcgtgatcggggacgagatggccgtcatggcggccgcggaccgcgacggcgtgcccatgatgatcgccatgatcagcctggccggcagtttcggcggggcgatcggctacgcggttgccggggccatctacgccaacaccttcccacaggcgctgctccgagggctcccggacgacctgaaaggcgattctgcgactatctacctggggggctcgacggcgcaggtgatgtacccgcccggcagtgcggcccggaatgcaatcaaccatgcatggacggagagtcagaagtatga

SEQ ID NO: 14273 - DNA, 1554 bp, A.fumigatus
  unsure (95): Identity of nucleotide sequences at the above locations are unknown.
acaggatctgggtgtgtttcttcatttctaaacctgcagttttccatcagcaacaatatgatctattacgcttatgcgggcttctcatcggctcnccagatctcccaggcgtatattctctcgactatcatcgggggagtgctacagctgcctatcgccaaaaccctcaatctctggggccgagccgagggctttctggttttcgtcggggtcttgatcgtcgggattatcgtgatcgcctcttgcaatggccccaatggcttcgcagccggatacacgctgtactggattggctacacggccgtcaacttcatcctggttgtctttgtcgcggacgcgtccgggctgcgcaatcgggcatttgcctacgcattcattggcaccccgaccatctgtacagcctttgttggcccgctcgctgcgcaggcgttctatgcccattccacgtggcggtgggcctacggctgtttcgccatcgtcatcttcttcacctttgtgcctctcgcgctggtcttcaagttctaccagcgcaaggccgagaagacgggcgtgtttgtccgggaccccagcggccggacgcctctccagtccttccggcattactttcgcgagttcgacctcgtcggcgcctttctcctcatggctgcctttgtcctgtttctcttgcccttcagcctcgagacgtacggcttcagcggctactcctcggccacctttatcagcatggtcgtcatcggcgtgctgctcttccccgtcttcgcgatatgggagagattcttcgccccgaccgctttcatcaagtggcagctcttcaagaaccggacggtgctcggggcctgcattttggctgcggtcattttcttcaactattacacctgggaccagtactactactactacctccaggtcgtctacaacctgaacaccgccaacaccggctacatgacacagatctacagcgtcggctcgaccctctgggccgtcctcttcggcatctggatccgccagaccaaacacttccagaaaacctgcctgtatttcggcgccccgctgatgctcctcggcgccggcctcatgatccacttccgcggcgccgagagcaagatcgggtatctcgtgatgtgccagatcttcatcgcctttggcggcggcacgctcgtgatcggggacgagatggccgtcatggcggccgcggaccgcgacggcgtgcccatgatgatcgccatgatcagcctggccggcagtttcggcggggcgatcggctacgcggttgccggggccatctacgccaacaccttcccacaggcgctgctccgagggctcccggacgacctgaaaggcgattctgcgactatctacctggggggctcgacggcgcaggtgatgtacccgcccggcagtgcggcccggaatgcaatcaaccatgcatggacggagagtcagaagtatgagtgtatcacggcgacggcggttgtggttctggcgttcccggcgattgccatgtggaagaactacaacgtggatcggaaacaggtcaaggggacggtcatctag

SEQ ID NO: 14274 - DNA, 216 bp, A.fumigatus
acaatggcggcaactactgaaaaggacctcactgctcgaacaacagccaacatcgaggccgcctccgacacagtgagtctggaggaaaagagcgagcgagaaatcctcgaacgtcccaatgagattacacaagatgcccagattggagtgcaaaaagccgaagccacggccctcgtatggtccaagacggccttgtatgccacatatgcctggtga

SEQ ID NO: 14275 - DNA, 687 bp, A.fumigatus
tcgcctcttgcaatggccccaatggcttcgcagccggatacacgctgtactggattggctacacggccgtcaacttcatcctggttgtctttgtcgcggacgcgtccgggctgcgcaatcgggcatttgcctacgcattcattggcaccccgaccatctgtacagcctttgttggcccgctcgctgcgcaggcgttctatgcccattccacgtggcggtgggcctacggctgtttcgccatcgtcatcttcttcacctttgtgcctctcgcgctggtcttcaagttctaccagcgcaaggccgagaagacgggcgtgtttgtccgggaccccagcggccggacgcctctccagtccttccggcattactttcgcgagttcgacctcgtcggcgcctttctcctcatggctgcctttgtcctgtttctcttgcccttcagcctcgagacgtacggcttcagcggctactcctcggccacctttatcagcatggtcgtcatcggcgtgctgctcttccccgtcttcgcgatatgggagagattcttcgccccgaccgctttcatcaagtggcagctcttcaagaaccggacggtgctcggggcctgcattttggctgcggtcattttcttcaactattacacctgggaccagtactactactactacctccaggtcgtctacaacctga

SEQ ID NO: 14276 - DNA, 294 bp, A.fumigatus
ccaaaacaaaacagtaagttgggtctatgggatttttctcttggtatatcatgctttttatctttctctggatatctcgttcatgcccagcttagtatgtatgctagagctcttttatatgaccacggttctgacatgtataccggaactaacagagaccacaacgcaatcacagaccctccgatgtccttgttctctcatctacctcaatcgcacggctccccctcacatgcgccttccgccgccacatccgactctctctccttgcatatcgactccctctttcaattttga

SEQ ID NO: 14277 - DNA, 1428 bp, A.fumigatus
cccactcacggaccccgcttccgttcatccttggcagtcattatgtctcgaatcctggttttgcgaaaaaagccgcagctcatcggcatcctagaggaagaggtcttgcgtccagcgaaaaaacttcttgagggagcgcgagagggtaaaaaaacgagcccaggtatcccagatatgcctagtcgcgcgacatctgtggcgagtgattatgacggacaacgcgaatacgtcgatagggagtctatgcctccaccgccgacaccgtctactgtctctcccgcgaccgggacaagaagaggccggtcgaggatgagcacgagggcatcaacggcagatattgaggagaataacgtaccgagcacaccgtcaatcgtcacgaagaagaaggtaccgaaatcggagaacaagcacgcacgcgcttttgacagagaattgcatgatgatggcccggtgacgcctgttgctcgggatatggtcactccgcgcaaatccacgactaggaaattgcgaaatagtgaaattgctccttcaattgagcccgagccacatactgtctacgttaaatcggaaccaaaggaggacagtgttttcaccgatgacaatccatttcagagtggcagctctcctgcttcaaggagcatcagtcgtgatgtcaaacgaaagacaagttcacggctttccaccgccagccctgctttcagccacggactgagaccacgaaagtctgagaccccttatgatcttgatggtgatatttctagaacgcctacaagatcacccgttggatctcctgtcttcccgagggaggaagttgagatggacggtaaagaggatgaaagtgagctcagtgccggcgaggaatttacgcccgaggagcaattagccttggagaaacaacaagcggagttaatgtatccgacggctccacggatccgacgacgagctgccaagcagagtacggcaaacaaagctgctccctggatcctcattttctctttgctttgcggttttggcggttggtggcgcaaggagaagatcgagatcgggtactgtggtattggcaagcctacttggtcactggcagaaaccagagtgcccgaatgggcccgtgtactggagccgcagtgtgaaccttgccctccacatgcgttctgctacccgaacttcgaggcgagctgtgagaatgacttcattctgaaaccgcatcctctatcgcttggaggtctaatccctctgcctcccacatgcgaaccagacagtgagaaagctcgtcgcgtgaaagccgttactgacaaagcgatcgaagagctccgggatcgacgagctaaatttgaatgtggagagcgtctagaggatggtgaagacagtgacgtctccggaaatgagcgaagcggatctgaaacaggcgattgcacagaaacggcgtag

SEQ ID NO: 14278 - DNA, 648 bp, A.fumigatus
cagagaccacaacgcaatcacagaccctccgatgtccttgttctctcatctacctcaatcgcacggctccccctcacatgcgccttccgccgccacatccgactctctctccttgcatatcgactccctctttcaattttgattattatggttctgggtctggtttacactcgagcaaaaatccttgctcggcgatccgacctagctcgcgtcccagagctggtagcgaccacgttagatcgcctagcgacacaagcagcgcttcatgctcgcggtgaggcgagggaaccgtatatccccattggtcagttgcgtgacgacgtcctccgttctgagcttcatggcaagcgacgtgaagagctctggaggcgtgttcgcaatgtagttgagggcaatgccaacattcgcgctgcggtccgcgagggccggggtggagatgttgcgcgggtttgggaatggattgggggtatcggcggtgttcacggcaatgctctcgagagcagcgctatccgacgagagagtaaccgccaattgtcctactcatctccgtcgagcgagggaaaccgccctccgggcgatcaacaacaattgacgcccagaagtccgggtgaacttcgccgttgggacgaaggtagacccgtctattaa

SEQ ID NO: 14279 - DNA, 297 bp, A.fumigatus
gtaggacaattggcggttactctctcgtcggatagcgctgctctcgagagcattgccgtgaacaccgccgatacccccaatccattcccaaacccgcgcaacatctccaccccggccctcgcggaccgcagcgcgaatgttggcattgccctcaactacattgcgaacacgcctccagagctcttcacgtcgcttgccatgaagctcagaacggaggacgtcgtcacgcaactgaccaatggggatatacggttccctcgcctcaccgcgagcatgaagcgctgcttgtgtcgctag

SEQ ID NO: 14280 - DNA, 246 bp, A.fumigatus
gagccctcccaaagcatcggagggttacggttggtctcttgctcattgccgatgaagtgcttgacacaggcaatgactgactcctgtagaccacggatagtctctccggtcagggaaccggccaagtacgggtcgttggagaagccttcccagttacggccgccacgcgcggtccgaccaagaggtccaacaacgggacccagagcgacgttgacacccttgcgcctgaattccgcccccatgtag

SEQ ID NO: 14281 - DNA, 252 bp, A.fumigatus
atcgcagctatatcaaggtcgtgtatcccctggcttcttgtgctgaagatcgcatctatcgactcttctactcttgtctcctcggaagggaagatgaaactcacggttcctcttcttgctgctgccctgcagctggcaggcattgctgccgggcaggaggatgctgccatcgccgccaatctcgagaagttctggtcgtatggccgctcagagcccgtctatcccagccgtaagtgtgaccgagagtcgtga

SEQ ID NO: 14282 - DNA, 1485 bp, A.fumigatus
  unsure (82),(102): Identity of nucleotide sequences at the above locations are unknown.
ctaacagtacgttgctcaacagctgaaacccagggcttgggtgactggaatgaggcatatgccaaggccaaggctctcgtancgagaatgactgacgagcanaagaataatctcacttacgggtacaagtcaaccaccaatggctgttccggtaactcgggaggtgctcctggcgttgggtttcctgaactgtgcctgcaggatgccggaaatggtgtccgcggtactgacatggtgaatggatacgcctccggtgtccatgtaggagctgcatggaaccgtgatcttgcctacgaacgtgcgcactacatgggggcggaattcaggcgcaagggtgtcaacgtcgctctgggtcccgttgttggacctcttggtcggaccgcgcgtggcggccgtaactgggaaggcttctccaacgacccgtacttggccggttccctgaccggagagactatccgtggtctacaggagtcagtcattgcctgtgtcaagcacttcatcggcaatgagcaagagaccaaccgtaaccctccgatgctttgggagggctcctacaaccaatccgtctcgtcgaacctggacgacaagaccatgcatgagctttacctgtggcccttccaggacgcaatcaaggccggtgcgggatccgtcatgtgcagctacaaccggatcaacaacagctacgggtgccagaacagcaaggcactcaatggcctgctcaagggtgagctcggcttccagggctttgtcgtcacggactgggatgctcagcactcaggggtcgccgctgccgacgcgggtctggacatggcaatgcccgactccgtctattgggagaatggaaccctcgctttggccgtcaaaaatggctcgttggctcaaagtcgtttggacgatatggccacccggatccttgcatcttggtataagtatgcagagatcgagcatccaggtcatgggattcctgtcgatctccggaagcctcatgagttgaccgatgctcgcgatcccaagtcccggtccaccattttccagagcgctgtggagggtcacgttctggtgaagaacaccggcaatgctctgccactgcacaagcccaaattcctctctctcttcggctacgatggtattgccgccaccggaaacaccatggacaacgtcacctttggccgctgggtctttggactgtccaacaccctgaactatcccaacggcagcgccatcgataccaaaatccaaagggatatgttcctctcgagctacgaccccgcagccgagggacctggcgtcgccctgaatggcaccctgatcaccggcggcggttccggagccaccacgccctcctacatcgacgctccattcgacgccttccagcgccaggctcgtgaagacggcaccttccttgcatgggactttgcctcgcagaagcccatcgtgaaccccgccagcgaggcctgcatcgtctttgtcaacgagctggcctct

SEQ ID NO: 14283 - DNA, 552 bp, A.fumigatus
ccggagagactatccgtggtctacaggagtcagtcattgcctgtgtcaagcacttcatcggcaatgagcaagagaccaaccgtaaccctccgatgctttgggagggctcctacaaccaatccgtctcgtcgaacctggacgacaagaccatgcatgagctttacctgtggcccttccaggacgcaatcaaggccggtgcgggatccgtcatgtgcagctacaaccggatcaacaacagctacgggtgccagaacagcaaggcactcaatggcctgctcaagggtgagctcggcttccagggctttgtcgtcacggactgggatgctcagcactcaggggtcgccgctgccgacgcgggtctggacatggcaatgcccgactccgtctattgggagaatggaaccctcgctttggccgtcaaaaatggctcgttggctcaaagtcgtttggacgatatggccacccggatccttgcatcttggtataagtatgcagagatcgagcatccaggtcatgggattcctgtcgatctccggaagcctcatgagttga

SEQ ID NO: 14284 - DNA, 1734 bp, A.fumigatus
aaaagacaccgctcatctgcctcccacgcctggagagccagccccggacggtcaacgcagcaccttcaatctgtttttgctgcgccttcagtaaacgaaggtatgtcgtctgctgctatgcaaacggttcctcagtacacacccgcccgttccactgctacctatgtttcacttccccatccaatccccgcttcgacgtctcaatacgactatgcgcagcaactattcaatgacttaccccggtcaacgcaaccatcgtggcggtcgcgtgaccctcatactgccgtcgtgagcaccgcgctaagttctcagcagccatcttctcccccgacgacgacatattcttcggctatgagcgacccccacgaacaagctccgccgttgtccacccatgcatccccatctttgaaccccacactgccgacgcctggccagaatagtaaccgagcacccgtataccccgatcttcaaggtgctcctcccatcccgccgccgaggacatcttcaactcatcggactcaacatggttcaagcactacatcatcctccggcgaaagagtctctagttcgcgccgcaacaagagcaaacctgacgatcgaagcaccggccaccgcgaaagaagaggcgacgagcctcgctcgcactgttcagcagctcattcgtctgaggaaccgacgagggaaccgtccggtaagggatcgaggcgagtccagacaggatcatcctcagcggtcgactcacgctcggaggaggtgatggagaccatccccagcctgggaactttggtaaaggagtccagtacagttatcaaccaagtggtggtaagtgacccatcagtggacatcatgagggagcaagcacggcaagccgaagcgtcgatatcgccttctagcgacagtgctccgccatcgggactcgccttggtcggcagcgagggtgtggatgacggagggcgcggcggactacgcagtcggcacgacttcaacgaaaacacgatcaagcgcaaagagactacgttcggccagtacatccttgggcaaactctcggtgagggcgagtttggaaaggtcaagctgggttggaagaaagatggcagcgtccaggttgccatcaagctcattcggagggaatctctcggatccaaccctaatcggctgcccaagatctaccgagaaatctccattcttcgcgatctccatcacccgaatatcgttcgactccatgaaatggtggagaccgatcgccacatcggtattattatggaatatgcatcaggtggagagctctttgaccacattctgaacaatcgttacctcaaagacaattcggcccggcgcctgttcgcccagctcgtatcaggcgtggggtatcttcataagaaaggcattgttcatcgagatctcaaactggaaaatctgctcctggatcgcaaccgcaacatcatcatcacggattttggcttcgccaatacatttgacccaagtgacgagttgggcgaggagatcgaatacaatctcaccaataaggagtttgtgaagcgaatgcgcttagacaagcctaacgccaaaggcatgagacggggcgacctgatgcagaccagctgcggaagcccgtgttatgcggcccccgaactggtggtgagtgattcactgtacacagggcgcaaagtggacgtctggagctgcggtgtgatcttggtaagttggcacagactttcattgtcctctggatga

SEQ ID NO: 14285 - DNA, 948 bp, A.fumigatus
cgagttttcgcatgttgtgtctcacatcacgagcagtacaaccaaagttgcggacattgccgacacgacagttcctcctggtcagtgttcccacacgcgctcttggagcctgacgctaacttatcgtcgtgttttgcagaaagccatagggaagccccagcgctggctcgcagtgcctccgtcagagagcctccgaaagcataccagagctcgatacctacggttggagggcttgtgcatcaatccggagacatctcccaagagccgtcagtcgatcggtcaaagacttctcgggacacaaaacggcgaacggtacaggtcgaatatgtcgccccccaatctcagacagcaagaggagaaagcccttccgcgccagaatccccgaacgcaaagccatccgaagtccttccagccgcaaggcccggcagtcgagatgcggcggcaaacacacaagtaggcgctctaccctcgggtgttcatatggagcagcgctcaatacgggctggagaacccaaggcacccgctggctcggtgccgcctaccccagggcatttgccccgatcgacctcggacagcactgccctcacgggaacgcacacgacaatgcctccgacgcaagccacgcggcctacgacgggcgcctcaatggcctcgttcaatactggtcgcttgccctctcggggttcatacggacagcctgtggctcctactgttgcagcaaccaacgcacagggtcgccttgcccagccaaagagcaagcaatatgtgatctcggcaccaatccctcagaattcctcgcagcacgctgccatgtcgatcggacgtccaagcacacaggccctcccggccaaattcaacaccacccctcggcaggaaccactcaagggccataagaggtccagtcttcaccacggggctggaaggacagcgatggtcatcaatataacc

SEQ ID NO: 14286 - DNA, 672 bp, A.fumigatus
tatgctatgttggctggctatttgcctttcgatgatgatccagcaaatccagatggcgataacatcaatctgttgtacaagtatattgttagtacaccgctgacgttcccggaatacgtgacaccgcatgctcgcgatcttttgagacggatattggtgcccgacccgcgcaaacgagcagaccttttcgaagtggctcgtcacagttggcttagcgagttttcgcatgttgtgtctcacatcacgagcagtacaaccaaagttgcggacattgccgacacgacagttcctcctggtcagtgttcccacacgcgctcttggagcctgacgctaacttatcgtcgtgttttgcagaaagccatagggaagccccagcgctggctcgcagtgcctccgtcagagagcctccgaaagcataccagagctcgatacctacggttggagggcttgtgcatcaatccggagacatctcccaagagccgtcagtcgatcggtcaaagacttctcgggacacaaaacggcgaacggtacaggtcgaatatgtcgccccccaatctcagacagcaagaggagaaagcccttccgcgccagaatccccgaacgcaaagccatccgaagtccttccagccgcaaggcccggcagtcgagatgcggcggcaaacacacaagtag

SEQ ID NO: 14287 - DNA, 354 bp, A.fumigatus
  unsure (210): Identity of nucleotide sequences at the above locations are unknown.
atttctttataccctcttggattcgtttgcaaccagaatgaagaggagtgggcgatatctgcactgcaggattaccttttcgagttctcctcttcttcacagatattccctacccaattgggtaactcgacgggaaggaggtattttgcgtctcgaaggaacggtgatcgggaagaccgacaaacgcgggcgggaaaggatggtgttcancctccgaggcgcgatcgaacccacccactgaattaccaagccgcgcctgtgatgggattgaaagccgagggctatcaggcgcacacgctcaacactggcgagagaattgacgagatggagctatcgctgcgacgaggaccatga

SEQ ID NO: 14288 - DNA, 1191 bp, A.fumigatus
agtatgagctgccgtattgggaatattatcaagcgcgtcagagatcggttggctaaccagcatccttggtggcggcaggactcccaaacttcagatgacgagagcaattactttacctctgcagctcccagggctacatcgccaagagctgcacggagccgaaagtctcgacgccatatcacagaccgcagcggctacataccaacgccaccgtcctcgcccaagtatagcctaacaatcaagaacccctcgtcgttgatggaggtcctgtcacaactgtggaccaccagtggcccgacttcgccatggaaagcgaccaacgcgacttttatctactctctactccttccgacgttgaacacctttatacgcagtctcttgtctgccattgtgggattaccagaagaggatattgcgtcatccatgacagccgatattctgacgtcgacatcaccttttgcgacattggtgctgtcctttattgcttcgtcactgtctgccatgctgttatccccgattgacaccgctcgcaccttcctcatcctcaccccagcgactcatgggccgcgttcgctcctccgagcgattcgacagctccccacccccaactgcatgatcccttcccacctgatccctatcaccattctgcactcgagtctacctaacttcatcacaactactacaccgctgtttttcaagacctacctatcgatcgacccagttctgaatccttccatgtggaatcttcttgcttttctggggtctggtctagagcttgctgttcgatttccattggagactgtcctgcgtcgtgcgcagattgccacgtacacatcgcccagtatccggcagaagtatgccgccacctctcgttcgaacacgtccgctgccactgaggagacatctgtggtcgagaccatcgttcccgttccccagacctaccgcggcattgtaggaacgatgtggggcatagtctatgaagagggcgtcagcgcgccctcttccgatgctgagcgggttctcgggaagcccatctcttccaggaaacgccagggacagggcatcggcggtctctaccggggctggagaattggtatgtggggtatcgccggtatttggggcgccggcctgttaggctccatcggaggcggaggggatgaggaagtgatggttagtggtggtcgtttctga

SEQ ID NO: 14289 - DNA, 321 bp, A.fumigatus
aggttccaaaagcataatgtttcacatcccccggctccgtcatccgcacaggtcttcggaagctccgctcgcgacttgctaccggatctagactattcagagtacctggagagctctccctcgctatcagaatggattcgagatgcaatggatgcggcgatctggcggtacacaagcgtgctgactgcccagccatttgacgtcgccaaaaccattctccaggcgtatgtggtgcccaattcgcaagatggacaacggcctgcggatgaacgcaggaggtcaggccggatgggctccttcgatgaaagtgatgaagtatga

SEQ ID NO: 14290 - DNA, 339 bp, A.fumigatus
gtaacgctaagtcgcggtccttgccgccccgtggtgaaaaccgaagggctggcagctctgtctgccggcaaagcaacgcgcgaagagcgcatcgctcatgctaaggaaggcaaggatcggtccgagtacaagagtgtgaccgcacggcgcaaggagcgcaaggaagcgcagggaaagagtactaccaacaaggagaaggcgcgccgaaagaatctcttcatgactctaggaaaagcgaagagcaaaaacaagagaagtcttgtggaaacacgaaacatcttgcgtgctcaccagcaacggcaaaagcgtggtggtaggagaggaaacaccggatcttag

SEQ ID NO: 14291 - DNA, 879 bp, A.fumigatus
attgcaggaactctccactccactgctttgcacggcgttctccagatccatcaccatcctattccaagcaagatgtctcttgcgcagaacagcaacttagactccaagcgcagacgattccaaccgcctattacaactttcttctctccagctgtgtccgactcgaatggaacggatgctgcctgcagcccccatctttctcataaccactacgctgccgctacccattctcccacccccattgtccccgccaaaatccagtcctctctcctctccgtcggcatgcgcgtccgcaaatcagtcgctgaaggttacaagaccaagggtgtgaagatgttcgatacacctaccagtaccatctctctctccgcaaagcatgaacattccaccggtagagggtttcccaccgtccgcggggaacttgctcctttctgcggcctctccaaatcatgcgactataccgtggaacctcattccaatacagtctatgagctgtccgagacaaggggatacaacgtcgacatcgtcactgacgatggtgatgcgttctcgcttcctcccagcagtcaagagtccgtttactcggccaacaatggccagaaacgatcctatgacccctatgcggatgaagacgccagtgactttgaacacagtgtgtttgtgaccacagacaccgtacccggccgtaccatcctctgtccgagcctgggacgccaacggcgccgtttcgttgctttacaaagccaagccattcaacaggggactatgcaagtcgatgacttcgaagagccagtgttccttcgtaggcgggaagaggttgatgccgactacatgcctgctcgaatgggggactgtgaggttaaaatgggaggggcatga

SEQ ID NO: 14292 - DNA, 783 bp, A.fumigatus
  unsure (681),(682): Identity of nucleotide sequences at the above locations are unknown.
cccccgcactgcgttaccttccacgcccgggctgaagagctcgatggcgatggtgctgacgctacaacatccgagttccgggccaagcttaagtctttgaaggatatcgtcaaccctgctctgaggagaaaacaggagaatgctaatcggccggctcgtgttcagcttcttcaagactcgttgaaaaactcgaaaaccattctggacattttgcagaagcagattgaacaagacgaagagctctactcctcgagtctttctagtgcaacctccaccgaatccaaggagagctcaacttccactacttcaacagcatcttccagcgagtcgtcttcgacgaccgctgaccccctcgacgatttcgagaaggacccctacacaacgcccgcatccgagacaacctcgaccacctcgactaccacaacccctaaacccacaggcccgaagtactcaatcttccatccctctgacctctccagcctcaccaaggtctacgagtccacaaatacctggctcgaaacccagctcgccctccaggagaagctgacagagtccgacgacccggctttgacagtcgcagagattgacacccgtctcaaggaactggaacgaacgatgaaacgcatctacgagaagatgggcgccgcggcagccaagtctggtaaatcgtccggggaacanntcgaagagaacggcaagggcaattcccagaagcccaagaaggacaaggggaagaaggaaaaggccgagaaggccaaggctcctcccaaggatgaattgtaa

SEQ ID NO: 14293 - DNA, 348 bp, A.fumigatus
cccaccaatgagcagtcggcgctgacagcattcagtaacaacattgggcagattgcctacttacaatctgagaagcaccaggttaagcacatatactttggaggctcgtttattcgggggcatcaccagacgatgaatacattgtcgtatgccatccgattctggtctaagggtgagaaacaagcctacttcctacgccatgaaggctacctcggcgctgttggtgcatttctcaggaggcaaccagagaactggggtcgcagaaatagtattcatgacgcatcttccgcaattcaggcggcaaaggaagccatccccaagaaagatgaagggttgagctcaacgtag

SEQ ID NO: 14294 - DNA, 192 bp, A.fumigatus
cggggccgccttagaactcaattgtttcctaatgcattagatgataagatatccgagtttctcgacgataaaggaaataggctcatcgaggaggtatatcaaggagtttccaggtattttagcgccacttacttcgacgtacataatactactacatggattcatcagtatacatcaggctacaagcattga

SEQ ID NO: 14295 - DNA, 387 bp, A.fumigatus
ctctgccaaatcctcggcgtcagcacgagactatgccggctccaacaacaaacatctagttctctagcaagggctcgcaaggcgacctacccggccaaagcaacaaacacggccaaggtgactttcaaacttgtctcctacaggtcgggcgctattcacgcctttcccttagacgaatgcaagtacgggaaagatctattcgacaaggcccgggcatttttttttcgactattagacaggaacgtcgatgtcaagatactttcatgccagatttcgtctgagcgtgcgcaacattttcttttcggcagcgagggcgaatttgagcttctcattcaacacgccaaggacagcaagagacaaaagatggaacagttaccattgaagtga

SEQ ID NO: 14296 - DNA, 1224 bp, A.fumigatus
aatccaattgctagaaggtggaagaagctgatgggcatggccacagatccggataactacactgacactgaaacctttctcgaccatctccagcgaaacccgcgcgtggggccctacgacttctggcctctagtggctgactcgacagtgatagttcagcatgtgtgctcggtggcgattttcgtgtgctgttttgttgggattgtccaggagagattgagccctgtttctgtcgtctgctggggcagtgttggaacagccatggggtggattctgtgggactcttgggtttggcgcgagcaccatgccgaacaggctccgaatgcggggcgcatcgcggacggagacgatggttctagttcgagctctgcagtgagctcggtcaatccgtcgtccggggctacgtcgcgaccggttggcccgaaggatggtcagaacgaggttcatggtctggggctgaccatttccagcggtgaacctgacggattgctgcggcgacgtagcacaggattcagtggtgaggcttatggtccgtgtgagcctggctcgcctagtcaccaggccagtggtggcctcagcaatatgcatttgcaccacggctcccaggagaccgacgagacttcgttactctcgtcaaggaaccgccaacgactttcgactgtcaaatcggcgttcctgatctacttttcgctgcttggacttagccctatcctgaaatcgcttaccaagtctaccgccagcgattcgatctgggcaatgagttgctggctattgatcatgaacatattctcctttgattacggaagcggggaaggcgcgggcgccaccaaattcccggcttccctgtccactaacgcggctgtgatggcatcgactgtcctggcgtctcgtctgccgtctacaacccatgtcttcagtctgatgttgttctcaattgaagtctttggactgttccccatcttccgccggcagctacggcacacctcctggactggacatgtcctcctcacgctggcgctggtcattgtcgccggaggtgcggtcggaatgaccctgcgcggaggatggacagccgcggtggtcgggtcgttcttaggaagcatcatgactgcttttgccatggggggatgtagctggtggctcatcagtcttcagaagtacaagaacgtggtaacagggccatgggacccagcgcggccgattatccggcgacaatgggattag

SEQ ID NO: 14297 - DNA, 297 bp, A.fumigatus
ttaaccagacgctgggccctcgatgacaatggagtgctgggccgtcaagcctccaaccaatgcaacgccaactggaacctggacatcgcgcacattgaagcatgcaaaagcaacaactttcttgatcgctggacaggattggaatattttacgtatgaggaaatcatccatgaccgtatgaaaggacacgtccagttcctgcaggaatgggtatgtcttttcttcttgaaacacctcttcgaaagcagcacgcgatatgtgacggcacgacgagatattcagtttctgaagggttga

SEQ ID NO: 14298 - DNA, 1029 bp, A.fumigatus
cttgccatagaactcgaaacggacgactttcacaaaatattcgctagtatgccggccttgaatagtgtcaatctccgatttgcgggccaaatcaaagacagagtctttgaatacgtgattgaccgggatctccaaatcaggcaactgcaattagatgccgctaaccttgtctctgatacttattggcggcggctcttccagaaattgggatctcagctcgaaagcctgaaactgtcgaatctcgacttttcctttgatgacgaaaccgtggaaacactatgtagaaactgtacagccctcaaaagactaaagctcaagcagtgctggaagattggtagcgattctctacggacaatttcaactttaccaacgcttgagcacttgtctcttgatactatccaagatttggagattgaacccttattacagatggtgaatactcttggcccgaatctacacacactatccctggagggcttccacaacgctgatgatcggcttttggatcttattcatgacaaatgtcggttgctctcaaaacttcgtttttcagacaatgctctgtgcagcgatagaggatttgtcaacctgttcacgaattgggccaatcctcccttaagattcgtggatttgtcttctacacgagacgtggataatgctaaccctgatggtcctgtcgaggcaattggactcgcatctcacgggttcattgcgctcatgaaccactcgggctcaacccttcagaaactgaatatctcgtcgtgccgtcacatatcgcgtgctgctttcgaagaggtgtttcaagaagaaaagacatacccattcctgcaggaactggacgtgtcctttcatacggtcatggatgatttcctcatacgtaaaatattccaatcctgtccagcgatcaagaaagttgttgcttttgcatgcttcaatgtgcgcgatgtccaggttccagttggcgttgcattggttggaggcttgacggcccagcactccattgtcatcgagggcccagcgtctggttaa

SEQ ID NO: 14299 - DNA, 813 bp, A.fumigatus
tccaacaacatctccgctgctcagattcatcaagactaccaaagacgagtgagacaagccgagcgagaggtggctgcgaatgaaccggcagatgaactcgaggaggaagatgaatatgaagacaatgacggcgaaacggccgagcagagaaagaaacgcaagcgaaaggaggcagcgacgctcgcaaagatcaagcagagcaaggagttcgctcgccgcaaggcccgccgcactgggaaacccgatgatgacgacgatgtcattgctagagagatgatgtatcaaaaatcacgaccgatgccaggccaacttgagaattgtgagttgtgcaataagcgtttcacggtcactccatacagcaaaaccggccccaatggaggtctcctctgcgccaaatgttccaaagatgtagcagacgatgaaagaaagtcaaaagctaagaagcgagggccgagaagtggtcggcggcagaatcaaagcaacttgctcgacggaatcgttcagcaaggtgctctcagtttggtcgagatgtgtgcaaaggtgaacatcttggagcaatccttcgataagtcttgttggagaactgaccgcattcagaaagttgctgataaccacaacgacatcgaagaatttggggacttaccgtcacgattgcttcggcgccttagccagatattttccaaaaggcgtattcttacatcaaggactttgaacttgttcctgcgacctgaattgaatttcattgatatctacgatgcggctagtatgtctctacttgttttgtcaaattttcaacgtattaacttgccatag

SEQ ID NO: 14300 - DNA, 300 bp, A.fumigatus
  unsure (230): Identity of nucleotide sequences at the above locations are unknown.
tcctccaaacttgaacatggaactttccacaggctttcattttatgctagtctgttggaggtcaacacagctcaattgcagtggaatgcccccgttgcctcatgtctctcggtagacatgcctatcggcatgcactacacccatcttccacatatctcatcgaccacatctggattagcgaagaattgctcgcatcaaccttccgacgattcgcaaccagccaacgacgntacgaaagtcgagtaccagggcccttggaagccagaagacgtctggccaagcgacgaaataccgcattag

SEQ ID NO: 14301 - DNA, 2376 bp, A.fumigatus
  unsure (180): Identity of nucleotide sequences at the above locations are unknown.
tctgttggaggtcaacacagctcaattgcagtggaatgcccccgttgcctcatgtctctcggtagacatgcctatcggcatgcactacacccatcttccacatatctcatcgaccacatctggattagcgaagaattgctcgcatcaaccttccgacgattcgcaaccagccaacgacgntacgaaagtcgagtaccagggcccttggaagccagaagacgtctggccaagcgacgaaataccgcattagccggtatagccggctcaggacctctagaagatattgcatgtttgttcggacgaaatgggcgggagcatatgaaatggacggacagggagggacgaaatgttcacccggagacgcatggtaagaatctactaccgtgtcaatcttttgagaagatgtatcgtattcctaactgcaccaaagactcgcctccctttccattgagacctccggagcctcgtttgccgttctacagcgaaagcgtcgccccgatagagctcgacactttggatggtacccgggggttcccggatgcgtcacacaaaacgtctcgtgagcaggcactagaagaattcctgaggtcgcgtccttcggtcacagctatcgggatcttcgtgcgccaactcaatttcgatctccaacgggagcctacctacagccgcttgatacttgaacaccttctgcggcgatcagccaacgacgagggcgccatgaagaaggttgtcgaatttctcgatgatccgtatcttaacactagaggggctggaaattatctgtgcgctcttaagcataccttatcaacagcggcggttctcaggaaacagccggtattcgacgccgtcattcgatcgttggagctagggctcttacatcccagtgagcttcaagatattataaagactatatcaaatgttagattcaaacgatcgaatggattcacaacgcggaactccaggttcctggtcaggtttcatcgagagatgtgggacgccatcggacgctgcgatgtctatcgacacagggaccttggcaaggaaatagtcgatgcatggctgagcatcctttgcgaaagacaaacttatgaggacttcatactggcgaaggacgtgatcctggcaacccaggatcctagttcagctgatcgtcgatgggtgcctaccctgattgcatgctggcttaaagattcggcggaatcacgacgtagcagcaatcggcattttatcaaggagcttttgggctatttccatcccaccgccacatctgaaatcattattcgcacaaccgagtatatggtgtctacgaagatgggctgcttgcttgagtggcagcgccgcttgtccgagcttgacaacataacaaatattgtctcgtcacagaaatgggtcgatattggcacgcaacatactgccgagttattgggatctccgcaagagatgaactcgacgctatcattaaggcaccaaatcatcttgcgcatttggatgttgcgagcccttagcaaatctctcccccagggtccgctttggaggaaagatcagagggtgactgactcaccgataacccatctctgcacaatttacgaatctactctcgacaaagacggcggttacgaggacctcttaagcagcttgatgctggaaatccatacccttggcataccatctaacggcctgctgatgtcggtcgtggaattgaaggctgcaaagcggcgcacgacgcgagctcaaagacggacattagcgaaactcgagacaacaaaagtgtctttcgcagagatgttctcagacatccatgcttacaacgcgtcaaacacccatttcttcgccgcctatgagaagatggtgcggcagatcgatatcaccgacccttcgttcgtgaatcatgccattgagatcgccagagacggaaatattcaaagaatctggacactgatccgtttattccgttgccacacccctctcaaaattgcgatatcgagcttttggccgcgggtcccagacccctctgaaaaagctctagtgcggtactacccagagccaagaacctcgctctgtccagaccctcatttggccgtagagatgctccacctctttgctatttctctagcatgttcgaggaacatcagcccgcgccgtgcttatgcgctggtccactggctctacaatttcctgatgaagcacaacgcgcacgtgaaaccgtcacttgtgcgcgctatgtatcatgctggtgtattgcgtttccgaagagcagggttaaacgttgcgccgactcagtatgcctatatccttgaccgcgtgaaagaaatcgagacgccagaaatggtgcaagccctcatggagccgccccgcatgggggaaagcaggaaatga

SEQ ID NO: 14302 - DNA, 633 bp, A.fumigatus
  unsure (94),(189): Identity of nucleotide sequences at the above locations are unknown.
tccattatatcccccccaagatgttggtgtgctgtagccggaacagttgcagacaccgtattcacaacggccgtgatcagatccaacatcgtantgcactatctgtcgacgggcggccccccacggttagtcacgtgcatgaccttgttgaagcagcacctattcaggtaccagggacacatcggcgcntatctggtcgtcgcgggcgttgacccgacaggcgtcggtcttttcaccgtccacgctcacggttcaaccgacaagctcccatacgtcaccatgggctctggctctctggctgccatgtctgttttcgagtcgatgtggaagccgcagttgaaccgcgaagaggctatcgctttgtgttcggaagctattaaagccggtatcttcaacgacttgggctccggcagcaacgttgacgtgtgcgtcatccagaaggataagcccacacagctactgcgtaactacatgcggcccaacgagcgtggtgagaaagagcgcaattaccgcttccctaggggcacaacggcctacctgaacgagaagatcatcaccaaacaggacttgagaaaatatgtgactgtggaggatgtctctggggatccaaacctcatggaggtagattcgtga

SEQ ID NO: 14303 - DNA, 201 bp, A.fumigatus
aattctctctgcaaggagttgctttcctttcagcgcttggcctacggcgaccctatcagcaaagcttccctgcgaaactggaccggtttcgagaaacatggaagttccgggtctccagacagcagtgggttcgcgctcgttttgtggttccccatcactctggatcaacgcctcttgcttcgcttcttgtatatagtctga

SEQ ID NO: 14304 - DNA, 498 bp, A.fumigatus
atcaggactcacccatcaaccttatccaacaactatccaaagcccctttttccaacctccaaaatggaccaaccgcctctctcacctccggcagagcccgaatcaatctcaacagcaaatcttccctcaaacgcaccagtcccgctggactcccccctccgcaccaaccccattcatccctccctccccgatatccgcgtccccgggtcgcctttaagaccataccagtacgacccagtcacctgcacacccatcgatctggaatctgactctttccggactcaacttgaccacctcagaacggaatacgcaacccctagcgctgcgctgaaagcgcaggagcaagtagcaaaggaagcaaagcggaagatcgaggaggcggagaagaagcgcgaggaagtgcaaaaagccatggataagaaggttaaggaacgggatacggagatgaaggtgctgtctaagtatcagaaggttaggggcttggatattccgtcttga

SEQ ID NO: 14305 - DNA, 1110 bp, A.fumigatus
cctagattcgaatttatattaagagtaagtctgaccgttctcgcatatcgtagattcttactaaccaagatcttcgctcagatcatcgatttaaacaatgtaccacttgtgagtggaacggcgttcgttaaatggcgtttgccgtcgtctagtacggccgagcaccatggacatacggacaaagcaatcatccttgatcatcgagcgtactggaactacgagaagaccctgcaggtcaggcttacgattgatcgaaatcagacactccatgaatgcgaactcgtcctagacatcatacaagagtttgggtctggggggcacagcgacaagaattttttaggaaggatcaggctcaaccttgccgagtatgtcgacaagagcgatgacgaggaaggcatcgtgaggaggtacctgatgcaggatagtaaggtcaacagcacgctcagggttgggattgtgatgcaccaaatcgatggcgatcgaaatttcatcacgtatgctttgttatcactaatcataattagtctggtactgattgctagcagtccccccctaaggtccgccgcggttttcgcaggcattgcgggcgtggtctcctcagaacaagctgatcatgatgaacttggccggcttccgtccatcaacacccagagtcgagaggttgctgatatgcaggacatgtaccgccgcactcttgctgcttcatggctgtgtggcacagatgacatccccgcggataagttaatcgaggacctctttgccactgggtcttgcgggaacgacgaacatcctgatgctcgctctcggaggacagcggataataataacgagcttcatcctgatagggatacagatacaaggcaaaccagatcagggaaccgattgtccccaagtttcgagaggcgaccaaagagctcatccagccaattcctcaacgaaagcaaagggtctgactcgtcgggacacatcaggaaaggtggcagtattcaagagcagcttcaggacagtgcaaatggcaagacctggaaaagccgtagtgaagtggatgaattatctgaatttgatgtacgagaggatttgcggagctgggaggtttctgtaaaggaatga

SEQ ID NO: 14306 - DNA, 204 bp, A.fumigatus
cgtatcttgaccgataagattgcatccaaagctctaaagaaactctcgattacgaagaatttcatggagcggctggctcgaaacaatttgcccattttcccatatgctttcacggttcgcgaggccggcagcagggcgtctggcctgtcaatgcatcaccccttgcagagatattctacgatcatcagcgagtcgccagcgtga

SEQ ID NO: 14307 - DNA, 222 bp, A.fumigatus
tgtctactaccttatggatcagtgagcaatgactctctaccctggtatgaccgagtgagactaggtggttctgagggtctagtacgtaactgtgttgtagctactgtcaagttccaacatccgcagaatgccaacgtgcatgcactttgtctgatcctcggctccgttaaccccaccagcactaagcaggtacaagggtcgaggagtcctcctgagtcctga

SEQ ID NO: 14308 - DNA, 231 bp, A.fumigatus
ttgagcggccaacggtatactattgctactgagaccactcctctgccgaacaagacagtcggcgcagaggtcatgcaaagatactacgaccactggtttaatgtgacaaacactgtacttgaagtgcctaacatgctcgggtccattgcattccaaccaatgcctcggactatcaccagcaaagccaaagctagaggaggagtaatcgctgaaagccttcatagcatctaa

SEQ ID NO: 14309 - DNA, 390 bp, A.fumigatus
aaagcacaggtatggggaggaaactatatctttacagccgataagacgcctcaagtcttgagcgctcttcgtgacttcaccgagcattatcccgatgacaaggcggccatcattgtgacttgtgagcatggcttgttgatccacacctggatcatgttcctcttctacgacgggcctgagccaccagagggtgtttttaccaactttacagcaatcggacctaccgatactactaaaacgtgggatagctactatgacttggttagtaaccctgccgtcagtcatctggagtggcttatctcatatcgaaacagcttaaacataacgatatttttattttgcagtaagatgatcttctcagtactcgtgtcagctactgactttgattga

SEQ ID NO: 14310 - DNA, 366 bp, A.fumigatus
tcgctgaaagccttcatagcatctaaaaatgcgctaacaacccacaaggaccttctcgactttcccacagatcaagactatattatcattgagctggacttctcctatgcttttgctgcagacgatggcaagattgatgctgccaatcagaatctctacaggggctttgacaacatcatcagcgacaacattgacaagggactgttgcctgatgtttaccggccactcttcctgaatgatgcatatttccgacaggactactggggtcgtatccgtaccagggagcaggcattgcaaaccaggatcaagtatgatccagatgggtttttccagaagagaactagcggaggattcaggcttcattaa

SEQ ID NO: 14311 - DNA, 543 bp, A.fumigatus
cgcaccatcatgacccgaggtcaaccatggcgcgcagctgtagcaataaccgtggcggctcttgctcgcctttcggctgcagatatctgctcggtgatcaagcaacagggcatagagattcaaaagccgctgagtccccactactataaggacctggcgaattattggtctgctgcctgtggagacctgaagccgacatgtatcgctactcctacgagcgccctggagatgtctgcgattgtgaagcaactgcacaattttgacgacctcttcgcggtgaagtcgggcggacatatgcccaacaatggcttcgccagcattcaagatggccttctcatctcgaccgagaaccttgatcaagttatctacaatcccgaagaccagactgctatcatcggtcctggccttacatgggaagatgctcagaaaggtctcgatggtactgggcggacactcgttggtggacgtcttggtggagtgggcgtcggaggatatatgctcggaggcaagttgcagtccttgcgatggttgacatctcactga

SEQ ID NO: 14312 - DNA, 231 bp, A.fumigatus
gcagatatcaatccactacactccttcgacaccataggttatcatctgctcaatccctacacaatcaacatggccagatacggcgcactaggtgcaaccttccaaatcggccggaacgtccaagcttgctctctcatcgccattataggcctaacaagccaattcaatggcgagaacgtttcaaagaaccgcacggcggccagccgtttctttggacaaataccggggtaa

SEQ ID NO: 14313 - DNA, 1359 bp, A.fumigatus
ctttggcctcccaagatgcgaaatggccaattgggaacgatgagcggggtctatgggactttttctgatctcgcggaccccgtgccagctaaaacgccggttcctagaaaagccgacttcattcaactcgacggagtcagtcagcctgcggttgcagatatcgtgcgcagctttgtacgtgtctcctgcaccatgcccttgaagctcgatgggtacccgcaagccaagaaaaccggtttcgggttggtgatcgatgctggaaaaggcctggttgtggtgtccagagctattgttccctatgatctgtgtgacatcaacattacagtggccgattcgatcattgttgtggccaaggttatcttcatgcatcctctacagaactataccatcatccaatatgaccccagtctggtacaggctcctgtccagagcgccaagttgagcaccgagtacatcaagcagggccaggagaccatcttcgtgggcttcaatcagaacttccgcatcgtggtggccaagacagcggtcaccgacatcaccaccgtctcgattcccgcgaatgcctcggcgccgcgctaccgggcgatcaacctggatgccatcacggttgacacgggcctgagtgggcagtgcacaaatggtgtgctgattggggaagatggagtcgtccaggctttgtggctcaactatctgggagagcgcaccccaaactctcacaaggatgtggaataccatctcggtttcgccacgccggcgctcctgcccgttacatccaagattcagcaggggatcattcccaagctgcgaatcctcaacatggagagctatgtggttcaaatgagtcaggcccgcatcatgggtgtctcggaagagtggatccagaaggtagcacaggcaaatccgtcgcggcaccagctcttcatggtgcgcaaagtcgactgtcctccgccgcagtttacgtccaatgcggactccttacaagaaggggacatcatcttaaccttggacggtcaactgatcactcgcgtctctgagttggacaagatgtatgagaaggaggttcttgacgcccttatcgtgcgcaacggacaggagattcatctcaagttaccaacggtacctaccgaggacctggagaccgaccgtgctgttgtgttctgcggtgctgtgctgcagaagccacaccacgcggtacgtcagcaaatttccaagctgcacagcgaggtgtatgtcagtgcaagggtatgttcaacattgtacttaaagtttaatgtagccatggtactaaccttctccagagtcgcggttcgccggcgtatcaatatggcctggcaccgacaaatttcatcaccgccgtga

SEQ ID NO: 14314 - DNA, 210 bp, A.fumigatus
ttcgggactctcgatcctctggccaagtcctactttgtgactatccacgtatccggagactcgaggtattcacacaatatggatctaatttcaagtgagtggatgaacagtgaacattccgacctttactaccaacctgctcaagctattacctttggccccctcccttacttttctatgaacattatcacttctccagctgctcgttga

SEQ ID NO: 14315 - DNA, 447 bp, A.fumigatus
tgtagccatggtactaaccttctccagagtcgcggttcgccggcgtatcaatatggcctggcaccgacaaatttcatcaccgccgtgaatggcgtttcgacgccgaaccttgacagcttcgtcagggaagtcagcatgattccagacaatacatacttccgtctgcgtgctgtgacctttgacaacgtgccatgggttgtcacgatgaagaagaacgatcattacgtaggttatctcttttcctctgttggatatttgctgactgcgggacagttccccatgtccgaatacgtcaaagacccgtcgcagccacttggatggcgcacggtatcccacgagagagacaggcacaaggatggcatcacccctgacgcagccaatctcaatccagacgccatggacgaggtgtacgaagaggtcagcgacgttgaaccggaggttgattga

SEQ ID NO: 14316 - DNA, 798 bp, A.fumigatus
  unsure (771),(773),(783): Identity of nucleotide sequences at the above locations are unknown.
ggacacggtcgacttgatgacatctacgactctgtcacaaggtcagctactcgaaggggctgggatggcgtcgatctggtggtgatcggaggtgactttcaagtaagactgattcctaattcgagtgtcctttttgcctctaactttccaacccaggccgtccgcaactcaaatgatctcgcttgtatgtcagtgcctcagaaatacaaggcgattggcgacttccatgaatactatagcggaaagaagaccgccccttacttgaccatcttcattggaggtaaccatgaagcaagcaactatctgttcgagctttactacggtggttgggtggcacccaatatctattacttgggggcagcaaatgtcatccgttgtggccctcttcgcattgcaggcttgtcgggcatctggaaaggttacgactaccgaaagccacattttgagcgccttccctacaacaatgatgacgtgcagagcatttatcatgtgagagagttagatgtacgcaagcttctgcagattcgtactcaggtcgacctcggcctgtctcatgactggcccaaccgagttgagctttgcggtgaccacgagacgcttttcgcaaagaagcacggcttccgagaagattctaacaacggccgacttggaagcattgccgccagatttgttcttgaccgtctgcgccctgccttctggttctcagcccacttgcatgtgaaatttaatgcggtggttcaacacgcgcgacaacttttcttacaccagacngngcggaagganccacgtatggcgctc

SEQ ID NO: 14317 - DNA, 660 bp, A.fumigatus
gctgatattcacaaaagcctcttttcgcatatctcgagcagcccttttacttttgacgatatgcctatcagtgatcatactcctcgcttgaattttctcaaggactctgccagcgtgctggactcgctcagcccttcgacagcatctcatttgttaatggtccataatcgagttcttcatgatgagttcaaacctctgactcaacggcaactcgacttcgcatgtggtgcatgtggtagtatcagaaaacctgagaggaccaaaactattgaaattagaaagaaaaaagcaaaatcatctagttcttttgctcccaagaaatcttccgctctaggagctacggtctacaaatgccttcgttgccatcgaagaacagttaaaccagcagcacgccccaatataaaatctaagcccgacacaacagcagctcctgttcctactactcagtccacgacatctaccaccactgcaaaatacgtttctccaaccgcacaatctggtgaggcggaccgaagcagtaaaacagccgacaacgccagtagcaagaaacgtgcgaaagcgagaaagcaaggaggactacaagctcttctggcatcaaagcaacaatctcaatcaaaatcatctgcgtctcttgatttattcgattttctacagcagtga

SEQ ID NO: 14318 - DNA, 642 bp, A.fumigatus
acacaatcagctaggcagatgtcctccgactcgatgtccgactattcccacgatgaggagcacgacccccaggcggatgagctccgcgagacagctctagtgacgctggaaacgcttataagctcctgcagtcagcaaatgcaaccttacctggccaacgccgtcaaatcatcccttcgcttcctcaagtacgatcctaatgtggccgatgtcgaagacgatgaggaaatgggaggcactcaggatgatggctccgaggatgacgcaacagaggagcccgacttggaagacgacgaattcggtgactttgaagatgaaggaggctatagtgatattgatgatatgagctggaaggttcggcgctgcgcagcaaagttgctttacactgtcatctcaacttatgggcgtactcgtgctttggacgacacgtctttatatcagcaaattgctcccgctctcattgcccggttcaagaaggagagagaagagagcgtgaagcttgaggtcgtctcaactatgactgctctcgtccgaaagaccagtgaaggagctatgattataacctcgaatgggtttcttgaatcagtgggaggatcgaaaaattcgagaaagaggagacgccaggagacgacgttagtatga

SEQ ID NO: 14319 - DNA, 195 bp, A.fumigatus
atcttacgaccgaagtggagggagctgtatgctgcgcggaggcgacagcgctgcgctgcttttcacttgcccgaactccctgacaccttctttggctggatgcctgttctgtttcggataacggacgaacaagtactcaattctgcggggctggatgcgttcgtcgtaagttcgctactggttttgagtccatga

SEQ ID NO: 14320 - DNA, 1203 bp, A.fumigatus
ttcctctcgttcttcaaattcgcaatccggttttctaatattgtcttcgtgttccccgtcatcattatgggcccagttcatttcaagtataccggcaaatatgggatgccggattgggatcatgacgatggcgatgacgggaaggacggaaaaaagaagttgatctcggacccgaactatttatggatgtatgtggtcttcacgtatatcttcagcggtctggcgatatacatgcttcttcaggagacgaacaagatcatcagcatccgacaatactatcttggcagtcagaccagtacaacggatcgcactatccgtctttcaggcatacccaaggaattggcatctgaagagaagatcaaggaattcatggaagggttgcgtgttggaaacgtggagagtgtcactttgtgccgcgactggcgcgagcttgatcatctgatcgatgaacgcttaaagatcttgcgaaagttagaatgggcctggaccaaacatttggggtacaaacgaccaaaacactccgaaaactcgatttctttgacgcgccagcaacctcgaggttccagtctgttgtcggatggggatagcgagcacacacagcttctttctgaaagtgggagggcacatatttctgaacatgtccagaggcgaccaaccatccgactttggtacgggccgctgaagttgagatacaggaacgtcgacgcgattgattactacgaggagaaacttcgaaggatagacgagaagatccaggctgctcgtgaaaaggaatatccacccacggaaatggcgttcgtgacaatggaatctatcgcttcatctcagatggtcgttcaagcgattcttgatccgcatcccatgcaattgttcgcaaggctggcaccagccccagcggacgttgtttggaagaacacctatgtttctcgccccagacggatgatgcagtcatggttcattacaggggttattagtttcctgactgttttctggtcggtgcttttgattcccgtcgcttatttgctggaactcgagactttgcataaggtgtttcctcagcttgctgaggccctggctcgaaaccctattttaagttcgctggtgcagacaggtcttccaaccttggtcctctcgctattgacggttgctgtcccttacctatacaattgtatgtttacttttttcttggcggtgagtgcctga

SEQ ID NO: 14321 - DNA, 564 bp, A.fumigatus
actgaccataatacagggctctcgaaccagcagggtatggtgtcgcggggcgatatcgaactctctgtgatatcgaagaatttcttcttctcattcttcaacctcttcctaatcttcactgttttcggtacagcgacaacattctaccagttttgggaaacgcttcgagacgctttcaaggatgcaaccgccatcgcatttgctttggccaagtcgctcgagtctttcgctcctttctacatcaacttaatcattctacagggtctgggactatttcccttccgacttctggagttcggaagcgttgcattatatcccttcttattcctcagtgccaaaacaccgcgcgattatgctgagctgcaaacccccccaacgttcagctatggatattccattccgcagacaatccttattttgattatttgcgtggtatatagtgttttcccaagctcctggctgatctgtcttttcgggctggtctactttactatcggcaaattcatttataaataccagctactgtacgctatggatcaccagcaacactctaccggacgagct

SEQ ID NO: 14322 - DNA, 288 bp, A.fumigatus
ttcaaaatctcagagatcctcgatacggcagctaagacgcaggcgactactcctcagtgtttctttaccagcaccatttctctgcagagcgattgcatccctagccaaaccgcaacatcgtgttctatacgaaactccacccctgacgtcagttctcgtttgcccaaaccacttccgttgggacacaaccacgtgccggatgcatacgtgaacgccaccattgagacatacattcagcacacgcttggtgcatctcgagagccatgtctctcacagagtccgccgtga

SEQ ID NO: 14323 - DNA, 249 bp, A.fumigatus
gataaacgtatgggactgagagtatcttctatggtatacggatatcataactttatctactttaaatatgcaaacggtatatccaatcctcttcaacaaatcatcaatatcaaagcttctctcacaaaattccatgtctggaggcgtcataatataggtcaagtaagcaacctgccgaccatgactgagtgggacactatagcagaattgcatcagctttctcgtatggaagtacagcaagtagggtaa

SEQ ID NO: 14324 - DNA, 1278 bp, A.fumigatus
gaacgttcactgaagatgttccacacctttgcacttcgccacagcaacccgcgcgcagcgacgggagaagaacggcgaggcagacgaccaggattacgagcctgcaaggaatgccgtcgacgcaagatccgctgcacagggacgcatccttgtgagccgtgtctatactacaaaaagccggagctgtgtcgctattcagatcccagagtgccacacatcgggacgcgaggaaatggttcccatgccgatagtcagtatctgtctgttttggagagactgtttccttcagtctcgttgcagtcgcttgcctctctgacgcgcgaggagctcctggatctgttgcgagatagtatacttggctcggatcggcccccttcgcagcctccggagggtgcggaggaccactcacgatcgtctttcgaggcgatgtcaacgggaaatgctgacagcggtgatgtcaatgctgtcaatgacaaggctgatgtatcggatgatgtcaatgcgctctccatggctacgcgtccgccgtccacctacctgggcatctcgtccatcaatgccgtcctcaaggtgatcagctgggtcaatccggagtcaatagctcgaccgttcactacagctcccttgagaaacaagcctcgaccgaaagcgcaagtgtcaagacccccatcaaccgactgccatgcccccgaccaactcatcgacgcctacttcaacttcatccatcccttcatgccgctcctcgacgaaaccgacttccgacagacctacgtatccaacaccaggcgcgacgagcagtggctcgccctcatgaacatggtcctcgccctaggcagcatctccttctaccccagcgatgacaccacgcacatcacgtactgcaagcgcgcgcgccaacacctctccctcgaatccctcggcagcgcacatatcgagaccgtccagaccctcggcatcatggccggccactacctacactatatcagccagccgaacctggcgtacgtgctcatcggagccgcgattcggatggccaccgcgctgggtctccacaaggagaccgcagacacggacgccagcgagagcagaccgctccagtcgtcgtctgtgcccgtcgacctgcgccggcgcatctggtggtcgctctactgcctcgatacatggggctgcatgaccctcggacggccaacgctaggccgcacatcgatggccgtctcgacaaagccgccagcggttcgttcgccgttcccctctgttgtccttgcactcctcaactaa

SEQ ID NO: 14325 - DNA, 588 bp, A.fumigatus
  unsure (471): Identity of nucleotide sequences at the above locations are unknown.
gcacgaaacccccggccctcaccttggaactcgaatctaatatcccccacaccaggccgctccaccatggcagaaggagtcttccgcaacatggcaagcacccatccattgatcaacgagatcgattccgcaggcacaggagcctatcacacactcgagccccccgattcccgcaccatgtccaccctccgccgccacggcatcacaaactacaaccacgcggcgcggaagattaccaaggatgacttcttgcactttgactacctcctcgcgatggataaatacaacctgcgggatctgctggatgtgcgcgaatcggttgttgcttcgttgcgaaagtctggaggtgccaagggtactcgggcgtcgagcggaggtgccggcgcgaaagttgcggaggtgaggttgtttggtgattttgggccgggcggtgttctccacgaccgaataggtggtggtgaagttgtgcangatccttattacggtggtgttaatgggttcgaggaggtttatcagcaagttgtgcggttttccaagtcgtttttagagtacttggagaagaagcagggctctgaggttgaggagtga

SEQ ID NO: 14326 - DNA, 654 bp, A.fumigatus
tactcggtagaacgaatccccaactcctacggtcataatgaagcatacgagcaacgtcatcacgagcaatatcccgcctacgattatgctgtgaacccggaagctcatcacgacgcatactatacccagccatacgagccaacagtcacgccgcaaagtcattatgatctagggcagtaccacgagcaacatcagccttaccaagatgaccaagtgcccattttacaacctgagaacccgttcggcccagacccgtacagtgaagagtaccatgacgaccctgcggctgtgcccactccgagtccagcgccaatacgacgctggaagacggtcaaggaagtacaactcttccacggtaacctggtcctggactgtcccattgcgccgaagctggtcagtcaagttcctcatgcggagcctcctggtcgtgacgagttcactcacatgcgctactcggcggcaacctgcgatcccgctgatttttacgaggagcggttcacattgcgccagaaactgttcgcgaagcctcgtcacaccgagcttttcatcgtcattaccatgtacaacgaggacgactttcttttcgctcgaacattaatcggtgtgttcaagaacatcgagtacatgtgcaatcggacgcagagtaaaacctgg

SEQ ID NO: 14327 - DNA, 318 bp, A.fumigatus
ggatggtcggcggcaaccatgggccgggggcggcccatggcttgtacggaggcggtggagacggagattgggactcattatcacgaccaagtgcgggagatactttcatgggaggcagacgcgaagagtcggggagaggagctcgatgatgaactcaaagagatgctggtaacattccgtcggattcgtgatgaggagctagagcatttggatcatgctattgagaacgatgccaaggaggcgcagccttatgatcccttggtcaatgtgatccgcttgggctgtagagcggccatcaagatcagtgaacgggtctga

SEQ ID NO: 14328 - DNA, 336 bp, A.fumigatus
  unsure (48): Identity of nucleotide sequences at the above locations are unknown.
gaaaatcggggcgacagaccaaagtcgtacatcctctccatgtttccntacccctctgggacattacatatgggtcatttacgggtttacacgatctccgatgtattggcgaggttctatcgtatgcgagggcatgaggttctccatccgatgggttgggatgcgttcgggttaccggccgagaatgcggcgatcgaacgcgggattgacccggccgagtggacgaagcagaatatcgcgaagatgaaggagcagttacgcagcatatcgacgtcttttgactgggatcgggtatgtctggcatacgtctcaatcggactagttgactctcgttga

SEQ ID NO: 14329 - DNA, 2346 bp, A.fumigatus
ctcctccaggttgattccaatggtttttcatggcgctcaggggcaaaggttgaaaagttgaagctaaaacaatggttcttccgaatcacagatttcaaagaaatgttactgaaggatctggactccttaaccggggcttggcctgagcgggtattgactatgcagcgcaactggctgggcaagtcatacggtgcgaaaatcaaattccaggtagctgttgacgcgagcggtgatgccaatctacatgtcaatgtttttaccacacgcccagataccttgtacggagttgaatacctcgctctctctttggaccaccccattgtccttgaggctgcagagaaggatgcagccttgcggaaatttctcgatgaagcagcttcgcttccaccagactccaaggtgggttataagctggccaatgtgactgcttcaaacccgttgcatatcattgacaaggaaagtcctcacattgcgaggagattgcctatcttcgtggccccttatgtcctcagtgactacggtgagggagccgttatgggagttccaggtcacgactctagagacttggcgttcttcaaagagaacacaaattccgaatcaataccagtcgttatcgaaccagaacacttgtctaacccaaacaacgacagcgcagggactgtcacacgtccaaacgacatgaaagcatttacccaagaaggtatccttacctcgagatgctggaaataccagggcctccactcccgtgaagctaagaagcagatcgttaccgacctcaaaggagtcggccatggtgatttcgttgagcagtggagacttagggactggcttatcagtaggcagcgctactggggagctcccattcccatcattcactgcgagagttgtgggcccgtgcctgtgccggaagaccagcttcccgtccgactacccaagattgagggtgactggctcaaagggaaaaagggcaatccgcttgagtcgtcgcaggattgggtcaacacaaaatgcccaagttgcagcgggcctgcaaagcgtgacacagacactatggatactttcgttgactcctcctggtactatctccgctttccagacgcccacaacaaggagcagccgttttctccttcaacagcacgacaggtcgatatttacattggcggcgtcgagcacgctatcctgcacttgctgtatgctcgatttatctacaaatttctttctcagacggagttgtttccggagattgctcgcagtggcgatggcttggggccttctgaaccgttcaagacagtcctgacccagggtatggtccacggaaagacgtatactgagccgtccactggtcgattcctactcccctcggaagtcgatctttccaatccgaacaagccgctcatcaagggcacccaagtcgccccaaatatctcttttgaaaagatgtctaagagcaaacacaacggtgtggatcccacgtcttgcgcgctacagtatggtgccgatgccacccgtgcacatgttcttttttccgcgcctgtcagcgaagtacttgagtgggatgacacgaagattgtaggcattgagcgttggtttggtcggctctggaagcttgtgctggatgccaagcaaagcctggcttcggcatcgtttacagtttcgcagaatgatctgcagaaatctccctacgcaacctccaagcttccttccctattgcagggtcttggtgatagtgacgctgagggtcttctgcacacccatcagaccatcgtatctgtgaccaactgcatagaaaacaacccgtatggtctgaacaccgtcatctccgacctgaccaagttgacgaacacattgacatcgtcaaacccaacatctccccaggttttgtacctttgtgtctcctcacttgtccggcttctcgctcctgtggccccagccttggcctctgaatgttgggaggttcttaatgatacactcattgaccagaatgcgaacaccggagcccgtgtcccagatatcttcgactgcgcgtggccttctccccttttgacctccgagcaggctgatgttctatccgcgcgcgggggtcagattgtagctgttcagatcaatggaaagctacgcttcacggtgactattcctcgacgattgtcacccacaacatctgcggactccagtgattccggcgcagtcactgatgaacaagactggattatcagtcgaattttggaaacggacgagggccgcgtctggttgcgcgagaagaacgactgggaaaagcggagacgagtagtggttgtcaaaggaggcaaattggtcaatattgtcttctacactggcatgctgctgtaa

SEQ ID NO: 14330 - DNA, 558 bp, A.fumigatus
actctgcgagcctttttctgctcctttttagtgagcgccggcgtagactcttcctgctgcttcgttttcttctttttcttcttcggctcctcactttcaatacgcacaggctggatttcctccaagtcacgcatatccgtgactttgattttgtgcgcattcagcacagtacgacactgcacctcatccatctcatcaacatcatcagcatcggacgtatcatcccggtgctcttgctgctcctgctgttccttcgcctgctccttggccatcgaagcactagaccgccgagccttactcgagccgaaaaagttcagctccgcatcatcatcatcatccaactcagctgcctccggaccagctactctcttcctcttcttcccatggctcgcttcttccagaaccttgtcagcctctgagctacggaagagctgcgggttcgccgccttgcccgtagacgggagacgggtcaagctctgcgttgatgatggggcggcgccactcttcaacttggttgcccttgtcagcaacttaaaggcgtccatcttcaatgcataa

SEQ ID NO: 14331 - DNA, 315 bp, A.fumigatus
ctcctccgtaagcacattcaccaccgtgcaaaacaccaggtgcacacgcagtccgctgacttccatattagcaacctggctaccttccaggcttacttccagcctctggttaacgctgctcgcaaccccgccaccctcaagaacttctctttccagaacgtcatttctcgggttcgcaatgccagcaagaaggagcttgctttcgctggtgttaccgccgccgaggttattggtttcttcaccgtcggcgagatgatcggtagaatgaacattgtcggctacaggggccacgccgatcacggcgaccaccactag

SEQ ID NO: 14332 - DNA, 2094 bp, A.fumigatus
tcagaccaggcgcgatcgcgtacatcgacctatctgcataagcatttaccatcttatgcattgaagatggacgcctttaagttgctgacaagggcaaccaagttgaagagtggcgccgccccatcatcaacgcagagcttgacccgtctcccgtctacgggcaaggcggcgaacccgcagctcttccgtagctcagaggctgacaaggttctggaagaagcgagccatgggaagaagaggaagagagtagctggtccggaggcagctgagttggatgatgatgatgatgcggagctgaactttttcggctcgagtaaggctcggcggtctagtgcttcgatggccaaggagcaggcgaaggaacagcaggagcagcaagagcaccgggatgatacgtccgatgctgatgatgttgatgagatggatgaggtgcagtgtcgtactgtgctgaatgcgcacaaaatcaaagtcacggatatgcgtgacttggaggaaatccagcctgtgcgtattgaaagtgaggagccgaagaagaaaaagaagaaaacgaagcagcaggaagagtctacgccggcgctcactaaaaaggagcagaaaaaggctcgcagagtttatcctcagccgcttgtttcgttcaaggagttgcgcacccggtacaagatttctcgacggcttgccgagaatatcgccgaacaagggtttaccgtgcctacggaagttcagctgggtactctgccactgctgcttgggggtttcaaagcttccgggaattcaaaaagtgctgagagcattgaaccagacttattggttgttgctccaaccggaagtggaaagacgctgtctttcctgattcctgtgatcaacaagatagtccgccaccaccatgagcaagagaaagagcgtggtatcttctctgtcatcgtcgcacccacaaaagagcttgcaagtcagatcgtgaacgagggaaggaagttggtccatgggactggggtgaagattacactaatgaaaaagggcatgcgagtggtggaccgcgaagatgatgacgatgaaaacagtcacagcgaagatagcgaagaaggctcggattccgaacaggacgaaccatccactacaaggaaaaagaaagggaaagctcctattaccaaaagcgatatcctcgtcactacgccgttacttttggttaatgcgctctcagccaaccgaaccaaacctatggctactctacctctggtcaggaatattgtgcttgacgaagcagatgtcctgctagacgagctcttccgcgagcagacccttgacatttggcgcgcctgcacgcaccccgagctccgagcaagtctgtggtcagctaccatgggatccaacattgaagatctcgccaaaagcacgatcaaggagcggaaacaagcctacgatcaaacaaagtcatatcccttgcttcgtcttgtcgtagggttgaaggactctgccatcccgaatatcgagcacaagctggtctatgccgcaacggaacagggaaaactcctgggtctacgacagctactacatccagcagcggcctcggtttctgatgtccgcctccgccctcccttcctgattttcacccagaccatccccagagctatcgccctacattctgaactgcggtatgatattcccgccgaggccggcggctcctcacgaatcgcagtcctccactcagatctttcagacggtcaacgctccgagatcatgaagaacttccgcaaaggtgaaatctggatcctcgtgacgacggatctgttggcgcgcggcgtggacttccggggcatcaacggagtcgtcaattacgacattccgaattcggctgcggtctacgtccaccgggttgggcgaactggccgggctggtcgtgagggtggcattgcagtgacttactacaccaaagaagatatcccatacgtgaagagcattgccaacatcatcgatgtcagcgagaagctgcgtggcaaggacggagagaaatccattcagaattggttgttggatgcactgccggacttgagccagattgacaagatagagctgaagacacatggcgtcaatgcccga

SEQ ID NO: 14333 - DNA, 753 bp, A.fumigatus
acattcttttccacctccaacaataagtttctcgtcaagagtctcccgcgacatttcgaacactccttcttccgagaagacctcctcgaaccgtactacgagttcatgagcactcatgcagactcaattctggtctggataacagattatgtgtatgcaccgtacagaaccatcggaagcatgttgaagaccacgccggctcatcatattatcatggagaatatgctagtcgggaaggaggaggactctgccaaggacgactgggagacgtatgatttgaaaccaatcgactacttctacccggagcgggacttactaccggatccattggtcagcgaagagaccctgaataggctagctgataagtttgaggataagatacacatgccgcagtcggactatgaacggtttcgagaagtacttgaagccgacactcgcttccttcagtcagcaaatgccgttgactactcactctttctgatccgttacccagcgtcctccaatcccggcgtggtgggaaagaaaaatccatggcgcgtaggattccagtcccttgatgggaagtggaagtaccgcgcggtaatcttggatttcttctgggcaaaacacaagctgcatgcgcaggctatgaccacagtggtgcagacctttaatgttattggtcaccatgggcccatgacaatcacaacgacggcagacgaataccgacagaaattcttggatatggtcgatgagctgctggaggtgcattga

SEQ ID NO: 14334 - DNA, 519 bp, A.fumigatus
agtcagcgaaggaaaaagttgttcccctcgcgaggcttagaagattcccctccgtctatgggtcgttatctgcttagcggggcccggcgattttcaagcgacatttttctgactgttcgatcctacagtccactgcacagtcgctgtccttcctactttcgtacctctactgatctccaatacaataccccacgtccgtccctctaccctcgagccttcggtacctccgcttcgctgtacgcgctctccgggaagtcctcgaaattacacgcagctatggcatctgccgctgaccttcctgtcgccgttgagggcctgactctccagtctaccgctgagacctccaagttccccaactgctacccctcgttaaatcctgtcgacgtctacagagtgcacattgcggagaagctgggtgccgcagctggcatcgagcctgagaagctttaccccaagctgcaatggaccaatacactggacaagggtgacttggttctgccggtacggactattgcgtga

SEQ ID NO: 14335 - DNA, 1182 bp, A.fumigatus
  unsure (131),(158): Identity of nucleotide sequences at the above locations are unknown.
aagaaaaatgctggctttcgggtcccatatggtaaccaaggtttgcgaagacccctcggattcttcccaagggaaagaaaagattcatcgtcaagttttggtcacctaaccatggccaggcccttcaatgntggttccctgcgaagtcctatcatcgnaggtttcctggcgaatctctacacggttatgggttgggacgtcatcaagatgaactaccttggtgattggggaaagcaatatggcctccttgccaatggtttcaagcgctttggtaatgaggaggaactactcaagaaccctatcaaccacctgtttgatgtctacgtcaagatcaaccagattgttgcccagcaggagggccctatcaaggagttgaaggagcagatcaaggccaagaaggagaagaatgaggatgtgtctgtgcttgaagccgagcttgccaagctcgttgacgttagcgaggacgaaaaggctcgtcgttacttcaagagcatggaggatggcgacgaggaagctctcgccctctggcgacgattccgtgacctcagtatcgagaagtacaagcagacctatgctcgtctcaacattgactttgatgtctactctggagagtcccagatcaaaaacgagagcatgaccgccgcctacgagactatggagaagactggagtttccgagaagtccgagggtgctgtcattgtcgactttacgaagcacggcgctaagaagctcggaaaggccatcattgtccgcaaggacggcactcctctgtacttgacccgtgatattggagctatcatggagcgtgatgaggcctaccacttcgataagatgatctacgttgtcgccgcacagcaggacctccacttggctcaactcttcaagatcacagagctgatgggccgcaaggatttagccagccgctgccagcatatcaaattcggtatggtccgtggtatgagcacccgtaagggtactgtcaagttcttggatgacatcctgagggatgttgcggacaagatgcacgaagtcatgaagggcaatgccgagaagtacgcgcaagtcgagaaccccgaagagacggcggatattttgggtttgacctcggtcatggtacaggatatgaccgggaaacggtgcgtatatttcacttctaaccttgagtcgagcccacgaaactaa

SEQ ID NO: 14336 - DNA, 816 bp, A.fumigatus
tgtttgttgttgaggattactgacatattcccgtgcaagttctacgttgtcctttacctcgtcgcacccgaaccgcgaaaaccattacctgaggagaagcgataccgcaccctttccgaggatggagcagtcacccaacccgaacaattgccctgctggcaggacgccctcgaccggcagaaacgtcccggtcggatctttgaccattcacatatggagaaggcggagctattcatgtccttggtggtccctgcatacaacgaggaggaccgtctggccggcatgctggaggaggcggtcaactacctggagaggatgtacgggacacttgcggcatcatctgcctcgaacaagaaggccggagacgcggtccgacagcggaaaccgaccaacggctatgcgaacgggcatgccacgacaatggtcacgcctagcggcaaggttccacctgagaagggctgggagattatcattgtctccgatgggtccaaggataagacggaggaggtcgcgtttgcttttgcccgcgaccaccagctttcgttgcatcctaaggggtatgctggtccttggacgccgacgccccacgagggggtccatattccacccggcacgatccgggtagtcactctggccgagaatcggggaaagggcggggcggttacacatggcatgcggcatgtccgcggtcagtacgtggtgttcgcggatgccgatggggcgagcaattttgaagacctggggaagctggttactgcttgtcgggacattgaggacgtcttcacccacggggcatgggacgtgccgcgcttgaag

SEQ ID NO: 14337 - DNA, 225 bp, A.fumigatus
gtgcccgtcggctgttgtggggttgaagcatcgcggcttgtcaaggaccacctatgtaaaaaggatccagaggatcggattaagcaaccacctatctactactcactaaacccaaaaccaaaaggacaagttggctatccggtcctccgcccccaattttatggcattccacgcatgatggccattgtctgtagcgacttcaacgatcaatgcaagcattactga

SEQ ID NO: 14338 - DNA, 1734 bp, A.fumigatus
cgcgtttccggcatcgcgtgtccttccagccccgcggtgaagatatcgacacttcagccaagtgtcaggcaagagaaactcgctgcgcggcccaaggggcaaccagcagaacccgtggaaggattgagctttgatcagaaatccgctggaggtgactctgcggtagccggaggtacagcatcacatgggatcttcctacagccagaaactcatcctataacagaagagcaattgatcaatgaagtgcgcggaatctacgccgggctattcatggtggagaagaaatgcattgaaatcgacaagcaacagtccgagtcgaagactccgctgtccccagtccaatggcaggccctgattgccttgcatcgaacgctgctgaacgagcatcacgacttctttctagcatcacaacatccgtccgcgagtcctgtactcaaaaggctagcagagaaatatgccatgccggctcgtatgtggcgttatgggatccattccttcctcgaactactacgccaccggcttcctgactccttggagcatatgctgactttcatttacatggcttactcgatgatgactctgctattcgaaagtgtccgcgcatttgaagacacgtggatcgaatgcctgggagacttggcgcgatacagaatggcagtagaagaggtggacgtgcgagaccgcgagatctgggctggcgtcgccagatattggtacaacaaggcggcggataagaatcctgatgttggcaggatacagcatcacctcgccgtcctcgctcgtccggatgtagtccagcagctgttctactatacgaagtctttagtcagtgtgcattcttttccaagcacaagggaaagcataccatcattgtttaatcctcttctgaatgcgccaaaagctcatcaccactatccgctcattgcggcttttgttttggctcatggctatctcttctatcgcaacccatcacctcagttctccagatcagcggaggaattcttgacacacttggaaactcatgtcggccgaatgggggccgcctttaagatgcaaggtgtctatatgtcgtcgtgcaatttcgcagccatattcgaatacaatcaccctgacgccgccttacccgccaagttccacccgcgggaaacccatcatgggaggcctgctttggagacccaaccgacgcctgcaaaaacctcgacttccgcttgtgacgtccctctgacagcggatgggtcaatggcatccccagatggtcgaaggtattcgccactaagtctttacgcgtcgtgcctgacgtttcaaacattgtctgtccttcttgaccagatcggaaacaagaacgtttatcccacagtgcatatctcgatggccttcctttggtgcctagcacttaacggcagaagcagcatggagtatatcgaagctttcgttccgtggagaaaaatcgccatctttctcaataccatgattcgcgatgacgtagacattcaaattttcgaaggtccccatttccctacggtggaagagagaaagcaattgccggaggactttttcatacgtggtcaaatctggagtcagcattatttcccacctcgtttttttgaggattctctcattgaagatgaggggcgtttcattgagctaccgtctctgaatgtttccaggatgtacaggtgcctttggctgggaatgaagctggcgacggtatgtctgaagaatcacggcgaatga

SEQ ID NO: 14339 - DNA, 501 bp, A.fumigatus
  unsure (6): Identity of nucleotide sequences at the above locations are unknown.
agcacnatatctttccctggtgatggcaacacggatgccacatctagctttgacgcagaccattccggagacgacgaatgggccctgtctttctgtcgagtcgcctacggactccgagcgaagctgaatgcaatcgatgacgactatatccgcgactatatcttgtacgtgcaaaagtctccgtgccatctgtccgtgacactggataccgagaacctgtacctcagcaattggcgcgagatcggtgtgtatgatgccgattttggaggcatgttgggcaagccgctccggatgagagctccggatggatacaccgatggcctgatctttgtgatggcgcagcggagcgacgataagttcgcgccgtgggagtttaatatctcgctggaggcatcgacaataaagcggattgtgcatgatcccctccggtgcaagtatgttgagctggatgagttctggcatagcgagcttcactttcagggaccggcagattttcgatag

SEQ ID NO: 14340 - DNA, 237 bp, A.fumigatus
cgagcttcactttcagggaccggcagattttcgatagctatctacgcgagctttctcaaatcttgtggatatatctactgtagacatgctccagatatactgacacaactgcgaccctaccctgccgtgactttgatccgtgtatatttcgttatgtctctcccattcacgcttttttcttcctggcatctcctggcctctgagactgtgcaaggggtaggtgagactgcaacatga

SEQ ID NO: 14341 - DNA, 312 bp, A.fumigatus
cagggttgtgggcattggccctgcgtcagtatgccgaggtcgacaccggtggctagcgaacaggtcgactttgtaatgaagcttctcgggaacacaaccaagcagatcactacggcaacttacatcaagctggcatgggctgtcgtcatttcctgcaacactggcagcaatgacactgtctttggcattacagtcaatggccgaggtgctcctatcgacggggccggtgagatgaccggtgcaaccatcgccaccatcccacagcgtatcaagctgaagccggaccaggctgcgacgaattgcattggctga

SEQ ID NO: 14342 - DNA, 1893 bp, A.fumigatus
  unsure (117),(658): Identity of nucleotide sequences at the above locations are unknown.
cagaaccattcaggagccttcgccggaggcaagggcggcctgtatgttccaaagccaactgatcattcaaccttgtcttccgagcccgccggattttttcgagacttgcgaccattntgcaactcagacgggtgcattctccgcgtatggtctctccctcgaatgccagctggcatgatcagtcgggagcgcgtgcaacggctgctgcagcacctcgaacttgtcttgcaagacctcatggccgatccctcatgcaaagtcggcgatttgcctcggatgagtcggcaagagtgggatcagatacagcgatggagtggcactctgccaccagtctcgaggcagtgcgtgcatgaaattgtcaaccaacgttctctgcagtttcccaatgcatgtgcggtgtctgctcccgacggggatctctcctacgccgagctgatacgttctgctaacgccgtggcggctgaactacttgtccacggggtcgaacggggcaattatatccccgtgttgttcgagaagtgcaagtggtcgccagtggctatgttgggggttctgaaagcaggcgccgcatttgtcctccttgactcttcctaccctccccagcgtctccataccatctgcggaggcttgaagacccaaatcatactatgctcaaagnatatgtatgcaagagcagcctcgctcggccccacggccatagccattcaagagaatgccgcattcctggcggatattcccgacgtcactttccccgttgtcagccccgaaaacgcagcatacgtggtattcacatccgggtcaacaggtaccccaaaaggcgctgttattgaccatcaatcatattgttccggcgctctagcccacaaccgcgcccatgtccttggtcgcaactcgagagtgctacagtatgcttcctacgccttcgacgtcagcattatggagacgctcagcacacttatggcgggcgggtgtgtctgcatactctccgacttggagcgtcatgaccactttgccaattctgttcagaggttggccgtcacccatgcatttctgactccttctaccgcccgactgctcatgcagcgagagctcccgtcgttgtgcgtgctcgtcctgggtggcgaggcaatgtcactggctgaccgcagctactggatgagccgggttcggttgatgaacgaatacggtattgcagaatgttccgtggcatctaccatcagggaggtctcgcatgtcgagcaaaaggatattggcttcccgatgggcgtcgtggcctgggttgtcgatcagaacgaccacgagaaactagtggccattggcgcaactggggagctcttgcttgaagggccctcggtgggtcgaggatacttggacaatccaaaagccacctgtcgggcgttcatcgagcaaccgggctggctccgggcggtgcgcaatgggaagccaagccgggtctacaaaaccggcgacctggtccggtacaacgaggatggctcattgagtttcataagtcggaaggactcgcagattaagatccgcgggcagaggttcgagttggaggaggttgagcagcacctccgccggatcgatgagatccaggaagcaacgacagtcgttgccgcgccttcggataggccgaagcagccatatctggtggcgttcatcgtcccacgagcccgcgaatccttctgtgtctgctctgcaagggcactcattccgcatcctacagaagaattccgcctccaggcggcaaccattcaaaccaaactgcactcgatcctcccagcccacatggtgccgtcaatctatcttccagtgaaccgaatgccaaagacaagcagcgataaggttgaccgttgccgactgaaggaggaggtcgggaaatggtcgtct

SEQ ID NO: 14343 - DNA, 720 bp, A.fumigatus
aacggccaagacgccttcatcgatgccacctccaccccggaccccagcgtcgccatccgcctcatcgacgcatccgtcgccgctggcatccaccgcttcatccccgccgagttcagcatcgaccccgccgccacaaactgccgcgcgctgcccgtgttcgccggtaaggcaaaggtctacgactacctccgccaggtgggcgccgcgggccggataacctacaccagcatctcgacgggggccttcctggagctgagtctgcggacggggttcgtgaacatcgacattgccacgaagcgcatcgatctgctgaatgccgggtcgcgtgttactccctggacgcgtttgtcctcggtaggcagcgccgtggcgaatgctctgctgcgcgcggacgagaccaagaacaggacgtgctacgtgtgcagtatcatgaagagccagagggaggtgggcgagctggcgcaggaggctctgggcaaggagggctggcgcgtgcagagtcaggatgccgcaaaggcgctggagggggcgattgcacagttccaggttgggaatgtcacggttgaggtgattggggccatgattcggtggacgcttacgcagccggagagcgcggctggctgggccacgaatgataatgagttgctgggggttccgactatgacggatgacgagatcaagcagttgattcagcagattgcggaggagatgaaggcataa

SEQ ID NO: 14344 - DNA, 183 bp, A.fumigatus
gttgcctgcacactgtctaacctgtgcgtcagatacgacatgtacaaggatgtcgaggaggttctggccaaacgccggggaaagccgttcatgcagcagtatatccgaggtcttcccatcggattgaagttatcgaatggcactgtcgttggccagcagccgtctgctgaggtgaagctttga

SEQ ID NO: 14345 - DNA, 249 bp, A.fumigatus
gctaatgatggcaatcatctactacaatcagtctactaccaacagatttatatcctggtcaaactcagcaggatactaaaatacacgattaagcgccgtatcacgtcctacgccaaattggatatgattggtaacgtccttcggggtgagtggttgtgccttcttcaaattctgcaagtaagcatccttgttatgacgcagtatcttcagtgtacgatctcgagcccagaaggtctcgctactccgtag

SEQ ID NO: 14346 - DNA, 1683 bp, A.fumigatus
ttgcgtgatttgatgttatcatggctaattgctgcaaacttcgagtatttattctctctaccgtgtgacaacttgccgggatattcttatctataccgatcattgattcctcattgtcctggatcagcacaacagttgaccatggtcgctaccacggcggtcgactctccccaaagcccgcgggacgacaaggctccagctatcagagtgaaacaggacaagctccccacaaaaggcgatgcagctttgcaacttcttgccggaagagacactgagaatggggtcctagaccccgatgcctcgcgccgcctcgtccgcaaaatcgacctgtacgtgatgccgttgatttgcatcgtctacttctgccaatacctagacaagatcgcaatcagctatgccagcgtcacaggtatcagagaatcggcacatctccacgggaatcaatttaattggatctccagcatcttcttcttcggccagctcaccttccaattccccaccatgcgcctcattcaggccttcccgttggcccggtacgtcgcgaccaacgtcacactctggggcattattctcgcctgcatggcagcctgcaaatcctttgcgtcgctgatggtctgccgcacactcctcggctgtgcggaggccgccatcgtcccggcgtgggttgtcttcacgtcgcagtggtaccgcaaggaggaacaggcattccgtgtgggactgtggttctccatgtgcggctgggcgcagatgtttggcgggtacgtggcgtatggggtagcggttcatgtcggcagcgatccgcacgcggcgcttcgcggatggcaggtgatctttctcatcttaggagtctttaccaccctggtgggtgtgctgttcttctttatcttgcctgattcgcccgtcacagcagggttcctctcagccgaggagaaggcgctgcatgccgagcgtcttcgtggcaacgagcaggggattgggagcacagtgttcaagcgtgaacaattctacgaggcgttgcgagatcccaaaacatggctttattcattctgggtttttgccgcgaatattcccaactcgatcgctaccagctttggcaatatcctcgtcacggggatggggtactcggcgacacagagcctgctacttgtgacgccattgggtgcgtacgaggtggtcgttctggttggattgacgtacctggctatgcgaacgaaccagcgcctgctctggtgtatcatcgggcatatcccgagcatcgtgggtgcgatcctcatggctacgacgaataaagctcccgccttggttgggtattatctgtctggcggtatccccatcggatggacgacgattctggggctgacgagtaccaacgtcgccggatcaacgaagaagatcactgtctcgtgcatccagaccatcgcatacacagtgggcaacattatatcgccgcagacgtttcaacacaaggacgcgccgaggtatcttccagcaaagatctcgattgtcattctgtatgtccttatcaccctggacttgtgtctgatccggtggttgtcgatccgggagaataagaaacgggatgcggaaagggaagcgctgggggatgcatacgtggtggaaaaggaccatgagttcttggatcagactgattttgagaatcgcgagtttagatatgcgatttga

SEQ ID NO: 14347 - DNA, 273 bp, A.fumigatus
atactcgcccactacccaagcgagggatccaagggcctggctatcggtgtgaggttcaaggaacaatgcatgtcggttatcaacagaaatcagaagttctgccgctcttgtggcctgcagtcggactcctttaacacggacggcgacattgcgtatttccaaacagatccgggacattatatcatctccacgatcgtcttccagcacccgagtagctcgcggaaaacggaattgtttagtttgcagtggtcggagcttcatcaactctactaa

SEQ ID NO: 14348 - DNA, 252 bp, A.fumigatus
cccgttctaaagcggcgtgttgctcttctgcgtgcattgtctcggcccacagatgccatacacagcctaatagatctgttgaaggcagctcctacggatgcggaagcttggtgtgaactctcagatctatataagtctcaaggattgggactccaggcaattttctgccttgaggaagcattattgattgcaccaaacgcatggaatgtaactacttcaaagcacattaccgtccataagaagagaggctaa

SEQ ID NO: 14349 - DNA, 237 bp, A.fumigatus
tatattccagataaaaaagctactgcgctcttgaaaataatttatctggagatgtttgggtatgatatgtcatgggcatccttccatgtcctagaagtcatgtcatcttcgagatatctccagaagagagctggctaccttggggcagttcagagctttagacccgatactgacgtattgatgctggcaacgaatctattgaagaaggtctttaaagtcccgaattctgttctatga

SEQ ID NO: 14350 - DNA, 459 bp, A.fumigatus
gatctcatatcatcaagtactccgagcctgtccttaccactgaccacattaccgcacattatcactccttcgcttgcgatgtcattgcttcctgacgttctatctcggctttctcactcgcgcggggttgtgcgcaagaaggcagttgtgtgcctctacagacttgcattgatttatcccgaggcgctcaagtttgcatggccgaaactaagggagcgactcatggacgatgaagaggaaggtagcgtaactacggccgtgatcaacgtcatatgtgagcttggttggagaaggccccgtgatttccttccacttgccccgaggcttttcgaattattagtcgatggggggaataattggatggctatcaagataatcaagctggtatggtgttccctcttcgcgggatatatgcttctaacgagactagtttgcgactttgacacccttagaacctag

SEQ ID NO: 14351 - DNA, 189 bp, A.fumigatus
ttagaagtacctaggttcgagaaatcactttacgacctgatcaaagggctaaggaaccataaaggggcagaagaagagtttatacaggagagtcttcgagaatgtaggactgagatcaaatctcaagatatgggtgtgcatttccaccttcaagatacggcaagtagcccactaatatattccagataa

SEQ ID NO: 14352 - DNA, 252 bp, A.fumigatus
tttgcgactttgacacccttagaacctagactaattcggaaactctctgggccgctgatgaacataattgaaacgacgaccgccatgtcactgctatatgaatgtattaatggcgtcattcaaggaggcatacttgatggcgacgaagcacttgaagagagagatgaagtcgcaagtctctgtgtcgggaaacttcgaggaatgattgtcgccaattccgacccaaaccgtaagtttctttgtggaaagtaa

SEQ ID NO: 14353 - DNA, 897 bp, A.fumigatus
  unsure (253): Identity of nucleotide sequences at the above locations are unknown.
attgtagtcaaatatgtcgcgttactggcgttcaatcgaatcctgctctcgcatcctgcgctagtatcagtccattgtgatgtcatcatggattgtttggaggatgccgatgtctccatacgaatgcaggccttggagcttgcagccaggatggtcacaagcgacacactccagtccgtcgtcgatcggttactcaagcagcttcgggatgctacgacgtttgatcctgttgagtcgggacatcccgcaccancagagaacttgaacaatcaaaaaggatccatgattttgcctgcgagctatagaatcgacgtgatacatcggatacttgacatatgctccttcaacaactattcggacttgtatgacttcgaatggtatgtcgaccttttagtagagttgatgaagctccgaccactgcaaactaaacaattccgttttccgcgagctactcgggtgctggaagacgatcgtggagatgatataatgtcccggatctgtttggaaatacgcaatgtcgccgtccgtgttaaaggagtccgactgcaggccacaagagcggcagaacttctgatttctgttgataaccgacatgcattgttccttgaacctcacaccgatagccaggcccttggatccctcgcttgggtagtgggcgagtattcaggctgtctttgtaaccctcgtcgaacgctccagtcattgatcgacatttcaaacatgtcacttccagctaaggtattgtctctctgcgttcaggcagttcctaaggtactcatacaagtggccaatgacccacaccaagattggaacacagcgaccgtgtgcgagatatcattactgttcgggcccgttatcaagttcctactgacccagccgggatcgaaagaagtacgc

SEQ ID NO: 14354 - DNA, 1368 bp, A.fumigatus
ccaagttggaatcccggtatcaaggttcgacatacagcccgcgaatatggctgtggtgtggctgctgactttgttttgcacacagaactcctcaaagcgtatcgtatggcccatgcacgtgtcctgtcgatcgaaccgtttgaagccgcgctacgtgaaaacactcctctgacgtcgattgccgatccgaaagctctcaccgagtatttgaatcagattacattgaaaggggacatggtgattgaggagctcaaacgagtcactacggaaagggacgactacaagaagaagctggaggaagcgcagaagtcgacaaaagaggcttgtgatgcggtcgccgatctcaagaaggacaagacgcaaggcgccaaggaggagaaaaccgccagtactgaggataccgcctcaaagaaggaattaccagcaaaagaagaaagcgaggaattcttttcgttcgataatgaactgccccgattggagtctgagctgaaggagaaacaagaagaggttgaaactctcaagtcgcaggtcgagtcgctcaaacgtgatcttgccgttgctcgtgagtcaacggagggcatggtgcagaatctcgaatccgcaactcgcgagctcgtggagttgagagatattagagacaaacaggattcggaaatcaagaagctgaaggataccaggcaggctgaggttgacgacgtaaaagccaagctcgcggaatccgagaataccattgccaaggcaggcgaggaggcggagaaactaaaggctgagttgaagcagaagaccgaagaaattgagaagcttcaggaccaagtcacgcaacagaaggacaatgaccagcaaaaagagttgcaggaaaagttggaagaggtcgccaaggagaaagatgctagtgagaaaaagttgggtgtcctccaaggcctcgtggacaacctgcggtctcagctgaaagacacggaagtggtggtgtcggatcttaaggctgacatgaaaggtaaagtcgaagagcttggtaagctgcagaacgtggttgattatctaaacaacaacctgaaagacaacgccgagtggcagcaaacgagagatcaagcggcgagtggacagtcacccgactttgactcccttcgaaagagcctggcaccgttacaacaagaaccggggggtggcaacctggctacagagccagagcctccagcaaatggcgcgaccggtggcgcgggcgcgagtaaaaagaagaagaacaagaagaagaagggcggaaaaggcggagaagatacggctaaggtaccggtgctgctgtggtccaggacaaggaatcgcacgcagcagagtccgaccaagcagcttcggacctggccgacctcgagc

SEQ ID NO: 14355 - DNA, 525 bp, A.fumigatus
agcttctcaatttcttcggtcttctgcttcaactcagcctttagtttctccgcctcctcgcctgccttggcaatggtattctcggattccgcgagcttggcttttacgtcgtcaacctcagcctgcctggtatccttcagcttcttgatttccgaatcctgtttgtctctaatatctctcaactccacgagctcgcgagttgcggattcgagattctgcaccatgccctccgttgactcacgagcaacggcaagatcacgtttgagcgactcgacctgcgacttgagagtttcaacctcttcttgtttctccttcagctcagactccaatcggggcagttcattatcgaacgaaaagaattcctcgctttcttcttttgctggtaattccttctttgaggcggtatcctcagtactggcggttttctcctccttggcgccttgcgtcttgtccttcttgagatcggcgaccgcatcacaagcctcttttgtcgacttctgcgcttcctccagcttcttcttgtag

SEQ ID NO: 14356 - DNA, 498 bp, A.fumigatus
cctgttgggcaaactgtaagcctgcctctgaataggatcctgaaccgggctaacccgcgcagaacggccatgaacctcatcctcgcgtttgccgtcgccctaaagcacaaactgcgcttcgagccagacatcggctacgaagacctggcgggtctggtcggacacctggatacctttgccaaggacgcccacgaccgtgcactccttcagccgcccaaaaagagttcctggaaggcgatgggcgaatatctcggcgtctccttcgccgagtcgaatcccagaaagctcgtcaagcgctccaagaagcctctgggacatctgcccctggagattctcaactacttgtcggcctatattgaccggtgcattgcgaatggcactctgtccgtcagtcttcaccagagtcaagccagtaagtccccgtcctgccaagggccatttgcgttttggatcgggttgctaatctgcttccaccagttggtgctctgtgttccctga

SEQ ID NO: 14357 - DNA, 462 bp, A.fumigatus
cagtacatgctccccgacaactccgttatgtacattggctgtgttggtaaggacaagtacgccgatatcctcaaggaggcctgcaaccaggctggtgttcacaccgagtatcgtgtggacgatgtccagcccactggcaagtgcggcgtcattatcactggtcacaaccgtagcatgtgcactcaccttgctgcggcaaacgagtacaagattgaccacttgaagcagcctcacgtctggtctcttgtcgagaaggctcagtactattatgttggtggataccacctgacagtttgcgtccctgccattttggcccttgccgaggaggctgctgcgaagaacaaggtgagcaagatggccttccctccgcatcccgctcgaccgaggttgacgtttgactcaggtcttcatgctttctctttccgcccccttcattcctcagttcttcaaagaccagcttga

SEQ ID NO: 14358 - DNA, 354 bp, A.fumigatus
cgtttgactcaggtcttcatgctttctctttccgcccccttcattcctcagttcttcaaagaccagcttgacagcgtcctgccctacaccgactacactttctgcaacgagacagaggctcgcgcctacgccgagtcccacgaatggaatacggatgatgttgttgagattgcgaaaaagctcgctcagcttcccaagaagaacagtagccgccccagagttgctattgtcacccaaggcactctgcccacaatcactgcgaccgttaagccagacggcgaggttgaggtcaaggagttccctgtgcacgagatttctaagagtagcatcaacgacaccaacggcgctgggtaa

SEQ ID NO: 14359 - DNA, 612 bp, A.fumigatus
  unsure (29): Identity of nucleotide sequences at the above locations are unknown.
ttggaattgactacagctgatccttcccnccccgtggtgaagacccgcgccgctgggatgctttaccgcgggggtcgtcggttcggtcttcgcacagtacgtctggtggccctgggtgatgtggacgtacggcatcggatgcttcatcatcgctgccgtcggcctttgggtgatcccatccgactacccgcgctgccaaaaggccgcgacactccagttcgactatatcgggtcagtcctgggcgttgcaggcttgctcttgctcaatatctcatggaaccaagcaccaatcgatggctggtccacgccttatgtttatgtcttattgattggtggattccttgttctgggtctctttgtgctgcaggaacggcgcgcgccggggatccgatcctggatgtatccatctttagtcgatgggttgtagcaatcctggtgactaccggcttaggatggagcagttttggcgtctggttctattacttgttccagtttatccagcaatttcgccatgtgtctcctttggattcagcagtgcagttcgcgccaggggccatctcagggaattctgcctgcccttgccacaccctatctgatggcggtcatcactag

SEQ ID NO: 14360 - DNA, 1329 bp, A.fumigatus
tttgggtccgcagaaccaattaagattaccggaatgacgagcaagcttgcatactcatgtcctaatcgggcatccaagtggccggatcaaggccgatcttggtcgagttgttcgctggctctgggtaaatacttcattgaaccccactgtaggaggtcagaagttcctgttagaggatcctgcacccgtcaagtaacgactcttcaactaccaactaaccccactacaacaggattgcaagcagtatctctctccttgtccccatctttgaaatgccttgccggccagcaatctcgtccatgtcccttggtcgcgccagtgcgcacgatctgccagaaaaaactccagcaagccgcgcatcaagggttcaaaggcattgaattcttcttctacgaagacttagagacgtttgccgcacagtcgtctggcggtgccagtcgccttaacatcctcaaaggtgctctccgcatgcgccatctttgcacctcgctccagctagagatcatcgccctgcagccgttctggttttacgaaggtgtcctggatgaagccgagcataaccgcctcattgatgataagttgcgcttctgttttgagatctgtcatatcctgcacacagacatgatccttatcccgtccaattttctccctccagaccctgagaccggcgaaccccggactaccggcaaccggcgagtgatcgtatccgacctgcgccaggctgcagatctaggactggcccagtccccgccgatccgtttctcttacgaggctcttgcctggggaaaccacgtcgatacttgggaacaaagctgggacatcgttcgtcgtgtagatcgtcccaactttggtctttgcctggataccttcaacattgccgcccgggtgtacgccgatccggccagtgcatcggggatgacttataatggcgcgaaagagctgcagaggtccctcgcacgtctccgtcagactgtcgacccgaaacgagtgtttttgttccaggttgtcgacggggaacgcttgaaggcgccattggtgatgggtcatgaatggtatgtggcggagcagccaagtcgcatgagctgggtctcggaatgcaagactgtttgccttcgaagaaaggggatatcttccggtgaaggacattgcccgaactgtctttgctctgggatacgagggttgggtttcgacggaattgttctcccgcacaaccttcgaccccgaccccaatactccttacggccatgcacaacgtgggatcgcatcatggaagacactgtgactgaaatgcagggagagatggtttgtgcgaaggctgacagtgtataa

SEQ ID NO: 14361 - DNA, 387 bp, A.fumigatus
agacccgcgccgctgggatgctttaccgcgggggtcgtcggttcggtcttcgcacagtacgtctggtggccctgggtgatgtggacgtacggcatcggatgcttcatcatcgctgccgtcggcctttgggtgatcccatccgactacccgcgctgccaaaaggccgcgacactccagttcgactatatcgggtcagtcctgggcgttgcaggcttgctcttgctcaatatctcatggaaccaagcaccaatcgatggctggtccacgccttatgtttatgtcttattgattggtggattccttgttctgggtctctttgtgctgcaggaacggcgcgcgccggggatccgatcctggatgtatccatctttagtcgatgggttgtag

SEQ ID NO: 14362 - DNA, 288 bp, A.fumigatus
gatggagcagttttggcgtctggttctattacttgttccagtttatccagcaatttcgccatgtgtctcctttggattcagcagtgcagttcgcgccaggggccatctcagggaattctgcctgcccttgccacaccctatctgatggcggtcatcactagcggctggctgatggcaatcgcttgtgctgcgtttctgggtggatgcatcctgcaaagtacggcaccagtagagcagtcctactggatgaatacgttctggtcgtttgttatcatggcctgggggtaa

SEQ ID NO: 14363 - DNA, 201 bp, A.fumigatus
gctgggtctcggaatgcaagactgtttgccttcgaagaaaggggatatcttccggtgaaggacattgcccgaactgtctttgctctgggatacgagggttgggtttcgacggaattgttctcccgcacaaccttcgaccccgaccccaatactccttacggccatgcacaacgtgggatcgcatcatggaagacactgtga

SEQ ID NO: 14364 - DNA, 531 bp, A.fumigatus
atacgttctggtcgtttgttatcatggcctgggggtaaggcccctatcgcgcccgtagcgctctatatcgacaaaactgacctaatgatccgtaggatggatatctccttccctgcgtccactactatcttgagtgatgcagtgcccgtcaagcaccaaggagcctcggcatcactagtcaacaccgtcatcaactactccatcgccatcggtctaggcatcgcggggacggtcgaggcggaagtaagtcatcagggcgtgaaccagttaagggggtaccgggctgccctgtggtcgtctgtgggactggctgcacttgcatttggtatcgctttggtgtatgcggtccgcacattccaggagcaacgaaattccagaaagagcagccaggaacgcgaacagagagcttgtatagaaggctgtattctaggtctgactctgactccagatagagaatgggaaagagtagaattgggtagactcctgtcccatgtttcccaaacaggcggtttgcggaatcagtccgtttga

SEQ ID NO: 14365 - DNA, 1014 bp, A.fumigatus
gctcatcggagagttgaatcctgcttttcagtccgccgcagctacagaggtatgcgagacagacttcctaactccccactagagcaattcaggaggctgaccaaaaaccttttcaatgcaatgcagtccaaattcaaacgtctcaagcgtggtcacaaagaccatcggcaagcgtctcaaggcatcgacgatattttcaattcggatgaagacgaggaggcggcaggcgactatggcagaccgagccatcgaagacctatgcacgatgagatgaaggactttatcgaggaagacgtcttcacggatgatgagctagagcgggaacgagaggatctggagattgcccgtccggcgaagaggggcgtcaccggtctcggggccaccgacgcagccggcctggacgagaatgccctcgaagatatgcgcgcagcgttcggcgatggaaacgaatacctgttcgcccttgaaatggaagaacaagaggaggagcaagaggaggaccaggagaagcatctggatctaaaggatgttttcgagccgtcgcaattggcagagaggatgttgacagaagaggacaaccagattcgcttgttggacgagcccgagcgtcatcagcttgcccgcaaaccgtatcgcaacctcgttctgacggaagagcagttccgcgaagaggcagcctggatcgcaaatctcatgcttctcaagaagcgcatcgagcccgaattgagagaaccgttccagcggtccgtagccaaagtgctagagttcctcgtgaccgacgactgggaggttcctttcattttccagcatcgcaaggactatatgattcacgcgaccaaggttcctgtggctggtgcgcctgctgatggggacacgtctcagtacaccatcaaggccgagaagcttttgaacatgacggatctctgggacatctttgaccacgatctcaaatttagagcattggttgagaagcgcaatacaatccagaagacatacgacaatctgcagagctta

SEQ ID NO: 14366 - DNA, 204 bp, A.fumigatus
tcagggactgattggagagttcatcttgacaacgatgagcgactaactgaagtggttgagagaccgttggagttgatgggccaactattgggtactgaggatgcacacaagcgccgagaatccgggaaactcaaggctacagttcccgaagaggaagtccttggccttcggtatttggattatggcctttatcactatttttga

SEQ ID NO: 14367 - DNA, 1170 bp, A.fumigatus
ggaggaaatttcgggccaaatttggggaaccccagggggttaccccagggccggttcaaggtttccccaaacatccgttgggatttacctttggatgatccggctgtcattatcgacgccactcagttgctattactcttcattgaccggaactctgctggattcggagccgatccctcaaaggtcatggcgttcatcaaagactttgtgccgatcttctatggcatggatcgtgatactttccacatgtacatgaacgagatctcgagtgatgctccatctggggaagatggtgatgacgagagcttggccgctgaagacgcctcgacctggcgcaatcggagaggcgtgaacgcaaagaagatggatctccttcgcgatgtcctcgagcggcgcagtgaaaaggccaataggtcggacaaggaccgcaatactcccgctagccgtgatggcaccccggatgctgttctggtcccatcgacgcctgtccctgagcctgctgaggcgtttgacgttgcagagctgaagtggatggaacatcctgggcaagggaacttcaatttgcagcgggaatacgcgttgaatgaatcctacgtgaagaaagtccatcatttgtatgccaatctgaacatctactgcttcttccgcactttcgagattctttattcgcgactcttgcggatcaagatgcacgagaaggacgctcacgagcatgtgcgccgggcgctgatccccaaaccggcccgtgacctcggtctcatcgacaagcttccaaccgacttcttctacgactgcgacccgaaggccaatctataccaacagattgtccgcatgtgcgaggaggtcatcaagggcgacatggatgcctcgcacttggaggagacactccgccgttactacttgcgtagcgggtaccagctatacaatctggaaaagatgtttgcgggaatcgccaagtttgctggctccatcttcaatggcgactccaaggatcgcagtgccgacatcatcaatctcttctttaaggagcgggaccgggaggagacgacacataaccaggagatccagtaccggaagcaggttgagaggctagttaaggacggcgatatctatcgtattacttatgtaagtgctccctctgttggtccatcattgcaagtccaaagctga

SEQ ID NO: 14368 - DNA, 630 bp, A.fumigatus
aaccctcaaactaagaagaccaccgtgcaactgctcaccccagaggacgcaaccttggagaacgaagagctaagccaggaagcgcgctggtcgtactacgtctctgcctacacaatgcgtgatcctacggaaggtgttccattttcgcagatgcgcatgcccttcctgaagcggaacctgccgcccaagcttgagcaagaagaggagtacaatcgctactatcggcctctggtccaccaagatggtctcatcatccggatctgtgccaacagctatcatattctgtacgaacccgggagctgcgattggtggtggcgccccaaggctctctcagaggagtcaccggaagacatcgccaaggaggaggccgctgtcaaggaaagacgacgcgatcggttcatggaaaagtttgttaacaaccctagctgggcgcaggggctcagcaaggaccaagtcgacgagtctaaccaacgattccgctcctggatcaggggccctgaatctgaaaaggagaaggagaaggcctcggtgggcgcaacggaagaggccggcttcgagaagaaggctgacaatgaagatgccgagatgcctgacgcggaccccacagcgcccgagtccaaggaccaatga

SEQ ID NO: 14369 - DNA, 1368 bp, A.fumigatus
gcctccacatgtcctgccagtccaaagccaggatattacaggtgctttgcagtatgttgcagaatagcagtcctctggaagtcggacttgttgcaacggaccttacagctcattgtcagtaaacttgccggtgccccggggtttgaaaactatgaagagatcatatctccttccctactgaaggcactaatttggagcccatatcagtgtccatcaatacccttgcctgcttctcagaccaagaatcacgataccatcgttagatggaaccctggtatttcctttgctcactgggctcgtagcattgggcttttcttgacaaaggcggctccccaagatcctgttattgggccgctgagaaacattcttcacgtcataccttcattggcagtccggattttgccatatattctgcatgatgttctgctcacagagcctgacggcgtcgccaatgttaggaaaaccatttctgatgttttccagcaaggtctacacgaagctgatgatcattccatccctcatgtccgtctcatcatcaactgtcttctgtatcttcggaatcaaccgcgtcctcaagaagcaacgatagtagagcgtgatgagtggcttgaaattgattttgcagtagcatctagggctgcaaacacatgcggcttacccaagacagcactgctgtttctggagatacaggcctcgcgagccgtgtccggatctcgccgctcctctctcgtgaagtatgaacctcctcctgatctccttcatgacatctttagaaacgtggacgatccggatcttttttacggcgtccagcaaagctcgtcactagagtccgtgatggagaccttggaacatgagagctccgggttcaaaaatctcctttttcagagtgcccagtatgattgcgagattcagatgtcgggagacgctgacgcgcatggtctcttaaaagcactcaactcaagtaacctgcagggaattgcaaactctttgacatcgaccctcagaggctcaaaaagctctgtctcatttgatagcatgatgcaagctgcgatagatctgcgacaatgggatttaccagtttcgcctatgaatcactctccgtccgctgcactctttagaacctttcaaagcctgaacacttcaacgtctctggttgatgtttcgaattccgtcaacgaaagcctcttggccatattgggctcgctaggaagcaccagtcgctcagctatgtcctttcgggcagcgatgagagacctgggaattgtgactgagataagcgatgtcttaagtgcgacgtctctcgaagagttaagtgaagaatggcggaagatcgcagaacgaaactcttggttgaaggcaacaaggtaa

SEQ ID NO: 14370 - DNA, 1827 bp, A.fumigatus
  unsure (1510),(1538): Identity of nucleotide sequences at the above locations are unknown.
ttgtcttcaaaagacttcctgcccgacgtttatcgggcatgtgcaggatatgaacgcacttccctattagatttgttggaggacatgggcgagaaatgtctgcacacctaccaactggaacgttgcgaaacctctcaggttctgtgcattcacatgctggatagtttcattaaatcatggacgacaggagatggagatcatctcagtgattcggcctcagatatctacaattgggttaccgatgtcttattggtaaagggcagggcttcttctcgagtatccatcgccttttccaggcttctagaggaaatattcagtaccaaccctgcgtacacaagcggagaatccaacccctctcccaggacaactcttttcatgatccttcaggaaagtgatatcctgactaagtacaacgtgggcaatctcgttcccaaattgtttaggcacttcccactgaaagatcacgatgcgatcttcgatgatattttggaaagccttccccgcgatcctgactggactgagggtattgcgctccgtttattcatattggcaaggttggcttcacagtggcacactctacttcggaggagcatctatcatatgttcgagacgccggcccagcttccgcactctcggtggcatgctgaaaaatgcatccgacacgttgcaagtgtccttggactcgaagacgcacgacaattattccgcctcttctcctcccagattctttacacctggactgaaaatgaatcagttatgacaatgcccttcagtatatttggttattccaccattgaggatatgctgagcgatgtccaagacgaaattgtaggtcaaatcatgatgcgggccaatgagcacgaggcaagtgagctctccacccgtctgaaaatacctttcatagagctcctggcgacatctttctataaggcagaggcgtatagtattgcacgagacatcagcactcctcctgggcagagttctcaaccgaaaggggttgaaaatcgattgaagaagatcctgggcgctgaccgtttcgtgagtctggttgagaagcaatttccgcaagtaattgcaacgttctttggaaccctagatcagtgtgagcagatcgagagagcgttctccaagagggccaattttcaagaagctttcagtatcttgaaatcaattactgctaagggcgcctcaaaggaaatacttccccccaatcagcaaccttccttcagagcgcgctaccttctagatgagcttgaattcctctgtaaacgaagcggttatgagctcgaaacgatatggacacctacattggcatcttatgtctgccggacacttctggaatcaattcaccccgcgcttggctctcttcatgcctgctctgtcattcgcaagatcaggattttgatctgtattaccggccctgttatgctgagagattatcccttcgaaatgctcctacacgctcttcggccgttcctcacagatatacattgctccgaggatgcactgngaatgttctggtatctcttggacgctgngaggtcttacttgactgaaaatcctagtttcacagctggcatcgcagtgtccaccctgctctcttttcgaaagttcttggcctctacatcagccactatgcaggaaagcgaatctgttgcagttctgacaatcgttcagacctttcttcaatggttcgaagacttacttgaaatcttacgagtcacctcatctgagcccagaggcgcatgccttctttcagcgtctgatggagtcttcgcgcaggatctctactccagacaaagagttggatggtacggaggagtgtaa

SEQ ID NO: 14371 - DNA, 387 bp, A.fumigatus
actgatgatccgtctagtgctcaaatacacccgccatcagtgggatatccccgcctgctggtttaccgccagatacatgaaggcatggcaatccctgttgcttgcacttcgactgcttaccatgcgactatccagatactctacgcacaaggcaccctccttgggcccgtcatcttttttgcgaaatcctccattttcctactctgtcgacagatcttcaccatccagaaacagatgaaatacgccatccggttcggtctgctcttcacttttcttctttactggccaggcgtcggtctggaatcgtacttcgccgcaccgcatgtcggcgagacatcggaggatcgtcttcacctaagggagcgcccggatccgcggagggtccca

SEQ ID NO: 14372 - DNA, 345 bp, A.fumigatus
cgagcgcttgtaggctttgtgcttatcgcgctggtgctgtccgcaacatacaatgccttggttctggatagtcagtttctggtctatgagatttgtcgcttgattagactgatgatccgtctagtgctcaaatacacccgccatcagtgggatatccccgcctgctggtttaccgccagatacatgaaggcatggcaatccctgttgcttgcacttcgactgcttaccatgcgactatccagatactctacgcacaaggcaccctccttgggcccgtcatcttttttgcgaaatcctccattttcctactctgtcgacagatcttcaccatccagaaacagatga

SEQ ID NO: 14373 - DNA, 792 bp, A.fumigatus
tcgctaatttccggccgtttcatcgtcgcttctcctggactggaactcgttgttctttcaactggccttattcagacattatttcctacgtctgtcgtacgtcactttcaaactcgactgttcgcattatccgtgaatatgtccgttaacccccgcaagcctgggacttcaggcagtgggagcaaaaccaccaccacggacaataacacagtcaacggaacaccgtcgcgagttcacactcgatcccccagtgcttctacgaacggtctatccagatctccttccctccgtggctcagctccggtctctgcgcgcgctgctgcccggaagcctggtcggtccaacctcagtatgtccaatgtaccgaaggtggcggccgattcgtcggaggaagaggcccgggcccagaatgcggctctgattgaagagttgaaggagcagttgcagaaagctgagagcgcatcggagcagtatcgcaagcagcttggagtcttgcaaatgcgccttgacgaagccatcagcgagcagggcaagctggaggaccaggctcatgagaaggacagcaagattgaagctctcaacagtgaaatcagagaccacattcgccaaatccgagacctagaacaggcacacgaatcggagcggaatgccatgctccaggagaaggagcagtacttgagccgggaggaagaaatgcaggcgactatccagcgcttgaaagatacgctggctcagaaagagatacgaatgaatgctgataacgagaagaatgtttcccgctcttgtgagtaa

SEQ ID NO: 14374 - DNA, 855 bp, A.fumigatus
tcccaccggcccccaatagttgtcactgacgcagtcattacagccagtttcctgaatcggtcctcaccagatgtggaagggcaatttgcgccttcatcccagatcgagcggagcccatcgcggaacaattcgaagctgcttttgcagaaggacaaactgatcgagtctctccgtctcgaattggctgaatcccaaatcaagctcgtggagatggaaaacaagggcggtggccggcaacgcgaattggagaaggagcttttggaagcccggatggctaacgctcgtctgatggaggacaacgagagttaccagctactcttgagcgaacggacattgaatggggacttcaccaaaggtgatttcatgcgtgaagcccaccccgattatgatgaggggcaggaacccagcaatggattgggctctctggctgacgagctcgagtcagtggatgccaaagcggaaaccgacaatacccgtaaactcgaaacggagatcaaggcgctcaaggaccagaacaaggccctgaccctgtacattgagcgcattatcagtcgtctcctgcaacatgacggcttcgaaaccatcttggacaaaaacgaaaacgagccttcaactactgcaaagcaggtttcttcagtaactgaaaaggacctgcccccgacacctccagagaaggatgactcatcttcccagacttttctgcaaagagccaagtcagtcgtcgctggccaacccaaccgttctcaacatagatctcgcccgtctactttcatgccacccccaacaagtgtcccgacagctcacgaaaaccccgagacagcgcccagcatccctatcaatcgagcacagcgtggc

SEQ ID NO: 14375 - DNA, 372 bp, A.fumigatus
agtctggaaagggtgtgtgacatttcagtcaaattgaccatggagaccaaatcactgattgttttcacccctacagtcacccttggctacaagtccaccatcaagactctgcgttccggcaaggccaagctggtcctcattgctgccaacgctcctcctctccgcaagagtgagctcgagtactacgccatgctggccaagactcccgtccaccacttctctggcaacaacgtaagtcacaagtgtttctgcattggtttttactgctatgccccgacgctggttcttctccgatggagggaaggcgacgcgggagcagccctgagaagaagccgtatatctgggctttggagggtaaatgacaatggctga

SEQ ID NO: 14376 - DNA, 228 bp, A.fumigatus
ggtttagggctttgccactcgttagcgggagttgcttggaaatcaacgtcgagacttgcccgcaggcgaagaattcccccttcccttttgaactccccgacaccacccttttcgacaacctcaccgttcgcaggaagtgcagtcagcccatttccagcagtcacaatggcccgtcgtcccgcgagatgctaccgctactgcaagaacaaggtgcgtgcgatcgcttga

SEQ ID NO: 14377 - DNA, 1089 bp, A.fumigatus
acttacccattcgtcatgaagtgggagtcgttccttttgacggccatcaccgctggctcggccatggctggagcacaccatgcaaacgagcatgctcatcttcgtcaccgtctggttcataatgcagaattgaaggctagagaggttgacgatcaggccaatccagcggtcagcaccaagactatcgtcaacctcgaggttgtcaccatgtacaccactatcacgcgacgccctcacggccacaagccaactaccaccgtggcagccgtagagacgtccactactggcagccagcctctcgcaagcgtcagcctcgacgtcgatgcgaacctcctggatgtccgttcagccaccaccagcacagcgactacgttgagcactagcaccagcagcgccaccgtgtctgcggcgaccagcagctccggcaacagcgccagctggacctccaccccttccaatggcgtgtactcgacctctggttttggccaacgcaccaactcgtccgggtcagggatcgaatacgtcggcaacgtcggcagcccctggggcagcaacatcatcgaggtgaccgcctccacagcctcacagtacaagtacgttgtgaaattcacaggcagcaacaccgacgactggttcgtctcgttctggaacaaggttggccccgacggcaagctggacgggtggtacggccactcagcgctcaacttcaccctggcacctggccagaccaggtacgttgcgtttgatgagaactcacagggcggatggggtgccgcggcgggcgattcgctgccgacggatgagtacggcgggtatgcgtgtacctggggcgagtttgactttgggaataccagtaacgatcagtggtcggggtgggatgtgtctgccatccaggcgcagaacgcgggtctgacggtgcaggggatgaggatctgtgatcataacggggatgattgctcgtatatcaccactgatgctgccaaagtggtgaatgcgtacacggcggcggaggcgtctgttgatggtatcggggggagtgtgagtgccggtgcggtgaggttggtggttgaggtggattacagtggttga

SEQ ID NO: 14378 - DNA, 225 bp, A.fumigatus
tcgagtagatatggcactggaactgagtgtgacggtggctgcacgggcactgttgcagagcaaaagtacctcaatacgaagatcactctggcctcggctgatactacctttggcaacactattgcttcggctgccggtgcgacgtactctggcttgagctcgagcgagggaggaaaggtgtggacaatcgagagcatcaccattcccgctatgtcgaggtcgtag

SEQ ID NO: 14379 - DNA, 462 bp, A.fumigatus
cagctgactctcctcgtctatatcccaatgaaactcgttctcggcctccttctccctaccctgggcgtatctgcctccgtcatcaaacgggaagacacctggggcggcagcgtctctctcggtcctaccaaatccaccatcgtcaacgccgtcaccaccctcatccccggtgcggcgcctgcaactcaaagcggcgagctcttcctctggcccgggatgagcaacggcaccggcgatcttgtccaaaccacgctggaaagctggcccagcaatgcctggtgcggtgcaacaacaggccagtggtgtgtaagggctagtctgttcggcagctttggacagttggatggggacgccagcccagtgagcgggacggatcaggttcgcatcgagtatactttgttggatgatcaggagacctgggtgcagtatgtatcacacaatgaaggcaaggatagtggctaa

SEQ ID NO: 14380 - DNA, 279 bp, A.fumigatus
cgcccactagcgctccgccttcgctgctttaaatacttccaaactgcccgcttcccgcaacttttttctttttccttcttctcatcaacaaccgccgataacatatatcaacagcttctgtctcttgtcatgatgaagctgttttcgcgtcgcgcgaagactgaccctacccgacgctgggcacctagctttgaaaggtcgttccgatcctttgcgataatctgggaatcagctgtggttacaattgacctcgtacaatttgctcttttagagacctaa

SEQ ID NO: 14381 - DNA, 615 bp, A.fumigatus
gcccaagttcacgagcttggatatactgaatgtgcgaaatcgtacgttttcagaggcagcaaggagtatgcggcgaagcaggtccaggagatgctcggactcctcgccgcaggacctcgccccaacatgccgcagcagccaactcgcccgcctgttggtcccgctgcgcgcttcctgctacccgttcagcaagccgagttccagatcaccaatgtccttgaacagctgcagcgtgatccttggcccgttgccaatgacaagcgacccctcagatgcactggtgtggctctgagtgttgctgttggcctgctcgagacatccttccagaacgctggtggtcgcatcatggttttcaccagcggtcccgctactgaaggccccggtcacgtcgttggacctgagctgaaggagccaatgcgttcccaccacgatatcgaccgggataatattaagtactataagaaggctgtcaaggtaggcgtcatttcgtcgtctcatacgggttgttcccatgctgatcaatttagttctacgacgccctggccaagcgcgccgctaacaacggacatgttgttgacatttttgccggctgccttgaccaagtcggtcttctaa

SEQ ID NO: 14382 - DNA, 555 bp, A.fumigatus
aacgcggttaaaaaagggcggaggagccgcgttggaacaattcaaaaatttttaaggcgaggtcagcccggggcaggggcatttgaagaactttccttcaatgcatcctcttcctacggtgcattagatcagcgtttaaagaatgaacgccagaaagatcattattcccacttcatccttcgccttgcgttttcggcaaccgaggacctccgccgacgcttcgtgcgggcggagacaatgctgttcagatttcggtttcagcaagacgactcacgagagaaacgtgcctttattgagtccttaaatctggattgggaacctgtgagtgatgaggagagacgcgaggttgctgagaaattggtgagcgcaacacccggtctgcggcgtgttgatgaggagacttggtataaagtggactgggagcgagttcccgagcttgtggaaaggagagctgtgctcctgtccaaggggaaagcgtatgtgcctggcagagaacaattgagtatgatcatagctgaattcacggcacgattggagcgcgccctcgaggtatga

SEQ ID NO: 14383 - DNA, 849 bp, A.fumigatus
ctgaattcacggcacgattggagcgcgccctcgaggtatgaatcttttctacactgtgggtgttacgggttagctgaccactgccagctcacgagccgcgctctgccacgattggatgaggatgatcgtcttacgccaatcctgaatcacctgtcgaagaacttcggtagcgcagaatcagtatactctgaaggcgaagggtttgttgaaggagcaccaattactgccagtaacatcgatcgcctttcacagcacttccctctctgcatgcggagcctacacatgacgttgcgcaagaacaaccacttgaagcacttcggtcgacttcaatatacgctcttcctgaaaggaattggcctttctcttgaagagtgtatcattttctggcgacagtctttcaaaggcttcacggatgacgagtttaattctcggtacaaatacaatatccgccacgcttacggtgacgtcggcggtgacgtgaaccgaagaggtcggggataccctccttactcttgccaaaagatcctcaacgactccaaccccggagttggccagactcatggatgcccctaccgtcacttctccgtcgataatctcatcggactacttcagtccacaggtgttcatgacaaggacgttctacgaggcgtgcgcgaggatgttgaaaagacacgctatcatattgcctgcaacagggtctttgaatgggcgcacaaagcagatatcaagcgagtcaaagaagatggtacttggggtcagacagatttggacaccatagtccatccgaacacctacttcaagcgcagctatctcctgaaacaaatggggaagcctcctaaggacgcatga

SEQ ID NO: 14384 - DNA, 231 bp, A.fumigatus
cactcgcatggtaggtttactgggagtgcttcgcgtctatgcccctccatactcattcacgttcgcatacaggaagcgtcccgactcgttgtccctattgccgctgtttacactcccctgaaggagaagcccgattcgccgttactacaatatgagccggtaacttgcaaagcaccctgtcgggctgtcctgaacccctatgcgtatgacctacgcccctgtcggctctga

SEQ ID NO: 14385 - DNA, 345 bp, A.fumigatus
ctgacgaaggacagcaacgtcgatgttcgggcccggatctggatttgccctttctgcctcatgcgcaatccccttccccctcactataaggacatcactgagaatgcgatacccccggaactgcatcctcagagcacgacgatcgaataccaattggcgcgccccgctcccgctccccctatctttgtctacgtcgtcgatacttgtcaggaggaagacagtctgaaggctttgaaggatactctgattctgagcttgtctttgctaccgccgaatgctctggttggattgattacttatggcacaatggtacgaactgaattacatttctttggtttcggatga

SEQ ID NO: 14386 - DNA, 240 bp, A.fumigatus
ttctacgacgccctggccaagcgcgccgctaacaacggacatgttgttgacatttttgccggctgccttgaccaagtcggtcttctaaaaatgaaaaacctggccaacttcactggaggtcatatgctccttacagatagcttcacatcgtcccagttcaagccatcctttgttcgggttttcgataaagaccccacgaaaacctccggatgggtttcaccccctcccctgaaatcctga

SEQ ID NO: 14387 - DNA, 186 bp, A.fumigatus
tgtcgcccttgcggctactcgaatcgcacctccggccttacatcgatcacttggctggggtggcatcccctggaggaccgcgccatcatcgtcggccattacatgcagacatctaccgattcagggaccctgcgtcccattaccacaataccatgccgtggagcagccgcgatcgcagcttcatga

SEQ ID NO: 14388 - DNA, 645 bp, A.fumigatus
gacaccatgggcgctcttttgaattatttcctggggactgcgacggccgtattggcggttgtttggttcctacgaaggacaaagtctccaccccaagcgcgaccgcagctagaagttctaccaaattcggctctggtaagcaagctcgcaagggcgctgccacatattgtgcttttgcatcgtgatggagacgcctttcgcacatcaataaacacctactgggtccaacaggagcgcgaggtcgtgcaagcctgcatcgtccagccacgtgatgctgatgagttggctacggccatcgacatcctgaaacgggaatatgacgagcgaaggacgctgccaccgaaagaatctgatagtgttttgtttgctgtccggggcggcggccaatctcctgtacctggcggtgcaagcgccaaaggaggcgtgttgatcgacctcgctctgtttcgggaagtgaccatctcggacgatagagaaagtgttaccctgggagcaggagttcggtgggctgaagcatcgcggatcctggatgaaaagggtctcggcgttgtaggaggcagaagctctgatgtcggtgtggcggggtatacattagggggtgagcatcactgttctgtctggacatgttctcaactaactctatag

SEQ ID NO: 14389 - DNA, 441 bp, A.fumigatus
cctacgaagtcgttctcgcctcagggtaagattgtgacggccacggccttgtcgcaccccgacctttggcgcgccctcaaaggcggctcgaacaatttcggcatcgtcccccgctttaccgtgcgctgcttcccgtccacgcaaatctggagtgggttcatgtacgcccctaattcgcagtccaccaaggcgctcatggccttacatgagagtgcaaaacacgccgattccagaatatgcggagcggctgtcgatacgcacgccgcggcgccgatcgcctgtttcacctacatacaggggttaggcatgcacgcagtcacggtccatctgggctacacaaagccaccggaagagcccaagaaatggccggtttactggaataaaattcggggttcgcaactatctggcgattctggagcaccttcaaagtccagacaataa

SEQ ID NO: 14390 - DNA, 216 bp, A.fumigatus
  unsure (199): Identity of nucleotide sequences at the above locations are unknown.
atttttccccataataaaaaatgttgccagaatgccatggtcccatctgggccattgatgacgtttcccgttgctttcagcgcaagtatgtctgaagccgctcacctgttcctgcaatttgcgaagaattattttggtctaacgcattttgagttatttcagatatctgcaactcatatttccattaacagcatgcggnctttccttaatggaaac

SEQ ID NO: 14391 - DNA, 264 bp, A.fumigatus
gtggcatctagtctgacaagaacctggcagctcaatgacgaagatatcttcaactggaatgtcggcctcatcgtactgaacccagactctctgtactacggcggttacttcaaggcgtccatgaaattctccaagaactacccatactccccacctggtgagccttcccccctcttctttttccttgtgtccatcttggacggcactgacctttacaattcctcatgtagagtttcggtttctccgccctctataccaccctaa

SEQ ID NO: 14392 - DNA, 483 bp, A.fumigatus
aattctccaagaactacccatactccccacctggtgagccttcccccctcttctttttccttgtgtccatcttggacggcactgacctttacaattcctcatgtagagtttcggtttctccgccctctataccaccctaacatctatccggacggcaaactctgtatatctatcctgcacgcgcccggtgaggatgagatgtcaggcgagctggcttcggaacgctggtcgcccgctcaacgtgtcgagtctgtccttatctcaattttgtcactcctagatgatgccgaagtgtcttcgcccgcaaacgttgatgccggcgtcatgctacgaaaggacttcgaatcttacaaggcgctggtgaggaaggatgttgagcaatcaaagatggacattcctgaagggttcgtcatgcccactcatgagtcctcgatgaaaagaccaacagagaagcccgacgatgccgacttctgggccgactag

SEQ ID NO: 14393 - DNA, 1425 bp, A.fumigatus
gacgctttcaacgctttcaacgttgtcgaatgcctggttactttggccaaaacctacaatcgcacagttattttcaccattcaccaaccgagatcgaacatcgtggcgctcttcgatcgtcttattctcctagctcatggaaagaccgtatattcgggcccattctccacgtgtcagcagtatttcgacgattcaggctactcctgccctccggggttcaatattgcggactaccttgtggatctcaccatgcatgctagcgttacccggtcacatgaaaatggacatgagaggcccttcttggacatgcagcccccgcggactgcatcgagtagtttgagagcggtgaagtcggttgcgagcgcctccaacgcgagcatcgaggacagcgtcgagtccagtcgacgtcccaagagtaaacgacggatctctctcaagcagcgacaggataaacagctatactcgcgtaaaaaggaccaccagacgccgccaacaccgaagaccgatgaagaagacggcggtgaaatatctgacagcactcagcagtggcttcgcctctcccgccaacaaggccatgtaccaccccaggttctggatgaccctgatcacttgccacccgctgcccctggcccaaccgatcttgacatcctgatcgccaactacgcctcctccgatgttgctcgctcggttcatgatgagatcgttgcggccgtccagaaagctcacgtcgcgaacggctctaccaatgcggagatcatgtcaggagctgctaccggtcatgcaaagagttatccaagagttagccttttgcgccagtttgtgatcctctctcagcggacatggcgcaacttgtatcggaatccgatgctgatgcttacacattacgcgatctcaattctcctggcagtgctatgtggatacctcttctatgggctgacggacgacatcaagggcttccagaaccgcttgggtctgttcttcttcatcttggctctgttcggattcagcacgcttaccagtctgactgtcttctccaccgaaaggcttctgttcgtcagagagcgggccaatggctactaccatccaatcacctactttgctgccaaggtggtcttcgacgtcgtgcccctaagattgatacctccgatcatcatgggaatcattgtgtaccctatgaccggactgattcctgcttggggagaattcttccgcttcattctggtgcttgtgctcttcaatttggctgcggctaacatctgcttgttcatcggtattgtcttccgcgacggaggcgtggccaacttgatcggcagtctcgtcatgctcttcagtttgttgtttgcgggtctcttgcttaaccatgatgcgattccaaagtccgcattgtggcttcagactgtgagttttcagcctatatccccctga

SEQ ID NO: 14394 - DNA, 222 bp, A.fumigatus
  unsure (133): Identity of nucleotide sequences at the above locations are unknown.
gcttcaagcagcggctcatcctcatcttcatcttctccatcaccctctcctgaaagcagtgcaatcagcaacatgtccggtgaagcgtggctctacctgttggcggtgctcatcaacgccgtcaacctgttcntacaggtcttctttactatcatgtacagcgatttggaatggtcagtctccgtacttgcgatcttgagtcaattacgacacccaaactaa

SEQ ID NO: 14395 - DNA, 237 bp, A.fumigatus
ctgtccatcttccactacggtttcgaggccttgattgtgaatgaagtgaccttcttgacgttgattgaccacaaatatggactagacatcgaagttcctggagcctccatattaagcgcctttgggtttgataccctggcgttctggccggatgtcatcggactggcgatcatctccggagcattcatcgtgattgcctatgcggcgatgcatttcttgctcgtagagaagcggtag

SEQ ID NO: 14396 - DNA, 228 bp, A.fumigatus
gtcaattacgacacccaaactaatctggtgacttgctgcagtgactacatcaaccccattgacctctgcaaccgtcttaacgcctacatcatccccgaagccgctgttcatgccttcctcactatcttattcctgattaacggctactggctcgcgctcattctcaacctgcctctgttggcattcaatgctaagaagtacgtttcgtccggaataggagttccatag

SEQ ID NO: 14397 - DNA, 663 bp, A.fumigatus
actccttgtctcctgttttcgggttgcctccgtcacaggtcatttcacatggacctgatgagctcacgatttaaatccttcggcttcaaacgcaataagaacaacagtagcgtctccgtctccgctacccaagtcgccagtcctagcccgtccacccacactctcgtcgccccgccttcaaccgccacctcccccagctctccgccttctggccatagttcctcatcgaccagtctccccatgaacaatcagaataccttgggtcgccctccgagttatacttacaacaccgcgggccggccaaccagccccatgccgcccggccaacagttggctcatcacccacccccattaaacaccaacgtgcagtacggccatcagcctgtccagcccgtgggcgctccgcctgggtatccgttgcagcaacctgttccacatggaatccctccttcgttgccgcagcctcagtataacgtacggaatcccgcggtcgaagtcgagggtgctggtcggagcaaggcacagctgattgttggtattgactttggtacaacattctccggtgtcgcgttcgcctttgcgaccaacaatgaggctcgcgaagatatcatcacagaatggcctggggcaggaacgcataccaagcagaaggtgggcgcttag

SEQ ID NO: 14398 - DNA, 957 bp, A.fumigatus
attcccaccgtcttgtactacgatcaatatcagaaggtggtaggctggggcccggacattgcggaggctctggcacccactggatacccgaagaccggcgtgcaaaaggtcgaatggttcaaactacagctcatgctctccggcaatacttatatcgaccccatcaacctaccgcctcttcctcccggcaaatcagaaattgatgttgctgccgattacctctttaagttgcgacaagcgatgcgggcgcaattacagaagactcttggtgaggtgttcactcgagaagagcgtaatatccgatactatctcaccgtgcctgcgatctggaatgatgcagggaaggcagcgaccagggcggcggccctgcaggccggatttctgcgcgacgagaacgataatcgcttgacgttgatctcggagcccgaggctgccgcactgttctgcgcgaagaccggtctgcttcagctcaaagtcggggatgcgatcctgattgtggactgcggtggaggaacggtggatctgattgcgtacgaggtcgaagaggagcagcccttcagcgtggcggagtgtacagcgggatcgggcgattcctgcggttcgacggctctgaaccggaatttcagcaacattttgcgggccaagattcgcaagatgaagttgcccgacggttcgagaaccgcgggcaaggtgtatgcaaagtgcattatggactttgagaaccgcatcaaagccgatttccgcaacaatggccagaagtgggctgtggatgttggtatcgaagcagacttccccgaggctaatatcgaagaagggtacatgacatttaccaatgaggaaatccttcaatgcttcgagcctgtcgtcaaccgcattctcgagttggttcggaaccagatcatcgcgattcaagcgcagaatcgatcgcttcaggtaggttcatctcgactatgctga

SEQ ID NO: 14399 - DNA, 225 bp, A.fumigatus
ccagcgattcgcagcgggttcgaacaggcgaacaaatacgtcatcatggatgcaaatggaaaccatatcggatatatggccgaacaagagaaaggcatggcaaatatgatggcgagacagtggtttcgaacacaccgaagttttgtgacgcacgtgtttgatcggcacgaaaacgaggtgcttcgagtatgtccatatccatttgtgaaattccaccagcaatga

SEQ ID NO: 14400 - DNA, 1131 bp, A.fumigatus
aattccaccagcaatgagtctcctaacgcttttcagttccaccgccccttctcttggattaactctcgcattcgggtgtacgaccctcttgatgttgccaaaagcgccttctcgtcttcaaccgcagtccagactgcatcttcagggtcacttgtccaagctacggggacatcaaatgcacgcatctcgcctttgggattagaggatatgcgtgtgatcggagaagcacagcagcagtgggcgccgttgcggcggaaatacaaccttttcacctatcatcactcccctctcagcgccacggagatgggaactcagagattacctctctcgcaaacagggttatcaaactcgcagcagatgcaattgacgcagactaatgccagcggtcaagatgttggtgaataccatcagttcgcctatgtcgatgagcccttcttgtcatgggacttctctctacgctcggctgacaaccgactcatcggctcagtcaaccggaacttcgttggcttcgcgcgggaactgttcactgacacaggtgtctatgctcttcgcatggattctgcggctcttggttccgaggatttgaccacacgaacaaacgcgccaacaggaatgacgctggaccaacgggcagtaatgctggccactgcggtcagtatcgacttcgattactttagccgtcacagtggtgctggcggttttggcttcatgcccatctggttccccggtattggcggagaggccgctgccggtggtgccgctgccggtggtgcagctgctggcgaagctggagctgtaggtgaggcggccgcgggcaccatcggcagggctggcgccgctggaggaatcgctgaaggtgctgctgctggagctgcgggtgcgggtgcgatggctggttacgatgcgttgtcaagaggcatggcaggagacagcaattcacagcatcctctcccacccgagcagcagccgtactcggcagaccagcaatcatcggtttccggtcaagcaggtccttacggggatgtatgggccgaggagcaagaggatccttttgctcgcgcgcccgaagatccctggaacatcgaggagccagatgatgagggcgaagaaggggacaatgactggttttga

SEQ ID NO: 14401 - DNA, 303 bp, A.fumigatus
ttctgctcgctcactttcctccaattttggatatctggttacacaatgtcgtccgtcgcacagaagcgtctctttcacgagtataagaacttatcaaccaaccctcccgagggcatcactgctggtccagtcagcgaggatgatatgtttcactgggaggccttgattcaaggtcctgagggtacgccatatgaaggaggcgtgtttgcagcagagctcaaattccccaaagattacccgctgagtccgccaacaatgaaattcgtcggtggtggggtgtggcatccgaatggtgagagatag

SEQ ID NO: 14402 - DNA, 270 bp, A.fumigatus
catagcctcctaacagtctatcccaacggaactgtctgcatatccattcttcatcctcccggtgatgatccgaaccattacgagcatgcctccgagcggtggtcgcccattcagagtgtggagaaaatcctgatctccgtcatgagcatgctggcagaacccaatgacgaaagtcctgctaatgtcgaagcggcaaaaatgtggagagaacgcagaagcgagtatgagcggaaggttcgtgatgaggtcagaaagggcttgggtctgtag

SEQ ID NO: 14403 - DNA, 978 bp, A.fumigatus
ctgtataacgttattactcaagtcgccgttccaaatgttcaagcatcccaaagcaatgcgcaggttgaagtggtctgcgggcctttgatcaactacaagaacatgaccgtcaccccctcctcctccctctggcatggaagcgtcttgattgtcacgaaacccggtcaaggacagccacagctgctcctgcgacaaagtggtccggtcggcggtagcaatgctccggtcaatggcgacctatcagcccgtcagcccgtcacaattgatggtttgcgcctttacgaggatccccagaaagccttctggcgcttctccatcaccgtccccctgcaatcctatgaagcgcgctgggagtatgacattcccggctttcagtatgcggaagccaatcgaacgattacaccctggaactttgtggtgccttcagtgaaccagtccatgcggctcatgttccactcctgcaacggtttctccgtcggcacggatatggatgcatggctgggtcccaatctgtggaatgatgtccttcgtgttcatgcgcaaaagcccttccacgtcatgatcggtggcggtgaccaaatctacaatgacggagtccgggtggatggccccttgaaggaatggacagcgatcgcaaatccccataaaagacgggcacacaatttcgataattccatgcgagccaaatgcgacgagtactactatgcaaactacaagagatggtactccaccgagccgttcaagaccgctaatgcgcagatccctcagatcaatatctgggacgaccacgacatcattgacggcttcggctcatacacagaccactttatgcggtgctctgtctttcgcggcattggaggcgtggcgtacaagtattactgcctgttttcaacaccaccttgcgcctccaaaggtttaccttccaccaggatgtcccccagaactatgaagccaaatcatggctctgccgggttctaa

SEQ ID NO: 14404 - DNA, 441 bp, A.fumigatus
  unsure (46),(155): Identity of nucleotide sequences at the above locations are unknown.
actcaattatcttcactattagcatcagaccccaaacagcattcantacttacacgtactttccactccccaaatccacaaaccatcgaaagcactccccttgcgccctcccacgctcatcaaacaccactccttccgcctccaacaacagccgnttctcaacctgatacttcccacccaagatccactcccccttatatccccccaacgtcccattcgtcgccagcacccgatggcagggcacttctggcgcaaacgggttcgtgcgcattgcattccccacggcccgtgcgctggagcctaggtgtgtcgcgagcgccgagtacgtggtccagcgccctttcggcacggagaggagggtgcggtagacgcggcggcggtaaggggttagggtgggatggagggagatgcggtggaggaatttcttggtttgggggctga

SEQ ID NO: 14405 - DNA, 441 bp, A.fumigatus
cgtcggcgccgagacgggaccaaacggaagcctgtgtttcagacacaatcagtacaaggaaaattcaaagtcgtccgaattttcgtcatcaagttcacataccatctccaaaccgatgataccaccgccaatgacaaccatcttcttggggacctccttcagggaaagagcgccggtactggtgatgattctcttctcatcaatgttgaggccagggaaaggagtggcctcacttccggtggcaatgacaatgttctttccgcgcagagtctgttcaccaccatccagcaggttcaccttgacggtgtgctcgtcgacaaaagcaccggtacccttgatgtaatcgacgccgttcttcttgaacagaaactcaataccttttgtgagaccttccaccggaggtgtccttggccttcatcatctgctcgaggttcaacttga

SEQ ID NO: 14406 - DNA, 225 bp, A.fumigatus
  unsure (104),(213): Identity of nucleotide sequences at the above locations are unknown.
aatccattcactccgcaatggcatagcattcataatacccgtccagatcattcaatagactcaattatcttcactattagcatcagaccccaaacagcattcantacttacacgtactttccactccccaaatccacaaaccatcgaaagcactccccttgcgccctcccacgctcatcaaacaccactccttccgcctccaacaacagccgnttctcaacctga

SEQ ID NO: 14407 - DNA, 201 bp, A.fumigatus
tacttcccacccaagatccactcccccttatatccccccaacgtcccattcgtcgccagcacccgatggcagggcacttctggcgcaaacgggttcgtgcgcattgcattccccacggcccgtgcgctggagcctaggtgtgtcgcgagcgccgagtacgtggtccagcgccctttcggcacggagaggagggtgcggtag

SEQ ID NO: 14408 - DNA, 1317 bp, A.fumigatus
ccagttgggagttataatgatataccttttcgtcatagattctctagtagacaaaataaccaacataggaaaaataataaggcgaaatgctacatgtggttcgctagcgtggctaggctagaggagaaaatacagggcggcggagcaagaggattttcagggagtttagaagtggatggccttggagtaggtggccatggcagcctccttgaaggcctcggccaaggtagggtgagcgtggcatgtgcgggcaatatcctcgcaagaagcaccgtattcgacggccagagtggcctcagcaatcatctcaccagcgttgggaccgatgatgtggacaccgagaatgcggtcggtctcagcatcggcgatgaacttcacctggccctcagtgtcgaggttggtcttggcacgagagttggcgctgaaggggaaggtaccgacgcggtactttatgccagcggccttgacctcggcctcgttctggccaacccaggcgacttcggggtgggtgtacatgacgctagggatagcagcatagttgacgtggccgtgacccttcttaatgtactcgacagcagcaacagcctcttcctcggccttatgggcaagcatgggaccgaaggtgcagtcaccgatgacacggatgtgggggatcttggtgcggtactcctggtcgatcacaaggcggcctctctcatccttgtcaattccaatgttctccagacccagtccttcggtgtagggtctgcggccgatggcaaccaaaacaacgtcagcatccagggtctcctcctttccacctttggcggcctcaatgctcagcttgacagtcgcgccgctgtcatcacccttggtgaccttggtgttggtcttgaacttgataccctgcttctgcagaatcttctgggcctgcttggcgatgtcggcgtccataccaggtccaccaatctggccaaggaattcaacaacggtaacgtcggcgccgagacgggaccaaacggaagcctgtgtttcagacacaatcagtacaaggaaaattcaaagtcgtccgaattttcgtcatcaagttcacataccatctccaaaccgatgataccaccgccaatgacaaccatcttcttggggacctccttcagggaaagagcgccggtactggtgatgattctcttctcatcaatgttgaggccagggaaaggagtggcctcacttccggtggcaatgacaatgttctttccgcgcagagtctgttcaccaccatccagcaggttcaccttgacggtgtgctcgtcgacaaaagcaccggtacccttgatgtaa

SEQ ID NO: 14409 - DNA, 216 bp, A.fumigatus
accgcttgtattgaaaagcgtggacgtctcggtggtacttgcctgaatgtcggctgcattccctcgaaatccctgcttaacaactcccacctctaccaccagatcctccacgacacaaaaaagcgcggtattgaggtcggtgatgtcaagttgaacctcgagcagatgatgaaggccaaggacacctccggtggaaggtctcacaaaaggtattga

SEQ ID NO: 14410 - DNA, 873 bp, A.fumigatus
attttccttgtactgattgtgtctgaaacacaggcttccgtttggtcccgtctcggcgccgacgttaccgttgttgaattccttggccagattggtggacctggtatggacgccgacatcgccaagcaggcccagaagattctgcagaagcagggtatcaagttcaagaccaacaccaaggtcaccaagggtgatgacagcggcgcgactgtcaagctgagcattgaggccgccaaaggtggaaaggaggagaccctggatgctgacgttgttttggttgccatcggccgcagaccctacaccgaaggactgggtctggagaacattggaattgacaaggatgagagaggccgccttgtgatcgaccaggagtaccgcaccaagatcccccacatccgtgtcatcggtgactgcaccttcggtcccatgcttgcccataaggccgaggaagaggctgttgctgctgtcgagtacattaagaagggtcacggccacgtcaactatgctgctatccctagcgtcatgtacacccaccccgaagtcgcctgggttggccagaacgaggccgaggtcaaggccgctggcataaagtaccgcgtcggtaccttccccttcagcgccaactctcgtgccaagaccaacctcgacactgagggccaggtgaagttcatcgccgatgctgagaccgaccgcattctcggtgtccacatcatcggtcccaacgctggtgagatgattgctgaggccactctggccgtcgaatacggtgcttcttgcgaggatattgcccgcacatgccacgctcaccctaccttggccgaggccttcaaggaggctgccatggccacctactccaaggccatccacttctaa

SEQ ID NO: 14411 - DNA, 366 bp, A.fumigatus
aggccaaggacacctccggtggaaggtctcacaaaaggtattgagtttctgttcaagaagaacggcgtcgattacatcaagggtaccggtgcttttgtcgacgagcacaccgtcaaggtgaacctgctggatggtggtgaacagactctgcgcggaaagaacattgtcattgccaccggaagtgaggccactcctttccctggcctcaacattgatgagaagagaatcatcaccagtaccggcgctctttccctgaaggaggtccccaagaagatggttgtcattggcggtggtatcatcggtttggagatggtatgtgaacttgatgacgaaaattcggacgactttgaattttccttgtactga

SEQ ID NO: 14412 - DNA, 570 bp, A.fumigatus
  unsure (465): Identity of nucleotide sequences at the above locations are unknown.
tcacatgcgatccacctctgcaaaggtcacatcaccgttatccaatacttgcagaagagagcttggtggttcatattggataaccacccgagaataactatggcatctcttatgagaaccaagcagtccccatccaaacccacaccaacacccccgtcgtcacaagaatgcatatccctcagcccccaaaccaagaaattcctccaccgcatctccctccatcccaccctaaccccttaccgccgccgcgtctaccgcaccctcctctccgtgccgaaagggcgctggaccacgtactcggcgctcgcgacacacctaggctccagcgcacgggccgtggggaatgcaatgcgcacgaacccgtttgcgccagaagtgccctgccatcgggtgctggcgacgaatgggacgttggggggatataagggggagtggatcttgggtgggaagtatcaggttgagaancggctgttgttggaggcggaaggagtggtgtttgatgagcgtgggagggcgcaaggggagtgctttcgatggtttgtggatttggggagtggaaagtacgtgtaa

SEQ ID NO: 14413 - DNA, 378 bp, A.fumigatus
atatctcagaagccgaacttcccacaccttacgatcgccgttgttggccaagagaaagccggcaaatctacgttcattcggagcgctctagacatgaagaacccgctatcctcacgatcgacaacaaagaagatgtcattagacggcactgtttacctggttcgattcgtggagatttcgaccaaagagataacagtcggaagcaatggagagctcgcgtggcctcggattggcaacgatgtcacttcgccaaaggttattgacggagtgctcgtgcttcacgatgtgacccaacccgagagcctctcagagctgactggcctacttggtatgtttcacggagtacttgcgcttgcttcagattcccacttcctctag

SEQ ID NO: 14414 - DNA, 1566 bp, A.fumigatus
ctgggatcctcagaattcaccgatcattcccccagccagtccgaacagggaacctctggcgacgccccgtaccggccgggctctcaagaccgccgccatacccgggccaactccgaaacacctacagccttcttcaacggagccgcgggcggctcaaactccaccagtgtatttgaatcaggagtcgatgggtacggcgacgacctgtatcccgtcgaccggaccgactcatccaacctggcttccaattcgcacagtcccagatatgcccggagcaactcgtttccggtgcgaccgcacacccccccttccggagccacgttgaacttgcacaggcaatcagcgtcaggggagtcatctccagccaaggaccgcaatcgccagcatcggcttcattctgcttggcgaaacagtggcggatcggatgcctttaatagcttcttggagacggaagatgagattgacgtgtcatgtagcgccccgtcaagtcctggtggcagcagtaaggacaaatcaacaagcgatggaagttcgaatgaaaccggctacacctttgacgagttagttgatcggcttgtggcgcagccaatgtcgaagcaggactcgaagttctcatcgatcttcttgtgcttgtatcgcaagtttgcagcacccgccagtctactcaatgcgctaatacatcgttttgaacgaaatgagaagaacatcactgaccagctggcacgcattgccgatcagttgagactgctcaacgtgatggcacagtgggtatcggagtaccccggtgacttggcgtatccaaagacgcggaagcggatcctggatttcgtatcaacattggaaaagagtcatttctacatgtttgctgcaaaggagatcggatcgtatctcgaagtgaacacggaagatgacgatgttgggtggccattcaaagacggtgacgtggaggaattcgaagaccaggaagccctctacgtcaattcgggctggagctctccatctatgtttctgggagggcctacctcgggagaagatgagggcgaggaagaggaggaggatcccatctacaacatgagcgctctggatctgagcgaaggcccgccagagcagagcacaagactctctggtacttctacggtggacaagcccggcacgatctcaagccaatcgttcatgagcttgtgcattgacgctgcacaaagagagtctgaacgcctggagctgacacctaccgtgccactaaccaaaatccaatggcgacagttcatggagatacccgatgaagattttgcacgcgagttaacacgaattgactggatcatgttcaactcgtttcgacctcgggaccttgtacgccatgtcagcatctcaggcccagacaaggataagattcagagcttgaagcatgtcaatcgcatgatcaagcaattcaaccatgtcgcgtttttcgtggctagtatgatccttcttcgggacaagccgaagcaccgggcaagggccctggagaagtttatgaacattgcacaggtaagaattaatcgtgaacaaggcaaaggagatatctaa

SEQ ID NO: 14415 - DNA, 450 bp, A.fumigatus
cgttcgctcacccttttgccgtttcgaaaagaaaccgaacctttatttttttgtctcctggtggaaacctacctaaatctcacagctgcggcgctctgcgagccaggtcttaatttgaatgctaactgggatcctcagaattcaccgatcattcccccagccagtccgaacagggaacctctggcgacgccccgtaccggccgggctctcaagaccgccgccatacccgggccaactccgaaacacctacagccttcttcaacggagccgcgggcggctcaaactccaccagtgtatttgaatcaggagtcgatgggtacggcgacgacctgtatcccgtcgaccggaccgactcatccaacctggcttccaattcgcacagtcccagatatgcccggagcaactcgtttccggtgcgaccgcacacccccccttccggagccacgttga

SEQ ID NO: 14416 - DNA, 231 bp, A.fumigatus
aacggcccctatggcagcggctccttccagccccgtggtgaagacgagcaaaacatgctccacgaccgtggtaacaacacaggcctggagacgcatccagcagtggatcatgatgcggacattcttcaagcggcacagctactcctcccgggtgcctatcgagacagtcaacctgttggtaggcaatcagtcgtcatattgatcaatcattggtttgctaattgctattag

SEQ ID NO: 14417 - DNA, 468 bp, A.fumigatus
gcattgcacaggagagcacttcgttcctggacctctgtctggcagcaggcaccggagtcaagtctcgatccccacaatgaaaatggacccattccattcacgtcgagctcccttttgggtttggcgtatgtccgtctttctctgaatctagggccctaccgccagttagaatcccgagacccgtacgtcattgctgcggcgctacatcgatcaccgcggccgggacgaagctatcgcctgacgcctgcgctgatctatgctgcgcacgcattaagcattcctgtacgcctggggatagactatgttgcacgaagtcaggccttcttctggagtgtccgacattctattgccagtctggagtgcgcagtactcctaagcaaatggctactgtctctagctgaggcaggaaatcagacatctctaagtggtatgaggcgccactcttcggatactcttgtcagttactaa

SEQ ID NO: 14418 - DNA, 1170 bp, A.fumigatus
ctcgccattcagatcttggctaccctcggtaccgccaggagatcagagcctcgggacggtatccgatcatggtatgttgccttagctggaaaggagctgttgagtctgacgtacagtttagaaccccctcagaccgcaacgaattattcccctcttaaggtgactgaagaacaaagactgcggctcgccacctctctagaggagttccgtcacttaattcctgactttgttttgccgtcgcggcacacgctgacgagatacttaacctcgttctttgatggcttccacactcacctacctttcatacaccttcccacactacggatcaatgaacgcgcgccagagttgatattagccttcttaactgtgggggcccagtatcggctggagcaccggaacgccgaaagacttttctacgcctcaaaagctatcttacttcacaggctctctaaagaggcgcagccctccactggagggtcgtacagcaatgccatccagatgccgatctctactgttccggggacgtttcaccaacaggcgcccgcttcgattcctcttcctttaggcaatgctcccgggtggagtgcctggaggcagatagaaaacatccgcaccctgcttgtcttaatgggatttgcaagctgggaaggacctgaactcgttcaggaagcgtttggtttacagcatttactagtaaggtgtttgcgggaatttggcttgactgaaaacatcgcagtcactccaagacattcgcctatgcattggcatgagtgggcggaggacgagtccgtccgccgtactcggcttgtctcgttctgctttgtgcatgtccacagcatcgcgtacaatatctacccggtgcttcgtagtagcgaggtacacttacgcttgccctgttccacccaggaatggaaagccaccactgctagtgaatgggaggccgcgcaaaaggaggttggctcgcagcaattgttcttccaagatgcgctggctctgcttctgcaaaagtcacgaacgcctgttatgttggatccgatcccttcgccgttaggcaactacattctactccatggccttctacagcgcattcatctggtcagcgaactttccatcccgaatggagaccagtcattttcattgcccacagaggaactaaataaactggagtaa

SEQ ID NO: 14419 - DNA, 228 bp, A.fumigatus
agtgctgaccctccccttttcgactacagcatcgacgattcctctgccgtctacgccacccttgtattggctggccgcacgttcctcgcgatgctcgcgcagctcgagcaccttgacctcctaaagccagattccgaggtcaaaaatctcggcttcataatggccctctacattaagcttgctgccactgaggacatcattgaccttgaggagtcagcgccgagatct

SEQ ID NO: 14420 - DNA, 1404 bp, A.fumigatus
tcaccatgcccaatcagaaatcccgatgttcttgccatgaagaattccgagatcctcgtccacatctccgctcccagcggagtccgagatgatgtccgataccgagctcaggtcgaggctattcttggatttcagagcctgtcacggcagctcatcaccttgtcgtctgatgagcgtcgagggaaccatggtgcactggctacgggacagtcaacgtctacggatccaccagttgatgcagacctcgggggggaatcgaaatgcattcaaccgatcctttctaactcacagagcacaattcccgatgaagacgtggaagtgggacgcttcaatgcagccaggcccaacccaggacatgagggactactcaacgctactgctggttcaacaacactaatggtcaaagactcgatgattcttccagattccaaggtcgataatagccatcacatcagccccgtctcactactttctcagccgcaaaatgagcgcgccgcaaaagattcgctcgagagtccgctcagtgtcatacccgactcgcaaccagaagcgatacgtagccaagctgaaggcattatgcttcgcccggacccctgtgtagcccttggttctcctcccaccaaacgacattgttcaggtttatcgtcgatgctacgggaagctgtgcctgcctctgacgctctcatacttgctcccaagctgaacgaagagcaccacagaagttgcgagttggctgatcctcatcctgttacgcagatcaccccacaaccagatcccgagagaccaccacaagtatcccttgatggtcttccactagccatcaagccctcgcctcctccagtgtccagggagcaatttgtaacccatgtcacccccactctggccatgttgacaaggcgtttgaaaccatcacgaacatataagcctgtgaaacaaaccagggacctggagcagttggagaggggccattggtaccttcgaatcaatattttgcaacttgaaagagacagatcccttggtgctcctggtcaacaggaaagtgaggctcggaactgggatttagcctgcttctcccgcttctggtcgtttttgtcggatttcatcgctaaggacggtcgggctggttggggtgtctggtgcatattggaagatgcgactgaaaatctctgctcagattcaaccgacggccagatcatgccacagagaacgacagcgccgatcatatctgacggaaagactaatccccacagctttgttcggcccgtgatactgaaactctacgcgtggggtgagatcgcgcttcatatgtatctcctcctgttcttagccagcgaacgaaaaatccgcaaaatgggcgcgcagtggcgagacggtcgggatgaagtagtcattcaaatgccctaa

SEQ ID NO: 14421 - DNA, 366 bp, A.fumigatus
  unsure (326): Identity of nucleotide sequences at the above locations are unknown.
tcagcattgaagacaacagctgacgccacacccacatatacacacacacaggatctccaaacacccagacgtgaactttaccgttgtgatcaacccagggaagcggacttggacccaacgcactgccggatggcaactacacgcgttgagattcccaagctggcttcgtacgaaaatgtgcggctgctaggctatgtggcgacaacctacgcgaaacgcaatatctcgctggtgcgcccggacatcgagaactatgcagcgtggccaacgaactcttccaacccggctctagctgttcgggggatctttttcgacgataccctcancagtatgatgaagatgccttggcgtatctgccggaattga

SEQ ID NO: 14422 - DNA, 267 bp, A.fumigatus
  unsure (2): Identity of nucleotide sequences at the above locations are unknown.
anaatacccctggttttggggccggatcattacgtacgtttccctggtaattcattatcatatttggtaatttttatttccatttttatttattttttttatttgtttggttttgtttcctcgcttgccaccttcccagtgtatatatcactttgttttttttttttttttttttttttttttttcagccaagctgtcgtctacagtttgcaagtgctaaaatgctcactaattacaggtggttcacaatcccggcgcgatccctga

SEQ ID NO: 14423 - DNA, 327 bp, A.fumigatus
ttacaggtggttcacaatcccggcgcgatccctgactctcgctacctgtcgactgcagactcgactgtcgtgttcgaagcaacgtacgacacctttcaggaacgccatggagccaagctgttcgaggcgatcccggacagcaaccgcagccagctctgtgcggtgatccactccgtccccgagagtgtcgaagggtctgcgctccggagtttggtgaagcaggtccgcaaggttgccgatgagatcttcatcacccacttggatacggattactatgccagttttgggcggcagtggccggagtttgtggatttgatgggaaaatag

SEQ ID NO: 14424 - DNA, 972 bp, A.fumigatus
tctacatctccactgatggattcccttggaaaaggccagtcggccggcggctggaaatcatggaccaccaggaagaagctcttcgtcctcgcgctcgttctcctcgtcatcatcgccctgggagtcggtctcggagttggactcggcatcggtctgggcggcggcggcggcggcgaaggtgaagaaggctcaggcggggagaccacaccgccagaaggcaactacaccacggccaagtggcagccagcggtgggaaccaaatggcagatcgagctgctttacgcgttgaacgacacctccgtcgacgctgagatctacgacatcgacctgttcatcaacgacaagtccaccatcgcaggactccaacgagccggccgcaaggtgatctgctacttctcggcaggcagctacgagaactggcgaccggacaaggacaagttcaaggactcggatctgggccacgacctggacgactggccgggagagaaatggctgaacatcagctcggcaaacgtacgccagatcatgctggaccggttggacatggcgcgcgacaagggctgcgacggggtggacccggacaacgtcgacgggtacgacaatgacaacgggctggacctgacgcaggcggactcgatcagctttgtgaacttcctggcgaatgcggcgcatgcgcggaacatgtcgattggcctgaagaacgcgggggacatcatcccgtcggtgatcaaaaacatgcagtggagtgtcaacgagcagtgtgcgcagtacaacgagtgcgacacctacgcggtgtttccgcagaatggcaagccggtgtttcacatcgagtatcccaagggggataagaccaacaatgatctgtccgtcacggccagtcagaagaacgcggcgtgcgactttgccggctcggcgaatttctccactgtcattaagaatatgaatctgaacaattgggtggaatattgttag

SEQ ID NO: 14425 - DNA, 729 bp, A.fumigatus
gtcgcgatcgagttggccggcattcgcgtccttccccacatcctcaacgccggcatcctcctcttcgtcttctccgccgctaactcggacctctacatcgccactcgtaccatttacggtctcgcgcgcgagggcaaagcgcccgccatcttcgcccgcaccgaccgccgcggcgtccccatctatgccctcgccatctccgcctgcttcgcctgcctggcctacatgaacgtctcgagtgactccaagaccgtcttcaaatattttgtggatctggtcaccatttttggccttctcacctggatctcgctgctcgtcacccacatctacttcgttcgcgcccgcaaagcccagaacgtctctgactctgacctcgtatacacagccccctttggcgccgcaggctcctacttcgccctcgtcttctgctgcatcattgcgctcactaagagcttcgacgtattcgtccatagcagctcctatggcaacttcaactacaagggcttcatcaccgcgtacctcggtatccccctatacttatgcctcatcttcgggtacaagctcttcactcgctgcaagggcgtcaagcccgaagaggcagatctgtggtcaggtaaggatgagatcgaccgcgaggaggcggagtatctggctcgcaaggcgatggaagagccaaccagtaagcgcgggaactggttctatcagacatttgtggcgtggctgttctaa

SEQ ID NO: 14426 - DNA, 579 bp, A.fumigatus
acgtctcgagtgactccaagaccgtcttcaaatattttgtggatctggtcaccatttttggccttctcacctggatctcgctgctcgtcacccacatctacttcgttcgcgcccgcaaagcccagaacgtctctgactctgacctcgtatacacagccccctttggcgccgcaggctcctacttcgccctcgtcttctgctgcatcattgcgctcactaagagcttcgacgtattcgtccatagcagctcctatggcaacttcaactacaagggcttcatcaccgcgtacctcggtatccccctatacttatgcctcatcttcgggtacaagctcttcactcgctgcaagggcgtcaagcccgaagaggcagatctgtggtcaggtaaggatgagatcgaccgcgaggaggcggagtatctggctcgcaaggcgatggaagagccaaccagtaagcgcgggaactggttctatcagacatttgtggcgtggctgttctaagactccgccgtcccggttatttactttttttttttttttttcttctgcaaatatgcgttttggatgtgacacgagctag

SEQ ID NO: 14427 - DNA, 531 bp, A.fumigatus
ggggataccgaggtacgcggtgatgaagcccttgtagttgaagttgccataggagctgctatggacgaatacgtcgaagctcttagtgagcgcaatgatgcagcagaagacgagggcgaagtaggagcctgcggcgccaaagggggctgtgtatacgaggtcagagtcagagacgttctgggctttgcgggcgcgaacgaagtagatgtgggtgacgagcagcgagatccaggtgagaaggccaaaaatggtgaccagatccacaaaatatttgaagacggtcttggagtcactcgagacgttcatgtaggccaggcaggcgaagcaggcggagatggcgagggcatagatggggacgccgcggcggtcggtgcgggcgaagatggcgggcgctttgccctcgcgcgcgagaccgtaaatggtacgagtggcgatgtagaggtccgagttagcggcggagaagacgaagaggaggatgccggcgttgaggatgtggggaaggacgcgaatgccggccaactcgatcgcgac

SEQ ID NO: 14428 - DNA, 1182 bp, A.fumigatus
ggatcagccgggattcatcccgtcgatgcgccagtcgacccaatttggagatttgttcttccgcgactaccagcctctgtcggttatcgtcccgtggatgcggctgatggcttcgatgttctcctctcatgtccagatgatcaatgtcggggtgtcccacgaagggcgggaaatcccggcgcttcgacttgggaggacccgtggccagacggccgacccctaccctcgcaagaccatcgtcgtcgtcggtggcagccatgcgcgagaatggatcagtacctcaaccgtaatctacgtcgcgtacagtctcatcacccgctatggaaaatcgcagcaagtcacccgtctcctggaggacttcgactgggtgtttgtgccgacgctgaaccccgacggctacgtctatacctgggaatccgatcgcctatggcgcaagaaccgccagcccacgagtctccatttctgtcccggcatcgacctcgaccgcgcctgggaattccaatgggacggcgagcgcacacggtcgaacccgtgctcggagaactacgccggcaccgagccattcgaaggcacggaagcgcaccaactggcccagtgggccctcaacgagacacaaaccaacaacgccaaaatcgtcggcttcctcgacctccactcctactcccaacagatcctctaccccttctcgttctcctgctcgtccgtcccgcccacgctggaaagcctcgaagagctaggcataggcctcgcaaaagtcatccgcctgaccacccacgaaatctacgacgtcaccgccgcctgcgaaggcaccatcaccgccgacgaccaagcccggaacagcccaccccagagacccatcttccccaccggcggcagctcaggcggcagcgctctcgactggttctaccaccagctacacacagactacgcctaccagatcaaactgcgcgaccgcgggagctacggcttcctcctgccgtccgagtacatcgtgccgaccggcaaggagatcttcaatgtcgttctgacgtttgggaaattcctcatcggcgatcttgcgcagaacacagatctggactgggacgcggagctgcagcgcacggagcccgacgaagctcctgcatcccaaggcgacgggccagcgccagccacgcagcaagtcctgcaggcggatgtcgatga

SEQ ID NO: 14429 - DNA, 1353 bp, A.fumigatus
atcccctcactcctgggcctgttgcccgattcgcttcggaccgcatacactcctcttattgataatcttgctgaaatgatatatgcgacttacccgactcgacgaccggctgggtttgaggatcagccgggattcatcccgtcgatgcgccagtcgacccaatttggagatttgttcttccgcgactaccagcctctgtcggttatcgtcccgtggatgcggctgatggcttcgatgttctcctctcatgtccagatgatcaatgtcggggtgtcccacgaagggcgggaaatcccggcgcttcgacttgggaggacccgtggccagacggccgacccctaccctcgcaagaccatcgtcgtcgtcggtggcagccatgcgcgagaatggatcagtacctcaaccgtaatctacgtcgcgtacagtctcatcacccgctatggaaaatcgcagcaagtcacccgtctcctggaggacttcgactgggtgtttgtgccgacgctgaaccccgacggctacgtctatacctgggaatccgatcgcctatggcgcaagaaccgccagcccacgagtctccatttctgtcccggcatcgacctcgaccgcgcctgggaattccaatgggacggcgagcgcacacggtcgaacccgtgctcggagaactacgccggcaccgagccattcgaaggcacggaagcgcaccaactggcccagtgggccctcaacgagacacaaaccaacaacgccaaaatcgtcggcttcctcgacctccactcctactcccaacagatcctctaccccttctcgttctcctgctcgtccgtcccgcccacgctggaaagcctcgaagagctaggcataggcctcgcaaaagtcatccgcctgaccacccacgaaatctacgacgtcaccgccgcctgcgaaggcaccatcaccgccgacgaccaagcccggaacagcccaccccagagacccatcttccccaccggcggcagctcaggcggcagcgctctcgactggttctaccaccagctacacacagactacgcctaccagatcaaactgcgcgaccgcgggagctacggcttcctcctgccgtccgagtacatcgtgccgaccggcaaggagatcttcaatgtcgttctgacgtttgggaaattcctcatcggcgatcttgcgcagaacacagatctggactgggacgcggagctgcagcgcacggagcccgacgaagctcctgcatcccaaggcgacgggccagcgccagccacgcagcaagtcctgcaggcggatgtcgatgatgaggaaacggagtgggtggagaatgcccgatccgagttccgacggcgataa

SEQ ID NO: 14430 - DNA, 273 bp, A.fumigatus
gctaatacgttcacagatatggacgcctcgttcggtgcgatatcccagcaccgcgtactccatctagcagactgtacgtttccctcacttttcatacctattcatggttctgatgaggcaagttttgcttttgttgagtacgagagccgccgtgatgcggacgatgcatatcacgagatgcacaataagcggattggccgcgatgatctgctgaagatagaggtacgtttcttggctttctgccgttgtccctccagactaatttctccttag

SEQ ID NO: 14431 - DNA, 411 bp, A.fumigatus
tgggctcgtactcctccttctgcctcatggcgctttgaatccggacgtgaccgacgtcgtgaccgtactccccctcgtcgaggtcgctccccatctcctcgtcggagtcgaggtgattattcccctcgcagggatgaaagatacgatagagattatgaccgacatgaccgggactatgaccgtcgcgaccgagactatgaccgccgtgatcgagactatgaccgtcgcgatagggaccgagaacgctctcgtgaccgttcgcgaagccctgatgaaagggaccgtgatgtcaaggaagacagagaacatcgtgatgatgagagagagcgccgcgaagaagatcgcgaaaacggcccgaacggtgaagacaggaaaggtacatacctttcaatccatcagggacaaagatga

SEQ ID NO: 14432 - DNA, 435 bp, A.fumigatus
tttctccttagtgggctcgtactcctccttctgcctcatggcgctttgaatccggacgtgaccgacgtcgtgaccgtactccccctcgtcgaggtcgctccccatctcctcgtcggagtcgaggtgattattcccctcgcagggatgaaagatacgatagagattatgaccgacatgaccgggactatgaccgtcgcgaccgagactatgaccgccgtgatcgagactatgaccgtcgcgatagggaccgagaacgctctcgtgaccgttcgcgaagccctgatgaaagggaccgtgatgtcaaggaagacagagaacatcgtgatgatgagagagagcgccgcgaagaagatcgcgaaaacggcccgaacggtgaagacaggaaaggtacatacctttcaatccatcagggacaaagatgagttctgcagctaa

SEQ ID NO: 14433 - DNA, 1062 bp, A.fumigatus
gaaggaggtgcgtcctccagaggtctatataagatcacaacttatcctaccttgaagctcttacgtatactccctaaacttctcttcggcccttgccccagccagaacctatccaatcctccagccaccatgcgagtctccctctttgctatcatcacagcactaacatgtgtgattgccaaaatccccgactctccacgattcgacctcaccaaaccgtcgtatgacctctggcggaacaagaaaaccgccgccaaaaccgtccaacagtcattcacctttgacaacgtcaaccgccgcctgttcatcgtaaaccgtcgcgatggctccgccctcgactcaggagacttgacaatcagccaagtcgacttctccggaaaggtcctcggctcaatgaacctgctcggctgcggccacggtgtgaaaatcgccgcggaaccagtcggaagcgatacgtatatctggagtgaaaccgacgctgcagccagcggatacgggacagcattgtggaagttcaagttccagaatggcaagacgttgaatagcgccacggataagcgcaagcggattgtgccgttgcccgagtttgacaggggcactgccacaattgaccccgtttataagcggttgatcgtgcgataccagacggggaccgtgcagaacatcgccgcgtttgaccttgctgaggcgagcgcaggcaatttttcgaacccactggccaaatgggagattccgcatctcgtcaaggagctcggggcaaaggttaacgtctttcaggggtatacagcttacgggcggtatgtctatttcctgactggggaatcttatgacgctagtggtggtaagctgaattcggaggttatggctctggacttgaatactgggaagcttgtgcaagggcctgtcaccacaaaggcggggtcgacgttgaaatttcgtgagccagaggggatggcaatctataagacggccagtggggaggtgaggcttttcttgggattcgcgtcgggggttgcaggagaccggaggagtaatctgttttacaagaacgcgctgatatag

SEQ ID NO: 14434 - DNA, 201 bp, A.fumigatus
actcgcgatcagcatctcgttcaacaaggagccgagaaatatgaggatgtctatgtattgcagctagatgtagatgccatgagtattattatccgcagcgaagcccagtgcagagcaatctggccggtatcaatcttcatggtgacttggtgccgcgatgaaacaatcactctgcagctcatgcatgtcccgtcagagtag

SEQ ID NO: 14435 - DNA, 264 bp, A.fumigatus
aggtatatgaggaaacaaggaaagtaccgttcagagaataagccagatgccagcatacttaattctttccactggcaagaagggattcccagtatcacttatagcgttggtggcaagtttcgacagtattatgtttccatcactcatgaacctgccgctcttgccatgtcatcaagagctggcatttggaatgcggctaacctgatcatcatccgtaatagcaaccagttatgtacctggtgctccgtgcgcaaggccgttttc

SEQ ID NO: 14436 - DNA, 261 bp, A.fumigatus
ctggaacaggaggagattgataaggaatctctgcgaaaggtctcgcaagaattgtcgacggcgaatctgctagcccataaggataaaggagttcgagcttggacggcttgctgcattgttgatgtcttgcgtctttgcgcgcctgacgcgccgtttacggcgaatcagctcaaggtgcgttggatatgcagatgttctctagatgttttaggttttgatctaacgattatgatcactaggacattttcacttgcttcgtga

SEQ ID NO: 14437 - DNA, 1659 bp, A.fumigatus
gacattttcacttgcttcgtgacctccatcatcccggctcttggggatccatccaatacctataatgctcaacacatctacgttctcaactccctggcggaggtgaagagcattgtgcttatgaccgatttggatcagccggactcattgatcattccgctcttcaccacttgtttcgacatcgtttccggttcttccaaggcctcgaccggggaggaaatcgccaagaatgtggaattcgacatgactcgtctcttggtgactgtgattgatgagtcgccagtcctcgcacccgacgtggtagacatcatcgtggcgcagtttctgcgcgttgacccccgcgtgctagaacccctgaacaagagaagcaggaaggcagatacgctcgtggactcaaaacagggcacactcctgctcaaggactacccgccagcatataacatggccaaggccatatgtcaagcgtgtccagagaggatgacgagtcatatcagtcaatactttaacaatgtgatcatcgacgcttctggctctggggccacaaacgggtcctcgaaacatcatcgcaaaccgaaccttgatgagtctgacgaagagggtgaggatgtcaaggagttgagtaaagctcaccgtcttatccgggagctctggcgggcctgccccgatgtgctgcagaacgtggttccccaactagaggctgaattgtccgctgaatcagtatcattacgtctgctggccacgcagacgataggtgatctcactgctggtattggagttgccggtccacctccacctccgcccatggatcctgcaggttttccaccggtaaccttggcagagtatgcgcagacgatccctcagcccaacgtgcttgtcaagcctttatccccgaagccattctcgcaggcacacagctccacatatgaaagctttctcagccggcgctttgacaaatccgcttccgttagagctgcctgggtgactgtcataggccgcattctactcacatctgcaggtggctctggtctcagtgagaacgagcagcagactctcatcgagaacttgacatcaatgcttcgggatgctgatgagaaagtcagactggcggcagttgatgcagtcggaatgttcggtctatcggatgttgtgagcaaactcggattgggtggcggattttcaacctcagattcgttgcttgccgtccttgcagagcgggtcaaagatcgaaagtcccaggtacgagaccatgcgacgaagacgttggcgcgaatctgggccgttgcagcgggcgacatcgagcacgggaacgaacaagtggtctccctactcaaggatgggccgtcaaagatcttcgatgcttactataccaatgatcctgagatccatatcttaattgatcgtgtgctcttcgaaattctccttcccctcaattatcctccgatcaagcccaaactatcgcggagcagttccagtcaatcccagaaacaaaaagaatcacaaagtgccgaggccgacagtgatgccgatattgacaagatacgtgttcgtcgcattctcactctacttgcgggactagacgacaaggccaagaggtcttttacgcgatgcaaggtcggcaaatctctgtcaggtcttcaacagccggcgaggatcatcgac

SEQ ID NO: 14438 - DNA, 327 bp, A.fumigatus
gcaagggtactcaggcgccacggcttaaggagaagtactgcgtgtgccacttggtacgttattgaattgcaagtcattgtgcaaagtgtgcgtctgacattcccctctccaacctcaaaggctaccggtgatatgctgcggtcccaggtcgccaagaagactgagctcggaaaggaggccaagaagatcatggaccagggtggtcttgtcagcgatgagatcatggtcaacatgatcaaaaacgagctcgacaccaattctgagtgcaagaacgggttcgtacacacgtgccttgttgaagttcattcagtcggagacggaaagtga

SEQ ID NO: 14439 - DNA, 423 bp, A.fumigatus
ttgtcgaatgtttctagattcattctggatggcttccctcgtactgttgctcaggctgagcgtctggatgacatgcttgaagctcgtaaccagaagctccagcatgctattgagcttcagatcgacgatgccctcctggtcgccagaattacgggacgtcttgtccaccctgcctctggacggtcgtaccacaagatcttcaaccctccccagaacgatatgaaggatgatgtcaccggcgagcccctgaatcaacgttccgatgacaccgccgagacgctgaagaagcgtctttcgacttaccacgcccagaccgcccctgtcgtcgaatactacaagaagaccggtatctggcgaggcattgatgccagccaggagcccggccaggtgtggaaaagcttgcttggtgttttccagaagtaa

SEQ ID NO: 14440 - DNA, 228 bp, A.fumigatus
cgtcatagctcaattcagccggcagtaatcgcaatggctcctatcacagaagaggtcgtccacggtctgaaagacatgattgagaaacttgagaaccgtgtgcaggagttggaggcccgcctcggcggcgaatccaagcccaagtctatcgccgagcagatgcgcatcgtccttatgggaccccccggtgctggtatggtcttttacaagggttgccgcttgcgataa

SEQ ID NO: 14441 - DNA, 669 bp, A.fumigatus
ttccgggctcccaatgatgctactttacgcaacacgccctgtcccatttgtcaggagacatttgaatcgacatggtcggaggaagtccaagactggatatggcaggatgccgtcaaggttgggaaccggatataccacgcaagctgctatgcggaagttacaaaggacgggacgactacagctgcaggtcggggtacgccttcggcacggactggaacgccggattccgttttgggcaagaggaaggcggaggtatgttcgatccaccgtggcagaaagtttgcacgtatcaaactaattcgacgtaggggaccgactctcctgggtccaatgtccgagtcaagatggagcctgcgtgaacgacagtgtttcaatcaagttcgataccccggtccctgctttctgctggtgccgaggggggcggcatgcatgcgttggagttggcattatactctttgtttggtggttgcatttagccggcggctgtactgcattctgagagcctgcactattttgagaagattgggggatttttcactatctacgagcattaccatacctgtattccatacaattctccatagaacattccataaaccaatggctattgcgagaatggcactgattcttgtaccccacagtttattttccctggatagtcccagatga

SEQ ID NO: 14442 - DNA, 228 bp, A.fumigatus
atacaatcctgctcccaagtctctgtctcgctttggcaccatccttctctgctgtatagttccactgccagttccccatccttcgacgtcaccatggctccgtacaatgtccggtggggtattatgggtatgtttttccatcctcccttgtaccacccctcacctaaaggccgttctaagctgacagtgcttcaaataaaacatagccaccggctggattgccgatag

SEQ ID NO: 14443 - DNA, 570 bp, A.fumigatus
cacttagtctttgtaagagaccttctgcgcgaccccaatctccgagacgcatctgacgtctctcacaccgtcgttgccgttgcctcttcttcagccaaagaccgggcggagaagtttattgctgatacgggcatcccggcgccgtgtgctgcgtacggctcgtacgaagagctcgtggccgatgctaacgtggacgtggtgtatgtcgcgacgccgcactcgcaccacttccagaatgtgatgcttgcgctggaagcaggcaagaatgttctctgtgagaaggctttcaccgtgaatgcggcgcaggcgaagatcctatgcgagacggcgaagaagaagaaccttttcctgatggaggccgtgtggacccggtacttccctctgagtgtgcaggtccggaacctcatcaaggagggggccataggcgaggtcctccgggtggttgctgacaacagcttcggggataacgtcgaggagcgatggggcactcagcatcggatggtgaacaaggatctcgccggtggctgcttgctggattgtgagtttcccctttcttctacgggctcctga

SEQ ID NO: 14444 - DNA, 354 bp, A.fumigatus
gtgtgcacgaaatttgcacttgtaaaatggtcgctgctgtttcatatgctaataggatgcagaccgcgcgagggactaatagccagtctctacgaagcgagatctaaccgttgtggaacatgtggccgtcgattctttgcaactgaagaaggaaaggaaaagaaagctcgccatctggactggcactttcggaccaaccaacggatggcggacgctgccaagcgagcgcagaatcgcagctggtacgttgacgagcgggtgagtggatttctctttgtccaattttcatatcccggagagtttcctaacaaccgggcaggattggataaaatcccgcgaagccggagacgatga

SEQ ID NO: 14445 - DNA, 273 bp, A.fumigatus
acaaggatctcgccggtggctgcttgctggattgtgagtttcccctttcttctacgggctcctgaatcatttagcacagcttctaatgatcgtttccttgcagtgggcatctactccttgacctgggtcttccagactatgtaccacactcttccccgggaagcagcgcaaagctccttcggccatctccgcgcacatgtctctttaccacctcactggcgccgacgaggccaccacgatccttctcacgttcccgacgaccaccccaactaa

SEQ ID NO: 14446 - DNA, 549 bp, A.fumigatus
acttcaacaaggcacgtgtgtacgaacccgttcttgcactcagaattggtgtcgagctcgtttttgatcatgttgaccatgatctcatcgctgacaagaccaccctggtccatgatcttcttggcctcctttccgagctcagtcttcttggcgacctgggaccgcagcatatcaccggtagcctttgaggttggagaggggaatgtcagacgcacactttgcacaatgacttgcaattcaataacgtaccaagtggcacacgcagtacttctccttaagccgtggcgcctgagtacccttgcctacaacccgattagaaccatgaagccattatcgcaagcggcaacccttgtaaaagaccataccagcaccggggggtcccataaggacgatgcgcatctgctcggcgatagacttgggcttggattcgccgccgaggcgggcctccaactcctgcacacggttctcaagtttctcaatcatgtctttcagaccgtggacgacctcttctgtgataggagccattgcgattactgccggctgaattga

SEQ ID NO: 14447 - DNA, 558 bp, A.fumigatus
cctgggtcttccagactatgtaccacactcttccccgggaagcagcgcaaagctccttcggccatctccgcgcacatgtctctttaccacctcactggcgccgacgaggccaccacgatccttctcacgttcccgacgaccaccccaactaacaatgctcagcctggtcaatcgcatgctgtcgccatgacccatctgcgggtcgcgaccgatcccaatgagcagggagccgctggtccctcgatccgtatccaagggaccaagggcgagattcaggtctttgggcctgccttccggcctgagcggtaccgtctgatccccaaaaagggactcggcgagatcaaggacgtgcagtgcccgttcccggcggatgggaagggcatgtactgggaggccgacgaggtggcgcggtgcttgcgcgatggaaagctcgagagcgatgggctgccctgggaagagagcattgtcatcatggaggtcatggacgaggttagacgccagggtgggttgacctatccggagaagattgagtccaccgtttaccctacccagctgtaa

SEQ ID NO: 14448 - DNA, 615 bp, A.fumigatus
  unsure (597): Identity of nucleotide sequences at the above locations are unknown.
ccacctctggaaccacttgtttctctagctgaccctacaaagctggtcggaatgatgatggttctctcgatgccgacatatgctcacggaaccctcgttgtcggcccgcctgcgcctccttccgccgacaccgtcgtcgatatcttcaaatacgggcgggttgacagcgccctcctcacacccgctctcatcgacgagatgtgcctcaacgaccgagccctctctgcattgagaagcctcaagttggtcagttacggcggagctcccctctcacgaaagtccggcgaccttctcgctcctcacgtccagctcgtgcccgccatcggaagcaccgaagcaggcggctatttcaccaagttccgccgggatgacaaggactgggattacctcgaattccagaaacaatccggcgctgtctttgagccgcgttccggagccctccacgagcttgtttttgtgcgtgtgcccgaatgtagaatgcagcagatcttcctcctttatccggaccaagaccgattcgagacgaaggacctgtgggttgagcatcccacacggaaagggcgtcttcaccacggggctggaaggtccgacgcgggngtcagttccatcaatggg

SEQ ID NO: 14449 - DNA, 417 bp, A.fumigatus
tcgactcccacttgcaaatttaccagtcactcagcaattgacagtttcctcccaggatcagtaaccatgactagaatagctacatttccacttcctggcatcaagcatggcaagcgcatcttggtgtcgacgattgaagaacgagcgaagaacgacccagacagctcttgggtatcgatgccagtagataataacgatctatctaaaggatacaaggagatcacatttgcagagttcaacaacgcggtcaaccatgcggtgcactggttgcggcaaaatctcccggaatccgacgagccgttccaatccttcgcctatgccggccctaaggaccttcggtatcccattcttgcggctgcggctggaaagttgcagaaagtggtgagtatgctgggaatgacagttgttcctcgctga

SEQ ID NO: 14450 - DNA, 1104 bp, A.fumigatus
agaccagctgtaactactgccacagatactccggattatttcaactcggttcacaatcccttctctctggagcctaacccgtttgaacaatcatttgggggtggttcccagagcgaaacccctggaaagtcgttactaccccctgtagcagcgctcacatcacctgctttgcctggcaccagttccacaggcggctataattggtccaattctttgcgctctgggccgttgagtcctgccatgcttgctggaccagctggtggtaatgattatttcgacagcattggccgaggtttcccaactcccaacgaatcttctcttcgcaccggtctcaccccaggtggtgggggctctatgttccctgcgccgagtccgaactcacaggcgattctgcagcaattacagagcggcggcgcgactccctccacaattgaattccatcgtactgcgttgaacgctgccaagaagaacggcttgagtggtcctacttctaatcccacagccgattccgagggagttcacagttcaagcatggatatcaagagcagtcagcctgccagcgtggatcccttcacgcatcacgatgctgcagatgcagccaacgggttgttcatgttggccaagggcggacaggccaatcaattcgtctccaaccaatcgtctgtcccacctcatactattcagggtaacaatcaatcgcgtgacgcagacaggcgtggatcccagaatgtcaatggccccgtagccagtagtagagagatgagcggtgatgcatctgatatgcagacagaacaggcaaagccttccgccaaagggaaaggaaagaagaacactgcctcgaaatcagggacgacagccaacaatagacgcaaagcagacgatacacccgccaagggtcctaacaagaaggctaagacaagcgttagctccggtagcgccgagcctccgtccgaagctggcgactccgaggatgaggatgacatgaagaagaaatctcagaccgacacgaagaagatgacggacgaagagaagaggagaaatttcttggaaaggaacaggtacgcccttgactgttgcatgactcccaaggcaactctgatttaa

SEQ ID NO: 14451 - DNA, 321 bp, A.fumigatus
tataatctgaccagggtcgcggctctgaaatgtcgtcagcgcaagaaacagtggcttgccaatcttcaggcgaaggttgagctatttactacggagaatgacgcgcttaccgccactgttacgcagcttcgagaggaaattgtcaaccttaaaaccctgttgcttgctcacaaggactgtcccgtgtctcaagctcagggactaggttctctcatgatgaatggaatgtcgacaggtttcgaccctcatccgtacaacatcgcgaacaacatgggtatgcagccaggtgcacctatccctactcagggtatgcgacgatga

SEQ ID NO: 14452 - DNA, 1371 bp, A.fumigatus
aaggcatatccgcgaacggcggcccggacaatggcttcgcgtcagcccgcgcgctcgcgtcgcatcgaagatgccctttctcaacttgtcgattctctaactccacctatctccctctcagagatcggcgatactgtctccgaagacccagatgagctacttgccgaagcagaagaacgtcgacaccaggagaacctcgagcgtgcatggcgcatcatcgacacatacggcggctccggaaatgatcatgcctcgccagctaacggcgcaggcctgggcatcagtcgcagaggcagtttagcaggaggagagaacatcaataacgcgtcagaccttatcaagcgaaagctcctccgggagaatgcgagcccggataaagctgtgcggttttcgaacttgtattcacggttgctgacacagccggttctgtcgcagaaatgggccatcctgtacttgctgtatcggctgtcgggctcagattctcaggttgaggttgtggatgagaatgggagaagtcggagtccgcttatggatgcggggaatctgcagaatatgatgttgaagggtggtcatcagagagtacgacattccctggggccgagattggagggggactcggatgaggatagccctgctgtcagttcctctgcttcgcagattccagccaagatggagcggaaggcctccatgcggcggcaggggtgggaaaaggaaaaggatgttgaccaggagcacgggcatgccacggctgacagggttaaaggaggtcgaacgcctcgcggcgcacacgatgctgcgcctgggggtaaccgccctgtggacgaccagaaagcatcatttcaaacacagtccttttcagataccttcgaaaagcggcctcatgagagcggacttctacgtgatttaccctacaacttgcaaggattatcgtcttccaatttggaattctcgtcatctaccgttctaaaactaccaccgactctccccctacccatcttgtctctcttgaacaccttggcggagccgtgtctgctatataaaggtctgtcaaagtatgtagaggattccggaggtggcttgctcacccagagcttgcgggctgctctttcaaacgagctccggtcctacttgggccttgtagcaaccttggaaggggagattcgacgggcgctggccgctagtgaagatccctatcagtcgaaggaatcgtccaaagggttggtaacgttgaaacgttgtgtagtatggacaagagatgcgacaatggcgttacgattgatgagtttgatagtggaggaggcttgcagtaagtgtgcttttcgtcttcaccacggggctggaaggatcagcgctctcaagaaaacgaaggtc

SEQ ID NO: 14453 - DNA, 1179 bp, A.fumigatus
catgcccaggtataccccgcatcattcaaagattccaacggcgacggatggggcgatatccccggtctgatctccaaggtcccataccttcattcgctgggcgtcgacgtagtatggctctcaccgcactacgactcgccaatgcacgacatgggctacgacatttccgactatgaaaaagtgcttccggcatacgggactgtcgcggacgtcaagaagctaattgacgagtgccatgcgcgcggtatgaagcttatccttgatttagttgtgaaccacaccagtgacgagcacgcctggttcaaggaaagccgcagcagcagagacaacgaaaaacgcgactggtatttctggcggccggcacggtacgacgagcacggcaatcggcttccaccgacaaattaccggggctattttgcagggagtacgtggacgtgggacgagcagacgcaagagtattacctacatctgtacgcgaaggagcagcctgacttgaactgggataaccgagccacgcgggaagccatctataacagcgcgattcggttctggcttgatagaggggtggatggcttccgcgttgacaccgtcaacaaatatagcaagcggacggatttccctgatgcgcctgtcaccgaccccaagagctatattcagcccgcggtggagatgtggtgcaatggtccgcgcatccatgagttcctgcgcgaaatgtacgacgaagcgttggcgccgtacggagacgtaatgaccgttggtgagttggcgaatacgcccgacccgaacgatgtgctcaagtatgttggtgcgtctgcgaagcagttgagcatggtcttccacttggatattggtcatatcggcatgggtagcagcttggaagacaagtacatcttccagccatggaagctcactgagctgaaggccatcgtgggcaagtggcagtcttttgtcgaggggacggacgggtggacgacggcattctgtgagaaccacgacaacggccggtcggtgtcacgatttggatccgatgaccctgagtttcgagagcgctccgcgaagatgctggcgttgatgatggtggccatgaccggaacattgttcttatatcaggggcaggaaatcggaatgatcaatgcgccgcgggattggtattcaccgccgggctggaaggatcaacgc
